United States Patent 11,492,591 (UNIVERSAL DONOR STEM CELLS AND RELATED METHODS) - sequence listing, part 18

SEQ ID NO: 571068 - DNA, 20 bp, Artificial
  CRISPR gRNA sequence
ttggggtgtgtgggttgtca

SEQ ID NO: 571069 - DNA, 20 bp, Artificial
  CRISPR gRNA sequence
tgtgtgattgtgtgatgatg

SEQ ID NO: 571070 - DNA, 20 bp, Artificial
  CRISPR gRNA sequence
ttgtgtgatgatgcagcttt

SEQ ID NO: 571071 - DNA, 20 bp, Artificial
  CRISPR gRNA sequence
tgtgtgatgatgcagctttg

SEQ ID NO: 571072 - DNA, 20 bp, Artificial
  CRISPR gRNA sequence
atgcagctttgaggttgttt

SEQ ID NO: 571073 - DNA, 20 bp, Artificial
  CRISPR gRNA sequence
tgaggttgtttgagtgtact

SEQ ID NO: 571074 - DNA, 20 bp, Artificial
  CRISPR gRNA sequence
gaggttgtttgagtgtactg

SEQ ID NO: 571075 - DNA, 20 bp, Artificial
  CRISPR gRNA sequence
gttgtttgagtgtactgagg

SEQ ID NO: 571076 - DNA, 20 bp, Artificial
  CRISPR gRNA sequence
ttgtttgagtgtactgaggc

SEQ ID NO: 571077 - DNA, 20 bp, Artificial
  CRISPR gRNA sequence
gaggcaggctctctgtgttt

SEQ ID NO: 571078 - DNA, 20 bp, Artificial
  CRISPR gRNA sequence
aggcaggctctctgtgtttt

SEQ ID NO: 571079 - DNA, 20 bp, Artificial
  CRISPR gRNA sequence
ggcaggctctctgtgttttg

SEQ ID NO: 571080 - DNA, 20 bp, Artificial
  CRISPR gRNA sequence
tgtgttttggggtttgtgtt

SEQ ID NO: 571081 - DNA, 20 bp, Artificial
  CRISPR gRNA sequence
ttttggggtttgtgttgagt

SEQ ID NO: 571082 - DNA, 20 bp, Artificial
  CRISPR gRNA sequence
tttggggtttgtgttgagtg

SEQ ID NO: 571083 - DNA, 20 bp, Artificial
  CRISPR gRNA sequence
ttggggtttgtgttgagtga

SEQ ID NO: 571084 - DNA, 20 bp, Artificial
  CRISPR gRNA sequence
ggtttgtgttgagtgaggga

SEQ ID NO: 571085 - DNA, 20 bp, Artificial
  CRISPR gRNA sequence
gtttgtgttgagtgagggac

SEQ ID NO: 571086 - DNA, 20 bp, Artificial
  CRISPR gRNA sequence
gtgtgtctgtgtgacttttc

SEQ ID NO: 571087 - DNA, 20 bp, Artificial
  CRISPR gRNA sequence
gtgtgacttttccagccctg

SEQ ID NO: 571088 - DNA, 20 bp, Artificial
  CRISPR gRNA sequence
agccctgaagtaatctgtgc

SEQ ID NO: 571089 - DNA, 20 bp, Artificial
  CRISPR gRNA sequence
cctgaagtaatctgtgcgag

SEQ ID NO: 571090 - DNA, 20 bp, Artificial
  CRISPR gRNA sequence
agtaatctgtgcgagcagct

SEQ ID NO: 571091 - DNA, 20 bp, Artificial
  CRISPR gRNA sequence
gtaatctgtgcgagcagctg

SEQ ID NO: 571092 - DNA, 20 bp, Artificial
  CRISPR gRNA sequence
atctgtgcgagcagctgagg

SEQ ID NO: 571093 - DNA, 20 bp, Artificial
  CRISPR gRNA sequence
tctgtgcgagcagctgaggc

SEQ ID NO: 571094 - DNA, 20 bp, Artificial
  CRISPR gRNA sequence
cagctgaggcaggctctgtg

SEQ ID NO: 571095 - DNA, 20 bp, Artificial
  CRISPR gRNA sequence
tgaggcaggctctgtgtggc

SEQ ID NO: 571096 - DNA, 20 bp, Artificial
  CRISPR gRNA sequence
gctctgtgtggctggttgtg

SEQ ID NO: 571097 - DNA, 20 bp, Artificial
  CRISPR gRNA sequence
ctctgtgtggctggttgtga

SEQ ID NO: 571098 - DNA, 20 bp, Artificial
  CRISPR gRNA sequence
ctggttgtgaaggctctgtt

SEQ ID NO: 571099 - DNA, 20 bp, Artificial
  CRISPR gRNA sequence
gtgaaggctctgtttggctg

SEQ ID NO: 571100 - DNA, 20 bp, Artificial
  CRISPR gRNA sequence
tgaaggctctgtttggctgc

SEQ ID NO: 571101 - DNA, 20 bp, Artificial
  CRISPR gRNA sequence
gaaggctctgtttggctgca

SEQ ID NO: 571102 - DNA, 20 bp, Artificial
  CRISPR gRNA sequence
gtttggctgcagggctcgac

SEQ ID NO: 571103 - DNA, 20 bp, Artificial
  CRISPR gRNA sequence
tttggctgcagggctcgact

SEQ ID NO: 571104 - DNA, 20 bp, Artificial
  CRISPR gRNA sequence
ttggctgcagggctcgactg

SEQ ID NO: 571105 - DNA, 20 bp, Artificial
  CRISPR gRNA sequence
tggctgcagggctcgactgg

SEQ ID NO: 571106 - DNA, 20 bp, Artificial
  CRISPR gRNA sequence
ggctgcagggctcgactggg

SEQ ID NO: 571107 - DNA, 20 bp, Artificial
  CRISPR gRNA sequence
gctcgactggggggtgtgtc

SEQ ID NO: 571108 - DNA, 20 bp, Artificial
  CRISPR gRNA sequence
ctcgactggggggtgtgtct

SEQ ID NO: 571109 - DNA, 20 bp, Artificial
  CRISPR gRNA sequence
tcgactggggggtgtgtctg

SEQ ID NO: 571110 - DNA, 20 bp, Artificial
  CRISPR gRNA sequence
actggggggtgtgtctgggg

SEQ ID NO: 571111 - DNA, 20 bp, Artificial
  CRISPR gRNA sequence
tggggggtgtgtctggggcg

SEQ ID NO: 571112 - DNA, 20 bp, Artificial
  CRISPR gRNA sequence
ggggggtgtgtctggggcgg

SEQ ID NO: 571113 - DNA, 20 bp, Artificial
  CRISPR gRNA sequence
gggtgtgtctggggcggagg

SEQ ID NO: 571114 - DNA, 20 bp, Artificial
  CRISPR gRNA sequence
ggtgtgtctggggcggaggt

SEQ ID NO: 571115 - DNA, 20 bp, Artificial
  CRISPR gRNA sequence
gtgtgtctggggcggaggtg

SEQ ID NO: 571116 - DNA, 20 bp, Artificial
  CRISPR gRNA sequence
tgtgtctggggcggaggtgg

SEQ ID NO: 571117 - DNA, 20 bp, Artificial
  CRISPR gRNA sequence
tctggggcggaggtgggggc

SEQ ID NO: 571118 - DNA, 20 bp, Artificial
  CRISPR gRNA sequence
ctggggcggaggtgggggct

SEQ ID NO: 571119 - DNA, 20 bp, Artificial
  CRISPR gRNA sequence
tggggcggaggtgggggctg

SEQ ID NO: 571120 - DNA, 20 bp, Artificial
  CRISPR gRNA sequence
gcggaggtgggggctggggc

SEQ ID NO: 571121 - DNA, 20 bp, Artificial
  CRISPR gRNA sequence
cggaggtgggggctggggcc

SEQ ID NO: 571122 - DNA, 20 bp, Artificial
  CRISPR gRNA sequence
gtgggggctggggccaggac

SEQ ID NO: 571123 - DNA, 20 bp, Artificial
  CRISPR gRNA sequence
tgggggctggggccaggacc

SEQ ID NO: 571124 - DNA, 20 bp, Artificial
  CRISPR gRNA sequence
gggggctggggccaggaccg

SEQ ID NO: 571125 - DNA, 20 bp, Artificial
  CRISPR gRNA sequence
gccaggaccggggcccctct

SEQ ID NO: 571126 - DNA, 20 bp, Artificial
  CRISPR gRNA sequence
aggaccggggcccctctgag

SEQ ID NO: 571127 - DNA, 20 bp, Artificial
  CRISPR gRNA sequence
ggggcccctctgagcagcct

SEQ ID NO: 571128 - DNA, 20 bp, Artificial
  CRISPR gRNA sequence
gggcccctctgagcagcctt

SEQ ID NO: 571129 - DNA, 20 bp, Artificial
  CRISPR gRNA sequence
ggcccctctgagcagccttg

SEQ ID NO: 571130 - DNA, 20 bp, Artificial
  CRISPR gRNA sequence
ctctgagcagccttggggca

SEQ ID NO: 571131 - DNA, 20 bp, Artificial
  CRISPR gRNA sequence
tctgagcagccttggggcaa

SEQ ID NO: 571132 - DNA, 20 bp, Artificial
  CRISPR gRNA sequence
ccttggggcaaaggatatga

SEQ ID NO: 571133 - DNA, 20 bp, Artificial
  CRISPR gRNA sequence
cttggggcaaaggatatgat

SEQ ID NO: 571134 - DNA, 20 bp, Artificial
  CRISPR gRNA sequence
ttggggcaaaggatatgatg

SEQ ID NO: 571135 - DNA, 20 bp, Artificial
  CRISPR gRNA sequence
tggggcaaaggatatgatgg

SEQ ID NO: 571136 - DNA, 20 bp, Artificial
  CRISPR gRNA sequence
gggcaaaggatatgatgggg

SEQ ID NO: 571137 - DNA, 20 bp, Artificial
  CRISPR gRNA sequence
ggcaaaggatatgatggggg

SEQ ID NO: 571138 - DNA, 20 bp, Artificial
  CRISPR gRNA sequence
gcaaaggatatgatggggga

SEQ ID NO: 571139 - DNA, 20 bp, Artificial
  CRISPR gRNA sequence
caaaggatatgatgggggag

SEQ ID NO: 571140 - DNA, 20 bp, Artificial
  CRISPR gRNA sequence
aaaggatatgatgggggagg

SEQ ID NO: 571141 - DNA, 20 bp, Artificial
  CRISPR gRNA sequence
ggatatgatgggggaggggg

SEQ ID NO: 571142 - DNA, 20 bp, Artificial
  CRISPR gRNA sequence
atgggggagggggtggctgc

SEQ ID NO: 571143 - DNA, 20 bp, Artificial
  CRISPR gRNA sequence
ggggagggggtggctgccag

SEQ ID NO: 571144 - DNA, 20 bp, Artificial
  CRISPR gRNA sequence
gggagggggtggctgccagc

SEQ ID NO: 571145 - DNA, 20 bp, Artificial
  CRISPR gRNA sequence
ggagggggtggctgccagcg

SEQ ID NO: 571146 - DNA, 20 bp, Artificial
  CRISPR gRNA sequence
gagggggtggctgccagcgg

SEQ ID NO: 571147 - DNA, 20 bp, Artificial
  CRISPR gRNA sequence
ggtggctgccagcgggggaa

SEQ ID NO: 571148 - DNA, 20 bp, Artificial
  CRISPR gRNA sequence
gtggctgccagcgggggaac

SEQ ID NO: 571149 - DNA, 20 bp, Artificial
  CRISPR gRNA sequence
tggctgccagcgggggaaca

SEQ ID NO: 571150 - DNA, 20 bp, Artificial
  CRISPR gRNA sequence
ggctgccagcgggggaacag

SEQ ID NO: 571151 - DNA, 20 bp, Artificial
  CRISPR gRNA sequence
cagcgggggaacaggggccc

SEQ ID NO: 571152 - DNA, 20 bp, Artificial
  CRISPR gRNA sequence
cgggggaacaggggccctgg

SEQ ID NO: 571153 - DNA, 20 bp, Artificial
  CRISPR gRNA sequence
gggggaacaggggccctggc

SEQ ID NO: 571154 - DNA, 20 bp, Artificial
  CRISPR gRNA sequence
gaacaggggccctggcaggc

SEQ ID NO: 571155 - DNA, 20 bp, Artificial
  CRISPR gRNA sequence
aggggccctggcaggcaaga

SEQ ID NO: 571156 - DNA, 20 bp, Artificial
  CRISPR gRNA sequence
ggccctggcaggcaagacag

SEQ ID NO: 571157 - DNA, 20 bp, Artificial
  CRISPR gRNA sequence
acagtggaaacctcacttct

SEQ ID NO: 571158 - DNA, 20 bp, Artificial
  CRISPR gRNA sequence
acctcacttcttggtccctg

SEQ ID NO: 571159 - DNA, 20 bp, Artificial
  CRISPR gRNA sequence
cctcacttcttggtccctgt

SEQ ID NO: 571160 - DNA, 20 bp, Artificial
  CRISPR gRNA sequence
ttggtccctgtgggcacatc

SEQ ID NO: 571161 - DNA, 20 bp, Artificial
  CRISPR gRNA sequence
tggtccctgtgggcacatcc

SEQ ID NO: 571162 - DNA, 20 bp, Artificial
  CRISPR gRNA sequence
ggtccctgtgggcacatcca

SEQ ID NO: 571163 - DNA, 20 bp, Artificial
  CRISPR gRNA sequence
ccaccacctctgcctcccac

SEQ ID NO: 571164 - DNA, 20 bp, Artificial
  CRISPR gRNA sequence
acctctgcctcccaccagtt

SEQ ID NO: 571165 - DNA, 20 bp, Artificial
  CRISPR gRNA sequence
atcctcctttccttgatctt

SEQ ID NO: 571166 - DNA, 20 bp, Artificial
  CRISPR gRNA sequence
tcctcctttccttgatcttg

SEQ ID NO: 571167 - DNA, 20 bp, Artificial
  CRISPR gRNA sequence
cctttccttgatcttgaggt

SEQ ID NO: 571168 - DNA, 20 bp, Artificial
  CRISPR gRNA sequence
ctttccttgatcttgaggtc

SEQ ID NO: 571169 - DNA, 20 bp, Artificial
  CRISPR gRNA sequence
tttccttgatcttgaggtca

SEQ ID NO: 571170 - DNA, 20 bp, Artificial
  CRISPR gRNA sequence
ttccttgatcttgaggtcag

SEQ ID NO: 571171 - DNA, 20 bp, Artificial
  CRISPR gRNA sequence
ttgatcttgaggtcaggggc

SEQ ID NO: 571172 - DNA, 20 bp, Artificial
  CRISPR gRNA sequence
tgatcttgaggtcaggggcc

SEQ ID NO: 571173 - DNA, 20 bp, Artificial
  CRISPR gRNA sequence
ttgaggtcaggggccaggtg

SEQ ID NO: 571174 - DNA, 20 bp, Artificial
  CRISPR gRNA sequence
tgaggtcaggggccaggtgt

SEQ ID NO: 571175 - DNA, 20 bp, Artificial
  CRISPR gRNA sequence
gaggtcaggggccaggtgta

SEQ ID NO: 571176 - DNA, 20 bp, Artificial
  CRISPR gRNA sequence
tcaggggccaggtgtagggt

SEQ ID NO: 571177 - DNA, 20 bp, Artificial
  CRISPR gRNA sequence
tgtagggttggaacacctgc

SEQ ID NO: 571178 - DNA, 20 bp, Artificial
  CRISPR gRNA sequence
gtagggttggaacacctgct

SEQ ID NO: 571179 - DNA, 20 bp, Artificial
  CRISPR gRNA sequence
tggaacacctgctgggcctc

SEQ ID NO: 571180 - DNA, 20 bp, Artificial
  CRISPR gRNA sequence
gcctctggctccgtttcttg

SEQ ID NO: 571181 - DNA, 20 bp, Artificial
  CRISPR gRNA sequence
ctccgtttcttgcggaactc

SEQ ID NO: 571182 - DNA, 20 bp, Artificial
  CRISPR gRNA sequence
gcggaactccagctcatcca

SEQ ID NO: 571183 - DNA, 20 bp, Artificial
  CRISPR gRNA sequence
cagctcatccacggtccaca

SEQ ID NO: 571184 - DNA, 20 bp, Artificial
  CRISPR gRNA sequence
tctcgctctccacccgcaca

SEQ ID NO: 571185 - DNA, 20 bp, Artificial
  CRISPR gRNA sequence
acccgcacaaagcacttgtg

SEQ ID NO: 571186 - DNA, 20 bp, Artificial
  CRISPR gRNA sequence
acaaagcacttgtgcagact

SEQ ID NO: 571187 - DNA, 20 bp, Artificial
  CRISPR gRNA sequence
caaagcacttgtgcagactc

SEQ ID NO: 571188 - DNA, 20 bp, Artificial
  CRISPR gRNA sequence
acttgtgcagactcaggttg

SEQ ID NO: 571189 - DNA, 20 bp, Artificial
  CRISPR gRNA sequence
tgtgcagactcaggttgtgg

SEQ ID NO: 571190 - DNA, 20 bp, Artificial
  CRISPR gRNA sequence
cagactcaggttgtggcgga

SEQ ID NO: 571191 - DNA, 20 bp, Artificial
  CRISPR gRNA sequence
ttgtggcggatggcgttctg

SEQ ID NO: 571192 - DNA, 20 bp, Artificial
  CRISPR gRNA sequence
tggcggatggcgttctgtgg

SEQ ID NO: 571193 - DNA, 20 bp, Artificial
  CRISPR gRNA sequence
ggcggatggcgttctgtgga

SEQ ID NO: 571194 - DNA, 20 bp, Artificial
  CRISPR gRNA sequence
gatggcgttctgtggaaggc

SEQ ID NO: 571195 - DNA, 20 bp, Artificial
  CRISPR gRNA sequence
atggcgttctgtggaaggcc

SEQ ID NO: 571196 - DNA, 20 bp, Artificial
  CRISPR gRNA sequence
tggcgttctgtggaaggccg

SEQ ID NO: 571197 - DNA, 20 bp, Artificial
  CRISPR gRNA sequence
gttctgtggaaggccgggga

SEQ ID NO: 571198 - DNA, 20 bp, Artificial
  CRISPR gRNA sequence
ttctgtggaaggccggggac

SEQ ID NO: 571199 - DNA, 20 bp, Artificial
  CRISPR gRNA sequence
tctgtggaaggccggggaca

SEQ ID NO: 571200 - DNA, 20 bp, Artificial
  CRISPR gRNA sequence
tgtggaaggccggggacagg

SEQ ID NO: 571201 - DNA, 20 bp, Artificial
  CRISPR gRNA sequence
ggaaggccggggacagggag

SEQ ID NO: 571202 - DNA, 20 bp, Artificial
  CRISPR gRNA sequence
gaaggccggggacagggagc

SEQ ID NO: 571203 - DNA, 20 bp, Artificial
  CRISPR gRNA sequence
ggccggggacagggagcagg

SEQ ID NO: 571204 - DNA, 20 bp, Artificial
  CRISPR gRNA sequence
gccggggacagggagcaggt

SEQ ID NO: 571205 - DNA, 20 bp, Artificial
  CRISPR gRNA sequence
gcaggtgggcgtcaacctct

SEQ ID NO: 571206 - DNA, 20 bp, Artificial
  CRISPR gRNA sequence
caggtgggcgtcaacctctg

SEQ ID NO: 571207 - DNA, 20 bp, Artificial
  CRISPR gRNA sequence
tgggcgtcaacctctgaggc

SEQ ID NO: 571208 - DNA, 20 bp, Artificial
  CRISPR gRNA sequence
gcgtcaacctctgaggccag

SEQ ID NO: 571209 - DNA, 20 bp, Artificial
  CRISPR gRNA sequence
ttcctccccaatgtgcctat

SEQ ID NO: 571210 - DNA, 20 bp, Artificial
  CRISPR gRNA sequence
ccccaatgtgcctatgagcc

SEQ ID NO: 571211 - DNA, 20 bp, Artificial
  CRISPR gRNA sequence
tgtgcctatgagcccagacc

SEQ ID NO: 571212 - DNA, 20 bp, Artificial
  CRISPR gRNA sequence
gtgcctatgagcccagaccc

SEQ ID NO: 571213 - DNA, 20 bp, Artificial
  CRISPR gRNA sequence
gacccaggcctgcccacttt

SEQ ID NO: 571214 - DNA, 20 bp, Artificial
  CRISPR gRNA sequence
ctgcccactttgagctgcga

SEQ ID NO: 571215 - DNA, 20 bp, Artificial
  CRISPR gRNA sequence
tttgagctgcgatggcactt

SEQ ID NO: 571216 - DNA, 20 bp, Artificial
  CRISPR gRNA sequence
ttgagctgcgatggcacttg

SEQ ID NO: 571217 - DNA, 20 bp, Artificial
  CRISPR gRNA sequence
gatggcacttgaggccatcc

SEQ ID NO: 571218 - DNA, 20 bp, Artificial
  CRISPR gRNA sequence
catcccagtcaccgccacct

SEQ ID NO: 571219 - DNA, 20 bp, Artificial
  CRISPR gRNA sequence
tcccagtcaccgccacctca

SEQ ID NO: 571220 - DNA, 20 bp, Artificial
  CRISPR gRNA sequence
cccagtcaccgccacctcag

SEQ ID NO: 571221 - DNA, 20 bp, Artificial
  CRISPR gRNA sequence
cagtcaccgccacctcagag

SEQ ID NO: 571222 - DNA, 20 bp, Artificial
  CRISPR gRNA sequence
cctcagaggagctcaccttc

SEQ ID NO: 571223 - DNA, 20 bp, Artificial
  CRISPR gRNA sequence
ctcagaggagctcaccttcc

SEQ ID NO: 571224 - DNA, 20 bp, Artificial
  CRISPR gRNA sequence
agaggagctcaccttccagg

SEQ ID NO: 571225 - DNA, 20 bp, Artificial
  CRISPR gRNA sequence
ggagctcaccttccaggtgg

SEQ ID NO: 571226 - DNA, 20 bp, Artificial
  CRISPR gRNA sequence
gagctcaccttccaggtggc

SEQ ID NO: 571227 - DNA, 20 bp, Artificial
  CRISPR gRNA sequence
tcaccttccaggtggcagga

SEQ ID NO: 571228 - DNA, 20 bp, Artificial
  CRISPR gRNA sequence
aggtggcaggatggtttctg

SEQ ID NO: 571229 - DNA, 20 bp, Artificial
  CRISPR gRNA sequence
tggcaggatggtttctgaag

SEQ ID NO: 571230 - DNA, 20 bp, Artificial
  CRISPR gRNA sequence
ggcaggatggtttctgaaga

SEQ ID NO: 571231 - DNA, 20 bp, Artificial
  CRISPR gRNA sequence
aggcaaacatgcgtgtgaac

SEQ ID NO: 571232 - DNA, 20 bp, Artificial
  CRISPR gRNA sequence
caaacatgcgtgtgaaccag

SEQ ID NO: 571233 - DNA, 20 bp, Artificial
  CRISPR gRNA sequence
acatgcgtgtgaaccagtgg

SEQ ID NO: 571234 - DNA, 20 bp, Artificial
  CRISPR gRNA sequence
aaccagtggtagatctcatt

SEQ ID NO: 571235 - DNA, 20 bp, Artificial
  CRISPR gRNA sequence
ttgagtgtccgctgcttctc

SEQ ID NO: 571236 - DNA, 20 bp, Artificial
  CRISPR gRNA sequence
gagtgtccgctgcttctctg

SEQ ID NO: 571237 - DNA, 20 bp, Artificial
  CRISPR gRNA sequence
cgctgcttctctggagcctc

SEQ ID NO: 571238 - DNA, 20 bp, Artificial
  CRISPR gRNA sequence
gctgcttctctggagcctcc

SEQ ID NO: 571239 - DNA, 20 bp, Artificial
  CRISPR gRNA sequence
cttctctggagcctccagga

SEQ ID NO: 571240 - DNA, 20 bp, Artificial
  CRISPR gRNA sequence
ctggagcctccaggatggcc

SEQ ID NO: 571241 - DNA, 20 bp, Artificial
  CRISPR gRNA sequence
gagcctccaggatggcctgg

SEQ ID NO: 571242 - DNA, 20 bp, Artificial
  CRISPR gRNA sequence
ctccaggatggcctggaagt

SEQ ID NO: 571243 - DNA, 20 bp, Artificial
  CRISPR gRNA sequence
tccaggatggcctggaagtt

SEQ ID NO: 571244 - DNA, 20 bp, Artificial
  CRISPR gRNA sequence
ccaggatggcctggaagttg

SEQ ID NO: 571245 - DNA, 20 bp, Artificial
  CRISPR gRNA sequence
caggatggcctggaagttgg

SEQ ID NO: 571246 - DNA, 20 bp, Artificial
  CRISPR gRNA sequence
aggatggcctggaagttggg

SEQ ID NO: 571247 - DNA, 20 bp, Artificial
  CRISPR gRNA sequence
atggcctggaagttgggggg

SEQ ID NO: 571248 - DNA, 20 bp, Artificial
  CRISPR gRNA sequence
tggcctggaagttggggggt

SEQ ID NO: 571249 - DNA, 20 bp, Artificial
  CRISPR gRNA sequence
ggcctggaagttggggggtg

SEQ ID NO: 571250 - DNA, 20 bp, Artificial
  CRISPR gRNA sequence
tggaagttggggggtggggt

SEQ ID NO: 571251 - DNA, 20 bp, Artificial
  CRISPR gRNA sequence
ggaagttggggggtggggta

SEQ ID NO: 571252 - DNA, 20 bp, Artificial
  CRISPR gRNA sequence
gaagttggggggtggggtaa

SEQ ID NO: 571253 - DNA, 20 bp, Artificial
  CRISPR gRNA sequence
aagttggggggtggggtaag

SEQ ID NO: 571254 - DNA, 20 bp, Artificial
  CRISPR gRNA sequence
aggggcacattccccaaact

SEQ ID NO: 571255 - DNA, 20 bp, Artificial
  CRISPR gRNA sequence
ggggcacattccccaaactt

SEQ ID NO: 571256 - DNA, 20 bp, Artificial
  CRISPR gRNA sequence
gggcacattccccaaacttg

SEQ ID NO: 571257 - DNA, 20 bp, Artificial
  CRISPR gRNA sequence
cattccccaaacttggggtt

SEQ ID NO: 571258 - DNA, 20 bp, Artificial
  CRISPR gRNA sequence
ttccccaaacttggggttta

SEQ ID NO: 571259 - DNA, 20 bp, Artificial
  CRISPR gRNA sequence
tccccaaacttggggtttag

SEQ ID NO: 571260 - DNA, 20 bp, Artificial
  CRISPR gRNA sequence
ccccaaacttggggtttaga

SEQ ID NO: 571261 - DNA, 20 bp, Artificial
  CRISPR gRNA sequence
cccaaacttggggtttagag

SEQ ID NO: 571262 - DNA, 20 bp, Artificial
  CRISPR gRNA sequence
gaggggctatgacctacccc

SEQ ID NO: 571263 - DNA, 20 bp, Artificial
  CRISPR gRNA sequence
ctaccccgagccatctgaca

SEQ ID NO: 571264 - DNA, 20 bp, Artificial
  CRISPR gRNA sequence
taccccgagccatctgacat

SEQ ID NO: 571265 - DNA, 20 bp, Artificial
  CRISPR gRNA sequence
accccgagccatctgacatg

SEQ ID NO: 571266 - DNA, 20 bp, Artificial
  CRISPR gRNA sequence
ccccgagccatctgacatgg

SEQ ID NO: 571267 - DNA, 20 bp, Artificial
  CRISPR gRNA sequence
cgagccatctgacatggggg

SEQ ID NO: 571268 - DNA, 20 bp, Artificial
  CRISPR gRNA sequence
ctgacatgggggcggaattg

SEQ ID NO: 571269 - DNA, 20 bp, Artificial
  CRISPR gRNA sequence
tgacatgggggcggaattgt

SEQ ID NO: 571270 - DNA, 20 bp, Artificial
  CRISPR gRNA sequence
gacatgggggcggaattgta

SEQ ID NO: 571271 - DNA, 20 bp, Artificial
  CRISPR gRNA sequence
acatgggggcggaattgtag

SEQ ID NO: 571272 - DNA, 20 bp, Artificial
  CRISPR gRNA sequence
tgggggcggaattgtagggg

SEQ ID NO: 571273 - DNA, 20 bp, Artificial
  CRISPR gRNA sequence
gggggcggaattgtaggggc

SEQ ID NO: 571274 - DNA, 20 bp, Artificial
  CRISPR gRNA sequence
gaattgtaggggcaggtaat

SEQ ID NO: 571275 - DNA, 20 bp, Artificial
  CRISPR gRNA sequence
aattgtaggggcaggtaatc

SEQ ID NO: 571276 - DNA, 20 bp, Artificial
  CRISPR gRNA sequence
attgtaggggcaggtaatca

SEQ ID NO: 571277 - DNA, 20 bp, Artificial
  CRISPR gRNA sequence
taggggcaggtaatcaggga

SEQ ID NO: 571278 - DNA, 20 bp, Artificial
  CRISPR gRNA sequence
aggggcaggtaatcagggac

SEQ ID NO: 571279 - DNA, 20 bp, Artificial
  CRISPR gRNA sequence
caggtaatcagggacaggac

SEQ ID NO: 571280 - DNA, 20 bp, Artificial
  CRISPR gRNA sequence
atcagggacaggactagatg

SEQ ID NO: 571281 - DNA, 20 bp, Artificial
  CRISPR gRNA sequence
tcagggacaggactagatgt

SEQ ID NO: 571282 - DNA, 20 bp, Artificial
  CRISPR gRNA sequence
cagggacaggactagatgtg

SEQ ID NO: 571283 - DNA, 20 bp, Artificial
  CRISPR gRNA sequence
acaggactagatgtggggtg

SEQ ID NO: 571284 - DNA, 20 bp, Artificial
  CRISPR gRNA sequence
actagatgtggggtgaagca

SEQ ID NO: 571285 - DNA, 20 bp, Artificial
  CRISPR gRNA sequence
ctagatgtggggtgaagcat

SEQ ID NO: 571286 - DNA, 20 bp, Artificial
  CRISPR gRNA sequence
tagatgtggggtgaagcatg

SEQ ID NO: 571287 - DNA, 20 bp, Artificial
  CRISPR gRNA sequence
tggggtgaagcatggggtca

SEQ ID NO: 571288 - DNA, 20 bp, Artificial
  CRISPR gRNA sequence
gtgaagcatggggtcaaaga

SEQ ID NO: 571289 - DNA, 20 bp, Artificial
  CRISPR gRNA sequence
tgaagcatggggtcaaagat

SEQ ID NO: 571290 - DNA, 20 bp, Artificial
  CRISPR gRNA sequence
gaagcatggggtcaaagatg

SEQ ID NO: 571291 - DNA, 20 bp, Artificial
  CRISPR gRNA sequence
catggggtcaaagatggggt

SEQ ID NO: 571292 - DNA, 20 bp, Artificial
  CRISPR gRNA sequence
ggtcaaagatggggttagaa

SEQ ID NO: 571293 - DNA, 20 bp, Artificial
  CRISPR gRNA sequence
gtcaaagatggggttagaaa

SEQ ID NO: 571294 - DNA, 20 bp, Artificial
  CRISPR gRNA sequence
tcaaagatggggttagaaaa

SEQ ID NO: 571295 - DNA, 20 bp, Artificial
  CRISPR gRNA sequence
caaagatggggttagaaaag

SEQ ID NO: 571296 - DNA, 20 bp, Artificial
  CRISPR gRNA sequence
atggggttagaaaaggggtg

SEQ ID NO: 571297 - DNA, 20 bp, Artificial
  CRISPR gRNA sequence
ttagaaaaggggtgaagtgt

SEQ ID NO: 571298 - DNA, 20 bp, Artificial
  CRISPR gRNA sequence
tagaaaaggggtgaagtgtc

SEQ ID NO: 571299 - DNA, 20 bp, Artificial
  CRISPR gRNA sequence
aaaggggtgaagtgtcgggt

SEQ ID NO: 571300 - DNA, 20 bp, Artificial
  CRISPR gRNA sequence
aaggggtgaagtgtcgggtt

SEQ ID NO: 571301 - DNA, 20 bp, Artificial
  CRISPR gRNA sequence
gggtgaagtgtcgggttggg

SEQ ID NO: 571302 - DNA, 20 bp, Artificial
  CRISPR gRNA sequence
ggtgaagtgtcgggttgggc

SEQ ID NO: 571303 - DNA, 20 bp, Artificial
  CRISPR gRNA sequence
gtgaagtgtcgggttgggca

SEQ ID NO: 571304 - DNA, 20 bp, Artificial
  CRISPR gRNA sequence
agtgtcgggttgggcagggt

SEQ ID NO: 571305 - DNA, 20 bp, Artificial
  CRISPR gRNA sequence
tcgggttgggcagggttaga

SEQ ID NO: 571306 - DNA, 20 bp, Artificial
  CRISPR gRNA sequence
cgggttgggcagggttagat

SEQ ID NO: 571307 - DNA, 20 bp, Artificial
  CRISPR gRNA sequence
tgggcagggttagatgggtg

SEQ ID NO: 571308 - DNA, 20 bp, Artificial
  CRISPR gRNA sequence
gggcagggttagatgggtgt

SEQ ID NO: 571309 - DNA, 20 bp, Artificial
  CRISPR gRNA sequence
gggttagatgggtgtgggta

SEQ ID NO: 571310 - DNA, 20 bp, Artificial
  CRISPR gRNA sequence
gggtgtgggtatggttgttc

SEQ ID NO: 571311 - DNA, 20 bp, Artificial
  CRISPR gRNA sequence
ggtgtgggtatggttgttct

SEQ ID NO: 571312 - DNA, 20 bp, Artificial
  CRISPR gRNA sequence
gggtatggttgttctgggat

SEQ ID NO: 571313 - DNA, 20 bp, Artificial
  CRISPR gRNA sequence
ggtatggttgttctgggatt

SEQ ID NO: 571314 - DNA, 20 bp, Artificial
  CRISPR gRNA sequence
tggttgttctgggattaggt

SEQ ID NO: 571315 - DNA, 20 bp, Artificial
  CRISPR gRNA sequence
ggttgttctgggattaggta

SEQ ID NO: 571316 - DNA, 20 bp, Artificial
  CRISPR gRNA sequence
gttgttctgggattaggtaa

SEQ ID NO: 571317 - DNA, 20 bp, Artificial
  CRISPR gRNA sequence
tctgggattaggtaagggat

SEQ ID NO: 571318 - DNA, 20 bp, Artificial
  CRISPR gRNA sequence
ctgggattaggtaagggatc

SEQ ID NO: 571319 - DNA, 20 bp, Artificial
  CRISPR gRNA sequence
ttaggtaagggatcaggact

SEQ ID NO: 571320 - DNA, 20 bp, Artificial
  CRISPR gRNA sequence
taggtaagggatcaggactg

SEQ ID NO: 571321 - DNA, 20 bp, Artificial
  CRISPR gRNA sequence
taagggatcaggactgaggt

SEQ ID NO: 571322 - DNA, 20 bp, Artificial
  CRISPR gRNA sequence
aagggatcaggactgaggtt

SEQ ID NO: 571323 - DNA, 20 bp, Artificial
  CRISPR gRNA sequence
gggatcaggactgaggttgg

SEQ ID NO: 571324 - DNA, 20 bp, Artificial
  CRISPR gRNA sequence
atcaggactgaggttgggag

SEQ ID NO: 571325 - DNA, 20 bp, Artificial
  CRISPR gRNA sequence
tcaggactgaggttgggagt

SEQ ID NO: 571326 - DNA, 20 bp, Artificial
  CRISPR gRNA sequence
caggactgaggttgggagtg

SEQ ID NO: 571327 - DNA, 20 bp, Artificial
  CRISPR gRNA sequence
gttgggagtggggtcttgtt

SEQ ID NO: 571328 - DNA, 20 bp, Artificial
  CRISPR gRNA sequence
ttgggagtggggtcttgttc

SEQ ID NO: 571329 - DNA, 20 bp, Artificial
  CRISPR gRNA sequence
tgggagtggggtcttgttca

SEQ ID NO: 571330 - DNA, 20 bp, Artificial
  CRISPR gRNA sequence
agtggggtcttgttcagggc

SEQ ID NO: 571331 - DNA, 20 bp, Artificial
  CRISPR gRNA sequence
gtggggtcttgttcagggct

SEQ ID NO: 571332 - DNA, 20 bp, Artificial
  CRISPR gRNA sequence
tggggtcttgttcagggcta

SEQ ID NO: 571333 - DNA, 20 bp, Artificial
  CRISPR gRNA sequence
cttgttcagggctagggctg

SEQ ID NO: 571334 - DNA, 20 bp, Artificial
  CRISPR gRNA sequence
ttcagggctagggctgaagt

SEQ ID NO: 571335 - DNA, 20 bp, Artificial
  CRISPR gRNA sequence
tcagggctagggctgaagtg

SEQ ID NO: 571336 - DNA, 20 bp, Artificial
  CRISPR gRNA sequence
ctagggctgaagtgaggtga

SEQ ID NO: 571337 - DNA, 20 bp, Artificial
  CRISPR gRNA sequence
tagggctgaagtgaggtgaa

SEQ ID NO: 571338 - DNA, 20 bp, Artificial
  CRISPR gRNA sequence
ctgaagtgaggtgaaaggtc

SEQ ID NO: 571339 - DNA, 20 bp, Artificial
  CRISPR gRNA sequence
tgaagtgaggtgaaaggtct

SEQ ID NO: 571340 - DNA, 20 bp, Artificial
  CRISPR gRNA sequence
gtgaggtgaaaggtctggga

SEQ ID NO: 571341 - DNA, 20 bp, Artificial
  CRISPR gRNA sequence
gaggtgaaaggtctgggatg

SEQ ID NO: 571342 - DNA, 20 bp, Artificial
  CRISPR gRNA sequence
tgaaaggtctgggatggagt

SEQ ID NO: 571343 - DNA, 20 bp, Artificial
  CRISPR gRNA sequence
aaaggtctgggatggagttg

SEQ ID NO: 571344 - DNA, 20 bp, Artificial
  CRISPR gRNA sequence
gtctgggatggagttggagt

SEQ ID NO: 571345 - DNA, 20 bp, Artificial
  CRISPR gRNA sequence
tctgggatggagttggagtt

SEQ ID NO: 571346 - DNA, 20 bp, Artificial
  CRISPR gRNA sequence
ctgggatggagttggagttg

SEQ ID NO: 571347 - DNA, 20 bp, Artificial
  CRISPR gRNA sequence
gttggagttggggttctctg

SEQ ID NO: 571348 - DNA, 20 bp, Artificial
  CRISPR gRNA sequence
tggagttggggttctctgtg

SEQ ID NO: 571349 - DNA, 20 bp, Artificial
  CRISPR gRNA sequence
ggagttggggttctctgtgg

SEQ ID NO: 571350 - DNA, 20 bp, Artificial
  CRISPR gRNA sequence
tctctgtggaggtgacattt

SEQ ID NO: 571351 - DNA, 20 bp, Artificial
  CRISPR gRNA sequence
ctctgtggaggtgacatttc

SEQ ID NO: 571352 - DNA, 20 bp, Artificial
  CRISPR gRNA sequence
tctgtggaggtgacatttca

SEQ ID NO: 571353 - DNA, 20 bp, Artificial
  CRISPR gRNA sequence
tggaggtgacatttcagggt

SEQ ID NO: 571354 - DNA, 20 bp, Artificial
  CRISPR gRNA sequence
ggaggtgacatttcagggtt

SEQ ID NO: 571355 - DNA, 20 bp, Artificial
  CRISPR gRNA sequence
gaggtgacatttcagggttg

SEQ ID NO: 571356 - DNA, 20 bp, Artificial
  CRISPR gRNA sequence
gtgacatttcagggttgggg

SEQ ID NO: 571357 - DNA, 20 bp, Artificial
  CRISPR gRNA sequence
tgacatttcagggttgggga

SEQ ID NO: 571358 - DNA, 20 bp, Artificial
  CRISPR gRNA sequence
tttcagggttggggaaggtg

SEQ ID NO: 571359 - DNA, 20 bp, Artificial
  CRISPR gRNA sequence
ttcagggttggggaaggtga

SEQ ID NO: 571360 - DNA, 20 bp, Artificial
  CRISPR gRNA sequence
tcagggttggggaaggtgaa

SEQ ID NO: 571361 - DNA, 20 bp, Artificial
  CRISPR gRNA sequence
ggttggggaaggtgaagggt

SEQ ID NO: 571362 - DNA, 20 bp, Artificial
  CRISPR gRNA sequence
tggggaaggtgaagggtcag

SEQ ID NO: 571363 - DNA, 20 bp, Artificial
  CRISPR gRNA sequence
ggaaggtgaagggtcagaag

SEQ ID NO: 571364 - DNA, 20 bp, Artificial
  CRISPR gRNA sequence
gaaggtgaagggtcagaagt

SEQ ID NO: 571365 - DNA, 20 bp, Artificial
  CRISPR gRNA sequence
aaggtgaagggtcagaagtg

SEQ ID NO: 571366 - DNA, 20 bp, Artificial
  CRISPR gRNA sequence
gaagggtcagaagtggggtc

SEQ ID NO: 571367 - DNA, 20 bp, Artificial
  CRISPR gRNA sequence
aagggtcagaagtggggtca

SEQ ID NO: 571368 - DNA, 20 bp, Artificial
  CRISPR gRNA sequence
cagaagtggggtcaaggatt

SEQ ID NO: 571369 - DNA, 20 bp, Artificial
  CRISPR gRNA sequence
aagtggggtcaaggatttgg

SEQ ID NO: 571370 - DNA, 20 bp, Artificial
  CRISPR gRNA sequence
agtggggtcaaggatttgga

SEQ ID NO: 571371 - DNA, 20 bp, Artificial
  CRISPR gRNA sequence
gtggggtcaaggatttggaa

SEQ ID NO: 571372 - DNA, 20 bp, Artificial
  CRISPR gRNA sequence
tggggtcaaggatttggaag

SEQ ID NO: 571373 - DNA, 20 bp, Artificial
  CRISPR gRNA sequence
tcaaggatttggaaggggta

SEQ ID NO: 571374 - DNA, 20 bp, Artificial
  CRISPR gRNA sequence
caaggatttggaaggggtaa

SEQ ID NO: 571375 - DNA, 20 bp, Artificial
  CRISPR gRNA sequence
aaggatttggaaggggtaaa

SEQ ID NO: 571376 - DNA, 20 bp, Artificial
  CRISPR gRNA sequence
atttggaaggggtaaagggc

SEQ ID NO: 571377 - DNA, 20 bp, Artificial
  CRISPR gRNA sequence
tttggaaggggtaaagggcc

SEQ ID NO: 571378 - DNA, 20 bp, Artificial
  CRISPR gRNA sequence
gtaaagggccaggccaactt

SEQ ID NO: 571379 - DNA, 20 bp, Artificial
  CRISPR gRNA sequence
taaagggccaggccaactta

SEQ ID NO: 571380 - DNA, 20 bp, Artificial
  CRISPR gRNA sequence
aaagggccaggccaacttaa

SEQ ID NO: 571381 - DNA, 20 bp, Artificial
  CRISPR gRNA sequence
ggccaggccaacttaagggt

SEQ ID NO: 571382 - DNA, 20 bp, Artificial
  CRISPR gRNA sequence
gccaggccaacttaagggtc

SEQ ID NO: 571383 - DNA, 20 bp, Artificial
  CRISPR gRNA sequence
ccaggccaacttaagggtca

SEQ ID NO: 571384 - DNA, 20 bp, Artificial
  CRISPR gRNA sequence
ggccaacttaagggtcaggg

SEQ ID NO: 571385 - DNA, 20 bp, Artificial
  CRISPR gRNA sequence
gccaacttaagggtcaggga

SEQ ID NO: 571386 - DNA, 20 bp, Artificial
  CRISPR gRNA sequence
ccaacttaagggtcagggaa

SEQ ID NO: 571387 - DNA, 20 bp, Artificial
  CRISPR gRNA sequence
caacttaagggtcagggaag

SEQ ID NO: 571388 - DNA, 20 bp, Artificial
  CRISPR gRNA sequence
cttaagggtcagggaagggg

SEQ ID NO: 571389 - DNA, 20 bp, Artificial
  CRISPR gRNA sequence
ttaagggtcagggaaggggt

SEQ ID NO: 571390 - DNA, 20 bp, Artificial
  CRISPR gRNA sequence
ggtcagggaaggggtgggtt

SEQ ID NO: 571391 - DNA, 20 bp, Artificial
  CRISPR gRNA sequence
tcagggaaggggtgggttaa

SEQ ID NO: 571392 - DNA, 20 bp, Artificial
  CRISPR gRNA sequence
ggaaggggtgggttaagagt

SEQ ID NO: 571393 - DNA, 20 bp, Artificial
  CRISPR gRNA sequence
gaaggggtgggttaagagtc

SEQ ID NO: 571394 - DNA, 20 bp, Artificial
  CRISPR gRNA sequence
gggtgggttaagagtcaggc

SEQ ID NO: 571395 - DNA, 20 bp, Artificial
  CRISPR gRNA sequence
ggtgggttaagagtcaggct

SEQ ID NO: 571396 - DNA, 20 bp, Artificial
  CRISPR gRNA sequence
gtgggttaagagtcaggctg

SEQ ID NO: 571397 - DNA, 20 bp, Artificial
  CRISPR gRNA sequence
ggttaagagtcaggctgggg

SEQ ID NO: 571398 - DNA, 20 bp, Artificial
  CRISPR gRNA sequence
gagtcaggctggggtggact

SEQ ID NO: 571399 - DNA, 20 bp, Artificial
  CRISPR gRNA sequence
agtcaggctggggtggactc

SEQ ID NO: 571400 - DNA, 20 bp, Artificial
  CRISPR gRNA sequence
caggctggggtggactcagg

SEQ ID NO: 571401 - DNA, 20 bp, Artificial
  CRISPR gRNA sequence
aggctggggtggactcaggt

SEQ ID NO: 571402 - DNA, 20 bp, Artificial
  CRISPR gRNA sequence
ggctggggtggactcaggtg

SEQ ID NO: 571403 - DNA, 20 bp, Artificial
  CRISPR gRNA sequence
gctggggtggactcaggtgg

SEQ ID NO: 571404 - DNA, 20 bp, Artificial
  CRISPR gRNA sequence
ctggggtggactcaggtggg

SEQ ID NO: 571405 - DNA, 20 bp, Artificial
  CRISPR gRNA sequence
gtggactcaggtggggggtc

SEQ ID NO: 571406 - DNA, 20 bp, Artificial
  CRISPR gRNA sequence
tggactcaggtggggggtct

SEQ ID NO: 571407 - DNA, 20 bp, Artificial
  CRISPR gRNA sequence
ggactcaggtggggggtcta

SEQ ID NO: 571408 - DNA, 20 bp, Artificial
  CRISPR gRNA sequence
gactcaggtggggggtctag

SEQ ID NO: 571409 - DNA, 20 bp, Artificial
  CRISPR gRNA sequence
caggtggggggtctaggggt

SEQ ID NO: 571410 - DNA, 20 bp, Artificial
  CRISPR gRNA sequence
aggtggggggtctaggggtg

SEQ ID NO: 571411 - DNA, 20 bp, Artificial
  CRISPR gRNA sequence
ggtggggggtctaggggtga

SEQ ID NO: 571412 - DNA, 20 bp, Artificial
  CRISPR gRNA sequence
gggggtctaggggtgaggga

SEQ ID NO: 571413 - DNA, 20 bp, Artificial
  CRISPR gRNA sequence
ggggtctaggggtgagggat

SEQ ID NO: 571414 - DNA, 20 bp, Artificial
  CRISPR gRNA sequence
gggtgagggatgggatgact

SEQ ID NO: 571415 - DNA, 20 bp, Artificial
  CRISPR gRNA sequence
gggatgggatgacttggctt

SEQ ID NO: 571416 - DNA, 20 bp, Artificial
  CRISPR gRNA sequence
ggatgggatgacttggcttt

SEQ ID NO: 571417 - DNA, 20 bp, Artificial
  CRISPR gRNA sequence
gggatgacttggctttaggt

SEQ ID NO: 571418 - DNA, 20 bp, Artificial
  CRISPR gRNA sequence
atgacttggctttaggtcag

SEQ ID NO: 571419 - DNA, 20 bp, Artificial
  CRISPR gRNA sequence
cttggctttaggtcagaagc

SEQ ID NO: 571420 - DNA, 20 bp, Artificial
  CRISPR gRNA sequence
tggctttaggtcagaagcca

SEQ ID NO: 571421 - DNA, 20 bp, Artificial
  CRISPR gRNA sequence
tttaggtcagaagccagaga

SEQ ID NO: 571422 - DNA, 20 bp, Artificial
  CRISPR gRNA sequence
cagagatggtttgaattatc

SEQ ID NO: 571423 - DNA, 20 bp, Artificial
  CRISPR gRNA sequence
ttatcgagtatcttacgtgt

SEQ ID NO: 571424 - DNA, 20 bp, Artificial
  CRISPR gRNA sequence
tatcgagtatcttacgtgtc

SEQ ID NO: 571425 - DNA, 20 bp, Artificial
  CRISPR gRNA sequence
atcgagtatcttacgtgtca

SEQ ID NO: 571426 - DNA, 20 bp, Artificial
  CRISPR gRNA sequence
tatcttacgtgtcagggaca

SEQ ID NO: 571427 - DNA, 20 bp, Artificial
  CRISPR gRNA sequence
ttacgtgtcagggacatggt

SEQ ID NO: 571428 - DNA, 20 bp, Artificial
  CRISPR gRNA sequence
tacgtgtcagggacatggtt

SEQ ID NO: 571429 - DNA, 20 bp, Artificial
  CRISPR gRNA sequence
gtgtcagggacatggttagg

SEQ ID NO: 571430 - DNA, 20 bp, Artificial
  CRISPR gRNA sequence
cagggacatggttaggtggt

SEQ ID NO: 571431 - DNA, 20 bp, Artificial
  CRISPR gRNA sequence
agggacatggttaggtggtt

SEQ ID NO: 571432 - DNA, 20 bp, Artificial
  CRISPR gRNA sequence
catggttaggtggttaggct

SEQ ID NO: 571433 - DNA, 20 bp, Artificial
  CRISPR gRNA sequence
atggttaggtggttaggctc

SEQ ID NO: 571434 - DNA, 20 bp, Artificial
  CRISPR gRNA sequence
tggttaggtggttaggctca

SEQ ID NO: 571435 - DNA, 20 bp, Artificial
  CRISPR gRNA sequence
taggtggttaggctcagggc

SEQ ID NO: 571436 - DNA, 20 bp, Artificial
  CRISPR gRNA sequence
aggtggttaggctcagggca

SEQ ID NO: 571437 - DNA, 20 bp, Artificial
  CRISPR gRNA sequence
gttaggctcagggcaaggat

SEQ ID NO: 571438 - DNA, 20 bp, Artificial
  CRISPR gRNA sequence
ttaggctcagggcaaggatg

SEQ ID NO: 571439 - DNA, 20 bp, Artificial
  CRISPR gRNA sequence
gctcagggcaaggatgaggt

SEQ ID NO: 571440 - DNA, 20 bp, Artificial
  CRISPR gRNA sequence
ggcaaggatgaggttagttg

SEQ ID NO: 571441 - DNA, 20 bp, Artificial
  CRISPR gRNA sequence
gcaaggatgaggttagttgt

SEQ ID NO: 571442 - DNA, 20 bp, Artificial
  CRISPR gRNA sequence
caaggatgaggttagttgtg

SEQ ID NO: 571443 - DNA, 20 bp, Artificial
  CRISPR gRNA sequence
atgaggttagttgtggggtt

SEQ ID NO: 571444 - DNA, 20 bp, Artificial
  CRISPR gRNA sequence
gttagttgtggggttcggtg

SEQ ID NO: 571445 - DNA, 20 bp, Artificial
  CRISPR gRNA sequence
tagttgtggggttcggtgtg

SEQ ID NO: 571446 - DNA, 20 bp, Artificial
  CRISPR gRNA sequence
tgtggggttcggtgtggagt

SEQ ID NO: 571447 - DNA, 20 bp, Artificial
  CRISPR gRNA sequence
gtggggttcggtgtggagtg

SEQ ID NO: 571448 - DNA, 20 bp, Artificial
  CRISPR gRNA sequence
gttcggtgtggagtgaggct

SEQ ID NO: 571449 - DNA, 20 bp, Artificial
  CRISPR gRNA sequence
ttcggtgtggagtgaggctg

SEQ ID NO: 571450 - DNA, 20 bp, Artificial
  CRISPR gRNA sequence
tcggtgtggagtgaggctga

SEQ ID NO: 571451 - DNA, 20 bp, Artificial
  CRISPR gRNA sequence
tgtggagtgaggctgagggt

SEQ ID NO: 571452 - DNA, 20 bp, Artificial
  CRISPR gRNA sequence
gtggagtgaggctgagggtc

SEQ ID NO: 571453 - DNA, 20 bp, Artificial
  CRISPR gRNA sequence
tggagtgaggctgagggtca

SEQ ID NO: 571454 - DNA, 20 bp, Artificial
  CRISPR gRNA sequence
tgagggtcagggaatttgat

SEQ ID NO: 571455 - DNA, 20 bp, Artificial
  CRISPR gRNA sequence
gtcagggaatttgatcagtt

SEQ ID NO: 571456 - DNA, 20 bp, Artificial
  CRISPR gRNA sequence
gaatttgatcagtttggatt

SEQ ID NO: 571457 - DNA, 20 bp, Artificial
  CRISPR gRNA sequence
aatttgatcagtttggattc

SEQ ID NO: 571458 - DNA, 20 bp, Artificial
  CRISPR gRNA sequence
gatcagtttggattcaggaa

SEQ ID NO: 571459 - DNA, 20 bp, Artificial
  CRISPR gRNA sequence
atcagtttggattcaggaat

SEQ ID NO: 571460 - DNA, 20 bp, Artificial
  CRISPR gRNA sequence
tggattcaggaatgggatta

SEQ ID NO: 571461 - DNA, 20 bp, Artificial
  CRISPR gRNA sequence
gattcaggaatgggattaca

SEQ ID NO: 571462 - DNA, 20 bp, Artificial
  CRISPR gRNA sequence
caggaatgggattacagagt

SEQ ID NO: 571463 - DNA, 20 bp, Artificial
  CRISPR gRNA sequence
agagtcagcgatgatgattg

SEQ ID NO: 571464 - DNA, 20 bp, Artificial
  CRISPR gRNA sequence
tcagcgatgatgattgcagt

SEQ ID NO: 571465 - DNA, 20 bp, Artificial
  CRISPR gRNA sequence
cagcgatgatgattgcagtg

SEQ ID NO: 571466 - DNA, 20 bp, Artificial
  CRISPR gRNA sequence
gatgattgcagtgaggctat

SEQ ID NO: 571467 - DNA, 20 bp, Artificial
  CRISPR gRNA sequence
attgcagtgaggctatcagt

SEQ ID NO: 571468 - DNA, 20 bp, Artificial
  CRISPR gRNA sequence
ttgcagtgaggctatcagtc

SEQ ID NO: 571469 - DNA, 20 bp, Artificial
  CRISPR gRNA sequence
agtgaggctatcagtcagga

SEQ ID NO: 571470 - DNA, 20 bp, Artificial
  CRISPR gRNA sequence
gtgaggctatcagtcaggat

SEQ ID NO: 571471 - DNA, 20 bp, Artificial
  CRISPR gRNA sequence
tgaggctatcagtcaggatg

SEQ ID NO: 571472 - DNA, 20 bp, Artificial
  CRISPR gRNA sequence
gctatcagtcaggatggggc

SEQ ID NO: 571473 - DNA, 20 bp, Artificial
  CRISPR gRNA sequence
ctatcagtcaggatggggct

SEQ ID NO: 571474 - DNA, 20 bp, Artificial
  CRISPR gRNA sequence
cagtcaggatggggctaggt

SEQ ID NO: 571475 - DNA, 20 bp, Artificial
  CRISPR gRNA sequence
agtcaggatggggctaggtc

SEQ ID NO: 571476 - DNA, 20 bp, Artificial
  CRISPR gRNA sequence
gtcaggatggggctaggtca

SEQ ID NO: 571477 - DNA, 20 bp, Artificial
  CRISPR gRNA sequence
atggggctaggtcagggttt

SEQ ID NO: 571478 - DNA, 20 bp, Artificial
  CRISPR gRNA sequence
gctaggtcagggtttcagtt

SEQ ID NO: 571479 - DNA, 20 bp, Artificial
  CRISPR gRNA sequence
taggtcagggtttcagttca

SEQ ID NO: 571480 - DNA, 20 bp, Artificial
  CRISPR gRNA sequence
tcagggtttcagttcagaga

SEQ ID NO: 571481 - DNA, 20 bp, Artificial
  CRISPR gRNA sequence
ggtttcagttcagagacagt

SEQ ID NO: 571482 - DNA, 20 bp, Artificial
  CRISPR gRNA sequence
gtttcagttcagagacagtc

SEQ ID NO: 571483 - DNA, 20 bp, Artificial
  CRISPR gRNA sequence
tttcagttcagagacagtcg

SEQ ID NO: 571484 - DNA, 20 bp, Artificial
  CRISPR gRNA sequence
agagacagtcggggaatatc

SEQ ID NO: 571485 - DNA, 20 bp, Artificial
  CRISPR gRNA sequence
ggggaatatctggtatcatg

SEQ ID NO: 571486 - DNA, 20 bp, Artificial
  CRISPR gRNA sequence
gggaatatctggtatcatgt

SEQ ID NO: 571487 - DNA, 20 bp, Artificial
  CRISPR gRNA sequence
ggaatatctggtatcatgta

SEQ ID NO: 571488 - DNA, 20 bp, Artificial
  CRISPR gRNA sequence
gaatatctggtatcatgtag

SEQ ID NO: 571489 - DNA, 20 bp, Artificial
  CRISPR gRNA sequence
atctggtatcatgtaggggt

SEQ ID NO: 571490 - DNA, 20 bp, Artificial
  CRISPR gRNA sequence
tctggtatcatgtaggggtg

SEQ ID NO: 571491 - DNA, 20 bp, Artificial
  CRISPR gRNA sequence
tatcatgtaggggtgaggtt

SEQ ID NO: 571492 - DNA, 20 bp, Artificial
  CRISPR gRNA sequence
atcatgtaggggtgaggttc

SEQ ID NO: 571493 - DNA, 20 bp, Artificial
  CRISPR gRNA sequence
gtaggggtgaggttcaggtt

SEQ ID NO: 571494 - DNA, 20 bp, Artificial
  CRISPR gRNA sequence
taggggtgaggttcaggttt

SEQ ID NO: 571495 - DNA, 20 bp, Artificial
  CRISPR gRNA sequence
aggggtgaggttcaggtttg

SEQ ID NO: 571496 - DNA, 20 bp, Artificial
  CRISPR gRNA sequence
gtgaggttcaggtttggggt

SEQ ID NO: 571497 - DNA, 20 bp, Artificial
  CRISPR gRNA sequence
tgaggttcaggtttggggtt

SEQ ID NO: 571498 - DNA, 20 bp, Artificial
  CRISPR gRNA sequence
ttcaggtttggggttaggtg

SEQ ID NO: 571499 - DNA, 20 bp, Artificial
  CRISPR gRNA sequence
tttggggttaggtgtggcgc

SEQ ID NO: 571500 - DNA, 20 bp, Artificial
  CRISPR gRNA sequence
ttggggttaggtgtggcgct

SEQ ID NO: 571501 - DNA, 20 bp, Artificial
  CRISPR gRNA sequence
ttaggtgtggcgctaggatg

SEQ ID NO: 571502 - DNA, 20 bp, Artificial
  CRISPR gRNA sequence
taggtgtggcgctaggatga

SEQ ID NO: 571503 - DNA, 20 bp, Artificial
  CRISPR gRNA sequence
ggcgctaggatgaaggttct

SEQ ID NO: 571504 - DNA, 20 bp, Artificial
  CRISPR gRNA sequence
gctaggatgaaggttctgag

SEQ ID NO: 571505 - DNA, 20 bp, Artificial
  CRISPR gRNA sequence
ctaggatgaaggttctgaga

SEQ ID NO: 571506 - DNA, 20 bp, Artificial
  CRISPR gRNA sequence
tgaaggttctgagaaggcat

SEQ ID NO: 571507 - DNA, 20 bp, Artificial
  CRISPR gRNA sequence
gaaggttctgagaaggcatt

SEQ ID NO: 571508 - DNA, 20 bp, Artificial
  CRISPR gRNA sequence
aaggttctgagaaggcattg

SEQ ID NO: 571509 - DNA, 20 bp, Artificial
  CRISPR gRNA sequence
ggttctgagaaggcattggg

SEQ ID NO: 571510 - DNA, 20 bp, Artificial
  CRISPR gRNA sequence
gttctgagaaggcattgggg

SEQ ID NO: 571511 - DNA, 20 bp, Artificial
  CRISPR gRNA sequence
gagaaggcattggggaggct

SEQ ID NO: 571512 - DNA, 20 bp, Artificial
  CRISPR gRNA sequence
gcattggggaggctgagatg

SEQ ID NO: 571513 - DNA, 20 bp, Artificial
  CRISPR gRNA sequence
cattggggaggctgagatga

SEQ ID NO: 571514 - DNA, 20 bp, Artificial
  CRISPR gRNA sequence
ttggggaggctgagatgaag

SEQ ID NO: 571515 - DNA, 20 bp, Artificial
  CRISPR gRNA sequence
ggaggctgagatgaaggagt

SEQ ID NO: 571516 - DNA, 20 bp, Artificial
  CRISPR gRNA sequence
gaggctgagatgaaggagtt

SEQ ID NO: 571517 - DNA, 20 bp, Artificial
  CRISPR gRNA sequence
ctgagatgaaggagttggga

SEQ ID NO: 571518 - DNA, 20 bp, Artificial
  CRISPR gRNA sequence
tgagatgaaggagttgggat

SEQ ID NO: 571519 - DNA, 20 bp, Artificial
  CRISPR gRNA sequence
gagatgaaggagttgggatg

SEQ ID NO: 571520 - DNA, 20 bp, Artificial
  CRISPR gRNA sequence
ggagttgggatggggtgatg

SEQ ID NO: 571521 - DNA, 20 bp, Artificial
  CRISPR gRNA sequence
tgggatggggtgatgaagtt

SEQ ID NO: 571522 - DNA, 20 bp, Artificial
  CRISPR gRNA sequence
gggatggggtgatgaagtta

SEQ ID NO: 571523 - DNA, 20 bp, Artificial
  CRISPR gRNA sequence
tgatgaagttaaggatcaaa

SEQ ID NO: 571524 - DNA, 20 bp, Artificial
  CRISPR gRNA sequence
gatgaagttaaggatcaaat

SEQ ID NO: 571525 - DNA, 20 bp, Artificial
  CRISPR gRNA sequence
aaggatcaaatgggtgttac

SEQ ID NO: 571526 - DNA, 20 bp, Artificial
  CRISPR gRNA sequence
aggatcaaatgggtgttaca

SEQ ID NO: 571527 - DNA, 20 bp, Artificial
  CRISPR gRNA sequence
tcaaatgggtgttacaagga

SEQ ID NO: 571528 - DNA, 20 bp, Artificial
  CRISPR gRNA sequence
caaatgggtgttacaaggaa

SEQ ID NO: 571529 - DNA, 20 bp, Artificial
  CRISPR gRNA sequence
tgggtgttacaaggaaaggt

SEQ ID NO: 571530 - DNA, 20 bp, Artificial
  CRISPR gRNA sequence
gggtgttacaaggaaaggtt

SEQ ID NO: 571531 - DNA, 20 bp, Artificial
  CRISPR gRNA sequence
ttacaaggaaaggttgggaa

SEQ ID NO: 571532 - DNA, 20 bp, Artificial
  CRISPR gRNA sequence
gaaaggttgggaatggtgcc

SEQ ID NO: 571533 - DNA, 20 bp, Artificial
  CRISPR gRNA sequence
ggttgggaatggtgcccagt

SEQ ID NO: 571534 - DNA, 20 bp, Artificial
  CRISPR gRNA sequence
gttgggaatggtgcccagtt

SEQ ID NO: 571535 - DNA, 20 bp, Artificial
  CRISPR gRNA sequence
ttgggaatggtgcccagttg

SEQ ID NO: 571536 - DNA, 20 bp, Artificial
  CRISPR gRNA sequence
tgggaatggtgcccagttgg

SEQ ID NO: 571537 - DNA, 20 bp, Artificial
  CRISPR gRNA sequence
ttgggggtgtattgacatac

SEQ ID NO: 571538 - DNA, 20 bp, Artificial
  CRISPR gRNA sequence
tgggggtgtattgacatact

SEQ ID NO: 571539 - DNA, 20 bp, Artificial
  CRISPR gRNA sequence
gggggtgtattgacatactg

SEQ ID NO: 571540 - DNA, 20 bp, Artificial
  CRISPR gRNA sequence
attgacatactggggtacgt

SEQ ID NO: 571541 - DNA, 20 bp, Artificial
  CRISPR gRNA sequence
ttgacatactggggtacgtt

SEQ ID NO: 571542 - DNA, 20 bp, Artificial
  CRISPR gRNA sequence
tgacatactggggtacgttg

SEQ ID NO: 571543 - DNA, 20 bp, Artificial
  CRISPR gRNA sequence
atactggggtacgttggggc

SEQ ID NO: 571544 - DNA, 20 bp, Artificial
  CRISPR gRNA sequence
tactggggtacgttggggcc

SEQ ID NO: 571545 - DNA, 20 bp, Artificial
  CRISPR gRNA sequence
actggggtacgttggggcca

SEQ ID NO: 571546 - DNA, 20 bp, Artificial
  CRISPR gRNA sequence
ggggtacgttggggccaggg

SEQ ID NO: 571547 - DNA, 20 bp, Artificial
  CRISPR gRNA sequence
gggtacgttggggccaggga

SEQ ID NO: 571548 - DNA, 20 bp, Artificial
  CRISPR gRNA sequence
gtacgttggggccagggaag

SEQ ID NO: 571549 - DNA, 20 bp, Artificial
  CRISPR gRNA sequence
gttggggccagggaaggaga

SEQ ID NO: 571550 - DNA, 20 bp, Artificial
  CRISPR gRNA sequence
ttggggccagggaaggagat

SEQ ID NO: 571551 - DNA, 20 bp, Artificial
  CRISPR gRNA sequence
tggggccagggaaggagatg

SEQ ID NO: 571552 - DNA, 20 bp, Artificial
  CRISPR gRNA sequence
gccagggaaggagatggggt

SEQ ID NO: 571553 - DNA, 20 bp, Artificial
  CRISPR gRNA sequence
ccagggaaggagatggggtt

SEQ ID NO: 571554 - DNA, 20 bp, Artificial
  CRISPR gRNA sequence
ggaaggagatggggttgggt

SEQ ID NO: 571555 - DNA, 20 bp, Artificial
  CRISPR gRNA sequence
gatggggttgggttggcata

SEQ ID NO: 571556 - DNA, 20 bp, Artificial
  CRISPR gRNA sequence
atggggttgggttggcataa

SEQ ID NO: 571557 - DNA, 20 bp, Artificial
  CRISPR gRNA sequence
ggttgggttggcataaaggc

SEQ ID NO: 571558 - DNA, 20 bp, Artificial
  CRISPR gRNA sequence
gttgggttggcataaaggct

SEQ ID NO: 571559 - DNA, 20 bp, Artificial
  CRISPR gRNA sequence
ttgggttggcataaaggctg

SEQ ID NO: 571560 - DNA, 20 bp, Artificial
  CRISPR gRNA sequence
ggttggcataaaggctgggg

SEQ ID NO: 571561 - DNA, 20 bp, Artificial
  CRISPR gRNA sequence
gttggcataaaggctgggga

SEQ ID NO: 571562 - DNA, 20 bp, Artificial
  CRISPR gRNA sequence
tggcataaaggctggggaag

SEQ ID NO: 571563 - DNA, 20 bp, Artificial
  CRISPR gRNA sequence
ataaaggctggggaaggagt

SEQ ID NO: 571564 - DNA, 20 bp, Artificial
  CRISPR gRNA sequence
aaaggctggggaaggagtta

SEQ ID NO: 571565 - DNA, 20 bp, Artificial
  CRISPR gRNA sequence
gctggggaaggagttagagt

SEQ ID NO: 571566 - DNA, 20 bp, Artificial
  CRISPR gRNA sequence
tggggaaggagttagagtaa

SEQ ID NO: 571567 - DNA, 20 bp, Artificial
  CRISPR gRNA sequence
gaaggagttagagtaagagc

SEQ ID NO: 571568 - DNA, 20 bp, Artificial
  CRISPR gRNA sequence
aaggagttagagtaagagct

SEQ ID NO: 571569 - DNA, 20 bp, Artificial
  CRISPR gRNA sequence
aggagttagagtaagagctg

SEQ ID NO: 571570 - DNA, 20 bp, Artificial
  CRISPR gRNA sequence
agtaagagctggggtacgtt

SEQ ID NO: 571571 - DNA, 20 bp, Artificial
  CRISPR gRNA sequence
gtaagagctggggtacgttt

SEQ ID NO: 571572 - DNA, 20 bp, Artificial
  CRISPR gRNA sequence
taagagctggggtacgttta

SEQ ID NO: 571573 - DNA, 20 bp, Artificial
  CRISPR gRNA sequence
agctggggtacgtttagggc

SEQ ID NO: 571574 - DNA, 20 bp, Artificial
  CRISPR gRNA sequence
gctggggtacgtttagggca

SEQ ID NO: 571575 - DNA, 20 bp, Artificial
  CRISPR gRNA sequence
ggtacgtttagggcaaggtg

SEQ ID NO: 571576 - DNA, 20 bp, Artificial
  CRISPR gRNA sequence
tacgtttagggcaaggtgca

SEQ ID NO: 571577 - DNA, 20 bp, Artificial
  CRISPR gRNA sequence
tttagggcaaggtgcagaga

SEQ ID NO: 571578 - DNA, 20 bp, Artificial
  CRISPR gRNA sequence
ttagggcaaggtgcagagat

SEQ ID NO: 571579 - DNA, 20 bp, Artificial
  CRISPR gRNA sequence
tagggcaaggtgcagagatg

SEQ ID NO: 571580 - DNA, 20 bp, Artificial
  CRISPR gRNA sequence
gcaaggtgcagagatggggt

SEQ ID NO: 571581 - DNA, 20 bp, Artificial
  CRISPR gRNA sequence
tgcagagatggggttagctt

SEQ ID NO: 571582 - DNA, 20 bp, Artificial
  CRISPR gRNA sequence
gcagagatggggttagcttt

SEQ ID NO: 571583 - DNA, 20 bp, Artificial
  CRISPR gRNA sequence
gttagctttaggctatttta

SEQ ID NO: 571584 - DNA, 20 bp, Artificial
  CRISPR gRNA sequence
ttagctttaggctattttat

SEQ ID NO: 571585 - DNA, 20 bp, Artificial
  CRISPR gRNA sequence
tttaggctattttatgggtc

SEQ ID NO: 571586 - DNA, 20 bp, Artificial
  CRISPR gRNA sequence
ttaggctattttatgggtcc

SEQ ID NO: 571587 - DNA, 20 bp, Artificial
  CRISPR gRNA sequence
aggctattttatgggtccag

SEQ ID NO: 571588 - DNA, 20 bp, Artificial
  CRISPR gRNA sequence
gctattttatgggtccagga

SEQ ID NO: 571589 - DNA, 20 bp, Artificial
  CRISPR gRNA sequence
ctattttatgggtccaggag

SEQ ID NO: 571590 - DNA, 20 bp, Artificial
  CRISPR gRNA sequence
tattttatgggtccaggaga

SEQ ID NO: 571591 - DNA, 20 bp, Artificial
  CRISPR gRNA sequence
ttatgggtccaggagagggt

SEQ ID NO: 571592 - DNA, 20 bp, Artificial
  CRISPR gRNA sequence
tatgggtccaggagagggtt

SEQ ID NO: 571593 - DNA, 20 bp, Artificial
  CRISPR gRNA sequence
gtccaggagagggttaggta

SEQ ID NO: 571594 - DNA, 20 bp, Artificial
  CRISPR gRNA sequence
tccaggagagggttaggtat

SEQ ID NO: 571595 - DNA, 20 bp, Artificial
  CRISPR gRNA sequence
ccaggagagggttaggtatg

SEQ ID NO: 571596 - DNA, 20 bp, Artificial
  CRISPR gRNA sequence
agagggttaggtatggggct

SEQ ID NO: 571597 - DNA, 20 bp, Artificial
  CRISPR gRNA sequence
gagggttaggtatggggctg

SEQ ID NO: 571598 - DNA, 20 bp, Artificial
  CRISPR gRNA sequence
ggttaggtatggggctgagg

SEQ ID NO: 571599 - DNA, 20 bp, Artificial
  CRISPR gRNA sequence
atggggctgaggtggacatc

SEQ ID NO: 571600 - DNA, 20 bp, Artificial
  CRISPR gRNA sequence
ggctgaggtggacatctgga

SEQ ID NO: 571601 - DNA, 20 bp, Artificial
  CRISPR gRNA sequence
gctgaggtggacatctggaa

SEQ ID NO: 571602 - DNA, 20 bp, Artificial
  CRISPR gRNA sequence
ctgaggtggacatctggaaa

SEQ ID NO: 571603 - DNA, 20 bp, Artificial
  CRISPR gRNA sequence
tgaggtggacatctggaaag

SEQ ID NO: 571604 - DNA, 20 bp, Artificial
  CRISPR gRNA sequence
ggtggacatctggaaagggg

SEQ ID NO: 571605 - DNA, 20 bp, Artificial
  CRISPR gRNA sequence
gtggacatctggaaaggggt

SEQ ID NO: 571606 - DNA, 20 bp, Artificial
  CRISPR gRNA sequence
catctggaaaggggtaggtt

SEQ ID NO: 571607 - DNA, 20 bp, Artificial
  CRISPR gRNA sequence
atctggaaaggggtaggttt

SEQ ID NO: 571608 - DNA, 20 bp, Artificial
  CRISPR gRNA sequence
tctggaaaggggtaggttta

SEQ ID NO: 571609 - DNA, 20 bp, Artificial
  CRISPR gRNA sequence
gaaaggggtaggtttagggt

SEQ ID NO: 571610 - DNA, 20 bp, Artificial
  CRISPR gRNA sequence
gtaggtttagggtcagaatt

SEQ ID NO: 571611 - DNA, 20 bp, Artificial
  CRISPR gRNA sequence
ggtcagaatttggcatgctc

SEQ ID NO: 571612 - DNA, 20 bp, Artificial
  CRISPR gRNA sequence
gaatttggcatgctctggcc

SEQ ID NO: 571613 - DNA, 20 bp, Artificial
  CRISPR gRNA sequence
ttggcatgctctggcctgga

SEQ ID NO: 571614 - DNA, 20 bp, Artificial
  CRISPR gRNA sequence
gcatgctctggcctggatgg

SEQ ID NO: 571615 - DNA, 20 bp, Artificial
  CRISPR gRNA sequence
ctctggcctggatggtggtt

SEQ ID NO: 571616 - DNA, 20 bp, Artificial
  CRISPR gRNA sequence
tctggcctggatggtggttt

SEQ ID NO: 571617 - DNA, 20 bp, Artificial
  CRISPR gRNA sequence
cctggatggtggtttaggtt

SEQ ID NO: 571618 - DNA, 20 bp, Artificial
  CRISPR gRNA sequence
gtggtttaggtttggatttg

SEQ ID NO: 571619 - DNA, 20 bp, Artificial
  CRISPR gRNA sequence
tttaggtttggatttgcgga

SEQ ID NO: 571620 - DNA, 20 bp, Artificial
  CRISPR gRNA sequence
ttaggtttggatttgcggac

SEQ ID NO: 571621 - DNA, 20 bp, Artificial
  CRISPR gRNA sequence
tttggatttgcggacaggtt

SEQ ID NO: 571622 - DNA, 20 bp, Artificial
  CRISPR gRNA sequence
ttggatttgcggacaggttt

SEQ ID NO: 571623 - DNA, 20 bp, Artificial
  CRISPR gRNA sequence
tggatttgcggacaggtttg

SEQ ID NO: 571624 - DNA, 20 bp, Artificial
  CRISPR gRNA sequence
ttgcggacaggtttggggtg

SEQ ID NO: 571625 - DNA, 20 bp, Artificial
  CRISPR gRNA sequence
ggacaggtttggggtgaagc

SEQ ID NO: 571626 - DNA, 20 bp, Artificial
  CRISPR gRNA sequence
gtttggggtgaagccagcat

SEQ ID NO: 571627 - DNA, 20 bp, Artificial
  CRISPR gRNA sequence
tttggggtgaagccagcatg

SEQ ID NO: 571628 - DNA, 20 bp, Artificial
  CRISPR gRNA sequence
ttggggtgaagccagcatga

SEQ ID NO: 571629 - DNA, 20 bp, Artificial
  CRISPR gRNA sequence
tggggtgaagccagcatgag

SEQ ID NO: 571630 - DNA, 20 bp, Artificial
  CRISPR gRNA sequence
cagcatgaggggtcacattt

SEQ ID NO: 571631 - DNA, 20 bp, Artificial
  CRISPR gRNA sequence
agcatgaggggtcacatttg

SEQ ID NO: 571632 - DNA, 20 bp, Artificial
  CRISPR gRNA sequence
gaggggtcacatttgaggca

SEQ ID NO: 571633 - DNA, 20 bp, Artificial
  CRISPR gRNA sequence
gtcacatttgaggcacggct

SEQ ID NO: 571634 - DNA, 20 bp, Artificial
  CRISPR gRNA sequence
tcacatttgaggcacggctt

SEQ ID NO: 571635 - DNA, 20 bp, Artificial
  CRISPR gRNA sequence
cacatttgaggcacggcttg

SEQ ID NO: 571636 - DNA, 20 bp, Artificial
  CRISPR gRNA sequence
aggcacggcttggggatcct

SEQ ID NO: 571637 - DNA, 20 bp, Artificial
  CRISPR gRNA sequence
ggcacggcttggggatcctt

SEQ ID NO: 571638 - DNA, 20 bp, Artificial
  CRISPR gRNA sequence
gcacggcttggggatccttg

SEQ ID NO: 571639 - DNA, 20 bp, Artificial
  CRISPR gRNA sequence
ggcttggggatccttggggc

SEQ ID NO: 571640 - DNA, 20 bp, Artificial
  CRISPR gRNA sequence
gcttggggatccttggggct

SEQ ID NO: 571641 - DNA, 20 bp, Artificial
  CRISPR gRNA sequence
cttggggatccttggggctg

SEQ ID NO: 571642 - DNA, 20 bp, Artificial
  CRISPR gRNA sequence
ggatccttggggctggggct

SEQ ID NO: 571643 - DNA, 20 bp, Artificial
  CRISPR gRNA sequence
gatccttggggctggggctt

SEQ ID NO: 571644 - DNA, 20 bp, Artificial
  CRISPR gRNA sequence
ttggggctggggcttgggaa

SEQ ID NO: 571645 - DNA, 20 bp, Artificial
  CRISPR gRNA sequence
ggggctggggcttgggaatg

SEQ ID NO: 571646 - DNA, 20 bp, Artificial
  CRISPR gRNA sequence
gggctggggcttgggaatgg

SEQ ID NO: 571647 - DNA, 20 bp, Artificial
  CRISPR gRNA sequence
ggaatggaggaacccactct

SEQ ID NO: 571648 - DNA, 20 bp, Artificial
  CRISPR gRNA sequence
gaatggaggaacccactctg

SEQ ID NO: 571649 - DNA, 20 bp, Artificial
  CRISPR gRNA sequence
aatggaggaacccactctga

SEQ ID NO: 571650 - DNA, 20 bp, Artificial
  CRISPR gRNA sequence
gaacccactctgagggcact

SEQ ID NO: 571651 - DNA, 20 bp, Artificial
  CRISPR gRNA sequence
acccactctgagggcactca

SEQ ID NO: 571652 - DNA, 20 bp, Artificial
  CRISPR gRNA sequence
cccactctgagggcactcag

SEQ ID NO: 571653 - DNA, 20 bp, Artificial
  CRISPR gRNA sequence
ccactctgagggcactcaga

SEQ ID NO: 571654 - DNA, 20 bp, Artificial
  CRISPR gRNA sequence
actctgagggcactcagagg

SEQ ID NO: 571655 - DNA, 20 bp, Artificial
  CRISPR gRNA sequence
tgagggcactcagagggaga

SEQ ID NO: 571656 - DNA, 20 bp, Artificial
  CRISPR gRNA sequence
gagggcactcagagggagac

SEQ ID NO: 571657 - DNA, 20 bp, Artificial
  CRISPR gRNA sequence
gggcactcagagggagacag

SEQ ID NO: 571658 - DNA, 20 bp, Artificial
  CRISPR gRNA sequence
ctcagagggagacaggagtt

SEQ ID NO: 571659 - DNA, 20 bp, Artificial
  CRISPR gRNA sequence
tcagagggagacaggagttt

SEQ ID NO: 571660 - DNA, 20 bp, Artificial
  CRISPR gRNA sequence
agagggagacaggagtttgg

SEQ ID NO: 571661 - DNA, 20 bp, Artificial
  CRISPR gRNA sequence
gagggagacaggagtttggg

SEQ ID NO: 571662 - DNA, 20 bp, Artificial
  CRISPR gRNA sequence
ggagacaggagtttgggagg

SEQ ID NO: 571663 - DNA, 20 bp, Artificial
  CRISPR gRNA sequence
gagacaggagtttgggaggc

SEQ ID NO: 571664 - DNA, 20 bp, Artificial
  CRISPR gRNA sequence
atctttgtcttcctcctcct

SEQ ID NO: 571665 - DNA, 20 bp, Artificial
  CRISPR gRNA sequence
tctttgtcttcctcctcctt

SEQ ID NO: 571666 - DNA, 20 bp, Artificial
  CRISPR gRNA sequence
ctttgtcttcctcctccttg

SEQ ID NO: 571667 - DNA, 20 bp, Artificial
  CRISPR gRNA sequence
tcttcctcctccttggggcc

SEQ ID NO: 571668 - DNA, 20 bp, Artificial
  CRISPR gRNA sequence
gccgagctgccctgcttacc

SEQ ID NO: 571669 - DNA, 20 bp, Artificial
  CRISPR gRNA sequence
gagctgccctgcttacccag

SEQ ID NO: 571670 - DNA, 20 bp, Artificial
  CRISPR gRNA sequence
gccctgcttacccagcggat

SEQ ID NO: 571671 - DNA, 20 bp, Artificial
  CRISPR gRNA sequence
gcttacccagcggatgagcg

SEQ ID NO: 571672 - DNA, 20 bp, Artificial
  CRISPR gRNA sequence
cccagcggatgagcgtggcg

SEQ ID NO: 571673 - DNA, 20 bp, Artificial
  CRISPR gRNA sequence
ccagcggatgagcgtggcgt

SEQ ID NO: 571674 - DNA, 20 bp, Artificial
  CRISPR gRNA sequence
gatgagcgtggcgtaggtga

SEQ ID NO: 571675 - DNA, 20 bp, Artificial
  CRISPR gRNA sequence
atgagcgtggcgtaggtgaa

SEQ ID NO: 571676 - DNA, 20 bp, Artificial
  CRISPR gRNA sequence
tgagcgtggcgtaggtgaaa

SEQ ID NO: 571677 - DNA, 20 bp, Artificial
  CRISPR gRNA sequence
gagcgtggcgtaggtgaaag

SEQ ID NO: 571678 - DNA, 20 bp, Artificial
  CRISPR gRNA sequence
agcgtggcgtaggtgaaagg

SEQ ID NO: 571679 - DNA, 20 bp, Artificial
  CRISPR gRNA sequence
tgaaagggggtcgcatgttg

SEQ ID NO: 571680 - DNA, 20 bp, Artificial
  CRISPR gRNA sequence
gtcgcatgttgtggaacttg

SEQ ID NO: 571681 - DNA, 20 bp, Artificial
  CRISPR gRNA sequence
gcatgttgtggaacttgaag

SEQ ID NO: 571682 - DNA, 20 bp, Artificial
  CRISPR gRNA sequence
acttgaagtagtccatgttg

SEQ ID NO: 571683 - DNA, 20 bp, Artificial
  CRISPR gRNA sequence
ttgaagtagtccatgttgtg

SEQ ID NO: 571684 - DNA, 20 bp, Artificial
  CRISPR gRNA sequence
tgaagtagtccatgttgtgg

SEQ ID NO: 571685 - DNA, 20 bp, Artificial
  CRISPR gRNA sequence
atgttgtggaggaactctgt

SEQ ID NO: 571686 - DNA, 20 bp, Artificial
  CRISPR gRNA sequence
gttgtggaggaactctgtca

SEQ ID NO: 571687 - DNA, 20 bp, Artificial
  CRISPR gRNA sequence
ttgtggaggaactctgtcag

SEQ ID NO: 571688 - DNA, 20 bp, Artificial
  CRISPR gRNA sequence
tgtggaggaactctgtcaga

SEQ ID NO: 571689 - DNA, 20 bp, Artificial
  CRISPR gRNA sequence
ggaggaactctgtcagaggg

SEQ ID NO: 571690 - DNA, 20 bp, Artificial
  CRISPR gRNA sequence
gaggaactctgtcagagggt

SEQ ID NO: 571691 - DNA, 20 bp, Artificial
  CRISPR gRNA sequence
aggaactctgtcagagggtg

SEQ ID NO: 571692 - DNA, 20 bp, Artificial
  CRISPR gRNA sequence
tcagagggtggggatgaatc

SEQ ID NO: 571693 - DNA, 20 bp, Artificial
  CRISPR gRNA sequence
gggatgaatcaagccccatg

SEQ ID NO: 571694 - DNA, 20 bp, Artificial
  CRISPR gRNA sequence
ggatgaatcaagccccatgc

SEQ ID NO: 571695 - DNA, 20 bp, Artificial
  CRISPR gRNA sequence
aagccccatgcaggacctcc

SEQ ID NO: 571696 - DNA, 20 bp, Artificial
  CRISPR gRNA sequence
cccatgcaggacctcctagc

SEQ ID NO: 571697 - DNA, 20 bp, Artificial
  CRISPR gRNA sequence
tccctgtcccctccccctac

SEQ ID NO: 571698 - DNA, 20 bp, Artificial
  CRISPR gRNA sequence
ccctgtcccctccccctaca

SEQ ID NO: 571699 - DNA, 20 bp, Artificial
  CRISPR gRNA sequence
gtcccctccccctacaaggt

SEQ ID NO: 571700 - DNA, 20 bp, Artificial
  CRISPR gRNA sequence
ccccctacaaggtgagtcta

SEQ ID NO: 571701 - DNA, 20 bp, Artificial
  CRISPR gRNA sequence
cccctacaaggtgagtctac

SEQ ID NO: 571702 - DNA, 20 bp, Artificial
  CRISPR gRNA sequence
caaggtgagtctacaggcct

SEQ ID NO: 571703 - DNA, 20 bp, Artificial
  CRISPR gRNA sequence
accgtcaacacccgtgtcca

SEQ ID NO: 571704 - DNA, 20 bp, Artificial
  CRISPR gRNA sequence
ccgtcaacacccgtgtccac

SEQ ID NO: 571705 - DNA, 20 bp, Artificial
  CRISPR gRNA sequence
aacacccgtgtccacgggca

SEQ ID NO: 571706 - DNA, 20 bp, Artificial
  CRISPR gRNA sequence
acacccgtgtccacgggcac

SEQ ID NO: 571707 - DNA, 20 bp, Artificial
  CRISPR gRNA sequence
gggcacaggtactgtttgct

SEQ ID NO: 571708 - DNA, 20 bp, Artificial
  CRISPR gRNA sequence
gtttgctgagcacctgacat

SEQ ID NO: 571709 - DNA, 20 bp, Artificial
  CRISPR gRNA sequence
ttgcaccacttctgccaaaa

SEQ ID NO: 571710 - DNA, 20 bp, Artificial
  CRISPR gRNA sequence
ctgccaaaatagttctcccc

SEQ ID NO: 571711 - DNA, 20 bp, Artificial
  CRISPR gRNA sequence
tgccaaaatagttctccccg

SEQ ID NO: 571712 - DNA, 20 bp, Artificial
  CRISPR gRNA sequence
tagttctccccgaggttgaa

SEQ ID NO: 571713 - DNA, 20 bp, Artificial
  CRISPR gRNA sequence
ttctccccgaggttgaaaag

SEQ ID NO: 571714 - DNA, 20 bp, Artificial
  CRISPR gRNA sequence
tccccgaggttgaaaagaag

SEQ ID NO: 571715 - DNA, 20 bp, Artificial
  CRISPR gRNA sequence
cccgaggttgaaaagaagcg

SEQ ID NO: 571716 - DNA, 20 bp, Artificial
  CRISPR gRNA sequence
gcggagtaacttgcacacca

SEQ ID NO: 571717 - DNA, 20 bp, Artificial
  CRISPR gRNA sequence
cggagtaacttgcacaccaa

SEQ ID NO: 571718 - DNA, 20 bp, Artificial
  CRISPR gRNA sequence
acttgcacaccaaaggatgc

SEQ ID NO: 571719 - DNA, 20 bp, Artificial
  CRISPR gRNA sequence
ttgcacaccaaaggatgcaa

SEQ ID NO: 571720 - DNA, 20 bp, Artificial
  CRISPR gRNA sequence
tgcacaccaaaggatgcaag

SEQ ID NO: 571721 - DNA, 20 bp, Artificial
  CRISPR gRNA sequence
aaaggatgcaagaggttaaa

SEQ ID NO: 571722 - DNA, 20 bp, Artificial
  CRISPR gRNA sequence
ggatgcaagaggttaaatgg

SEQ ID NO: 571723 - DNA, 20 bp, Artificial
  CRISPR gRNA sequence
atgcaagaggttaaatggca

SEQ ID NO: 571724 - DNA, 20 bp, Artificial
  CRISPR gRNA sequence
aagaggttaaatggcagagc

SEQ ID NO: 571725 - DNA, 20 bp, Artificial
  CRISPR gRNA sequence
agaggttaaatggcagagcc

SEQ ID NO: 571726 - DNA, 20 bp, Artificial
  CRISPR gRNA sequence
aaatggcagagccaggatga

SEQ ID NO: 571727 - DNA, 20 bp, Artificial
  CRISPR gRNA sequence
gcagagccaggatgacagtc

SEQ ID NO: 571728 - DNA, 20 bp, Artificial
  CRISPR gRNA sequence
cagagccaggatgacagtca

SEQ ID NO: 571729 - DNA, 20 bp, Artificial
  CRISPR gRNA sequence
caaggtctctgatccctgct

SEQ ID NO: 571730 - DNA, 20 bp, Artificial
  CRISPR gRNA sequence
tctgatccctgctaagccca

SEQ ID NO: 571731 - DNA, 20 bp, Artificial
  CRISPR gRNA sequence
ctgatccctgctaagcccac

SEQ ID NO: 571732 - DNA, 20 bp, Artificial
  CRISPR gRNA sequence
tccctgctaagcccacaggc

SEQ ID NO: 571733 - DNA, 20 bp, Artificial
  CRISPR gRNA sequence
ccctgctaagcccacaggcc

SEQ ID NO: 571734 - DNA, 20 bp, Artificial
  CRISPR gRNA sequence
ctaagcccacaggccaggcc

SEQ ID NO: 571735 - DNA, 20 bp, Artificial
  CRISPR gRNA sequence
agcccacaggccaggcctgg

SEQ ID NO: 571736 - DNA, 20 bp, Artificial
  CRISPR gRNA sequence
cccacaggccaggcctggtg

SEQ ID NO: 571737 - DNA, 20 bp, Artificial
  CRISPR gRNA sequence
cacaggccaggcctggtgga

SEQ ID NO: 571738 - DNA, 20 bp, Artificial
  CRISPR gRNA sequence
aggccaggcctggtggagag

SEQ ID NO: 571739 - DNA, 20 bp, Artificial
  CRISPR gRNA sequence
ccaggcctggtggagagcag

SEQ ID NO: 571740 - DNA, 20 bp, Artificial
  CRISPR gRNA sequence
gcctggtggagagcagtgga

SEQ ID NO: 571741 - DNA, 20 bp, Artificial
  CRISPR gRNA sequence
cctggtggagagcagtggat

SEQ ID NO: 571742 - DNA, 20 bp, Artificial
  CRISPR gRNA sequence
gtggagagcagtggataggt

SEQ ID NO: 571743 - DNA, 20 bp, Artificial
  CRISPR gRNA sequence
gagcagtggataggtgagct

SEQ ID NO: 571744 - DNA, 20 bp, Artificial
  CRISPR gRNA sequence
agcagtggataggtgagctc

SEQ ID NO: 571745 - DNA, 20 bp, Artificial
  CRISPR gRNA sequence
gaatccaccccgattttcct

SEQ ID NO: 571746 - DNA, 20 bp, Artificial
  CRISPR gRNA sequence
ccaccccgattttccttggt

SEQ ID NO: 571747 - DNA, 20 bp, Artificial
  CRISPR gRNA sequence
caccccgattttccttggtc

SEQ ID NO: 571748 - DNA, 20 bp, Artificial
  CRISPR gRNA sequence
accccgattttccttggtca

SEQ ID NO: 571749 - DNA, 20 bp, Artificial
  CRISPR gRNA sequence
ccccgattttccttggtcag

SEQ ID NO: 571750 - DNA, 20 bp, Artificial
  CRISPR gRNA sequence
ccgattttccttggtcaggg

SEQ ID NO: 571751 - DNA, 20 bp, Artificial
  CRISPR gRNA sequence
cgattttccttggtcagggg

SEQ ID NO: 571752 - DNA, 20 bp, Artificial
  CRISPR gRNA sequence
tttccttggtcaggggagga

SEQ ID NO: 571753 - DNA, 20 bp, Artificial
  CRISPR gRNA sequence
ttccttggtcaggggaggaa

SEQ ID NO: 571754 - DNA, 20 bp, Artificial
  CRISPR gRNA sequence
ccttggtcaggggaggaaag

SEQ ID NO: 571755 - DNA, 20 bp, Artificial
  CRISPR gRNA sequence
cttggtcaggggaggaaagg

SEQ ID NO: 571756 - DNA, 20 bp, Artificial
  CRISPR gRNA sequence
gggaggaaaggaggtgctcc

SEQ ID NO: 571757 - DNA, 20 bp, Artificial
  CRISPR gRNA sequence
gaggtgctcctggaattact

SEQ ID NO: 571758 - DNA, 20 bp, Artificial
  CRISPR gRNA sequence
gtgctcctggaattacttag

SEQ ID NO: 571759 - DNA, 20 bp, Artificial
  CRISPR gRNA sequence
tgctcctggaattacttagc

SEQ ID NO: 571760 - DNA, 20 bp, Artificial
  CRISPR gRNA sequence
gctcctggaattacttagca

SEQ ID NO: 571761 - DNA, 20 bp, Artificial
  CRISPR gRNA sequence
gcagggtccctcccttctga

SEQ ID NO: 571762 - DNA, 20 bp, Artificial
  CRISPR gRNA sequence
tcccttctgatggccgaata

SEQ ID NO: 571763 - DNA, 20 bp, Artificial
  CRISPR gRNA sequence
cttctgatggccgaatatag

SEQ ID NO: 571764 - DNA, 20 bp, Artificial
  CRISPR gRNA sequence
tgatggccgaatatagtagc

SEQ ID NO: 571765 - DNA, 20 bp, Artificial
  CRISPR gRNA sequence
atggccgaatatagtagctg

SEQ ID NO: 571766 - DNA, 20 bp, Artificial
  CRISPR gRNA sequence
cgaatatagtagctggagtc

SEQ ID NO: 571767 - DNA, 20 bp, Artificial
  CRISPR gRNA sequence
aatatagtagctggagtcca

SEQ ID NO: 571768 - DNA, 20 bp, Artificial
  CRISPR gRNA sequence
atagtagctggagtccagag

SEQ ID NO: 571769 - DNA, 20 bp, Artificial
  CRISPR gRNA sequence
tagtagctggagtccagagt

SEQ ID NO: 571770 - DNA, 20 bp, Artificial
  CRISPR gRNA sequence
agctggagtccagagtgggt

SEQ ID NO: 571771 - DNA, 20 bp, Artificial
  CRISPR gRNA sequence
gctggagtccagagtgggtg

SEQ ID NO: 571772 - DNA, 20 bp, Artificial
  CRISPR gRNA sequence
agtccagagtgggtgaggca

SEQ ID NO: 571773 - DNA, 20 bp, Artificial
  CRISPR gRNA sequence
gaggcatggccccaatcccc

SEQ ID NO: 571774 - DNA, 20 bp, Artificial
  CRISPR gRNA sequence
aggcatggccccaatcccca

SEQ ID NO: 571775 - DNA, 20 bp, Artificial
  CRISPR gRNA sequence
ggcatggccccaatccccaa

SEQ ID NO: 571776 - DNA, 20 bp, Artificial
  CRISPR gRNA sequence
catggccccaatccccaagg

SEQ ID NO: 571777 - DNA, 20 bp, Artificial
  CRISPR gRNA sequence
gccccaatccccaagggagt

SEQ ID NO: 571778 - DNA, 20 bp, Artificial
  CRISPR gRNA sequence
ccccaatccccaagggagtc

SEQ ID NO: 571779 - DNA, 20 bp, Artificial
  CRISPR gRNA sequence
cccaatccccaagggagtca

SEQ ID NO: 571780 - DNA, 20 bp, Artificial
  CRISPR gRNA sequence
atccccaagggagtcagggc

SEQ ID NO: 571781 - DNA, 20 bp, Artificial
  CRISPR gRNA sequence
tccccaagggagtcagggct

SEQ ID NO: 571782 - DNA, 20 bp, Artificial
  CRISPR gRNA sequence
ccccaagggagtcagggcta

SEQ ID NO: 571783 - DNA, 20 bp, Artificial
  CRISPR gRNA sequence
cccaagggagtcagggctag

SEQ ID NO: 571784 - DNA, 20 bp, Artificial
  CRISPR gRNA sequence
gggctaggggcccgacactc

SEQ ID NO: 571785 - DNA, 20 bp, Artificial
  CRISPR gRNA sequence
gcccgacactcgagaccata

SEQ ID NO: 571786 - DNA, 20 bp, Artificial
  CRISPR gRNA sequence
cccgacactcgagaccatat

SEQ ID NO: 571787 - DNA, 20 bp, Artificial
  CRISPR gRNA sequence
ccgacactcgagaccatatg

SEQ ID NO: 571788 - DNA, 20 bp, Artificial
  CRISPR gRNA sequence
cgacactcgagaccatatgg

SEQ ID NO: 571789 - DNA, 20 bp, Artificial
  CRISPR gRNA sequence
gacactcgagaccatatggg

SEQ ID NO: 571790 - DNA, 20 bp, Artificial
  CRISPR gRNA sequence
gagaccatatggggggcttt

SEQ ID NO: 571791 - DNA, 20 bp, Artificial
  CRISPR gRNA sequence
agaccatatggggggctttc

SEQ ID NO: 571792 - DNA, 20 bp, Artificial
  CRISPR gRNA sequence
tatggggggctttcaggcca

SEQ ID NO: 571793 - DNA, 20 bp, Artificial
  CRISPR gRNA sequence
tcaggccacggacatcccga

SEQ ID NO: 571794 - DNA, 20 bp, Artificial
  CRISPR gRNA sequence
caggccacggacatcccgaa

SEQ ID NO: 571795 - DNA, 20 bp, Artificial
  CRISPR gRNA sequence
gccacggacatcccgaaagg

SEQ ID NO: 571796 - DNA, 20 bp, Artificial
  CRISPR gRNA sequence
tcccgaaaggaagcttttgt

SEQ ID NO: 571797 - DNA, 20 bp, Artificial
  CRISPR gRNA sequence
cgaaaggaagcttttgtgag

SEQ ID NO: 571798 - DNA, 20 bp, Artificial
  CRISPR gRNA sequence
tgagcggatgcattttccca

SEQ ID NO: 571799 - DNA, 20 bp, Artificial
  CRISPR gRNA sequence
gagcggatgcattttcccaa

SEQ ID NO: 571800 - DNA, 20 bp, Artificial
  CRISPR gRNA sequence
gatgcattttcccaaaggct

SEQ ID NO: 571801 - DNA, 20 bp, Artificial
  CRISPR gRNA sequence
gcattttcccaaaggctgag

SEQ ID NO: 571802 - DNA, 20 bp, Artificial
  CRISPR gRNA sequence
ttttcccaaaggctgagtgg

SEQ ID NO: 571803 - DNA, 20 bp, Artificial
  CRISPR gRNA sequence
tcccaaaggctgagtggcgg

SEQ ID NO: 571804 - DNA, 20 bp, Artificial
  CRISPR gRNA sequence
aggctgagtggcggcagctg

SEQ ID NO: 571805 - DNA, 20 bp, Artificial
  CRISPR gRNA sequence
ctgagtggcggcagctgcag

SEQ ID NO: 571806 - DNA, 20 bp, Artificial
  CRISPR gRNA sequence
agtggcggcagctgcagtgg

SEQ ID NO: 571807 - DNA, 20 bp, Artificial
  CRISPR gRNA sequence
ggcggcagctgcagtggtgg

SEQ ID NO: 571808 - DNA, 20 bp, Artificial
  CRISPR gRNA sequence
ggcagctgcagtggtggtgg

SEQ ID NO: 571809 - DNA, 20 bp, Artificial
  CRISPR gRNA sequence
agctgcagtggtggtggtgg

SEQ ID NO: 571810 - DNA, 20 bp, Artificial
  CRISPR gRNA sequence
gctgcagtggtggtggtggt

SEQ ID NO: 571811 - DNA, 20 bp, Artificial
  CRISPR gRNA sequence
gcagtggtggtggtggtggg

SEQ ID NO: 571812 - DNA, 20 bp, Artificial
  CRISPR gRNA sequence
cagtggtggtggtggtggga

SEQ ID NO: 571813 - DNA, 20 bp, Artificial
  CRISPR gRNA sequence
agtggtggtggtggtgggaa

SEQ ID NO: 571814 - DNA, 20 bp, Artificial
  CRISPR gRNA sequence
gtggtggtggtggtgggaag

SEQ ID NO: 571815 - DNA, 20 bp, Artificial
  CRISPR gRNA sequence
gtggtggtggtgggaagggg

SEQ ID NO: 571816 - DNA, 20 bp, Artificial
  CRISPR gRNA sequence
ggtggtgggaaggggcagca

SEQ ID NO: 571817 - DNA, 20 bp, Artificial
  CRISPR gRNA sequence
tggtgggaaggggcagcatg

SEQ ID NO: 571818 - DNA, 20 bp, Artificial
  CRISPR gRNA sequence
gctcctttgcaccctccacc

SEQ ID NO: 571819 - DNA, 20 bp, Artificial
  CRISPR gRNA sequence
tcctttgcaccctccaccca

SEQ ID NO: 571820 - DNA, 20 bp, Artificial
  CRISPR gRNA sequence
accctccacccagagcctgt

SEQ ID NO: 571821 - DNA, 20 bp, Artificial
  CRISPR gRNA sequence
ccctccacccagagcctgtc

SEQ ID NO: 571822 - DNA, 20 bp, Artificial
  CRISPR gRNA sequence
cacccagagcctgtcaggat

SEQ ID NO: 571823 - DNA, 20 bp, Artificial
  CRISPR gRNA sequence
acccagagcctgtcaggatt

SEQ ID NO: 571824 - DNA, 20 bp, Artificial
  CRISPR gRNA sequence
ccagagcctgtcaggattag

SEQ ID NO: 571825 - DNA, 20 bp, Artificial
  CRISPR gRNA sequence
gcctgtcaggattaggagct

SEQ ID NO: 571826 - DNA, 20 bp, Artificial
  CRISPR gRNA sequence
cctgtcaggattaggagctt

SEQ ID NO: 571827 - DNA, 20 bp, Artificial
  CRISPR gRNA sequence
ctgtcaggattaggagcttg

SEQ ID NO: 571828 - DNA, 20 bp, Artificial
  CRISPR gRNA sequence
tgtcaggattaggagcttgg

SEQ ID NO: 571829 - DNA, 20 bp, Artificial
  CRISPR gRNA sequence
aggagcttgggggcaccgtg

SEQ ID NO: 571830 - DNA, 20 bp, Artificial
  CRISPR gRNA sequence
ttgggggcaccgtgtagtgc

SEQ ID NO: 571831 - DNA, 20 bp, Artificial
  CRISPR gRNA sequence
tgggggcaccgtgtagtgca

SEQ ID NO: 571832 - DNA, 20 bp, Artificial
  CRISPR gRNA sequence
gtgcaaggaccattcttacc

SEQ ID NO: 571833 - DNA, 20 bp, Artificial
  CRISPR gRNA sequence
tgcaaggaccattcttacct

SEQ ID NO: 571834 - DNA, 20 bp, Artificial
  CRISPR gRNA sequence
ctgggaatgtgctgtttcca

SEQ ID NO: 571835 - DNA, 20 bp, Artificial
  CRISPR gRNA sequence
ctgtttccatggctacccca

SEQ ID NO: 571836 - DNA, 20 bp, Artificial
  CRISPR gRNA sequence
tgtttccatggctaccccac

SEQ ID NO: 571837 - DNA, 20 bp, Artificial
  CRISPR gRNA sequence
ggctaccccacaggtgcctc

SEQ ID NO: 571838 - DNA, 20 bp, Artificial
  CRISPR gRNA sequence
accccacaggtgcctccgga

SEQ ID NO: 571839 - DNA, 20 bp, Artificial
  CRISPR gRNA sequence
aggtgcctccggacagcaaa

SEQ ID NO: 571840 - DNA, 20 bp, Artificial
  CRISPR gRNA sequence
ggtgcctccggacagcaaac

SEQ ID NO: 571841 - DNA, 20 bp, Artificial
  CRISPR gRNA sequence
ccggacagcaaacaggctgt

SEQ ID NO: 571842 - DNA, 20 bp, Artificial
  CRISPR gRNA sequence
cggacagcaaacaggctgtc

SEQ ID NO: 571843 - DNA, 20 bp, Artificial
  CRISPR gRNA sequence
ggacagcaaacaggctgtca

SEQ ID NO: 571844 - DNA, 20 bp, Artificial
  CRISPR gRNA sequence
gacagcaaacaggctgtcag

SEQ ID NO: 571845 - DNA, 20 bp, Artificial
  CRISPR gRNA sequence
acaggctgtcaggggcctcc

SEQ ID NO: 571846 - DNA, 20 bp, Artificial
  CRISPR gRNA sequence
caggctgtcaggggcctccc

SEQ ID NO: 571847 - DNA, 20 bp, Artificial
  CRISPR gRNA sequence
aggctgtcaggggcctcccg

SEQ ID NO: 571848 - DNA, 20 bp, Artificial
  CRISPR gRNA sequence
ggctgtcaggggcctcccgg

SEQ ID NO: 571849 - DNA, 20 bp, Artificial
  CRISPR gRNA sequence
gtcaggggcctcccgggggc

SEQ ID NO: 571850 - DNA, 20 bp, Artificial
  CRISPR gRNA sequence
gggcctcccgggggccagac

SEQ ID NO: 571851 - DNA, 20 bp, Artificial
  CRISPR gRNA sequence
ggcctcccgggggccagacc

SEQ ID NO: 571852 - DNA, 20 bp, Artificial
  CRISPR gRNA sequence
tcccgggggccagaccaggc

SEQ ID NO: 571853 - DNA, 20 bp, Artificial
  CRISPR gRNA sequence
cccgggggccagaccaggct

SEQ ID NO: 571854 - DNA, 20 bp, Artificial
  CRISPR gRNA sequence
gccagaccaggctgggacga

SEQ ID NO: 571855 - DNA, 20 bp, Artificial
  CRISPR gRNA sequence
ccagaccaggctgggacgac

SEQ ID NO: 571856 - DNA, 20 bp, Artificial
  CRISPR gRNA sequence
cagaccaggctgggacgaca

SEQ ID NO: 571857 - DNA, 20 bp, Artificial
  CRISPR gRNA sequence
aggctgggacgacagggcct

SEQ ID NO: 571858 - DNA, 20 bp, Artificial
  CRISPR gRNA sequence
gacgacagggccttggctgc

SEQ ID NO: 571859 - DNA, 20 bp, Artificial
  CRISPR gRNA sequence
gacagggccttggctgccag

SEQ ID NO: 571860 - DNA, 20 bp, Artificial
  CRISPR gRNA sequence
ggctgccagcagctacgatg

SEQ ID NO: 571861 - DNA, 20 bp, Artificial
  CRISPR gRNA sequence
tgccagcagctacgatgcag

SEQ ID NO: 571862 - DNA, 20 bp, Artificial
  CRISPR gRNA sequence
gccagcagctacgatgcagc

SEQ ID NO: 571863 - DNA, 20 bp, Artificial
  CRISPR gRNA sequence
cagcagctacgatgcagcag

SEQ ID NO: 571864 - DNA, 20 bp, Artificial
  CRISPR gRNA sequence
gatgcagcaggagcccttgt

SEQ ID NO: 571865 - DNA, 20 bp, Artificial
  CRISPR gRNA sequence
agcccttgtcggatgatgcc

SEQ ID NO: 571866 - DNA, 20 bp, Artificial
  CRISPR gRNA sequence
gcccttgtcggatgatgcct

SEQ ID NO: 571867 - DNA, 20 bp, Artificial
  CRISPR gRNA sequence
ttgtcggatgatgcctgggt

SEQ ID NO: 571868 - DNA, 20 bp, Artificial
  CRISPR gRNA sequence
tgtcggatgatgcctgggtg

SEQ ID NO: 571869 - DNA, 20 bp, Artificial
  CRISPR gRNA sequence
gtcggatgatgcctgggtga

SEQ ID NO: 571870 - DNA, 20 bp, Artificial
  CRISPR gRNA sequence
tcggatgatgcctgggtgag

SEQ ID NO: 571871 - DNA, 20 bp, Artificial
  CRISPR gRNA sequence
cggatgatgcctgggtgagg

SEQ ID NO: 571872 - DNA, 20 bp, Artificial
  CRISPR gRNA sequence
gatgatgcctgggtgagggg

SEQ ID NO: 571873 - DNA, 20 bp, Artificial
  CRISPR gRNA sequence
tgatgcctgggtgaggggga

SEQ ID NO: 571874 - DNA, 20 bp, Artificial
  CRISPR gRNA sequence
gatgcctgggtgagggggag

SEQ ID NO: 571875 - DNA, 20 bp, Artificial
  CRISPR gRNA sequence
cctgggtgagggggagaggc

SEQ ID NO: 571876 - DNA, 20 bp, Artificial
  CRISPR gRNA sequence
agggggagaggctggtgacc

SEQ ID NO: 571877 - DNA, 20 bp, Artificial
  CRISPR gRNA sequence
ggggagaggctggtgaccca

SEQ ID NO: 571878 - DNA, 20 bp, Artificial
  CRISPR gRNA sequence
gggagaggctggtgacccag

SEQ ID NO: 571879 - DNA, 20 bp, Artificial
  CRISPR gRNA sequence
tttttattttttttgatact

SEQ ID NO: 571880 - DNA, 20 bp, Artificial
  CRISPR gRNA sequence
ctgagtcttgctctgtcgcc

SEQ ID NO: 571881 - DNA, 20 bp, Artificial
  CRISPR gRNA sequence
tgagtcttgctctgtcgccc

SEQ ID NO: 571882 - DNA, 20 bp, Artificial
  CRISPR gRNA sequence
tcttgctctgtcgcccaggc

SEQ ID NO: 571883 - DNA, 20 bp, Artificial
  CRISPR gRNA sequence
ttgctctgtcgcccaggctg

SEQ ID NO: 571884 - DNA, 20 bp, Artificial
  CRISPR gRNA sequence
ctgtcgcccaggctggagtg

SEQ ID NO: 571885 - DNA, 20 bp, Artificial
  CRISPR gRNA sequence
tcgcccaggctggagtgcag

SEQ ID NO: 571886 - DNA, 20 bp, Artificial
  CRISPR gRNA sequence
ggagtgcagtggtgcaatct

SEQ ID NO: 571887 - DNA, 20 bp, Artificial
  CRISPR gRNA sequence
tcactgcaacccccacctcc

SEQ ID NO: 571888 - DNA, 20 bp, Artificial
  CRISPR gRNA sequence
aacccccacctcccagattc

SEQ ID NO: 571889 - DNA, 20 bp, Artificial
  CRISPR gRNA sequence
cccacctcccagattcaagc

SEQ ID NO: 571890 - DNA, 20 bp, Artificial
  CRISPR gRNA sequence
ttcaagcaagtcttctgcct

SEQ ID NO: 571891 - DNA, 20 bp, Artificial
  CRISPR gRNA sequence
gtcttctgcctcagcctccc

SEQ ID NO: 571892 - DNA, 20 bp, Artificial
  CRISPR gRNA sequence
ttctgcctcagcctcccgag

SEQ ID NO: 571893 - DNA, 20 bp, Artificial
  CRISPR gRNA sequence
gcctcagcctcccgagtagc

SEQ ID NO: 571894 - DNA, 20 bp, Artificial
  CRISPR gRNA sequence
cctcagcctcccgagtagct

SEQ ID NO: 571895 - DNA, 20 bp, Artificial
  CRISPR gRNA sequence
ctcccgagtagctgggacta

SEQ ID NO: 571896 - DNA, 20 bp, Artificial
  CRISPR gRNA sequence
tcccgagtagctgggactac

SEQ ID NO: 571897 - DNA, 20 bp, Artificial
  CRISPR gRNA sequence
caggtgcccgtcactacgcc

SEQ ID NO: 571898 - DNA, 20 bp, Artificial
  CRISPR gRNA sequence
ccagctaatttttgtatttt

SEQ ID NO: 571899 - DNA, 20 bp, Artificial
  CRISPR gRNA sequence
gctaatttttgtatttttgg

SEQ ID NO: 571900 - DNA, 20 bp, Artificial
  CRISPR gRNA sequence
taatttttgtatttttggta

SEQ ID NO: 571901 - DNA, 20 bp, Artificial
  CRISPR gRNA sequence
ttttgtatttttggtagaga

SEQ ID NO: 571902 - DNA, 20 bp, Artificial
  CRISPR gRNA sequence
tttgtatttttggtagagat

SEQ ID NO: 571903 - DNA, 20 bp, Artificial
  CRISPR gRNA sequence
ttgtatttttggtagagatg

SEQ ID NO: 571904 - DNA, 20 bp, Artificial
  CRISPR gRNA sequence
gagatggggtttcaccatgt

SEQ ID NO: 571905 - DNA, 20 bp, Artificial
  CRISPR gRNA sequence
tggggtttcaccatgttagc

SEQ ID NO: 571906 - DNA, 20 bp, Artificial
  CRISPR gRNA sequence
ggggtttcaccatgttagcc

SEQ ID NO: 571907 - DNA, 20 bp, Artificial
  CRISPR gRNA sequence
tttcaccatgttagccaggc

SEQ ID NO: 571908 - DNA, 20 bp, Artificial
  CRISPR gRNA sequence
ctcatgtgatccacccgctt

SEQ ID NO: 571909 - DNA, 20 bp, Artificial
  CRISPR gRNA sequence
ccacccgcttcagcctccca

SEQ ID NO: 571910 - DNA, 20 bp, Artificial
  CRISPR gRNA sequence
gcttcagcctcccaaagtgc

SEQ ID NO: 571911 - DNA, 20 bp, Artificial
  CRISPR gRNA sequence
cttcagcctcccaaagtgct

SEQ ID NO: 571912 - DNA, 20 bp, Artificial
  CRISPR gRNA sequence
ctcccaaagtgctgggatta

SEQ ID NO: 571913 - DNA, 20 bp, Artificial
  CRISPR gRNA sequence
tcccaaagtgctgggattac

SEQ ID NO: 571914 - DNA, 20 bp, Artificial
  CRISPR gRNA sequence
agtgctgggattacaggcat

SEQ ID NO: 571915 - DNA, 20 bp, Artificial
  CRISPR gRNA sequence
caggcatgagccactgcgcc

SEQ ID NO: 571916 - DNA, 20 bp, Artificial
  CRISPR gRNA sequence
gctccactttatttttaaat

SEQ ID NO: 571917 - DNA, 20 bp, Artificial
  CRISPR gRNA sequence
ttttaaatcagtgtttttca

SEQ ID NO: 571918 - DNA, 20 bp, Artificial
  CRISPR gRNA sequence
aaatcagtgtttttcaaagc

SEQ ID NO: 571919 - DNA, 20 bp, Artificial
  CRISPR gRNA sequence
aatcagtgtttttcaaagca

SEQ ID NO: 571920 - DNA, 20 bp, Artificial
  CRISPR gRNA sequence
ggacgccctcttctaaattc

SEQ ID NO: 571921 - DNA, 20 bp, Artificial
  CRISPR gRNA sequence
cctcttctaaattccagtct

SEQ ID NO: 571922 - DNA, 20 bp, Artificial
  CRISPR gRNA sequence
ctcttctaaattccagtctg

SEQ ID NO: 571923 - DNA, 20 bp, Artificial
  CRISPR gRNA sequence
ttctaaattccagtctgagg

SEQ ID NO: 571924 - DNA, 20 bp, Artificial
  CRISPR gRNA sequence
tgaggtggaatcccacaaaa

SEQ ID NO: 571925 - DNA, 20 bp, Artificial
  CRISPR gRNA sequence
ggaatcccacaaaacagcat

SEQ ID NO: 571926 - DNA, 20 bp, Artificial
  CRISPR gRNA sequence
acagcatgagccgtatttat

SEQ ID NO: 571927 - DNA, 20 bp, Artificial
  CRISPR gRNA sequence
agcatgagccgtatttatta

SEQ ID NO: 571928 - DNA, 20 bp, Artificial
  CRISPR gRNA sequence
gagccgtatttattagagca

SEQ ID NO: 571929 - DNA, 20 bp, Artificial
  CRISPR gRNA sequence
agccgtatttattagagcac

SEQ ID NO: 571930 - DNA, 20 bp, Artificial
  CRISPR gRNA sequence
tatttattagagcacaggtg

SEQ ID NO: 571931 - DNA, 20 bp, Artificial
  CRISPR gRNA sequence
acaggtgcggatgtcgtatg

SEQ ID NO: 571932 - DNA, 20 bp, Artificial
  CRISPR gRNA sequence
tcgtatgtggccactgatgc

SEQ ID NO: 571933 - DNA, 20 bp, Artificial
  CRISPR gRNA sequence
cgtatgtggccactgatgct

SEQ ID NO: 571934 - DNA, 20 bp, Artificial
  CRISPR gRNA sequence
ctgatgctgggaccatgaac

SEQ ID NO: 571935 - DNA, 20 bp, Artificial
  CRISPR gRNA sequence
tgatgctgggaccatgaact

SEQ ID NO: 571936 - DNA, 20 bp, Artificial
  CRISPR gRNA sequence
gatgctgggaccatgaactg

SEQ ID NO: 571937 - DNA, 20 bp, Artificial
  CRISPR gRNA sequence
gaccatgaactggggttgaa

SEQ ID NO: 571938 - DNA, 20 bp, Artificial
  CRISPR gRNA sequence
accatgaactggggttgaat

SEQ ID NO: 571939 - DNA, 20 bp, Artificial
  CRISPR gRNA sequence
ccatgaactggggttgaata

SEQ ID NO: 571940 - DNA, 20 bp, Artificial
  CRISPR gRNA sequence
ttaccacccaactgtgacct

SEQ ID NO: 571941 - DNA, 20 bp, Artificial
  CRISPR gRNA sequence
taccacccaactgtgacctt

SEQ ID NO: 571942 - DNA, 20 bp, Artificial
  CRISPR gRNA sequence
acccaactgtgaccttggga

SEQ ID NO: 571943 - DNA, 20 bp, Artificial
  CRISPR gRNA sequence
gaaagtcacctaaacccccc

SEQ ID NO: 571944 - DNA, 20 bp, Artificial
  CRISPR gRNA sequence
catctgtacattcgcatcat

SEQ ID NO: 571945 - DNA, 20 bp, Artificial
  CRISPR gRNA sequence
catgagaaataaattaccac

SEQ ID NO: 571946 - DNA, 20 bp, Artificial
  CRISPR gRNA sequence
gaaataaattaccaccagca

SEQ ID NO: 571947 - DNA, 20 bp, Artificial
  CRISPR gRNA sequence
attaccaccagcaaagcgct

SEQ ID NO: 571948 - DNA, 20 bp, Artificial
  CRISPR gRNA sequence
accagcaaagcgctcagaaa

SEQ ID NO: 571949 - DNA, 20 bp, Artificial
  CRISPR gRNA sequence
aagcgctcagaaacagtgcc

SEQ ID NO: 571950 - DNA, 20 bp, Artificial
  CRISPR gRNA sequence
cagaaacagtgcctggcctc

SEQ ID NO: 571951 - DNA, 20 bp, Artificial
  CRISPR gRNA sequence
agaaacagtgcctggcctcc

SEQ ID NO: 571952 - DNA, 20 bp, Artificial
  CRISPR gRNA sequence
gaaacagtgcctggcctcca

SEQ ID NO: 571953 - DNA, 20 bp, Artificial
  CRISPR gRNA sequence
cagtgcctggcctccagggc

SEQ ID NO: 571954 - DNA, 20 bp, Artificial
  CRISPR gRNA sequence
ggcctccagggctggcttca

SEQ ID NO: 571955 - DNA, 20 bp, Artificial
  CRISPR gRNA sequence
gcctccagggctggcttcat

SEQ ID NO: 571956 - DNA, 20 bp, Artificial
  CRISPR gRNA sequence
tcatgggcgtgtgacctatg

SEQ ID NO: 571957 - DNA, 20 bp, Artificial
  CRISPR gRNA sequence
gtgtgacctatgtggttatg

SEQ ID NO: 571958 - DNA, 20 bp, Artificial
  CRISPR gRNA sequence
gtgctttgtttaatgctctg

SEQ ID NO: 571959 - DNA, 20 bp, Artificial
  CRISPR gRNA sequence
cgccatcttgaaatctgaac

SEQ ID NO: 571960 - DNA, 20 bp, Artificial
  CRISPR gRNA sequence
gccatcttgaaatctgaaca

SEQ ID NO: 571961 - DNA, 20 bp, Artificial
  CRISPR gRNA sequence
ccatcttgaaatctgaacaa

SEQ ID NO: 571962 - DNA, 20 bp, Artificial
  CRISPR gRNA sequence
catcttgaaatctgaacaag

SEQ ID NO: 571963 - DNA, 20 bp, Artificial
  CRISPR gRNA sequence
aatctgaacaaggggccctg

SEQ ID NO: 571964 - DNA, 20 bp, Artificial
  CRISPR gRNA sequence
atctgaacaaggggccctgc

SEQ ID NO: 571965 - DNA, 20 bp, Artificial
  CRISPR gRNA sequence
aaggggccctgcaggttaca

SEQ ID NO: 571966 - DNA, 20 bp, Artificial
  CRISPR gRNA sequence
ggccctgcaggttacatagc

SEQ ID NO: 571967 - DNA, 20 bp, Artificial
  CRISPR gRNA sequence
ggttacatagctggtcctgc

SEQ ID NO: 571968 - DNA, 20 bp, Artificial
  CRISPR gRNA sequence
tagctggtcctgctggcaca

SEQ ID NO: 571969 - DNA, 20 bp, Artificial
  CRISPR gRNA sequence
gctggcacacagcctgcatc

SEQ ID NO: 571970 - DNA, 20 bp, Artificial
  CRISPR gRNA sequence
gcacacagcctgcatctggc

SEQ ID NO: 571971 - DNA, 20 bp, Artificial
  CRISPR gRNA sequence
cagcctgcatctggcaagtc

SEQ ID NO: 571972 - DNA, 20 bp, Artificial
  CRISPR gRNA sequence
ttgcatttgctttaacaact

SEQ ID NO: 571973 - DNA, 20 bp, Artificial
  CRISPR gRNA sequence
tgcatttgctttaacaactc

SEQ ID NO: 571974 - DNA, 20 bp, Artificial
  CRISPR gRNA sequence
gctttaacaactcaggatca

SEQ ID NO: 571975 - DNA, 20 bp, Artificial
  CRISPR gRNA sequence
caactcaggatcacagtgtt

SEQ ID NO: 571976 - DNA, 20 bp, Artificial
  CRISPR gRNA sequence
aactcaggatcacagtgttt

SEQ ID NO: 571977 - DNA, 20 bp, Artificial
  CRISPR gRNA sequence
actcaggatcacagtgtttg

SEQ ID NO: 571978 - DNA, 20 bp, Artificial
  CRISPR gRNA sequence
atcacagtgtttggggatct

SEQ ID NO: 571979 - DNA, 20 bp, Artificial
  CRISPR gRNA sequence
cacagtgtttggggatctta

SEQ ID NO: 571980 - DNA, 20 bp, Artificial
  CRISPR gRNA sequence
gtgtttggggatcttagagt

SEQ ID NO: 571981 - DNA, 20 bp, Artificial
  CRISPR gRNA sequence
gtttggggatcttagagtca

SEQ ID NO: 571982 - DNA, 20 bp, Artificial
  CRISPR gRNA sequence
tttggggatcttagagtcag

SEQ ID NO: 571983 - DNA, 20 bp, Artificial
  CRISPR gRNA sequence
ttggggatcttagagtcaga

SEQ ID NO: 571984 - DNA, 20 bp, Artificial
  CRISPR gRNA sequence
tttttttttttttttttctt

SEQ ID NO: 571985 - DNA, 20 bp, Artificial
  CRISPR gRNA sequence
tttttttttttttcttgaga

SEQ ID NO: 571986 - DNA, 20 bp, Artificial
  CRISPR gRNA sequence
tttttttttttcttgagacg

SEQ ID NO: 571987 - DNA, 20 bp, Artificial
  CRISPR gRNA sequence
cggagtcttgatctgtcgcc

SEQ ID NO: 571988 - DNA, 20 bp, Artificial
  CRISPR gRNA sequence
ggagtcttgatctgtcgcct

SEQ ID NO: 571989 - DNA, 20 bp, Artificial
  CRISPR gRNA sequence
tcttgatctgtcgcctaggc

SEQ ID NO: 571990 - DNA, 20 bp, Artificial
  CRISPR gRNA sequence
ttgatctgtcgcctaggctg

SEQ ID NO: 571991 - DNA, 20 bp, Artificial
  CRISPR gRNA sequence
ctgtcgcctaggctggagtg

SEQ ID NO: 571992 - DNA, 20 bp, Artificial
  CRISPR gRNA sequence
tcgcctaggctggagtgcag

SEQ ID NO: 571993 - DNA, 20 bp, Artificial
  CRISPR gRNA sequence
ggagtgcagtggtatgatct

SEQ ID NO: 571994 - DNA, 20 bp, Artificial
  CRISPR gRNA sequence
tcactgcaaactccgcctcc

SEQ ID NO: 571995 - DNA, 20 bp, Artificial
  CRISPR gRNA sequence
cactgcaaactccgcctccc

SEQ ID NO: 571996 - DNA, 20 bp, Artificial
  CRISPR gRNA sequence
aaactccgcctcccaggttc

SEQ ID NO: 571997 - DNA, 20 bp, Artificial
  CRISPR gRNA sequence
gttcaagcaattctctgcct

SEQ ID NO: 571998 - DNA, 20 bp, Artificial
  CRISPR gRNA sequence
attctctgcctcagcctccc

SEQ ID NO: 571999 - DNA, 20 bp, Artificial
  CRISPR gRNA sequence
ctctgcctcagcctcccaag

SEQ ID NO: 572000 - DNA, 20 bp, Artificial
  CRISPR gRNA sequence
gcctcagcctcccaagtagt

SEQ ID NO: 572001 - DNA, 20 bp, Artificial
  CRISPR gRNA sequence
cctcagcctcccaagtagtt

SEQ ID NO: 572002 - DNA, 20 bp, Artificial
  CRISPR gRNA sequence
ctcccaagtagttgggacta

SEQ ID NO: 572003 - DNA, 20 bp, Artificial
  CRISPR gRNA sequence
cagacacctgccaccacgcc

SEQ ID NO: 572004 - DNA, 20 bp, Artificial
  CRISPR gRNA sequence
tggctaattttttgtacttt

SEQ ID NO: 572005 - DNA, 20 bp, Artificial
  CRISPR gRNA sequence
ctaattttttgtacttttag

SEQ ID NO: 572006 - DNA, 20 bp, Artificial
  CRISPR gRNA sequence
ttttgtacttttagtagaca

SEQ ID NO: 572007 - DNA, 20 bp, Artificial
  CRISPR gRNA sequence
tttgtacttttagtagacac

SEQ ID NO: 572008 - DNA, 20 bp, Artificial
  CRISPR gRNA sequence
ttgtacttttagtagacaca

SEQ ID NO: 572009 - DNA, 20 bp, Artificial
  CRISPR gRNA sequence
gacacagggtttcaccatct

SEQ ID NO: 572010 - DNA, 20 bp, Artificial
  CRISPR gRNA sequence
cagggtttcaccatcttggc

SEQ ID NO: 572011 - DNA, 20 bp, Artificial
  CRISPR gRNA sequence
agggtttcaccatcttggcg

SEQ ID NO: 572012 - DNA, 20 bp, Artificial
  CRISPR gRNA sequence
tttcaccatcttggcgaggc

SEQ ID NO: 572013 - DNA, 20 bp, Artificial
  CRISPR gRNA sequence
acctcgtgatccacccgcct

SEQ ID NO: 572014 - DNA, 20 bp, Artificial
  CRISPR gRNA sequence
ccacccgcctcggcctccca

SEQ ID NO: 572015 - DNA, 20 bp, Artificial
  CRISPR gRNA sequence
gcctcggcctcccaaagtgc

SEQ ID NO: 572016 - DNA, 20 bp, Artificial
  CRISPR gRNA sequence
cctcggcctcccaaagtgct

SEQ ID NO: 572017 - DNA, 20 bp, Artificial
  CRISPR gRNA sequence
ctcccaaagtgctgggatta

SEQ ID NO: 572018 - DNA, 20 bp, Artificial
  CRISPR gRNA sequence
tcccaaagtgctgggattac

SEQ ID NO: 572019 - DNA, 20 bp, Artificial
  CRISPR gRNA sequence
agtgctgggattacaggcgt

SEQ ID NO: 572020 - DNA, 20 bp, Artificial
  CRISPR gRNA sequence
caggcgtgagccaccacgcc

SEQ ID NO: 572021 - DNA, 20 bp, Artificial
  CRISPR gRNA sequence
cgtgagccaccacgcccagc

SEQ ID NO: 572022 - DNA, 20 bp, Artificial
  CRISPR gRNA sequence
gtgagccaccacgcccagcc

SEQ ID NO: 572023 - DNA, 20 bp, Artificial
  CRISPR gRNA sequence
tgagccaccacgcccagccg

SEQ ID NO: 572024 - DNA, 20 bp, Artificial
  CRISPR gRNA sequence
ccaccacgcccagccggggt

SEQ ID NO: 572025 - DNA, 20 bp, Artificial
  CRISPR gRNA sequence
accacgcccagccggggtca

SEQ ID NO: 572026 - DNA, 20 bp, Artificial
  CRISPR gRNA sequence
ccacgcccagccggggtcag

SEQ ID NO: 572027 - DNA, 20 bp, Artificial
  CRISPR gRNA sequence
cacgcccagccggggtcaga

SEQ ID NO: 572028 - DNA, 20 bp, Artificial
  CRISPR gRNA sequence
gccggggtcagagggtttgt

SEQ ID NO: 572029 - DNA, 20 bp, Artificial
  CRISPR gRNA sequence
ggggtcagagggtttgtaag

SEQ ID NO: 572030 - DNA, 20 bp, Artificial
  CRISPR gRNA sequence
gtcagagggtttgtaagtag

SEQ ID NO: 572031 - DNA, 20 bp, Artificial
  CRISPR gRNA sequence
tcagagggtttgtaagtaga

SEQ ID NO: 572032 - DNA, 20 bp, Artificial
  CRISPR gRNA sequence
cagagggtttgtaagtagaa

SEQ ID NO: 572033 - DNA, 20 bp, Artificial
  CRISPR gRNA sequence
agagggtttgtaagtagaag

SEQ ID NO: 572034 - DNA, 20 bp, Artificial
  CRISPR gRNA sequence
ggtttgtaagtagaagggga

SEQ ID NO: 572035 - DNA, 20 bp, Artificial
  CRISPR gRNA sequence
agtagaaggggacagatttc

SEQ ID NO: 572036 - DNA, 20 bp, Artificial
  CRISPR gRNA sequence
gtagaaggggacagatttcc

SEQ ID NO: 572037 - DNA, 20 bp, Artificial
  CRISPR gRNA sequence
aggggacagatttccaggtc

SEQ ID NO: 572038 - DNA, 20 bp, Artificial
  CRISPR gRNA sequence
ggggacagatttccaggtct

SEQ ID NO: 572039 - DNA, 20 bp, Artificial
  CRISPR gRNA sequence
tttccaggtctgggcatgtt

SEQ ID NO: 572040 - DNA, 20 bp, Artificial
  CRISPR gRNA sequence
tccaggtctgggcatgtttg

SEQ ID NO: 572041 - DNA, 20 bp, Artificial
  CRISPR gRNA sequence
ggtctgggcatgtttggagc

SEQ ID NO: 572042 - DNA, 20 bp, Artificial
  CRISPR gRNA sequence
gtctgggcatgtttggagct

SEQ ID NO: 572043 - DNA, 20 bp, Artificial
  CRISPR gRNA sequence
tctgggcatgtttggagctg

SEQ ID NO: 572044 - DNA, 20 bp, Artificial
  CRISPR gRNA sequence
ggcatgtttggagctgggga

SEQ ID NO: 572045 - DNA, 20 bp, Artificial
  CRISPR gRNA sequence
gcatgtttggagctggggac

SEQ ID NO: 572046 - DNA, 20 bp, Artificial
  CRISPR gRNA sequence
catgtttggagctggggaca

SEQ ID NO: 572047 - DNA, 20 bp, Artificial
  CRISPR gRNA sequence
atgtttggagctggggacag

SEQ ID NO: 572048 - DNA, 20 bp, Artificial
  CRISPR gRNA sequence
gagctggggacaggggcccc

SEQ ID NO: 572049 - DNA, 20 bp, Artificial
  CRISPR gRNA sequence
ggacaggggcccctagctct

SEQ ID NO: 572050 - DNA, 20 bp, Artificial
  CRISPR gRNA sequence
gacaggggcccctagctctc

SEQ ID NO: 572051 - DNA, 20 bp, Artificial
  CRISPR gRNA sequence
agctctcaggacctgaatgt

SEQ ID NO: 572052 - DNA, 20 bp, Artificial
  CRISPR gRNA sequence
gctctcaggacctgaatgtg

SEQ ID NO: 572053 - DNA, 20 bp, Artificial
  CRISPR gRNA sequence
tcaggacctgaatgtgaggt

SEQ ID NO: 572054 - DNA, 20 bp, Artificial
  CRISPR gRNA sequence
caggacctgaatgtgaggtt

SEQ ID NO: 572055 - DNA, 20 bp, Artificial
  CRISPR gRNA sequence
gttaggttccctgcaccgtg

SEQ ID NO: 572056 - DNA, 20 bp, Artificial
  CRISPR gRNA sequence
cagacctcctccctgccccc

SEQ ID NO: 572057 - DNA, 20 bp, Artificial
  CRISPR gRNA sequence
acctcctccctgccccccag

SEQ ID NO: 572058 - DNA, 20 bp, Artificial
  CRISPR gRNA sequence
tccctgccccccagcagtct

SEQ ID NO: 572059 - DNA, 20 bp, Artificial
  CRISPR gRNA sequence
cagtctgagtctgccaccac

SEQ ID NO: 572060 - DNA, 20 bp, Artificial
  CRISPR gRNA sequence
gagtctgccaccaccagtcc

SEQ ID NO: 572061 - DNA, 20 bp, Artificial
  CRISPR gRNA sequence
agtctgccaccaccagtcct

SEQ ID NO: 572062 - DNA, 20 bp, Artificial
  CRISPR gRNA sequence
gtctgccaccaccagtcctg

SEQ ID NO: 572063 - DNA, 20 bp, Artificial
  CRISPR gRNA sequence
agtcctggggtcgctcacca

SEQ ID NO: 572064 - DNA, 20 bp, Artificial
  CRISPR gRNA sequence
ggggtcgctcaccacagatg

SEQ ID NO: 572065 - DNA, 20 bp, Artificial
  CRISPR gRNA sequence
gctcaccacagatgaagcct

SEQ ID NO: 572066 - DNA, 20 bp, Artificial
  CRISPR gRNA sequence
accacagatgaagccttggt

SEQ ID NO: 572067 - DNA, 20 bp, Artificial
  CRISPR gRNA sequence
cttggtcagtgccattttcc

SEQ ID NO: 572068 - DNA, 20 bp, Artificial
  CRISPR gRNA sequence
gtcagtgccattttcccagc

SEQ ID NO: 572069 - DNA, 20 bp, Artificial
  CRISPR gRNA sequence
tcagtgccattttcccagcc

SEQ ID NO: 572070 - DNA, 20 bp, Artificial
  CRISPR gRNA sequence
gtgccattttcccagccagg

SEQ ID NO: 572071 - DNA, 20 bp, Artificial
  CRISPR gRNA sequence
tgccattttcccagccaggt

SEQ ID NO: 572072 - DNA, 20 bp, Artificial
  CRISPR gRNA sequence
cccagccaggtgggcctgca

SEQ ID NO: 572073 - DNA, 20 bp, Artificial
  CRISPR gRNA sequence
aggtgggcctgcatggcact

SEQ ID NO: 572074 - DNA, 20 bp, Artificial
  CRISPR gRNA sequence
gcactcagcttctccttctc

SEQ ID NO: 572075 - DNA, 20 bp, Artificial
  CRISPR gRNA sequence
agcttctccttctccagcac

SEQ ID NO: 572076 - DNA, 20 bp, Artificial
  CRISPR gRNA sequence
ctccagcaccagctgtgaaa

SEQ ID NO: 572077 - DNA, 20 bp, Artificial
  CRISPR gRNA sequence
ctgtgaaatggcacaaacat

SEQ ID NO: 572078 - DNA, 20 bp, Artificial
  CRISPR gRNA sequence
tgtgaaatggcacaaacatg

SEQ ID NO: 572079 - DNA, 20 bp, Artificial
  CRISPR gRNA sequence
atggcacaaacatgaggcct

SEQ ID NO: 572080 - DNA, 20 bp, Artificial
  CRISPR gRNA sequence
acaaacatgaggcctcagcc

SEQ ID NO: 572081 - DNA, 20 bp, Artificial
  CRISPR gRNA sequence
ttctctgccacatctttgcc

SEQ ID NO: 572082 - DNA, 20 bp, Artificial
  CRISPR gRNA sequence
tctctgccacatctttgccc

SEQ ID NO: 572083 - DNA, 20 bp, Artificial
  CRISPR gRNA sequence
ccacatctttgcccaggcta

SEQ ID NO: 572084 - DNA, 20 bp, Artificial
  CRISPR gRNA sequence
gcccaggctacggtcttccc

SEQ ID NO: 572085 - DNA, 20 bp, Artificial
  CRISPR gRNA sequence
cccaggctacggtcttccct

SEQ ID NO: 572086 - DNA, 20 bp, Artificial
  CRISPR gRNA sequence
caggctacggtcttccctgg

SEQ ID NO: 572087 - DNA, 20 bp, Artificial
  CRISPR gRNA sequence
tcctcttccttcctttatac

SEQ ID NO: 572088 - DNA, 20 bp, Artificial
  CRISPR gRNA sequence
ctttataccagccctcgtcc

SEQ ID NO: 572089 - DNA, 20 bp, Artificial
  CRISPR gRNA sequence
tttataccagccctcgtccc

SEQ ID NO: 572090 - DNA, 20 bp, Artificial
  CRISPR gRNA sequence
gccctcgtcccaggtgaact

SEQ ID NO: 572091 - DNA, 20 bp, Artificial
  CRISPR gRNA sequence
tcccaggtgaacttggtttc

SEQ ID NO: 572092 - DNA, 20 bp, Artificial
  CRISPR gRNA sequence
tgaacttggtttctggcaca

SEQ ID NO: 572093 - DNA, 20 bp, Artificial
  CRISPR gRNA sequence
acttggtttctggcacatgg

SEQ ID NO: 572094 - DNA, 20 bp, Artificial
  CRISPR gRNA sequence
ggtttctggcacatggtgga

SEQ ID NO: 572095 - DNA, 20 bp, Artificial
  CRISPR gRNA sequence
ttctggcacatggtggacag

SEQ ID NO: 572096 - DNA, 20 bp, Artificial
  CRISPR gRNA sequence
tctggcacatggtggacaga

SEQ ID NO: 572097 - DNA, 20 bp, Artificial
  CRISPR gRNA sequence
tcccttaccctccaccgccc

SEQ ID NO: 572098 - DNA, 20 bp, Artificial
  CRISPR gRNA sequence
cctggcattacctgctgctc

SEQ ID NO: 572099 - DNA, 20 bp, Artificial
  CRISPR gRNA sequence
tggcattacctgctgctcca

SEQ ID NO: 572100 - DNA, 20 bp, Artificial
  CRISPR gRNA sequence
gagactgtaccatctctctc

SEQ ID NO: 572101 - DNA, 20 bp, Artificial
  CRISPR gRNA sequence
gactgtaccatctctctctg

SEQ ID NO: 572102 - DNA, 20 bp, Artificial
  CRISPR gRNA sequence
actgtaccatctctctctgg

SEQ ID NO: 572103 - DNA, 20 bp, Artificial
  CRISPR gRNA sequence
tgtaccatctctctctggag

SEQ ID NO: 572104 - DNA, 20 bp, Artificial
  CRISPR gRNA sequence
tgtgccctgcccttctcatc

SEQ ID NO: 572105 - DNA, 20 bp, Artificial
  CRISPR gRNA sequence
gccctgcccttctcatccag

SEQ ID NO: 572106 - DNA, 20 bp, Artificial
  CRISPR gRNA sequence
tgcccttctcatccagaaga

SEQ ID NO: 572107 - DNA, 20 bp, Artificial
  CRISPR gRNA sequence
catccagaagatggtccgcc

SEQ ID NO: 572108 - DNA, 20 bp, Artificial
  CRISPR gRNA sequence
ccagaagatggtccgcctgg

SEQ ID NO: 572109 - DNA, 20 bp, Artificial
  CRISPR gRNA sequence
tggtccgcctggcagtgcct

SEQ ID NO: 572110 - DNA, 20 bp, Artificial
  CRISPR gRNA sequence
tccgcctggcagtgcctaag

SEQ ID NO: 572111 - DNA, 20 bp, Artificial
  CRISPR gRNA sequence
ccgcctggcagtgcctaagt

SEQ ID NO: 572112 - DNA, 20 bp, Artificial
  CRISPR gRNA sequence
cgcctggcagtgcctaagta

SEQ ID NO: 572113 - DNA, 20 bp, Artificial
  CRISPR gRNA sequence
cctggcagtgcctaagtagg

SEQ ID NO: 572114 - DNA, 20 bp, Artificial
  CRISPR gRNA sequence
ggcagtgcctaagtagggag

SEQ ID NO: 572115 - DNA, 20 bp, Artificial
  CRISPR gRNA sequence
agtagggagaagattccatg

SEQ ID NO: 572116 - DNA, 20 bp, Artificial
  CRISPR gRNA sequence
gtagggagaagattccatgc

SEQ ID NO: 572117 - DNA, 20 bp, Artificial
  CRISPR gRNA sequence
ttccatgcaggtgaccacga

SEQ ID NO: 572118 - DNA, 20 bp, Artificial
  CRISPR gRNA sequence
tccatgcaggtgaccacgac

SEQ ID NO: 572119 - DNA, 20 bp, Artificial
  CRISPR gRNA sequence
gcaggtgaccacgacaggcc

SEQ ID NO: 572120 - DNA, 20 bp, Artificial
  CRISPR gRNA sequence
tgaccacgacaggcctggtc

SEQ ID NO: 572121 - DNA, 20 bp, Artificial
  CRISPR gRNA sequence
gtctggctcaatgctctgaa

SEQ ID NO: 572122 - DNA, 20 bp, Artificial
  CRISPR gRNA sequence
tctggctcaatgctctgaat

SEQ ID NO: 572123 - DNA, 20 bp, Artificial
  CRISPR gRNA sequence
ctggctcaatgctctgaatg

SEQ ID NO: 572124 - DNA, 20 bp, Artificial
  CRISPR gRNA sequence
ggctcaatgctctgaatggg

SEQ ID NO: 572125 - DNA, 20 bp, Artificial
  CRISPR gRNA sequence
gctcaatgctctgaatgggg

SEQ ID NO: 572126 - DNA, 20 bp, Artificial
  CRISPR gRNA sequence
ctcaatgctctgaatgggga

SEQ ID NO: 572127 - DNA, 20 bp, Artificial
  CRISPR gRNA sequence
tgctctgaatggggagggcc

SEQ ID NO: 572128 - DNA, 20 bp, Artificial
  CRISPR gRNA sequence
tggggagggcccagaccctc

SEQ ID NO: 572129 - DNA, 20 bp, Artificial
  CRISPR gRNA sequence
ggggagggcccagaccctct

SEQ ID NO: 572130 - DNA, 20 bp, Artificial
  CRISPR gRNA sequence
ggagggcccagaccctctgg

SEQ ID NO: 572131 - DNA, 20 bp, Artificial
  CRISPR gRNA sequence
ctctgggagttctctcctct

SEQ ID NO: 572132 - DNA, 20 bp, Artificial
  CRISPR gRNA sequence
gagttctctcctctgagccc

SEQ ID NO: 572133 - DNA, 20 bp, Artificial
  CRISPR gRNA sequence
ctcccctcccctctctacct

SEQ ID NO: 572134 - DNA, 20 bp, Artificial
  CRISPR gRNA sequence
ttcccttaacacatgcccct

SEQ ID NO: 572135 - DNA, 20 bp, Artificial
  CRISPR gRNA sequence
cctcagcacctactgcatgt

SEQ ID NO: 572136 - DNA, 20 bp, Artificial
  CRISPR gRNA sequence
ctcagcacctactgcatgtc

SEQ ID NO: 572137 - DNA, 20 bp, Artificial
  CRISPR gRNA sequence
caggcctgaactcaccactt

SEQ ID NO: 572138 - DNA, 20 bp, Artificial
  CRISPR gRNA sequence
ctgaactcaccacttgagcc

SEQ ID NO: 572139 - DNA, 20 bp, Artificial
  CRISPR gRNA sequence
actcaccacttgagcctggc

SEQ ID NO: 572140 - DNA, 20 bp, Artificial
  CRISPR gRNA sequence
tcaccacttgagcctggcca

SEQ ID NO: 572141 - DNA, 20 bp, Artificial
  CRISPR gRNA sequence
cttgagcctggccagagtgc

SEQ ID NO: 572142 - DNA, 20 bp, Artificial
  CRISPR gRNA sequence
tgagcctggccagagtgctg

SEQ ID NO: 572143 - DNA, 20 bp, Artificial
  CRISPR gRNA sequence
cagagtgctggagataatgt

SEQ ID NO: 572144 - DNA, 20 bp, Artificial
  CRISPR gRNA sequence
agtgctggagataatgttgg

SEQ ID NO: 572145 - DNA, 20 bp, Artificial
  CRISPR gRNA sequence
tggagataatgttggaagtg

SEQ ID NO: 572146 - DNA, 20 bp, Artificial
  CRISPR gRNA sequence
gataatgttggaagtgtggt

SEQ ID NO: 572147 - DNA, 20 bp, Artificial
  CRISPR gRNA sequence
tgttggaagtgtggtgagtt

SEQ ID NO: 572148 - DNA, 20 bp, Artificial
  CRISPR gRNA sequence
gaagtgtggtgagttgagaa

SEQ ID NO: 572149 - DNA, 20 bp, Artificial
  CRISPR gRNA sequence
aagtgtggtgagttgagaat

SEQ ID NO: 572150 - DNA, 20 bp, Artificial
  CRISPR gRNA sequence
gtggtgagttgagaatgggc

SEQ ID NO: 572151 - DNA, 20 bp, Artificial
  CRISPR gRNA sequence
tggtgagttgagaatgggcc

SEQ ID NO: 572152 - DNA, 20 bp, Artificial
  CRISPR gRNA sequence
ggtgagttgagaatgggcca

SEQ ID NO: 572153 - DNA, 20 bp, Artificial
  CRISPR gRNA sequence
tgagttgagaatgggccagg

SEQ ID NO: 572154 - DNA, 20 bp, Artificial
  CRISPR gRNA sequence
gagttgagaatgggccaggg

SEQ ID NO: 572155 - DNA, 20 bp, Artificial
  CRISPR gRNA sequence
tgagaatgggccagggaggt

SEQ ID NO: 572156 - DNA, 20 bp, Artificial
  CRISPR gRNA sequence
agaatgggccagggaggtga

SEQ ID NO: 572157 - DNA, 20 bp, Artificial
  CRISPR gRNA sequence
atgggccagggaggtgagag

SEQ ID NO: 572158 - DNA, 20 bp, Artificial
  CRISPR gRNA sequence
tgggccagggaggtgagagt

SEQ ID NO: 572159 - DNA, 20 bp, Artificial
  CRISPR gRNA sequence
cagggaggtgagagtgggca

SEQ ID NO: 572160 - DNA, 20 bp, Artificial
  CRISPR gRNA sequence
tgagagtgggcaaagcattc

SEQ ID NO: 572161 - DNA, 20 bp, Artificial
  CRISPR gRNA sequence
gagagtgggcaaagcattct

SEQ ID NO: 572162 - DNA, 20 bp, Artificial
  CRISPR gRNA sequence
agtgggcaaagcattctggg

SEQ ID NO: 572163 - DNA, 20 bp, Artificial
  CRISPR gRNA sequence
tgggcaaagcattctgggtg

SEQ ID NO: 572164 - DNA, 20 bp, Artificial
  CRISPR gRNA sequence
gggcaaagcattctgggtgg

SEQ ID NO: 572165 - DNA, 20 bp, Artificial
  CRISPR gRNA sequence
ggcaaagcattctgggtgga

SEQ ID NO: 572166 - DNA, 20 bp, Artificial
  CRISPR gRNA sequence
aagcattctgggtggaggga

SEQ ID NO: 572167 - DNA, 20 bp, Artificial
  CRISPR gRNA sequence
gtggagggacggcctgtgca

SEQ ID NO: 572168 - DNA, 20 bp, Artificial
  CRISPR gRNA sequence
tggagggacggcctgtgcaa

SEQ ID NO: 572169 - DNA, 20 bp, Artificial
  CRISPR gRNA sequence
ggacggcctgtgcaaaggcc

SEQ ID NO: 572170 - DNA, 20 bp, Artificial
  CRISPR gRNA sequence
ctgtgcaaaggcctggctgc

SEQ ID NO: 572171 - DNA, 20 bp, Artificial
  CRISPR gRNA sequence
tgtgcaaaggcctggctgca

SEQ ID NO: 572172 - DNA, 20 bp, Artificial
  CRISPR gRNA sequence
tgcaaaggcctggctgcaag

SEQ ID NO: 572173 - DNA, 20 bp, Artificial
  CRISPR gRNA sequence
gcaaaggcctggctgcaagg

SEQ ID NO: 572174 - DNA, 20 bp, Artificial
  CRISPR gRNA sequence
aggcctggctgcaaggagga

SEQ ID NO: 572175 - DNA, 20 bp, Artificial
  CRISPR gRNA sequence
ggcctggctgcaaggaggac

SEQ ID NO: 572176 - DNA, 20 bp, Artificial
  CRISPR gRNA sequence
tgcaaggaggacaggacatg

SEQ ID NO: 572177 - DNA, 20 bp, Artificial
  CRISPR gRNA sequence
gcaaggaggacaggacatgt

SEQ ID NO: 572178 - DNA, 20 bp, Artificial
  CRISPR gRNA sequence
caaggaggacaggacatgtg

SEQ ID NO: 572179 - DNA, 20 bp, Artificial
  CRISPR gRNA sequence
ggacatgtggggttgctgct

SEQ ID NO: 572180 - DNA, 20 bp, Artificial
  CRISPR gRNA sequence
gacatgtggggttgctgcta

SEQ ID NO: 572181 - DNA, 20 bp, Artificial
  CRISPR gRNA sequence
acatgtggggttgctgctaa

SEQ ID NO: 572182 - DNA, 20 bp, Artificial
  CRISPR gRNA sequence
ttgctgctaagggttgtgtg

SEQ ID NO: 572183 - DNA, 20 bp, Artificial
  CRISPR gRNA sequence
gctaagggttgtgtgtagtg

SEQ ID NO: 572184 - DNA, 20 bp, Artificial
  CRISPR gRNA sequence
atttgtgtgtgtgtgtgtgt

SEQ ID NO: 572185 - DNA, 20 bp, Artificial
  CRISPR gRNA sequence
ttgtgtgtgtgtgtgtgtga

SEQ ID NO: 572186 - DNA, 20 bp, Artificial
  CRISPR gRNA sequence
gtgtgtgtgtgtgtgtgaga

SEQ ID NO: 572187 - DNA, 20 bp, Artificial
  CRISPR gRNA sequence
gtgtgtgtgtgtgtgagaga

SEQ ID NO: 572188 - DNA, 20 bp, Artificial
  CRISPR gRNA sequence
gtgtgtgtgtgtgagagaga

SEQ ID NO: 572189 - DNA, 20 bp, Artificial
  CRISPR gRNA sequence
gtgtgtgtgagagagagaga

SEQ ID NO: 572190 - DNA, 20 bp, Artificial
  CRISPR gRNA sequence
gtgtgtgagagagagagaaa

SEQ ID NO: 572191 - DNA, 20 bp, Artificial
  CRISPR gRNA sequence
gtgtgagagagagagaaaga

SEQ ID NO: 572192 - DNA, 20 bp, Artificial
  CRISPR gRNA sequence
gtgagagagagagaaagaga

SEQ ID NO: 572193 - DNA, 20 bp, Artificial
  CRISPR gRNA sequence
gagagagagagaaagagaga

SEQ ID NO: 572194 - DNA, 20 bp, Artificial
  CRISPR gRNA sequence
gagagagagaaagagagaga

SEQ ID NO: 572195 - DNA, 20 bp, Artificial
  CRISPR gRNA sequence
gagagagaaagagagagaga

SEQ ID NO: 572196 - DNA, 20 bp, Artificial
  CRISPR gRNA sequence
gagagaaagagagagagaga

SEQ ID NO: 572197 - DNA, 20 bp, Artificial
  CRISPR gRNA sequence
gagaaagagagagagagaga

SEQ ID NO: 572198 - DNA, 20 bp, Artificial
  CRISPR gRNA sequence
gaaagagagagagagagaga

SEQ ID NO: 572199 - DNA, 20 bp, Artificial
  CRISPR gRNA sequence
aagagagagagagagagaga

SEQ ID NO: 572200 - DNA, 20 bp, Artificial
  CRISPR gRNA sequence
gagagagagagagagagaga

SEQ ID NO: 572201 - DNA, 20 bp, Artificial
  CRISPR gRNA sequence
gagagagagagagagagaga

SEQ ID NO: 572202 - DNA, 20 bp, Artificial
  CRISPR gRNA sequence
gagagagagagagagagaga

SEQ ID NO: 572203 - DNA, 20 bp, Artificial
  CRISPR gRNA sequence
gagagagagagagagagaga

SEQ ID NO: 572204 - DNA, 20 bp, Artificial
  CRISPR gRNA sequence
gagagagagagagagagaga

SEQ ID NO: 572205 - DNA, 20 bp, Artificial
  CRISPR gRNA sequence
gagagagagagagagagaga

SEQ ID NO: 572206 - DNA, 20 bp, Artificial
  CRISPR gRNA sequence
gagagagagagagagagaga

SEQ ID NO: 572207 - DNA, 20 bp, Artificial
  CRISPR gRNA sequence
gagagagagagagagagaga

SEQ ID NO: 572208 - DNA, 20 bp, Artificial
  CRISPR gRNA sequence
gagagagagagagagagaga

SEQ ID NO: 572209 - DNA, 20 bp, Artificial
  CRISPR gRNA sequence
gagagagagagagagagaga

SEQ ID NO: 572210 - DNA, 20 bp, Artificial
  CRISPR gRNA sequence
gagagagagagagagagaga

SEQ ID NO: 572211 - DNA, 20 bp, Artificial
  CRISPR gRNA sequence
gagagagagagagagagaga

SEQ ID NO: 572212 - DNA, 20 bp, Artificial
  CRISPR gRNA sequence
gagagagagagagagagaga

SEQ ID NO: 572213 - DNA, 20 bp, Artificial
  CRISPR gRNA sequence
gagagagagagagagagaga

SEQ ID NO: 572214 - DNA, 20 bp, Artificial
  CRISPR gRNA sequence
gagagagagagagagagaga

SEQ ID NO: 572215 - DNA, 20 bp, Artificial
  CRISPR gRNA sequence
gagagagagagagagagaga

SEQ ID NO: 572216 - DNA, 20 bp, Artificial
  CRISPR gRNA sequence
gagagagagagagagacata

SEQ ID NO: 572217 - DNA, 20 bp, Artificial
  CRISPR gRNA sequence
agagagagagagagacatat

SEQ ID NO: 572218 - DNA, 20 bp, Artificial
  CRISPR gRNA sequence
gagagagagagagacatatg

SEQ ID NO: 572219 - DNA, 20 bp, Artificial
  CRISPR gRNA sequence
agagagagagagacatatgg

SEQ ID NO: 572220 - DNA, 20 bp, Artificial
  CRISPR gRNA sequence
gagagagagagacatatggg

SEQ ID NO: 572221 - DNA, 20 bp, Artificial
  CRISPR gRNA sequence
gagagacatatggggggact

SEQ ID NO: 572222 - DNA, 20 bp, Artificial
  CRISPR gRNA sequence
agagacatatggggggactg

SEQ ID NO: 572223 - DNA, 20 bp, Artificial
  CRISPR gRNA sequence
gagacatatggggggactga

SEQ ID NO: 572224 - DNA, 20 bp, Artificial
  CRISPR gRNA sequence
agacatatggggggactgag

SEQ ID NO: 572225 - DNA, 20 bp, Artificial
  CRISPR gRNA sequence
acatatggggggactgaggg

SEQ ID NO: 572226 - DNA, 20 bp, Artificial
  CRISPR gRNA sequence
catatggggggactgagggg

SEQ ID NO: 572227 - DNA, 20 bp, Artificial
  CRISPR gRNA sequence
atggggggactgaggggagg

SEQ ID NO: 572228 - DNA, 20 bp, Artificial
  CRISPR gRNA sequence
gggggactgaggggaggcag

SEQ ID NO: 572229 - DNA, 20 bp, Artificial
  CRISPR gRNA sequence
ggactgaggggaggcagcag

SEQ ID NO: 572230 - DNA, 20 bp, Artificial
  CRISPR gRNA sequence
gggaggcagcagcagccatc

SEQ ID NO: 572231 - DNA, 20 bp, Artificial
  CRISPR gRNA sequence
gaggcagcagcagccatcta

SEQ ID NO: 572232 - DNA, 20 bp, Artificial
  CRISPR gRNA sequence
aggcagcagcagccatctag

SEQ ID NO: 572233 - DNA, 20 bp, Artificial
  CRISPR gRNA sequence
gcagcagcagccatctagag

SEQ ID NO: 572234 - DNA, 20 bp, Artificial
  CRISPR gRNA sequence
cagcagccatctagaggagc

SEQ ID NO: 572235 - DNA, 20 bp, Artificial
  CRISPR gRNA sequence
atctagaggagctagaactt

SEQ ID NO: 572236 - DNA, 20 bp, Artificial
  CRISPR gRNA sequence
tctagaggagctagaacttt

SEQ ID NO: 572237 - DNA, 20 bp, Artificial
  CRISPR gRNA sequence
aggagctagaactttgggaa

SEQ ID NO: 572238 - DNA, 20 bp, Artificial
  CRISPR gRNA sequence
agctagaactttgggaacag

SEQ ID NO: 572239 - DNA, 20 bp, Artificial
  CRISPR gRNA sequence
aactttgggaacagtggaat

SEQ ID NO: 572240 - DNA, 20 bp, Artificial
  CRISPR gRNA sequence
actttgggaacagtggaata

SEQ ID NO: 572241 - DNA, 20 bp, Artificial
  CRISPR gRNA sequence
tgggaacagtggaataaggc

SEQ ID NO: 572242 - DNA, 20 bp, Artificial
  CRISPR gRNA sequence
gtggaataaggctggcatgt

SEQ ID NO: 572243 - DNA, 20 bp, Artificial
  CRISPR gRNA sequence
taaggctggcatgttggcat

SEQ ID NO: 572244 - DNA, 20 bp, Artificial
  CRISPR gRNA sequence
aaggctggcatgttggcatg

SEQ ID NO: 572245 - DNA, 20 bp, Artificial
  CRISPR gRNA sequence
ggctggcatgttggcatgag

SEQ ID NO: 572246 - DNA, 20 bp, Artificial
  CRISPR gRNA sequence
tggcatgttggcatgaggag

SEQ ID NO: 572247 - DNA, 20 bp, Artificial
  CRISPR gRNA sequence
catgttggcatgaggagtag

SEQ ID NO: 572248 - DNA, 20 bp, Artificial
  CRISPR gRNA sequence
atgttggcatgaggagtagc

SEQ ID NO: 572249 - DNA, 20 bp, Artificial
  CRISPR gRNA sequence
tgttggcatgaggagtagca

SEQ ID NO: 572250 - DNA, 20 bp, Artificial
  CRISPR gRNA sequence
gcatgaggagtagcagggca

SEQ ID NO: 572251 - DNA, 20 bp, Artificial
  CRISPR gRNA sequence
tgaggagtagcagggcaaag

SEQ ID NO: 572252 - DNA, 20 bp, Artificial
  CRISPR gRNA sequence
gaggagtagcagggcaaagc

SEQ ID NO: 572253 - DNA, 20 bp, Artificial
  CRISPR gRNA sequence
ggagtagcagggcaaagcag

SEQ ID NO: 572254 - DNA, 20 bp, Artificial
  CRISPR gRNA sequence
agcagggcaaagcaggagtg

SEQ ID NO: 572255 - DNA, 20 bp, Artificial
  CRISPR gRNA sequence
caaagcaggagtgcagattc

SEQ ID NO: 572256 - DNA, 20 bp, Artificial
  CRISPR gRNA sequence
aagcaggagtgcagattcta

SEQ ID NO: 572257 - DNA, 20 bp, Artificial
  CRISPR gRNA sequence
ggagtgcagattctagagcc

SEQ ID NO: 572258 - DNA, 20 bp, Artificial
  CRISPR gRNA sequence
gattctagagcctggctaca

SEQ ID NO: 572259 - DNA, 20 bp, Artificial
  CRISPR gRNA sequence
attctagagcctggctacat

SEQ ID NO: 572260 - DNA, 20 bp, Artificial
  CRISPR gRNA sequence
ggctacatgggttcaaatcc

SEQ ID NO: 572261 - DNA, 20 bp, Artificial
  CRISPR gRNA sequence
caaatcccagctctgtcact

SEQ ID NO: 572262 - DNA, 20 bp, Artificial
  CRISPR gRNA sequence
aaatcccagctctgtcactc

SEQ ID NO: 572263 - DNA, 20 bp, Artificial
  CRISPR gRNA sequence
cagctctgtcactcaggaac

SEQ ID NO: 572264 - DNA, 20 bp, Artificial
  CRISPR gRNA sequence
agctctgtcactcaggaact

SEQ ID NO: 572265 - DNA, 20 bp, Artificial
  CRISPR gRNA sequence
ctctgtcactcaggaactgg

SEQ ID NO: 572266 - DNA, 20 bp, Artificial
  CRISPR gRNA sequence
ggaactgggagattttgatc

SEQ ID NO: 572267 - DNA, 20 bp, Artificial
  CRISPR gRNA sequence
atcaagacacttaacctctt

SEQ ID NO: 572268 - DNA, 20 bp, Artificial
  CRISPR gRNA sequence
acacttaacctctttggcct

SEQ ID NO: 572269 - DNA, 20 bp, Artificial
  CRISPR gRNA sequence
cagtctccttgtctgtaaaa

SEQ ID NO: 572270 - DNA, 20 bp, Artificial
  CRISPR gRNA sequence
agtctccttgtctgtaaaat

SEQ ID NO: 572271 - DNA, 20 bp, Artificial
  CRISPR gRNA sequence
gtctccttgtctgtaaaatg

SEQ ID NO: 572272 - DNA, 20 bp, Artificial
  CRISPR gRNA sequence
tctccttgtctgtaaaatgg

SEQ ID NO: 572273 - DNA, 20 bp, Artificial
  CRISPR gRNA sequence
tgtaaaatgggggtaaataa

SEQ ID NO: 572274 - DNA, 20 bp, Artificial
  CRISPR gRNA sequence
acgtttcttattatacatac

SEQ ID NO: 572275 - DNA, 20 bp, Artificial
  CRISPR gRNA sequence
attatacatacgagaaaact

SEQ ID NO: 572276 - DNA, 20 bp, Artificial
  CRISPR gRNA sequence
ttatacatacgagaaaactg

SEQ ID NO: 572277 - DNA, 20 bp, Artificial
  CRISPR gRNA sequence
catacgagaaaactgaggtc

SEQ ID NO: 572278 - DNA, 20 bp, Artificial
  CRISPR gRNA sequence
tacgagaaaactgaggtcga

SEQ ID NO: 572279 - DNA, 20 bp, Artificial
  CRISPR gRNA sequence
gagaaaactgaggtcgagag

SEQ ID NO: 572280 - DNA, 20 bp, Artificial
  CRISPR gRNA sequence
aactgaggtcgagagaagct

SEQ ID NO: 572281 - DNA, 20 bp, Artificial
  CRISPR gRNA sequence
agaagctaagtaatttgtcc

SEQ ID NO: 572282 - DNA, 20 bp, Artificial
  CRISPR gRNA sequence
gaagctaagtaatttgtcca

SEQ ID NO: 572283 - DNA, 20 bp, Artificial
  CRISPR gRNA sequence
gtaatttgtccaaggtcaca

SEQ ID NO: 572284 - DNA, 20 bp, Artificial
  CRISPR gRNA sequence
tttgtccaaggtcacacagc

SEQ ID NO: 572285 - DNA, 20 bp, Artificial
  CRISPR gRNA sequence
tccaaggtcacacagccagt

SEQ ID NO: 572286 - DNA, 20 bp, Artificial
  CRISPR gRNA sequence
ccaaggtcacacagccagtc

SEQ ID NO: 572287 - DNA, 20 bp, Artificial
  CRISPR gRNA sequence
caaggtcacacagccagtca

SEQ ID NO: 572288 - DNA, 20 bp, Artificial
  CRISPR gRNA sequence
gtcacacagccagtcaggga

SEQ ID NO: 572289 - DNA, 20 bp, Artificial
  CRISPR gRNA sequence
cacacagccagtcagggatg

SEQ ID NO: 572290 - DNA, 20 bp, Artificial
  CRISPR gRNA sequence
cagccagtcagggatggagc

SEQ ID NO: 572291 - DNA, 20 bp, Artificial
  CRISPR gRNA sequence
agccagtcagggatggagct

SEQ ID NO: 572292 - DNA, 20 bp, Artificial
  CRISPR gRNA sequence
ggagctgggatttgaaccca

SEQ ID NO: 572293 - DNA, 20 bp, Artificial
  CRISPR gRNA sequence
gggatttgaacccacagtct

SEQ ID NO: 572294 - DNA, 20 bp, Artificial
  CRISPR gRNA sequence
gatttgaacccacagtctca

SEQ ID NO: 572295 - DNA, 20 bp, Artificial
  CRISPR gRNA sequence
gaacccacagtctcagagtt

SEQ ID NO: 572296 - DNA, 20 bp, Artificial
  CRISPR gRNA sequence
tcttgcatcttactacttat

SEQ ID NO: 572297 - DNA, 20 bp, Artificial
  CRISPR gRNA sequence
cttgcatcttactacttatt

SEQ ID NO: 572298 - DNA, 20 bp, Artificial
  CRISPR gRNA sequence
tcttactacttattgggatg

SEQ ID NO: 572299 - DNA, 20 bp, Artificial
  CRISPR gRNA sequence
tacttattgggatgaagcct

SEQ ID NO: 572300 - DNA, 20 bp, Artificial
  CRISPR gRNA sequence
attgggatgaagcctgagct

SEQ ID NO: 572301 - DNA, 20 bp, Artificial
  CRISPR gRNA sequence
ctgagctgagatctgcaccc

SEQ ID NO: 572302 - DNA, 20 bp, Artificial
  CRISPR gRNA sequence
caccctagacctctccccac

SEQ ID NO: 572303 - DNA, 20 bp, Artificial
  CRISPR gRNA sequence
ctagacctctccccacaagc

SEQ ID NO: 572304 - DNA, 20 bp, Artificial
  CRISPR gRNA sequence
tagacctctccccacaagcc

SEQ ID NO: 572305 - DNA, 20 bp, Artificial
  CRISPR gRNA sequence
agacctctccccacaagcca

SEQ ID NO: 572306 - DNA, 20 bp, Artificial
  CRISPR gRNA sequence
ctctccccacaagccagggc

SEQ ID NO: 572307 - DNA, 20 bp, Artificial
  CRISPR gRNA sequence
tccccacaagccagggccgg

SEQ ID NO: 572308 - DNA, 20 bp, Artificial
  CRISPR gRNA sequence
acaagccagggccggtagac

SEQ ID NO: 572309 - DNA, 20 bp, Artificial
  CRISPR gRNA sequence
ccagggccggtagactggca

SEQ ID NO: 572310 - DNA, 20 bp, Artificial
  CRISPR gRNA sequence
cagggccggtagactggcac

SEQ ID NO: 572311 - DNA, 20 bp, Artificial
  CRISPR gRNA sequence
ccggtagactggcacaggcc

SEQ ID NO: 572312 - DNA, 20 bp, Artificial
  CRISPR gRNA sequence
cggtagactggcacaggcct

SEQ ID NO: 572313 - DNA, 20 bp, Artificial
  CRISPR gRNA sequence
caggcctgggccactcactt

SEQ ID NO: 572314 - DNA, 20 bp, Artificial
  CRISPR gRNA sequence
aggcctgggccactcacttg

SEQ ID NO: 572315 - DNA, 20 bp, Artificial
  CRISPR gRNA sequence
cctgggccactcacttgagg

SEQ ID NO: 572316 - DNA, 20 bp, Artificial
  CRISPR gRNA sequence
actcacttgaggaagtcctc

SEQ ID NO: 572317 - DNA, 20 bp, Artificial
  CRISPR gRNA sequence
ggaagtcctctggctcttcg

SEQ ID NO: 572318 - DNA, 20 bp, Artificial
  CRISPR gRNA sequence
ttcgaagaccttctcacatc

SEQ ID NO: 572319 - DNA, 20 bp, Artificial
  CRISPR gRNA sequence
tcgaagaccttctcacatcc

SEQ ID NO: 572320 - DNA, 20 bp, Artificial
  CRISPR gRNA sequence
tctcacatccgggccacttg

SEQ ID NO: 572321 - DNA, 20 bp, Artificial
  CRISPR gRNA sequence
cacttgcagacaccatttgc

SEQ ID NO: 572322 - DNA, 20 bp, Artificial
  CRISPR gRNA sequence
ttgcagacaccatttgccag

SEQ ID NO: 572323 - DNA, 20 bp, Artificial
  CRISPR gRNA sequence
cagacaccatttgccagcag

SEQ ID NO: 572324 - DNA, 20 bp, Artificial
  CRISPR gRNA sequence
agacaccatttgccagcagt

SEQ ID NO: 572325 - DNA, 20 bp, Artificial
  CRISPR gRNA sequence
caccatttgccagcagtggg

SEQ ID NO: 572326 - DNA, 20 bp, Artificial
  CRISPR gRNA sequence
accatttgccagcagtgggt

SEQ ID NO: 572327 - DNA, 20 bp, Artificial
  CRISPR gRNA sequence
catttgccagcagtgggtag

SEQ ID NO: 572328 - DNA, 20 bp, Artificial
  CRISPR gRNA sequence
ccagcagtgggtaggagctc

SEQ ID NO: 572329 - DNA, 20 bp, Artificial
  CRISPR gRNA sequence
cagcagtgggtaggagctct

SEQ ID NO: 572330 - DNA, 20 bp, Artificial
  CRISPR gRNA sequence
agcagtgggtaggagctctg

SEQ ID NO: 572331 - DNA, 20 bp, Artificial
  CRISPR gRNA sequence
tgggtaggagctctggggca

SEQ ID NO: 572332 - DNA, 20 bp, Artificial
  CRISPR gRNA sequence
gagctctggggcacagccga

SEQ ID NO: 572333 - DNA, 20 bp, Artificial
  CRISPR gRNA sequence
agctctggggcacagccgaa

SEQ ID NO: 572334 - DNA, 20 bp, Artificial
  CRISPR gRNA sequence
gctctggggcacagccgaaa

SEQ ID NO: 572335 - DNA, 20 bp, Artificial
  CRISPR gRNA sequence
gggcacagccgaaagggtgc

SEQ ID NO: 572336 - DNA, 20 bp, Artificial
  CRISPR gRNA sequence
ggcacagccgaaagggtgct

SEQ ID NO: 572337 - DNA, 20 bp, Artificial
  CRISPR gRNA sequence
gcacagccgaaagggtgctg

SEQ ID NO: 572338 - DNA, 20 bp, Artificial
  CRISPR gRNA sequence
cacagccgaaagggtgctgg

SEQ ID NO: 572339 - DNA, 20 bp, Artificial
  CRISPR gRNA sequence
acagccgaaagggtgctggg

SEQ ID NO: 572340 - DNA, 20 bp, Artificial
  CRISPR gRNA sequence
ccgaaagggtgctgggggga

SEQ ID NO: 572341 - DNA, 20 bp, Artificial
  CRISPR gRNA sequence
gaaagggtgctggggggaca

SEQ ID NO: 572342 - DNA, 20 bp, Artificial
  CRISPR gRNA sequence
aaagggtgctggggggacag

SEQ ID NO: 572343 - DNA, 20 bp, Artificial
  CRISPR gRNA sequence
aagggtgctggggggacaga

SEQ ID NO: 572344 - DNA, 20 bp, Artificial
  CRISPR gRNA sequence
gctggggggacagagggtgt

SEQ ID NO: 572345 - DNA, 20 bp, Artificial
  CRISPR gRNA sequence
ctggggggacagagggtgtc

SEQ ID NO: 572346 - DNA, 20 bp, Artificial
  CRISPR gRNA sequence
tggggggacagagggtgtca

SEQ ID NO: 572347 - DNA, 20 bp, Artificial
  CRISPR gRNA sequence
ggggggacagagggtgtcag

SEQ ID NO: 572348 - DNA, 20 bp, Artificial
  CRISPR gRNA sequence
ggggacagagggtgtcaggg

SEQ ID NO: 572349 - DNA, 20 bp, Artificial
  CRISPR gRNA sequence
gggacagagggtgtcagggg

SEQ ID NO: 572350 - DNA, 20 bp, Artificial
  CRISPR gRNA sequence
ggacagagggtgtcagggga

SEQ ID NO: 572351 - DNA, 20 bp, Artificial
  CRISPR gRNA sequence
gacagagggtgtcaggggag

SEQ ID NO: 572352 - DNA, 20 bp, Artificial
  CRISPR gRNA sequence
gagggtgtcaggggagggga

SEQ ID NO: 572353 - DNA, 20 bp, Artificial
  CRISPR gRNA sequence
agggtgtcaggggaggggat

SEQ ID NO: 572354 - DNA, 20 bp, Artificial
  CRISPR gRNA sequence
ggtgtcaggggaggggatag

SEQ ID NO: 572355 - DNA, 20 bp, Artificial
  CRISPR gRNA sequence
gtgtcaggggaggggatagg

SEQ ID NO: 572356 - DNA, 20 bp, Artificial
  CRISPR gRNA sequence
tgtcaggggaggggatagga

SEQ ID NO: 572357 - DNA, 20 bp, Artificial
  CRISPR gRNA sequence
aggggaggggataggagggc

SEQ ID NO: 572358 - DNA, 20 bp, Artificial
  CRISPR gRNA sequence
ggggaggggataggagggcg

SEQ ID NO: 572359 - DNA, 20 bp, Artificial
  CRISPR gRNA sequence
aggagggcgaggatccttcc

SEQ ID NO: 572360 - DNA, 20 bp, Artificial
  CRISPR gRNA sequence
gtccactgacctgtccttcc

SEQ ID NO: 572361 - DNA, 20 bp, Artificial
  CRISPR gRNA sequence
tccactgacctgtccttcct

SEQ ID NO: 572362 - DNA, 20 bp, Artificial
  CRISPR gRNA sequence
cctgtccttcctgggtgcac

SEQ ID NO: 572363 - DNA, 20 bp, Artificial
  CRISPR gRNA sequence
ctgtccttcctgggtgcact

SEQ ID NO: 572364 - DNA, 20 bp, Artificial
  CRISPR gRNA sequence
ttcctgggtgcactgggatt

SEQ ID NO: 572365 - DNA, 20 bp, Artificial
  CRISPR gRNA sequence
tcctgggtgcactgggattt

SEQ ID NO: 572366 - DNA, 20 bp, Artificial
  CRISPR gRNA sequence
tgggtgcactgggatttggg

SEQ ID NO: 572367 - DNA, 20 bp, Artificial
  CRISPR gRNA sequence
gggtgcactgggatttggga

SEQ ID NO: 572368 - DNA, 20 bp, Artificial
  CRISPR gRNA sequence
cactgggatttgggaaggtg

SEQ ID NO: 572369 - DNA, 20 bp, Artificial
  CRISPR gRNA sequence
ctgggatttgggaaggtgca

SEQ ID NO: 572370 - DNA, 20 bp, Artificial
  CRISPR gRNA sequence
ggatttgggaaggtgcagag

SEQ ID NO: 572371 - DNA, 20 bp, Artificial
  CRISPR gRNA sequence
gggaaggtgcagagcagtgc

SEQ ID NO: 572372 - DNA, 20 bp, Artificial
  CRISPR gRNA sequence
gcagagcagtgccggctccc

SEQ ID NO: 572373 - DNA, 20 bp, Artificial
  CRISPR gRNA sequence
ggctccctggacacccattc

SEQ ID NO: 572374 - DNA, 20 bp, Artificial
  CRISPR gRNA sequence
gctccctggacacccattcc

SEQ ID NO: 572375 - DNA, 20 bp, Artificial
  CRISPR gRNA sequence
cctggacacccattccaggc

SEQ ID NO: 572376 - DNA, 20 bp, Artificial
  CRISPR gRNA sequence
gctggccacgttgatccctg

SEQ ID NO: 572377 - DNA, 20 bp, Artificial
  CRISPR gRNA sequence
ctggccacgttgatccctgt

SEQ ID NO: 572378 - DNA, 20 bp, Artificial
  CRISPR gRNA sequence
gccacgttgatccctgtggg

SEQ ID NO: 572379 - DNA, 20 bp, Artificial
  CRISPR gRNA sequence
ccacgttgatccctgtgggt

SEQ ID NO: 572380 - DNA, 20 bp, Artificial
  CRISPR gRNA sequence
cacgttgatccctgtgggtg

SEQ ID NO: 572381 - DNA, 20 bp, Artificial
  CRISPR gRNA sequence
ttgatccctgtgggtgggga

SEQ ID NO: 572382 - DNA, 20 bp, Artificial
  CRISPR gRNA sequence
tgatccctgtgggtggggac

SEQ ID NO: 572383 - DNA, 20 bp, Artificial
  CRISPR gRNA sequence
gatccctgtgggtggggaca

SEQ ID NO: 572384 - DNA, 20 bp, Artificial
  CRISPR gRNA sequence
gggtggggacagggcaccta

SEQ ID NO: 572385 - DNA, 20 bp, Artificial
  CRISPR gRNA sequence
gtggggacagggcacctatg

SEQ ID NO: 572386 - DNA, 20 bp, Artificial
  CRISPR gRNA sequence
tggggacagggcacctatgg

SEQ ID NO: 572387 - DNA, 20 bp, Artificial
  CRISPR gRNA sequence
cagggcacctatggaggctg

SEQ ID NO: 572388 - DNA, 20 bp, Artificial
  CRISPR gRNA sequence
agggcacctatggaggctgt

SEQ ID NO: 572389 - DNA, 20 bp, Artificial
  CRISPR gRNA sequence
cacctatggaggctgtgggc

SEQ ID NO: 572390 - DNA, 20 bp, Artificial
  CRISPR gRNA sequence
acctatggaggctgtgggct

SEQ ID NO: 572391 - DNA, 20 bp, Artificial
  CRISPR gRNA sequence
ggaggctgtgggctgggctc

SEQ ID NO: 572392 - DNA, 20 bp, Artificial
  CRISPR gRNA sequence
aggctgtgggctgggctctg

SEQ ID NO: 572393 - DNA, 20 bp, Artificial
  CRISPR gRNA sequence
gtgggctgggctctggagct

SEQ ID NO: 572394 - DNA, 20 bp, Artificial
  CRISPR gRNA sequence
ggctctggagcttggcccac

SEQ ID NO: 572395 - DNA, 20 bp, Artificial
  CRISPR gRNA sequence
gctctggagcttggcccaca

SEQ ID NO: 572396 - DNA, 20 bp, Artificial
  CRISPR gRNA sequence
cccacaaggcctctcatttt

SEQ ID NO: 572397 - DNA, 20 bp, Artificial
  CRISPR gRNA sequence
tttgagcttcccaccctcct

SEQ ID NO: 572398 - DNA, 20 bp, Artificial
  CRISPR gRNA sequence
gcctcgaaaaccctgactcc

SEQ ID NO: 572399 - DNA, 20 bp, Artificial
  CRISPR gRNA sequence
cctcgaaaaccctgactccc

SEQ ID NO: 572400 - DNA, 20 bp, Artificial
  CRISPR gRNA sequence
ctcgaaaaccctgactccca

SEQ ID NO: 572401 - DNA, 20 bp, Artificial
  CRISPR gRNA sequence
tcgaaaaccctgactcccag

SEQ ID NO: 572402 - DNA, 20 bp, Artificial
  CRISPR gRNA sequence
cgaaaaccctgactcccagg

SEQ ID NO: 572403 - DNA, 20 bp, Artificial
  CRISPR gRNA sequence
agggggctctgctgtcccca

SEQ ID NO: 572404 - DNA, 20 bp, Artificial
  CRISPR gRNA sequence
ctctgctgtccccaaagtcc

SEQ ID NO: 572405 - DNA, 20 bp, Artificial
  CRISPR gRNA sequence
tctgctgtccccaaagtccc

SEQ ID NO: 572406 - DNA, 20 bp, Artificial
  CRISPR gRNA sequence
tccccaaagtcccaggcttc

SEQ ID NO: 572407 - DNA, 20 bp, Artificial
  CRISPR gRNA sequence
ccaaagtcccaggcttctgg

SEQ ID NO: 572408 - DNA, 20 bp, Artificial
  CRISPR gRNA sequence
aaagtcccaggcttctggca

SEQ ID NO: 572409 - DNA, 20 bp, Artificial
  CRISPR gRNA sequence
gtcccaggcttctggcagag

SEQ ID NO: 572410 - DNA, 20 bp, Artificial
  CRISPR gRNA sequence
gcttctggcagagaagctta

SEQ ID NO: 572411 - DNA, 20 bp, Artificial
  CRISPR gRNA sequence
ctggcagagaagcttaaaga

SEQ ID NO: 572412 - DNA, 20 bp, Artificial
  CRISPR gRNA sequence
agcttaaagacggccattcg

SEQ ID NO: 572413 - DNA, 20 bp, Artificial
  CRISPR gRNA sequence
gcttaaagacggccattcgc

SEQ ID NO: 572414 - DNA, 20 bp, Artificial
  CRISPR gRNA sequence
gcaggtgctgacattttgac

SEQ ID NO: 572415 - DNA, 20 bp, Artificial
  CRISPR gRNA sequence
acattttgactagctttgta

SEQ ID NO: 572416 - DNA, 20 bp, Artificial
  CRISPR gRNA sequence
actagctttgtaaagctctg

SEQ ID NO: 572417 - DNA, 20 bp, Artificial
  CRISPR gRNA sequence
ttttgacattctgcatcttt

SEQ ID NO: 572418 - DNA, 20 bp, Artificial
  CRISPR gRNA sequence
tttgacattctgcatcttta

SEQ ID NO: 572419 - DNA, 20 bp, Artificial
  CRISPR gRNA sequence
gttctgcacctgacgttttt

SEQ ID NO: 572420 - DNA, 20 bp, Artificial
  CRISPR gRNA sequence
tctgcacctgacgttttttg

SEQ ID NO: 572421 - DNA, 20 bp, Artificial
  CRISPR gRNA sequence
ctgcacctgacgttttttgg

SEQ ID NO: 572422 - DNA, 20 bp, Artificial
  CRISPR gRNA sequence
tgcacctgacgttttttgga

SEQ ID NO: 572423 - DNA, 20 bp, Artificial
  CRISPR gRNA sequence
acctgacgttttttggaggg

SEQ ID NO: 572424 - DNA, 20 bp, Artificial
  CRISPR gRNA sequence
ctgacgttttttggagggtg

SEQ ID NO: 572425 - DNA, 20 bp, Artificial
  CRISPR gRNA sequence
ttttggagggtggagtttcc

SEQ ID NO: 572426 - DNA, 20 bp, Artificial
  CRISPR gRNA sequence
ggtggagtttccaagcctct

SEQ ID NO: 572427 - DNA, 20 bp, Artificial
  CRISPR gRNA sequence
gacctgacacctttgacccc

SEQ ID NO: 572428 - DNA, 20 bp, Artificial
  CRISPR gRNA sequence
cctgacacctttgaccccca

SEQ ID NO: 572429 - DNA, 20 bp, Artificial
  CRISPR gRNA sequence
acccccagagtactgcaatt

SEQ ID NO: 572430 - DNA, 20 bp, Artificial
  CRISPR gRNA sequence
cagagtactgcaattcagaa

SEQ ID NO: 572431 - DNA, 20 bp, Artificial
  CRISPR gRNA sequence
agaatagcctacactgctca

SEQ ID NO: 572432 - DNA, 20 bp, Artificial
  CRISPR gRNA sequence
agcctacactgctcacagcc

SEQ ID NO: 572433 - DNA, 20 bp, Artificial
  CRISPR gRNA sequence
gcctacactgctcacagcca

SEQ ID NO: 572434 - DNA, 20 bp, Artificial
  CRISPR gRNA sequence
actgctcacagccaaggatc

SEQ ID NO: 572435 - DNA, 20 bp, Artificial
  CRISPR gRNA sequence
ctgctcacagccaaggatct

SEQ ID NO: 572436 - DNA, 20 bp, Artificial
  CRISPR gRNA sequence
tgctcacagccaaggatctg

SEQ ID NO: 572437 - DNA, 20 bp, Artificial
  CRISPR gRNA sequence
cagccaaggatctggggact

SEQ ID NO: 572438 - DNA, 20 bp, Artificial
  CRISPR gRNA sequence
agccaaggatctggggactt

SEQ ID NO: 572439 - DNA, 20 bp, Artificial
  CRISPR gRNA sequence
gccaaggatctggggacttg

SEQ ID NO: 572440 - DNA, 20 bp, Artificial
  CRISPR gRNA sequence
ccaaggatctggggacttgg

SEQ ID NO: 572441 - DNA, 20 bp, Artificial
  CRISPR gRNA sequence
ggggacttgggggttctgtg

SEQ ID NO: 572442 - DNA, 20 bp, Artificial
  CRISPR gRNA sequence
ttgggggttctgtgaagcca

SEQ ID NO: 572443 - DNA, 20 bp, Artificial
  CRISPR gRNA sequence
tgggggttctgtgaagccat

SEQ ID NO: 572444 - DNA, 20 bp, Artificial
  CRISPR gRNA sequence
gggggttctgtgaagccatg

SEQ ID NO: 572445 - DNA, 20 bp, Artificial
  CRISPR gRNA sequence
ttctgtgaagccatggggta

SEQ ID NO: 572446 - DNA, 20 bp, Artificial
  CRISPR gRNA sequence
tctgtgaagccatggggtac

SEQ ID NO: 572447 - DNA, 20 bp, Artificial
  CRISPR gRNA sequence
gaagccatggggtacgggct

SEQ ID NO: 572448 - DNA, 20 bp, Artificial
  CRISPR gRNA sequence
aagccatggggtacgggctg

SEQ ID NO: 572449 - DNA, 20 bp, Artificial
  CRISPR gRNA sequence
ggtacgggctgaggtgttac

SEQ ID NO: 572450 - DNA, 20 bp, Artificial
  CRISPR gRNA sequence
gtacgggctgaggtgttacc

SEQ ID NO: 572451 - DNA, 20 bp, Artificial
  CRISPR gRNA sequence
cgggctgaggtgttaccagg

SEQ ID NO: 572452 - DNA, 20 bp, Artificial
  CRISPR gRNA sequence
gggctgaggtgttaccaggt

SEQ ID NO: 572453 - DNA, 20 bp, Artificial
  CRISPR gRNA sequence
gctgaggtgttaccaggtgg

SEQ ID NO: 572454 - DNA, 20 bp, Artificial
  CRISPR gRNA sequence
ctgaggtgttaccaggtggg

SEQ ID NO: 572455 - DNA, 20 bp, Artificial
  CRISPR gRNA sequence
ggtgttaccaggtgggaggc

SEQ ID NO: 572456 - DNA, 20 bp, Artificial
  CRISPR gRNA sequence
gtgttaccaggtgggaggcc

SEQ ID NO: 572457 - DNA, 20 bp, Artificial
  CRISPR gRNA sequence
taccaggtgggaggccaggc

SEQ ID NO: 572458 - DNA, 20 bp, Artificial
  CRISPR gRNA sequence
accaggtgggaggccaggcc

SEQ ID NO: 572459 - DNA, 20 bp, Artificial
  CRISPR gRNA sequence
gggaggccaggccgggcctt

SEQ ID NO: 572460 - DNA, 20 bp, Artificial
  CRISPR gRNA sequence
ggaggccaggccgggccttg

SEQ ID NO: 572461 - DNA, 20 bp, Artificial
  CRISPR gRNA sequence
gaggccaggccgggccttga

SEQ ID NO: 572462 - DNA, 20 bp, Artificial
  CRISPR gRNA sequence
ggccaggccgggccttgagg

SEQ ID NO: 572463 - DNA, 20 bp, Artificial
  CRISPR gRNA sequence
caggccgggccttgagggag

SEQ ID NO: 572464 - DNA, 20 bp, Artificial
  CRISPR gRNA sequence
ggccttgagggagaagaccc

SEQ ID NO: 572465 - DNA, 20 bp, Artificial
  CRISPR gRNA sequence
cttgagggagaagaccccag

SEQ ID NO: 572466 - DNA, 20 bp, Artificial
  CRISPR gRNA sequence
gagggagaagaccccagtgg

SEQ ID NO: 572467 - DNA, 20 bp, Artificial
  CRISPR gRNA sequence
ggagaagaccccagtggcgg

SEQ ID NO: 572468 - DNA, 20 bp, Artificial
  CRISPR gRNA sequence
gaagaccccagtggcggtgg

SEQ ID NO: 572469 - DNA, 20 bp, Artificial
  CRISPR gRNA sequence
aagaccccagtggcggtggt

SEQ ID NO: 572470 - DNA, 20 bp, Artificial
  CRISPR gRNA sequence
accccagtggcggtggtggg

SEQ ID NO: 572471 - DNA, 20 bp, Artificial
  CRISPR gRNA sequence
gtggcggtggtgggtggtgt

SEQ ID NO: 572472 - DNA, 20 bp, Artificial
  CRISPR gRNA sequence
tggcggtggtgggtggtgtg

SEQ ID NO: 572473 - DNA, 20 bp, Artificial
  CRISPR gRNA sequence
gggtggtgtgaggctgatca

SEQ ID NO: 572474 - DNA, 20 bp, Artificial
  CRISPR gRNA sequence
ggtgtgaggctgatcatggc

SEQ ID NO: 572475 - DNA, 20 bp, Artificial
  CRISPR gRNA sequence
gtgtgaggctgatcatggct

SEQ ID NO: 572476 - DNA, 20 bp, Artificial
  CRISPR gRNA sequence
ctgatcatggctgggctctc

SEQ ID NO: 572477 - DNA, 20 bp, Artificial
  CRISPR gRNA sequence
tgatcatggctgggctctcc

SEQ ID NO: 572478 - DNA, 20 bp, Artificial
  CRISPR gRNA sequence
gatcatggctgggctctcca

SEQ ID NO: 572479 - DNA, 20 bp, Artificial
  CRISPR gRNA sequence
atcatggctgggctctccag

SEQ ID NO: 572480 - DNA, 20 bp, Artificial
  CRISPR gRNA sequence
tcatggctgggctctccagg

SEQ ID NO: 572481 - DNA, 20 bp, Artificial
  CRISPR gRNA sequence
ctctccagggggtgcacctg

SEQ ID NO: 572482 - DNA, 20 bp, Artificial
  CRISPR gRNA sequence
cagggggtgcacctgcagca

SEQ ID NO: 572483 - DNA, 20 bp, Artificial
  CRISPR gRNA sequence
agggggtgcacctgcagcac

SEQ ID NO: 572484 - DNA, 20 bp, Artificial
  CRISPR gRNA sequence
gggggtgcacctgcagcaca

SEQ ID NO: 572485 - DNA, 20 bp, Artificial
  CRISPR gRNA sequence
ggggtgcacctgcagcacag

SEQ ID NO: 572486 - DNA, 20 bp, Artificial
  CRISPR gRNA sequence
gcacctgcagcacaggggtc

SEQ ID NO: 572487 - DNA, 20 bp, Artificial
  CRISPR gRNA sequence
cacctgcagcacaggggtcc

SEQ ID NO: 572488 - DNA, 20 bp, Artificial
  CRISPR gRNA sequence
gcagcacaggggtccgggcg

SEQ ID NO: 572489 - DNA, 20 bp, Artificial
  CRISPR gRNA sequence
cagcacaggggtccgggcgt

SEQ ID NO: 572490 - DNA, 20 bp, Artificial
  CRISPR gRNA sequence
gggcgtgggcatccaccgtt

SEQ ID NO: 572491 - DNA, 20 bp, Artificial
  CRISPR gRNA sequence
gcgtgggcatccaccgttga

SEQ ID NO: 572492 - DNA, 20 bp, Artificial
  CRISPR gRNA sequence
gggcatccaccgttgagagc

SEQ ID NO: 572493 - DNA, 20 bp, Artificial
  CRISPR gRNA sequence
ggcatccaccgttgagagct

SEQ ID NO: 572494 - DNA, 20 bp, Artificial
  CRISPR gRNA sequence
gcatccaccgttgagagctg

SEQ ID NO: 572495 - DNA, 20 bp, Artificial
  CRISPR gRNA sequence
catccaccgttgagagctgg

SEQ ID NO: 572496 - DNA, 20 bp, Artificial
  CRISPR gRNA sequence
atccaccgttgagagctggg

SEQ ID NO: 572497 - DNA, 20 bp, Artificial
  CRISPR gRNA sequence
tgagagctggggggcacatg

SEQ ID NO: 572498 - DNA, 20 bp, Artificial
  CRISPR gRNA sequence
gagagctggggggcacatgt

SEQ ID NO: 572499 - DNA, 20 bp, Artificial
  CRISPR gRNA sequence
tggggggcacatgtgggctg

SEQ ID NO: 572500 - DNA, 20 bp, Artificial
  CRISPR gRNA sequence
ggcacatgtgggctgtggtt

SEQ ID NO: 572501 - DNA, 20 bp, Artificial
  CRISPR gRNA sequence
ggctgtggttcagcctgact

SEQ ID NO: 572502 - DNA, 20 bp, Artificial
  CRISPR gRNA sequence
gctgtggttcagcctgactc

SEQ ID NO: 572503 - DNA, 20 bp, Artificial
  CRISPR gRNA sequence
ctgtggttcagcctgactcg

SEQ ID NO: 572504 - DNA, 20 bp, Artificial
  CRISPR gRNA sequence
tgactcggggcccctcccca

SEQ ID NO: 572505 - DNA, 20 bp, Artificial
  CRISPR gRNA sequence
gcccattcaccgtccatacc

SEQ ID NO: 572506 - DNA, 20 bp, Artificial
  CRISPR gRNA sequence
catacctggtgcatgaaatg

SEQ ID NO: 572507 - DNA, 20 bp, Artificial
  CRISPR gRNA sequence
gcatgaaatgtggcctgtcc

SEQ ID NO: 572508 - DNA, 20 bp, Artificial
  CRISPR gRNA sequence
atgaaatgtggcctgtcctg

SEQ ID NO: 572509 - DNA, 20 bp, Artificial
  CRISPR gRNA sequence
tgaaatgtggcctgtcctgg

SEQ ID NO: 572510 - DNA, 20 bp, Artificial
  CRISPR gRNA sequence
aaatgtggcctgtcctggag

SEQ ID NO: 572511 - DNA, 20 bp, Artificial
  CRISPR gRNA sequence
tgtcctggaggagtgcctgt

SEQ ID NO: 572512 - DNA, 20 bp, Artificial
  CRISPR gRNA sequence
cctggaggagtgcctgtaag

SEQ ID NO: 572513 - DNA, 20 bp, Artificial
  CRISPR gRNA sequence
ctggaggagtgcctgtaagt

SEQ ID NO: 572514 - DNA, 20 bp, Artificial
  CRISPR gRNA sequence
tggaggagtgcctgtaagtg

SEQ ID NO: 572515 - DNA, 20 bp, Artificial
  CRISPR gRNA sequence
ggagtgcctgtaagtggggc

SEQ ID NO: 572516 - DNA, 20 bp, Artificial
  CRISPR gRNA sequence
gagtgcctgtaagtggggca

SEQ ID NO: 572517 - DNA, 20 bp, Artificial
  CRISPR gRNA sequence
agtgcctgtaagtggggcaa

SEQ ID NO: 572518 - DNA, 20 bp, Artificial
  CRISPR gRNA sequence
gtgcctgtaagtggggcaag

SEQ ID NO: 572519 - DNA, 20 bp, Artificial
  CRISPR gRNA sequence
tgtaagtggggcaaggggcc

SEQ ID NO: 572520 - DNA, 20 bp, Artificial
  CRISPR gRNA sequence
caaggggcccagccgtgccc

SEQ ID NO: 572521 - DNA, 20 bp, Artificial
  CRISPR gRNA sequence
aggggcccagccgtgccccg

SEQ ID NO: 572522 - DNA, 20 bp, Artificial
  CRISPR gRNA sequence
ggggcccagccgtgccccgg

SEQ ID NO: 572523 - DNA, 20 bp, Artificial
  CRISPR gRNA sequence
gggcccagccgtgccccgga

SEQ ID NO: 572524 - DNA, 20 bp, Artificial
  CRISPR gRNA sequence
ccggagggtgccaccatgac

SEQ ID NO: 572525 - DNA, 20 bp, Artificial
  CRISPR gRNA sequence
cggagggtgccaccatgact

SEQ ID NO: 572526 - DNA, 20 bp, Artificial
  CRISPR gRNA sequence
ggagggtgccaccatgacta

SEQ ID NO: 572527 - DNA, 20 bp, Artificial
  CRISPR gRNA sequence
gagggtgccaccatgactag

SEQ ID NO: 572528 - DNA, 20 bp, Artificial
  CRISPR gRNA sequence
ggtgccaccatgactagggg

SEQ ID NO: 572529 - DNA, 20 bp, Artificial
  CRISPR gRNA sequence
caccatgactaggggcagtg

SEQ ID NO: 572530 - DNA, 20 bp, Artificial
  CRISPR gRNA sequence
accatgactaggggcagtgt

SEQ ID NO: 572531 - DNA, 20 bp, Artificial
  CRISPR gRNA sequence
atgactaggggcagtgtggg

SEQ ID NO: 572532 - DNA, 20 bp, Artificial
  CRISPR gRNA sequence
ctaggggcagtgtgggcagc

SEQ ID NO: 572533 - DNA, 20 bp, Artificial
  CRISPR gRNA sequence
taggggcagtgtgggcagct

SEQ ID NO: 572534 - DNA, 20 bp, Artificial
  CRISPR gRNA sequence
gggcagtgtgggcagctggg

SEQ ID NO: 572535 - DNA, 20 bp, Artificial
  CRISPR gRNA sequence
agtgtgggcagctgggcaga

SEQ ID NO: 572536 - DNA, 20 bp, Artificial
  CRISPR gRNA sequence
gtgtgggcagctgggcagaa

SEQ ID NO: 572537 - DNA, 20 bp, Artificial
  CRISPR gRNA sequence
tgggcagctgggcagaaagg

SEQ ID NO: 572538 - DNA, 20 bp, Artificial
  CRISPR gRNA sequence
gggcagctgggcagaaaggc

SEQ ID NO: 572539 - DNA, 20 bp, Artificial
  CRISPR gRNA sequence
cagctgggcagaaaggcagg

SEQ ID NO: 572540 - DNA, 20 bp, Artificial
  CRISPR gRNA sequence
agctgggcagaaaggcaggt

SEQ ID NO: 572541 - DNA, 20 bp, Artificial
  CRISPR gRNA sequence
gggcagaaaggcaggtgggt

SEQ ID NO: 572542 - DNA, 20 bp, Artificial
  CRISPR gRNA sequence
gcagaaaggcaggtgggtga

SEQ ID NO: 572543 - DNA, 20 bp, Artificial
  CRISPR gRNA sequence
cagaaaggcaggtgggtgag

SEQ ID NO: 572544 - DNA, 20 bp, Artificial
  CRISPR gRNA sequence
attcaaatactctgcactgc

SEQ ID NO: 572545 - DNA, 20 bp, Artificial
  CRISPR gRNA sequence
ctctgcactgcaagcccaca

SEQ ID NO: 572546 - DNA, 20 bp, Artificial
  CRISPR gRNA sequence
tgcactgcaagcccacatgg

SEQ ID NO: 572547 - DNA, 20 bp, Artificial
  CRISPR gRNA sequence
tcatcccccttttacacgta

SEQ ID NO: 572548 - DNA, 20 bp, Artificial
  CRISPR gRNA sequence
cttttacacgtatggaaact

SEQ ID NO: 572549 - DNA, 20 bp, Artificial
  CRISPR gRNA sequence
ttttacacgtatggaaactg

SEQ ID NO: 572550 - DNA, 20 bp, Artificial
  CRISPR gRNA sequence
cgtatggaaactgaggctca

SEQ ID NO: 572551 - DNA, 20 bp, Artificial
  CRISPR gRNA sequence
tatggaaactgaggctcatg

SEQ ID NO: 572552 - DNA, 20 bp, Artificial
  CRISPR gRNA sequence
aactgaggctcatggagatc

SEQ ID NO: 572553 - DNA, 20 bp, Artificial
  CRISPR gRNA sequence
ggagatcgagtaacttttta

SEQ ID NO: 572554 - DNA, 20 bp, Artificial
  CRISPR gRNA sequence
gtaactttttaaagatcaaa

SEQ ID NO: 572555 - DNA, 20 bp, Artificial
  CRISPR gRNA sequence
ttaaagatcaaacagctaat

SEQ ID NO: 572556 - DNA, 20 bp, Artificial
  CRISPR gRNA sequence
atcaaacagctaataagttg

SEQ ID NO: 572557 - DNA, 20 bp, Artificial
  CRISPR gRNA sequence
caaacagctaataagttgca

SEQ ID NO: 572558 - DNA, 20 bp, Artificial
  CRISPR gRNA sequence
cagctaataagttgcagagc

SEQ ID NO: 572559 - DNA, 20 bp, Artificial
  CRISPR gRNA sequence
ataagttgcagagctggcct

SEQ ID NO: 572560 - DNA, 20 bp, Artificial
  CRISPR gRNA sequence
gccctgtcacctcacctact

SEQ ID NO: 572561 - DNA, 20 bp, Artificial
  CRISPR gRNA sequence
tcacctcacctacttggccc

SEQ ID NO: 572562 - DNA, 20 bp, Artificial
  CRISPR gRNA sequence
agtcctcttctcttgtcaca

SEQ ID NO: 572563 - DNA, 20 bp, Artificial
  CRISPR gRNA sequence
gtcctcttctcttgtcacat

SEQ ID NO: 572564 - DNA, 20 bp, Artificial
  CRISPR gRNA sequence
tcctcttctcttgtcacatg

SEQ ID NO: 572565 - DNA, 20 bp, Artificial
  CRISPR gRNA sequence
cttctcttgtcacatgggga

SEQ ID NO: 572566 - DNA, 20 bp, Artificial
  CRISPR gRNA sequence
ttctcttgtcacatggggat

SEQ ID NO: 572567 - DNA, 20 bp, Artificial
  CRISPR gRNA sequence
tctcttgtcacatggggatg

SEQ ID NO: 572568 - DNA, 20 bp, Artificial
  CRISPR gRNA sequence
cacatggggatggggacaca

SEQ ID NO: 572569 - DNA, 20 bp, Artificial
  CRISPR gRNA sequence
gggacacatagctatgctca

SEQ ID NO: 572570 - DNA, 20 bp, Artificial
  CRISPR gRNA sequence
ggacacatagctatgctcat

SEQ ID NO: 572571 - DNA, 20 bp, Artificial
  CRISPR gRNA sequence
atgctcatgggactacaata

SEQ ID NO: 572572 - DNA, 20 bp, Artificial
  CRISPR gRNA sequence
atacggcctcctcctctcct

SEQ ID NO: 572573 - DNA, 20 bp, Artificial
  CRISPR gRNA sequence
ggcctcctcctctcctgaga

SEQ ID NO: 572574 - DNA, 20 bp, Artificial
  CRISPR gRNA sequence
gcctcctcctctcctgagac

SEQ ID NO: 572575 - DNA, 20 bp, Artificial
  CRISPR gRNA sequence
cctcctcctctcctgagaca

SEQ ID NO: 572576 - DNA, 20 bp, Artificial
  CRISPR gRNA sequence
tcctctcctgagacagggat

SEQ ID NO: 572577 - DNA, 20 bp, Artificial
  CRISPR gRNA sequence
cctctcctgagacagggatt

SEQ ID NO: 572578 - DNA, 20 bp, Artificial
  CRISPR gRNA sequence
tctcctgagacagggattgg

SEQ ID NO: 572579 - DNA, 20 bp, Artificial
  CRISPR gRNA sequence
ctcctgagacagggattggg

SEQ ID NO: 572580 - DNA, 20 bp, Artificial
  CRISPR gRNA sequence
tgagacagggattgggaggt

SEQ ID NO: 572581 - DNA, 20 bp, Artificial
  CRISPR gRNA sequence
gagacagggattgggaggtc

SEQ ID NO: 572582 - DNA, 20 bp, Artificial
  CRISPR gRNA sequence
agacagggattgggaggtcg

SEQ ID NO: 572583 - DNA, 20 bp, Artificial
  CRISPR gRNA sequence
acagggattgggaggtcggg

SEQ ID NO: 572584 - DNA, 20 bp, Artificial
  CRISPR gRNA sequence
agggattgggaggtcgggga

SEQ ID NO: 572585 - DNA, 20 bp, Artificial
  CRISPR gRNA sequence
ggggagagcctccaatctct

SEQ ID NO: 572586 - DNA, 20 bp, Artificial
  CRISPR gRNA sequence
gggagagcctccaatctctg

SEQ ID NO: 572587 - DNA, 20 bp, Artificial
  CRISPR gRNA sequence
agcctccaatctctgaggcc

SEQ ID NO: 572588 - DNA, 20 bp, Artificial
  CRISPR gRNA sequence
ctccaatctctgaggcctgg

SEQ ID NO: 572589 - DNA, 20 bp, Artificial
  CRISPR gRNA sequence
tccaatctctgaggcctggc

SEQ ID NO: 572590 - DNA, 20 bp, Artificial
  CRISPR gRNA sequence
aatctctgaggcctggcagg

SEQ ID NO: 572591 - DNA, 20 bp, Artificial
  CRISPR gRNA sequence
atctctgaggcctggcaggt

SEQ ID NO: 572592 - DNA, 20 bp, Artificial
  CRISPR gRNA sequence
tctctgaggcctggcaggtg

SEQ ID NO: 572593 - DNA, 20 bp, Artificial
  CRISPR gRNA sequence
ctggcaggtggggattttct

SEQ ID NO: 572594 - DNA, 20 bp, Artificial
  CRISPR gRNA sequence
tggccctgcaacatctgcat

SEQ ID NO: 572595 - DNA, 20 bp, Artificial
  CRISPR gRNA sequence
tgcaacatctgcataagtca

SEQ ID NO: 572596 - DNA, 20 bp, Artificial
  CRISPR gRNA sequence
gcataagtcacagacttgcc

SEQ ID NO: 572597 - DNA, 20 bp, Artificial
  CRISPR gRNA sequence
cataagtcacagacttgcct

SEQ ID NO: 572598 - DNA, 20 bp, Artificial
  CRISPR gRNA sequence
tcacagacttgcctgggacc

SEQ ID NO: 572599 - DNA, 20 bp, Artificial
  CRISPR gRNA sequence
agaaaccacttcctgtgccc

SEQ ID NO: 572600 - DNA, 20 bp, Artificial
  CRISPR gRNA sequence
accacttcctgtgccccagc

SEQ ID NO: 572601 - DNA, 20 bp, Artificial
  CRISPR gRNA sequence
cagccagcccccctcccgcc

SEQ ID NO: 572602 - DNA, 20 bp, Artificial
  CRISPR gRNA sequence
ccccctcccgcccagtgcca

SEQ ID NO: 572603 - DNA, 20 bp, Artificial
  CRISPR gRNA sequence
tcccgcccagtgccacagta

SEQ ID NO: 572604 - DNA, 20 bp, Artificial
  CRISPR gRNA sequence
cccgcccagtgccacagtaa

SEQ ID NO: 572605 - DNA, 20 bp, Artificial
  CRISPR gRNA sequence
cccagtgccacagtaaaggt

SEQ ID NO: 572606 - DNA, 20 bp, Artificial
  CRISPR gRNA sequence
acagtaaaggtcggcacctg

SEQ ID NO: 572607 - DNA, 20 bp, Artificial
  CRISPR gRNA sequence
cagtaaaggtcggcacctgt

SEQ ID NO: 572608 - DNA, 20 bp, Artificial
  CRISPR gRNA sequence
aaggtcggcacctgtaggtc

SEQ ID NO: 572609 - DNA, 20 bp, Artificial
  CRISPR gRNA sequence
aggtcggcacctgtaggtcc

SEQ ID NO: 572610 - DNA, 20 bp, Artificial
  CRISPR gRNA sequence
ccaccctgcctgccccatcc

SEQ ID NO: 572611 - DNA, 20 bp, Artificial
  CRISPR gRNA sequence
caccctgcctgccccatcct

SEQ ID NO: 572612 - DNA, 20 bp, Artificial
  CRISPR gRNA sequence
tgcctgccccatcctgggcc

SEQ ID NO: 572613 - DNA, 20 bp, Artificial
  CRISPR gRNA sequence
gcctgccccatcctgggccc

SEQ ID NO: 572614 - DNA, 20 bp, Artificial
  CRISPR gRNA sequence
cctgccccatcctgggccca

SEQ ID NO: 572615 - DNA, 20 bp, Artificial
  CRISPR gRNA sequence
tgggcccagggcctcacctg

SEQ ID NO: 572616 - DNA, 20 bp, Artificial
  CRISPR gRNA sequence
ggcctcacctgcagctgcga

SEQ ID NO: 572617 - DNA, 20 bp, Artificial
  CRISPR gRNA sequence
ctcacctgcagctgcgatgg

SEQ ID NO: 572618 - DNA, 20 bp, Artificial
  CRISPR gRNA sequence
ctgcagctgcgatggtggca

SEQ ID NO: 572619 - DNA, 20 bp, Artificial
  CRISPR gRNA sequence
tgcagctgcgatggtggcat

SEQ ID NO: 572620 - DNA, 20 bp, Artificial
  CRISPR gRNA sequence
gcagctgcgatggtggcatg

SEQ ID NO: 572621 - DNA, 20 bp, Artificial
  CRISPR gRNA sequence
gcgatggtggcatggggttc

SEQ ID NO: 572622 - DNA, 20 bp, Artificial
  CRISPR gRNA sequence
cgatggtggcatggggttca

SEQ ID NO: 572623 - DNA, 20 bp, Artificial
  CRISPR gRNA sequence
tggtggcatggggttcaagg

SEQ ID NO: 572624 - DNA, 20 bp, Artificial
  CRISPR gRNA sequence
tggcatggggttcaaggaag

SEQ ID NO: 572625 - DNA, 20 bp, Artificial
  CRISPR gRNA sequence
gcatggggttcaaggaagaa

SEQ ID NO: 572626 - DNA, 20 bp, Artificial
  CRISPR gRNA sequence
catggggttcaaggaagaag

SEQ ID NO: 572627 - DNA, 20 bp, Artificial
  CRISPR gRNA sequence
tggggttcaaggaagaagag

SEQ ID NO: 572628 - DNA, 20 bp, Artificial
  CRISPR gRNA sequence
ggggttcaaggaagaagagg

SEQ ID NO: 572629 - DNA, 20 bp, Artificial
  CRISPR gRNA sequence
tcaaggaagaagaggaggca

SEQ ID NO: 572630 - DNA, 20 bp, Artificial
  CRISPR gRNA sequence
caaggaagaagaggaggcat

SEQ ID NO: 572631 - DNA, 20 bp, Artificial
  CRISPR gRNA sequence
gaggcatgggccccgcctcg

SEQ ID NO: 572632 - DNA, 20 bp, Artificial
  CRISPR gRNA sequence
gggccccgcctcgaagatct

SEQ ID NO: 572633 - DNA, 20 bp, Artificial
  CRISPR gRNA sequence
cgcctcgaagatctcggccc

SEQ ID NO: 572634 - DNA, 20 bp, Artificial
  CRISPR gRNA sequence
ctcgaagatctcggccctgg

SEQ ID NO: 572635 - DNA, 20 bp, Artificial
  CRISPR gRNA sequence
tcgaagatctcggccctgga

SEQ ID NO: 572636 - DNA, 20 bp, Artificial
  CRISPR gRNA sequence
cggccctggaaggttccccc

SEQ ID NO: 572637 - DNA, 20 bp, Artificial
  CRISPR gRNA sequence
ggccctggaaggttccccct

SEQ ID NO: 572638 - DNA, 20 bp, Artificial
  CRISPR gRNA sequence
ggaaggttccccctgggccc

SEQ ID NO: 572639 - DNA, 20 bp, Artificial
  CRISPR gRNA sequence
gaaggttccccctgggcccc

SEQ ID NO: 572640 - DNA, 20 bp, Artificial
  CRISPR gRNA sequence
ccccctgggccccgggcccc

SEQ ID NO: 572641 - DNA, 20 bp, Artificial
  CRISPR gRNA sequence
cctgggccccgggcccccag

SEQ ID NO: 572642 - DNA, 20 bp, Artificial
  CRISPR gRNA sequence
ctgggccccgggcccccagc

SEQ ID NO: 572643 - DNA, 20 bp, Artificial
  CRISPR gRNA sequence
cccgggcccccagcaggtct

SEQ ID NO: 572644 - DNA, 20 bp, Artificial
  CRISPR gRNA sequence
ccgggcccccagcaggtctg

SEQ ID NO: 572645 - DNA, 20 bp, Artificial
  CRISPR gRNA sequence
ccccagcaggtctgaggctt

SEQ ID NO: 572646 - DNA, 20 bp, Artificial
  CRISPR gRNA sequence
cccagcaggtctgaggcttt

SEQ ID NO: 572647 - DNA, 20 bp, Artificial
  CRISPR gRNA sequence
caggtctgaggctttgggtg

SEQ ID NO: 572648 - DNA, 20 bp, Artificial
  CRISPR gRNA sequence
aggctttgggtgcagccctc

SEQ ID NO: 572649 - DNA, 20 bp, Artificial
  CRISPR gRNA sequence
tttgggtgcagccctccagc

SEQ ID NO: 572650 - DNA, 20 bp, Artificial
  CRISPR gRNA sequence
ttgggtgcagccctccagct

SEQ ID NO: 572651 - DNA, 20 bp, Artificial
  CRISPR gRNA sequence
gtgcagccctccagctgggc

SEQ ID NO: 572652 - DNA, 20 bp, Artificial
  CRISPR gRNA sequence
tgcagccctccagctgggcg

SEQ ID NO: 572653 - DNA, 20 bp, Artificial
  CRISPR gRNA sequence
ctccagctgggcgaggctcc

SEQ ID NO: 572654 - DNA, 20 bp, Artificial
  CRISPR gRNA sequence
tccagctgggcgaggctcct

SEQ ID NO: 572655 - DNA, 20 bp, Artificial
  CRISPR gRNA sequence
ccagctgggcgaggctcctg

SEQ ID NO: 572656 - DNA, 20 bp, Artificial
  CRISPR gRNA sequence
ctgggcgaggctcctgggga

SEQ ID NO: 572657 - DNA, 20 bp, Artificial
  CRISPR gRNA sequence
tgggcgaggctcctggggat

SEQ ID NO: 572658 - DNA, 20 bp, Artificial
  CRISPR gRNA sequence
gaggctcctggggatgggcc

SEQ ID NO: 572659 - DNA, 20 bp, Artificial
  CRISPR gRNA sequence
aggctcctggggatgggcca

SEQ ID NO: 572660 - DNA, 20 bp, Artificial
  CRISPR gRNA sequence
ggctcctggggatgggccaa

SEQ ID NO: 572661 - DNA, 20 bp, Artificial
  CRISPR gRNA sequence
ctggggatgggccaagggcc

SEQ ID NO: 572662 - DNA, 20 bp, Artificial
  CRISPR gRNA sequence
tggggatgggccaagggcca

SEQ ID NO: 572663 - DNA, 20 bp, Artificial
  CRISPR gRNA sequence
ggatgggccaagggccaagg

SEQ ID NO: 572664 - DNA, 20 bp, Artificial
  CRISPR gRNA sequence
gatgggccaagggccaagga

SEQ ID NO: 572665 - DNA, 20 bp, Artificial
  CRISPR gRNA sequence
atgggccaagggccaaggaa

SEQ ID NO: 572666 - DNA, 20 bp, Artificial
  CRISPR gRNA sequence
tgggccaagggccaaggaag

SEQ ID NO: 572667 - DNA, 20 bp, Artificial
  CRISPR gRNA sequence
caagggccaaggaaggggcc

SEQ ID NO: 572668 - DNA, 20 bp, Artificial
  CRISPR gRNA sequence
aagggccaaggaaggggccg

SEQ ID NO: 572669 - DNA, 20 bp, Artificial
  CRISPR gRNA sequence
agggccaaggaaggggccga

SEQ ID NO: 572670 - DNA, 20 bp, Artificial
  CRISPR gRNA sequence
ggaaggggccgagggcttgc

SEQ ID NO: 572671 - DNA, 20 bp, Artificial
  CRISPR gRNA sequence
gaaggggccgagggcttgcc

SEQ ID NO: 572672 - DNA, 20 bp, Artificial
  CRISPR gRNA sequence
ggccgagggcttgccaggcc

SEQ ID NO: 572673 - DNA, 20 bp, Artificial
  CRISPR gRNA sequence
gccgagggcttgccaggcct

SEQ ID NO: 572674 - DNA, 20 bp, Artificial
  CRISPR gRNA sequence
ccgagggcttgccaggcctg

SEQ ID NO: 572675 - DNA, 20 bp, Artificial
  CRISPR gRNA sequence
gggcttgccaggcctggggt

SEQ ID NO: 572676 - DNA, 20 bp, Artificial
  CRISPR gRNA sequence
ggcttgccaggcctggggtt

SEQ ID NO: 572677 - DNA, 20 bp, Artificial
  CRISPR gRNA sequence
ccaggcctggggttgggcat

SEQ ID NO: 572678 - DNA, 20 bp, Artificial
  CRISPR gRNA sequence
caggcctggggttgggcatc

SEQ ID NO: 572679 - DNA, 20 bp, Artificial
  CRISPR gRNA sequence
tgggcatcgggtccttgtcc

SEQ ID NO: 572680 - DNA, 20 bp, Artificial
  CRISPR gRNA sequence
gggcatcgggtccttgtcca

SEQ ID NO: 572681 - DNA, 20 bp, Artificial
  CRISPR gRNA sequence
ggcatcgggtccttgtccaa

SEQ ID NO: 572682 - DNA, 20 bp, Artificial
  CRISPR gRNA sequence
atcgggtccttgtccaaggg

SEQ ID NO: 572683 - DNA, 20 bp, Artificial
  CRISPR gRNA sequence
tcgggtccttgtccaagggc

SEQ ID NO: 572684 - DNA, 20 bp, Artificial
  CRISPR gRNA sequence
ttgtccaagggcaggctgcg

SEQ ID NO: 572685 - DNA, 20 bp, Artificial
  CRISPR gRNA sequence
agggcaggctgcgtagacaa

SEQ ID NO: 572686 - DNA, 20 bp, Artificial
  CRISPR gRNA sequence
gggcaggctgcgtagacaat

SEQ ID NO: 572687 - DNA, 20 bp, Artificial
  CRISPR gRNA sequence
ggcaggctgcgtagacaata

SEQ ID NO: 572688 - DNA, 20 bp, Artificial
  CRISPR gRNA sequence
gcaggctgcgtagacaatag

SEQ ID NO: 572689 - DNA, 20 bp, Artificial
  CRISPR gRNA sequence
gctgcgtagacaatagggga

SEQ ID NO: 572690 - DNA, 20 bp, Artificial
  CRISPR gRNA sequence
ctgcgtagacaataggggaa

SEQ ID NO: 572691 - DNA, 20 bp, Artificial
  CRISPR gRNA sequence
gcgtagacaataggggaaag

SEQ ID NO: 572692 - DNA, 20 bp, Artificial
  CRISPR gRNA sequence
gaaaggagtcacacgtgtgc

SEQ ID NO: 572693 - DNA, 20 bp, Artificial
  CRISPR gRNA sequence
aaaggagtcacacgtgtgct

SEQ ID NO: 572694 - DNA, 20 bp, Artificial
  CRISPR gRNA sequence
aaggagtcacacgtgtgcta

SEQ ID NO: 572695 - DNA, 20 bp, Artificial
  CRISPR gRNA sequence
gagtcacacgtgtgctaggg

SEQ ID NO: 572696 - DNA, 20 bp, Artificial
  CRISPR gRNA sequence
cacgtgtgctagggcggtat

SEQ ID NO: 572697 - DNA, 20 bp, Artificial
  CRISPR gRNA sequence
tatgagatactcgaccacct

SEQ ID NO: 572698 - DNA, 20 bp, Artificial
  CRISPR gRNA sequence
actcgaccacctgagccacg

SEQ ID NO: 572699 - DNA, 20 bp, Artificial
  CRISPR gRNA sequence
gagccacgtggacactcctc

SEQ ID NO: 572700 - DNA, 20 bp, Artificial
  CRISPR gRNA sequence
cgtggacactcctctggtca

SEQ ID NO: 572701 - DNA, 20 bp, Artificial
  CRISPR gRNA sequence
ggacactcctctggtcaaag

SEQ ID NO: 572702 - DNA, 20 bp, Artificial
  CRISPR gRNA sequence
gacactcctctggtcaaagc

SEQ ID NO: 572703 - DNA, 20 bp, Artificial
  CRISPR gRNA sequence
cctctggtcaaagcaggcat

SEQ ID NO: 572704 - DNA, 20 bp, Artificial
  CRISPR gRNA sequence
tggtcaaagcaggcattggc

SEQ ID NO: 572705 - DNA, 20 bp, Artificial
  CRISPR gRNA sequence
ggtcaaagcaggcattggct

SEQ ID NO: 572706 - DNA, 20 bp, Artificial
  CRISPR gRNA sequence
cattggctgggacatgtccc

SEQ ID NO: 572707 - DNA, 20 bp, Artificial
  CRISPR gRNA sequence
attggctgggacatgtcccg

SEQ ID NO: 572708 - DNA, 20 bp, Artificial
  CRISPR gRNA sequence
ttggctgggacatgtcccga

SEQ ID NO: 572709 - DNA, 20 bp, Artificial
  CRISPR gRNA sequence
tggctgggacatgtcccgag

SEQ ID NO: 572710 - DNA, 20 bp, Artificial
  CRISPR gRNA sequence
acatgtcccgaggggcccca

SEQ ID NO: 572711 - DNA, 20 bp, Artificial
  CRISPR gRNA sequence
ggggccccatagttgcaccc

SEQ ID NO: 572712 - DNA, 20 bp, Artificial
  CRISPR gRNA sequence
ccatagttgcaccccagctc

SEQ ID NO: 572713 - DNA, 20 bp, Artificial
  CRISPR gRNA sequence
cacacacacacacacacacc

SEQ ID NO: 572714 - DNA, 20 bp, Artificial
  CRISPR gRNA sequence
acacacacacaccaagaaca

SEQ ID NO: 572715 - DNA, 20 bp, Artificial
  CRISPR gRNA sequence
cacacacacaccaagaacac

SEQ ID NO: 572716 - DNA, 20 bp, Artificial
  CRISPR gRNA sequence
acccacacatgccccacgtg

SEQ ID NO: 572717 - DNA, 20 bp, Artificial
  CRISPR gRNA sequence
ccacacatgccccacgtgca

SEQ ID NO: 572718 - DNA, 20 bp, Artificial
  CRISPR gRNA sequence
cacacatgccccacgtgcag

SEQ ID NO: 572719 - DNA, 20 bp, Artificial
  CRISPR gRNA sequence
atgccccacgtgcagaggtc

SEQ ID NO: 572720 - DNA, 20 bp, Artificial
  CRISPR gRNA sequence
acgtgcagaggtccagcacc

SEQ ID NO: 572721 - DNA, 20 bp, Artificial
  CRISPR gRNA sequence
cctggcttgcctgcccacgc

SEQ ID NO: 572722 - DNA, 20 bp, Artificial
  CRISPR gRNA sequence
cttgcctgcccacgctagca

SEQ ID NO: 572723 - DNA, 20 bp, Artificial
  CRISPR gRNA sequence
tgcccacgctagcacagccc

SEQ ID NO: 572724 - DNA, 20 bp, Artificial
  CRISPR gRNA sequence
acgctagcacagccctggtg

SEQ ID NO: 572725 - DNA, 20 bp, Artificial
  CRISPR gRNA sequence
ggtgtggatgtgtcctctat

SEQ ID NO: 572726 - DNA, 20 bp, Artificial
  CRISPR gRNA sequence
gtgtggatgtgtcctctatg

SEQ ID NO: 572727 - DNA, 20 bp, Artificial
  CRISPR gRNA sequence
tgtggatgtgtcctctatga

SEQ ID NO: 572728 - DNA, 20 bp, Artificial
  CRISPR gRNA sequence
tgtgtcctctatgagggcaa

SEQ ID NO: 572729 - DNA, 20 bp, Artificial
  CRISPR gRNA sequence
ggttgtttccccctccactt

SEQ ID NO: 572730 - DNA, 20 bp, Artificial
  CRISPR gRNA sequence
ttgtttccccctccacttga

SEQ ID NO: 572731 - DNA, 20 bp, Artificial
  CRISPR gRNA sequence
ctccacttgagagctgtttc

SEQ ID NO: 572732 - DNA, 20 bp, Artificial
  CRISPR gRNA sequence
ttgagagctgtttcaagcct

SEQ ID NO: 572733 - DNA, 20 bp, Artificial
  CRISPR gRNA sequence
tgagagctgtttcaagcctc

SEQ ID NO: 572734 - DNA, 20 bp, Artificial
  CRISPR gRNA sequence
tgtttcaagcctcaggcctc

SEQ ID NO: 572735 - DNA, 20 bp, Artificial
  CRISPR gRNA sequence
agccctccctgcaccctgca

SEQ ID NO: 572736 - DNA, 20 bp, Artificial
  CRISPR gRNA sequence
gccctccctgcaccctgcac

SEQ ID NO: 572737 - DNA, 20 bp, Artificial
  CRISPR gRNA sequence
gctgtgtttgctcatcttgc

SEQ ID NO: 572738 - DNA, 20 bp, Artificial
  CRISPR gRNA sequence
tgtgtttgctcatcttgccg

SEQ ID NO: 572739 - DNA, 20 bp, Artificial
  CRISPR gRNA sequence
tttgctcatcttgccggagc

SEQ ID NO: 572740 - DNA, 20 bp, Artificial
  CRISPR gRNA sequence
catcttgccggagctggtct

SEQ ID NO: 572741 - DNA, 20 bp, Artificial
  CRISPR gRNA sequence
ctggtctcggactttctcct

SEQ ID NO: 572742 - DNA, 20 bp, Artificial
  CRISPR gRNA sequence
ggtctcggactttctcctcg

SEQ ID NO: 572743 - DNA, 20 bp, Artificial
  CRISPR gRNA sequence
ctcggagtcctattttgccc

SEQ ID NO: 572744 - DNA, 20 bp, Artificial
  CRISPR gRNA sequence
tcctattttgccccagtgac

SEQ ID NO: 572745 - DNA, 20 bp, Artificial
  CRISPR gRNA sequence
cctattttgccccagtgact

SEQ ID NO: 572746 - DNA, 20 bp, Artificial
  CRISPR gRNA sequence
tttgccccagtgactaggca

SEQ ID NO: 572747 - DNA, 20 bp, Artificial
  CRISPR gRNA sequence
gtgactaggcatggactcaa

SEQ ID NO: 572748 - DNA, 20 bp, Artificial
  CRISPR gRNA sequence
atggactcaaaagattcatc

SEQ ID NO: 572749 - DNA, 20 bp, Artificial
  CRISPR gRNA sequence
aagattcatctggctgctgt

SEQ ID NO: 572750 - DNA, 20 bp, Artificial
  CRISPR gRNA sequence
attcatctggctgctgtgag

SEQ ID NO: 572751 - DNA, 20 bp, Artificial
  CRISPR gRNA sequence
ttcatctggctgctgtgagt

SEQ ID NO: 572752 - DNA, 20 bp, Artificial
  CRISPR gRNA sequence
tcatctggctgctgtgagtg

SEQ ID NO: 572753 - DNA, 20 bp, Artificial
  CRISPR gRNA sequence
ctggctgctgtgagtggggc

SEQ ID NO: 572754 - DNA, 20 bp, Artificial
  CRISPR gRNA sequence
ctgctgtgagtggggctagt

SEQ ID NO: 572755 - DNA, 20 bp, Artificial
  CRISPR gRNA sequence
tgctgtgagtggggctagtg

SEQ ID NO: 572756 - DNA, 20 bp, Artificial
  CRISPR gRNA sequence
ctgtgagtggggctagtgag

SEQ ID NO: 572757 - DNA, 20 bp, Artificial
  CRISPR gRNA sequence
tgtgagtggggctagtgagg

SEQ ID NO: 572758 - DNA, 20 bp, Artificial
  CRISPR gRNA sequence
tagtgaggaggctattgtaa

SEQ ID NO: 572759 - DNA, 20 bp, Artificial
  CRISPR gRNA sequence
ggaggctattgtaacagtcc

SEQ ID NO: 572760 - DNA, 20 bp, Artificial
  CRISPR gRNA sequence
gctattgtaacagtcctggc

SEQ ID NO: 572761 - DNA, 20 bp, Artificial
  CRISPR gRNA sequence
gtcctggcaagtgatgatgc

SEQ ID NO: 572762 - DNA, 20 bp, Artificial
  CRISPR gRNA sequence
ggcaagtgatgatgctggca

SEQ ID NO: 572763 - DNA, 20 bp, Artificial
  CRISPR gRNA sequence
gtgatgatgctggcacagaa

SEQ ID NO: 572764 - DNA, 20 bp, Artificial
  CRISPR gRNA sequence
tgatgatgctggcacagaat

SEQ ID NO: 572765 - DNA, 20 bp, Artificial
  CRISPR gRNA sequence
gatgctggcacagaatgggc

SEQ ID NO: 572766 - DNA, 20 bp, Artificial
  CRISPR gRNA sequence
gctggcacagaatgggctgg

SEQ ID NO: 572767 - DNA, 20 bp, Artificial
  CRISPR gRNA sequence
ggcacagaatgggctggtgg

SEQ ID NO: 572768 - DNA, 20 bp, Artificial
  CRISPR gRNA sequence
acagaatgggctggtggcag

SEQ ID NO: 572769 - DNA, 20 bp, Artificial
  CRISPR gRNA sequence
agaatgggctggtggcagtg

SEQ ID NO: 572770 - DNA, 20 bp, Artificial
  CRISPR gRNA sequence
atgggctggtggcagtggag

SEQ ID NO: 572771 - DNA, 20 bp, Artificial
  CRISPR gRNA sequence
tgggctggtggcagtggaga

SEQ ID NO: 572772 - DNA, 20 bp, Artificial
  CRISPR gRNA sequence
ctggtggcagtggagaaggc

SEQ ID NO: 572773 - DNA, 20 bp, Artificial
  CRISPR gRNA sequence
gtggcagtggagaaggcgag

SEQ ID NO: 572774 - DNA, 20 bp, Artificial
  CRISPR gRNA sequence
gcagtggagaaggcgagaag

SEQ ID NO: 572775 - DNA, 20 bp, Artificial
  CRISPR gRNA sequence
cagtggagaaggcgagaagt

SEQ ID NO: 572776 - DNA, 20 bp, Artificial
  CRISPR gRNA sequence
tggagaaggcgagaagtggg

SEQ ID NO: 572777 - DNA, 20 bp, Artificial
  CRISPR gRNA sequence
gcgagaagtgggtagattct

SEQ ID NO: 572778 - DNA, 20 bp, Artificial
  CRISPR gRNA sequence
agattctgagacttaatctg

SEQ ID NO: 572779 - DNA, 20 bp, Artificial
  CRISPR gRNA sequence
tctgagacttaatctgaagc

SEQ ID NO: 572780 - DNA, 20 bp, Artificial
  CRISPR gRNA sequence
gacttaatctgaagctggat

SEQ ID NO: 572781 - DNA, 20 bp, Artificial
  CRISPR gRNA sequence
acttaatctgaagctggatc

SEQ ID NO: 572782 - DNA, 20 bp, Artificial
  CRISPR gRNA sequence
ttaatctgaagctggatcag

SEQ ID NO: 572783 - DNA, 20 bp, Artificial
  CRISPR gRNA sequence
atctgaagctggatcaggag

SEQ ID NO: 572784 - DNA, 20 bp, Artificial
  CRISPR gRNA sequence
agctggatcaggagcagtgc

SEQ ID NO: 572785 - DNA, 20 bp, Artificial
  CRISPR gRNA sequence
tggatcaggagcagtgctag

SEQ ID NO: 572786 - DNA, 20 bp, Artificial
  CRISPR gRNA sequence
caggagcagtgctagcagct

SEQ ID NO: 572787 - DNA, 20 bp, Artificial
  CRISPR gRNA sequence
cagtgctagcagcttggatg

SEQ ID NO: 572788 - DNA, 20 bp, Artificial
  CRISPR gRNA sequence
tgctagcagcttggatgtag

SEQ ID NO: 572789 - DNA, 20 bp, Artificial
  CRISPR gRNA sequence
gctagcagcttggatgtagt

SEQ ID NO: 572790 - DNA, 20 bp, Artificial
  CRISPR gRNA sequence
gcagcttggatgtagtgggc

SEQ ID NO: 572791 - DNA, 20 bp, Artificial
  CRISPR gRNA sequence
agcttggatgtagtgggcaa

SEQ ID NO: 572792 - DNA, 20 bp, Artificial
  CRISPR gRNA sequence
gcttggatgtagtgggcaag

SEQ ID NO: 572793 - DNA, 20 bp, Artificial
  CRISPR gRNA sequence
cttggatgtagtgggcaaga

SEQ ID NO: 572794 - DNA, 20 bp, Artificial
  CRISPR gRNA sequence
tggatgtagtgggcaagagg

SEQ ID NO: 572795 - DNA, 20 bp, Artificial
  CRISPR gRNA sequence
gatgtagtgggcaagaggga

SEQ ID NO: 572796 - DNA, 20 bp, Artificial
  CRISPR gRNA sequence
gtgggcaagagggagagtca

SEQ ID NO: 572797 - DNA, 20 bp, Artificial
  CRISPR gRNA sequence
gagggagagtcaaagtgaca

SEQ ID NO: 572798 - DNA, 20 bp, Artificial
  CRISPR gRNA sequence
agggagagtcaaagtgacat

SEQ ID NO: 572799 - DNA, 20 bp, Artificial
  CRISPR gRNA sequence
agtcaaagtgacatgggttt

SEQ ID NO: 572800 - DNA, 20 bp, Artificial
  CRISPR gRNA sequence
agtgacatgggttttagctt

SEQ ID NO: 572801 - DNA, 20 bp, Artificial
  CRISPR gRNA sequence
gacatgggttttagcttgag

SEQ ID NO: 572802 - DNA, 20 bp, Artificial
  CRISPR gRNA sequence
tgggttttagcttgagcagc

SEQ ID NO: 572803 - DNA, 20 bp, Artificial
  CRISPR gRNA sequence
gttttagcttgagcagctgg

SEQ ID NO: 572804 - DNA, 20 bp, Artificial
  CRISPR gRNA sequence
ttttagcttgagcagctgga

SEQ ID NO: 572805 - DNA, 20 bp, Artificial
  CRISPR gRNA sequence
cttgagcagctggaaggacc

SEQ ID NO: 572806 - DNA, 20 bp, Artificial
  CRISPR gRNA sequence
ggaccgagctgacattacct

SEQ ID NO: 572807 - DNA, 20 bp, Artificial
  CRISPR gRNA sequence
cgagctgacattacctgaga

SEQ ID NO: 572808 - DNA, 20 bp, Artificial
  CRISPR gRNA sequence
gagctgacattacctgagat

SEQ ID NO: 572809 - DNA, 20 bp, Artificial
  CRISPR gRNA sequence
agctgacattacctgagatg

SEQ ID NO: 572810 - DNA, 20 bp, Artificial
  CRISPR gRNA sequence
gctgacattacctgagatgg

SEQ ID NO: 572811 - DNA, 20 bp, Artificial
  CRISPR gRNA sequence
attacctgagatgggggaca

SEQ ID NO: 572812 - DNA, 20 bp, Artificial
  CRISPR gRNA sequence
acctgagatgggggacatgg

SEQ ID NO: 572813 - DNA, 20 bp, Artificial
  CRISPR gRNA sequence
cctgagatgggggacatggc

SEQ ID NO: 572814 - DNA, 20 bp, Artificial
  CRISPR gRNA sequence
ctgagatgggggacatggcg

SEQ ID NO: 572815 - DNA, 20 bp, Artificial
  CRISPR gRNA sequence
gagatgggggacatggcggg

SEQ ID NO: 572816 - DNA, 20 bp, Artificial
  CRISPR gRNA sequence
tgggggacatggcggggagt

SEQ ID NO: 572817 - DNA, 20 bp, Artificial
  CRISPR gRNA sequence
gacatggcggggagttggat

SEQ ID NO: 572818 - DNA, 20 bp, Artificial
  CRISPR gRNA sequence
acatggcggggagttggatt

SEQ ID NO: 572819 - DNA, 20 bp, Artificial
  CRISPR gRNA sequence
gggagttggattgggtgcaa

SEQ ID NO: 572820 - DNA, 20 bp, Artificial
  CRISPR gRNA sequence
ttggattgggtgcaaaagtg

SEQ ID NO: 572821 - DNA, 20 bp, Artificial
  CRISPR gRNA sequence
tggattgggtgcaaaagtgc

SEQ ID NO: 572822 - DNA, 20 bp, Artificial
  CRISPR gRNA sequence
tgggtgcaaaagtgcaggtg

SEQ ID NO: 572823 - DNA, 20 bp, Artificial
  CRISPR gRNA sequence
tgcaaaagtgcaggtgtaga

SEQ ID NO: 572824 - DNA, 20 bp, Artificial
  CRISPR gRNA sequence
tgcaggtgtagatagacatg

SEQ ID NO: 572825 - DNA, 20 bp, Artificial
  CRISPR gRNA sequence
caggtgtagatagacatgaa

SEQ ID NO: 572826 - DNA, 20 bp, Artificial
  CRISPR gRNA sequence
gtagatagacatgaagagtc

SEQ ID NO: 572827 - DNA, 20 bp, Artificial
  CRISPR gRNA sequence
gagtctggcattaaatatgt

SEQ ID NO: 572828 - DNA, 20 bp, Artificial
  CRISPR gRNA sequence
tctggcattaaatatgtgag

SEQ ID NO: 572829 - DNA, 20 bp, Artificial
  CRISPR gRNA sequence
tggcattaaatatgtgagtg

SEQ ID NO: 572830 - DNA, 20 bp, Artificial
  CRISPR gRNA sequence
ggcattaaatatgtgagtgg

SEQ ID NO: 572831 - DNA, 20 bp, Artificial
  CRISPR gRNA sequence
cattaaatatgtgagtggag

SEQ ID NO: 572832 - DNA, 20 bp, Artificial
  CRISPR gRNA sequence
aatatgtgagtggaggagct

SEQ ID NO: 572833 - DNA, 20 bp, Artificial
  CRISPR gRNA sequence
atatgtgagtggaggagctg

SEQ ID NO: 572834 - DNA, 20 bp, Artificial
  CRISPR gRNA sequence
tatgtgagtggaggagctga

SEQ ID NO: 572835 - DNA, 20 bp, Artificial
  CRISPR gRNA sequence
atgtgagtggaggagctgag

SEQ ID NO: 572836 - DNA, 20 bp, Artificial
  CRISPR gRNA sequence
tgtgagtggaggagctgagg

SEQ ID NO: 572837 - DNA, 20 bp, Artificial
  CRISPR gRNA sequence
gagtggaggagctgaggggg

SEQ ID NO: 572838 - DNA, 20 bp, Artificial
  CRISPR gRNA sequence
gctgagggggcagctgaata

SEQ ID NO: 572839 - DNA, 20 bp, Artificial
  CRISPR gRNA sequence
ctgagggggcagctgaatac

SEQ ID NO: 572840 - DNA, 20 bp, Artificial
  CRISPR gRNA sequence
tgagggggcagctgaatacg

SEQ ID NO: 572841 - DNA, 20 bp, Artificial
  CRISPR gRNA sequence
gagggggcagctgaatacgg

SEQ ID NO: 572842 - DNA, 20 bp, Artificial
  CRISPR gRNA sequence
ggcagctgaatacgggggtc

SEQ ID NO: 572843 - DNA, 20 bp, Artificial
  CRISPR gRNA sequence
gaatacgggggtctggatct

SEQ ID NO: 572844 - DNA, 20 bp, Artificial
  CRISPR gRNA sequence
aatacgggggtctggatctc

SEQ ID NO: 572845 - DNA, 20 bp, Artificial
  CRISPR gRNA sequence
atacgggggtctggatctca

SEQ ID NO: 572846 - DNA, 20 bp, Artificial
  CRISPR gRNA sequence
gggggtctggatctcagggc

SEQ ID NO: 572847 - DNA, 20 bp, Artificial
  CRISPR gRNA sequence
ggggtctggatctcagggca

SEQ ID NO: 572848 - DNA, 20 bp, Artificial
  CRISPR gRNA sequence
ggtctggatctcagggcaag

SEQ ID NO: 572849 - DNA, 20 bp, Artificial
  CRISPR gRNA sequence
gtctggatctcagggcaagg

SEQ ID NO: 572850 - DNA, 20 bp, Artificial
  CRISPR gRNA sequence
ggatctcagggcaaggaggc

SEQ ID NO: 572851 - DNA, 20 bp, Artificial
  CRISPR gRNA sequence
tcagggcaaggaggcgagtc

SEQ ID NO: 572852 - DNA, 20 bp, Artificial
  CRISPR gRNA sequence
cagggcaaggaggcgagtcc

SEQ ID NO: 572853 - DNA, 20 bp, Artificial
  CRISPR gRNA sequence
gggcaaggaggcgagtccag

SEQ ID NO: 572854 - DNA, 20 bp, Artificial
  CRISPR gRNA sequence
tccaggagtgtgatcatgca

SEQ ID NO: 572855 - DNA, 20 bp, Artificial
  CRISPR gRNA sequence
agtgtgatcatgcacggatc

SEQ ID NO: 572856 - DNA, 20 bp, Artificial
  CRISPR gRNA sequence
gatcatgcacggatccagca

SEQ ID NO: 572857 - DNA, 20 bp, Artificial
  CRISPR gRNA sequence
atgcacggatccagcatggc

SEQ ID NO: 572858 - DNA, 20 bp, Artificial
  CRISPR gRNA sequence
ggatccagcatggcaagtga

SEQ ID NO: 572859 - DNA, 20 bp, Artificial
  CRISPR gRNA sequence
atccagcatggcaagtgaca

SEQ ID NO: 572860 - DNA, 20 bp, Artificial
  CRISPR gRNA sequence
ccagcatggcaagtgacaga

SEQ ID NO: 572861 - DNA, 20 bp, Artificial
  CRISPR gRNA sequence
cagcatggcaagtgacagag

SEQ ID NO: 572862 - DNA, 20 bp, Artificial
  CRISPR gRNA sequence
gcatggcaagtgacagagag

SEQ ID NO: 572863 - DNA, 20 bp, Artificial
  CRISPR gRNA sequence
catggcaagtgacagagagg

SEQ ID NO: 572864 - DNA, 20 bp, Artificial
  CRISPR gRNA sequence
tggcaagtgacagagaggag

SEQ ID NO: 572865 - DNA, 20 bp, Artificial
  CRISPR gRNA sequence
gcaagtgacagagaggagga

SEQ ID NO: 572866 - DNA, 20 bp, Artificial
  CRISPR gRNA sequence
gtgacagagaggaggagaga

SEQ ID NO: 572867 - DNA, 20 bp, Artificial
  CRISPR gRNA sequence
tgacagagaggaggagagat

SEQ ID NO: 572868 - DNA, 20 bp, Artificial
  CRISPR gRNA sequence
gacagagaggaggagagatg

SEQ ID NO: 572869 - DNA, 20 bp, Artificial
  CRISPR gRNA sequence
gaggagagatggggtctctt

SEQ ID NO: 572870 - DNA, 20 bp, Artificial
  CRISPR gRNA sequence
agagatggggtctcttgagc

SEQ ID NO: 572871 - DNA, 20 bp, Artificial
  CRISPR gRNA sequence
gagatggggtctcttgagct

SEQ ID NO: 572872 - DNA, 20 bp, Artificial
  CRISPR gRNA sequence
agatggggtctcttgagctg

SEQ ID NO: 572873 - DNA, 20 bp, Artificial
  CRISPR gRNA sequence
gtctcttgagctggggcctg

SEQ ID NO: 572874 - DNA, 20 bp, Artificial
  CRISPR gRNA sequence
tcttgagctggggcctgtag

SEQ ID NO: 572875 - DNA, 20 bp, Artificial
  CRISPR gRNA sequence
cctgtagaagcttctctacc

SEQ ID NO: 572876 - DNA, 20 bp, Artificial
  CRISPR gRNA sequence
cttctctacccagcccccat

SEQ ID NO: 572877 - DNA, 20 bp, Artificial
  CRISPR gRNA sequence
tctctacccagcccccatca

SEQ ID NO: 572878 - DNA, 20 bp, Artificial
  CRISPR gRNA sequence
tcagagttcaccccaatttc

SEQ ID NO: 572879 - DNA, 20 bp, Artificial
  CRISPR gRNA sequence
caccccaatttctggccctc

SEQ ID NO: 572880 - DNA, 20 bp, Artificial
  CRISPR gRNA sequence
caatttctggccctcaagcc

SEQ ID NO: 572881 - DNA, 20 bp, Artificial
  CRISPR gRNA sequence
cttctcctctttccctgtcc

SEQ ID NO: 572882 - DNA, 20 bp, Artificial
  CRISPR gRNA sequence
tttccctgtccaagccacgc

SEQ ID NO: 572883 - DNA, 20 bp, Artificial
  CRISPR gRNA sequence
ttctattgtcctcaccttga

SEQ ID NO: 572884 - DNA, 20 bp, Artificial
  CRISPR gRNA sequence
accttgaaagccctccacaa

SEQ ID NO: 572885 - DNA, 20 bp, Artificial
  CRISPR gRNA sequence
aaagccctccacaatggctc

SEQ ID NO: 572886 - DNA, 20 bp, Artificial
  CRISPR gRNA sequence
aagccctccacaatggctcc

SEQ ID NO: 572887 - DNA, 20 bp, Artificial
  CRISPR gRNA sequence
atggctccgggccccctgct

SEQ ID NO: 572888 - DNA, 20 bp, Artificial
  CRISPR gRNA sequence
ccgggccccctgctgagccc

SEQ ID NO: 572889 - DNA, 20 bp, Artificial
  CRISPR gRNA sequence
cccagaaccttccactccct

SEQ ID NO: 572890 - DNA, 20 bp, Artificial
  CRISPR gRNA sequence
ccagaaccttccactccctg

SEQ ID NO: 572891 - DNA, 20 bp, Artificial
  CRISPR gRNA sequence
cagaaccttccactccctga

SEQ ID NO: 572892 - DNA, 20 bp, Artificial
  CRISPR gRNA sequence
aaccttccactccctgaggg

SEQ ID NO: 572893 - DNA, 20 bp, Artificial
  CRISPR gRNA sequence
ccactccctgagggaagcac

SEQ ID NO: 572894 - DNA, 20 bp, Artificial
  CRISPR gRNA sequence
tgagggaagcactggctttt

SEQ ID NO: 572895 - DNA, 20 bp, Artificial
  CRISPR gRNA sequence
gagggaagcactggcttttc

SEQ ID NO: 572896 - DNA, 20 bp, Artificial
  CRISPR gRNA sequence
ttttcaggatcctataatcc

SEQ ID NO: 572897 - DNA, 20 bp, Artificial
  CRISPR gRNA sequence
ggatcctataatcctggtct

SEQ ID NO: 572898 - DNA, 20 bp, Artificial
  CRISPR gRNA sequence
atcctataatcctggtctga

SEQ ID NO: 572899 - DNA, 20 bp, Artificial
  CRISPR gRNA sequence
tcctataatcctggtctgag

SEQ ID NO: 572900 - DNA, 20 bp, Artificial
  CRISPR gRNA sequence
tataatcctggtctgagagg

SEQ ID NO: 572901 - DNA, 20 bp, Artificial
  CRISPR gRNA sequence
atcctggtctgagaggaagc

SEQ ID NO: 572902 - DNA, 20 bp, Artificial
  CRISPR gRNA sequence
cctggtctgagaggaagcca

SEQ ID NO: 572903 - DNA, 20 bp, Artificial
  CRISPR gRNA sequence
gtctgagaggaagccagagc

SEQ ID NO: 572904 - DNA, 20 bp, Artificial
  CRISPR gRNA sequence
tgagaggaagccagagctgg

SEQ ID NO: 572905 - DNA, 20 bp, Artificial
  CRISPR gRNA sequence
gagaggaagccagagctgga

SEQ ID NO: 572906 - DNA, 20 bp, Artificial
  CRISPR gRNA sequence
agaggaagccagagctggaa

SEQ ID NO: 572907 - DNA, 20 bp, Artificial
  CRISPR gRNA sequence
cagagctggaagggactgcc

SEQ ID NO: 572908 - DNA, 20 bp, Artificial
  CRISPR gRNA sequence
gcccagccaaccccattata

SEQ ID NO: 572909 - DNA, 20 bp, Artificial
  CRISPR gRNA sequence
cagccaaccccattatacag

SEQ ID NO: 572910 - DNA, 20 bp, Artificial
  CRISPR gRNA sequence
agccaaccccattatacaga

SEQ ID NO: 572911 - DNA, 20 bp, Artificial
  CRISPR gRNA sequence
gccaaccccattatacagaa

SEQ ID NO: 572912 - DNA, 20 bp, Artificial
  CRISPR gRNA sequence
ccaaccccattatacagaag

SEQ ID NO: 572913 - DNA, 20 bp, Artificial
  CRISPR gRNA sequence
attatacagaaggggatgct

SEQ ID NO: 572914 - DNA, 20 bp, Artificial
  CRISPR gRNA sequence
gaaggggatgctcagatgcc

SEQ ID NO: 572915 - DNA, 20 bp, Artificial
  CRISPR gRNA sequence
tgctcagatgccgagttccg

SEQ ID NO: 572916 - DNA, 20 bp, Artificial
  CRISPR gRNA sequence
tgccgagttccgtagtccca

SEQ ID NO: 572917 - DNA, 20 bp, Artificial
  CRISPR gRNA sequence
ccgtagtcccatagtgactt

SEQ ID NO: 572918 - DNA, 20 bp, Artificial
  CRISPR gRNA sequence
gagaactccacttctttctt

SEQ ID NO: 572919 - DNA, 20 bp, Artificial
  CRISPR gRNA sequence
agaactccacttctttcttt

SEQ ID NO: 572920 - DNA, 20 bp, Artificial
  CRISPR gRNA sequence
actccacttctttctttagg

SEQ ID NO: 572921 - DNA, 20 bp, Artificial
  CRISPR gRNA sequence
tgcacattttataaactctc

SEQ ID NO: 572922 - DNA, 20 bp, Artificial
  CRISPR gRNA sequence
catctccccgttccacctca

SEQ ID NO: 572923 - DNA, 20 bp, Artificial
  CRISPR gRNA sequence
ccgttccacctcacagcact

SEQ ID NO: 572924 - DNA, 20 bp, Artificial
  CRISPR gRNA sequence
tccacctcacagcactgagt

SEQ ID NO: 572925 - DNA, 20 bp, Artificial
  CRISPR gRNA sequence
ccacctcacagcactgagtt

SEQ ID NO: 572926 - DNA, 20 bp, Artificial
  CRISPR gRNA sequence
acagcactgagttgggcaca

SEQ ID NO: 572927 - DNA, 20 bp, Artificial
  CRISPR gRNA sequence
gagttgggcacacagctgct

SEQ ID NO: 572928 - DNA, 20 bp, Artificial
  CRISPR gRNA sequence
gttgggcacacagctgctga

SEQ ID NO: 572929 - DNA, 20 bp, Artificial
  CRISPR gRNA sequence
gggcacacagctgctgagag

SEQ ID NO: 572930 - DNA, 20 bp, Artificial
  CRISPR gRNA sequence
cacagctgctgagagcagcc

SEQ ID NO: 572931 - DNA, 20 bp, Artificial
  CRISPR gRNA sequence
acagctgctgagagcagccc

SEQ ID NO: 572932 - DNA, 20 bp, Artificial
  CRISPR gRNA sequence
cagctgctgagagcagcccg

SEQ ID NO: 572933 - DNA, 20 bp, Artificial
  CRISPR gRNA sequence
agctgctgagagcagcccgg

SEQ ID NO: 572934 - DNA, 20 bp, Artificial
  CRISPR gRNA sequence
ctgctgagagcagcccgggg

SEQ ID NO: 572935 - DNA, 20 bp, Artificial
  CRISPR gRNA sequence
gagagcagcccgggggagta

SEQ ID NO: 572936 - DNA, 20 bp, Artificial
  CRISPR gRNA sequence
agcagcccgggggagtatag

SEQ ID NO: 572937 - DNA, 20 bp, Artificial
  CRISPR gRNA sequence
gcagcccgggggagtataga

SEQ ID NO: 572938 - DNA, 20 bp, Artificial
  CRISPR gRNA sequence
cagcccgggggagtatagaa

SEQ ID NO: 572939 - DNA, 20 bp, Artificial
  CRISPR gRNA sequence
gggggagtatagaagggttc

SEQ ID NO: 572940 - DNA, 20 bp, Artificial
  CRISPR gRNA sequence
ggggagtatagaagggttct

SEQ ID NO: 572941 - DNA, 20 bp, Artificial
  CRISPR gRNA sequence
gggagtatagaagggttctg

SEQ ID NO: 572942 - DNA, 20 bp, Artificial
  CRISPR gRNA sequence
ggagtatagaagggttctgg

SEQ ID NO: 572943 - DNA, 20 bp, Artificial
  CRISPR gRNA sequence
agtatagaagggttctgggg

SEQ ID NO: 572944 - DNA, 20 bp, Artificial
  CRISPR gRNA sequence
atagaagggttctgggggag

SEQ ID NO: 572945 - DNA, 20 bp, Artificial
  CRISPR gRNA sequence
ctttctttgctgtcacctcc

SEQ ID NO: 572946 - DNA, 20 bp, Artificial
  CRISPR gRNA sequence
tttctttgctgtcacctcct

SEQ ID NO: 572947 - DNA, 20 bp, Artificial
  CRISPR gRNA sequence
ttctttgctgtcacctcctg

SEQ ID NO: 572948 - DNA, 20 bp, Artificial
  CRISPR gRNA sequence
tctttgctgtcacctcctgg

SEQ ID NO: 572949 - DNA, 20 bp, Artificial
  CRISPR gRNA sequence
ttgctgtcacctcctggggg

SEQ ID NO: 572950 - DNA, 20 bp, Artificial
  CRISPR gRNA sequence
cacctcctgggggtggttgt

SEQ ID NO: 572951 - DNA, 20 bp, Artificial
  CRISPR gRNA sequence
cctcctgggggtggttgtca

SEQ ID NO: 572952 - DNA, 20 bp, Artificial
  CRISPR gRNA sequence
gggggtggttgtcagagctg

SEQ ID NO: 572953 - DNA, 20 bp, Artificial
  CRISPR gRNA sequence
gttgtcagagctgtggtgct

SEQ ID NO: 572954 - DNA, 20 bp, Artificial
  CRISPR gRNA sequence
ttgtcagagctgtggtgctg

SEQ ID NO: 572955 - DNA, 20 bp, Artificial
  CRISPR gRNA sequence
tgtcagagctgtggtgctga

SEQ ID NO: 572956 - DNA, 20 bp, Artificial
  CRISPR gRNA sequence
tcagagctgtggtgctgagg

SEQ ID NO: 572957 - DNA, 20 bp, Artificial
  CRISPR gRNA sequence
gctgtggtgctgagggagat

SEQ ID NO: 572958 - DNA, 20 bp, Artificial
  CRISPR gRNA sequence
gtgctgagggagatgagtgt

SEQ ID NO: 572959 - DNA, 20 bp, Artificial
  CRISPR gRNA sequence
gggagatgagtgtgagaatc

SEQ ID NO: 572960 - DNA, 20 bp, Artificial
  CRISPR gRNA sequence
ggagatgagtgtgagaatcc

SEQ ID NO: 572961 - DNA, 20 bp, Artificial
  CRISPR gRNA sequence
agtgtgagaatccaggtatt

SEQ ID NO: 572962 - DNA, 20 bp, Artificial
  CRISPR gRNA sequence
gaatccaggtattaagttct

SEQ ID NO: 572963 - DNA, 20 bp, Artificial
  CRISPR gRNA sequence
gtattaagttcttagtctcc

SEQ ID NO: 572964 - DNA, 20 bp, Artificial
  CRISPR gRNA sequence
tattaagttcttagtctcct

SEQ ID NO: 572965 - DNA, 20 bp, Artificial
  CRISPR gRNA sequence
attaagttcttagtctcctg

SEQ ID NO: 572966 - DNA, 20 bp, Artificial
  CRISPR gRNA sequence
ttaagttcttagtctcctgg

SEQ ID NO: 572967 - DNA, 20 bp, Artificial
  CRISPR gRNA sequence
ttcttagtctcctgggggct

SEQ ID NO: 572968 - DNA, 20 bp, Artificial
  CRISPR gRNA sequence
ggcttagaacattactgcgt

SEQ ID NO: 572969 - DNA, 20 bp, Artificial
  CRISPR gRNA sequence
gaacattactgcgtgagaaa

SEQ ID NO: 572970 - DNA, 20 bp, Artificial
  CRISPR gRNA sequence
aacattactgcgtgagaaac

SEQ ID NO: 572971 - DNA, 20 bp, Artificial
  CRISPR gRNA sequence
cattactgcgtgagaaacag

SEQ ID NO: 572972 - DNA, 20 bp, Artificial
  CRISPR gRNA sequence
ctgcgtgagaaacaggagtg

SEQ ID NO: 572973 - DNA, 20 bp, Artificial
  CRISPR gRNA sequence
tgcgtgagaaacaggagtgt

SEQ ID NO: 572974 - DNA, 20 bp, Artificial
  CRISPR gRNA sequence
gaaacaggagtgtgggtctg

SEQ ID NO: 572975 - DNA, 20 bp, Artificial
  CRISPR gRNA sequence
aacaggagtgtgggtctgtg

SEQ ID NO: 572976 - DNA, 20 bp, Artificial
  CRISPR gRNA sequence
acaggagtgtgggtctgtgg

SEQ ID NO: 572977 - DNA, 20 bp, Artificial
  CRISPR gRNA sequence
ggtctgtggaggctccgaac

SEQ ID NO: 572978 - DNA, 20 bp, Artificial
  CRISPR gRNA sequence
gtctgtggaggctccgaaca

SEQ ID NO: 572979 - DNA, 20 bp, Artificial
  CRISPR gRNA sequence
tctgtggaggctccgaacaa

SEQ ID NO: 572980 - DNA, 20 bp, Artificial
  CRISPR gRNA sequence
ggaggctccgaacaagggcc

SEQ ID NO: 572981 - DNA, 20 bp, Artificial
  CRISPR gRNA sequence
gaggctccgaacaagggcct

SEQ ID NO: 572982 - DNA, 20 bp, Artificial
  CRISPR gRNA sequence
ggctccgaacaagggcctgg

SEQ ID NO: 572983 - DNA, 20 bp, Artificial
  CRISPR gRNA sequence
ctccgaacaagggcctggga

SEQ ID NO: 572984 - DNA, 20 bp, Artificial
  CRISPR gRNA sequence
acaagggcctgggagagcac

SEQ ID NO: 572985 - DNA, 20 bp, Artificial
  CRISPR gRNA sequence
gggcctgggagagcactggt

SEQ ID NO: 572986 - DNA, 20 bp, Artificial
  CRISPR gRNA sequence
tgggagagcactggtgagat

SEQ ID NO: 572987 - DNA, 20 bp, Artificial
  CRISPR gRNA sequence
gagagcactggtgagatgag

SEQ ID NO: 572988 - DNA, 20 bp, Artificial
  CRISPR gRNA sequence
agagcactggtgagatgaga

SEQ ID NO: 572989 - DNA, 20 bp, Artificial
  CRISPR gRNA sequence
cactggtgagatgagaaggt

SEQ ID NO: 572990 - DNA, 20 bp, Artificial
  CRISPR gRNA sequence
agaaggtgagtgaatgaatg

SEQ ID NO: 572991 - DNA, 20 bp, Artificial
  CRISPR gRNA sequence
ggtgagtgaatgaatgaagc

SEQ ID NO: 572992 - DNA, 20 bp, Artificial
  CRISPR gRNA sequence
tgagtgaatgaatgaagcca

SEQ ID NO: 572993 - DNA, 20 bp, Artificial
  CRISPR gRNA sequence
tgaatgaatgaagccagaga

SEQ ID NO: 572994 - DNA, 20 bp, Artificial
  CRISPR gRNA sequence
gaatgaatgaagccagagat

SEQ ID NO: 572995 - DNA, 20 bp, Artificial
  CRISPR gRNA sequence
aatgaatgaagccagagatg

SEQ ID NO: 572996 - DNA, 20 bp, Artificial
  CRISPR gRNA sequence
agatggggtgatgctccttc

SEQ ID NO: 572997 - DNA, 20 bp, Artificial
  CRISPR gRNA sequence
gggtgatgctccttcaagcc

SEQ ID NO: 572998 - DNA, 20 bp, Artificial
  CRISPR gRNA sequence
cttcaagccaagaaataaca

SEQ ID NO: 572999 - DNA, 20 bp, Artificial
  CRISPR gRNA sequence
caagaaataacaaagattgc

SEQ ID NO: 573000 - DNA, 20 bp, Artificial
  CRISPR gRNA sequence
caaagattgccagcaaccac

SEQ ID NO: 573001 - DNA, 20 bp, Artificial
  CRISPR gRNA sequence
agattgccagcaaccaccag

SEQ ID NO: 573002 - DNA, 20 bp, Artificial
  CRISPR gRNA sequence
tgccagcaaccaccagaagc

SEQ ID NO: 573003 - DNA, 20 bp, Artificial
  CRISPR gRNA sequence
gccagcaaccaccagaagct

SEQ ID NO: 573004 - DNA, 20 bp, Artificial
  CRISPR gRNA sequence
ccagcaaccaccagaagctg

SEQ ID NO: 573005 - DNA, 20 bp, Artificial
  CRISPR gRNA sequence
cagcaaccaccagaagctgg

SEQ ID NO: 573006 - DNA, 20 bp, Artificial
  CRISPR gRNA sequence
gcaaccaccagaagctgggg

SEQ ID NO: 573007 - DNA, 20 bp, Artificial
  CRISPR gRNA sequence
aaccaccagaagctggggga

SEQ ID NO: 573008 - DNA, 20 bp, Artificial
  CRISPR gRNA sequence
accaccagaagctgggggag

SEQ ID NO: 573009 - DNA, 20 bp, Artificial
  CRISPR gRNA sequence
cagaagctgggggagaggcc

SEQ ID NO: 573010 - DNA, 20 bp, Artificial
  CRISPR gRNA sequence
gaagctgggggagaggcctg

SEQ ID NO: 573011 - DNA, 20 bp, Artificial
  CRISPR gRNA sequence
gctgggggagaggcctggag

SEQ ID NO: 573012 - DNA, 20 bp, Artificial
  CRISPR gRNA sequence
ctggagcagcttctccctta

SEQ ID NO: 573013 - DNA, 20 bp, Artificial
  CRISPR gRNA sequence
agcttctcccttatggcccc

SEQ ID NO: 573014 - DNA, 20 bp, Artificial
  CRISPR gRNA sequence
ttctcccttatggcccccag

SEQ ID NO: 573015 - DNA, 20 bp, Artificial
  CRISPR gRNA sequence
tctcccttatggcccccaga

SEQ ID NO: 573016 - DNA, 20 bp, Artificial
  CRISPR gRNA sequence
cccccagaaggaaccaaccc

SEQ ID NO: 573017 - DNA, 20 bp, Artificial
  CRISPR gRNA sequence
ccctggcaacaccttgatct

SEQ ID NO: 573018 - DNA, 20 bp, Artificial
  CRISPR gRNA sequence
aacaccttgatcttggactc

SEQ ID NO: 573019 - DNA, 20 bp, Artificial
  CRISPR gRNA sequence
tgatcttggactctggcctc

SEQ ID NO: 573020 - DNA, 20 bp, Artificial
  CRISPR gRNA sequence
actctggcctccagaactgt

SEQ ID NO: 573021 - DNA, 20 bp, Artificial
  CRISPR gRNA sequence
atgatcaatttctgttgctg

SEQ ID NO: 573022 - DNA, 20 bp, Artificial
  CRISPR gRNA sequence
tttctgttgctgaagccact

SEQ ID NO: 573023 - DNA, 20 bp, Artificial
  CRISPR gRNA sequence
ttgctgaagccactcagttg

SEQ ID NO: 573024 - DNA, 20 bp, Artificial
  CRISPR gRNA sequence
tcagttgtggtactttgtta

SEQ ID NO: 573025 - DNA, 20 bp, Artificial
  CRISPR gRNA sequence
gttgtggtactttgttatag

SEQ ID NO: 573026 - DNA, 20 bp, Artificial
  CRISPR gRNA sequence
tggtactttgttatagcagc

SEQ ID NO: 573027 - DNA, 20 bp, Artificial
  CRISPR gRNA sequence
gaacaaactaataccgattt

SEQ ID NO: 573028 - DNA, 20 bp, Artificial
  CRISPR gRNA sequence
aataccgatttcggtgcaaa

SEQ ID NO: 573029 - DNA, 20 bp, Artificial
  CRISPR gRNA sequence
atggatgttttccaccactc

SEQ ID NO: 573030 - DNA, 20 bp, Artificial
  CRISPR gRNA sequence
tgttttccaccactctggcc

SEQ ID NO: 573031 - DNA, 20 bp, Artificial
  CRISPR gRNA sequence
ccactctggcctggcccatg

SEQ ID NO: 573032 - DNA, 20 bp, Artificial
  CRISPR gRNA sequence
tctggcctggcccatgtggc

SEQ ID NO: 573033 - DNA, 20 bp, Artificial
  CRISPR gRNA sequence
tggcccatgtggctggcctg

SEQ ID NO: 573034 - DNA, 20 bp, Artificial
  CRISPR gRNA sequence
ctggcctgtggtcacttctg

SEQ ID NO: 573035 - DNA, 20 bp, Artificial
  CRISPR gRNA sequence
tggtcacttctgaagctgcc

SEQ ID NO: 573036 - DNA, 20 bp, Artificial
  CRISPR gRNA sequence
tctgaagctgcctggacact

SEQ ID NO: 573037 - DNA, 20 bp, Artificial
  CRISPR gRNA sequence
aagctgcctggacacttggc

SEQ ID NO: 573038 - DNA, 20 bp, Artificial
  CRISPR gRNA sequence
gctgcctggacacttggcca

SEQ ID NO: 573039 - DNA, 20 bp, Artificial
  CRISPR gRNA sequence
ctggacacttggccagagct

SEQ ID NO: 573040 - DNA, 20 bp, Artificial
  CRISPR gRNA sequence
gaattctccccaaacacatg

SEQ ID NO: 573041 - DNA, 20 bp, Artificial
  CRISPR gRNA sequence
aattctccccaaacacatgt

SEQ ID NO: 573042 - DNA, 20 bp, Artificial
  CRISPR gRNA sequence
ctccccaaacacatgtggga

SEQ ID NO: 573043 - DNA, 20 bp, Artificial
  CRISPR gRNA sequence
acatgtgggatggcctgact

SEQ ID NO: 573044 - DNA, 20 bp, Artificial
  CRISPR gRNA sequence
tgggatggcctgactcagca

SEQ ID NO: 573045 - DNA, 20 bp, Artificial
  CRISPR gRNA sequence
tggcctgactcagcaaagca

SEQ ID NO: 573046 - DNA, 20 bp, Artificial
  CRISPR gRNA sequence
gcaaagcatagatacattct

SEQ ID NO: 573047 - DNA, 20 bp, Artificial
  CRISPR gRNA sequence
agcatagatacattctcaga

SEQ ID NO: 573048 - DNA, 20 bp, Artificial
  CRISPR gRNA sequence
gcatagatacattctcagac

SEQ ID NO: 573049 - DNA, 20 bp, Artificial
  CRISPR gRNA sequence
catagatacattctcagaca

SEQ ID NO: 573050 - DNA, 20 bp, Artificial
  CRISPR gRNA sequence
tacattctcagacagggaca

SEQ ID NO: 573051 - DNA, 20 bp, Artificial
  CRISPR gRNA sequence
cattctcagacagggacatg

SEQ ID NO: 573052 - DNA, 20 bp, Artificial
  CRISPR gRNA sequence
ggacatggagatgatctgtc

SEQ ID NO: 573053 - DNA, 20 bp, Artificial
  CRISPR gRNA sequence
gacatggagatgatctgtct

SEQ ID NO: 573054 - DNA, 20 bp, Artificial
  CRISPR gRNA sequence
acatggagatgatctgtctg

SEQ ID NO: 573055 - DNA, 20 bp, Artificial
  CRISPR gRNA sequence
catggagatgatctgtctgg

SEQ ID NO: 573056 - DNA, 20 bp, Artificial
  CRISPR gRNA sequence
ggagatgatctgtctggggg

SEQ ID NO: 573057 - DNA, 20 bp, Artificial
  CRISPR gRNA sequence
agatgatctgtctgggggta

SEQ ID NO: 573058 - DNA, 20 bp, Artificial
  CRISPR gRNA sequence
gatgatctgtctgggggtag

SEQ ID NO: 573059 - DNA, 20 bp, Artificial
  CRISPR gRNA sequence
ctgtctgggggtagaggacc

SEQ ID NO: 573060 - DNA, 20 bp, Artificial
  CRISPR gRNA sequence
gtctgggggtagaggaccta

SEQ ID NO: 573061 - DNA, 20 bp, Artificial
  CRISPR gRNA sequence
tctgggggtagaggacctag

SEQ ID NO: 573062 - DNA, 20 bp, Artificial
  CRISPR gRNA sequence
ctgggggtagaggacctaga

SEQ ID NO: 573063 - DNA, 20 bp, Artificial
  CRISPR gRNA sequence
gggtagaggacctagagggc

SEQ ID NO: 573064 - DNA, 20 bp, Artificial
  CRISPR gRNA sequence
ggtagaggacctagagggcc

SEQ ID NO: 573065 - DNA, 20 bp, Artificial
  CRISPR gRNA sequence
gaggacctagagggccgggc

SEQ ID NO: 573066 - DNA, 20 bp, Artificial
  CRISPR gRNA sequence
aggacctagagggccgggct

SEQ ID NO: 573067 - DNA, 20 bp, Artificial
  CRISPR gRNA sequence
acctagagggccgggctggg

SEQ ID NO: 573068 - DNA, 20 bp, Artificial
  CRISPR gRNA sequence
agagggccgggctgggcagc

SEQ ID NO: 573069 - DNA, 20 bp, Artificial
  CRISPR gRNA sequence
cggcttcctgcactgtctgt

SEQ ID NO: 573070 - DNA, 20 bp, Artificial
  CRISPR gRNA sequence
ggcttcctgcactgtctgtt

SEQ ID NO: 573071 - DNA, 20 bp, Artificial
  CRISPR gRNA sequence
ttgggacgtccctttctgac

SEQ ID NO: 573072 - DNA, 20 bp, Artificial
  CRISPR gRNA sequence
tgggacgtccctttctgact

SEQ ID NO: 573073 - DNA, 20 bp, Artificial
  CRISPR gRNA sequence
ccctttctgactgggtttct

SEQ ID NO: 573074 - DNA, 20 bp, Artificial
  CRISPR gRNA sequence
tttctgactgggtttctcag

SEQ ID NO: 573075 - DNA, 20 bp, Artificial
  CRISPR gRNA sequence
tgggtttctcagaagctgaa

SEQ ID NO: 573076 - DNA, 20 bp, Artificial
  CRISPR gRNA sequence
gggtttctcagaagctgaat

SEQ ID NO: 573077 - DNA, 20 bp, Artificial
  CRISPR gRNA sequence
ggtttctcagaagctgaatg

SEQ ID NO: 573078 - DNA, 20 bp, Artificial
  CRISPR gRNA sequence
gtttctcagaagctgaatgg

SEQ ID NO: 573079 - DNA, 20 bp, Artificial
  CRISPR gRNA sequence
agctgaatgggggatgtttc

SEQ ID NO: 573080 - DNA, 20 bp, Artificial
  CRISPR gRNA sequence
gctgaatgggggatgtttct

SEQ ID NO: 573081 - DNA, 20 bp, Artificial
  CRISPR gRNA sequence
tgggggatgtttctgggaca

SEQ ID NO: 573082 - DNA, 20 bp, Artificial
  CRISPR gRNA sequence
cacagattatgttttcatat

SEQ ID NO: 573083 - DNA, 20 bp, Artificial
  CRISPR gRNA sequence
acagattatgttttcatatc

SEQ ID NO: 573084 - DNA, 20 bp, Artificial
  CRISPR gRNA sequence
cagattatgttttcatatcg

SEQ ID NO: 573085 - DNA, 20 bp, Artificial
  CRISPR gRNA sequence
ttcatatcggggtctgcatc

SEQ ID NO: 573086 - DNA, 20 bp, Artificial
  CRISPR gRNA sequence
tcatatcggggtctgcatct

SEQ ID NO: 573087 - DNA, 20 bp, Artificial
  CRISPR gRNA sequence
gcatctgggccctgttgtca

SEQ ID NO: 573088 - DNA, 20 bp, Artificial
  CRISPR gRNA sequence
gtcacagcccccgacttgcc

SEQ ID NO: 573089 - DNA, 20 bp, Artificial
  CRISPR gRNA sequence
tttttccgccattgacgtca

SEQ ID NO: 573090 - DNA, 20 bp, Artificial
  CRISPR gRNA sequence
ttccgccattgacgtcatgg

SEQ ID NO: 573091 - DNA, 20 bp, Artificial
  CRISPR gRNA sequence
gccattgacgtcatggcggc

SEQ ID NO: 573092 - DNA, 20 bp, Artificial
  CRISPR gRNA sequence
gtcatggcggccggatgcgc

SEQ ID NO: 573093 - DNA, 20 bp, Artificial
  CRISPR gRNA sequence
tcatggcggccggatgcgcc

SEQ ID NO: 573094 - DNA, 20 bp, Artificial
  CRISPR gRNA sequence
gccgggcttcatcgacacca

SEQ ID NO: 573095 - DNA, 20 bp, Artificial
  CRISPR gRNA sequence
cgggcttcatcgacaccacg

SEQ ID NO: 573096 - DNA, 20 bp, Artificial
  CRISPR gRNA sequence
gggcttcatcgacaccacgg

SEQ ID NO: 573097 - DNA, 20 bp, Artificial
  CRISPR gRNA sequence
cttcatcgacaccacggagg

SEQ ID NO: 573098 - DNA, 20 bp, Artificial
  CRISPR gRNA sequence
tcatcgacaccacggaggaa

SEQ ID NO: 573099 - DNA, 20 bp, Artificial
  CRISPR gRNA sequence
tcgacaccacggaggaagag

SEQ ID NO: 573100 - DNA, 20 bp, Artificial
  CRISPR gRNA sequence
gacaccacggaggaagagaa

SEQ ID NO: 573101 - DNA, 20 bp, Artificial
  CRISPR gRNA sequence
acaccacggaggaagagaag

SEQ ID NO: 573102 - DNA, 20 bp, Artificial
  CRISPR gRNA sequence
caccacggaggaagagaaga

SEQ ID NO: 573103 - DNA, 20 bp, Artificial
  CRISPR gRNA sequence
cacggaggaagagaagaggg

SEQ ID NO: 573104 - DNA, 20 bp, Artificial
  CRISPR gRNA sequence
agggcagataccccacccca

SEQ ID NO: 573105 - DNA, 20 bp, Artificial
  CRISPR gRNA sequence
gggcagataccccaccccac

SEQ ID NO: 573106 - DNA, 20 bp, Artificial
  CRISPR gRNA sequence
caccccacaggtttcgttcc

SEQ ID NO: 573107 - DNA, 20 bp, Artificial
  CRISPR gRNA sequence
acaggtttcgttccgagaac

SEQ ID NO: 573108 - DNA, 20 bp, Artificial
  CRISPR gRNA sequence
gaactggctgccctgtcctg

SEQ ID NO: 573109 - DNA, 20 bp, Artificial
  CRISPR gRNA sequence
ctggctgccctgtcctgcag

SEQ ID NO: 573110 - DNA, 20 bp, Artificial
  CRISPR gRNA sequence
tggctgccctgtcctgcagc

SEQ ID NO: 573111 - DNA, 20 bp, Artificial
  CRISPR gRNA sequence
gccctgtcctgcagcaggct

SEQ ID NO: 573112 - DNA, 20 bp, Artificial
  CRISPR gRNA sequence
gtcctgcagcaggcttggcc

SEQ ID NO: 573113 - DNA, 20 bp, Artificial
  CRISPR gRNA sequence
tcctgcagcaggcttggccc

SEQ ID NO: 573114 - DNA, 20 bp, Artificial
  CRISPR gRNA sequence
tgcagcaggcttggcccagg

SEQ ID NO: 573115 - DNA, 20 bp, Artificial
  CRISPR gRNA sequence
gcagcaggcttggcccaggt

SEQ ID NO: 573116 - DNA, 20 bp, Artificial
  CRISPR gRNA sequence
cagcaggcttggcccaggtg

SEQ ID NO: 573117 - DNA, 20 bp, Artificial
  CRISPR gRNA sequence
ttggcccaggtggggtgaca

SEQ ID NO: 573118 - DNA, 20 bp, Artificial
  CRISPR gRNA sequence
tggcccaggtggggtgacat

SEQ ID NO: 573119 - DNA, 20 bp, Artificial
  CRISPR gRNA sequence
aggtggggtgacatgggtgc

SEQ ID NO: 573120 - DNA, 20 bp, Artificial
  CRISPR gRNA sequence
tggggtgacatgggtgctgg

SEQ ID NO: 573121 - DNA, 20 bp, Artificial
  CRISPR gRNA sequence
gacatgggtgctggtggatg

SEQ ID NO: 573122 - DNA, 20 bp, Artificial
  CRISPR gRNA sequence
atgggtgctggtggatgtgg

SEQ ID NO: 573123 - DNA, 20 bp, Artificial
  CRISPR gRNA sequence
tgggtgctggtggatgtggt

SEQ ID NO: 573124 - DNA, 20 bp, Artificial
  CRISPR gRNA sequence
tgtggtaggtgatgtccatc

SEQ ID NO: 573125 - DNA, 20 bp, Artificial
  CRISPR gRNA sequence
gtccatctggccactatgac

SEQ ID NO: 573126 - DNA, 20 bp, Artificial
  CRISPR gRNA sequence
tggccactatgacaagcccc

SEQ ID NO: 573127 - DNA, 20 bp, Artificial
  CRISPR gRNA sequence
atgacaagcccctagctctg

SEQ ID NO: 573128 - DNA, 20 bp, Artificial
  CRISPR gRNA sequence
agcccctagctctgaagacc

SEQ ID NO: 573129 - DNA, 20 bp, Artificial
  CRISPR gRNA sequence
tctgaagacctggcccttct

SEQ ID NO: 573130 - DNA, 20 bp, Artificial
  CRISPR gRNA sequence
ctgaagacctggcccttctt

SEQ ID NO: 573131 - DNA, 20 bp, Artificial
  CRISPR gRNA sequence
acctggcccttcttgggttg

SEQ ID NO: 573132 - DNA, 20 bp, Artificial
  CRISPR gRNA sequence
ctggcccttcttgggttgtg

SEQ ID NO: 573133 - DNA, 20 bp, Artificial
  CRISPR gRNA sequence
ggcccttcttgggttgtgga

SEQ ID NO: 573134 - DNA, 20 bp, Artificial
  CRISPR gRNA sequence
gcccttcttgggttgtggag

SEQ ID NO: 573135 - DNA, 20 bp, Artificial
  CRISPR gRNA sequence
cttgggttgtggagaggacc

SEQ ID NO: 573136 - DNA, 20 bp, Artificial
  CRISPR gRNA sequence
ttgggttgtggagaggaccc

SEQ ID NO: 573137 - DNA, 20 bp, Artificial
  CRISPR gRNA sequence
gtggagaggacccaggtttg

SEQ ID NO: 573138 - DNA, 20 bp, Artificial
  CRISPR gRNA sequence
ggacccaggtttgaagctct

SEQ ID NO: 573139 - DNA, 20 bp, Artificial
  CRISPR gRNA sequence
acccaggtttgaagctctga

SEQ ID NO: 573140 - DNA, 20 bp, Artificial
  CRISPR gRNA sequence
gtttgaagctctgagagtgc

SEQ ID NO: 573141 - DNA, 20 bp, Artificial
  CRISPR gRNA sequence
tttgaagctctgagagtgcc

SEQ ID NO: 573142 - DNA, 20 bp, Artificial
  CRISPR gRNA sequence
gaagctctgagagtgccagg

SEQ ID NO: 573143 - DNA, 20 bp, Artificial
  CRISPR gRNA sequence
aagctctgagagtgccaggc

SEQ ID NO: 573144 - DNA, 20 bp, Artificial
  CRISPR gRNA sequence
agagtgccaggcaggctcca

SEQ ID NO: 573145 - DNA, 20 bp, Artificial
  CRISPR gRNA sequence
caggcaggctccacagatac

SEQ ID NO: 573146 - DNA, 20 bp, Artificial
  CRISPR gRNA sequence
aggcaggctccacagatact

SEQ ID NO: 573147 - DNA, 20 bp, Artificial
  CRISPR gRNA sequence
tccacagatactgggacccc

SEQ ID NO: 573148 - DNA, 20 bp, Artificial
  CRISPR gRNA sequence
ccacagatactgggacccct

SEQ ID NO: 573149 - DNA, 20 bp, Artificial
  CRISPR gRNA sequence
cacagatactgggacccctg

SEQ ID NO: 573150 - DNA, 20 bp, Artificial
  CRISPR gRNA sequence
ggacccctggggtcttcaaa

SEQ ID NO: 573151 - DNA, 20 bp, Artificial
  CRISPR gRNA sequence
gtcttcaaatagtataacac

SEQ ID NO: 573152 - DNA, 20 bp, Artificial
  CRISPR gRNA sequence
tcttcaaatagtataacacc

SEQ ID NO: 573153 - DNA, 20 bp, Artificial
  CRISPR gRNA sequence
atagtataacaccaggacct

SEQ ID NO: 573154 - DNA, 20 bp, Artificial
  CRISPR gRNA sequence
acaccaggacctcagaatca

SEQ ID NO: 573155 - DNA, 20 bp, Artificial
  CRISPR gRNA sequence
aggacctcagaatcatagaa

SEQ ID NO: 573156 - DNA, 20 bp, Artificial
  CRISPR gRNA sequence
aatcatagaacagcatttct

SEQ ID NO: 573157 - DNA, 20 bp, Artificial
  CRISPR gRNA sequence
aacagcatttcttagattta

SEQ ID NO: 573158 - DNA, 20 bp, Artificial
  CRISPR gRNA sequence
acagcatttcttagatttaa

SEQ ID NO: 573159 - DNA, 20 bp, Artificial
  CRISPR gRNA sequence
ttcttagatttaaaggatcc

SEQ ID NO: 573160 - DNA, 20 bp, Artificial
  CRISPR gRNA sequence
atcctagaatctcaaaacca

SEQ ID NO: 573161 - DNA, 20 bp, Artificial
  CRISPR gRNA sequence
aatctcaaaaccacagactg

SEQ ID NO: 573162 - DNA, 20 bp, Artificial
  CRISPR gRNA sequence
atctcaaaaccacagactgt

SEQ ID NO: 573163 - DNA, 20 bp, Artificial
  CRISPR gRNA sequence
tctcaaaaccacagactgtg

SEQ ID NO: 573164 - DNA, 20 bp, Artificial
  CRISPR gRNA sequence
accacagactgtggggtcta

SEQ ID NO: 573165 - DNA, 20 bp, Artificial
  CRISPR gRNA sequence
ctgtggggtctacggtccca

SEQ ID NO: 573166 - DNA, 20 bp, Artificial
  CRISPR gRNA sequence
ggtctacggtcccaaagtct

SEQ ID NO: 573167 - DNA, 20 bp, Artificial
  CRISPR gRNA sequence
tcccaaagtctcagtatgtg

SEQ ID NO: 573168 - DNA, 20 bp, Artificial
  CRISPR gRNA sequence
cccaaagtctcagtatgtgt

SEQ ID NO: 573169 - DNA, 20 bp, Artificial
  CRISPR gRNA sequence
aagtctcagtatgtgtaggc

SEQ ID NO: 573170 - DNA, 20 bp, Artificial
  CRISPR gRNA sequence
tatgtgtaggccagtgtccc

SEQ ID NO: 573171 - DNA, 20 bp, Artificial
  CRISPR gRNA sequence
tccctggtgtccaaactcct

SEQ ID NO: 573172 - DNA, 20 bp, Artificial
  CRISPR gRNA sequence
aactccttggaaccatctga

SEQ ID NO: 573173 - DNA, 20 bp, Artificial
  CRISPR gRNA sequence
ccttggaaccatctgaaagt

SEQ ID NO: 573174 - DNA, 20 bp, Artificial
  CRISPR gRNA sequence
cttggaaccatctgaaagtc

SEQ ID NO: 573175 - DNA, 20 bp, Artificial
  CRISPR gRNA sequence
ggaaccatctgaaagtcagg

SEQ ID NO: 573176 - DNA, 20 bp, Artificial
  CRISPR gRNA sequence
tcaggcagcttgctgcttca

SEQ ID NO: 573177 - DNA, 20 bp, Artificial
  CRISPR gRNA sequence
caggcagcttgctgcttcat

SEQ ID NO: 573178 - DNA, 20 bp, Artificial
  CRISPR gRNA sequence
aggcagcttgctgcttcata

SEQ ID NO: 573179 - DNA, 20 bp, Artificial
  CRISPR gRNA sequence
tcatagggcctcttgcctac

SEQ ID NO: 573180 - DNA, 20 bp, Artificial
  CRISPR gRNA sequence
catagggcctcttgcctacc

SEQ ID NO: 573181 - DNA, 20 bp, Artificial
  CRISPR gRNA sequence
ggcctcttgcctaccaggcc

SEQ ID NO: 573182 - DNA, 20 bp, Artificial
  CRISPR gRNA sequence
ttgcctaccaggcctggaaa

SEQ ID NO: 573183 - DNA, 20 bp, Artificial
  CRISPR gRNA sequence
gcctaccaggcctggaaaca

SEQ ID NO: 573184 - DNA, 20 bp, Artificial
  CRISPR gRNA sequence
accaggcctggaaacagagc

SEQ ID NO: 573185 - DNA, 20 bp, Artificial
  CRISPR gRNA sequence
ggaaacagagccagcctccc

SEQ ID NO: 573186 - DNA, 20 bp, Artificial
  CRISPR gRNA sequence
gaaacagagccagcctccct

SEQ ID NO: 573187 - DNA, 20 bp, Artificial
  CRISPR gRNA sequence
aaacagagccagcctcccta

SEQ ID NO: 573188 - DNA, 20 bp, Artificial
  CRISPR gRNA sequence
agccagcctccctagggcct

SEQ ID NO: 573189 - DNA, 20 bp, Artificial
  CRISPR gRNA sequence
ctcagtctccctgtccactc

SEQ ID NO: 573190 - DNA, 20 bp, Artificial
  CRISPR gRNA sequence
gaacaacgttcccaaataca

SEQ ID NO: 573191 - DNA, 20 bp, Artificial
  CRISPR gRNA sequence
caaatacatggccactccgc

SEQ ID NO: 573192 - DNA, 20 bp, Artificial
  CRISPR gRNA sequence
aatacatggccactccgcca

SEQ ID NO: 573193 - DNA, 20 bp, Artificial
  CRISPR gRNA sequence
catggccactccgccagaga

SEQ ID NO: 573194 - DNA, 20 bp, Artificial
  CRISPR gRNA sequence
cactccgccagagatggcaa

SEQ ID NO: 573195 - DNA, 20 bp, Artificial
  CRISPR gRNA sequence
actccgccagagatggcaac

SEQ ID NO: 573196 - DNA, 20 bp, Artificial
  CRISPR gRNA sequence
ctccgccagagatggcaaca

SEQ ID NO: 573197 - DNA, 20 bp, Artificial
  CRISPR gRNA sequence
tccgccagagatggcaacag

SEQ ID NO: 573198 - DNA, 20 bp, Artificial
  CRISPR gRNA sequence
ccgccagagatggcaacagg

SEQ ID NO: 573199 - DNA, 20 bp, Artificial
  CRISPR gRNA sequence
gccagagatggcaacagggg

SEQ ID NO: 573200 - DNA, 20 bp, Artificial
  CRISPR gRNA sequence
ccagagatggcaacaggggg

SEQ ID NO: 573201 - DNA, 20 bp, Artificial
  CRISPR gRNA sequence
agagatggcaacagggggag

SEQ ID NO: 573202 - DNA, 20 bp, Artificial
  CRISPR gRNA sequence
gagatggcaacagggggagg

SEQ ID NO: 573203 - DNA, 20 bp, Artificial
  CRISPR gRNA sequence
gatggcaacagggggaggag

SEQ ID NO: 573204 - DNA, 20 bp, Artificial
  CRISPR gRNA sequence
atggcaacagggggaggagg

SEQ ID NO: 573205 - DNA, 20 bp, Artificial
  CRISPR gRNA sequence
aacagggggaggaggaggtt

SEQ ID NO: 573206 - DNA, 20 bp, Artificial
  CRISPR gRNA sequence
acagggggaggaggaggttg

SEQ ID NO: 573207 - DNA, 20 bp, Artificial
  CRISPR gRNA sequence
ggggaggaggaggttgaggc

SEQ ID NO: 573208 - DNA, 20 bp, Artificial
  CRISPR gRNA sequence
ggttgaggctggtgtgcctt

SEQ ID NO: 573209 - DNA, 20 bp, Artificial
  CRISPR gRNA sequence
aggctggtgtgcctttggtc

SEQ ID NO: 573210 - DNA, 20 bp, Artificial
  CRISPR gRNA sequence
ggctggtgtgcctttggtct

SEQ ID NO: 573211 - DNA, 20 bp, Artificial
  CRISPR gRNA sequence
tgcctttggtctgggcctca

SEQ ID NO: 573212 - DNA, 20 bp, Artificial
  CRISPR gRNA sequence
gcctttggtctgggcctcat

SEQ ID NO: 573213 - DNA, 20 bp, Artificial
  CRISPR gRNA sequence
cctttggtctgggcctcatg

SEQ ID NO: 573214 - DNA, 20 bp, Artificial
  CRISPR gRNA sequence
ctttggtctgggcctcatgg

SEQ ID NO: 573215 - DNA, 20 bp, Artificial
  CRISPR gRNA sequence
tttggtctgggcctcatggg

SEQ ID NO: 573216 - DNA, 20 bp, Artificial
  CRISPR gRNA sequence
tggtctgggcctcatggggg

SEQ ID NO: 573217 - DNA, 20 bp, Artificial
  CRISPR gRNA sequence
ctgggcctcatggggggagc

SEQ ID NO: 573218 - DNA, 20 bp, Artificial
  CRISPR gRNA sequence
cctcatggggggagctggaa

SEQ ID NO: 573219 - DNA, 20 bp, Artificial
  CRISPR gRNA sequence
ggggggagctggaaaagcct

SEQ ID NO: 573220 - DNA, 20 bp, Artificial
  CRISPR gRNA sequence
agcctcagccttcgccaata

SEQ ID NO: 573221 - DNA, 20 bp, Artificial
  CRISPR gRNA sequence
cctcagccttcgccaataca

SEQ ID NO: 573222 - DNA, 20 bp, Artificial
  CRISPR gRNA sequence
gccaatacagagcccatcat

SEQ ID NO: 573223 - DNA, 20 bp, Artificial
  CRISPR gRNA sequence
gagcccatcatcagactctc

SEQ ID NO: 573224 - DNA, 20 bp, Artificial
  CRISPR gRNA sequence
gcccatcatcagactctcta

SEQ ID NO: 573225 - DNA, 20 bp, Artificial
  CRISPR gRNA sequence
cccatcatcagactctctag

SEQ ID NO: 573226 - DNA, 20 bp, Artificial
  CRISPR gRNA sequence
ccatcatcagactctctaga

SEQ ID NO: 573227 - DNA, 20 bp, Artificial
  CRISPR gRNA sequence
catcatcagactctctagag

SEQ ID NO: 573228 - DNA, 20 bp, Artificial
  CRISPR gRNA sequence
tctagaggggccccacaatc

SEQ ID NO: 573229 - DNA, 20 bp, Artificial
  CRISPR gRNA sequence
ctagaggggccccacaatca

SEQ ID NO: 573230 - DNA, 20 bp, Artificial
  CRISPR gRNA sequence
ggccccacaatcaaggtttt

SEQ ID NO: 573231 - DNA, 20 bp, Artificial
  CRISPR gRNA sequence
gccccacaatcaaggttttc

SEQ ID NO: 573232 - DNA, 20 bp, Artificial
  CRISPR gRNA sequence
ccccacaatcaaggttttcg

SEQ ID NO: 573233 - DNA, 20 bp, Artificial
  CRISPR gRNA sequence
caatcaaggttttcggggac

SEQ ID NO: 573234 - DNA, 20 bp, Artificial
  CRISPR gRNA sequence
aggttttcggggaccagcac

SEQ ID NO: 573235 - DNA, 20 bp, Artificial
  CRISPR gRNA sequence
tcggggaccagcaccagctc

SEQ ID NO: 573236 - DNA, 20 bp, Artificial
  CRISPR gRNA sequence
cggggaccagcaccagctct

SEQ ID NO: 573237 - DNA, 20 bp, Artificial
  CRISPR gRNA sequence
ggggaccagcaccagctctg

SEQ ID NO: 573238 - DNA, 20 bp, Artificial
  CRISPR gRNA sequence
gcaccagctctggggacaca

SEQ ID NO: 573239 - DNA, 20 bp, Artificial
  CRISPR gRNA sequence
cctccatcatcaccacgctc

SEQ ID NO: 573240 - DNA, 20 bp, Artificial
  CRISPR gRNA sequence
atcaccacgctctggccaac

SEQ ID NO: 573241 - DNA, 20 bp, Artificial
  CRISPR gRNA sequence
tcaccacgctctggccaact

SEQ ID NO: 573242 - DNA, 20 bp, Artificial
  CRISPR gRNA sequence
caactaggcctcctgaccta

SEQ ID NO: 573243 - DNA, 20 bp, Artificial
  CRISPR gRNA sequence
actaggcctcctgacctatg

SEQ ID NO: 573244 - DNA, 20 bp, Artificial
  CRISPR gRNA sequence
gcctcctgacctatggagtc

SEQ ID NO: 573245 - DNA, 20 bp, Artificial
  CRISPR gRNA sequence
cctcctgacctatggagtcc

SEQ ID NO: 573246 - DNA, 20 bp, Artificial
  CRISPR gRNA sequence
ctcctgacctatggagtccg

SEQ ID NO: 573247 - DNA, 20 bp, Artificial
  CRISPR gRNA sequence
atggagtccggggcctcacc

SEQ ID NO: 573248 - DNA, 20 bp, Artificial
  CRISPR gRNA sequence
gtccggggcctcacctagcc

SEQ ID NO: 573249 - DNA, 20 bp, Artificial
  CRISPR gRNA sequence
tcacctagcccagctcttgt

SEQ ID NO: 573250 - DNA, 20 bp, Artificial
  CRISPR gRNA sequence
cacctagcccagctcttgtg

SEQ ID NO: 573251 - DNA, 20 bp, Artificial
  CRISPR gRNA sequence
tagcccagctcttgtgaggc

SEQ ID NO: 573252 - DNA, 20 bp, Artificial
  CRISPR gRNA sequence
agcccagctcttgtgaggct

SEQ ID NO: 573253 - DNA, 20 bp, Artificial
  CRISPR gRNA sequence
tgggccccacactgtgatcg

SEQ ID NO: 573254 - DNA, 20 bp, Artificial
  CRISPR gRNA sequence
atcgtggatcgtccaacctg

SEQ ID NO: 573255 - DNA, 20 bp, Artificial
  CRISPR gRNA sequence
tcgtggatcgtccaacctgt

SEQ ID NO: 573256 - DNA, 20 bp, Artificial
  CRISPR gRNA sequence
tggatcgtccaacctgtggg

SEQ ID NO: 573257 - DNA, 20 bp, Artificial
  CRISPR gRNA sequence
tcgtccaacctgtgggaagt

SEQ ID NO: 573258 - DNA, 20 bp, Artificial
  CRISPR gRNA sequence
cgtccaacctgtgggaagtt

SEQ ID NO: 573259 - DNA, 20 bp, Artificial
  CRISPR gRNA sequence
gtccaacctgtgggaagttg

SEQ ID NO: 573260 - DNA, 20 bp, Artificial
  CRISPR gRNA sequence
gaagttggggtccaacgtgt

SEQ ID NO: 573261 - DNA, 20 bp, Artificial
  CRISPR gRNA sequence
gttggggtccaacgtgtgag

SEQ ID NO: 573262 - DNA, 20 bp, Artificial
  CRISPR gRNA sequence
ttggggtccaacgtgtgaga

SEQ ID NO: 573263 - DNA, 20 bp, Artificial
  CRISPR gRNA sequence
gggtccaacgtgtgagaagg

SEQ ID NO: 573264 - DNA, 20 bp, Artificial
  CRISPR gRNA sequence
tccaacgtgtgagaaggcag

SEQ ID NO: 573265 - DNA, 20 bp, Artificial
  CRISPR gRNA sequence
ccaacgtgtgagaaggcaga

SEQ ID NO: 573266 - DNA, 20 bp, Artificial
  CRISPR gRNA sequence
caacgtgtgagaaggcagaa

SEQ ID NO: 573267 - DNA, 20 bp, Artificial
  CRISPR gRNA sequence
aacgtgtgagaaggcagaag

SEQ ID NO: 573268 - DNA, 20 bp, Artificial
  CRISPR gRNA sequence
acgtgtgagaaggcagaagg

SEQ ID NO: 573269 - DNA, 20 bp, Artificial
  CRISPR gRNA sequence
tgagaaggcagaagggggaa

SEQ ID NO: 573270 - DNA, 20 bp, Artificial
  CRISPR gRNA sequence
gaaggcagaagggggaatgg

SEQ ID NO: 573271 - DNA, 20 bp, Artificial
  CRISPR gRNA sequence
cagaagggggaatggtagcc

SEQ ID NO: 573272 - DNA, 20 bp, Artificial
  CRISPR gRNA sequence
agaagggggaatggtagccc

SEQ ID NO: 573273 - DNA, 20 bp, Artificial
  CRISPR gRNA sequence
caggttccccttcccccttc

SEQ ID NO: 573274 - DNA, 20 bp, Artificial
  CRISPR gRNA sequence
aggttccccttcccccttct

SEQ ID NO: 573275 - DNA, 20 bp, Artificial
  CRISPR gRNA sequence
ccttcccccttctgggtgct

SEQ ID NO: 573276 - DNA, 20 bp, Artificial
  CRISPR gRNA sequence
cttcccccttctgggtgctg

SEQ ID NO: 573277 - DNA, 20 bp, Artificial
  CRISPR gRNA sequence
ttcccccttctgggtgctga

SEQ ID NO: 573278 - DNA, 20 bp, Artificial
  CRISPR gRNA sequence
tcccccttctgggtgctgag

SEQ ID NO: 573279 - DNA, 20 bp, Artificial
  CRISPR gRNA sequence
tgggtgctgaggggtaaact

SEQ ID NO: 573280 - DNA, 20 bp, Artificial
  CRISPR gRNA sequence
gggtgctgaggggtaaactg

SEQ ID NO: 573281 - DNA, 20 bp, Artificial
  CRISPR gRNA sequence
gaggggtaaactgaggcctg

SEQ ID NO: 573282 - DNA, 20 bp, Artificial
  CRISPR gRNA sequence
ggtaaactgaggcctgcagt

SEQ ID NO: 573283 - DNA, 20 bp, Artificial
  CRISPR gRNA sequence
gtaaactgaggcctgcagtt

SEQ ID NO: 573284 - DNA, 20 bp, Artificial
  CRISPR gRNA sequence
taaactgaggcctgcagttg

SEQ ID NO: 573285 - DNA, 20 bp, Artificial
  CRISPR gRNA sequence
aactgaggcctgcagttggg

SEQ ID NO: 573286 - DNA, 20 bp, Artificial
  CRISPR gRNA sequence
ctgaggcctgcagttgggga

SEQ ID NO: 573287 - DNA, 20 bp, Artificial
  CRISPR gRNA sequence
gaggcctgcagttggggaga

SEQ ID NO: 573288 - DNA, 20 bp, Artificial
  CRISPR gRNA sequence
cctgcagttggggagagagc

SEQ ID NO: 573289 - DNA, 20 bp, Artificial
  CRISPR gRNA sequence
gttggggagagagccagaac

SEQ ID NO: 573290 - DNA, 20 bp, Artificial
  CRISPR gRNA sequence
ttggggagagagccagaacc

SEQ ID NO: 573291 - DNA, 20 bp, Artificial
  CRISPR gRNA sequence
tggggagagagccagaacca

SEQ ID NO: 573292 - DNA, 20 bp, Artificial
  CRISPR gRNA sequence
gccagaaccagggtcccacc

SEQ ID NO: 573293 - DNA, 20 bp, Artificial
  CRISPR gRNA sequence
cagaaccagggtcccaccta

SEQ ID NO: 573294 - DNA, 20 bp, Artificial
  CRISPR gRNA sequence
agggtcccacctagagtcct

SEQ ID NO: 573295 - DNA, 20 bp, Artificial
  CRISPR gRNA sequence
ccacctagagtcctgagatc

SEQ ID NO: 573296 - DNA, 20 bp, Artificial
  CRISPR gRNA sequence
cacctagagtcctgagatct

SEQ ID NO: 573297 - DNA, 20 bp, Artificial
  CRISPR gRNA sequence
agagtcctgagatctaggct

SEQ ID NO: 573298 - DNA, 20 bp, Artificial
  CRISPR gRNA sequence
tcaactctgccgctgcattt

SEQ ID NO: 573299 - DNA, 20 bp, Artificial
  CRISPR gRNA sequence
ctctgccgctgcatttcggt

SEQ ID NO: 573300 - DNA, 20 bp, Artificial
  CRISPR gRNA sequence
tctgccgctgcatttcggtg

SEQ ID NO: 573301 - DNA, 20 bp, Artificial
  CRISPR gRNA sequence
ctgcatttcggtgaggccct

SEQ ID NO: 573302 - DNA, 20 bp, Artificial
  CRISPR gRNA sequence
cggtgaggccctgagatctc

SEQ ID NO: 573303 - DNA, 20 bp, Artificial
  CRISPR gRNA sequence
tcaatttgcccttctacact

SEQ ID NO: 573304 - DNA, 20 bp, Artificial
  CRISPR gRNA sequence
ttgcccttctacactgagca

SEQ ID NO: 573305 - DNA, 20 bp, Artificial
  CRISPR gRNA sequence
gcccttctacactgagcacg

SEQ ID NO: 573306 - DNA, 20 bp, Artificial
  CRISPR gRNA sequence
ccttctacactgagcacgga

SEQ ID NO: 573307 - DNA, 20 bp, Artificial
  CRISPR gRNA sequence
cttctacactgagcacggag

SEQ ID NO: 573308 - DNA, 20 bp, Artificial
  CRISPR gRNA sequence
acactgagcacggagaggcg

SEQ ID NO: 573309 - DNA, 20 bp, Artificial
  CRISPR gRNA sequence
actgagcacggagaggcgtg

SEQ ID NO: 573310 - DNA, 20 bp, Artificial
  CRISPR gRNA sequence
gagcacggagaggcgtggag

SEQ ID NO: 573311 - DNA, 20 bp, Artificial
  CRISPR gRNA sequence
cggagaggcgtggagtagac

SEQ ID NO: 573312 - DNA, 20 bp, Artificial
  CRISPR gRNA sequence
ggagaggcgtggagtagaca

SEQ ID NO: 573313 - DNA, 20 bp, Artificial
  CRISPR gRNA sequence
gagaggcgtggagtagacaa

SEQ ID NO: 573314 - DNA, 20 bp, Artificial
  CRISPR gRNA sequence
ggcgtggagtagacaagggc

SEQ ID NO: 573315 - DNA, 20 bp, Artificial
  CRISPR gRNA sequence
gcgtggagtagacaagggcc

SEQ ID NO: 573316 - DNA, 20 bp, Artificial
  CRISPR gRNA sequence
cgtggagtagacaagggcca

SEQ ID NO: 573317 - DNA, 20 bp, Artificial
  CRISPR gRNA sequence
cagggcccttctacgctgtc

SEQ ID NO: 573318 - DNA, 20 bp, Artificial
  CRISPR gRNA sequence
cccttctacgctgtctggtt

SEQ ID NO: 573319 - DNA, 20 bp, Artificial
  CRISPR gRNA sequence
acgctgtctggttaagtcat

SEQ ID NO: 573320 - DNA, 20 bp, Artificial
  CRISPR gRNA sequence
cgctgtctggttaagtcatt

SEQ ID NO: 573321 - DNA, 20 bp, Artificial
  CRISPR gRNA sequence
gttaagtcattaggtgtctg

SEQ ID NO: 573322 - DNA, 20 bp, Artificial
  CRISPR gRNA sequence
ttaagtcattaggtgtctgc

SEQ ID NO: 573323 - DNA, 20 bp, Artificial
  CRISPR gRNA sequence
taagtcattaggtgtctgca

SEQ ID NO: 573324 - DNA, 20 bp, Artificial
  CRISPR gRNA sequence
ttaggtgtctgcagggcttc

SEQ ID NO: 573325 - DNA, 20 bp, Artificial
  CRISPR gRNA sequence
ttgacaattgcccctctatc

SEQ ID NO: 573326 - DNA, 20 bp, Artificial
  CRISPR gRNA sequence
tgacaattgcccctctatcc

SEQ ID NO: 573327 - DNA, 20 bp, Artificial
  CRISPR gRNA sequence
gacaattgcccctctatcca

SEQ ID NO: 573328 - DNA, 20 bp, Artificial
  CRISPR gRNA sequence
acaattgcccctctatccag

SEQ ID NO: 573329 - DNA, 20 bp, Artificial
  CRISPR gRNA sequence
tgcccctctatccaggggac

SEQ ID NO: 573330 - DNA, 20 bp, Artificial
  CRISPR gRNA sequence
ctctatccaggggactggct

SEQ ID NO: 573331 - DNA, 20 bp, Artificial
  CRISPR gRNA sequence
ctatccaggggactggctga

SEQ ID NO: 573332 - DNA, 20 bp, Artificial
  CRISPR gRNA sequence
ccaggggactggctgagaga

SEQ ID NO: 573333 - DNA, 20 bp, Artificial
  CRISPR gRNA sequence
caggggactggctgagagat

SEQ ID NO: 573334 - DNA, 20 bp, Artificial
  CRISPR gRNA sequence
aggggactggctgagagata

SEQ ID NO: 573335 - DNA, 20 bp, Artificial
  CRISPR gRNA sequence
ggctgagagatagggataca

SEQ ID NO: 573336 - DNA, 20 bp, Artificial
  CRISPR gRNA sequence
ctgagagatagggatacata

SEQ ID NO: 573337 - DNA, 20 bp, Artificial
  CRISPR gRNA sequence
gatagggatacatagagaca

SEQ ID NO: 573338 - DNA, 20 bp, Artificial
  CRISPR gRNA sequence
tagggatacatagagacaaa

SEQ ID NO: 573339 - DNA, 20 bp, Artificial
  CRISPR gRNA sequence
gagacaaagagacacacaca

SEQ ID NO: 573340 - DNA, 20 bp, Artificial
  CRISPR gRNA sequence
gacaaagagacacacacaaa

SEQ ID NO: 573341 - DNA, 20 bp, Artificial
  CRISPR gRNA sequence
aagagacacacacaaagagc

SEQ ID NO: 573342 - DNA, 20 bp, Artificial
  CRISPR gRNA sequence
gacacacacaaagagcgagc

SEQ ID NO: 573343 - DNA, 20 bp, Artificial
  CRISPR gRNA sequence
cacacacaaagagcgagcaa

SEQ ID NO: 573344 - DNA, 20 bp, Artificial
  CRISPR gRNA sequence
cacacaaagagcgagcaaga

SEQ ID NO: 573345 - DNA, 20 bp, Artificial
  CRISPR gRNA sequence
aagagcgagcaagagagaac

SEQ ID NO: 573346 - DNA, 20 bp, Artificial
  CRISPR gRNA sequence
gagcgagcaagagagaacaa

SEQ ID NO: 573347 - DNA, 20 bp, Artificial
  CRISPR gRNA sequence
gagcaagagagaacaagaga

SEQ ID NO: 573348 - DNA, 20 bp, Artificial
  CRISPR gRNA sequence
aagagagaacaagagatagt

SEQ ID NO: 573349 - DNA, 20 bp, Artificial
  CRISPR gRNA sequence
gagagaacaagagatagtga

SEQ ID NO: 573350 - DNA, 20 bp, Artificial
  CRISPR gRNA sequence
aagagatagtgagagacatt

SEQ ID NO: 573351 - DNA, 20 bp, Artificial
  CRISPR gRNA sequence
gagatagtgagagacattga

SEQ ID NO: 573352 - DNA, 20 bp, Artificial
  CRISPR gRNA sequence
gtgagagacattgagagaaa

SEQ ID NO: 573353 - DNA, 20 bp, Artificial
  CRISPR gRNA sequence
gagagaaatggacacatgca

SEQ ID NO: 573354 - DNA, 20 bp, Artificial
  CRISPR gRNA sequence
gagaaatggacacatgcatg

SEQ ID NO: 573355 - DNA, 20 bp, Artificial
  CRISPR gRNA sequence
gaaatggacacatgcatgga

SEQ ID NO: 573356 - DNA, 20 bp, Artificial
  CRISPR gRNA sequence
tggacacatgcatggagagc

SEQ ID NO: 573357 - DNA, 20 bp, Artificial
  CRISPR gRNA sequence
gacacatgcatggagagcca

SEQ ID NO: 573358 - DNA, 20 bp, Artificial
  CRISPR gRNA sequence
gagccagagtgcatgtgtgc

SEQ ID NO: 573359 - DNA, 20 bp, Artificial
  CRISPR gRNA sequence
gccagagtgcatgtgtgcga

SEQ ID NO: 573360 - DNA, 20 bp, Artificial
  CRISPR gRNA sequence
ccagagtgcatgtgtgcgag

SEQ ID NO: 573361 - DNA, 20 bp, Artificial
  CRISPR gRNA sequence
agagtgcatgtgtgcgagag

SEQ ID NO: 573362 - DNA, 20 bp, Artificial
  CRISPR gRNA sequence
gagtgcatgtgtgcgagagg

SEQ ID NO: 573363 - DNA, 20 bp, Artificial
  CRISPR gRNA sequence
agaggaggattgcctcaaat

SEQ ID NO: 573364 - DNA, 20 bp, Artificial
  CRISPR gRNA sequence
cctcaaataagaacatttgc

SEQ ID NO: 573365 - DNA, 20 bp, Artificial
  CRISPR gRNA sequence
taagaacatttgctggtctc

SEQ ID NO: 573366 - DNA, 20 bp, Artificial
  CRISPR gRNA sequence
aacatttgctggtctctggc

SEQ ID NO: 573367 - DNA, 20 bp, Artificial
  CRISPR gRNA sequence
tgatgctgcctgaaataatc

SEQ ID NO: 573368 - DNA, 20 bp, Artificial
  CRISPR gRNA sequence
gcctgaaataatcaagaata

SEQ ID NO: 573369 - DNA, 20 bp, Artificial
  CRISPR gRNA sequence
tgaaataatcaagaataaag

SEQ ID NO: 573370 - DNA, 20 bp, Artificial
  CRISPR gRNA sequence
gaaataatcaagaataaaga

SEQ ID NO: 573371 - DNA, 20 bp, Artificial
  CRISPR gRNA sequence
aaataatcaagaataaagaa

SEQ ID NO: 573372 - DNA, 20 bp, Artificial
  CRISPR gRNA sequence
aatcaagaataaagaagggc

SEQ ID NO: 573373 - DNA, 20 bp, Artificial
  CRISPR gRNA sequence
atcaagaataaagaagggca

SEQ ID NO: 573374 - DNA, 20 bp, Artificial
  CRISPR gRNA sequence
aataaagaagggcaaggtgc

SEQ ID NO: 573375 - DNA, 20 bp, Artificial
  CRISPR gRNA sequence
ataaagaagggcaaggtgcc

SEQ ID NO: 573376 - DNA, 20 bp, Artificial
  CRISPR gRNA sequence
taaagaagggcaaggtgcca

SEQ ID NO: 573377 - DNA, 20 bp, Artificial
  CRISPR gRNA sequence
caaggtgccagggacaccca

SEQ ID NO: 573378 - DNA, 20 bp, Artificial
  CRISPR gRNA sequence
gtgccagggacacccatggc

SEQ ID NO: 573379 - DNA, 20 bp, Artificial
  CRISPR gRNA sequence
tgccagggacacccatggct

SEQ ID NO: 573380 - DNA, 20 bp, Artificial
  CRISPR gRNA sequence
gggtattgaattgtattgca

SEQ ID NO: 573381 - DNA, 20 bp, Artificial
  CRISPR gRNA sequence
ttgtattgcaaagcaacaat

SEQ ID NO: 573382 - DNA, 20 bp, Artificial
  CRISPR gRNA sequence
caaagcaacaatcagcaaaa

SEQ ID NO: 573383 - DNA, 20 bp, Artificial
  CRISPR gRNA sequence
caacaatcagcaaaacagtg

SEQ ID NO: 573384 - DNA, 20 bp, Artificial
  CRISPR gRNA sequence
tcagcaaaacagtgtggccc

SEQ ID NO: 573385 - DNA, 20 bp, Artificial
  CRISPR gRNA sequence
aaacagtgtggccctggtat

SEQ ID NO: 573386 - DNA, 20 bp, Artificial
  CRISPR gRNA sequence
gtgtggccctggtataagaa

SEQ ID NO: 573387 - DNA, 20 bp, Artificial
  CRISPR gRNA sequence
cctggtataagaacagatac

SEQ ID NO: 573388 - DNA, 20 bp, Artificial
  CRISPR gRNA sequence
ctggtataagaacagatact

SEQ ID NO: 573389 - DNA, 20 bp, Artificial
  CRISPR gRNA sequence
tggtataagaacagatactg

SEQ ID NO: 573390 - DNA, 20 bp, Artificial
  CRISPR gRNA sequence
tataagaacagatactgggg

SEQ ID NO: 573391 - DNA, 20 bp, Artificial
  CRISPR gRNA sequence
taagaacagatactggggaa

SEQ ID NO: 573392 - DNA, 20 bp, Artificial
  CRISPR gRNA sequence
acagatactggggaagagaa

SEQ ID NO: 573393 - DNA, 20 bp, Artificial
  CRISPR gRNA sequence
tactggggaagagaacagaa

SEQ ID NO: 573394 - DNA, 20 bp, Artificial
  CRISPR gRNA sequence
ggggaagagaacagaataga

SEQ ID NO: 573395 - DNA, 20 bp, Artificial
  CRISPR gRNA sequence
agagaacagaatagaaagct

SEQ ID NO: 573396 - DNA, 20 bp, Artificial
  CRISPR gRNA sequence
cagaatagaaagcttggaca

SEQ ID NO: 573397 - DNA, 20 bp, Artificial
  CRISPR gRNA sequence
cttggacatggacccacata

SEQ ID NO: 573398 - DNA, 20 bp, Artificial
  CRISPR gRNA sequence
tggacatggacccacatatg

SEQ ID NO: 573399 - DNA, 20 bp, Artificial
  CRISPR gRNA sequence
gacatggacccacatatgga

SEQ ID NO: 573400 - DNA, 20 bp, Artificial
  CRISPR gRNA sequence
aactgaatttgtgatgaatg

SEQ ID NO: 573401 - DNA, 20 bp, Artificial
  CRISPR gRNA sequence
atgaatgtggcatttcaaac

SEQ ID NO: 573402 - DNA, 20 bp, Artificial
  CRISPR gRNA sequence
gaatgtggcatttcaaactg

SEQ ID NO: 573403 - DNA, 20 bp, Artificial
  CRISPR gRNA sequence
aatgtggcatttcaaactgg

SEQ ID NO: 573404 - DNA, 20 bp, Artificial
  CRISPR gRNA sequence
catttcaaactggaggacca

SEQ ID NO: 573405 - DNA, 20 bp, Artificial
  CRISPR gRNA sequence
tttcaaactggaggaccatg

SEQ ID NO: 573406 - DNA, 20 bp, Artificial
  CRISPR gRNA sequence
aactggaggaccatggagta

SEQ ID NO: 573407 - DNA, 20 bp, Artificial
  CRISPR gRNA sequence
atggtttaacaaatgtgtct

SEQ ID NO: 573408 - DNA, 20 bp, Artificial
  CRISPR gRNA sequence
acaaatgtgtctgagataat

SEQ ID NO: 573409 - DNA, 20 bp, Artificial
  CRISPR gRNA sequence
caaatgtgtctgagataatt

SEQ ID NO: 573410 - DNA, 20 bp, Artificial
  CRISPR gRNA sequence
aaatgtgtctgagataatta

SEQ ID NO: 573411 - DNA, 20 bp, Artificial
  CRISPR gRNA sequence
atgtgtctgagataattagg

SEQ ID NO: 573412 - DNA, 20 bp, Artificial
  CRISPR gRNA sequence
tgtctgagataattagggag

SEQ ID NO: 573413 - DNA, 20 bp, Artificial
  CRISPR gRNA sequence
agataattagggagaagata

SEQ ID NO: 573414 - DNA, 20 bp, Artificial
  CRISPR gRNA sequence
agggagaagataaagttatt

SEQ ID NO: 573415 - DNA, 20 bp, Artificial
  CRISPR gRNA sequence
agataaagttattgagtgaa

SEQ ID NO: 573416 - DNA, 20 bp, Artificial
  CRISPR gRNA sequence
aaagttattgagtgaatagt

SEQ ID NO: 573417 - DNA, 20 bp, Artificial
  CRISPR gRNA sequence
cccaacaacccctccctgcc

SEQ ID NO: 573418 - DNA, 20 bp, Artificial
  CRISPR gRNA sequence
atcatataccctaaaatgcc

SEQ ID NO: 573419 - DNA, 20 bp, Artificial
  CRISPR gRNA sequence
taaaatgcccagatccattc

SEQ ID NO: 573420 - DNA, 20 bp, Artificial
  CRISPR gRNA sequence
cccagatccattcaagatat

SEQ ID NO: 573421 - DNA, 20 bp, Artificial
  CRISPR gRNA sequence
ttaacacctaatgctgatct

SEQ ID NO: 573422 - DNA, 20 bp, Artificial
  CRISPR gRNA sequence
taacacctaatgctgatctt

SEQ ID NO: 573423 - DNA, 20 bp, Artificial
  CRISPR gRNA sequence
atcttgggtttattgtgtgt

SEQ ID NO: 573424 - DNA, 20 bp, Artificial
  CRISPR gRNA sequence
tcttgggtttattgtgtgtc

SEQ ID NO: 573425 - DNA, 20 bp, Artificial
  CRISPR gRNA sequence
tgtgtgtcaggccttgtgct

SEQ ID NO: 573426 - DNA, 20 bp, Artificial
  CRISPR gRNA sequence
cttgtgctaagtatttactg

SEQ ID NO: 573427 - DNA, 20 bp, Artificial
  CRISPR gRNA sequence
taaaaattttaatctaaaca

SEQ ID NO: 573428 - DNA, 20 bp, Artificial
  CRISPR gRNA sequence
taatctaaacaaagactcct

SEQ ID NO: 573429 - DNA, 20 bp, Artificial
  CRISPR gRNA sequence
aatctaaacaaagactcctg

SEQ ID NO: 573430 - DNA, 20 bp, Artificial
  CRISPR gRNA sequence
ctaaacaaagactcctgagg

SEQ ID NO: 573431 - DNA, 20 bp, Artificial
  CRISPR gRNA sequence
taaacaaagactcctgagga

SEQ ID NO: 573432 - DNA, 20 bp, Artificial
  CRISPR gRNA sequence
aggtactattataaccattg

SEQ ID NO: 573433 - DNA, 20 bp, Artificial
  CRISPR gRNA sequence
ataaccattgcagtacatat

SEQ ID NO: 573434 - DNA, 20 bp, Artificial
  CRISPR gRNA sequence
taaccattgcagtacatatg

SEQ ID NO: 573435 - DNA, 20 bp, Artificial
  CRISPR gRNA sequence
ttgcagtacatatgaggaaa

SEQ ID NO: 573436 - DNA, 20 bp, Artificial
  CRISPR gRNA sequence
gcagtacatatgaggaaatg

SEQ ID NO: 573437 - DNA, 20 bp, Artificial
  CRISPR gRNA sequence
cagtacatatgaggaaatgg

SEQ ID NO: 573438 - DNA, 20 bp, Artificial
  CRISPR gRNA sequence
catatgaggaaatggaggta

SEQ ID NO: 573439 - DNA, 20 bp, Artificial
  CRISPR gRNA sequence
tatgaggaaatggaggtatg

SEQ ID NO: 573440 - DNA, 20 bp, Artificial
  CRISPR gRNA sequence
tgaggaaatggaggtatgga

SEQ ID NO: 573441 - DNA, 20 bp, Artificial
  CRISPR gRNA sequence
gaggaaatggaggtatggag

SEQ ID NO: 573442 - DNA, 20 bp, Artificial
  CRISPR gRNA sequence
aatggaggtatggagaggtt

SEQ ID NO: 573443 - DNA, 20 bp, Artificial
  CRISPR gRNA sequence
gtatggagaggttaagtgcc

SEQ ID NO: 573444 - DNA, 20 bp, Artificial
  CRISPR gRNA sequence
gcctggctaaaaatcacaca

SEQ ID NO: 573445 - DNA, 20 bp, Artificial
  CRISPR gRNA sequence
cctggctaaaaatcacacat

SEQ ID NO: 573446 - DNA, 20 bp, Artificial
  CRISPR gRNA sequence
ctggctaaaaatcacacata

SEQ ID NO: 573447 - DNA, 20 bp, Artificial
  CRISPR gRNA sequence
taaaaatcacacatagggct

SEQ ID NO: 573448 - DNA, 20 bp, Artificial
  CRISPR gRNA sequence
aaaaatcacacatagggctt

SEQ ID NO: 573449 - DNA, 20 bp, Artificial
  CRISPR gRNA sequence
aaaatcacacatagggcttg

SEQ ID NO: 573450 - DNA, 20 bp, Artificial
  CRISPR gRNA sequence
catagggcttggggtgacgc

SEQ ID NO: 573451 - DNA, 20 bp, Artificial
  CRISPR gRNA sequence
atagggcttggggtgacgct

SEQ ID NO: 573452 - DNA, 20 bp, Artificial
  CRISPR gRNA sequence
gggtgacgctgggtttgtcc

SEQ ID NO: 573453 - DNA, 20 bp, Artificial
  CRISPR gRNA sequence
gacgctgggtttgtcccaga

SEQ ID NO: 573454 - DNA, 20 bp, Artificial
  CRISPR gRNA sequence
tgggtttgtcccagacagtc

SEQ ID NO: 573455 - DNA, 20 bp, Artificial
  CRISPR gRNA sequence
tgtcccagacagtctggctc

SEQ ID NO: 573456 - DNA, 20 bp, Artificial
  CRISPR gRNA sequence
acccacactcttaacctcta

SEQ ID NO: 573457 - DNA, 20 bp, Artificial
  CRISPR gRNA sequence
ctcttaacctctatagtaaa

SEQ ID NO: 573458 - DNA, 20 bp, Artificial
  CRISPR gRNA sequence
tatagtaaatggaaaaaatg

SEQ ID NO: 573459 - DNA, 20 bp, Artificial
  CRISPR gRNA sequence
tggaaaaaatgaagccataa

SEQ ID NO: 573460 - DNA, 20 bp, Artificial
  CRISPR gRNA sequence
gaaaaaatgaagccataaaa

SEQ ID NO: 573461 - DNA, 20 bp, Artificial
  CRISPR gRNA sequence
aatgaagccataaaagagac

SEQ ID NO: 573462 - DNA, 20 bp, Artificial
  CRISPR gRNA sequence
gaagccataaaagagactag

SEQ ID NO: 573463 - DNA, 20 bp, Artificial
  CRISPR gRNA sequence
aaagagactagaagccaaca

SEQ ID NO: 573464 - DNA, 20 bp, Artificial
  CRISPR gRNA sequence
aagagactagaagccaacat

SEQ ID NO: 573465 - DNA, 20 bp, Artificial
  CRISPR gRNA sequence
tgaacatttatctcattttc

SEQ ID NO: 573466 - DNA, 20 bp, Artificial
  CRISPR gRNA sequence
acatttatctcattttcaag

SEQ ID NO: 573467 - DNA, 20 bp, Artificial
  CRISPR gRNA sequence
catttatctcattttcaagt

SEQ ID NO: 573468 - DNA, 20 bp, Artificial
  CRISPR gRNA sequence
tatctcattttcaagtagga

SEQ ID NO: 573469 - DNA, 20 bp, Artificial
  CRISPR gRNA sequence
atctcattttcaagtaggaa

SEQ ID NO: 573470 - DNA, 20 bp, Artificial
  CRISPR gRNA sequence
caagtaggaaaggactttct

SEQ ID NO: 573471 - DNA, 20 bp, Artificial
  CRISPR gRNA sequence
ggactttctaagcacaaaac

SEQ ID NO: 573472 - DNA, 20 bp, Artificial
  CRISPR gRNA sequence
actttctaagcacaaaacca

SEQ ID NO: 573473 - DNA, 20 bp, Artificial
  CRISPR gRNA sequence
tctaagcacaaaaccagaga

SEQ ID NO: 573474 - DNA, 20 bp, Artificial
  CRISPR gRNA sequence
aagcacaaaaccagagacag

SEQ ID NO: 573475 - DNA, 20 bp, Artificial
  CRISPR gRNA sequence
aaaaccagagacagaagcca

SEQ ID NO: 573476 - DNA, 20 bp, Artificial
  CRISPR gRNA sequence
agacagaagccacagaaaaa

SEQ ID NO: 573477 - DNA, 20 bp, Artificial
  CRISPR gRNA sequence
tgactgtataaaaccatcat

SEQ ID NO: 573478 - DNA, 20 bp, Artificial
  CRISPR gRNA sequence
caaaaaacaccataaacaaa

SEQ ID NO: 573479 - DNA, 20 bp, Artificial
  CRISPR gRNA sequence
accataaacaaatagaaaaa

SEQ ID NO: 573480 - DNA, 20 bp, Artificial
  CRISPR gRNA sequence
aaaaaaagcaaatgatgaat

SEQ ID NO: 573481 - DNA, 20 bp, Artificial
  CRISPR gRNA sequence
aaaaaagcaaatgatgaatt

SEQ ID NO: 573482 - DNA, 20 bp, Artificial
  CRISPR gRNA sequence
aaaaagcaaatgatgaattg

SEQ ID NO: 573483 - DNA, 20 bp, Artificial
  CRISPR gRNA sequence
aatatttgctatatatgtaa

SEQ ID NO: 573484 - DNA, 20 bp, Artificial
  CRISPR gRNA sequence
atatatgtaatggctgatga

SEQ ID NO: 573485 - DNA, 20 bp, Artificial
  CRISPR gRNA sequence
tatatgtaatggctgatgaa

SEQ ID NO: 573486 - DNA, 20 bp, Artificial
  CRISPR gRNA sequence
gttaataaccattccaaata

SEQ ID NO: 573487 - DNA, 20 bp, Artificial
  CRISPR gRNA sequence
taataaccattccaaataaa

SEQ ID NO: 573488 - DNA, 20 bp, Artificial
  CRISPR gRNA sequence
ccattccaaataaagagctg

SEQ ID NO: 573489 - DNA, 20 bp, Artificial
  CRISPR gRNA sequence
aagagctgtggcaaatcaat

SEQ ID NO: 573490 - DNA, 20 bp, Artificial
  CRISPR gRNA sequence
agagctgtggcaaatcaata

SEQ ID NO: 573491 - DNA, 20 bp, Artificial
  CRISPR gRNA sequence
gagctgtggcaaatcaataa

SEQ ID NO: 573492 - DNA, 20 bp, Artificial
  CRISPR gRNA sequence
caaatcaataagggaaaaat

SEQ ID NO: 573493 - DNA, 20 bp, Artificial
  CRISPR gRNA sequence
aaataagatgaacaccctat

SEQ ID NO: 573494 - DNA, 20 bp, Artificial
  CRISPR gRNA sequence
aataagatgaacaccctatt

SEQ ID NO: 573495 - DNA, 20 bp, Artificial
  CRISPR gRNA sequence
taagatgaacaccctattag

SEQ ID NO: 573496 - DNA, 20 bp, Artificial
  CRISPR gRNA sequence
atgaacaccctattaggagt

SEQ ID NO: 573497 - DNA, 20 bp, Artificial
  CRISPR gRNA sequence
tgaacaccctattaggagta

SEQ ID NO: 573498 - DNA, 20 bp, Artificial
  CRISPR gRNA sequence
attaggagtaaggacatgac

SEQ ID NO: 573499 - DNA, 20 bp, Artificial
  CRISPR gRNA sequence
aaccaaaaaaaaaaaaaaaa

SEQ ID NO: 573500 - DNA, 20 bp, Artificial
  CRISPR gRNA sequence
aaaaaaaaaaaaagcatgaa

SEQ ID NO: 573501 - DNA, 20 bp, Artificial
  CRISPR gRNA sequence
aagcatgaatggccaatgaa

SEQ ID NO: 573502 - DNA, 20 bp, Artificial
  CRISPR gRNA sequence
gaatggccaatgaatagtaa

SEQ ID NO: 573503 - DNA, 20 bp, Artificial
  CRISPR gRNA sequence
tgaatagtaaaagtaatcac

SEQ ID NO: 573504 - DNA, 20 bp, Artificial
  CRISPR gRNA sequence
gtttttcttacctgtcatgt

SEQ ID NO: 573505 - DNA, 20 bp, Artificial
  CRISPR gRNA sequence
tttttcttacctgtcatgtt

SEQ ID NO: 573506 - DNA, 20 bp, Artificial
  CRISPR gRNA sequence
aaaacataataatactcacc

SEQ ID NO: 573507 - DNA, 20 bp, Artificial
  CRISPR gRNA sequence
aaacataataatactcacct

SEQ ID NO: 573508 - DNA, 20 bp, Artificial
  CRISPR gRNA sequence
aacataataatactcaccta

SEQ ID NO: 573509 - DNA, 20 bp, Artificial
  CRISPR gRNA sequence
taataatactcacctagggt

SEQ ID NO: 573510 - DNA, 20 bp, Artificial
  CRISPR gRNA sequence
tactcacctagggttagctt

SEQ ID NO: 573511 - DNA, 20 bp, Artificial
  CRISPR gRNA sequence
tcacctagggttagcttaag

SEQ ID NO: 573512 - DNA, 20 bp, Artificial
  CRISPR gRNA sequence
acctagggttagcttaagta

SEQ ID NO: 573513 - DNA, 20 bp, Artificial
  CRISPR gRNA sequence
cctagggttagcttaagtag

SEQ ID NO: 573514 - DNA, 20 bp, Artificial
  CRISPR gRNA sequence
ctagggttagcttaagtaga

SEQ ID NO: 573515 - DNA, 20 bp, Artificial
  CRISPR gRNA sequence
agggttagcttaagtagagg

SEQ ID NO: 573516 - DNA, 20 bp, Artificial
  CRISPR gRNA sequence
taagtagagggagcataaaa

SEQ ID NO: 573517 - DNA, 20 bp, Artificial
  CRISPR gRNA sequence
aagtagagggagcataaaat

SEQ ID NO: 573518 - DNA, 20 bp, Artificial
  CRISPR gRNA sequence
cataaaataggacaaccttt

SEQ ID NO: 573519 - DNA, 20 bp, Artificial
  CRISPR gRNA sequence
aaaataggacaaccttttgg

SEQ ID NO: 573520 - DNA, 20 bp, Artificial
  CRISPR gRNA sequence
aaataggacaaccttttgga

SEQ ID NO: 573521 - DNA, 20 bp, Artificial
  CRISPR gRNA sequence
ataggacaaccttttggaag

SEQ ID NO: 573522 - DNA, 20 bp, Artificial
  CRISPR gRNA sequence
caaccttttggaaggagaat

SEQ ID NO: 573523 - DNA, 20 bp, Artificial
  CRISPR gRNA sequence
ccttttggaaggagaattag

SEQ ID NO: 573524 - DNA, 20 bp, Artificial
  CRISPR gRNA sequence
ttttggaaggagaattagca

SEQ ID NO: 573525 - DNA, 20 bp, Artificial
  CRISPR gRNA sequence
ttggaaggagaattagcaga

SEQ ID NO: 573526 - DNA, 20 bp, Artificial
  CRISPR gRNA sequence
tggaaggagaattagcagag

SEQ ID NO: 573527 - DNA, 20 bp, Artificial
  CRISPR gRNA sequence
ggaaggagaattagcagaga

SEQ ID NO: 573528 - DNA, 20 bp, Artificial
  CRISPR gRNA sequence
aatgcacgccccctttgccc

SEQ ID NO: 573529 - DNA, 20 bp, Artificial
  CRISPR gRNA sequence
tgccccagcaactccctttt

SEQ ID NO: 573530 - DNA, 20 bp, Artificial
  CRISPR gRNA sequence
gccccagcaactcccttttc

SEQ ID NO: 573531 - DNA, 20 bp, Artificial
  CRISPR gRNA sequence
aactcccttttcaggaatcc

SEQ ID NO: 573532 - DNA, 20 bp, Artificial
  CRISPR gRNA sequence
actcccttttcaggaatcca

SEQ ID NO: 573533 - DNA, 20 bp, Artificial
  CRISPR gRNA sequence
cccttttcaggaatccaagg

SEQ ID NO: 573534 - DNA, 20 bp, Artificial
  CRISPR gRNA sequence
ttttcaggaatccaaggaag

SEQ ID NO: 573535 - DNA, 20 bp, Artificial
  CRISPR gRNA sequence
caggaatccaaggaagcagt

SEQ ID NO: 573536 - DNA, 20 bp, Artificial
  CRISPR gRNA sequence
aggaatccaaggaagcagtc

SEQ ID NO: 573537 - DNA, 20 bp, Artificial
  CRISPR gRNA sequence
ggaatccaaggaagcagtca

SEQ ID NO: 573538 - DNA, 20 bp, Artificial
  CRISPR gRNA sequence
gaagcagtcagggatgttta

SEQ ID NO: 573539 - DNA, 20 bp, Artificial
  CRISPR gRNA sequence
ggatgtttatagaaaaaaac

SEQ ID NO: 573540 - DNA, 20 bp, Artificial
  CRISPR gRNA sequence
agaaaaaaacgagaaacaac

SEQ ID NO: 573541 - DNA, 20 bp, Artificial
  CRISPR gRNA sequence
caaccggaatgtccaacaat

SEQ ID NO: 573542 - DNA, 20 bp, Artificial
  CRISPR gRNA sequence
aatgtccaacaatcggcact

SEQ ID NO: 573543 - DNA, 20 bp, Artificial
  CRISPR gRNA sequence
gcacttggtcaaatcaatca

SEQ ID NO: 573544 - DNA, 20 bp, Artificial
  CRISPR gRNA sequence
atcaaagttcatgctgatgt

SEQ ID NO: 573545 - DNA, 20 bp, Artificial
  CRISPR gRNA sequence
tcaaagttcatgctgatgtg

SEQ ID NO: 573546 - DNA, 20 bp, Artificial
  CRISPR gRNA sequence
agttcatgctgatgtgagga

SEQ ID NO: 573547 - DNA, 20 bp, Artificial
  CRISPR gRNA sequence
gacagtcttgtccatcatga

SEQ ID NO: 573548 - DNA, 20 bp, Artificial
  CRISPR gRNA sequence
tcatgtgttcaaacaatttt

SEQ ID NO: 573549 - DNA, 20 bp, Artificial
  CRISPR gRNA sequence
gtgttcaaacaatttttagt

SEQ ID NO: 573550 - DNA, 20 bp, Artificial
  CRISPR gRNA sequence
acactactgttaattgaata

SEQ ID NO: 573551 - DNA, 20 bp, Artificial
  CRISPR gRNA sequence
ctactgttaattgaataaag

SEQ ID NO: 573552 - DNA, 20 bp, Artificial
  CRISPR gRNA sequence
tactgttaattgaataaagc

SEQ ID NO: 573553 - DNA, 20 bp, Artificial
  CRISPR gRNA sequence
gcaggaacaaaaccaatata

SEQ ID NO: 573554 - DNA, 20 bp, Artificial
  CRISPR gRNA sequence
tatatagcatgattctaatt

SEQ ID NO: 573555 - DNA, 20 bp, Artificial
  CRISPR gRNA sequence
gcatgattctaatttggtta

SEQ ID NO: 573556 - DNA, 20 bp, Artificial
  CRISPR gRNA sequence
tttggttacagaaatactaa

SEQ ID NO: 573557 - DNA, 20 bp, Artificial
  CRISPR gRNA sequence
actaatagctaacacttcgt

SEQ ID NO: 573558 - DNA, 20 bp, Artificial
  CRISPR gRNA sequence
tttgtgccaaacgctgtgct

SEQ ID NO: 573559 - DNA, 20 bp, Artificial
  CRISPR gRNA sequence
caaacgctgtgctaagcctg

SEQ ID NO: 573560 - DNA, 20 bp, Artificial
  CRISPR gRNA sequence
tgtgctaagcctgcagaatc

SEQ ID NO: 573561 - DNA, 20 bp, Artificial
  CRISPR gRNA sequence
ctgcagaatcgagctcaccc

SEQ ID NO: 573562 - DNA, 20 bp, Artificial
  CRISPR gRNA sequence
acctgtttgcttcctgaata

SEQ ID NO: 573563 - DNA, 20 bp, Artificial
  CRISPR gRNA sequence
tgcttcctgaatatggactc

SEQ ID NO: 573564 - DNA, 20 bp, Artificial
  CRISPR gRNA sequence
ggactctggtcacacacatg

SEQ ID NO: 573565 - DNA, 20 bp, Artificial
  CRISPR gRNA sequence
tggtcacacacatgcagtcc

SEQ ID NO: 573566 - DNA, 20 bp, Artificial
  CRISPR gRNA sequence
ggtcacacacatgcagtcct

SEQ ID NO: 573567 - DNA, 20 bp, Artificial
  CRISPR gRNA sequence
gtcacacacatgcagtcctg

SEQ ID NO: 573568 - DNA, 20 bp, Artificial
  CRISPR gRNA sequence
acacacatgcagtcctgggg

SEQ ID NO: 573569 - DNA, 20 bp, Artificial
  CRISPR gRNA sequence
cacacatgcagtcctggggt

SEQ ID NO: 573570 - DNA, 20 bp, Artificial
  CRISPR gRNA sequence
agtcctggggtaggtccaca

SEQ ID NO: 573571 - DNA, 20 bp, Artificial
  CRISPR gRNA sequence
aggtccacacagctaaacta

SEQ ID NO: 573572 - DNA, 20 bp, Artificial
  CRISPR gRNA sequence
agctaaactacggttgacaa

SEQ ID NO: 573573 - DNA, 20 bp, Artificial
  CRISPR gRNA sequence
ctacggttgacaatggtgtg

SEQ ID NO: 573574 - DNA, 20 bp, Artificial
  CRISPR gRNA sequence
gctccctgcccccccgcccc

SEQ ID NO: 573575 - DNA, 20 bp, Artificial
  CRISPR gRNA sequence
ctccctgcccccccgcccca

SEQ ID NO: 573576 - DNA, 20 bp, Artificial
  CRISPR gRNA sequence
tccctgcccccccgccccaa

SEQ ID NO: 573577 - DNA, 20 bp, Artificial
  CRISPR gRNA sequence
cgccccaagggtctcctcta

SEQ ID NO: 573578 - DNA, 20 bp, Artificial
  CRISPR gRNA sequence
ggtctcctctaaagcgatac

SEQ ID NO: 573579 - DNA, 20 bp, Artificial
  CRISPR gRNA sequence
cctctaaagcgatacaagca

SEQ ID NO: 573580 - DNA, 20 bp, Artificial
  CRISPR gRNA sequence
aaagcgatacaagcaaagtt

SEQ ID NO: 573581 - DNA, 20 bp, Artificial
  CRISPR gRNA sequence
gatacaagcaaagttcagtt

SEQ ID NO: 573582 - DNA, 20 bp, Artificial
  CRISPR gRNA sequence
gcaaagttcagttaagtgct

SEQ ID NO: 573583 - DNA, 20 bp, Artificial
  CRISPR gRNA sequence
gttaagtgctcagcttgccc

SEQ ID NO: 573584 - DNA, 20 bp, Artificial
  CRISPR gRNA sequence
ccttgcaatcctcctgctac

SEQ ID NO: 573585 - DNA, 20 bp, Artificial
  CRISPR gRNA sequence
cttgcaatcctcctgctact

SEQ ID NO: 573586 - DNA, 20 bp, Artificial
  CRISPR gRNA sequence
ttgcaatcctcctgctacta

SEQ ID NO: 573587 - DNA, 20 bp, Artificial
  CRISPR gRNA sequence
cctcctgctactagggtgaa

SEQ ID NO: 573588 - DNA, 20 bp, Artificial
  CRISPR gRNA sequence
gctcactctcataaaatgta

SEQ ID NO: 573589 - DNA, 20 bp, Artificial
  CRISPR gRNA sequence
ctcactctcataaaatgtaa

SEQ ID NO: 573590 - DNA, 20 bp, Artificial
  CRISPR gRNA sequence
tcataaaatgtaaaggtcct

SEQ ID NO: 573591 - DNA, 20 bp, Artificial
  CRISPR gRNA sequence
acattactattattaaacgc

SEQ ID NO: 573592 - DNA, 20 bp, Artificial
  CRISPR gRNA sequence
ttaaacgccagctgtgtaca

SEQ ID NO: 573593 - DNA, 20 bp, Artificial
  CRISPR gRNA sequence
gccagctgtgtacaaagctc

SEQ ID NO: 573594 - DNA, 20 bp, Artificial
  CRISPR gRNA sequence
ccagctgtgtacaaagctct

SEQ ID NO: 573595 - DNA, 20 bp, Artificial
  CRISPR gRNA sequence
ctgtgtacaaagctctaggc

SEQ ID NO: 573596 - DNA, 20 bp, Artificial
  CRISPR gRNA sequence
caaagctctaggctggatgc

SEQ ID NO: 573597 - DNA, 20 bp, Artificial
  CRISPR gRNA sequence
gctctaggctggatgctggc

SEQ ID NO: 573598 - DNA, 20 bp, Artificial
  CRISPR gRNA sequence
ctctaggctggatgctggct

SEQ ID NO: 573599 - DNA, 20 bp, Artificial
  CRISPR gRNA sequence
taggctggatgctggctggg

SEQ ID NO: 573600 - DNA, 20 bp, Artificial
  CRISPR gRNA sequence
aggctggatgctggctggga

SEQ ID NO: 573601 - DNA, 20 bp, Artificial
  CRISPR gRNA sequence
ctggatgctggctgggaagg

SEQ ID NO: 573602 - DNA, 20 bp, Artificial
  CRISPR gRNA sequence
tggatgctggctgggaaggc

SEQ ID NO: 573603 - DNA, 20 bp, Artificial
  CRISPR gRNA sequence
atgctggctgggaaggcagg

SEQ ID NO: 573604 - DNA, 20 bp, Artificial
  CRISPR gRNA sequence
tgctggctgggaaggcaggt

SEQ ID NO: 573605 - DNA, 20 bp, Artificial
  CRISPR gRNA sequence
gctggctgggaaggcaggtg

SEQ ID NO: 573606 - DNA, 20 bp, Artificial
  CRISPR gRNA sequence
ctggctgggaaggcaggtgg

SEQ ID NO: 573607 - DNA, 20 bp, Artificial
  CRISPR gRNA sequence
gctgggaaggcaggtggggg

SEQ ID NO: 573608 - DNA, 20 bp, Artificial
  CRISPR gRNA sequence
ctgggaaggcaggtggggga

SEQ ID NO: 573609 - DNA, 20 bp, Artificial
  CRISPR gRNA sequence
gaaggcaggtgggggaaggc

SEQ ID NO: 573610 - DNA, 20 bp, Artificial
  CRISPR gRNA sequence
caggtgggggaaggcaagaa

SEQ ID NO: 573611 - DNA, 20 bp, Artificial
  CRISPR gRNA sequence
ggtgggggaaggcaagaaaa

SEQ ID NO: 573612 - DNA, 20 bp, Artificial
  CRISPR gRNA sequence
tgggggaaggcaagaaaaga

SEQ ID NO: 573613 - DNA, 20 bp, Artificial
  CRISPR gRNA sequence
gggaaggcaagaaaagagag

SEQ ID NO: 573614 - DNA, 20 bp, Artificial
  CRISPR gRNA sequence
ggaaggcaagaaaagagagc

SEQ ID NO: 573615 - DNA, 20 bp, Artificial
  CRISPR gRNA sequence
aaggcaagaaaagagagcgg

SEQ ID NO: 573616 - DNA, 20 bp, Artificial
  CRISPR gRNA sequence
ggcaagaaaagagagcggga

SEQ ID NO: 573617 - DNA, 20 bp, Artificial
  CRISPR gRNA sequence
agaaaagagagcgggagaga

SEQ ID NO: 573618 - DNA, 20 bp, Artificial
  CRISPR gRNA sequence
aaaagagagcgggagagatg

SEQ ID NO: 573619 - DNA, 20 bp, Artificial
  CRISPR gRNA sequence
aaagagagcgggagagatgg

SEQ ID NO: 573620 - DNA, 20 bp, Artificial
  CRISPR gRNA sequence
agagcgggagagatggagga

SEQ ID NO: 573621 - DNA, 20 bp, Artificial
  CRISPR gRNA sequence
gagcgggagagatggaggaa

SEQ ID NO: 573622 - DNA, 20 bp, Artificial
  CRISPR gRNA sequence
gcgggagagatggaggaaag

SEQ ID NO: 573623 - DNA, 20 bp, Artificial
  CRISPR gRNA sequence
gatggaggaaaggagatcga

SEQ ID NO: 573624 - DNA, 20 bp, Artificial
  CRISPR gRNA sequence
tggaggaaaggagatcgatg

SEQ ID NO: 573625 - DNA, 20 bp, Artificial
  CRISPR gRNA sequence
gaaaggagatcgatggagtg

SEQ ID NO: 573626 - DNA, 20 bp, Artificial
  CRISPR gRNA sequence
gagatcgatggagtgtggtc

SEQ ID NO: 573627 - DNA, 20 bp, Artificial
  CRISPR gRNA sequence
tcgatggagtgtggtcaaga

SEQ ID NO: 573628 - DNA, 20 bp, Artificial
  CRISPR gRNA sequence
gatggagtgtggtcaagatg

SEQ ID NO: 573629 - DNA, 20 bp, Artificial
  CRISPR gRNA sequence
atggagtgtggtcaagatgg

SEQ ID NO: 573630 - DNA, 20 bp, Artificial
  CRISPR gRNA sequence
ggagtgtggtcaagatggag

SEQ ID NO: 573631 - DNA, 20 bp, Artificial
  CRISPR gRNA sequence
tgtggtcaagatggaggaga

SEQ ID NO: 573632 - DNA, 20 bp, Artificial
  CRISPR gRNA sequence
tggtcaagatggaggagaca

SEQ ID NO: 573633 - DNA, 20 bp, Artificial
  CRISPR gRNA sequence
caagatggaggagacagaga

SEQ ID NO: 573634 - DNA, 20 bp, Artificial
  CRISPR gRNA sequence
aagatggaggagacagagat

SEQ ID NO: 573635 - DNA, 20 bp, Artificial
  CRISPR gRNA sequence
agatggaggagacagagata

SEQ ID NO: 573636 - DNA, 20 bp, Artificial
  CRISPR gRNA sequence
gatggaggagacagagatag

SEQ ID NO: 573637 - DNA, 20 bp, Artificial
  CRISPR gRNA sequence
tggaggagacagagataggg

SEQ ID NO: 573638 - DNA, 20 bp, Artificial
  CRISPR gRNA sequence
ggagacagagataggggaga

SEQ ID NO: 573639 - DNA, 20 bp, Artificial
  CRISPR gRNA sequence
acagagataggggagatggt

SEQ ID NO: 573640 - DNA, 20 bp, Artificial
  CRISPR gRNA sequence
agagataggggagatggtca

SEQ ID NO: 573641 - DNA, 20 bp, Artificial
  CRISPR gRNA sequence
gagataggggagatggtcag

SEQ ID NO: 573642 - DNA, 20 bp, Artificial
  CRISPR gRNA sequence
taggggagatggtcagaggc

SEQ ID NO: 573643 - DNA, 20 bp, Artificial
  CRISPR gRNA sequence
aggggagatggtcagaggcc

SEQ ID NO: 573644 - DNA, 20 bp, Artificial
  CRISPR gRNA sequence
gggagatggtcagaggccag

SEQ ID NO: 573645 - DNA, 20 bp, Artificial
  CRISPR gRNA sequence
gagatggtcagaggccagga

SEQ ID NO: 573646 - DNA, 20 bp, Artificial
  CRISPR gRNA sequence
gtcagaggccaggagagatg

SEQ ID NO: 573647 - DNA, 20 bp, Artificial
  CRISPR gRNA sequence
tcagaggccaggagagatgc

SEQ ID NO: 573648 - DNA, 20 bp, Artificial
  CRISPR gRNA sequence
cagaggccaggagagatgcg

SEQ ID NO: 573649 - DNA, 20 bp, Artificial
  CRISPR gRNA sequence
ggccaggagagatgcgggga

SEQ ID NO: 573650 - DNA, 20 bp, Artificial
  CRISPR gRNA sequence
ccaggagagatgcggggaaa

SEQ ID NO: 573651 - DNA, 20 bp, Artificial
  CRISPR gRNA sequence
aggagagatgcggggaaaga

SEQ ID NO: 573652 - DNA, 20 bp, Artificial
  CRISPR gRNA sequence
gatgcggggaaagagagtct

SEQ ID NO: 573653 - DNA, 20 bp, Artificial
  CRISPR gRNA sequence
ggggaaagagagtctgagtg

SEQ ID NO: 573654 - DNA, 20 bp, Artificial
  CRISPR gRNA sequence
agagagtctgagtgtagcga

SEQ ID NO: 573655 - DNA, 20 bp, Artificial
  CRISPR gRNA sequence
agtctgagtgtagcgacaga

SEQ ID NO: 573656 - DNA, 20 bp, Artificial
  CRISPR gRNA sequence
tgagtgtagcgacagacaga

SEQ ID NO: 573657 - DNA, 20 bp, Artificial
  CRISPR gRNA sequence
gtgtagcgacagacagatgg

SEQ ID NO: 573658 - DNA, 20 bp, Artificial
  CRISPR gRNA sequence
tgtagcgacagacagatggc

SEQ ID NO: 573659 - DNA, 20 bp, Artificial
  CRISPR gRNA sequence
tagcgacagacagatggcgg

SEQ ID NO: 573660 - DNA, 20 bp, Artificial
  CRISPR gRNA sequence
gacagacagatggcgggaga

SEQ ID NO: 573661 - DNA, 20 bp, Artificial
  CRISPR gRNA sequence
cagacagatggcgggagaaa

SEQ ID NO: 573662 - DNA, 20 bp, Artificial
  CRISPR gRNA sequence
gacagatggcgggagaaaga

SEQ ID NO: 573663 - DNA, 20 bp, Artificial
  CRISPR gRNA sequence
acagatggcgggagaaagag

SEQ ID NO: 573664 - DNA, 20 bp, Artificial
  CRISPR gRNA sequence
gatggcgggagaaagagagg

SEQ ID NO: 573665 - DNA, 20 bp, Artificial
  CRISPR gRNA sequence
tggcgggagaaagagaggca

SEQ ID NO: 573666 - DNA, 20 bp, Artificial
  CRISPR gRNA sequence
agaggcagagaaacatgtaa

SEQ ID NO: 573667 - DNA, 20 bp, Artificial
  CRISPR gRNA sequence
aggcagagaaacatgtaaaa

SEQ ID NO: 573668 - DNA, 20 bp, Artificial
  CRISPR gRNA sequence
agagaaacatgtaaaagagc

SEQ ID NO: 573669 - DNA, 20 bp, Artificial
  CRISPR gRNA sequence
aaacatgtaaaagagcaaga

SEQ ID NO: 573670 - DNA, 20 bp, Artificial
  CRISPR gRNA sequence
aacatgtaaaagagcaagac

SEQ ID NO: 573671 - DNA, 20 bp, Artificial
  CRISPR gRNA sequence
acatgtaaaagagcaagaca

SEQ ID NO: 573672 - DNA, 20 bp, Artificial
  CRISPR gRNA sequence
gtaaaagagcaagacagggt

SEQ ID NO: 573673 - DNA, 20 bp, Artificial
  CRISPR gRNA sequence
aaagagcaagacagggtgag

SEQ ID NO: 573674 - DNA, 20 bp, Artificial
  CRISPR gRNA sequence
agagcaagacagggtgagca

SEQ ID NO: 573675 - DNA, 20 bp, Artificial
  CRISPR gRNA sequence
agcaagacagggtgagcaga

SEQ ID NO: 573676 - DNA, 20 bp, Artificial
  CRISPR gRNA sequence
agacagggtgagcagagaga

SEQ ID NO: 573677 - DNA, 20 bp, Artificial
  CRISPR gRNA sequence
acagggtgagcagagagaca

SEQ ID NO: 573678 - DNA, 20 bp, Artificial
  CRISPR gRNA sequence
gggtgagcagagagacagag

SEQ ID NO: 573679 - DNA, 20 bp, Artificial
  CRISPR gRNA sequence
ggtgagcagagagacagaga

SEQ ID NO: 573680 - DNA, 20 bp, Artificial
  CRISPR gRNA sequence
gcagagagacagagaaggat

SEQ ID NO: 573681 - DNA, 20 bp, Artificial
  CRISPR gRNA sequence
agagagacagagaaggatga

SEQ ID NO: 573682 - DNA, 20 bp, Artificial
  CRISPR gRNA sequence
gagagacagagaaggatgag

SEQ ID NO: 573683 - DNA, 20 bp, Artificial
  CRISPR gRNA sequence
agagaaggatgagaggcatc

SEQ ID NO: 573684 - DNA, 20 bp, Artificial
  CRISPR gRNA sequence
agaaggatgagaggcatcaa

SEQ ID NO: 573685 - DNA, 20 bp, Artificial
  CRISPR gRNA sequence
gatgagaggcatcaagagct

SEQ ID NO: 573686 - DNA, 20 bp, Artificial
  CRISPR gRNA sequence
tgagaggcatcaagagctaa

SEQ ID NO: 573687 - DNA, 20 bp, Artificial
  CRISPR gRNA sequence
gcatcaagagctaagagaca

SEQ ID NO: 573688 - DNA, 20 bp, Artificial
  CRISPR gRNA sequence
atcaagagctaagagacaaa

SEQ ID NO: 573689 - DNA, 20 bp, Artificial
  CRISPR gRNA sequence
gagctaagagacaaagagat

SEQ ID NO: 573690 - DNA, 20 bp, Artificial
  CRISPR gRNA sequence
gctaagagacaaagagatga

SEQ ID NO: 573691 - DNA, 20 bp, Artificial
  CRISPR gRNA sequence
taagagacaaagagatgaga

SEQ ID NO: 573692 - DNA, 20 bp, Artificial
  CRISPR gRNA sequence
acaaagagatgagagagatg

SEQ ID NO: 573693 - DNA, 20 bp, Artificial
  CRISPR gRNA sequence
agagatgcagttgaaatttt

SEQ ID NO: 573694 - DNA, 20 bp, Artificial
  CRISPR gRNA sequence
ttgaaattttcagttgcacc

SEQ ID NO: 573695 - DNA, 20 bp, Artificial
  CRISPR gRNA sequence
aattttcagttgcacctgga

SEQ ID NO: 573696 - DNA, 20 bp, Artificial
  CRISPR gRNA sequence
ttgcacctggacagcatttc

SEQ ID NO: 573697 - DNA, 20 bp, Artificial
  CRISPR gRNA sequence
acagcatttcaagttgttca

SEQ ID NO: 573698 - DNA, 20 bp, Artificial
  CRISPR gRNA sequence
tcaaagctctgaaatccata

SEQ ID NO: 573699 - DNA, 20 bp, Artificial
  CRISPR gRNA sequence
gctctgaaatccataaagac

SEQ ID NO: 573700 - DNA, 20 bp, Artificial
  CRISPR gRNA sequence
ctgaaatccataaagactgg

SEQ ID NO: 573701 - DNA, 20 bp, Artificial
  CRISPR gRNA sequence
tttgcccctgcccatgcatt

SEQ ID NO: 573702 - DNA, 20 bp, Artificial
  CRISPR gRNA sequence
gcattaagtacttcaccttt

SEQ ID NO: 573703 - DNA, 20 bp, Artificial
  CRISPR gRNA sequence
tttattctattattttttta

SEQ ID NO: 573704 - DNA, 20 bp, Artificial
  CRISPR gRNA sequence
atttttttaaagaccttacc

SEQ ID NO: 573705 - DNA, 20 bp, Artificial
  CRISPR gRNA sequence
ttttaaagaccttacctggc

SEQ ID NO: 573706 - DNA, 20 bp, Artificial
  CRISPR gRNA sequence
accttacctggctggaatca

SEQ ID NO: 573707 - DNA, 20 bp, Artificial
  CRISPR gRNA sequence
ttacctggctggaatcacgg

SEQ ID NO: 573708 - DNA, 20 bp, Artificial
  CRISPR gRNA sequence
ctggctggaatcacggtagc

SEQ ID NO: 573709 - DNA, 20 bp, Artificial
  CRISPR gRNA sequence
tggctggaatcacggtagct

SEQ ID NO: 573710 - DNA, 20 bp, Artificial
  CRISPR gRNA sequence
ctgggtacatcccactgtac

SEQ ID NO: 573711 - DNA, 20 bp, Artificial
  CRISPR gRNA sequence
gggtacatcccactgtacca

SEQ ID NO: 573712 - DNA, 20 bp, Artificial
  CRISPR gRNA sequence
ggtacatcccactgtaccag

SEQ ID NO: 573713 - DNA, 20 bp, Artificial
  CRISPR gRNA sequence
gtacatcccactgtaccaga

SEQ ID NO: 573714 - DNA, 20 bp, Artificial
  CRISPR gRNA sequence
ctccctgccatctcctccaa

SEQ ID NO: 573715 - DNA, 20 bp, Artificial
  CRISPR gRNA sequence
tccctgccatctcctccaat

SEQ ID NO: 573716 - DNA, 20 bp, Artificial
  CRISPR gRNA sequence
ccctgccatctcctccaatg

SEQ ID NO: 573717 - DNA, 20 bp, Artificial
  CRISPR gRNA sequence
cctccaatggggcccacatc

SEQ ID NO: 573718 - DNA, 20 bp, Artificial
  CRISPR gRNA sequence
ccaatggggcccacatctgg

SEQ ID NO: 573719 - DNA, 20 bp, Artificial
  CRISPR gRNA sequence
caatggggcccacatctggt

SEQ ID NO: 573720 - DNA, 20 bp, Artificial
  CRISPR gRNA sequence
aatggggcccacatctggta

SEQ ID NO: 573721 - DNA, 20 bp, Artificial
  CRISPR gRNA sequence
atggggcccacatctggtag

SEQ ID NO: 573722 - DNA, 20 bp, Artificial
  CRISPR gRNA sequence
ggggcccacatctggtaggg

SEQ ID NO: 573723 - DNA, 20 bp, Artificial
  CRISPR gRNA sequence
ggcccacatctggtagggga

SEQ ID NO: 573724 - DNA, 20 bp, Artificial
  CRISPR gRNA sequence
ccacatctggtaggggagag

SEQ ID NO: 573725 - DNA, 20 bp, Artificial
  CRISPR gRNA sequence
cacatctggtaggggagagc

SEQ ID NO: 573726 - DNA, 20 bp, Artificial
  CRISPR gRNA sequence
acatctggtaggggagagca

SEQ ID NO: 573727 - DNA, 20 bp, Artificial
  CRISPR gRNA sequence
gagagcagggacactcacct

SEQ ID NO: 573728 - DNA, 20 bp, Artificial
  CRISPR gRNA sequence
cagggacactcaccttggtg

SEQ ID NO: 573729 - DNA, 20 bp, Artificial
  CRISPR gRNA sequence
ggacactcaccttggtgaag

SEQ ID NO: 573730 - DNA, 20 bp, Artificial
  CRISPR gRNA sequence
accttggtgaagtggactga

SEQ ID NO: 573731 - DNA, 20 bp, Artificial
  CRISPR gRNA sequence
ggtgaagtggactgacagaa

SEQ ID NO: 573732 - DNA, 20 bp, Artificial
  CRISPR gRNA sequence
gtgaagtggactgacagaaa

SEQ ID NO: 573733 - DNA, 20 bp, Artificial
  CRISPR gRNA sequence
gtggactgacagaaaaggat

SEQ ID NO: 573734 - DNA, 20 bp, Artificial
  CRISPR gRNA sequence
ctgacagaaaaggatcagcc

SEQ ID NO: 573735 - DNA, 20 bp, Artificial
  CRISPR gRNA sequence
aaaaggatcagcctggcttg

SEQ ID NO: 573736 - DNA, 20 bp, Artificial
  CRISPR gRNA sequence
aaaggatcagcctggcttgt

SEQ ID NO: 573737 - DNA, 20 bp, Artificial
  CRISPR gRNA sequence
aacaactttgcttttatacc

SEQ ID NO: 573738 - DNA, 20 bp, Artificial
  CRISPR gRNA sequence
aactttgcttttataccgag

SEQ ID NO: 573739 - DNA, 20 bp, Artificial
  CRISPR gRNA sequence
agaagaaaaaccacgctgta

SEQ ID NO: 573740 - DNA, 20 bp, Artificial
  CRISPR gRNA sequence
aaaaaccacgctgtacggtg

SEQ ID NO: 573741 - DNA, 20 bp, Artificial
  CRISPR gRNA sequence
aaccacgctgtacggtgtgg

SEQ ID NO: 573742 - DNA, 20 bp, Artificial
  CRISPR gRNA sequence
gctgtacggtgtggaagccg

SEQ ID NO: 573743 - DNA, 20 bp, Artificial
  CRISPR gRNA sequence
taatccaaatttttttcgat

SEQ ID NO: 573744 - DNA, 20 bp, Artificial
  CRISPR gRNA sequence
agtgtgtgcgctgataatca

SEQ ID NO: 573745 - DNA, 20 bp, Artificial
  CRISPR gRNA sequence
gtgtgtgcgctgataatcac

SEQ ID NO: 573746 - DNA, 20 bp, Artificial
  CRISPR gRNA sequence
tgtgtgcgctgataatcacg

SEQ ID NO: 573747 - DNA, 20 bp, Artificial
  CRISPR gRNA sequence
gtgcgctgataatcacgggg

SEQ ID NO: 573748 - DNA, 20 bp, Artificial
  CRISPR gRNA sequence
tgcgctgataatcacggggt

SEQ ID NO: 573749 - DNA, 20 bp, Artificial
  CRISPR gRNA sequence
gcgctgataatcacggggtg

SEQ ID NO: 573750 - DNA, 20 bp, Artificial
  CRISPR gRNA sequence
gctgataatcacggggtggg

SEQ ID NO: 573751 - DNA, 20 bp, Artificial
  CRISPR gRNA sequence
ctgataatcacggggtgggg

SEQ ID NO: 573752 - DNA, 20 bp, Artificial
  CRISPR gRNA sequence
tgataatcacggggtgggga

SEQ ID NO: 573753 - DNA, 20 bp, Artificial
  CRISPR gRNA sequence
gataatcacggggtggggag

SEQ ID NO: 573754 - DNA, 20 bp, Artificial
  CRISPR gRNA sequence
ggggtggggaggggttctca

SEQ ID NO: 573755 - DNA, 20 bp, Artificial
  CRISPR gRNA sequence
tttctccttttcttgattat

SEQ ID NO: 573756 - DNA, 20 bp, Artificial
  CRISPR gRNA sequence
tcttgattatgagacttaaa

SEQ ID NO: 573757 - DNA, 20 bp, Artificial
  CRISPR gRNA sequence
aaacggaaattttgaaattt

SEQ ID NO: 573758 - DNA, 20 bp, Artificial
  CRISPR gRNA sequence
aacggaaattttgaaatttt

SEQ ID NO: 573759 - DNA, 20 bp, Artificial
  CRISPR gRNA sequence
tttttttctttgccctttac

SEQ ID NO: 573760 - DNA, 20 bp, Artificial
  CRISPR gRNA sequence
atgatttcttcccctcacca

SEQ ID NO: 573761 - DNA, 20 bp, Artificial
  CRISPR gRNA sequence
gatttcttcccctcaccaca

SEQ ID NO: 573762 - DNA, 20 bp, Artificial
  CRISPR gRNA sequence
atttcttcccctcaccacag

SEQ ID NO: 573763 - DNA, 20 bp, Artificial
  CRISPR gRNA sequence
cttcccctcaccacagaggt

SEQ ID NO: 573764 - DNA, 20 bp, Artificial
  CRISPR gRNA sequence
tcccctcaccacagaggtga

SEQ ID NO: 573765 - DNA, 20 bp, Artificial
  CRISPR gRNA sequence
cccctcaccacagaggtgag

SEQ ID NO: 573766 - DNA, 20 bp, Artificial
  CRISPR gRNA sequence
cagaggtgagaggtatcaat

SEQ ID NO: 573767 - DNA, 20 bp, Artificial
  CRISPR gRNA sequence
gagaggtatcaatgagataa

SEQ ID NO: 573768 - DNA, 20 bp, Artificial
  CRISPR gRNA sequence
agaggtatcaatgagataat

SEQ ID NO: 573769 - DNA, 20 bp, Artificial
  CRISPR gRNA sequence
gaggtatcaatgagataata

SEQ ID NO: 573770 - DNA, 20 bp, Artificial
  CRISPR gRNA sequence
aatgagataatagggctcat

SEQ ID NO: 573771 - DNA, 20 bp, Artificial
  CRISPR gRNA sequence
atagggctcatgagaaacca

SEQ ID NO: 573772 - DNA, 20 bp, Artificial
  CRISPR gRNA sequence
aaccacagtttttaaaacaa

SEQ ID NO: 573773 - DNA, 20 bp, Artificial
  CRISPR gRNA sequence
gtttttaaaacaaaagtgta

SEQ ID NO: 573774 - DNA, 20 bp, Artificial
  CRISPR gRNA sequence
ttttaaaacaaaagtgtata

SEQ ID NO: 573775 - DNA, 20 bp, Artificial
  CRISPR gRNA sequence
gagtttgaaaaaaaaaaaac

SEQ ID NO: 573776 - DNA, 20 bp, Artificial
  CRISPR gRNA sequence
agtttgaaaaaaaaaaaaca

SEQ ID NO: 573777 - DNA, 20 bp, Artificial
  CRISPR gRNA sequence
gtttgaaaaaaaaaaaacaa

SEQ ID NO: 573778 - DNA, 20 bp, Artificial
  CRISPR gRNA sequence
aaaaaaaaaaaacaagggaa

SEQ ID NO: 573779 - DNA, 20 bp, Artificial
  CRISPR gRNA sequence
aaaagaactaaaataaatca

SEQ ID NO: 573780 - DNA, 20 bp, Artificial
  CRISPR gRNA sequence
aaagaactaaaataaatcac

SEQ ID NO: 573781 - DNA, 20 bp, Artificial
  CRISPR gRNA sequence
aagaactaaaataaatcaca

SEQ ID NO: 573782 - DNA, 20 bp, Artificial
  CRISPR gRNA sequence
ataaatcacagggccaaccc

SEQ ID NO: 573783 - DNA, 20 bp, Artificial
  CRISPR gRNA sequence
taaatcacagggccaacccg

SEQ ID NO: 573784 - DNA, 20 bp, Artificial
  CRISPR gRNA sequence
atcacagggccaacccgagg

SEQ ID NO: 573785 - DNA, 20 bp, Artificial
  CRISPR gRNA sequence
tcacagggccaacccgaggc

SEQ ID NO: 573786 - DNA, 20 bp, Artificial
  CRISPR gRNA sequence
cagggccaacccgaggcagg

SEQ ID NO: 573787 - DNA, 20 bp, Artificial
  CRISPR gRNA sequence
gggccaacccgaggcaggca

SEQ ID NO: 573788 - DNA, 20 bp, Artificial
  CRISPR gRNA sequence
aggcagagacaccattctgt

SEQ ID NO: 573789 - DNA, 20 bp, Artificial
  CRISPR gRNA sequence
agagacaccattctgtgagt

SEQ ID NO: 573790 - DNA, 20 bp, Artificial
  CRISPR gRNA sequence
agacaccattctgtgagtga

SEQ ID NO: 573791 - DNA, 20 bp, Artificial
  CRISPR gRNA sequence
gacaccattctgtgagtgag

SEQ ID NO: 573792 - DNA, 20 bp, Artificial
  CRISPR gRNA sequence
ctgtgagtgagaggatattt

SEQ ID NO: 573793 - DNA, 20 bp, Artificial
  CRISPR gRNA sequence
tgtgagtgagaggatatttg

SEQ ID NO: 573794 - DNA, 20 bp, Artificial
  CRISPR gRNA sequence
gtgagtgagaggatatttga

SEQ ID NO: 573795 - DNA, 20 bp, Artificial
  CRISPR gRNA sequence
agaggatatttgagggtctc

SEQ ID NO: 573796 - DNA, 20 bp, Artificial
  CRISPR gRNA sequence
gaggatatttgagggtctct

SEQ ID NO: 573797 - DNA, 20 bp, Artificial
  CRISPR gRNA sequence
aggatatttgagggtctctg

SEQ ID NO: 573798 - DNA, 20 bp, Artificial
  CRISPR gRNA sequence
tatttgagggtctctgggga

SEQ ID NO: 573799 - DNA, 20 bp, Artificial
  CRISPR gRNA sequence
tgagggtctctggggaaaga

SEQ ID NO: 573800 - DNA, 20 bp, Artificial
  CRISPR gRNA sequence
agggtctctggggaaagaaa

SEQ ID NO: 573801 - DNA, 20 bp, Artificial
  CRISPR gRNA sequence
ggggaaagaaagagaatctg

SEQ ID NO: 573802 - DNA, 20 bp, Artificial
  CRISPR gRNA sequence
agaatctgaagctctatgtg

SEQ ID NO: 573803 - DNA, 20 bp, Artificial
  CRISPR gRNA sequence
tctgaagctctatgtgtgga

SEQ ID NO: 573804 - DNA, 20 bp, Artificial
  CRISPR gRNA sequence
ctgaagctctatgtgtggat

SEQ ID NO: 573805 - DNA, 20 bp, Artificial
  CRISPR gRNA sequence
tatgtgtggatgggaaatgc

SEQ ID NO: 573806 - DNA, 20 bp, Artificial
  CRISPR gRNA sequence
atgtgtggatgggaaatgcc

SEQ ID NO: 573807 - DNA, 20 bp, Artificial
  CRISPR gRNA sequence
tgtgtggatgggaaatgcca

SEQ ID NO: 573808 - DNA, 20 bp, Artificial
  CRISPR gRNA sequence
tggatgggaaatgccaggga

SEQ ID NO: 573809 - DNA, 20 bp, Artificial
  CRISPR gRNA sequence
gatgggaaatgccagggaaa

SEQ ID NO: 573810 - DNA, 20 bp, Artificial
  CRISPR gRNA sequence
ggaaatgccagggaaagaga

SEQ ID NO: 573811 - DNA, 20 bp, Artificial
  CRISPR gRNA sequence
tgccagggaaagagacagaa

SEQ ID NO: 573812 - DNA, 20 bp, Artificial
  CRISPR gRNA sequence
gccagggaaagagacagaat

SEQ ID NO: 573813 - DNA, 20 bp, Artificial
  CRISPR gRNA sequence
ccagggaaagagacagaata

SEQ ID NO: 573814 - DNA, 20 bp, Artificial
  CRISPR gRNA sequence
ggaaagagacagaatagggc

SEQ ID NO: 573815 - DNA, 20 bp, Artificial
  CRISPR gRNA sequence
gaaagagacagaatagggct

SEQ ID NO: 573816 - DNA, 20 bp, Artificial
  CRISPR gRNA sequence
acagaatagggctgggttcc

SEQ ID NO: 573817 - DNA, 20 bp, Artificial
  CRISPR gRNA sequence
agaatagggctgggttccca

SEQ ID NO: 573818 - DNA, 20 bp, Artificial
  CRISPR gRNA sequence
gaatagggctgggttcccag

SEQ ID NO: 573819 - DNA, 20 bp, Artificial
  CRISPR gRNA sequence
ccagaggcctcgccctactc

SEQ ID NO: 573820 - DNA, 20 bp, Artificial
  CRISPR gRNA sequence
cagaggcctcgccctactcc

SEQ ID NO: 573821 - DNA, 20 bp, Artificial
  CRISPR gRNA sequence
cctcgccctactccaggcct

SEQ ID NO: 573822 - DNA, 20 bp, Artificial
  CRISPR gRNA sequence
tccaggcctcagtttcccta

SEQ ID NO: 573823 - DNA, 20 bp, Artificial
  CRISPR gRNA sequence
ggcctcagtttccctataga

SEQ ID NO: 573824 - DNA, 20 bp, Artificial
  CRISPR gRNA sequence
ccctatagatggaattgata

SEQ ID NO: 573825 - DNA, 20 bp, Artificial
  CRISPR gRNA sequence
tccccattgcttgaactacc

SEQ ID NO: 573826 - DNA, 20 bp, Artificial
  CRISPR gRNA sequence
cattgcttgaactacccggc

SEQ ID NO: 573827 - DNA, 20 bp, Artificial
  CRISPR gRNA sequence
attgcttgaactacccggcg

SEQ ID NO: 573828 - DNA, 20 bp, Artificial
  CRISPR gRNA sequence
ttgcttgaactacccggcga

SEQ ID NO: 573829 - DNA, 20 bp, Artificial
  CRISPR gRNA sequence
tgcttgaactacccggcgag

SEQ ID NO: 573830 - DNA, 20 bp, Artificial
  CRISPR gRNA sequence
cttgaactacccggcgaggg

SEQ ID NO: 573831 - DNA, 20 bp, Artificial
  CRISPR gRNA sequence
cccctgcaacacccctccca

SEQ ID NO: 573832 - DNA, 20 bp, Artificial
  CRISPR gRNA sequence
cctgcaacacccctcccaca

SEQ ID NO: 573833 - DNA, 20 bp, Artificial
  CRISPR gRNA sequence
ctgcaacacccctcccacag

SEQ ID NO: 573834 - DNA, 20 bp, Artificial
  CRISPR gRNA sequence
tgcaacacccctcccacaga

SEQ ID NO: 573835 - DNA, 20 bp, Artificial
  CRISPR gRNA sequence
acacccctcccacagagggt

SEQ ID NO: 573836 - DNA, 20 bp, Artificial
  CRISPR gRNA sequence
cacccctcccacagagggtg

SEQ ID NO: 573837 - DNA, 20 bp, Artificial
  CRISPR gRNA sequence
acccctcccacagagggtga

SEQ ID NO: 573838 - DNA, 20 bp, Artificial
  CRISPR gRNA sequence
cccctcccacagagggtgag

SEQ ID NO: 573839 - DNA, 20 bp, Artificial
  CRISPR gRNA sequence
acagagggtgaggggcatgt

SEQ ID NO: 573840 - DNA, 20 bp, Artificial
  CRISPR gRNA sequence
ggggcatgtaagttacttca

SEQ ID NO: 573841 - DNA, 20 bp, Artificial
  CRISPR gRNA sequence
ggcatgtaagttacttcatg

SEQ ID NO: 573842 - DNA, 20 bp, Artificial
  CRISPR gRNA sequence
gcatgtaagttacttcatgg

SEQ ID NO: 573843 - DNA, 20 bp, Artificial
  CRISPR gRNA sequence
atgtaagttacttcatggag

SEQ ID NO: 573844 - DNA, 20 bp, Artificial
  CRISPR gRNA sequence
aagttacttcatggaggaga

SEQ ID NO: 573845 - DNA, 20 bp, Artificial
  CRISPR gRNA sequence
ttacttcatggaggagaaag

SEQ ID NO: 573846 - DNA, 20 bp, Artificial
  CRISPR gRNA sequence
acttcatggaggagaaagcg

SEQ ID NO: 573847 - DNA, 20 bp, Artificial
  CRISPR gRNA sequence
ttcatggaggagaaagcgga

SEQ ID NO: 573848 - DNA, 20 bp, Artificial
  CRISPR gRNA sequence
ctgtcatcccctaaaattca

SEQ ID NO: 573849 - DNA, 20 bp, Artificial
  CRISPR gRNA sequence
ccctaaaattcatggacttg

SEQ ID NO: 573850 - DNA, 20 bp, Artificial
  CRISPR gRNA sequence
ctaaaattcatggacttgaa

SEQ ID NO: 573851 - DNA, 20 bp, Artificial
  CRISPR gRNA sequence
aattcatggacttgaagagt

SEQ ID NO: 573852 - DNA, 20 bp, Artificial
  CRISPR gRNA sequence
ttcatggacttgaagagtcg

SEQ ID NO: 573853 - DNA, 20 bp, Artificial
  CRISPR gRNA sequence
ttgaagagtcggagaatccc

SEQ ID NO: 573854 - DNA, 20 bp, Artificial
  CRISPR gRNA sequence
gtcggagaatccctggctcc

SEQ ID NO: 573855 - DNA, 20 bp, Artificial
  CRISPR gRNA sequence
tggctcccagaatctactga

SEQ ID NO: 573856 - DNA, 20 bp, Artificial
  CRISPR gRNA sequence
tctactgacagttactgaat

SEQ ID NO: 573857 - DNA, 20 bp, Artificial
  CRISPR gRNA sequence
ctactgacagttactgaatg

SEQ ID NO: 573858 - DNA, 20 bp, Artificial
  CRISPR gRNA sequence
tgacagttactgaatgagga

SEQ ID NO: 573859 - DNA, 20 bp, Artificial
  CRISPR gRNA sequence
acagttactgaatgaggaaa

SEQ ID NO: 573860 - DNA, 20 bp, Artificial
  CRISPR gRNA sequence
agttactgaatgaggaaaga

SEQ ID NO: 573861 - DNA, 20 bp, Artificial
  CRISPR gRNA sequence
ctgaatgaggaaagagagaa

SEQ ID NO: 573862 - DNA, 20 bp, Artificial
  CRISPR gRNA sequence
agtctcgcctcatcacgttt

SEQ ID NO: 573863 - DNA, 20 bp, Artificial
  CRISPR gRNA sequence
gtctcgcctcatcacgtttt

SEQ ID NO: 573864 - DNA, 20 bp, Artificial
  CRISPR gRNA sequence
tctcgcctcatcacgtttta

SEQ ID NO: 573865 - DNA, 20 bp, Artificial
  CRISPR gRNA sequence
ctcatcacgttttagggctt

SEQ ID NO: 573866 - DNA, 20 bp, Artificial
  CRISPR gRNA sequence
agggcttgagtgccctgacc

SEQ ID NO: 573867 - DNA, 20 bp, Artificial
  CRISPR gRNA sequence
tgacccagccactgtcccac

SEQ ID NO: 573868 - DNA, 20 bp, Artificial
  CRISPR gRNA sequence
gacccagccactgtcccact

SEQ ID NO: 573869 - DNA, 20 bp, Artificial
  CRISPR gRNA sequence
ccagccactgtcccactggg

SEQ ID NO: 573870 - DNA, 20 bp, Artificial
  CRISPR gRNA sequence
cagccactgtcccactggga

SEQ ID NO: 573871 - DNA, 20 bp, Artificial
  CRISPR gRNA sequence
tgtcccactgggaaggtccc

SEQ ID NO: 573872 - DNA, 20 bp, Artificial
  CRISPR gRNA sequence
cccactgggaaggtccctag

SEQ ID NO: 573873 - DNA, 20 bp, Artificial
  CRISPR gRNA sequence
ccactgggaaggtccctagc

SEQ ID NO: 573874 - DNA, 20 bp, Artificial
  CRISPR gRNA sequence
tccatcctcacgatgaaccc

SEQ ID NO: 573875 - DNA, 20 bp, Artificial
  CRISPR gRNA sequence
catcctcacgatgaacccca

SEQ ID NO: 573876 - DNA, 20 bp, Artificial
  CRISPR gRNA sequence
atcctcacgatgaaccccag

SEQ ID NO: 573877 - DNA, 20 bp, Artificial
  CRISPR gRNA sequence
gatgaaccccagaggcccat

SEQ ID NO: 573878 - DNA, 20 bp, Artificial
  CRISPR gRNA sequence
atgaaccccagaggcccatt

SEQ ID NO: 573879 - DNA, 20 bp, Artificial
  CRISPR gRNA sequence
ggaccctgaccctcttgttt

SEQ ID NO: 573880 - DNA, 20 bp, Artificial
  CRISPR gRNA sequence
gaccctgaccctcttgtttc

SEQ ID NO: 573881 - DNA, 20 bp, Artificial
  CRISPR gRNA sequence
ctcttgtttcaggaacatca

SEQ ID NO: 573882 - DNA, 20 bp, Artificial
  CRISPR gRNA sequence
catcatggcctgatgcttct

SEQ ID NO: 573883 - DNA, 20 bp, Artificial
  CRISPR gRNA sequence
atcatggcctgatgcttctg

SEQ ID NO: 573884 - DNA, 20 bp, Artificial
  CRISPR gRNA sequence
cctgatgcttctgaggccct

SEQ ID NO: 573885 - DNA, 20 bp, Artificial
  CRISPR gRNA sequence
cttctgaggccctcagcctt

SEQ ID NO: 573886 - DNA, 20 bp, Artificial
  CRISPR gRNA sequence
ttctgaggccctcagccttt

SEQ ID NO: 573887 - DNA, 20 bp, Artificial
  CRISPR gRNA sequence
tctgaggccctcagcctttg

SEQ ID NO: 573888 - DNA, 20 bp, Artificial
  CRISPR gRNA sequence
ttggggtcttttacttcaaa

SEQ ID NO: 573889 - DNA, 20 bp, Artificial
  CRISPR gRNA sequence
tcttttacttcaaaaagccc

SEQ ID NO: 573890 - DNA, 20 bp, Artificial
  CRISPR gRNA sequence
ttcaaaaagccccagtttcc

SEQ ID NO: 573891 - DNA, 20 bp, Artificial
  CRISPR gRNA sequence
tcaaaaagccccagtttcca

SEQ ID NO: 573892 - DNA, 20 bp, Artificial
  CRISPR gRNA sequence
agccccagtttccaaggatt

SEQ ID NO: 573893 - DNA, 20 bp, Artificial
  CRISPR gRNA sequence
gccccagtttccaaggattt

SEQ ID NO: 573894 - DNA, 20 bp, Artificial
  CRISPR gRNA sequence
ccaaatatccgccatcatct

SEQ ID NO: 573895 - DNA, 20 bp, Artificial
  CRISPR gRNA sequence
aatatccgccatcatctcag

SEQ ID NO: 573896 - DNA, 20 bp, Artificial
  CRISPR gRNA sequence
tgtttatcttgaattttcca

SEQ ID NO: 573897 - DNA, 20 bp, Artificial
  CRISPR gRNA sequence
gtttatcttgaattttccat

SEQ ID NO: 573898 - DNA, 20 bp, Artificial
  CRISPR gRNA sequence
atcttgaattttccatgggt

SEQ ID NO: 573899 - DNA, 20 bp, Artificial
  CRISPR gRNA sequence
aattttccatgggtcagata

SEQ ID NO: 573900 - DNA, 20 bp, Artificial
  CRISPR gRNA sequence
cagtgctgaacatgtctcac

SEQ ID NO: 573901 - DNA, 20 bp, Artificial
  CRISPR gRNA sequence
atcatgttcaatcctcacca

SEQ ID NO: 573902 - DNA, 20 bp, Artificial
  CRISPR gRNA sequence
aatcctcaccatggcccctt

SEQ ID NO: 573903 - DNA, 20 bp, Artificial
  CRISPR gRNA sequence
attattgtattcctgttata

SEQ ID NO: 573904 - DNA, 20 bp, Artificial
  CRISPR gRNA sequence
tgtattcctgttatacagat

SEQ ID NO: 573905 - DNA, 20 bp, Artificial
  CRISPR gRNA sequence
gtattcctgttatacagatg

SEQ ID NO: 573906 - DNA, 20 bp, Artificial
  CRISPR gRNA sequence
tattcctgttatacagatga

SEQ ID NO: 573907 - DNA, 20 bp, Artificial
  CRISPR gRNA sequence
tgttatacagatgagggaaa

SEQ ID NO: 573908 - DNA, 20 bp, Artificial
  CRISPR gRNA sequence
ttatacagatgagggaaacg

SEQ ID NO: 573909 - DNA, 20 bp, Artificial
  CRISPR gRNA sequence
tatacagatgagggaaacgg

SEQ ID NO: 573910 - DNA, 20 bp, Artificial
  CRISPR gRNA sequence
gatgagggaaacggaggtat

SEQ ID NO: 573911 - DNA, 20 bp, Artificial
  CRISPR gRNA sequence
gagggaaacggaggtataag

SEQ ID NO: 573912 - DNA, 20 bp, Artificial
  CRISPR gRNA sequence
aaacggaggtataagtagtc

SEQ ID NO: 573913 - DNA, 20 bp, Artificial
  CRISPR gRNA sequence
agtagtcaagcaacttgccc

SEQ ID NO: 573914 - DNA, 20 bp, Artificial
  CRISPR gRNA sequence
aagcaacttgcccaagatca

SEQ ID NO: 573915 - DNA, 20 bp, Artificial
  CRISPR gRNA sequence
gcaacttgcccaagatcaca

SEQ ID NO: 573916 - DNA, 20 bp, Artificial
  CRISPR gRNA sequence
cttgcccaagatcacagagc

SEQ ID NO: 573917 - DNA, 20 bp, Artificial
  CRISPR gRNA sequence
cccaagatcacagagctggc

SEQ ID NO: 573918 - DNA, 20 bp, Artificial
  CRISPR gRNA sequence
gatcacagagctggcgagtg

SEQ ID NO: 573919 - DNA, 20 bp, Artificial
  CRISPR gRNA sequence
atcacagagctggcgagtgt

SEQ ID NO: 573920 - DNA, 20 bp, Artificial
  CRISPR gRNA sequence
agtgtgggtcccgctttctt

SEQ ID NO: 573921 - DNA, 20 bp, Artificial
  CRISPR gRNA sequence
ggtcccgctttctttggtgc

SEQ ID NO: 573922 - DNA, 20 bp, Artificial
  CRISPR gRNA sequence
gtcccgctttctttggtgct

SEQ ID NO: 573923 - DNA, 20 bp, Artificial
  CRISPR gRNA sequence
tgctgggctttgaaatcccc

SEQ ID NO: 573924 - DNA, 20 bp, Artificial
  CRISPR gRNA sequence
tttcctgaacttgatgttct

SEQ ID NO: 573925 - DNA, 20 bp, Artificial
  CRISPR gRNA sequence
ttcctgaacttgatgttctc

SEQ ID NO: 573926 - DNA, 20 bp, Artificial
  CRISPR gRNA sequence
tgttctcaggttttaaattc

SEQ ID NO: 573927 - DNA, 20 bp, Artificial
  CRISPR gRNA sequence
gttctcaggttttaaattct

SEQ ID NO: 573928 - DNA, 20 bp, Artificial
  CRISPR gRNA sequence
ttttaaattctaggatgtga

SEQ ID NO: 573929 - DNA, 20 bp, Artificial
  CRISPR gRNA sequence
taaattctaggatgtgatgg

SEQ ID NO: 573930 - DNA, 20 bp, Artificial
  CRISPR gRNA sequence
aaattctaggatgtgatggc

SEQ ID NO: 573931 - DNA, 20 bp, Artificial
  CRISPR gRNA sequence
aattctaggatgtgatggca

SEQ ID NO: 573932 - DNA, 20 bp, Artificial
  CRISPR gRNA sequence
ttctaggatgtgatggcagg

SEQ ID NO: 573933 - DNA, 20 bp, Artificial
  CRISPR gRNA sequence
atgtgatggcagggagatcc

SEQ ID NO: 573934 - DNA, 20 bp, Artificial
  CRISPR gRNA sequence
tgtgatggcagggagatcct

SEQ ID NO: 573935 - DNA, 20 bp, Artificial
  CRISPR gRNA sequence
ggcagggagatcctgggatt

SEQ ID NO: 573936 - DNA, 20 bp, Artificial
  CRISPR gRNA sequence
cagggagatcctgggatttg

SEQ ID NO: 573937 - DNA, 20 bp, Artificial
  CRISPR gRNA sequence
gggagatcctgggatttgga

SEQ ID NO: 573938 - DNA, 20 bp, Artificial
  CRISPR gRNA sequence
cctgggatttggagagtcct

SEQ ID NO: 573939 - DNA, 20 bp, Artificial
  CRISPR gRNA sequence
tgggatttggagagtccttg

SEQ ID NO: 573940 - DNA, 20 bp, Artificial
  CRISPR gRNA sequence
ggagagtccttggagacttg

SEQ ID NO: 573941 - DNA, 20 bp, Artificial
  CRISPR gRNA sequence
cttggagacttgaagcttgt

SEQ ID NO: 573942 - DNA, 20 bp, Artificial
  CRISPR gRNA sequence
ttggagacttgaagcttgtg

SEQ ID NO: 573943 - DNA, 20 bp, Artificial
  CRISPR gRNA sequence
cttgaagcttgtgaggcttt

SEQ ID NO: 573944 - DNA, 20 bp, Artificial
  CRISPR gRNA sequence
ttgaagcttgtgaggctttt

SEQ ID NO: 573945 - DNA, 20 bp, Artificial
  CRISPR gRNA sequence
tgtgaggcttttaggttgtc

SEQ ID NO: 573946 - DNA, 20 bp, Artificial
  CRISPR gRNA sequence
gtgaggcttttaggttgtcc

SEQ ID NO: 573947 - DNA, 20 bp, Artificial
  CRISPR gRNA sequence
cttttaggttgtccaggaat

SEQ ID NO: 573948 - DNA, 20 bp, Artificial
  CRISPR gRNA sequence
ttaggttgtccaggaattgg

SEQ ID NO: 573949 - DNA, 20 bp, Artificial
  CRISPR gRNA sequence
gcggctgcatctcttgacct

SEQ ID NO: 573950 - DNA, 20 bp, Artificial
  CRISPR gRNA sequence
gctgcatctcttgacctcag

SEQ ID NO: 573951 - DNA, 20 bp, Artificial
  CRISPR gRNA sequence
ctgcatctcttgacctcagc

SEQ ID NO: 573952 - DNA, 20 bp, Artificial
  CRISPR gRNA sequence
caggcactctattcaaccac

SEQ ID NO: 573953 - DNA, 20 bp, Artificial
  CRISPR gRNA sequence
cactctattcaaccactggt

SEQ ID NO: 573954 - DNA, 20 bp, Artificial
  CRISPR gRNA sequence
tattcaaccactggtcagca

SEQ ID NO: 573955 - DNA, 20 bp, Artificial
  CRISPR gRNA sequence
tcaaccactggtcagcatgg

SEQ ID NO: 573956 - DNA, 20 bp, Artificial
  CRISPR gRNA sequence
cactggtcagcatggtagac

SEQ ID NO: 573957 - DNA, 20 bp, Artificial
  CRISPR gRNA sequence
cagcatggtagaccagcccc

SEQ ID NO: 573958 - DNA, 20 bp, Artificial
  CRISPR gRNA sequence
agcatggtagaccagccccc

SEQ ID NO: 573959 - DNA, 20 bp, Artificial
  CRISPR gRNA sequence
gcatggtagaccagccccca

SEQ ID NO: 573960 - DNA, 20 bp, Artificial
  CRISPR gRNA sequence
catggtagaccagcccccag

SEQ ID NO: 573961 - DNA, 20 bp, Artificial
  CRISPR gRNA sequence
cccccaggggcttctcctga

SEQ ID NO: 573962 - DNA, 20 bp, Artificial
  CRISPR gRNA sequence
ccccaggggcttctcctgac

SEQ ID NO: 573963 - DNA, 20 bp, Artificial
  CRISPR gRNA sequence
gggcttctcctgacaggcca

SEQ ID NO: 573964 - DNA, 20 bp, Artificial
  CRISPR gRNA sequence
tctcctgacaggccatggtg

SEQ ID NO: 573965 - DNA, 20 bp, Artificial
  CRISPR gRNA sequence
caggccatggtgaagacttc

SEQ ID NO: 573966 - DNA, 20 bp, Artificial
  CRISPR gRNA sequence
tggtgaagacttccagctcc

SEQ ID NO: 573967 - DNA, 20 bp, Artificial
  CRISPR gRNA sequence
ccagctcccagcaccctgca

SEQ ID NO: 573968 - DNA, 20 bp, Artificial
  CRISPR gRNA sequence
tcccagcaccctgcaaagcc

SEQ ID NO: 573969 - DNA, 20 bp, Artificial
  CRISPR gRNA sequence
cccagcaccctgcaaagccc

SEQ ID NO: 573970 - DNA, 20 bp, Artificial
  CRISPR gRNA sequence
ccagcaccctgcaaagccca

SEQ ID NO: 573971 - DNA, 20 bp, Artificial
  CRISPR gRNA sequence
ccctgcaaagcccagggttc

SEQ ID NO: 573972 - DNA, 20 bp, Artificial
  CRISPR gRNA sequence
tagtcgtccaacaaccactc

SEQ ID NO: 573973 - DNA, 20 bp, Artificial
  CRISPR gRNA sequence
caaccactccagccctctac

SEQ ID NO: 573974 - DNA, 20 bp, Artificial
  CRISPR gRNA sequence
actccagccctctacaagac

SEQ ID NO: 573975 - DNA, 20 bp, Artificial
  CRISPR gRNA sequence
gccctctacaagactggctt

SEQ ID NO: 573976 - DNA, 20 bp, Artificial
  CRISPR gRNA sequence
tacaagactggcttcagacc

SEQ ID NO: 573977 - DNA, 20 bp, Artificial
  CRISPR gRNA sequence
acaagactggcttcagacct

SEQ ID NO: 573978 - DNA, 20 bp, Artificial
  CRISPR gRNA sequence
caagactggcttcagacctg

SEQ ID NO: 573979 - DNA, 20 bp, Artificial
  CRISPR gRNA sequence
gactggcttcagacctgggg

SEQ ID NO: 573980 - DNA, 20 bp, Artificial
  CRISPR gRNA sequence
ctggcttcagacctggggaa

SEQ ID NO: 573981 - DNA, 20 bp, Artificial
  CRISPR gRNA sequence
cagacctggggaagagaaat

SEQ ID NO: 573982 - DNA, 20 bp, Artificial
  CRISPR gRNA sequence
cctggggaagagaaattgga

SEQ ID NO: 573983 - DNA, 20 bp, Artificial
  CRISPR gRNA sequence
ctggggaagagaaattggaa

SEQ ID NO: 573984 - DNA, 20 bp, Artificial
  CRISPR gRNA sequence
tggggaagagaaattggaaa

SEQ ID NO: 573985 - DNA, 20 bp, Artificial
  CRISPR gRNA sequence
gaaagggctttttatttaca

SEQ ID NO: 573986 - DNA, 20 bp, Artificial
  CRISPR gRNA sequence
ttatttacatggtacaaatc

SEQ ID NO: 573987 - DNA, 20 bp, Artificial
  CRISPR gRNA sequence
tttacatggtacaaatctgg

SEQ ID NO: 573988 - DNA, 20 bp, Artificial
  CRISPR gRNA sequence
atggtacaaatctggtggcc

SEQ ID NO: 573989 - DNA, 20 bp, Artificial
  CRISPR gRNA sequence
ctttcctcccccaaccttct

SEQ ID NO: 573990 - DNA, 20 bp, Artificial
  CRISPR gRNA sequence
accttctaagccctcgtaaa

SEQ ID NO: 573991 - DNA, 20 bp, Artificial
  CRISPR gRNA sequence
ccttctaagccctcgtaaaa

SEQ ID NO: 573992 - DNA, 20 bp, Artificial
  CRISPR gRNA sequence
ttctaagccctcgtaaaaag

SEQ ID NO: 573993 - DNA, 20 bp, Artificial
  CRISPR gRNA sequence
tctaagccctcgtaaaaagg

SEQ ID NO: 573994 - DNA, 20 bp, Artificial
  CRISPR gRNA sequence
ctaagccctcgtaaaaagga

SEQ ID NO: 573995 - DNA, 20 bp, Artificial
  CRISPR gRNA sequence
gagggcctctttcctcaact

SEQ ID NO: 573996 - DNA, 20 bp, Artificial
  CRISPR gRNA sequence
tcaactcagactcacccttc

SEQ ID NO: 573997 - DNA, 20 bp, Artificial
  CRISPR gRNA sequence
tcagactcacccttctggaa

SEQ ID NO: 573998 - DNA, 20 bp, Artificial
  CRISPR gRNA sequence
ctcacccttctggaaaagcc

SEQ ID NO: 573999 - DNA, 20 bp, Artificial
  CRISPR gRNA sequence
ccttctggaaaagcccagaa

SEQ ID NO: 574000 - DNA, 20 bp, Artificial
  CRISPR gRNA sequence
cttctggaaaagcccagaat

SEQ ID NO: 574001 - DNA, 20 bp, Artificial
  CRISPR gRNA sequence
aaagcccagaatgggcctga

SEQ ID NO: 574002 - DNA, 20 bp, Artificial
  CRISPR gRNA sequence
ccagaatgggcctgatggcc

SEQ ID NO: 574003 - DNA, 20 bp, Artificial
  CRISPR gRNA sequence
cctgatggcctggctttgtg

SEQ ID NO: 574004 - DNA, 20 bp, Artificial
  CRISPR gRNA sequence
tggcctggctttgtgaagac

SEQ ID NO: 574005 - DNA, 20 bp, Artificial
  CRISPR gRNA sequence
agacaagaaaaaaaaaaaaa

SEQ ID NO: 574006 - DNA, 20 bp, Artificial
  CRISPR gRNA sequence
agaaaaaaaaaaaaaaagaa

SEQ ID NO: 574007 - DNA, 20 bp, Artificial
  CRISPR gRNA sequence
aaaaaaagaatagaaaaaaa

SEQ ID NO: 574008 - DNA, 20 bp, Artificial
  CRISPR gRNA sequence
aaaaaagaccttaaaaaaat

SEQ ID NO: 574009 - DNA, 20 bp, Artificial
  CRISPR gRNA sequence
cacccaaccctccccaccat

SEQ ID NO: 574010 - DNA, 20 bp, Artificial
  CRISPR gRNA sequence
gttcaaaacaaaactttcgc

SEQ ID NO: 574011 - DNA, 20 bp, Artificial
  CRISPR gRNA sequence
aaacaaaactttcgctggtt

SEQ ID NO: 574012 - DNA, 20 bp, Artificial
  CRISPR gRNA sequence
aacaaaactttcgctggttg

SEQ ID NO: 574013 - DNA, 20 bp, Artificial
  CRISPR gRNA sequence
tttcgctggttgaggcttct

SEQ ID NO: 574014 - DNA, 20 bp, Artificial
  CRISPR gRNA sequence
gctggttgaggcttctgagt

SEQ ID NO: 574015 - DNA, 20 bp, Artificial
  CRISPR gRNA sequence
ggttgaggcttctgagttgg

SEQ ID NO: 574016 - DNA, 20 bp, Artificial
  CRISPR gRNA sequence
gttgaggcttctgagttggt

SEQ ID NO: 574017 - DNA, 20 bp, Artificial
  CRISPR gRNA sequence
tgagttggtgggacacatct

SEQ ID NO: 574018 - DNA, 20 bp, Artificial
  CRISPR gRNA sequence
acacatctgagacccaaaaa

SEQ ID NO: 574019 - DNA, 20 bp, Artificial
  CRISPR gRNA sequence
tctgagacccaaaaatggct

SEQ ID NO: 574020 - DNA, 20 bp, Artificial
  CRISPR gRNA sequence
ctgagacccaaaaatggctt

SEQ ID NO: 574021 - DNA, 20 bp, Artificial
  CRISPR gRNA sequence
caaaaatggcttgggtgtgt

SEQ ID NO: 574022 - DNA, 20 bp, Artificial
  CRISPR gRNA sequence
aatggcttgggtgtgttgga

SEQ ID NO: 574023 - DNA, 20 bp, Artificial
  CRISPR gRNA sequence
gcttgggtgtgttggacagc

SEQ ID NO: 574024 - DNA, 20 bp, Artificial
  CRISPR gRNA sequence
cttgggtgtgttggacagcc

SEQ ID NO: 574025 - DNA, 20 bp, Artificial
  CRISPR gRNA sequence
ttgggtgtgttggacagcca

SEQ ID NO: 574026 - DNA, 20 bp, Artificial
  CRISPR gRNA sequence
tgggtgtgttggacagccag

SEQ ID NO: 574027 - DNA, 20 bp, Artificial
  CRISPR gRNA sequence
ggtgtgttggacagccaggg

SEQ ID NO: 574028 - DNA, 20 bp, Artificial
  CRISPR gRNA sequence
gtgtgttggacagccagggg

SEQ ID NO: 574029 - DNA, 20 bp, Artificial
  CRISPR gRNA sequence
ggacagccaggggaggcacc

SEQ ID NO: 574030 - DNA, 20 bp, Artificial
  CRISPR gRNA sequence
gacagccaggggaggcacca

SEQ ID NO: 574031 - DNA, 20 bp, Artificial
  CRISPR gRNA sequence
agccaggggaggcaccaagg

SEQ ID NO: 574032 - DNA, 20 bp, Artificial
  CRISPR gRNA sequence
gccaggggaggcaccaaggt

SEQ ID NO: 574033 - DNA, 20 bp, Artificial
  CRISPR gRNA sequence
gggaggcaccaaggtgggat

SEQ ID NO: 574034 - DNA, 20 bp, Artificial
  CRISPR gRNA sequence
ggaggcaccaaggtgggatg

SEQ ID NO: 574035 - DNA, 20 bp, Artificial
  CRISPR gRNA sequence
gtgggatgaggtcccctgct

SEQ ID NO: 574036 - DNA, 20 bp, Artificial
  CRISPR gRNA sequence
gggatgaggtcccctgcttg

SEQ ID NO: 574037 - DNA, 20 bp, Artificial
  CRISPR gRNA sequence
ggatgaggtcccctgcttgg

SEQ ID NO: 574038 - DNA, 20 bp, Artificial
  CRISPR gRNA sequence
gtcccctgcttggaggcctg

SEQ ID NO: 574039 - DNA, 20 bp, Artificial
  CRISPR gRNA sequence
tcccctgcttggaggcctgc

SEQ ID NO: 574040 - DNA, 20 bp, Artificial
  CRISPR gRNA sequence
cccctgcttggaggcctgca

SEQ ID NO: 574041 - DNA, 20 bp, Artificial
  CRISPR gRNA sequence
gcctgcagggaccctgtgaa

SEQ ID NO: 574042 - DNA, 20 bp, Artificial
  CRISPR gRNA sequence
tgcagggaccctgtgaacag

SEQ ID NO: 574043 - DNA, 20 bp, Artificial
  CRISPR gRNA sequence
gcagggaccctgtgaacagc

SEQ ID NO: 574044 - DNA, 20 bp, Artificial
  CRISPR gRNA sequence
tgtgaacagcaggtgtttaa

SEQ ID NO: 574045 - DNA, 20 bp, Artificial
  CRISPR gRNA sequence
caggtgtttaacagatgtca

SEQ ID NO: 574046 - DNA, 20 bp, Artificial
  CRISPR gRNA sequence
ttaacagatgtcacggcatg

SEQ ID NO: 574047 - DNA, 20 bp, Artificial
  CRISPR gRNA sequence
taacagatgtcacggcatgt

SEQ ID NO: 574048 - DNA, 20 bp, Artificial
  CRISPR gRNA sequence
acagatgtcacggcatgtgg

SEQ ID NO: 574049 - DNA, 20 bp, Artificial
  CRISPR gRNA sequence
cagatgtcacggcatgtggg

SEQ ID NO: 574050 - DNA, 20 bp, Artificial
  CRISPR gRNA sequence
agatgtcacggcatgtggga

SEQ ID NO: 574051 - DNA, 20 bp, Artificial
  CRISPR gRNA sequence
atgtcacggcatgtgggagg

SEQ ID NO: 574052 - DNA, 20 bp, Artificial
  CRISPR gRNA sequence
cacggcatgtgggagggagc

SEQ ID NO: 574053 - DNA, 20 bp, Artificial
  CRISPR gRNA sequence
acggcatgtgggagggagca

SEQ ID NO: 574054 - DNA, 20 bp, Artificial
  CRISPR gRNA sequence
cggcatgtgggagggagcaa

SEQ ID NO: 574055 - DNA, 20 bp, Artificial
  CRISPR gRNA sequence
gcatgtgggagggagcaagg

SEQ ID NO: 574056 - DNA, 20 bp, Artificial
  CRISPR gRNA sequence
catgtgggagggagcaaggg

SEQ ID NO: 574057 - DNA, 20 bp, Artificial
  CRISPR gRNA sequence
atgtgggagggagcaaggga

SEQ ID NO: 574058 - DNA, 20 bp, Artificial
  CRISPR gRNA sequence
tgtgggagggagcaagggag

SEQ ID NO: 574059 - DNA, 20 bp, Artificial
  CRISPR gRNA sequence
gtgggagggagcaagggagg

SEQ ID NO: 574060 - DNA, 20 bp, Artificial
  CRISPR gRNA sequence
gagggagcaagggagggggt

SEQ ID NO: 574061 - DNA, 20 bp, Artificial
  CRISPR gRNA sequence
agggagcaagggagggggtg

SEQ ID NO: 574062 - DNA, 20 bp, Artificial
  CRISPR gRNA sequence
ggagcaagggagggggtgag

SEQ ID NO: 574063 - DNA, 20 bp, Artificial
  CRISPR gRNA sequence
ggggtgaggagcatgcatgt

SEQ ID NO: 574064 - DNA, 20 bp, Artificial
  CRISPR gRNA sequence
gggtgaggagcatgcatgtc

SEQ ID NO: 574065 - DNA, 20 bp, Artificial
  CRISPR gRNA sequence
tgaggagcatgcatgtcagg

SEQ ID NO: 574066 - DNA, 20 bp, Artificial
  CRISPR gRNA sequence
gaggagcatgcatgtcagga

SEQ ID NO: 574067 - DNA, 20 bp, Artificial
  CRISPR gRNA sequence
ggagcatgcatgtcaggaag

SEQ ID NO: 574068 - DNA, 20 bp, Artificial
  CRISPR gRNA sequence
tgcatgtcaggaaggagtcc

SEQ ID NO: 574069 - DNA, 20 bp, Artificial
  CRISPR gRNA sequence
gcatgtcaggaaggagtcct

SEQ ID NO: 574070 - DNA, 20 bp, Artificial
  CRISPR gRNA sequence
catgtcaggaaggagtcctg

SEQ ID NO: 574071 - DNA, 20 bp, Artificial
  CRISPR gRNA sequence
tgtcaggaaggagtcctggg

SEQ ID NO: 574072 - DNA, 20 bp, Artificial
  CRISPR gRNA sequence
gagtcctggggagctgattc

SEQ ID NO: 574073 - DNA, 20 bp, Artificial
  CRISPR gRNA sequence
tggggagctgattctagtga

SEQ ID NO: 574074 - DNA, 20 bp, Artificial
  CRISPR gRNA sequence
ctgattctagtgatggcccc

SEQ ID NO: 574075 - DNA, 20 bp, Artificial
  CRISPR gRNA sequence
tgattctagtgatggcccca

SEQ ID NO: 574076 - DNA, 20 bp, Artificial
  CRISPR gRNA sequence
ccaaggttaatgaccccttg

SEQ ID NO: 574077 - DNA, 20 bp, Artificial
  CRISPR gRNA sequence
ttaatgaccccttgcagtga

SEQ ID NO: 574078 - DNA, 20 bp, Artificial
  CRISPR gRNA sequence
ccccttgcagtgatggtcct

SEQ ID NO: 574079 - DNA, 20 bp, Artificial
  CRISPR gRNA sequence
cccttgcagtgatggtccta

SEQ ID NO: 574080 - DNA, 20 bp, Artificial
  CRISPR gRNA sequence
cccttgcactgatgttccca

SEQ ID NO: 574081 - DNA, 20 bp, Artificial
  CRISPR gRNA sequence
taataaccccttgctccctg

SEQ ID NO: 574082 - DNA, 20 bp, Artificial
  CRISPR gRNA sequence
ccccttgctccctgcagact

SEQ ID NO: 574083 - DNA, 20 bp, Artificial
  CRISPR gRNA sequence
cccttgctccctgcagactt

SEQ ID NO: 574084 - DNA, 20 bp, Artificial
  CRISPR gRNA sequence
tgctccctgcagacttgggt

SEQ ID NO: 574085 - DNA, 20 bp, Artificial
  CRISPR gRNA sequence
cctcctgcgtaattataaac

SEQ ID NO: 574086 - DNA, 20 bp, Artificial
  CRISPR gRNA sequence
ctcctgcgtaattataaacc

SEQ ID NO: 574087 - DNA, 20 bp, Artificial
  CRISPR gRNA sequence
tgcgtaattataaaccaggc

SEQ ID NO: 574088 - DNA, 20 bp, Artificial
  CRISPR gRNA sequence
ataaaccaggccagttctat

SEQ ID NO: 574089 - DNA, 20 bp, Artificial
  CRISPR gRNA sequence
aaccaggccagttctatcag

SEQ ID NO: 574090 - DNA, 20 bp, Artificial
  CRISPR gRNA sequence
ccaggccagttctatcagca

SEQ ID NO: 574091 - DNA, 20 bp, Artificial
  CRISPR gRNA sequence
caggccagttctatcagcag

SEQ ID NO: 574092 - DNA, 20 bp, Artificial
  CRISPR gRNA sequence
agaggcattgttccctgccc

SEQ ID NO: 574093 - DNA, 20 bp, Artificial
  CRISPR gRNA sequence
cccagcacctgtccccctcc

SEQ ID NO: 574094 - DNA, 20 bp, Artificial
  CRISPR gRNA sequence
cacctgtccccctcctggaa

SEQ ID NO: 574095 - DNA, 20 bp, Artificial
  CRISPR gRNA sequence
acctgtccccctcctggaaa

SEQ ID NO: 574096 - DNA, 20 bp, Artificial
  CRISPR gRNA sequence
cctgtccccctcctggaaaa

SEQ ID NO: 574097 - DNA, 20 bp, Artificial
  CRISPR gRNA sequence
ctgtccccctcctggaaaag

SEQ ID NO: 574098 - DNA, 20 bp, Artificial
  CRISPR gRNA sequence
tgtccccctcctggaaaagg

SEQ ID NO: 574099 - DNA, 20 bp, Artificial
  CRISPR gRNA sequence
cccctcctggaaaagggggc

SEQ ID NO: 574100 - DNA, 20 bp, Artificial
  CRISPR gRNA sequence
agggggctagttttctctct

SEQ ID NO: 574101 - DNA, 20 bp, Artificial
  CRISPR gRNA sequence
gggggctagttttctctctc

SEQ ID NO: 574102 - DNA, 20 bp, Artificial
  CRISPR gRNA sequence
ctagttttctctctcaggat

SEQ ID NO: 574103 - DNA, 20 bp, Artificial
  CRISPR gRNA sequence
agttttctctctcaggatca

SEQ ID NO: 574104 - DNA, 20 bp, Artificial
  CRISPR gRNA sequence
gttttctctctcaggatcag

SEQ ID NO: 574105 - DNA, 20 bp, Artificial
  CRISPR gRNA sequence
ctctctcaggatcagaggtg

SEQ ID NO: 574106 - DNA, 20 bp, Artificial
  CRISPR gRNA sequence
tctctcaggatcagaggtgt

SEQ ID NO: 574107 - DNA, 20 bp, Artificial
  CRISPR gRNA sequence
cattctccttataccttccc

SEQ ID NO: 574108 - DNA, 20 bp, Artificial
  CRISPR gRNA sequence
tactgtcactcactccatga

SEQ ID NO: 574109 - DNA, 20 bp, Artificial
  CRISPR gRNA sequence
ctgtcactcactccatgaaa

SEQ ID NO: 574110 - DNA, 20 bp, Artificial
  CRISPR gRNA sequence
gtcactcactccatgaaaga

SEQ ID NO: 574111 - DNA, 20 bp, Artificial
  CRISPR gRNA sequence
actcactccatgaaagagag

SEQ ID NO: 574112 - DNA, 20 bp, Artificial
  CRISPR gRNA sequence
actccatgaaagagagtggc

SEQ ID NO: 574113 - DNA, 20 bp, Artificial
  CRISPR gRNA sequence
tccatgaaagagagtggcca

SEQ ID NO: 574114 - DNA, 20 bp, Artificial
  CRISPR gRNA sequence
aaagagagtggccagagata

SEQ ID NO: 574115 - DNA, 20 bp, Artificial
  CRISPR gRNA sequence
aagagagtggccagagatat

SEQ ID NO: 574116 - DNA, 20 bp, Artificial
  CRISPR gRNA sequence
gagagtggccagagatatag

SEQ ID NO: 574117 - DNA, 20 bp, Artificial
  CRISPR gRNA sequence
agagtggccagagatatagg

SEQ ID NO: 574118 - DNA, 20 bp, Artificial
  CRISPR gRNA sequence
agagatataggaggcaaacg

SEQ ID NO: 574119 - DNA, 20 bp, Artificial
  CRISPR gRNA sequence
atataggaggcaaacgaagt

SEQ ID NO: 574120 - DNA, 20 bp, Artificial
  CRISPR gRNA sequence
tataggaggcaaacgaagtg

SEQ ID NO: 574121 - DNA, 20 bp, Artificial
  CRISPR gRNA sequence
ggaggcaaacgaagtgagga

SEQ ID NO: 574122 - DNA, 20 bp, Artificial
  CRISPR gRNA sequence
ggcaaacgaagtgaggatgg

SEQ ID NO: 574123 - DNA, 20 bp, Artificial
  CRISPR gRNA sequence
acgaagtgaggatggtggcc

SEQ ID NO: 574124 - DNA, 20 bp, Artificial
  CRISPR gRNA sequence
aggatggtggccgagaatgt

SEQ ID NO: 574125 - DNA, 20 bp, Artificial
  CRISPR gRNA sequence
tggtggccgagaatgtgagc

SEQ ID NO: 574126 - DNA, 20 bp, Artificial
  CRISPR gRNA sequence
gagaatgtgagctggcccct

SEQ ID NO: 574127 - DNA, 20 bp, Artificial
  CRISPR gRNA sequence
agaatgtgagctggcccctt

SEQ ID NO: 574128 - DNA, 20 bp, Artificial
  CRISPR gRNA sequence
atgtgagctggccccttggg

SEQ ID NO: 574129 - DNA, 20 bp, Artificial
  CRISPR gRNA sequence
tgtgagctggccccttgggc

SEQ ID NO: 574130 - DNA, 20 bp, Artificial
  CRISPR gRNA sequence
gctggccccttgggcaggcc

SEQ ID NO: 574131 - DNA, 20 bp, Artificial
  CRISPR gRNA sequence
ctggccccttgggcaggccc

SEQ ID NO: 574132 - DNA, 20 bp, Artificial
  CRISPR gRNA sequence
tggccccttgggcaggccca

SEQ ID NO: 574133 - DNA, 20 bp, Artificial
  CRISPR gRNA sequence
cttgggcaggcccagggtgt

SEQ ID NO: 574134 - DNA, 20 bp, Artificial
  CRISPR gRNA sequence
tgggcaggcccagggtgtga

SEQ ID NO: 574135 - DNA, 20 bp, Artificial
  CRISPR gRNA sequence
gggcaggcccagggtgtgag

SEQ ID NO: 574136 - DNA, 20 bp, Artificial
  CRISPR gRNA sequence
ggcaggcccagggtgtgaga

SEQ ID NO: 574137 - DNA, 20 bp, Artificial
  CRISPR gRNA sequence
ggtgtgagagggaaatgcta

SEQ ID NO: 574138 - DNA, 20 bp, Artificial
  CRISPR gRNA sequence
ggaaatgctacggctgctga

SEQ ID NO: 574139 - DNA, 20 bp, Artificial
  CRISPR gRNA sequence
tgctacggctgctgaaagcc

SEQ ID NO: 574140 - DNA, 20 bp, Artificial
  CRISPR gRNA sequence
gctgaaagccaagatccttg

SEQ ID NO: 574141 - DNA, 20 bp, Artificial
  CRISPR gRNA sequence
aagccaagatccttgcagaa

SEQ ID NO: 574142 - DNA, 20 bp, Artificial
  CRISPR gRNA sequence
agccaagatccttgcagaat

SEQ ID NO: 574143 - DNA, 20 bp, Artificial
  CRISPR gRNA sequence
gccaagatccttgcagaatg

SEQ ID NO: 574144 - DNA, 20 bp, Artificial
  CRISPR gRNA sequence
ccaagatccttgcagaatgg

SEQ ID NO: 574145 - DNA, 20 bp, Artificial
  CRISPR gRNA sequence
gatccttgcagaatgggggc

SEQ ID NO: 574146 - DNA, 20 bp, Artificial
  CRISPR gRNA sequence
atccttgcagaatgggggct

SEQ ID NO: 574147 - DNA, 20 bp, Artificial
  CRISPR gRNA sequence
tccttgcagaatgggggctg

SEQ ID NO: 574148 - DNA, 20 bp, Artificial
  CRISPR gRNA sequence
tgcagaatgggggctggggt

SEQ ID NO: 574149 - DNA, 20 bp, Artificial
  CRISPR gRNA sequence
gcagaatgggggctggggtc

SEQ ID NO: 574150 - DNA, 20 bp, Artificial
  CRISPR gRNA sequence
agaatgggggctggggtcag

SEQ ID NO: 574151 - DNA, 20 bp, Artificial
  CRISPR gRNA sequence
gaatgggggctggggtcagg

SEQ ID NO: 574152 - DNA, 20 bp, Artificial
  CRISPR gRNA sequence
aatgggggctggggtcagga

SEQ ID NO: 574153 - DNA, 20 bp, Artificial
  CRISPR gRNA sequence
gggggctggggtcaggaggg

SEQ ID NO: 574154 - DNA, 20 bp, Artificial
  CRISPR gRNA sequence
gggctggggtcaggagggca

SEQ ID NO: 574155 - DNA, 20 bp, Artificial
  CRISPR gRNA sequence
gctggggtcaggagggcaga

SEQ ID NO: 574156 - DNA, 20 bp, Artificial
  CRISPR gRNA sequence
ctggggtcaggagggcagag

SEQ ID NO: 574157 - DNA, 20 bp, Artificial
  CRISPR gRNA sequence
tggggtcaggagggcagaga

SEQ ID NO: 574158 - DNA, 20 bp, Artificial
  CRISPR gRNA sequence
ggggtcaggagggcagagag

SEQ ID NO: 574159 - DNA, 20 bp, Artificial
  CRISPR gRNA sequence
gtcaggagggcagagagggg

SEQ ID NO: 574160 - DNA, 20 bp, Artificial
  CRISPR gRNA sequence
caggagggcagagaggggta

SEQ ID NO: 574161 - DNA, 20 bp, Artificial
  CRISPR gRNA sequence
aggagggcagagaggggtag

SEQ ID NO: 574162 - DNA, 20 bp, Artificial
  CRISPR gRNA sequence
tcgctacctcccctctatac

SEQ ID NO: 574163 - DNA, 20 bp, Artificial
  CRISPR gRNA sequence
ctggactatatcctctctca

SEQ ID NO: 574164 - DNA, 20 bp, Artificial
  CRISPR gRNA sequence
ggactatatcctctctcatg

SEQ ID NO: 574165 - DNA, 20 bp, Artificial
  CRISPR gRNA sequence
gactatatcctctctcatgg

SEQ ID NO: 574166 - DNA, 20 bp, Artificial
  CRISPR gRNA sequence
actatatcctctctcatgga

SEQ ID NO: 574167 - DNA, 20 bp, Artificial
  CRISPR gRNA sequence
ctctctcatggagggcttct

SEQ ID NO: 574168 - DNA, 20 bp, Artificial
  CRISPR gRNA sequence
tctctcatggagggcttctc

SEQ ID NO: 574169 - DNA, 20 bp, Artificial
  CRISPR gRNA sequence
ctcatggagggcttctcggg

SEQ ID NO: 574170 - DNA, 20 bp, Artificial
  CRISPR gRNA sequence
tcatggagggcttctcggga

SEQ ID NO: 574171 - DNA, 20 bp, Artificial
  CRISPR gRNA sequence
atggagggcttctcgggaag

SEQ ID NO: 574172 - DNA, 20 bp, Artificial
  CRISPR gRNA sequence
gggcttctcgggaaggagac

SEQ ID NO: 574173 - DNA, 20 bp, Artificial
  CRISPR gRNA sequence
ggcttctcgggaaggagact

SEQ ID NO: 574174 - DNA, 20 bp, Artificial
  CRISPR gRNA sequence
cttctcgggaaggagactgg

SEQ ID NO: 574175 - DNA, 20 bp, Artificial
  CRISPR gRNA sequence
ttctcgggaaggagactggg

SEQ ID NO: 574176 - DNA, 20 bp, Artificial
  CRISPR gRNA sequence
tctcgggaaggagactggga

SEQ ID NO: 574177 - DNA, 20 bp, Artificial
  CRISPR gRNA sequence
gggaaggagactgggagggc

SEQ ID NO: 574178 - DNA, 20 bp, Artificial
  CRISPR gRNA sequence
ggaaggagactgggagggct

SEQ ID NO: 574179 - DNA, 20 bp, Artificial
  CRISPR gRNA sequence
aaggagactgggagggctgg

SEQ ID NO: 574180 - DNA, 20 bp, Artificial
  CRISPR gRNA sequence
agactgggagggctgggagt

SEQ ID NO: 574181 - DNA, 20 bp, Artificial
  CRISPR gRNA sequence
gactgggagggctgggagtt

SEQ ID NO: 574182 - DNA, 20 bp, Artificial
  CRISPR gRNA sequence
actgggagggctgggagttg

SEQ ID NO: 574183 - DNA, 20 bp, Artificial
  CRISPR gRNA sequence
ctgggagggctgggagttgg

SEQ ID NO: 574184 - DNA, 20 bp, Artificial
  CRISPR gRNA sequence
gagggctgggagttgggggt

SEQ ID NO: 574185 - DNA, 20 bp, Artificial
  CRISPR gRNA sequence
ggctgggagttgggggtgag

SEQ ID NO: 574186 - DNA, 20 bp, Artificial
  CRISPR gRNA sequence
gctgggagttgggggtgagt

SEQ ID NO: 574187 - DNA, 20 bp, Artificial
  CRISPR gRNA sequence
ggagttgggggtgagtaggc

SEQ ID NO: 574188 - DNA, 20 bp, Artificial
  CRISPR gRNA sequence
ggtgagtaggcaagattaaa

SEQ ID NO: 574189 - DNA, 20 bp, Artificial
  CRISPR gRNA sequence
gtgagtaggcaagattaaac

SEQ ID NO: 574190 - DNA, 20 bp, Artificial
  CRISPR gRNA sequence
gtaggcaagattaaacgggt

SEQ ID NO: 574191 - DNA, 20 bp, Artificial
  CRISPR gRNA sequence
taggcaagattaaacgggtc

SEQ ID NO: 574192 - DNA, 20 bp, Artificial
  CRISPR gRNA sequence
aagattaaacgggtcaggaa

SEQ ID NO: 574193 - DNA, 20 bp, Artificial
  CRISPR gRNA sequence
aacgggtcaggaaaagtccc

SEQ ID NO: 574194 - DNA, 20 bp, Artificial
  CRISPR gRNA sequence
cgggtcaggaaaagtcccca

SEQ ID NO: 574195 - DNA, 20 bp, Artificial
  CRISPR gRNA sequence
tcaggaaaagtccccagaga

SEQ ID NO: 574196 - DNA, 20 bp, Artificial
  CRISPR gRNA sequence
caggaaaagtccccagagac

SEQ ID NO: 574197 - DNA, 20 bp, Artificial
  CRISPR gRNA sequence
aggaaaagtccccagagaca

SEQ ID NO: 574198 - DNA, 20 bp, Artificial
  CRISPR gRNA sequence
ggaaaagtccccagagacag

SEQ ID NO: 574199 - DNA, 20 bp, Artificial
  CRISPR gRNA sequence
agagacaggggcctctgaca

SEQ ID NO: 574200 - DNA, 20 bp, Artificial
  CRISPR gRNA sequence
gggcctctgacaaagacttg

SEQ ID NO: 574201 - DNA, 20 bp, Artificial
  CRISPR gRNA sequence
ggcctctgacaaagacttga

SEQ ID NO: 574202 - DNA, 20 bp, Artificial
  CRISPR gRNA sequence
cctctgacaaagacttgaag

SEQ ID NO: 574203 - DNA, 20 bp, Artificial
  CRISPR gRNA sequence
gacaaagacttgaaggagat

SEQ ID NO: 574204 - DNA, 20 bp, Artificial
  CRISPR gRNA sequence
acaaagacttgaaggagatg

SEQ ID NO: 574205 - DNA, 20 bp, Artificial
  CRISPR gRNA sequence
caaagacttgaaggagatga

SEQ ID NO: 574206 - DNA, 20 bp, Artificial
  CRISPR gRNA sequence
aagacttgaaggagatgagg

SEQ ID NO: 574207 - DNA, 20 bp, Artificial
  CRISPR gRNA sequence
agacttgaaggagatgaggg

SEQ ID NO: 574208 - DNA, 20 bp, Artificial
  CRISPR gRNA sequence
gacttgaaggagatgaggga

SEQ ID NO: 574209 - DNA, 20 bp, Artificial
  CRISPR gRNA sequence
cttgaaggagatgagggagg

SEQ ID NO: 574210 - DNA, 20 bp, Artificial
  CRISPR gRNA sequence
aaggagatgagggagggagc

SEQ ID NO: 574211 - DNA, 20 bp, Artificial
  CRISPR gRNA sequence
agatgagggagggagccagc

SEQ ID NO: 574212 - DNA, 20 bp, Artificial
  CRISPR gRNA sequence
agggagccagctagatatct

SEQ ID NO: 574213 - DNA, 20 bp, Artificial
  CRISPR gRNA sequence
gggagccagctagatatctg

SEQ ID NO: 574214 - DNA, 20 bp, Artificial
  CRISPR gRNA sequence
tagatatctgaggaactcca

SEQ ID NO: 574215 - DNA, 20 bp, Artificial
  CRISPR gRNA sequence
agatatctgaggaactccaa

SEQ ID NO: 574216 - DNA, 20 bp, Artificial
  CRISPR gRNA sequence
ctgaggaactccaaaggaaa

SEQ ID NO: 574217 - DNA, 20 bp, Artificial
  CRISPR gRNA sequence
ggaactccaaaggaaacagc

SEQ ID NO: 574218 - DNA, 20 bp, Artificial
  CRISPR gRNA sequence
gaactccaaaggaaacagcc

SEQ ID NO: 574219 - DNA, 20 bp, Artificial
  CRISPR gRNA sequence
aactccaaaggaaacagcca

SEQ ID NO: 574220 - DNA, 20 bp, Artificial
  CRISPR gRNA sequence
caaaggaaacagccagggca

SEQ ID NO: 574221 - DNA, 20 bp, Artificial
  CRISPR gRNA sequence
aaaggaaacagccagggcaa

SEQ ID NO: 574222 - DNA, 20 bp, Artificial
  CRISPR gRNA sequence
acagccagggcaaaggtcct

SEQ ID NO: 574223 - DNA, 20 bp, Artificial
  CRISPR gRNA sequence
cagccagggcaaaggtcctg

SEQ ID NO: 574224 - DNA, 20 bp, Artificial
  CRISPR gRNA sequence
ccagggcaaaggtcctgagg

SEQ ID NO: 574225 - DNA, 20 bp, Artificial
  CRISPR gRNA sequence
cagggcaaaggtcctgaggt

SEQ ID NO: 574226 - DNA, 20 bp, Artificial
  CRISPR gRNA sequence
ggaatgtacctgatttgttc

SEQ ID NO: 574227 - DNA, 20 bp, Artificial
  CRISPR gRNA sequence
gaatgtacctgatttgttca

SEQ ID NO: 574228 - DNA, 20 bp, Artificial
  CRISPR gRNA sequence
ctgatttgttcaaggtctac

SEQ ID NO: 574229 - DNA, 20 bp, Artificial
  CRISPR gRNA sequence
tgatttgttcaaggtctaca

SEQ ID NO: 574230 - DNA, 20 bp, Artificial
  CRISPR gRNA sequence
gatttgttcaaggtctacaa

SEQ ID NO: 574231 - DNA, 20 bp, Artificial
  CRISPR gRNA sequence
atttgttcaaggtctacaag

SEQ ID NO: 574232 - DNA, 20 bp, Artificial
  CRISPR gRNA sequence
tttgttcaaggtctacaagg

SEQ ID NO: 574233 - DNA, 20 bp, Artificial
  CRISPR gRNA sequence
ttcaaggtctacaagggggc

SEQ ID NO: 574234 - DNA, 20 bp, Artificial
  CRISPR gRNA sequence
ggtctacaagggggctggtg

SEQ ID NO: 574235 - DNA, 20 bp, Artificial
  CRISPR gRNA sequence
tacaagggggctggtgtggt

SEQ ID NO: 574236 - DNA, 20 bp, Artificial
  CRISPR gRNA sequence
gggggctggtgtggttagtg

SEQ ID NO: 574237 - DNA, 20 bp, Artificial
  CRISPR gRNA sequence
gggctggtgtggttagtgtg

SEQ ID NO: 574238 - DNA, 20 bp, Artificial
  CRISPR gRNA sequence
gctggtgtggttagtgtgga

SEQ ID NO: 574239 - DNA, 20 bp, Artificial
  CRISPR gRNA sequence
tggtgtggttagtgtggaga

SEQ ID NO: 574240 - DNA, 20 bp, Artificial
  CRISPR gRNA sequence
gtggttagtgtggagagagc

SEQ ID NO: 574241 - DNA, 20 bp, Artificial
  CRISPR gRNA sequence
gttagtgtggagagagcaag

SEQ ID NO: 574242 - DNA, 20 bp, Artificial
  CRISPR gRNA sequence
tagtgtggagagagcaagaa

SEQ ID NO: 574243 - DNA, 20 bp, Artificial
  CRISPR gRNA sequence
tgtggagagagcaagaagag

SEQ ID NO: 574244 - DNA, 20 bp, Artificial
  CRISPR gRNA sequence
gagagagcaagaagagaagc

SEQ ID NO: 574245 - DNA, 20 bp, Artificial
  CRISPR gRNA sequence
gagagcaagaagagaagctg

SEQ ID NO: 574246 - DNA, 20 bp, Artificial
  CRISPR gRNA sequence
agagcaagaagagaagctgg

SEQ ID NO: 574247 - DNA, 20 bp, Artificial
  CRISPR gRNA sequence
caagaagagaagctggaggt

SEQ ID NO: 574248 - DNA, 20 bp, Artificial
  CRISPR gRNA sequence
aagaagagaagctggaggtg

SEQ ID NO: 574249 - DNA, 20 bp, Artificial
  CRISPR gRNA sequence
agagaagctggaggtgaggt

SEQ ID NO: 574250 - DNA, 20 bp, Artificial
  CRISPR gRNA sequence
aagctggaggtgaggtcaga

SEQ ID NO: 574251 - DNA, 20 bp, Artificial
  CRISPR gRNA sequence
agctggaggtgaggtcagaa

SEQ ID NO: 574252 - DNA, 20 bp, Artificial
  CRISPR gRNA sequence
gctggaggtgaggtcagaaa

SEQ ID NO: 574253 - DNA, 20 bp, Artificial
  CRISPR gRNA sequence
ctggaggtgaggtcagaaag

SEQ ID NO: 574254 - DNA, 20 bp, Artificial
  CRISPR gRNA sequence
gtgaggtcagaaaggggact

SEQ ID NO: 574255 - DNA, 20 bp, Artificial
  CRISPR gRNA sequence
gaggtcagaaaggggactcg

SEQ ID NO: 574256 - DNA, 20 bp, Artificial
  CRISPR gRNA sequence
aggtcagaaaggggactcgg

SEQ ID NO: 574257 - DNA, 20 bp, Artificial
  CRISPR gRNA sequence
cagaaaggggactcggaggt

SEQ ID NO: 574258 - DNA, 20 bp, Artificial
  CRISPR gRNA sequence
gactcggaggttagaccacg

SEQ ID NO: 574259 - DNA, 20 bp, Artificial
  CRISPR gRNA sequence
actcggaggttagaccacgc

SEQ ID NO: 574260 - DNA, 20 bp, Artificial
  CRISPR gRNA sequence
ttagaccacgcaggaccttg

SEQ ID NO: 574261 - DNA, 20 bp, Artificial
  CRISPR gRNA sequence
tagaccacgcaggaccttgt

SEQ ID NO: 574262 - DNA, 20 bp, Artificial
  CRISPR gRNA sequence
acgcaggaccttgtaggcca

SEQ ID NO: 574263 - DNA, 20 bp, Artificial
  CRISPR gRNA sequence
aggaccttgtaggccatggt

SEQ ID NO: 574264 - DNA, 20 bp, Artificial
  CRISPR gRNA sequence
ggaccttgtaggccatggta

SEQ ID NO: 574265 - DNA, 20 bp, Artificial
  CRISPR gRNA sequence
gtaggccatggtaaggactt

SEQ ID NO: 574266 - DNA, 20 bp, Artificial
  CRISPR gRNA sequence
aggactttggcttcaacgct

SEQ ID NO: 574267 - DNA, 20 bp, Artificial
  CRISPR gRNA sequence
ctttggcttcaacgctgagt

SEQ ID NO: 574268 - DNA, 20 bp, Artificial
  CRISPR gRNA sequence
tttggcttcaacgctgagtg

SEQ ID NO: 574269 - DNA, 20 bp, Artificial
  CRISPR gRNA sequence
tggcttcaacgctgagtgag

SEQ ID NO: 574270 - DNA, 20 bp, Artificial
  CRISPR gRNA sequence
ggcttcaacgctgagtgagg

SEQ ID NO: 574271 - DNA, 20 bp, Artificial
  CRISPR gRNA sequence
ttcaacgctgagtgaggagg

SEQ ID NO: 574272 - DNA, 20 bp, Artificial
  CRISPR gRNA sequence
tcaacgctgagtgaggagga

SEQ ID NO: 574273 - DNA, 20 bp, Artificial
  CRISPR gRNA sequence
gagtgaggaggaaggcatga

SEQ ID NO: 574274 - DNA, 20 bp, Artificial
  CRISPR gRNA sequence
agtgaggaggaaggcatgac

SEQ ID NO: 574275 - DNA, 20 bp, Artificial
  CRISPR gRNA sequence
gtgaggaggaaggcatgaca

SEQ ID NO: 574276 - DNA, 20 bp, Artificial
  CRISPR gRNA sequence
ggaaggcatgacagggttgc

SEQ ID NO: 574277 - DNA, 20 bp, Artificial
  CRISPR gRNA sequence
aggcatgacagggttgcaag

SEQ ID NO: 574278 - DNA, 20 bp, Artificial
  CRISPR gRNA sequence
gcatgacagggttgcaagca

SEQ ID NO: 574279 - DNA, 20 bp, Artificial
  CRISPR gRNA sequence
catgacagggttgcaagcag

SEQ ID NO: 574280 - DNA, 20 bp, Artificial
  CRISPR gRNA sequence
tgacagggttgcaagcagag

SEQ ID NO: 574281 - DNA, 20 bp, Artificial
  CRISPR gRNA sequence
aggagaaacacaaaccgtgt

SEQ ID NO: 574282 - DNA, 20 bp, Artificial
  CRISPR gRNA sequence
ggagaaacacaaaccgtgtt

SEQ ID NO: 574283 - DNA, 20 bp, Artificial
  CRISPR gRNA sequence
caaaccgtgttaggatttaa

SEQ ID NO: 574284 - DNA, 20 bp, Artificial
  CRISPR gRNA sequence
aaaccgtgttaggatttaac

SEQ ID NO: 574285 - DNA, 20 bp, Artificial
  CRISPR gRNA sequence
ccgtgttaggatttaacagg

SEQ ID NO: 574286 - DNA, 20 bp, Artificial
  CRISPR gRNA sequence
acaggaagcccctgaatgct

SEQ ID NO: 574287 - DNA, 20 bp, Artificial
  CRISPR gRNA sequence
cctgaatgctgagtgtacaa

SEQ ID NO: 574288 - DNA, 20 bp, Artificial
  CRISPR gRNA sequence
ctgaatgctgagtgtacaat

SEQ ID NO: 574289 - DNA, 20 bp, Artificial
  CRISPR gRNA sequence
tgaatgctgagtgtacaatg

SEQ ID NO: 574290 - DNA, 20 bp, Artificial
  CRISPR gRNA sequence
gctgagtgtacaatggggtc

SEQ ID NO: 574291 - DNA, 20 bp, Artificial
  CRISPR gRNA sequence
ctgagtgtacaatggggtct

SEQ ID NO: 574292 - DNA, 20 bp, Artificial
  CRISPR gRNA sequence
tgagtgtacaatggggtcta

SEQ ID NO: 574293 - DNA, 20 bp, Artificial
  CRISPR gRNA sequence
tggggtctagggcctgaatg

SEQ ID NO: 574294 - DNA, 20 bp, Artificial
  CRISPR gRNA sequence
ggtctagggcctgaatgtgg

SEQ ID NO: 574295 - DNA, 20 bp, Artificial
  CRISPR gRNA sequence
ctagggcctgaatgtggaag

SEQ ID NO: 574296 - DNA, 20 bp, Artificial
  CRISPR gRNA sequence
tagggcctgaatgtggaagc

SEQ ID NO: 574297 - DNA, 20 bp, Artificial
  CRISPR gRNA sequence
agggcctgaatgtggaagca

SEQ ID NO: 574298 - DNA, 20 bp, Artificial
  CRISPR gRNA sequence
gggcctgaatgtggaagcag

SEQ ID NO: 574299 - DNA, 20 bp, Artificial
  CRISPR gRNA sequence
tgaatgtggaagcaggggac

SEQ ID NO: 574300 - DNA, 20 bp, Artificial
  CRISPR gRNA sequence
tgtggaagcaggggaccagc

SEQ ID NO: 574301 - DNA, 20 bp, Artificial
  CRISPR gRNA sequence
gtggaagcaggggaccagca

SEQ ID NO: 574302 - DNA, 20 bp, Artificial
  CRISPR gRNA sequence
ggaagcaggggaccagcaag

SEQ ID NO: 574303 - DNA, 20 bp, Artificial
  CRISPR gRNA sequence
gcaggggaccagcaaggagc

SEQ ID NO: 574304 - DNA, 20 bp, Artificial
  CRISPR gRNA sequence
cagcaaggagctggctactg

SEQ ID NO: 574305 - DNA, 20 bp, Artificial
  CRISPR gRNA sequence
caaggagctggctactgcag

SEQ ID NO: 574306 - DNA, 20 bp, Artificial
  CRISPR gRNA sequence
agctggctactgcagtagtc

SEQ ID NO: 574307 - DNA, 20 bp, Artificial
  CRISPR gRNA sequence
gctggctactgcagtagtct

SEQ ID NO: 574308 - DNA, 20 bp, Artificial
  CRISPR gRNA sequence
actgcagtagtctaggtgac

SEQ ID NO: 574309 - DNA, 20 bp, Artificial
  CRISPR gRNA sequence
gtagtctaggtgactggtga

SEQ ID NO: 574310 - DNA, 20 bp, Artificial
  CRISPR gRNA sequence
taggtgactggtgatagtgc

SEQ ID NO: 574311 - DNA, 20 bp, Artificial
  CRISPR gRNA sequence
gtgactggtgatagtgctgg

SEQ ID NO: 574312 - DNA, 20 bp, Artificial
  CRISPR gRNA sequence
actggtgatagtgctggcag

SEQ ID NO: 574313 - DNA, 20 bp, Artificial
  CRISPR gRNA sequence
tggtgatagtgctggcagtg

SEQ ID NO: 574314 - DNA, 20 bp, Artificial
  CRISPR gRNA sequence
ggtgatagtgctggcagtgg

SEQ ID NO: 574315 - DNA, 20 bp, Artificial
  CRISPR gRNA sequence
gatagtgctggcagtggagg

SEQ ID NO: 574316 - DNA, 20 bp, Artificial
  CRISPR gRNA sequence
gtgctggcagtggaggtggt

SEQ ID NO: 574317 - DNA, 20 bp, Artificial
  CRISPR gRNA sequence
ctggcagtggaggtggtgag

SEQ ID NO: 574318 - DNA, 20 bp, Artificial
  CRISPR gRNA sequence
ggcagtggaggtggtgagaa

SEQ ID NO: 574319 - DNA, 20 bp, Artificial
  CRISPR gRNA sequence
gcagtggaggtggtgagaag

SEQ ID NO: 574320 - DNA, 20 bp, Artificial
  CRISPR gRNA sequence
tggaggtggtgagaagagga

SEQ ID NO: 574321 - DNA, 20 bp, Artificial
  CRISPR gRNA sequence
tggtgagaagaggatggatt

SEQ ID NO: 574322 - DNA, 20 bp, Artificial
  CRISPR gRNA sequence
gatttggtaaatatttttaa

SEQ ID NO: 574323 - DNA, 20 bp, Artificial
  CRISPR gRNA sequence
tggtaaatatttttaataga

SEQ ID NO: 574324 - DNA, 20 bp, Artificial
  CRISPR gRNA sequence
tatttttaatagacagccaa

SEQ ID NO: 574325 - DNA, 20 bp, Artificial
  CRISPR gRNA sequence
atttttaatagacagccaaa

SEQ ID NO: 574326 - DNA, 20 bp, Artificial
  CRISPR gRNA sequence
acagccaaaaggatttgttg

SEQ ID NO: 574327 - DNA, 20 bp, Artificial
  CRISPR gRNA sequence
aaaaggatttgttgaagact

SEQ ID NO: 574328 - DNA, 20 bp, Artificial
  CRISPR gRNA sequence
aaggatttgttgaagactga

SEQ ID NO: 574329 - DNA, 20 bp, Artificial
  CRISPR gRNA sequence
ttgttgaagactgagagtct

SEQ ID NO: 574330 - DNA, 20 bp, Artificial
  CRISPR gRNA sequence
gttgaagactgagagtcttg

SEQ ID NO: 574331 - DNA, 20 bp, Artificial
  CRISPR gRNA sequence
aagactgagagtcttggagc

SEQ ID NO: 574332 - DNA, 20 bp, Artificial
  CRISPR gRNA sequence
tgagagtcttggagccagat

SEQ ID NO: 574333 - DNA, 20 bp, Artificial
  CRISPR gRNA sequence
gagagtcttggagccagatc

SEQ ID NO: 574334 - DNA, 20 bp, Artificial
  CRISPR gRNA sequence
gtcttggagccagatcggga

SEQ ID NO: 574335 - DNA, 20 bp, Artificial
  CRISPR gRNA sequence
gggacagacaatgcccaaac

SEQ ID NO: 574336 - DNA, 20 bp, Artificial
  CRISPR gRNA sequence
ggacagacaatgcccaaacc

SEQ ID NO: 574337 - DNA, 20 bp, Artificial
  CRISPR gRNA sequence
cagacaatgcccaaaccagg

SEQ ID NO: 574338 - DNA, 20 bp, Artificial
  CRISPR gRNA sequence
agacaatgcccaaaccaggt

SEQ ID NO: 574339 - DNA, 20 bp, Artificial
  CRISPR gRNA sequence
caatgcccaaaccaggtggg

SEQ ID NO: 574340 - DNA, 20 bp, Artificial
  CRISPR gRNA sequence
aatgcccaaaccaggtgggc

SEQ ID NO: 574341 - DNA, 20 bp, Artificial
  CRISPR gRNA sequence
gcccaaaccaggtgggcagg

SEQ ID NO: 574342 - DNA, 20 bp, Artificial
  CRISPR gRNA sequence
cccaaaccaggtgggcagga

SEQ ID NO: 574343 - DNA, 20 bp, Artificial
  CRISPR gRNA sequence
caaaccaggtgggcaggaag

SEQ ID NO: 574344 - DNA, 20 bp, Artificial
  CRISPR gRNA sequence
ggtgggcaggaaggagtccc

SEQ ID NO: 574345 - DNA, 20 bp, Artificial
  CRISPR gRNA sequence
ggagtccctggactatttgc

SEQ ID NO: 574346 - DNA, 20 bp, Artificial
  CRISPR gRNA sequence
tatttgccagcttgaacttt

SEQ ID NO: 574347 - DNA, 20 bp, Artificial
  CRISPR gRNA sequence
atttgccagcttgaactttt

SEQ ID NO: 574348 - DNA, 20 bp, Artificial
  CRISPR gRNA sequence
gccagcttgaacttttaggt

SEQ ID NO: 574349 - DNA, 20 bp, Artificial
  CRISPR gRNA sequence
ttttaggtgagaaaaaaata

SEQ ID NO: 574350 - DNA, 20 bp, Artificial
  CRISPR gRNA sequence
aataaagttctgtcttgctt

SEQ ID NO: 574351 - DNA, 20 bp, Artificial
  CRISPR gRNA sequence
tatgatttttctgttacttg

SEQ ID NO: 574352 - DNA, 20 bp, Artificial
  CRISPR gRNA sequence
acatattcatttctaactca

SEQ ID NO: 574353 - DNA, 20 bp, Artificial
  CRISPR gRNA sequence
actcatggacatcctgaaca

SEQ ID NO: 574354 - DNA, 20 bp, Artificial
  CRISPR gRNA sequence
tcatggacatcctgaacatg

SEQ ID NO: 574355 - DNA, 20 bp, Artificial
  CRISPR gRNA sequence
acatcctgaacatggagacc

SEQ ID NO: 574356 - DNA, 20 bp, Artificial
  CRISPR gRNA sequence
catcctgaacatggagacct

SEQ ID NO: 574357 - DNA, 20 bp, Artificial
  CRISPR gRNA sequence
atcctgaacatggagacctg

SEQ ID NO: 574358 - DNA, 20 bp, Artificial
  CRISPR gRNA sequence
cctgaacatggagacctggg

SEQ ID NO: 574359 - DNA, 20 bp, Artificial
  CRISPR gRNA sequence
tgaacatggagacctgggga

SEQ ID NO: 574360 - DNA, 20 bp, Artificial
  CRISPR gRNA sequence
gaacatggagacctggggag

SEQ ID NO: 574361 - DNA, 20 bp, Artificial
  CRISPR gRNA sequence
aacatggagacctggggaga

SEQ ID NO: 574362 - DNA, 20 bp, Artificial
  CRISPR gRNA sequence
acatggagacctggggagag

SEQ ID NO: 574363 - DNA, 20 bp, Artificial
  CRISPR gRNA sequence
gacctggggagaggggctgc

SEQ ID NO: 574364 - DNA, 20 bp, Artificial
  CRISPR gRNA sequence
ctggggagaggggctgctgg

SEQ ID NO: 574365 - DNA, 20 bp, Artificial
  CRISPR gRNA sequence
tggggagaggggctgctgga

SEQ ID NO: 574366 - DNA, 20 bp, Artificial
  CRISPR gRNA sequence
tggaaggatcacctccctcc

SEQ ID NO: 574367 - DNA, 20 bp, Artificial
  CRISPR gRNA sequence
ggaaggatcacctccctcct

SEQ ID NO: 574368 - DNA, 20 bp, Artificial
  CRISPR gRNA sequence
cctccctcctaggatgctgt

SEQ ID NO: 574369 - DNA, 20 bp, Artificial
  CRISPR gRNA sequence
ctccctcctaggatgctgtg

SEQ ID NO: 574370 - DNA, 20 bp, Artificial
  CRISPR gRNA sequence
ggatgctgtgaggttctaat

SEQ ID NO: 574371 - DNA, 20 bp, Artificial
  CRISPR gRNA sequence
gtgaggttctaatgagataa

SEQ ID NO: 574372 - DNA, 20 bp, Artificial
  CRISPR gRNA sequence
taatgagataacagcatgct

SEQ ID NO: 574373 - DNA, 20 bp, Artificial
  CRISPR gRNA sequence
ataacagcatgctcagaacc

SEQ ID NO: 574374 - DNA, 20 bp, Artificial
  CRISPR gRNA sequence
catgctcagaacctggcact

SEQ ID NO: 574375 - DNA, 20 bp, Artificial
  CRISPR gRNA sequence
gctcagaacctggcactcag

SEQ ID NO: 574376 - DNA, 20 bp, Artificial
  CRISPR gRNA sequence
ctcagaacctggcactcagt

SEQ ID NO: 574377 - DNA, 20 bp, Artificial
  CRISPR gRNA sequence
cctggcactcagtaggtgtt

SEQ ID NO: 574378 - DNA, 20 bp, Artificial
  CRISPR gRNA sequence
aggtgttcagtaaatcttcc

SEQ ID NO: 574379 - DNA, 20 bp, Artificial
  CRISPR gRNA sequence
ggtgttcagtaaatcttccc

SEQ ID NO: 574380 - DNA, 20 bp, Artificial
  CRISPR gRNA sequence
ttcagtaaatcttcccagga

SEQ ID NO: 574381 - DNA, 20 bp, Artificial
  CRISPR gRNA sequence
cagtaaatcttcccaggatg

SEQ ID NO: 574382 - DNA, 20 bp, Artificial
  CRISPR gRNA sequence
taaatcttcccaggatggag

SEQ ID NO: 574383 - DNA, 20 bp, Artificial
  CRISPR gRNA sequence
aaatcttcccaggatggaga

SEQ ID NO: 574384 - DNA, 20 bp, Artificial
  CRISPR gRNA sequence
atggagaaggaatgtatgaa

SEQ ID NO: 574385 - DNA, 20 bp, Artificial
  CRISPR gRNA sequence
aatgtatgaatggatgtgtt

SEQ ID NO: 574386 - DNA, 20 bp, Artificial
  CRISPR gRNA sequence
gtatgaatggatgtgttcag

SEQ ID NO: 574387 - DNA, 20 bp, Artificial
  CRISPR gRNA sequence
tggatgtgttcagcggacaa

SEQ ID NO: 574388 - DNA, 20 bp, Artificial
  CRISPR gRNA sequence
tgttcagcggacaaaagctg

SEQ ID NO: 574389 - DNA, 20 bp, Artificial
  CRISPR gRNA sequence
agcggacaaaagctgcagtt

SEQ ID NO: 574390 - DNA, 20 bp, Artificial
  CRISPR gRNA sequence
aagctgcagttgagttccca

SEQ ID NO: 574391 - DNA, 20 bp, Artificial
  CRISPR gRNA sequence
ctgcagttgagttcccacag

SEQ ID NO: 574392 - DNA, 20 bp, Artificial
  CRISPR gRNA sequence
tgcagttgagttcccacaga

SEQ ID NO: 574393 - DNA, 20 bp, Artificial
  CRISPR gRNA sequence
gttgagttcccacagaaggt

SEQ ID NO: 574394 - DNA, 20 bp, Artificial
  CRISPR gRNA sequence
ccacagaaggtgagacccca

SEQ ID NO: 574395 - DNA, 20 bp, Artificial
  CRISPR gRNA sequence
cacagaaggtgagaccccaa

SEQ ID NO: 574396 - DNA, 20 bp, Artificial
  CRISPR gRNA sequence
acagaaggtgagaccccaaa

SEQ ID NO: 574397 - DNA, 20 bp, Artificial
  CRISPR gRNA sequence
agaaggtgagaccccaaagg

SEQ ID NO: 574398 - DNA, 20 bp, Artificial
  CRISPR gRNA sequence
aaggtgagaccccaaaggga

SEQ ID NO: 574399 - DNA, 20 bp, Artificial
  CRISPR gRNA sequence
agaccccaaagggagagcga

SEQ ID NO: 574400 - DNA, 20 bp, Artificial
  CRISPR gRNA sequence
gaccccaaagggagagcgaa

SEQ ID NO: 574401 - DNA, 20 bp, Artificial
  CRISPR gRNA sequence
ccccaaagggagagcgaaag

SEQ ID NO: 574402 - DNA, 20 bp, Artificial
  CRISPR gRNA sequence
ggagagcgaaaggagtttac

SEQ ID NO: 574403 - DNA, 20 bp, Artificial
  CRISPR gRNA sequence
agcgaaaggagtttactaga

SEQ ID NO: 574404 - DNA, 20 bp, Artificial
  CRISPR gRNA sequence
gaaaggagtttactagatgg

SEQ ID NO: 574405 - DNA, 20 bp, Artificial
  CRISPR gRNA sequence
aggagtttactagatggaag

SEQ ID NO: 574406 - DNA, 20 bp, Artificial
  CRISPR gRNA sequence
agtttactagatggaagcag

SEQ ID NO: 574407 - DNA, 20 bp, Artificial
  CRISPR gRNA sequence
ttactagatggaagcagcag

SEQ ID NO: 574408 - DNA, 20 bp, Artificial
  CRISPR gRNA sequence
tactagatggaagcagcaga

SEQ ID NO: 574409 - DNA, 20 bp, Artificial
  CRISPR gRNA sequence
gatggaagcagcagaaggaa

SEQ ID NO: 574410 - DNA, 20 bp, Artificial
  CRISPR gRNA sequence
agcagaaggaacagcactct

SEQ ID NO: 574411 - DNA, 20 bp, Artificial
  CRISPR gRNA sequence
gcagaaggaacagcactctt

SEQ ID NO: 574412 - DNA, 20 bp, Artificial
  CRISPR gRNA sequence
agaaggaacagcactcttgg

SEQ ID NO: 574413 - DNA, 20 bp, Artificial
  CRISPR gRNA sequence
aaggaacagcactcttggga

SEQ ID NO: 574414 - DNA, 20 bp, Artificial
  CRISPR gRNA sequence
aggaacagcactcttgggag

SEQ ID NO: 574415 - DNA, 20 bp, Artificial
  CRISPR gRNA sequence
ggaacagcactcttgggaga

SEQ ID NO: 574416 - DNA, 20 bp, Artificial
  CRISPR gRNA sequence
agcactcttgggagagggaa

SEQ ID NO: 574417 - DNA, 20 bp, Artificial
  CRISPR gRNA sequence
actcttgggagagggaacag

SEQ ID NO: 574418 - DNA, 20 bp, Artificial
  CRISPR gRNA sequence
cttgggagagggaacagtag

SEQ ID NO: 574419 - DNA, 20 bp, Artificial
  CRISPR gRNA sequence
gggagagggaacagtagaag

SEQ ID NO: 574420 - DNA, 20 bp, Artificial
  CRISPR gRNA sequence
gagagggaacagtagaagca

SEQ ID NO: 574421 - DNA, 20 bp, Artificial
  CRISPR gRNA sequence
gggaacagtagaagcagaga

SEQ ID NO: 574422 - DNA, 20 bp, Artificial
  CRISPR gRNA sequence
ggaacagtagaagcagagat

SEQ ID NO: 574423 - DNA, 20 bp, Artificial
  CRISPR gRNA sequence
gaacagtagaagcagagatg

SEQ ID NO: 574424 - DNA, 20 bp, Artificial
  CRISPR gRNA sequence
aacagtagaagcagagatgg

SEQ ID NO: 574425 - DNA, 20 bp, Artificial
  CRISPR gRNA sequence
acagtagaagcagagatggg

SEQ ID NO: 574426 - DNA, 20 bp, Artificial
  CRISPR gRNA sequence
tagaagcagagatgggggga

SEQ ID NO: 574427 - DNA, 20 bp, Artificial
  CRISPR gRNA sequence
agcagagatggggggacaga

SEQ ID NO: 574428 - DNA, 20 bp, Artificial
  CRISPR gRNA sequence
agagatggggggacagaaag

SEQ ID NO: 574429 - DNA, 20 bp, Artificial
  CRISPR gRNA sequence
gagatggggggacagaaaga

SEQ ID NO: 574430 - DNA, 20 bp, Artificial
  CRISPR gRNA sequence
agatggggggacagaaagaa

SEQ ID NO: 574431 - DNA, 20 bp, Artificial
  CRISPR gRNA sequence
atggggggacagaaagaagg

SEQ ID NO: 574432 - DNA, 20 bp, Artificial
  CRISPR gRNA sequence
tggggggacagaaagaaggg

SEQ ID NO: 574433 - DNA, 20 bp, Artificial
  CRISPR gRNA sequence
gggacagaaagaagggaggt

SEQ ID NO: 574434 - DNA, 20 bp, Artificial
  CRISPR gRNA sequence
ggacagaaagaagggaggtg

SEQ ID NO: 574435 - DNA, 20 bp, Artificial
  CRISPR gRNA sequence
gaagggaggtgaggcccctg

SEQ ID NO: 574436 - DNA, 20 bp, Artificial
  CRISPR gRNA sequence
aagggaggtgaggcccctgt

SEQ ID NO: 574437 - DNA, 20 bp, Artificial
  CRISPR gRNA sequence
agggaggtgaggcccctgtg

SEQ ID NO: 574438 - DNA, 20 bp, Artificial
  CRISPR gRNA sequence
ggtgaggcccctgtggggtg

SEQ ID NO: 574439 - DNA, 20 bp, Artificial
  CRISPR gRNA sequence
tgaggcccctgtggggtgtg

SEQ ID NO: 574440 - DNA, 20 bp, Artificial
  CRISPR gRNA sequence
ccctgtggggtgtggagtgt

SEQ ID NO: 574441 - DNA, 20 bp, Artificial
  CRISPR gRNA sequence
cctgtggggtgtggagtgtc

SEQ ID NO: 574442 - DNA, 20 bp, Artificial
  CRISPR gRNA sequence
tggggtgtggagtgtcaggt

SEQ ID NO: 574443 - DNA, 20 bp, Artificial
  CRISPR gRNA sequence
ggggtgtggagtgtcaggtt

SEQ ID NO: 574444 - DNA, 20 bp, Artificial
  CRISPR gRNA sequence
tgtggagtgtcaggttgggc

SEQ ID NO: 574445 - DNA, 20 bp, Artificial
  CRISPR gRNA sequence
ggagtgtcaggttgggcaag

SEQ ID NO: 574446 - DNA, 20 bp, Artificial
  CRISPR gRNA sequence
gagtgtcaggttgggcaaga

SEQ ID NO: 574447 - DNA, 20 bp, Artificial
  CRISPR gRNA sequence
gtcaggttgggcaagaagga

SEQ ID NO: 574448 - DNA, 20 bp, Artificial
  CRISPR gRNA sequence
tcaggttgggcaagaaggac

SEQ ID NO: 574449 - DNA, 20 bp, Artificial
  CRISPR gRNA sequence
caggttgggcaagaaggaca

SEQ ID NO: 574450 - DNA, 20 bp, Artificial
  CRISPR gRNA sequence
ggctttgattgtgattccat

SEQ ID NO: 574451 - DNA, 20 bp, Artificial
  CRISPR gRNA sequence
ttgattgtgattccattagt

SEQ ID NO: 574452 - DNA, 20 bp, Artificial
  CRISPR gRNA sequence
attgtgattccattagtcag

SEQ ID NO: 574453 - DNA, 20 bp, Artificial
  CRISPR gRNA sequence
ccatatgcccaatcaacttc

SEQ ID NO: 574454 - DNA, 20 bp, Artificial
  CRISPR gRNA sequence
tatgcccaatcaacttctgg

SEQ ID NO: 574455 - DNA, 20 bp, Artificial
  CRISPR gRNA sequence
aatcaacttctggtagcaca

SEQ ID NO: 574456 - DNA, 20 bp, Artificial
  CRISPR gRNA sequence
aacttctggtagcacacagt

SEQ ID NO: 574457 - DNA, 20 bp, Artificial
  CRISPR gRNA sequence
acttctggtagcacacagtc

SEQ ID NO: 574458 - DNA, 20 bp, Artificial
  CRISPR gRNA sequence
ctggtagcacacagtcaggt

SEQ ID NO: 574459 - DNA, 20 bp, Artificial
  CRISPR gRNA sequence
cagtcaggtcagtgtttgct

SEQ ID NO: 574460 - DNA, 20 bp, Artificial
  CRISPR gRNA sequence
tgctgagctgaaatttaaaa

SEQ ID NO: 574461 - DNA, 20 bp, Artificial
  CRISPR gRNA sequence
atttaaaaaagtgaatcctt

SEQ ID NO: 574462 - DNA, 20 bp, Artificial
  CRISPR gRNA sequence
aaaaaagtgaatccttcaga

SEQ ID NO: 574463 - DNA, 20 bp, Artificial
  CRISPR gRNA sequence
agaaagttaaatttcctatt

SEQ ID NO: 574464 - DNA, 20 bp, Artificial
  CRISPR gRNA sequence
ttcggccattcattcaacaa

SEQ ID NO: 574465 - DNA, 20 bp, Artificial
  CRISPR gRNA sequence
attcattcaacaatagtatc

SEQ ID NO: 574466 - DNA, 20 bp, Artificial
  CRISPR gRNA sequence
tcaacaatagtatcaagtcc

SEQ ID NO: 574467 - DNA, 20 bp, Artificial
  CRISPR gRNA sequence
aacaatagtatcaagtcctg

SEQ ID NO: 574468 - DNA, 20 bp, Artificial
  CRISPR gRNA sequence
caatagtatcaagtcctgga

SEQ ID NO: 574469 - DNA, 20 bp, Artificial
  CRISPR gRNA sequence
caagtcctggagagtgcttg

SEQ ID NO: 574470 - DNA, 20 bp, Artificial
  CRISPR gRNA sequence
gagtgcttgcggctaacaat

SEQ ID NO: 574471 - DNA, 20 bp, Artificial
  CRISPR gRNA sequence
agtgcttgcggctaacaatc

SEQ ID NO: 574472 - DNA, 20 bp, Artificial
  CRISPR gRNA sequence
gtgcttgcggctaacaatca

SEQ ID NO: 574473 - DNA, 20 bp, Artificial
  CRISPR gRNA sequence
tgcttgcggctaacaatcag

SEQ ID NO: 574474 - DNA, 20 bp, Artificial
  CRISPR gRNA sequence
ctaacaatcaggggcattct

SEQ ID NO: 574475 - DNA, 20 bp, Artificial
  CRISPR gRNA sequence
tcaggggcattcttggcttg

SEQ ID NO: 574476 - DNA, 20 bp, Artificial
  CRISPR gRNA sequence
cttggcttgtggcactgctc

SEQ ID NO: 574477 - DNA, 20 bp, Artificial
  CRISPR gRNA sequence
cttgtggcactgctcaagaa

SEQ ID NO: 574478 - DNA, 20 bp, Artificial
  CRISPR gRNA sequence
ttgtggcactgctcaagaaa

SEQ ID NO: 574479 - DNA, 20 bp, Artificial
  CRISPR gRNA sequence
cactgctcaagaaaaggttg

SEQ ID NO: 574480 - DNA, 20 bp, Artificial
  CRISPR gRNA sequence
gctcaagaaaaggttgtagt

SEQ ID NO: 574481 - DNA, 20 bp, Artificial
  CRISPR gRNA sequence
ctcaagaaaaggttgtagtt

SEQ ID NO: 574482 - DNA, 20 bp, Artificial
  CRISPR gRNA sequence
aagaaaaggttgtagttggg

SEQ ID NO: 574483 - DNA, 20 bp, Artificial
  CRISPR gRNA sequence
agaaaaggttgtagttgggc

SEQ ID NO: 574484 - DNA, 20 bp, Artificial
  CRISPR gRNA sequence
gaaaaggttgtagttgggca

SEQ ID NO: 574485 - DNA, 20 bp, Artificial
  CRISPR gRNA sequence
aaaggttgtagttgggcagg

SEQ ID NO: 574486 - DNA, 20 bp, Artificial
  CRISPR gRNA sequence
aaggttgtagttgggcaggg

SEQ ID NO: 574487 - DNA, 20 bp, Artificial
  CRISPR gRNA sequence
gtagttgggcagggaggacc

SEQ ID NO: 574488 - DNA, 20 bp, Artificial
  CRISPR gRNA sequence
ttgggcagggaggacccagt

SEQ ID NO: 574489 - DNA, 20 bp, Artificial
  CRISPR gRNA sequence
cagtaagtaactaactgcaa

SEQ ID NO: 574490 - DNA, 20 bp, Artificial
  CRISPR gRNA sequence
agtaagtaactaactgcaac

SEQ ID NO: 574491 - DNA, 20 bp, Artificial
  CRISPR gRNA sequence
agtaactaactgcaacagga

SEQ ID NO: 574492 - DNA, 20 bp, Artificial
  CRISPR gRNA sequence
gacagtcattttcactttcc

SEQ ID NO: 574493 - DNA, 20 bp, Artificial
  CRISPR gRNA sequence
actttcctagttcacacacc

SEQ ID NO: 574494 - DNA, 20 bp, Artificial
  CRISPR gRNA sequence
ctttcctagttcacacacca

SEQ ID NO: 574495 - DNA, 20 bp, Artificial
  CRISPR gRNA sequence
ctagttcacacaccaaggtg

SEQ ID NO: 574496 - DNA, 20 bp, Artificial
  CRISPR gRNA sequence
tcacacaccaaggtgtggtc

SEQ ID NO: 574497 - DNA, 20 bp, Artificial
  CRISPR gRNA sequence
cacacaccaaggtgtggtct

SEQ ID NO: 574498 - DNA, 20 bp, Artificial
  CRISPR gRNA sequence
caaggtgtggtctaggcctt

SEQ ID NO: 574499 - DNA, 20 bp, Artificial
  CRISPR gRNA sequence
aaggtgtggtctaggccttc

SEQ ID NO: 574500 - DNA, 20 bp, Artificial
  CRISPR gRNA sequence
aggtgtggtctaggccttca

SEQ ID NO: 574501 - DNA, 20 bp, Artificial
  CRISPR gRNA sequence
ggtgtggtctaggccttcag

SEQ ID NO: 574502 - DNA, 20 bp, Artificial
  CRISPR gRNA sequence
gtctaggccttcaggggctc

SEQ ID NO: 574503 - DNA, 20 bp, Artificial
  CRISPR gRNA sequence
tctaggccttcaggggctct

SEQ ID NO: 574504 - DNA, 20 bp, Artificial
  CRISPR gRNA sequence
tcaggggctctgggtattcc

SEQ ID NO: 574505 - DNA, 20 bp, Artificial
  CRISPR gRNA sequence
caggggctctgggtattcct

SEQ ID NO: 574506 - DNA, 20 bp, Artificial
  CRISPR gRNA sequence
aggggctctgggtattcctg

SEQ ID NO: 574507 - DNA, 20 bp, Artificial
  CRISPR gRNA sequence
tctgggtattcctggggcaa

SEQ ID NO: 574508 - DNA, 20 bp, Artificial
  CRISPR gRNA sequence
ctgggtattcctggggcaat

SEQ ID NO: 574509 - DNA, 20 bp, Artificial
  CRISPR gRNA sequence
tgggtattcctggggcaatg

SEQ ID NO: 574510 - DNA, 20 bp, Artificial
  CRISPR gRNA sequence
ggtattcctggggcaatggg

SEQ ID NO: 574511 - DNA, 20 bp, Artificial
  CRISPR gRNA sequence
cctggggcaatggggagtca

SEQ ID NO: 574512 - DNA, 20 bp, Artificial
  CRISPR gRNA sequence
tggggcaatggggagtcacg

SEQ ID NO: 574513 - DNA, 20 bp, Artificial
  CRISPR gRNA sequence
ggggcaatggggagtcacgg

SEQ ID NO: 574514 - DNA, 20 bp, Artificial
  CRISPR gRNA sequence
gggcaatggggagtcacgga

SEQ ID NO: 574515 - DNA, 20 bp, Artificial
  CRISPR gRNA sequence
aatggggagtcacggagggt

SEQ ID NO: 574516 - DNA, 20 bp, Artificial
  CRISPR gRNA sequence
atggggagtcacggagggtt

SEQ ID NO: 574517 - DNA, 20 bp, Artificial
  CRISPR gRNA sequence
tggggagtcacggagggtta

SEQ ID NO: 574518 - DNA, 20 bp, Artificial
  CRISPR gRNA sequence
gggagtcacggagggttagg

SEQ ID NO: 574519 - DNA, 20 bp, Artificial
  CRISPR gRNA sequence
gagtcacggagggttaggga

SEQ ID NO: 574520 - DNA, 20 bp, Artificial
  CRISPR gRNA sequence
agtcacggagggttagggag

SEQ ID NO: 574521 - DNA, 20 bp, Artificial
  CRISPR gRNA sequence
gtcacggagggttagggaga

SEQ ID NO: 574522 - DNA, 20 bp, Artificial
  CRISPR gRNA sequence
gagagggtaaccccatccct

SEQ ID NO: 574523 - DNA, 20 bp, Artificial
  CRISPR gRNA sequence
agggtaaccccatccctgag

SEQ ID NO: 574524 - DNA, 20 bp, Artificial
  CRISPR gRNA sequence
gagaagcacatttttcctaa

SEQ ID NO: 574525 - DNA, 20 bp, Artificial
  CRISPR gRNA sequence
taatggctgcctgcgttcta

SEQ ID NO: 574526 - DNA, 20 bp, Artificial
  CRISPR gRNA sequence
cgttctatggttctgctgtc

SEQ ID NO: 574527 - DNA, 20 bp, Artificial
  CRISPR gRNA sequence
tgtccggccacccaatacct

SEQ ID NO: 574528 - DNA, 20 bp, Artificial
  CRISPR gRNA sequence
tacctcagactctgtctaca

SEQ ID NO: 574529 - DNA, 20 bp, Artificial
  CRISPR gRNA sequence
ctacacagcgtcctcctctc

SEQ ID NO: 574530 - DNA, 20 bp, Artificial
  CRISPR gRNA sequence
ctcctctccagcctccttat

SEQ ID NO: 574531 - DNA, 20 bp, Artificial
  CRISPR gRNA sequence
accacctacactgcccccgt

SEQ ID NO: 574532 - DNA, 20 bp, Artificial
  CRISPR gRNA sequence
tttttccccatcttgcctcc

SEQ ID NO: 574533 - DNA, 20 bp, Artificial
  CRISPR gRNA sequence
ctccgtcccgctgcactatc

SEQ ID NO: 574534 - DNA, 20 bp, Artificial
  CRISPR gRNA sequence
cccgctgcactatctagcct

SEQ ID NO: 574535 - DNA, 20 bp, Artificial
  CRISPR gRNA sequence
gcactatctagcctcggcat

SEQ ID NO: 574536 - DNA, 20 bp, Artificial
  CRISPR gRNA sequence
ggcattggctcatcccatac

SEQ ID NO: 574537 - DNA, 20 bp, Artificial
  CRISPR gRNA sequence
ccatactagtactgtccttt

SEQ ID NO: 574538 - DNA, 20 bp, Artificial
  CRISPR gRNA sequence
catactagtactgtcctttg

SEQ ID NO: 574539 - DNA, 20 bp, Artificial
  CRISPR gRNA sequence
aggtctctacgccttcaccc

SEQ ID NO: 574540 - DNA, 20 bp, Artificial
  CRISPR gRNA sequence
cttcaccctggctccctcat

SEQ ID NO: 574541 - DNA, 20 bp, Artificial
  CRISPR gRNA sequence
ctccctcattggctatccgc

SEQ ID NO: 574542 - DNA, 20 bp, Artificial
  CRISPR gRNA sequence
ctcgtcctcgctcccgcctt

SEQ ID NO: 574543 - DNA, 20 bp, Artificial
  CRISPR gRNA sequence
ccttcagcctccacctccat

SEQ ID NO: 574544 - DNA, 20 bp, Artificial
  CRISPR gRNA sequence
agcctccacctccattggct

SEQ ID NO: 574545 - DNA, 20 bp, Artificial
  CRISPR gRNA sequence
ctccctacacacccgcctct

SEQ ID NO: 574546 - DNA, 20 bp, Artificial
  CRISPR gRNA sequence
cccgcctcttggtctccttt

SEQ ID NO: 574547 - DNA, 20 bp, Artificial
  CRISPR gRNA sequence
tctccttttagccttcgtat

SEQ ID NO: 574548 - DNA, 20 bp, Artificial
  CRISPR gRNA sequence
cttttagccttcgtattggc

SEQ ID NO: 574549 - DNA, 20 bp, Artificial
  CRISPR gRNA sequence
cgtattggctagctccacct

SEQ ID NO: 574550 - DNA, 20 bp, Artificial
  CRISPR gRNA sequence
accttggcaccaccccttcg

SEQ ID NO: 574551 - DNA, 20 bp, Artificial
  CRISPR gRNA sequence
gcaccaccccttcgaagccg

SEQ ID NO: 574552 - DNA, 20 bp, Artificial
  CRISPR gRNA sequence
aagccgcagtgcacgctcac

SEQ ID NO: 574553 - DNA, 20 bp, Artificial
  CRISPR gRNA sequence
acgctcacaagcctccccat

SEQ ID NO: 574554 - DNA, 20 bp, Artificial
  CRISPR gRNA sequence
gcctccccattggctcgctg

SEQ ID NO: 574555 - DNA, 20 bp, Artificial
  CRISPR gRNA sequence
cattgtcgtcatcccacgcg

SEQ ID NO: 574556 - DNA, 20 bp, Artificial
  CRISPR gRNA sequence
tcccacgcgtggctctccat

SEQ ID NO: 574557 - DNA, 20 bp, Artificial
  CRISPR gRNA sequence
cattggctgttctctctctc

SEQ ID NO: 574558 - DNA, 20 bp, Artificial
  CRISPR gRNA sequence
tccaccgcctacgcaacccg

SEQ ID NO: 574559 - DNA, 20 bp, Artificial
  CRISPR gRNA sequence
ccaccgcctacgcaacccgc

SEQ ID NO: 574560 - DNA, 20 bp, Artificial
  CRISPR gRNA sequence
ccgcgggatctcccactttt

SEQ ID NO: 574561 - DNA, 20 bp, Artificial
  CRISPR gRNA sequence
cgcgggatctcccacttttt

SEQ ID NO: 574562 - DNA, 20 bp, Artificial
  CRISPR gRNA sequence
tgggcctctgcgttcgttcc

SEQ ID NO: 574563 - DNA, 20 bp, Artificial
  CRISPR gRNA sequence
ccggctgccctcatcgcctg

SEQ ID NO: 574564 - DNA, 20 bp, Artificial
  CRISPR gRNA sequence
gcccacatgcctctctcgct

SEQ ID NO: 574565 - DNA, 20 bp, Artificial
  CRISPR gRNA sequence
tctcgctcagacttccgcat

SEQ ID NO: 574566 - DNA, 20 bp, Artificial
  CRISPR gRNA sequence
tgcttctgttttcttcatca

SEQ ID NO: 574567 - DNA, 20 bp, Artificial
  CRISPR gRNA sequence
atttcgcaccacccccattc

SEQ ID NO: 574568 - DNA, 20 bp, Artificial
  CRISPR gRNA sequence
ccccctacaccgcccactcc

SEQ ID NO: 574569 - DNA, 20 bp, Artificial
  CRISPR gRNA sequence
cccctacaccgcccactccc

SEQ ID NO: 574570 - DNA, 20 bp, Artificial
  CRISPR gRNA sequence
ccactcccgggcatccccat

SEQ ID NO: 574571 - DNA, 20 bp, Artificial
  CRISPR gRNA sequence
ccattggctgcgtgcttctc

SEQ ID NO: 574572 - DNA, 20 bp, Artificial
  CRISPR gRNA sequence
cgctgtacgtcatccgtgca

SEQ ID NO: 574573 - DNA, 20 bp, Artificial
  CRISPR gRNA sequence
atccgtgcatggctgcccat

SEQ ID NO: 574574 - DNA, 20 bp, Artificial
  CRISPR gRNA sequence
ctcaccgcctatgcccccgt

SEQ ID NO: 574575 - DNA, 20 bp, Artificial
  CRISPR gRNA sequence
tgagccgtacccctccgcgc

SEQ ID NO: 574576 - DNA, 20 bp, Artificial
  CRISPR gRNA sequence
ctccgcgctggccttcccat

SEQ ID NO: 574577 - DNA, 20 bp, Artificial
  CRISPR gRNA sequence
ccattggctgcccgcccctt

SEQ ID NO: 574578 - DNA, 20 bp, Artificial
  CRISPR gRNA sequence
cattggctgcccgccccttc

SEQ ID NO: 574579 - DNA, 20 bp, Artificial
  CRISPR gRNA sequence
ggcgggggcagggcctgaag

SEQ ID NO: 574580 - DNA, 20 bp, Artificial
  CRISPR gRNA sequence
gggggcagggcctgaagggg

SEQ ID NO: 574581 - DNA, 20 bp, Artificial
  CRISPR gRNA sequence
ggggcagggcctgaaggggc

SEQ ID NO: 574582 - DNA, 20 bp, Artificial
  CRISPR gRNA sequence
gcagggcctgaaggggcggg

SEQ ID NO: 574583 - DNA, 20 bp, Artificial
  CRISPR gRNA sequence
ctgaaggggcgggcagccaa

SEQ ID NO: 574584 - DNA, 20 bp, Artificial
  CRISPR gRNA sequence
tgaaggggcgggcagccaat

SEQ ID NO: 574585 - DNA, 20 bp, Artificial
  CRISPR gRNA sequence
aggggcgggcagccaatggg

SEQ ID NO: 574586 - DNA, 20 bp, Artificial
  CRISPR gRNA sequence
ggggcgggcagccaatggga

SEQ ID NO: 574587 - DNA, 20 bp, Artificial
  CRISPR gRNA sequence
cgggcagccaatgggaaggc

SEQ ID NO: 574588 - DNA, 20 bp, Artificial
  CRISPR gRNA sequence
agccaatgggaaggccagcg

SEQ ID NO: 574589 - DNA, 20 bp, Artificial
  CRISPR gRNA sequence
ccaatgggaaggccagcgcg

SEQ ID NO: 574590 - DNA, 20 bp, Artificial
  CRISPR gRNA sequence
caatgggaaggccagcgcgg

SEQ ID NO: 574591 - DNA, 20 bp, Artificial
  CRISPR gRNA sequence
aatgggaaggccagcgcgga

SEQ ID NO: 574592 - DNA, 20 bp, Artificial
  CRISPR gRNA sequence
atgggaaggccagcgcggag

SEQ ID NO: 574593 - DNA, 20 bp, Artificial
  CRISPR gRNA sequence
aaggccagcgcggaggggta

SEQ ID NO: 574594 - DNA, 20 bp, Artificial
  CRISPR gRNA sequence
gcgcggaggggtacggctca

SEQ ID NO: 574595 - DNA, 20 bp, Artificial
  CRISPR gRNA sequence
cgcggaggggtacggctcac

SEQ ID NO: 574596 - DNA, 20 bp, Artificial
  CRISPR gRNA sequence
gcggaggggtacggctcacg

SEQ ID NO: 574597 - DNA, 20 bp, Artificial
  CRISPR gRNA sequence
cggaggggtacggctcacgg

SEQ ID NO: 574598 - DNA, 20 bp, Artificial
  CRISPR gRNA sequence
gggtacggctcacgggggca

SEQ ID NO: 574599 - DNA, 20 bp, Artificial
  CRISPR gRNA sequence
ggtacggctcacgggggcat

SEQ ID NO: 574600 - DNA, 20 bp, Artificial
  CRISPR gRNA sequence
acggctcacgggggcatagg

SEQ ID NO: 574601 - DNA, 20 bp, Artificial
  CRISPR gRNA sequence
ctcacgggggcataggcggt

SEQ ID NO: 574602 - DNA, 20 bp, Artificial
  CRISPR gRNA sequence
ggggcataggcggtgagatg

SEQ ID NO: 574603 - DNA, 20 bp, Artificial
  CRISPR gRNA sequence
ataggcggtgagatgaagac

SEQ ID NO: 574604 - DNA, 20 bp, Artificial
  CRISPR gRNA sequence
tgagatgaagacaagtattg

SEQ ID NO: 574605 - DNA, 20 bp, Artificial
  CRISPR gRNA sequence
agatgaagacaagtattgca

SEQ ID NO: 574606 - DNA, 20 bp, Artificial
  CRISPR gRNA sequence
gatgaagacaagtattgcag

SEQ ID NO: 574607 - DNA, 20 bp, Artificial
  CRISPR gRNA sequence
atgaagacaagtattgcaga

SEQ ID NO: 574608 - DNA, 20 bp, Artificial
  CRISPR gRNA sequence
caagtattgcagagggccaa

SEQ ID NO: 574609 - DNA, 20 bp, Artificial
  CRISPR gRNA sequence
aagtattgcagagggccaat

SEQ ID NO: 574610 - DNA, 20 bp, Artificial
  CRISPR gRNA sequence
tattgcagagggccaatggg

SEQ ID NO: 574611 - DNA, 20 bp, Artificial
  CRISPR gRNA sequence
ggccaatgggcagccatgca

SEQ ID NO: 574612 - DNA, 20 bp, Artificial
  CRISPR gRNA sequence
agccatgcacggatgacgta

SEQ ID NO: 574613 - DNA, 20 bp, Artificial
  CRISPR gRNA sequence
cggatgacgtacagcgaatt

SEQ ID NO: 574614 - DNA, 20 bp, Artificial
  CRISPR gRNA sequence
gatgacgtacagcgaattga

SEQ ID NO: 574615 - DNA, 20 bp, Artificial
  CRISPR gRNA sequence
acgtacagcgaattgagagc

SEQ ID NO: 574616 - DNA, 20 bp, Artificial
  CRISPR gRNA sequence
gtacagcgaattgagagccg

SEQ ID NO: 574617 - DNA, 20 bp, Artificial
  CRISPR gRNA sequence
cagcgaattgagagccggag

SEQ ID NO: 574618 - DNA, 20 bp, Artificial
  CRISPR gRNA sequence
ttgagagccggagaagcacg

SEQ ID NO: 574619 - DNA, 20 bp, Artificial
  CRISPR gRNA sequence
ccggagaagcacgcagccaa

SEQ ID NO: 574620 - DNA, 20 bp, Artificial
  CRISPR gRNA sequence
cggagaagcacgcagccaat

SEQ ID NO: 574621 - DNA, 20 bp, Artificial
  CRISPR gRNA sequence
ggagaagcacgcagccaatg

SEQ ID NO: 574622 - DNA, 20 bp, Artificial
  CRISPR gRNA sequence
acgcagccaatggggatgcc

SEQ ID NO: 574623 - DNA, 20 bp, Artificial
  CRISPR gRNA sequence
cgcagccaatggggatgccc

SEQ ID NO: 574624 - DNA, 20 bp, Artificial
  CRISPR gRNA sequence
cagccaatggggatgcccgg

SEQ ID NO: 574625 - DNA, 20 bp, Artificial
  CRISPR gRNA sequence
ccaatggggatgcccgggag

SEQ ID NO: 574626 - DNA, 20 bp, Artificial
  CRISPR gRNA sequence
caatggggatgcccgggagt

SEQ ID NO: 574627 - DNA, 20 bp, Artificial
  CRISPR gRNA sequence
tggggatgcccgggagtggg

SEQ ID NO: 574628 - DNA, 20 bp, Artificial
  CRISPR gRNA sequence
atgcccgggagtgggcggtg

SEQ ID NO: 574629 - DNA, 20 bp, Artificial
  CRISPR gRNA sequence
tgcccgggagtgggcggtgt

SEQ ID NO: 574630 - DNA, 20 bp, Artificial
  CRISPR gRNA sequence
gcccgggagtgggcggtgta

SEQ ID NO: 574631 - DNA, 20 bp, Artificial
  CRISPR gRNA sequence
cccgggagtgggcggtgtag

SEQ ID NO: 574632 - DNA, 20 bp, Artificial
  CRISPR gRNA sequence
ccgggagtgggcggtgtagg

SEQ ID NO: 574633 - DNA, 20 bp, Artificial
  CRISPR gRNA sequence
ggagtgggcggtgtaggggg

SEQ ID NO: 574634 - DNA, 20 bp, Artificial
  CRISPR gRNA sequence
gagtgggcggtgtagggggc

SEQ ID NO: 574635 - DNA, 20 bp, Artificial
  CRISPR gRNA sequence
gtgtagggggcgggatgatc

SEQ ID NO: 574636 - DNA, 20 bp, Artificial
  CRISPR gRNA sequence
tgtagggggcgggatgatcg

SEQ ID NO: 574637 - DNA, 20 bp, Artificial
  CRISPR gRNA sequence
cgggatgatcgaggaatcaa

SEQ ID NO: 574638 - DNA, 20 bp, Artificial
  CRISPR gRNA sequence
ggatgatcgaggaatcaatg

SEQ ID NO: 574639 - DNA, 20 bp, Artificial
  CRISPR gRNA sequence
atgatcgaggaatcaatgga

SEQ ID NO: 574640 - DNA, 20 bp, Artificial
  CRISPR gRNA sequence
tgatcgaggaatcaatggag

SEQ ID NO: 574641 - DNA, 20 bp, Artificial
  CRISPR gRNA sequence
cgaggaatcaatggagaggc

SEQ ID NO: 574642 - DNA, 20 bp, Artificial
  CRISPR gRNA sequence
aatcaatggagaggccggaa

SEQ ID NO: 574643 - DNA, 20 bp, Artificial
  CRISPR gRNA sequence
atcaatggagaggccggaat

SEQ ID NO: 574644 - DNA, 20 bp, Artificial
  CRISPR gRNA sequence
tcaatggagaggccggaatg

SEQ ID NO: 574645 - DNA, 20 bp, Artificial
  CRISPR gRNA sequence
caatggagaggccggaatgg

SEQ ID NO: 574646 - DNA, 20 bp, Artificial
  CRISPR gRNA sequence
tggagaggccggaatggggg

SEQ ID NO: 574647 - DNA, 20 bp, Artificial
  CRISPR gRNA sequence
gtggtgcgaaatccatgatg

SEQ ID NO: 574648 - DNA, 20 bp, Artificial
  CRISPR gRNA sequence
gaaatccatgatgaagaaaa

SEQ ID NO: 574649 - DNA, 20 bp, Artificial
  CRISPR gRNA sequence
atccatgatgaagaaaacag

SEQ ID NO: 574650 - DNA, 20 bp, Artificial
  CRISPR gRNA sequence
catgatgaagaaaacagaag

SEQ ID NO: 574651 - DNA, 20 bp, Artificial
  CRISPR gRNA sequence
atgaagaaaacagaagcaga

SEQ ID NO: 574652 - DNA, 20 bp, Artificial
  CRISPR gRNA sequence
acagaagcagacagctaatg

SEQ ID NO: 574653 - DNA, 20 bp, Artificial
  CRISPR gRNA sequence
gaagcagacagctaatgcgg

SEQ ID NO: 574654 - DNA, 20 bp, Artificial
  CRISPR gRNA sequence
gacagctaatgcggaagtct

SEQ ID NO: 574655 - DNA, 20 bp, Artificial
  CRISPR gRNA sequence
gctaatgcggaagtctgagc

SEQ ID NO: 574656 - DNA, 20 bp, Artificial
  CRISPR gRNA sequence
taatgcggaagtctgagcga

SEQ ID NO: 574657 - DNA, 20 bp, Artificial
  CRISPR gRNA sequence
atgcggaagtctgagcgaga

SEQ ID NO: 574658 - DNA, 20 bp, Artificial
  CRISPR gRNA sequence
tgcggaagtctgagcgagag

SEQ ID NO: 574659 - DNA, 20 bp, Artificial
  CRISPR gRNA sequence
gtctgagcgagagaggcatg

SEQ ID NO: 574660 - DNA, 20 bp, Artificial
  CRISPR gRNA sequence
tctgagcgagagaggcatgt

SEQ ID NO: 574661 - DNA, 20 bp, Artificial
  CRISPR gRNA sequence
gagcgagagaggcatgtggg

SEQ ID NO: 574662 - DNA, 20 bp, Artificial
  CRISPR gRNA sequence
cgagagaggcatgtgggcgg

SEQ ID NO: 574663 - DNA, 20 bp, Artificial
  CRISPR gRNA sequence
gagagaggcatgtgggcggt

SEQ ID NO: 574664 - DNA, 20 bp, Artificial
  CRISPR gRNA sequence
aggcatgtgggcggtgggaa

SEQ ID NO: 574665 - DNA, 20 bp, Artificial
  CRISPR gRNA sequence
catgtgggcggtgggaaaag

SEQ ID NO: 574666 - DNA, 20 bp, Artificial
  CRISPR gRNA sequence
gggcggtgggaaaagtggaa

SEQ ID NO: 574667 - DNA, 20 bp, Artificial
  CRISPR gRNA sequence
tgggaaaagtggaatggcta

SEQ ID NO: 574668 - DNA, 20 bp, Artificial
  CRISPR gRNA sequence
gggaaaagtggaatggctac

SEQ ID NO: 574669 - DNA, 20 bp, Artificial
  CRISPR gRNA sequence
gtggaatggctacaggcgat

SEQ ID NO: 574670 - DNA, 20 bp, Artificial
  CRISPR gRNA sequence
tggaatggctacaggcgatg

SEQ ID NO: 574671 - DNA, 20 bp, Artificial
  CRISPR gRNA sequence
ggaatggctacaggcgatga

SEQ ID NO: 574672 - DNA, 20 bp, Artificial
  CRISPR gRNA sequence
atggctacaggcgatgaggg

SEQ ID NO: 574673 - DNA, 20 bp, Artificial
  CRISPR gRNA sequence
ctacaggcgatgagggcagc

SEQ ID NO: 574674 - DNA, 20 bp, Artificial
  CRISPR gRNA sequence
tacaggcgatgagggcagcc

SEQ ID NO: 574675 - DNA, 20 bp, Artificial
  CRISPR gRNA sequence
agggcagccgggaacgaacg

SEQ ID NO: 574676 - DNA, 20 bp, Artificial
  CRISPR gRNA sequence
ggcagccgggaacgaacgca

SEQ ID NO: 574677 - DNA, 20 bp, Artificial
  CRISPR gRNA sequence
gcagccgggaacgaacgcag

SEQ ID NO: 574678 - DNA, 20 bp, Artificial
  CRISPR gRNA sequence
aacgaacgcagaggcccaaa

SEQ ID NO: 574679 - DNA, 20 bp, Artificial
  CRISPR gRNA sequence
gaacgcagaggcccaaaaag

SEQ ID NO: 574680 - DNA, 20 bp, Artificial
  CRISPR gRNA sequence
aacgcagaggcccaaaaagt

SEQ ID NO: 574681 - DNA, 20 bp, Artificial
  CRISPR gRNA sequence
cgcagaggcccaaaaagtgg

SEQ ID NO: 574682 - DNA, 20 bp, Artificial
  CRISPR gRNA sequence
ccaaaaagtgggagatcccg

SEQ ID NO: 574683 - DNA, 20 bp, Artificial
  CRISPR gRNA sequence
caaaaagtgggagatcccgc

SEQ ID NO: 574684 - DNA, 20 bp, Artificial
  CRISPR gRNA sequence
gggagatcccgcgggttgcg

SEQ ID NO: 574685 - DNA, 20 bp, Artificial
  CRISPR gRNA sequence
ggagatcccgcgggttgcgt

SEQ ID NO: 574686 - DNA, 20 bp, Artificial
  CRISPR gRNA sequence
gatcccgcgggttgcgtagg

SEQ ID NO: 574687 - DNA, 20 bp, Artificial
  CRISPR gRNA sequence
cccgcgggttgcgtaggcgg

SEQ ID NO: 574688 - DNA, 20 bp, Artificial
  CRISPR gRNA sequence
gggttgcgtaggcggtggaa

SEQ ID NO: 574689 - DNA, 20 bp, Artificial
  CRISPR gRNA sequence
ttgcgtaggcggtggaacgg

SEQ ID NO: 574690 - DNA, 20 bp, Artificial
  CRISPR gRNA sequence
gtaggcggtggaacggtagc

SEQ ID NO: 574691 - DNA, 20 bp, Artificial
  CRISPR gRNA sequence
aggcggtggaacggtagcta

SEQ ID NO: 574692 - DNA, 20 bp, Artificial
  CRISPR gRNA sequence
gcggtggaacggtagctaga

SEQ ID NO: 574693 - DNA, 20 bp, Artificial
  CRISPR gRNA sequence
ggtggaacggtagctagaga

SEQ ID NO: 574694 - DNA, 20 bp, Artificial
  CRISPR gRNA sequence
tggaacggtagctagagaga

SEQ ID NO: 574695 - DNA, 20 bp, Artificial
  CRISPR gRNA sequence
cggtagctagagagagagaa

SEQ ID NO: 574696 - DNA, 20 bp, Artificial
  CRISPR gRNA sequence
tagagagagagaacagccaa

SEQ ID NO: 574697 - DNA, 20 bp, Artificial
  CRISPR gRNA sequence
gagagagagaacagccaatg

SEQ ID NO: 574698 - DNA, 20 bp, Artificial
  CRISPR gRNA sequence
gagagagaacagccaatgga

SEQ ID NO: 574699 - DNA, 20 bp, Artificial
  CRISPR gRNA sequence
agccaatggagagccacgcg

SEQ ID NO: 574700 - DNA, 20 bp, Artificial
  CRISPR gRNA sequence
gccaatggagagccacgcgt

SEQ ID NO: 574701 - DNA, 20 bp, Artificial
  CRISPR gRNA sequence
cacgcgtgggatgacgacaa

SEQ ID NO: 574702 - DNA, 20 bp, Artificial
  CRISPR gRNA sequence
tgggatgacgacaatggctg

SEQ ID NO: 574703 - DNA, 20 bp, Artificial
  CRISPR gRNA sequence
atgacgacaatggctgcagc

SEQ ID NO: 574704 - DNA, 20 bp, Artificial
  CRISPR gRNA sequence
caatggctgcagcgagccaa

SEQ ID NO: 574705 - DNA, 20 bp, Artificial
  CRISPR gRNA sequence
aatggctgcagcgagccaat

SEQ ID NO: 574706 - DNA, 20 bp, Artificial
  CRISPR gRNA sequence
atggctgcagcgagccaatg

SEQ ID NO: 574707 - DNA, 20 bp, Artificial
  CRISPR gRNA sequence
ggctgcagcgagccaatggg

SEQ ID NO: 574708 - DNA, 20 bp, Artificial
  CRISPR gRNA sequence
gctgcagcgagccaatgggg

SEQ ID NO: 574709 - DNA, 20 bp, Artificial
  CRISPR gRNA sequence
gagccaatggggaggcttgt

SEQ ID NO: 574710 - DNA, 20 bp, Artificial
  CRISPR gRNA sequence
aggcttgtgagcgtgcactg

SEQ ID NO: 574711 - DNA, 20 bp, Artificial
  CRISPR gRNA sequence
gagcgtgcactgcggcttcg

SEQ ID NO: 574712 - DNA, 20 bp, Artificial
  CRISPR gRNA sequence
agcgtgcactgcggcttcga

SEQ ID NO: 574713 - DNA, 20 bp, Artificial
  CRISPR gRNA sequence
gcgtgcactgcggcttcgaa

SEQ ID NO: 574714 - DNA, 20 bp, Artificial
  CRISPR gRNA sequence
cgtgcactgcggcttcgaag

SEQ ID NO: 574715 - DNA, 20 bp, Artificial
  CRISPR gRNA sequence
gcactgcggcttcgaagggg

SEQ ID NO: 574716 - DNA, 20 bp, Artificial
  CRISPR gRNA sequence
ggcttcgaaggggtggtgcc

SEQ ID NO: 574717 - DNA, 20 bp, Artificial
  CRISPR gRNA sequence
gcttcgaaggggtggtgcca

SEQ ID NO: 574718 - DNA, 20 bp, Artificial
  CRISPR gRNA sequence
tcgaaggggtggtgccaagg

SEQ ID NO: 574719 - DNA, 20 bp, Artificial
  CRISPR gRNA sequence
gaaggggtggtgccaaggtg

SEQ ID NO: 574720 - DNA, 20 bp, Artificial
  CRISPR gRNA sequence
gggtggtgccaaggtggagc

SEQ ID NO: 574721 - DNA, 20 bp, Artificial
  CRISPR gRNA sequence
aggtggagctagccaatacg

SEQ ID NO: 574722 - DNA, 20 bp, Artificial
  CRISPR gRNA sequence
ggtggagctagccaatacga

SEQ ID NO: 574723 - DNA, 20 bp, Artificial
  CRISPR gRNA sequence
ctagccaatacgaaggctaa

SEQ ID NO: 574724 - DNA, 20 bp, Artificial
  CRISPR gRNA sequence
tagccaatacgaaggctaaa

SEQ ID NO: 574725 - DNA, 20 bp, Artificial
  CRISPR gRNA sequence
gccaatacgaaggctaaaag

SEQ ID NO: 574726 - DNA, 20 bp, Artificial
  CRISPR gRNA sequence
acgaaggctaaaaggagacc

SEQ ID NO: 574727 - DNA, 20 bp, Artificial
  CRISPR gRNA sequence
gaaggctaaaaggagaccaa

SEQ ID NO: 574728 - DNA, 20 bp, Artificial
  CRISPR gRNA sequence
aaggctaaaaggagaccaag

SEQ ID NO: 574729 - DNA, 20 bp, Artificial
  CRISPR gRNA sequence
gctaaaaggagaccaagagg

SEQ ID NO: 574730 - DNA, 20 bp, Artificial
  CRISPR gRNA sequence
ctaaaaggagaccaagaggc

SEQ ID NO: 574731 - DNA, 20 bp, Artificial
  CRISPR gRNA sequence
gagaccaagaggcgggtgtg

SEQ ID NO: 574732 - DNA, 20 bp, Artificial
  CRISPR gRNA sequence
agaccaagaggcgggtgtgt

SEQ ID NO: 574733 - DNA, 20 bp, Artificial
  CRISPR gRNA sequence
gaccaagaggcgggtgtgta

SEQ ID NO: 574734 - DNA, 20 bp, Artificial
  CRISPR gRNA sequence
ccaagaggcgggtgtgtagg

SEQ ID NO: 574735 - DNA, 20 bp, Artificial
  CRISPR gRNA sequence
aggcgggtgtgtagggagcc

SEQ ID NO: 574736 - DNA, 20 bp, Artificial
  CRISPR gRNA sequence
tgtgtagggagccgagccaa

SEQ ID NO: 574737 - DNA, 20 bp, Artificial
  CRISPR gRNA sequence
tgtagggagccgagccaatg

SEQ ID NO: 574738 - DNA, 20 bp, Artificial
  CRISPR gRNA sequence
gtagggagccgagccaatgg

SEQ ID NO: 574739 - DNA, 20 bp, Artificial
  CRISPR gRNA sequence
gggagccgagccaatggagg

SEQ ID NO: 574740 - DNA, 20 bp, Artificial
  CRISPR gRNA sequence
gagccgagccaatggaggtg

SEQ ID NO: 574741 - DNA, 20 bp, Artificial
  CRISPR gRNA sequence
agccgagccaatggaggtgg

SEQ ID NO: 574742 - DNA, 20 bp, Artificial
  CRISPR gRNA sequence
gccaatggaggtggaggctg

SEQ ID NO: 574743 - DNA, 20 bp, Artificial
  CRISPR gRNA sequence
ccaatggaggtggaggctga

SEQ ID NO: 574744 - DNA, 20 bp, Artificial
  CRISPR gRNA sequence
atggaggtggaggctgaagg

SEQ ID NO: 574745 - DNA, 20 bp, Artificial
  CRISPR gRNA sequence
tggaggtggaggctgaaggc

SEQ ID NO: 574746 - DNA, 20 bp, Artificial
  CRISPR gRNA sequence
gaggtggaggctgaaggcgg

SEQ ID NO: 574747 - DNA, 20 bp, Artificial
  CRISPR gRNA sequence
tggaggctgaaggcgggagc

SEQ ID NO: 574748 - DNA, 20 bp, Artificial
  CRISPR gRNA sequence
ggaggctgaaggcgggagcg

SEQ ID NO: 574749 - DNA, 20 bp, Artificial
  CRISPR gRNA sequence
ctgaaggcgggagcgaggac

SEQ ID NO: 574750 - DNA, 20 bp, Artificial
  CRISPR gRNA sequence
gaaggcgggagcgaggacga

SEQ ID NO: 574751 - DNA, 20 bp, Artificial
  CRISPR gRNA sequence
gcgggagcgaggacgagagc

SEQ ID NO: 574752 - DNA, 20 bp, Artificial
  CRISPR gRNA sequence
ggagcgaggacgagagctgg

SEQ ID NO: 574753 - DNA, 20 bp, Artificial
  CRISPR gRNA sequence
cgaggacgagagctggcgga

SEQ ID NO: 574754 - DNA, 20 bp, Artificial
  CRISPR gRNA sequence
agagctggcggatagccaat

SEQ ID NO: 574755 - DNA, 20 bp, Artificial
  CRISPR gRNA sequence
gagctggcggatagccaatg

SEQ ID NO: 574756 - DNA, 20 bp, Artificial
  CRISPR gRNA sequence
agctggcggatagccaatga

SEQ ID NO: 574757 - DNA, 20 bp, Artificial
  CRISPR gRNA sequence
ctggcggatagccaatgagg

SEQ ID NO: 574758 - DNA, 20 bp, Artificial
  CRISPR gRNA sequence
cggatagccaatgagggagc

SEQ ID NO: 574759 - DNA, 20 bp, Artificial
  CRISPR gRNA sequence
ggatagccaatgagggagcc

SEQ ID NO: 574760 - DNA, 20 bp, Artificial
  CRISPR gRNA sequence
gatagccaatgagggagcca

SEQ ID NO: 574761 - DNA, 20 bp, Artificial
  CRISPR gRNA sequence
ccaatgagggagccagggtg

SEQ ID NO: 574762 - DNA, 20 bp, Artificial
  CRISPR gRNA sequence
caatgagggagccagggtga

SEQ ID NO: 574763 - DNA, 20 bp, Artificial
  CRISPR gRNA sequence
agggagccagggtgaaggcg

SEQ ID NO: 574764 - DNA, 20 bp, Artificial
  CRISPR gRNA sequence
ggagccagggtgaaggcgta

SEQ ID NO: 574765 - DNA, 20 bp, Artificial
  CRISPR gRNA sequence
gtgaaggcgtagagacctca

SEQ ID NO: 574766 - DNA, 20 bp, Artificial
  CRISPR gRNA sequence
tgaaggcgtagagacctcaa

SEQ ID NO: 574767 - DNA, 20 bp, Artificial
  CRISPR gRNA sequence
ggcgtagagacctcaaagga

SEQ ID NO: 574768 - DNA, 20 bp, Artificial
  CRISPR gRNA sequence
gagacctcaaaggacagtac

SEQ ID NO: 574769 - DNA, 20 bp, Artificial
  CRISPR gRNA sequence
ctcaaaggacagtactagta

SEQ ID NO: 574770 - DNA, 20 bp, Artificial
  CRISPR gRNA sequence
tcaaaggacagtactagtat

SEQ ID NO: 574771 - DNA, 20 bp, Artificial
  CRISPR gRNA sequence
ggacagtactagtatgggat

SEQ ID NO: 574772 - DNA, 20 bp, Artificial
  CRISPR gRNA sequence
gtatgggatgagccaatgcc

SEQ ID NO: 574773 - DNA, 20 bp, Artificial
  CRISPR gRNA sequence
tatgggatgagccaatgccg

SEQ ID NO: 574774 - DNA, 20 bp, Artificial
  CRISPR gRNA sequence
ggatgagccaatgccgaggc

SEQ ID NO: 574775 - DNA, 20 bp, Artificial
  CRISPR gRNA sequence
gagccaatgccgaggctaga

SEQ ID NO: 574776 - DNA, 20 bp, Artificial
  CRISPR gRNA sequence
aatgccgaggctagatagtg

SEQ ID NO: 574777 - DNA, 20 bp, Artificial
  CRISPR gRNA sequence
gccgaggctagatagtgcag

SEQ ID NO: 574778 - DNA, 20 bp, Artificial
  CRISPR gRNA sequence
ccgaggctagatagtgcagc

SEQ ID NO: 574779 - DNA, 20 bp, Artificial
  CRISPR gRNA sequence
ggctagatagtgcagcggga

SEQ ID NO: 574780 - DNA, 20 bp, Artificial
  CRISPR gRNA sequence
ctagatagtgcagcgggacg

SEQ ID NO: 574781 - DNA, 20 bp, Artificial
  CRISPR gRNA sequence
tagatagtgcagcgggacgg

SEQ ID NO: 574782 - DNA, 20 bp, Artificial
  CRISPR gRNA sequence
agatagtgcagcgggacgga

SEQ ID NO: 574783 - DNA, 20 bp, Artificial
  CRISPR gRNA sequence
atagtgcagcgggacggagg

SEQ ID NO: 574784 - DNA, 20 bp, Artificial
  CRISPR gRNA sequence
tagtgcagcgggacggaggg

SEQ ID NO: 574785 - DNA, 20 bp, Artificial
  CRISPR gRNA sequence
agcgggacggagggaggact

SEQ ID NO: 574786 - DNA, 20 bp, Artificial
  CRISPR gRNA sequence
cgggacggagggaggacttg

SEQ ID NO: 574787 - DNA, 20 bp, Artificial
  CRISPR gRNA sequence
gggacggagggaggacttgg

SEQ ID NO: 574788 - DNA, 20 bp, Artificial
  CRISPR gRNA sequence
cggagggaggacttggaggc

SEQ ID NO: 574789 - DNA, 20 bp, Artificial
  CRISPR gRNA sequence
gggaggacttggaggcaaga

SEQ ID NO: 574790 - DNA, 20 bp, Artificial
  CRISPR gRNA sequence
ggaggacttggaggcaagat

SEQ ID NO: 574791 - DNA, 20 bp, Artificial
  CRISPR gRNA sequence
gaggacttggaggcaagatg

SEQ ID NO: 574792 - DNA, 20 bp, Artificial
  CRISPR gRNA sequence
tggaggcaagatggggaaaa

SEQ ID NO: 574793 - DNA, 20 bp, Artificial
  CRISPR gRNA sequence
aggcaagatggggaaaaaag

SEQ ID NO: 574794 - DNA, 20 bp, Artificial
  CRISPR gRNA sequence
gcaagatggggaaaaaagca

SEQ ID NO: 574795 - DNA, 20 bp, Artificial
  CRISPR gRNA sequence
ggggaaaaaagcagagccga

SEQ ID NO: 574796 - DNA, 20 bp, Artificial
  CRISPR gRNA sequence
gggaaaaaagcagagccgac

SEQ ID NO: 574797 - DNA, 20 bp, Artificial
  CRISPR gRNA sequence
ggaaaaaagcagagccgacg

SEQ ID NO: 574798 - DNA, 20 bp, Artificial
  CRISPR gRNA sequence
gaaaaaagcagagccgacgg

SEQ ID NO: 574799 - DNA, 20 bp, Artificial
  CRISPR gRNA sequence
aaaagcagagccgacggggg

SEQ ID NO: 574800 - DNA, 20 bp, Artificial
  CRISPR gRNA sequence
cagagccgacgggggcagtg

SEQ ID NO: 574801 - DNA, 20 bp, Artificial
  CRISPR gRNA sequence
agagccgacgggggcagtgt

SEQ ID NO: 574802 - DNA, 20 bp, Artificial
  CRISPR gRNA sequence
gccgacgggggcagtgtagg

SEQ ID NO: 574803 - DNA, 20 bp, Artificial
  CRISPR gRNA sequence
ggggcagtgtaggtggtgtg

SEQ ID NO: 574804 - DNA, 20 bp, Artificial
  CRISPR gRNA sequence
gggcagtgtaggtggtgtga

SEQ ID NO: 574805 - DNA, 20 bp, Artificial
  CRISPR gRNA sequence
ggcagtgtaggtggtgtgaa

SEQ ID NO: 574806 - DNA, 20 bp, Artificial
  CRISPR gRNA sequence
cagtgtaggtggtgtgaagg

SEQ ID NO: 574807 - DNA, 20 bp, Artificial
  CRISPR gRNA sequence
agtgtaggtggtgtgaaggg

SEQ ID NO: 574808 - DNA, 20 bp, Artificial
  CRISPR gRNA sequence
ggtggtgtgaagggaggcat

SEQ ID NO: 574809 - DNA, 20 bp, Artificial
  CRISPR gRNA sequence
ggtgtgaagggaggcatgag

SEQ ID NO: 574810 - DNA, 20 bp, Artificial
  CRISPR gRNA sequence
gggaggcatgagtagccaat

SEQ ID NO: 574811 - DNA, 20 bp, Artificial
  CRISPR gRNA sequence
ggaggcatgagtagccaata

SEQ ID NO: 574812 - DNA, 20 bp, Artificial
  CRISPR gRNA sequence
aggcatgagtagccaataag

SEQ ID NO: 574813 - DNA, 20 bp, Artificial
  CRISPR gRNA sequence
ggcatgagtagccaataagg

SEQ ID NO: 574814 - DNA, 20 bp, Artificial
  CRISPR gRNA sequence
tgagtagccaataaggaggc

SEQ ID NO: 574815 - DNA, 20 bp, Artificial
  CRISPR gRNA sequence
agtagccaataaggaggctg

SEQ ID NO: 574816 - DNA, 20 bp, Artificial
  CRISPR gRNA sequence
tagccaataaggaggctgga

SEQ ID NO: 574817 - DNA, 20 bp, Artificial
  CRISPR gRNA sequence
agccaataaggaggctggag

SEQ ID NO: 574818 - DNA, 20 bp, Artificial
  CRISPR gRNA sequence
ccaataaggaggctggagag

SEQ ID NO: 574819 - DNA, 20 bp, Artificial
  CRISPR gRNA sequence
caataaggaggctggagagg

SEQ ID NO: 574820 - DNA, 20 bp, Artificial
  CRISPR gRNA sequence
ctggagaggaggacgctgtg

SEQ ID NO: 574821 - DNA, 20 bp, Artificial
  CRISPR gRNA sequence
agaggaggacgctgtgtaga

SEQ ID NO: 574822 - DNA, 20 bp, Artificial
  CRISPR gRNA sequence
aggaggacgctgtgtagaca

SEQ ID NO: 574823 - DNA, 20 bp, Artificial
  CRISPR gRNA sequence
acgctgtgtagacagagtct

SEQ ID NO: 574824 - DNA, 20 bp, Artificial
  CRISPR gRNA sequence
cgctgtgtagacagagtctg

SEQ ID NO: 574825 - DNA, 20 bp, Artificial
  CRISPR gRNA sequence
gtagacagagtctgaggtat

SEQ ID NO: 574826 - DNA, 20 bp, Artificial
  CRISPR gRNA sequence
tagacagagtctgaggtatt

SEQ ID NO: 574827 - DNA, 20 bp, Artificial
  CRISPR gRNA sequence
acagagtctgaggtattggg

SEQ ID NO: 574828 - DNA, 20 bp, Artificial
  CRISPR gRNA sequence
agtctgaggtattgggtggc

SEQ ID NO: 574829 - DNA, 20 bp, Artificial
  CRISPR gRNA sequence
tgaggtattgggtggccgga

SEQ ID NO: 574830 - DNA, 20 bp, Artificial
  CRISPR gRNA sequence
ggtattgggtggccggacag

SEQ ID NO: 574831 - DNA, 20 bp, Artificial
  CRISPR gRNA sequence
gtggccggacagcagaacca

SEQ ID NO: 574832 - DNA, 20 bp, Artificial
  CRISPR gRNA sequence
gacagcagaaccatagaacg

SEQ ID NO: 574833 - DNA, 20 bp, Artificial
  CRISPR gRNA sequence
acagcagaaccatagaacgc

SEQ ID NO: 574834 - DNA, 20 bp, Artificial
  CRISPR gRNA sequence
gcagaaccatagaacgcagg

SEQ ID NO: 574835 - DNA, 20 bp, Artificial
  CRISPR gRNA sequence
catagaacgcaggcagccat

SEQ ID NO: 574836 - DNA, 20 bp, Artificial
  CRISPR gRNA sequence
atagaacgcaggcagccatt

SEQ ID NO: 574837 - DNA, 20 bp, Artificial
  CRISPR gRNA sequence
attaggaaaaatgtgcttct

SEQ ID NO: 574838 - DNA, 20 bp, Artificial
  CRISPR gRNA sequence
ttaggaaaaatgtgcttctc

SEQ ID NO: 574839 - DNA, 20 bp, Artificial
  CRISPR gRNA sequence
taggaaaaatgtgcttctca

SEQ ID NO: 574840 - DNA, 20 bp, Artificial
  CRISPR gRNA sequence
aaaaatgtgcttctcaggga

SEQ ID NO: 574841 - DNA, 20 bp, Artificial
  CRISPR gRNA sequence
aaaatgtgcttctcagggat

SEQ ID NO: 574842 - DNA, 20 bp, Artificial
  CRISPR gRNA sequence
aaatgtgcttctcagggatg

SEQ ID NO: 574843 - DNA, 20 bp, Artificial
  CRISPR gRNA sequence
tccgtgactccccattgccc

SEQ ID NO: 574844 - DNA, 20 bp, Artificial
  CRISPR gRNA sequence
ccgtgactccccattgcccc

SEQ ID NO: 574845 - DNA, 20 bp, Artificial
  CRISPR gRNA sequence
cccattgccccaggaatacc

SEQ ID NO: 574846 - DNA, 20 bp, Artificial
  CRISPR gRNA sequence
cattgccccaggaataccca

SEQ ID NO: 574847 - DNA, 20 bp, Artificial
  CRISPR gRNA sequence
aggaatacccagagcccctg

SEQ ID NO: 574848 - DNA, 20 bp, Artificial
  CRISPR gRNA sequence
ggaatacccagagcccctga

SEQ ID NO: 574849 - DNA, 20 bp, Artificial
  CRISPR gRNA sequence
acccagagcccctgaaggcc

SEQ ID NO: 574850 - DNA, 20 bp, Artificial
  CRISPR gRNA sequence
tgaaggcctagaccacacct

SEQ ID NO: 574851 - DNA, 20 bp, Artificial
  CRISPR gRNA sequence
ccacaccttggtgtgtgaac

SEQ ID NO: 574852 - DNA, 20 bp, Artificial
  CRISPR gRNA sequence
cacaccttggtgtgtgaact

SEQ ID NO: 574853 - DNA, 20 bp, Artificial
  CRISPR gRNA sequence
ccttggtgtgtgaactagga

SEQ ID NO: 574854 - DNA, 20 bp, Artificial
  CRISPR gRNA sequence
tgaaaatgactgtcctgttg

SEQ ID NO: 574855 - DNA, 20 bp, Artificial
  CRISPR gRNA sequence
aatgactgtcctgttgcagt

SEQ ID NO: 574856 - DNA, 20 bp, Artificial
  CRISPR gRNA sequence
tgttgcagttagttacttac

SEQ ID NO: 574857 - DNA, 20 bp, Artificial
  CRISPR gRNA sequence
gttgcagttagttacttact

SEQ ID NO: 574858 - DNA, 20 bp, Artificial
  CRISPR gRNA sequence
cccaactacaaccttttctt

SEQ ID NO: 574859 - DNA, 20 bp, Artificial
  CRISPR gRNA sequence
aactacaaccttttcttgag

SEQ ID NO: 574860 - DNA, 20 bp, Artificial
  CRISPR gRNA sequence
cttttcttgagcagtgccac

SEQ ID NO: 574861 - DNA, 20 bp, Artificial
  CRISPR gRNA sequence
cttgagcagtgccacaagcc

SEQ ID NO: 574862 - DNA, 20 bp, Artificial
  CRISPR gRNA sequence
ccaagaatgcccctgattgt

SEQ ID NO: 574863 - DNA, 20 bp, Artificial
  CRISPR gRNA sequence
tgcccctgattgttagccgc

SEQ ID NO: 574864 - DNA, 20 bp, Artificial
  CRISPR gRNA sequence
tgttagccgcaagcactctc

SEQ ID NO: 574865 - DNA, 20 bp, Artificial
  CRISPR gRNA sequence
gttagccgcaagcactctcc

SEQ ID NO: 574866 - DNA, 20 bp, Artificial
  CRISPR gRNA sequence
tgatactattgttgaatgaa

SEQ ID NO: 574867 - DNA, 20 bp, Artificial
  CRISPR gRNA sequence
ttgttgaatgaatggccgaa

SEQ ID NO: 574868 - DNA, 20 bp, Artificial
  CRISPR gRNA sequence
tgttgaatgaatggccgaat

SEQ ID NO: 574869 - DNA, 20 bp, Artificial
  CRISPR gRNA sequence
ataggaaatttaactttctg

SEQ ID NO: 574870 - DNA, 20 bp, Artificial
  CRISPR gRNA sequence
taggaaatttaactttctga

SEQ ID NO: 574871 - DNA, 20 bp, Artificial
  CRISPR gRNA sequence
ggattcacttttttaaattt

SEQ ID NO: 574872 - DNA, 20 bp, Artificial
  CRISPR gRNA sequence
cacttttttaaatttcagct

SEQ ID NO: 574873 - DNA, 20 bp, Artificial
  CRISPR gRNA sequence
ctgacctgactgtgtgctac

SEQ ID NO: 574874 - DNA, 20 bp, Artificial
  CRISPR gRNA sequence
acctgactgtgtgctaccag

SEQ ID NO: 574875 - DNA, 20 bp, Artificial
  CRISPR gRNA sequence
gtgtgctaccagaagttgat

SEQ ID NO: 574876 - DNA, 20 bp, Artificial
  CRISPR gRNA sequence
tgtgctaccagaagttgatt

SEQ ID NO: 574877 - DNA, 20 bp, Artificial
  CRISPR gRNA sequence
ccagaagttgattgggcata

SEQ ID NO: 574878 - DNA, 20 bp, Artificial
  CRISPR gRNA sequence
cagaagttgattgggcatat

SEQ ID NO: 574879 - DNA, 20 bp, Artificial
  CRISPR gRNA sequence
aagttgattgggcatatggg

SEQ ID NO: 574880 - DNA, 20 bp, Artificial
  CRISPR gRNA sequence
tatgggtagcttctgactaa

SEQ ID NO: 574881 - DNA, 20 bp, Artificial
  CRISPR gRNA sequence
gactaatggaatcacaatca

SEQ ID NO: 574882 - DNA, 20 bp, Artificial
  CRISPR gRNA sequence
acctgacactccacacccca

SEQ ID NO: 574883 - DNA, 20 bp, Artificial
  CRISPR gRNA sequence
cctgacactccacaccccac

SEQ ID NO: 574884 - DNA, 20 bp, Artificial
  CRISPR gRNA sequence
ctgacactccacaccccaca

SEQ ID NO: 574885 - DNA, 20 bp, Artificial
  CRISPR gRNA sequence
tgacactccacaccccacag

SEQ ID NO: 574886 - DNA, 20 bp, Artificial
  CRISPR gRNA sequence
cttctactgttccctctccc

SEQ ID NO: 574887 - DNA, 20 bp, Artificial
  CRISPR gRNA sequence
tctactgttccctctcccaa

SEQ ID NO: 574888 - DNA, 20 bp, Artificial
  CRISPR gRNA sequence
ttccttctgctgcttccatc

SEQ ID NO: 574889 - DNA, 20 bp, Artificial
  CRISPR gRNA sequence
aactcctttcgctctccctt

SEQ ID NO: 574890 - DNA, 20 bp, Artificial
  CRISPR gRNA sequence
actcctttcgctctcccttt

SEQ ID NO: 574891 - DNA, 20 bp, Artificial
  CRISPR gRNA sequence
ctcctttcgctctccctttg

SEQ ID NO: 574892 - DNA, 20 bp, Artificial
  CRISPR gRNA sequence
ctttggggtctcaccttctg

SEQ ID NO: 574893 - DNA, 20 bp, Artificial
  CRISPR gRNA sequence
tttggggtctcaccttctgt

SEQ ID NO: 574894 - DNA, 20 bp, Artificial
  CRISPR gRNA sequence
cttctgtgggaactcaactg

SEQ ID NO: 574895 - DNA, 20 bp, Artificial
  CRISPR gRNA sequence
catacattccttctccatcc

SEQ ID NO: 574896 - DNA, 20 bp, Artificial
  CRISPR gRNA sequence
atacattccttctccatcct

SEQ ID NO: 574897 - DNA, 20 bp, Artificial
  CRISPR gRNA sequence
cattccttctccatcctggg

SEQ ID NO: 574898 - DNA, 20 bp, Artificial
  CRISPR gRNA sequence
agatttactgaacacctact

SEQ ID NO: 574899 - DNA, 20 bp, Artificial
  CRISPR gRNA sequence
actgaacacctactgagtgc

SEQ ID NO: 574900 - DNA, 20 bp, Artificial
  CRISPR gRNA sequence
ctgaacacctactgagtgcc

SEQ ID NO: 574901 - DNA, 20 bp, Artificial
  CRISPR gRNA sequence
cctactgagtgccaggttct

SEQ ID NO: 574902 - DNA, 20 bp, Artificial
  CRISPR gRNA sequence
tgagcatgctgttatctcat

SEQ ID NO: 574903 - DNA, 20 bp, Artificial
  CRISPR gRNA sequence
gttatctcattagaacctca

SEQ ID NO: 574904 - DNA, 20 bp, Artificial
  CRISPR gRNA sequence
attagaacctcacagcatcc

SEQ ID NO: 574905 - DNA, 20 bp, Artificial
  CRISPR gRNA sequence
ttagaacctcacagcatcct

SEQ ID NO: 574906 - DNA, 20 bp, Artificial
  CRISPR gRNA sequence
agaacctcacagcatcctag

SEQ ID NO: 574907 - DNA, 20 bp, Artificial
  CRISPR gRNA sequence
gaacctcacagcatcctagg

SEQ ID NO: 574908 - DNA, 20 bp, Artificial
  CRISPR gRNA sequence
aacctcacagcatcctagga

SEQ ID NO: 574909 - DNA, 20 bp, Artificial
  CRISPR gRNA sequence
cctcacagcatcctaggagg

SEQ ID NO: 574910 - DNA, 20 bp, Artificial
  CRISPR gRNA sequence
ctcacagcatcctaggaggg

SEQ ID NO: 574911 - DNA, 20 bp, Artificial
  CRISPR gRNA sequence
taggagggaggtgatccttc

SEQ ID NO: 574912 - DNA, 20 bp, Artificial
  CRISPR gRNA sequence
gagggaggtgatccttccag

SEQ ID NO: 574913 - DNA, 20 bp, Artificial
  CRISPR gRNA sequence
cttccagcagcccctctccc

SEQ ID NO: 574914 - DNA, 20 bp, Artificial
  CRISPR gRNA sequence
ttccagcagcccctctcccc

SEQ ID NO: 574915 - DNA, 20 bp, Artificial
  CRISPR gRNA sequence
tctccccaggtctccatgtt

SEQ ID NO: 574916 - DNA, 20 bp, Artificial
  CRISPR gRNA sequence
ctccccaggtctccatgttc

SEQ ID NO: 574917 - DNA, 20 bp, Artificial
  CRISPR gRNA sequence
tccatgttcaggatgtccat

SEQ ID NO: 574918 - DNA, 20 bp, Artificial
  CRISPR gRNA sequence
tgttcaggatgtccatgagt

SEQ ID NO: 574919 - DNA, 20 bp, Artificial
  CRISPR gRNA sequence
gagttagaaatgaatatgtt

SEQ ID NO: 574920 - DNA, 20 bp, Artificial
  CRISPR gRNA sequence
aaatgaatatgttcagctgc

SEQ ID NO: 574921 - DNA, 20 bp, Artificial
  CRISPR gRNA sequence
atatgttcagctgcaagtaa

SEQ ID NO: 574922 - DNA, 20 bp, Artificial
  CRISPR gRNA sequence
acagaaaaatcataaaataa

SEQ ID NO: 574923 - DNA, 20 bp, Artificial
  CRISPR gRNA sequence
cagaaaaatcataaaataat

SEQ ID NO: 574924 - DNA, 20 bp, Artificial
  CRISPR gRNA sequence
agaaaaatcataaaataatg

SEQ ID NO: 574925 - DNA, 20 bp, Artificial
  CRISPR gRNA sequence
gaaaaatcataaaataatgg

SEQ ID NO: 574926 - DNA, 20 bp, Artificial
  CRISPR gRNA sequence
tcataaaataatgggggctt

SEQ ID NO: 574927 - DNA, 20 bp, Artificial
  CRISPR gRNA sequence
aaaataatgggggcttaagc

SEQ ID NO: 574928 - DNA, 20 bp, Artificial
  CRISPR gRNA sequence
taatgggggcttaagcaaga

SEQ ID NO: 574929 - DNA, 20 bp, Artificial
  CRISPR gRNA sequence
tttatttttttctcacctaa

SEQ ID NO: 574930 - DNA, 20 bp, Artificial
  CRISPR gRNA sequence
tttttctcacctaaaagttc

SEQ ID NO: 574931 - DNA, 20 bp, Artificial
  CRISPR gRNA sequence
tctcacctaaaagttcaagc

SEQ ID NO: 574932 - DNA, 20 bp, Artificial
  CRISPR gRNA sequence
taaaagttcaagctggcaaa

SEQ ID NO: 574933 - DNA, 20 bp, Artificial
  CRISPR gRNA sequence
gttcaagctggcaaatagtc

SEQ ID NO: 574934 - DNA, 20 bp, Artificial
  CRISPR gRNA sequence
ttcaagctggcaaatagtcc

SEQ ID NO: 574935 - DNA, 20 bp, Artificial
  CRISPR gRNA sequence
tcaagctggcaaatagtcca

SEQ ID NO: 574936 - DNA, 20 bp, Artificial
  CRISPR gRNA sequence
gggactccttcctgcccacc

SEQ ID NO: 574937 - DNA, 20 bp, Artificial
  CRISPR gRNA sequence
tccttcctgcccacctggtt

SEQ ID NO: 574938 - DNA, 20 bp, Artificial
  CRISPR gRNA sequence
ccttcctgcccacctggttt

SEQ ID NO: 574939 - DNA, 20 bp, Artificial
  CRISPR gRNA sequence
gggcattgtctgtcccgatc

SEQ ID NO: 574940 - DNA, 20 bp, Artificial
  CRISPR gRNA sequence
gtctgtcccgatctggctcc

SEQ ID NO: 574941 - DNA, 20 bp, Artificial
  CRISPR gRNA sequence
cgatctggctccaagactct

SEQ ID NO: 574942 - DNA, 20 bp, Artificial
  CRISPR gRNA sequence
cagtcttcaacaaatccttt

SEQ ID NO: 574943 - DNA, 20 bp, Artificial
  CRISPR gRNA sequence
cttctcaccacctccactgc

SEQ ID NO: 574944 - DNA, 20 bp, Artificial
  CRISPR gRNA sequence
tccactgccagcactatcac

SEQ ID NO: 574945 - DNA, 20 bp, Artificial
  CRISPR gRNA sequence
cagcactatcaccagtcacc

SEQ ID NO: 574946 - DNA, 20 bp, Artificial
  CRISPR gRNA sequence
accagtcacctagactactg

SEQ ID NO: 574947 - DNA, 20 bp, Artificial
  CRISPR gRNA sequence
agtcacctagactactgcag

SEQ ID NO: 574948 - DNA, 20 bp, Artificial
  CRISPR gRNA sequence
acctagactactgcagtagc

SEQ ID NO: 574949 - DNA, 20 bp, Artificial
  CRISPR gRNA sequence
tgcagtagccagctccttgc

SEQ ID NO: 574950 - DNA, 20 bp, Artificial
  CRISPR gRNA sequence
tggtcccctgcttccacatt

SEQ ID NO: 574951 - DNA, 20 bp, Artificial
  CRISPR gRNA sequence
ggtcccctgcttccacattc

SEQ ID NO: 574952 - DNA, 20 bp, Artificial
  CRISPR gRNA sequence
ctgcttccacattcaggccc

SEQ ID NO: 574953 - DNA, 20 bp, Artificial
  CRISPR gRNA sequence
cctagaccccattgtacact

SEQ ID NO: 574954 - DNA, 20 bp, Artificial
  CRISPR gRNA sequence
cccattgtacactcagcatt

SEQ ID NO: 574955 - DNA, 20 bp, Artificial
  CRISPR gRNA sequence
ccattgtacactcagcattc

SEQ ID NO: 574956 - DNA, 20 bp, Artificial
  CRISPR gRNA sequence
cattgtacactcagcattca

SEQ ID NO: 574957 - DNA, 20 bp, Artificial
  CRISPR gRNA sequence
attgtacactcagcattcag

SEQ ID NO: 574958 - DNA, 20 bp, Artificial
  CRISPR gRNA sequence
cttcctgttaaatcctaaca

SEQ ID NO: 574959 - DNA, 20 bp, Artificial
  CRISPR gRNA sequence
gtcatgccttcctcctcact

SEQ ID NO: 574960 - DNA, 20 bp, Artificial
  CRISPR gRNA sequence
ttcctcctcactcagcgttg

SEQ ID NO: 574961 - DNA, 20 bp, Artificial
  CRISPR gRNA sequence
ctcactcagcgttgaagcca

SEQ ID NO: 574962 - DNA, 20 bp, Artificial
  CRISPR gRNA sequence
tgaagccaaagtccttacca

SEQ ID NO: 574963 - DNA, 20 bp, Artificial
  CRISPR gRNA sequence
aagtccttaccatggcctac

SEQ ID NO: 574964 - DNA, 20 bp, Artificial
  CRISPR gRNA sequence
agtccttaccatggcctaca

SEQ ID NO: 574965 - DNA, 20 bp, Artificial
  CRISPR gRNA sequence
atggcctacaaggtcctgcg

SEQ ID NO: 574966 - DNA, 20 bp, Artificial
  CRISPR gRNA sequence
tcctgcgtggtctaacctcc

SEQ ID NO: 574967 - DNA, 20 bp, Artificial
  CRISPR gRNA sequence
cccctttctgacctcacctc

SEQ ID NO: 574968 - DNA, 20 bp, Artificial
  CRISPR gRNA sequence
tctctccacactaaccacac

SEQ ID NO: 574969 - DNA, 20 bp, Artificial
  CRISPR gRNA sequence
taaccacaccagcccccttg

SEQ ID NO: 574970 - DNA, 20 bp, Artificial
  CRISPR gRNA sequence
cttgtagaccttgaacaaat

SEQ ID NO: 574971 - DNA, 20 bp, Artificial
  CRISPR gRNA sequence
ttgtagaccttgaacaaatc

SEQ ID NO: 574972 - DNA, 20 bp, Artificial
  CRISPR gRNA sequence
aatcaggtacattcccacct

SEQ ID NO: 574973 - DNA, 20 bp, Artificial
  CRISPR gRNA sequence
atcaggtacattcccacctc

SEQ ID NO: 574974 - DNA, 20 bp, Artificial
  CRISPR gRNA sequence
ccacctcaggacctttgccc

SEQ ID NO: 574975 - DNA, 20 bp, Artificial
  CRISPR gRNA sequence
tttgccctggctgtttcctt

SEQ ID NO: 574976 - DNA, 20 bp, Artificial
  CRISPR gRNA sequence
tgccctggctgtttcctttg

SEQ ID NO: 574977 - DNA, 20 bp, Artificial
  CRISPR gRNA sequence
ctgtttcctttggagttcct

SEQ ID NO: 574978 - DNA, 20 bp, Artificial
  CRISPR gRNA sequence
tttggagttcctcagatatc

SEQ ID NO: 574979 - DNA, 20 bp, Artificial
  CRISPR gRNA sequence
gagttcctcagatatctagc

SEQ ID NO: 574980 - DNA, 20 bp, Artificial
  CRISPR gRNA sequence
ctccctccctcatctccttc

SEQ ID NO: 574981 - DNA, 20 bp, Artificial
  CRISPR gRNA sequence
catctccttcaagtctttgt

SEQ ID NO: 574982 - DNA, 20 bp, Artificial
  CRISPR gRNA sequence
tctccttcaagtctttgtca

SEQ ID NO: 574983 - DNA, 20 bp, Artificial
  CRISPR gRNA sequence
ctccttcaagtctttgtcag

SEQ ID NO: 574984 - DNA, 20 bp, Artificial
  CRISPR gRNA sequence
ttgtcagaggcccctgtctc

SEQ ID NO: 574985 - DNA, 20 bp, Artificial
  CRISPR gRNA sequence
tgtcagaggcccctgtctct

SEQ ID NO: 574986 - DNA, 20 bp, Artificial
  CRISPR gRNA sequence
gtcagaggcccctgtctctg

SEQ ID NO: 574987 - DNA, 20 bp, Artificial
  CRISPR gRNA sequence
gcctactcacccccaactcc

SEQ ID NO: 574988 - DNA, 20 bp, Artificial
  CRISPR gRNA sequence
cccccaactcccagccctcc

SEQ ID NO: 574989 - DNA, 20 bp, Artificial
  CRISPR gRNA sequence
gccctcccagtctccttccc

SEQ ID NO: 574990 - DNA, 20 bp, Artificial
  CRISPR gRNA sequence
ctcccagtctccttcccgag

SEQ ID NO: 574991 - DNA, 20 bp, Artificial
  CRISPR gRNA sequence
cttcccgagaagccctccat

SEQ ID NO: 574992 - DNA, 20 bp, Artificial
  CRISPR gRNA sequence
tcccgagaagccctccatga

SEQ ID NO: 574993 - DNA, 20 bp, Artificial
  CRISPR gRNA sequence
ccgagaagccctccatgaga

SEQ ID NO: 574994 - DNA, 20 bp, Artificial
  CRISPR gRNA sequence
cgagaagccctccatgagag

SEQ ID NO: 574995 - DNA, 20 bp, Artificial
  CRISPR gRNA sequence
gccctccatgagagaggata

SEQ ID NO: 574996 - DNA, 20 bp, Artificial
  CRISPR gRNA sequence
ccatgagagaggatatagtc

SEQ ID NO: 574997 - DNA, 20 bp, Artificial
  CRISPR gRNA sequence
agagaggatatagtccagta

SEQ ID NO: 574998 - DNA, 20 bp, Artificial
  CRISPR gRNA sequence
agaggatatagtccagtata

SEQ ID NO: 574999 - DNA, 20 bp, Artificial
  CRISPR gRNA sequence
gaggatatagtccagtatag

SEQ ID NO: 575000 - DNA, 20 bp, Artificial
  CRISPR gRNA sequence
aggatatagtccagtataga

SEQ ID NO: 575001 - DNA, 20 bp, Artificial
  CRISPR gRNA sequence
ggatatagtccagtatagag

SEQ ID NO: 575002 - DNA, 20 bp, Artificial
  CRISPR gRNA sequence
atatagtccagtatagaggg

SEQ ID NO: 575003 - DNA, 20 bp, Artificial
  CRISPR gRNA sequence
tatagtccagtatagagggg

SEQ ID NO: 575004 - DNA, 20 bp, Artificial
  CRISPR gRNA sequence
agtccagtatagaggggagg

SEQ ID NO: 575005 - DNA, 20 bp, Artificial
  CRISPR gRNA sequence
cctctctgccctcctgaccc

SEQ ID NO: 575006 - DNA, 20 bp, Artificial
  CRISPR gRNA sequence
gaccccagcccccattctgc

SEQ ID NO: 575007 - DNA, 20 bp, Artificial
  CRISPR gRNA sequence
accccagcccccattctgca

SEQ ID NO: 575008 - DNA, 20 bp, Artificial
  CRISPR gRNA sequence
cccccattctgcaaggatct

SEQ ID NO: 575009 - DNA, 20 bp, Artificial
  CRISPR gRNA sequence
tctgcaaggatcttggcttt

SEQ ID NO: 575010 - DNA, 20 bp, Artificial
  CRISPR gRNA sequence
gcaaggatcttggctttcag

SEQ ID NO: 575011 - DNA, 20 bp, Artificial
  CRISPR gRNA sequence
atcttggctttcagcagccg

SEQ ID NO: 575012 - DNA, 20 bp, Artificial
  CRISPR gRNA sequence
agcatttccctctcacaccc

SEQ ID NO: 575013 - DNA, 20 bp, Artificial
  CRISPR gRNA sequence
gcatttccctctcacaccct

SEQ ID NO: 575014 - DNA, 20 bp, Artificial
  CRISPR gRNA sequence
ctcacaccctgggcctgccc

SEQ ID NO: 575015 - DNA, 20 bp, Artificial
  CRISPR gRNA sequence
tcacaccctgggcctgccca

SEQ ID NO: 575016 - DNA, 20 bp, Artificial
  CRISPR gRNA sequence
cacaccctgggcctgcccaa

SEQ ID NO: 575017 - DNA, 20 bp, Artificial
  CRISPR gRNA sequence
acaccctgggcctgcccaag

SEQ ID NO: 575018 - DNA, 20 bp, Artificial
  CRISPR gRNA sequence
cctgggcctgcccaaggggc

SEQ ID NO: 575019 - DNA, 20 bp, Artificial
  CRISPR gRNA sequence
aaggggccagctcacattct

SEQ ID NO: 575020 - DNA, 20 bp, Artificial
  CRISPR gRNA sequence
tcgtttgcctcctatatctc

SEQ ID NO: 575021 - DNA, 20 bp, Artificial
  CRISPR gRNA sequence
tctctggccactctctttca

SEQ ID NO: 575022 - DNA, 20 bp, Artificial
  CRISPR gRNA sequence
tctggccactctctttcatg

SEQ ID NO: 575023 - DNA, 20 bp, Artificial
  CRISPR gRNA sequence
gccactctctttcatggagt

SEQ ID NO: 575024 - DNA, 20 bp, Artificial
  CRISPR gRNA sequence
ctctttcatggagtgagtga

SEQ ID NO: 575025 - DNA, 20 bp, Artificial
  CRISPR gRNA sequence
ttcatggagtgagtgacagt

SEQ ID NO: 575026 - DNA, 20 bp, Artificial
  CRISPR gRNA sequence
tcatggagtgagtgacagta

SEQ ID NO: 575027 - DNA, 20 bp, Artificial
  CRISPR gRNA sequence
catggagtgagtgacagtaa

SEQ ID NO: 575028 - DNA, 20 bp, Artificial
  CRISPR gRNA sequence
gagtgagtgacagtaaggga

SEQ ID NO: 575029 - DNA, 20 bp, Artificial
  CRISPR gRNA sequence
gagtgacagtaagggacaga

SEQ ID NO: 575030 - DNA, 20 bp, Artificial
  CRISPR gRNA sequence
acagtaagggacagatggtc

SEQ ID NO: 575031 - DNA, 20 bp, Artificial
  CRISPR gRNA sequence
cagtaagggacagatggtct

SEQ ID NO: 575032 - DNA, 20 bp, Artificial
  CRISPR gRNA sequence
agtaagggacagatggtctg

SEQ ID NO: 575033 - DNA, 20 bp, Artificial
  CRISPR gRNA sequence
aagggacagatggtctgggg

SEQ ID NO: 575034 - DNA, 20 bp, Artificial
  CRISPR gRNA sequence
agggacagatggtctgggga

SEQ ID NO: 575035 - DNA, 20 bp, Artificial
  CRISPR gRNA sequence
agatggtctggggaaggtat

SEQ ID NO: 575036 - DNA, 20 bp, Artificial
  CRISPR gRNA sequence
gatggtctggggaaggtata

SEQ ID NO: 575037 - DNA, 20 bp, Artificial
  CRISPR gRNA sequence
tggtctggggaaggtataag

SEQ ID NO: 575038 - DNA, 20 bp, Artificial
  CRISPR gRNA sequence
gggaaggtataaggagaatg

SEQ ID NO: 575039 - DNA, 20 bp, Artificial
  CRISPR gRNA sequence
cagcccacacctctgatcct

SEQ ID NO: 575040 - DNA, 20 bp, Artificial
  CRISPR gRNA sequence
gcccacacctctgatcctga

SEQ ID NO: 575041 - DNA, 20 bp, Artificial
  CRISPR gRNA sequence
ccacacctctgatcctgaga

SEQ ID NO: 575042 - DNA, 20 bp, Artificial
  CRISPR gRNA sequence
ctgatcctgagagagaaaac

SEQ ID NO: 575043 - DNA, 20 bp, Artificial
  CRISPR gRNA sequence
agaaaactagcccccttttc

SEQ ID NO: 575044 - DNA, 20 bp, Artificial
  CRISPR gRNA sequence
gaaaactagcccccttttcc

SEQ ID NO: 575045 - DNA, 20 bp, Artificial
  CRISPR gRNA sequence
aaactagcccccttttccag

SEQ ID NO: 575046 - DNA, 20 bp, Artificial
  CRISPR gRNA sequence
aactagcccccttttccagg

SEQ ID NO: 575047 - DNA, 20 bp, Artificial
  CRISPR gRNA sequence
actagcccccttttccagga

SEQ ID NO: 575048 - DNA, 20 bp, Artificial
  CRISPR gRNA sequence
ctagcccccttttccaggag

SEQ ID NO: 575049 - DNA, 20 bp, Artificial
  CRISPR gRNA sequence
tagcccccttttccaggagg

SEQ ID NO: 575050 - DNA, 20 bp, Artificial
  CRISPR gRNA sequence
ccccttttccaggaggggga

SEQ ID NO: 575051 - DNA, 20 bp, Artificial
  CRISPR gRNA sequence
cccttttccaggagggggac

SEQ ID NO: 575052 - DNA, 20 bp, Artificial
  CRISPR gRNA sequence
tccaggagggggacaggtgc

SEQ ID NO: 575053 - DNA, 20 bp, Artificial
  CRISPR gRNA sequence
ccaggagggggacaggtgct

SEQ ID NO: 575054 - DNA, 20 bp, Artificial
  CRISPR gRNA sequence
caggagggggacaggtgctg

SEQ ID NO: 575055 - DNA, 20 bp, Artificial
  CRISPR gRNA sequence
gagggggacaggtgctgggg

SEQ ID NO: 575056 - DNA, 20 bp, Artificial
  CRISPR gRNA sequence
agggggacaggtgctggggc

SEQ ID NO: 575057 - DNA, 20 bp, Artificial
  CRISPR gRNA sequence
gggggacaggtgctggggca

SEQ ID NO: 575058 - DNA, 20 bp, Artificial
  CRISPR gRNA sequence
gggaacaatgcctctgctga

SEQ ID NO: 575059 - DNA, 20 bp, Artificial
  CRISPR gRNA sequence
aatgcctctgctgatagaac

SEQ ID NO: 575060 - DNA, 20 bp, Artificial
  CRISPR gRNA sequence
ctctgctgatagaactggcc

SEQ ID NO: 575061 - DNA, 20 bp, Artificial
  CRISPR gRNA sequence
tggcctggtttataattacg

SEQ ID NO: 575062 - DNA, 20 bp, Artificial
  CRISPR gRNA sequence
ggcctggtttataattacgc

SEQ ID NO: 575063 - DNA, 20 bp, Artificial
  CRISPR gRNA sequence
cctggtttataattacgcag

SEQ ID NO: 575064 - DNA, 20 bp, Artificial
  CRISPR gRNA sequence
ctggtttataattacgcagg

SEQ ID NO: 575065 - DNA, 20 bp, Artificial
  CRISPR gRNA sequence
ttataattacgcaggaggtg

SEQ ID NO: 575066 - DNA, 20 bp, Artificial
  CRISPR gRNA sequence
tataattacgcaggaggtgt

SEQ ID NO: 575067 - DNA, 20 bp, Artificial
  CRISPR gRNA sequence
ataattacgcaggaggtgta

SEQ ID NO: 575068 - DNA, 20 bp, Artificial
  CRISPR gRNA sequence
tgtagggaacattccgaccc

SEQ ID NO: 575069 - DNA, 20 bp, Artificial
  CRISPR gRNA sequence
aacattccgacccaagtctg

SEQ ID NO: 575070 - DNA, 20 bp, Artificial
  CRISPR gRNA sequence
acattccgacccaagtctgc

SEQ ID NO: 575071 - DNA, 20 bp, Artificial
  CRISPR gRNA sequence
cattccgacccaagtctgca

SEQ ID NO: 575072 - DNA, 20 bp, Artificial
  CRISPR gRNA sequence
ttccgacccaagtctgcagg

SEQ ID NO: 575073 - DNA, 20 bp, Artificial
  CRISPR gRNA sequence
gacccaagtctgcagggagc

SEQ ID NO: 575074 - DNA, 20 bp, Artificial
  CRISPR gRNA sequence
acccaagtctgcagggagca

SEQ ID NO: 575075 - DNA, 20 bp, Artificial
  CRISPR gRNA sequence
cccaagtctgcagggagcaa

SEQ ID NO: 575076 - DNA, 20 bp, Artificial
  CRISPR gRNA sequence
ccaagtctgcagggagcaag

SEQ ID NO: 575077 - DNA, 20 bp, Artificial
  CRISPR gRNA sequence
gagcaaggggttattaacta

SEQ ID NO: 575078 - DNA, 20 bp, Artificial
  CRISPR gRNA sequence
agcaaggggttattaactat

SEQ ID NO: 575079 - DNA, 20 bp, Artificial
  CRISPR gRNA sequence
gttattaactatgggaacat

SEQ ID NO: 575080 - DNA, 20 bp, Artificial
  CRISPR gRNA sequence
aactatgggaacatcagtgc

SEQ ID NO: 575081 - DNA, 20 bp, Artificial
  CRISPR gRNA sequence
actatgggaacatcagtgca

SEQ ID NO: 575082 - DNA, 20 bp, Artificial
  CRISPR gRNA sequence
ctatgggaacatcagtgcaa

SEQ ID NO: 575083 - DNA, 20 bp, Artificial
  CRISPR gRNA sequence
gtgcaagggatcattaacct

SEQ ID NO: 575084 - DNA, 20 bp, Artificial
  CRISPR gRNA sequence
tgcaagggatcattaacctt

SEQ ID NO: 575085 - DNA, 20 bp, Artificial
  CRISPR gRNA sequence
aaccttaggaccatcactgc

SEQ ID NO: 575086 - DNA, 20 bp, Artificial
  CRISPR gRNA sequence
accttaggaccatcactgca

SEQ ID NO: 575087 - DNA, 20 bp, Artificial
  CRISPR gRNA sequence
ccttaggaccatcactgcaa

SEQ ID NO: 575088 - DNA, 20 bp, Artificial
  CRISPR gRNA sequence
cttaggaccatcactgcaag

SEQ ID NO: 575089 - DNA, 20 bp, Artificial
  CRISPR gRNA sequence
ctgcaaggggtcattaacct

SEQ ID NO: 575090 - DNA, 20 bp, Artificial
  CRISPR gRNA sequence
tgcaaggggtcattaacctt

SEQ ID NO: 575091 - DNA, 20 bp, Artificial
  CRISPR gRNA sequence
gcaaggggtcattaaccttg

SEQ ID NO: 575092 - DNA, 20 bp, Artificial
  CRISPR gRNA sequence
attaaccttggggccatcac

SEQ ID NO: 575093 - DNA, 20 bp, Artificial
  CRISPR gRNA sequence
cttggggccatcactagaat

SEQ ID NO: 575094 - DNA, 20 bp, Artificial
  CRISPR gRNA sequence
catcactagaatcagctccc

SEQ ID NO: 575095 - DNA, 20 bp, Artificial
  CRISPR gRNA sequence
atcactagaatcagctcccc

SEQ ID NO: 575096 - DNA, 20 bp, Artificial
  CRISPR gRNA sequence
tgttaaacacctgctgttca

SEQ ID NO: 575097 - DNA, 20 bp, Artificial
  CRISPR gRNA sequence
gttaaacacctgctgttcac

SEQ ID NO: 575098 - DNA, 20 bp, Artificial
  CRISPR gRNA sequence
ttaaacacctgctgttcaca

SEQ ID NO: 575099 - DNA, 20 bp, Artificial
  CRISPR gRNA sequence
tgctgttcacagggtccctg

SEQ ID NO: 575100 - DNA, 20 bp, Artificial
  CRISPR gRNA sequence
gctgttcacagggtccctgc

SEQ ID NO: 575101 - DNA, 20 bp, Artificial
  CRISPR gRNA sequence
cagggtccctgcaggcctcc

SEQ ID NO: 575102 - DNA, 20 bp, Artificial
  CRISPR gRNA sequence
ggtccctgcaggcctccaag

SEQ ID NO: 575103 - DNA, 20 bp, Artificial
  CRISPR gRNA sequence
gtccctgcaggcctccaagc

SEQ ID NO: 575104 - DNA, 20 bp, Artificial
  CRISPR gRNA sequence
tccctgcaggcctccaagca

SEQ ID NO: 575105 - DNA, 20 bp, Artificial
  CRISPR gRNA sequence
ccctgcaggcctccaagcag

SEQ ID NO: 575106 - DNA, 20 bp, Artificial
  CRISPR gRNA sequence
caggggacctcatcccacct

SEQ ID NO: 575107 - DNA, 20 bp, Artificial
  CRISPR gRNA sequence
tcccaccttggtgcctcccc

SEQ ID NO: 575108 - DNA, 20 bp, Artificial
  CRISPR gRNA sequence
cctggctgtccaacacaccc

SEQ ID NO: 575109 - DNA, 20 bp, Artificial
  CRISPR gRNA sequence
caacacacccaagccatttt

SEQ ID NO: 575110 - DNA, 20 bp, Artificial
  CRISPR gRNA sequence
aacacacccaagccattttt

SEQ ID NO: 575111 - DNA, 20 bp, Artificial
  CRISPR gRNA sequence
cccaagccatttttgggtct

SEQ ID NO: 575112 - DNA, 20 bp, Artificial
  CRISPR gRNA sequence
tcagatgtgtcccaccaact

SEQ ID NO: 575113 - DNA, 20 bp, Artificial
  CRISPR gRNA sequence
gatgtgtcccaccaactcag

SEQ ID NO: 575114 - DNA, 20 bp, Artificial
  CRISPR gRNA sequence
accaactcagaagcctcaac

SEQ ID NO: 575115 - DNA, 20 bp, Artificial
  CRISPR gRNA sequence
tcagaagcctcaaccagcga

SEQ ID NO: 575116 - DNA, 20 bp, Artificial
  CRISPR gRNA sequence
aaagttttgttttgaactaa

SEQ ID NO: 575117 - DNA, 20 bp, Artificial
  CRISPR gRNA sequence
gttttgttttgaactaatgg

SEQ ID NO: 575118 - DNA, 20 bp, Artificial
  CRISPR gRNA sequence
ttttgttttgaactaatggt

SEQ ID NO: 575119 - DNA, 20 bp, Artificial
  CRISPR gRNA sequence
tttgttttgaactaatggtg

SEQ ID NO: 575120 - DNA, 20 bp, Artificial
  CRISPR gRNA sequence
tgttttgaactaatggtggg

SEQ ID NO: 575121 - DNA, 20 bp, Artificial
  CRISPR gRNA sequence
gttttgaactaatggtgggg

SEQ ID NO: 575122 - DNA, 20 bp, Artificial
  CRISPR gRNA sequence
ttttgaactaatggtgggga

SEQ ID NO: 575123 - DNA, 20 bp, Artificial
  CRISPR gRNA sequence
gaactaatggtggggagggt

SEQ ID NO: 575124 - DNA, 20 bp, Artificial
  CRISPR gRNA sequence
aactaatggtggggagggtt

SEQ ID NO: 575125 - DNA, 20 bp, Artificial
  CRISPR gRNA sequence
tttttttttttaattgttgt

SEQ ID NO: 575126 - DNA, 20 bp, Artificial
  CRISPR gRNA sequence
tgttgttggctgattttttt

SEQ ID NO: 575127 - DNA, 20 bp, Artificial
  CRISPR gRNA sequence
gttgttggctgattttttta

SEQ ID NO: 575128 - DNA, 20 bp, Artificial
  CRISPR gRNA sequence
ttttttttcttgtcttcaca

SEQ ID NO: 575129 - DNA, 20 bp, Artificial
  CRISPR gRNA sequence
ttttcttgtcttcacaaagc

SEQ ID NO: 575130 - DNA, 20 bp, Artificial
  CRISPR gRNA sequence
tttcttgtcttcacaaagcc

SEQ ID NO: 575131 - DNA, 20 bp, Artificial
  CRISPR gRNA sequence
tcttcacaaagccaggccat

SEQ ID NO: 575132 - DNA, 20 bp, Artificial
  CRISPR gRNA sequence
cttcacaaagccaggccatc

SEQ ID NO: 575133 - DNA, 20 bp, Artificial
  CRISPR gRNA sequence
ccaggccatcaggcccattc

SEQ ID NO: 575134 - DNA, 20 bp, Artificial
  CRISPR gRNA sequence
caggccatcaggcccattct

SEQ ID NO: 575135 - DNA, 20 bp, Artificial
  CRISPR gRNA sequence
aggcccattctgggcttttc

SEQ ID NO: 575136 - DNA, 20 bp, Artificial
  CRISPR gRNA sequence
cccattctgggcttttccag

SEQ ID NO: 575137 - DNA, 20 bp, Artificial
  CRISPR gRNA sequence
ccattctgggcttttccaga

SEQ ID NO: 575138 - DNA, 20 bp, Artificial
  CRISPR gRNA sequence
cattctgggcttttccagaa

SEQ ID NO: 575139 - DNA, 20 bp, Artificial
  CRISPR gRNA sequence
ctgggcttttccagaagggt

SEQ ID NO: 575140 - DNA, 20 bp, Artificial
  CRISPR gRNA sequence
ttttccagaagggtgagtct

SEQ ID NO: 575141 - DNA, 20 bp, Artificial
  CRISPR gRNA sequence
cagaagggtgagtctgagtt

SEQ ID NO: 575142 - DNA, 20 bp, Artificial
  CRISPR gRNA sequence
agaagggtgagtctgagttg

SEQ ID NO: 575143 - DNA, 20 bp, Artificial
  CRISPR gRNA sequence
gggtgagtctgagttgagga

SEQ ID NO: 575144 - DNA, 20 bp, Artificial
  CRISPR gRNA sequence
gtgagtctgagttgaggaaa

SEQ ID NO: 575145 - DNA, 20 bp, Artificial
  CRISPR gRNA sequence
tgagtctgagttgaggaaag

SEQ ID NO: 575146 - DNA, 20 bp, Artificial
  CRISPR gRNA sequence
aaagaggccctcctttttac

SEQ ID NO: 575147 - DNA, 20 bp, Artificial
  CRISPR gRNA sequence
aagaggccctcctttttacg

SEQ ID NO: 575148 - DNA, 20 bp, Artificial
  CRISPR gRNA sequence
agaggccctcctttttacga

SEQ ID NO: 575149 - DNA, 20 bp, Artificial
  CRISPR gRNA sequence
ccctcctttttacgagggct

SEQ ID NO: 575150 - DNA, 20 bp, Artificial
  CRISPR gRNA sequence
tcctttttacgagggcttag

SEQ ID NO: 575151 - DNA, 20 bp, Artificial
  CRISPR gRNA sequence
cctttttacgagggcttaga

SEQ ID NO: 575152 - DNA, 20 bp, Artificial
  CRISPR gRNA sequence
tttacgagggcttagaaggt

SEQ ID NO: 575153 - DNA, 20 bp, Artificial
  CRISPR gRNA sequence
ttacgagggcttagaaggtt

SEQ ID NO: 575154 - DNA, 20 bp, Artificial
  CRISPR gRNA sequence
tacgagggcttagaaggttg

SEQ ID NO: 575155 - DNA, 20 bp, Artificial
  CRISPR gRNA sequence
acgagggcttagaaggttgg

SEQ ID NO: 575156 - DNA, 20 bp, Artificial
  CRISPR gRNA sequence
gagggcttagaaggttgggg

SEQ ID NO: 575157 - DNA, 20 bp, Artificial
  CRISPR gRNA sequence
agggcttagaaggttggggg

SEQ ID NO: 575158 - DNA, 20 bp, Artificial
  CRISPR gRNA sequence
cttagaaggttgggggagga

SEQ ID NO: 575159 - DNA, 20 bp, Artificial
  CRISPR gRNA sequence
ttagaaggttgggggaggaa

SEQ ID NO: 575160 - DNA, 20 bp, Artificial
  CRISPR gRNA sequence
tagaaggttgggggaggaaa

SEQ ID NO: 575161 - DNA, 20 bp, Artificial
  CRISPR gRNA sequence
agaaggttgggggaggaaag

SEQ ID NO: 575162 - DNA, 20 bp, Artificial
  CRISPR gRNA sequence
gaaggttgggggaggaaagg

SEQ ID NO: 575163 - DNA, 20 bp, Artificial
  CRISPR gRNA sequence
ttgggggaggaaagggggca

SEQ ID NO: 575164 - DNA, 20 bp, Artificial
  CRISPR gRNA sequence
tgggggaggaaagggggcaa

SEQ ID NO: 575165 - DNA, 20 bp, Artificial
  CRISPR gRNA sequence
gggggaggaaagggggcaaa

SEQ ID NO: 575166 - DNA, 20 bp, Artificial
  CRISPR gRNA sequence
ggggaggaaagggggcaaag

SEQ ID NO: 575167 - DNA, 20 bp, Artificial
  CRISPR gRNA sequence
ggaaagggggcaaaggggtg

SEQ ID NO: 575168 - DNA, 20 bp, Artificial
  CRISPR gRNA sequence
gaaagggggcaaaggggtga

SEQ ID NO: 575169 - DNA, 20 bp, Artificial
  CRISPR gRNA sequence
aaagggggcaaaggggtgaa

SEQ ID NO: 575170 - DNA, 20 bp, Artificial
  CRISPR gRNA sequence
aagggggcaaaggggtgaag

SEQ ID NO: 575171 - DNA, 20 bp, Artificial
  CRISPR gRNA sequence
ggggcaaaggggtgaagggg

SEQ ID NO: 575172 - DNA, 20 bp, Artificial
  CRISPR gRNA sequence
aggggtgaaggggtggatct

SEQ ID NO: 575173 - DNA, 20 bp, Artificial
  CRISPR gRNA sequence
aaggggtggatcttggccac

SEQ ID NO: 575174 - DNA, 20 bp, Artificial
  CRISPR gRNA sequence
atttgtaccatgtaaataaa

SEQ ID NO: 575175 - DNA, 20 bp, Artificial
  CRISPR gRNA sequence
cctttccaatttctcttccc

SEQ ID NO: 575176 - DNA, 20 bp, Artificial
  CRISPR gRNA sequence
ctttccaatttctcttcccc

SEQ ID NO: 575177 - DNA, 20 bp, Artificial
  CRISPR gRNA sequence
atttctcttccccaggtctg

SEQ ID NO: 575178 - DNA, 20 bp, Artificial
  CRISPR gRNA sequence
ctcttccccaggtctgaagc

SEQ ID NO: 575179 - DNA, 20 bp, Artificial
  CRISPR gRNA sequence
caggtctgaagccagtcttg

SEQ ID NO: 575180 - DNA, 20 bp, Artificial
  CRISPR gRNA sequence
ggtctgaagccagtcttgta

SEQ ID NO: 575181 - DNA, 20 bp, Artificial
  CRISPR gRNA sequence
gtctgaagccagtcttgtag

SEQ ID NO: 575182 - DNA, 20 bp, Artificial
  CRISPR gRNA sequence
tctgaagccagtcttgtaga

SEQ ID NO: 575183 - DNA, 20 bp, Artificial
  CRISPR gRNA sequence
aagccagtcttgtagagggc

SEQ ID NO: 575184 - DNA, 20 bp, Artificial
  CRISPR gRNA sequence
gccagtcttgtagagggctg

SEQ ID NO: 575185 - DNA, 20 bp, Artificial
  CRISPR gRNA sequence
agtcttgtagagggctggag

SEQ ID NO: 575186 - DNA, 20 bp, Artificial
  CRISPR gRNA sequence
tagagggctggagtggttgt

SEQ ID NO: 575187 - DNA, 20 bp, Artificial
  CRISPR gRNA sequence
tggagtggttgttggacgac

SEQ ID NO: 575188 - DNA, 20 bp, Artificial
  CRISPR gRNA sequence
ttgttggacgactagaaccc

SEQ ID NO: 575189 - DNA, 20 bp, Artificial
  CRISPR gRNA sequence
tgttggacgactagaaccct

SEQ ID NO: 575190 - DNA, 20 bp, Artificial
  CRISPR gRNA sequence
gactagaaccctgggctttg

SEQ ID NO: 575191 - DNA, 20 bp, Artificial
  CRISPR gRNA sequence
actagaaccctgggctttgc

SEQ ID NO: 575192 - DNA, 20 bp, Artificial
  CRISPR gRNA sequence
ctagaaccctgggctttgca

SEQ ID NO: 575193 - DNA, 20 bp, Artificial
  CRISPR gRNA sequence
ccctgggctttgcagggtgc

SEQ ID NO: 575194 - DNA, 20 bp, Artificial
  CRISPR gRNA sequence
cctgggctttgcagggtgct

SEQ ID NO: 575195 - DNA, 20 bp, Artificial
  CRISPR gRNA sequence
tgggctttgcagggtgctgg

SEQ ID NO: 575196 - DNA, 20 bp, Artificial
  CRISPR gRNA sequence
ctttgcagggtgctgggagc

SEQ ID NO: 575197 - DNA, 20 bp, Artificial
  CRISPR gRNA sequence
tgcagggtgctgggagctgg

SEQ ID NO: 575198 - DNA, 20 bp, Artificial
  CRISPR gRNA sequence
ggagctggaagtcttcacca

SEQ ID NO: 575199 - DNA, 20 bp, Artificial
  CRISPR gRNA sequence
aagtcttcaccatggcctgt

SEQ ID NO: 575200 - DNA, 20 bp, Artificial
  CRISPR gRNA sequence
agtcttcaccatggcctgtc

SEQ ID NO: 575201 - DNA, 20 bp, Artificial
  CRISPR gRNA sequence
tcttcaccatggcctgtcag

SEQ ID NO: 575202 - DNA, 20 bp, Artificial
  CRISPR gRNA sequence
tcaccatggcctgtcaggag

SEQ ID NO: 575203 - DNA, 20 bp, Artificial
  CRISPR gRNA sequence
ggcctgtcaggagaagcccc

SEQ ID NO: 575204 - DNA, 20 bp, Artificial
  CRISPR gRNA sequence
gcctgtcaggagaagcccct

SEQ ID NO: 575205 - DNA, 20 bp, Artificial
  CRISPR gRNA sequence
cctgtcaggagaagcccctg

SEQ ID NO: 575206 - DNA, 20 bp, Artificial
  CRISPR gRNA sequence
ctgtcaggagaagcccctgg

SEQ ID NO: 575207 - DNA, 20 bp, Artificial
  CRISPR gRNA sequence
caggagaagcccctgggggc

SEQ ID NO: 575208 - DNA, 20 bp, Artificial
  CRISPR gRNA sequence
ggctggtctaccatgctgac

SEQ ID NO: 575209 - DNA, 20 bp, Artificial
  CRISPR gRNA sequence
tggtctaccatgctgaccag

SEQ ID NO: 575210 - DNA, 20 bp, Artificial
  CRISPR gRNA sequence
catgctgaccagtggttgaa

SEQ ID NO: 575211 - DNA, 20 bp, Artificial
  CRISPR gRNA sequence
tgctgaccagtggttgaata

SEQ ID NO: 575212 - DNA, 20 bp, Artificial
  CRISPR gRNA sequence
ggttgaatagagtgcctgct

SEQ ID NO: 575213 - DNA, 20 bp, Artificial
  CRISPR gRNA sequence
gttgaatagagtgcctgctg

SEQ ID NO: 575214 - DNA, 20 bp, Artificial
  CRISPR gRNA sequence
atagagtgcctgctgaggtc

SEQ ID NO: 575215 - DNA, 20 bp, Artificial
  CRISPR gRNA sequence
agagtgcctgctgaggtcaa

SEQ ID NO: 575216 - DNA, 20 bp, Artificial
  CRISPR gRNA sequence
cctgctgaggtcaagagatg

SEQ ID NO: 575217 - DNA, 20 bp, Artificial
  CRISPR gRNA sequence
gagatgcagccgccaattcc

SEQ ID NO: 575218 - DNA, 20 bp, Artificial
  CRISPR gRNA sequence
ccaattcctggacaacctaa

SEQ ID NO: 575219 - DNA, 20 bp, Artificial
  CRISPR gRNA sequence
ggacaacctaaaagcctcac

SEQ ID NO: 575220 - DNA, 20 bp, Artificial
  CRISPR gRNA sequence
ctaaaagcctcacaagcttc

SEQ ID NO: 575221 - DNA, 20 bp, Artificial
  CRISPR gRNA sequence
ctcacaagcttcaagtctcc

SEQ ID NO: 575222 - DNA, 20 bp, Artificial
  CRISPR gRNA sequence
tcacaagcttcaagtctcca

SEQ ID NO: 575223 - DNA, 20 bp, Artificial
  CRISPR gRNA sequence
tccaaggactctccaaatcc

SEQ ID NO: 575224 - DNA, 20 bp, Artificial
  CRISPR gRNA sequence
ccaaggactctccaaatccc

SEQ ID NO: 575225 - DNA, 20 bp, Artificial
  CRISPR gRNA sequence
atctccctgccatcacatcc

SEQ ID NO: 575226 - DNA, 20 bp, Artificial
  CRISPR gRNA sequence
catcctagaatttaaaacct

SEQ ID NO: 575227 - DNA, 20 bp, Artificial
  CRISPR gRNA sequence
atttaaaacctgagaacatc

SEQ ID NO: 575228 - DNA, 20 bp, Artificial
  CRISPR gRNA sequence
aaacctgagaacatcaagtt

SEQ ID NO: 575229 - DNA, 20 bp, Artificial
  CRISPR gRNA sequence
aacctgagaacatcaagttc

SEQ ID NO: 575230 - DNA, 20 bp, Artificial
  CRISPR gRNA sequence
tgagaacatcaagttcagga

SEQ ID NO: 575231 - DNA, 20 bp, Artificial
  CRISPR gRNA sequence
acatcaagttcaggaaagct

SEQ ID NO: 575232 - DNA, 20 bp, Artificial
  CRISPR gRNA sequence
catcaagttcaggaaagctt

SEQ ID NO: 575233 - DNA, 20 bp, Artificial
  CRISPR gRNA sequence
atcaagttcaggaaagcttg

SEQ ID NO: 575234 - DNA, 20 bp, Artificial
  CRISPR gRNA sequence
aggaaagcttggggatttca

SEQ ID NO: 575235 - DNA, 20 bp, Artificial
  CRISPR gRNA sequence
agcttggggatttcaaagcc

SEQ ID NO: 575236 - DNA, 20 bp, Artificial
  CRISPR gRNA sequence
gatttcaaagcccagcacca

SEQ ID NO: 575237 - DNA, 20 bp, Artificial
  CRISPR gRNA sequence
tcaaagcccagcaccaaaga

SEQ ID NO: 575238 - DNA, 20 bp, Artificial
  CRISPR gRNA sequence
aagcccagcaccaaagaaag

SEQ ID NO: 575239 - DNA, 20 bp, Artificial
  CRISPR gRNA sequence
agcccagcaccaaagaaagc

SEQ ID NO: 575240 - DNA, 20 bp, Artificial
  CRISPR gRNA sequence
aaagcgggacccacactcgc

SEQ ID NO: 575241 - DNA, 20 bp, Artificial
  CRISPR gRNA sequence
actcgccagctctgtgatct

SEQ ID NO: 575242 - DNA, 20 bp, Artificial
  CRISPR gRNA sequence
ctcgccagctctgtgatctt

SEQ ID NO: 575243 - DNA, 20 bp, Artificial
  CRISPR gRNA sequence
ccagctctgtgatcttgggc

SEQ ID NO: 575244 - DNA, 20 bp, Artificial
  CRISPR gRNA sequence
cgtttccctcatctgtataa

SEQ ID NO: 575245 - DNA, 20 bp, Artificial
  CRISPR gRNA sequence
gtttccctcatctgtataac

SEQ ID NO: 575246 - DNA, 20 bp, Artificial
  CRISPR gRNA sequence
aacaggaatacaataatgat

SEQ ID NO: 575247 - DNA, 20 bp, Artificial
  CRISPR gRNA sequence
ggaatacaataatgatgaga

SEQ ID NO: 575248 - DNA, 20 bp, Artificial
  CRISPR gRNA sequence
aatacaataatgatgagatg

SEQ ID NO: 575249 - DNA, 20 bp, Artificial
  CRISPR gRNA sequence
ataatgatgagatggagctc

SEQ ID NO: 575250 - DNA, 20 bp, Artificial
  CRISPR gRNA sequence
taatgatgagatggagctca

SEQ ID NO: 575251 - DNA, 20 bp, Artificial
  CRISPR gRNA sequence
aatgatgagatggagctcaa

SEQ ID NO: 575252 - DNA, 20 bp, Artificial
  CRISPR gRNA sequence
atgatgagatggagctcaag

SEQ ID NO: 575253 - DNA, 20 bp, Artificial
  CRISPR gRNA sequence
agatggagctcaaggggcca

SEQ ID NO: 575254 - DNA, 20 bp, Artificial
  CRISPR gRNA sequence
ggagctcaaggggccatggt

SEQ ID NO: 575255 - DNA, 20 bp, Artificial
  CRISPR gRNA sequence
gagctcaaggggccatggtg

SEQ ID NO: 575256 - DNA, 20 bp, Artificial
  CRISPR gRNA sequence
gattgaacatgatcacttgt

SEQ ID NO: 575257 - DNA, 20 bp, Artificial
  CRISPR gRNA sequence
gatcacttgtgagacatgtt

SEQ ID NO: 575258 - DNA, 20 bp, Artificial
  CRISPR gRNA sequence
tcagcactgtatctgaccca

SEQ ID NO: 575259 - DNA, 20 bp, Artificial
  CRISPR gRNA sequence
atctgacccatggaaaattc

SEQ ID NO: 575260 - DNA, 20 bp, Artificial
  CRISPR gRNA sequence
ggaaaattcaagataaacat

SEQ ID NO: 575261 - DNA, 20 bp, Artificial
  CRISPR gRNA sequence
caagataaacatcagctact

SEQ ID NO: 575262 - DNA, 20 bp, Artificial
  CRISPR gRNA sequence
aacatcagctactgagatga

SEQ ID NO: 575263 - DNA, 20 bp, Artificial
  CRISPR gRNA sequence
atcagctactgagatgatgg

SEQ ID NO: 575264 - DNA, 20 bp, Artificial
  CRISPR gRNA sequence
ctgagatgatggcggatatt

SEQ ID NO: 575265 - DNA, 20 bp, Artificial
  CRISPR gRNA sequence
tatttggaatcctaaatcct

SEQ ID NO: 575266 - DNA, 20 bp, Artificial
  CRISPR gRNA sequence
aatcctaaatccttggaaac

SEQ ID NO: 575267 - DNA, 20 bp, Artificial
  CRISPR gRNA sequence
atcctaaatccttggaaact

SEQ ID NO: 575268 - DNA, 20 bp, Artificial
  CRISPR gRNA sequence
tcctaaatccttggaaactg

SEQ ID NO: 575269 - DNA, 20 bp, Artificial
  CRISPR gRNA sequence
ttggaaactggggctttttg

SEQ ID NO: 575270 - DNA, 20 bp, Artificial
  CRISPR gRNA sequence
actggggctttttgaagtaa

SEQ ID NO: 575271 - DNA, 20 bp, Artificial
  CRISPR gRNA sequence
ttttgaagtaaaagacccca

SEQ ID NO: 575272 - DNA, 20 bp, Artificial
  CRISPR gRNA sequence
tttgaagtaaaagaccccaa

SEQ ID NO: 575273 - DNA, 20 bp, Artificial
  CRISPR gRNA sequence
agtaaaagaccccaaaggct

SEQ ID NO: 575274 - DNA, 20 bp, Artificial
  CRISPR gRNA sequence
gtaaaagaccccaaaggctg

SEQ ID NO: 575275 - DNA, 20 bp, Artificial
  CRISPR gRNA sequence
taaaagaccccaaaggctga

SEQ ID NO: 575276 - DNA, 20 bp, Artificial
  CRISPR gRNA sequence
accccaaaggctgagggcct

SEQ ID NO: 575277 - DNA, 20 bp, Artificial
  CRISPR gRNA sequence
ccaaaggctgagggcctcag

SEQ ID NO: 575278 - DNA, 20 bp, Artificial
  CRISPR gRNA sequence
gctgagggcctcagaagcat

SEQ ID NO: 575279 - DNA, 20 bp, Artificial
  CRISPR gRNA sequence
ctgagggcctcagaagcatc

SEQ ID NO: 575280 - DNA, 20 bp, Artificial
  CRISPR gRNA sequence
ggccatgatgttcctgaaac

SEQ ID NO: 575281 - DNA, 20 bp, Artificial
  CRISPR gRNA sequence
ccatgatgttcctgaaacaa

SEQ ID NO: 575282 - DNA, 20 bp, Artificial
  CRISPR gRNA sequence
catgatgttcctgaaacaag

SEQ ID NO: 575283 - DNA, 20 bp, Artificial
  CRISPR gRNA sequence
atgatgttcctgaaacaaga

SEQ ID NO: 575284 - DNA, 20 bp, Artificial
  CRISPR gRNA sequence
tgttcctgaaacaagagggt

SEQ ID NO: 575285 - DNA, 20 bp, Artificial
  CRISPR gRNA sequence
gttcctgaaacaagagggtc

SEQ ID NO: 575286 - DNA, 20 bp, Artificial
  CRISPR gRNA sequence
ttcctgaaacaagagggtca

SEQ ID NO: 575287 - DNA, 20 bp, Artificial
  CRISPR gRNA sequence
caagagggtcagggtcccaa

SEQ ID NO: 575288 - DNA, 20 bp, Artificial
  CRISPR gRNA sequence
aagagggtcagggtcccaat

SEQ ID NO: 575289 - DNA, 20 bp, Artificial
  CRISPR gRNA sequence
tcagggtcccaatgggcctc

SEQ ID NO: 575290 - DNA, 20 bp, Artificial
  CRISPR gRNA sequence
cagggtcccaatgggcctct

SEQ ID NO: 575291 - DNA, 20 bp, Artificial
  CRISPR gRNA sequence
agggtcccaatgggcctctg

SEQ ID NO: 575292 - DNA, 20 bp, Artificial
  CRISPR gRNA sequence
gggcctctggggttcatcgt

SEQ ID NO: 575293 - DNA, 20 bp, Artificial
  CRISPR gRNA sequence
ggcctctggggttcatcgtg

SEQ ID NO: 575294 - DNA, 20 bp, Artificial
  CRISPR gRNA sequence
tctggggttcatcgtgagga

SEQ ID NO: 575295 - DNA, 20 bp, Artificial
  CRISPR gRNA sequence
gaggatggatgcattaatat

SEQ ID NO: 575296 - DNA, 20 bp, Artificial
  CRISPR gRNA sequence
aggatggatgcattaatatt

SEQ ID NO: 575297 - DNA, 20 bp, Artificial
  CRISPR gRNA sequence
ggatggatgcattaatattg

SEQ ID NO: 575298 - DNA, 20 bp, Artificial
  CRISPR gRNA sequence
cattaatattggggacctgc

SEQ ID NO: 575299 - DNA, 20 bp, Artificial
  CRISPR gRNA sequence
attaatattggggacctgct

SEQ ID NO: 575300 - DNA, 20 bp, Artificial
  CRISPR gRNA sequence
ttaatattggggacctgcta

SEQ ID NO: 575301 - DNA, 20 bp, Artificial
  CRISPR gRNA sequence
ggacctgctagggaccttcc

SEQ ID NO: 575302 - DNA, 20 bp, Artificial
  CRISPR gRNA sequence
cctgctagggaccttcccag

SEQ ID NO: 575303 - DNA, 20 bp, Artificial
  CRISPR gRNA sequence
ctgctagggaccttcccagt

SEQ ID NO: 575304 - DNA, 20 bp, Artificial
  CRISPR gRNA sequence
tagggaccttcccagtggga

SEQ ID NO: 575305 - DNA, 20 bp, Artificial
  CRISPR gRNA sequence
ggaccttcccagtgggacag

SEQ ID NO: 575306 - DNA, 20 bp, Artificial
  CRISPR gRNA sequence
cttcccagtgggacagtggc

SEQ ID NO: 575307 - DNA, 20 bp, Artificial
  CRISPR gRNA sequence
ttcccagtgggacagtggct

SEQ ID NO: 575308 - DNA, 20 bp, Artificial
  CRISPR gRNA sequence
cagtgggacagtggctgggt

SEQ ID NO: 575309 - DNA, 20 bp, Artificial
  CRISPR gRNA sequence
agtgggacagtggctgggtc

SEQ ID NO: 575310 - DNA, 20 bp, Artificial
  CRISPR gRNA sequence
gtgggacagtggctgggtca

SEQ ID NO: 575311 - DNA, 20 bp, Artificial
  CRISPR gRNA sequence
gtggctgggtcagggcactc

SEQ ID NO: 575312 - DNA, 20 bp, Artificial
  CRISPR gRNA sequence
ctcaagccctaaaacgtgat

SEQ ID NO: 575313 - DNA, 20 bp, Artificial
  CRISPR gRNA sequence
tcaagccctaaaacgtgatg

SEQ ID NO: 575314 - DNA, 20 bp, Artificial
  CRISPR gRNA sequence
gccctaaaacgtgatgaggc

SEQ ID NO: 575315 - DNA, 20 bp, Artificial
  CRISPR gRNA sequence
cttttctctctttcctcatt

SEQ ID NO: 575316 - DNA, 20 bp, Artificial
  CRISPR gRNA sequence
tttcctcattcagtaactgt

SEQ ID NO: 575317 - DNA, 20 bp, Artificial
  CRISPR gRNA sequence
cctcattcagtaactgtcag

SEQ ID NO: 575318 - DNA, 20 bp, Artificial
  CRISPR gRNA sequence
cagtaactgtcagtagattc

SEQ ID NO: 575319 - DNA, 20 bp, Artificial
  CRISPR gRNA sequence
agtaactgtcagtagattct

SEQ ID NO: 575320 - DNA, 20 bp, Artificial
  CRISPR gRNA sequence
taactgtcagtagattctgg

SEQ ID NO: 575321 - DNA, 20 bp, Artificial
  CRISPR gRNA sequence
tgtcagtagattctgggagc

SEQ ID NO: 575322 - DNA, 20 bp, Artificial
  CRISPR gRNA sequence
gtcagtagattctgggagcc

SEQ ID NO: 575323 - DNA, 20 bp, Artificial
  CRISPR gRNA sequence
tcagtagattctgggagcca

SEQ ID NO: 575324 - DNA, 20 bp, Artificial
  CRISPR gRNA sequence
cagggattctccgactcttc

SEQ ID NO: 575325 - DNA, 20 bp, Artificial
  CRISPR gRNA sequence
ctcttcaagtccatgaattt

SEQ ID NO: 575326 - DNA, 20 bp, Artificial
  CRISPR gRNA sequence
tcttcaagtccatgaatttt

SEQ ID NO: 575327 - DNA, 20 bp, Artificial
  CRISPR gRNA sequence
cttcaagtccatgaatttta

SEQ ID NO: 575328 - DNA, 20 bp, Artificial
  CRISPR gRNA sequence
ttcaagtccatgaattttag

SEQ ID NO: 575329 - DNA, 20 bp, Artificial
  CRISPR gRNA sequence
ccatgaattttaggggatga

SEQ ID NO: 575330 - DNA, 20 bp, Artificial
  CRISPR gRNA sequence
tgaattttaggggatgacag

SEQ ID NO: 575331 - DNA, 20 bp, Artificial
  CRISPR gRNA sequence
gaattttaggggatgacagt

SEQ ID NO: 575332 - DNA, 20 bp, Artificial
  CRISPR gRNA sequence
tctccgctttctcctccatg

SEQ ID NO: 575333 - DNA, 20 bp, Artificial
  CRISPR gRNA sequence
tacatgcccctcaccctctg

SEQ ID NO: 575334 - DNA, 20 bp, Artificial
  CRISPR gRNA sequence
acatgcccctcaccctctgt

SEQ ID NO: 575335 - DNA, 20 bp, Artificial
  CRISPR gRNA sequence
atgcccctcaccctctgtgg

SEQ ID NO: 575336 - DNA, 20 bp, Artificial
  CRISPR gRNA sequence
tgcccctcaccctctgtggg

SEQ ID NO: 575337 - DNA, 20 bp, Artificial
  CRISPR gRNA sequence
gcccctcaccctctgtggga

SEQ ID NO: 575338 - DNA, 20 bp, Artificial
  CRISPR gRNA sequence
cccctcaccctctgtgggag

SEQ ID NO: 575339 - DNA, 20 bp, Artificial
  CRISPR gRNA sequence
cctctgtgggaggggtgttg

SEQ ID NO: 575340 - DNA, 20 bp, Artificial
  CRISPR gRNA sequence
ctctgtgggaggggtgttgc

SEQ ID NO: 575341 - DNA, 20 bp, Artificial
  CRISPR gRNA sequence
tctgtgggaggggtgttgca

SEQ ID NO: 575342 - DNA, 20 bp, Artificial
  CRISPR gRNA sequence
ctgtgggaggggtgttgcag

SEQ ID NO: 575343 - DNA, 20 bp, Artificial
  CRISPR gRNA sequence
tgtgggaggggtgttgcagg

SEQ ID NO: 575344 - DNA, 20 bp, Artificial
  CRISPR gRNA sequence
gaggggtgttgcagggggtg

SEQ ID NO: 575345 - DNA, 20 bp, Artificial
  CRISPR gRNA sequence
gggtgcagaactcccctcgc

SEQ ID NO: 575346 - DNA, 20 bp, Artificial
  CRISPR gRNA sequence
ggtgcagaactcccctcgcc

SEQ ID NO: 575347 - DNA, 20 bp, Artificial
  CRISPR gRNA sequence
gcagaactcccctcgccggg

SEQ ID NO: 575348 - DNA, 20 bp, Artificial
  CRISPR gRNA sequence
ctcccctcgccgggtagttc

SEQ ID NO: 575349 - DNA, 20 bp, Artificial
  CRISPR gRNA sequence
tcgccgggtagttcaagcaa

SEQ ID NO: 575350 - DNA, 20 bp, Artificial
  CRISPR gRNA sequence
cgccgggtagttcaagcaat

SEQ ID NO: 575351 - DNA, 20 bp, Artificial
  CRISPR gRNA sequence
gccgggtagttcaagcaatg

SEQ ID NO: 575352 - DNA, 20 bp, Artificial
  CRISPR gRNA sequence
gaccatatcaattccatcta

SEQ ID NO: 575353 - DNA, 20 bp, Artificial
  CRISPR gRNA sequence
accatatcaattccatctat

SEQ ID NO: 575354 - DNA, 20 bp, Artificial
  CRISPR gRNA sequence
ccatatcaattccatctata

SEQ ID NO: 575355 - DNA, 20 bp, Artificial
  CRISPR gRNA sequence
attccatctatagggaaact

SEQ ID NO: 575356 - DNA, 20 bp, Artificial
  CRISPR gRNA sequence
ttccatctatagggaaactg

SEQ ID NO: 575357 - DNA, 20 bp, Artificial
  CRISPR gRNA sequence
tctatagggaaactgaggcc

SEQ ID NO: 575358 - DNA, 20 bp, Artificial
  CRISPR gRNA sequence
tatagggaaactgaggcctg

SEQ ID NO: 575359 - DNA, 20 bp, Artificial
  CRISPR gRNA sequence
agggaaactgaggcctggag

SEQ ID NO: 575360 - DNA, 20 bp, Artificial
  CRISPR gRNA sequence
gggaaactgaggcctggagt

SEQ ID NO: 575361 - DNA, 20 bp, Artificial
  CRISPR gRNA sequence
ggaaactgaggcctggagta

SEQ ID NO: 575362 - DNA, 20 bp, Artificial
  CRISPR gRNA sequence
actgaggcctggagtagggc

SEQ ID NO: 575363 - DNA, 20 bp, Artificial
  CRISPR gRNA sequence
ctgaggcctggagtagggcg

SEQ ID NO: 575364 - DNA, 20 bp, Artificial
  CRISPR gRNA sequence
ctggagtagggcgaggcctc

SEQ ID NO: 575365 - DNA, 20 bp, Artificial
  CRISPR gRNA sequence
tggagtagggcgaggcctct

SEQ ID NO: 575366 - DNA, 20 bp, Artificial
  CRISPR gRNA sequence
gggcgaggcctctgggaacc

SEQ ID NO: 575367 - DNA, 20 bp, Artificial
  CRISPR gRNA sequence
ccctattctgtctctttccc

SEQ ID NO: 575368 - DNA, 20 bp, Artificial
  CRISPR gRNA sequence
tggcatttcccatccacaca

SEQ ID NO: 575369 - DNA, 20 bp, Artificial
  CRISPR gRNA sequence
gcatttcccatccacacata

SEQ ID NO: 575370 - DNA, 20 bp, Artificial
  CRISPR gRNA sequence
cccatccacacatagagctt

SEQ ID NO: 575371 - DNA, 20 bp, Artificial
  CRISPR gRNA sequence
tcagattctctttctttccc

SEQ ID NO: 575372 - DNA, 20 bp, Artificial
  CRISPR gRNA sequence
agattctctttctttcccca

SEQ ID NO: 575373 - DNA, 20 bp, Artificial
  CRISPR gRNA sequence
ctcaaatatcctctcactca

SEQ ID NO: 575374 - DNA, 20 bp, Artificial
  CRISPR gRNA sequence
atatcctctcactcacagaa

SEQ ID NO: 575375 - DNA, 20 bp, Artificial
  CRISPR gRNA sequence
aatggtgtctctgcctgcct

SEQ ID NO: 575376 - DNA, 20 bp, Artificial
  CRISPR gRNA sequence
atggtgtctctgcctgcctc

SEQ ID NO: 575377 - DNA, 20 bp, Artificial
  CRISPR gRNA sequence
tgtctctgcctgcctcgggt

SEQ ID NO: 575378 - DNA, 20 bp, Artificial
  CRISPR gRNA sequence
gttggccctgtgatttattt

SEQ ID NO: 575379 - DNA, 20 bp, Artificial
  CRISPR gRNA sequence
cacttttgttttaaaaactg

SEQ ID NO: 575380 - DNA, 20 bp, Artificial
  CRISPR gRNA sequence
taaaaactgtggtttctcat

SEQ ID NO: 575381 - DNA, 20 bp, Artificial
  CRISPR gRNA sequence
attgatacctctcacctctg

SEQ ID NO: 575382 - DNA, 20 bp, Artificial
  CRISPR gRNA sequence
atacctctcacctctgtggt

SEQ ID NO: 575383 - DNA, 20 bp, Artificial
  CRISPR gRNA sequence
tacctctcacctctgtggtg

SEQ ID NO: 575384 - DNA, 20 bp, Artificial
  CRISPR gRNA sequence
acctctcacctctgtggtga

SEQ ID NO: 575385 - DNA, 20 bp, Artificial
  CRISPR gRNA sequence
cctctcacctctgtggtgag

SEQ ID NO: 575386 - DNA, 20 bp, Artificial
  CRISPR gRNA sequence
ctcacctctgtggtgagggg

SEQ ID NO: 575387 - DNA, 20 bp, Artificial
  CRISPR gRNA sequence
aggggaagaaatcatatttt

SEQ ID NO: 575388 - DNA, 20 bp, Artificial
  CRISPR gRNA sequence
atattttcagatgactcgta

SEQ ID NO: 575389 - DNA, 20 bp, Artificial
  CRISPR gRNA sequence
tattttcagatgactcgtaa

SEQ ID NO: 575390 - DNA, 20 bp, Artificial
  CRISPR gRNA sequence
attttcagatgactcgtaaa

SEQ ID NO: 575391 - DNA, 20 bp, Artificial
  CRISPR gRNA sequence
cagatgactcgtaaagggca

SEQ ID NO: 575392 - DNA, 20 bp, Artificial
  CRISPR gRNA sequence
aaatttcaaaatttccgttt

SEQ ID NO: 575393 - DNA, 20 bp, Artificial
  CRISPR gRNA sequence
tccgtttaagtctcataatc

SEQ ID NO: 575394 - DNA, 20 bp, Artificial
  CRISPR gRNA sequence
ttaagtctcataatcaagaa

SEQ ID NO: 575395 - DNA, 20 bp, Artificial
  CRISPR gRNA sequence
taagtctcataatcaagaaa

SEQ ID NO: 575396 - DNA, 20 bp, Artificial
  CRISPR gRNA sequence
agtctcataatcaagaaaag

SEQ ID NO: 575397 - DNA, 20 bp, Artificial
  CRISPR gRNA sequence
aatcaagaaaaggagaaaca

SEQ ID NO: 575398 - DNA, 20 bp, Artificial
  CRISPR gRNA sequence
tcaagaaaaggagaaacaca

SEQ ID NO: 575399 - DNA, 20 bp, Artificial
  CRISPR gRNA sequence
aagaaaaggagaaacacaga

SEQ ID NO: 575400 - DNA, 20 bp, Artificial
  CRISPR gRNA sequence
gaaaaggagaaacacagaga

SEQ ID NO: 575401 - DNA, 20 bp, Artificial
  CRISPR gRNA sequence
aaaggagaaacacagagaga

SEQ ID NO: 575402 - DNA, 20 bp, Artificial
  CRISPR gRNA sequence
agagagaaaaaaaaaactat

SEQ ID NO: 575403 - DNA, 20 bp, Artificial
  CRISPR gRNA sequence
cctccccaccccgtgattat

SEQ ID NO: 575404 - DNA, 20 bp, Artificial
  CRISPR gRNA sequence
cacactcatcgaaaaaaatt

SEQ ID NO: 575405 - DNA, 20 bp, Artificial
  CRISPR gRNA sequence
tcgaaaaaaatttggattat

SEQ ID NO: 575406 - DNA, 20 bp, Artificial
  CRISPR gRNA sequence
aaaaaaatttggattattag

SEQ ID NO: 575407 - DNA, 20 bp, Artificial
  CRISPR gRNA sequence
aaaaatttggattattagaa

SEQ ID NO: 575408 - DNA, 20 bp, Artificial
  CRISPR gRNA sequence
aaatttggattattagaaga

SEQ ID NO: 575409 - DNA, 20 bp, Artificial
  CRISPR gRNA sequence
atttggattattagaagaga

SEQ ID NO: 575410 - DNA, 20 bp, Artificial
  CRISPR gRNA sequence
tttggattattagaagagag

SEQ ID NO: 575411 - DNA, 20 bp, Artificial
  CRISPR gRNA sequence
tattagaagagagaggtctg

SEQ ID NO: 575412 - DNA, 20 bp, Artificial
  CRISPR gRNA sequence
tctgcggcttccacaccgta

SEQ ID NO: 575413 - DNA, 20 bp, Artificial
  CRISPR gRNA sequence
ggcttccacaccgtacagcg

SEQ ID NO: 575414 - DNA, 20 bp, Artificial
  CRISPR gRNA sequence
tacagcgtggtttttcttct

SEQ ID NO: 575415 - DNA, 20 bp, Artificial
  CRISPR gRNA sequence
ggtttttcttctcggtataa

SEQ ID NO: 575416 - DNA, 20 bp, Artificial
  CRISPR gRNA sequence
ttcttctcggtataaaagca

SEQ ID NO: 575417 - DNA, 20 bp, Artificial
  CRISPR gRNA sequence
aagttgtttttgatacgtga

SEQ ID NO: 575418 - DNA, 20 bp, Artificial
  CRISPR gRNA sequence
gatacgtgacagtttcccac

SEQ ID NO: 575419 - DNA, 20 bp, Artificial
  CRISPR gRNA sequence
cgtgacagtttcccacaagc

SEQ ID NO: 575420 - DNA, 20 bp, Artificial
  CRISPR gRNA sequence
gtgacagtttcccacaagcc

SEQ ID NO: 575421 - DNA, 20 bp, Artificial
  CRISPR gRNA sequence
ccaggctgatccttttctgt

SEQ ID NO: 575422 - DNA, 20 bp, Artificial
  CRISPR gRNA sequence
ttctgtcagtccacttcacc

SEQ ID NO: 575423 - DNA, 20 bp, Artificial
  CRISPR gRNA sequence
tctgtcagtccacttcacca

SEQ ID NO: 575424 - DNA, 20 bp, Artificial
  CRISPR gRNA sequence
tcagtccacttcaccaaggt

SEQ ID NO: 575425 - DNA, 20 bp, Artificial
  CRISPR gRNA sequence
gtgtccctgctctcccctac

SEQ ID NO: 575426 - DNA, 20 bp, Artificial
  CRISPR gRNA sequence
ctgctctcccctaccagatg

SEQ ID NO: 575427 - DNA, 20 bp, Artificial
  CRISPR gRNA sequence
tgctctcccctaccagatgt

SEQ ID NO: 575428 - DNA, 20 bp, Artificial
  CRISPR gRNA sequence
ctaccagatgtgggccccat

SEQ ID NO: 575429 - DNA, 20 bp, Artificial
  CRISPR gRNA sequence
accagatgtgggccccattg

SEQ ID NO: 575430 - DNA, 20 bp, Artificial
  CRISPR gRNA sequence
ccagatgtgggccccattgg

SEQ ID NO: 575431 - DNA, 20 bp, Artificial
  CRISPR gRNA sequence
agatgtgggccccattggag

SEQ ID NO: 575432 - DNA, 20 bp, Artificial
  CRISPR gRNA sequence
gtgggccccattggaggaga

SEQ ID NO: 575433 - DNA, 20 bp, Artificial
  CRISPR gRNA sequence
ggccccattggaggagatgg

SEQ ID NO: 575434 - DNA, 20 bp, Artificial
  CRISPR gRNA sequence
gccccattggaggagatggc

SEQ ID NO: 575435 - DNA, 20 bp, Artificial
  CRISPR gRNA sequence
ccccattggaggagatggca

SEQ ID NO: 575436 - DNA, 20 bp, Artificial
  CRISPR gRNA sequence
ccattggaggagatggcagg

SEQ ID NO: 575437 - DNA, 20 bp, Artificial
  CRISPR gRNA sequence
cattggaggagatggcaggg

SEQ ID NO: 575438 - DNA, 20 bp, Artificial
  CRISPR gRNA sequence
tggaggagatggcagggagg

SEQ ID NO: 575439 - DNA, 20 bp, Artificial
  CRISPR gRNA sequence
ggaggagatggcagggaggt

SEQ ID NO: 575440 - DNA, 20 bp, Artificial
  CRISPR gRNA sequence
agatggcagggaggtaggca

SEQ ID NO: 575441 - DNA, 20 bp, Artificial
  CRISPR gRNA sequence
tggcagggaggtaggcacgg

SEQ ID NO: 575442 - DNA, 20 bp, Artificial
  CRISPR gRNA sequence
ggcagggaggtaggcacggc

SEQ ID NO: 575443 - DNA, 20 bp, Artificial
  CRISPR gRNA sequence
gcagggaggtaggcacggcg

SEQ ID NO: 575444 - DNA, 20 bp, Artificial
  CRISPR gRNA sequence
cagggaggtaggcacggcgg

SEQ ID NO: 575445 - DNA, 20 bp, Artificial
  CRISPR gRNA sequence
agggaggtaggcacggcggg

SEQ ID NO: 575446 - DNA, 20 bp, Artificial
  CRISPR gRNA sequence
gggaggtaggcacggcgggg

SEQ ID NO: 575447 - DNA, 20 bp, Artificial
  CRISPR gRNA sequence
ggtaggcacggcgggggggt

SEQ ID NO: 575448 - DNA, 20 bp, Artificial
  CRISPR gRNA sequence
gtaggcacggcgggggggtc

SEQ ID NO: 575449 - DNA, 20 bp, Artificial
  CRISPR gRNA sequence
taggcacggcgggggggtca

SEQ ID NO: 575450 - DNA, 20 bp, Artificial
  CRISPR gRNA sequence
aggcacggcgggggggtcag

SEQ ID NO: 575451 - DNA, 20 bp, Artificial
  CRISPR gRNA sequence
cgggggggtcaggggccctc

SEQ ID NO: 575452 - DNA, 20 bp, Artificial
  CRISPR gRNA sequence
gggtcaggggccctctggta

SEQ ID NO: 575453 - DNA, 20 bp, Artificial
  CRISPR gRNA sequence
tcaggggccctctggtacag

SEQ ID NO: 575454 - DNA, 20 bp, Artificial
  CRISPR gRNA sequence
caggggccctctggtacagt

SEQ ID NO: 575455 - DNA, 20 bp, Artificial
  CRISPR gRNA sequence
ctggtacagtgggatgtacc

SEQ ID NO: 575456 - DNA, 20 bp, Artificial
  CRISPR gRNA sequence
gtacccagctaccgtgattc

SEQ ID NO: 575457 - DNA, 20 bp, Artificial
  CRISPR gRNA sequence
ccagctaccgtgattccagc

SEQ ID NO: 575458 - DNA, 20 bp, Artificial
  CRISPR gRNA sequence
cagctaccgtgattccagcc

SEQ ID NO: 575459 - DNA, 20 bp, Artificial
  CRISPR gRNA sequence
taccgtgattccagccaggt

SEQ ID NO: 575460 - DNA, 20 bp, Artificial
  CRISPR gRNA sequence
accgtgattccagccaggta

SEQ ID NO: 575461 - DNA, 20 bp, Artificial
  CRISPR gRNA sequence
taaggtctttaaaaaaataa

SEQ ID NO: 575462 - DNA, 20 bp, Artificial
  CRISPR gRNA sequence
taaaaaaataatagaataaa

SEQ ID NO: 575463 - DNA, 20 bp, Artificial
  CRISPR gRNA sequence
aaaaataatagaataaatgg

SEQ ID NO: 575464 - DNA, 20 bp, Artificial
  CRISPR gRNA sequence
aataatagaataaatggcag

SEQ ID NO: 575465 - DNA, 20 bp, Artificial
  CRISPR gRNA sequence
aataaatggcagaagactta

SEQ ID NO: 575466 - DNA, 20 bp, Artificial
  CRISPR gRNA sequence
ataaatggcagaagacttaa

SEQ ID NO: 575467 - DNA, 20 bp, Artificial
  CRISPR gRNA sequence
tggcagaagacttaaaggtg

SEQ ID NO: 575468 - DNA, 20 bp, Artificial
  CRISPR gRNA sequence
aaggtgaagtacttaatgca

SEQ ID NO: 575469 - DNA, 20 bp, Artificial
  CRISPR gRNA sequence
aggtgaagtacttaatgcat

SEQ ID NO: 575470 - DNA, 20 bp, Artificial
  CRISPR gRNA sequence
tgaagtacttaatgcatggg

SEQ ID NO: 575471 - DNA, 20 bp, Artificial
  CRISPR gRNA sequence
gaagtacttaatgcatgggc

SEQ ID NO: 575472 - DNA, 20 bp, Artificial
  CRISPR gRNA sequence
aagtacttaatgcatgggca

SEQ ID NO: 575473 - DNA, 20 bp, Artificial
  CRISPR gRNA sequence
agtacttaatgcatgggcag

SEQ ID NO: 575474 - DNA, 20 bp, Artificial
  CRISPR gRNA sequence
tgaattcatcaattgatacg

SEQ ID NO: 575475 - DNA, 20 bp, Artificial
  CRISPR gRNA sequence
ttcatcaattgatacgtaga

SEQ ID NO: 575476 - DNA, 20 bp, Artificial
  CRISPR gRNA sequence
tcaattgatacgtagatgga

SEQ ID NO: 575477 - DNA, 20 bp, Artificial
  CRISPR gRNA sequence
caattgatacgtagatggat

SEQ ID NO: 575478 - DNA, 20 bp, Artificial
  CRISPR gRNA sequence
ataggatttttaaaatatgt

SEQ ID NO: 575479 - DNA, 20 bp, Artificial
  CRISPR gRNA sequence
ttttaaaatatgtcagctgc

SEQ ID NO: 575480 - DNA, 20 bp, Artificial
  CRISPR gRNA sequence
atgtcagctgccagtcttta

SEQ ID NO: 575481 - DNA, 20 bp, Artificial
  CRISPR gRNA sequence
ctgccagtctttatggattt

SEQ ID NO: 575482 - DNA, 20 bp, Artificial
  CRISPR gRNA sequence
gccagtctttatggatttca

SEQ ID NO: 575483 - DNA, 20 bp, Artificial
  CRISPR gRNA sequence
gaacaacttgaaatgctgtc

SEQ ID NO: 575484 - DNA, 20 bp, Artificial
  CRISPR gRNA sequence
aacaacttgaaatgctgtcc

SEQ ID NO: 575485 - DNA, 20 bp, Artificial
  CRISPR gRNA sequence
tctctcatctctttgtctct

SEQ ID NO: 575486 - DNA, 20 bp, Artificial
  CRISPR gRNA sequence
catctgtctgtcgctacact

SEQ ID NO: 575487 - DNA, 20 bp, Artificial
  CRISPR gRNA sequence
ctctttccccgcatctctcc

SEQ ID NO: 575488 - DNA, 20 bp, Artificial
  CRISPR gRNA sequence
ccttcccccacctgccttcc

SEQ ID NO: 575489 - DNA, 20 bp, Artificial
  CRISPR gRNA sequence
cccccacctgccttcccagc

SEQ ID NO: 575490 - DNA, 20 bp, Artificial
  CRISPR gRNA sequence
ctgccttcccagccagcatc

SEQ ID NO: 575491 - DNA, 20 bp, Artificial
  CRISPR gRNA sequence
ttcccagccagcatccagcc

SEQ ID NO: 575492 - DNA, 20 bp, Artificial
  CRISPR gRNA sequence
cccagccagcatccagccta

SEQ ID NO: 575493 - DNA, 20 bp, Artificial
  CRISPR gRNA sequence
ccagcctagagctttgtaca

SEQ ID NO: 575494 - DNA, 20 bp, Artificial
  CRISPR gRNA sequence
cctagagctttgtacacagc

SEQ ID NO: 575495 - DNA, 20 bp, Artificial
  CRISPR gRNA sequence
acacagctggcgtttaataa

SEQ ID NO: 575496 - DNA, 20 bp, Artificial
  CRISPR gRNA sequence
ttaataatagtaatgtcgcc

SEQ ID NO: 575497 - DNA, 20 bp, Artificial
  CRISPR gRNA sequence
taataatagtaatgtcgccg

SEQ ID NO: 575498 - DNA, 20 bp, Artificial
  CRISPR gRNA sequence
cgaggacctttacattttat

SEQ ID NO: 575499 - DNA, 20 bp, Artificial
  CRISPR gRNA sequence
aggacctttacattttatga

SEQ ID NO: 575500 - DNA, 20 bp, Artificial
  CRISPR gRNA sequence
cctttacattttatgagagt

SEQ ID NO: 575501 - DNA, 20 bp, Artificial
  CRISPR gRNA sequence
cattttatgagagtgagcat

SEQ ID NO: 575502 - DNA, 20 bp, Artificial
  CRISPR gRNA sequence
agcatcagttctgttcaccc

SEQ ID NO: 575503 - DNA, 20 bp, Artificial
  CRISPR gRNA sequence
atcagttctgttcaccctag

SEQ ID NO: 575504 - DNA, 20 bp, Artificial
  CRISPR gRNA sequence
agttctgttcaccctagtag

SEQ ID NO: 575505 - DNA, 20 bp, Artificial
  CRISPR gRNA sequence
gttctgttcaccctagtagc

SEQ ID NO: 575506 - DNA, 20 bp, Artificial
  CRISPR gRNA sequence
tctgttcaccctagtagcag

SEQ ID NO: 575507 - DNA, 20 bp, Artificial
  CRISPR gRNA sequence
ctgttcaccctagtagcagg

SEQ ID NO: 575508 - DNA, 20 bp, Artificial
  CRISPR gRNA sequence
cctagtagcaggaggattgc

SEQ ID NO: 575509 - DNA, 20 bp, Artificial
  CRISPR gRNA sequence
ctagtagcaggaggattgca

SEQ ID NO: 575510 - DNA, 20 bp, Artificial
  CRISPR gRNA sequence
gcaggaggattgcaaggtgc

SEQ ID NO: 575511 - DNA, 20 bp, Artificial
  CRISPR gRNA sequence
caggaggattgcaaggtgcc

SEQ ID NO: 575512 - DNA, 20 bp, Artificial
  CRISPR gRNA sequence
aggaggattgcaaggtgccg

SEQ ID NO: 575513 - DNA, 20 bp, Artificial
  CRISPR gRNA sequence
ggattgcaaggtgccggggc

SEQ ID NO: 575514 - DNA, 20 bp, Artificial
  CRISPR gRNA sequence
gcaaggtgccggggcaagct

SEQ ID NO: 575515 - DNA, 20 bp, Artificial
  CRISPR gRNA sequence
gaactttgcttgtatcgctt

SEQ ID NO: 575516 - DNA, 20 bp, Artificial
  CRISPR gRNA sequence
actttgcttgtatcgcttta

SEQ ID NO: 575517 - DNA, 20 bp, Artificial
  CRISPR gRNA sequence
ctttgcttgtatcgctttag

SEQ ID NO: 575518 - DNA, 20 bp, Artificial
  CRISPR gRNA sequence
ttgcttgtatcgctttagag

SEQ ID NO: 575519 - DNA, 20 bp, Artificial
  CRISPR gRNA sequence
atcgctttagaggagaccct

SEQ ID NO: 575520 - DNA, 20 bp, Artificial
  CRISPR gRNA sequence
tcgctttagaggagaccctt

SEQ ID NO: 575521 - DNA, 20 bp, Artificial
  CRISPR gRNA sequence
cgctttagaggagacccttg

SEQ ID NO: 575522 - DNA, 20 bp, Artificial
  CRISPR gRNA sequence
tttagaggagacccttgggg

SEQ ID NO: 575523 - DNA, 20 bp, Artificial
  CRISPR gRNA sequence
ttagaggagacccttggggc

SEQ ID NO: 575524 - DNA, 20 bp, Artificial
  CRISPR gRNA sequence
tagaggagacccttggggcg

SEQ ID NO: 575525 - DNA, 20 bp, Artificial
  CRISPR gRNA sequence
agaggagacccttggggcgg

SEQ ID NO: 575526 - DNA, 20 bp, Artificial
  CRISPR gRNA sequence
gaggagacccttggggcggg

SEQ ID NO: 575527 - DNA, 20 bp, Artificial
  CRISPR gRNA sequence
aggagacccttggggcgggg

SEQ ID NO: 575528 - DNA, 20 bp, Artificial
  CRISPR gRNA sequence
agacccttggggcggggggg

SEQ ID NO: 575529 - DNA, 20 bp, Artificial
  CRISPR gRNA sequence
gacccttggggcgggggggc

SEQ ID NO: 575530 - DNA, 20 bp, Artificial
  CRISPR gRNA sequence
acccttggggcgggggggca

SEQ ID NO: 575531 - DNA, 20 bp, Artificial
  CRISPR gRNA sequence
ccttggggcgggggggcagg

SEQ ID NO: 575532 - DNA, 20 bp, Artificial
  CRISPR gRNA sequence
cttcacaccattgtcaaccg

SEQ ID NO: 575533 - DNA, 20 bp, Artificial
  CRISPR gRNA sequence
caccattgtcaaccgtagtt

SEQ ID NO: 575534 - DNA, 20 bp, Artificial
  CRISPR gRNA sequence
tcaaccgtagtttagctgtg

SEQ ID NO: 575535 - DNA, 20 bp, Artificial
  CRISPR gRNA sequence
ttagctgtgtggacctaccc

SEQ ID NO: 575536 - DNA, 20 bp, Artificial
  CRISPR gRNA sequence
tagctgtgtggacctacccc

SEQ ID NO: 575537 - DNA, 20 bp, Artificial
  CRISPR gRNA sequence
caggactgcatgtgtgtgac

SEQ ID NO: 575538 - DNA, 20 bp, Artificial
  CRISPR gRNA sequence
ggactgcatgtgtgtgacca

SEQ ID NO: 575539 - DNA, 20 bp, Artificial
  CRISPR gRNA sequence
gtgtgaccagagtccatatt

SEQ ID NO: 575540 - DNA, 20 bp, Artificial
  CRISPR gRNA sequence
tgtgaccagagtccatattc

SEQ ID NO: 575541 - DNA, 20 bp, Artificial
  CRISPR gRNA sequence
gaccagagtccatattcagg

SEQ ID NO: 575542 - DNA, 20 bp, Artificial
  CRISPR gRNA sequence
gtccatattcaggaagcaaa

SEQ ID NO: 575543 - DNA, 20 bp, Artificial
  CRISPR gRNA sequence
tccatattcaggaagcaaac

SEQ ID NO: 575544 - DNA, 20 bp, Artificial
  CRISPR gRNA sequence
caggaagcaaacaggttgtt

SEQ ID NO: 575545 - DNA, 20 bp, Artificial
  CRISPR gRNA sequence
aggaagcaaacaggttgttc

SEQ ID NO: 575546 - DNA, 20 bp, Artificial
  CRISPR gRNA sequence
ggaagcaaacaggttgttca

SEQ ID NO: 575547 - DNA, 20 bp, Artificial
  CRISPR gRNA sequence
gcaaacaggttgttcagggc

SEQ ID NO: 575548 - DNA, 20 bp, Artificial
  CRISPR gRNA sequence
caaacaggttgttcagggct

SEQ ID NO: 575549 - DNA, 20 bp, Artificial
  CRISPR gRNA sequence
aaacaggttgttcagggctg

SEQ ID NO: 575550 - DNA, 20 bp, Artificial
  CRISPR gRNA sequence
aggttgttcagggctggggt

SEQ ID NO: 575551 - DNA, 20 bp, Artificial
  CRISPR gRNA sequence
ctggggtgagctcgattctg

SEQ ID NO: 575552 - DNA, 20 bp, Artificial
  CRISPR gRNA sequence
tggggtgagctcgattctgc

SEQ ID NO: 575553 - DNA, 20 bp, Artificial
  CRISPR gRNA sequence
tgagctcgattctgcaggct

SEQ ID NO: 575554 - DNA, 20 bp, Artificial
  CRISPR gRNA sequence
tcgattctgcaggcttagca

SEQ ID NO: 575555 - DNA, 20 bp, Artificial
  CRISPR gRNA sequence
tgcaggcttagcacagcgtt

SEQ ID NO: 575556 - DNA, 20 bp, Artificial
  CRISPR gRNA sequence
ttagcacagcgtttggcaca

SEQ ID NO: 575557 - DNA, 20 bp, Artificial
  CRISPR gRNA sequence
cacagcgtttggcacaaagt

SEQ ID NO: 575558 - DNA, 20 bp, Artificial
  CRISPR gRNA sequence
gcacaaagtaagtgctcacg

SEQ ID NO: 575559 - DNA, 20 bp, Artificial
  CRISPR gRNA sequence
agtaagtgctcacgaagtgt

SEQ ID NO: 575560 - DNA, 20 bp, Artificial
  CRISPR gRNA sequence
gctcacgaagtgttagctat

SEQ ID NO: 575561 - DNA, 20 bp, Artificial
  CRISPR gRNA sequence
tagtatttctgtaaccaaat

SEQ ID NO: 575562 - DNA, 20 bp, Artificial
  CRISPR gRNA sequence
attagaatcatgctatatat

SEQ ID NO: 575563 - DNA, 20 bp, Artificial
  CRISPR gRNA sequence
ttcctgctttattcaattaa

SEQ ID NO: 575564 - DNA, 20 bp, Artificial
  CRISPR gRNA sequence
ctgctttattcaattaacag

SEQ ID NO: 575565 - DNA, 20 bp, Artificial
  CRISPR gRNA sequence
aattaacagtagtgtttttg

SEQ ID NO: 575566 - DNA, 20 bp, Artificial
  CRISPR gRNA sequence
gaacacatgatctttcatga

SEQ ID NO: 575567 - DNA, 20 bp, Artificial
  CRISPR gRNA sequence
catgatctttcatgatggac

SEQ ID NO: 575568 - DNA, 20 bp, Artificial
  CRISPR gRNA sequence
ggacaagactgtcctcacat

SEQ ID NO: 575569 - DNA, 20 bp, Artificial
  CRISPR gRNA sequence
gaactttgattgatttgacc

SEQ ID NO: 575570 - DNA, 20 bp, Artificial
  CRISPR gRNA sequence
tttgaccaagtgccgattgt

SEQ ID NO: 575571 - DNA, 20 bp, Artificial
  CRISPR gRNA sequence
gtgccgattgttggacattc

SEQ ID NO: 575572 - DNA, 20 bp, Artificial
  CRISPR gRNA sequence
aacatccctgactgcttcct

SEQ ID NO: 575573 - DNA, 20 bp, Artificial
  CRISPR gRNA sequence
tgcttccttggattcctgaa

SEQ ID NO: 575574 - DNA, 20 bp, Artificial
  CRISPR gRNA sequence
gcttccttggattcctgaaa

SEQ ID NO: 575575 - DNA, 20 bp, Artificial
  CRISPR gRNA sequence
cttccttggattcctgaaaa

SEQ ID NO: 575576 - DNA, 20 bp, Artificial
  CRISPR gRNA sequence
tccttggattcctgaaaagg

SEQ ID NO: 575577 - DNA, 20 bp, Artificial
  CRISPR gRNA sequence
attcctgaaaagggagttgc

SEQ ID NO: 575578 - DNA, 20 bp, Artificial
  CRISPR gRNA sequence
ttcctgaaaagggagttgct

SEQ ID NO: 575579 - DNA, 20 bp, Artificial
  CRISPR gRNA sequence
tcctgaaaagggagttgctg

SEQ ID NO: 575580 - DNA, 20 bp, Artificial
  CRISPR gRNA sequence
aaaagggagttgctggggca

SEQ ID NO: 575581 - DNA, 20 bp, Artificial
  CRISPR gRNA sequence
aaagggagttgctggggcaa

SEQ ID NO: 575582 - DNA, 20 bp, Artificial
  CRISPR gRNA sequence
aagggagttgctggggcaaa

SEQ ID NO: 575583 - DNA, 20 bp, Artificial
  CRISPR gRNA sequence
agggagttgctggggcaaag

SEQ ID NO: 575584 - DNA, 20 bp, Artificial
  CRISPR gRNA sequence
gggagttgctggggcaaagg

SEQ ID NO: 575585 - DNA, 20 bp, Artificial
  CRISPR gRNA sequence
aaagggggcgtgcattttta

SEQ ID NO: 575586 - DNA, 20 bp, Artificial
  CRISPR gRNA sequence
tctgctaattctccttccaa

SEQ ID NO: 575587 - DNA, 20 bp, Artificial
  CRISPR gRNA sequence
ctgctaattctccttccaaa

SEQ ID NO: 575588 - DNA, 20 bp, Artificial
  CRISPR gRNA sequence
attttatgctccctctactt

SEQ ID NO: 575589 - DNA, 20 bp, Artificial
  CRISPR gRNA sequence
ccctctacttaagctaaccc

SEQ ID NO: 575590 - DNA, 20 bp, Artificial
  CRISPR gRNA sequence
cctctacttaagctaaccct

SEQ ID NO: 575591 - DNA, 20 bp, Artificial
  CRISPR gRNA sequence
tacttaagctaaccctaggt

SEQ ID NO: 575592 - DNA, 20 bp, Artificial
  CRISPR gRNA sequence
ttaattatttcccaacatga

SEQ ID NO: 575593 - DNA, 20 bp, Artificial
  CRISPR gRNA sequence
taattatttcccaacatgac

SEQ ID NO: 575594 - DNA, 20 bp, Artificial
  CRISPR gRNA sequence
tatttcccaacatgacaggt

SEQ ID NO: 575595 - DNA, 20 bp, Artificial
  CRISPR gRNA sequence
tgattacttttactattcat

SEQ ID NO: 575596 - DNA, 20 bp, Artificial
  CRISPR gRNA sequence
tgcttttttttttttttttt

SEQ ID NO: 575597 - DNA, 20 bp, Artificial
  CRISPR gRNA sequence
tttttttttttttggttgtc

SEQ ID NO: 575598 - DNA, 20 bp, Artificial
  CRISPR gRNA sequence
ggtcatgtccttactcctaa

SEQ ID NO: 575599 - DNA, 20 bp, Artificial
  CRISPR gRNA sequence
gtcatgtccttactcctaat

SEQ ID NO: 575600 - DNA, 20 bp, Artificial
  CRISPR gRNA sequence
tcatgtccttactcctaata

SEQ ID NO: 575601 - DNA, 20 bp, Artificial
  CRISPR gRNA sequence
tttcccttattgatttgcca

SEQ ID NO: 575602 - DNA, 20 bp, Artificial
  CRISPR gRNA sequence
atttgccacagctctttatt

SEQ ID NO: 575603 - DNA, 20 bp, Artificial
  CRISPR gRNA sequence
ccacagctctttatttggaa

SEQ ID NO: 575604 - DNA, 20 bp, Artificial
  CRISPR gRNA sequence
aatggttattaacctttcat

SEQ ID NO: 575605 - DNA, 20 bp, Artificial
  CRISPR gRNA sequence
ttcatcagccattacatata

SEQ ID NO: 575606 - DNA, 20 bp, Artificial
  CRISPR gRNA sequence
gctttttttctatttgttta

SEQ ID NO: 575607 - DNA, 20 bp, Artificial
  CRISPR gRNA sequence
gttttttgtgatgcttatga

SEQ ID NO: 575608 - DNA, 20 bp, Artificial
  CRISPR gRNA sequence
atgcttatgatggttttata

SEQ ID NO: 575609 - DNA, 20 bp, Artificial
  CRISPR gRNA sequence
gatggttttatacagtcaaa

SEQ ID NO: 575610 - DNA, 20 bp, Artificial
  CRISPR gRNA sequence
atggttttatacagtcaaat

SEQ ID NO: 575611 - DNA, 20 bp, Artificial
  CRISPR gRNA sequence
ttttatacagtcaaataggt

SEQ ID NO: 575612 - DNA, 20 bp, Artificial
  CRISPR gRNA sequence
taggttagtctttttttctg

SEQ ID NO: 575613 - DNA, 20 bp, Artificial
  CRISPR gRNA sequence
ttttctgtggcttctgtctc

SEQ ID NO: 575614 - DNA, 20 bp, Artificial
  CRISPR gRNA sequence
tctgtctctggttttgtgct

SEQ ID NO: 575615 - DNA, 20 bp, Artificial
  CRISPR gRNA sequence
tctctggttttgtgcttaga

SEQ ID NO: 575616 - DNA, 20 bp, Artificial
  CRISPR gRNA sequence
gtcctttcctacttgaaaat

SEQ ID NO: 575617 - DNA, 20 bp, Artificial
  CRISPR gRNA sequence
agataaatgttcacctatgt

SEQ ID NO: 575618 - DNA, 20 bp, Artificial
  CRISPR gRNA sequence
tgttcacctatgttggcttc

SEQ ID NO: 575619 - DNA, 20 bp, Artificial
  CRISPR gRNA sequence
ttggcttctagtctctttta

SEQ ID NO: 575620 - DNA, 20 bp, Artificial
  CRISPR gRNA sequence
ttcattttttccatttacta

SEQ ID NO: 575621 - DNA, 20 bp, Artificial
  CRISPR gRNA sequence
cattttttccatttactata

SEQ ID NO: 575622 - DNA, 20 bp, Artificial
  CRISPR gRNA sequence
attttttccatttactatag

SEQ ID NO: 575623 - DNA, 20 bp, Artificial
  CRISPR gRNA sequence
ttccatttactatagaggtt

SEQ ID NO: 575624 - DNA, 20 bp, Artificial
  CRISPR gRNA sequence
ccatttactatagaggttaa

SEQ ID NO: 575625 - DNA, 20 bp, Artificial
  CRISPR gRNA sequence
tactatagaggttaagagtg

SEQ ID NO: 575626 - DNA, 20 bp, Artificial
  CRISPR gRNA sequence
actatagaggttaagagtgt

SEQ ID NO: 575627 - DNA, 20 bp, Artificial
  CRISPR gRNA sequence
gaggttaagagtgtgggtac

SEQ ID NO: 575628 - DNA, 20 bp, Artificial
  CRISPR gRNA sequence
ggttaagagtgtgggtactg

SEQ ID NO: 575629 - DNA, 20 bp, Artificial
  CRISPR gRNA sequence
aagagtgtgggtactggagc

SEQ ID NO: 575630 - DNA, 20 bp, Artificial
  CRISPR gRNA sequence
ggtactggagccagactgtc

SEQ ID NO: 575631 - DNA, 20 bp, Artificial
  CRISPR gRNA sequence
gtactggagccagactgtct

SEQ ID NO: 575632 - DNA, 20 bp, Artificial
  CRISPR gRNA sequence
cagactgtctgggacaaacc

SEQ ID NO: 575633 - DNA, 20 bp, Artificial
  CRISPR gRNA sequence
gacaaacccagcgtcacccc

SEQ ID NO: 575634 - DNA, 20 bp, Artificial
  CRISPR gRNA sequence
caagccctatgtgtgatttt

SEQ ID NO: 575635 - DNA, 20 bp, Artificial
  CRISPR gRNA sequence
ccctatgtgtgatttttagc

SEQ ID NO: 575636 - DNA, 20 bp, Artificial
  CRISPR gRNA sequence
cctatgtgtgatttttagcc

SEQ ID NO: 575637 - DNA, 20 bp, Artificial
  CRISPR gRNA sequence
tttcctcatatgtactgcaa

SEQ ID NO: 575638 - DNA, 20 bp, Artificial
  CRISPR gRNA sequence
atgtactgcaatggttataa

SEQ ID NO: 575639 - DNA, 20 bp, Artificial
  CRISPR gRNA sequence
ggttataatagtaccttcct

SEQ ID NO: 575640 - DNA, 20 bp, Artificial
  CRISPR gRNA sequence
gttataatagtaccttcctc

SEQ ID NO: 575641 - DNA, 20 bp, Artificial
  CRISPR gRNA sequence
tataatagtaccttcctcag

SEQ ID NO: 575642 - DNA, 20 bp, Artificial
  CRISPR gRNA sequence
cttcctcaggagtctttgtt

SEQ ID NO: 575643 - DNA, 20 bp, Artificial
  CRISPR gRNA sequence
tagattaaaatttttaacca

SEQ ID NO: 575644 - DNA, 20 bp, Artificial
  CRISPR gRNA sequence
ttttaaccacagtaaatact

SEQ ID NO: 575645 - DNA, 20 bp, Artificial
  CRISPR gRNA sequence
ccacagtaaatacttagcac

SEQ ID NO: 575646 - DNA, 20 bp, Artificial
  CRISPR gRNA sequence
cacagtaaatacttagcaca

SEQ ID NO: 575647 - DNA, 20 bp, Artificial
  CRISPR gRNA sequence
gcctgacacacaataaaccc

SEQ ID NO: 575648 - DNA, 20 bp, Artificial
  CRISPR gRNA sequence
acacacaataaacccaagat

SEQ ID NO: 575649 - DNA, 20 bp, Artificial
  CRISPR gRNA sequence
aataaacccaagatcagcat

SEQ ID NO: 575650 - DNA, 20 bp, Artificial
  CRISPR gRNA sequence
ataaacccaagatcagcatt

SEQ ID NO: 575651 - DNA, 20 bp, Artificial
  CRISPR gRNA sequence
gttaaaacttatatcttgaa

SEQ ID NO: 575652 - DNA, 20 bp, Artificial
  CRISPR gRNA sequence
acttatatcttgaatggatc

SEQ ID NO: 575653 - DNA, 20 bp, Artificial
  CRISPR gRNA sequence
cttatatcttgaatggatct

SEQ ID NO: 575654 - DNA, 20 bp, Artificial
  CRISPR gRNA sequence
ttgaatggatctgggcattt

SEQ ID NO: 575655 - DNA, 20 bp, Artificial
  CRISPR gRNA sequence
tgaatggatctgggcatttt

SEQ ID NO: 575656 - DNA, 20 bp, Artificial
  CRISPR gRNA sequence
gaatggatctgggcatttta

SEQ ID NO: 575657 - DNA, 20 bp, Artificial
  CRISPR gRNA sequence
cattttagggtatatgatga

SEQ ID NO: 575658 - DNA, 20 bp, Artificial
  CRISPR gRNA sequence
atgatggtgacatttcaaac

SEQ ID NO: 575659 - DNA, 20 bp, Artificial
  CRISPR gRNA sequence
tgatggtgacatttcaaact

SEQ ID NO: 575660 - DNA, 20 bp, Artificial
  CRISPR gRNA sequence
tggtgacatttcaaactggg

SEQ ID NO: 575661 - DNA, 20 bp, Artificial
  CRISPR gRNA sequence
ggtgacatttcaaactgggc

SEQ ID NO: 575662 - DNA, 20 bp, Artificial
  CRISPR gRNA sequence
gtgacatttcaaactgggca

SEQ ID NO: 575663 - DNA, 20 bp, Artificial
  CRISPR gRNA sequence
gacatttcaaactgggcagg

SEQ ID NO: 575664 - DNA, 20 bp, Artificial
  CRISPR gRNA sequence
acatttcaaactgggcaggg

SEQ ID NO: 575665 - DNA, 20 bp, Artificial
  CRISPR gRNA sequence
catttcaaactgggcaggga

SEQ ID NO: 575666 - DNA, 20 bp, Artificial
  CRISPR gRNA sequence
atttcaaactgggcagggag

SEQ ID NO: 575667 - DNA, 20 bp, Artificial
  CRISPR gRNA sequence
actgggcagggaggggttgt

SEQ ID NO: 575668 - DNA, 20 bp, Artificial
  CRISPR gRNA sequence
ctgggcagggaggggttgtt

SEQ ID NO: 575669 - DNA, 20 bp, Artificial
  CRISPR gRNA sequence
gggaggggttgttgggataa

SEQ ID NO: 575670 - DNA, 20 bp, Artificial
  CRISPR gRNA sequence
tatcttctccctaattatct

SEQ ID NO: 575671 - DNA, 20 bp, Artificial
  CRISPR gRNA sequence
atttgttaaaccatactcca

SEQ ID NO: 575672 - DNA, 20 bp, Artificial
  CRISPR gRNA sequence
aaccatactccatggtcctc

SEQ ID NO: 575673 - DNA, 20 bp, Artificial
  CRISPR gRNA sequence
tgccacattcatcacaaatt

SEQ ID NO: 575674 - DNA, 20 bp, Artificial
  CRISPR gRNA sequence
aattcagttctctccatatg

SEQ ID NO: 575675 - DNA, 20 bp, Artificial
  CRISPR gRNA sequence
attcagttctctccatatgt

SEQ ID NO: 575676 - DNA, 20 bp, Artificial
  CRISPR gRNA sequence
ccatatgtgggtccatgtcc

SEQ ID NO: 575677 - DNA, 20 bp, Artificial
  CRISPR gRNA sequence
ttctattctgttctcttccc

SEQ ID NO: 575678 - DNA, 20 bp, Artificial
  CRISPR gRNA sequence
cccagtatctgttcttatac

SEQ ID NO: 575679 - DNA, 20 bp, Artificial
  CRISPR gRNA sequence
ccagtatctgttcttatacc

SEQ ID NO: 575680 - DNA, 20 bp, Artificial
  CRISPR gRNA sequence
cagtatctgttcttatacca

SEQ ID NO: 575681 - DNA, 20 bp, Artificial
  CRISPR gRNA sequence
ttgcaatacaattcaatacc

SEQ ID NO: 575682 - DNA, 20 bp, Artificial
  CRISPR gRNA sequence
tacaattcaatacccagcca

SEQ ID NO: 575683 - DNA, 20 bp, Artificial
  CRISPR gRNA sequence
acaattcaatacccagccat

SEQ ID NO: 575684 - DNA, 20 bp, Artificial
  CRISPR gRNA sequence
tacccagccatgggtgtccc

SEQ ID NO: 575685 - DNA, 20 bp, Artificial
  CRISPR gRNA sequence
ttctttattcttgattattt

SEQ ID NO: 575686 - DNA, 20 bp, Artificial
  CRISPR gRNA sequence
tctttattcttgattatttc

SEQ ID NO: 575687 - DNA, 20 bp, Artificial
  CRISPR gRNA sequence
ttattcttgattatttcagg

SEQ ID NO: 575688 - DNA, 20 bp, Artificial
  CRISPR gRNA sequence
ttgattatttcaggcagcat

SEQ ID NO: 575689 - DNA, 20 bp, Artificial
  CRISPR gRNA sequence
tcaggcagcatcagttgaac

SEQ ID NO: 575690 - DNA, 20 bp, Artificial
  CRISPR gRNA sequence
gcagcatcagttgaaccagc

SEQ ID NO: 575691 - DNA, 20 bp, Artificial
  CRISPR gRNA sequence
agcatcagttgaaccagcca

SEQ ID NO: 575692 - DNA, 20 bp, Artificial
  CRISPR gRNA sequence
cagttgaaccagccagagac

SEQ ID NO: 575693 - DNA, 20 bp, Artificial
  CRISPR gRNA sequence
accagcaaatgttcttattt

SEQ ID NO: 575694 - DNA, 20 bp, Artificial
  CRISPR gRNA sequence
ccagcaaatgttcttatttg

SEQ ID NO: 575695 - DNA, 20 bp, Artificial
  CRISPR gRNA sequence
cctctcgcacacatgcactc

SEQ ID NO: 575696 - DNA, 20 bp, Artificial
  CRISPR gRNA sequence
ctctatgtatccctatctct

SEQ ID NO: 575697 - DNA, 20 bp, Artificial
  CRISPR gRNA sequence
atgtatccctatctctcagc

SEQ ID NO: 575698 - DNA, 20 bp, Artificial
  CRISPR gRNA sequence
ctatctctcagccagtcccc

SEQ ID NO: 575699 - DNA, 20 bp, Artificial
  CRISPR gRNA sequence
ctctcagccagtcccctgga

SEQ ID NO: 575700 - DNA, 20 bp, Artificial
  CRISPR gRNA sequence
ctcagccagtcccctggata

SEQ ID NO: 575701 - DNA, 20 bp, Artificial
  CRISPR gRNA sequence
tcagccagtcccctggatag

SEQ ID NO: 575702 - DNA, 20 bp, Artificial
  CRISPR gRNA sequence
cagccagtcccctggataga

SEQ ID NO: 575703 - DNA, 20 bp, Artificial
  CRISPR gRNA sequence
agccagtcccctggatagag

SEQ ID NO: 575704 - DNA, 20 bp, Artificial
  CRISPR gRNA sequence
gaggggcaattgtcaacttg

SEQ ID NO: 575705 - DNA, 20 bp, Artificial
  CRISPR gRNA sequence
attgtcaacttgaagccctg

SEQ ID NO: 575706 - DNA, 20 bp, Artificial
  CRISPR gRNA sequence
cagacacctaatgacttaac

SEQ ID NO: 575707 - DNA, 20 bp, Artificial
  CRISPR gRNA sequence
cacctaatgacttaaccaga

SEQ ID NO: 575708 - DNA, 20 bp, Artificial
  CRISPR gRNA sequence
aatgacttaaccagacagcg

SEQ ID NO: 575709 - DNA, 20 bp, Artificial
  CRISPR gRNA sequence
gacttaaccagacagcgtag

SEQ ID NO: 575710 - DNA, 20 bp, Artificial
  CRISPR gRNA sequence
acttaaccagacagcgtaga

SEQ ID NO: 575711 - DNA, 20 bp, Artificial
  CRISPR gRNA sequence
cttaaccagacagcgtagaa

SEQ ID NO: 575712 - DNA, 20 bp, Artificial
  CRISPR gRNA sequence
cagacagcgtagaagggccc

SEQ ID NO: 575713 - DNA, 20 bp, Artificial
  CRISPR gRNA sequence
actccacgcctctccgtgct

SEQ ID NO: 575714 - DNA, 20 bp, Artificial
  CRISPR gRNA sequence
acgcctctccgtgctcagtg

SEQ ID NO: 575715 - DNA, 20 bp, Artificial
  CRISPR gRNA sequence
cctctccgtgctcagtgtag

SEQ ID NO: 575716 - DNA, 20 bp, Artificial
  CRISPR gRNA sequence
ctctccgtgctcagtgtaga

SEQ ID NO: 575717 - DNA, 20 bp, Artificial
  CRISPR gRNA sequence
tctccgtgctcagtgtagaa

SEQ ID NO: 575718 - DNA, 20 bp, Artificial
  CRISPR gRNA sequence
cagtgtagaagggcaaattg

SEQ ID NO: 575719 - DNA, 20 bp, Artificial
  CRISPR gRNA sequence
tagaagggcaaattgaagac

SEQ ID NO: 575720 - DNA, 20 bp, Artificial
  CRISPR gRNA sequence
gaagggcaaattgaagacca

SEQ ID NO: 575721 - DNA, 20 bp, Artificial
  CRISPR gRNA sequence
aaattgaagaccagagatct

SEQ ID NO: 575722 - DNA, 20 bp, Artificial
  CRISPR gRNA sequence
aattgaagaccagagatctc

SEQ ID NO: 575723 - DNA, 20 bp, Artificial
  CRISPR gRNA sequence
attgaagaccagagatctca

SEQ ID NO: 575724 - DNA, 20 bp, Artificial
  CRISPR gRNA sequence
ctcagggcctcaccgaaatg

SEQ ID NO: 575725 - DNA, 20 bp, Artificial
  CRISPR gRNA sequence
agggcctcaccgaaatgcag

SEQ ID NO: 575726 - DNA, 20 bp, Artificial
  CRISPR gRNA sequence
gcctcaccgaaatgcagcgg

SEQ ID NO: 575727 - DNA, 20 bp, Artificial
  CRISPR gRNA sequence
ctcaccgaaatgcagcggca

SEQ ID NO: 575728 - DNA, 20 bp, Artificial
  CRISPR gRNA sequence
cagcggcagagttgaaatcc

SEQ ID NO: 575729 - DNA, 20 bp, Artificial
  CRISPR gRNA sequence
gcagagttgaaatccaagcc

SEQ ID NO: 575730 - DNA, 20 bp, Artificial
  CRISPR gRNA sequence
tgaaatccaagcctagatct

SEQ ID NO: 575731 - DNA, 20 bp, Artificial
  CRISPR gRNA sequence
gaaatccaagcctagatctc

SEQ ID NO: 575732 - DNA, 20 bp, Artificial
  CRISPR gRNA sequence
aagcctagatctcaggactc

SEQ ID NO: 575733 - DNA, 20 bp, Artificial
  CRISPR gRNA sequence
agcctagatctcaggactct

SEQ ID NO: 575734 - DNA, 20 bp, Artificial
  CRISPR gRNA sequence
ctagatctcaggactctagg

SEQ ID NO: 575735 - DNA, 20 bp, Artificial
  CRISPR gRNA sequence
tagatctcaggactctaggt

SEQ ID NO: 575736 - DNA, 20 bp, Artificial
  CRISPR gRNA sequence
caggactctaggtgggaccc

SEQ ID NO: 575737 - DNA, 20 bp, Artificial
  CRISPR gRNA sequence
tctaggtgggaccctggttc

SEQ ID NO: 575738 - DNA, 20 bp, Artificial
  CRISPR gRNA sequence
tctggctctctccccaactg

SEQ ID NO: 575739 - DNA, 20 bp, Artificial
  CRISPR gRNA sequence
ctggctctctccccaactgc

SEQ ID NO: 575740 - DNA, 20 bp, Artificial
  CRISPR gRNA sequence
ctctccccaactgcaggcct

SEQ ID NO: 575741 - DNA, 20 bp, Artificial
  CRISPR gRNA sequence
gcaggcctcagtttacccct

SEQ ID NO: 575742 - DNA, 20 bp, Artificial
  CRISPR gRNA sequence
tcagtttacccctcagcacc

SEQ ID NO: 575743 - DNA, 20 bp, Artificial
  CRISPR gRNA sequence
gtttacccctcagcacccag

SEQ ID NO: 575744 - DNA, 20 bp, Artificial
  CRISPR gRNA sequence
tttacccctcagcacccaga

SEQ ID NO: 575745 - DNA, 20 bp, Artificial
  CRISPR gRNA sequence
ttacccctcagcacccagaa

SEQ ID NO: 575746 - DNA, 20 bp, Artificial
  CRISPR gRNA sequence
tacccctcagcacccagaag

SEQ ID NO: 575747 - DNA, 20 bp, Artificial
  CRISPR gRNA sequence
acccctcagcacccagaagg

SEQ ID NO: 575748 - DNA, 20 bp, Artificial
  CRISPR gRNA sequence
cctcagcacccagaaggggg

SEQ ID NO: 575749 - DNA, 20 bp, Artificial
  CRISPR gRNA sequence
ctcagcacccagaaggggga

SEQ ID NO: 575750 - DNA, 20 bp, Artificial
  CRISPR gRNA sequence
tcagcacccagaagggggaa

SEQ ID NO: 575751 - DNA, 20 bp, Artificial
  CRISPR gRNA sequence
cagcacccagaagggggaag

SEQ ID NO: 575752 - DNA, 20 bp, Artificial
  CRISPR gRNA sequence
cagaagggggaaggggaacc

SEQ ID NO: 575753 - DNA, 20 bp, Artificial
  CRISPR gRNA sequence
agaagggggaaggggaacct

SEQ ID NO: 575754 - DNA, 20 bp, Artificial
  CRISPR gRNA sequence
ccttctgccttctcacacgt

SEQ ID NO: 575755 - DNA, 20 bp, Artificial
  CRISPR gRNA sequence
cgttggaccccaacttccca

SEQ ID NO: 575756 - DNA, 20 bp, Artificial
  CRISPR gRNA sequence
gttggaccccaacttcccac

SEQ ID NO: 575757 - DNA, 20 bp, Artificial
  CRISPR gRNA sequence
gaccccaacttcccacaggt

SEQ ID NO: 575758 - DNA, 20 bp, Artificial
  CRISPR gRNA sequence
ggttggacgatccacgatca

SEQ ID NO: 575759 - DNA, 20 bp, Artificial
  CRISPR gRNA sequence
gacgatccacgatcacagtg

SEQ ID NO: 575760 - DNA, 20 bp, Artificial
  CRISPR gRNA sequence
acgatccacgatcacagtgt

SEQ ID NO: 575761 - DNA, 20 bp, Artificial
  CRISPR gRNA sequence
cgatccacgatcacagtgtg

SEQ ID NO: 575762 - DNA, 20 bp, Artificial
  CRISPR gRNA sequence
cacgatcacagtgtggggcc

SEQ ID NO: 575763 - DNA, 20 bp, Artificial
  CRISPR gRNA sequence
agtgtggggcccagcctcac

SEQ ID NO: 575764 - DNA, 20 bp, Artificial
  CRISPR gRNA sequence
tgtggggcccagcctcacaa

SEQ ID NO: 575765 - DNA, 20 bp, Artificial
  CRISPR gRNA sequence
gggcccagcctcacaagagc

SEQ ID NO: 575766 - DNA, 20 bp, Artificial
  CRISPR gRNA sequence
ggcccagcctcacaagagct

SEQ ID NO: 575767 - DNA, 20 bp, Artificial
  CRISPR gRNA sequence
cagcctcacaagagctgggc

SEQ ID NO: 575768 - DNA, 20 bp, Artificial
  CRISPR gRNA sequence
agcctcacaagagctgggct

SEQ ID NO: 575769 - DNA, 20 bp, Artificial
  CRISPR gRNA sequence
tcacaagagctgggctaggt

SEQ ID NO: 575770 - DNA, 20 bp, Artificial
  CRISPR gRNA sequence
cacaagagctgggctaggtg

SEQ ID NO: 575771 - DNA, 20 bp, Artificial
  CRISPR gRNA sequence
agctgggctaggtgaggccc

SEQ ID NO: 575772 - DNA, 20 bp, Artificial
  CRISPR gRNA sequence
aggtgaggccccggactcca

SEQ ID NO: 575773 - DNA, 20 bp, Artificial
  CRISPR gRNA sequence
ggtgaggccccggactccat

SEQ ID NO: 575774 - DNA, 20 bp, Artificial
  CRISPR gRNA sequence
aggccccggactccataggt

SEQ ID NO: 575775 - DNA, 20 bp, Artificial
  CRISPR gRNA sequence
ggccccggactccataggtc

SEQ ID NO: 575776 - DNA, 20 bp, Artificial
  CRISPR gRNA sequence
ccccggactccataggtcag

SEQ ID NO: 575777 - DNA, 20 bp, Artificial
  CRISPR gRNA sequence
cccggactccataggtcagg

SEQ ID NO: 575778 - DNA, 20 bp, Artificial
  CRISPR gRNA sequence
actccataggtcaggaggcc

SEQ ID NO: 575779 - DNA, 20 bp, Artificial
  CRISPR gRNA sequence
cataggtcaggaggcctagt

SEQ ID NO: 575780 - DNA, 20 bp, Artificial
  CRISPR gRNA sequence
ggtcaggaggcctagttggc

SEQ ID NO: 575781 - DNA, 20 bp, Artificial
  CRISPR gRNA sequence
tcaggaggcctagttggcca

SEQ ID NO: 575782 - DNA, 20 bp, Artificial
  CRISPR gRNA sequence
aggcctagttggccagagcg

SEQ ID NO: 575783 - DNA, 20 bp, Artificial
  CRISPR gRNA sequence
tggccagagcgtggtgatga

SEQ ID NO: 575784 - DNA, 20 bp, Artificial
  CRISPR gRNA sequence
gccagagcgtggtgatgatg

SEQ ID NO: 575785 - DNA, 20 bp, Artificial
  CRISPR gRNA sequence
ccagagcgtggtgatgatgg

SEQ ID NO: 575786 - DNA, 20 bp, Artificial
  CRISPR gRNA sequence
tggtgatgatggaggcatgt

SEQ ID NO: 575787 - DNA, 20 bp, Artificial
  CRISPR gRNA sequence
gatgatggaggcatgtcagt

SEQ ID NO: 575788 - DNA, 20 bp, Artificial
  CRISPR gRNA sequence
atggaggcatgtcagtcagt

SEQ ID NO: 575789 - DNA, 20 bp, Artificial
  CRISPR gRNA sequence
tggaggcatgtcagtcagtc

SEQ ID NO: 575790 - DNA, 20 bp, Artificial
  CRISPR gRNA sequence
tcagtcaggctgtgtgtccc

SEQ ID NO: 575791 - DNA, 20 bp, Artificial
  CRISPR gRNA sequence
agtcaggctgtgtgtcccca

SEQ ID NO: 575792 - DNA, 20 bp, Artificial
  CRISPR gRNA sequence
aggctgtgtgtccccagagc

SEQ ID NO: 575793 - DNA, 20 bp, Artificial
  CRISPR gRNA sequence
tgtgtccccagagctggtgc

SEQ ID NO: 575794 - DNA, 20 bp, Artificial
  CRISPR gRNA sequence
gtccccgaaaaccttgattg

SEQ ID NO: 575795 - DNA, 20 bp, Artificial
  CRISPR gRNA sequence
tccccgaaaaccttgattgt

SEQ ID NO: 575796 - DNA, 20 bp, Artificial
  CRISPR gRNA sequence
ccccgaaaaccttgattgtg

SEQ ID NO: 575797 - DNA, 20 bp, Artificial
  CRISPR gRNA sequence
ccttgattgtggggcccctc

SEQ ID NO: 575798 - DNA, 20 bp, Artificial
  CRISPR gRNA sequence
ttgattgtggggcccctcta

SEQ ID NO: 575799 - DNA, 20 bp, Artificial
  CRISPR gRNA sequence
gattgtggggcccctctaga

SEQ ID NO: 575800 - DNA, 20 bp, Artificial
  CRISPR gRNA sequence
ccctctagagagtctgatga

SEQ ID NO: 575801 - DNA, 20 bp, Artificial
  CRISPR gRNA sequence
cctctagagagtctgatgat

SEQ ID NO: 575802 - DNA, 20 bp, Artificial
  CRISPR gRNA sequence
tctgatgatgggctctgtat

SEQ ID NO: 575803 - DNA, 20 bp, Artificial
  CRISPR gRNA sequence
tgatgggctctgtattggcg

SEQ ID NO: 575804 - DNA, 20 bp, Artificial
  CRISPR gRNA sequence
gatgggctctgtattggcga

SEQ ID NO: 575805 - DNA, 20 bp, Artificial
  CRISPR gRNA sequence
gctctgtattggcgaaggct

SEQ ID NO: 575806 - DNA, 20 bp, Artificial
  CRISPR gRNA sequence
ctctgtattggcgaaggctg

SEQ ID NO: 575807 - DNA, 20 bp, Artificial
  CRISPR gRNA sequence
ggcgaaggctgaggcttttc

SEQ ID NO: 575808 - DNA, 20 bp, Artificial
  CRISPR gRNA sequence
gcttttccagctccccccat

SEQ ID NO: 575809 - DNA, 20 bp, Artificial
  CRISPR gRNA sequence
cttttccagctccccccatg

SEQ ID NO: 575810 - DNA, 20 bp, Artificial
  CRISPR gRNA sequence
ccagctccccccatgaggcc

SEQ ID NO: 575811 - DNA, 20 bp, Artificial
  CRISPR gRNA sequence
cccccatgaggcccagacca

SEQ ID NO: 575812 - DNA, 20 bp, Artificial
  CRISPR gRNA sequence
ccccatgaggcccagaccaa

SEQ ID NO: 575813 - DNA, 20 bp, Artificial
  CRISPR gRNA sequence
ggcccagaccaaaggcacac

SEQ ID NO: 575814 - DNA, 20 bp, Artificial
  CRISPR gRNA sequence
cctccccctgttgccatctc

SEQ ID NO: 575815 - DNA, 20 bp, Artificial
  CRISPR gRNA sequence
ccccctgttgccatctctgg

SEQ ID NO: 575816 - DNA, 20 bp, Artificial
  CRISPR gRNA sequence
ccctgttgccatctctggcg

SEQ ID NO: 575817 - DNA, 20 bp, Artificial
  CRISPR gRNA sequence
tgttgccatctctggcggag

SEQ ID NO: 575818 - DNA, 20 bp, Artificial
  CRISPR gRNA sequence
tggcggagtggccatgtatt

SEQ ID NO: 575819 - DNA, 20 bp, Artificial
  CRISPR gRNA sequence
ggcggagtggccatgtattt

SEQ ID NO: 575820 - DNA, 20 bp, Artificial
  CRISPR gRNA sequence
tgtatttgggaacgttgttc

SEQ ID NO: 575821 - DNA, 20 bp, Artificial
  CRISPR gRNA sequence
tatttgggaacgttgttcca

SEQ ID NO: 575822 - DNA, 20 bp, Artificial
  CRISPR gRNA sequence
ttgggaacgttgttccagag

SEQ ID NO: 575823 - DNA, 20 bp, Artificial
  CRISPR gRNA sequence
gaacgttgttccagagtgga

SEQ ID NO: 575824 - DNA, 20 bp, Artificial
  CRISPR gRNA sequence
aacgttgttccagagtggac

SEQ ID NO: 575825 - DNA, 20 bp, Artificial
  CRISPR gRNA sequence
acgttgttccagagtggaca

SEQ ID NO: 575826 - DNA, 20 bp, Artificial
  CRISPR gRNA sequence
gttgttccagagtggacagg

SEQ ID NO: 575827 - DNA, 20 bp, Artificial
  CRISPR gRNA sequence
ccagagtggacagggagact

SEQ ID NO: 575828 - DNA, 20 bp, Artificial
  CRISPR gRNA sequence
cagagtggacagggagactg

SEQ ID NO: 575829 - DNA, 20 bp, Artificial
  CRISPR gRNA sequence
ggacagggagactgaggccc

SEQ ID NO: 575830 - DNA, 20 bp, Artificial
  CRISPR gRNA sequence
gacagggagactgaggccct

SEQ ID NO: 575831 - DNA, 20 bp, Artificial
  CRISPR gRNA sequence
acagggagactgaggcccta

SEQ ID NO: 575832 - DNA, 20 bp, Artificial
  CRISPR gRNA sequence
agggagactgaggccctagg

SEQ ID NO: 575833 - DNA, 20 bp, Artificial
  CRISPR gRNA sequence
gggagactgaggccctaggg

SEQ ID NO: 575834 - DNA, 20 bp, Artificial
  CRISPR gRNA sequence
gactgaggccctagggaggc

SEQ ID NO: 575835 - DNA, 20 bp, Artificial
  CRISPR gRNA sequence
agggaggctggctctgtttc

SEQ ID NO: 575836 - DNA, 20 bp, Artificial
  CRISPR gRNA sequence
gggaggctggctctgtttcc

SEQ ID NO: 575837 - DNA, 20 bp, Artificial
  CRISPR gRNA sequence
gctggctctgtttccaggcc

SEQ ID NO: 575838 - DNA, 20 bp, Artificial
  CRISPR gRNA sequence
ggctctgtttccaggcctgg

SEQ ID NO: 575839 - DNA, 20 bp, Artificial
  CRISPR gRNA sequence
gctctgtttccaggcctggt

SEQ ID NO: 575840 - DNA, 20 bp, Artificial
  CRISPR gRNA sequence
tgtttccaggcctggtaggc

SEQ ID NO: 575841 - DNA, 20 bp, Artificial
  CRISPR gRNA sequence
tttccaggcctggtaggcaa

SEQ ID NO: 575842 - DNA, 20 bp, Artificial
  CRISPR gRNA sequence
ttccaggcctggtaggcaag

SEQ ID NO: 575843 - DNA, 20 bp, Artificial
  CRISPR gRNA sequence
ggtaggcaagaggccctatg

SEQ ID NO: 575844 - DNA, 20 bp, Artificial
  CRISPR gRNA sequence
aggcaagaggccctatgaag

SEQ ID NO: 575845 - DNA, 20 bp, Artificial
  CRISPR gRNA sequence
aagaggccctatgaagcagc

SEQ ID NO: 575846 - DNA, 20 bp, Artificial
  CRISPR gRNA sequence
gcagcaagctgcctgacttt

SEQ ID NO: 575847 - DNA, 20 bp, Artificial
  CRISPR gRNA sequence
caagctgcctgactttcaga

SEQ ID NO: 575848 - DNA, 20 bp, Artificial
  CRISPR gRNA sequence
cctgactttcagatggttcc

SEQ ID NO: 575849 - DNA, 20 bp, Artificial
  CRISPR gRNA sequence
ctgactttcagatggttcca

SEQ ID NO: 575850 - DNA, 20 bp, Artificial
  CRISPR gRNA sequence
gactttcagatggttccaag

SEQ ID NO: 575851 - DNA, 20 bp, Artificial
  CRISPR gRNA sequence
tcagatggttccaaggagtt

SEQ ID NO: 575852 - DNA, 20 bp, Artificial
  CRISPR gRNA sequence
gttccaaggagtttggacac

SEQ ID NO: 575853 - DNA, 20 bp, Artificial
  CRISPR gRNA sequence
ttccaaggagtttggacacc

SEQ ID NO: 575854 - DNA, 20 bp, Artificial
  CRISPR gRNA sequence
tccaaggagtttggacacca

SEQ ID NO: 575855 - DNA, 20 bp, Artificial
  CRISPR gRNA sequence
agtttggacaccagggacac

SEQ ID NO: 575856 - DNA, 20 bp, Artificial
  CRISPR gRNA sequence
gacactggcctacacatact

SEQ ID NO: 575857 - DNA, 20 bp, Artificial
  CRISPR gRNA sequence
gcctacacatactgagactt

SEQ ID NO: 575858 - DNA, 20 bp, Artificial
  CRISPR gRNA sequence
cctacacatactgagacttt

SEQ ID NO: 575859 - DNA, 20 bp, Artificial
  CRISPR gRNA sequence
atactgagactttgggaccg

SEQ ID NO: 575860 - DNA, 20 bp, Artificial
  CRISPR gRNA sequence
ctttgggaccgtagacccca

SEQ ID NO: 575861 - DNA, 20 bp, Artificial
  CRISPR gRNA sequence
accgtagaccccacagtctg

SEQ ID NO: 575862 - DNA, 20 bp, Artificial
  CRISPR gRNA sequence
accccacagtctgtggtttt

SEQ ID NO: 575863 - DNA, 20 bp, Artificial
  CRISPR gRNA sequence
agtctgtggttttgagattc

SEQ ID NO: 575864 - DNA, 20 bp, Artificial
  CRISPR gRNA sequence
gtctgtggttttgagattct

SEQ ID NO: 575865 - DNA, 20 bp, Artificial
  CRISPR gRNA sequence
ttctaggatcctttaaatct

SEQ ID NO: 575866 - DNA, 20 bp, Artificial
  CRISPR gRNA sequence
aaatgctgttctatgattct

SEQ ID NO: 575867 - DNA, 20 bp, Artificial
  CRISPR gRNA sequence
aatgctgttctatgattctg

SEQ ID NO: 575868 - DNA, 20 bp, Artificial
  CRISPR gRNA sequence
gttctatgattctgaggtcc

SEQ ID NO: 575869 - DNA, 20 bp, Artificial
  CRISPR gRNA sequence
tcctggtgttatactatttg

SEQ ID NO: 575870 - DNA, 20 bp, Artificial
  CRISPR gRNA sequence
gttatactatttgaagaccc

SEQ ID NO: 575871 - DNA, 20 bp, Artificial
  CRISPR gRNA sequence
ttatactatttgaagacccc

SEQ ID NO: 575872 - DNA, 20 bp, Artificial
  CRISPR gRNA sequence
tatactatttgaagacccca

SEQ ID NO: 575873 - DNA, 20 bp, Artificial
  CRISPR gRNA sequence
atactatttgaagaccccag

SEQ ID NO: 575874 - DNA, 20 bp, Artificial
  CRISPR gRNA sequence
tttgaagaccccaggggtcc

SEQ ID NO: 575875 - DNA, 20 bp, Artificial
  CRISPR gRNA sequence
cccaggggtcccagtatctg

SEQ ID NO: 575876 - DNA, 20 bp, Artificial
  CRISPR gRNA sequence
caggggtcccagtatctgtg

SEQ ID NO: 575877 - DNA, 20 bp, Artificial
  CRISPR gRNA sequence
cagtatctgtggagcctgcc

SEQ ID NO: 575878 - DNA, 20 bp, Artificial
  CRISPR gRNA sequence
tggagcctgcctggcactct

SEQ ID NO: 575879 - DNA, 20 bp, Artificial
  CRISPR gRNA sequence
gagcctgcctggcactctca

SEQ ID NO: 575880 - DNA, 20 bp, Artificial
  CRISPR gRNA sequence
cactctcagagcttcaaacc

SEQ ID NO: 575881 - DNA, 20 bp, Artificial
  CRISPR gRNA sequence
actctcagagcttcaaacct

SEQ ID NO: 575882 - DNA, 20 bp, Artificial
  CRISPR gRNA sequence
ctgggtcctctccacaaccc

SEQ ID NO: 575883 - DNA, 20 bp, Artificial
  CRISPR gRNA sequence
ggtcctctccacaacccaag

SEQ ID NO: 575884 - DNA, 20 bp, Artificial
  CRISPR gRNA sequence
gtcctctccacaacccaaga

SEQ ID NO: 575885 - DNA, 20 bp, Artificial
  CRISPR gRNA sequence
tcctctccacaacccaagaa

SEQ ID NO: 575886 - DNA, 20 bp, Artificial
  CRISPR gRNA sequence
ctccacaacccaagaagggc

SEQ ID NO: 575887 - DNA, 20 bp, Artificial
  CRISPR gRNA sequence
tccacaacccaagaagggcc

SEQ ID NO: 575888 - DNA, 20 bp, Artificial
  CRISPR gRNA sequence
cccaagaagggccaggtctt

SEQ ID NO: 575889 - DNA, 20 bp, Artificial
  CRISPR gRNA sequence
caagaagggccaggtcttca

SEQ ID NO: 575890 - DNA, 20 bp, Artificial
  CRISPR gRNA sequence
aagggccaggtcttcagagc

SEQ ID NO: 575891 - DNA, 20 bp, Artificial
  CRISPR gRNA sequence
agggccaggtcttcagagct

SEQ ID NO: 575892 - DNA, 20 bp, Artificial
  CRISPR gRNA sequence
gggccaggtcttcagagcta

SEQ ID NO: 575893 - DNA, 20 bp, Artificial
  CRISPR gRNA sequence
ggccaggtcttcagagctag

SEQ ID NO: 575894 - DNA, 20 bp, Artificial
  CRISPR gRNA sequence
tcagagctaggggcttgtca

SEQ ID NO: 575895 - DNA, 20 bp, Artificial
  CRISPR gRNA sequence
gagctaggggcttgtcatag

SEQ ID NO: 575896 - DNA, 20 bp, Artificial
  CRISPR gRNA sequence
taggggcttgtcatagtggc

SEQ ID NO: 575897 - DNA, 20 bp, Artificial
  CRISPR gRNA sequence
ggcttgtcatagtggccaga

SEQ ID NO: 575898 - DNA, 20 bp, Artificial
  CRISPR gRNA sequence
acatcacctaccacatccac

SEQ ID NO: 575899 - DNA, 20 bp, Artificial
  CRISPR gRNA sequence
agcacccatgtcaccccacc

SEQ ID NO: 575900 - DNA, 20 bp, Artificial
  CRISPR gRNA sequence
gcacccatgtcaccccacct

SEQ ID NO: 575901 - DNA, 20 bp, Artificial
  CRISPR gRNA sequence
catgtcaccccacctgggcc

SEQ ID NO: 575902 - DNA, 20 bp, Artificial
  CRISPR gRNA sequence
cacctgggccaagcctgctg

SEQ ID NO: 575903 - DNA, 20 bp, Artificial
  CRISPR gRNA sequence
acctgggccaagcctgctgc

SEQ ID NO: 575904 - DNA, 20 bp, Artificial
  CRISPR gRNA sequence
gggccaagcctgctgcagga

SEQ ID NO: 575905 - DNA, 20 bp, Artificial
  CRISPR gRNA sequence
ggccaagcctgctgcaggac

SEQ ID NO: 575906 - DNA, 20 bp, Artificial
  CRISPR gRNA sequence
gccaagcctgctgcaggaca

SEQ ID NO: 575907 - DNA, 20 bp, Artificial
  CRISPR gRNA sequence
aagcctgctgcaggacaggg

SEQ ID NO: 575908 - DNA, 20 bp, Artificial
  CRISPR gRNA sequence
ctgctgcaggacagggcagc

SEQ ID NO: 575909 - DNA, 20 bp, Artificial
  CRISPR gRNA sequence
aggacagggcagccagttct

SEQ ID NO: 575910 - DNA, 20 bp, Artificial
  CRISPR gRNA sequence
agttctcggaacgaaacctg

SEQ ID NO: 575911 - DNA, 20 bp, Artificial
  CRISPR gRNA sequence
gttctcggaacgaaacctgt

SEQ ID NO: 575912 - DNA, 20 bp, Artificial
  CRISPR gRNA sequence
ttctcggaacgaaacctgtg

SEQ ID NO: 575913 - DNA, 20 bp, Artificial
  CRISPR gRNA sequence
tcggaacgaaacctgtgggg

SEQ ID NO: 575914 - DNA, 20 bp, Artificial
  CRISPR gRNA sequence
cggaacgaaacctgtggggt

SEQ ID NO: 575915 - DNA, 20 bp, Artificial
  CRISPR gRNA sequence
ggaacgaaacctgtggggtg

SEQ ID NO: 575916 - DNA, 20 bp, Artificial
  CRISPR gRNA sequence
tgccctcttctcttcctccg

SEQ ID NO: 575917 - DNA, 20 bp, Artificial
  CRISPR gRNA sequence
cttcctccgtggtgtcgatg

SEQ ID NO: 575918 - DNA, 20 bp, Artificial
  CRISPR gRNA sequence
tccgtggtgtcgatgaagcc

SEQ ID NO: 575919 - DNA, 20 bp, Artificial
  CRISPR gRNA sequence
tcgatgaagcccggcgcatc

SEQ ID NO: 575920 - DNA, 20 bp, Artificial
  CRISPR gRNA sequence
tccggccgccatgacgtcaa

SEQ ID NO: 575921 - DNA, 20 bp, Artificial
  CRISPR gRNA sequence
ggccgccatgacgtcaatgg

SEQ ID NO: 575922 - DNA, 20 bp, Artificial
  CRISPR gRNA sequence
acgtcaatggcggaaaaatc

SEQ ID NO: 575923 - DNA, 20 bp, Artificial
  CRISPR gRNA sequence
cgtcaatggcggaaaaatct

SEQ ID NO: 575924 - DNA, 20 bp, Artificial
  CRISPR gRNA sequence
aatggcggaaaaatctgggc

SEQ ID NO: 575925 - DNA, 20 bp, Artificial
  CRISPR gRNA sequence
gcggaaaaatctgggcaagt

SEQ ID NO: 575926 - DNA, 20 bp, Artificial
  CRISPR gRNA sequence
cggaaaaatctgggcaagtc

SEQ ID NO: 575927 - DNA, 20 bp, Artificial
  CRISPR gRNA sequence
ggaaaaatctgggcaagtcg

SEQ ID NO: 575928 - DNA, 20 bp, Artificial
  CRISPR gRNA sequence
gaaaaatctgggcaagtcgg

SEQ ID NO: 575929 - DNA, 20 bp, Artificial
  CRISPR gRNA sequence
caagtcgggggctgtgacaa

SEQ ID NO: 575930 - DNA, 20 bp, Artificial
  CRISPR gRNA sequence
aagtcgggggctgtgacaac

SEQ ID NO: 575931 - DNA, 20 bp, Artificial
  CRISPR gRNA sequence
agtcgggggctgtgacaaca

SEQ ID NO: 575932 - DNA, 20 bp, Artificial
  CRISPR gRNA sequence
ggggctgtgacaacagggcc

SEQ ID NO: 575933 - DNA, 20 bp, Artificial
  CRISPR gRNA sequence
gtgacaacagggcccagatg

SEQ ID NO: 575934 - DNA, 20 bp, Artificial
  CRISPR gRNA sequence
tgaaaacataatctgtgtcc

SEQ ID NO: 575935 - DNA, 20 bp, Artificial
  CRISPR gRNA sequence
tcccagaaacatcccccatt

SEQ ID NO: 575936 - DNA, 20 bp, Artificial
  CRISPR gRNA sequence
acatcccccattcagcttct

SEQ ID NO: 575937 - DNA, 20 bp, Artificial
  CRISPR gRNA sequence
cattcagcttctgagaaacc

SEQ ID NO: 575938 - DNA, 20 bp, Artificial
  CRISPR gRNA sequence
cagcttctgagaaacccagt

SEQ ID NO: 575939 - DNA, 20 bp, Artificial
  CRISPR gRNA sequence
ttctgagaaacccagtcaga

SEQ ID NO: 575940 - DNA, 20 bp, Artificial
  CRISPR gRNA sequence
tctgagaaacccagtcagaa

SEQ ID NO: 575941 - DNA, 20 bp, Artificial
  CRISPR gRNA sequence
ctgagaaacccagtcagaaa

SEQ ID NO: 575942 - DNA, 20 bp, Artificial
  CRISPR gRNA sequence
gtcagaaagggacgtcccaa

SEQ ID NO: 575943 - DNA, 20 bp, Artificial
  CRISPR gRNA sequence
gaaagggacgtcccaacaga

SEQ ID NO: 575944 - DNA, 20 bp, Artificial
  CRISPR gRNA sequence
ggacgtcccaacagacagtg

SEQ ID NO: 575945 - DNA, 20 bp, Artificial
  CRISPR gRNA sequence
gacgtcccaacagacagtgc

SEQ ID NO: 575946 - DNA, 20 bp, Artificial
  CRISPR gRNA sequence
gtcccaacagacagtgcagg

SEQ ID NO: 575947 - DNA, 20 bp, Artificial
  CRISPR gRNA sequence
caacagacagtgcaggaagc

SEQ ID NO: 575948 - DNA, 20 bp, Artificial
  CRISPR gRNA sequence
agtgcaggaagccggctgcc

SEQ ID NO: 575949 - DNA, 20 bp, Artificial
  CRISPR gRNA sequence
aggaagccggctgcccagcc

SEQ ID NO: 575950 - DNA, 20 bp, Artificial
  CRISPR gRNA sequence
ggctgcccagcccggccctc

SEQ ID NO: 575951 - DNA, 20 bp, Artificial
  CRISPR gRNA sequence
gctgcccagcccggccctct

SEQ ID NO: 575952 - DNA, 20 bp, Artificial
  CRISPR gRNA sequence
ccctctaggtcctctacccc

SEQ ID NO: 575953 - DNA, 20 bp, Artificial
  CRISPR gRNA sequence
ctaggtcctctacccccaga

SEQ ID NO: 575954 - DNA, 20 bp, Artificial
  CRISPR gRNA sequence
tcatctccatgtccctgtct

SEQ ID NO: 575955 - DNA, 20 bp, Artificial
  CRISPR gRNA sequence
gaatgtatctatgctttgct

SEQ ID NO: 575956 - DNA, 20 bp, Artificial
  CRISPR gRNA sequence
gtatctatgctttgctgagt

SEQ ID NO: 575957 - DNA, 20 bp, Artificial
  CRISPR gRNA sequence
tatctatgctttgctgagtc

SEQ ID NO: 575958 - DNA, 20 bp, Artificial
  CRISPR gRNA sequence
caggccatcccacatgtgtt

SEQ ID NO: 575959 - DNA, 20 bp, Artificial
  CRISPR gRNA sequence
aggccatcccacatgtgttt

SEQ ID NO: 575960 - DNA, 20 bp, Artificial
  CRISPR gRNA sequence
ggccatcccacatgtgtttg

SEQ ID NO: 575961 - DNA, 20 bp, Artificial
  CRISPR gRNA sequence
ccatcccacatgtgtttggg

SEQ ID NO: 575962 - DNA, 20 bp, Artificial
  CRISPR gRNA sequence
atgtgtttggggagaattct

SEQ ID NO: 575963 - DNA, 20 bp, Artificial
  CRISPR gRNA sequence
ttggggagaattcttagctc

SEQ ID NO: 575964 - DNA, 20 bp, Artificial
  CRISPR gRNA sequence
gagaattcttagctctggcc

SEQ ID NO: 575965 - DNA, 20 bp, Artificial
  CRISPR gRNA sequence
cttagctctggccaagtgtc

SEQ ID NO: 575966 - DNA, 20 bp, Artificial
  CRISPR gRNA sequence
ttagctctggccaagtgtcc

SEQ ID NO: 575967 - DNA, 20 bp, Artificial
  CRISPR gRNA sequence
gctctggccaagtgtccagg

SEQ ID NO: 575968 - DNA, 20 bp, Artificial
  CRISPR gRNA sequence
gccaagtgtccaggcagctt

SEQ ID NO: 575969 - DNA, 20 bp, Artificial
  CRISPR gRNA sequence
aagtgtccaggcagcttcag

SEQ ID NO: 575970 - DNA, 20 bp, Artificial
  CRISPR gRNA sequence
ggcagcttcagaagtgacca

SEQ ID NO: 575971 - DNA, 20 bp, Artificial
  CRISPR gRNA sequence
gcagcttcagaagtgaccac

SEQ ID NO: 575972 - DNA, 20 bp, Artificial
  CRISPR gRNA sequence
cttcagaagtgaccacaggc

SEQ ID NO: 575973 - DNA, 20 bp, Artificial
  CRISPR gRNA sequence
gtgaccacaggccagccaca

SEQ ID NO: 575974 - DNA, 20 bp, Artificial
  CRISPR gRNA sequence
tgaccacaggccagccacat

SEQ ID NO: 575975 - DNA, 20 bp, Artificial
  CRISPR gRNA sequence
cacaggccagccacatgggc

SEQ ID NO: 575976 - DNA, 20 bp, Artificial
  CRISPR gRNA sequence
acaggccagccacatgggcc

SEQ ID NO: 575977 - DNA, 20 bp, Artificial
  CRISPR gRNA sequence
gccagccacatgggccaggc

SEQ ID NO: 575978 - DNA, 20 bp, Artificial
  CRISPR gRNA sequence
cagccacatgggccaggcca

SEQ ID NO: 575979 - DNA, 20 bp, Artificial
  CRISPR gRNA sequence
ccacatgggccaggccagag

SEQ ID NO: 575980 - DNA, 20 bp, Artificial
  CRISPR gRNA sequence
catgggccaggccagagtgg

SEQ ID NO: 575981 - DNA, 20 bp, Artificial
  CRISPR gRNA sequence
acatccatttgcaccgaaat

SEQ ID NO: 575982 - DNA, 20 bp, Artificial
  CRISPR gRNA sequence
atttgcaccgaaatcggtat

SEQ ID NO: 575983 - DNA, 20 bp, Artificial
  CRISPR gRNA sequence
aaatcggtattagtttgttc

SEQ ID NO: 575984 - DNA, 20 bp, Artificial
  CRISPR gRNA sequence
ttgttctggctgctataaca

SEQ ID NO: 575985 - DNA, 20 bp, Artificial
  CRISPR gRNA sequence
tataacaaagtaccacaact

SEQ ID NO: 575986 - DNA, 20 bp, Artificial
  CRISPR gRNA sequence
aacaaagtaccacaactgag

SEQ ID NO: 575987 - DNA, 20 bp, Artificial
  CRISPR gRNA sequence
gtaccacaactgagtggctt

SEQ ID NO: 575988 - DNA, 20 bp, Artificial
  CRISPR gRNA sequence
caactgagtggcttcagcaa

SEQ ID NO: 575989 - DNA, 20 bp, Artificial
  CRISPR gRNA sequence
aacagaaattgatcatctca

SEQ ID NO: 575990 - DNA, 20 bp, Artificial
  CRISPR gRNA sequence
aattgatcatctcacagttc

SEQ ID NO: 575991 - DNA, 20 bp, Artificial
  CRISPR gRNA sequence
ttgatcatctcacagttctg

SEQ ID NO: 575992 - DNA, 20 bp, Artificial
  CRISPR gRNA sequence
tgatcatctcacagttctgg

SEQ ID NO: 575993 - DNA, 20 bp, Artificial
  CRISPR gRNA sequence
catctcacagttctggaggc

SEQ ID NO: 575994 - DNA, 20 bp, Artificial
  CRISPR gRNA sequence
tctcacagttctggaggcca

SEQ ID NO: 575995 - DNA, 20 bp, Artificial
  CRISPR gRNA sequence
agttctggaggccagagtcc

SEQ ID NO: 575996 - DNA, 20 bp, Artificial
  CRISPR gRNA sequence
ggaggccagagtccaagatc

SEQ ID NO: 575997 - DNA, 20 bp, Artificial
  CRISPR gRNA sequence
gaggccagagtccaagatca

SEQ ID NO: 575998 - DNA, 20 bp, Artificial
  CRISPR gRNA sequence
gtccaagatcaaggtgttgc

SEQ ID NO: 575999 - DNA, 20 bp, Artificial
  CRISPR gRNA sequence
tccaagatcaaggtgttgcc

SEQ ID NO: 576000 - DNA, 20 bp, Artificial
  CRISPR gRNA sequence
ccaagatcaaggtgttgcca

SEQ ID NO: 576001 - DNA, 20 bp, Artificial
  CRISPR gRNA sequence
gatcaaggtgttgccagggt

SEQ ID NO: 576002 - DNA, 20 bp, Artificial
  CRISPR gRNA sequence
ttgccagggttggttccttc

SEQ ID NO: 576003 - DNA, 20 bp, Artificial
  CRISPR gRNA sequence
tgccagggttggttccttct

SEQ ID NO: 576004 - DNA, 20 bp, Artificial
  CRISPR gRNA sequence
gccagggttggttccttctg

SEQ ID NO: 576005 - DNA, 20 bp, Artificial
  CRISPR gRNA sequence
ccagggttggttccttctgg

SEQ ID NO: 576006 - DNA, 20 bp, Artificial
  CRISPR gRNA sequence
tggttccttctgggggccat

SEQ ID NO: 576007 - DNA, 20 bp, Artificial
  CRISPR gRNA sequence
ggttccttctgggggccata

SEQ ID NO: 576008 - DNA, 20 bp, Artificial
  CRISPR gRNA sequence
gttccttctgggggccataa

SEQ ID NO: 576009 - DNA, 20 bp, Artificial
  CRISPR gRNA sequence
tccttctgggggccataagg

SEQ ID NO: 576010 - DNA, 20 bp, Artificial
  CRISPR gRNA sequence
ttctgggggccataagggag

SEQ ID NO: 576011 - DNA, 20 bp, Artificial
  CRISPR gRNA sequence
ccataagggagaagctgctc

SEQ ID NO: 576012 - DNA, 20 bp, Artificial
  CRISPR gRNA sequence
cataagggagaagctgctcc

SEQ ID NO: 576013 - DNA, 20 bp, Artificial
  CRISPR gRNA sequence
gctgctccaggcctctcccc

SEQ ID NO: 576014 - DNA, 20 bp, Artificial
  CRISPR gRNA sequence
caggcctctcccccagcttc

SEQ ID NO: 576015 - DNA, 20 bp, Artificial
  CRISPR gRNA sequence
gcctctcccccagcttctgg

SEQ ID NO: 576016 - DNA, 20 bp, Artificial
  CRISPR gRNA sequence
ccccagcttctggtggttgc

SEQ ID NO: 576017 - DNA, 20 bp, Artificial
  CRISPR gRNA sequence
tggcaatctttgttatttct

SEQ ID NO: 576018 - DNA, 20 bp, Artificial
  CRISPR gRNA sequence
ctttgttatttcttggcttg

SEQ ID NO: 576019 - DNA, 20 bp, Artificial
  CRISPR gRNA sequence
tttgttatttcttggcttga

SEQ ID NO: 576020 - DNA, 20 bp, Artificial
  CRISPR gRNA sequence
tgttatttcttggcttgaag

SEQ ID NO: 576021 - DNA, 20 bp, Artificial
  CRISPR gRNA sequence
aaggagcatcaccccatctc

SEQ ID NO: 576022 - DNA, 20 bp, Artificial
  CRISPR gRNA sequence
cactcaccttctcatctcac

SEQ ID NO: 576023 - DNA, 20 bp, Artificial
  CRISPR gRNA sequence
tcatctcaccagtgctctcc

SEQ ID NO: 576024 - DNA, 20 bp, Artificial
  CRISPR gRNA sequence
catctcaccagtgctctccc

SEQ ID NO: 576025 - DNA, 20 bp, Artificial
  CRISPR gRNA sequence
tgctctcccaggcccttgtt

SEQ ID NO: 576026 - DNA, 20 bp, Artificial
  CRISPR gRNA sequence
ctctcccaggcccttgttcg

SEQ ID NO: 576027 - DNA, 20 bp, Artificial
  CRISPR gRNA sequence
gcccttgttcggagcctcca

SEQ ID NO: 576028 - DNA, 20 bp, Artificial
  CRISPR gRNA sequence
ccacactcctgtttctcacg

SEQ ID NO: 576029 - DNA, 20 bp, Artificial
  CRISPR gRNA sequence
ttctcacgcagtaatgttct

SEQ ID NO: 576030 - DNA, 20 bp, Artificial
  CRISPR gRNA sequence
gcagtaatgttctaagcccc

SEQ ID NO: 576031 - DNA, 20 bp, Artificial
  CRISPR gRNA sequence
cagtaatgttctaagccccc

SEQ ID NO: 576032 - DNA, 20 bp, Artificial
  CRISPR gRNA sequence
gtaatgttctaagcccccag

SEQ ID NO: 576033 - DNA, 20 bp, Artificial
  CRISPR gRNA sequence
ttctaagcccccaggagact

SEQ ID NO: 576034 - DNA, 20 bp, Artificial
  CRISPR gRNA sequence
gagactaagaacttaatacc

SEQ ID NO: 576035 - DNA, 20 bp, Artificial
  CRISPR gRNA sequence
attctcacactcatctccct

SEQ ID NO: 576036 - DNA, 20 bp, Artificial
  CRISPR gRNA sequence
actcatctccctcagcacca

SEQ ID NO: 576037 - DNA, 20 bp, Artificial
  CRISPR gRNA sequence
acagctctgacaaccacccc

SEQ ID NO: 576038 - DNA, 20 bp, Artificial
  CRISPR gRNA sequence
cagctctgacaaccaccccc

SEQ ID NO: 576039 - DNA, 20 bp, Artificial
  CRISPR gRNA sequence
gctctgacaaccacccccag

SEQ ID NO: 576040 - DNA, 20 bp, Artificial
  CRISPR gRNA sequence
ctctgacaaccacccccagg

SEQ ID NO: 576041 - DNA, 20 bp, Artificial
  CRISPR gRNA sequence
caaccacccccaggaggtga

SEQ ID NO: 576042 - DNA, 20 bp, Artificial
  CRISPR gRNA sequence
acccccaggaggtgacagca

SEQ ID NO: 576043 - DNA, 20 bp, Artificial
  CRISPR gRNA sequence
ccaggaggtgacagcaaaga

SEQ ID NO: 576044 - DNA, 20 bp, Artificial
  CRISPR gRNA sequence
caggaggtgacagcaaagaa

SEQ ID NO: 576045 - DNA, 20 bp, Artificial
  CRISPR gRNA sequence
gaggtgacagcaaagaaagg

SEQ ID NO: 576046 - DNA, 20 bp, Artificial
  CRISPR gRNA sequence
aggtgacagcaaagaaagga

SEQ ID NO: 576047 - DNA, 20 bp, Artificial
  CRISPR gRNA sequence
gtgacagcaaagaaaggaag

SEQ ID NO: 576048 - DNA, 20 bp, Artificial
  CRISPR gRNA sequence
ggaaggagcaactgctcccc

SEQ ID NO: 576049 - DNA, 20 bp, Artificial
  CRISPR gRNA sequence
agaacccttctatactcccc

SEQ ID NO: 576050 - DNA, 20 bp, Artificial
  CRISPR gRNA sequence
gaacccttctatactccccc

SEQ ID NO: 576051 - DNA, 20 bp, Artificial
  CRISPR gRNA sequence
atactcccccgggctgctct

SEQ ID NO: 576052 - DNA, 20 bp, Artificial
  CRISPR gRNA sequence
ctcccccgggctgctctcag

SEQ ID NO: 576053 - DNA, 20 bp, Artificial
  CRISPR gRNA sequence
cagcagctgtgtgcccaact

SEQ ID NO: 576054 - DNA, 20 bp, Artificial
  CRISPR gRNA sequence
tgtgcccaactcagtgctgt

SEQ ID NO: 576055 - DNA, 20 bp, Artificial
  CRISPR gRNA sequence
gtgcccaactcagtgctgtg

SEQ ID NO: 576056 - DNA, 20 bp, Artificial
  CRISPR gRNA sequence
cccaactcagtgctgtgagg

SEQ ID NO: 576057 - DNA, 20 bp, Artificial
  CRISPR gRNA sequence
ctcagtgctgtgaggtggaa

SEQ ID NO: 576058 - DNA, 20 bp, Artificial
  CRISPR gRNA sequence
tcagtgctgtgaggtggaac

SEQ ID NO: 576059 - DNA, 20 bp, Artificial
  CRISPR gRNA sequence
cagtgctgtgaggtggaacg

SEQ ID NO: 576060 - DNA, 20 bp, Artificial
  CRISPR gRNA sequence
gtgctgtgaggtggaacggg

SEQ ID NO: 576061 - DNA, 20 bp, Artificial
  CRISPR gRNA sequence
tgtgaggtggaacggggaga

SEQ ID NO: 576062 - DNA, 20 bp, Artificial
  CRISPR gRNA sequence
tgaggtggaacggggagatg

SEQ ID NO: 576063 - DNA, 20 bp, Artificial
  CRISPR gRNA sequence
agacacacacacacacacac

SEQ ID NO: 576064 - DNA, 20 bp, Artificial
  CRISPR gRNA sequence
acacacacacacacacacca

SEQ ID NO: 576065 - DNA, 20 bp, Artificial
  CRISPR gRNA sequence
acacacacacacacaccaga

SEQ ID NO: 576066 - DNA, 20 bp, Artificial
  CRISPR gRNA sequence
gagtttataaaatgtgcaca

SEQ ID NO: 576067 - DNA, 20 bp, Artificial
  CRISPR gRNA sequence
gcacacggaaacacttccta

SEQ ID NO: 576068 - DNA, 20 bp, Artificial
  CRISPR gRNA sequence
acggaaacacttcctaaaga

SEQ ID NO: 576069 - DNA, 20 bp, Artificial
  CRISPR gRNA sequence
gaaacacttcctaaagaaag

SEQ ID NO: 576070 - DNA, 20 bp, Artificial
  CRISPR gRNA sequence
acacttcctaaagaaagaag

SEQ ID NO: 576071 - DNA, 20 bp, Artificial
  CRISPR gRNA sequence
acttcctaaagaaagaagtg

SEQ ID NO: 576072 - DNA, 20 bp, Artificial
  CRISPR gRNA sequence
aagaaagaagtggagttctc

SEQ ID NO: 576073 - DNA, 20 bp, Artificial
  CRISPR gRNA sequence
gtggagttctcaagtcacta

SEQ ID NO: 576074 - DNA, 20 bp, Artificial
  CRISPR gRNA sequence
tggagttctcaagtcactat

SEQ ID NO: 576075 - DNA, 20 bp, Artificial
  CRISPR gRNA sequence
ctcaagtcactatgggacta

SEQ ID NO: 576076 - DNA, 20 bp, Artificial
  CRISPR gRNA sequence
cactatgggactacggaact

SEQ ID NO: 576077 - DNA, 20 bp, Artificial
  CRISPR gRNA sequence
gactacggaactcggcatct

SEQ ID NO: 576078 - DNA, 20 bp, Artificial
  CRISPR gRNA sequence
gagcatccccttctgtataa

SEQ ID NO: 576079 - DNA, 20 bp, Artificial
  CRISPR gRNA sequence
agcatccccttctgtataat

SEQ ID NO: 576080 - DNA, 20 bp, Artificial
  CRISPR gRNA sequence
gcatccccttctgtataatg

SEQ ID NO: 576081 - DNA, 20 bp, Artificial
  CRISPR gRNA sequence
ccccttctgtataatggggt

SEQ ID NO: 576082 - DNA, 20 bp, Artificial
  CRISPR gRNA sequence
ttctgtataatggggttggc

SEQ ID NO: 576083 - DNA, 20 bp, Artificial
  CRISPR gRNA sequence
tctgtataatggggttggct

SEQ ID NO: 576084 - DNA, 20 bp, Artificial
  CRISPR gRNA sequence
gtataatggggttggctggg

SEQ ID NO: 576085 - DNA, 20 bp, Artificial
  CRISPR gRNA sequence
gttggctgggcagtcccttc

SEQ ID NO: 576086 - DNA, 20 bp, Artificial
  CRISPR gRNA sequence
tgggcagtcccttccagctc

SEQ ID NO: 576087 - DNA, 20 bp, Artificial
  CRISPR gRNA sequence
ttccagctctggcttcctct

SEQ ID NO: 576088 - DNA, 20 bp, Artificial
  CRISPR gRNA sequence
gctctggcttcctctcagac

SEQ ID NO: 576089 - DNA, 20 bp, Artificial
  CRISPR gRNA sequence
ctctggcttcctctcagacc

SEQ ID NO: 576090 - DNA, 20 bp, Artificial
  CRISPR gRNA sequence
ttcctctcagaccaggatta

SEQ ID NO: 576091 - DNA, 20 bp, Artificial
  CRISPR gRNA sequence
tcctctcagaccaggattat

SEQ ID NO: 576092 - DNA, 20 bp, Artificial
  CRISPR gRNA sequence
caggattataggatcctgaa

SEQ ID NO: 576093 - DNA, 20 bp, Artificial
  CRISPR gRNA sequence
attataggatcctgaaaagc

SEQ ID NO: 576094 - DNA, 20 bp, Artificial
  CRISPR gRNA sequence
tgaaaagccagtgcttccct

SEQ ID NO: 576095 - DNA, 20 bp, Artificial
  CRISPR gRNA sequence
gaaaagccagtgcttccctc

SEQ ID NO: 576096 - DNA, 20 bp, Artificial
  CRISPR gRNA sequence
aaaagccagtgcttccctca

SEQ ID NO: 576097 - DNA, 20 bp, Artificial
  CRISPR gRNA sequence
aagccagtgcttccctcagg

SEQ ID NO: 576098 - DNA, 20 bp, Artificial
  CRISPR gRNA sequence
ccagtgcttccctcagggag

SEQ ID NO: 576099 - DNA, 20 bp, Artificial
  CRISPR gRNA sequence
gtgcttccctcagggagtgg

SEQ ID NO: 576100 - DNA, 20 bp, Artificial
  CRISPR gRNA sequence
tgcttccctcagggagtgga

SEQ ID NO: 576101 - DNA, 20 bp, Artificial
  CRISPR gRNA sequence
cctcagggagtggaaggttc

SEQ ID NO: 576102 - DNA, 20 bp, Artificial
  CRISPR gRNA sequence
ctcagggagtggaaggttct

SEQ ID NO: 576103 - DNA, 20 bp, Artificial
  CRISPR gRNA sequence
tcagggagtggaaggttctg

SEQ ID NO: 576104 - DNA, 20 bp, Artificial
  CRISPR gRNA sequence
gagtggaaggttctggggct

SEQ ID NO: 576105 - DNA, 20 bp, Artificial
  CRISPR gRNA sequence
tggaaggttctggggctcag

SEQ ID NO: 576106 - DNA, 20 bp, Artificial
  CRISPR gRNA sequence
ggaaggttctggggctcagc

SEQ ID NO: 576107 - DNA, 20 bp, Artificial
  CRISPR gRNA sequence
gaaggttctggggctcagca

SEQ ID NO: 576108 - DNA, 20 bp, Artificial
  CRISPR gRNA sequence
aaggttctggggctcagcag

SEQ ID NO: 576109 - DNA, 20 bp, Artificial
  CRISPR gRNA sequence
aggttctggggctcagcagg

SEQ ID NO: 576110 - DNA, 20 bp, Artificial
  CRISPR gRNA sequence
ctggggctcagcagggggcc

SEQ ID NO: 576111 - DNA, 20 bp, Artificial
  CRISPR gRNA sequence
ggggctcagcagggggcccg

SEQ ID NO: 576112 - DNA, 20 bp, Artificial
  CRISPR gRNA sequence
cagggggcccggagccattg

SEQ ID NO: 576113 - DNA, 20 bp, Artificial
  CRISPR gRNA sequence
gggggcccggagccattgtg

SEQ ID NO: 576114 - DNA, 20 bp, Artificial
  CRISPR gRNA sequence
ggggcccggagccattgtgg

SEQ ID NO: 576115 - DNA, 20 bp, Artificial
  CRISPR gRNA sequence
gggcccggagccattgtgga

SEQ ID NO: 576116 - DNA, 20 bp, Artificial
  CRISPR gRNA sequence
agccattgtggagggctttc

SEQ ID NO: 576117 - DNA, 20 bp, Artificial
  CRISPR gRNA sequence
gccattgtggagggctttca

SEQ ID NO: 576118 - DNA, 20 bp, Artificial
  CRISPR gRNA sequence
ttgtggagggctttcaaggt

SEQ ID NO: 576119 - DNA, 20 bp, Artificial
  CRISPR gRNA sequence
tgtggagggctttcaaggtg

SEQ ID NO: 576120 - DNA, 20 bp, Artificial
  CRISPR gRNA sequence
ggctttcaaggtgaggacaa

SEQ ID NO: 576121 - DNA, 20 bp, Artificial
  CRISPR gRNA sequence
tttcaaggtgaggacaatag

SEQ ID NO: 576122 - DNA, 20 bp, Artificial
  CRISPR gRNA sequence
tcaaggtgaggacaatagaa

SEQ ID NO: 576123 - DNA, 20 bp, Artificial
  CRISPR gRNA sequence
aggtgaggacaatagaagag

SEQ ID NO: 576124 - DNA, 20 bp, Artificial
  CRISPR gRNA sequence
ggtgaggacaatagaagagc

SEQ ID NO: 576125 - DNA, 20 bp, Artificial
  CRISPR gRNA sequence
atagaagagcaggtcttgcg

SEQ ID NO: 576126 - DNA, 20 bp, Artificial
  CRISPR gRNA sequence
agagcaggtcttgcgtggct

SEQ ID NO: 576127 - DNA, 20 bp, Artificial
  CRISPR gRNA sequence
caggtcttgcgtggcttgga

SEQ ID NO: 576128 - DNA, 20 bp, Artificial
  CRISPR gRNA sequence
aggtcttgcgtggcttggac

SEQ ID NO: 576129 - DNA, 20 bp, Artificial
  CRISPR gRNA sequence
ggtcttgcgtggcttggaca

SEQ ID NO: 576130 - DNA, 20 bp, Artificial
  CRISPR gRNA sequence
ttgcgtggcttggacaggga

SEQ ID NO: 576131 - DNA, 20 bp, Artificial
  CRISPR gRNA sequence
gcgtggcttggacagggaaa

SEQ ID NO: 576132 - DNA, 20 bp, Artificial
  CRISPR gRNA sequence
cgtggcttggacagggaaag

SEQ ID NO: 576133 - DNA, 20 bp, Artificial
  CRISPR gRNA sequence
tggcttggacagggaaagag

SEQ ID NO: 576134 - DNA, 20 bp, Artificial
  CRISPR gRNA sequence
cttggacagggaaagaggag

SEQ ID NO: 576135 - DNA, 20 bp, Artificial
  CRISPR gRNA sequence
ttggacagggaaagaggaga

SEQ ID NO: 576136 - DNA, 20 bp, Artificial
  CRISPR gRNA sequence
ggacagggaaagaggagaag

SEQ ID NO: 576137 - DNA, 20 bp, Artificial
  CRISPR gRNA sequence
cagggaaagaggagaaggag

SEQ ID NO: 576138 - DNA, 20 bp, Artificial
  CRISPR gRNA sequence
agggaaagaggagaaggagt

SEQ ID NO: 576139 - DNA, 20 bp, Artificial
  CRISPR gRNA sequence
aggagaaggagtgggcattt

SEQ ID NO: 576140 - DNA, 20 bp, Artificial
  CRISPR gRNA sequence
ggagaaggagtgggcatttg

SEQ ID NO: 576141 - DNA, 20 bp, Artificial
  CRISPR gRNA sequence
gaaggagtgggcatttgagg

SEQ ID NO: 576142 - DNA, 20 bp, Artificial
  CRISPR gRNA sequence
aaggagtgggcatttgaggc

SEQ ID NO: 576143 - DNA, 20 bp, Artificial
  CRISPR gRNA sequence
aggagtgggcatttgaggca

SEQ ID NO: 576144 - DNA, 20 bp, Artificial
  CRISPR gRNA sequence
ggagtgggcatttgaggcag

SEQ ID NO: 576145 - DNA, 20 bp, Artificial
  CRISPR gRNA sequence
gagtgggcatttgaggcagg

SEQ ID NO: 576146 - DNA, 20 bp, Artificial
  CRISPR gRNA sequence
ggcatttgaggcagggggtg

SEQ ID NO: 576147 - DNA, 20 bp, Artificial
  CRISPR gRNA sequence
tgaggcagggggtgtagcat

SEQ ID NO: 576148 - DNA, 20 bp, Artificial
  CRISPR gRNA sequence
gcagggggtgtagcatgagc

SEQ ID NO: 576149 - DNA, 20 bp, Artificial
  CRISPR gRNA sequence
cagggggtgtagcatgagcc

SEQ ID NO: 576150 - DNA, 20 bp, Artificial
  CRISPR gRNA sequence
gtgtagcatgagccaggctt

SEQ ID NO: 576151 - DNA, 20 bp, Artificial
  CRISPR gRNA sequence
tgtagcatgagccaggcttg

SEQ ID NO: 576152 - DNA, 20 bp, Artificial
  CRISPR gRNA sequence
gtagcatgagccaggcttga

SEQ ID NO: 576153 - DNA, 20 bp, Artificial
  CRISPR gRNA sequence
catgagccaggcttgagggc

SEQ ID NO: 576154 - DNA, 20 bp, Artificial
  CRISPR gRNA sequence
caggcttgagggccagaaat

SEQ ID NO: 576155 - DNA, 20 bp, Artificial
  CRISPR gRNA sequence
aggcttgagggccagaaatt

SEQ ID NO: 576156 - DNA, 20 bp, Artificial
  CRISPR gRNA sequence
ggcttgagggccagaaattg

SEQ ID NO: 576157 - DNA, 20 bp, Artificial
  CRISPR gRNA sequence
gaaattggggtgaactctga

SEQ ID NO: 576158 - DNA, 20 bp, Artificial
  CRISPR gRNA sequence
aaattggggtgaactctgat

SEQ ID NO: 576159 - DNA, 20 bp, Artificial
  CRISPR gRNA sequence
aattggggtgaactctgatg

SEQ ID NO: 576160 - DNA, 20 bp, Artificial
  CRISPR gRNA sequence
attggggtgaactctgatgg

SEQ ID NO: 576161 - DNA, 20 bp, Artificial
  CRISPR gRNA sequence
gggtgaactctgatgggggc

SEQ ID NO: 576162 - DNA, 20 bp, Artificial
  CRISPR gRNA sequence
ggtgaactctgatgggggct

SEQ ID NO: 576163 - DNA, 20 bp, Artificial
  CRISPR gRNA sequence
gaactctgatgggggctggg

SEQ ID NO: 576164 - DNA, 20 bp, Artificial
  CRISPR gRNA sequence
actctgatgggggctgggta

SEQ ID NO: 576165 - DNA, 20 bp, Artificial
  CRISPR gRNA sequence
ctgatgggggctgggtagag

SEQ ID NO: 576166 - DNA, 20 bp, Artificial
  CRISPR gRNA sequence
gctgggtagagaagcttcta

SEQ ID NO: 576167 - DNA, 20 bp, Artificial
  CRISPR gRNA sequence
ctgggtagagaagcttctac

SEQ ID NO: 576168 - DNA, 20 bp, Artificial
  CRISPR gRNA sequence
agagaagcttctacaggccc

SEQ ID NO: 576169 - DNA, 20 bp, Artificial
  CRISPR gRNA sequence
gcttctacaggccccagctc

SEQ ID NO: 576170 - DNA, 20 bp, Artificial
  CRISPR gRNA sequence
ttctacaggccccagctcaa

SEQ ID NO: 576171 - DNA, 20 bp, Artificial
  CRISPR gRNA sequence
ctctctgtcacttgccatgc

SEQ ID NO: 576172 - DNA, 20 bp, Artificial
  CRISPR gRNA sequence
tccgtgcatgatcacactcc

SEQ ID NO: 576173 - DNA, 20 bp, Artificial
  CRISPR gRNA sequence
tggactcgcctccttgccct

SEQ ID NO: 576174 - DNA, 20 bp, Artificial
  CRISPR gRNA sequence
cgcctccttgccctgagatc

SEQ ID NO: 576175 - DNA, 20 bp, Artificial
  CRISPR gRNA sequence
gagatccagacccccgtatt

SEQ ID NO: 576176 - DNA, 20 bp, Artificial
  CRISPR gRNA sequence
cccgtattcagctgccccct

SEQ ID NO: 576177 - DNA, 20 bp, Artificial
  CRISPR gRNA sequence
tccactcacatatttaatgc

SEQ ID NO: 576178 - DNA, 20 bp, Artificial
  CRISPR gRNA sequence
ccccgccatgtcccccatct

SEQ ID NO: 576179 - DNA, 20 bp, Artificial
  CRISPR gRNA sequence
cccgccatgtcccccatctc

SEQ ID NO: 576180 - DNA, 20 bp, Artificial
  CRISPR gRNA sequence
tcccccatctcaggtaatgt

SEQ ID NO: 576181 - DNA, 20 bp, Artificial
  CRISPR gRNA sequence
catctcaggtaatgtcagct

SEQ ID NO: 576182 - DNA, 20 bp, Artificial
  CRISPR gRNA sequence
taatgtcagctcggtccttc

SEQ ID NO: 576183 - DNA, 20 bp, Artificial
  CRISPR gRNA sequence
ctcggtccttccagctgctc

SEQ ID NO: 576184 - DNA, 20 bp, Artificial
  CRISPR gRNA sequence
ccctcttgcccactacatcc

SEQ ID NO: 576185 - DNA, 20 bp, Artificial
  CRISPR gRNA sequence
gcccactacatccaagctgc

SEQ ID NO: 576186 - DNA, 20 bp, Artificial
  CRISPR gRNA sequence
tgctagcactgctcctgatc

SEQ ID NO: 576187 - DNA, 20 bp, Artificial
  CRISPR gRNA sequence
cactgctcctgatccagctt

SEQ ID NO: 576188 - DNA, 20 bp, Artificial
  CRISPR gRNA sequence
tcctgatccagcttcagatt

SEQ ID NO: 576189 - DNA, 20 bp, Artificial
  CRISPR gRNA sequence
tccagcttcagattaagtct

SEQ ID NO: 576190 - DNA, 20 bp, Artificial
  CRISPR gRNA sequence
ctcgccttctccactgccac

SEQ ID NO: 576191 - DNA, 20 bp, Artificial
  CRISPR gRNA sequence
gccaccagcccattctgtgc

SEQ ID NO: 576192 - DNA, 20 bp, Artificial
  CRISPR gRNA sequence
gtgccagcatcatcacttgc

SEQ ID NO: 576193 - DNA, 20 bp, Artificial
  CRISPR gRNA sequence
tgccagcatcatcacttgcc

SEQ ID NO: 576194 - DNA, 20 bp, Artificial
  CRISPR gRNA sequence
acttgccaggactgttacaa

SEQ ID NO: 576195 - DNA, 20 bp, Artificial
  CRISPR gRNA sequence
tgttacaatagcctcctcac

SEQ ID NO: 576196 - DNA, 20 bp, Artificial
  CRISPR gRNA sequence
ctcctcactagccccactca

SEQ ID NO: 576197 - DNA, 20 bp, Artificial
  CRISPR gRNA sequence
ctcactagccccactcacag

SEQ ID NO: 576198 - DNA, 20 bp, Artificial
  CRISPR gRNA sequence
ctagccccactcacagcagc

SEQ ID NO: 576199 - DNA, 20 bp, Artificial
  CRISPR gRNA sequence
agcagccagatgaatctttt

SEQ ID NO: 576200 - DNA, 20 bp, Artificial
  CRISPR gRNA sequence
gaatcttttgagtccatgcc

SEQ ID NO: 576201 - DNA, 20 bp, Artificial
  CRISPR gRNA sequence
ttgagtccatgcctagtcac

SEQ ID NO: 576202 - DNA, 20 bp, Artificial
  CRISPR gRNA sequence
tgagtccatgcctagtcact

SEQ ID NO: 576203 - DNA, 20 bp, Artificial
  CRISPR gRNA sequence
gagtccatgcctagtcactg

SEQ ID NO: 576204 - DNA, 20 bp, Artificial
  CRISPR gRNA sequence
gcctagtcactggggcaaaa

SEQ ID NO: 576205 - DNA, 20 bp, Artificial
  CRISPR gRNA sequence
cctagtcactggggcaaaat

SEQ ID NO: 576206 - DNA, 20 bp, Artificial
  CRISPR gRNA sequence
ctggggcaaaataggactcc

SEQ ID NO: 576207 - DNA, 20 bp, Artificial
  CRISPR gRNA sequence
tggggcaaaataggactccg

SEQ ID NO: 576208 - DNA, 20 bp, Artificial
  CRISPR gRNA sequence
gggcaaaataggactccgag

SEQ ID NO: 576209 - DNA, 20 bp, Artificial
  CRISPR gRNA sequence
aaaataggactccgaggaga

SEQ ID NO: 576210 - DNA, 20 bp, Artificial
  CRISPR gRNA sequence
ggactccgaggagaaagtcc

SEQ ID NO: 576211 - DNA, 20 bp, Artificial
  CRISPR gRNA sequence
ccgaggagaaagtccgagac

SEQ ID NO: 576212 - DNA, 20 bp, Artificial
  CRISPR gRNA sequence
agaaagtccgagaccagctc

SEQ ID NO: 576213 - DNA, 20 bp, Artificial
  CRISPR gRNA sequence
agtccgagaccagctccggc

SEQ ID NO: 576214 - DNA, 20 bp, Artificial
  CRISPR gRNA sequence
gagaccagctccggcaagat

SEQ ID NO: 576215 - DNA, 20 bp, Artificial
  CRISPR gRNA sequence
tccggcaagatgagcaaaca

SEQ ID NO: 576216 - DNA, 20 bp, Artificial
  CRISPR gRNA sequence
atgagcaaacacagcctgtg

SEQ ID NO: 576217 - DNA, 20 bp, Artificial
  CRISPR gRNA sequence
tgagcaaacacagcctgtgc

SEQ ID NO: 576218 - DNA, 20 bp, Artificial
  CRISPR gRNA sequence
gagcaaacacagcctgtgca

SEQ ID NO: 576219 - DNA, 20 bp, Artificial
  CRISPR gRNA sequence
aacacagcctgtgcagggtg

SEQ ID NO: 576220 - DNA, 20 bp, Artificial
  CRISPR gRNA sequence
acacagcctgtgcagggtgc

SEQ ID NO: 576221 - DNA, 20 bp, Artificial
  CRISPR gRNA sequence
cacagcctgtgcagggtgca

SEQ ID NO: 576222 - DNA, 20 bp, Artificial
  CRISPR gRNA sequence
cagcctgtgcagggtgcagg

SEQ ID NO: 576223 - DNA, 20 bp, Artificial
  CRISPR gRNA sequence
agcctgtgcagggtgcaggg

SEQ ID NO: 576224 - DNA, 20 bp, Artificial
  CRISPR gRNA sequence
gcctgtgcagggtgcaggga

SEQ ID NO: 576225 - DNA, 20 bp, Artificial
  CRISPR gRNA sequence
gtgcagggtgcagggagggc

SEQ ID NO: 576226 - DNA, 20 bp, Artificial
  CRISPR gRNA sequence
gcagggtgcagggagggcta

SEQ ID NO: 576227 - DNA, 20 bp, Artificial
  CRISPR gRNA sequence
cagggtgcagggagggctag

SEQ ID NO: 576228 - DNA, 20 bp, Artificial
  CRISPR gRNA sequence
gcagggagggctagaggcct

SEQ ID NO: 576229 - DNA, 20 bp, Artificial
  CRISPR gRNA sequence
cagggagggctagaggcctg

SEQ ID NO: 576230 - DNA, 20 bp, Artificial
  CRISPR gRNA sequence
tagaggcctgaggcttgaaa

SEQ ID NO: 576231 - DNA, 20 bp, Artificial
  CRISPR gRNA sequence
tgaggcttgaaacagctctc

SEQ ID NO: 576232 - DNA, 20 bp, Artificial
  CRISPR gRNA sequence
ggcttgaaacagctctcaag

SEQ ID NO: 576233 - DNA, 20 bp, Artificial
  CRISPR gRNA sequence
cttgaaacagctctcaagtg

SEQ ID NO: 576234 - DNA, 20 bp, Artificial
  CRISPR gRNA sequence
ttgaaacagctctcaagtgg

SEQ ID NO: 576235 - DNA, 20 bp, Artificial
  CRISPR gRNA sequence
tgaaacagctctcaagtgga

SEQ ID NO: 576236 - DNA, 20 bp, Artificial
  CRISPR gRNA sequence
gaaacagctctcaagtggag

SEQ ID NO: 576237 - DNA, 20 bp, Artificial
  CRISPR gRNA sequence
aaacagctctcaagtggagg

SEQ ID NO: 576238 - DNA, 20 bp, Artificial
  CRISPR gRNA sequence
ggaaacaaccattgccctca

SEQ ID NO: 576239 - DNA, 20 bp, Artificial
  CRISPR gRNA sequence
aaacaaccattgccctcata

SEQ ID NO: 576240 - DNA, 20 bp, Artificial
  CRISPR gRNA sequence
aacaaccattgccctcatag

SEQ ID NO: 576241 - DNA, 20 bp, Artificial
  CRISPR gRNA sequence
catagaggacacatccacac

SEQ ID NO: 576242 - DNA, 20 bp, Artificial
  CRISPR gRNA sequence
atagaggacacatccacacc

SEQ ID NO: 576243 - DNA, 20 bp, Artificial
  CRISPR gRNA sequence
tagaggacacatccacacca

SEQ ID NO: 576244 - DNA, 20 bp, Artificial
  CRISPR gRNA sequence
catccacaccagggctgtgc

SEQ ID NO: 576245 - DNA, 20 bp, Artificial
  CRISPR gRNA sequence
acaccagggctgtgctagcg

SEQ ID NO: 576246 - DNA, 20 bp, Artificial
  CRISPR gRNA sequence
caccagggctgtgctagcgt

SEQ ID NO: 576247 - DNA, 20 bp, Artificial
  CRISPR gRNA sequence
cagggctgtgctagcgtggg

SEQ ID NO: 576248 - DNA, 20 bp, Artificial
  CRISPR gRNA sequence
agggctgtgctagcgtgggc

SEQ ID NO: 576249 - DNA, 20 bp, Artificial
  CRISPR gRNA sequence
ctgtgctagcgtgggcaggc

SEQ ID NO: 576250 - DNA, 20 bp, Artificial
  CRISPR gRNA sequence
gctagcgtgggcaggcaagc

SEQ ID NO: 576251 - DNA, 20 bp, Artificial
  CRISPR gRNA sequence
ctagcgtgggcaggcaagcc

SEQ ID NO: 576252 - DNA, 20 bp, Artificial
  CRISPR gRNA sequence
tgggcaggcaagccaggtgc

SEQ ID NO: 576253 - DNA, 20 bp, Artificial
  CRISPR gRNA sequence
aggtgctggacctctgcacg

SEQ ID NO: 576254 - DNA, 20 bp, Artificial
  CRISPR gRNA sequence
ggtgctggacctctgcacgt

SEQ ID NO: 576255 - DNA, 20 bp, Artificial
  CRISPR gRNA sequence
gtgctggacctctgcacgtg

SEQ ID NO: 576256 - DNA, 20 bp, Artificial
  CRISPR gRNA sequence
ctctgcacgtggggcatgtg

SEQ ID NO: 576257 - DNA, 20 bp, Artificial
  CRISPR gRNA sequence
tctgcacgtggggcatgtgt

SEQ ID NO: 576258 - DNA, 20 bp, Artificial
  CRISPR gRNA sequence
tgtacatgtacctgtgttct

SEQ ID NO: 576259 - DNA, 20 bp, Artificial
  CRISPR gRNA sequence
tgtgtgtgtgtgtgtgtgtc

SEQ ID NO: 576260 - DNA, 20 bp, Artificial
  CRISPR gRNA sequence
tgtgtgtgtgtgtgtgtcta

SEQ ID NO: 576261 - DNA, 20 bp, Artificial
  CRISPR gRNA sequence
tgtgtgtgtgtgtctagagc

SEQ ID NO: 576262 - DNA, 20 bp, Artificial
  CRISPR gRNA sequence
gtgtgtgtgtgtctagagct

SEQ ID NO: 576263 - DNA, 20 bp, Artificial
  CRISPR gRNA sequence
tgtgtgtgtgtctagagctg

SEQ ID NO: 576264 - DNA, 20 bp, Artificial
  CRISPR gRNA sequence
ctagagctggggtgcaacta

SEQ ID NO: 576265 - DNA, 20 bp, Artificial
  CRISPR gRNA sequence
tagagctggggtgcaactat

SEQ ID NO: 576266 - DNA, 20 bp, Artificial
  CRISPR gRNA sequence
agagctggggtgcaactatg

SEQ ID NO: 576267 - DNA, 20 bp, Artificial
  CRISPR gRNA sequence
ggtgcaactatggggcccct

SEQ ID NO: 576268 - DNA, 20 bp, Artificial
  CRISPR gRNA sequence
gtgcaactatggggcccctc

SEQ ID NO: 576269 - DNA, 20 bp, Artificial
  CRISPR gRNA sequence
gggcccctcgggacatgtcc

SEQ ID NO: 576270 - DNA, 20 bp, Artificial
  CRISPR gRNA sequence
cagccaatgcctgctttgac

SEQ ID NO: 576271 - DNA, 20 bp, Artificial
  CRISPR gRNA sequence
gccaatgcctgctttgacca

SEQ ID NO: 576272 - DNA, 20 bp, Artificial
  CRISPR gRNA sequence
ccaatgcctgctttgaccag

SEQ ID NO: 576273 - DNA, 20 bp, Artificial
  CRISPR gRNA sequence
aatgcctgctttgaccagag

SEQ ID NO: 576274 - DNA, 20 bp, Artificial
  CRISPR gRNA sequence
tgaccagaggagtgtccacg

SEQ ID NO: 576275 - DNA, 20 bp, Artificial
  CRISPR gRNA sequence
agaggagtgtccacgtggct

SEQ ID NO: 576276 - DNA, 20 bp, Artificial
  CRISPR gRNA sequence
gaggagtgtccacgtggctc

SEQ ID NO: 576277 - DNA, 20 bp, Artificial
  CRISPR gRNA sequence
gagtgtccacgtggctcagg

SEQ ID NO: 576278 - DNA, 20 bp, Artificial
  CRISPR gRNA sequence
tccacgtggctcaggtggtc

SEQ ID NO: 576279 - DNA, 20 bp, Artificial
  CRISPR gRNA sequence
tcgagtatctcataccgccc

SEQ ID NO: 576280 - DNA, 20 bp, Artificial
  CRISPR gRNA sequence
cctttcccctattgtctacg

SEQ ID NO: 576281 - DNA, 20 bp, Artificial
  CRISPR gRNA sequence
ttgtctacgcagcctgccct

SEQ ID NO: 576282 - DNA, 20 bp, Artificial
  CRISPR gRNA sequence
tacgcagcctgcccttggac

SEQ ID NO: 576283 - DNA, 20 bp, Artificial
  CRISPR gRNA sequence
acgcagcctgcccttggaca

SEQ ID NO: 576284 - DNA, 20 bp, Artificial
  CRISPR gRNA sequence
aaggacccgatgcccaaccc

SEQ ID NO: 576285 - DNA, 20 bp, Artificial
  CRISPR gRNA sequence
aggacccgatgcccaacccc

SEQ ID NO: 576286 - DNA, 20 bp, Artificial
  CRISPR gRNA sequence
ccgatgcccaaccccaggcc

SEQ ID NO: 576287 - DNA, 20 bp, Artificial
  CRISPR gRNA sequence
tgcccaaccccaggcctggc

SEQ ID NO: 576288 - DNA, 20 bp, Artificial
  CRISPR gRNA sequence
ccccaggcctggcaagccct

SEQ ID NO: 576289 - DNA, 20 bp, Artificial
  CRISPR gRNA sequence
caagccctcggccccttcct

SEQ ID NO: 576290 - DNA, 20 bp, Artificial
  CRISPR gRNA sequence
tcggccccttccttggccct

SEQ ID NO: 576291 - DNA, 20 bp, Artificial
  CRISPR gRNA sequence
cttggcccttggcccatccc

SEQ ID NO: 576292 - DNA, 20 bp, Artificial
  CRISPR gRNA sequence
ttggcccttggcccatcccc

SEQ ID NO: 576293 - DNA, 20 bp, Artificial
  CRISPR gRNA sequence
ggcccttggcccatccccag

SEQ ID NO: 576294 - DNA, 20 bp, Artificial
  CRISPR gRNA sequence
ccatccccaggagcctcgcc

SEQ ID NO: 576295 - DNA, 20 bp, Artificial
  CRISPR gRNA sequence
ccccaggagcctcgcccagc

SEQ ID NO: 576296 - DNA, 20 bp, Artificial
  CRISPR gRNA sequence
ccaggagcctcgcccagctg

SEQ ID NO: 576297 - DNA, 20 bp, Artificial
  CRISPR gRNA sequence
caggagcctcgcccagctgg

SEQ ID NO: 576298 - DNA, 20 bp, Artificial
  CRISPR gRNA sequence
aggagcctcgcccagctgga

SEQ ID NO: 576299 - DNA, 20 bp, Artificial
  CRISPR gRNA sequence
cagctggagggctgcaccca

SEQ ID NO: 576300 - DNA, 20 bp, Artificial
  CRISPR gRNA sequence
gagggctgcacccaaagcct

SEQ ID NO: 576301 - DNA, 20 bp, Artificial
  CRISPR gRNA sequence
acccaaagcctcagacctgc

SEQ ID NO: 576302 - DNA, 20 bp, Artificial
  CRISPR gRNA sequence
cccaaagcctcagacctgct

SEQ ID NO: 576303 - DNA, 20 bp, Artificial
  CRISPR gRNA sequence
ccaaagcctcagacctgctg

SEQ ID NO: 576304 - DNA, 20 bp, Artificial
  CRISPR gRNA sequence
caaagcctcagacctgctgg

SEQ ID NO: 576305 - DNA, 20 bp, Artificial
  CRISPR gRNA sequence
cctcagacctgctgggggcc

SEQ ID NO: 576306 - DNA, 20 bp, Artificial
  CRISPR gRNA sequence
ctcagacctgctgggggccc

SEQ ID NO: 576307 - DNA, 20 bp, Artificial
  CRISPR gRNA sequence
tcagacctgctgggggcccg

SEQ ID NO: 576308 - DNA, 20 bp, Artificial
  CRISPR gRNA sequence
cctgctgggggcccggggcc

SEQ ID NO: 576309 - DNA, 20 bp, Artificial
  CRISPR gRNA sequence
ctgctgggggcccggggccc

SEQ ID NO: 576310 - DNA, 20 bp, Artificial
  CRISPR gRNA sequence
tgctgggggcccggggccca

SEQ ID NO: 576311 - DNA, 20 bp, Artificial
  CRISPR gRNA sequence
gctgggggcccggggcccag

SEQ ID NO: 576312 - DNA, 20 bp, Artificial
  CRISPR gRNA sequence
ctgggggcccggggcccagg

SEQ ID NO: 576313 - DNA, 20 bp, Artificial
  CRISPR gRNA sequence
ggggcccagggggaaccttc

SEQ ID NO: 576314 - DNA, 20 bp, Artificial
  CRISPR gRNA sequence
gggcccagggggaaccttcc

SEQ ID NO: 576315 - DNA, 20 bp, Artificial
  CRISPR gRNA sequence
ggcccagggggaaccttcca

SEQ ID NO: 576316 - DNA, 20 bp, Artificial
  CRISPR gRNA sequence
agggggaaccttccagggcc

SEQ ID NO: 576317 - DNA, 20 bp, Artificial
  CRISPR gRNA sequence
cttccagggccgagatcttc

SEQ ID NO: 576318 - DNA, 20 bp, Artificial
  CRISPR gRNA sequence
ttccagggccgagatcttcg

SEQ ID NO: 576319 - DNA, 20 bp, Artificial
  CRISPR gRNA sequence
cagggccgagatcttcgagg

SEQ ID NO: 576320 - DNA, 20 bp, Artificial
  CRISPR gRNA sequence
agggccgagatcttcgaggc

SEQ ID NO: 576321 - DNA, 20 bp, Artificial
  CRISPR gRNA sequence
gggccgagatcttcgaggcg

SEQ ID NO: 576322 - DNA, 20 bp, Artificial
  CRISPR gRNA sequence
tgaaccccatgccaccatcg

SEQ ID NO: 576323 - DNA, 20 bp, Artificial
  CRISPR gRNA sequence
ccatgccaccatcgcagctg

SEQ ID NO: 576324 - DNA, 20 bp, Artificial
  CRISPR gRNA sequence
catgccaccatcgcagctgc

SEQ ID NO: 576325 - DNA, 20 bp, Artificial
  CRISPR gRNA sequence
ccaccatcgcagctgcaggt

SEQ ID NO: 576326 - DNA, 20 bp, Artificial
  CRISPR gRNA sequence
caccatcgcagctgcaggtg

SEQ ID NO: 576327 - DNA, 20 bp, Artificial
  CRISPR gRNA sequence
cgcagctgcaggtgaggccc

SEQ ID NO: 576328 - DNA, 20 bp, Artificial
  CRISPR gRNA sequence
gcagctgcaggtgaggccct

SEQ ID NO: 576329 - DNA, 20 bp, Artificial
  CRISPR gRNA sequence
tgcaggtgaggccctgggcc

SEQ ID NO: 576330 - DNA, 20 bp, Artificial
  CRISPR gRNA sequence
gcaggtgaggccctgggccc

SEQ ID NO: 576331 - DNA, 20 bp, Artificial
  CRISPR gRNA sequence
gtgaggccctgggcccagga

SEQ ID NO: 576332 - DNA, 20 bp, Artificial
  CRISPR gRNA sequence
tgaggccctgggcccaggat

SEQ ID NO: 576333 - DNA, 20 bp, Artificial
  CRISPR gRNA sequence
gaggccctgggcccaggatg

SEQ ID NO: 576334 - DNA, 20 bp, Artificial
  CRISPR gRNA sequence
gccctgggcccaggatgggg

SEQ ID NO: 576335 - DNA, 20 bp, Artificial
  CRISPR gRNA sequence
ccctgggcccaggatggggc

SEQ ID NO: 576336 - DNA, 20 bp, Artificial
  CRISPR gRNA sequence
tgggcccaggatggggcagg

SEQ ID NO: 576337 - DNA, 20 bp, Artificial
  CRISPR gRNA sequence
gggcccaggatggggcaggc

SEQ ID NO: 576338 - DNA, 20 bp, Artificial
  CRISPR gRNA sequence
ggcccaggatggggcaggca

SEQ ID NO: 576339 - DNA, 20 bp, Artificial
  CRISPR gRNA sequence
ccaggatggggcaggcaggg

SEQ ID NO: 576340 - DNA, 20 bp, Artificial
  CRISPR gRNA sequence
caggatggggcaggcagggt

SEQ ID NO: 576341 - DNA, 20 bp, Artificial
  CRISPR gRNA sequence
aggatggggcaggcagggtg

SEQ ID NO: 576342 - DNA, 20 bp, Artificial
  CRISPR gRNA sequence
ggcaggcagggtggggtacc

SEQ ID NO: 576343 - DNA, 20 bp, Artificial
  CRISPR gRNA sequence
gggtggggtacctggaccta

SEQ ID NO: 576344 - DNA, 20 bp, Artificial
  CRISPR gRNA sequence
ggtggggtacctggacctac

SEQ ID NO: 576345 - DNA, 20 bp, Artificial
  CRISPR gRNA sequence
acaggtgccgacctttactg

SEQ ID NO: 576346 - DNA, 20 bp, Artificial
  CRISPR gRNA sequence
gccgacctttactgtggcac

SEQ ID NO: 576347 - DNA, 20 bp, Artificial
  CRISPR gRNA sequence
ccgacctttactgtggcact

SEQ ID NO: 576348 - DNA, 20 bp, Artificial
  CRISPR gRNA sequence
acctttactgtggcactggg

SEQ ID NO: 576349 - DNA, 20 bp, Artificial
  CRISPR gRNA sequence
cctttactgtggcactgggc

SEQ ID NO: 576350 - DNA, 20 bp, Artificial
  CRISPR gRNA sequence
tttactgtggcactgggcgg

SEQ ID NO: 576351 - DNA, 20 bp, Artificial
  CRISPR gRNA sequence
ttactgtggcactgggcggg

SEQ ID NO: 576352 - DNA, 20 bp, Artificial
  CRISPR gRNA sequence
tactgtggcactgggcggga

SEQ ID NO: 576353 - DNA, 20 bp, Artificial
  CRISPR gRNA sequence
actgtggcactgggcgggag

SEQ ID NO: 576354 - DNA, 20 bp, Artificial
  CRISPR gRNA sequence
ctgtggcactgggcgggagg

SEQ ID NO: 576355 - DNA, 20 bp, Artificial
  CRISPR gRNA sequence
tgtggcactgggcgggaggg

SEQ ID NO: 576356 - DNA, 20 bp, Artificial
  CRISPR gRNA sequence
gcactgggcgggaggggggc

SEQ ID NO: 576357 - DNA, 20 bp, Artificial
  CRISPR gRNA sequence
tgggcgggaggggggctggc

SEQ ID NO: 576358 - DNA, 20 bp, Artificial
  CRISPR gRNA sequence
gggcgggaggggggctggct

SEQ ID NO: 576359 - DNA, 20 bp, Artificial
  CRISPR gRNA sequence
ggcgggaggggggctggctg

SEQ ID NO: 576360 - DNA, 20 bp, Artificial
  CRISPR gRNA sequence
gaggggggctggctggggca

SEQ ID NO: 576361 - DNA, 20 bp, Artificial
  CRISPR gRNA sequence
aggggggctggctggggcac

SEQ ID NO: 576362 - DNA, 20 bp, Artificial
  CRISPR gRNA sequence
ggggctggctggggcacagg

SEQ ID NO: 576363 - DNA, 20 bp, Artificial
  CRISPR gRNA sequence
gctggctggggcacaggaag

SEQ ID NO: 576364 - DNA, 20 bp, Artificial
  CRISPR gRNA sequence
ggggcacaggaagtggtttc

SEQ ID NO: 576365 - DNA, 20 bp, Artificial
  CRISPR gRNA sequence
gggcacaggaagtggtttct

SEQ ID NO: 576366 - DNA, 20 bp, Artificial
  CRISPR gRNA sequence
aggaagtggtttctgggtcc

SEQ ID NO: 576367 - DNA, 20 bp, Artificial
  CRISPR gRNA sequence
ggaagtggtttctgggtccc

SEQ ID NO: 576368 - DNA, 20 bp, Artificial
  CRISPR gRNA sequence
gtggtttctgggtcccaggc

SEQ ID NO: 576369 - DNA, 20 bp, Artificial
  CRISPR gRNA sequence
aggcaagtctgtgacttatg

SEQ ID NO: 576370 - DNA, 20 bp, Artificial
  CRISPR gRNA sequence
tgtgacttatgcagatgttg

SEQ ID NO: 576371 - DNA, 20 bp, Artificial
  CRISPR gRNA sequence
gtgacttatgcagatgttgc

SEQ ID NO: 576372 - DNA, 20 bp, Artificial
  CRISPR gRNA sequence
tgacttatgcagatgttgca

SEQ ID NO: 576373 - DNA, 20 bp, Artificial
  CRISPR gRNA sequence
tatgcagatgttgcagggcc

SEQ ID NO: 576374 - DNA, 20 bp, Artificial
  CRISPR gRNA sequence
ccaagaaaatccccacctgc

SEQ ID NO: 576375 - DNA, 20 bp, Artificial
  CRISPR gRNA sequence
caagaaaatccccacctgcc

SEQ ID NO: 576376 - DNA, 20 bp, Artificial
  CRISPR gRNA sequence
aatccccacctgccaggcct

SEQ ID NO: 576377 - DNA, 20 bp, Artificial
  CRISPR gRNA sequence
tccccacctgccaggcctca

SEQ ID NO: 576378 - DNA, 20 bp, Artificial
  CRISPR gRNA sequence
acctgccaggcctcagagat

SEQ ID NO: 576379 - DNA, 20 bp, Artificial
  CRISPR gRNA sequence
ctgccaggcctcagagattg

SEQ ID NO: 576380 - DNA, 20 bp, Artificial
  CRISPR gRNA sequence
tgccaggcctcagagattgg

SEQ ID NO: 576381 - DNA, 20 bp, Artificial
  CRISPR gRNA sequence
cgacctcccaatccctgtct

SEQ ID NO: 576382 - DNA, 20 bp, Artificial
  CRISPR gRNA sequence
gacctcccaatccctgtctc

SEQ ID NO: 576383 - DNA, 20 bp, Artificial
  CRISPR gRNA sequence
cctcccaatccctgtctcag

SEQ ID NO: 576384 - DNA, 20 bp, Artificial
  CRISPR gRNA sequence
tcccaatccctgtctcagga

SEQ ID NO: 576385 - DNA, 20 bp, Artificial
  CRISPR gRNA sequence
cccaatccctgtctcaggag

SEQ ID NO: 576386 - DNA, 20 bp, Artificial
  CRISPR gRNA sequence
caatccctgtctcaggagag

SEQ ID NO: 576387 - DNA, 20 bp, Artificial
  CRISPR gRNA sequence
aatccctgtctcaggagagg

SEQ ID NO: 576388 - DNA, 20 bp, Artificial
  CRISPR gRNA sequence
tccctgtctcaggagaggag

SEQ ID NO: 576389 - DNA, 20 bp, Artificial
  CRISPR gRNA sequence
ccctgtctcaggagaggagg

SEQ ID NO: 576390 - DNA, 20 bp, Artificial
  CRISPR gRNA sequence
gagaggaggaggccgtattg

SEQ ID NO: 576391 - DNA, 20 bp, Artificial
  CRISPR gRNA sequence
aggccgtattgtagtcccat

SEQ ID NO: 576392 - DNA, 20 bp, Artificial
  CRISPR gRNA sequence
gtattgtagtcccatgagca

SEQ ID NO: 576393 - DNA, 20 bp, Artificial
  CRISPR gRNA sequence
tgtccccatccccatgtgac

SEQ ID NO: 576394 - DNA, 20 bp, Artificial
  CRISPR gRNA sequence
tccccatccccatgtgacaa

SEQ ID NO: 576395 - DNA, 20 bp, Artificial
  CRISPR gRNA sequence
ccatccccatgtgacaagag

SEQ ID NO: 576396 - DNA, 20 bp, Artificial
  CRISPR gRNA sequence
atccccatgtgacaagagaa

SEQ ID NO: 576397 - DNA, 20 bp, Artificial
  CRISPR gRNA sequence
tccccatgtgacaagagaag

SEQ ID NO: 576398 - DNA, 20 bp, Artificial
  CRISPR gRNA sequence
atgtgacaagagaagaggac

SEQ ID NO: 576399 - DNA, 20 bp, Artificial
  CRISPR gRNA sequence
tgtgacaagagaagaggact

SEQ ID NO: 576400 - DNA, 20 bp, Artificial
  CRISPR gRNA sequence
gtgacaagagaagaggactg

SEQ ID NO: 576401 - DNA, 20 bp, Artificial
  CRISPR gRNA sequence
aagagaagaggactggggcc

SEQ ID NO: 576402 - DNA, 20 bp, Artificial
  CRISPR gRNA sequence
agaagaggactggggccaag

SEQ ID NO: 576403 - DNA, 20 bp, Artificial
  CRISPR gRNA sequence
gaagaggactggggccaagt

SEQ ID NO: 576404 - DNA, 20 bp, Artificial
  CRISPR gRNA sequence
aggactggggccaagtaggt

SEQ ID NO: 576405 - DNA, 20 bp, Artificial
  CRISPR gRNA sequence
ggactggggccaagtaggtg

SEQ ID NO: 576406 - DNA, 20 bp, Artificial
  CRISPR gRNA sequence
gggccaagtaggtgaggtga

SEQ ID NO: 576407 - DNA, 20 bp, Artificial
  CRISPR gRNA sequence
ggccaagtaggtgaggtgac

SEQ ID NO: 576408 - DNA, 20 bp, Artificial
  CRISPR gRNA sequence
gccaagtaggtgaggtgaca

SEQ ID NO: 576409 - DNA, 20 bp, Artificial
  CRISPR gRNA sequence
gtaggtgaggtgacagggct

SEQ ID NO: 576410 - DNA, 20 bp, Artificial
  CRISPR gRNA sequence
taggtgaggtgacagggctg

SEQ ID NO: 576411 - DNA, 20 bp, Artificial
  CRISPR gRNA sequence
tgaggtgacagggctgaggc

SEQ ID NO: 576412 - DNA, 20 bp, Artificial
  CRISPR gRNA sequence
aggccagctctgcaacttat

SEQ ID NO: 576413 - DNA, 20 bp, Artificial
  CRISPR gRNA sequence
ttagctgtttgatctttaaa

SEQ ID NO: 576414 - DNA, 20 bp, Artificial
  CRISPR gRNA sequence
aaaagttactcgatctccat

SEQ ID NO: 576415 - DNA, 20 bp, Artificial
  CRISPR gRNA sequence
tactcgatctccatgagcct

SEQ ID NO: 576416 - DNA, 20 bp, Artificial
  CRISPR gRNA sequence
ctcagtttccatacgtgtaa

SEQ ID NO: 576417 - DNA, 20 bp, Artificial
  CRISPR gRNA sequence
tcagtttccatacgtgtaaa

SEQ ID NO: 576418 - DNA, 20 bp, Artificial
  CRISPR gRNA sequence
cagtttccatacgtgtaaaa

SEQ ID NO: 576419 - DNA, 20 bp, Artificial
  CRISPR gRNA sequence
agtttccatacgtgtaaaag

SEQ ID NO: 576420 - DNA, 20 bp, Artificial
  CRISPR gRNA sequence
gtttccatacgtgtaaaagg

SEQ ID NO: 576421 - DNA, 20 bp, Artificial
  CRISPR gRNA sequence
gtgtaaaagggggatgatca

SEQ ID NO: 576422 - DNA, 20 bp, Artificial
  CRISPR gRNA sequence
tgatcatagcatctaccatg

SEQ ID NO: 576423 - DNA, 20 bp, Artificial
  CRISPR gRNA sequence
gatcatagcatctaccatgt

SEQ ID NO: 576424 - DNA, 20 bp, Artificial
  CRISPR gRNA sequence
gcatctaccatgtgggcttg

SEQ ID NO: 576425 - DNA, 20 bp, Artificial
  CRISPR gRNA sequence
taccatgtgggcttgcagtg

SEQ ID NO: 576426 - DNA, 20 bp, Artificial
  CRISPR gRNA sequence
ccatgtgggcttgcagtgca

SEQ ID NO: 576427 - DNA, 20 bp, Artificial
  CRISPR gRNA sequence
gcagtgcagagtatttgaat

SEQ ID NO: 576428 - DNA, 20 bp, Artificial
  CRISPR gRNA sequence
cagagtatttgaattagaca

SEQ ID NO: 576429 - DNA, 20 bp, Artificial
  CRISPR gRNA sequence
tatttgaattagacacagaa

SEQ ID NO: 576430 - DNA, 20 bp, Artificial
  CRISPR gRNA sequence
tgaattagacacagaacagt

SEQ ID NO: 576431 - DNA, 20 bp, Artificial
  CRISPR gRNA sequence
gaattagacacagaacagtg

SEQ ID NO: 576432 - DNA, 20 bp, Artificial
  CRISPR gRNA sequence
agacacagaacagtgaggat

SEQ ID NO: 576433 - DNA, 20 bp, Artificial
  CRISPR gRNA sequence
gacacagaacagtgaggatc

SEQ ID NO: 576434 - DNA, 20 bp, Artificial
  CRISPR gRNA sequence
cagaacagtgaggatcagga

SEQ ID NO: 576435 - DNA, 20 bp, Artificial
  CRISPR gRNA sequence
cacccacctgcctttctgcc

SEQ ID NO: 576436 - DNA, 20 bp, Artificial
  CRISPR gRNA sequence
ccagctgcccacactgcccc

SEQ ID NO: 576437 - DNA, 20 bp, Artificial
  CRISPR gRNA sequence
gcccacactgcccctagtca

SEQ ID NO: 576438 - DNA, 20 bp, Artificial
  CRISPR gRNA sequence
cacactgcccctagtcatgg

SEQ ID NO: 576439 - DNA, 20 bp, Artificial
  CRISPR gRNA sequence
ctagtcatggtggcaccctc

SEQ ID NO: 576440 - DNA, 20 bp, Artificial
  CRISPR gRNA sequence
tagtcatggtggcaccctcc

SEQ ID NO: 576441 - DNA, 20 bp, Artificial
  CRISPR gRNA sequence
agtcatggtggcaccctccg

SEQ ID NO: 576442 - DNA, 20 bp, Artificial
  CRISPR gRNA sequence
tggtggcaccctccggggca

SEQ ID NO: 576443 - DNA, 20 bp, Artificial
  CRISPR gRNA sequence
ggcaccctccggggcacggc

SEQ ID NO: 576444 - DNA, 20 bp, Artificial
  CRISPR gRNA sequence
gcaccctccggggcacggct

SEQ ID NO: 576445 - DNA, 20 bp, Artificial
  CRISPR gRNA sequence
tgggccccttgccccactta

SEQ ID NO: 576446 - DNA, 20 bp, Artificial
  CRISPR gRNA sequence
gggccccttgccccacttac

SEQ ID NO: 576447 - DNA, 20 bp, Artificial
  CRISPR gRNA sequence
cccacttacaggcactcctc

SEQ ID NO: 576448 - DNA, 20 bp, Artificial
  CRISPR gRNA sequence
ccacttacaggcactcctcc

SEQ ID NO: 576449 - DNA, 20 bp, Artificial
  CRISPR gRNA sequence
ttacaggcactcctccagga

SEQ ID NO: 576450 - DNA, 20 bp, Artificial
  CRISPR gRNA sequence
tacaggcactcctccaggac

SEQ ID NO: 576451 - DNA, 20 bp, Artificial
  CRISPR gRNA sequence
acaggccacatttcatgcac

SEQ ID NO: 576452 - DNA, 20 bp, Artificial
  CRISPR gRNA sequence
caggccacatttcatgcacc

SEQ ID NO: 576453 - DNA, 20 bp, Artificial
  CRISPR gRNA sequence
cacatttcatgcaccaggta

SEQ ID NO: 576454 - DNA, 20 bp, Artificial
  CRISPR gRNA sequence
tttcatgcaccaggtatgga

SEQ ID NO: 576455 - DNA, 20 bp, Artificial
  CRISPR gRNA sequence
caccaggtatggacggtgaa

SEQ ID NO: 576456 - DNA, 20 bp, Artificial
  CRISPR gRNA sequence
accaggtatggacggtgaat

SEQ ID NO: 576457 - DNA, 20 bp, Artificial
  CRISPR gRNA sequence
aggtatggacggtgaatggg

SEQ ID NO: 576458 - DNA, 20 bp, Artificial
  CRISPR gRNA sequence
ggtatggacggtgaatgggc

SEQ ID NO: 576459 - DNA, 20 bp, Artificial
  CRISPR gRNA sequence
gtatggacggtgaatgggca

SEQ ID NO: 576460 - DNA, 20 bp, Artificial
  CRISPR gRNA sequence
atggacggtgaatgggcagg

SEQ ID NO: 576461 - DNA, 20 bp, Artificial
  CRISPR gRNA sequence
tggacggtgaatgggcaggg

SEQ ID NO: 576462 - DNA, 20 bp, Artificial
  CRISPR gRNA sequence
gacggtgaatgggcagggag

SEQ ID NO: 576463 - DNA, 20 bp, Artificial
  CRISPR gRNA sequence
acggtgaatgggcagggagg

SEQ ID NO: 576464 - DNA, 20 bp, Artificial
  CRISPR gRNA sequence
cggtgaatgggcagggagga

SEQ ID NO: 576465 - DNA, 20 bp, Artificial
  CRISPR gRNA sequence
gtgaatgggcagggaggagg

SEQ ID NO: 576466 - DNA, 20 bp, Artificial
  CRISPR gRNA sequence
aatgggcagggaggagggag

SEQ ID NO: 576467 - DNA, 20 bp, Artificial
  CRISPR gRNA sequence
atgggcagggaggagggagc

SEQ ID NO: 576468 - DNA, 20 bp, Artificial
  CRISPR gRNA sequence
ggcagggaggagggagcagg

SEQ ID NO: 576469 - DNA, 20 bp, Artificial
  CRISPR gRNA sequence
gcagggaggagggagcaggt

SEQ ID NO: 576470 - DNA, 20 bp, Artificial
  CRISPR gRNA sequence
agggaggagggagcaggtgg

SEQ ID NO: 576471 - DNA, 20 bp, Artificial
  CRISPR gRNA sequence
gggagcaggtgggagaactg

SEQ ID NO: 576472 - DNA, 20 bp, Artificial
  CRISPR gRNA sequence
ggagcaggtgggagaactgt

SEQ ID NO: 576473 - DNA, 20 bp, Artificial
  CRISPR gRNA sequence
gagcaggtgggagaactgtg

SEQ ID NO: 576474 - DNA, 20 bp, Artificial
  CRISPR gRNA sequence
gcaggtgggagaactgtggg

SEQ ID NO: 576475 - DNA, 20 bp, Artificial
  CRISPR gRNA sequence
caggtgggagaactgtgggg

SEQ ID NO: 576476 - DNA, 20 bp, Artificial
  CRISPR gRNA sequence
aggtgggagaactgtgggga

SEQ ID NO: 576477 - DNA, 20 bp, Artificial
  CRISPR gRNA sequence
ggtgggagaactgtggggag

SEQ ID NO: 576478 - DNA, 20 bp, Artificial
  CRISPR gRNA sequence
gaactgtggggaggggcccc

SEQ ID NO: 576479 - DNA, 20 bp, Artificial
  CRISPR gRNA sequence
tgtggggaggggccccgagt

SEQ ID NO: 576480 - DNA, 20 bp, Artificial
  CRISPR gRNA sequence
gtggggaggggccccgagtc

SEQ ID NO: 576481 - DNA, 20 bp, Artificial
  CRISPR gRNA sequence
ccccgagtcaggctgaacca

SEQ ID NO: 576482 - DNA, 20 bp, Artificial
  CRISPR gRNA sequence
cacagcccacatgtgccccc

SEQ ID NO: 576483 - DNA, 20 bp, Artificial
  CRISPR gRNA sequence
atgtgccccccagctctcaa

SEQ ID NO: 576484 - DNA, 20 bp, Artificial
  CRISPR gRNA sequence
tgccccccagctctcaacgg

SEQ ID NO: 576485 - DNA, 20 bp, Artificial
  CRISPR gRNA sequence
caacggtggatgcccacgcc

SEQ ID NO: 576486 - DNA, 20 bp, Artificial
  CRISPR gRNA sequence
acgcccggacccctgtgctg

SEQ ID NO: 576487 - DNA, 20 bp, Artificial
  CRISPR gRNA sequence
cgcccggacccctgtgctgc

SEQ ID NO: 576488 - DNA, 20 bp, Artificial
  CRISPR gRNA sequence
tgtgctgcaggtgcaccccc

SEQ ID NO: 576489 - DNA, 20 bp, Artificial
  CRISPR gRNA sequence
tgctgcaggtgcaccccctg

SEQ ID NO: 576490 - DNA, 20 bp, Artificial
  CRISPR gRNA sequence
ctgcaggtgcaccccctgga

SEQ ID NO: 576491 - DNA, 20 bp, Artificial
  CRISPR gRNA sequence
ggtgcaccccctggagagcc

SEQ ID NO: 576492 - DNA, 20 bp, Artificial
  CRISPR gRNA sequence
ctggagagcccagccatgat

SEQ ID NO: 576493 - DNA, 20 bp, Artificial
  CRISPR gRNA sequence
acaccacccaccaccgccac

SEQ ID NO: 576494 - DNA, 20 bp, Artificial
  CRISPR gRNA sequence
caccacccaccaccgccact

SEQ ID NO: 576495 - DNA, 20 bp, Artificial
  CRISPR gRNA sequence
accacccaccaccgccactg

SEQ ID NO: 576496 - DNA, 20 bp, Artificial
  CRISPR gRNA sequence
ccactggggtcttctccctc

SEQ ID NO: 576497 - DNA, 20 bp, Artificial
  CRISPR gRNA sequence
cactggggtcttctccctca

SEQ ID NO: 576498 - DNA, 20 bp, Artificial
  CRISPR gRNA sequence
gggtcttctccctcaaggcc

SEQ ID NO: 576499 - DNA, 20 bp, Artificial
  CRISPR gRNA sequence
ttctccctcaaggcccggcc

SEQ ID NO: 576500 - DNA, 20 bp, Artificial
  CRISPR gRNA sequence
gcccggcctggcctcccacc

SEQ ID NO: 576501 - DNA, 20 bp, Artificial
  CRISPR gRNA sequence
cctcccacctggtaacacct

SEQ ID NO: 576502 - DNA, 20 bp, Artificial
  CRISPR gRNA sequence
acacctcagcccgtacccca

SEQ ID NO: 576503 - DNA, 20 bp, Artificial
  CRISPR gRNA sequence
gcccgtaccccatggcttca

SEQ ID NO: 576504 - DNA, 20 bp, Artificial
  CRISPR gRNA sequence
catggcttcacagaaccccc

SEQ ID NO: 576505 - DNA, 20 bp, Artificial
  CRISPR gRNA sequence
tcacagaacccccaagtccc

SEQ ID NO: 576506 - DNA, 20 bp, Artificial
  CRISPR gRNA sequence
cccccaagtccccagatcct

SEQ ID NO: 576507 - DNA, 20 bp, Artificial
  CRISPR gRNA sequence
gtccccagatccttggctgt

SEQ ID NO: 576508 - DNA, 20 bp, Artificial
  CRISPR gRNA sequence
cccagatccttggctgtgag

SEQ ID NO: 576509 - DNA, 20 bp, Artificial
  CRISPR gRNA sequence
atccttggctgtgagcagtg

SEQ ID NO: 576510 - DNA, 20 bp, Artificial
  CRISPR gRNA sequence
tccttggctgtgagcagtgt

SEQ ID NO: 576511 - DNA, 20 bp, Artificial
  CRISPR gRNA sequence
gtgtaggctattctgaattg

SEQ ID NO: 576512 - DNA, 20 bp, Artificial
  CRISPR gRNA sequence
tattctgaattgcagtactc

SEQ ID NO: 576513 - DNA, 20 bp, Artificial
  CRISPR gRNA sequence
attctgaattgcagtactct

SEQ ID NO: 576514 - DNA, 20 bp, Artificial
  CRISPR gRNA sequence
ttctgaattgcagtactctg

SEQ ID NO: 576515 - DNA, 20 bp, Artificial
  CRISPR gRNA sequence
tctgaattgcagtactctgg

SEQ ID NO: 576516 - DNA, 20 bp, Artificial
  CRISPR gRNA sequence
ttgcagtactctgggggtca

SEQ ID NO: 576517 - DNA, 20 bp, Artificial
  CRISPR gRNA sequence
tgcagtactctgggggtcaa

SEQ ID NO: 576518 - DNA, 20 bp, Artificial
  CRISPR gRNA sequence
actctgggggtcaaaggtgt

SEQ ID NO: 576519 - DNA, 20 bp, Artificial
  CRISPR gRNA sequence
ctctgggggtcaaaggtgtc

SEQ ID NO: 576520 - DNA, 20 bp, Artificial
  CRISPR gRNA sequence
gggtcaaaggtgtcaggtct

SEQ ID NO: 576521 - DNA, 20 bp, Artificial
  CRISPR gRNA sequence
gtcaaaggtgtcaggtctca

SEQ ID NO: 576522 - DNA, 20 bp, Artificial
  CRISPR gRNA sequence
tcaaaggtgtcaggtctcag

SEQ ID NO: 576523 - DNA, 20 bp, Artificial
  CRISPR gRNA sequence
ggtgtcaggtctcagaggct

SEQ ID NO: 576524 - DNA, 20 bp, Artificial
  CRISPR gRNA sequence
ctccaccctccaaaaaacgt

SEQ ID NO: 576525 - DNA, 20 bp, Artificial
  CRISPR gRNA sequence
tccaccctccaaaaaacgtc

SEQ ID NO: 576526 - DNA, 20 bp, Artificial
  CRISPR gRNA sequence
cctccaaaaaacgtcaggtg

SEQ ID NO: 576527 - DNA, 20 bp, Artificial
  CRISPR gRNA sequence
acgtcaggtgcagaacctta

SEQ ID NO: 576528 - DNA, 20 bp, Artificial
  CRISPR gRNA sequence
ggtgcagaaccttaaagatg

SEQ ID NO: 576529 - DNA, 20 bp, Artificial
  CRISPR gRNA sequence
atgtcaaaatcacaaaacca

SEQ ID NO: 576530 - DNA, 20 bp, Artificial
  CRISPR gRNA sequence
gtcaaaatcacaaaaccaca

SEQ ID NO: 576531 - DNA, 20 bp, Artificial
  CRISPR gRNA sequence
caaaaccacagagctttaca

SEQ ID NO: 576532 - DNA, 20 bp, Artificial
  CRISPR gRNA sequence
accacagagctttacaaagc

SEQ ID NO: 576533 - DNA, 20 bp, Artificial
  CRISPR gRNA sequence
tacaaagctagtcaaaatgt

SEQ ID NO: 576534 - DNA, 20 bp, Artificial
  CRISPR gRNA sequence
aaaatgtcagcacctgcgaa

SEQ ID NO: 576535 - DNA, 20 bp, Artificial
  CRISPR gRNA sequence
acctgcgaatggccgtcttt

SEQ ID NO: 576536 - DNA, 20 bp, Artificial
  CRISPR gRNA sequence
ccgtctttaagcttctctgc

SEQ ID NO: 576537 - DNA, 20 bp, Artificial
  CRISPR gRNA sequence
tctttaagcttctctgccag

SEQ ID NO: 576538 - DNA, 20 bp, Artificial
  CRISPR gRNA sequence
aagcttctctgccagaagcc

SEQ ID NO: 576539 - DNA, 20 bp, Artificial
  CRISPR gRNA sequence
agcttctctgccagaagcct

SEQ ID NO: 576540 - DNA, 20 bp, Artificial
  CRISPR gRNA sequence
ctgccagaagcctgggactt

SEQ ID NO: 576541 - DNA, 20 bp, Artificial
  CRISPR gRNA sequence
tgccagaagcctgggacttt

SEQ ID NO: 576542 - DNA, 20 bp, Artificial
  CRISPR gRNA sequence
gccagaagcctgggactttg

SEQ ID NO: 576543 - DNA, 20 bp, Artificial
  CRISPR gRNA sequence
gaagcctgggactttgggga

SEQ ID NO: 576544 - DNA, 20 bp, Artificial
  CRISPR gRNA sequence
gcctgggactttggggacag

SEQ ID NO: 576545 - DNA, 20 bp, Artificial
  CRISPR gRNA sequence
ctgggactttggggacagca

SEQ ID NO: 576546 - DNA, 20 bp, Artificial
  CRISPR gRNA sequence
ttggggacagcagagccccc

SEQ ID NO: 576547 - DNA, 20 bp, Artificial
  CRISPR gRNA sequence
tggggacagcagagccccct

SEQ ID NO: 576548 - DNA, 20 bp, Artificial
  CRISPR gRNA sequence
gggacagcagagccccctgg

SEQ ID NO: 576549 - DNA, 20 bp, Artificial
  CRISPR gRNA sequence
cagcagagccccctgggagt

SEQ ID NO: 576550 - DNA, 20 bp, Artificial
  CRISPR gRNA sequence
agcagagccccctgggagtc

SEQ ID NO: 576551 - DNA, 20 bp, Artificial
  CRISPR gRNA sequence
gcagagccccctgggagtca

SEQ ID NO: 576552 - DNA, 20 bp, Artificial
  CRISPR gRNA sequence
ccctgggagtcagggttttc

SEQ ID NO: 576553 - DNA, 20 bp, Artificial
  CRISPR gRNA sequence
cctgggagtcagggttttcg

SEQ ID NO: 576554 - DNA, 20 bp, Artificial
  CRISPR gRNA sequence
gagtcagggttttcgaggct

SEQ ID NO: 576555 - DNA, 20 bp, Artificial
  CRISPR gRNA sequence
agtcagggttttcgaggctc

SEQ ID NO: 576556 - DNA, 20 bp, Artificial
  CRISPR gRNA sequence
tcagggttttcgaggctcag

SEQ ID NO: 576557 - DNA, 20 bp, Artificial
  CRISPR gRNA sequence
cagggttttcgaggctcagg

SEQ ID NO: 576558 - DNA, 20 bp, Artificial
  CRISPR gRNA sequence
agggttttcgaggctcagga

SEQ ID NO: 576559 - DNA, 20 bp, Artificial
  CRISPR gRNA sequence
gttttcgaggctcaggaggg

SEQ ID NO: 576560 - DNA, 20 bp, Artificial
  CRISPR gRNA sequence
ttttcgaggctcaggagggt

SEQ ID NO: 576561 - DNA, 20 bp, Artificial
  CRISPR gRNA sequence
tcgaggctcaggagggtggg

SEQ ID NO: 576562 - DNA, 20 bp, Artificial
  CRISPR gRNA sequence
gagggtgggaagctcaaaat

SEQ ID NO: 576563 - DNA, 20 bp, Artificial
  CRISPR gRNA sequence
gggtgggaagctcaaaatga

SEQ ID NO: 576564 - DNA, 20 bp, Artificial
  CRISPR gRNA sequence
ggtgggaagctcaaaatgag

SEQ ID NO: 576565 - DNA, 20 bp, Artificial
  CRISPR gRNA sequence
gctcaaaatgagaggccttg

SEQ ID NO: 576566 - DNA, 20 bp, Artificial
  CRISPR gRNA sequence
ctcaaaatgagaggccttgt

SEQ ID NO: 576567 - DNA, 20 bp, Artificial
  CRISPR gRNA sequence
aatgagaggccttgtgggcc

SEQ ID NO: 576568 - DNA, 20 bp, Artificial
  CRISPR gRNA sequence
aggccttgtgggccaagctc

SEQ ID NO: 576569 - DNA, 20 bp, Artificial
  CRISPR gRNA sequence
gccttgtgggccaagctcca

SEQ ID NO: 576570 - DNA, 20 bp, Artificial
  CRISPR gRNA sequence
gtgggccaagctccagagcc

SEQ ID NO: 576571 - DNA, 20 bp, Artificial
  CRISPR gRNA sequence
aagctccagagcccagccca

SEQ ID NO: 576572 - DNA, 20 bp, Artificial
  CRISPR gRNA sequence
agcccagcccacagcctcca

SEQ ID NO: 576573 - DNA, 20 bp, Artificial
  CRISPR gRNA sequence
gcccagcccacagcctccat

SEQ ID NO: 576574 - DNA, 20 bp, Artificial
  CRISPR gRNA sequence
aggtgccctgtccccaccca

SEQ ID NO: 576575 - DNA, 20 bp, Artificial
  CRISPR gRNA sequence
ggtgccctgtccccacccac

SEQ ID NO: 576576 - DNA, 20 bp, Artificial
  CRISPR gRNA sequence
gtgccctgtccccacccaca

SEQ ID NO: 576577 - DNA, 20 bp, Artificial
  CRISPR gRNA sequence
cccacccacagggatcaacg

SEQ ID NO: 576578 - DNA, 20 bp, Artificial
  CRISPR gRNA sequence
cccacagggatcaacgtggc

SEQ ID NO: 576579 - DNA, 20 bp, Artificial
  CRISPR gRNA sequence
agggatcaacgtggccagcc

SEQ ID NO: 576580 - DNA, 20 bp, Artificial
  CRISPR gRNA sequence
tcaacgtggccagcctggaa

SEQ ID NO: 576581 - DNA, 20 bp, Artificial
  CRISPR gRNA sequence
caacgtggccagcctggaat

SEQ ID NO: 576582 - DNA, 20 bp, Artificial
  CRISPR gRNA sequence
gccagcctggaatgggtgtc

SEQ ID NO: 576583 - DNA, 20 bp, Artificial
  CRISPR gRNA sequence
ccagcctggaatgggtgtcc

SEQ ID NO: 576584 - DNA, 20 bp, Artificial
  CRISPR gRNA sequence
cagcctggaatgggtgtcca

SEQ ID NO: 576585 - DNA, 20 bp, Artificial
  CRISPR gRNA sequence
gcctggaatgggtgtccagg

SEQ ID NO: 576586 - DNA, 20 bp, Artificial
  CRISPR gRNA sequence
ggaatgggtgtccagggagc

SEQ ID NO: 576587 - DNA, 20 bp, Artificial
  CRISPR gRNA sequence
ctctgcaccttcccaaatcc

SEQ ID NO: 576588 - DNA, 20 bp, Artificial
  CRISPR gRNA sequence
ttcccaaatcccagtgcacc

SEQ ID NO: 576589 - DNA, 20 bp, Artificial
  CRISPR gRNA sequence
tcccaaatcccagtgcaccc

SEQ ID NO: 576590 - DNA, 20 bp, Artificial
  CRISPR gRNA sequence
caaatcccagtgcacccagg

SEQ ID NO: 576591 - DNA, 20 bp, Artificial
  CRISPR gRNA sequence
aaatcccagtgcacccagga

SEQ ID NO: 576592 - DNA, 20 bp, Artificial
  CRISPR gRNA sequence
cccagtgcacccaggaagga

SEQ ID NO: 576593 - DNA, 20 bp, Artificial
  CRISPR gRNA sequence
ccagtgcacccaggaaggac

SEQ ID NO: 576594 - DNA, 20 bp, Artificial
  CRISPR gRNA sequence
tgcacccaggaaggacaggt

SEQ ID NO: 576595 - DNA, 20 bp, Artificial
  CRISPR gRNA sequence
acccaggaaggacaggtcag

SEQ ID NO: 576596 - DNA, 20 bp, Artificial
  CRISPR gRNA sequence
aggaaggacaggtcagtgga

SEQ ID NO: 576597 - DNA, 20 bp, Artificial
  CRISPR gRNA sequence
ggaaggacaggtcagtggac

SEQ ID NO: 576598 - DNA, 20 bp, Artificial
  CRISPR gRNA sequence
gaaggacaggtcagtggaca

SEQ ID NO: 576599 - DNA, 20 bp, Artificial
  CRISPR gRNA sequence
gacaggtcagtggacagggc

SEQ ID NO: 576600 - DNA, 20 bp, Artificial
  CRISPR gRNA sequence
acaggtcagtggacagggct

SEQ ID NO: 576601 - DNA, 20 bp, Artificial
  CRISPR gRNA sequence
ggtcagtggacagggctggg

SEQ ID NO: 576602 - DNA, 20 bp, Artificial
  CRISPR gRNA sequence
gtcagtggacagggctggga

SEQ ID NO: 576603 - DNA, 20 bp, Artificial
  CRISPR gRNA sequence
cctgacaccctctgtccccc

SEQ ID NO: 576604 - DNA, 20 bp, Artificial
  CRISPR gRNA sequence
ctgtccccccagcacccttt

SEQ ID NO: 576605 - DNA, 20 bp, Artificial
  CRISPR gRNA sequence
gcaccctttcggctgtgccc

SEQ ID NO: 576606 - DNA, 20 bp, Artificial
  CRISPR gRNA sequence
accctttcggctgtgcccca

SEQ ID NO: 576607 - DNA, 20 bp, Artificial
  CRISPR gRNA sequence
ccagagctcctacccactgc

SEQ ID NO: 576608 - DNA, 20 bp, Artificial
  CRISPR gRNA sequence
tcctacccactgctggcaaa

SEQ ID NO: 576609 - DNA, 20 bp, Artificial
  CRISPR gRNA sequence
tgctggcaaatggtgtctgc

SEQ ID NO: 576610 - DNA, 20 bp, Artificial
  CRISPR gRNA sequence
tggcaaatggtgtctgcaag

SEQ ID NO: 576611 - DNA, 20 bp, Artificial
  CRISPR gRNA sequence
aatggtgtctgcaagtggcc

SEQ ID NO: 576612 - DNA, 20 bp, Artificial
  CRISPR gRNA sequence
tctgcaagtggcccggatgt

SEQ ID NO: 576613 - DNA, 20 bp, Artificial
  CRISPR gRNA sequence
gcaagtggcccggatgtgag

SEQ ID NO: 576614 - DNA, 20 bp, Artificial
  CRISPR gRNA sequence
caagtggcccggatgtgaga

SEQ ID NO: 576615 - DNA, 20 bp, Artificial
  CRISPR gRNA sequence
cggatgtgagaaggtcttcg

SEQ ID NO: 576616 - DNA, 20 bp, Artificial
  CRISPR gRNA sequence
gatgtgagaaggtcttcgaa

SEQ ID NO: 576617 - DNA, 20 bp, Artificial
  CRISPR gRNA sequence
tgagaaggtcttcgaagagc

SEQ ID NO: 576618 - DNA, 20 bp, Artificial
  CRISPR gRNA sequence
agaaggtcttcgaagagcca

SEQ ID NO: 576619 - DNA, 20 bp, Artificial
  CRISPR gRNA sequence
gaaggtcttcgaagagccag

SEQ ID NO: 576620 - DNA, 20 bp, Artificial
  CRISPR gRNA sequence
aagagccagaggacttcctc

SEQ ID NO: 576621 - DNA, 20 bp, Artificial
  CRISPR gRNA sequence
gccagaggacttcctcaagt

SEQ ID NO: 576622 - DNA, 20 bp, Artificial
  CRISPR gRNA sequence
agaggacttcctcaagtgag

SEQ ID NO: 576623 - DNA, 20 bp, Artificial
  CRISPR gRNA sequence
acttcctcaagtgagtggcc

SEQ ID NO: 576624 - DNA, 20 bp, Artificial
  CRISPR gRNA sequence
cttcctcaagtgagtggccc

SEQ ID NO: 576625 - DNA, 20 bp, Artificial
  CRISPR gRNA sequence
tgagtggcccaggcctgtgc

SEQ ID NO: 576626 - DNA, 20 bp, Artificial
  CRISPR gRNA sequence
ccaggcctgtgccagtctac

SEQ ID NO: 576627 - DNA, 20 bp, Artificial
  CRISPR gRNA sequence
ctgtgccagtctaccggccc

SEQ ID NO: 576628 - DNA, 20 bp, Artificial
  CRISPR gRNA sequence
agtctaccggccctggcttg

SEQ ID NO: 576629 - DNA, 20 bp, Artificial
  CRISPR gRNA sequence
gtctaccggccctggcttgt

SEQ ID NO: 576630 - DNA, 20 bp, Artificial
  CRISPR gRNA sequence
tctaccggccctggcttgtg

SEQ ID NO: 576631 - DNA, 20 bp, Artificial
  CRISPR gRNA sequence
taccggccctggcttgtggg

SEQ ID NO: 576632 - DNA, 20 bp, Artificial
  CRISPR gRNA sequence
ccggccctggcttgtgggga

SEQ ID NO: 576633 - DNA, 20 bp, Artificial
  CRISPR gRNA sequence
cggccctggcttgtggggag

SEQ ID NO: 576634 - DNA, 20 bp, Artificial
  CRISPR gRNA sequence
ctggcttgtggggagaggtc

SEQ ID NO: 576635 - DNA, 20 bp, Artificial
  CRISPR gRNA sequence
tggcttgtggggagaggtct

SEQ ID NO: 576636 - DNA, 20 bp, Artificial
  CRISPR gRNA sequence
ggcttgtggggagaggtcta

SEQ ID NO: 576637 - DNA, 20 bp, Artificial
  CRISPR gRNA sequence
gtggggagaggtctagggtg

SEQ ID NO: 576638 - DNA, 20 bp, Artificial
  CRISPR gRNA sequence
gaggtctagggtgcagatct

SEQ ID NO: 576639 - DNA, 20 bp, Artificial
  CRISPR gRNA sequence
ctagggtgcagatctcagct

SEQ ID NO: 576640 - DNA, 20 bp, Artificial
  CRISPR gRNA sequence
tagggtgcagatctcagctc

SEQ ID NO: 576641 - DNA, 20 bp, Artificial
  CRISPR gRNA sequence
agctcaggcttcatcccaat

SEQ ID NO: 576642 - DNA, 20 bp, Artificial
  CRISPR gRNA sequence
tcaggcttcatcccaataag

SEQ ID NO: 576643 - DNA, 20 bp, Artificial
  CRISPR gRNA sequence
gcttcatcccaataagtagt

SEQ ID NO: 576644 - DNA, 20 bp, Artificial
  CRISPR gRNA sequence
cccaataagtagtaagatgc

SEQ ID NO: 576645 - DNA, 20 bp, Artificial
  CRISPR gRNA sequence
caataagtagtaagatgcaa

SEQ ID NO: 576646 - DNA, 20 bp, Artificial
  CRISPR gRNA sequence
agatgcaagagctaaactct

SEQ ID NO: 576647 - DNA, 20 bp, Artificial
  CRISPR gRNA sequence
agagctaaactctgagactg

SEQ ID NO: 576648 - DNA, 20 bp, Artificial
  CRISPR gRNA sequence
gagctaaactctgagactgt

SEQ ID NO: 576649 - DNA, 20 bp, Artificial
  CRISPR gRNA sequence
gagactgtgggttcaaatcc

SEQ ID NO: 576650 - DNA, 20 bp, Artificial
  CRISPR gRNA sequence
atcccagctccatccctgac

SEQ ID NO: 576651 - DNA, 20 bp, Artificial
  CRISPR gRNA sequence
cctgactggctgtgtgacct

SEQ ID NO: 576652 - DNA, 20 bp, Artificial
  CRISPR gRNA sequence
gtgaccttggacaaattact

SEQ ID NO: 576653 - DNA, 20 bp, Artificial
  CRISPR gRNA sequence
tacttagcttctctcgacct

SEQ ID NO: 576654 - DNA, 20 bp, Artificial
  CRISPR gRNA sequence
agttttctcgtatgtataat

SEQ ID NO: 576655 - DNA, 20 bp, Artificial
  CRISPR gRNA sequence
tgttatttacccccatttta

SEQ ID NO: 576656 - DNA, 20 bp, Artificial
  CRISPR gRNA sequence
tttacccccattttacagac

SEQ ID NO: 576657 - DNA, 20 bp, Artificial
  CRISPR gRNA sequence
ttacccccattttacagaca

SEQ ID NO: 576658 - DNA, 20 bp, Artificial
  CRISPR gRNA sequence
acccccattttacagacaag

SEQ ID NO: 576659 - DNA, 20 bp, Artificial
  CRISPR gRNA sequence
attttacagacaaggagact

SEQ ID NO: 576660 - DNA, 20 bp, Artificial
  CRISPR gRNA sequence
ttttacagacaaggagactg

SEQ ID NO: 576661 - DNA, 20 bp, Artificial
  CRISPR gRNA sequence
agacaaggagactgaggcca

SEQ ID NO: 576662 - DNA, 20 bp, Artificial
  CRISPR gRNA sequence
acaaggagactgaggccaaa

SEQ ID NO: 576663 - DNA, 20 bp, Artificial
  CRISPR gRNA sequence
caaggagactgaggccaaag

SEQ ID NO: 576664 - DNA, 20 bp, Artificial
  CRISPR gRNA sequence
agactgaggccaaagaggtt

SEQ ID NO: 576665 - DNA, 20 bp, Artificial
  CRISPR gRNA sequence
gtgtcttgatcaaaatctcc

SEQ ID NO: 576666 - DNA, 20 bp, Artificial
  CRISPR gRNA sequence
atcaaaatctcccagttcct

SEQ ID NO: 576667 - DNA, 20 bp, Artificial
  CRISPR gRNA sequence
atctcccagttcctgagtga

SEQ ID NO: 576668 - DNA, 20 bp, Artificial
  CRISPR gRNA sequence
ctcccagttcctgagtgaca

SEQ ID NO: 576669 - DNA, 20 bp, Artificial
  CRISPR gRNA sequence
cagttcctgagtgacagagc

SEQ ID NO: 576670 - DNA, 20 bp, Artificial
  CRISPR gRNA sequence
agttcctgagtgacagagct

SEQ ID NO: 576671 - DNA, 20 bp, Artificial
  CRISPR gRNA sequence
agctgggatttgaacccatg

SEQ ID NO: 576672 - DNA, 20 bp, Artificial
  CRISPR gRNA sequence
gggatttgaacccatgtagc

SEQ ID NO: 576673 - DNA, 20 bp, Artificial
  CRISPR gRNA sequence
ggatttgaacccatgtagcc

SEQ ID NO: 576674 - DNA, 20 bp, Artificial
  CRISPR gRNA sequence
gaacccatgtagccaggctc

SEQ ID NO: 576675 - DNA, 20 bp, Artificial
  CRISPR gRNA sequence
tactcctcatgccaacatgc

SEQ ID NO: 576676 - DNA, 20 bp, Artificial
  CRISPR gRNA sequence
gccttattccactgttccca

SEQ ID NO: 576677 - DNA, 20 bp, Artificial
  CRISPR gRNA sequence
ttccactgttcccaaagttc

SEQ ID NO: 576678 - DNA, 20 bp, Artificial
  CRISPR gRNA sequence
tcccaaagttctagctcctc

SEQ ID NO: 576679 - DNA, 20 bp, Artificial
  CRISPR gRNA sequence
aaagttctagctcctctaga

SEQ ID NO: 576680 - DNA, 20 bp, Artificial
  CRISPR gRNA sequence
tggctgctgctgcctcccct

SEQ ID NO: 576681 - DNA, 20 bp, Artificial
  CRISPR gRNA sequence
accacactacacacaaccct

SEQ ID NO: 576682 - DNA, 20 bp, Artificial
  CRISPR gRNA sequence
acactacacacaacccttag

SEQ ID NO: 576683 - DNA, 20 bp, Artificial
  CRISPR gRNA sequence
cacatgtcctgtcctccttg

SEQ ID NO: 576684 - DNA, 20 bp, Artificial
  CRISPR gRNA sequence
tgtcctgtcctccttgcagc

SEQ ID NO: 576685 - DNA, 20 bp, Artificial
  CRISPR gRNA sequence
gtcctgtcctccttgcagcc

SEQ ID NO: 576686 - DNA, 20 bp, Artificial
  CRISPR gRNA sequence
cttgcagccaggcctttgca

SEQ ID NO: 576687 - DNA, 20 bp, Artificial
  CRISPR gRNA sequence
ttgcagccaggcctttgcac

SEQ ID NO: 576688 - DNA, 20 bp, Artificial
  CRISPR gRNA sequence
gcacaggccgtccctccacc

SEQ ID NO: 576689 - DNA, 20 bp, Artificial
  CRISPR gRNA sequence
tttgcccactctcacctccc

SEQ ID NO: 576690 - DNA, 20 bp, Artificial
  CRISPR gRNA sequence
cacacttccaacattatctc

SEQ ID NO: 576691 - DNA, 20 bp, Artificial
  CRISPR gRNA sequence
caacattatctccagcactc

SEQ ID NO: 576692 - DNA, 20 bp, Artificial
  CRISPR gRNA sequence
attatctccagcactctggc

SEQ ID NO: 576693 - DNA, 20 bp, Artificial
  CRISPR gRNA sequence
ttatctccagcactctggcc

SEQ ID NO: 576694 - DNA, 20 bp, Artificial
  CRISPR gRNA sequence
ccagcactctggccaggctc

SEQ ID NO: 576695 - DNA, 20 bp, Artificial
  CRISPR gRNA sequence
gcactctggccaggctcaag

SEQ ID NO: 576696 - DNA, 20 bp, Artificial
  CRISPR gRNA sequence
tctggccaggctcaagtggt

SEQ ID NO: 576697 - DNA, 20 bp, Artificial
  CRISPR gRNA sequence
ccaggctcaagtggtgagtt

SEQ ID NO: 576698 - DNA, 20 bp, Artificial
  CRISPR gRNA sequence
caggctcaagtggtgagttc

SEQ ID NO: 576699 - DNA, 20 bp, Artificial
  CRISPR gRNA sequence
gtgagttcaggcctgacatg

SEQ ID NO: 576700 - DNA, 20 bp, Artificial
  CRISPR gRNA sequence
agttcaggcctgacatgcag

SEQ ID NO: 576701 - DNA, 20 bp, Artificial
  CRISPR gRNA sequence
gttcaggcctgacatgcagt

SEQ ID NO: 576702 - DNA, 20 bp, Artificial
  CRISPR gRNA sequence
cctgacatgcagtaggtgct

SEQ ID NO: 576703 - DNA, 20 bp, Artificial
  CRISPR gRNA sequence
ctgacatgcagtaggtgctg

SEQ ID NO: 576704 - DNA, 20 bp, Artificial
  CRISPR gRNA sequence
tgacatgcagtaggtgctga

SEQ ID NO: 576705 - DNA, 20 bp, Artificial
  CRISPR gRNA sequence
gacatgcagtaggtgctgag

SEQ ID NO: 576706 - DNA, 20 bp, Artificial
  CRISPR gRNA sequence
ggtgctgaggggcatgtgtt

SEQ ID NO: 576707 - DNA, 20 bp, Artificial
  CRISPR gRNA sequence
gtgctgaggggcatgtgtta

SEQ ID NO: 576708 - DNA, 20 bp, Artificial
  CRISPR gRNA sequence
tgctgaggggcatgtgttaa

SEQ ID NO: 576709 - DNA, 20 bp, Artificial
  CRISPR gRNA sequence
ggggcatgtgttaagggaac

SEQ ID NO: 576710 - DNA, 20 bp, Artificial
  CRISPR gRNA sequence
gggcatgtgttaagggaacg

SEQ ID NO: 576711 - DNA, 20 bp, Artificial
  CRISPR gRNA sequence
ggcatgtgttaagggaacga

SEQ ID NO: 576712 - DNA, 20 bp, Artificial
  CRISPR gRNA sequence
gcatgtgttaagggaacgag

SEQ ID NO: 576713 - DNA, 20 bp, Artificial
  CRISPR gRNA sequence
gttaagggaacgaggggtgt

SEQ ID NO: 576714 - DNA, 20 bp, Artificial
  CRISPR gRNA sequence
taagggaacgaggggtgtga

SEQ ID NO: 576715 - DNA, 20 bp, Artificial
  CRISPR gRNA sequence
aagggaacgaggggtgtgag

SEQ ID NO: 576716 - DNA, 20 bp, Artificial
  CRISPR gRNA sequence
agggaacgaggggtgtgaga

SEQ ID NO: 576717 - DNA, 20 bp, Artificial
  CRISPR gRNA sequence
ggaacgaggggtgtgagagg

SEQ ID NO: 576718 - DNA, 20 bp, Artificial
  CRISPR gRNA sequence
aggggtgtgagagggagact

SEQ ID NO: 576719 - DNA, 20 bp, Artificial
  CRISPR gRNA sequence
ggggtgtgagagggagactg

SEQ ID NO: 576720 - DNA, 20 bp, Artificial
  CRISPR gRNA sequence
gtgtgagagggagactgagg

SEQ ID NO: 576721 - DNA, 20 bp, Artificial
  CRISPR gRNA sequence
gtgagagggagactgaggta

SEQ ID NO: 576722 - DNA, 20 bp, Artificial
  CRISPR gRNA sequence
gagagggagactgaggtaga

SEQ ID NO: 576723 - DNA, 20 bp, Artificial
  CRISPR gRNA sequence
agagggagactgaggtagag

SEQ ID NO: 576724 - DNA, 20 bp, Artificial
  CRISPR gRNA sequence
gagggagactgaggtagaga

SEQ ID NO: 576725 - DNA, 20 bp, Artificial
  CRISPR gRNA sequence
agggagactgaggtagagag

SEQ ID NO: 576726 - DNA, 20 bp, Artificial
  CRISPR gRNA sequence
ggagactgaggtagagaggg

SEQ ID NO: 576727 - DNA, 20 bp, Artificial
  CRISPR gRNA sequence
gagactgaggtagagagggg

SEQ ID NO: 576728 - DNA, 20 bp, Artificial
  CRISPR gRNA sequence
agactgaggtagagagggga

SEQ ID NO: 576729 - DNA, 20 bp, Artificial
  CRISPR gRNA sequence
gactgaggtagagaggggag

SEQ ID NO: 576730 - DNA, 20 bp, Artificial
  CRISPR gRNA sequence
ctgaggtagagaggggaggg

SEQ ID NO: 576731 - DNA, 20 bp, Artificial
  CRISPR gRNA sequence
ggtagagaggggaggggagc

SEQ ID NO: 576732 - DNA, 20 bp, Artificial
  CRISPR gRNA sequence
gtagagaggggaggggagct

SEQ ID NO: 576733 - DNA, 20 bp, Artificial
  CRISPR gRNA sequence
tagagaggggaggggagctg

SEQ ID NO: 576734 - DNA, 20 bp, Artificial
  CRISPR gRNA sequence
aggggaggggagctggggct

SEQ ID NO: 576735 - DNA, 20 bp, Artificial
  CRISPR gRNA sequence
gggaggggagctggggctca

SEQ ID NO: 576736 - DNA, 20 bp, Artificial
  CRISPR gRNA sequence
ggaggggagctggggctcag

SEQ ID NO: 576737 - DNA, 20 bp, Artificial
  CRISPR gRNA sequence
aggggagctggggctcagag

SEQ ID NO: 576738 - DNA, 20 bp, Artificial
  CRISPR gRNA sequence
gggagctggggctcagagga

SEQ ID NO: 576739 - DNA, 20 bp, Artificial
  CRISPR gRNA sequence
ggctcagaggagagaactcc

SEQ ID NO: 576740 - DNA, 20 bp, Artificial
  CRISPR gRNA sequence
ctcagaggagagaactccca

SEQ ID NO: 576741 - DNA, 20 bp, Artificial
  CRISPR gRNA sequence
tcagaggagagaactcccag

SEQ ID NO: 576742 - DNA, 20 bp, Artificial
  CRISPR gRNA sequence
cagaggagagaactcccaga

SEQ ID NO: 576743 - DNA, 20 bp, Artificial
  CRISPR gRNA sequence
gagagaactcccagagggtc

SEQ ID NO: 576744 - DNA, 20 bp, Artificial
  CRISPR gRNA sequence
agagaactcccagagggtct

SEQ ID NO: 576745 - DNA, 20 bp, Artificial
  CRISPR gRNA sequence
gggtctgggccctccccatt

SEQ ID NO: 576746 - DNA, 20 bp, Artificial
  CRISPR gRNA sequence
gtctgggccctccccattca

SEQ ID NO: 576747 - DNA, 20 bp, Artificial
  CRISPR gRNA sequence
ccctccccattcagagcatt

SEQ ID NO: 576748 - DNA, 20 bp, Artificial
  CRISPR gRNA sequence
ccccattcagagcattgagc

SEQ ID NO: 576749 - DNA, 20 bp, Artificial
  CRISPR gRNA sequence
ttcagagcattgagccagac

SEQ ID NO: 576750 - DNA, 20 bp, Artificial
  CRISPR gRNA sequence
tcagagcattgagccagacc

SEQ ID NO: 576751 - DNA, 20 bp, Artificial
  CRISPR gRNA sequence
gagccagaccaggcctgtcg

SEQ ID NO: 576752 - DNA, 20 bp, Artificial
  CRISPR gRNA sequence
gcctgtcgtggtcacctgca

SEQ ID NO: 576753 - DNA, 20 bp, Artificial
  CRISPR gRNA sequence
catggaatcttctccctact

SEQ ID NO: 576754 - DNA, 20 bp, Artificial
  CRISPR gRNA sequence
atggaatcttctccctactt

SEQ ID NO: 576755 - DNA, 20 bp, Artificial
  CRISPR gRNA sequence
tctccctacttaggcactgc

SEQ ID NO: 576756 - DNA, 20 bp, Artificial
  CRISPR gRNA sequence
ctccctacttaggcactgcc

SEQ ID NO: 576757 - DNA, 20 bp, Artificial
  CRISPR gRNA sequence
cctacttaggcactgccagg

SEQ ID NO: 576758 - DNA, 20 bp, Artificial
  CRISPR gRNA sequence
ctgccaggcggaccatcttc

SEQ ID NO: 576759 - DNA, 20 bp, Artificial
  CRISPR gRNA sequence
aggcggaccatcttctggat

SEQ ID NO: 576760 - DNA, 20 bp, Artificial
  CRISPR gRNA sequence
cggaccatcttctggatgag

SEQ ID NO: 576761 - DNA, 20 bp, Artificial
  CRISPR gRNA sequence
ggaccatcttctggatgaga

SEQ ID NO: 576762 - DNA, 20 bp, Artificial
  CRISPR gRNA sequence
gaccatcttctggatgagaa

SEQ ID NO: 576763 - DNA, 20 bp, Artificial
  CRISPR gRNA sequence
catcttctggatgagaaggg

SEQ ID NO: 576764 - DNA, 20 bp, Artificial
  CRISPR gRNA sequence
atcttctggatgagaagggc

SEQ ID NO: 576765 - DNA, 20 bp, Artificial
  CRISPR gRNA sequence
tcttctggatgagaagggca

SEQ ID NO: 576766 - DNA, 20 bp, Artificial
  CRISPR gRNA sequence
gcagggcacaatgtctcctc

SEQ ID NO: 576767 - DNA, 20 bp, Artificial
  CRISPR gRNA sequence
agggcacaatgtctcctcca

SEQ ID NO: 576768 - DNA, 20 bp, Artificial
  CRISPR gRNA sequence
ggcacaatgtctcctccaga

SEQ ID NO: 576769 - DNA, 20 bp, Artificial
  CRISPR gRNA sequence
cacaatgtctcctccagaga

SEQ ID NO: 576770 - DNA, 20 bp, Artificial
  CRISPR gRNA sequence
atgtctcctccagagagaga

SEQ ID NO: 576771 - DNA, 20 bp, Artificial
  CRISPR gRNA sequence
tcctccagagagagatggta

SEQ ID NO: 576772 - DNA, 20 bp, Artificial
  CRISPR gRNA sequence
gagagagatggtacagtctc

SEQ ID NO: 576773 - DNA, 20 bp, Artificial
  CRISPR gRNA sequence
gagagatggtacagtctctg

SEQ ID NO: 576774 - DNA, 20 bp, Artificial
  CRISPR gRNA sequence
agatggtacagtctctggag

SEQ ID NO: 576775 - DNA, 20 bp, Artificial
  CRISPR gRNA sequence
tggtacagtctctggagcag

SEQ ID NO: 576776 - DNA, 20 bp, Artificial
  CRISPR gRNA sequence
ggtacagtctctggagcagc

SEQ ID NO: 576777 - DNA, 20 bp, Artificial
  CRISPR gRNA sequence
tctggagcagcaggtaatgc

SEQ ID NO: 576778 - DNA, 20 bp, Artificial
  CRISPR gRNA sequence
ctggagcagcaggtaatgcc

SEQ ID NO: 576779 - DNA, 20 bp, Artificial
  CRISPR gRNA sequence
tggagcagcaggtaatgcca

SEQ ID NO: 576780 - DNA, 20 bp, Artificial
  CRISPR gRNA sequence
agcagcaggtaatgccaggg

SEQ ID NO: 576781 - DNA, 20 bp, Artificial
  CRISPR gRNA sequence
agcaggtaatgccagggcgg

SEQ ID NO: 576782 - DNA, 20 bp, Artificial
  CRISPR gRNA sequence
caggtaatgccagggcggtg

SEQ ID NO: 576783 - DNA, 20 bp, Artificial
  CRISPR gRNA sequence
aggtaatgccagggcggtgg

SEQ ID NO: 576784 - DNA, 20 bp, Artificial
  CRISPR gRNA sequence
ggtaatgccagggcggtgga

SEQ ID NO: 576785 - DNA, 20 bp, Artificial
  CRISPR gRNA sequence
atgccagggcggtggagggt

SEQ ID NO: 576786 - DNA, 20 bp, Artificial
  CRISPR gRNA sequence
tgccagggcggtggagggta

SEQ ID NO: 576787 - DNA, 20 bp, Artificial
  CRISPR gRNA sequence
gccagggcggtggagggtaa

SEQ ID NO: 576788 - DNA, 20 bp, Artificial
  CRISPR gRNA sequence
gggcggtggagggtaaggga

SEQ ID NO: 576789 - DNA, 20 bp, Artificial
  CRISPR gRNA sequence
ggcggtggagggtaagggat

SEQ ID NO: 576790 - DNA, 20 bp, Artificial
  CRISPR gRNA sequence
gcggtggagggtaagggata

SEQ ID NO: 576791 - DNA, 20 bp, Artificial
  CRISPR gRNA sequence
tggagggtaagggataggga

SEQ ID NO: 576792 - DNA, 20 bp, Artificial
  CRISPR gRNA sequence
accttctgtccaccatgtgc

SEQ ID NO: 576793 - DNA, 20 bp, Artificial
  CRISPR gRNA sequence
tccaccatgtgccagaaacc

SEQ ID NO: 576794 - DNA, 20 bp, Artificial
  CRISPR gRNA sequence
tgccagaaaccaagttcacc

SEQ ID NO: 576795 - DNA, 20 bp, Artificial
  CRISPR gRNA sequence
gccagaaaccaagttcacct

SEQ ID NO: 576796 - DNA, 20 bp, Artificial
  CRISPR gRNA sequence
aaaccaagttcacctgggac

SEQ ID NO: 576797 - DNA, 20 bp, Artificial
  CRISPR gRNA sequence
aaccaagttcacctgggacg

SEQ ID NO: 576798 - DNA, 20 bp, Artificial
  CRISPR gRNA sequence
accaagttcacctgggacga

SEQ ID NO: 576799 - DNA, 20 bp, Artificial
  CRISPR gRNA sequence
agttcacctgggacgagggc

SEQ ID NO: 576800 - DNA, 20 bp, Artificial
  CRISPR gRNA sequence
ctgggacgagggctggtata

SEQ ID NO: 576801 - DNA, 20 bp, Artificial
  CRISPR gRNA sequence
tgggacgagggctggtataa

SEQ ID NO: 576802 - DNA, 20 bp, Artificial
  CRISPR gRNA sequence
gacgagggctggtataaagg

SEQ ID NO: 576803 - DNA, 20 bp, Artificial
  CRISPR gRNA sequence
acgagggctggtataaagga

SEQ ID NO: 576804 - DNA, 20 bp, Artificial
  CRISPR gRNA sequence
agggctggtataaaggaagg

SEQ ID NO: 576805 - DNA, 20 bp, Artificial
  CRISPR gRNA sequence
ggctggtataaaggaaggaa

SEQ ID NO: 576806 - DNA, 20 bp, Artificial
  CRISPR gRNA sequence
gctggtataaaggaaggaag

SEQ ID NO: 576807 - DNA, 20 bp, Artificial
  CRISPR gRNA sequence
tggtataaaggaaggaagag

SEQ ID NO: 576808 - DNA, 20 bp, Artificial
  CRISPR gRNA sequence
tataaaggaaggaagaggag

SEQ ID NO: 576809 - DNA, 20 bp, Artificial
  CRISPR gRNA sequence
ataaaggaaggaagaggagc

SEQ ID NO: 576810 - DNA, 20 bp, Artificial
  CRISPR gRNA sequence
ggaagaggagcgggcactcc

SEQ ID NO: 576811 - DNA, 20 bp, Artificial
  CRISPR gRNA sequence
gaagaggagcgggcactccc

SEQ ID NO: 576812 - DNA, 20 bp, Artificial
  CRISPR gRNA sequence
aagaggagcgggcactccca

SEQ ID NO: 576813 - DNA, 20 bp, Artificial
  CRISPR gRNA sequence
aggagcgggcactcccaggg

SEQ ID NO: 576814 - DNA, 20 bp, Artificial
  CRISPR gRNA sequence
ggcactcccagggaagaccg

SEQ ID NO: 576815 - DNA, 20 bp, Artificial
  CRISPR gRNA sequence
tcccagggaagaccgtagcc

SEQ ID NO: 576816 - DNA, 20 bp, Artificial
  CRISPR gRNA sequence
cccagggaagaccgtagcct

SEQ ID NO: 576817 - DNA, 20 bp, Artificial
  CRISPR gRNA sequence
ggaagaccgtagcctgggca

SEQ ID NO: 576818 - DNA, 20 bp, Artificial
  CRISPR gRNA sequence
ccgtagcctgggcaaagatg

SEQ ID NO: 576819 - DNA, 20 bp, Artificial
  CRISPR gRNA sequence
tagcctgggcaaagatgtgg

SEQ ID NO: 576820 - DNA, 20 bp, Artificial
  CRISPR gRNA sequence
gcctgggcaaagatgtggca

SEQ ID NO: 576821 - DNA, 20 bp, Artificial
  CRISPR gRNA sequence
tgggcaaagatgtggcagag

SEQ ID NO: 576822 - DNA, 20 bp, Artificial
  CRISPR gRNA sequence
gggcaaagatgtggcagaga

SEQ ID NO: 576823 - DNA, 20 bp, Artificial
  CRISPR gRNA sequence
ggcaaagatgtggcagagaa

SEQ ID NO: 576824 - DNA, 20 bp, Artificial
  CRISPR gRNA sequence
aagatgtggcagagaagggc

SEQ ID NO: 576825 - DNA, 20 bp, Artificial
  CRISPR gRNA sequence
agatgtggcagagaagggcc

SEQ ID NO: 576826 - DNA, 20 bp, Artificial
  CRISPR gRNA sequence
tggcagagaagggccaggct

SEQ ID NO: 576827 - DNA, 20 bp, Artificial
  CRISPR gRNA sequence
ggcagagaagggccaggctg

SEQ ID NO: 576828 - DNA, 20 bp, Artificial
  CRISPR gRNA sequence
ctcatgtttgtgccatttca

SEQ ID NO: 576829 - DNA, 20 bp, Artificial
  CRISPR gRNA sequence
tgtttgtgccatttcacagc

SEQ ID NO: 576830 - DNA, 20 bp, Artificial
  CRISPR gRNA sequence
tgccatttcacagctggtgc

SEQ ID NO: 576831 - DNA, 20 bp, Artificial
  CRISPR gRNA sequence
ccatttcacagctggtgctg

SEQ ID NO: 576832 - DNA, 20 bp, Artificial
  CRISPR gRNA sequence
tttcacagctggtgctggag

SEQ ID NO: 576833 - DNA, 20 bp, Artificial
  CRISPR gRNA sequence
ttcacagctggtgctggaga

SEQ ID NO: 576834 - DNA, 20 bp, Artificial
  CRISPR gRNA sequence
cacagctggtgctggagaag

SEQ ID NO: 576835 - DNA, 20 bp, Artificial
  CRISPR gRNA sequence
agctggtgctggagaaggag

SEQ ID NO: 576836 - DNA, 20 bp, Artificial
  CRISPR gRNA sequence
gtgctggagaaggagaagct

SEQ ID NO: 576837 - DNA, 20 bp, Artificial
  CRISPR gRNA sequence
aggagaagctgagtgccatg

SEQ ID NO: 576838 - DNA, 20 bp, Artificial
  CRISPR gRNA sequence
ggagaagctgagtgccatgc

SEQ ID NO: 576839 - DNA, 20 bp, Artificial
  CRISPR gRNA sequence
gagtgccatgcaggcccacc

SEQ ID NO: 576840 - DNA, 20 bp, Artificial
  CRISPR gRNA sequence
gccatgcaggcccacctggc

SEQ ID NO: 576841 - DNA, 20 bp, Artificial
  CRISPR gRNA sequence
ccatgcaggcccacctggct

SEQ ID NO: 576842 - DNA, 20 bp, Artificial
  CRISPR gRNA sequence
ggcccacctggctgggaaaa

SEQ ID NO: 576843 - DNA, 20 bp, Artificial
  CRISPR gRNA sequence
ctgggaaaatggcactgacc

SEQ ID NO: 576844 - DNA, 20 bp, Artificial
  CRISPR gRNA sequence
tgggaaaatggcactgacca

SEQ ID NO: 576845 - DNA, 20 bp, Artificial
  CRISPR gRNA sequence
actgaccaaggcttcatctg

SEQ ID NO: 576846 - DNA, 20 bp, Artificial
  CRISPR gRNA sequence
accaaggcttcatctgtggt

SEQ ID NO: 576847 - DNA, 20 bp, Artificial
  CRISPR gRNA sequence
tcatctgtggtgagcgaccc

SEQ ID NO: 576848 - DNA, 20 bp, Artificial
  CRISPR gRNA sequence
catctgtggtgagcgacccc

SEQ ID NO: 576849 - DNA, 20 bp, Artificial
  CRISPR gRNA sequence
gtggtgagcgaccccaggac

SEQ ID NO: 576850 - DNA, 20 bp, Artificial
  CRISPR gRNA sequence
gtgagcgaccccaggactgg

SEQ ID NO: 576851 - DNA, 20 bp, Artificial
  CRISPR gRNA sequence
agcgaccccaggactggtgg

SEQ ID NO: 576852 - DNA, 20 bp, Artificial
  CRISPR gRNA sequence
gaccccaggactggtggtgg

SEQ ID NO: 576853 - DNA, 20 bp, Artificial
  CRISPR gRNA sequence
aggactggtggtggcagact

SEQ ID NO: 576854 - DNA, 20 bp, Artificial
  CRISPR gRNA sequence
tggtggcagactcagactgc

SEQ ID NO: 576855 - DNA, 20 bp, Artificial
  CRISPR gRNA sequence
ggtggcagactcagactgct

SEQ ID NO: 576856 - DNA, 20 bp, Artificial
  CRISPR gRNA sequence
gtggcagactcagactgctg

SEQ ID NO: 576857 - DNA, 20 bp, Artificial
  CRISPR gRNA sequence
tggcagactcagactgctgg

SEQ ID NO: 576858 - DNA, 20 bp, Artificial
  CRISPR gRNA sequence
ggcagactcagactgctggg

SEQ ID NO: 576859 - DNA, 20 bp, Artificial
  CRISPR gRNA sequence
agactcagactgctgggggg

SEQ ID NO: 576860 - DNA, 20 bp, Artificial
  CRISPR gRNA sequence
gactcagactgctggggggc

SEQ ID NO: 576861 - DNA, 20 bp, Artificial
  CRISPR gRNA sequence
actcagactgctggggggca

SEQ ID NO: 576862 - DNA, 20 bp, Artificial
  CRISPR gRNA sequence
tcagactgctggggggcagg

SEQ ID NO: 576863 - DNA, 20 bp, Artificial
  CRISPR gRNA sequence
cagactgctggggggcaggg

SEQ ID NO: 576864 - DNA, 20 bp, Artificial
  CRISPR gRNA sequence
gactgctggggggcagggag

SEQ ID NO: 576865 - DNA, 20 bp, Artificial
  CRISPR gRNA sequence
actgctggggggcagggagg

SEQ ID NO: 576866 - DNA, 20 bp, Artificial
  CRISPR gRNA sequence
gggcagggaggaggtctgca

SEQ ID NO: 576867 - DNA, 20 bp, Artificial
  CRISPR gRNA sequence
gggaggaggtctgcacggtg

SEQ ID NO: 576868 - DNA, 20 bp, Artificial
  CRISPR gRNA sequence
ggaggaggtctgcacggtgc

SEQ ID NO: 576869 - DNA, 20 bp, Artificial
  CRISPR gRNA sequence
gaggaggtctgcacggtgca

SEQ ID NO: 576870 - DNA, 20 bp, Artificial
  CRISPR gRNA sequence
agggaacctaacctcacatt

SEQ ID NO: 576871 - DNA, 20 bp, Artificial
  CRISPR gRNA sequence
gggaacctaacctcacattc

SEQ ID NO: 576872 - DNA, 20 bp, Artificial
  CRISPR gRNA sequence
taacctcacattcaggtcct

SEQ ID NO: 576873 - DNA, 20 bp, Artificial
  CRISPR gRNA sequence
acctcacattcaggtcctga

SEQ ID NO: 576874 - DNA, 20 bp, Artificial
  CRISPR gRNA sequence
cacattcaggtcctgagagc

SEQ ID NO: 576875 - DNA, 20 bp, Artificial
  CRISPR gRNA sequence
acattcaggtcctgagagct

SEQ ID NO: 576876 - DNA, 20 bp, Artificial
  CRISPR gRNA sequence
cattcaggtcctgagagcta

SEQ ID NO: 576877 - DNA, 20 bp, Artificial
  CRISPR gRNA sequence
attcaggtcctgagagctag

SEQ ID NO: 576878 - DNA, 20 bp, Artificial
  CRISPR gRNA sequence
gagctaggggcccctgtccc

SEQ ID NO: 576879 - DNA, 20 bp, Artificial
  CRISPR gRNA sequence
tccccagctccaaacatgcc

SEQ ID NO: 576880 - DNA, 20 bp, Artificial
  CRISPR gRNA sequence
gctccaaacatgcccagacc

SEQ ID NO: 576881 - DNA, 20 bp, Artificial
  CRISPR gRNA sequence
acttacaaaccctctgaccc

SEQ ID NO: 576882 - DNA, 20 bp, Artificial
  CRISPR gRNA sequence
acaaaccctctgaccccggc

SEQ ID NO: 576883 - DNA, 20 bp, Artificial
  CRISPR gRNA sequence
caaaccctctgaccccggct

SEQ ID NO: 576884 - DNA, 20 bp, Artificial
  CRISPR gRNA sequence
cctctgaccccggctgggcg

SEQ ID NO: 576885 - DNA, 20 bp, Artificial
  CRISPR gRNA sequence
ctgaccccggctgggcgtgg

SEQ ID NO: 576886 - DNA, 20 bp, Artificial
  CRISPR gRNA sequence
gtggctcacgcctgtaatcc

SEQ ID NO: 576887 - DNA, 20 bp, Artificial
  CRISPR gRNA sequence
cgcctgtaatcccagcactt

SEQ ID NO: 576888 - DNA, 20 bp, Artificial
  CRISPR gRNA sequence
gcctgtaatcccagcacttt

SEQ ID NO: 576889 - DNA, 20 bp, Artificial
  CRISPR gRNA sequence
ctgtaatcccagcactttgg

SEQ ID NO: 576890 - DNA, 20 bp, Artificial
  CRISPR gRNA sequence
tgtaatcccagcactttggg

SEQ ID NO: 576891 - DNA, 20 bp, Artificial
  CRISPR gRNA sequence
tcccagcactttgggaggcc

SEQ ID NO: 576892 - DNA, 20 bp, Artificial
  CRISPR gRNA sequence
cccagcactttgggaggccg

SEQ ID NO: 576893 - DNA, 20 bp, Artificial
  CRISPR gRNA sequence
agcactttgggaggccgagg

SEQ ID NO: 576894 - DNA, 20 bp, Artificial
  CRISPR gRNA sequence
gcactttgggaggccgaggc

SEQ ID NO: 576895 - DNA, 20 bp, Artificial
  CRISPR gRNA sequence
ctttgggaggccgaggcggg

SEQ ID NO: 576896 - DNA, 20 bp, Artificial
  CRISPR gRNA sequence
ggccgaggcgggtggatcac

SEQ ID NO: 576897 - DNA, 20 bp, Artificial
  CRISPR gRNA sequence
gccgaggcgggtggatcacg

SEQ ID NO: 576898 - DNA, 20 bp, Artificial
  CRISPR gRNA sequence
aggcgggtggatcacgaggt

SEQ ID NO: 576899 - DNA, 20 bp, Artificial
  CRISPR gRNA sequence
ggcgggtggatcacgaggtc

SEQ ID NO: 576900 - DNA, 20 bp, Artificial
  CRISPR gRNA sequence
cgggtggatcacgaggtcag

SEQ ID NO: 576901 - DNA, 20 bp, Artificial
  CRISPR gRNA sequence
gatcacgaggtcaggagttc

SEQ ID NO: 576902 - DNA, 20 bp, Artificial
  CRISPR gRNA sequence
cgaggtcaggagttcaagac

SEQ ID NO: 576903 - DNA, 20 bp, Artificial
  CRISPR gRNA sequence
agttcaagaccagcctcgcc

SEQ ID NO: 576904 - DNA, 20 bp, Artificial
  CRISPR gRNA sequence
caagaccagcctcgccaaga

SEQ ID NO: 576905 - DNA, 20 bp, Artificial
  CRISPR gRNA sequence
tgaaaccctgtgtctactaa

SEQ ID NO: 576906 - DNA, 20 bp, Artificial
  CRISPR gRNA sequence
ctactaaaagtacaaaaaat

SEQ ID NO: 576907 - DNA, 20 bp, Artificial
  CRISPR gRNA sequence
taaaagtacaaaaaattagc

SEQ ID NO: 576908 - DNA, 20 bp, Artificial
  CRISPR gRNA sequence
aaaagtacaaaaaattagcc

SEQ ID NO: 576909 - DNA, 20 bp, Artificial
  CRISPR gRNA sequence
tacaaaaaattagccaggcg

SEQ ID NO: 576910 - DNA, 20 bp, Artificial
  CRISPR gRNA sequence
aaaaaattagccaggcgtgg

SEQ ID NO: 576911 - DNA, 20 bp, Artificial
  CRISPR gRNA sequence
aaattagccaggcgtggtgg

SEQ ID NO: 576912 - DNA, 20 bp, Artificial
  CRISPR gRNA sequence
aattagccaggcgtggtggc

SEQ ID NO: 576913 - DNA, 20 bp, Artificial
  CRISPR gRNA sequence
ggcgtggtggcaggtgtctg

SEQ ID NO: 576914 - DNA, 20 bp, Artificial
  CRISPR gRNA sequence
tgtctgtagtcccaactact

SEQ ID NO: 576915 - DNA, 20 bp, Artificial
  CRISPR gRNA sequence
gtctgtagtcccaactactt

SEQ ID NO: 576916 - DNA, 20 bp, Artificial
  CRISPR gRNA sequence
ctgtagtcccaactacttgg

SEQ ID NO: 576917 - DNA, 20 bp, Artificial
  CRISPR gRNA sequence
tgtagtcccaactacttggg

SEQ ID NO: 576918 - DNA, 20 bp, Artificial
  CRISPR gRNA sequence
tcccaactacttgggaggct

SEQ ID NO: 576919 - DNA, 20 bp, Artificial
  CRISPR gRNA sequence
cccaactacttgggaggctg

SEQ ID NO: 576920 - DNA, 20 bp, Artificial
  CRISPR gRNA sequence
aactacttgggaggctgagg

SEQ ID NO: 576921 - DNA, 20 bp, Artificial
  CRISPR gRNA sequence
ctacttgggaggctgaggca

SEQ ID NO: 576922 - DNA, 20 bp, Artificial
  CRISPR gRNA sequence
ggcagagaattgcttgaacc

SEQ ID NO: 576923 - DNA, 20 bp, Artificial
  CRISPR gRNA sequence
gcagagaattgcttgaacct

SEQ ID NO: 576924 - DNA, 20 bp, Artificial
  CRISPR gRNA sequence
agagaattgcttgaacctgg

SEQ ID NO: 576925 - DNA, 20 bp, Artificial
  CRISPR gRNA sequence
gagaattgcttgaacctggg

SEQ ID NO: 576926 - DNA, 20 bp, Artificial
  CRISPR gRNA sequence
aattgcttgaacctgggagg

SEQ ID NO: 576927 - DNA, 20 bp, Artificial
  CRISPR gRNA sequence
ttgcttgaacctgggaggcg

SEQ ID NO: 576928 - DNA, 20 bp, Artificial
  CRISPR gRNA sequence
aacctgggaggcggagtttg

SEQ ID NO: 576929 - DNA, 20 bp, Artificial
  CRISPR gRNA sequence
tgggaggcggagtttgcagt

SEQ ID NO: 576930 - DNA, 20 bp, Artificial
  CRISPR gRNA sequence
ggcggagtttgcagtgagct

SEQ ID NO: 576931 - DNA, 20 bp, Artificial
  CRISPR gRNA sequence
gagatcataccactgcactc

SEQ ID NO: 576932 - DNA, 20 bp, Artificial
  CRISPR gRNA sequence
cataccactgcactccagcc

SEQ ID NO: 576933 - DNA, 20 bp, Artificial
  CRISPR gRNA sequence
ataccactgcactccagcct

SEQ ID NO: 576934 - DNA, 20 bp, Artificial
  CRISPR gRNA sequence
ctgcactccagcctaggcga

SEQ ID NO: 576935 - DNA, 20 bp, Artificial
  CRISPR gRNA sequence
tccagcctaggcgacagatc

SEQ ID NO: 576936 - DNA, 20 bp, Artificial
  CRISPR gRNA sequence
acagatcaagactccgtctc

SEQ ID NO: 576937 - DNA, 20 bp, Artificial
  CRISPR gRNA sequence
aaaaaaaaccctctgactct

SEQ ID NO: 576938 - DNA, 20 bp, Artificial
  CRISPR gRNA sequence
tccccaaacactgtgatcct

SEQ ID NO: 576939 - DNA, 20 bp, Artificial
  CRISPR gRNA sequence
actgtgatcctgagttgtta

SEQ ID NO: 576940 - DNA, 20 bp, Artificial
  CRISPR gRNA sequence
gttgttaaagcaaatgcaaa

SEQ ID NO: 576941 - DNA, 20 bp, Artificial
  CRISPR gRNA sequence
ttaaagcaaatgcaaatagc

SEQ ID NO: 576942 - DNA, 20 bp, Artificial
  CRISPR gRNA sequence
atgcaaatagccagacttgc

SEQ ID NO: 576943 - DNA, 20 bp, Artificial
  CRISPR gRNA sequence
atagccagacttgccagatg

SEQ ID NO: 576944 - DNA, 20 bp, Artificial
  CRISPR gRNA sequence
tagccagacttgccagatgc

SEQ ID NO: 576945 - DNA, 20 bp, Artificial
  CRISPR gRNA sequence
gccagatgcaggctgtgtgc

SEQ ID NO: 576946 - DNA, 20 bp, Artificial
  CRISPR gRNA sequence
agatgcaggctgtgtgccag

SEQ ID NO: 576947 - DNA, 20 bp, Artificial
  CRISPR gRNA sequence
gatgcaggctgtgtgccagc

SEQ ID NO: 576948 - DNA, 20 bp, Artificial
  CRISPR gRNA sequence
aggctgtgtgccagcaggac

SEQ ID NO: 576949 - DNA, 20 bp, Artificial
  CRISPR gRNA sequence
aggaccagctatgtaacctg

SEQ ID NO: 576950 - DNA, 20 bp, Artificial
  CRISPR gRNA sequence
ggaccagctatgtaacctgc

SEQ ID NO: 576951 - DNA, 20 bp, Artificial
  CRISPR gRNA sequence
gaccagctatgtaacctgca

SEQ ID NO: 576952 - DNA, 20 bp, Artificial
  CRISPR gRNA sequence
aacctgcagggccccttgtt

SEQ ID NO: 576953 - DNA, 20 bp, Artificial
  CRISPR gRNA sequence
gggccccttgttcagatttc

SEQ ID NO: 576954 - DNA, 20 bp, Artificial
  CRISPR gRNA sequence
cccttgttcagatttcaaga

SEQ ID NO: 576955 - DNA, 20 bp, Artificial
  CRISPR gRNA sequence
agatttcaagatggcgacca

SEQ ID NO: 576956 - DNA, 20 bp, Artificial
  CRISPR gRNA sequence
atttcaagatggcgaccaca

SEQ ID NO: 576957 - DNA, 20 bp, Artificial
  CRISPR gRNA sequence
cgaccacagagcattaaaca

SEQ ID NO: 576958 - DNA, 20 bp, Artificial
  CRISPR gRNA sequence
acagagcattaaacaaagca

SEQ ID NO: 576959 - DNA, 20 bp, Artificial
  CRISPR gRNA sequence
cagagcattaaacaaagcac

SEQ ID NO: 576960 - DNA, 20 bp, Artificial
  CRISPR gRNA sequence
agagcattaaacaaagcaca

SEQ ID NO: 576961 - DNA, 20 bp, Artificial
  CRISPR gRNA sequence
cagggtgccacataaccaca

SEQ ID NO: 576962 - DNA, 20 bp, Artificial
  CRISPR gRNA sequence
agggtgccacataaccacat

SEQ ID NO: 576963 - DNA, 20 bp, Artificial
  CRISPR gRNA sequence
acataggtcacacgcccatg

SEQ ID NO: 576964 - DNA, 20 bp, Artificial
  CRISPR gRNA sequence
aggtcacacgcccatgaagc

SEQ ID NO: 576965 - DNA, 20 bp, Artificial
  CRISPR gRNA sequence
cacgcccatgaagccagccc

SEQ ID NO: 576966 - DNA, 20 bp, Artificial
  CRISPR gRNA sequence
cgcccatgaagccagccctg

SEQ ID NO: 576967 - DNA, 20 bp, Artificial
  CRISPR gRNA sequence
gcccatgaagccagccctgg

SEQ ID NO: 576968 - DNA, 20 bp, Artificial
  CRISPR gRNA sequence
atgaagccagccctggaggc

SEQ ID NO: 576969 - DNA, 20 bp, Artificial
  CRISPR gRNA sequence
tgaagccagccctggaggcc

SEQ ID NO: 576970 - DNA, 20 bp, Artificial
  CRISPR gRNA sequence
ggaggccaggcactgtttct

SEQ ID NO: 576971 - DNA, 20 bp, Artificial
  CRISPR gRNA sequence
actgtttctgagcgctttgc

SEQ ID NO: 576972 - DNA, 20 bp, Artificial
  CRISPR gRNA sequence
gtttctgagcgctttgctgg

SEQ ID NO: 576973 - DNA, 20 bp, Artificial
  CRISPR gRNA sequence
tttctcatgatgcgaatgta

SEQ ID NO: 576974 - DNA, 20 bp, Artificial
  CRISPR gRNA sequence
catgatgcgaatgtacagat

SEQ ID NO: 576975 - DNA, 20 bp, Artificial
  CRISPR gRNA sequence
atgatgcgaatgtacagatg

SEQ ID NO: 576976 - DNA, 20 bp, Artificial
  CRISPR gRNA sequence
atgtacagatgaggaatatt

SEQ ID NO: 576977 - DNA, 20 bp, Artificial
  CRISPR gRNA sequence
tgtacagatgaggaatattg

SEQ ID NO: 576978 - DNA, 20 bp, Artificial
  CRISPR gRNA sequence
cagatgaggaatattgaggc

SEQ ID NO: 576979 - DNA, 20 bp, Artificial
  CRISPR gRNA sequence
agatgaggaatattgaggcc

SEQ ID NO: 576980 - DNA, 20 bp, Artificial
  CRISPR gRNA sequence
gatgaggaatattgaggcca

SEQ ID NO: 576981 - DNA, 20 bp, Artificial
  CRISPR gRNA sequence
atgaggaatattgaggccag

SEQ ID NO: 576982 - DNA, 20 bp, Artificial
  CRISPR gRNA sequence
tgaggaatattgaggccagg

SEQ ID NO: 576983 - DNA, 20 bp, Artificial
  CRISPR gRNA sequence
gaggaatattgaggccaggg

SEQ ID NO: 576984 - DNA, 20 bp, Artificial
  CRISPR gRNA sequence
atattgaggccaggggggtt

SEQ ID NO: 576985 - DNA, 20 bp, Artificial
  CRISPR gRNA sequence
tattgaggccaggggggttt

SEQ ID NO: 576986 - DNA, 20 bp, Artificial
  CRISPR gRNA sequence
ggggtttaggtgactttccc

SEQ ID NO: 576987 - DNA, 20 bp, Artificial
  CRISPR gRNA sequence
gggtttaggtgactttccca

SEQ ID NO: 576988 - DNA, 20 bp, Artificial
  CRISPR gRNA sequence
aggtgactttcccaaggtca

SEQ ID NO: 576989 - DNA, 20 bp, Artificial
  CRISPR gRNA sequence
gactttcccaaggtcacagt

SEQ ID NO: 576990 - DNA, 20 bp, Artificial
  CRISPR gRNA sequence
actttcccaaggtcacagtt

SEQ ID NO: 576991 - DNA, 20 bp, Artificial
  CRISPR gRNA sequence
ttcccaaggtcacagttggg

SEQ ID NO: 576992 - DNA, 20 bp, Artificial
  CRISPR gRNA sequence
aaggtcacagttgggtggta

SEQ ID NO: 576993 - DNA, 20 bp, Artificial
  CRISPR gRNA sequence
ggtcacagttgggtggtaaa

SEQ ID NO: 576994 - DNA, 20 bp, Artificial
  CRISPR gRNA sequence
taaagagccctattcaaccc

SEQ ID NO: 576995 - DNA, 20 bp, Artificial
  CRISPR gRNA sequence
ccctattcaaccccagttca

SEQ ID NO: 576996 - DNA, 20 bp, Artificial
  CRISPR gRNA sequence
tcaaccccagttcatggtcc

SEQ ID NO: 576997 - DNA, 20 bp, Artificial
  CRISPR gRNA sequence
ccagttcatggtcccagcat

SEQ ID NO: 576998 - DNA, 20 bp, Artificial
  CRISPR gRNA sequence
gttcatggtcccagcatcag

SEQ ID NO: 576999 - DNA, 20 bp, Artificial
  CRISPR gRNA sequence
cacctgtgctctaataaata

SEQ ID NO: 577000 - DNA, 20 bp, Artificial
  CRISPR gRNA sequence
atacggctcatgctgttttg

SEQ ID NO: 577001 - DNA, 20 bp, Artificial
  CRISPR gRNA sequence
tacggctcatgctgttttgt

SEQ ID NO: 577002 - DNA, 20 bp, Artificial
  CRISPR gRNA sequence
tgttttgtgggattccacct

SEQ ID NO: 577003 - DNA, 20 bp, Artificial
  CRISPR gRNA sequence
tgtgggattccacctcagac

SEQ ID NO: 577004 - DNA, 20 bp, Artificial
  CRISPR gRNA sequence
ttccacctcagactggaatt

SEQ ID NO: 577005 - DNA, 20 bp, Artificial
  CRISPR gRNA sequence
cacctcagactggaatttag

SEQ ID NO: 577006 - DNA, 20 bp, Artificial
  CRISPR gRNA sequence
cctcagactggaatttagaa

SEQ ID NO: 577007 - DNA, 20 bp, Artificial
  CRISPR gRNA sequence
ctcagactggaatttagaag

SEQ ID NO: 577008 - DNA, 20 bp, Artificial
  CRISPR gRNA sequence
tcagactggaatttagaaga

SEQ ID NO: 577009 - DNA, 20 bp, Artificial
  CRISPR gRNA sequence
aaaacactgatttaaaaata

SEQ ID NO: 577010 - DNA, 20 bp, Artificial
  CRISPR gRNA sequence
acactgatttaaaaataaag

SEQ ID NO: 577011 - DNA, 20 bp, Artificial
  CRISPR gRNA sequence
actgatttaaaaataaagtg

SEQ ID NO: 577012 - DNA, 20 bp, Artificial
  CRISPR gRNA sequence
atttaaaaataaagtggagc

SEQ ID NO: 577013 - DNA, 20 bp, Artificial
  CRISPR gRNA sequence
tttaaaaataaagtggagcc

SEQ ID NO: 577014 - DNA, 20 bp, Artificial
  CRISPR gRNA sequence
aaataaagtggagccaggcg

SEQ ID NO: 577015 - DNA, 20 bp, Artificial
  CRISPR gRNA sequence
taaagtggagccaggcgcag

SEQ ID NO: 577016 - DNA, 20 bp, Artificial
  CRISPR gRNA sequence
gtggctcatgcctgtaatcc

SEQ ID NO: 577017 - DNA, 20 bp, Artificial
  CRISPR gRNA sequence
tgcctgtaatcccagcactt

SEQ ID NO: 577018 - DNA, 20 bp, Artificial
  CRISPR gRNA sequence
gcctgtaatcccagcacttt

SEQ ID NO: 577019 - DNA, 20 bp, Artificial
  CRISPR gRNA sequence
ctgtaatcccagcactttgg

SEQ ID NO: 577020 - DNA, 20 bp, Artificial
  CRISPR gRNA sequence
tgtaatcccagcactttggg

SEQ ID NO: 577021 - DNA, 20 bp, Artificial
  CRISPR gRNA sequence
cccagcactttgggaggctg

SEQ ID NO: 577022 - DNA, 20 bp, Artificial
  CRISPR gRNA sequence
agcactttgggaggctgaag

SEQ ID NO: 577023 - DNA, 20 bp, Artificial
  CRISPR gRNA sequence
gcactttgggaggctgaagc

SEQ ID NO: 577024 - DNA, 20 bp, Artificial
  CRISPR gRNA sequence
ctttgggaggctgaagcggg

SEQ ID NO: 577025 - DNA, 20 bp, Artificial
  CRISPR gRNA sequence
ctgaagcgggtggatcacat

SEQ ID NO: 577026 - DNA, 20 bp, Artificial
  CRISPR gRNA sequence
tgaagcgggtggatcacatg

SEQ ID NO: 577027 - DNA, 20 bp, Artificial
  CRISPR gRNA sequence
gcgggtggatcacatgaggt

SEQ ID NO: 577028 - DNA, 20 bp, Artificial
  CRISPR gRNA sequence
cgggtggatcacatgaggtc

SEQ ID NO: 577029 - DNA, 20 bp, Artificial
  CRISPR gRNA sequence
ggtggatcacatgaggtcag

SEQ ID NO: 577030 - DNA, 20 bp, Artificial
  CRISPR gRNA sequence
tcacatgaggtcaggagttc

SEQ ID NO: 577031 - DNA, 20 bp, Artificial
  CRISPR gRNA sequence
tgaggtcaggagttcgagac

SEQ ID NO: 577032 - DNA, 20 bp, Artificial
  CRISPR gRNA sequence
tcaggagttcgagaccagcc

SEQ ID NO: 577033 - DNA, 20 bp, Artificial
  CRISPR gRNA sequence
cgagaccagcctggctaaca

SEQ ID NO: 577034 - DNA, 20 bp, Artificial
  CRISPR gRNA sequence
tctaccaaaaatacaaaaat

SEQ ID NO: 577035 - DNA, 20 bp, Artificial
  CRISPR gRNA sequence
ccaaaaatacaaaaattagc

SEQ ID NO: 577036 - DNA, 20 bp, Artificial
  CRISPR gRNA sequence
caaaaatacaaaaattagct

SEQ ID NO: 577037 - DNA, 20 bp, Artificial
  CRISPR gRNA sequence
atacaaaaattagctgggcg

SEQ ID NO: 577038 - DNA, 20 bp, Artificial
  CRISPR gRNA sequence
aaattagctgggcgtagtga

SEQ ID NO: 577039 - DNA, 20 bp, Artificial
  CRISPR gRNA sequence
aattagctgggcgtagtgac

SEQ ID NO: 577040 - DNA, 20 bp, Artificial
  CRISPR gRNA sequence
ggcgtagtgacgggcacctg

SEQ ID NO: 577041 - DNA, 20 bp, Artificial
  CRISPR gRNA sequence
gtgacgggcacctgtagtcc

SEQ ID NO: 577042 - DNA, 20 bp, Artificial
  CRISPR gRNA sequence
cacctgtagtcccagctact

SEQ ID NO: 577043 - DNA, 20 bp, Artificial
  CRISPR gRNA sequence
acctgtagtcccagctactc

SEQ ID NO: 577044 - DNA, 20 bp, Artificial
  CRISPR gRNA sequence
ctgtagtcccagctactcgg

SEQ ID NO: 577045 - DNA, 20 bp, Artificial
  CRISPR gRNA sequence
tgtagtcccagctactcggg

SEQ ID NO: 577046 - DNA, 20 bp, Artificial
  CRISPR gRNA sequence
tcccagctactcgggaggct

SEQ ID NO: 577047 - DNA, 20 bp, Artificial
  CRISPR gRNA sequence
cccagctactcgggaggctg

SEQ ID NO: 577048 - DNA, 20 bp, Artificial
  CRISPR gRNA sequence
agctactcgggaggctgagg

SEQ ID NO: 577049 - DNA, 20 bp, Artificial
  CRISPR gRNA sequence
tactcgggaggctgaggcag

SEQ ID NO: 577050 - DNA, 20 bp, Artificial
  CRISPR gRNA sequence
gcagaagacttgcttgaatc

SEQ ID NO: 577051 - DNA, 20 bp, Artificial
  CRISPR gRNA sequence
cagaagacttgcttgaatct

SEQ ID NO: 577052 - DNA, 20 bp, Artificial
  CRISPR gRNA sequence
gaagacttgcttgaatctgg

SEQ ID NO: 577053 - DNA, 20 bp, Artificial
  CRISPR gRNA sequence
aagacttgcttgaatctggg

SEQ ID NO: 577054 - DNA, 20 bp, Artificial
  CRISPR gRNA sequence
acttgcttgaatctgggagg

SEQ ID NO: 577055 - DNA, 20 bp, Artificial
  CRISPR gRNA sequence
cttgcttgaatctgggaggt

SEQ ID NO: 577056 - DNA, 20 bp, Artificial
  CRISPR gRNA sequence
ttgcttgaatctgggaggtg

SEQ ID NO: 577057 - DNA, 20 bp, Artificial
  CRISPR gRNA sequence
tgcttgaatctgggaggtgg

SEQ ID NO: 577058 - DNA, 20 bp, Artificial
  CRISPR gRNA sequence
aatctgggaggtgggggttg

SEQ ID NO: 577059 - DNA, 20 bp, Artificial
  CRISPR gRNA sequence
tgggaggtgggggttgcagt

SEQ ID NO: 577060 - DNA, 20 bp, Artificial
  CRISPR gRNA sequence
ggtgggggttgcagtgagcc

SEQ ID NO: 577061 - DNA, 20 bp, Artificial
  CRISPR gRNA sequence
gagattgcaccactgcactc

SEQ ID NO: 577062 - DNA, 20 bp, Artificial
  CRISPR gRNA sequence
tgcaccactgcactccagcc

SEQ ID NO: 577063 - DNA, 20 bp, Artificial
  CRISPR gRNA sequence
gcaccactgcactccagcct

SEQ ID NO: 577064 - DNA, 20 bp, Artificial
  CRISPR gRNA sequence
ctgcactccagcctgggcga

SEQ ID NO: 577065 - DNA, 20 bp, Artificial
  CRISPR gRNA sequence
gcactccagcctgggcgaca

SEQ ID NO: 577066 - DNA, 20 bp, Artificial
  CRISPR gRNA sequence
tccagcctgggcgacagagc

SEQ ID NO: 577067 - DNA, 20 bp, Artificial
  CRISPR gRNA sequence
ctgggcgacagagcaagact

SEQ ID NO: 577068 - DNA, 20 bp, Artificial
  CRISPR gRNA sequence
aaaaaataaaaaacataaaa

SEQ ID NO: 577069 - DNA, 20 bp, Artificial
  CRISPR gRNA sequence
aataaaaaacataaaataga

SEQ ID NO: 577070 - DNA, 20 bp, Artificial
  CRISPR gRNA sequence
aacataaaatagaaagtaaa

SEQ ID NO: 577071 - DNA, 20 bp, Artificial
  CRISPR gRNA sequence
ataaaatagaaagtaaaaag

SEQ ID NO: 577072 - DNA, 20 bp, Artificial
  CRISPR gRNA sequence
taaaatagaaagtaaaaagt

SEQ ID NO: 577073 - DNA, 20 bp, Artificial
  CRISPR gRNA sequence
aatagaaagtaaaaagtggg

SEQ ID NO: 577074 - DNA, 20 bp, Artificial
  CRISPR gRNA sequence
aagtaaaaagtgggaagttt

SEQ ID NO: 577075 - DNA, 20 bp, Artificial
  CRISPR gRNA sequence
aagtgggaagtttaagcctc

SEQ ID NO: 577076 - DNA, 20 bp, Artificial
  CRISPR gRNA sequence
agtgggaagtttaagcctct

SEQ ID NO: 577077 - DNA, 20 bp, Artificial
  CRISPR gRNA sequence
agtttaagcctctgggtcac

SEQ ID NO: 577078 - DNA, 20 bp, Artificial
  CRISPR gRNA sequence
accagcctctccccctcacc

SEQ ID NO: 577079 - DNA, 20 bp, Artificial
  CRISPR gRNA sequence
ccagcctctccccctcaccc

SEQ ID NO: 577080 - DNA, 20 bp, Artificial
  CRISPR gRNA sequence
tcacccaggcatcatccgac

SEQ ID NO: 577081 - DNA, 20 bp, Artificial
  CRISPR gRNA sequence
cacccaggcatcatccgaca

SEQ ID NO: 577082 - DNA, 20 bp, Artificial
  CRISPR gRNA sequence
acccaggcatcatccgacaa

SEQ ID NO: 577083 - DNA, 20 bp, Artificial
  CRISPR gRNA sequence
caagggctcctgctgcatcg

SEQ ID NO: 577084 - DNA, 20 bp, Artificial
  CRISPR gRNA sequence
tcctgctgcatcgtagctgc

SEQ ID NO: 577085 - DNA, 20 bp, Artificial
  CRISPR gRNA sequence
tgctgcatcgtagctgctgg

SEQ ID NO: 577086 - DNA, 20 bp, Artificial
  CRISPR gRNA sequence
catcgtagctgctggcagcc

SEQ ID NO: 577087 - DNA, 20 bp, Artificial
  CRISPR gRNA sequence
atcgtagctgctggcagcca

SEQ ID NO: 577088 - DNA, 20 bp, Artificial
  CRISPR gRNA sequence
cagccaaggccctgtcgtcc

SEQ ID NO: 577089 - DNA, 20 bp, Artificial
  CRISPR gRNA sequence
aaggccctgtcgtcccagcc

SEQ ID NO: 577090 - DNA, 20 bp, Artificial
  CRISPR gRNA sequence
cctgtcgtcccagcctggtc

SEQ ID NO: 577091 - DNA, 20 bp, Artificial
  CRISPR gRNA sequence
tcccagcctggtctggcccc

SEQ ID NO: 577092 - DNA, 20 bp, Artificial
  CRISPR gRNA sequence
cccagcctggtctggccccc

SEQ ID NO: 577093 - DNA, 20 bp, Artificial
  CRISPR gRNA sequence
cagcctggtctggcccccgg

SEQ ID NO: 577094 - DNA, 20 bp, Artificial
  CRISPR gRNA sequence
agcctggtctggcccccggg

SEQ ID NO: 577095 - DNA, 20 bp, Artificial
  CRISPR gRNA sequence
ggcccccgggaggcccctga

SEQ ID NO: 577096 - DNA, 20 bp, Artificial
  CRISPR gRNA sequence
ctgacagcctgtttgctgtc

SEQ ID NO: 577097 - DNA, 20 bp, Artificial
  CRISPR gRNA sequence
gacagcctgtttgctgtccg

SEQ ID NO: 577098 - DNA, 20 bp, Artificial
  CRISPR gRNA sequence
acagcctgtttgctgtccgg

SEQ ID NO: 577099 - DNA, 20 bp, Artificial
  CRISPR gRNA sequence
ttgctgtccggaggcacctg

SEQ ID NO: 577100 - DNA, 20 bp, Artificial
  CRISPR gRNA sequence
tgctgtccggaggcacctgt

SEQ ID NO: 577101 - DNA, 20 bp, Artificial
  CRISPR gRNA sequence
gctgtccggaggcacctgtg

SEQ ID NO: 577102 - DNA, 20 bp, Artificial
  CRISPR gRNA sequence
gtccggaggcacctgtgggg

SEQ ID NO: 577103 - DNA, 20 bp, Artificial
  CRISPR gRNA sequence
aggcacctgtggggtagcca

SEQ ID NO: 577104 - DNA, 20 bp, Artificial
  CRISPR gRNA sequence
ctgtggggtagccatggaaa

SEQ ID NO: 577105 - DNA, 20 bp, Artificial
  CRISPR gRNA sequence
ccatggaaacagcacattcc

SEQ ID NO: 577106 - DNA, 20 bp, Artificial
  CRISPR gRNA sequence
catggaaacagcacattccc

SEQ ID NO: 577107 - DNA, 20 bp, Artificial
  CRISPR gRNA sequence
gaaacagcacattcccaggt

SEQ ID NO: 577108 - DNA, 20 bp, Artificial
  CRISPR gRNA sequence
agcacattcccaggtaagaa

SEQ ID NO: 577109 - DNA, 20 bp, Artificial
  CRISPR gRNA sequence
agaatggtccttgcactaca

SEQ ID NO: 577110 - DNA, 20 bp, Artificial
  CRISPR gRNA sequence
ttgcactacacggtgccccc

SEQ ID NO: 577111 - DNA, 20 bp, Artificial
  CRISPR gRNA sequence
ccccaagctcctaatcctga

SEQ ID NO: 577112 - DNA, 20 bp, Artificial
  CRISPR gRNA sequence
cccaagctcctaatcctgac

SEQ ID NO: 577113 - DNA, 20 bp, Artificial
  CRISPR gRNA sequence
ctcctaatcctgacaggctc

SEQ ID NO: 577114 - DNA, 20 bp, Artificial
  CRISPR gRNA sequence
tcctaatcctgacaggctct

SEQ ID NO: 577115 - DNA, 20 bp, Artificial
  CRISPR gRNA sequence
taatcctgacaggctctggg

SEQ ID NO: 577116 - DNA, 20 bp, Artificial
  CRISPR gRNA sequence
atcctgacaggctctgggtg

SEQ ID NO: 577117 - DNA, 20 bp, Artificial
  CRISPR gRNA sequence
tcctgacaggctctgggtgg

SEQ ID NO: 577118 - DNA, 20 bp, Artificial
  CRISPR gRNA sequence
cctgacaggctctgggtgga

SEQ ID NO: 577119 - DNA, 20 bp, Artificial
  CRISPR gRNA sequence
ggctctgggtggagggtgca

SEQ ID NO: 577120 - DNA, 20 bp, Artificial
  CRISPR gRNA sequence
gctctgggtggagggtgcaa

SEQ ID NO: 577121 - DNA, 20 bp, Artificial
  CRISPR gRNA sequence
tctgggtggagggtgcaaag

SEQ ID NO: 577122 - DNA, 20 bp, Artificial
  CRISPR gRNA sequence
tcccaccaccaccaccactg

SEQ ID NO: 577123 - DNA, 20 bp, Artificial
  CRISPR gRNA sequence
ccactgcagctgccgccact

SEQ ID NO: 577124 - DNA, 20 bp, Artificial
  CRISPR gRNA sequence
agctgccgccactcagcctt

SEQ ID NO: 577125 - DNA, 20 bp, Artificial
  CRISPR gRNA sequence
gctgccgccactcagccttt

SEQ ID NO: 577126 - DNA, 20 bp, Artificial
  CRISPR gRNA sequence
gaaaatgcatccgctcacaa

SEQ ID NO: 577127 - DNA, 20 bp, Artificial
  CRISPR gRNA sequence
cgctcacaaaagcttccttt

SEQ ID NO: 577128 - DNA, 20 bp, Artificial
  CRISPR gRNA sequence
gctcacaaaagcttcctttc

SEQ ID NO: 577129 - DNA, 20 bp, Artificial
  CRISPR gRNA sequence
gcttcctttcgggatgtccg

SEQ ID NO: 577130 - DNA, 20 bp, Artificial
  CRISPR gRNA sequence
tcgggatgtccgtggcctga

SEQ ID NO: 577131 - DNA, 20 bp, Artificial
  CRISPR gRNA sequence
tggcctgaaagccccccata

SEQ ID NO: 577132 - DNA, 20 bp, Artificial
  CRISPR gRNA sequence
aaagccccccatatggtctc

SEQ ID NO: 577133 - DNA, 20 bp, Artificial
  CRISPR gRNA sequence
ccccatatggtctcgagtgt

SEQ ID NO: 577134 - DNA, 20 bp, Artificial
  CRISPR gRNA sequence
cccatatggtctcgagtgtc

SEQ ID NO: 577135 - DNA, 20 bp, Artificial
  CRISPR gRNA sequence
ggtctcgagtgtcgggcccc

SEQ ID NO: 577136 - DNA, 20 bp, Artificial
  CRISPR gRNA sequence
gcccctagccctgactccct

SEQ ID NO: 577137 - DNA, 20 bp, Artificial
  CRISPR gRNA sequence
cccctagccctgactccctt

SEQ ID NO: 577138 - DNA, 20 bp, Artificial
  CRISPR gRNA sequence
ccctagccctgactcccttg

SEQ ID NO: 577139 - DNA, 20 bp, Artificial
  CRISPR gRNA sequence
gccctgactcccttggggat

SEQ ID NO: 577140 - DNA, 20 bp, Artificial
  CRISPR gRNA sequence
ccctgactcccttggggatt

SEQ ID NO: 577141 - DNA, 20 bp, Artificial
  CRISPR gRNA sequence
cctgactcccttggggattg

SEQ ID NO: 577142 - DNA, 20 bp, Artificial
  CRISPR gRNA sequence
gggccatgcctcacccactc

SEQ ID NO: 577143 - DNA, 20 bp, Artificial
  CRISPR gRNA sequence
gcctcacccactctggactc

SEQ ID NO: 577144 - DNA, 20 bp, Artificial
  CRISPR gRNA sequence
tggactccagctactatatt

SEQ ID NO: 577145 - DNA, 20 bp, Artificial
  CRISPR gRNA sequence
cagctactatattcggccat

SEQ ID NO: 577146 - DNA, 20 bp, Artificial
  CRISPR gRNA sequence
ctactatattcggccatcag

SEQ ID NO: 577147 - DNA, 20 bp, Artificial
  CRISPR gRNA sequence
tactatattcggccatcaga

SEQ ID NO: 577148 - DNA, 20 bp, Artificial
  CRISPR gRNA sequence
actatattcggccatcagaa

SEQ ID NO: 577149 - DNA, 20 bp, Artificial
  CRISPR gRNA sequence
tatattcggccatcagaagg

SEQ ID NO: 577150 - DNA, 20 bp, Artificial
  CRISPR gRNA sequence
atattcggccatcagaaggg

SEQ ID NO: 577151 - DNA, 20 bp, Artificial
  CRISPR gRNA sequence
tattcggccatcagaaggga

SEQ ID NO: 577152 - DNA, 20 bp, Artificial
  CRISPR gRNA sequence
cagaagggagggaccctgct

SEQ ID NO: 577153 - DNA, 20 bp, Artificial
  CRISPR gRNA sequence
gggaccctgctaagtaattc

SEQ ID NO: 577154 - DNA, 20 bp, Artificial
  CRISPR gRNA sequence
ggaccctgctaagtaattcc

SEQ ID NO: 577155 - DNA, 20 bp, Artificial
  CRISPR gRNA sequence
accctgctaagtaattccag

SEQ ID NO: 577156 - DNA, 20 bp, Artificial
  CRISPR gRNA sequence
cctcctttcctcccctgacc

SEQ ID NO: 577157 - DNA, 20 bp, Artificial
  CRISPR gRNA sequence
ctcctttcctcccctgacca

SEQ ID NO: 577158 - DNA, 20 bp, Artificial
  CRISPR gRNA sequence
ctcccctgaccaaggaaaat

SEQ ID NO: 577159 - DNA, 20 bp, Artificial
  CRISPR gRNA sequence
tcccctgaccaaggaaaatc

SEQ ID NO: 577160 - DNA, 20 bp, Artificial
  CRISPR gRNA sequence
cccctgaccaaggaaaatcg

SEQ ID NO: 577161 - DNA, 20 bp, Artificial
  CRISPR gRNA sequence
ctgaccaaggaaaatcgggg

SEQ ID NO: 577162 - DNA, 20 bp, Artificial
  CRISPR gRNA sequence
aaatcggggtggattcgccc

SEQ ID NO: 577163 - DNA, 20 bp, Artificial
  CRISPR gRNA sequence
acctatccactgctctccac

SEQ ID NO: 577164 - DNA, 20 bp, Artificial
  CRISPR gRNA sequence
cctatccactgctctccacc

SEQ ID NO: 577165 - DNA, 20 bp, Artificial
  CRISPR gRNA sequence
ccactgctctccaccaggcc

SEQ ID NO: 577166 - DNA, 20 bp, Artificial
  CRISPR gRNA sequence
tctccaccaggcctggcctg

SEQ ID NO: 577167 - DNA, 20 bp, Artificial
  CRISPR gRNA sequence
ctccaccaggcctggcctgt

SEQ ID NO: 577168 - DNA, 20 bp, Artificial
  CRISPR gRNA sequence
ccaggcctggcctgtgggct

SEQ ID NO: 577169 - DNA, 20 bp, Artificial
  CRISPR gRNA sequence
ggcctggcctgtgggcttag

SEQ ID NO: 577170 - DNA, 20 bp, Artificial
  CRISPR gRNA sequence
gcctggcctgtgggcttagc

SEQ ID NO: 577171 - DNA, 20 bp, Artificial
  CRISPR gRNA sequence
cctggcctgtgggcttagca

SEQ ID NO: 577172 - DNA, 20 bp, Artificial
  CRISPR gRNA sequence
cctgtgggcttagcagggat

SEQ ID NO: 577173 - DNA, 20 bp, Artificial
  CRISPR gRNA sequence
tgtgggcttagcagggatca

SEQ ID NO: 577174 - DNA, 20 bp, Artificial
  CRISPR gRNA sequence
agagaccttgactgtcatcc

SEQ ID NO: 577175 - DNA, 20 bp, Artificial
  CRISPR gRNA sequence
atttaacctcttgcatcctt

SEQ ID NO: 577176 - DNA, 20 bp, Artificial
  CRISPR gRNA sequence
tcttgcatcctttggtgtgc

SEQ ID NO: 577177 - DNA, 20 bp, Artificial
  CRISPR gRNA sequence
actccgcttcttttcaacct

SEQ ID NO: 577178 - DNA, 20 bp, Artificial
  CRISPR gRNA sequence
ctccgcttcttttcaacctc

SEQ ID NO: 577179 - DNA, 20 bp, Artificial
  CRISPR gRNA sequence
tccgcttcttttcaacctcg

SEQ ID NO: 577180 - DNA, 20 bp, Artificial
  CRISPR gRNA sequence
cgcttcttttcaacctcggg

SEQ ID NO: 577181 - DNA, 20 bp, Artificial
  CRISPR gRNA sequence
aacctcggggagaactattt

SEQ ID NO: 577182 - DNA, 20 bp, Artificial
  CRISPR gRNA sequence
ctcggggagaactattttgg

SEQ ID NO: 577183 - DNA, 20 bp, Artificial
  CRISPR gRNA sequence
ggggagaactattttggcag

SEQ ID NO: 577184 - DNA, 20 bp, Artificial
  CRISPR gRNA sequence
gagaactattttggcagaag

SEQ ID NO: 577185 - DNA, 20 bp, Artificial
  CRISPR gRNA sequence
attttggcagaagtggtgca

SEQ ID NO: 577186 - DNA, 20 bp, Artificial
  CRISPR gRNA sequence
ataaatgatacaacttatgt

SEQ ID NO: 577187 - DNA, 20 bp, Artificial
  CRISPR gRNA sequence
taaatgatacaacttatgtc

SEQ ID NO: 577188 - DNA, 20 bp, Artificial
  CRISPR gRNA sequence
tacaacttatgtcaggtgct

SEQ ID NO: 577189 - DNA, 20 bp, Artificial
  CRISPR gRNA sequence
tatgtcaggtgctcagcaaa

SEQ ID NO: 577190 - DNA, 20 bp, Artificial
  CRISPR gRNA sequence
gcaaacagtacctgtgcccg

SEQ ID NO: 577191 - DNA, 20 bp, Artificial
  CRISPR gRNA sequence
agtacctgtgcccgtggaca

SEQ ID NO: 577192 - DNA, 20 bp, Artificial
  CRISPR gRNA sequence
gtacctgtgcccgtggacac

SEQ ID NO: 577193 - DNA, 20 bp, Artificial
  CRISPR gRNA sequence
cccgtggacacgggtgttga

SEQ ID NO: 577194 - DNA, 20 bp, Artificial
  CRISPR gRNA sequence
tggacacgggtgttgacggt

SEQ ID NO: 577195 - DNA, 20 bp, Artificial
  CRISPR gRNA sequence
gggtgttgacggtgagatct

SEQ ID NO: 577196 - DNA, 20 bp, Artificial
  CRISPR gRNA sequence
ggtgttgacggtgagatctc

SEQ ID NO: 577197 - DNA, 20 bp, Artificial
  CRISPR gRNA sequence
acggtgagatctcaggcctg

SEQ ID NO: 577198 - DNA, 20 bp, Artificial
  CRISPR gRNA sequence
aggcctgtagactcaccttg

SEQ ID NO: 577199 - DNA, 20 bp, Artificial
  CRISPR gRNA sequence
ggcctgtagactcaccttgt

SEQ ID NO: 577200 - DNA, 20 bp, Artificial
  CRISPR gRNA sequence
gcctgtagactcaccttgta

SEQ ID NO: 577201 - DNA, 20 bp, Artificial
  CRISPR gRNA sequence
cctgtagactcaccttgtag

SEQ ID NO: 577202 - DNA, 20 bp, Artificial
  CRISPR gRNA sequence
ctgtagactcaccttgtagg

SEQ ID NO: 577203 - DNA, 20 bp, Artificial
  CRISPR gRNA sequence
gtagactcaccttgtagggg

SEQ ID NO: 577204 - DNA, 20 bp, Artificial
  CRISPR gRNA sequence
tagactcaccttgtaggggg

SEQ ID NO: 577205 - DNA, 20 bp, Artificial
  CRISPR gRNA sequence
agactcaccttgtaggggga

SEQ ID NO: 577206 - DNA, 20 bp, Artificial
  CRISPR gRNA sequence
gactcaccttgtagggggag

SEQ ID NO: 577207 - DNA, 20 bp, Artificial
  CRISPR gRNA sequence
caccttgtagggggagggga

SEQ ID NO: 577208 - DNA, 20 bp, Artificial
  CRISPR gRNA sequence
accttgtagggggaggggac

SEQ ID NO: 577209 - DNA, 20 bp, Artificial
  CRISPR gRNA sequence
ccttgtagggggaggggaca

SEQ ID NO: 577210 - DNA, 20 bp, Artificial
  CRISPR gRNA sequence
ttgtagggggaggggacagg

SEQ ID NO: 577211 - DNA, 20 bp, Artificial
  CRISPR gRNA sequence
agggggaggggacagggagc

SEQ ID NO: 577212 - DNA, 20 bp, Artificial
  CRISPR gRNA sequence
ggaggggacagggagctagc

SEQ ID NO: 577213 - DNA, 20 bp, Artificial
  CRISPR gRNA sequence
gaggggacagggagctagct

SEQ ID NO: 577214 - DNA, 20 bp, Artificial
  CRISPR gRNA sequence
ggggacagggagctagctag

SEQ ID NO: 577215 - DNA, 20 bp, Artificial
  CRISPR gRNA sequence
gggacagggagctagctagg

SEQ ID NO: 577216 - DNA, 20 bp, Artificial
  CRISPR gRNA sequence
gctagctaggaggtcctgca

SEQ ID NO: 577217 - DNA, 20 bp, Artificial
  CRISPR gRNA sequence
ctagctaggaggtcctgcat

SEQ ID NO: 577218 - DNA, 20 bp, Artificial
  CRISPR gRNA sequence
tagctaggaggtcctgcatg

SEQ ID NO: 577219 - DNA, 20 bp, Artificial
  CRISPR gRNA sequence
gattcatccccaccctctga

SEQ ID NO: 577220 - DNA, 20 bp, Artificial
  CRISPR gRNA sequence
ttcatccccaccctctgaca

SEQ ID NO: 577221 - DNA, 20 bp, Artificial
  CRISPR gRNA sequence
gacagagttcctccacaaca

SEQ ID NO: 577222 - DNA, 20 bp, Artificial
  CRISPR gRNA sequence
tccacaacatggactacttc

SEQ ID NO: 577223 - DNA, 20 bp, Artificial
  CRISPR gRNA sequence
cctacgccacgctcatccgc

SEQ ID NO: 577224 - DNA, 20 bp, Artificial
  CRISPR gRNA sequence
ctacgccacgctcatccgct

SEQ ID NO: 577225 - DNA, 20 bp, Artificial
  CRISPR gRNA sequence
gccacgctcatccgctgggt

SEQ ID NO: 577226 - DNA, 20 bp, Artificial
  CRISPR gRNA sequence
acgctcatccgctgggtaag

SEQ ID NO: 577227 - DNA, 20 bp, Artificial
  CRISPR gRNA sequence
cgctcatccgctgggtaagc

SEQ ID NO: 577228 - DNA, 20 bp, Artificial
  CRISPR gRNA sequence
gctcatccgctgggtaagca

SEQ ID NO: 577229 - DNA, 20 bp, Artificial
  CRISPR gRNA sequence
catccgctgggtaagcaggg

SEQ ID NO: 577230 - DNA, 20 bp, Artificial
  CRISPR gRNA sequence
gctgggtaagcagggcagct

SEQ ID NO: 577231 - DNA, 20 bp, Artificial
  CRISPR gRNA sequence
aagcagggcagctcggcccc

SEQ ID NO: 577232 - DNA, 20 bp, Artificial
  CRISPR gRNA sequence
agcagggcagctcggcccca

SEQ ID NO: 577233 - DNA, 20 bp, Artificial
  CRISPR gRNA sequence
cagggcagctcggccccaag

SEQ ID NO: 577234 - DNA, 20 bp, Artificial
  CRISPR gRNA sequence
agggcagctcggccccaagg

SEQ ID NO: 577235 - DNA, 20 bp, Artificial
  CRISPR gRNA sequence
ggcagctcggccccaaggag

SEQ ID NO: 577236 - DNA, 20 bp, Artificial
  CRISPR gRNA sequence
gcagctcggccccaaggagg

SEQ ID NO: 577237 - DNA, 20 bp, Artificial
  CRISPR gRNA sequence
gctcggccccaaggaggagg

SEQ ID NO: 577238 - DNA, 20 bp, Artificial
  CRISPR gRNA sequence
ccccaaggaggaggaagaca

SEQ ID NO: 577239 - DNA, 20 bp, Artificial
  CRISPR gRNA sequence
aaggaggaggaagacaaaga

SEQ ID NO: 577240 - DNA, 20 bp, Artificial
  CRISPR gRNA sequence
aggaggaggaagacaaagat

SEQ ID NO: 577241 - DNA, 20 bp, Artificial
  CRISPR gRNA sequence
ggaggaggaagacaaagatg

SEQ ID NO: 577242 - DNA, 20 bp, Artificial
  CRISPR gRNA sequence
ggaggaagacaaagatgggg

SEQ ID NO: 577243 - DNA, 20 bp, Artificial
  CRISPR gRNA sequence
gaggaagacaaagatggggt

SEQ ID NO: 577244 - DNA, 20 bp, Artificial
  CRISPR gRNA sequence
aggaagacaaagatggggtg

SEQ ID NO: 577245 - DNA, 20 bp, Artificial
  CRISPR gRNA sequence
ggaagacaaagatggggtgg

SEQ ID NO: 577246 - DNA, 20 bp, Artificial
  CRISPR gRNA sequence
ccaaactcctgtctccctct

SEQ ID NO: 577247 - DNA, 20 bp, Artificial
  CRISPR gRNA sequence
tgtctccctctgagtgccct

SEQ ID NO: 577248 - DNA, 20 bp, Artificial
  CRISPR gRNA sequence
tctccctctgagtgccctca

SEQ ID NO: 577249 - DNA, 20 bp, Artificial
  CRISPR gRNA sequence
ccctctgagtgccctcagag

SEQ ID NO: 577250 - DNA, 20 bp, Artificial
  CRISPR gRNA sequence
cctctgagtgccctcagagt

SEQ ID NO: 577251 - DNA, 20 bp, Artificial
  CRISPR gRNA sequence
gagtgggttcctccattccc

SEQ ID NO: 577252 - DNA, 20 bp, Artificial
  CRISPR gRNA sequence
gttcctccattcccaagccc

SEQ ID NO: 577253 - DNA, 20 bp, Artificial
  CRISPR gRNA sequence
cattcccaagccccagcccc

SEQ ID NO: 577254 - DNA, 20 bp, Artificial
  CRISPR gRNA sequence
attcccaagccccagcccca

SEQ ID NO: 577255 - DNA, 20 bp, Artificial
  CRISPR gRNA sequence
ccccagccccaaggatcccc

SEQ ID NO: 577256 - DNA, 20 bp, Artificial
  CRISPR gRNA sequence
tcaaatgtgacccctcatgc

SEQ ID NO: 577257 - DNA, 20 bp, Artificial
  CRISPR gRNA sequence
tccaaacctaaaccaccatc

SEQ ID NO: 577258 - DNA, 20 bp, Artificial
  CRISPR gRNA sequence
ccaaacctaaaccaccatcc

SEQ ID NO: 577259 - DNA, 20 bp, Artificial
  CRISPR gRNA sequence
acctaaaccaccatccaggc

SEQ ID NO: 577260 - DNA, 20 bp, Artificial
  CRISPR gRNA sequence
ctaaaccaccatccaggcca

SEQ ID NO: 577261 - DNA, 20 bp, Artificial
  CRISPR gRNA sequence
accctaaacctacccctttc

SEQ ID NO: 577262 - DNA, 20 bp, Artificial
  CRISPR gRNA sequence
ccctttccagatgtccacct

SEQ ID NO: 577263 - DNA, 20 bp, Artificial
  CRISPR gRNA sequence
ccccatacctaaccctctcc

SEQ ID NO: 577264 - DNA, 20 bp, Artificial
  CRISPR gRNA sequence
cctctcctggacccataaaa

SEQ ID NO: 577265 - DNA, 20 bp, Artificial
  CRISPR gRNA sequence
tggacccataaaatagccta

SEQ ID NO: 577266 - DNA, 20 bp, Artificial
  CRISPR gRNA sequence
accttgccctaaacgtaccc

SEQ ID NO: 577267 - DNA, 20 bp, Artificial
  CRISPR gRNA sequence
tcttactctaactccttccc

SEQ ID NO: 577268 - DNA, 20 bp, Artificial
  CRISPR gRNA sequence
cccaaccccatctccttccc

SEQ ID NO: 577269 - DNA, 20 bp, Artificial
  CRISPR gRNA sequence
tccctggccccaacgtaccc

SEQ ID NO: 577270 - DNA, 20 bp, Artificial
  CRISPR gRNA sequence
tatgtcaatacacccccaac

SEQ ID NO: 577271 - DNA, 20 bp, Artificial
  CRISPR gRNA sequence
atgtcaatacacccccaact

SEQ ID NO: 577272 - DNA, 20 bp, Artificial
  CRISPR gRNA sequence
ccatcccaactccttcatct

SEQ ID NO: 577273 - DNA, 20 bp, Artificial
  CRISPR gRNA sequence
cagcctccccaatgccttct

SEQ ID NO: 577274 - DNA, 20 bp, Artificial
  CRISPR gRNA sequence
ccttctcagaaccttcatcc

SEQ ID NO: 577275 - DNA, 20 bp, Artificial
  CRISPR gRNA sequence
acctcacccctacatgatac

SEQ ID NO: 577276 - DNA, 20 bp, Artificial
  CRISPR gRNA sequence
tctgaactgaaaccctgacc

SEQ ID NO: 577277 - DNA, 20 bp, Artificial
  CRISPR gRNA sequence
cctagccccatcctgactga

SEQ ID NO: 577278 - DNA, 20 bp, Artificial
  CRISPR gRNA sequence
tgatcaaattccctgaccct

SEQ ID NO: 577279 - DNA, 20 bp, Artificial
  CRISPR gRNA sequence
actaacctcatccttgccct

SEQ ID NO: 577280 - DNA, 20 bp, Artificial
  CRISPR gRNA sequence
taaccatgtccctgacacgt

SEQ ID NO: 577281 - DNA, 20 bp, Artificial
  CRISPR gRNA sequence
tcgataattcaaaccatctc

SEQ ID NO: 577282 - DNA, 20 bp, Artificial
  CRISPR gRNA sequence
catctctggcttctgaccta

SEQ ID NO: 577283 - DNA, 20 bp, Artificial
  CRISPR gRNA sequence
ctggcttctgacctaaagcc

SEQ ID NO: 577284 - DNA, 20 bp, Artificial
  CRISPR gRNA sequence
gtcatcccatccctcacccc

SEQ ID NO: 577285 - DNA, 20 bp, Artificial
  CRISPR gRNA sequence
cacccctagaccccccacct

SEQ ID NO: 577286 - DNA, 20 bp, Artificial
  CRISPR gRNA sequence
ccccccacctgagtccaccc

SEQ ID NO: 577287 - DNA, 20 bp, Artificial
  CRISPR gRNA sequence
ccaccccttccctgaccctt

SEQ ID NO: 577288 - DNA, 20 bp, Artificial
  CRISPR gRNA sequence
cccttccctgacccttaagt

SEQ ID NO: 577289 - DNA, 20 bp, Artificial
  CRISPR gRNA sequence
ccctgacccttaagttggcc

SEQ ID NO: 577290 - DNA, 20 bp, Artificial
  CRISPR gRNA sequence
accctgaaatgtcacctcca

SEQ ID NO: 577291 - DNA, 20 bp, Artificial
  CRISPR gRNA sequence
cctgaaatgtcacctccaca

SEQ ID NO: 577292 - DNA, 20 bp, Artificial
  CRISPR gRNA sequence
ccccaactccaactccatcc

SEQ ID NO: 577293 - DNA, 20 bp, Artificial
  CRISPR gRNA sequence
ccagacctttcacctcactt

SEQ ID NO: 577294 - DNA, 20 bp, Artificial
  CRISPR gRNA sequence
ctttcacctcacttcagccc

SEQ ID NO: 577295 - DNA, 20 bp, Artificial
  CRISPR gRNA sequence
cttcagccctagccctgaac

SEQ ID NO: 577296 - DNA, 20 bp, Artificial
  CRISPR gRNA sequence
caagaccccactcccaacct

SEQ ID NO: 577297 - DNA, 20 bp, Artificial
  CRISPR gRNA sequence
cctgatcccttacctaatcc

SEQ ID NO: 577298 - DNA, 20 bp, Artificial
  CRISPR gRNA sequence
cccatgcttcaccccacatc

SEQ ID NO: 577299 - DNA, 20 bp, Artificial
  CRISPR gRNA sequence
ctacaattccgcccccatgt

SEQ ID NO: 577300 - DNA, 20 bp, Artificial
  CRISPR gRNA sequence
aattccgcccccatgtcaga

SEQ ID NO: 577301 - DNA, 20 bp, Artificial
  CRISPR gRNA sequence
cgcccccatgtcagatggct

SEQ ID NO: 577302 - DNA, 20 bp, Artificial
  CRISPR gRNA sequence
gcccccatgtcagatggctc

SEQ ID NO: 577303 - DNA, 20 bp, Artificial
  CRISPR gRNA sequence
cccccatgtcagatggctcg

SEQ ID NO: 577304 - DNA, 20 bp, Artificial
  CRISPR gRNA sequence
ccatgtcagatggctcgggg

SEQ ID NO: 577305 - DNA, 20 bp, Artificial
  CRISPR gRNA sequence
catgtcagatggctcggggt

SEQ ID NO: 577306 - DNA, 20 bp, Artificial
  CRISPR gRNA sequence
agatggctcggggtaggtca

SEQ ID NO: 577307 - DNA, 20 bp, Artificial
  CRISPR gRNA sequence
tcatagcccctctaaacccc

SEQ ID NO: 577308 - DNA, 20 bp, Artificial
  CRISPR gRNA sequence
gcccctctaaaccccaagtt

SEQ ID NO: 577309 - DNA, 20 bp, Artificial
  CRISPR gRNA sequence
cccctctaaaccccaagttt

SEQ ID NO: 577310 - DNA, 20 bp, Artificial
  CRISPR gRNA sequence
ccctctaaaccccaagtttg

SEQ ID NO: 577311 - DNA, 20 bp, Artificial
  CRISPR gRNA sequence
ttaccccaccccccaacttc

SEQ ID NO: 577312 - DNA, 20 bp, Artificial
  CRISPR gRNA sequence
taccccaccccccaacttcc

SEQ ID NO: 577313 - DNA, 20 bp, Artificial
  CRISPR gRNA sequence
ccccaacttccaggccatcc

SEQ ID NO: 577314 - DNA, 20 bp, Artificial
  CRISPR gRNA sequence
ccaacttccaggccatcctg

SEQ ID NO: 577315 - DNA, 20 bp, Artificial
  CRISPR gRNA sequence
caacttccaggccatcctgg

SEQ ID NO: 577316 - DNA, 20 bp, Artificial
  CRISPR gRNA sequence
ccaggccatcctggaggctc

SEQ ID NO: 577317 - DNA, 20 bp, Artificial
  CRISPR gRNA sequence
aggccatcctggaggctcca

SEQ ID NO: 577318 - DNA, 20 bp, Artificial
  CRISPR gRNA sequence
ccatcctggaggctccagag

SEQ ID NO: 577319 - DNA, 20 bp, Artificial
  CRISPR gRNA sequence
tcctggaggctccagagaag

SEQ ID NO: 577320 - DNA, 20 bp, Artificial
  CRISPR gRNA sequence
tggaggctccagagaagcag

SEQ ID NO: 577321 - DNA, 20 bp, Artificial
  CRISPR gRNA sequence
agaagcagcggacactcaat

SEQ ID NO: 577322 - DNA, 20 bp, Artificial
  CRISPR gRNA sequence
cactcaatgagatctaccac

SEQ ID NO: 577323 - DNA, 20 bp, Artificial
  CRISPR gRNA sequence
acacgcatgtttgccttctt

SEQ ID NO: 577324 - DNA, 20 bp, Artificial
  CRISPR gRNA sequence
tcagaaaccatcctgccacc

SEQ ID NO: 577325 - DNA, 20 bp, Artificial
  CRISPR gRNA sequence
gaaaccatcctgccacctgg

SEQ ID NO: 577326 - DNA, 20 bp, Artificial
  CRISPR gRNA sequence
aaaccatcctgccacctgga

SEQ ID NO: 577327 - DNA, 20 bp, Artificial
  CRISPR gRNA sequence
catcctgccacctggaaggt

SEQ ID NO: 577328 - DNA, 20 bp, Artificial
  CRISPR gRNA sequence
cctggaaggtgagctcctct

SEQ ID NO: 577329 - DNA, 20 bp, Artificial
  CRISPR gRNA sequence
ctggaaggtgagctcctctg

SEQ ID NO: 577330 - DNA, 20 bp, Artificial
  CRISPR gRNA sequence
gaaggtgagctcctctgagg

SEQ ID NO: 577331 - DNA, 20 bp, Artificial
  CRISPR gRNA sequence
ggtgagctcctctgaggtgg

SEQ ID NO: 577332 - DNA, 20 bp, Artificial
  CRISPR gRNA sequence
tcctctgaggtggcggtgac

SEQ ID NO: 577333 - DNA, 20 bp, Artificial
  CRISPR gRNA sequence
cctctgaggtggcggtgact

SEQ ID NO: 577334 - DNA, 20 bp, Artificial
  CRISPR gRNA sequence
tgaggtggcggtgactggga

SEQ ID NO: 577335 - DNA, 20 bp, Artificial
  CRISPR gRNA sequence
gcggtgactgggatggcctc

SEQ ID NO: 577336 - DNA, 20 bp, Artificial
  CRISPR gRNA sequence
gatggcctcaagtgccatcg

SEQ ID NO: 577337 - DNA, 20 bp, Artificial
  CRISPR gRNA sequence
tcaagtgccatcgcagctca

SEQ ID NO: 577338 - DNA, 20 bp, Artificial
  CRISPR gRNA sequence
agtgccatcgcagctcaaag

SEQ ID NO: 577339 - DNA, 20 bp, Artificial
  CRISPR gRNA sequence
gtgccatcgcagctcaaagt

SEQ ID NO: 577340 - DNA, 20 bp, Artificial
  CRISPR gRNA sequence
ccatcgcagctcaaagtggg

SEQ ID NO: 577341 - DNA, 20 bp, Artificial
  CRISPR gRNA sequence
catcgcagctcaaagtgggc

SEQ ID NO: 577342 - DNA, 20 bp, Artificial
  CRISPR gRNA sequence
cagctcaaagtgggcaggcc

SEQ ID NO: 577343 - DNA, 20 bp, Artificial
  CRISPR gRNA sequence
agctcaaagtgggcaggcct

SEQ ID NO: 577344 - DNA, 20 bp, Artificial
  CRISPR gRNA sequence
aaagtgggcaggcctgggtc

SEQ ID NO: 577345 - DNA, 20 bp, Artificial
  CRISPR gRNA sequence
aagtgggcaggcctgggtct

SEQ ID NO: 577346 - DNA, 20 bp, Artificial
  CRISPR gRNA sequence
caggcctgggtctgggctca

SEQ ID NO: 577347 - DNA, 20 bp, Artificial
  CRISPR gRNA sequence
aggcctgggtctgggctcat

SEQ ID NO: 577348 - DNA, 20 bp, Artificial
  CRISPR gRNA sequence
gtctgggctcataggcacat

SEQ ID NO: 577349 - DNA, 20 bp, Artificial
  CRISPR gRNA sequence
tctgggctcataggcacatt

SEQ ID NO: 577350 - DNA, 20 bp, Artificial
  CRISPR gRNA sequence
ctgggctcataggcacattg

SEQ ID NO: 577351 - DNA, 20 bp, Artificial
  CRISPR gRNA sequence
gggctcataggcacattggg

SEQ ID NO: 577352 - DNA, 20 bp, Artificial
  CRISPR gRNA sequence
ggctcataggcacattgggg

SEQ ID NO: 577353 - DNA, 20 bp, Artificial
  CRISPR gRNA sequence
ataggcacattggggaggaa

SEQ ID NO: 577354 - DNA, 20 bp, Artificial
  CRISPR gRNA sequence
taggcacattggggaggaac

SEQ ID NO: 577355 - DNA, 20 bp, Artificial
  CRISPR gRNA sequence
cattggggaggaacgggatg

SEQ ID NO: 577356 - DNA, 20 bp, Artificial
  CRISPR gRNA sequence
attggggaggaacgggatgt

SEQ ID NO: 577357 - DNA, 20 bp, Artificial
  CRISPR gRNA sequence
aggaacgggatgtgggttgt

SEQ ID NO: 577358 - DNA, 20 bp, Artificial
  CRISPR gRNA sequence
aacgggatgtgggttgttgg

SEQ ID NO: 577359 - DNA, 20 bp, Artificial
  CRISPR gRNA sequence
gggatgtgggttgttggtgg

SEQ ID NO: 577360 - DNA, 20 bp, Artificial
  CRISPR gRNA sequence
gggttgttggtggtggctgc

SEQ ID NO: 577361 - DNA, 20 bp, Artificial
  CRISPR gRNA sequence
ttggtggtggctgctggcct

SEQ ID NO: 577362 - DNA, 20 bp, Artificial
  CRISPR gRNA sequence
ggtggtggctgctggcctca

SEQ ID NO: 577363 - DNA, 20 bp, Artificial
  CRISPR gRNA sequence
gtggtggctgctggcctcag

SEQ ID NO: 577364 - DNA, 20 bp, Artificial
  CRISPR gRNA sequence
gcccacctgctccctgtccc

SEQ ID NO: 577365 - DNA, 20 bp, Artificial
  CRISPR gRNA sequence
tccctgtccccggccttcca

SEQ ID NO: 577366 - DNA, 20 bp, Artificial
  CRISPR gRNA sequence
aacgccatccgccacaacct

SEQ ID NO: 577367 - DNA, 20 bp, Artificial
  CRISPR gRNA sequence
gccacaacctgagtctgcac

SEQ ID NO: 577368 - DNA, 20 bp, Artificial
  CRISPR gRNA sequence
gtctgcacaagtgctttgtg

SEQ ID NO: 577369 - DNA, 20 bp, Artificial
  CRISPR gRNA sequence
tctgcacaagtgctttgtgc

SEQ ID NO: 577370 - DNA, 20 bp, Artificial
  CRISPR gRNA sequence
gcacaagtgctttgtgcggg

SEQ ID NO: 577371 - DNA, 20 bp, Artificial
  CRISPR gRNA sequence
acaagtgctttgtgcgggtg

SEQ ID NO: 577372 - DNA, 20 bp, Artificial
  CRISPR gRNA sequence
aagtgctttgtgcgggtgga

SEQ ID NO: 577373 - DNA, 20 bp, Artificial
  CRISPR gRNA sequence
gctttgtgcgggtggagagc

SEQ ID NO: 577374 - DNA, 20 bp, Artificial
  CRISPR gRNA sequence
ttgtgcgggtggagagcgag

SEQ ID NO: 577375 - DNA, 20 bp, Artificial
  CRISPR gRNA sequence
tgtgcgggtggagagcgaga

SEQ ID NO: 577376 - DNA, 20 bp, Artificial
  CRISPR gRNA sequence
gtgcgggtggagagcgagaa

SEQ ID NO: 577377 - DNA, 20 bp, Artificial
  CRISPR gRNA sequence
tgcgggtggagagcgagaag

SEQ ID NO: 577378 - DNA, 20 bp, Artificial
  CRISPR gRNA sequence
gcgggtggagagcgagaagg

SEQ ID NO: 577379 - DNA, 20 bp, Artificial
  CRISPR gRNA sequence
agagcgagaagggggctgtg

SEQ ID NO: 577380 - DNA, 20 bp, Artificial
  CRISPR gRNA sequence
gaagggggctgtgtggaccg

SEQ ID NO: 577381 - DNA, 20 bp, Artificial
  CRISPR gRNA sequence
gggctgtgtggaccgtggat

SEQ ID NO: 577382 - DNA, 20 bp, Artificial
  CRISPR gRNA sequence
tgtgtggaccgtggatgagc

SEQ ID NO: 577383 - DNA, 20 bp, Artificial
  CRISPR gRNA sequence
tgtggaccgtggatgagctg

SEQ ID NO: 577384 - DNA, 20 bp, Artificial
  CRISPR gRNA sequence
tggatgagctggagttccgc

SEQ ID NO: 577385 - DNA, 20 bp, Artificial
  CRISPR gRNA sequence
agctggagttccgcaagaaa

SEQ ID NO: 577386 - DNA, 20 bp, Artificial
  CRISPR gRNA sequence
ctggagttccgcaagaaacg

SEQ ID NO: 577387 - DNA, 20 bp, Artificial
  CRISPR gRNA sequence
agttccgcaagaaacggagc

SEQ ID NO: 577388 - DNA, 20 bp, Artificial
  CRISPR gRNA sequence
ttccgcaagaaacggagcca

SEQ ID NO: 577389 - DNA, 20 bp, Artificial
  CRISPR gRNA sequence
tccgcaagaaacggagccag

SEQ ID NO: 577390 - DNA, 20 bp, Artificial
  CRISPR gRNA sequence
aagaaacggagccagaggcc

SEQ ID NO: 577391 - DNA, 20 bp, Artificial
  CRISPR gRNA sequence
aaacggagccagaggcccag

SEQ ID NO: 577392 - DNA, 20 bp, Artificial
  CRISPR gRNA sequence
aacggagccagaggcccagc

SEQ ID NO: 577393 - DNA, 20 bp, Artificial
  CRISPR gRNA sequence
aggtgttccaaccctacacc

SEQ ID NO: 577394 - DNA, 20 bp, Artificial
  CRISPR gRNA sequence
tacacctggcccctgacctc

SEQ ID NO: 577395 - DNA, 20 bp, Artificial
  CRISPR gRNA sequence
tggcccctgacctcaagatc

SEQ ID NO: 577396 - DNA, 20 bp, Artificial
  CRISPR gRNA sequence
ggcccctgacctcaagatca

SEQ ID NO: 577397 - DNA, 20 bp, Artificial
  CRISPR gRNA sequence
cctgacctcaagatcaagga

SEQ ID NO: 577398 - DNA, 20 bp, Artificial
  CRISPR gRNA sequence
ctgacctcaagatcaaggaa

SEQ ID NO: 577399 - DNA, 20 bp, Artificial
  CRISPR gRNA sequence
gacctcaagatcaaggaaag

SEQ ID NO: 577400 - DNA, 20 bp, Artificial
  CRISPR gRNA sequence
acctcaagatcaaggaaagg

SEQ ID NO: 577401 - DNA, 20 bp, Artificial
  CRISPR gRNA sequence
caagatcaaggaaaggagga

SEQ ID NO: 577402 - DNA, 20 bp, Artificial
  CRISPR gRNA sequence
aggaaaggaggatggacgaa

SEQ ID NO: 577403 - DNA, 20 bp, Artificial
  CRISPR gRNA sequence
ggaaaggaggatggacgaac

SEQ ID NO: 577404 - DNA, 20 bp, Artificial
  CRISPR gRNA sequence
gaaaggaggatggacgaaca

SEQ ID NO: 577405 - DNA, 20 bp, Artificial
  CRISPR gRNA sequence
aaaggaggatggacgaacag

SEQ ID NO: 577406 - DNA, 20 bp, Artificial
  CRISPR gRNA sequence
tggacgaacaggggccaaac

SEQ ID NO: 577407 - DNA, 20 bp, Artificial
  CRISPR gRNA sequence
acgaacaggggccaaactgg

SEQ ID NO: 577408 - DNA, 20 bp, Artificial
  CRISPR gRNA sequence
cgaacaggggccaaactggt

SEQ ID NO: 577409 - DNA, 20 bp, Artificial
  CRISPR gRNA sequence
aacaggggccaaactggtgg

SEQ ID NO: 577410 - DNA, 20 bp, Artificial
  CRISPR gRNA sequence
acaggggccaaactggtggg

SEQ ID NO: 577411 - DNA, 20 bp, Artificial
  CRISPR gRNA sequence
ggggccaaactggtgggagg

SEQ ID NO: 577412 - DNA, 20 bp, Artificial
  CRISPR gRNA sequence
ggccaaactggtgggaggca

SEQ ID NO: 577413 - DNA, 20 bp, Artificial
  CRISPR gRNA sequence
gccaaactggtgggaggcag

SEQ ID NO: 577414 - DNA, 20 bp, Artificial
  CRISPR gRNA sequence
aaactggtgggaggcagagg

SEQ ID NO: 577415 - DNA, 20 bp, Artificial
  CRISPR gRNA sequence
ctggtgggaggcagaggtgg

SEQ ID NO: 577416 - DNA, 20 bp, Artificial
  CRISPR gRNA sequence
tggtgggaggcagaggtggt

SEQ ID NO: 577417 - DNA, 20 bp, Artificial
  CRISPR gRNA sequence
ggtgggaggcagaggtggtg

SEQ ID NO: 577418 - DNA, 20 bp, Artificial
  CRISPR gRNA sequence
gtgggaggcagaggtggtgg

SEQ ID NO: 577419 - DNA, 20 bp, Artificial
  CRISPR gRNA sequence
ggaggcagaggtggtggggg

SEQ ID NO: 577420 - DNA, 20 bp, Artificial
  CRISPR gRNA sequence
gaggcagaggtggtgggggc

SEQ ID NO: 577421 - DNA, 20 bp, Artificial
  CRISPR gRNA sequence
aggcagaggtggtgggggca

SEQ ID NO: 577422 - DNA, 20 bp, Artificial
  CRISPR gRNA sequence
ggtggtgggggcagggatga

SEQ ID NO: 577423 - DNA, 20 bp, Artificial
  CRISPR gRNA sequence
gtggtgggggcagggatgat

SEQ ID NO: 577424 - DNA, 20 bp, Artificial
  CRISPR gRNA sequence
ggggcagggatgataggccc

SEQ ID NO: 577425 - DNA, 20 bp, Artificial
  CRISPR gRNA sequence
ataggccctggatgtgccca

SEQ ID NO: 577426 - DNA, 20 bp, Artificial
  CRISPR gRNA sequence
taggccctggatgtgcccac

SEQ ID NO: 577427 - DNA, 20 bp, Artificial
  CRISPR gRNA sequence
aggccctggatgtgcccaca

SEQ ID NO: 577428 - DNA, 20 bp, Artificial
  CRISPR gRNA sequence
tggatgtgcccacagggacc

SEQ ID NO: 577429 - DNA, 20 bp, Artificial
  CRISPR gRNA sequence
atgtgcccacagggaccaag

SEQ ID NO: 577430 - DNA, 20 bp, Artificial
  CRISPR gRNA sequence
gcccacagggaccaagaagt

SEQ ID NO: 577431 - DNA, 20 bp, Artificial
  CRISPR gRNA sequence
cccacagggaccaagaagtg

SEQ ID NO: 577432 - DNA, 20 bp, Artificial
  CRISPR gRNA sequence
gtttccactgtcttgcctgc

SEQ ID NO: 577433 - DNA, 20 bp, Artificial
  CRISPR gRNA sequence
tttccactgtcttgcctgcc

SEQ ID NO: 577434 - DNA, 20 bp, Artificial
  CRISPR gRNA sequence
ttccactgtcttgcctgcca

SEQ ID NO: 577435 - DNA, 20 bp, Artificial
  CRISPR gRNA sequence
cagggcccctgttcccccgc

SEQ ID NO: 577436 - DNA, 20 bp, Artificial
  CRISPR gRNA sequence
ggcccctgttcccccgctgg

SEQ ID NO: 577437 - DNA, 20 bp, Artificial
  CRISPR gRNA sequence
cccatcatatcctttgcccc

SEQ ID NO: 577438 - DNA, 20 bp, Artificial
  CRISPR gRNA sequence
ccatcatatcctttgcccca

SEQ ID NO: 577439 - DNA, 20 bp, Artificial
  CRISPR gRNA sequence
tcctttgccccaaggctgct

SEQ ID NO: 577440 - DNA, 20 bp, Artificial
  CRISPR gRNA sequence
ctttgccccaaggctgctca

SEQ ID NO: 577441 - DNA, 20 bp, Artificial
  CRISPR gRNA sequence
tttgccccaaggctgctcag

SEQ ID NO: 577442 - DNA, 20 bp, Artificial
  CRISPR gRNA sequence
ttgccccaaggctgctcaga

SEQ ID NO: 577443 - DNA, 20 bp, Artificial
  CRISPR gRNA sequence
tgccccaaggctgctcagag

SEQ ID NO: 577444 - DNA, 20 bp, Artificial
  CRISPR gRNA sequence
aaggctgctcagaggggccc

SEQ ID NO: 577445 - DNA, 20 bp, Artificial
  CRISPR gRNA sequence
gctcagaggggccccggtcc

SEQ ID NO: 577446 - DNA, 20 bp, Artificial
  CRISPR gRNA sequence
aggggccccggtcctggccc

SEQ ID NO: 577447 - DNA, 20 bp, Artificial
  CRISPR gRNA sequence
cccagcccccacctccgccc

SEQ ID NO: 577448 - DNA, 20 bp, Artificial
  CRISPR gRNA sequence
tccgccccagacacaccccc

SEQ ID NO: 577449 - DNA, 20 bp, Artificial
  CRISPR gRNA sequence
cccagacacaccccccagtc

SEQ ID NO: 577450 - DNA, 20 bp, Artificial
  CRISPR gRNA sequence
caccccccagtcgagccctg

SEQ ID NO: 577451 - DNA, 20 bp, Artificial
  CRISPR gRNA sequence
agtcgagccctgcagccaaa

SEQ ID NO: 577452 - DNA, 20 bp, Artificial
  CRISPR gRNA sequence
tcgagccctgcagccaaaca

SEQ ID NO: 577453 - DNA, 20 bp, Artificial
  CRISPR gRNA sequence
ccaaacagagccttcacaac

SEQ ID NO: 577454 - DNA, 20 bp, Artificial
  CRISPR gRNA sequence
agccttcacaaccagccaca

SEQ ID NO: 577455 - DNA, 20 bp, Artificial
  CRISPR gRNA sequence
ccttcacaaccagccacaca

SEQ ID NO: 577456 - DNA, 20 bp, Artificial
  CRISPR gRNA sequence
cagccacacagagcctgcct

SEQ ID NO: 577457 - DNA, 20 bp, Artificial
  CRISPR gRNA sequence
gcctgcctcagctgctcgca

SEQ ID NO: 577458 - DNA, 20 bp, Artificial
  CRISPR gRNA sequence
gctgctcgcacagattactt

SEQ ID NO: 577459 - DNA, 20 bp, Artificial
  CRISPR gRNA sequence
ctgctcgcacagattacttc

SEQ ID NO: 577460 - DNA, 20 bp, Artificial
  CRISPR gRNA sequence
tgctcgcacagattacttca

SEQ ID NO: 577461 - DNA, 20 bp, Artificial
  CRISPR gRNA sequence
cgcacagattacttcagggc

SEQ ID NO: 577462 - DNA, 20 bp, Artificial
  CRISPR gRNA sequence
agattacttcagggctggaa

SEQ ID NO: 577463 - DNA, 20 bp, Artificial
  CRISPR gRNA sequence
tcagggctggaaaagtcaca

SEQ ID NO: 577464 - DNA, 20 bp, Artificial
  CRISPR gRNA sequence
tcaacacaaaccccaaaaca

SEQ ID NO: 577465 - DNA, 20 bp, Artificial
  CRISPR gRNA sequence
aacacaaaccccaaaacaca

SEQ ID NO: 577466 - DNA, 20 bp, Artificial
  CRISPR gRNA sequence
cacaaaccccaaaacacaga

SEQ ID NO: 577467 - DNA, 20 bp, Artificial
  CRISPR gRNA sequence
aaaacacagagagcctgcct

SEQ ID NO: 577468 - DNA, 20 bp, Artificial
  CRISPR gRNA sequence
agtacactcaaacaacctca

SEQ ID NO: 577469 - DNA, 20 bp, Artificial
  CRISPR gRNA sequence
atcatcacacaatcacacac

SEQ ID NO: 577470 - DNA, 20 bp, Artificial
  CRISPR gRNA sequence
cacacaatcacacacaagca

SEQ ID NO: 577471 - DNA, 20 bp, Artificial
  CRISPR gRNA sequence
cctgacaacccacacacccc

SEQ ID NO: 577472 - DNA, 20 bp, Artificial
  CRISPR gRNA sequence
ctgacaacccacacacccca

SEQ ID NO: 577473 - DNA, 20 bp, Artificial
  CRISPR gRNA sequence
caccccaaggcacgcaccca

SEQ ID NO: 577474 - DNA, 20 bp, Artificial
  CRISPR gRNA sequence
ccaaggcacgcacccacagc

SEQ ID NO: 577475 - DNA, 20 bp, Artificial
  CRISPR gRNA sequence
cacgcacccacagccagcct

SEQ ID NO: 577476 - DNA, 20 bp, Artificial
  CRISPR gRNA sequence
acgcacccacagccagcctc

SEQ ID NO: 577477 - DNA, 20 bp, Artificial
  CRISPR gRNA sequence
cgcacccacagccagcctca

SEQ ID NO: 577478 - DNA, 20 bp, Artificial
  CRISPR gRNA sequence
acagccagcctcagggccca

SEQ ID NO: 577479 - DNA, 20 bp, Artificial
  CRISPR gRNA sequence
cagccagcctcagggcccac

SEQ ID NO: 577480 - DNA, 20 bp, Artificial
  CRISPR gRNA sequence
agccagcctcagggcccaca

SEQ ID NO: 577481 - DNA, 20 bp, Artificial
  CRISPR gRNA sequence
gccagcctcagggcccacag

SEQ ID NO: 577482 - DNA, 20 bp, Artificial
  CRISPR gRNA sequence
ccacaggggcactgtcaaca

SEQ ID NO: 577483 - DNA, 20 bp, Artificial
  CRISPR gRNA sequence
cacaggggcactgtcaacac

SEQ ID NO: 577484 - DNA, 20 bp, Artificial
  CRISPR gRNA sequence
acaggggcactgtcaacaca

SEQ ID NO: 577485 - DNA, 20 bp, Artificial
  CRISPR gRNA sequence
caggggcactgtcaacacag

SEQ ID NO: 577486 - DNA, 20 bp, Artificial
  CRISPR gRNA sequence
tgtcaacacaggggtgtgcc

SEQ ID NO: 577487 - DNA, 20 bp, Artificial
  CRISPR gRNA sequence
tcaacacaggggtgtgccca

SEQ ID NO: 577488 - DNA, 20 bp, Artificial
  CRISPR gRNA sequence
caacacaggggtgtgcccag

SEQ ID NO: 577489 - DNA, 20 bp, Artificial
  CRISPR gRNA sequence
ggtgtgcccagaggcctaca

SEQ ID NO: 577490 - DNA, 20 bp, Artificial
  CRISPR gRNA sequence
gtgcccagaggcctacacag

SEQ ID NO: 577491 - DNA, 20 bp, Artificial
  CRISPR gRNA sequence
cccagaggcctacacagaag

SEQ ID NO: 577492 - DNA, 20 bp, Artificial
  CRISPR gRNA sequence
ggcctacacagaagcagcgt

SEQ ID NO: 577493 - DNA, 20 bp, Artificial
  CRISPR gRNA sequence
agaagcagcgtcagtaccct

SEQ ID NO: 577494 - DNA, 20 bp, Artificial
  CRISPR gRNA sequence
gaagcagcgtcagtaccctc

SEQ ID NO: 577495 - DNA, 20 bp, Artificial
  CRISPR gRNA sequence
cgtcagtaccctcaggatct

SEQ ID NO: 577496 - DNA, 20 bp, Artificial
  CRISPR gRNA sequence
gtcagtaccctcaggatctg

SEQ ID NO: 577497 - DNA, 20 bp, Artificial
  CRISPR gRNA sequence
cacgtgctcgctcacacaca

SEQ ID NO: 577498 - DNA, 20 bp, Artificial
  CRISPR gRNA sequence
cgctcacacacacggcctgt

SEQ ID NO: 577499 - DNA, 20 bp, Artificial
  CRISPR gRNA sequence
ctcacgcatatgcacacgca

SEQ ID NO: 577500 - DNA, 20 bp, Artificial
  CRISPR gRNA sequence
tatgcacacgcacagccccc

SEQ ID NO: 577501 - DNA, 20 bp, Artificial
  CRISPR gRNA sequence
gcacacgcacagccccccag

SEQ ID NO: 577502 - DNA, 20 bp, Artificial
  CRISPR gRNA sequence
cacacgcacagccccccagt

SEQ ID NO: 577503 - DNA, 20 bp, Artificial
  CRISPR gRNA sequence
agccccccagtgggtctctt

SEQ ID NO: 577504 - DNA, 20 bp, Artificial
  CRISPR gRNA sequence
tgggtctcttgagtcccgtg

SEQ ID NO: 577505 - DNA, 20 bp, Artificial
  CRISPR gRNA sequence
gagtcccgtgcagacacaca

SEQ ID NO: 577506 - DNA, 20 bp, Artificial
  CRISPR gRNA sequence
tcacctcactcccattccct

SEQ ID NO: 577507 - DNA, 20 bp, Artificial
  CRISPR gRNA sequence
ctgagccctgatccatgcct

SEQ ID NO: 577508 - DNA, 20 bp, Artificial
  CRISPR gRNA sequence
ccctgatccatgcctcagct

SEQ ID NO: 577509 - DNA, 20 bp, Artificial
  CRISPR gRNA sequence
ccatgcctcagcttagactg

SEQ ID NO: 577510 - DNA, 20 bp, Artificial
  CRISPR gRNA sequence
atgcctcagcttagactgca

SEQ ID NO: 577511 - DNA, 20 bp, Artificial
  CRISPR gRNA sequence
tgcctcagcttagactgcag

SEQ ID NO: 577512 - DNA, 20 bp, Artificial
  CRISPR gRNA sequence
agaggaactactcatttatt

SEQ ID NO: 577513 - DNA, 20 bp, Artificial
  CRISPR gRNA sequence
gaggaactactcatttattt

SEQ ID NO: 577514 - DNA, 20 bp, Artificial
  CRISPR gRNA sequence
tactcatttatttgggatcc

SEQ ID NO: 577515 - DNA, 20 bp, Artificial
  CRISPR gRNA sequence
actcatttatttgggatcca

SEQ ID NO: 577516 - DNA, 20 bp, Artificial
  CRISPR gRNA sequence
gatccaaggcccccaaccca

SEQ ID NO: 577517 - DNA, 20 bp, Artificial
  CRISPR gRNA sequence
gtaccgtccccaataaactg

SEQ ID NO: 577518 - DNA, 20 bp, Artificial
  CRISPR gRNA sequence
gtccccaataaactgcagcc

SEQ ID NO: 577519 - DNA, 20 bp, Artificial
  CRISPR gRNA sequence
cagccgagctccccacatgc

SEQ ID NO: 577520 - DNA, 20 bp, Artificial
  CRISPR gRNA sequence
gctggactatcaccccatat

SEQ ID NO: 577521 - DNA, 20 bp, Artificial
  CRISPR gRNA sequence
ctggactatcaccccatata

SEQ ID NO: 577522 - DNA, 20 bp, Artificial
  CRISPR gRNA sequence
tggactatcaccccatataa

SEQ ID NO: 577523 - DNA, 20 bp, Artificial
  CRISPR gRNA sequence
atcaccccatataagggttg

SEQ ID NO: 577524 - DNA, 20 bp, Artificial
  CRISPR gRNA sequence
ccccatataagggttgcggt

SEQ ID NO: 577525 - DNA, 20 bp, Artificial
  CRISPR gRNA sequence
catataagggttgcggtcag

SEQ ID NO: 577526 - DNA, 20 bp, Artificial
  CRISPR gRNA sequence
atataagggttgcggtcagt

SEQ ID NO: 577527 - DNA, 20 bp, Artificial
  CRISPR gRNA sequence
taagggttgcggtcagtggg

SEQ ID NO: 577528 - DNA, 20 bp, Artificial
  CRISPR gRNA sequence
aagggttgcggtcagtgggc

SEQ ID NO: 577529 - DNA, 20 bp, Artificial
  CRISPR gRNA sequence
agggttgcggtcagtgggca

SEQ ID NO: 577530 - DNA, 20 bp, Artificial
  CRISPR gRNA sequence
gggttgcggtcagtgggcag

SEQ ID NO: 577531 - DNA, 20 bp, Artificial
  CRISPR gRNA sequence
gcggtcagtgggcaggggtc

SEQ ID NO: 577532 - DNA, 20 bp, Artificial
  CRISPR gRNA sequence
cggtcagtgggcaggggtct

SEQ ID NO: 577533 - DNA, 20 bp, Artificial
  CRISPR gRNA sequence
gtgggcaggggtctgggtcc

SEQ ID NO: 577534 - DNA, 20 bp, Artificial
  CRISPR gRNA sequence
tgggcaggggtctgggtcca

SEQ ID NO: 577535 - DNA, 20 bp, Artificial
  CRISPR gRNA sequence
ggggtctgggtccaaggccg

SEQ ID NO: 577536 - DNA, 20 bp, Artificial
  CRISPR gRNA sequence
gtctgggtccaaggccgcag

SEQ ID NO: 577537 - DNA, 20 bp, Artificial
  CRISPR gRNA sequence
tctgggtccaaggccgcagc

SEQ ID NO: 577538 - DNA, 20 bp, Artificial
  CRISPR gRNA sequence
tgggtccaaggccgcagcag

SEQ ID NO: 577539 - DNA, 20 bp, Artificial
  CRISPR gRNA sequence
gggtccaaggccgcagcagg

SEQ ID NO: 577540 - DNA, 20 bp, Artificial
  CRISPR gRNA sequence
aaggccgcagcaggaggaac

SEQ ID NO: 577541 - DNA, 20 bp, Artificial
  CRISPR gRNA sequence
ccgcagcaggaggaactgga

SEQ ID NO: 577542 - DNA, 20 bp, Artificial
  CRISPR gRNA sequence
cagcaggaggaactggacag

SEQ ID NO: 577543 - DNA, 20 bp, Artificial
  CRISPR gRNA sequence
gcaggaggaactggacagcg

SEQ ID NO: 577544 - DNA, 20 bp, Artificial
  CRISPR gRNA sequence
caggaggaactggacagcgg

SEQ ID NO: 577545 - DNA, 20 bp, Artificial
  CRISPR gRNA sequence
gaggaactggacagcggagg

SEQ ID NO: 577546 - DNA, 20 bp, Artificial
  CRISPR gRNA sequence
gaactggacagcggaggaag

SEQ ID NO: 577547 - DNA, 20 bp, Artificial
  CRISPR gRNA sequence
tggacagcggaggaagtagc

SEQ ID NO: 577548 - DNA, 20 bp, Artificial
  CRISPR gRNA sequence
ggacagcggaggaagtagct

SEQ ID NO: 577549 - DNA, 20 bp, Artificial
  CRISPR gRNA sequence
gacagcggaggaagtagcta

SEQ ID NO: 577550 - DNA, 20 bp, Artificial
  CRISPR gRNA sequence
cactgaccgcaacccttata

SEQ ID NO: 577551 - DNA, 20 bp, Artificial
  CRISPR gRNA sequence
agtttattggggacggtact

SEQ ID NO: 577552 - DNA, 20 bp, Artificial
  CRISPR gRNA sequence
ggtactgtgggttgggggcc

SEQ ID NO: 577553 - DNA, 20 bp, Artificial
  CRISPR gRNA sequence
gggccttggatcccaaataa

SEQ ID NO: 577554 - DNA, 20 bp, Artificial
  CRISPR gRNA sequence
tctgcagtctaagctgaggc

SEQ ID NO: 577555 - DNA, 20 bp, Artificial
  CRISPR gRNA sequence
gaggcatggatcagggctca

SEQ ID NO: 577556 - DNA, 20 bp, Artificial
  CRISPR gRNA sequence
tggatcagggctcagggaat

SEQ ID NO: 577557 - DNA, 20 bp, Artificial
  CRISPR gRNA sequence
gctcagggaatgggagtgag

SEQ ID NO: 577558 - DNA, 20 bp, Artificial
  CRISPR gRNA sequence
ggtgagtggcaggggagaca

SEQ ID NO: 577559 - DNA, 20 bp, Artificial
  CRISPR gRNA sequence
catatgcgtgagatacacag

SEQ ID NO: 577560 - DNA, 20 bp, Artificial
  CRISPR gRNA sequence
gtgttgggacctcagatcct

SEQ ID NO: 577561 - DNA, 20 bp, Artificial
  CRISPR gRNA sequence
tgtgggccctgaggctggct

SEQ ID NO: 577562 - DNA, 20 bp, Artificial
  CRISPR gRNA sequence
ctggctgtgggtgcgtgcct

SEQ ID NO: 577563 - DNA, 20 bp, Artificial
  CRISPR gRNA sequence
gggtgcgtgccttggggtgt

SEQ ID NO: 577564 - DNA, 20 bp, Artificial
  CRISPR gRNA sequence
tgatgcagctttgaggttgt

SEQ ID NO: 577565 - DNA, 20 bp, Artificial
  CRISPR gRNA sequence
gaggcaggctctctgtgttt

SEQ ID NO: 577566 - DNA, 20 bp, Artificial
  CRISPR gRNA sequence
tctgtgttttggggtttgtg

SEQ ID NO: 577567 - DNA, 20 bp, Artificial
  CRISPR gRNA sequence
ggtttgtgttgagtgaggga

SEQ ID NO: 577568 - DNA, 20 bp, Artificial
  CRISPR gRNA sequence
ttggctgcagggctcgactg

SEQ ID NO: 577569 - DNA, 20 bp, Artificial
  CRISPR gRNA sequence
ctctgagcagccttggggca

SEQ ID NO: 577570 - DNA, 20 bp, Artificial
  CRISPR gRNA sequence
gcaaaggatatgatggggga

SEQ ID NO: 577571 - DNA, 20 bp, Artificial
  CRISPR gRNA sequence
ttgaggtcaggggccaggtg

SEQ ID NO: 577572 - DNA, 20 bp, Artificial
  CRISPR gRNA sequence
ttgtgcagactcaggttgtg

SEQ ID NO: 577573 - DNA, 20 bp, Artificial
  CRISPR gRNA sequence
ggagctcaccttccaggtgg

SEQ ID NO: 577574 - DNA, 20 bp, Artificial
  CRISPR gRNA sequence
tgaaccagtggtagatctca

SEQ ID NO: 577575 - DNA, 20 bp, Artificial
  CRISPR gRNA sequence
cgctgcttctctggagcctc

SEQ ID NO: 577576 - DNA, 20 bp, Artificial
  CRISPR gRNA sequence
ccaggatggcctggaagttg

SEQ ID NO: 577577 - DNA, 20 bp, Artificial
  CRISPR gRNA sequence
atggcctggaagttgggggg

SEQ ID NO: 577578 - DNA, 20 bp, Artificial
  CRISPR gRNA sequence
aggggcacattccccaaact

SEQ ID NO: 577579 - DNA, 20 bp, Artificial
  CRISPR gRNA sequence
cgagccatctgacatggggg

SEQ ID NO: 577580 - DNA, 20 bp, Artificial
  CRISPR gRNA sequence
atcagggacaggactagatg

SEQ ID NO: 577581 - DNA, 20 bp, Artificial
  CRISPR gRNA sequence
actagatgtggggtgaagca

SEQ ID NO: 577582 - DNA, 20 bp, Artificial
  CRISPR gRNA sequence
gtgaagcatggggtcaaaga

SEQ ID NO: 577583 - DNA, 20 bp, Artificial
  CRISPR gRNA sequence
gtcaaagatggggttagaaa

SEQ ID NO: 577584 - DNA, 20 bp, Artificial
  CRISPR gRNA sequence
gttagaaaaggggtgaagtg

SEQ ID NO: 577585 - DNA, 20 bp, Artificial
  CRISPR gRNA sequence
gggtgaagtgtcgggttggg

SEQ ID NO: 577586 - DNA, 20 bp, Artificial
  CRISPR gRNA sequence
gtcgggttgggcagggttag

SEQ ID NO: 577587 - DNA, 20 bp, Artificial
  CRISPR gRNA sequence
ttgggcagggttagatgggt

SEQ ID NO: 577588 - DNA, 20 bp, Artificial
  CRISPR gRNA sequence
gggtgtgggtatggttgttc

SEQ ID NO: 577589 - DNA, 20 bp, Artificial
  CRISPR gRNA sequence
ggttgttctgggattaggta

SEQ ID NO: 577590 - DNA, 20 bp, Artificial
  CRISPR gRNA sequence
aagggatcaggactgaggtt

SEQ ID NO: 577591 - DNA, 20 bp, Artificial
  CRISPR gRNA sequence
atcaggactgaggttgggag

SEQ ID NO: 577592 - DNA, 20 bp, Artificial
  CRISPR gRNA sequence
ctgaagtgaggtgaaaggtc

SEQ ID NO: 577593 - DNA, 20 bp, Artificial
  CRISPR gRNA sequence
gtgaggtgaaaggtctggga

SEQ ID NO: 577594 - DNA, 20 bp, Artificial
  CRISPR gRNA sequence
tgaaaggtctgggatggagt

SEQ ID NO: 577595 - DNA, 20 bp, Artificial
  CRISPR gRNA sequence
gtctgggatggagttggagt

SEQ ID NO: 577596 - DNA, 20 bp, Artificial
  CRISPR gRNA sequence
tctctgtggaggtgacattt

SEQ ID NO: 577597 - DNA, 20 bp, Artificial
  CRISPR gRNA sequence
tttcagggttggggaaggtg

SEQ ID NO: 577598 - DNA, 20 bp, Artificial
  CRISPR gRNA sequence
ggaaggtgaagggtcagaag

SEQ ID NO: 577599 - DNA, 20 bp, Artificial
  CRISPR gRNA sequence
gaagggtcagaagtggggtc

SEQ ID NO: 577600 - DNA, 20 bp, Artificial
  CRISPR gRNA sequence
agtggggtcaaggatttgga

SEQ ID NO: 577601 - DNA, 20 bp, Artificial
  CRISPR gRNA sequence
gtaaagggccaggccaactt

SEQ ID NO: 577602 - DNA, 20 bp, Artificial
  CRISPR gRNA sequence
gccaacttaagggtcaggga

SEQ ID NO: 577603 - DNA, 20 bp, Artificial
  CRISPR gRNA sequence
acttaagggtcagggaaggg

SEQ ID NO: 577604 - DNA, 20 bp, Artificial
  CRISPR gRNA sequence
ggtcagggaaggggtgggtt

SEQ ID NO: 577605 - DNA, 20 bp, Artificial
  CRISPR gRNA sequence
gggtgggttaagagtcaggc

SEQ ID NO: 577606 - DNA, 20 bp, Artificial
  CRISPR gRNA sequence
ggctggggtggactcaggtg

SEQ ID NO: 577607 - DNA, 20 bp, Artificial
  CRISPR gRNA sequence
tggactcaggtggggggtct

SEQ ID NO: 577608 - DNA, 20 bp, Artificial
  CRISPR gRNA sequence
aggtggggggtctaggggtg

SEQ ID NO: 577609 - DNA, 20 bp, Artificial
  CRISPR gRNA sequence
gggggtctaggggtgaggga

SEQ ID NO: 577610 - DNA, 20 bp, Artificial
  CRISPR gRNA sequence
ggtcagaagccagagatggt

SEQ ID NO: 577611 - DNA, 20 bp, Artificial
  CRISPR gRNA sequence
gccagagatggtttgaatta

SEQ ID NO: 577612 - DNA, 20 bp, Artificial
  CRISPR gRNA sequence
taggtggttaggctcagggc

SEQ ID NO: 577613 - DNA, 20 bp, Artificial
  CRISPR gRNA sequence
ggcaaggatgaggttagttg

SEQ ID NO: 577614 - DNA, 20 bp, Artificial
  CRISPR gRNA sequence
gttagttgtggggttcggtg

SEQ ID NO: 577615 - DNA, 20 bp, Artificial
  CRISPR gRNA sequence
gttcggtgtggagtgaggct

SEQ ID NO: 577616 - DNA, 20 bp, Artificial
  CRISPR gRNA sequence
tggagtgaggctgagggtca

SEQ ID NO: 577617 - DNA, 20 bp, Artificial
  CRISPR gRNA sequence
ggtcagggaatttgatcagt

SEQ ID NO: 577618 - DNA, 20 bp, Artificial
  CRISPR gRNA sequence
aatttgatcagtttggattc

SEQ ID NO: 577619 - DNA, 20 bp, Artificial
  CRISPR gRNA sequence
gatcagtttggattcaggaa

SEQ ID NO: 577620 - DNA, 20 bp, Artificial
  CRISPR gRNA sequence
tggattcaggaatgggatta

SEQ ID NO: 577621 - DNA, 20 bp, Artificial
  CRISPR gRNA sequence
attgcagtgaggctatcagt

SEQ ID NO: 577622 - DNA, 20 bp, Artificial
  CRISPR gRNA sequence
cagtcaggatggggctaggt

SEQ ID NO: 577623 - DNA, 20 bp, Artificial
  CRISPR gRNA sequence
tttcagttcagagacagtcg

SEQ ID NO: 577624 - DNA, 20 bp, Artificial
  CRISPR gRNA sequence
gggaatatctggtatcatgt

SEQ ID NO: 577625 - DNA, 20 bp, Artificial
  CRISPR gRNA sequence
gtaggggtgaggttcaggtt

SEQ ID NO: 577626 - DNA, 20 bp, Artificial
  CRISPR gRNA sequence
tttggggttaggtgtggcgc

SEQ ID NO: 577627 - DNA, 20 bp, Artificial
  CRISPR gRNA sequence
cattggggaggctgagatga

SEQ ID NO: 577628 - DNA, 20 bp, Artificial
  CRISPR gRNA sequence
ggaggctgagatgaaggagt

SEQ ID NO: 577629 - DNA, 20 bp, Artificial
  CRISPR gRNA sequence
ctgagatgaaggagttggga

SEQ ID NO: 577630 - DNA, 20 bp, Artificial
  CRISPR gRNA sequence
tgggatggggtgatgaagtt

SEQ ID NO: 577631 - DNA, 20 bp, Artificial
  CRISPR gRNA sequence
gtgatgaagttaaggatcaa

SEQ ID NO: 577632 - DNA, 20 bp, Artificial
  CRISPR gRNA sequence
gggtgttacaaggaaaggtt

SEQ ID NO: 577633 - DNA, 20 bp, Artificial
  CRISPR gRNA sequence
gttgggaatggtgcccagtt

SEQ ID NO: 577634 - DNA, 20 bp, Artificial
  CRISPR gRNA sequence
ttgggggtgtattgacatac

SEQ ID NO: 577635 - DNA, 20 bp, Artificial
  CRISPR gRNA sequence
gttggggccagggaaggaga

SEQ ID NO: 577636 - DNA, 20 bp, Artificial
  CRISPR gRNA sequence
ggccagggaaggagatgggg

SEQ ID NO: 577637 - DNA, 20 bp, Artificial
  CRISPR gRNA sequence
gttggcataaaggctgggga

SEQ ID NO: 577638 - DNA, 20 bp, Artificial
  CRISPR gRNA sequence
ataaaggctggggaaggagt

SEQ ID NO: 577639 - DNA, 20 bp, Artificial
  CRISPR gRNA sequence
gaaggagttagagtaagagc

SEQ ID NO: 577640 - DNA, 20 bp, Artificial
  CRISPR gRNA sequence
tttagggcaaggtgcagaga

SEQ ID NO: 577641 - DNA, 20 bp, Artificial
  CRISPR gRNA sequence
ggttagctttaggctatttt

SEQ ID NO: 577642 - DNA, 20 bp, Artificial
  CRISPR gRNA sequence
gctattttatgggtccagga

SEQ ID NO: 577643 - DNA, 20 bp, Artificial
  CRISPR gRNA sequence
gctgaggtggacatctggaa

SEQ ID NO: 577644 - DNA, 20 bp, Artificial
  CRISPR gRNA sequence
catctggaaaggggtaggtt

SEQ ID NO: 577645 - DNA, 20 bp, Artificial
  CRISPR gRNA sequence
gaaaggggtaggtttagggt

SEQ ID NO: 577646 - DNA, 20 bp, Artificial
  CRISPR gRNA sequence
agaatttggcatgctctggc

SEQ ID NO: 577647 - DNA, 20 bp, Artificial
  CRISPR gRNA sequence
gcctggatggtggtttaggt

SEQ ID NO: 577648 - DNA, 20 bp, Artificial
  CRISPR gRNA sequence
tttggatttgcggacaggtt

SEQ ID NO: 577649 - DNA, 20 bp, Artificial
  CRISPR gRNA sequence
tttggggtgaagccagcatg

SEQ ID NO: 577650 - DNA, 20 bp, Artificial
  CRISPR gRNA sequence
tcacatttgaggcacggctt

SEQ ID NO: 577651 - DNA, 20 bp, Artificial
  CRISPR gRNA sequence
gatccttggggctggggctt

SEQ ID NO: 577652 - DNA, 20 bp, Artificial
  CRISPR gRNA sequence
gagggcactcagagggagac

SEQ ID NO: 577653 - DNA, 20 bp, Artificial
  CRISPR gRNA sequence
cgagctgccctgcttaccca

SEQ ID NO: 577654 - DNA, 20 bp, Artificial
  CRISPR gRNA sequence
tgagcgtggcgtaggtgaaa

SEQ ID NO: 577655 - DNA, 20 bp, Artificial
  CRISPR gRNA sequence
gttgtggaggaactctgtca

SEQ ID NO: 577656 - DNA, 20 bp, Artificial
  CRISPR gRNA sequence
gaggaactctgtcagagggt

SEQ ID NO: 577657 - DNA, 20 bp, Artificial
  CRISPR gRNA sequence
aactctgtcagagggtgggg

SEQ ID NO: 577658 - DNA, 20 bp, Artificial
  CRISPR gRNA sequence
ctgtcccctccccctacaag

SEQ ID NO: 577659 - DNA, 20 bp, Artificial
  CRISPR gRNA sequence
tccccgaggttgaaaagaag

SEQ ID NO: 577660 - DNA, 20 bp, Artificial
  CRISPR gRNA sequence
gcggagtaacttgcacacca

SEQ ID NO: 577661 - DNA, 20 bp, Artificial
  CRISPR gRNA sequence
aagaggttaaatggcagagc

SEQ ID NO: 577662 - DNA, 20 bp, Artificial
  CRISPR gRNA sequence
gccaggcctggtggagagca

SEQ ID NO: 577663 - DNA, 20 bp, Artificial
  CRISPR gRNA sequence
cagtggataggtgagctcgg

SEQ ID NO: 577664 - DNA, 20 bp, Artificial
  CRISPR gRNA sequence
gggaggaaaggaggtgctcc

SEQ ID NO: 577665 - DNA, 20 bp, Artificial
  CRISPR gRNA sequence
gtgctcctggaattacttag

SEQ ID NO: 577666 - DNA, 20 bp, Artificial
  CRISPR gRNA sequence
gggtccctcccttctgatgg

SEQ ID NO: 577667 - DNA, 20 bp, Artificial
  CRISPR gRNA sequence
tgatggccgaatatagtagc

SEQ ID NO: 577668 - DNA, 20 bp, Artificial
  CRISPR gRNA sequence
cgaatatagtagctggagtc

SEQ ID NO: 577669 - DNA, 20 bp, Artificial
  CRISPR gRNA sequence
tatagtagctggagtccaga

SEQ ID NO: 577670 - DNA, 20 bp, Artificial
  CRISPR gRNA sequence
ggcatggccccaatccccaa

SEQ ID NO: 577671 - DNA, 20 bp, Artificial
  CRISPR gRNA sequence
ccgaaaggaagcttttgtga

SEQ ID NO: 577672 - DNA, 20 bp, Artificial
  CRISPR gRNA sequence
cggatgcattttcccaaagg

SEQ ID NO: 577673 - DNA, 20 bp, Artificial
  CRISPR gRNA sequence
accctccacccagagcctgt

SEQ ID NO: 577674 - DNA, 20 bp, Artificial
  CRISPR gRNA sequence
tgcaaggaccattcttacct

SEQ ID NO: 577675 - DNA, 20 bp, Artificial
  CRISPR gRNA sequence
cgatgcagcaggagcccttg

SEQ ID NO: 577676 - DNA, 20 bp, Artificial
  CRISPR gRNA sequence
gagcccttgtcggatgatgc

SEQ ID NO: 577677 - DNA, 20 bp, Artificial
  CRISPR gRNA sequence
gttttttattttttttgata

SEQ ID NO: 577678 - DNA, 20 bp, Artificial
  CRISPR gRNA sequence
tcttgctctgtcgcccaggc

SEQ ID NO: 577679 - DNA, 20 bp, Artificial
  CRISPR gRNA sequence
aagtcttctgcctcagcctc

SEQ ID NO: 577680 - DNA, 20 bp, Artificial
  CRISPR gRNA sequence
ttttgtatttttggtagaga

SEQ ID NO: 577681 - DNA, 20 bp, Artificial
  CRISPR gRNA sequence
gcttcagcctcccaaagtgc

SEQ ID NO: 577682 - DNA, 20 bp, Artificial
  CRISPR gRNA sequence
ttctaaattccagtctgagg

SEQ ID NO: 577683 - DNA, 20 bp, Artificial
  CRISPR gRNA sequence
gtatttattagagcacaggt

SEQ ID NO: 577684 - DNA, 20 bp, Artificial
  CRISPR gRNA sequence
ctgatgctgggaccatgaac

SEQ ID NO: 577685 - DNA, 20 bp, Artificial
  CRISPR gRNA sequence
gctgggaccatgaactgggg

SEQ ID NO: 577686 - DNA, 20 bp, Artificial
  CRISPR gRNA sequence
ttgcatttgctttaacaact

SEQ ID NO: 577687 - DNA, 20 bp, Artificial
  CRISPR gRNA sequence
aactcaggatcacagtgttt

SEQ ID NO: 577688 - DNA, 20 bp, Artificial
  CRISPR gRNA sequence
atcacagtgtttggggatct

SEQ ID NO: 577689 - DNA, 20 bp, Artificial
  CRISPR gRNA sequence
gtttggggatcttagagtca

SEQ ID NO: 577690 - DNA, 20 bp, Artificial
  CRISPR gRNA sequence
tttttttttttttcttgaga

SEQ ID NO: 577691 - DNA, 20 bp, Artificial
  CRISPR gRNA sequence
tcttgatctgtcgcctaggc

SEQ ID NO: 577692 - DNA, 20 bp, Artificial
  CRISPR gRNA sequence
ttttgtacttttagtagaca

SEQ ID NO: 577693 - DNA, 20 bp, Artificial
  CRISPR gRNA sequence
gcctcggcctcccaaagtgc

SEQ ID NO: 577694 - DNA, 20 bp, Artificial
  CRISPR gRNA sequence
cgtgagccaccacgcccagc

SEQ ID NO: 577695 - DNA, 20 bp, Artificial
  CRISPR gRNA sequence
accacgcccagccggggtca

SEQ ID NO: 577696 - DNA, 20 bp, Artificial
  CRISPR gRNA sequence
gggcccctagctctcaggac

SEQ ID NO: 577697 - DNA, 20 bp, Artificial
  CRISPR gRNA sequence
cctccctgccccccagcagt

SEQ ID NO: 577698 - DNA, 20 bp, Artificial
  CRISPR gRNA sequence
gagtctgccaccaccagtcc

SEQ ID NO: 577699 - DNA, 20 bp, Artificial
  CRISPR gRNA sequence
cccaggctacggtcttccct

SEQ ID NO: 577700 - DNA, 20 bp, Artificial
  CRISPR gRNA sequence
gcctggtctggctcaatgct

SEQ ID NO: 577701 - DNA, 20 bp, Artificial
  CRISPR gRNA sequence
ggggagggcccagaccctct

SEQ ID NO: 577702 - DNA, 20 bp, Artificial
  CRISPR gRNA sequence
actcaccacttgagcctggc

SEQ ID NO: 577703 - DNA, 20 bp, Artificial
  CRISPR gRNA sequence
gagataatgttggaagtgtg

SEQ ID NO: 577704 - DNA, 20 bp, Artificial
  CRISPR gRNA sequence
tgttggaagtgtggtgagtt

SEQ ID NO: 577705 - DNA, 20 bp, Artificial
  CRISPR gRNA sequence
tgagaatgggccagggaggt

SEQ ID NO: 577706 - DNA, 20 bp, Artificial
  CRISPR gRNA sequence
gtgagagtgggcaaagcatt

SEQ ID NO: 577707 - DNA, 20 bp, Artificial
  CRISPR gRNA sequence
tgcaaggaggacaggacatg

SEQ ID NO: 577708 - DNA, 20 bp, Artificial
  CRISPR gRNA sequence
ggacatgtggggttgctgct

SEQ ID NO: 577709 - DNA, 20 bp, Artificial
  CRISPR gRNA sequence
agctagaactttgggaacag

SEQ ID NO: 577710 - DNA, 20 bp, Artificial
  CRISPR gRNA sequence
aaggctggcatgttggcatg

SEQ ID NO: 577711 - DNA, 20 bp, Artificial
  CRISPR gRNA sequence
gaggagtagcagggcaaagc

SEQ ID NO: 577712 - DNA, 20 bp, Artificial
  CRISPR gRNA sequence
agattctagagcctggctac

SEQ ID NO: 577713 - DNA, 20 bp, Artificial
  CRISPR gRNA sequence
agtctccttgtctgtaaaat

SEQ ID NO: 577714 - DNA, 20 bp, Artificial
  CRISPR gRNA sequence
ccaaggtcacacagccagtc

SEQ ID NO: 577715 - DNA, 20 bp, Artificial
  CRISPR gRNA sequence
cagccagtcagggatggagc

SEQ ID NO: 577716 - DNA, 20 bp, Artificial
  CRISPR gRNA sequence
gggatttgaacccacagtct

SEQ ID NO: 577717 - DNA, 20 bp, Artificial
  CRISPR gRNA sequence
tcttgcatcttactacttat

SEQ ID NO: 577718 - DNA, 20 bp, Artificial
  CRISPR gRNA sequence
gcagacaccatttgccagca

SEQ ID NO: 577719 - DNA, 20 bp, Artificial
  CRISPR gRNA sequence
gagctctggggcacagccga

SEQ ID NO: 577720 - DNA, 20 bp, Artificial
  CRISPR gRNA sequence
gaaagggtgctggggggaca

SEQ ID NO: 577721 - DNA, 20 bp, Artificial
  CRISPR gRNA sequence
ggacagagggtgtcagggga

SEQ ID NO: 577722 - DNA, 20 bp, Artificial
  CRISPR gRNA sequence
aggggaggggataggagggc

SEQ ID NO: 577723 - DNA, 20 bp, Artificial
  CRISPR gRNA sequence
tgtccactgacctgtccttc

SEQ ID NO: 577724 - DNA, 20 bp, Artificial
  CRISPR gRNA sequence
cctgtccttcctgggtgcac

SEQ ID NO: 577725 - DNA, 20 bp, Artificial
  CRISPR gRNA sequence
ggctggccacgttgatccct

SEQ ID NO: 577726 - DNA, 20 bp, Artificial
  CRISPR gRNA sequence
tctgcacctgacgttttttg

SEQ ID NO: 577727 - DNA, 20 bp, Artificial
  CRISPR gRNA sequence
acctgacgttttttggaggg

SEQ ID NO: 577728 - DNA, 20 bp, Artificial
  CRISPR gRNA sequence
gacctgacacctttgacccc

SEQ ID NO: 577729 - DNA, 20 bp, Artificial
  CRISPR gRNA sequence
acccccagagtactgcaatt

SEQ ID NO: 577730 - DNA, 20 bp, Artificial
  CRISPR gRNA sequence
agcctacactgctcacagcc

SEQ ID NO: 577731 - DNA, 20 bp, Artificial
  CRISPR gRNA sequence
agccaaggatctggggactt

SEQ ID NO: 577732 - DNA, 20 bp, Artificial
  CRISPR gRNA sequence
ttgggggttctgtgaagcca

SEQ ID NO: 577733 - DNA, 20 bp, Artificial
  CRISPR gRNA sequence
agaagaccccagtggcggtg

SEQ ID NO: 577734 - DNA, 20 bp, Artificial
  CRISPR gRNA sequence
gatcatggctgggctctcca

SEQ ID NO: 577735 - DNA, 20 bp, Artificial
  CRISPR gRNA sequence
agggggtgcacctgcagcac

SEQ ID NO: 577736 - DNA, 20 bp, Artificial
  CRISPR gRNA sequence
tgaaatgtggcctgtcctgg

SEQ ID NO: 577737 - DNA, 20 bp, Artificial
  CRISPR gRNA sequence
aggggcccagccgtgccccg

SEQ ID NO: 577738 - DNA, 20 bp, Artificial
  CRISPR gRNA sequence
gcagctgggcagaaaggcag

SEQ ID NO: 577739 - DNA, 20 bp, Artificial
  CRISPR gRNA sequence
gaaactgaggctcatggaga

SEQ ID NO: 577740 - DNA, 20 bp, Artificial
  CRISPR gRNA sequence
gtcctcttctcttgtcacat

SEQ ID NO: 577741 - DNA, 20 bp, Artificial
  CRISPR gRNA sequence
gcctcctcctctcctgagac

SEQ ID NO: 577742 - DNA, 20 bp, Artificial
  CRISPR gRNA sequence
atctctgaggcctggcaggt

SEQ ID NO: 577743 - DNA, 20 bp, Artificial
  CRISPR gRNA sequence
ctgcagctgcgatggtggca

SEQ ID NO: 577744 - DNA, 20 bp, Artificial
  CRISPR gRNA sequence
cccccagcaggtctgaggct

SEQ ID NO: 577745 - DNA, 20 bp, Artificial
  CRISPR gRNA sequence
tccagctgggcgaggctcct

SEQ ID NO: 577746 - DNA, 20 bp, Artificial
  CRISPR gRNA sequence
ggccgagggcttgccaggcc

SEQ ID NO: 577747 - DNA, 20 bp, Artificial
  CRISPR gRNA sequence
gccaggcctggggttgggca

SEQ ID NO: 577748 - DNA, 20 bp, Artificial
  CRISPR gRNA sequence
ctgcgtagacaataggggaa

SEQ ID NO: 577749 - DNA, 20 bp, Artificial
  CRISPR gRNA sequence
cacgctagcacagccctggt

SEQ ID NO: 577750 - DNA, 20 bp, Artificial
  CRISPR gRNA sequence
ctggtctcggactttctcct

SEQ ID NO: 577751 - DNA, 20 bp, Artificial
  CRISPR gRNA sequence
aaaagattcatctggctgct

SEQ ID NO: 577752 - DNA, 20 bp, Artificial
  CRISPR gRNA sequence
ggcaagtgatgatgctggca

SEQ ID NO: 577753 - DNA, 20 bp, Artificial
  CRISPR gRNA sequence
ggcagtggagaaggcgagaa

SEQ ID NO: 577754 - DNA, 20 bp, Artificial
  CRISPR gRNA sequence
ttctgagacttaatctgaag

SEQ ID NO: 577755 - DNA, 20 bp, Artificial
  CRISPR gRNA sequence
tcaggagcagtgctagcagc

SEQ ID NO: 577756 - DNA, 20 bp, Artificial
  CRISPR gRNA sequence
tggatgtagtgggcaagagg

SEQ ID NO: 577757 - DNA, 20 bp, Artificial
  CRISPR gRNA sequence
agagggagagtcaaagtgac

SEQ ID NO: 577758 - DNA, 20 bp, Artificial
  CRISPR gRNA sequence
ctgagatgggggacatggcg

SEQ ID NO: 577759 - DNA, 20 bp, Artificial
  CRISPR gRNA sequence
atgggggacatggcggggag

SEQ ID NO: 577760 - DNA, 20 bp, Artificial
  CRISPR gRNA sequence
ggacatggcggggagttgga

SEQ ID NO: 577761 - DNA, 20 bp, Artificial
  CRISPR gRNA sequence
tgcaggtgtagatagacatg

SEQ ID NO: 577762 - DNA, 20 bp, Artificial
  CRISPR gRNA sequence
aagagtctggcattaaatat

SEQ ID NO: 577763 - DNA, 20 bp, Artificial
  CRISPR gRNA sequence
tggaggagctgagggggcag

SEQ ID NO: 577764 - DNA, 20 bp, Artificial
  CRISPR gRNA sequence
ctgagggggcagctgaatac

SEQ ID NO: 577765 - DNA, 20 bp, Artificial
  CRISPR gRNA sequence
gggcagctgaatacgggggt

SEQ ID NO: 577766 - DNA, 20 bp, Artificial
  CRISPR gRNA sequence
ctggatctcagggcaaggag

SEQ ID NO: 577767 - DNA, 20 bp, Artificial
  CRISPR gRNA sequence
cagggcaaggaggcgagtcc

SEQ ID NO: 577768 - DNA, 20 bp, Artificial
  CRISPR gRNA sequence
gtccaggagtgtgatcatgc

SEQ ID NO: 577769 - DNA, 20 bp, Artificial
  CRISPR gRNA sequence
gtgacagagaggaggagaga

SEQ ID NO: 577770 - DNA, 20 bp, Artificial
  CRISPR gRNA sequence
cttctctacccagcccccat

SEQ ID NO: 577771 - DNA, 20 bp, Artificial
  CRISPR gRNA sequence
tgagggaagcactggctttt

SEQ ID NO: 577772 - DNA, 20 bp, Artificial
  CRISPR gRNA sequence
gccaaccccattatacagaa

SEQ ID NO: 577773 - DNA, 20 bp, Artificial
  CRISPR gRNA sequence
cagaaggggatgctcagatg

SEQ ID NO: 577774 - DNA, 20 bp, Artificial
  CRISPR gRNA sequence
ccccgttccacctcacagca

SEQ ID NO: 577775 - DNA, 20 bp, Artificial
  CRISPR gRNA sequence
agctgctgagagcagcccgg

SEQ ID NO: 577776 - DNA, 20 bp, Artificial
  CRISPR gRNA sequence
agcagcccgggggagtatag

SEQ ID NO: 577777 - DNA, 20 bp, Artificial
  CRISPR gRNA sequence
tttctttgctgtcacctcct

SEQ ID NO: 577778 - DNA, 20 bp, Artificial
  CRISPR gRNA sequence
gagctgtggtgctgagggag

SEQ ID NO: 577779 - DNA, 20 bp, Artificial
  CRISPR gRNA sequence
gtgctgagggagatgagtgt

SEQ ID NO: 577780 - DNA, 20 bp, Artificial
  CRISPR gRNA sequence
aacattactgcgtgagaaac

SEQ ID NO: 577781 - DNA, 20 bp, Artificial
  CRISPR gRNA sequence
actgcgtgagaaacaggagt

SEQ ID NO: 577782 - DNA, 20 bp, Artificial
  CRISPR gRNA sequence
agcactggtgagatgagaag

SEQ ID NO: 577783 - DNA, 20 bp, Artificial
  CRISPR gRNA sequence
ctggtgagatgagaaggtga

SEQ ID NO: 577784 - DNA, 20 bp, Artificial
  CRISPR gRNA sequence
tgagatgagaaggtgagtga

SEQ ID NO: 577785 - DNA, 20 bp, Artificial
  CRISPR gRNA sequence
tgaatgaatgaagccagaga

SEQ ID NO: 577786 - DNA, 20 bp, Artificial
  CRISPR gRNA sequence
taataccgatttcggtgcaa

SEQ ID NO: 577787 - DNA, 20 bp, Artificial
  CRISPR gRNA sequence
ctggacacttggccagagct

SEQ ID NO: 577788 - DNA, 20 bp, Artificial
  CRISPR gRNA sequence
gaattctccccaaacacatg

SEQ ID NO: 577789 - DNA, 20 bp, Artificial
  CRISPR gRNA sequence
gacatggagatgatctgtct

SEQ ID NO: 577790 - DNA, 20 bp, Artificial
  CRISPR gRNA sequence
gttgggacgtccctttctga

SEQ ID NO: 577791 - DNA, 20 bp, Artificial
  CRISPR gRNA sequence
ctgactgggtttctcagaag

SEQ ID NO: 577792 - DNA, 20 bp, Artificial
  CRISPR gRNA sequence
ggtttctcagaagctgaatg

SEQ ID NO: 577793 - DNA, 20 bp, Artificial
  CRISPR gRNA sequence
cacagattatgttttcatat

SEQ ID NO: 577794 - DNA, 20 bp, Artificial
  CRISPR gRNA sequence
cgccattgacgtcatggcgg

SEQ ID NO: 577795 - DNA, 20 bp, Artificial
  CRISPR gRNA sequence
tgcagcaggcttggcccagg

SEQ ID NO: 577796 - DNA, 20 bp, Artificial
  CRISPR gRNA sequence
cttggcccaggtggggtgac

SEQ ID NO: 577797 - DNA, 20 bp, Artificial
  CRISPR gRNA sequence
gtggggtgacatgggtgctg

SEQ ID NO: 577798 - DNA, 20 bp, Artificial
  CRISPR gRNA sequence
ctctgaagacctggcccttc

SEQ ID NO: 577799 - DNA, 20 bp, Artificial
  CRISPR gRNA sequence
ggacccaggtttgaagctct

SEQ ID NO: 577800 - DNA, 20 bp, Artificial
  CRISPR gRNA sequence
tccacagatactgggacccc

SEQ ID NO: 577801 - DNA, 20 bp, Artificial
  CRISPR gRNA sequence
atagtataacaccaggacct

SEQ ID NO: 577802 - DNA, 20 bp, Artificial
  CRISPR gRNA sequence
aacagcatttcttagattta

SEQ ID NO: 577803 - DNA, 20 bp, Artificial
  CRISPR gRNA sequence
ttcttagatttaaaggatcc

SEQ ID NO: 577804 - DNA, 20 bp, Artificial
  CRISPR gRNA sequence
aatctcaaaaccacagactg

SEQ ID NO: 577805 - DNA, 20 bp, Artificial
  CRISPR gRNA sequence
caactaggcctcctgaccta

SEQ ID NO: 577806 - DNA, 20 bp, Artificial
  CRISPR gRNA sequence
ctgggccccacactgtgatc

SEQ ID NO: 577807 - DNA, 20 bp, Artificial
  CRISPR gRNA sequence
tcgtccaacctgtgggaagt

SEQ ID NO: 577808 - DNA, 20 bp, Artificial
  CRISPR gRNA sequence
acgtgtgagaaggcagaagg

SEQ ID NO: 577809 - DNA, 20 bp, Artificial
  CRISPR gRNA sequence
ccaggttccccttccccctt

SEQ ID NO: 577810 - DNA, 20 bp, Artificial
  CRISPR gRNA sequence
cttcccccttctgggtgctg

SEQ ID NO: 577811 - DNA, 20 bp, Artificial
  CRISPR gRNA sequence
gttggggagagagccagaac

SEQ ID NO: 577812 - DNA, 20 bp, Artificial
  CRISPR gRNA sequence
gccagaaccagggtcccacc

SEQ ID NO: 577813 - DNA, 20 bp, Artificial
  CRISPR gRNA sequence
tagagtcctgagatctaggc

SEQ ID NO: 577814 - DNA, 20 bp, Artificial
  CRISPR gRNA sequence
acactgagcacggagaggcg

SEQ ID NO: 577815 - DNA, 20 bp, Artificial
  CRISPR gRNA sequence
caggggactggctgagagat

SEQ ID NO: 577816 - DNA, 20 bp, Artificial
  CRISPR gRNA sequence
tggacacatgcatggagagc

SEQ ID NO: 577817 - DNA, 20 bp, Artificial
  CRISPR gRNA sequence
agagtgcatgtgtgcgagag

SEQ ID NO: 577818 - DNA, 20 bp, Artificial
  CRISPR gRNA sequence
tgatgctgcctgaaataatc

SEQ ID NO: 577819 - DNA, 20 bp, Artificial
  CRISPR gRNA sequence
ggtgccagggacacccatgg

SEQ ID NO: 577820 - DNA, 20 bp, Artificial
  CRISPR gRNA sequence
gggacacccatggctgggta

SEQ ID NO: 577821 - DNA, 20 bp, Artificial
  CRISPR gRNA sequence
acagatactggggaagagaa

SEQ ID NO: 577822 - DNA, 20 bp, Artificial
  CRISPR gRNA sequence
ggacccacatatggagagaa

SEQ ID NO: 577823 - DNA, 20 bp, Artificial
  CRISPR gRNA sequence
tggagagaactgaatttgtg

SEQ ID NO: 577824 - DNA, 20 bp, Artificial
  CRISPR gRNA sequence
catttcaaactggaggacca

SEQ ID NO: 577825 - DNA, 20 bp, Artificial
  CRISPR gRNA sequence
ttagggagaagataaagtta

SEQ ID NO: 577826 - DNA, 20 bp, Artificial
  CRISPR gRNA sequence
ggagaagataaagttattga

SEQ ID NO: 577827 - DNA, 20 bp, Artificial
  CRISPR gRNA sequence
tttaacacctaatgctgatc

SEQ ID NO: 577828 - DNA, 20 bp, Artificial
  CRISPR gRNA sequence
taaaaatcacacatagggct

SEQ ID NO: 577829 - DNA, 20 bp, Artificial
  CRISPR gRNA sequence
acatagggcttggggtgacg

SEQ ID NO: 577830 - DNA, 20 bp, Artificial
  CRISPR gRNA sequence
aaatagaaaaaaagcaaatg

SEQ ID NO: 577831 - DNA, 20 bp, Artificial
  CRISPR gRNA sequence
aataagatgaacaccctatt

SEQ ID NO: 577832 - DNA, 20 bp, Artificial
  CRISPR gRNA sequence
aaaaaaaaaaaaaaaaaagc

SEQ ID NO: 577833 - DNA, 20 bp, Artificial
  CRISPR gRNA sequence
aaaaaaagcatgaatggcca

SEQ ID NO: 577834 - DNA, 20 bp, Artificial
  CRISPR gRNA sequence
aaaacataataatactcacc

SEQ ID NO: 577835 - DNA, 20 bp, Artificial
  CRISPR gRNA sequence
ataggacaaccttttggaag

SEQ ID NO: 577836 - DNA, 20 bp, Artificial
  CRISPR gRNA sequence
ttggaaggagaattagcaga

SEQ ID NO: 577837 - DNA, 20 bp, Artificial
  CRISPR gRNA sequence
gccccagcaactcccttttc

SEQ ID NO: 577838 - DNA, 20 bp, Artificial
  CRISPR gRNA sequence
aggaatccaaggaagcagtc

SEQ ID NO: 577839 - DNA, 20 bp, Artificial
  CRISPR gRNA sequence
agaaaaaaacgagaaacaac

SEQ ID NO: 577840 - DNA, 20 bp, Artificial
  CRISPR gRNA sequence
ttcaaaaacactactgttaa

SEQ ID NO: 577841 - DNA, 20 bp, Artificial
  CRISPR gRNA sequence
caaacgctgtgctaagcctg

SEQ ID NO: 577842 - DNA, 20 bp, Artificial
  CRISPR gRNA sequence
ctgaacaacctgtttgcttc

SEQ ID NO: 577843 - DNA, 20 bp, Artificial
  CRISPR gRNA sequence
tggtcacacacatgcagtcc

SEQ ID NO: 577844 - DNA, 20 bp, Artificial
  CRISPR gRNA sequence
gctccctgcccccccgcccc

SEQ ID NO: 577845 - DNA, 20 bp, Artificial
  CRISPR gRNA sequence
ccttgcaatcctcctgctac

SEQ ID NO: 577846 - DNA, 20 bp, Artificial
  CRISPR gRNA sequence
gctgtgtacaaagctctagg

SEQ ID NO: 577847 - DNA, 20 bp, Artificial
  CRISPR gRNA sequence
gatggaggaaaggagatcga

SEQ ID NO: 577848 - DNA, 20 bp, Artificial
  CRISPR gRNA sequence
ccaggagagatgcggggaaa

SEQ ID NO: 577849 - DNA, 20 bp, Artificial
  CRISPR gRNA sequence
gagatgcggggaaagagagt

SEQ ID NO: 577850 - DNA, 20 bp, Artificial
  CRISPR gRNA sequence
aaacatgtaaaagagcaaga

SEQ ID NO: 577851 - DNA, 20 bp, Artificial
  CRISPR gRNA sequence
gggtgagcagagagacagag

SEQ ID NO: 577852 - DNA, 20 bp, Artificial
  CRISPR gRNA sequence
atccatctacgtatcaattg

SEQ ID NO: 577853 - DNA, 20 bp, Artificial
  CRISPR gRNA sequence
ttttaaagaccttacctggc

SEQ ID NO: 577854 - DNA, 20 bp, Artificial
  CRISPR gRNA sequence
cctggctggaatcacggtag

SEQ ID NO: 577855 - DNA, 20 bp, Artificial
  CRISPR gRNA sequence
ggtgaagtggactgacagaa

SEQ ID NO: 577856 - DNA, 20 bp, Artificial
  CRISPR gRNA sequence
aataatccaaatttttttcg

SEQ ID NO: 577857 - DNA, 20 bp, Artificial
  CRISPR gRNA sequence
agtgtgtgcgctgataatca

SEQ ID NO: 577858 - DNA, 20 bp, Artificial
  CRISPR gRNA sequence
ctgataatcacggggtgggg

SEQ ID NO: 577859 - DNA, 20 bp, Artificial
  CRISPR gRNA sequence
taaacggaaattttgaaatt

SEQ ID NO: 577860 - DNA, 20 bp, Artificial
  CRISPR gRNA sequence
ggtttttttctttgcccttt

SEQ ID NO: 577861 - DNA, 20 bp, Artificial
  CRISPR gRNA sequence
gtttttaaaacaaaagtgta

SEQ ID NO: 577862 - DNA, 20 bp, Artificial
  CRISPR gRNA sequence
gcaggcagagacaccattct

SEQ ID NO: 577863 - DNA, 20 bp, Artificial
  CRISPR gRNA sequence
agacaccattctgtgagtga

SEQ ID NO: 577864 - DNA, 20 bp, Artificial
  CRISPR gRNA sequence
ctgtgagtgagaggatattt

SEQ ID NO: 577865 - DNA, 20 bp, Artificial
  CRISPR gRNA sequence
agggtctctggggaaagaaa

SEQ ID NO: 577866 - DNA, 20 bp, Artificial
  CRISPR gRNA sequence
gagaatctgaagctctatgt

SEQ ID NO: 577867 - DNA, 20 bp, Artificial
  CRISPR gRNA sequence
ggaaatgccagggaaagaga

SEQ ID NO: 577868 - DNA, 20 bp, Artificial
  CRISPR gRNA sequence
gggaaagagacagaataggg

SEQ ID NO: 577869 - DNA, 20 bp, Artificial
  CRISPR gRNA sequence
ggcctcagtttccctataga

SEQ ID NO: 577870 - DNA, 20 bp, Artificial
  CRISPR gRNA sequence
tgcttgaactacccggcgag

SEQ ID NO: 577871 - DNA, 20 bp, Artificial
  CRISPR gRNA sequence
cctgcaacacccctcccaca

SEQ ID NO: 577872 - DNA, 20 bp, Artificial
  CRISPR gRNA sequence
ccctaaaattcatggacttg

SEQ ID NO: 577873 - DNA, 20 bp, Artificial
  CRISPR gRNA sequence
ttcatggacttgaagagtcg

SEQ ID NO: 577874 - DNA, 20 bp, Artificial
  CRISPR gRNA sequence
gtcggagaatccctggctcc

SEQ ID NO: 577875 - DNA, 20 bp, Artificial
  CRISPR gRNA sequence
ccagaatctactgacagtta

SEQ ID NO: 577876 - DNA, 20 bp, Artificial
  CRISPR gRNA sequence
gcctcatcacgttttagggc

SEQ ID NO: 577877 - DNA, 20 bp, Artificial
  CRISPR gRNA sequence
cttctgaggccctcagcctt

SEQ ID NO: 577878 - DNA, 20 bp, Artificial
  CRISPR gRNA sequence
ttcaaaaagccccagtttcc

SEQ ID NO: 577879 - DNA, 20 bp, Artificial
  CRISPR gRNA sequence
agccccagtttccaaggatt

SEQ ID NO: 577880 - DNA, 20 bp, Artificial
  CRISPR gRNA sequence
ctcagtagctgatgtttatc

SEQ ID NO: 577881 - DNA, 20 bp, Artificial
  CRISPR gRNA sequence
atgtttatcttgaattttcc

SEQ ID NO: 577882 - DNA, 20 bp, Artificial
  CRISPR gRNA sequence
tgcccaagatcacagagctg

SEQ ID NO: 577883 - DNA, 20 bp, Artificial
  CRISPR gRNA sequence
agatcacagagctggcgagt

SEQ ID NO: 577884 - DNA, 20 bp, Artificial
  CRISPR gRNA sequence
tgttctcaggttttaaattc

SEQ ID NO: 577885 - DNA, 20 bp, Artificial
  CRISPR gRNA sequence
atgtgatggcagggagatcc

SEQ ID NO: 577886 - DNA, 20 bp, Artificial
  CRISPR gRNA sequence
cagggagatcctgggatttg

SEQ ID NO: 577887 - DNA, 20 bp, Artificial
  CRISPR gRNA sequence
gtgaggcttttaggttgtcc

SEQ ID NO: 577888 - DNA, 20 bp, Artificial
  CRISPR gRNA sequence
tcccagcaccctgcaaagcc

SEQ ID NO: 577889 - DNA, 20 bp, Artificial
  CRISPR gRNA sequence
ctcacccttctggaaaagcc

SEQ ID NO: 577890 - DNA, 20 bp, Artificial
  CRISPR gRNA sequence
agacaagaaaaaaaaaaaaa

SEQ ID NO: 577891 - DNA, 20 bp, Artificial
  CRISPR gRNA sequence
actttcgctggttgaggctt

SEQ ID NO: 577892 - DNA, 20 bp, Artificial
  CRISPR gRNA sequence
atctgagacccaaaaatggc

SEQ ID NO: 577893 - DNA, 20 bp, Artificial
  CRISPR gRNA sequence
agccaggggaggcaccaagg

SEQ ID NO: 577894 - DNA, 20 bp, Artificial
  CRISPR gRNA sequence
atgtgggagggagcaaggga

SEQ ID NO: 577895 - DNA, 20 bp, Artificial
  CRISPR gRNA sequence
gaggagcatgcatgtcagga

SEQ ID NO: 577896 - DNA, 20 bp, Artificial
  CRISPR gRNA sequence
accccttgctccctgcagac

SEQ ID NO: 577897 - DNA, 20 bp, Artificial
  CRISPR gRNA sequence
tgctccctgcagacttgggt

SEQ ID NO: 577898 - DNA, 20 bp, Artificial
  CRISPR gRNA sequence
agggggctagttttctctct

SEQ ID NO: 577899 - DNA, 20 bp, Artificial
  CRISPR gRNA sequence
ctgtcactcactccatgaaa

SEQ ID NO: 577900 - DNA, 20 bp, Artificial
  CRISPR gRNA sequence
atataggaggcaaacgaagt

SEQ ID NO: 577901 - DNA, 20 bp, Artificial
  CRISPR gRNA sequence
acgaagtgaggatggtggcc

SEQ ID NO: 577902 - DNA, 20 bp, Artificial
  CRISPR gRNA sequence
gctggccccttgggcaggcc

SEQ ID NO: 577903 - DNA, 20 bp, Artificial
  CRISPR gRNA sequence
gctgaaagccaagatccttg

SEQ ID NO: 577904 - DNA, 20 bp, Artificial
  CRISPR gRNA sequence
gatccttgcagaatgggggc

SEQ ID NO: 577905 - DNA, 20 bp, Artificial
  CRISPR gRNA sequence
ctggggtcaggagggcagag

SEQ ID NO: 577906 - DNA, 20 bp, Artificial
  CRISPR gRNA sequence
ggaaggagactgggagggct

SEQ ID NO: 577907 - DNA, 20 bp, Artificial
  CRISPR gRNA sequence
gactgggagggctgggagtt

SEQ ID NO: 577908 - DNA, 20 bp, Artificial
  CRISPR gRNA sequence
gggagggctgggagttgggg

SEQ ID NO: 577909 - DNA, 20 bp, Artificial
  CRISPR gRNA sequence
gggtgagtaggcaagattaa

SEQ ID NO: 577910 - DNA, 20 bp, Artificial
  CRISPR gRNA sequence
cagggcaaaggtcctgaggt

SEQ ID NO: 577911 - DNA, 20 bp, Artificial
  CRISPR gRNA sequence
taaggactttggcttcaacg

SEQ ID NO: 577912 - DNA, 20 bp, Artificial
  CRISPR gRNA sequence
gagtgaggaggaaggcatga

SEQ ID NO: 577913 - DNA, 20 bp, Artificial
  CRISPR gRNA sequence
aggagaaacacaaaccgtgt

SEQ ID NO: 577914 - DNA, 20 bp, Artificial
  CRISPR gRNA sequence
taggatttaacaggaagccc

SEQ ID NO: 577915 - DNA, 20 bp, Artificial
  CRISPR gRNA sequence
taacaggaagcccctgaatg

SEQ ID NO: 577916 - DNA, 20 bp, Artificial
  CRISPR gRNA sequence
cctgaatgctgagtgtacaa

SEQ ID NO: 577917 - DNA, 20 bp, Artificial
  CRISPR gRNA sequence
tgtacaatggggtctagggc

SEQ ID NO: 577918 - DNA, 20 bp, Artificial
  CRISPR gRNA sequence
ggcagtggaggtggtgagaa

SEQ ID NO: 577919 - DNA, 20 bp, Artificial
  CRISPR gRNA sequence
gtggaggtggtgagaagagg

SEQ ID NO: 577920 - DNA, 20 bp, Artificial
  CRISPR gRNA sequence
tatttttaatagacagccaa

SEQ ID NO: 577921 - DNA, 20 bp, Artificial
  CRISPR gRNA sequence
aaaaggatttgttgaagact

SEQ ID NO: 577922 - DNA, 20 bp, Artificial
  CRISPR gRNA sequence
cccaaaccaggtgggcagga

SEQ ID NO: 577923 - DNA, 20 bp, Artificial
  CRISPR gRNA sequence
ctggggagaggggctgctgg

SEQ ID NO: 577924 - DNA, 20 bp, Artificial
  CRISPR gRNA sequence
tggaaggatcacctccctcc

SEQ ID NO: 577925 - DNA, 20 bp, Artificial
  CRISPR gRNA sequence
aggtgttcagtaaatcttcc

SEQ ID NO: 577926 - DNA, 20 bp, Artificial
  CRISPR gRNA sequence
aaatcttcccaggatggaga

SEQ ID NO: 577927 - DNA, 20 bp, Artificial
  CRISPR gRNA sequence
ccaggatggagaaggaatgt

SEQ ID NO: 577928 - DNA, 20 bp, Artificial
  CRISPR gRNA sequence
gatggagaaggaatgtatga

SEQ ID NO: 577929 - DNA, 20 bp, Artificial
  CRISPR gRNA sequence
tcagcggacaaaagctgcag

SEQ ID NO: 577930 - DNA, 20 bp, Artificial
  CRISPR gRNA sequence
gaccccaaagggagagcgaa

SEQ ID NO: 577931 - DNA, 20 bp, Artificial
  CRISPR gRNA sequence
gaagggaggtgaggcccctg

SEQ ID NO: 577932 - DNA, 20 bp, Artificial
  CRISPR gRNA sequence
ggtgaggcccctgtggggtg

SEQ ID NO: 577933 - DNA, 20 bp, Artificial
  CRISPR gRNA sequence
ctgagctgaaatttaaaaaa

SEQ ID NO: 577934 - DNA, 20 bp, Artificial
  CRISPR gRNA sequence
aacaatagtatcaagtcctg

SEQ ID NO: 577935 - DNA, 20 bp, Artificial
  CRISPR gRNA sequence
ggtctaggccttcaggggct

SEQ ID NO: 577936 - DNA, 20 bp, Artificial
  CRISPR gRNA sequence
tgggtattcctggggcaatg

SEQ ID NO: 577937 - DNA, 20 bp, Artificial
  CRISPR gRNA sequence
tggggcaatggggagtcacg

SEQ ID NO: 577938 - DNA, 20 bp, Artificial
  CRISPR gRNA sequence
gagtcacggagggttaggga

SEQ ID NO: 577939 - DNA, 20 bp, Artificial
  CRISPR gRNA sequence
tccaccgcctacgcaacccg

SEQ ID NO: 577940 - DNA, 20 bp, Artificial
  CRISPR gRNA sequence
ctgcttctgttttcttcatc

SEQ ID NO: 577941 - DNA, 20 bp, Artificial
  CRISPR gRNA sequence
caatgggaaggccagcgcgg

SEQ ID NO: 577942 - DNA, 20 bp, Artificial
  CRISPR gRNA sequence
gggccaatgggcagccatgc

SEQ ID NO: 577943 - DNA, 20 bp, Artificial
  CRISPR gRNA sequence
ccatgcacggatgacgtaca

SEQ ID NO: 577944 - DNA, 20 bp, Artificial
  CRISPR gRNA sequence
cggagaagcacgcagccaat

SEQ ID NO: 577945 - DNA, 20 bp, Artificial
  CRISPR gRNA sequence
cgcagccaatggggatgccc

SEQ ID NO: 577946 - DNA, 20 bp, Artificial
  CRISPR gRNA sequence
ggagtgggcggtgtaggggg

SEQ ID NO: 577947 - DNA, 20 bp, Artificial
  CRISPR gRNA sequence
tgtagggggcgggatgatcg

SEQ ID NO: 577948 - DNA, 20 bp, Artificial
  CRISPR gRNA sequence
cgaggaatcaatggagaggc

SEQ ID NO: 577949 - DNA, 20 bp, Artificial
  CRISPR gRNA sequence
atcaatggagaggccggaat

SEQ ID NO: 577950 - DNA, 20 bp, Artificial
  CRISPR gRNA sequence
catgtgggcggtgggaaaag

SEQ ID NO: 577951 - DNA, 20 bp, Artificial
  CRISPR gRNA sequence
cccaaaaagtgggagatccc

SEQ ID NO: 577952 - DNA, 20 bp, Artificial
  CRISPR gRNA sequence
agccaatggagagccacgcg

SEQ ID NO: 577953 - DNA, 20 bp, Artificial
  CRISPR gRNA sequence
agcgtgcactgcggcttcga

SEQ ID NO: 577954 - DNA, 20 bp, Artificial
  CRISPR gRNA sequence
ggctaaaaggagaccaagag

SEQ ID NO: 577955 - DNA, 20 bp, Artificial
  CRISPR gRNA sequence
gggagcgaggacgagagctg

SEQ ID NO: 577956 - DNA, 20 bp, Artificial
  CRISPR gRNA sequence
cggatagccaatgagggagc

SEQ ID NO: 577957 - DNA, 20 bp, Artificial
  CRISPR gRNA sequence
ctcaaaggacagtactagta

SEQ ID NO: 577958 - DNA, 20 bp, Artificial
  CRISPR gRNA sequence
taggtggtgtgaagggaggc

SEQ ID NO: 577959 - DNA, 20 bp, Artificial
  CRISPR gRNA sequence
agaggaggacgctgtgtaga

SEQ ID NO: 577960 - DNA, 20 bp, Artificial
  CRISPR gRNA sequence
tgtagacagagtctgaggta

SEQ ID NO: 577961 - DNA, 20 bp, Artificial
  CRISPR gRNA sequence
ttaggaaaaatgtgcttctc

SEQ ID NO: 577962 - DNA, 20 bp, Artificial
  CRISPR gRNA sequence
aaaaatgtgcttctcaggga

SEQ ID NO: 577963 - DNA, 20 bp, Artificial
  CRISPR gRNA sequence
ccgtgactccccattgcccc

SEQ ID NO: 577964 - DNA, 20 bp, Artificial
  CRISPR gRNA sequence
ctgttgcagttagttactta

SEQ ID NO: 577965 - DNA, 20 bp, Artificial
  CRISPR gRNA sequence
cttgagcagtgccacaagcc

SEQ ID NO: 577966 - DNA, 20 bp, Artificial
  CRISPR gRNA sequence
tccaggacttgatactattg

SEQ ID NO: 577967 - DNA, 20 bp, Artificial
  CRISPR gRNA sequence
ggacttgatactattgttga

SEQ ID NO: 577968 - DNA, 20 bp, Artificial
  CRISPR gRNA sequence
tactattgttgaatgaatgg

SEQ ID NO: 577969 - DNA, 20 bp, Artificial
  CRISPR gRNA sequence
ataggaaatttaactttctg

SEQ ID NO: 577970 - DNA, 20 bp, Artificial
  CRISPR gRNA sequence
accagaagttgattgggcat

SEQ ID NO: 577971 - DNA, 20 bp, Artificial
  CRISPR gRNA sequence
tatgggtagcttctgactaa

SEQ ID NO: 577972 - DNA, 20 bp, Artificial
  CRISPR gRNA sequence
cttctactgttccctctccc

SEQ ID NO: 577973 - DNA, 20 bp, Artificial
  CRISPR gRNA sequence
aactcctttcgctctccctt

SEQ ID NO: 577974 - DNA, 20 bp, Artificial
  CRISPR gRNA sequence
gaagatttactgaacaccta

SEQ ID NO: 577975 - DNA, 20 bp, Artificial
  CRISPR gRNA sequence
tctccccaggtctccatgtt

SEQ ID NO: 577976 - DNA, 20 bp, Artificial
  CRISPR gRNA sequence
tctccatgttcaggatgtcc

SEQ ID NO: 577977 - DNA, 20 bp, Artificial
  CRISPR gRNA sequence
aggatgtccatgagttagaa

SEQ ID NO: 577978 - DNA, 20 bp, Artificial
  CRISPR gRNA sequence
ggtcctgcgtggtctaacct

SEQ ID NO: 577979 - DNA, 20 bp, Artificial
  CRISPR gRNA sequence
tttgccctggctgtttcctt

SEQ ID NO: 577980 - DNA, 20 bp, Artificial
  CRISPR gRNA sequence
ccgagaagccctccatgaga

SEQ ID NO: 577981 - DNA, 20 bp, Artificial
  CRISPR gRNA sequence
gaccccagcccccattctgc

SEQ ID NO: 577982 - DNA, 20 bp, Artificial
  CRISPR gRNA sequence
tctctggccactctctttca

SEQ ID NO: 577983 - DNA, 20 bp, Artificial
  CRISPR gRNA sequence
tggccactctctttcatgga

SEQ ID NO: 577984 - DNA, 20 bp, Artificial
  CRISPR gRNA sequence
tggtctggggaaggtataag

SEQ ID NO: 577985 - DNA, 20 bp, Artificial
  CRISPR gRNA sequence
acccaagtctgcagggagca

SEQ ID NO: 577986 - DNA, 20 bp, Artificial
  CRISPR gRNA sequence
actatgggaacatcagtgca

SEQ ID NO: 577987 - DNA, 20 bp, Artificial
  CRISPR gRNA sequence
accttaggaccatcactgca

SEQ ID NO: 577988 - DNA, 20 bp, Artificial
  CRISPR gRNA sequence
attaaccttggggccatcac

SEQ ID NO: 577989 - DNA, 20 bp, Artificial
  CRISPR gRNA sequence
tgttaaacacctgctgttca

SEQ ID NO: 577990 - DNA, 20 bp, Artificial
  CRISPR gRNA sequence
ccaacacacccaagccattt

SEQ ID NO: 577991 - DNA, 20 bp, Artificial
  CRISPR gRNA sequence
tgttttgaactaatggtggg

SEQ ID NO: 577992 - DNA, 20 bp, Artificial
  CRISPR gRNA sequence
tgaactaatggtggggaggg

SEQ ID NO: 577993 - DNA, 20 bp, Artificial
  CRISPR gRNA sequence
cccattctgggcttttccag

SEQ ID NO: 577994 - DNA, 20 bp, Artificial
  CRISPR gRNA sequence
ttctgggcttttccagaagg

SEQ ID NO: 577995 - DNA, 20 bp, Artificial
  CRISPR gRNA sequence
gcttttccagaagggtgagt

SEQ ID NO: 577996 - DNA, 20 bp, Artificial
  CRISPR gRNA sequence
tgggggaggaaagggggcaa

SEQ ID NO: 577997 - DNA, 20 bp, Artificial
  CRISPR gRNA sequence
gaaagggggcaaaggggtga

SEQ ID NO: 577998 - DNA, 20 bp, Artificial
  CRISPR gRNA sequence
gggggcaaaggggtgaaggg

SEQ ID NO: 577999 - DNA, 20 bp, Artificial
  CRISPR gRNA sequence
aagccagtcttgtagagggc

SEQ ID NO: 578000 - DNA, 20 bp, Artificial
  CRISPR gRNA sequence
gactagaaccctgggctttg

SEQ ID NO: 578001 - DNA, 20 bp, Artificial
  CRISPR gRNA sequence
tctaccatgctgaccagtgg

SEQ ID NO: 578002 - DNA, 20 bp, Artificial
  CRISPR gRNA sequence
catgctgaccagtggttgaa

SEQ ID NO: 578003 - DNA, 20 bp, Artificial
  CRISPR gRNA sequence
tccaaggactctccaaatcc

SEQ ID NO: 578004 - DNA, 20 bp, Artificial
  CRISPR gRNA sequence
atctccctgccatcacatcc

SEQ ID NO: 578005 - DNA, 20 bp, Artificial
  CRISPR gRNA sequence
catcaagttcaggaaagctt

SEQ ID NO: 578006 - DNA, 20 bp, Artificial
  CRISPR gRNA sequence
gtttccctcatctgtataac

SEQ ID NO: 578007 - DNA, 20 bp, Artificial
  CRISPR gRNA sequence
ggagctcaaggggccatggt

SEQ ID NO: 578008 - DNA, 20 bp, Artificial
  CRISPR gRNA sequence
catcagctactgagatgatg

SEQ ID NO: 578009 - DNA, 20 bp, Artificial
  CRISPR gRNA sequence
ctgagatgatggcggatatt

SEQ ID NO: 578010 - DNA, 20 bp, Artificial
  CRISPR gRNA sequence
ccatgatgttcctgaaacaa

SEQ ID NO: 578011 - DNA, 20 bp, Artificial
  CRISPR gRNA sequence
tgttcctgaaacaagagggt

SEQ ID NO: 578012 - DNA, 20 bp, Artificial
  CRISPR gRNA sequence
tcagggtcccaatgggcctc

SEQ ID NO: 578013 - DNA, 20 bp, Artificial
  CRISPR gRNA sequence
gggcctctggggttcatcgt

SEQ ID NO: 578014 - DNA, 20 bp, Artificial
  CRISPR gRNA sequence
ctctggggttcatcgtgagg

SEQ ID NO: 578015 - DNA, 20 bp, Artificial
  CRISPR gRNA sequence
ccttcccagtgggacagtgg

SEQ ID NO: 578016 - DNA, 20 bp, Artificial
  CRISPR gRNA sequence
gtcagtagattctgggagcc

SEQ ID NO: 578017 - DNA, 20 bp, Artificial
  CRISPR gRNA sequence
ttctccgactcttcaagtcc

SEQ ID NO: 578018 - DNA, 20 bp, Artificial
  CRISPR gRNA sequence
cttcaagtccatgaatttta

SEQ ID NO: 578019 - DNA, 20 bp, Artificial
  CRISPR gRNA sequence
tgcccctcaccctctgtggg

SEQ ID NO: 578020 - DNA, 20 bp, Artificial
  CRISPR gRNA sequence
tctgtgggaggggtgttgca

SEQ ID NO: 578021 - DNA, 20 bp, Artificial
  CRISPR gRNA sequence
ggggtgcagaactcccctcg

SEQ ID NO: 578022 - DNA, 20 bp, Artificial
  CRISPR gRNA sequence
tctatagggaaactgaggcc

SEQ ID NO: 578023 - DNA, 20 bp, Artificial
  CRISPR gRNA sequence
ctcaaatatcctctcactca

SEQ ID NO: 578024 - DNA, 20 bp, Artificial
  CRISPR gRNA sequence
gaatggtgtctctgcctgcc

SEQ ID NO: 578025 - DNA, 20 bp, Artificial
  CRISPR gRNA sequence
acacactcatcgaaaaaaat

SEQ ID NO: 578026 - DNA, 20 bp, Artificial
  CRISPR gRNA sequence
tgtcagtccacttcaccaag

SEQ ID NO: 578027 - DNA, 20 bp, Artificial
  CRISPR gRNA sequence
cagggaggtaggcacggcgg

SEQ ID NO: 578028 - DNA, 20 bp, Artificial
  CRISPR gRNA sequence
tcaggggccctctggtacag

SEQ ID NO: 578029 - DNA, 20 bp, Artificial
  CRISPR gRNA sequence
taaggtctttaaaaaaataa

SEQ ID NO: 578030 - DNA, 20 bp, Artificial
  CRISPR gRNA sequence
atgggcaggggcaaaaataa

SEQ ID NO: 578031 - DNA, 20 bp, Artificial
  CRISPR gRNA sequence
attcatcaattgatacgtag

SEQ ID NO: 578032 - DNA, 20 bp, Artificial
  CRISPR gRNA sequence
tcaattgatacgtagatgga

SEQ ID NO: 578033 - DNA, 20 bp, Artificial
  CRISPR gRNA sequence
tatgtcagctgccagtcttt

SEQ ID NO: 578034 - DNA, 20 bp, Artificial
  CRISPR gRNA sequence
cgaggacctttacattttat

SEQ ID NO: 578035 - DNA, 20 bp, Artificial
  CRISPR gRNA sequence
tctgttcaccctagtagcag

SEQ ID NO: 578036 - DNA, 20 bp, Artificial
  CRISPR gRNA sequence
caggactgcatgtgtgtgac

SEQ ID NO: 578037 - DNA, 20 bp, Artificial
  CRISPR gRNA sequence
gcaaacaggttgttcagggc

SEQ ID NO: 578038 - DNA, 20 bp, Artificial
  CRISPR gRNA sequence
tagtatttctgtaaccaaat

SEQ ID NO: 578039 - DNA, 20 bp, Artificial
  CRISPR gRNA sequence
aaacatccctgactgcttcc

SEQ ID NO: 578040 - DNA, 20 bp, Artificial
  CRISPR gRNA sequence
cttccttggattcctgaaaa

SEQ ID NO: 578041 - DNA, 20 bp, Artificial
  CRISPR gRNA sequence
tctacttaagctaaccctag

SEQ ID NO: 578042 - DNA, 20 bp, Artificial
  CRISPR gRNA sequence
ggtcatgtccttactcctaa

SEQ ID NO: 578043 - DNA, 20 bp, Artificial
  CRISPR gRNA sequence
atttgccacagctctttatt

SEQ ID NO: 578044 - DNA, 20 bp, Artificial
  CRISPR gRNA sequence
ttccatttactatagaggtt

SEQ ID NO: 578045 - DNA, 20 bp, Artificial
  CRISPR gRNA sequence
ttactatagaggttaagagt

SEQ ID NO: 578046 - DNA, 20 bp, Artificial
  CRISPR gRNA sequence
gttataatagtaccttcctc

SEQ ID NO: 578047 - DNA, 20 bp, Artificial
  CRISPR gRNA sequence
taggtgttaaaacttatatc

SEQ ID NO: 578048 - DNA, 20 bp, Artificial
  CRISPR gRNA sequence
tgttaaaacttatatcttga

SEQ ID NO: 578049 - DNA, 20 bp, Artificial
  CRISPR gRNA sequence
ttgaatggatctgggcattt

SEQ ID NO: 578050 - DNA, 20 bp, Artificial
  CRISPR gRNA sequence
acatttcaaactgggcaggg

SEQ ID NO: 578051 - DNA, 20 bp, Artificial
  CRISPR gRNA sequence
actgggcagggaggggttgt

SEQ ID NO: 578052 - DNA, 20 bp, Artificial
  CRISPR gRNA sequence
aaattcagttctctccatat

SEQ ID NO: 578053 - DNA, 20 bp, Artificial
  CRISPR gRNA sequence
atacaattcaatacccagcc

SEQ ID NO: 578054 - DNA, 20 bp, Artificial
  CRISPR gRNA sequence
cctatctctcagccagtccc

SEQ ID NO: 578055 - DNA, 20 bp, Artificial
  CRISPR gRNA sequence
gcctcaccgaaatgcagcgg

SEQ ID NO: 578056 - DNA, 20 bp, Artificial
  CRISPR gRNA sequence
ttgattgtggggcccctcta

SEQ ID NO: 578057 - DNA, 20 bp, Artificial
  CRISPR gRNA sequence
ccccctgttgccatctctgg

SEQ ID NO: 578058 - DNA, 20 bp, Artificial
  CRISPR gRNA sequence
tgtatttgggaacgttgttc

SEQ ID NO: 578059 - DNA, 20 bp, Artificial
  CRISPR gRNA sequence
ctgactttcagatggttcca

SEQ ID NO: 578060 - DNA, 20 bp, Artificial
  CRISPR gRNA sequence
agtctgtggttttgagattc

SEQ ID NO: 578061 - DNA, 20 bp, Artificial
  CRISPR gRNA sequence
ttatactatttgaagacccc

SEQ ID NO: 578062 - DNA, 20 bp, Artificial
  CRISPR gRNA sequence
gcactctcagagcttcaaac

SEQ ID NO: 578063 - DNA, 20 bp, Artificial
  CRISPR gRNA sequence
agttctcggaacgaaacctg

SEQ ID NO: 578064 - DNA, 20 bp, Artificial
  CRISPR gRNA sequence
tcggaacgaaacctgtgggg

SEQ ID NO: 578065 - DNA, 20 bp, Artificial
  CRISPR gRNA sequence
tcatctccatgtccctgtct

SEQ ID NO: 578066 - DNA, 20 bp, Artificial
  CRISPR gRNA sequence
gagaatgtatctatgctttg

SEQ ID NO: 578067 - DNA, 20 bp, Artificial
  CRISPR gRNA sequence
ccatcccacatgtgtttggg

SEQ ID NO: 578068 - DNA, 20 bp, Artificial
  CRISPR gRNA sequence
gccagccacatgggccaggc

SEQ ID NO: 578069 - DNA, 20 bp, Artificial
  CRISPR gRNA sequence
gctataacaaagtaccacaa

SEQ ID NO: 578070 - DNA, 20 bp, Artificial
  CRISPR gRNA sequence
catctcacagttctggaggc

SEQ ID NO: 578071 - DNA, 20 bp, Artificial
  CRISPR gRNA sequence
gtccaagatcaaggtgttgc

SEQ ID NO: 578072 - DNA, 20 bp, Artificial
  CRISPR gRNA sequence
ggagactaagaacttaatac

SEQ ID NO: 578073 - DNA, 20 bp, Artificial
  CRISPR gRNA sequence
acacacacacacacacacca

SEQ ID NO: 578074 - DNA, 20 bp, Artificial
  CRISPR gRNA sequence
acacttcctaaagaaagaag

SEQ ID NO: 578075 - DNA, 20 bp, Artificial
  CRISPR gRNA sequence
gagcatccccttctgtataa

SEQ ID NO: 578076 - DNA, 20 bp, Artificial
  CRISPR gRNA sequence
gctctggcttcctctcagac

SEQ ID NO: 578077 - DNA, 20 bp, Artificial
  CRISPR gRNA sequence
ttcctctcagaccaggatta

SEQ ID NO: 578078 - DNA, 20 bp, Artificial
  CRISPR gRNA sequence
aaaagccagtgcttccctca

SEQ ID NO: 578079 - DNA, 20 bp, Artificial
  CRISPR gRNA sequence
ttggacagggaaagaggaga

SEQ ID NO: 578080 - DNA, 20 bp, Artificial
  CRISPR gRNA sequence
aggagtgggcatttgaggca

SEQ ID NO: 578081 - DNA, 20 bp, Artificial
  CRISPR gRNA sequence
caggcttgagggccagaaat

SEQ ID NO: 578082 - DNA, 20 bp, Artificial
  CRISPR gRNA sequence
ggggtgaactctgatggggg

SEQ ID NO: 578083 - DNA, 20 bp, Artificial
  CRISPR gRNA sequence
cctctctgtcacttgccatg

SEQ ID NO: 578084 - DNA, 20 bp, Artificial
  CRISPR gRNA sequence
tccagcttcagattaagtct

SEQ ID NO: 578085 - DNA, 20 bp, Artificial
  CRISPR gRNA sequence
gccccactcacagcagccag

SEQ ID NO: 578086 - DNA, 20 bp, Artificial
  CRISPR gRNA sequence
acagcagccagatgaatctt

SEQ ID NO: 578087 - DNA, 20 bp, Artificial
  CRISPR gRNA sequence
atgagcaaacacagcctgtg

SEQ ID NO: 578088 - DNA, 20 bp, Artificial
  CRISPR gRNA sequence
cctctgcacgtggggcatgt

SEQ ID NO: 578089 - DNA, 20 bp, Artificial
  CRISPR gRNA sequence
tgtgtgtgtgtgtctagagc

SEQ ID NO: 578090 - DNA, 20 bp, Artificial
  CRISPR gRNA sequence
ccaatgcctgctttgaccag

SEQ ID NO: 578091 - DNA, 20 bp, Artificial
  CRISPR gRNA sequence
tgtccacgtggctcaggtgg

SEQ ID NO: 578092 - DNA, 20 bp, Artificial
  CRISPR gRNA sequence
tgcaggtgaggccctgggcc

SEQ ID NO: 578093 - DNA, 20 bp, Artificial
  CRISPR gRNA sequence
tgggcccaggatggggcagg

SEQ ID NO: 578094 - DNA, 20 bp, Artificial
  CRISPR gRNA sequence
ccaggatggggcaggcaggg

SEQ ID NO: 578095 - DNA, 20 bp, Artificial
  CRISPR gRNA sequence
tggggcacaggaagtggttt

SEQ ID NO: 578096 - DNA, 20 bp, Artificial
  CRISPR gRNA sequence
agtttccatacgtgtaaaag

SEQ ID NO: 578097 - DNA, 20 bp, Artificial
  CRISPR gRNA sequence
taccatgtgggcttgcagtg

SEQ ID NO: 578098 - DNA, 20 bp, Artificial
  CRISPR gRNA sequence
gggcttgcagtgcagagtat

SEQ ID NO: 578099 - DNA, 20 bp, Artificial
  CRISPR gRNA sequence
tgaattagacacagaacagt

SEQ ID NO: 578100 - DNA, 20 bp, Artificial
  CRISPR gRNA sequence
agacacagaacagtgaggat

SEQ ID NO: 578101 - DNA, 20 bp, Artificial
  CRISPR gRNA sequence
tcatgcaccaggtatggacg

SEQ ID NO: 578102 - DNA, 20 bp, Artificial
  CRISPR gRNA sequence
gagaactgtggggaggggcc

SEQ ID NO: 578103 - DNA, 20 bp, Artificial
  CRISPR gRNA sequence
gtgccccccagctctcaacg

SEQ ID NO: 578104 - DNA, 20 bp, Artificial
  CRISPR gRNA sequence
acaccacccaccaccgccac

SEQ ID NO: 578105 - DNA, 20 bp, Artificial
  CRISPR gRNA sequence
tgtgagcagtgtaggctatt

SEQ ID NO: 578106 - DNA, 20 bp, Artificial
  CRISPR gRNA sequence
attctgaattgcagtactct

SEQ ID NO: 578107 - DNA, 20 bp, Artificial
  CRISPR gRNA sequence
ggtgcagaaccttaaagatg

SEQ ID NO: 578108 - DNA, 20 bp, Artificial
  CRISPR gRNA sequence
tagtcaaaatgtcagcacct

SEQ ID NO: 578109 - DNA, 20 bp, Artificial
  CRISPR gRNA sequence
tggggacagcagagccccct

SEQ ID NO: 578110 - DNA, 20 bp, Artificial
  CRISPR gRNA sequence
cagcagagccccctgggagt

SEQ ID NO: 578111 - DNA, 20 bp, Artificial
  CRISPR gRNA sequence
tcagggttttcgaggctcag

SEQ ID NO: 578112 - DNA, 20 bp, Artificial
  CRISPR gRNA sequence
ggtgccctgtccccacccac

SEQ ID NO: 578113 - DNA, 20 bp, Artificial
  CRISPR gRNA sequence
agggatcaacgtggccagcc

SEQ ID NO: 578114 - DNA, 20 bp, Artificial
  CRISPR gRNA sequence
atcaacgtggccagcctgga

SEQ ID NO: 578115 - DNA, 20 bp, Artificial
  CRISPR gRNA sequence
ggtcagtggacagggctggg

SEQ ID NO: 578116 - DNA, 20 bp, Artificial
  CRISPR gRNA sequence
aaatggtgtctgcaagtggc

SEQ ID NO: 578117 - DNA, 20 bp, Artificial
  CRISPR gRNA sequence
gagccagaggacttcctcaa

SEQ ID NO: 578118 - DNA, 20 bp, Artificial
  CRISPR gRNA sequence
ctggcttgtggggagaggtc

SEQ ID NO: 578119 - DNA, 20 bp, Artificial
  CRISPR gRNA sequence
aagagctaaactctgagact

SEQ ID NO: 578120 - DNA, 20 bp, Artificial
  CRISPR gRNA sequence
tgatcaaaatctcccagttc

SEQ ID NO: 578121 - DNA, 20 bp, Artificial
  CRISPR gRNA sequence
cagttcctgagtgacagagc

SEQ ID NO: 578122 - DNA, 20 bp, Artificial
  CRISPR gRNA sequence
gaacccatgtagccaggctc

SEQ ID NO: 578123 - DNA, 20 bp, Artificial
  CRISPR gRNA sequence
gcacaggccgtccctccacc

SEQ ID NO: 578124 - DNA, 20 bp, Artificial
  CRISPR gRNA sequence
actctggccaggctcaagtg

SEQ ID NO: 578125 - DNA, 20 bp, Artificial
  CRISPR gRNA sequence
gggcatgtgttaagggaacg

SEQ ID NO: 578126 - DNA, 20 bp, Artificial
  CRISPR gRNA sequence
ctcagaggagagaactccca

SEQ ID NO: 578127 - DNA, 20 bp, Artificial
  CRISPR gRNA sequence
gcctgtcgtggtcacctgca

SEQ ID NO: 578128 - DNA, 20 bp, Artificial
  CRISPR gRNA sequence
actgccaggcggaccatctt

SEQ ID NO: 578129 - DNA, 20 bp, Artificial
  CRISPR gRNA sequence
caggtaatgccagggcggtg

SEQ ID NO: 578130 - DNA, 20 bp, Artificial
  CRISPR gRNA sequence
tgccagggcggtggagggta

SEQ ID NO: 578131 - DNA, 20 bp, Artificial
  CRISPR gRNA sequence
ggcggtggagggtaagggat

SEQ ID NO: 578132 - DNA, 20 bp, Artificial
  CRISPR gRNA sequence
tggtgctggagaaggagaag

SEQ ID NO: 578133 - DNA, 20 bp, Artificial
  CRISPR gRNA sequence
cagcactttgggaggccgag

SEQ ID NO: 578134 - DNA, 20 bp, Artificial
  CRISPR gRNA sequence
actttgggaggccgaggcgg

SEQ ID NO: 578135 - DNA, 20 bp, Artificial
  CRISPR gRNA sequence
ggcgggtggatcacgaggtc

SEQ ID NO: 578136 - DNA, 20 bp, Artificial
  CRISPR gRNA sequence
ctacttgggaggctgaggca

SEQ ID NO: 578137 - DNA, 20 bp, Artificial
  CRISPR gRNA sequence
aattgcttgaacctgggagg

SEQ ID NO: 578138 - DNA, 20 bp, Artificial
  CRISPR gRNA sequence
gatccccaaacactgtgatc

SEQ ID NO: 578139 - DNA, 20 bp, Artificial
  CRISPR gRNA sequence
acagagcattaaacaaagca

SEQ ID NO: 578140 - DNA, 20 bp, Artificial
  CRISPR gRNA sequence
ggtaatttatttctcatgat

SEQ ID NO: 578141 - DNA, 20 bp, Artificial
  CRISPR gRNA sequence
atgatgcgaatgtacagatg

SEQ ID NO: 578142 - DNA, 20 bp, Artificial
  CRISPR gRNA sequence
atgaggaatattgaggccag

SEQ ID NO: 578143 - DNA, 20 bp, Artificial
  CRISPR gRNA sequence
tgactttcccaaggtcacag

SEQ ID NO: 578144 - DNA, 20 bp, Artificial
  CRISPR gRNA sequence
atacggctcatgctgttttg

SEQ ID NO: 578145 - DNA, 20 bp, Artificial
  CRISPR gRNA sequence
tgtgggattccacctcagac

SEQ ID NO: 578146 - DNA, 20 bp, Artificial
  CRISPR gRNA sequence
cagcactttgggaggctgaa

SEQ ID NO: 578147 - DNA, 20 bp, Artificial
  CRISPR gRNA sequence
actttgggaggctgaagcgg

SEQ ID NO: 578148 - DNA, 20 bp, Artificial
  CRISPR gRNA sequence
cgggtggatcacatgaggtc

SEQ ID NO: 578149 - DNA, 20 bp, Artificial
  CRISPR gRNA sequence
ggctgaggcagaagacttgc

SEQ ID NO: 578150 - DNA, 20 bp, Artificial
  CRISPR gRNA sequence
cttgcttgaatctgggaggt

SEQ ID NO: 578151 - DNA, 20 bp, Artificial
  CRISPR gRNA sequence
aaagtgggaagtttaagcct

SEQ ID NO: 578152 - DNA, 20 bp, Artificial
  CRISPR gRNA sequence
ttgctgtccggaggcacctg

SEQ ID NO: 578153 - DNA, 20 bp, Artificial
  CRISPR gRNA sequence
gaaacagcacattcccaggt

SEQ ID NO: 578154 - DNA, 20 bp, Artificial
  CRISPR gRNA sequence
gctcctaatcctgacaggct

SEQ ID NO: 578155 - DNA, 20 bp, Artificial
  CRISPR gRNA sequence
atcctgacaggctctgggtg

SEQ ID NO: 578156 - DNA, 20 bp, Artificial
  CRISPR gRNA sequence
cgctcacaaaagcttccttt

SEQ ID NO: 578157 - DNA, 20 bp, Artificial
  CRISPR gRNA sequence
tgaaagccccccatatggtc

SEQ ID NO: 578158 - DNA, 20 bp, Artificial
  CRISPR gRNA sequence
cccctagccctgactccctt

SEQ ID NO: 578159 - DNA, 20 bp, Artificial
  CRISPR gRNA sequence
ctcccctgaccaaggaaaat

SEQ ID NO: 578160 - DNA, 20 bp, Artificial
  CRISPR gRNA sequence
cctgaccaaggaaaatcggg

SEQ ID NO: 578161 - DNA, 20 bp, Artificial
  CRISPR gRNA sequence
gcctggcctgtgggcttagc

SEQ ID NO: 578162 - DNA, 20 bp, Artificial
  CRISPR gRNA sequence
attttggcagaagtggtgca

SEQ ID NO: 578163 - DNA, 20 bp, Artificial
  CRISPR gRNA sequence
cagtacctgtgcccgtggac

SEQ ID NO: 578164 - DNA, 20 bp, Artificial
  CRISPR gRNA sequence
gattcatccccaccctctga

SEQ ID NO: 578165 - DNA, 20 bp, Artificial
  CRISPR gRNA sequence
acctacgccacgctcatccg

SEQ ID NO: 578166 - DNA, 20 bp, Artificial
  CRISPR gRNA sequence
aaggaggaggaagacaaaga

SEQ ID NO: 578167 - DNA, 20 bp, Artificial
  CRISPR gRNA sequence
tcccaaactcctgtctccct

SEQ ID NO: 578168 - DNA, 20 bp, Artificial
  CRISPR gRNA sequence
tgtctccctctgagtgccct

SEQ ID NO: 578169 - DNA, 20 bp, Artificial
  CRISPR gRNA sequence
tccctctgagtgccctcaga

SEQ ID NO: 578170 - DNA, 20 bp, Artificial
  CRISPR gRNA sequence
cattcccaagccccagcccc

SEQ ID NO: 578171 - DNA, 20 bp, Artificial
  CRISPR gRNA sequence
ctgactctgtaatcccattc

SEQ ID NO: 578172 - DNA, 20 bp, Artificial
  CRISPR gRNA sequence
ctcacccctagaccccccac

SEQ ID NO: 578173 - DNA, 20 bp, Artificial
  CRISPR gRNA sequence
cgcccccatgtcagatggct

SEQ ID NO: 578174 - DNA, 20 bp, Artificial
  CRISPR gRNA sequence
ccctctaaaccccaagtttg

SEQ ID NO: 578175 - DNA, 20 bp, Artificial
  CRISPR gRNA sequence
tcctctgaggtggcggtgac

SEQ ID NO: 578176 - DNA, 20 bp, Artificial
  CRISPR gRNA sequence
gcagctcaaagtgggcaggc

SEQ ID NO: 578177 - DNA, 20 bp, Artificial
  CRISPR gRNA sequence
ataggcacattggggaggaa

SEQ ID NO: 578178 - DNA, 20 bp, Artificial
  CRISPR gRNA sequence
acattggggaggaacgggat

SEQ ID NO: 578179 - DNA, 20 bp, Artificial
  CRISPR gRNA sequence
agaacgccatccgccacaac

SEQ ID NO: 578180 - DNA, 20 bp, Artificial
  CRISPR gRNA sequence
agtctgcacaagtgctttgt

SEQ ID NO: 578181 - DNA, 20 bp, Artificial
  CRISPR gRNA sequence
agaagggggctgtgtggacc

SEQ ID NO: 578182 - DNA, 20 bp, Artificial
  CRISPR gRNA sequence
tgtgtggaccgtggatgagc

SEQ ID NO: 578183 - DNA, 20 bp, Artificial
  CRISPR gRNA sequence
gacctcaagatcaaggaaag

SEQ ID NO: 578184 - DNA, 20 bp, Artificial
  CRISPR gRNA sequence
gaggcagaggtggtgggggc

SEQ ID NO: 578185 - DNA, 20 bp, Artificial
  CRISPR gRNA sequence
gggggcagggatgataggcc

SEQ ID NO: 578186 - DNA, 20 bp, Artificial
  CRISPR gRNA sequence
cacaggggcactgtcaacac

SEQ ID NO: 578187 - DNA, 20 bp, Artificial
  CRISPR gRNA sequence
agaagcagcgtcagtaccct

SEQ ID NO: 578188 - DNA, 20 bp, Artificial
  CRISPR gRNA sequence
cgctcacacacacggcctgt

SEQ ID NO: 578189 - DNA, 20 bp, Artificial
  CRISPR gRNA sequence
tgcacacgcacagcccccca

SEQ ID NO: 578190 - DNA, 20 bp, Artificial
  CRISPR gRNA sequence
acagccccccagtgggtctc

SEQ ID NO: 578191 - DNA, 20 bp, Artificial
  CRISPR gRNA sequence
agaggaactactcatttatt

SEQ ID NO: 578192 - DNA, 20 bp, Artificial
  CRISPR gRNA sequence
gctggactatcaccccatat

SEQ ID NO: 578193 - DNA, 20 bp, Artificial
  CRISPR gRNA sequence
aagggttgcggtcagtgggc

SEQ ID NO: 578194 - DNA, 20 bp, Artificial
  CRISPR gRNA sequence
tgcggtcagtgggcaggggt

SEQ ID NO: 578195 - DNA, 20 bp, Artificial
  CRISPR gRNA sequence
cagcatgtggggagctcggc

SEQ ID NO: 578196 - DNA, 20 bp, Artificial
  CRISPR gRNA sequence
tcagatcctgagggtactga

SEQ ID NO: 578197 - DNA, 20 bp, Artificial
  CRISPR gRNA sequence
gggtgtgtgggttgtcaggg

SEQ ID NO: 578198 - DNA, 20 bp, Artificial
  CRISPR gRNA sequence
gttgtcagggctgtgcttgt

SEQ ID NO: 578199 - DNA, 20 bp, Artificial
  CRISPR gRNA sequence
tgtgtgtgattgtgtgatga

SEQ ID NO: 578200 - DNA, 20 bp, Artificial
  CRISPR gRNA sequence
gtgtgatgatgcagctttga

SEQ ID NO: 578201 - DNA, 20 bp, Artificial
  CRISPR gRNA sequence
agtgtactgaggcaggctct

SEQ ID NO: 578202 - DNA, 20 bp, Artificial
  CRISPR gRNA sequence
gaggcaggctctctgtgttt

SEQ ID NO: 578203 - DNA, 20 bp, Artificial
  CRISPR gRNA sequence
gggtttgtgttgagtgaggg

SEQ ID NO: 578204 - DNA, 20 bp, Artificial
  CRISPR gRNA sequence
tgtgtggctggttgtgaagg

SEQ ID NO: 578205 - DNA, 20 bp, Artificial
  CRISPR gRNA sequence
ccccaccacctctgcctccc

SEQ ID NO: 578206 - DNA, 20 bp, Artificial
  CRISPR gRNA sequence
aacacctgctgggcctctgg

SEQ ID NO: 578207 - DNA, 20 bp, Artificial
  CRISPR gRNA sequence
gctcaccttccaggtggcag

SEQ ID NO: 578208 - DNA, 20 bp, Artificial
  CRISPR gRNA sequence
ggtagatctcattgagtgtc

SEQ ID NO: 578209 - DNA, 20 bp, Artificial
  CRISPR gRNA sequence
aggggcacattccccaaact

SEQ ID NO: 578210 - DNA, 20 bp, Artificial
  CRISPR gRNA sequence
tgggtgtgggtatggttgtt

SEQ ID NO: 578211 - DNA, 20 bp, Artificial
  CRISPR gRNA sequence
tgaagggtcagaagtggggt

SEQ ID NO: 578212 - DNA, 20 bp, Artificial
  CRISPR gRNA sequence
aggggtgagggatgggatga

SEQ ID NO: 578213 - DNA, 20 bp, Artificial
  CRISPR gRNA sequence
gctttaggtcagaagccaga

SEQ ID NO: 578214 - DNA, 20 bp, Artificial
  CRISPR gRNA sequence
gctgagggtcagggaatttg

SEQ ID NO: 578215 - DNA, 20 bp, Artificial
  CRISPR gRNA sequence
gggtcagggaatttgatcag

SEQ ID NO: 578216 - DNA, 20 bp, Artificial
  CRISPR gRNA sequence
tgatcagtttggattcagga

SEQ ID NO: 578217 - DNA, 20 bp, Artificial
  CRISPR gRNA sequence
tgggattacagagtcagcga

SEQ ID NO: 578218 - DNA, 20 bp, Artificial
  CRISPR gRNA sequence
cagtcaggatggggctaggt

SEQ ID NO: 578219 - DNA, 20 bp, Artificial
  CRISPR gRNA sequence
gtatcatgtaggggtgaggt

SEQ ID NO: 578220 - DNA, 20 bp, Artificial
  CRISPR gRNA sequence
gagttagagtaagagctggg

SEQ ID NO: 578221 - DNA, 20 bp, Artificial
  CRISPR gRNA sequence
gggcaaggtgcagagatggg

SEQ ID NO: 578222 - DNA, 20 bp, Artificial
  CRISPR gRNA sequence
aggtggacatctggaaaggg

SEQ ID NO: 578223 - DNA, 20 bp, Artificial
  CRISPR gRNA sequence
tggcatgctctggcctggat

SEQ ID NO: 578224 - DNA, 20 bp, Artificial
  CRISPR gRNA sequence
gctctggcctggatggtggt

SEQ ID NO: 578225 - DNA, 20 bp, Artificial
  CRISPR gRNA sequence
ggcctggatggtggtttagg

SEQ ID NO: 578226 - DNA, 20 bp, Artificial
  CRISPR gRNA sequence
gtttaggtttggatttgcgg

SEQ ID NO: 578227 - DNA, 20 bp, Artificial
  CRISPR gRNA sequence
atgaggggtcacatttgagg

SEQ ID NO: 578228 - DNA, 20 bp, Artificial
  CRISPR gRNA sequence
ggcttggggatccttggggc

SEQ ID NO: 578229 - DNA, 20 bp, Artificial
  CRISPR gRNA sequence
gagggcactcagagggagac

SEQ ID NO: 578230 - DNA, 20 bp, Artificial
  CRISPR gRNA sequence
tcctccttggggccgagctg

SEQ ID NO: 578231 - DNA, 20 bp, Artificial
  CRISPR gRNA sequence
cccgtgtccacgggcacagg

SEQ ID NO: 578232 - DNA, 20 bp, Artificial
  CRISPR gRNA sequence
ggtgagctcgggcgaatcca

SEQ ID NO: 578233 - DNA, 20 bp, Artificial
  CRISPR gRNA sequence
ccgacactcgagaccatatg

SEQ ID NO: 578234 - DNA, 20 bp, Artificial
  CRISPR gRNA sequence
aggccacggacatcccgaaa

SEQ ID NO: 578235 - DNA, 20 bp, Artificial
  CRISPR gRNA sequence
caccctccacccagagcctg

SEQ ID NO: 578236 - DNA, 20 bp, Artificial
  CRISPR gRNA sequence
acccagagcctgtcaggatt

SEQ ID NO: 578237 - DNA, 20 bp, Artificial
  CRISPR gRNA sequence
accattcttacctgggaatg

SEQ ID NO: 578238 - DNA, 20 bp, Artificial
  CRISPR gRNA sequence
gggggagaggctggtgaccc

SEQ ID NO: 578239 - DNA, 20 bp, Artificial
  CRISPR gRNA sequence
cccactttttactttctatt

SEQ ID NO: 578240 - DNA, 20 bp, Artificial
  CRISPR gRNA sequence
gctcactgcaacccccacct

SEQ ID NO: 578241 - DNA, 20 bp, Artificial
  CRISPR gRNA sequence
ttttgtatttttggtagaga

SEQ ID NO: 578242 - DNA, 20 bp, Artificial
  CRISPR gRNA sequence
ctcctgacctcatgtgatcc

SEQ ID NO: 578243 - DNA, 20 bp, Artificial
  CRISPR gRNA sequence
cgcttcagcctcccaaagtg

SEQ ID NO: 578244 - DNA, 20 bp, Artificial
  CRISPR gRNA sequence
gctccactttatttttaaat

SEQ ID NO: 578245 - DNA, 20 bp, Artificial
  CRISPR gRNA sequence
aacagtgcctggcctccagg

SEQ ID NO: 578246 - DNA, 20 bp, Artificial
  CRISPR gRNA sequence
ctatgtggttatgtggcacc

SEQ ID NO: 578247 - DNA, 20 bp, Artificial
  CRISPR gRNA sequence
tggttatgtggcaccctgtg

SEQ ID NO: 578248 - DNA, 20 bp, Artificial
  CRISPR gRNA sequence
tggcaagtctggctatttgc

SEQ ID NO: 578249 - DNA, 20 bp, Artificial
  CRISPR gRNA sequence
gctttaacaactcaggatca

SEQ ID NO: 578250 - DNA, 20 bp, Artificial
  CRISPR gRNA sequence
gtttggggatcttagagtca

SEQ ID NO: 578251 - DNA, 20 bp, Artificial
  CRISPR gRNA sequence
ttttgtacttttagtagaca

SEQ ID NO: 578252 - DNA, 20 bp, Artificial
  CRISPR gRNA sequence
cgcctcggcctcccaaagtg

SEQ ID NO: 578253 - DNA, 20 bp, Artificial
  CRISPR gRNA sequence
accacgcccagccggggtca

SEQ ID NO: 578254 - DNA, 20 bp, Artificial
  CRISPR gRNA sequence
agggtttgtaagtagaaggg

SEQ ID NO: 578255 - DNA, 20 bp, Artificial
  CRISPR gRNA sequence
ggacagatttccaggtctgg

SEQ ID NO: 578256 - DNA, 20 bp, Artificial
  CRISPR gRNA sequence
ccaggtgggcctgcatggca

SEQ ID NO: 578257 - DNA, 20 bp, Artificial
  CRISPR gRNA sequence
cagccctcgtcccaggtgaa

SEQ ID NO: 578258 - DNA, 20 bp, Artificial
  CRISPR gRNA sequence
tttctggcacatggtggaca

SEQ ID NO: 578259 - DNA, 20 bp, Artificial
  CRISPR gRNA sequence
ctggcagtgcctaagtaggg

SEQ ID NO: 578260 - DNA, 20 bp, Artificial
  CRISPR gRNA sequence
gtagcagggcaaagcaggag

SEQ ID NO: 578261 - DNA, 20 bp, Artificial
  CRISPR gRNA sequence
agctctgtcactcaggaact

SEQ ID NO: 578262 - DNA, 20 bp, Artificial
  CRISPR gRNA sequence
atgggggtaaataacagcac

SEQ ID NO: 578263 - DNA, 20 bp, Artificial
  CRISPR gRNA sequence
acagccagtcagggatggag

SEQ ID NO: 578264 - DNA, 20 bp, Artificial
  CRISPR gRNA sequence
gggatttgaacccacagtct

SEQ ID NO: 578265 - DNA, 20 bp, Artificial
  CRISPR gRNA sequence
acctgtccttcctgggtgca

SEQ ID NO: 578266 - DNA, 20 bp, Artificial
  CRISPR gRNA sequence
ggaggctgtgggctgggctc

SEQ ID NO: 578267 - DNA, 20 bp, Artificial
  CRISPR gRNA sequence
ggcccacaaggcctctcatt

SEQ ID NO: 578268 - DNA, 20 bp, Artificial
  CRISPR gRNA sequence
gctctgctgtccccaaagtc

SEQ ID NO: 578269 - DNA, 20 bp, Artificial
  CRISPR gRNA sequence
aagtcccaggcttctggcag

SEQ ID NO: 578270 - DNA, 20 bp, Artificial
  CRISPR gRNA sequence
tcgcaggtgctgacattttg

SEQ ID NO: 578271 - DNA, 20 bp, Artificial
  CRISPR gRNA sequence
tgactagctttgtaaagctc

SEQ ID NO: 578272 - DNA, 20 bp, Artificial
  CRISPR gRNA sequence
ctttgtaaagctctgtggtt

SEQ ID NO: 578273 - DNA, 20 bp, Artificial
  CRISPR gRNA sequence
catctttaaggttctgcacc

SEQ ID NO: 578274 - DNA, 20 bp, Artificial
  CRISPR gRNA sequence
acctgacgttttttggaggg

SEQ ID NO: 578275 - DNA, 20 bp, Artificial
  CRISPR gRNA sequence
ggcctcctcctctcctgaga

SEQ ID NO: 578276 - DNA, 20 bp, Artificial
  CRISPR gRNA sequence
aatctctgaggcctggcagg

SEQ ID NO: 578277 - DNA, 20 bp, Artificial
  CRISPR gRNA sequence
ccccgggcccccagcaggtc

SEQ ID NO: 578278 - DNA, 20 bp, Artificial
  CRISPR gRNA sequence
caagggccaaggaaggggcc

SEQ ID NO: 578279 - DNA, 20 bp, Artificial
  CRISPR gRNA sequence
ccacgtgcagaggtccagca

SEQ ID NO: 578280 - DNA, 20 bp, Artificial
  CRISPR gRNA sequence
gtgtcctctatgagggcaat

SEQ ID NO: 578281 - DNA, 20 bp, Artificial
  CRISPR gRNA sequence
tgtttccccctccacttgag

SEQ ID NO: 578282 - DNA, 20 bp, Artificial
  CRISPR gRNA sequence
ctccctgcaccctgcacagg

SEQ ID NO: 578283 - DNA, 20 bp, Artificial
  CRISPR gRNA sequence
cagtgactaggcatggactc

SEQ ID NO: 578284 - DNA, 20 bp, Artificial
  CRISPR gRNA sequence
agtggagaaggcgagaagtg

SEQ ID NO: 578285 - DNA, 20 bp, Artificial
  CRISPR gRNA sequence
gctggatcaggagcagtgct

SEQ ID NO: 578286 - DNA, 20 bp, Artificial
  CRISPR gRNA sequence
agagggagagtcaaagtgac

SEQ ID NO: 578287 - DNA, 20 bp, Artificial
  CRISPR gRNA sequence
agagtcaaagtgacatgggt

SEQ ID NO: 578288 - DNA, 20 bp, Artificial
  CRISPR gRNA sequence
gatgggggacatggcgggga

SEQ ID NO: 578289 - DNA, 20 bp, Artificial
  CRISPR gRNA sequence
tctcttgagctggggcctgt

SEQ ID NO: 578290 - DNA, 20 bp, Artificial
  CRISPR gRNA sequence
ttccactccctgagggaagc

SEQ ID NO: 578291 - DNA, 20 bp, Artificial
  CRISPR gRNA sequence
actccacttctttctttagg

SEQ ID NO: 578292 - DNA, 20 bp, Artificial
  CRISPR gRNA sequence
tattaagttcttagtctcct

SEQ ID NO: 578293 - DNA, 20 bp, Artificial
  CRISPR gRNA sequence
tccttcaagccaagaaataa

SEQ ID NO: 578294 - DNA, 20 bp, Artificial
  CRISPR gRNA sequence
aagctgggggagaggcctgg

SEQ ID NO: 578295 - DNA, 20 bp, Artificial
  CRISPR gRNA sequence
tagcagccagaacaaactaa

SEQ ID NO: 578296 - DNA, 20 bp, Artificial
  CRISPR gRNA sequence
ataccgatttcggtgcaaat

SEQ ID NO: 578297 - DNA, 20 bp, Artificial
  CRISPR gRNA sequence
ctagagggccgggctgggca

SEQ ID NO: 578298 - DNA, 20 bp, Artificial
  CRISPR gRNA sequence
gttgggacgtccctttctga

SEQ ID NO: 578299 - DNA, 20 bp, Artificial
  CRISPR gRNA sequence
tttctcagaagctgaatggg

SEQ ID NO: 578300 - DNA, 20 bp, Artificial
  CRISPR gRNA sequence
aatgggggatgtttctggga

SEQ ID NO: 578301 - DNA, 20 bp, Artificial
  CRISPR gRNA sequence
ggatgtttctgggacacaga

SEQ ID NO: 578302 - DNA, 20 bp, Artificial
  CRISPR gRNA sequence
ttgtcacagcccccgacttg

SEQ ID NO: 578303 - DNA, 20 bp, Artificial
  CRISPR gRNA sequence
cgtcatggcggccggatgcg

SEQ ID NO: 578304 - DNA, 20 bp, Artificial
  CRISPR gRNA sequence
gagggcagataccccacccc

SEQ ID NO: 578305 - DNA, 20 bp, Artificial
  CRISPR gRNA sequence
actggctgccctgtcctgca

SEQ ID NO: 578306 - DNA, 20 bp, Artificial
  CRISPR gRNA sequence
tcttgggttgtggagaggac

SEQ ID NO: 578307 - DNA, 20 bp, Artificial
  CRISPR gRNA sequence
agaatcatagaacagcattt

SEQ ID NO: 578308 - DNA, 20 bp, Artificial
  CRISPR gRNA sequence
ttggaaccatctgaaagtca

SEQ ID NO: 578309 - DNA, 20 bp, Artificial
  CRISPR gRNA sequence
catctgaaagtcaggcagct

SEQ ID NO: 578310 - DNA, 20 bp, Artificial
  CRISPR gRNA sequence
ctctagaggggccccacaat

SEQ ID NO: 578311 - DNA, 20 bp, Artificial
  CRISPR gRNA sequence
cccacctagagtcctgagat

SEQ ID NO: 578312 - DNA, 20 bp, Artificial
  CRISPR gRNA sequence
ctagagtcctgagatctagg

SEQ ID NO: 578313 - DNA, 20 bp, Artificial
  CRISPR gRNA sequence
gttaagtcattaggtgtctg

SEQ ID NO: 578314 - DNA, 20 bp, Artificial
  CRISPR gRNA sequence
cagagtgcatgtgtgcgaga

SEQ ID NO: 578315 - DNA, 20 bp, Artificial
  CRISPR gRNA sequence
ctggggaagagaacagaata

SEQ ID NO: 578316 - DNA, 20 bp, Artificial
  CRISPR gRNA sequence
caaactggaggaccatggag

SEQ ID NO: 578317 - DNA, 20 bp, Artificial
  CRISPR gRNA sequence
atcccaacaacccctccctg

SEQ ID NO: 578318 - DNA, 20 bp, Artificial
  CRISPR gRNA sequence
tgcccagatccattcaagat

SEQ ID NO: 578319 - DNA, 20 bp, Artificial
  CRISPR gRNA sequence
tttaacacctaatgctgatc

SEQ ID NO: 578320 - DNA, 20 bp, Artificial
  CRISPR gRNA sequence
gcctggctaaaaatcacaca

SEQ ID NO: 578321 - DNA, 20 bp, Artificial
  CRISPR gRNA sequence
acatagggcttggggtgacg

SEQ ID NO: 578322 - DNA, 20 bp, Artificial
  CRISPR gRNA sequence
caaatttcaacaatgtgata

SEQ ID NO: 578323 - DNA, 20 bp, Artificial
  CRISPR gRNA sequence
cataataatactcacctagg

SEQ ID NO: 578324 - DNA, 20 bp, Artificial
  CRISPR gRNA sequence
gaatccaaggaagcagtcag

SEQ ID NO: 578325 - DNA, 20 bp, Artificial
  CRISPR gRNA sequence
atgtgttcaaacaattttta

SEQ ID NO: 578326 - DNA, 20 bp, Artificial
  CRISPR gRNA sequence
aggaacaaaaccaatatata

SEQ ID NO: 578327 - DNA, 20 bp, Artificial
  CRISPR gRNA sequence
gctcaccccagccctgaaca

SEQ ID NO: 578328 - DNA, 20 bp, Artificial
  CRISPR gRNA sequence
accccagccctgaacaacct

SEQ ID NO: 578329 - DNA, 20 bp, Artificial
  CRISPR gRNA sequence
aagcaaagttcagttaagtg

SEQ ID NO: 578330 - DNA, 20 bp, Artificial
  CRISPR gRNA sequence
gactgacagaaaaggatcag

SEQ ID NO: 578331 - DNA, 20 bp, Artificial
  CRISPR gRNA sequence
ctgtcacgtatcaaaaacaa

SEQ ID NO: 578332 - DNA, 20 bp, Artificial
  CRISPR gRNA sequence
acggggtggggaggggttct

SEQ ID NO: 578333 - DNA, 20 bp, Artificial
  CRISPR gRNA sequence
agttttttttttctctctct

SEQ ID NO: 578334 - DNA, 20 bp, Artificial
  CRISPR gRNA sequence
tctctctgtgtttctccttt

SEQ ID NO: 578335 - DNA, 20 bp, Artificial
  CRISPR gRNA sequence
taaacggaaattttgaaatt

SEQ ID NO: 578336 - DNA, 20 bp, Artificial
  CRISPR gRNA sequence
cctttacgagtcatctgaaa

SEQ ID NO: 578337 - DNA, 20 bp, Artificial
  CRISPR gRNA sequence
taatagggctcatgagaaac

SEQ ID NO: 578338 - DNA, 20 bp, Artificial
  CRISPR gRNA sequence
gtttttaaaacaaaagtgta

SEQ ID NO: 578339 - DNA, 20 bp, Artificial
  CRISPR gRNA sequence
ggcctcgccctactccaggc

SEQ ID NO: 578340 - DNA, 20 bp, Artificial
  CRISPR gRNA sequence
gatggaattgatatggtccc

SEQ ID NO: 578341 - DNA, 20 bp, Artificial
  CRISPR gRNA sequence
gagagaaaagtctcgcctca

SEQ ID NO: 578342 - DNA, 20 bp, Artificial
  CRISPR gRNA sequence
agtctcgcctcatcacgttt

SEQ ID NO: 578343 - DNA, 20 bp, Artificial
  CRISPR gRNA sequence
gcccattgggaccctgaccc

SEQ ID NO: 578344 - DNA, 20 bp, Artificial
  CRISPR gRNA sequence
gtttcaggaacatcatggcc

SEQ ID NO: 578345 - DNA, 20 bp, Artificial
  CRISPR gRNA sequence
ggtcttttacttcaaaaagc

SEQ ID NO: 578346 - DNA, 20 bp, Artificial
  CRISPR gRNA sequence
cttcaaaaagccccagtttc

SEQ ID NO: 578347 - DNA, 20 bp, Artificial
  CRISPR gRNA sequence
aagccccagtttccaaggat

SEQ ID NO: 578348 - DNA, 20 bp, Artificial
  CRISPR gRNA sequence
tccgccatcatctcagtagc

SEQ ID NO: 578349 - DNA, 20 bp, Artificial
  CRISPR gRNA sequence
acagagctggcgagtgtggg

SEQ ID NO: 578350 - DNA, 20 bp, Artificial
  CRISPR gRNA sequence
gggtcccgctttctttggtg

SEQ ID NO: 578351 - DNA, 20 bp, Artificial
  CRISPR gRNA sequence
ggtgctgggctttgaaatcc

SEQ ID NO: 578352 - DNA, 20 bp, Artificial
  CRISPR gRNA sequence
ctttcctgaacttgatgttc

SEQ ID NO: 578353 - DNA, 20 bp, Artificial
  CRISPR gRNA sequence
gatgtgatggcagggagatc

SEQ ID NO: 578354 - DNA, 20 bp, Artificial
  CRISPR gRNA sequence
ttggagagtccttggagact

SEQ ID NO: 578355 - DNA, 20 bp, Artificial
  CRISPR gRNA sequence
ccttggagacttgaagcttg

SEQ ID NO: 578356 - DNA, 20 bp, Artificial
  CRISPR gRNA sequence
agcatggtagaccagccccc

SEQ ID NO: 578357 - DNA, 20 bp, Artificial
  CRISPR gRNA sequence
ccactccagccctctacaag

SEQ ID NO: 578358 - DNA, 20 bp, Artificial
  CRISPR gRNA sequence
cctggggaagagaaattgga

SEQ ID NO: 578359 - DNA, 20 bp, Artificial
  CRISPR gRNA sequence
gcccagaatgggcctgatgg

SEQ ID NO: 578360 - DNA, 20 bp, Artificial
  CRISPR gRNA sequence
aaaacaaaactttcgctggt

SEQ ID NO: 578361 - DNA, 20 bp, Artificial
  CRISPR gRNA sequence
ggacacatctgagacccaaa

SEQ ID NO: 578362 - DNA, 20 bp, Artificial
  CRISPR gRNA sequence
caccaaggtgggatgaggtc

SEQ ID NO: 578363 - DNA, 20 bp, Artificial
  CRISPR gRNA sequence
gcagggaccctgtgaacagc

SEQ ID NO: 578364 - DNA, 20 bp, Artificial
  CRISPR gRNA sequence
gtcaggaaggagtcctgggg

SEQ ID NO: 578365 - DNA, 20 bp, Artificial
  CRISPR gRNA sequence
tccccctcctggaaaagggg

SEQ ID NO: 578366 - DNA, 20 bp, Artificial
  CRISPR gRNA sequence
ggactatatcctctctcatg

SEQ ID NO: 578367 - DNA, 20 bp, Artificial
  CRISPR gRNA sequence
tgggagttgggggtgagtag

SEQ ID NO: 578368 - DNA, 20 bp, Artificial
  CRISPR gRNA sequence
aggtcctgaggtgggaatgt

SEQ ID NO: 578369 - DNA, 20 bp, Artificial
  CRISPR gRNA sequence
ttgtaggccatggtaaggac

SEQ ID NO: 578370 - DNA, 20 bp, Artificial
  CRISPR gRNA sequence
gaggagaaacacaaaccgtg

SEQ ID NO: 578371 - DNA, 20 bp, Artificial
  CRISPR gRNA sequence
agtggaggtggtgagaagag

SEQ ID NO: 578372 - DNA, 20 bp, Artificial
  CRISPR gRNA sequence
atatttttaatagacagcca

SEQ ID NO: 578373 - DNA, 20 bp, Artificial
  CRISPR gRNA sequence
aaggagtccctggactattt

SEQ ID NO: 578374 - DNA, 20 bp, Artificial
  CRISPR gRNA sequence
gagaaaaaaataaagttctg

SEQ ID NO: 578375 - DNA, 20 bp, Artificial
  CRISPR gRNA sequence
ttgcttaagcccccattatt

SEQ ID NO: 578376 - DNA, 20 bp, Artificial
  CRISPR gRNA sequence
gaccccaaagggagagcgaa

SEQ ID NO: 578377 - DNA, 20 bp, Artificial
  CRISPR gRNA sequence
gtcaggttgggcaagaagga

SEQ ID NO: 578378 - DNA, 20 bp, Artificial
  CRISPR gRNA sequence
gttgggcaagaaggacaggg

SEQ ID NO: 578379 - DNA, 20 bp, Artificial
  CRISPR gRNA sequence
caagaaggacagggctttga

SEQ ID NO: 578380 - DNA, 20 bp, Artificial
  CRISPR gRNA sequence
ctggtagcacacagtcaggt

SEQ ID NO: 578381 - DNA, 20 bp, Artificial
  CRISPR gRNA sequence
caatagtatcaagtcctgga

SEQ ID NO: 578382 - DNA, 20 bp, Artificial
  CRISPR gRNA sequence
ggctaacaatcaggggcatt

SEQ ID NO: 578383 - DNA, 20 bp, Artificial
  CRISPR gRNA sequence
acctacactgcccccgtcgg

SEQ ID NO: 578384 - DNA, 20 bp, Artificial
  CRISPR gRNA sequence
ctcagacttccgcattagct

SEQ ID NO: 578385 - DNA, 20 bp, Artificial
  CRISPR gRNA sequence
cttccgcattagctgtctgc

SEQ ID NO: 578386 - DNA, 20 bp, Artificial
  CRISPR gRNA sequence
tctgcttctgttttcttcat

SEQ ID NO: 578387 - DNA, 20 bp, Artificial
  CRISPR gRNA sequence
cacccccattccggcctctc

SEQ ID NO: 578388 - DNA, 20 bp, Artificial
  CRISPR gRNA sequence
cccgggcatccccattggct

SEQ ID NO: 578389 - DNA, 20 bp, Artificial
  CRISPR gRNA sequence
tggctgcagcgagccaatgg

SEQ ID NO: 578390 - DNA, 20 bp, Artificial
  CRISPR gRNA sequence
ggaggcttgtgagcgtgcac

SEQ ID NO: 578391 - DNA, 20 bp, Artificial
  CRISPR gRNA sequence
gcaggcagccattaggaaaa

SEQ ID NO: 578392 - DNA, 20 bp, Artificial
  CRISPR gRNA sequence
gtgccacaagccaagaatgc

SEQ ID NO: 578393 - DNA, 20 bp, Artificial
  CRISPR gRNA sequence
aataggaaatttaactttct

SEQ ID NO: 578394 - DNA, 20 bp, Artificial
  CRISPR gRNA sequence
cctgactgtgtgctaccaga

SEQ ID NO: 578395 - DNA, 20 bp, Artificial
  CRISPR gRNA sequence
agaagttgattgggcatatg

SEQ ID NO: 578396 - DNA, 20 bp, Artificial
  CRISPR gRNA sequence
ccttctttctgtccccccat

SEQ ID NO: 578397 - DNA, 20 bp, Artificial
  CRISPR gRNA sequence
cccaagagtgctgttccttc

SEQ ID NO: 578398 - DNA, 20 bp, Artificial
  CRISPR gRNA sequence
accttctgtgggaactcaac

SEQ ID NO: 578399 - DNA, 20 bp, Artificial
  CRISPR gRNA sequence
tacattccttctccatcctg

SEQ ID NO: 578400 - DNA, 20 bp, Artificial
  CRISPR gRNA sequence
cagaaaaatcataaaataat

SEQ ID NO: 578401 - DNA, 20 bp, Artificial
  CRISPR gRNA sequence
cagggactccttcctgccca

SEQ ID NO: 578402 - DNA, 20 bp, Artificial
  CRISPR gRNA sequence
tagccagctccttgctggtc

SEQ ID NO: 578403 - DNA, 20 bp, Artificial
  CRISPR gRNA sequence
ccattgtacactcagcattc

SEQ ID NO: 578404 - DNA, 20 bp, Artificial
  CRISPR gRNA sequence
ggcttcctgttaaatcctaa

SEQ ID NO: 578405 - DNA, 20 bp, Artificial
  CRISPR gRNA sequence
ctgttaaatcctaacacggt

SEQ ID NO: 578406 - DNA, 20 bp, Artificial
  CRISPR gRNA sequence
taacacggtttgtgtttctc

SEQ ID NO: 578407 - DNA, 20 bp, Artificial
  CRISPR gRNA sequence
gtcccctttctgacctcacc

SEQ ID NO: 578408 - DNA, 20 bp, Artificial
  CRISPR gRNA sequence
cacctcaggacctttgccct

SEQ ID NO: 578409 - DNA, 20 bp, Artificial
  CRISPR gRNA sequence
gtctctggggacttttcctg

SEQ ID NO: 578410 - DNA, 20 bp, Artificial
  CRISPR gRNA sequence
agcccccattctgcaaggat

SEQ ID NO: 578411 - DNA, 20 bp, Artificial
  CRISPR gRNA sequence
attctcggccaccatcctca

SEQ ID NO: 578412 - DNA, 20 bp, Artificial
  CRISPR gRNA sequence
gcctctgctgatagaactgg

SEQ ID NO: 578413 - DNA, 20 bp, Artificial
  CRISPR gRNA sequence
actcagaagcctcaaccagc

SEQ ID NO: 578414 - DNA, 20 bp, Artificial
  CRISPR gRNA sequence
gaagcctcaaccagcgaaag

SEQ ID NO: 578415 - DNA, 20 bp, Artificial
  CRISPR gRNA sequence
aactaatggtggggagggtt

SEQ ID NO: 578416 - DNA, 20 bp, Artificial
  CRISPR gRNA sequence
ttttttttttaattgttgtt

SEQ ID NO: 578417 - DNA, 20 bp, Artificial
  CRISPR gRNA sequence
gccaggccatcaggcccatt

SEQ ID NO: 578418 - DNA, 20 bp, Artificial
  CRISPR gRNA sequence
aaagaggccctcctttttac

SEQ ID NO: 578419 - DNA, 20 bp, Artificial
  CRISPR gRNA sequence
tgaaggggtggatcttggcc

SEQ ID NO: 578420 - DNA, 20 bp, Artificial
  CRISPR gRNA sequence
gttgttggacgactagaacc

SEQ ID NO: 578421 - DNA, 20 bp, Artificial
  CRISPR gRNA sequence
ctggacaacctaaaagcctc

SEQ ID NO: 578422 - DNA, 20 bp, Artificial
  CRISPR gRNA sequence
cctgagaacatcaagttcag

SEQ ID NO: 578423 - DNA, 20 bp, Artificial
  CRISPR gRNA sequence
acatcaagttcaggaaagct

SEQ ID NO: 578424 - DNA, 20 bp, Artificial
  CRISPR gRNA sequence
cagctctgtgatcttgggca

SEQ ID NO: 578425 - DNA, 20 bp, Artificial
  CRISPR gRNA sequence
agttgcttgactacttatac

SEQ ID NO: 578426 - DNA, 20 bp, Artificial
  CRISPR gRNA sequence
tggagctcaaggggccatgg

SEQ ID NO: 578427 - DNA, 20 bp, Artificial
  CRISPR gRNA sequence
aatcctaaatccttggaaac

SEQ ID NO: 578428 - DNA, 20 bp, Artificial
  CRISPR gRNA sequence
ttcctcattcagtaactgtc

SEQ ID NO: 578429 - DNA, 20 bp, Artificial
  CRISPR gRNA sequence
tgtcagtagattctgggagc

SEQ ID NO: 578430 - DNA, 20 bp, Artificial
  CRISPR gRNA sequence
ttaggggatgacagtgggct

SEQ ID NO: 578431 - DNA, 20 bp, Artificial
  CRISPR gRNA sequence
tggcatttcccatccacaca

SEQ ID NO: 578432 - DNA, 20 bp, Artificial
  CRISPR gRNA sequence
ttcccatccacacatagagc

SEQ ID NO: 578433 - DNA, 20 bp, Artificial
  CRISPR gRNA sequence
ctgcctgcctcgggttggcc

SEQ ID NO: 578434 - DNA, 20 bp, Artificial
  CRISPR gRNA sequence
gatttattttagttcttttc

SEQ ID NO: 578435 - DNA, 20 bp, Artificial
  CRISPR gRNA sequence
ttttttcaaactctatacac

SEQ ID NO: 578436 - DNA, 20 bp, Artificial
  CRISPR gRNA sequence
tacacttttgttttaaaaac

SEQ ID NO: 578437 - DNA, 20 bp, Artificial
  CRISPR gRNA sequence
aaaacccaaaatttcaaaat

SEQ ID NO: 578438 - DNA, 20 bp, Artificial
  CRISPR gRNA sequence
tatgagaacccctccccacc

SEQ ID NO: 578439 - DNA, 20 bp, Artificial
  CRISPR gRNA sequence
cacacactcatcgaaaaaaa

SEQ ID NO: 578440 - DNA, 20 bp, Artificial
  CRISPR gRNA sequence
attattagaagagagaggtc

SEQ ID NO: 578441 - DNA, 20 bp, Artificial
  CRISPR gRNA sequence
gcggcttccacaccgtacag

SEQ ID NO: 578442 - DNA, 20 bp, Artificial
  CRISPR gRNA sequence
tcttctcggtataaaagcaa

SEQ ID NO: 578443 - DNA, 20 bp, Artificial
  CRISPR gRNA sequence
caaagttgtttttgatacgt

SEQ ID NO: 578444 - DNA, 20 bp, Artificial
  CRISPR gRNA sequence
cagtgggatgtacccagcta

SEQ ID NO: 578445 - DNA, 20 bp, Artificial
  CRISPR gRNA sequence
atcaattgatacgtagatgg

SEQ ID NO: 578446 - DNA, 20 bp, Artificial
  CRISPR gRNA sequence
atatgtcagctgccagtctt

SEQ ID NO: 578447 - DNA, 20 bp, Artificial
  CRISPR gRNA sequence
ctgccagtctttatggattt

SEQ ID NO: 578448 - DNA, 20 bp, Artificial
  CRISPR gRNA sequence
tcaccctgtcttgctctttt

SEQ ID NO: 578449 - DNA, 20 bp, Artificial
  CRISPR gRNA sequence
ttcccagccagcatccagcc

SEQ ID NO: 578450 - DNA, 20 bp, Artificial
  CRISPR gRNA sequence
cctagagctttgtacacagc

SEQ ID NO: 578451 - DNA, 20 bp, Artificial
  CRISPR gRNA sequence
ttctgttcaccctagtagca

SEQ ID NO: 578452 - DNA, 20 bp, Artificial
  CRISPR gRNA sequence
aagctgagcacttaactgaa

SEQ ID NO: 578453 - DNA, 20 bp, Artificial
  CRISPR gRNA sequence
acttaactgaactttgcttg

SEQ ID NO: 578454 - DNA, 20 bp, Artificial
  CRISPR gRNA sequence
cacttcacaccattgtcaac

SEQ ID NO: 578455 - DNA, 20 bp, Artificial
  CRISPR gRNA sequence
gttgttcagggctggggtga

SEQ ID NO: 578456 - DNA, 20 bp, Artificial
  CRISPR gRNA sequence
gctggggtgagctcgattct

SEQ ID NO: 578457 - DNA, 20 bp, Artificial
  CRISPR gRNA sequence
tcgattctgcaggcttagca

SEQ ID NO: 578458 - DNA, 20 bp, Artificial
  CRISPR gRNA sequence
aaattagaatcatgctatat

SEQ ID NO: 578459 - DNA, 20 bp, Artificial
  CRISPR gRNA sequence
atgctatatattggttttgt

SEQ ID NO: 578460 - DNA, 20 bp, Artificial
  CRISPR gRNA sequence
ctgctttattcaattaacag

SEQ ID NO: 578461 - DNA, 20 bp, Artificial
  CRISPR gRNA sequence
tcaattaacagtagtgtttt

SEQ ID NO: 578462 - DNA, 20 bp, Artificial
  CRISPR gRNA sequence
tgtttttgaagcttactaaa

SEQ ID NO: 578463 - DNA, 20 bp, Artificial
  CRISPR gRNA sequence
tgtcctcacatcagcatgaa

SEQ ID NO: 578464 - DNA, 20 bp, Artificial
  CRISPR gRNA sequence
ctcacatcagcatgaacttt

SEQ ID NO: 578465 - DNA, 20 bp, Artificial
  CRISPR gRNA sequence
ctttgattgatttgaccaag

SEQ ID NO: 578466 - DNA, 20 bp, Artificial
  CRISPR gRNA sequence
tgccgattgttggacattcc

SEQ ID NO: 578467 - DNA, 20 bp, Artificial
  CRISPR gRNA sequence
tgttggacattccggttgtt

SEQ ID NO: 578468 - DNA, 20 bp, Artificial
  CRISPR gRNA sequence
ttttttctataaacatccct

SEQ ID NO: 578469 - DNA, 20 bp, Artificial
  CRISPR gRNA sequence
taaacatccctgactgcttc

SEQ ID NO: 578470 - DNA, 20 bp, Artificial
  CRISPR gRNA sequence
gcaaagggggcgtgcatttt

SEQ ID NO: 578471 - DNA, 20 bp, Artificial
  CRISPR gRNA sequence
ctaaccctaggtgagtatta

SEQ ID NO: 578472 - DNA, 20 bp, Artificial
  CRISPR gRNA sequence
acattgttgaaatttgcatc

SEQ ID NO: 578473 - DNA, 20 bp, Artificial
  CRISPR gRNA sequence
ttttactattcattggccat

SEQ ID NO: 578474 - DNA, 20 bp, Artificial
  CRISPR gRNA sequence
tgttcatcttatttttccct

SEQ ID NO: 578475 - DNA, 20 bp, Artificial
  CRISPR gRNA sequence
aatattttccccaattcatc

SEQ ID NO: 578476 - DNA, 20 bp, Artificial
  CRISPR gRNA sequence
tcatcatttgctttttttct

SEQ ID NO: 578477 - DNA, 20 bp, Artificial
  CRISPR gRNA sequence
gctttttttctatttgttta

SEQ ID NO: 578478 - DNA, 20 bp, Artificial
  CRISPR gRNA sequence
tttgtttatggtgttttttg

SEQ ID NO: 578479 - DNA, 20 bp, Artificial
  CRISPR gRNA sequence
gtgttttttgtgatgcttat

SEQ ID NO: 578480 - DNA, 20 bp, Artificial
  CRISPR gRNA sequence
aataggttagtctttttttc

SEQ ID NO: 578481 - DNA, 20 bp, Artificial
  CRISPR gRNA sequence
ttttttctgtggcttctgtc

SEQ ID NO: 578482 - DNA, 20 bp, Artificial
  CRISPR gRNA sequence
tgtggcttctgtctctggtt

SEQ ID NO: 578483 - DNA, 20 bp, Artificial
  CRISPR gRNA sequence
tgagataaatgttcacctat

SEQ ID NO: 578484 - DNA, 20 bp, Artificial
  CRISPR gRNA sequence
tgttggcttctagtctcttt

SEQ ID NO: 578485 - DNA, 20 bp, Artificial
  CRISPR gRNA sequence
agcgtcaccccaagccctat

SEQ ID NO: 578486 - DNA, 20 bp, Artificial
  CRISPR gRNA sequence
atagtaccttcctcaggagt

SEQ ID NO: 578487 - DNA, 20 bp, Artificial
  CRISPR gRNA sequence
accttcctcaggagtctttg

SEQ ID NO: 578488 - DNA, 20 bp, Artificial
  CRISPR gRNA sequence
taaaccatactccatggtcc

SEQ ID NO: 578489 - DNA, 20 bp, Artificial
  CRISPR gRNA sequence
ctccatatgtgggtccatgt

SEQ ID NO: 578490 - DNA, 20 bp, Artificial
  CRISPR gRNA sequence
ctgttcttataccagggcca

SEQ ID NO: 578491 - DNA, 20 bp, Artificial
  CRISPR gRNA sequence
ataccagggccacactgttt

SEQ ID NO: 578492 - DNA, 20 bp, Artificial
  CRISPR gRNA sequence
ggccacactgttttgctgat

SEQ ID NO: 578493 - DNA, 20 bp, Artificial
  CRISPR gRNA sequence
ggcaccttgcccttctttat

SEQ ID NO: 578494 - DNA, 20 bp, Artificial
  CRISPR gRNA sequence
ctctctccccaactgcaggc

SEQ ID NO: 578495 - DNA, 20 bp, Artificial
  CRISPR gRNA sequence
ctggtgctggtccccgaaaa

SEQ ID NO: 578496 - DNA, 20 bp, Artificial
  CRISPR gRNA sequence
ggctctgtattggcgaaggc

SEQ ID NO: 578497 - DNA, 20 bp, Artificial
  CRISPR gRNA sequence
tgaggccctagggaggctgg

SEQ ID NO: 578498 - DNA, 20 bp, Artificial
  CRISPR gRNA sequence
ctgactttcagatggttcca

SEQ ID NO: 578499 - DNA, 20 bp, Artificial
  CRISPR gRNA sequence
ggaccgtagaccccacagtc

SEQ ID NO: 578500 - DNA, 20 bp, Artificial
  CRISPR gRNA sequence
agaccccacagtctgtggtt

SEQ ID NO: 578501 - DNA, 20 bp, Artificial
  CRISPR gRNA sequence
taaatctaagaaatgctgtt

SEQ ID NO: 578502 - DNA, 20 bp, Artificial
  CRISPR gRNA sequence
tggagcctgcctggcactct

SEQ ID NO: 578503 - DNA, 20 bp, Artificial
  CRISPR gRNA sequence
agggccaggtcttcagagct

SEQ ID NO: 578504 - DNA, 20 bp, Artificial
  CRISPR gRNA sequence
tgtcccagaaacatccccca

SEQ ID NO: 578505 - DNA, 20 bp, Artificial
  CRISPR gRNA sequence
gtccctgtctgagaatgtat

SEQ ID NO: 578506 - DNA, 20 bp, Artificial
  CRISPR gRNA sequence
gctgagtcaggccatcccac

SEQ ID NO: 578507 - DNA, 20 bp, Artificial
  CRISPR gRNA sequence
tagctctggccaagtgtcca

SEQ ID NO: 578508 - DNA, 20 bp, Artificial
  CRISPR gRNA sequence
ccatttgcaccgaaatcggt

SEQ ID NO: 578509 - DNA, 20 bp, Artificial
  CRISPR gRNA sequence
ataacaaagtaccacaactg

SEQ ID NO: 578510 - DNA, 20 bp, Artificial
  CRISPR gRNA sequence
aagctgctccaggcctctcc

SEQ ID NO: 578511 - DNA, 20 bp, Artificial
  CRISPR gRNA sequence
gctggcaatctttgttattt

SEQ ID NO: 578512 - DNA, 20 bp, Artificial
  CRISPR gRNA sequence
tgaaggagcatcaccccatc

SEQ ID NO: 578513 - DNA, 20 bp, Artificial
  CRISPR gRNA sequence
gagcctccacagacccacac

SEQ ID NO: 578514 - DNA, 20 bp, Artificial
  CRISPR gRNA sequence
aggagactaagaacttaata

SEQ ID NO: 578515 - DNA, 20 bp, Artificial
  CRISPR gRNA sequence
acacacacacacacacacca

SEQ ID NO: 578516 - DNA, 20 bp, Artificial
  CRISPR gRNA sequence
gctgggcagtcccttccagc

SEQ ID NO: 578517 - DNA, 20 bp, Artificial
  CRISPR gRNA sequence
agctctggcttcctctcaga

SEQ ID NO: 578518 - DNA, 20 bp, Artificial
  CRISPR gRNA sequence
attataggatcctgaaaagc

SEQ ID NO: 578519 - DNA, 20 bp, Artificial
  CRISPR gRNA sequence
gggggcccggagccattgtg

SEQ ID NO: 578520 - DNA, 20 bp, Artificial
  CRISPR gRNA sequence
caatagaagagcaggtcttg

SEQ ID NO: 578521 - DNA, 20 bp, Artificial
  CRISPR gRNA sequence
ggcagggggtgtagcatgag

SEQ ID NO: 578522 - DNA, 20 bp, Artificial
  CRISPR gRNA sequence
ctctgatgggggctgggtag

SEQ ID NO: 578523 - DNA, 20 bp, Artificial
  CRISPR gRNA sequence
gctgctagcactgctcctga

SEQ ID NO: 578524 - DNA, 20 bp, Artificial
  CRISPR gRNA sequence
agcactgctcctgatccagc

SEQ ID NO: 578525 - DNA, 20 bp, Artificial
  CRISPR gRNA sequence
tgcagggagggctagaggcc

SEQ ID NO: 578526 - DNA, 20 bp, Artificial
  CRISPR gRNA sequence
cgggacatgtcccagccaat

SEQ ID NO: 578527 - DNA, 20 bp, Artificial
  CRISPR gRNA sequence
gggctggctggggcacagga

SEQ ID NO: 578528 - DNA, 20 bp, Artificial
  CRISPR gRNA sequence
aatccccacctgccaggcct

SEQ ID NO: 578529 - DNA, 20 bp, Artificial
  CRISPR gRNA sequence
ggccagctctgcaacttatt

SEQ ID NO: 578530 - DNA, 20 bp, Artificial
  CRISPR gRNA sequence
gttactcgatctccatgagc

SEQ ID NO: 578531 - DNA, 20 bp, Artificial
  CRISPR gRNA sequence
atgatcatagcatctaccat

SEQ ID NO: 578532 - DNA, 20 bp, Artificial
  CRISPR gRNA sequence
taacacctcagcccgtaccc

SEQ ID NO: 578533 - DNA, 20 bp, Artificial
  CRISPR gRNA sequence
ggtcaaaggtgtcaggtctc

SEQ ID NO: 578534 - DNA, 20 bp, Artificial
  CRISPR gRNA sequence
atgtcaaaatcacaaaacca

SEQ ID NO: 578535 - DNA, 20 bp, Artificial
  CRISPR gRNA sequence
gcacctgcgaatggccgtct

SEQ ID NO: 578536 - DNA, 20 bp, Artificial
  CRISPR gRNA sequence
cagcagagccccctgggagt

SEQ ID NO: 578537 - DNA, 20 bp, Artificial
  CRISPR gRNA sequence
gcctgtgccagtctaccggc

SEQ ID NO: 578538 - DNA, 20 bp, Artificial
  CRISPR gRNA sequence
tctagggtgcagatctcagc

SEQ ID NO: 578539 - DNA, 20 bp, Artificial
  CRISPR gRNA sequence
gtgtgaccttggacaaatta

SEQ ID NO: 578540 - DNA, 20 bp, Artificial
  CRISPR gRNA sequence
attacttagcttctctcgac

SEQ ID NO: 578541 - DNA, 20 bp, Artificial
  CRISPR gRNA sequence
tttctcgtatgtataataag

SEQ ID NO: 578542 - DNA, 20 bp, Artificial
  CRISPR gRNA sequence
ccagttcctgagtgacagag

SEQ ID NO: 578543 - DNA, 20 bp, Artificial
  CRISPR gRNA sequence
ccaggctctagaatctgcac

SEQ ID NO: 578544 - DNA, 20 bp, Artificial
  CRISPR gRNA sequence
acaggccgtccctccaccca

SEQ ID NO: 578545 - DNA, 20 bp, Artificial
  CRISPR gRNA sequence
agaagggccaggctgaggcc

SEQ ID NO: 578546 - DNA, 20 bp, Artificial
  CRISPR gRNA sequence
gctgggaaaatggcactgac

SEQ ID NO: 578547 - DNA, 20 bp, Artificial
  CRISPR gRNA sequence
cttgggaggctgaggcagag

SEQ ID NO: 578548 - DNA, 20 bp, Artificial
  CRISPR gRNA sequence
aattgcttgaacctgggagg

SEQ ID NO: 578549 - DNA, 20 bp, Artificial
  CRISPR gRNA sequence
gtaacctgcagggccccttg

SEQ ID NO: 578550 - DNA, 20 bp, Artificial
  CRISPR gRNA sequence
agccagccctggaggccagg

SEQ ID NO: 578551 - DNA, 20 bp, Artificial
  CRISPR gRNA sequence
ggaggccaggcactgtttct

SEQ ID NO: 578552 - DNA, 20 bp, Artificial
  CRISPR gRNA sequence
atgaggaatattgaggccag

SEQ ID NO: 578553 - DNA, 20 bp, Artificial
  CRISPR gRNA sequence
gctctaataaatacggctca

SEQ ID NO: 578554 - DNA, 20 bp, Artificial
  CRISPR gRNA sequence
aatacggctcatgctgtttt

SEQ ID NO: 578555 - DNA, 20 bp, Artificial
  CRISPR gRNA sequence
tggaatttagaagagggcgt

SEQ ID NO: 578556 - DNA, 20 bp, Artificial
  CRISPR gRNA sequence
ggcgtccttgctttgaaaaa

SEQ ID NO: 578557 - DNA, 20 bp, Artificial
  CRISPR gRNA sequence
tcgggaggctgaggcagaag

SEQ ID NO: 578558 - DNA, 20 bp, Artificial
  CRISPR gRNA sequence
gaggtgggggttgcagtgag

SEQ ID NO: 578559 - DNA, 20 bp, Artificial
  CRISPR gRNA sequence
aaaatagaaagtaaaaagtg

SEQ ID NO: 578560 - DNA, 20 bp, Artificial
  CRISPR gRNA sequence
cccccgggaggcccctgaca

SEQ ID NO: 578561 - DNA, 20 bp, Artificial
  CRISPR gRNA sequence
gggaaaatgcatccgctcac

SEQ ID NO: 578562 - DNA, 20 bp, Artificial
  CRISPR gRNA sequence
gcccctagccctgactccct

SEQ ID NO: 578563 - DNA, 20 bp, Artificial
  CRISPR gRNA sequence
ccctgaccaaggaaaatcgg

SEQ ID NO: 578564 - DNA, 20 bp, Artificial
  CRISPR gRNA sequence
ctctccaccaggcctggcct

SEQ ID NO: 578565 - DNA, 20 bp, Artificial
  CRISPR gRNA sequence
atcctttggtgtgcaagtta

SEQ ID NO: 578566 - DNA, 20 bp, Artificial
  CRISPR gRNA sequence
gctagctaggaggtcctgca

SEQ ID NO: 578567 - DNA, 20 bp, Artificial
  CRISPR gRNA sequence
gctaggaggtcctgcatggg

SEQ ID NO: 578568 - DNA, 20 bp, Artificial
  CRISPR gRNA sequence
cctcaaatgtgacccctcat

SEQ ID NO: 578569 - DNA, 20 bp, Artificial
  CRISPR gRNA sequence
actcgataattcaaaccatc

SEQ ID NO: 578570 - DNA, 20 bp, Artificial
  CRISPR gRNA sequence
ttctaaccccatctttgacc

SEQ ID NO: 578571 - DNA, 20 bp, Artificial
  CRISPR gRNA sequence
caccccacatctagtcctgt

SEQ ID NO: 578572 - DNA, 20 bp, Artificial
  CRISPR gRNA sequence
ggtcatagcccctctaaacc

SEQ ID NO: 578573 - DNA, 20 bp, Artificial
  CRISPR gRNA sequence
gatctaccactggttcacac

SEQ ID NO: 578574 - DNA, 20 bp, Artificial
  CRISPR gRNA sequence
gccacaacctgagtctgcac

SEQ ID NO: 578575 - DNA, 20 bp, Artificial
  CRISPR gRNA sequence
tgcccacagggaccaagaag

SEQ ID NO: 578576 - DNA, 20 bp, Artificial
  CRISPR gRNA sequence
gagcctgcctcagctgctcg

SEQ ID NO: 578577 - DNA, 20 bp, Artificial
  CRISPR gRNA sequence
ccctgagccctgatccatgc

SEQ ID NO: 578578 - DNA, 20 bp, Artificial
  CRISPR gRNA sequence
gcatggggtcaaagatgggg

SEQ ID NO: 578579 - DNA, 20 bp, Artificial
  CRISPR gRNA sequence
ggaaaggggtaggtttaggg

SEQ ID NO: 578580 - DNA, 20 bp, Artificial
  CRISPR gRNA sequence
tcatctgtacattcgcatca

SEQ ID NO: 578581 - DNA, 20 bp, Artificial
  CRISPR gRNA sequence
aattaccaccagcaaagcgc

SEQ ID NO: 578582 - DNA, 20 bp, Artificial
  CRISPR gRNA sequence
atgttggaagtgtggtgagt

SEQ ID NO: 578583 - DNA, 20 bp, Artificial
  CRISPR gRNA sequence
tgtgtgtgtgtgtgagagag

SEQ ID NO: 578584 - DNA, 20 bp, Artificial
  CRISPR gRNA sequence
aacgtttcttattatacata

SEQ ID NO: 578585 - DNA, 20 bp, Artificial
  CRISPR gRNA sequence
gacccccagagtactgcaat

SEQ ID NO: 578586 - DNA, 20 bp, Artificial
  CRISPR gRNA sequence
ggggcagtgtgggcagctgg

SEQ ID NO: 578587 - DNA, 20 bp, Artificial
  CRISPR gRNA sequence
gtcacagacttgcctgggac

SEQ ID NO: 578588 - DNA, 20 bp, Artificial
  CRISPR gRNA sequence
tggcaagtgatgatgctggc

SEQ ID NO: 578589 - DNA, 20 bp, Artificial
  CRISPR gRNA sequence
ggtgctgagggagatgagtg

SEQ ID NO: 578590 - DNA, 20 bp, Artificial
  CRISPR gRNA sequence
gggcttagaacattactgcg

SEQ ID NO: 578591 - DNA, 20 bp, Artificial
  CRISPR gRNA sequence
ggggtgatgctccttcaagc

SEQ ID NO: 578592 - DNA, 20 bp, Artificial
  CRISPR gRNA sequence
cctggacacttggccagagc

SEQ ID NO: 578593 - DNA, 20 bp, Artificial
  CRISPR gRNA sequence
aatagtataacaccaggacc

SEQ ID NO: 578594 - DNA, 20 bp, Artificial
  CRISPR gRNA sequence
tttcttagatttaaaggatc

SEQ ID NO: 578595 - DNA, 20 bp, Artificial
  CRISPR gRNA sequence
agagatagtgagagacattg

SEQ ID NO: 578596 - DNA, 20 bp, Artificial
  CRISPR gRNA sequence
ctgatgctgcctgaaataat

SEQ ID NO: 578597 - DNA, 20 bp, Artificial
  CRISPR gRNA sequence
aacagatactggggaagaga

SEQ ID NO: 578598 - DNA, 20 bp, Artificial
  CRISPR gRNA sequence
atactggggaagagaacaga

SEQ ID NO: 578599 - DNA, 20 bp, Artificial
  CRISPR gRNA sequence
caaaaccagagacagaagcc

SEQ ID NO: 578600 - DNA, 20 bp, Artificial
  CRISPR gRNA sequence
acaaaaaacaccataaacaa

SEQ ID NO: 578601 - DNA, 20 bp, Artificial
  CRISPR gRNA sequence
aataggacaaccttttggaa

SEQ ID NO: 578602 - DNA, 20 bp, Artificial
  CRISPR gRNA sequence
ggaagcagtcagggatgttt

SEQ ID NO: 578603 - DNA, 20 bp, Artificial
  CRISPR gRNA sequence
gggatgtttatagaaaaaaa

SEQ ID NO: 578604 - DNA, 20 bp, Artificial
  CRISPR gRNA sequence
agcatgattctaatttggtt

SEQ ID NO: 578605 - DNA, 20 bp, Artificial
  CRISPR gRNA sequence
ccaaacgctgtgctaagcct

SEQ ID NO: 578606 - DNA, 20 bp, Artificial
  CRISPR gRNA sequence
ggaaggcaggtgggggaagg

SEQ ID NO: 578607 - DNA, 20 bp, Artificial
  CRISPR gRNA sequence
gtagcgacagacagatggcg

SEQ ID NO: 578608 - DNA, 20 bp, Artificial
  CRISPR gRNA sequence
atggcgggagaaagagaggc

SEQ ID NO: 578609 - DNA, 20 bp, Artificial
  CRISPR gRNA sequence
caccttggtgaagtggactg

SEQ ID NO: 578610 - DNA, 20 bp, Artificial
  CRISPR gRNA sequence
caactttgcttttataccga

SEQ ID NO: 578611 - DNA, 20 bp, Artificial
  CRISPR gRNA sequence
caatgagataatagggctca

SEQ ID NO: 578612 - DNA, 20 bp, Artificial
  CRISPR gRNA sequence
atatttgagggtctctgggg

SEQ ID NO: 578613 - DNA, 20 bp, Artificial
  CRISPR gRNA sequence
gagggtctctggggaaagaa

SEQ ID NO: 578614 - DNA, 20 bp, Artificial
  CRISPR gRNA sequence
gggaaatgccagggaaagag

SEQ ID NO: 578615 - DNA, 20 bp, Artificial
  CRISPR gRNA sequence
catgtaagttacttcatgga

SEQ ID NO: 578616 - DNA, 20 bp, Artificial
  CRISPR gRNA sequence
attcatggacttgaagagtc

SEQ ID NO: 578617 - DNA, 20 bp, Artificial
  CRISPR gRNA sequence
agtcggagaatccctggctc

SEQ ID NO: 578618 - DNA, 20 bp, Artificial
  CRISPR gRNA sequence
cagttactgaatgaggaaag

SEQ ID NO: 578619 - DNA, 20 bp, Artificial
  CRISPR gRNA sequence
actggcttcagacctgggga

SEQ ID NO: 578620 - DNA, 20 bp, Artificial
  CRISPR gRNA sequence
actcacccttctggaaaagc

SEQ ID NO: 578621 - DNA, 20 bp, Artificial
  CRISPR gRNA sequence
atggcctggctttgtgaaga

SEQ ID NO: 578622 - DNA, 20 bp, Artificial
  CRISPR gRNA sequence
aagacaagaaaaaaaaaaaa

SEQ ID NO: 578623 - DNA, 20 bp, Artificial
  CRISPR gRNA sequence
aagaaaaaaaaaaaaaaaga

SEQ ID NO: 578624 - DNA, 20 bp, Artificial
  CRISPR gRNA sequence
aacgaagtgaggatggtggc

SEQ ID NO: 578625 - DNA, 20 bp, Artificial
  CRISPR gRNA sequence
tgctgaaagccaagatcctt

SEQ ID NO: 578626 - DNA, 20 bp, Artificial
  CRISPR gRNA sequence
aagagaagctggaggtgagg

SEQ ID NO: 578627 - DNA, 20 bp, Artificial
  CRISPR gRNA sequence
atgacagggttgcaagcaga

SEQ ID NO: 578628 - DNA, 20 bp, Artificial
  CRISPR gRNA sequence
tgccagcttgaacttttagg

SEQ ID NO: 578629 - DNA, 20 bp, Artificial
  CRISPR gRNA sequence
gtagaagcagagatgggggg

SEQ ID NO: 578630 - DNA, 20 bp, Artificial
  CRISPR gRNA sequence
aatttaaaaaagtgaatcct

SEQ ID NO: 578631 - DNA, 20 bp, Artificial
  CRISPR gRNA sequence
tcttggcttgtggcactgct

SEQ ID NO: 578632 - DNA, 20 bp, Artificial
  CRISPR gRNA sequence
ggtggtgcgaaatccatgat

SEQ ID NO: 578633 - DNA, 20 bp, Artificial
  CRISPR gRNA sequence
tcttgagcagtgccacaagc

SEQ ID NO: 578634 - DNA, 20 bp, Artificial
  CRISPR gRNA sequence
atgttcaggatgtccatgag

SEQ ID NO: 578635 - DNA, 20 bp, Artificial
  CRISPR gRNA sequence
aatatgttcagctgcaagta

SEQ ID NO: 578636 - DNA, 20 bp, Artificial
  CRISPR gRNA sequence
atggtctggggaaggtataa

SEQ ID NO: 578637 - DNA, 20 bp, Artificial
  CRISPR gRNA sequence
cccacacctctgatcctgag

SEQ ID NO: 578638 - DNA, 20 bp, Artificial
  CRISPR gRNA sequence
cattaaccttggggccatca

SEQ ID NO: 578639 - DNA, 20 bp, Artificial
  CRISPR gRNA sequence
gatctccctgccatcacatc

SEQ ID NO: 578640 - DNA, 20 bp, Artificial
  CRISPR gRNA sequence
ggatttcaaagcccagcacc

SEQ ID NO: 578641 - DNA, 20 bp, Artificial
  CRISPR gRNA sequence
cctcaaatatcctctcactc

SEQ ID NO: 578642 - DNA, 20 bp, Artificial
  CRISPR gRNA sequence
tctcacctctgtggtgaggg

SEQ ID NO: 578643 - DNA, 20 bp, Artificial
  CRISPR gRNA sequence
tcagatgactcgtaaagggc

SEQ ID NO: 578644 - DNA, 20 bp, Artificial
  CRISPR gRNA sequence
ttccgtttaagtctcataat

SEQ ID NO: 578645 - DNA, 20 bp, Artificial
  CRISPR gRNA sequence
aagtctcataatcaagaaaa

SEQ ID NO: 578646 - DNA, 20 bp, Artificial
  CRISPR gRNA sequence
aaaaggagaaacacagagag

SEQ ID NO: 578647 - DNA, 20 bp, Artificial
  CRISPR gRNA sequence
gtaaggtctttaaaaaaata

SEQ ID NO: 578648 - DNA, 20 bp, Artificial
  CRISPR gRNA sequence
ttagtatttctgtaaccaaa

SEQ ID NO: 578649 - DNA, 20 bp, Artificial
  CRISPR gRNA sequence
ttatttcccaacatgacagg

SEQ ID NO: 578650 - DNA, 20 bp, Artificial
  CRISPR gRNA sequence
ttctgtctctggttttgtgc

SEQ ID NO: 578651 - DNA, 20 bp, Artificial
  CRISPR gRNA sequence
attctaggatcctttaaatc

SEQ ID NO: 578652 - DNA, 20 bp, Artificial
  CRISPR gRNA sequence
atgaaaacataatctgtgtc

SEQ ID NO: 578653 - DNA, 20 bp, Artificial
  CRISPR gRNA sequence
aacatcccccattcagcttc

SEQ ID NO: 578654 - DNA, 20 bp, Artificial
  CRISPR gRNA sequence
tcagcttctgagaaacccag

SEQ ID NO: 578655 - DNA, 20 bp, Artificial
  CRISPR gRNA sequence
atcatctccatgtccctgtc

SEQ ID NO: 578656 - DNA, 20 bp, Artificial
  CRISPR gRNA sequence
gccatcccacatgtgtttgg

SEQ ID NO: 578657 - DNA, 20 bp, Artificial
  CRISPR gRNA sequence
acaactgagtggcttcagca

SEQ ID NO: 578658 - DNA, 20 bp, Artificial
  CRISPR gRNA sequence
cacccccaggaggtgacagc

SEQ ID NO: 578659 - DNA, 20 bp, Artificial
  CRISPR gRNA sequence
tgcacacggaaacacttcct

SEQ ID NO: 578660 - DNA, 20 bp, Artificial
  CRISPR gRNA sequence
gcatgagccaggcttgaggg

SEQ ID NO: 578661 - DNA, 20 bp, Artificial
  CRISPR gRNA sequence
atccagcttcagattaagtc

SEQ ID NO: 578662 - DNA, 20 bp, Artificial
  CRISPR gRNA sequence
ggggcaaaataggactccga

SEQ ID NO: 578663 - DNA, 20 bp, Artificial
  CRISPR gRNA sequence
ttatgcagatgttgcagggc

SEQ ID NO: 578664 - DNA, 20 bp, Artificial
  CRISPR gRNA sequence
aggtgcagaaccttaaagat

SEQ ID NO: 578665 - DNA, 20 bp, Artificial
  CRISPR gRNA sequence
cagttttctcgtatgtataa

SEQ ID NO: 578666 - DNA, 20 bp, Artificial
  CRISPR gRNA sequence
tgaacccatgtagccaggct

SEQ ID NO: 578667 - DNA, 20 bp, Artificial
  CRISPR gRNA sequence
tgcacaggccgtccctccac

SEQ ID NO: 578668 - DNA, 20 bp, Artificial
  CRISPR gRNA sequence
aaccttctgtccaccatgtg

SEQ ID NO: 578669 - DNA, 20 bp, Artificial
  CRISPR gRNA sequence
actacttgggaggctgaggc

SEQ ID NO: 578670 - DNA, 20 bp, Artificial
  CRISPR gRNA sequence
gacagatcaagactccgtct

SEQ ID NO: 578671 - DNA, 20 bp, Artificial
  CRISPR gRNA sequence
aaaaaaataaaaaacataaa

SEQ ID NO: 578672 - DNA, 20 bp, Artificial
  CRISPR gRNA sequence
ggaaacagcacattcccagg

SEQ ID NO: 578673 - DNA, 20 bp, Artificial
  CRISPR gRNA sequence
tattttggcagaagtggtgc

SEQ ID NO: 578674 - DNA, 20 bp, Artificial
  CRISPR gRNA sequence
cacacgcatgtttgccttct

SEQ ID NO: 578675 - DNA, 20 bp, Artificial
  CRISPR gRNA sequence
gtggatgagctggagttccg

SEQ ID NO: 578676 - DNA, 20 bp, Artificial
  CRISPR gRNA sequence
tcgctcacacacacggcctg

SEQ ID NO: 578677 - DNA, 20 bp, Artificial
  CRISPR gRNA sequence
cagtctgaggtggaatccca

SEQ ID NO: 578678 - DNA, 20 bp, Artificial
  CRISPR gRNA sequence
gtttcttattatacatacga

SEQ ID NO: 578679 - DNA, 20 bp, Artificial
  CRISPR gRNA sequence
ttcccaccctcctgagcctc

SEQ ID NO: 578680 - DNA, 20 bp, Artificial
  CRISPR gRNA sequence
tttaaaggatcctagaatct

SEQ ID NO: 578681 - DNA, 20 bp, Artificial
  CRISPR gRNA sequence
tattgcaaagcaacaatcag

SEQ ID NO: 578682 - DNA, 20 bp, Artificial
  CRISPR gRNA sequence
aggaaaggactttctaagca

SEQ ID NO: 578683 - DNA, 20 bp, Artificial
  CRISPR gRNA sequence
gactaacctatttgactgta

SEQ ID NO: 578684 - DNA, 20 bp, Artificial
  CRISPR gRNA sequence
aaaccatcataagcatcaca

SEQ ID NO: 578685 - DNA, 20 bp, Artificial
  CRISPR gRNA sequence
ctgtcatgttgggaaataat

SEQ ID NO: 578686 - DNA, 20 bp, Artificial
  CRISPR gRNA sequence
agtcagggatgtttatagaa

SEQ ID NO: 578687 - DNA, 20 bp, Artificial
  CRISPR gRNA sequence
aacaatttttagtaagcttc

SEQ ID NO: 578688 - DNA, 20 bp, Artificial
  CRISPR gRNA sequence
ttaattgaataaagcaggaa

SEQ ID NO: 578689 - DNA, 20 bp, Artificial
  CRISPR gRNA sequence
gtgggaaactgtcacgtatc

SEQ ID NO: 578690 - DNA, 20 bp, Artificial
  CRISPR gRNA sequence
tttgcttttataccgagaag

SEQ ID NO: 578691 - DNA, 20 bp, Artificial
  CRISPR gRNA sequence
tcatgagaaaccacagtttt

SEQ ID NO: 578692 - DNA, 20 bp, Artificial
  CRISPR gRNA sequence
tgtatagagtttgaaaaaaa

SEQ ID NO: 578693 - DNA, 20 bp, Artificial
  CRISPR gRNA sequence
aacaacaattaaaaaaaaaa

SEQ ID NO: 578694 - DNA, 20 bp, Artificial
  CRISPR gRNA sequence
aaccctccccaccattagtt

SEQ ID NO: 578695 - DNA, 20 bp, Artificial
  CRISPR gRNA sequence
tccccaccattagttcaaaa

SEQ ID NO: 578696 - DNA, 20 bp, Artificial
  CRISPR gRNA sequence
ggtgcgaaatccatgatgaa

SEQ ID NO: 578697 - DNA, 20 bp, Artificial
  CRISPR gRNA sequence
acacctctgatcctgagaga

SEQ ID NO: 578698 - DNA, 20 bp, Artificial
  CRISPR gRNA sequence
tgccatcacatcctagaatt

SEQ ID NO: 578699 - DNA, 20 bp, Artificial
  CRISPR gRNA sequence
gggtcagggcactcaagccc

SEQ ID NO: 578700 - DNA, 20 bp, Artificial
  CRISPR gRNA sequence
actctatacacttttgtttt

SEQ ID NO: 578701 - DNA, 20 bp, Artificial
  CRISPR gRNA sequence
gactcgtaaagggcaaagaa

SEQ ID NO: 578702 - DNA, 20 bp, Artificial
  CRISPR gRNA sequence
aacacagagagagagaaaaa

SEQ ID NO: 578703 - DNA, 20 bp, Artificial
  CRISPR gRNA sequence
ttcccaacatgacaggtaag

SEQ ID NO: 578704 - DNA, 20 bp, Artificial
  CRISPR gRNA sequence
ccaagatcagcattaggtgt

SEQ ID NO: 578705 - DNA, 20 bp, Artificial
  CRISPR gRNA sequence
cagagctggtgctggtcccc

SEQ ID NO: 578706 - DNA, 20 bp, Artificial
  CRISPR gRNA sequence
ccagatgcagaccccgatat

SEQ ID NO: 578707 - DNA, 20 bp, Artificial
  CRISPR gRNA sequence
tgggccaggccagagtggtg

SEQ ID NO: 578708 - DNA, 20 bp, Artificial
  CRISPR gRNA sequence
gtccttccagctgctcaagc

SEQ ID NO: 578709 - DNA, 20 bp, Artificial
  CRISPR gRNA sequence
cttggaaactccaccctcca

SEQ ID NO: 578710 - DNA, 20 bp, Artificial
  CRISPR gRNA sequence
gatgcagaatgtcaaaatca

SEQ ID NO: 578711 - DNA, 20 bp, Artificial
  CRISPR gRNA sequence
taagggatagggatagtgcg

SEQ ID NO: 578712 - DNA, 20 bp, Artificial
  CRISPR gRNA sequence
tctcaagaaaaaaaaaaaaa

SEQ ID NO: 578713 - DNA, 20 bp, Artificial
  CRISPR gRNA sequence
aagagggcgtccttgctttg

SEQ ID NO: 578714 - DNA, 20 bp, Artificial
  CRISPR gRNA sequence
actcagtatcaaaaaaaata

SEQ ID NO: 578715 - DNA, 20 bp, Artificial
  CRISPR gRNA sequence
ccctcactcaacacaaaccc

SEQ ID NO: 578716 - DNA, 20 bp, Artificial
  CRISPR gRNA sequence
gctacttcctccgctgtcca

SEQ ID NO: 578717 - DNA, 20 bp, Artificial
  CRISPR gRNA sequence
cttcctccgctgtccagttc

SEQ ID NO: 578718 - DNA, 20 bp, Artificial
  CRISPR gRNA sequence
cctccgctgtccagttcctc

SEQ ID NO: 578719 - DNA, 20 bp, Artificial
  CRISPR gRNA sequence
ctccgctgtccagttcctcc

SEQ ID NO: 578720 - DNA, 20 bp, Artificial
  CRISPR gRNA sequence
cgctgtccagttcctcctgc

SEQ ID NO: 578721 - DNA, 20 bp, Artificial
  CRISPR gRNA sequence
tccagttcctcctgctgcgg

SEQ ID NO: 578722 - DNA, 20 bp, Artificial
  CRISPR gRNA sequence
ctcctgctgcggccttggac

SEQ ID NO: 578723 - DNA, 20 bp, Artificial
  CRISPR gRNA sequence
ctgctgcggccttggaccca

SEQ ID NO: 578724 - DNA, 20 bp, Artificial
  CRISPR gRNA sequence
ctgcggccttggacccagac

SEQ ID NO: 578725 - DNA, 20 bp, Artificial
  CRISPR gRNA sequence
cggccttggacccagacccc

SEQ ID NO: 578726 - DNA, 20 bp, Artificial
  CRISPR gRNA sequence
ggacccagacccctgcccac

SEQ ID NO: 578727 - DNA, 20 bp, Artificial
  CRISPR gRNA sequence
gacccagacccctgcccact

SEQ ID NO: 578728 - DNA, 20 bp, Artificial
  CRISPR gRNA sequence
cccactgaccgcaaccctta

SEQ ID NO: 578729 - DNA, 20 bp, Artificial
  CRISPR gRNA sequence
accgcaacccttatatgggg

SEQ ID NO: 578730 - DNA, 20 bp, Artificial
  CRISPR gRNA sequence
atatggggtgatagtccagc

SEQ ID NO: 578731 - DNA, 20 bp, Artificial
  CRISPR gRNA sequence
tatggggtgatagtccagca

SEQ ID NO: 578732 - DNA, 20 bp, Artificial
  CRISPR gRNA sequence
ggctgcagtttattggggac

SEQ ID NO: 578733 - DNA, 20 bp, Artificial
  CRISPR gRNA sequence
cagtttattggggacggtac

SEQ ID NO: 578734 - DNA, 20 bp, Artificial
  CRISPR gRNA sequence
attggggacggtactgtggg

SEQ ID NO: 578735 - DNA, 20 bp, Artificial
  CRISPR gRNA sequence
ttggggacggtactgtgggt

SEQ ID NO: 578736 - DNA, 20 bp, Artificial
  CRISPR gRNA sequence
gggacggtactgtgggttgg

SEQ ID NO: 578737 - DNA, 20 bp, Artificial
  CRISPR gRNA sequence
tgggttgggggccttggatc

SEQ ID NO: 578738 - DNA, 20 bp, Artificial
  CRISPR gRNA sequence
ggggccttggatcccaaata

SEQ ID NO: 578739 - DNA, 20 bp, Artificial
  CRISPR gRNA sequence
ggatcccaaataaatgagta

SEQ ID NO: 578740 - DNA, 20 bp, Artificial
  CRISPR gRNA sequence
gatcccaaataaatgagtag

SEQ ID NO: 578741 - DNA, 20 bp, Artificial
  CRISPR gRNA sequence
ctctgcagtctaagctgagg

SEQ ID NO: 578742 - DNA, 20 bp, Artificial
  CRISPR gRNA sequence
tgcagtctaagctgaggcat

SEQ ID NO: 578743 - DNA, 20 bp, Artificial
  CRISPR gRNA sequence
cagtctaagctgaggcatgg

SEQ ID NO: 578744 - DNA, 20 bp, Artificial
  CRISPR gRNA sequence
agctgaggcatggatcaggg

SEQ ID NO: 578745 - DNA, 20 bp, Artificial
  CRISPR gRNA sequence
aggcatggatcagggctcag

SEQ ID NO: 578746 - DNA, 20 bp, Artificial
  CRISPR gRNA sequence
agggaatgggagtgaggtga

SEQ ID NO: 578747 - DNA, 20 bp, Artificial
  CRISPR gRNA sequence
ttggcaaggcagtgtgtgtg

SEQ ID NO: 578748 - DNA, 20 bp, Artificial
  CRISPR gRNA sequence
tggcaaggcagtgtgtgtgg

SEQ ID NO: 578749 - DNA, 20 bp, Artificial
  CRISPR gRNA sequence
ggcaaggcagtgtgtgtggc

SEQ ID NO: 578750 - DNA, 20 bp, Artificial
  CRISPR gRNA sequence
gcaaggcagtgtgtgtggct

SEQ ID NO: 578751 - DNA, 20 bp, Artificial
  CRISPR gRNA sequence
tgtgtgtctgcacgggactc

SEQ ID NO: 578752 - DNA, 20 bp, Artificial
  CRISPR gRNA sequence
cacgggactcaagagaccca

SEQ ID NO: 578753 - DNA, 20 bp, Artificial
  CRISPR gRNA sequence
aagagacccactggggggct

SEQ ID NO: 578754 - DNA, 20 bp, Artificial
  CRISPR gRNA sequence
gggggctgtgcgtgtgcata

SEQ ID NO: 578755 - DNA, 20 bp, Artificial
  CRISPR gRNA sequence
tgcgtgtgcatatgcgtgag

SEQ ID NO: 578756 - DNA, 20 bp, Artificial
  CRISPR gRNA sequence
taacaggccgtgtgtgtgag

SEQ ID NO: 578757 - DNA, 20 bp, Artificial
  CRISPR gRNA sequence
acaggccgtgtgtgtgagcg

SEQ ID NO: 578758 - DNA, 20 bp, Artificial
  CRISPR gRNA sequence
ggacctcagatcctgagggt

SEQ ID NO: 578759 - DNA, 20 bp, Artificial
  CRISPR gRNA sequence
agatcctgagggtactgacg

SEQ ID NO: 578760 - DNA, 20 bp, Artificial
  CRISPR gRNA sequence
agggtactgacgctgcttct

SEQ ID NO: 578761 - DNA, 20 bp, Artificial
  CRISPR gRNA sequence
acgctgcttctgtgtaggcc

SEQ ID NO: 578762 - DNA, 20 bp, Artificial
  CRISPR gRNA sequence
cttctgtgtaggcctctggg

SEQ ID NO: 578763 - DNA, 20 bp, Artificial
  CRISPR gRNA sequence
ctgtgtaggcctctgggcac

SEQ ID NO: 578764 - DNA, 20 bp, Artificial
  CRISPR gRNA sequence
tgtgtaggcctctgggcaca

SEQ ID NO: 578765 - DNA, 20 bp, Artificial
  CRISPR gRNA sequence
tgtaggcctctgggcacacc

SEQ ID NO: 578766 - DNA, 20 bp, Artificial
  CRISPR gRNA sequence
tgggcacacccctgtgttga

SEQ ID NO: 578767 - DNA, 20 bp, Artificial
  CRISPR gRNA sequence
ggcacacccctgtgttgaca

SEQ ID NO: 578768 - DNA, 20 bp, Artificial
  CRISPR gRNA sequence
tgttgacagtgcccctgtgg

SEQ ID NO: 578769 - DNA, 20 bp, Artificial
  CRISPR gRNA sequence
acagtgcccctgtgggccct

SEQ ID NO: 578770 - DNA, 20 bp, Artificial
  CRISPR gRNA sequence
tgggccctgaggctggctgt

SEQ ID NO: 578771 - DNA, 20 bp, Artificial
  CRISPR gRNA sequence
aggctggctgtgggtgcgtg

SEQ ID NO: 578772 - DNA, 20 bp, Artificial
  CRISPR gRNA sequence
gctgtgggtgcgtgccttgg

SEQ ID NO: 578773 - DNA, 20 bp, Artificial
  CRISPR gRNA sequence
tgggtgcgtgccttggggtg

SEQ ID NO: 578774 - DNA, 20 bp, Artificial
  CRISPR gRNA sequence
ggggtgtgtgggttgtcagg

SEQ ID NO: 578775 - DNA, 20 bp, Artificial
  CRISPR gRNA sequence
gggtgtgtgggttgtcaggg

SEQ ID NO: 578776 - DNA, 20 bp, Artificial
  CRISPR gRNA sequence
tcagggctgtgcttgtgtgt

SEQ ID NO: 578777 - DNA, 20 bp, Artificial
  CRISPR gRNA sequence
tgcttgtgtgtgattgtgtg

SEQ ID NO: 578778 - DNA, 20 bp, Artificial
  CRISPR gRNA sequence
gtgtgtgattgtgtgatgat

SEQ ID NO: 578779 - DNA, 20 bp, Artificial
  CRISPR gRNA sequence
tgtgtgattgtgtgatgatg

SEQ ID NO: 578780 - DNA, 20 bp, Artificial
  CRISPR gRNA sequence
tgtgatgatgcagctttgag

SEQ ID NO: 578781 - DNA, 20 bp, Artificial
  CRISPR gRNA sequence
tgaggttgtttgagtgtact

SEQ ID NO: 578782 - DNA, 20 bp, Artificial
  CRISPR gRNA sequence
gaggttgtttgagtgtactg

SEQ ID NO: 578783 - DNA, 20 bp, Artificial
  CRISPR gRNA sequence
aggttgtttgagtgtactga

SEQ ID NO: 578784 - DNA, 20 bp, Artificial
  CRISPR gRNA sequence
tttgagtgtactgaggcagg

SEQ ID NO: 578785 - DNA, 20 bp, Artificial
  CRISPR gRNA sequence
gagtgtactgaggcaggctc

SEQ ID NO: 578786 - DNA, 20 bp, Artificial
  CRISPR gRNA sequence
agtgtactgaggcaggctct

SEQ ID NO: 578787 - DNA, 20 bp, Artificial
  CRISPR gRNA sequence
aggcaggctctctgtgtttt

SEQ ID NO: 578788 - DNA, 20 bp, Artificial
  CRISPR gRNA sequence
tctgtgttttggggtttgtg

SEQ ID NO: 578789 - DNA, 20 bp, Artificial
  CRISPR gRNA sequence
tgtgttttggggtttgtgtt

SEQ ID NO: 578790 - DNA, 20 bp, Artificial
  CRISPR gRNA sequence
tgttttggggtttgtgttga

SEQ ID NO: 578791 - DNA, 20 bp, Artificial
  CRISPR gRNA sequence
tggggtttgtgttgagtgag

SEQ ID NO: 578792 - DNA, 20 bp, Artificial
  CRISPR gRNA sequence
ggggtttgtgttgagtgagg

SEQ ID NO: 578793 - DNA, 20 bp, Artificial
  CRISPR gRNA sequence
gggtttgtgttgagtgaggg

SEQ ID NO: 578794 - DNA, 20 bp, Artificial
  CRISPR gRNA sequence
gtgttgagtgagggacagga

SEQ ID NO: 578795 - DNA, 20 bp, Artificial
  CRISPR gRNA sequence
tgttgagtgagggacaggat

SEQ ID NO: 578796 - DNA, 20 bp, Artificial
  CRISPR gRNA sequence
agtgagggacaggattgtga

SEQ ID NO: 578797 - DNA, 20 bp, Artificial
  CRISPR gRNA sequence
tgacattttgtgtgtctgtg

SEQ ID NO: 578798 - DNA, 20 bp, Artificial
  CRISPR gRNA sequence
tgtgtgtctgtgtgactttt

SEQ ID NO: 578799 - DNA, 20 bp, Artificial
  CRISPR gRNA sequence
gtgtgtctgtgtgacttttc

SEQ ID NO: 578800 - DNA, 20 bp, Artificial
  CRISPR gRNA sequence
tgtgtctgtgtgacttttcc

SEQ ID NO: 578801 - DNA, 20 bp, Artificial
  CRISPR gRNA sequence
tgtgacttttccagccctga

SEQ ID NO: 578802 - DNA, 20 bp, Artificial
  CRISPR gRNA sequence
ttccagccctgaagtaatct

SEQ ID NO: 578803 - DNA, 20 bp, Artificial
  CRISPR gRNA sequence
tccagccctgaagtaatctg

SEQ ID NO: 578804 - DNA, 20 bp, Artificial
  CRISPR gRNA sequence
ccagccctgaagtaatctgt

SEQ ID NO: 578805 - DNA, 20 bp, Artificial
  CRISPR gRNA sequence
cagccctgaagtaatctgtg

SEQ ID NO: 578806 - DNA, 20 bp, Artificial
  CRISPR gRNA sequence
aagtaatctgtgcgagcagc

SEQ ID NO: 578807 - DNA, 20 bp, Artificial
  CRISPR gRNA sequence
tgcgagcagctgaggcaggc

SEQ ID NO: 578808 - DNA, 20 bp, Artificial
  CRISPR gRNA sequence
aggcaggctctgtgtggctg

SEQ ID NO: 578809 - DNA, 20 bp, Artificial
  CRISPR gRNA sequence
tgtgtggctggttgtgaagg

SEQ ID NO: 578810 - DNA, 20 bp, Artificial
  CRISPR gRNA sequence
tgtggctggttgtgaaggct

SEQ ID NO: 578811 - DNA, 20 bp, Artificial
  CRISPR gRNA sequence
gttgtgaaggctctgtttgg

SEQ ID NO: 578812 - DNA, 20 bp, Artificial
  CRISPR gRNA sequence
tgaaggctctgtttggctgc

SEQ ID NO: 578813 - DNA, 20 bp, Artificial
  CRISPR gRNA sequence
tgtttggctgcagggctcga

SEQ ID NO: 578814 - DNA, 20 bp, Artificial
  CRISPR gRNA sequence
tttggctgcagggctcgact

SEQ ID NO: 578815 - DNA, 20 bp, Artificial
  CRISPR gRNA sequence
ggctgcagggctcgactggg

SEQ ID NO: 578816 - DNA, 20 bp, Artificial
  CRISPR gRNA sequence
gctgcagggctcgactgggg

SEQ ID NO: 578817 - DNA, 20 bp, Artificial
  CRISPR gRNA sequence
cagggctcgactggggggtg

SEQ ID NO: 578818 - DNA, 20 bp, Artificial
  CRISPR gRNA sequence
gactggggggtgtgtctggg

SEQ ID NO: 578819 - DNA, 20 bp, Artificial
  CRISPR gRNA sequence
gggggtgtgtctggggcgga

SEQ ID NO: 578820 - DNA, 20 bp, Artificial
  CRISPR gRNA sequence
gggcggaggtgggggctggg

SEQ ID NO: 578821 - DNA, 20 bp, Artificial
  CRISPR gRNA sequence
gggccaggaccggggcccct

SEQ ID NO: 578822 - DNA, 20 bp, Artificial
  CRISPR gRNA sequence
tgagcagccttggggcaaag

SEQ ID NO: 578823 - DNA, 20 bp, Artificial
  CRISPR gRNA sequence
agcagccttggggcaaagga

SEQ ID NO: 578824 - DNA, 20 bp, Artificial
  CRISPR gRNA sequence
ggggcaaaggatatgatggg

SEQ ID NO: 578825 - DNA, 20 bp, Artificial
  CRISPR gRNA sequence
gggcaaaggatatgatgggg

SEQ ID NO: 578826 - DNA, 20 bp, Artificial
  CRISPR gRNA sequence
ccagcgggggaacaggggcc

SEQ ID NO: 578827 - DNA, 20 bp, Artificial
  CRISPR gRNA sequence
gcaggcaagacagtggaaac

SEQ ID NO: 578828 - DNA, 20 bp, Artificial
  CRISPR gRNA sequence
acttcttggtccctgtgggc

SEQ ID NO: 578829 - DNA, 20 bp, Artificial
  CRISPR gRNA sequence
cttggtccctgtgggcacat

SEQ ID NO: 578830 - DNA, 20 bp, Artificial
  CRISPR gRNA sequence
ttggtccctgtgggcacatc

SEQ ID NO: 578831 - DNA, 20 bp, Artificial
  CRISPR gRNA sequence
ggtccctgtgggcacatcca

SEQ ID NO: 578832 - DNA, 20 bp, Artificial
  CRISPR gRNA sequence
gtccctgtgggcacatccag

SEQ ID NO: 578833 - DNA, 20 bp, Artificial
  CRISPR gRNA sequence
tgggcacatccagggcctat

SEQ ID NO: 578834 - DNA, 20 bp, Artificial
  CRISPR gRNA sequence
tcatccctgcccccaccacc

SEQ ID NO: 578835 - DNA, 20 bp, Artificial
  CRISPR gRNA sequence
cccccaccacctctgcctcc

SEQ ID NO: 578836 - DNA, 20 bp, Artificial
  CRISPR gRNA sequence
tgcctcccaccagtttggcc

SEQ ID NO: 578837 - DNA, 20 bp, Artificial
  CRISPR gRNA sequence
cctcccaccagtttggcccc

SEQ ID NO: 578838 - DNA, 20 bp, Artificial
  CRISPR gRNA sequence
ccaccagtttggcccctgtt

SEQ ID NO: 578839 - DNA, 20 bp, Artificial
  CRISPR gRNA sequence
ggcccctgttcgtccatcct

SEQ ID NO: 578840 - DNA, 20 bp, Artificial
  CRISPR gRNA sequence
gcccctgttcgtccatcctc

SEQ ID NO: 578841 - DNA, 20 bp, Artificial
  CRISPR gRNA sequence
ttcgtccatcctcctttcct

SEQ ID NO: 578842 - DNA, 20 bp, Artificial
  CRISPR gRNA sequence
gtccatcctcctttccttga

SEQ ID NO: 578843 - DNA, 20 bp, Artificial
  CRISPR gRNA sequence
ctttccttgatcttgaggtc

SEQ ID NO: 578844 - DNA, 20 bp, Artificial
  CRISPR gRNA sequence
tccttgatcttgaggtcagg

SEQ ID NO: 578845 - DNA, 20 bp, Artificial
  CRISPR gRNA sequence
ccttgatcttgaggtcaggg

SEQ ID NO: 578846 - DNA, 20 bp, Artificial
  CRISPR gRNA sequence
cttgatcttgaggtcagggg

SEQ ID NO: 578847 - DNA, 20 bp, Artificial
  CRISPR gRNA sequence
gatcttgaggtcaggggcca

SEQ ID NO: 578848 - DNA, 20 bp, Artificial
  CRISPR gRNA sequence
atcttgaggtcaggggccag

SEQ ID NO: 578849 - DNA, 20 bp, Artificial
  CRISPR gRNA sequence
gaggtcaggggccaggtgta

SEQ ID NO: 578850 - DNA, 20 bp, Artificial
  CRISPR gRNA sequence
aggtcaggggccaggtgtag

SEQ ID NO: 578851 - DNA, 20 bp, Artificial
  CRISPR gRNA sequence
gaacacctgctgggcctctg

SEQ ID NO: 578852 - DNA, 20 bp, Artificial
  CRISPR gRNA sequence
ctgggcctctggctccgttt

SEQ ID NO: 578853 - DNA, 20 bp, Artificial
  CRISPR gRNA sequence
ggcctctggctccgtttctt

SEQ ID NO: 578854 - DNA, 20 bp, Artificial
  CRISPR gRNA sequence
tggctccgtttcttgcggaa

SEQ ID NO: 578855 - DNA, 20 bp, Artificial
  CRISPR gRNA sequence
gctccgtttcttgcggaact

SEQ ID NO: 578856 - DNA, 20 bp, Artificial
  CRISPR gRNA sequence
cgtttcttgcggaactccag

SEQ ID NO: 578857 - DNA, 20 bp, Artificial
  CRISPR gRNA sequence
cttgcggaactccagctcat

SEQ ID NO: 578858 - DNA, 20 bp, Artificial
  CRISPR gRNA sequence
ttgcggaactccagctcatc

SEQ ID NO: 578859 - DNA, 20 bp, Artificial
  CRISPR gRNA sequence
gcggaactccagctcatcca

SEQ ID NO: 578860 - DNA, 20 bp, Artificial
  CRISPR gRNA sequence
cggaactccagctcatccac

SEQ ID NO: 578861 - DNA, 20 bp, Artificial
  CRISPR gRNA sequence
cagctcatccacggtccaca

SEQ ID NO: 578862 - DNA, 20 bp, Artificial
  CRISPR gRNA sequence
atccacggtccacacagccc

SEQ ID NO: 578863 - DNA, 20 bp, Artificial
  CRISPR gRNA sequence
ctcgctctccacccgcacaa

SEQ ID NO: 578864 - DNA, 20 bp, Artificial
  CRISPR gRNA sequence
tcgctctccacccgcacaaa

SEQ ID NO: 578865 - DNA, 20 bp, Artificial
  CRISPR gRNA sequence
gctctccacccgcacaaagc

SEQ ID NO: 578866 - DNA, 20 bp, Artificial
  CRISPR gRNA sequence
tccacccgcacaaagcactt

SEQ ID NO: 578867 - DNA, 20 bp, Artificial
  CRISPR gRNA sequence
cacccgcacaaagcacttgt

SEQ ID NO: 578868 - DNA, 20 bp, Artificial
  CRISPR gRNA sequence
gtgcagactcaggttgtggc

SEQ ID NO: 578869 - DNA, 20 bp, Artificial
  CRISPR gRNA sequence
tgcagactcaggttgtggcg

SEQ ID NO: 578870 - DNA, 20 bp, Artificial
  CRISPR gRNA sequence
aggttgtggcggatggcgtt

SEQ ID NO: 578871 - DNA, 20 bp, Artificial
  CRISPR gRNA sequence
tggcggatggcgttctgtgg

SEQ ID NO: 578872 - DNA, 20 bp, Artificial
  CRISPR gRNA sequence
tgtggaaggccggggacagg

SEQ ID NO: 578873 - DNA, 20 bp, Artificial
  CRISPR gRNA sequence
tggaaggccggggacaggga

SEQ ID NO: 578874 - DNA, 20 bp, Artificial
  CRISPR gRNA sequence
tgaggccagcagccaccacc

SEQ ID NO: 578875 - DNA, 20 bp, Artificial
  CRISPR gRNA sequence
aggccagcagccaccaccaa

SEQ ID NO: 578876 - DNA, 20 bp, Artificial
  CRISPR gRNA sequence
ctccccaatgtgcctatgag

SEQ ID NO: 578877 - DNA, 20 bp, Artificial
  CRISPR gRNA sequence
cccaatgtgcctatgagccc

SEQ ID NO: 578878 - DNA, 20 bp, Artificial
  CRISPR gRNA sequence
tgagcccagacccaggcctg

SEQ ID NO: 578879 - DNA, 20 bp, Artificial
  CRISPR gRNA sequence
cccactttgagctgcgatgg

SEQ ID NO: 578880 - DNA, 20 bp, Artificial
  CRISPR gRNA sequence
tgagctgcgatggcacttga

SEQ ID NO: 578881 - DNA, 20 bp, Artificial
  CRISPR gRNA sequence
gagctgcgatggcacttgag

SEQ ID NO: 578882 - DNA, 20 bp, Artificial
  CRISPR gRNA sequence
agctgcgatggcacttgagg

SEQ ID NO: 578883 - DNA, 20 bp, Artificial
  CRISPR gRNA sequence
cgatggcacttgaggccatc

SEQ ID NO: 578884 - DNA, 20 bp, Artificial
  CRISPR gRNA sequence
gaggccatcccagtcaccgc

SEQ ID NO: 578885 - DNA, 20 bp, Artificial
  CRISPR gRNA sequence
aggccatcccagtcaccgcc

SEQ ID NO: 578886 - DNA, 20 bp, Artificial
  CRISPR gRNA sequence
agaggagctcaccttccagg

SEQ ID NO: 578887 - DNA, 20 bp, Artificial
  CRISPR gRNA sequence
accttccaggtggcaggatg

SEQ ID NO: 578888 - DNA, 20 bp, Artificial
  CRISPR gRNA sequence
ccaggtggcaggatggtttc

SEQ ID NO: 578889 - DNA, 20 bp, Artificial
  CRISPR gRNA sequence
caggtggcaggatggtttct

SEQ ID NO: 578890 - DNA, 20 bp, Artificial
  CRISPR gRNA sequence
ctgaagaaggcaaacatgcg

SEQ ID NO: 578891 - DNA, 20 bp, Artificial
  CRISPR gRNA sequence
tgaagaaggcaaacatgcgt

SEQ ID NO: 578892 - DNA, 20 bp, Artificial
  CRISPR gRNA sequence
aagaaggcaaacatgcgtgt

SEQ ID NO: 578893 - DNA, 20 bp, Artificial
  CRISPR gRNA sequence
attgagtgtccgctgcttct

SEQ ID NO: 578894 - DNA, 20 bp, Artificial
  CRISPR gRNA sequence
agtgtccgctgcttctctgg

SEQ ID NO: 578895 - DNA, 20 bp, Artificial
  CRISPR gRNA sequence
cttctctggagcctccagga

SEQ ID NO: 578896 - DNA, 20 bp, Artificial
  CRISPR gRNA sequence
ctctggagcctccaggatgg

SEQ ID NO: 578897 - DNA, 20 bp, Artificial
  CRISPR gRNA sequence
tctggagcctccaggatggc

SEQ ID NO: 578898 - DNA, 20 bp, Artificial
  CRISPR gRNA sequence
tggagcctccaggatggcct

SEQ ID NO: 578899 - DNA, 20 bp, Artificial
  CRISPR gRNA sequence
gagcctccaggatggcctgg

SEQ ID NO: 578900 - DNA, 20 bp, Artificial
  CRISPR gRNA sequence
caggatggcctggaagttgg

SEQ ID NO: 578901 - DNA, 20 bp, Artificial
  CRISPR gRNA sequence
gaagttggggggtggggtaa

SEQ ID NO: 578902 - DNA, 20 bp, Artificial
  CRISPR gRNA sequence
gggggtggggtaaggggcac

SEQ ID NO: 578903 - DNA, 20 bp, Artificial
  CRISPR gRNA sequence
cccaaacttggggtttagag

SEQ ID NO: 578904 - DNA, 20 bp, Artificial
  CRISPR gRNA sequence
ggggtttagaggggctatga

SEQ ID NO: 578905 - DNA, 20 bp, Artificial
  CRISPR gRNA sequence
gggtttagaggggctatgac

SEQ ID NO: 578906 - DNA, 20 bp, Artificial
  CRISPR gRNA sequence
agaggggctatgacctaccc

SEQ ID NO: 578907 - DNA, 20 bp, Artificial
  CRISPR gRNA sequence
gaggggctatgacctacccc

SEQ ID NO: 578908 - DNA, 20 bp, Artificial
  CRISPR gRNA sequence
tgacctaccccgagccatct

SEQ ID NO: 578909 - DNA, 20 bp, Artificial
  CRISPR gRNA sequence
ccccgagccatctgacatgg

SEQ ID NO: 578910 - DNA, 20 bp, Artificial
  CRISPR gRNA sequence
acatgggggcggaattgtag

SEQ ID NO: 578911 - DNA, 20 bp, Artificial
  CRISPR gRNA sequence
taggggcaggtaatcaggga

SEQ ID NO: 578912 - DNA, 20 bp, Artificial
  CRISPR gRNA sequence
gatgtggggtgaagcatggg

SEQ ID NO: 578913 - DNA, 20 bp, Artificial
  CRISPR gRNA sequence
gaaaaggggtgaagtgtcgg

SEQ ID NO: 578914 - DNA, 20 bp, Artificial
  CRISPR gRNA sequence
ggcagggttagatgggtgtg

SEQ ID NO: 578915 - DNA, 20 bp, Artificial
  CRISPR gRNA sequence
gatgggtgtgggtatggttg

SEQ ID NO: 578916 - DNA, 20 bp, Artificial
  CRISPR gRNA sequence
ttctgggattaggtaaggga

SEQ ID NO: 578917 - DNA, 20 bp, Artificial
  CRISPR gRNA sequence
tgggattaggtaagggatca

SEQ ID NO: 578918 - DNA, 20 bp, Artificial
  CRISPR gRNA sequence
ggattaggtaagggatcagg

SEQ ID NO: 578919 - DNA, 20 bp, Artificial
  CRISPR gRNA sequence
ggtaagggatcaggactgag

SEQ ID NO: 578920 - DNA, 20 bp, Artificial
  CRISPR gRNA sequence
aggttgggagtggggtcttg

SEQ ID NO: 578921 - DNA, 20 bp, Artificial
  CRISPR gRNA sequence
ggagtggggtcttgttcagg

SEQ ID NO: 578922 - DNA, 20 bp, Artificial
  CRISPR gRNA sequence
gttcagggctagggctgaag

SEQ ID NO: 578923 - DNA, 20 bp, Artificial
  CRISPR gRNA sequence
ttcagggctagggctgaagt

SEQ ID NO: 578924 - DNA, 20 bp, Artificial
  CRISPR gRNA sequence
agggctagggctgaagtgag

SEQ ID NO: 578925 - DNA, 20 bp, Artificial
  CRISPR gRNA sequence
gggctgaagtgaggtgaaag

SEQ ID NO: 578926 - DNA, 20 bp, Artificial
  CRISPR gRNA sequence
aagtgaggtgaaaggtctgg

SEQ ID NO: 578927 - DNA, 20 bp, Artificial
  CRISPR gRNA sequence
ggatggagttggagttgggg

SEQ ID NO: 578928 - DNA, 20 bp, Artificial
  CRISPR gRNA sequence
gagttggggttctctgtgga

SEQ ID NO: 578929 - DNA, 20 bp, Artificial
  CRISPR gRNA sequence
gggttctctgtggaggtgac

SEQ ID NO: 578930 - DNA, 20 bp, Artificial
  CRISPR gRNA sequence
tctgtggaggtgacatttca

SEQ ID NO: 578931 - DNA, 20 bp, Artificial
  CRISPR gRNA sequence
tgtggaggtgacatttcagg

SEQ ID NO: 578932 - DNA, 20 bp, Artificial
  CRISPR gRNA sequence
tggaggtgacatttcagggt

SEQ ID NO: 578933 - DNA, 20 bp, Artificial
  CRISPR gRNA sequence
cagggttggggaaggtgaag

SEQ ID NO: 578934 - DNA, 20 bp, Artificial
  CRISPR gRNA sequence
agggttggggaaggtgaagg

SEQ ID NO: 578935 - DNA, 20 bp, Artificial
  CRISPR gRNA sequence
gggaaggtgaagggtcagaa

SEQ ID NO: 578936 - DNA, 20 bp, Artificial
  CRISPR gRNA sequence
ggaaggggtaaagggccagg

SEQ ID NO: 578937 - DNA, 20 bp, Artificial
  CRISPR gRNA sequence
gaaggggtaaagggccaggc

SEQ ID NO: 578938 - DNA, 20 bp, Artificial
  CRISPR gRNA sequence
aagggtcagggaaggggtgg

SEQ ID NO: 578939 - DNA, 20 bp, Artificial
  CRISPR gRNA sequence
agggtcagggaaggggtggg

SEQ ID NO: 578940 - DNA, 20 bp, Artificial
  CRISPR gRNA sequence
agagtcaggctggggtggac

SEQ ID NO: 578941 - DNA, 20 bp, Artificial
  CRISPR gRNA sequence
gggtggactcaggtgggggg

SEQ ID NO: 578942 - DNA, 20 bp, Artificial
  CRISPR gRNA sequence
aggtggggggtctaggggtg

SEQ ID NO: 578943 - DNA, 20 bp, Artificial
  CRISPR gRNA sequence
ggggtgagggatgggatgac

SEQ ID NO: 578944 - DNA, 20 bp, Artificial
  CRISPR gRNA sequence
ggctttaggtcagaagccag

SEQ ID NO: 578945 - DNA, 20 bp, Artificial
  CRISPR gRNA sequence
gctttaggtcagaagccaga

SEQ ID NO: 578946 - DNA, 20 bp, Artificial
  CRISPR gRNA sequence
taggtcagaagccagagatg

SEQ ID NO: 578947 - DNA, 20 bp, Artificial
  CRISPR gRNA sequence
aggtcagaagccagagatgg

SEQ ID NO: 578948 - DNA, 20 bp, Artificial
  CRISPR gRNA sequence
ggtcagaagccagagatggt

SEQ ID NO: 578949 - DNA, 20 bp, Artificial
  CRISPR gRNA sequence
gaattatcgagtatcttacg

SEQ ID NO: 578950 - DNA, 20 bp, Artificial
  CRISPR gRNA sequence
aattatcgagtatcttacgt

SEQ ID NO: 578951 - DNA, 20 bp, Artificial
  CRISPR gRNA sequence
tcgagtatcttacgtgtcag

SEQ ID NO: 578952 - DNA, 20 bp, Artificial
  CRISPR gRNA sequence
acgtgtcagggacatggtta

SEQ ID NO: 578953 - DNA, 20 bp, Artificial
  CRISPR gRNA sequence
cgtgtcagggacatggttag

SEQ ID NO: 578954 - DNA, 20 bp, Artificial
  CRISPR gRNA sequence
ggtggttaggctcagggcaa

SEQ ID NO: 578955 - DNA, 20 bp, Artificial
  CRISPR gRNA sequence
ggctcagggcaaggatgagg

SEQ ID NO: 578956 - DNA, 20 bp, Artificial
  CRISPR gRNA sequence
agggcaaggatgaggttagt

SEQ ID NO: 578957 - DNA, 20 bp, Artificial
  CRISPR gRNA sequence
gttgtggggttcggtgtgga

SEQ ID NO: 578958 - DNA, 20 bp, Artificial
  CRISPR gRNA sequence
tggggttcggtgtggagtga

SEQ ID NO: 578959 - DNA, 20 bp, Artificial
  CRISPR gRNA sequence
ggtgtggagtgaggctgagg

SEQ ID NO: 578960 - DNA, 20 bp, Artificial
  CRISPR gRNA sequence
agggtcagggaatttgatca

SEQ ID NO: 578961 - DNA, 20 bp, Artificial
  CRISPR gRNA sequence
gatcagtttggattcaggaa

SEQ ID NO: 578962 - DNA, 20 bp, Artificial
  CRISPR gRNA sequence
atcagtttggattcaggaat

SEQ ID NO: 578963 - DNA, 20 bp, Artificial
  CRISPR gRNA sequence
ggattcaggaatgggattac

SEQ ID NO: 578964 - DNA, 20 bp, Artificial
  CRISPR gRNA sequence
gattcaggaatgggattaca

SEQ ID NO: 578965 - DNA, 20 bp, Artificial
  CRISPR gRNA sequence
aggaatgggattacagagtc

SEQ ID NO: 578966 - DNA, 20 bp, Artificial
  CRISPR gRNA sequence
cagagtcagcgatgatgatt

SEQ ID NO: 578967 - DNA, 20 bp, Artificial
  CRISPR gRNA sequence
cagtgaggctatcagtcagg

SEQ ID NO: 578968 - DNA, 20 bp, Artificial
  CRISPR gRNA sequence
tcagtcaggatggggctagg

SEQ ID NO: 578969 - DNA, 20 bp, Artificial
  CRISPR gRNA sequence
ggtcagggtttcagttcaga

SEQ ID NO: 578970 - DNA, 20 bp, Artificial
  CRISPR gRNA sequence
cagttcagagacagtcgggg

SEQ ID NO: 578971 - DNA, 20 bp, Artificial
  CRISPR gRNA sequence
agttcagagacagtcgggga

SEQ ID NO: 578972 - DNA, 20 bp, Artificial
  CRISPR gRNA sequence
agagacagtcggggaatatc

SEQ ID NO: 578973 - DNA, 20 bp, Artificial
  CRISPR gRNA sequence
gtatcatgtaggggtgaggt

SEQ ID NO: 578974 - DNA, 20 bp, Artificial
  CRISPR gRNA sequence
aggtttggggttaggtgtgg

SEQ ID NO: 578975 - DNA, 20 bp, Artificial
  CRISPR gRNA sequence
ggggttaggtgtggcgctag

SEQ ID NO: 578976 - DNA, 20 bp, Artificial
  CRISPR gRNA sequence
gggttaggtgtggcgctagg

SEQ ID NO: 578977 - DNA, 20 bp, Artificial
  CRISPR gRNA sequence
ggtgtggcgctaggatgaag

SEQ ID NO: 578978 - DNA, 20 bp, Artificial
  CRISPR gRNA sequence
ggatgaaggttctgagaagg

SEQ ID NO: 578979 - DNA, 20 bp, Artificial
  CRISPR gRNA sequence
tgagaaggcattggggaggc

SEQ ID NO: 578980 - DNA, 20 bp, Artificial
  CRISPR gRNA sequence
agaaggcattggggaggctg

SEQ ID NO: 578981 - DNA, 20 bp, Artificial
  CRISPR gRNA sequence
gggaggctgagatgaaggag

SEQ ID NO: 578982 - DNA, 20 bp, Artificial
  CRISPR gRNA sequence
agatgaaggagttgggatgg

SEQ ID NO: 578983 - DNA, 20 bp, Artificial
  CRISPR gRNA sequence
ggatggggtgatgaagttaa

SEQ ID NO: 578984 - DNA, 20 bp, Artificial
  CRISPR gRNA sequence
aggatcaaatgggtgttaca

SEQ ID NO: 578985 - DNA, 20 bp, Artificial
  CRISPR gRNA sequence
caaggaaaggttgggaatgg

SEQ ID NO: 578986 - DNA, 20 bp, Artificial
  CRISPR gRNA sequence
ggaatggtgcccagttgggg

SEQ ID NO: 578987 - DNA, 20 bp, Artificial
  CRISPR gRNA sequence
ggggtgtattgacatactgg

SEQ ID NO: 578988 - DNA, 20 bp, Artificial
  CRISPR gRNA sequence
acatactggggtacgttggg

SEQ ID NO: 578989 - DNA, 20 bp, Artificial
  CRISPR gRNA sequence
gggtacgttggggccaggga

SEQ ID NO: 578990 - DNA, 20 bp, Artificial
  CRISPR gRNA sequence
gggccagggaaggagatggg

SEQ ID NO: 578991 - DNA, 20 bp, Artificial
  CRISPR gRNA sequence
ggttggcataaaggctgggg

SEQ ID NO: 578992 - DNA, 20 bp, Artificial
  CRISPR gRNA sequence
gcataaaggctggggaagga

SEQ ID NO: 578993 - DNA, 20 bp, Artificial
  CRISPR gRNA sequence
gggaaggagttagagtaaga

SEQ ID NO: 578994 - DNA, 20 bp, Artificial
  CRISPR gRNA sequence
gagtaagagctggggtacgt

SEQ ID NO: 578995 - DNA, 20 bp, Artificial
  CRISPR gRNA sequence
gggtacgtttagggcaaggt

SEQ ID NO: 578996 - DNA, 20 bp, Artificial
  CRISPR gRNA sequence
agggcaaggtgcagagatgg

SEQ ID NO: 578997 - DNA, 20 bp, Artificial
  CRISPR gRNA sequence
gggcaaggtgcagagatggg

SEQ ID NO: 578998 - DNA, 20 bp, Artificial
  CRISPR gRNA sequence
gctttaggctattttatggg

SEQ ID NO: 578999 - DNA, 20 bp, Artificial
  CRISPR gRNA sequence
taggctattttatgggtcca

SEQ ID NO: 579000 - DNA, 20 bp, Artificial
  CRISPR gRNA sequence
aggctattttatgggtccag

SEQ ID NO: 579001 - DNA, 20 bp, Artificial
  CRISPR gRNA sequence
ggctattttatgggtccagg

SEQ ID NO: 579002 - DNA, 20 bp, Artificial
  CRISPR gRNA sequence
ttttatgggtccaggagagg

SEQ ID NO: 579003 - DNA, 20 bp, Artificial
  CRISPR gRNA sequence
tatgggtccaggagagggtt

SEQ ID NO: 579004 - DNA, 20 bp, Artificial
  CRISPR gRNA sequence
atgggtccaggagagggtta

SEQ ID NO: 579005 - DNA, 20 bp, Artificial
  CRISPR gRNA sequence
tgggtccaggagagggttag

SEQ ID NO: 579006 - DNA, 20 bp, Artificial
  CRISPR gRNA sequence
ggtatggggctgaggtggac

SEQ ID NO: 579007 - DNA, 20 bp, Artificial
  CRISPR gRNA sequence
aggtggacatctggaaaggg

SEQ ID NO: 579008 - DNA, 20 bp, Artificial
  CRISPR gRNA sequence
gaaaggggtaggtttagggt

SEQ ID NO: 579009 - DNA, 20 bp, Artificial
  CRISPR gRNA sequence
agggtcagaatttggcatgc

SEQ ID NO: 579010 - DNA, 20 bp, Artificial
  CRISPR gRNA sequence
gggtcagaatttggcatgct

SEQ ID NO: 579011 - DNA, 20 bp, Artificial
  CRISPR gRNA sequence
ggcatgctctggcctggatg

SEQ ID NO: 579012 - DNA, 20 bp, Artificial
  CRISPR gRNA sequence
gcatgctctggcctggatgg

SEQ ID NO: 579013 - DNA, 20 bp, Artificial
  CRISPR gRNA sequence
tggcctggatggtggtttag

SEQ ID NO: 579014 - DNA, 20 bp, Artificial
  CRISPR gRNA sequence
gcctggatggtggtttaggt

SEQ ID NO: 579015 - DNA, 20 bp, Artificial
  CRISPR gRNA sequence
gatggtggtttaggtttgga

SEQ ID NO: 579016 - DNA, 20 bp, Artificial
  CRISPR gRNA sequence
aggtttggatttgcggacag

SEQ ID NO: 579017 - DNA, 20 bp, Artificial
  CRISPR gRNA sequence
ggtttggatttgcggacagg

SEQ ID NO: 579018 - DNA, 20 bp, Artificial
  CRISPR gRNA sequence
ggatttgcggacaggtttgg

SEQ ID NO: 579019 - DNA, 20 bp, Artificial
  CRISPR gRNA sequence
gatttgcggacaggtttggg

SEQ ID NO: 579020 - DNA, 20 bp, Artificial
  CRISPR gRNA sequence
gcggacaggtttggggtgaa

SEQ ID NO: 579021 - DNA, 20 bp, Artificial
  CRISPR gRNA sequence
cggacaggtttggggtgaag

SEQ ID NO: 579022 - DNA, 20 bp, Artificial
  CRISPR gRNA sequence
ggggtgaagccagcatgagg

SEQ ID NO: 579023 - DNA, 20 bp, Artificial
  CRISPR gRNA sequence
gggtgaagccagcatgaggg

SEQ ID NO: 579024 - DNA, 20 bp, Artificial
  CRISPR gRNA sequence
gaggcacggcttggggatcc

SEQ ID NO: 579025 - DNA, 20 bp, Artificial
  CRISPR gRNA sequence
aggcacggcttggggatcct

SEQ ID NO: 579026 - DNA, 20 bp, Artificial
  CRISPR gRNA sequence
ggggatccttggggctgggg

SEQ ID NO: 579027 - DNA, 20 bp, Artificial
  CRISPR gRNA sequence
gggatccttggggctggggc

SEQ ID NO: 579028 - DNA, 20 bp, Artificial
  CRISPR gRNA sequence
ggggctggggcttgggaatg

SEQ ID NO: 579029 - DNA, 20 bp, Artificial
  CRISPR gRNA sequence
gggctggggcttgggaatgg

SEQ ID NO: 579030 - DNA, 20 bp, Artificial
  CRISPR gRNA sequence
gggcttgggaatggaggaac

SEQ ID NO: 579031 - DNA, 20 bp, Artificial
  CRISPR gRNA sequence
gggaatggaggaacccactc

SEQ ID NO: 579032 - DNA, 20 bp, Artificial
  CRISPR gRNA sequence
ggaatggaggaacccactct

SEQ ID NO: 579033 - DNA, 20 bp, Artificial
  CRISPR gRNA sequence
tgagggcactcagagggaga

SEQ ID NO: 579034 - DNA, 20 bp, Artificial
  CRISPR gRNA sequence
agggcactcagagggagaca

SEQ ID NO: 579035 - DNA, 20 bp, Artificial
  CRISPR gRNA sequence
agagggagacaggagtttgg

SEQ ID NO: 579036 - DNA, 20 bp, Artificial
  CRISPR gRNA sequence
gggaggcaggtcccccaccc

SEQ ID NO: 579037 - DNA, 20 bp, Artificial
  CRISPR gRNA sequence
ggaggcaggtcccccacccc

SEQ ID NO: 579038 - DNA, 20 bp, Artificial
  CRISPR gRNA sequence
tgtcttcctcctccttgggg

SEQ ID NO: 579039 - DNA, 20 bp, Artificial
  CRISPR gRNA sequence
gtcttcctcctccttggggc

SEQ ID NO: 579040 - DNA, 20 bp, Artificial
  CRISPR gRNA sequence
tcttcctcctccttggggcc

SEQ ID NO: 579041 - DNA, 20 bp, Artificial
  CRISPR gRNA sequence
cctcctccttggggccgagc

SEQ ID NO: 579042 - DNA, 20 bp, Artificial
  CRISPR gRNA sequence
ctcctccttggggccgagct

SEQ ID NO: 579043 - DNA, 20 bp, Artificial
  CRISPR gRNA sequence
ctccttggggccgagctgcc

SEQ ID NO: 579044 - DNA, 20 bp, Artificial
  CRISPR gRNA sequence
cttggggccgagctgccctg

SEQ ID NO: 579045 - DNA, 20 bp, Artificial
  CRISPR gRNA sequence
ggggccgagctgccctgctt

SEQ ID NO: 579046 - DNA, 20 bp, Artificial
  CRISPR gRNA sequence
gggccgagctgccctgctta

SEQ ID NO: 579047 - DNA, 20 bp, Artificial
  CRISPR gRNA sequence
ccctgcttacccagcggatg

SEQ ID NO: 579048 - DNA, 20 bp, Artificial
  CRISPR gRNA sequence
cttacccagcggatgagcgt

SEQ ID NO: 579049 - DNA, 20 bp, Artificial
  CRISPR gRNA sequence
acccagcggatgagcgtggc

SEQ ID NO: 579050 - DNA, 20 bp, Artificial
  CRISPR gRNA sequence
cccagcggatgagcgtggcg

SEQ ID NO: 579051 - DNA, 20 bp, Artificial
  CRISPR gRNA sequence
tggaacttgaagtagtccat

SEQ ID NO: 579052 - DNA, 20 bp, Artificial
  CRISPR gRNA sequence
gaagtagtccatgttgtgga

SEQ ID NO: 579053 - DNA, 20 bp, Artificial
  CRISPR gRNA sequence
aagtagtccatgttgtggag

SEQ ID NO: 579054 - DNA, 20 bp, Artificial
  CRISPR gRNA sequence
tggaggaactctgtcagagg

SEQ ID NO: 579055 - DNA, 20 bp, Artificial
  CRISPR gRNA sequence
tgtcagagggtggggatgaa

SEQ ID NO: 579056 - DNA, 20 bp, Artificial
  CRISPR gRNA sequence
tcagagggtggggatgaatc

SEQ ID NO: 579057 - DNA, 20 bp, Artificial
  CRISPR gRNA sequence
ctagctagctccctgtcccc

SEQ ID NO: 579058 - DNA, 20 bp, Artificial
  CRISPR gRNA sequence
gctagctccctgtcccctcc

SEQ ID NO: 579059 - DNA, 20 bp, Artificial
  CRISPR gRNA sequence
gctccctgtcccctccccct

SEQ ID NO: 579060 - DNA, 20 bp, Artificial
  CRISPR gRNA sequence
cctgtcccctccccctacaa

SEQ ID NO: 579061 - DNA, 20 bp, Artificial
  CRISPR gRNA sequence
tcccctccccctacaaggtg

SEQ ID NO: 579062 - DNA, 20 bp, Artificial
  CRISPR gRNA sequence
cccctacaaggtgagtctac

SEQ ID NO: 579063 - DNA, 20 bp, Artificial
  CRISPR gRNA sequence
caaggtgagtctacaggcct

SEQ ID NO: 579064 - DNA, 20 bp, Artificial
  CRISPR gRNA sequence
caggcctgagatctcaccgt

SEQ ID NO: 579065 - DNA, 20 bp, Artificial
  CRISPR gRNA sequence
agatctcaccgtcaacaccc

SEQ ID NO: 579066 - DNA, 20 bp, Artificial
  CRISPR gRNA sequence
accgtcaacacccgtgtcca

SEQ ID NO: 579067 - DNA, 20 bp, Artificial
  CRISPR gRNA sequence
tttgctgagcacctgacata

SEQ ID NO: 579068 - DNA, 20 bp, Artificial
  CRISPR gRNA sequence
gctgagcacctgacataagt

SEQ ID NO: 579069 - DNA, 20 bp, Artificial
  CRISPR gRNA sequence
ctgagcacctgacataagtt

SEQ ID NO: 579070 - DNA, 20 bp, Artificial
  CRISPR gRNA sequence
agcacctgacataagttgta

SEQ ID NO: 579071 - DNA, 20 bp, Artificial
  CRISPR gRNA sequence
acataagttgtatcatttat

SEQ ID NO: 579072 - DNA, 20 bp, Artificial
  CRISPR gRNA sequence
tatcatttattctttgcacc

SEQ ID NO: 579073 - DNA, 20 bp, Artificial
  CRISPR gRNA sequence
attctttgcaccacttctgc

SEQ ID NO: 579074 - DNA, 20 bp, Artificial
  CRISPR gRNA sequence
ttctttgcaccacttctgcc

SEQ ID NO: 579075 - DNA, 20 bp, Artificial
  CRISPR gRNA sequence
tttgcaccacttctgccaaa

SEQ ID NO: 579076 - DNA, 20 bp, Artificial
  CRISPR gRNA sequence
tgcaccacttctgccaaaat

SEQ ID NO: 579077 - DNA, 20 bp, Artificial
  CRISPR gRNA sequence
gcaccacttctgccaaaata

SEQ ID NO: 579078 - DNA, 20 bp, Artificial
  CRISPR gRNA sequence
caccacttctgccaaaatag

SEQ ID NO: 579079 - DNA, 20 bp, Artificial
  CRISPR gRNA sequence
ctgccaaaatagttctcccc

SEQ ID NO: 579080 - DNA, 20 bp, Artificial
  CRISPR gRNA sequence
tgccaaaatagttctccccg

SEQ ID NO: 579081 - DNA, 20 bp, Artificial
  CRISPR gRNA sequence
ccaaaatagttctccccgag

SEQ ID NO: 579082 - DNA, 20 bp, Artificial
  CRISPR gRNA sequence
tccccgaggttgaaaagaag

SEQ ID NO: 579083 - DNA, 20 bp, Artificial
  CRISPR gRNA sequence
cccgaggttgaaaagaagcg

SEQ ID NO: 579084 - DNA, 20 bp, Artificial
  CRISPR gRNA sequence
aaaagaagcggagtaacttg

SEQ ID NO: 579085 - DNA, 20 bp, Artificial
  CRISPR gRNA sequence
gcacaccaaaggatgcaaga

SEQ ID NO: 579086 - DNA, 20 bp, Artificial
  CRISPR gRNA sequence
cacaccaaaggatgcaagag

SEQ ID NO: 579087 - DNA, 20 bp, Artificial
  CRISPR gRNA sequence
aatggcagagccaggatgac

SEQ ID NO: 579088 - DNA, 20 bp, Artificial
  CRISPR gRNA sequence
tgatccctgctaagcccaca

SEQ ID NO: 579089 - DNA, 20 bp, Artificial
  CRISPR gRNA sequence
atccctgctaagcccacagg

SEQ ID NO: 579090 - DNA, 20 bp, Artificial
  CRISPR gRNA sequence
ctaagcccacaggccaggcc

SEQ ID NO: 579091 - DNA, 20 bp, Artificial
  CRISPR gRNA sequence
agcccacaggccaggcctgg

SEQ ID NO: 579092 - DNA, 20 bp, Artificial
  CRISPR gRNA sequence
gtggagagcagtggataggt

SEQ ID NO: 579093 - DNA, 20 bp, Artificial
  CRISPR gRNA sequence
gggcgaatccaccccgattt

SEQ ID NO: 579094 - DNA, 20 bp, Artificial
  CRISPR gRNA sequence
tccttggtcaggggaggaaa

SEQ ID NO: 579095 - DNA, 20 bp, Artificial
  CRISPR gRNA sequence
ccttggtcaggggaggaaag

SEQ ID NO: 579096 - DNA, 20 bp, Artificial
  CRISPR gRNA sequence
cttggtcaggggaggaaagg

SEQ ID NO: 579097 - DNA, 20 bp, Artificial
  CRISPR gRNA sequence
ggtcaggggaggaaaggagg

SEQ ID NO: 579098 - DNA, 20 bp, Artificial
  CRISPR gRNA sequence
gtcaggggaggaaaggaggt

SEQ ID NO: 579099 - DNA, 20 bp, Artificial
  CRISPR gRNA sequence
ctggaattacttagcagggt

SEQ ID NO: 579100 - DNA, 20 bp, Artificial
  CRISPR gRNA sequence
gaattacttagcagggtccc

SEQ ID NO: 579101 - DNA, 20 bp, Artificial
  CRISPR gRNA sequence
cttagcagggtccctccctt

SEQ ID NO: 579102 - DNA, 20 bp, Artificial
  CRISPR gRNA sequence
agcagggtccctcccttctg

SEQ ID NO: 579103 - DNA, 20 bp, Artificial
  CRISPR gRNA sequence
gcagggtccctcccttctga

SEQ ID NO: 579104 - DNA, 20 bp, Artificial
  CRISPR gRNA sequence
ccttctgatggccgaatata

SEQ ID NO: 579105 - DNA, 20 bp, Artificial
  CRISPR gRNA sequence
ctgatggccgaatatagtag

SEQ ID NO: 579106 - DNA, 20 bp, Artificial
  CRISPR gRNA sequence
tgatggccgaatatagtagc

SEQ ID NO: 579107 - DNA, 20 bp, Artificial
  CRISPR gRNA sequence
atggccgaatatagtagctg

SEQ ID NO: 579108 - DNA, 20 bp, Artificial
  CRISPR gRNA sequence
gagtccagagtgggtgaggc

SEQ ID NO: 579109 - DNA, 20 bp, Artificial
  CRISPR gRNA sequence
ggggcccgacactcgagacc

SEQ ID NO: 579110 - DNA, 20 bp, Artificial
  CRISPR gRNA sequence
gagaccatatggggggcttt

SEQ ID NO: 579111 - DNA, 20 bp, Artificial
  CRISPR gRNA sequence
tcaggccacggacatcccga

SEQ ID NO: 579112 - DNA, 20 bp, Artificial
  CRISPR gRNA sequence
caggccacggacatcccgaa

SEQ ID NO: 579113 - DNA, 20 bp, Artificial
  CRISPR gRNA sequence
aggccacggacatcccgaaa

SEQ ID NO: 579114 - DNA, 20 bp, Artificial
  CRISPR gRNA sequence
ttgtgagcggatgcattttc

SEQ ID NO: 579115 - DNA, 20 bp, Artificial
  CRISPR gRNA sequence
tgtgagcggatgcattttcc

SEQ ID NO: 579116 - DNA, 20 bp, Artificial
  CRISPR gRNA sequence
gtgagcggatgcattttccc

SEQ ID NO: 579117 - DNA, 20 bp, Artificial
  CRISPR gRNA sequence
tgagcggatgcattttccca

SEQ ID NO: 579118 - DNA, 20 bp, Artificial
  CRISPR gRNA sequence
tcccaaaggctgagtggcgg

SEQ ID NO: 579119 - DNA, 20 bp, Artificial
  CRISPR gRNA sequence
cccaaaggctgagtggcggc

SEQ ID NO: 579120 - DNA, 20 bp, Artificial
  CRISPR gRNA sequence
ccaaaggctgagtggcggca

SEQ ID NO: 579121 - DNA, 20 bp, Artificial
  CRISPR gRNA sequence
agtggcggcagctgcagtgg

SEQ ID NO: 579122 - DNA, 20 bp, Artificial
  CRISPR gRNA sequence
cagtggtggtggtggtggga

SEQ ID NO: 579123 - DNA, 20 bp, Artificial
  CRISPR gRNA sequence
ctttgcaccctccacccaga

SEQ ID NO: 579124 - DNA, 20 bp, Artificial
  CRISPR gRNA sequence
tgcaccctccacccagagcc

SEQ ID NO: 579125 - DNA, 20 bp, Artificial
  CRISPR gRNA sequence
gcaccctccacccagagcct

SEQ ID NO: 579126 - DNA, 20 bp, Artificial
  CRISPR gRNA sequence
caccctccacccagagcctg

SEQ ID NO: 579127 - DNA, 20 bp, Artificial
  CRISPR gRNA sequence
cacccagagcctgtcaggat

SEQ ID NO: 579128 - DNA, 20 bp, Artificial
  CRISPR gRNA sequence
tcaggattaggagcttgggg

SEQ ID NO: 579129 - DNA, 20 bp, Artificial
  CRISPR gRNA sequence
ggagcttgggggcaccgtgt

SEQ ID NO: 579130 - DNA, 20 bp, Artificial
  CRISPR gRNA sequence
gggggcaccgtgtagtgcaa

SEQ ID NO: 579131 - DNA, 20 bp, Artificial
  CRISPR gRNA sequence
ggggcaccgtgtagtgcaag

SEQ ID NO: 579132 - DNA, 20 bp, Artificial
  CRISPR gRNA sequence
ttacctgggaatgtgctgtt

SEQ ID NO: 579133 - DNA, 20 bp, Artificial
  CRISPR gRNA sequence
acctgggaatgtgctgtttc

SEQ ID NO: 579134 - DNA, 20 bp, Artificial
  CRISPR gRNA sequence
cctgggaatgtgctgtttcc

SEQ ID NO: 579135 - DNA, 20 bp, Artificial
  CRISPR gRNA sequence
ggaatgtgctgtttccatgg

SEQ ID NO: 579136 - DNA, 20 bp, Artificial
  CRISPR gRNA sequence
tttccatggctaccccacag

SEQ ID NO: 579137 - DNA, 20 bp, Artificial
  CRISPR gRNA sequence
ccatggctaccccacaggtg

SEQ ID NO: 579138 - DNA, 20 bp, Artificial
  CRISPR gRNA sequence
catggctaccccacaggtgc

SEQ ID NO: 579139 - DNA, 20 bp, Artificial
  CRISPR gRNA sequence
ccccacaggtgcctccggac

SEQ ID NO: 579140 - DNA, 20 bp, Artificial
  CRISPR gRNA sequence
cggacagcaaacaggctgtc

SEQ ID NO: 579141 - DNA, 20 bp, Artificial
  CRISPR gRNA sequence
tcaggggcctcccgggggcc

SEQ ID NO: 579142 - DNA, 20 bp, Artificial
  CRISPR gRNA sequence
ccgggggccagaccaggctg

SEQ ID NO: 579143 - DNA, 20 bp, Artificial
  CRISPR gRNA sequence
ggacgacagggccttggctg

SEQ ID NO: 579144 - DNA, 20 bp, Artificial
  CRISPR gRNA sequence
ggctgccagcagctacgatg

SEQ ID NO: 579145 - DNA, 20 bp, Artificial
  CRISPR gRNA sequence
gctgccagcagctacgatgc

SEQ ID NO: 579146 - DNA, 20 bp, Artificial
  CRISPR gRNA sequence
ccagcagctacgatgcagca

SEQ ID NO: 579147 - DNA, 20 bp, Artificial
  CRISPR gRNA sequence
cgatgcagcaggagcccttg

SEQ ID NO: 579148 - DNA, 20 bp, Artificial
  CRISPR gRNA sequence
gtcggatgatgcctgggtga

SEQ ID NO: 579149 - DNA, 20 bp, Artificial
  CRISPR gRNA sequence
tcggatgatgcctgggtgag

SEQ ID NO: 579150 - DNA, 20 bp, Artificial
  CRISPR gRNA sequence
ggtgagggggagaggctggt

SEQ ID NO: 579151 - DNA, 20 bp, Artificial
  CRISPR gRNA sequence
gtgacccagaggcttaaact

SEQ ID NO: 579152 - DNA, 20 bp, Artificial
  CRISPR gRNA sequence
aaacttcccactttttactt

SEQ ID NO: 579153 - DNA, 20 bp, Artificial
  CRISPR gRNA sequence
aacttcccactttttacttt

SEQ ID NO: 579154 - DNA, 20 bp, Artificial
  CRISPR gRNA sequence
cccactttttactttctatt

SEQ ID NO: 579155 - DNA, 20 bp, Artificial
  CRISPR gRNA sequence
ccactttttactttctattt

SEQ ID NO: 579156 - DNA, 20 bp, Artificial
  CRISPR gRNA sequence
tttactttctattttatgtt

SEQ ID NO: 579157 - DNA, 20 bp, Artificial
  CRISPR gRNA sequence
ttactttctattttatgttt

SEQ ID NO: 579158 - DNA, 20 bp, Artificial
  CRISPR gRNA sequence
tactttctattttatgtttt

SEQ ID NO: 579159 - DNA, 20 bp, Artificial
  CRISPR gRNA sequence
actttctattttatgttttt

SEQ ID NO: 579160 - DNA, 20 bp, Artificial
  CRISPR gRNA sequence
ctttctattttatgtttttt

SEQ ID NO: 579161 - DNA, 20 bp, Artificial
  CRISPR gRNA sequence
tctattttatgttttttatt

SEQ ID NO: 579162 - DNA, 20 bp, Artificial
  CRISPR gRNA sequence
ctattttatgttttttattt

SEQ ID NO: 579163 - DNA, 20 bp, Artificial
  CRISPR gRNA sequence
tattttatgttttttatttt

SEQ ID NO: 579164 - DNA, 20 bp, Artificial
  CRISPR gRNA sequence
ttttatgttttttatttttt

SEQ ID NO: 579165 - DNA, 20 bp, Artificial
  CRISPR gRNA sequence
tatgttttttattttttttg

SEQ ID NO: 579166 - DNA, 20 bp, Artificial
  CRISPR gRNA sequence
atgttttttattttttttga

SEQ ID NO: 579167 - DNA, 20 bp, Artificial
  CRISPR gRNA sequence
tgttttttattttttttgat

SEQ ID NO: 579168 - DNA, 20 bp, Artificial
  CRISPR gRNA sequence
tttattttttttgatactga

SEQ ID NO: 579169 - DNA, 20 bp, Artificial
  CRISPR gRNA sequence
ttattttttttgatactgag

SEQ ID NO: 579170 - DNA, 20 bp, Artificial
  CRISPR gRNA sequence
tattttttttgatactgagt

SEQ ID NO: 579171 - DNA, 20 bp, Artificial
  CRISPR gRNA sequence
attttttttgatactgagtc

SEQ ID NO: 579172 - DNA, 20 bp, Artificial
  CRISPR gRNA sequence
ttttttttgatactgagtct

SEQ ID NO: 579173 - DNA, 20 bp, Artificial
  CRISPR gRNA sequence
tttttgatactgagtcttgc

SEQ ID NO: 579174 - DNA, 20 bp, Artificial
  CRISPR gRNA sequence
ttttgatactgagtcttgct

SEQ ID NO: 579175 - DNA, 20 bp, Artificial
  CRISPR gRNA sequence
tttgatactgagtcttgctc

SEQ ID NO: 579176 - DNA, 20 bp, Artificial
  CRISPR gRNA sequence
ttgatactgagtcttgctct

SEQ ID NO: 579177 - DNA, 20 bp, Artificial
  CRISPR gRNA sequence
tgatactgagtcttgctctg

SEQ ID NO: 579178 - DNA, 20 bp, Artificial
  CRISPR gRNA sequence
gatactgagtcttgctctgt

SEQ ID NO: 579179 - DNA, 20 bp, Artificial
  CRISPR gRNA sequence
atactgagtcttgctctgtc

SEQ ID NO: 579180 - DNA, 20 bp, Artificial
  CRISPR gRNA sequence
agtcttgctctgtcgcccag

SEQ ID NO: 579181 - DNA, 20 bp, Artificial
  CRISPR gRNA sequence
gctctgtcgcccaggctgga

SEQ ID NO: 579182 - DNA, 20 bp, Artificial
  CRISPR gRNA sequence
ctctgtcgcccaggctggag

SEQ ID NO: 579183 - DNA, 20 bp, Artificial
  CRISPR gRNA sequence
tgtcgcccaggctggagtgc

SEQ ID NO: 579184 - DNA, 20 bp, Artificial
  CRISPR gRNA sequence
tcgcccaggctggagtgcag

SEQ ID NO: 579185 - DNA, 20 bp, Artificial
  CRISPR gRNA sequence
gagtgcagtggtgcaatctc

SEQ ID NO: 579186 - DNA, 20 bp, Artificial
  CRISPR gRNA sequence
ggctcactgcaacccccacc

SEQ ID NO: 579187 - DNA, 20 bp, Artificial
  CRISPR gRNA sequence
actgcaacccccacctccca

SEQ ID NO: 579188 - DNA, 20 bp, Artificial
  CRISPR gRNA sequence
caacccccacctcccagatt

SEQ ID NO: 579189 - DNA, 20 bp, Artificial
  CRISPR gRNA sequence
ccagattcaagcaagtcttc

SEQ ID NO: 579190 - DNA, 20 bp, Artificial
  CRISPR gRNA sequence
aagcaagtcttctgcctcag

SEQ ID NO: 579191 - DNA, 20 bp, Artificial
  CRISPR gRNA sequence
ctgcctcagcctcccgagta

SEQ ID NO: 579192 - DNA, 20 bp, Artificial
  CRISPR gRNA sequence
tgcctcagcctcccgagtag

SEQ ID NO: 579193 - DNA, 20 bp, Artificial
  CRISPR gRNA sequence
cctcagcctcccgagtagct

SEQ ID NO: 579194 - DNA, 20 bp, Artificial
  CRISPR gRNA sequence
agcctcccgagtagctggga

SEQ ID NO: 579195 - DNA, 20 bp, Artificial
  CRISPR gRNA sequence
ccgagtagctgggactacag

SEQ ID NO: 579196 - DNA, 20 bp, Artificial
  CRISPR gRNA sequence
ggactacaggtgcccgtcac

SEQ ID NO: 579197 - DNA, 20 bp, Artificial
  CRISPR gRNA sequence
caggtgcccgtcactacgcc

SEQ ID NO: 579198 - DNA, 20 bp, Artificial
  CRISPR gRNA sequence
cgcccagctaatttttgtat

SEQ ID NO: 579199 - DNA, 20 bp, Artificial
  CRISPR gRNA sequence
atttttgtatttttggtaga

SEQ ID NO: 579200 - DNA, 20 bp, Artificial
  CRISPR gRNA sequence
ttgtatttttggtagagatg

SEQ ID NO: 579201 - DNA, 20 bp, Artificial
  CRISPR gRNA sequence
tgtatttttggtagagatgg

SEQ ID NO: 579202 - DNA, 20 bp, Artificial
  CRISPR gRNA sequence
gtatttttggtagagatggg

SEQ ID NO: 579203 - DNA, 20 bp, Artificial
  CRISPR gRNA sequence
tatttttggtagagatgggg

SEQ ID NO: 579204 - DNA, 20 bp, Artificial
  CRISPR gRNA sequence
ttggtagagatggggtttca

SEQ ID NO: 579205 - DNA, 20 bp, Artificial
  CRISPR gRNA sequence
tggtagagatggggtttcac

SEQ ID NO: 579206 - DNA, 20 bp, Artificial
  CRISPR gRNA sequence
ggtagagatggggtttcacc

SEQ ID NO: 579207 - DNA, 20 bp, Artificial
  CRISPR gRNA sequence
gtagagatggggtttcacca

SEQ ID NO: 579208 - DNA, 20 bp, Artificial
  CRISPR gRNA sequence
caccatgttagccaggctgg

SEQ ID NO: 579209 - DNA, 20 bp, Artificial
  CRISPR gRNA sequence
accatgttagccaggctggt

SEQ ID NO: 579210 - DNA, 20 bp, Artificial
  CRISPR gRNA sequence
gccaggctggtctcgaactc

SEQ ID NO: 579211 - DNA, 20 bp, Artificial
  CRISPR gRNA sequence
gtctcgaactcctgacctca

SEQ ID NO: 579212 - DNA, 20 bp, Artificial
  CRISPR gRNA sequence
gaactcctgacctcatgtga

SEQ ID NO: 579213 - DNA, 20 bp, Artificial
  CRISPR gRNA sequence
ctgacctcatgtgatccacc

SEQ ID NO: 579214 - DNA, 20 bp, Artificial
  CRISPR gRNA sequence
acctcatgtgatccacccgc

SEQ ID NO: 579215 - DNA, 20 bp, Artificial
  CRISPR gRNA sequence
atgtgatccacccgcttcag

SEQ ID NO: 579216 - DNA, 20 bp, Artificial
  CRISPR gRNA sequence
cagcctcccaaagtgctggg

SEQ ID NO: 579217 - DNA, 20 bp, Artificial
  CRISPR gRNA sequence
agcctcccaaagtgctggga

SEQ ID NO: 579218 - DNA, 20 bp, Artificial
  CRISPR gRNA sequence
ccaaagtgctgggattacag

SEQ ID NO: 579219 - DNA, 20 bp, Artificial
  CRISPR gRNA sequence
ggattacaggcatgagccac

SEQ ID NO: 579220 - DNA, 20 bp, Artificial
  CRISPR gRNA sequence
caggcatgagccactgcgcc

SEQ ID NO: 579221 - DNA, 20 bp, Artificial
  CRISPR gRNA sequence
cgcctggctccactttattt

SEQ ID NO: 579222 - DNA, 20 bp, Artificial
  CRISPR gRNA sequence
gctccactttatttttaaat

SEQ ID NO: 579223 - DNA, 20 bp, Artificial
  CRISPR gRNA sequence
cactttatttttaaatcagt

SEQ ID NO: 579224 - DNA, 20 bp, Artificial
  CRISPR gRNA sequence
tatttttaaatcagtgtttt

SEQ ID NO: 579225 - DNA, 20 bp, Artificial
  CRISPR gRNA sequence
atttttaaatcagtgttttt

SEQ ID NO: 579226 - DNA, 20 bp, Artificial
  CRISPR gRNA sequence
tttttaaatcagtgtttttc

SEQ ID NO: 579227 - DNA, 20 bp, Artificial
  CRISPR gRNA sequence
ttaaatcagtgtttttcaaa

SEQ ID NO: 579228 - DNA, 20 bp, Artificial
  CRISPR gRNA sequence
taaatcagtgtttttcaaag

SEQ ID NO: 579229 - DNA, 20 bp, Artificial
  CRISPR gRNA sequence
aaatcagtgtttttcaaagc

SEQ ID NO: 579230 - DNA, 20 bp, Artificial
  CRISPR gRNA sequence
aatcagtgtttttcaaagca

SEQ ID NO: 579231 - DNA, 20 bp, Artificial
  CRISPR gRNA sequence
ttcaaagcaaggacgccctc

SEQ ID NO: 579232 - DNA, 20 bp, Artificial
  CRISPR gRNA sequence
tcaaagcaaggacgccctct

SEQ ID NO: 579233 - DNA, 20 bp, Artificial
  CRISPR gRNA sequence
caaagcaaggacgccctctt

SEQ ID NO: 579234 - DNA, 20 bp, Artificial
  CRISPR gRNA sequence
aaagcaaggacgccctcttc

SEQ ID NO: 579235 - DNA, 20 bp, Artificial
  CRISPR gRNA sequence
ttctaaattccagtctgagg

SEQ ID NO: 579236 - DNA, 20 bp, Artificial
  CRISPR gRNA sequence
ctaaattccagtctgaggtg

SEQ ID NO: 579237 - DNA, 20 bp, Artificial
  CRISPR gRNA sequence
taaattccagtctgaggtgg

SEQ ID NO: 579238 - DNA, 20 bp, Artificial
  CRISPR gRNA sequence
aattccagtctgaggtggaa

SEQ ID NO: 579239 - DNA, 20 bp, Artificial
  CRISPR gRNA sequence
cagtctgaggtggaatccca

SEQ ID NO: 579240 - DNA, 20 bp, Artificial
  CRISPR gRNA sequence
aggtggaatcccacaaaaca

SEQ ID NO: 579241 - DNA, 20 bp, Artificial
  CRISPR gRNA sequence
attagagcacaggtgcggat

SEQ ID NO: 579242 - DNA, 20 bp, Artificial
  CRISPR gRNA sequence
ttagagcacaggtgcggatg

SEQ ID NO: 579243 - DNA, 20 bp, Artificial
  CRISPR gRNA sequence
gagcacaggtgcggatgtcg

SEQ ID NO: 579244 - DNA, 20 bp, Artificial
  CRISPR gRNA sequence
atgctgggaccatgaactgg

SEQ ID NO: 579245 - DNA, 20 bp, Artificial
  CRISPR gRNA sequence
ggaccatgaactggggttga

SEQ ID NO: 579246 - DNA, 20 bp, Artificial
  CRISPR gRNA sequence
gggttgaatagggctcttta

SEQ ID NO: 579247 - DNA, 20 bp, Artificial
  CRISPR gRNA sequence
aatagggctctttaccaccc

SEQ ID NO: 579248 - DNA, 20 bp, Artificial
  CRISPR gRNA sequence
tttaccacccaactgtgacc

SEQ ID NO: 579249 - DNA, 20 bp, Artificial
  CRISPR gRNA sequence
taccacccaactgtgacctt

SEQ ID NO: 579250 - DNA, 20 bp, Artificial
  CRISPR gRNA sequence
accacccaactgtgaccttg

SEQ ID NO: 579251 - DNA, 20 bp, Artificial
  CRISPR gRNA sequence
ccacccaactgtgaccttgg

SEQ ID NO: 579252 - DNA, 20 bp, Artificial
  CRISPR gRNA sequence
tgaccttgggaaagtcacct

SEQ ID NO: 579253 - DNA, 20 bp, Artificial
  CRISPR gRNA sequence
gggaaagtcacctaaacccc

SEQ ID NO: 579254 - DNA, 20 bp, Artificial
  CRISPR gRNA sequence
ggaaagtcacctaaaccccc

SEQ ID NO: 579255 - DNA, 20 bp, Artificial
  CRISPR gRNA sequence
aacccccctggcctcaatat

SEQ ID NO: 579256 - DNA, 20 bp, Artificial
  CRISPR gRNA sequence
gcctcaatattcctcatctg

SEQ ID NO: 579257 - DNA, 20 bp, Artificial
  CRISPR gRNA sequence
aatattcctcatctgtacat

SEQ ID NO: 579258 - DNA, 20 bp, Artificial
  CRISPR gRNA sequence
ctcatctgtacattcgcatc

SEQ ID NO: 579259 - DNA, 20 bp, Artificial
  CRISPR gRNA sequence
atctgtacattcgcatcatg

SEQ ID NO: 579260 - DNA, 20 bp, Artificial
  CRISPR gRNA sequence
tacattcgcatcatgagaaa

SEQ ID NO: 579261 - DNA, 20 bp, Artificial
  CRISPR gRNA sequence
gcatcatgagaaataaatta

SEQ ID NO: 579262 - DNA, 20 bp, Artificial
  CRISPR gRNA sequence
ccaccagcaaagcgctcaga

SEQ ID NO: 579263 - DNA, 20 bp, Artificial
  CRISPR gRNA sequence
agaaacagtgcctggcctcc

SEQ ID NO: 579264 - DNA, 20 bp, Artificial
  CRISPR gRNA sequence
gcctccagggctggcttcat

SEQ ID NO: 579265 - DNA, 20 bp, Artificial
  CRISPR gRNA sequence
cagggctggcttcatgggcg

SEQ ID NO: 579266 - DNA, 20 bp, Artificial
  CRISPR gRNA sequence
gcttcatgggcgtgtgacct

SEQ ID NO: 579267 - DNA, 20 bp, Artificial
  CRISPR gRNA sequence
catgggcgtgtgacctatgt

SEQ ID NO: 579268 - DNA, 20 bp, Artificial
  CRISPR gRNA sequence
atgggcgtgtgacctatgtg

SEQ ID NO: 579269 - DNA, 20 bp, Artificial
  CRISPR gRNA sequence
tgtggttatgtggcaccctg

SEQ ID NO: 579270 - DNA, 20 bp, Artificial
  CRISPR gRNA sequence
tgtggcaccctgtgctttgt

SEQ ID NO: 579271 - DNA, 20 bp, Artificial
  CRISPR gRNA sequence
tgctttgtttaatgctctgt

SEQ ID NO: 579272 - DNA, 20 bp, Artificial
  CRISPR gRNA sequence
tgtttaatgctctgtggtcg

SEQ ID NO: 579273 - DNA, 20 bp, Artificial
  CRISPR gRNA sequence
gtttaatgctctgtggtcgc

SEQ ID NO: 579274 - DNA, 20 bp, Artificial
  CRISPR gRNA sequence
tttaatgctctgtggtcgcc

SEQ ID NO: 579275 - DNA, 20 bp, Artificial
  CRISPR gRNA sequence
aatgctctgtggtcgccatc

SEQ ID NO: 579276 - DNA, 20 bp, Artificial
  CRISPR gRNA sequence
atgctctgtggtcgccatct

SEQ ID NO: 579277 - DNA, 20 bp, Artificial
  CRISPR gRNA sequence
tgtggtcgccatcttgaaat

SEQ ID NO: 579278 - DNA, 20 bp, Artificial
  CRISPR gRNA sequence
tggtcgccatcttgaaatct

SEQ ID NO: 579279 - DNA, 20 bp, Artificial
  CRISPR gRNA sequence
gaaatctgaacaaggggccc

SEQ ID NO: 579280 - DNA, 20 bp, Artificial
  CRISPR gRNA sequence
aaatctgaacaaggggccct

SEQ ID NO: 579281 - DNA, 20 bp, Artificial
  CRISPR gRNA sequence
aacaaggggccctgcaggtt

SEQ ID NO: 579282 - DNA, 20 bp, Artificial
  CRISPR gRNA sequence
caggttacatagctggtcct

SEQ ID NO: 579283 - DNA, 20 bp, Artificial
  CRISPR gRNA sequence
catagctggtcctgctggca

SEQ ID NO: 579284 - DNA, 20 bp, Artificial
  CRISPR gRNA sequence
gtcctgctggcacacagcct

SEQ ID NO: 579285 - DNA, 20 bp, Artificial
  CRISPR gRNA sequence
ctggcacacagcctgcatct

SEQ ID NO: 579286 - DNA, 20 bp, Artificial
  CRISPR gRNA sequence
gcacacagcctgcatctggc

SEQ ID NO: 579287 - DNA, 20 bp, Artificial
  CRISPR gRNA sequence
catctggcaagtctggctat

SEQ ID NO: 579288 - DNA, 20 bp, Artificial
  CRISPR gRNA sequence
gcaagtctggctatttgcat

SEQ ID NO: 579289 - DNA, 20 bp, Artificial
  CRISPR gRNA sequence
gctatttgcatttgctttaa

SEQ ID NO: 579290 - DNA, 20 bp, Artificial
  CRISPR gRNA sequence
tttgcatttgctttaacaac

SEQ ID NO: 579291 - DNA, 20 bp, Artificial
  CRISPR gRNA sequence
gcatttgctttaacaactca

SEQ ID NO: 579292 - DNA, 20 bp, Artificial
  CRISPR gRNA sequence
catttgctttaacaactcag

SEQ ID NO: 579293 - DNA, 20 bp, Artificial
  CRISPR gRNA sequence
gctttaacaactcaggatca

SEQ ID NO: 579294 - DNA, 20 bp, Artificial
  CRISPR gRNA sequence
ctttaacaactcaggatcac

SEQ ID NO: 579295 - DNA, 20 bp, Artificial
  CRISPR gRNA sequence
taacaactcaggatcacagt

SEQ ID NO: 579296 - DNA, 20 bp, Artificial
  CRISPR gRNA sequence
aacaactcaggatcacagtg

SEQ ID NO: 579297 - DNA, 20 bp, Artificial
  CRISPR gRNA sequence
acaactcaggatcacagtgt

SEQ ID NO: 579298 - DNA, 20 bp, Artificial
  CRISPR gRNA sequence
aggatcacagtgtttgggga

SEQ ID NO: 579299 - DNA, 20 bp, Artificial
  CRISPR gRNA sequence
ggggatcttagagtcagagg

SEQ ID NO: 579300 - DNA, 20 bp, Artificial
  CRISPR gRNA sequence
gggatcttagagtcagaggg

SEQ ID NO: 579301 - DNA, 20 bp, Artificial
  CRISPR gRNA sequence
agagtcagagggtttttttt

SEQ ID NO: 579302 - DNA, 20 bp, Artificial
  CRISPR gRNA sequence
gagtcagagggttttttttt

SEQ ID NO: 579303 - DNA, 20 bp, Artificial
  CRISPR gRNA sequence
tttttttttttttttcttga

SEQ ID NO: 579304 - DNA, 20 bp, Artificial
  CRISPR gRNA sequence
ttttttttttttttcttgag

SEQ ID NO: 579305 - DNA, 20 bp, Artificial
  CRISPR gRNA sequence
tttttttttttttcttgaga

SEQ ID NO: 579306 - DNA, 20 bp, Artificial
  CRISPR gRNA sequence
ttttttttttttcttgagac

SEQ ID NO: 579307 - DNA, 20 bp, Artificial
  CRISPR gRNA sequence
tttttttttttcttgagacg

SEQ ID NO: 579308 - DNA, 20 bp, Artificial
  CRISPR gRNA sequence
ttttttttttcttgagacgg

SEQ ID NO: 579309 - DNA, 20 bp, Artificial
  CRISPR gRNA sequence
tttttttttcttgagacgga

SEQ ID NO: 579310 - DNA, 20 bp, Artificial
  CRISPR gRNA sequence
ttttttttcttgagacggag

SEQ ID NO: 579311 - DNA, 20 bp, Artificial
  CRISPR gRNA sequence
tttttttcttgagacggagt

SEQ ID NO: 579312 - DNA, 20 bp, Artificial
  CRISPR gRNA sequence
ttttttcttgagacggagtc

SEQ ID NO: 579313 - DNA, 20 bp, Artificial
  CRISPR gRNA sequence
tttttcttgagacggagtct

SEQ ID NO: 579314 - DNA, 20 bp, Artificial
  CRISPR gRNA sequence
ttttcttgagacggagtctt

SEQ ID NO: 579315 - DNA, 20 bp, Artificial
  CRISPR gRNA sequence
tttcttgagacggagtcttg

SEQ ID NO: 579316 - DNA, 20 bp, Artificial
  CRISPR gRNA sequence
ttcttgagacggagtcttga

SEQ ID NO: 579317 - DNA, 20 bp, Artificial
  CRISPR gRNA sequence
tcttgagacggagtcttgat

SEQ ID NO: 579318 - DNA, 20 bp, Artificial
  CRISPR gRNA sequence
cttgagacggagtcttgatc

SEQ ID NO: 579319 - DNA, 20 bp, Artificial
  CRISPR gRNA sequence
ttgagacggagtcttgatct

SEQ ID NO: 579320 - DNA, 20 bp, Artificial
  CRISPR gRNA sequence
gagacggagtcttgatctgt

SEQ ID NO: 579321 - DNA, 20 bp, Artificial
  CRISPR gRNA sequence
agacggagtcttgatctgtc

SEQ ID NO: 579322 - DNA, 20 bp, Artificial
  CRISPR gRNA sequence
gatctgtcgcctaggctgga

SEQ ID NO: 579323 - DNA, 20 bp, Artificial
  CRISPR gRNA sequence
atctgtcgcctaggctggag

SEQ ID NO: 579324 - DNA, 20 bp, Artificial
  CRISPR gRNA sequence
tcgcctaggctggagtgcag

SEQ ID NO: 579325 - DNA, 20 bp, Artificial
  CRISPR gRNA sequence
ggctggagtgcagtggtatg

SEQ ID NO: 579326 - DNA, 20 bp, Artificial
  CRISPR gRNA sequence
gagtgcagtggtatgatctc

SEQ ID NO: 579327 - DNA, 20 bp, Artificial
  CRISPR gRNA sequence
agctcactgcaaactccgcc

SEQ ID NO: 579328 - DNA, 20 bp, Artificial
  CRISPR gRNA sequence
actgcaaactccgcctccca

SEQ ID NO: 579329 - DNA, 20 bp, Artificial
  CRISPR gRNA sequence
caaactccgcctcccaggtt

SEQ ID NO: 579330 - DNA, 20 bp, Artificial
  CRISPR gRNA sequence
cgcctcccaggttcaagcaa

SEQ ID NO: 579331 - DNA, 20 bp, Artificial
  CRISPR gRNA sequence
ccaggttcaagcaattctct

SEQ ID NO: 579332 - DNA, 20 bp, Artificial
  CRISPR gRNA sequence
aagcaattctctgcctcagc

SEQ ID NO: 579333 - DNA, 20 bp, Artificial
  CRISPR gRNA sequence
tctgcctcagcctcccaagt

SEQ ID NO: 579334 - DNA, 20 bp, Artificial
  CRISPR gRNA sequence
tgcctcagcctcccaagtag

SEQ ID NO: 579335 - DNA, 20 bp, Artificial
  CRISPR gRNA sequence
cctcagcctcccaagtagtt

SEQ ID NO: 579336 - DNA, 20 bp, Artificial
  CRISPR gRNA sequence
agcctcccaagtagttggga

SEQ ID NO: 579337 - DNA, 20 bp, Artificial
  CRISPR gRNA sequence
ccaagtagttgggactacag

SEQ ID NO: 579338 - DNA, 20 bp, Artificial
  CRISPR gRNA sequence
ggactacagacacctgccac

SEQ ID NO: 579339 - DNA, 20 bp, Artificial
  CRISPR gRNA sequence
cagacacctgccaccacgcc

SEQ ID NO: 579340 - DNA, 20 bp, Artificial
  CRISPR gRNA sequence
ccaccacgcctggctaattt

SEQ ID NO: 579341 - DNA, 20 bp, Artificial
  CRISPR gRNA sequence
gctaattttttgtactttta

SEQ ID NO: 579342 - DNA, 20 bp, Artificial
  CRISPR gRNA sequence
attttttgtacttttagtag

SEQ ID NO: 579343 - DNA, 20 bp, Artificial
  CRISPR gRNA sequence
tttgtacttttagtagacac

SEQ ID NO: 579344 - DNA, 20 bp, Artificial
  CRISPR gRNA sequence
ttgtacttttagtagacaca

SEQ ID NO: 579345 - DNA, 20 bp, Artificial
  CRISPR gRNA sequence
tgtacttttagtagacacag

SEQ ID NO: 579346 - DNA, 20 bp, Artificial
  CRISPR gRNA sequence
gtacttttagtagacacagg

SEQ ID NO: 579347 - DNA, 20 bp, Artificial
  CRISPR gRNA sequence
tacttttagtagacacaggg

SEQ ID NO: 579348 - DNA, 20 bp, Artificial
  CRISPR gRNA sequence
ttagtagacacagggtttca

SEQ ID NO: 579349 - DNA, 20 bp, Artificial
  CRISPR gRNA sequence
tagtagacacagggtttcac

SEQ ID NO: 579350 - DNA, 20 bp, Artificial
  CRISPR gRNA sequence
agtagacacagggtttcacc

SEQ ID NO: 579351 - DNA, 20 bp, Artificial
  CRISPR gRNA sequence
gtagacacagggtttcacca

SEQ ID NO: 579352 - DNA, 20 bp, Artificial
  CRISPR gRNA sequence
caccatcttggcgaggctgg

SEQ ID NO: 579353 - DNA, 20 bp, Artificial
  CRISPR gRNA sequence
accatcttggcgaggctggt

SEQ ID NO: 579354 - DNA, 20 bp, Artificial
  CRISPR gRNA sequence
ggcgaggctggtcttgaact

SEQ ID NO: 579355 - DNA, 20 bp, Artificial
  CRISPR gRNA sequence
gcgaggctggtcttgaactc

SEQ ID NO: 579356 - DNA, 20 bp, Artificial
  CRISPR gRNA sequence
gtcttgaactcctgacctcg

SEQ ID NO: 579357 - DNA, 20 bp, Artificial
  CRISPR gRNA sequence
gaactcctgacctcgtgatc

SEQ ID NO: 579358 - DNA, 20 bp, Artificial
  CRISPR gRNA sequence
aactcctgacctcgtgatcc

SEQ ID NO: 579359 - DNA, 20 bp, Artificial
  CRISPR gRNA sequence
ctgacctcgtgatccacccg

SEQ ID NO: 579360 - DNA, 20 bp, Artificial
  CRISPR gRNA sequence
acctcgtgatccacccgcct

SEQ ID NO: 579361 - DNA, 20 bp, Artificial
  CRISPR gRNA sequence
gtgatccacccgcctcggcc

SEQ ID NO: 579362 - DNA, 20 bp, Artificial
  CRISPR gRNA sequence
ggcctcccaaagtgctggga

SEQ ID NO: 579363 - DNA, 20 bp, Artificial
  CRISPR gRNA sequence
ccaaagtgctgggattacag

SEQ ID NO: 579364 - DNA, 20 bp, Artificial
  CRISPR gRNA sequence
ggattacaggcgtgagccac

SEQ ID NO: 579365 - DNA, 20 bp, Artificial
  CRISPR gRNA sequence
caggcgtgagccaccacgcc

SEQ ID NO: 579366 - DNA, 20 bp, Artificial
  CRISPR gRNA sequence
gtaagtagaaggggacagat

SEQ ID NO: 579367 - DNA, 20 bp, Artificial
  CRISPR gRNA sequence
taagtagaaggggacagatt

SEQ ID NO: 579368 - DNA, 20 bp, Artificial
  CRISPR gRNA sequence
ccaggtctgggcatgtttgg

SEQ ID NO: 579369 - DNA, 20 bp, Artificial
  CRISPR gRNA sequence
caggtctgggcatgtttgga

SEQ ID NO: 579370 - DNA, 20 bp, Artificial
  CRISPR gRNA sequence
ggcatgtttggagctgggga

SEQ ID NO: 579371 - DNA, 20 bp, Artificial
  CRISPR gRNA sequence
ggagctggggacaggggccc

SEQ ID NO: 579372 - DNA, 20 bp, Artificial
  CRISPR gRNA sequence
gagctggggacaggggcccc

SEQ ID NO: 579373 - DNA, 20 bp, Artificial
  CRISPR gRNA sequence
gggacaggggcccctagctc

SEQ ID NO: 579374 - DNA, 20 bp, Artificial
  CRISPR gRNA sequence
gctctcaggacctgaatgtg

SEQ ID NO: 579375 - DNA, 20 bp, Artificial
  CRISPR gRNA sequence
tcaggacctgaatgtgaggt

SEQ ID NO: 579376 - DNA, 20 bp, Artificial
  CRISPR gRNA sequence
aggacctgaatgtgaggtta

SEQ ID NO: 579377 - DNA, 20 bp, Artificial
  CRISPR gRNA sequence
aatgtgaggttaggttccct

SEQ ID NO: 579378 - DNA, 20 bp, Artificial
  CRISPR gRNA sequence
ggttccctgcaccgtgcaga

SEQ ID NO: 579379 - DNA, 20 bp, Artificial
  CRISPR gRNA sequence
cctgcaccgtgcagacctcc

SEQ ID NO: 579380 - DNA, 20 bp, Artificial
  CRISPR gRNA sequence
caccgtgcagacctcctccc

SEQ ID NO: 579381 - DNA, 20 bp, Artificial
  CRISPR gRNA sequence
ctccctgccccccagcagtc

SEQ ID NO: 579382 - DNA, 20 bp, Artificial
  CRISPR gRNA sequence
cctgccccccagcagtctga

SEQ ID NO: 579383 - DNA, 20 bp, Artificial
  CRISPR gRNA sequence
ccccccagcagtctgagtct

SEQ ID NO: 579384 - DNA, 20 bp, Artificial
  CRISPR gRNA sequence
agtctgccaccaccagtcct

SEQ ID NO: 579385 - DNA, 20 bp, Artificial
  CRISPR gRNA sequence
ccaccaccagtcctggggtc

SEQ ID NO: 579386 - DNA, 20 bp, Artificial
  CRISPR gRNA sequence
gggtcgctcaccacagatga

SEQ ID NO: 579387 - DNA, 20 bp, Artificial
  CRISPR gRNA sequence
accacagatgaagccttggt

SEQ ID NO: 579388 - DNA, 20 bp, Artificial
  CRISPR gRNA sequence
ggtcagtgccattttcccag

SEQ ID NO: 579389 - DNA, 20 bp, Artificial
  CRISPR gRNA sequence
gtcagtgccattttcccagc

SEQ ID NO: 579390 - DNA, 20 bp, Artificial
  CRISPR gRNA sequence
tcccagccaggtgggcctgc

SEQ ID NO: 579391 - DNA, 20 bp, Artificial
  CRISPR gRNA sequence
cccagccaggtgggcctgca

SEQ ID NO: 579392 - DNA, 20 bp, Artificial
  CRISPR gRNA sequence
ccagccaggtgggcctgcat

SEQ ID NO: 579393 - DNA, 20 bp, Artificial
  CRISPR gRNA sequence
catggcactcagcttctcct

SEQ ID NO: 579394 - DNA, 20 bp, Artificial
  CRISPR gRNA sequence
agcttctccttctccagcac

SEQ ID NO: 579395 - DNA, 20 bp, Artificial
  CRISPR gRNA sequence
ctccttctccagcaccagct

SEQ ID NO: 579396 - DNA, 20 bp, Artificial
  CRISPR gRNA sequence
tccttctccagcaccagctg

SEQ ID NO: 579397 - DNA, 20 bp, Artificial
  CRISPR gRNA sequence
cttctccagcaccagctgtg

SEQ ID NO: 579398 - DNA, 20 bp, Artificial
  CRISPR gRNA sequence
ctccagcaccagctgtgaaa

SEQ ID NO: 579399 - DNA, 20 bp, Artificial
  CRISPR gRNA sequence
tccagcaccagctgtgaaat

SEQ ID NO: 579400 - DNA, 20 bp, Artificial
  CRISPR gRNA sequence
cagcaccagctgtgaaatgg

SEQ ID NO: 579401 - DNA, 20 bp, Artificial
  CRISPR gRNA sequence
tgaaatggcacaaacatgag

SEQ ID NO: 579402 - DNA, 20 bp, Artificial
  CRISPR gRNA sequence
agcctggcccttctctgcca

SEQ ID NO: 579403 - DNA, 20 bp, Artificial
  CRISPR gRNA sequence
gcccttctctgccacatctt

SEQ ID NO: 579404 - DNA, 20 bp, Artificial
  CRISPR gRNA sequence
ctctgccacatctttgccca

SEQ ID NO: 579405 - DNA, 20 bp, Artificial
  CRISPR gRNA sequence
tctgccacatctttgcccag

SEQ ID NO: 579406 - DNA, 20 bp, Artificial
  CRISPR gRNA sequence
tgccacatctttgcccaggc

SEQ ID NO: 579407 - DNA, 20 bp, Artificial
  CRISPR gRNA sequence
ccacatctttgcccaggcta

SEQ ID NO: 579408 - DNA, 20 bp, Artificial
  CRISPR gRNA sequence
tgcccaggctacggtcttcc

SEQ ID NO: 579409 - DNA, 20 bp, Artificial
  CRISPR gRNA sequence
gcccaggctacggtcttccc

SEQ ID NO: 579410 - DNA, 20 bp, Artificial
  CRISPR gRNA sequence
cccaggctacggtcttccct

SEQ ID NO: 579411 - DNA, 20 bp, Artificial
  CRISPR gRNA sequence
cggtcttccctgggagtgcc

SEQ ID NO: 579412 - DNA, 20 bp, Artificial
  CRISPR gRNA sequence
ccctgggagtgcccgctcct

SEQ ID NO: 579413 - DNA, 20 bp, Artificial
  CRISPR gRNA sequence
cctgggagtgcccgctcctc

SEQ ID NO: 579414 - DNA, 20 bp, Artificial
  CRISPR gRNA sequence
ggagtgcccgctcctcttcc

SEQ ID NO: 579415 - DNA, 20 bp, Artificial
  CRISPR gRNA sequence
ctcttccttcctttatacca

SEQ ID NO: 579416 - DNA, 20 bp, Artificial
  CRISPR gRNA sequence
ttccttcctttataccagcc

SEQ ID NO: 579417 - DNA, 20 bp, Artificial
  CRISPR gRNA sequence
ccttcctttataccagccct

SEQ ID NO: 579418 - DNA, 20 bp, Artificial
  CRISPR gRNA sequence
cttcctttataccagccctc

SEQ ID NO: 579419 - DNA, 20 bp, Artificial
  CRISPR gRNA sequence
cctttataccagccctcgtc

SEQ ID NO: 579420 - DNA, 20 bp, Artificial
  CRISPR gRNA sequence
ctttataccagccctcgtcc

SEQ ID NO: 579421 - DNA, 20 bp, Artificial
  CRISPR gRNA sequence
tataccagccctcgtcccag

SEQ ID NO: 579422 - DNA, 20 bp, Artificial
  CRISPR gRNA sequence
ataccagccctcgtcccagg

SEQ ID NO: 579423 - DNA, 20 bp, Artificial
  CRISPR gRNA sequence
taccagccctcgtcccaggt

SEQ ID NO: 579424 - DNA, 20 bp, Artificial
  CRISPR gRNA sequence
gtcccaggtgaacttggttt

SEQ ID NO: 579425 - DNA, 20 bp, Artificial
  CRISPR gRNA sequence
ggtttctggcacatggtgga

SEQ ID NO: 579426 - DNA, 20 bp, Artificial
  CRISPR gRNA sequence
gtttctggcacatggtggac

SEQ ID NO: 579427 - DNA, 20 bp, Artificial
  CRISPR gRNA sequence
ctggcacatggtggacagaa

SEQ ID NO: 579428 - DNA, 20 bp, Artificial
  CRISPR gRNA sequence
tggcacatggtggacagaag

SEQ ID NO: 579429 - DNA, 20 bp, Artificial
  CRISPR gRNA sequence
gcacatggtggacagaaggt

SEQ ID NO: 579430 - DNA, 20 bp, Artificial
  CRISPR gRNA sequence
tgcgcactatccctatccct

SEQ ID NO: 579431 - DNA, 20 bp, Artificial
  CRISPR gRNA sequence
gcgcactatccctatccctt

SEQ ID NO: 579432 - DNA, 20 bp, Artificial
  CRISPR gRNA sequence
cgcactatccctatccctta

SEQ ID NO: 579433 - DNA, 20 bp, Artificial
  CRISPR gRNA sequence
tccctatcccttaccctcca

SEQ ID NO: 579434 - DNA, 20 bp, Artificial
  CRISPR gRNA sequence
tcccttaccctccaccgccc

SEQ ID NO: 579435 - DNA, 20 bp, Artificial
  CRISPR gRNA sequence
accctccaccgccctggcat

SEQ ID NO: 579436 - DNA, 20 bp, Artificial
  CRISPR gRNA sequence
ccctccaccgccctggcatt

SEQ ID NO: 579437 - DNA, 20 bp, Artificial
  CRISPR gRNA sequence
caccgccctggcattacctg

SEQ ID NO: 579438 - DNA, 20 bp, Artificial
  CRISPR gRNA sequence
gcattacctgctgctccaga

SEQ ID NO: 579439 - DNA, 20 bp, Artificial
  CRISPR gRNA sequence
cctgctgctccagagactgt

SEQ ID NO: 579440 - DNA, 20 bp, Artificial
  CRISPR gRNA sequence
ctgctccagagactgtacca

SEQ ID NO: 579441 - DNA, 20 bp, Artificial
  CRISPR gRNA sequence
ctccagagactgtaccatct

SEQ ID NO: 579442 - DNA, 20 bp, Artificial
  CRISPR gRNA sequence
cagagactgtaccatctctc

SEQ ID NO: 579443 - DNA, 20 bp, Artificial
  CRISPR gRNA sequence
taccatctctctctggagga

SEQ ID NO: 579444 - DNA, 20 bp, Artificial
  CRISPR gRNA sequence
tctctggaggagacattgtg

SEQ ID NO: 579445 - DNA, 20 bp, Artificial
  CRISPR gRNA sequence
tctggaggagacattgtgcc

SEQ ID NO: 579446 - DNA, 20 bp, Artificial
  CRISPR gRNA sequence
tggaggagacattgtgccct

SEQ ID NO: 579447 - DNA, 20 bp, Artificial
  CRISPR gRNA sequence
gaggagacattgtgccctgc

SEQ ID NO: 579448 - DNA, 20 bp, Artificial
  CRISPR gRNA sequence
tgccctgcccttctcatcca

SEQ ID NO: 579449 - DNA, 20 bp, Artificial
  CRISPR gRNA sequence
cccttctcatccagaagatg

SEQ ID NO: 579450 - DNA, 20 bp, Artificial
  CRISPR gRNA sequence
ctcatccagaagatggtccg

SEQ ID NO: 579451 - DNA, 20 bp, Artificial
  CRISPR gRNA sequence
tcatccagaagatggtccgc

SEQ ID NO: 579452 - DNA, 20 bp, Artificial
  CRISPR gRNA sequence
atccagaagatggtccgcct

SEQ ID NO: 579453 - DNA, 20 bp, Artificial
  CRISPR gRNA sequence
gcagtgcctaagtagggaga

SEQ ID NO: 579454 - DNA, 20 bp, Artificial
  CRISPR gRNA sequence
agtagggagaagattccatg

SEQ ID NO: 579455 - DNA, 20 bp, Artificial
  CRISPR gRNA sequence
catgcaggtgaccacgacag

SEQ ID NO: 579456 - DNA, 20 bp, Artificial
  CRISPR gRNA sequence
gtctggctcaatgctctgaa

SEQ ID NO: 579457 - DNA, 20 bp, Artificial
  CRISPR gRNA sequence
gctcaatgctctgaatgggg

SEQ ID NO: 579458 - DNA, 20 bp, Artificial
  CRISPR gRNA sequence
aatgctctgaatggggaggg

SEQ ID NO: 579459 - DNA, 20 bp, Artificial
  CRISPR gRNA sequence
tgaatggggagggcccagac

SEQ ID NO: 579460 - DNA, 20 bp, Artificial
  CRISPR gRNA sequence
aatggggagggcccagaccc

SEQ ID NO: 579461 - DNA, 20 bp, Artificial
  CRISPR gRNA sequence
tgggagttctctcctctgag

SEQ ID NO: 579462 - DNA, 20 bp, Artificial
  CRISPR gRNA sequence
ggagttctctcctctgagcc

SEQ ID NO: 579463 - DNA, 20 bp, Artificial
  CRISPR gRNA sequence
tctcctctgagccccagctc

SEQ ID NO: 579464 - DNA, 20 bp, Artificial
  CRISPR gRNA sequence
tcctctgagccccagctccc

SEQ ID NO: 579465 - DNA, 20 bp, Artificial
  CRISPR gRNA sequence
ctctgagccccagctcccct

SEQ ID NO: 579466 - DNA, 20 bp, Artificial
  CRISPR gRNA sequence
tgagccccagctcccctccc

SEQ ID NO: 579467 - DNA, 20 bp, Artificial
  CRISPR gRNA sequence
agccccagctcccctcccct

SEQ ID NO: 579468 - DNA, 20 bp, Artificial
  CRISPR gRNA sequence
ccctcccctctctacctcag

SEQ ID NO: 579469 - DNA, 20 bp, Artificial
  CRISPR gRNA sequence
ccctctctacctcagtctcc

SEQ ID NO: 579470 - DNA, 20 bp, Artificial
  CRISPR gRNA sequence
tctacctcagtctccctctc

SEQ ID NO: 579471 - DNA, 20 bp, Artificial
  CRISPR gRNA sequence
tacctcagtctccctctcac

SEQ ID NO: 579472 - DNA, 20 bp, Artificial
  CRISPR gRNA sequence
cctcagtctccctctcacac

SEQ ID NO: 579473 - DNA, 20 bp, Artificial
  CRISPR gRNA sequence
agtctccctctcacacccct

SEQ ID NO: 579474 - DNA, 20 bp, Artificial
  CRISPR gRNA sequence
cctctcacacccctcgttcc

SEQ ID NO: 579475 - DNA, 20 bp, Artificial
  CRISPR gRNA sequence
tcacacccctcgttccctta

SEQ ID NO: 579476 - DNA, 20 bp, Artificial
  CRISPR gRNA sequence
acacccctcgttcccttaac

SEQ ID NO: 579477 - DNA, 20 bp, Artificial
  CRISPR gRNA sequence
gttcccttaacacatgcccc

SEQ ID NO: 579478 - DNA, 20 bp, Artificial
  CRISPR gRNA sequence
ccttaacacatgcccctcag

SEQ ID NO: 579479 - DNA, 20 bp, Artificial
  CRISPR gRNA sequence
aacacatgcccctcagcacc

SEQ ID NO: 579480 - DNA, 20 bp, Artificial
  CRISPR gRNA sequence
acacatgcccctcagcacct

SEQ ID NO: 579481 - DNA, 20 bp, Artificial
  CRISPR gRNA sequence
agcacctactgcatgtcagg

SEQ ID NO: 579482 - DNA, 20 bp, Artificial
  CRISPR gRNA sequence
ctgcatgtcaggcctgaact

SEQ ID NO: 579483 - DNA, 20 bp, Artificial
  CRISPR gRNA sequence
catgtcaggcctgaactcac

SEQ ID NO: 579484 - DNA, 20 bp, Artificial
  CRISPR gRNA sequence
aactcaccacttgagcctgg

SEQ ID NO: 579485 - DNA, 20 bp, Artificial
  CRISPR gRNA sequence
accacttgagcctggccaga

SEQ ID NO: 579486 - DNA, 20 bp, Artificial
  CRISPR gRNA sequence
gagcctggccagagtgctgg

SEQ ID NO: 579487 - DNA, 20 bp, Artificial
  CRISPR gRNA sequence
agcctggccagagtgctgga

SEQ ID NO: 579488 - DNA, 20 bp, Artificial
  CRISPR gRNA sequence
gccagagtgctggagataat

SEQ ID NO: 579489 - DNA, 20 bp, Artificial
  CRISPR gRNA sequence
gagataatgttggaagtgtg

SEQ ID NO: 579490 - DNA, 20 bp, Artificial
  CRISPR gRNA sequence
gaagtgtggtgagttgagaa

SEQ ID NO: 579491 - DNA, 20 bp, Artificial
  CRISPR gRNA sequence
agaatgggccagggaggtga

SEQ ID NO: 579492 - DNA, 20 bp, Artificial
  CRISPR gRNA sequence
tgggtggagggacggcctgt

SEQ ID NO: 579493 - DNA, 20 bp, Artificial
  CRISPR gRNA sequence
ggtggagggacggcctgtgc

SEQ ID NO: 579494 - DNA, 20 bp, Artificial
  CRISPR gRNA sequence
tgcaaaggcctggctgcaag

SEQ ID NO: 579495 - DNA, 20 bp, Artificial
  CRISPR gRNA sequence
gctgcaaggaggacaggaca

SEQ ID NO: 579496 - DNA, 20 bp, Artificial
  CRISPR gRNA sequence
caaggaggacaggacatgtg

SEQ ID NO: 579497 - DNA, 20 bp, Artificial
  CRISPR gRNA sequence
ctgctaagggttgtgtgtag

SEQ ID NO: 579498 - DNA, 20 bp, Artificial
  CRISPR gRNA sequence
ctaagggttgtgtgtagtgt

SEQ ID NO: 579499 - DNA, 20 bp, Artificial
  CRISPR gRNA sequence
agggttgtgtgtagtgtggt

SEQ ID NO: 579500 - DNA, 20 bp, Artificial
  CRISPR gRNA sequence
tgtgtagtgtggtgtgtatt

SEQ ID NO: 579501 - DNA, 20 bp, Artificial
  CRISPR gRNA sequence
gtgtgtgtgtgtgtgtgaga

SEQ ID NO: 579502 - DNA, 20 bp, Artificial
  CRISPR gRNA sequence
tgtgtgtgtgtgtgtgagag

SEQ ID NO: 579503 - DNA, 20 bp, Artificial
  CRISPR gRNA sequence
aggggaggcagcagcagcca

SEQ ID NO: 579504 - DNA, 20 bp, Artificial
  CRISPR gRNA sequence
gaggagctagaactttggga

SEQ ID NO: 579505 - DNA, 20 bp, Artificial
  CRISPR gRNA sequence
gaactttgggaacagtggaa

SEQ ID NO: 579506 - DNA, 20 bp, Artificial
  CRISPR gRNA sequence
tgggaacagtggaataaggc

SEQ ID NO: 579507 - DNA, 20 bp, Artificial
  CRISPR gRNA sequence
gggaacagtggaataaggct

SEQ ID NO: 579508 - DNA, 20 bp, Artificial
  CRISPR gRNA sequence
ggaacagtggaataaggctg

SEQ ID NO: 579509 - DNA, 20 bp, Artificial
  CRISPR gRNA sequence
gcatgttggcatgaggagta

SEQ ID NO: 579510 - DNA, 20 bp, Artificial
  CRISPR gRNA sequence
gcatgaggagtagcagggca

SEQ ID NO: 579511 - DNA, 20 bp, Artificial
  CRISPR gRNA sequence
tagagcctggctacatgggt

SEQ ID NO: 579512 - DNA, 20 bp, Artificial
  CRISPR gRNA sequence
gagcctggctacatgggttc

SEQ ID NO: 579513 - DNA, 20 bp, Artificial
  CRISPR gRNA sequence
gctacatgggttcaaatccc

SEQ ID NO: 579514 - DNA, 20 bp, Artificial
  CRISPR gRNA sequence
catgggttcaaatcccagct

SEQ ID NO: 579515 - DNA, 20 bp, Artificial
  CRISPR gRNA sequence
aaatcccagctctgtcactc

SEQ ID NO: 579516 - DNA, 20 bp, Artificial
  CRISPR gRNA sequence
tgtcactcaggaactgggag

SEQ ID NO: 579517 - DNA, 20 bp, Artificial
  CRISPR gRNA sequence
tcactcaggaactgggagat

SEQ ID NO: 579518 - DNA, 20 bp, Artificial
  CRISPR gRNA sequence
aggaactgggagattttgat

SEQ ID NO: 579519 - DNA, 20 bp, Artificial
  CRISPR gRNA sequence
ggagattttgatcaagacac

SEQ ID NO: 579520 - DNA, 20 bp, Artificial
  CRISPR gRNA sequence
tgatcaagacacttaacctc

SEQ ID NO: 579521 - DNA, 20 bp, Artificial
  CRISPR gRNA sequence
gatcaagacacttaacctct

SEQ ID NO: 579522 - DNA, 20 bp, Artificial
  CRISPR gRNA sequence
atcaagacacttaacctctt

SEQ ID NO: 579523 - DNA, 20 bp, Artificial
  CRISPR gRNA sequence
aacctctttggcctcagtct

SEQ ID NO: 579524 - DNA, 20 bp, Artificial
  CRISPR gRNA sequence
acctctttggcctcagtctc

SEQ ID NO: 579525 - DNA, 20 bp, Artificial
  CRISPR gRNA sequence
tttggcctcagtctccttgt

SEQ ID NO: 579526 - DNA, 20 bp, Artificial
  CRISPR gRNA sequence
tggcctcagtctccttgtct

SEQ ID NO: 579527 - DNA, 20 bp, Artificial
  CRISPR gRNA sequence
ggcctcagtctccttgtctg

SEQ ID NO: 579528 - DNA, 20 bp, Artificial
  CRISPR gRNA sequence
gcctcagtctccttgtctgt

SEQ ID NO: 579529 - DNA, 20 bp, Artificial
  CRISPR gRNA sequence
agtctccttgtctgtaaaat

SEQ ID NO: 579530 - DNA, 20 bp, Artificial
  CRISPR gRNA sequence
cttgtctgtaaaatgggggt

SEQ ID NO: 579531 - DNA, 20 bp, Artificial
  CRISPR gRNA sequence
gtctgtaaaatgggggtaaa

SEQ ID NO: 579532 - DNA, 20 bp, Artificial
  CRISPR gRNA sequence
tctgtaaaatgggggtaaat

SEQ ID NO: 579533 - DNA, 20 bp, Artificial
  CRISPR gRNA sequence
taaaatgggggtaaataaca

SEQ ID NO: 579534 - DNA, 20 bp, Artificial
  CRISPR gRNA sequence
cttattatacatacgagaaa

SEQ ID NO: 579535 - DNA, 20 bp, Artificial
  CRISPR gRNA sequence
ttattatacatacgagaaaa

SEQ ID NO: 579536 - DNA, 20 bp, Artificial
  CRISPR gRNA sequence
attatacatacgagaaaact

SEQ ID NO: 579537 - DNA, 20 bp, Artificial
  CRISPR gRNA sequence
ttatacatacgagaaaactg

SEQ ID NO: 579538 - DNA, 20 bp, Artificial
  CRISPR gRNA sequence
tacatacgagaaaactgagg

SEQ ID NO: 579539 - DNA, 20 bp, Artificial
  CRISPR gRNA sequence
aggtcgagagaagctaagta

SEQ ID NO: 579540 - DNA, 20 bp, Artificial
  CRISPR gRNA sequence
agtaatttgtccaaggtcac

SEQ ID NO: 579541 - DNA, 20 bp, Artificial
  CRISPR gRNA sequence
gtccaaggtcacacagccag

SEQ ID NO: 579542 - DNA, 20 bp, Artificial
  CRISPR gRNA sequence
tccaaggtcacacagccagt

SEQ ID NO: 579543 - DNA, 20 bp, Artificial
  CRISPR gRNA sequence
ggatttgaacccacagtctc

SEQ ID NO: 579544 - DNA, 20 bp, Artificial
  CRISPR gRNA sequence
gaacccacagtctcagagtt

SEQ ID NO: 579545 - DNA, 20 bp, Artificial
  CRISPR gRNA sequence
aacccacagtctcagagttt

SEQ ID NO: 579546 - DNA, 20 bp, Artificial
  CRISPR gRNA sequence
agagtttagctcttgcatct

SEQ ID NO: 579547 - DNA, 20 bp, Artificial
  CRISPR gRNA sequence
agctcttgcatcttactact

SEQ ID NO: 579548 - DNA, 20 bp, Artificial
  CRISPR gRNA sequence
gctcttgcatcttactactt

SEQ ID NO: 579549 - DNA, 20 bp, Artificial
  CRISPR gRNA sequence
ttgcatcttactacttattg

SEQ ID NO: 579550 - DNA, 20 bp, Artificial
  CRISPR gRNA sequence
gcatcttactacttattggg

SEQ ID NO: 579551 - DNA, 20 bp, Artificial
  CRISPR gRNA sequence
catcttactacttattggga

SEQ ID NO: 579552 - DNA, 20 bp, Artificial
  CRISPR gRNA sequence
actacttattgggatgaagc

SEQ ID NO: 579553 - DNA, 20 bp, Artificial
  CRISPR gRNA sequence
ctacttattgggatgaagcc

SEQ ID NO: 579554 - DNA, 20 bp, Artificial
  CRISPR gRNA sequence
cttattgggatgaagcctga

SEQ ID NO: 579555 - DNA, 20 bp, Artificial
  CRISPR gRNA sequence
attgggatgaagcctgagct

SEQ ID NO: 579556 - DNA, 20 bp, Artificial
  CRISPR gRNA sequence
ttgggatgaagcctgagctg

SEQ ID NO: 579557 - DNA, 20 bp, Artificial
  CRISPR gRNA sequence
ggatgaagcctgagctgaga

SEQ ID NO: 579558 - DNA, 20 bp, Artificial
  CRISPR gRNA sequence
agctgagatctgcaccctag

SEQ ID NO: 579559 - DNA, 20 bp, Artificial
  CRISPR gRNA sequence
agatctgcaccctagacctc

SEQ ID NO: 579560 - DNA, 20 bp, Artificial
  CRISPR gRNA sequence
caccctagacctctccccac

SEQ ID NO: 579561 - DNA, 20 bp, Artificial
  CRISPR gRNA sequence
gacctctccccacaagccag

SEQ ID NO: 579562 - DNA, 20 bp, Artificial
  CRISPR gRNA sequence
tccccacaagccagggccgg

SEQ ID NO: 579563 - DNA, 20 bp, Artificial
  CRISPR gRNA sequence
cccacaagccagggccggta

SEQ ID NO: 579564 - DNA, 20 bp, Artificial
  CRISPR gRNA sequence
gcacaggcctgggccactca

SEQ ID NO: 579565 - DNA, 20 bp, Artificial
  CRISPR gRNA sequence
ggccactcacttgaggaagt

SEQ ID NO: 579566 - DNA, 20 bp, Artificial
  CRISPR gRNA sequence
acttgaggaagtcctctggc

SEQ ID NO: 579567 - DNA, 20 bp, Artificial
  CRISPR gRNA sequence
gaggaagtcctctggctctt

SEQ ID NO: 579568 - DNA, 20 bp, Artificial
  CRISPR gRNA sequence
aggaagtcctctggctcttc

SEQ ID NO: 579569 - DNA, 20 bp, Artificial
  CRISPR gRNA sequence
tggctcttcgaagaccttct

SEQ ID NO: 579570 - DNA, 20 bp, Artificial
  CRISPR gRNA sequence
gctcttcgaagaccttctca

SEQ ID NO: 579571 - DNA, 20 bp, Artificial
  CRISPR gRNA sequence
ttcgaagaccttctcacatc

SEQ ID NO: 579572 - DNA, 20 bp, Artificial
  CRISPR gRNA sequence
cgaagaccttctcacatccg

SEQ ID NO: 579573 - DNA, 20 bp, Artificial
  CRISPR gRNA sequence
gaagaccttctcacatccgg

SEQ ID NO: 579574 - DNA, 20 bp, Artificial
  CRISPR gRNA sequence
ctcacatccgggccacttgc

SEQ ID NO: 579575 - DNA, 20 bp, Artificial
  CRISPR gRNA sequence
tcacatccgggccacttgca

SEQ ID NO: 579576 - DNA, 20 bp, Artificial
  CRISPR gRNA sequence
acatccgggccacttgcaga

SEQ ID NO: 579577 - DNA, 20 bp, Artificial
  CRISPR gRNA sequence
gcagacaccatttgccagca

SEQ ID NO: 579578 - DNA, 20 bp, Artificial
  CRISPR gRNA sequence
cagacaccatttgccagcag

SEQ ID NO: 579579 - DNA, 20 bp, Artificial
  CRISPR gRNA sequence
gccagcagtgggtaggagct

SEQ ID NO: 579580 - DNA, 20 bp, Artificial
  CRISPR gRNA sequence
ccagcagtgggtaggagctc

SEQ ID NO: 579581 - DNA, 20 bp, Artificial
  CRISPR gRNA sequence
tggggcacagccgaaagggt

SEQ ID NO: 579582 - DNA, 20 bp, Artificial
  CRISPR gRNA sequence
gggcacagccgaaagggtgc

SEQ ID NO: 579583 - DNA, 20 bp, Artificial
  CRISPR gRNA sequence
gggggacagagggtgtcagg

SEQ ID NO: 579584 - DNA, 20 bp, Artificial
  CRISPR gRNA sequence
cccagccctgtccactgacc

SEQ ID NO: 579585 - DNA, 20 bp, Artificial
  CRISPR gRNA sequence
ccagccctgtccactgacct

SEQ ID NO: 579586 - DNA, 20 bp, Artificial
  CRISPR gRNA sequence
tccactgacctgtccttcct

SEQ ID NO: 579587 - DNA, 20 bp, Artificial
  CRISPR gRNA sequence
acctgtccttcctgggtgca

SEQ ID NO: 579588 - DNA, 20 bp, Artificial
  CRISPR gRNA sequence
tccttcctgggtgcactggg

SEQ ID NO: 579589 - DNA, 20 bp, Artificial
  CRISPR gRNA sequence
cctgggtgcactgggatttg

SEQ ID NO: 579590 - DNA, 20 bp, Artificial
  CRISPR gRNA sequence
ctgggtgcactgggatttgg

SEQ ID NO: 579591 - DNA, 20 bp, Artificial
  CRISPR gRNA sequence
ggtgcactgggatttgggaa

SEQ ID NO: 579592 - DNA, 20 bp, Artificial
  CRISPR gRNA sequence
ggatttgggaaggtgcagag

SEQ ID NO: 579593 - DNA, 20 bp, Artificial
  CRISPR gRNA sequence
gggaaggtgcagagcagtgc

SEQ ID NO: 579594 - DNA, 20 bp, Artificial
  CRISPR gRNA sequence
ggaaggtgcagagcagtgcc

SEQ ID NO: 579595 - DNA, 20 bp, Artificial
  CRISPR gRNA sequence
cctggacacccattccaggc

SEQ ID NO: 579596 - DNA, 20 bp, Artificial
  CRISPR gRNA sequence
gacacccattccaggctggc

SEQ ID NO: 579597 - DNA, 20 bp, Artificial
  CRISPR gRNA sequence
caggctggccacgttgatcc

SEQ ID NO: 579598 - DNA, 20 bp, Artificial
  CRISPR gRNA sequence
gccacgttgatccctgtggg

SEQ ID NO: 579599 - DNA, 20 bp, Artificial
  CRISPR gRNA sequence
atccctgtgggtggggacag

SEQ ID NO: 579600 - DNA, 20 bp, Artificial
  CRISPR gRNA sequence
tgggtggggacagggcacct

SEQ ID NO: 579601 - DNA, 20 bp, Artificial
  CRISPR gRNA sequence
tggaggctgtgggctgggct

SEQ ID NO: 579602 - DNA, 20 bp, Artificial
  CRISPR gRNA sequence
tgggctgggctctggagctt

SEQ ID NO: 579603 - DNA, 20 bp, Artificial
  CRISPR gRNA sequence
ggctctggagcttggcccac

SEQ ID NO: 579604 - DNA, 20 bp, Artificial
  CRISPR gRNA sequence
tggagcttggcccacaaggc

SEQ ID NO: 579605 - DNA, 20 bp, Artificial
  CRISPR gRNA sequence
gagcttggcccacaaggcct

SEQ ID NO: 579606 - DNA, 20 bp, Artificial
  CRISPR gRNA sequence
ggcccacaaggcctctcatt

SEQ ID NO: 579607 - DNA, 20 bp, Artificial
  CRISPR gRNA sequence
gcccacaaggcctctcattt

SEQ ID NO: 579608 - DNA, 20 bp, Artificial
  CRISPR gRNA sequence
tcattttgagcttcccaccc

SEQ ID NO: 579609 - DNA, 20 bp, Artificial
  CRISPR gRNA sequence
attttgagcttcccaccctc

SEQ ID NO: 579610 - DNA, 20 bp, Artificial
  CRISPR gRNA sequence
tgagcttcccaccctcctga

SEQ ID NO: 579611 - DNA, 20 bp, Artificial
  CRISPR gRNA sequence
gagcttcccaccctcctgag

SEQ ID NO: 579612 - DNA, 20 bp, Artificial
  CRISPR gRNA sequence
agcttcccaccctcctgagc

SEQ ID NO: 579613 - DNA, 20 bp, Artificial
  CRISPR gRNA sequence
cccaccctcctgagcctcga

SEQ ID NO: 579614 - DNA, 20 bp, Artificial
  CRISPR gRNA sequence
ccaccctcctgagcctcgaa

SEQ ID NO: 579615 - DNA, 20 bp, Artificial
  CRISPR gRNA sequence
ctgagcctcgaaaaccctga

SEQ ID NO: 579616 - DNA, 20 bp, Artificial
  CRISPR gRNA sequence
agcctcgaaaaccctgactc

SEQ ID NO: 579617 - DNA, 20 bp, Artificial
  CRISPR gRNA sequence
gaaaaccctgactcccaggg

SEQ ID NO: 579618 - DNA, 20 bp, Artificial
  CRISPR gRNA sequence
actcccagggggctctgctg

SEQ ID NO: 579619 - DNA, 20 bp, Artificial
  CRISPR gRNA sequence
ccagggggctctgctgtccc

SEQ ID NO: 579620 - DNA, 20 bp, Artificial
  CRISPR gRNA sequence
tgctgtccccaaagtcccag

SEQ ID NO: 579621 - DNA, 20 bp, Artificial
  CRISPR gRNA sequence
ctgtccccaaagtcccaggc

SEQ ID NO: 579622 - DNA, 20 bp, Artificial
  CRISPR gRNA sequence
tccccaaagtcccaggcttc

SEQ ID NO: 579623 - DNA, 20 bp, Artificial
  CRISPR gRNA sequence
ctggcagagaagcttaaaga

SEQ ID NO: 579624 - DNA, 20 bp, Artificial
  CRISPR gRNA sequence
tggcagagaagcttaaagac

SEQ ID NO: 579625 - DNA, 20 bp, Artificial
  CRISPR gRNA sequence
gcagagaagcttaaagacgg

SEQ ID NO: 579626 - DNA, 20 bp, Artificial
  CRISPR gRNA sequence
aaagacggccattcgcaggt

SEQ ID NO: 579627 - DNA, 20 bp, Artificial
  CRISPR gRNA sequence
aagacggccattcgcaggtg

SEQ ID NO: 579628 - DNA, 20 bp, Artificial
  CRISPR gRNA sequence
gcaggtgctgacattttgac

SEQ ID NO: 579629 - DNA, 20 bp, Artificial
  CRISPR gRNA sequence
acattttgactagctttgta

SEQ ID NO: 579630 - DNA, 20 bp, Artificial
  CRISPR gRNA sequence
tgactagctttgtaaagctc

SEQ ID NO: 579631 - DNA, 20 bp, Artificial
  CRISPR gRNA sequence
gactagctttgtaaagctct

SEQ ID NO: 579632 - DNA, 20 bp, Artificial
  CRISPR gRNA sequence
actagctttgtaaagctctg

SEQ ID NO: 579633 - DNA, 20 bp, Artificial
  CRISPR gRNA sequence
gctttgtaaagctctgtggt

SEQ ID NO: 579634 - DNA, 20 bp, Artificial
  CRISPR gRNA sequence
tgtaaagctctgtggttttg

SEQ ID NO: 579635 - DNA, 20 bp, Artificial
  CRISPR gRNA sequence
gtaaagctctgtggttttgt

SEQ ID NO: 579636 - DNA, 20 bp, Artificial
  CRISPR gRNA sequence
taaagctctgtggttttgtg

SEQ ID NO: 579637 - DNA, 20 bp, Artificial
  CRISPR gRNA sequence
tgtggttttgtgattttgac

SEQ ID NO: 579638 - DNA, 20 bp, Artificial
  CRISPR gRNA sequence
tggttttgtgattttgacat

SEQ ID NO: 579639 - DNA, 20 bp, Artificial
  CRISPR gRNA sequence
tgtgattttgacattctgca

SEQ ID NO: 579640 - DNA, 20 bp, Artificial
  CRISPR gRNA sequence
gtgattttgacattctgcat

SEQ ID NO: 579641 - DNA, 20 bp, Artificial
  CRISPR gRNA sequence
tgattttgacattctgcatc

SEQ ID NO: 579642 - DNA, 20 bp, Artificial
  CRISPR gRNA sequence
tgacattctgcatctttaag

SEQ ID NO: 579643 - DNA, 20 bp, Artificial
  CRISPR gRNA sequence
gacattctgcatctttaagg

SEQ ID NO: 579644 - DNA, 20 bp, Artificial
  CRISPR gRNA sequence
acattctgcatctttaaggt

SEQ ID NO: 579645 - DNA, 20 bp, Artificial
  CRISPR gRNA sequence
tgcatctttaaggttctgca

SEQ ID NO: 579646 - DNA, 20 bp, Artificial
  CRISPR gRNA sequence
catctttaaggttctgcacc

SEQ ID NO: 579647 - DNA, 20 bp, Artificial
  CRISPR gRNA sequence
taaggttctgcacctgacgt

SEQ ID NO: 579648 - DNA, 20 bp, Artificial
  CRISPR gRNA sequence
aaggttctgcacctgacgtt

SEQ ID NO: 579649 - DNA, 20 bp, Artificial
  CRISPR gRNA sequence
aggttctgcacctgacgttt

SEQ ID NO: 579650 - DNA, 20 bp, Artificial
  CRISPR gRNA sequence
tgcacctgacgttttttgga

SEQ ID NO: 579651 - DNA, 20 bp, Artificial
  CRISPR gRNA sequence
cacctgacgttttttggagg

SEQ ID NO: 579652 - DNA, 20 bp, Artificial
  CRISPR gRNA sequence
acgttttttggagggtggag

SEQ ID NO: 579653 - DNA, 20 bp, Artificial
  CRISPR gRNA sequence
tttggagggtggagtttcca

SEQ ID NO: 579654 - DNA, 20 bp, Artificial
  CRISPR gRNA sequence
ttggagggtggagtttccaa

SEQ ID NO: 579655 - DNA, 20 bp, Artificial
  CRISPR gRNA sequence
tggagggtggagtttccaag

SEQ ID NO: 579656 - DNA, 20 bp, Artificial
  CRISPR gRNA sequence
ggagggtggagtttccaagc

SEQ ID NO: 579657 - DNA, 20 bp, Artificial
  CRISPR gRNA sequence
gagggtggagtttccaagcc

SEQ ID NO: 579658 - DNA, 20 bp, Artificial
  CRISPR gRNA sequence
ccaagcctctgagacctgac

SEQ ID NO: 579659 - DNA, 20 bp, Artificial
  CRISPR gRNA sequence
caagcctctgagacctgaca

SEQ ID NO: 579660 - DNA, 20 bp, Artificial
  CRISPR gRNA sequence
tgagacctgacacctttgac

SEQ ID NO: 579661 - DNA, 20 bp, Artificial
  CRISPR gRNA sequence
agacctgacacctttgaccc

SEQ ID NO: 579662 - DNA, 20 bp, Artificial
  CRISPR gRNA sequence
acacctttgacccccagagt

SEQ ID NO: 579663 - DNA, 20 bp, Artificial
  CRISPR gRNA sequence
tgacccccagagtactgcaa

SEQ ID NO: 579664 - DNA, 20 bp, Artificial
  CRISPR gRNA sequence
gacccccagagtactgcaat

SEQ ID NO: 579665 - DNA, 20 bp, Artificial
  CRISPR gRNA sequence
acccccagagtactgcaatt

SEQ ID NO: 579666 - DNA, 20 bp, Artificial
  CRISPR gRNA sequence
caattcagaatagcctacac

SEQ ID NO: 579667 - DNA, 20 bp, Artificial
  CRISPR gRNA sequence
agaatagcctacactgctca

SEQ ID NO: 579668 - DNA, 20 bp, Artificial
  CRISPR gRNA sequence
cactgctcacagccaaggat

SEQ ID NO: 579669 - DNA, 20 bp, Artificial
  CRISPR gRNA sequence
ctcacagccaaggatctggg

SEQ ID NO: 579670 - DNA, 20 bp, Artificial
  CRISPR gRNA sequence
acagccaaggatctggggac

SEQ ID NO: 579671 - DNA, 20 bp, Artificial
  CRISPR gRNA sequence
gggacttgggggttctgtga

SEQ ID NO: 579672 - DNA, 20 bp, Artificial
  CRISPR gRNA sequence
gggggttctgtgaagccatg

SEQ ID NO: 579673 - DNA, 20 bp, Artificial
  CRISPR gRNA sequence
ggggttctgtgaagccatgg

SEQ ID NO: 579674 - DNA, 20 bp, Artificial
  CRISPR gRNA sequence
tgtgaagccatggggtacgg

SEQ ID NO: 579675 - DNA, 20 bp, Artificial
  CRISPR gRNA sequence
tgaagccatggggtacgggc

SEQ ID NO: 579676 - DNA, 20 bp, Artificial
  CRISPR gRNA sequence
aggtgttaccaggtgggagg

SEQ ID NO: 579677 - DNA, 20 bp, Artificial
  CRISPR gRNA sequence
ccaggtgggaggccaggccg

SEQ ID NO: 579678 - DNA, 20 bp, Artificial
  CRISPR gRNA sequence
gagggagaagaccccagtgg

SEQ ID NO: 579679 - DNA, 20 bp, Artificial
  CRISPR gRNA sequence
agggagaagaccccagtggc

SEQ ID NO: 579680 - DNA, 20 bp, Artificial
  CRISPR gRNA sequence
atcatggctgggctctccag

SEQ ID NO: 579681 - DNA, 20 bp, Artificial
  CRISPR gRNA sequence
ggctctccagggggtgcacc

SEQ ID NO: 579682 - DNA, 20 bp, Artificial
  CRISPR gRNA sequence
tccagggggtgcacctgcag

SEQ ID NO: 579683 - DNA, 20 bp, Artificial
  CRISPR gRNA sequence
cagggggtgcacctgcagca

SEQ ID NO: 579684 - DNA, 20 bp, Artificial
  CRISPR gRNA sequence
cagcacaggggtccgggcgt

SEQ ID NO: 579685 - DNA, 20 bp, Artificial
  CRISPR gRNA sequence
agagctggggggcacatgtg

SEQ ID NO: 579686 - DNA, 20 bp, Artificial
  CRISPR gRNA sequence
gggggcacatgtgggctgtg

SEQ ID NO: 579687 - DNA, 20 bp, Artificial
  CRISPR gRNA sequence
tggttcagcctgactcgggg

SEQ ID NO: 579688 - DNA, 20 bp, Artificial
  CRISPR gRNA sequence
agcctgactcggggcccctc

SEQ ID NO: 579689 - DNA, 20 bp, Artificial
  CRISPR gRNA sequence
actcggggcccctccccaca

SEQ ID NO: 579690 - DNA, 20 bp, Artificial
  CRISPR gRNA sequence
ggggcccctccccacagttc

SEQ ID NO: 579691 - DNA, 20 bp, Artificial
  CRISPR gRNA sequence
cccacagttctcccacctgc

SEQ ID NO: 579692 - DNA, 20 bp, Artificial
  CRISPR gRNA sequence
tcccacctgctccctcctcc

SEQ ID NO: 579693 - DNA, 20 bp, Artificial
  CRISPR gRNA sequence
ccacctgctccctcctccct

SEQ ID NO: 579694 - DNA, 20 bp, Artificial
  CRISPR gRNA sequence
ctccctcctccctgcccatt

SEQ ID NO: 579695 - DNA, 20 bp, Artificial
  CRISPR gRNA sequence
cctcctccctgcccattcac

SEQ ID NO: 579696 - DNA, 20 bp, Artificial
  CRISPR gRNA sequence
ctccctgcccattcaccgtc

SEQ ID NO: 579697 - DNA, 20 bp, Artificial
  CRISPR gRNA sequence
cctgcccattcaccgtccat

SEQ ID NO: 579698 - DNA, 20 bp, Artificial
  CRISPR gRNA sequence
cccattcaccgtccatacct

SEQ ID NO: 579699 - DNA, 20 bp, Artificial
  CRISPR gRNA sequence
accgtccatacctggtgcat

SEQ ID NO: 579700 - DNA, 20 bp, Artificial
  CRISPR gRNA sequence
gtgcatgaaatgtggcctgt

SEQ ID NO: 579701 - DNA, 20 bp, Artificial
  CRISPR gRNA sequence
tcctggaggagtgcctgtaa

SEQ ID NO: 579702 - DNA, 20 bp, Artificial
  CRISPR gRNA sequence
gaggagtgcctgtaagtggg

SEQ ID NO: 579703 - DNA, 20 bp, Artificial
  CRISPR gRNA sequence
taagtggggcaaggggccca

SEQ ID NO: 579704 - DNA, 20 bp, Artificial
  CRISPR gRNA sequence
ggggcagtgtgggcagctgg

SEQ ID NO: 579705 - DNA, 20 bp, Artificial
  CRISPR gRNA sequence
ggcagaaaggcaggtgggtg

SEQ ID NO: 579706 - DNA, 20 bp, Artificial
  CRISPR gRNA sequence
atcctcactgttctgtgtct

SEQ ID NO: 579707 - DNA, 20 bp, Artificial
  CRISPR gRNA sequence
actgttctgtgtctaattca

SEQ ID NO: 579708 - DNA, 20 bp, Artificial
  CRISPR gRNA sequence
ttctgtgtctaattcaaata

SEQ ID NO: 579709 - DNA, 20 bp, Artificial
  CRISPR gRNA sequence
tgtgtctaattcaaatactc

SEQ ID NO: 579710 - DNA, 20 bp, Artificial
  CRISPR gRNA sequence
tgtctaattcaaatactctg

SEQ ID NO: 579711 - DNA, 20 bp, Artificial
  CRISPR gRNA sequence
attcaaatactctgcactgc

SEQ ID NO: 579712 - DNA, 20 bp, Artificial
  CRISPR gRNA sequence
aaatactctgcactgcaagc

SEQ ID NO: 579713 - DNA, 20 bp, Artificial
  CRISPR gRNA sequence
tgcactgcaagcccacatgg

SEQ ID NO: 579714 - DNA, 20 bp, Artificial
  CRISPR gRNA sequence
cactgcaagcccacatggta

SEQ ID NO: 579715 - DNA, 20 bp, Artificial
  CRISPR gRNA sequence
caagcccacatggtagatgc

SEQ ID NO: 579716 - DNA, 20 bp, Artificial
  CRISPR gRNA sequence
tgatcatcccccttttacac

SEQ ID NO: 579717 - DNA, 20 bp, Artificial
  CRISPR gRNA sequence
ttacacgtatggaaactgag

SEQ ID NO: 579718 - DNA, 20 bp, Artificial
  CRISPR gRNA sequence
tacacgtatggaaactgagg

SEQ ID NO: 579719 - DNA, 20 bp, Artificial
  CRISPR gRNA sequence
acacgtatggaaactgaggc

SEQ ID NO: 579720 - DNA, 20 bp, Artificial
  CRISPR gRNA sequence
cacgtatggaaactgaggct

SEQ ID NO: 579721 - DNA, 20 bp, Artificial
  CRISPR gRNA sequence
aggctcatggagatcgagta

SEQ ID NO: 579722 - DNA, 20 bp, Artificial
  CRISPR gRNA sequence
atggagatcgagtaactttt

SEQ ID NO: 579723 - DNA, 20 bp, Artificial
  CRISPR gRNA sequence
tttaaagatcaaacagctaa

SEQ ID NO: 579724 - DNA, 20 bp, Artificial
  CRISPR gRNA sequence
ttaaagatcaaacagctaat

SEQ ID NO: 579725 - DNA, 20 bp, Artificial
  CRISPR gRNA sequence
taaagatcaaacagctaata

SEQ ID NO: 579726 - DNA, 20 bp, Artificial
  CRISPR gRNA sequence
aaagatcaaacagctaataa

SEQ ID NO: 579727 - DNA, 20 bp, Artificial
  CRISPR gRNA sequence
aagatcaaacagctaataag

SEQ ID NO: 579728 - DNA, 20 bp, Artificial
  CRISPR gRNA sequence
ataagttgcagagctggcct

SEQ ID NO: 579729 - DNA, 20 bp, Artificial
  CRISPR gRNA sequence
cagagctggcctcagccctg

SEQ ID NO: 579730 - DNA, 20 bp, Artificial
  CRISPR gRNA sequence
gcctcagccctgtcacctca

SEQ ID NO: 579731 - DNA, 20 bp, Artificial
  CRISPR gRNA sequence
agccctgtcacctcacctac

SEQ ID NO: 579732 - DNA, 20 bp, Artificial
  CRISPR gRNA sequence
tcacctcacctacttggccc

SEQ ID NO: 579733 - DNA, 20 bp, Artificial
  CRISPR gRNA sequence
acctacttggccccagtcct

SEQ ID NO: 579734 - DNA, 20 bp, Artificial
  CRISPR gRNA sequence
cttggccccagtcctcttct

SEQ ID NO: 579735 - DNA, 20 bp, Artificial
  CRISPR gRNA sequence
ggccccagtcctcttctctt

SEQ ID NO: 579736 - DNA, 20 bp, Artificial
  CRISPR gRNA sequence
gccccagtcctcttctcttg

SEQ ID NO: 579737 - DNA, 20 bp, Artificial
  CRISPR gRNA sequence
ttctcttgtcacatggggat

SEQ ID NO: 579738 - DNA, 20 bp, Artificial
  CRISPR gRNA sequence
ctcttgtcacatggggatgg

SEQ ID NO: 579739 - DNA, 20 bp, Artificial
  CRISPR gRNA sequence
tcttgtcacatggggatggg

SEQ ID NO: 579740 - DNA, 20 bp, Artificial
  CRISPR gRNA sequence
ttgtcacatggggatgggga

SEQ ID NO: 579741 - DNA, 20 bp, Artificial
  CRISPR gRNA sequence
gtcacatggggatggggaca

SEQ ID NO: 579742 - DNA, 20 bp, Artificial
  CRISPR gRNA sequence
tcacatggggatggggacac

SEQ ID NO: 579743 - DNA, 20 bp, Artificial
  CRISPR gRNA sequence
tgctcatgggactacaatac

SEQ ID NO: 579744 - DNA, 20 bp, Artificial
  CRISPR gRNA sequence
atgggactacaatacggcct

SEQ ID NO: 579745 - DNA, 20 bp, Artificial
  CRISPR gRNA sequence
caatacggcctcctcctctc

SEQ ID NO: 579746 - DNA, 20 bp, Artificial
  CRISPR gRNA sequence
ctcctctcctgagacaggga

SEQ ID NO: 579747 - DNA, 20 bp, Artificial
  CRISPR gRNA sequence
ctctcctgagacagggattg

SEQ ID NO: 579748 - DNA, 20 bp, Artificial
  CRISPR gRNA sequence
tcctgagacagggattggga

SEQ ID NO: 579749 - DNA, 20 bp, Artificial
  CRISPR gRNA sequence
ctgagacagggattgggagg

SEQ ID NO: 579750 - DNA, 20 bp, Artificial
  CRISPR gRNA sequence
agacagggattgggaggtcg

SEQ ID NO: 579751 - DNA, 20 bp, Artificial
  CRISPR gRNA sequence
ggaggtcggggagagcctcc

SEQ ID NO: 579752 - DNA, 20 bp, Artificial
  CRISPR gRNA sequence
caatctctgaggcctggcag

SEQ ID NO: 579753 - DNA, 20 bp, Artificial
  CRISPR gRNA sequence
tgaggcctggcaggtgggga

SEQ ID NO: 579754 - DNA, 20 bp, Artificial
  CRISPR gRNA sequence
aggcctggcaggtggggatt

SEQ ID NO: 579755 - DNA, 20 bp, Artificial
  CRISPR gRNA sequence
gcaggtggggattttcttgg

SEQ ID NO: 579756 - DNA, 20 bp, Artificial
  CRISPR gRNA sequence
tcttggccctgcaacatctg

SEQ ID NO: 579757 - DNA, 20 bp, Artificial
  CRISPR gRNA sequence
cttggccctgcaacatctgc

SEQ ID NO: 579758 - DNA, 20 bp, Artificial
  CRISPR gRNA sequence
ttggccctgcaacatctgca

SEQ ID NO: 579759 - DNA, 20 bp, Artificial
  CRISPR gRNA sequence
ggccctgcaacatctgcata

SEQ ID NO: 579760 - DNA, 20 bp, Artificial
  CRISPR gRNA sequence
gccctgcaacatctgcataa

SEQ ID NO: 579761 - DNA, 20 bp, Artificial
  CRISPR gRNA sequence
caacatctgcataagtcaca

SEQ ID NO: 579762 - DNA, 20 bp, Artificial
  CRISPR gRNA sequence
cataagtcacagacttgcct

SEQ ID NO: 579763 - DNA, 20 bp, Artificial
  CRISPR gRNA sequence
gcctgggacccagaaaccac

SEQ ID NO: 579764 - DNA, 20 bp, Artificial
  CRISPR gRNA sequence
cctgggacccagaaaccact

SEQ ID NO: 579765 - DNA, 20 bp, Artificial
  CRISPR gRNA sequence
ggacccagaaaccacttcct

SEQ ID NO: 579766 - DNA, 20 bp, Artificial
  CRISPR gRNA sequence
cctgtgccccagccagcccc

SEQ ID NO: 579767 - DNA, 20 bp, Artificial
  CRISPR gRNA sequence
ctgtgccccagccagccccc

SEQ ID NO: 579768 - DNA, 20 bp, Artificial
  CRISPR gRNA sequence
tgccccagccagcccccctc

SEQ ID NO: 579769 - DNA, 20 bp, Artificial
  CRISPR gRNA sequence
ccgcccagtgccacagtaaa

SEQ ID NO: 579770 - DNA, 20 bp, Artificial
  CRISPR gRNA sequence
taggtccaggtaccccaccc

SEQ ID NO: 579771 - DNA, 20 bp, Artificial
  CRISPR gRNA sequence
cctgccccatcctgggccca

SEQ ID NO: 579772 - DNA, 20 bp, Artificial
  CRISPR gRNA sequence
ccccatcctgggcccagggc

SEQ ID NO: 579773 - DNA, 20 bp, Artificial
  CRISPR gRNA sequence
ggcccagggcctcacctgca

SEQ ID NO: 579774 - DNA, 20 bp, Artificial
  CRISPR gRNA sequence
acctgcagctgcgatggtgg

SEQ ID NO: 579775 - DNA, 20 bp, Artificial
  CRISPR gRNA sequence
cagctgcgatggtggcatgg

SEQ ID NO: 579776 - DNA, 20 bp, Artificial
  CRISPR gRNA sequence
cgatggtggcatggggttca

SEQ ID NO: 579777 - DNA, 20 bp, Artificial
  CRISPR gRNA sequence
aaggaagaagaggaggcatg

SEQ ID NO: 579778 - DNA, 20 bp, Artificial
  CRISPR gRNA sequence
gaagatctcggccctggaag

SEQ ID NO: 579779 - DNA, 20 bp, Artificial
  CRISPR gRNA sequence
ggccctggaaggttccccct

SEQ ID NO: 579780 - DNA, 20 bp, Artificial
  CRISPR gRNA sequence
gaaggttccccctgggcccc

SEQ ID NO: 579781 - DNA, 20 bp, Artificial
  CRISPR gRNA sequence
cccctgggccccgggccccc

SEQ ID NO: 579782 - DNA, 20 bp, Artificial
  CRISPR gRNA sequence
ggccccgggcccccagcagg

SEQ ID NO: 579783 - DNA, 20 bp, Artificial
  CRISPR gRNA sequence
aggctttgggtgcagccctc

SEQ ID NO: 579784 - DNA, 20 bp, Artificial
  CRISPR gRNA sequence
tgggtgcagccctccagctg

SEQ ID NO: 579785 - DNA, 20 bp, Artificial
  CRISPR gRNA sequence
gggtgcagccctccagctgg

SEQ ID NO: 579786 - DNA, 20 bp, Artificial
  CRISPR gRNA sequence
ggtgcagccctccagctggg

SEQ ID NO: 579787 - DNA, 20 bp, Artificial
  CRISPR gRNA sequence
cagctgggcgaggctcctgg

SEQ ID NO: 579788 - DNA, 20 bp, Artificial
  CRISPR gRNA sequence
ggcgaggctcctggggatgg

SEQ ID NO: 579789 - DNA, 20 bp, Artificial
  CRISPR gRNA sequence
ctggggatgggccaagggcc

SEQ ID NO: 579790 - DNA, 20 bp, Artificial
  CRISPR gRNA sequence
gggatgggccaagggccaag

SEQ ID NO: 579791 - DNA, 20 bp, Artificial
  CRISPR gRNA sequence
gccaggcctggggttgggca

SEQ ID NO: 579792 - DNA, 20 bp, Artificial
  CRISPR gRNA sequence
ccaggcctggggttgggcat

SEQ ID NO: 579793 - DNA, 20 bp, Artificial
  CRISPR gRNA sequence
gggttgggcatcgggtcctt

SEQ ID NO: 579794 - DNA, 20 bp, Artificial
  CRISPR gRNA sequence
ggcatcgggtccttgtccaa

SEQ ID NO: 579795 - DNA, 20 bp, Artificial
  CRISPR gRNA sequence
gtccaagggcaggctgcgta

SEQ ID NO: 579796 - DNA, 20 bp, Artificial
  CRISPR gRNA sequence
tccaagggcaggctgcgtag

SEQ ID NO: 579797 - DNA, 20 bp, Artificial
  CRISPR gRNA sequence
cgtagacaataggggaaagg

SEQ ID NO: 579798 - DNA, 20 bp, Artificial
  CRISPR gRNA sequence
gggcggtatgagatactcga

SEQ ID NO: 579799 - DNA, 20 bp, Artificial
  CRISPR gRNA sequence
gaccacctgagccacgtgga

SEQ ID NO: 579800 - DNA, 20 bp, Artificial
  CRISPR gRNA sequence
agccacgtggacactcctct

SEQ ID NO: 579801 - DNA, 20 bp, Artificial
  CRISPR gRNA sequence
ctctggtcaaagcaggcatt

SEQ ID NO: 579802 - DNA, 20 bp, Artificial
  CRISPR gRNA sequence
tggtcaaagcaggcattggc

SEQ ID NO: 579803 - DNA, 20 bp, Artificial
  CRISPR gRNA sequence
gtcaaagcaggcattggctg

SEQ ID NO: 579804 - DNA, 20 bp, Artificial
  CRISPR gRNA sequence
gctgggacatgtcccgaggg

SEQ ID NO: 579805 - DNA, 20 bp, Artificial
  CRISPR gRNA sequence
ggacatgtcccgaggggccc

SEQ ID NO: 579806 - DNA, 20 bp, Artificial
  CRISPR gRNA sequence
caccccagctctagacacac

SEQ ID NO: 579807 - DNA, 20 bp, Artificial
  CRISPR gRNA sequence
tagacacacacacacacaca

SEQ ID NO: 579808 - DNA, 20 bp, Artificial
  CRISPR gRNA sequence
gacacacacacacacacaca

SEQ ID NO: 579809 - DNA, 20 bp, Artificial
  CRISPR gRNA sequence
gcttgcctgcccacgctagc

SEQ ID NO: 579810 - DNA, 20 bp, Artificial
  CRISPR gRNA sequence
gcctgcccacgctagcacag

SEQ ID NO: 579811 - DNA, 20 bp, Artificial
  CRISPR gRNA sequence
cctgcccacgctagcacagc

SEQ ID NO: 579812 - DNA, 20 bp, Artificial
  CRISPR gRNA sequence
cccacgctagcacagccctg

SEQ ID NO: 579813 - DNA, 20 bp, Artificial
  CRISPR gRNA sequence
gcacagccctggtgtggatg

SEQ ID NO: 579814 - DNA, 20 bp, Artificial
  CRISPR gRNA sequence
gtgtggatgtgtcctctatg

SEQ ID NO: 579815 - DNA, 20 bp, Artificial
  CRISPR gRNA sequence
tatgagggcaatggttgttt

SEQ ID NO: 579816 - DNA, 20 bp, Artificial
  CRISPR gRNA sequence
tgagggcaatggttgtttcc

SEQ ID NO: 579817 - DNA, 20 bp, Artificial
  CRISPR gRNA sequence
tttccccctccacttgagag

SEQ ID NO: 579818 - DNA, 20 bp, Artificial
  CRISPR gRNA sequence
ccccctccacttgagagctg

SEQ ID NO: 579819 - DNA, 20 bp, Artificial
  CRISPR gRNA sequence
cccctccacttgagagctgt

SEQ ID NO: 579820 - DNA, 20 bp, Artificial
  CRISPR gRNA sequence
cacttgagagctgtttcaag

SEQ ID NO: 579821 - DNA, 20 bp, Artificial
  CRISPR gRNA sequence
gagagctgtttcaagcctca

SEQ ID NO: 579822 - DNA, 20 bp, Artificial
  CRISPR gRNA sequence
agagctgtttcaagcctcag

SEQ ID NO: 579823 - DNA, 20 bp, Artificial
  CRISPR gRNA sequence
tttcaagcctcaggcctcta

SEQ ID NO: 579824 - DNA, 20 bp, Artificial
  CRISPR gRNA sequence
caagcctcaggcctctagcc

SEQ ID NO: 579825 - DNA, 20 bp, Artificial
  CRISPR gRNA sequence
aagcctcaggcctctagccc

SEQ ID NO: 579826 - DNA, 20 bp, Artificial
  CRISPR gRNA sequence
aggcctctagccctccctgc

SEQ ID NO: 579827 - DNA, 20 bp, Artificial
  CRISPR gRNA sequence
tagccctccctgcaccctgc

SEQ ID NO: 579828 - DNA, 20 bp, Artificial
  CRISPR gRNA sequence
gccctccctgcaccctgcac

SEQ ID NO: 579829 - DNA, 20 bp, Artificial
  CRISPR gRNA sequence
cctgcaccctgcacaggctg

SEQ ID NO: 579830 - DNA, 20 bp, Artificial
  CRISPR gRNA sequence
caccctgcacaggctgtgtt

SEQ ID NO: 579831 - DNA, 20 bp, Artificial
  CRISPR gRNA sequence
cacaggctgtgtttgctcat

SEQ ID NO: 579832 - DNA, 20 bp, Artificial
  CRISPR gRNA sequence
tgtttgctcatcttgccgga

SEQ ID NO: 579833 - DNA, 20 bp, Artificial
  CRISPR gRNA sequence
gctcatcttgccggagctgg

SEQ ID NO: 579834 - DNA, 20 bp, Artificial
  CRISPR gRNA sequence
ctcatcttgccggagctggt

SEQ ID NO: 579835 - DNA, 20 bp, Artificial
  CRISPR gRNA sequence
atcttgccggagctggtctc

SEQ ID NO: 579836 - DNA, 20 bp, Artificial
  CRISPR gRNA sequence
gccggagctggtctcggact

SEQ ID NO: 579837 - DNA, 20 bp, Artificial
  CRISPR gRNA sequence
ccggagctggtctcggactt

SEQ ID NO: 579838 - DNA, 20 bp, Artificial
  CRISPR gRNA sequence
gtctcggactttctcctcgg

SEQ ID NO: 579839 - DNA, 20 bp, Artificial
  CRISPR gRNA sequence
ggactttctcctcggagtcc

SEQ ID NO: 579840 - DNA, 20 bp, Artificial
  CRISPR gRNA sequence
tctcctcggagtcctatttt

SEQ ID NO: 579841 - DNA, 20 bp, Artificial
  CRISPR gRNA sequence
ctcctcggagtcctattttg

SEQ ID NO: 579842 - DNA, 20 bp, Artificial
  CRISPR gRNA sequence
tcctcggagtcctattttgc

SEQ ID NO: 579843 - DNA, 20 bp, Artificial
  CRISPR gRNA sequence
ctcggagtcctattttgccc

SEQ ID NO: 579844 - DNA, 20 bp, Artificial
  CRISPR gRNA sequence
ggagtcctattttgccccag

SEQ ID NO: 579845 - DNA, 20 bp, Artificial
  CRISPR gRNA sequence
ttttgccccagtgactaggc

SEQ ID NO: 579846 - DNA, 20 bp, Artificial
  CRISPR gRNA sequence
tgccccagtgactaggcatg

SEQ ID NO: 579847 - DNA, 20 bp, Artificial
  CRISPR gRNA sequence
gccccagtgactaggcatgg

SEQ ID NO: 579848 - DNA, 20 bp, Artificial
  CRISPR gRNA sequence
ccccagtgactaggcatgga

SEQ ID NO: 579849 - DNA, 20 bp, Artificial
  CRISPR gRNA sequence
ggcatggactcaaaagattc

SEQ ID NO: 579850 - DNA, 20 bp, Artificial
  CRISPR gRNA sequence
aaaagattcatctggctgct

SEQ ID NO: 579851 - DNA, 20 bp, Artificial
  CRISPR gRNA sequence
atctggctgctgtgagtggg

SEQ ID NO: 579852 - DNA, 20 bp, Artificial
  CRISPR gRNA sequence
gctgctgtgagtggggctag

SEQ ID NO: 579853 - DNA, 20 bp, Artificial
  CRISPR gRNA sequence
ctgtgagtggggctagtgag

SEQ ID NO: 579854 - DNA, 20 bp, Artificial
  CRISPR gRNA sequence
tgagtggggctagtgaggag

SEQ ID NO: 579855 - DNA, 20 bp, Artificial
  CRISPR gRNA sequence
gtgaggaggctattgtaaca

SEQ ID NO: 579856 - DNA, 20 bp, Artificial
  CRISPR gRNA sequence
ttgtaacagtcctggcaagt

SEQ ID NO: 579857 - DNA, 20 bp, Artificial
  CRISPR gRNA sequence
taacagtcctggcaagtgat

SEQ ID NO: 579858 - DNA, 20 bp, Artificial
  CRISPR gRNA sequence
gcaagtgatgatgctggcac

SEQ ID NO: 579859 - DNA, 20 bp, Artificial
  CRISPR gRNA sequence
gcacagaatgggctggtggc

SEQ ID NO: 579860 - DNA, 20 bp, Artificial
  CRISPR gRNA sequence
gtggcagtggagaaggcgag

SEQ ID NO: 579861 - DNA, 20 bp, Artificial
  CRISPR gRNA sequence
tgagacttaatctgaagctg

SEQ ID NO: 579862 - DNA, 20 bp, Artificial
  CRISPR gRNA sequence
agacttaatctgaagctgga

SEQ ID NO: 579863 - DNA, 20 bp, Artificial
  CRISPR gRNA sequence
aatctgaagctggatcagga

SEQ ID NO: 579864 - DNA, 20 bp, Artificial
  CRISPR gRNA sequence
atctgaagctggatcaggag

SEQ ID NO: 579865 - DNA, 20 bp, Artificial
  CRISPR gRNA sequence
aagctggatcaggagcagtg

SEQ ID NO: 579866 - DNA, 20 bp, Artificial
  CRISPR gRNA sequence
gatcaggagcagtgctagca

SEQ ID NO: 579867 - DNA, 20 bp, Artificial
  CRISPR gRNA sequence
gcagcttggatgtagtgggc

SEQ ID NO: 579868 - DNA, 20 bp, Artificial
  CRISPR gRNA sequence
ggatgtagtgggcaagaggg

SEQ ID NO: 579869 - DNA, 20 bp, Artificial
  CRISPR gRNA sequence
gatgtagtgggcaagaggga

SEQ ID NO: 579870 - DNA, 20 bp, Artificial
  CRISPR gRNA sequence
tagcttgagcagctggaagg

SEQ ID NO: 579871 - DNA, 20 bp, Artificial
  CRISPR gRNA sequence
agcttgagcagctggaagga

SEQ ID NO: 579872 - DNA, 20 bp, Artificial
  CRISPR gRNA sequence
gcttgagcagctggaaggac

SEQ ID NO: 579873 - DNA, 20 bp, Artificial
  CRISPR gRNA sequence
gagcagctggaaggaccgag

SEQ ID NO: 579874 - DNA, 20 bp, Artificial
  CRISPR gRNA sequence
agcagctggaaggaccgagc

SEQ ID NO: 579875 - DNA, 20 bp, Artificial
  CRISPR gRNA sequence
gaaggaccgagctgacatta

SEQ ID NO: 579876 - DNA, 20 bp, Artificial
  CRISPR gRNA sequence
acattacctgagatggggga

SEQ ID NO: 579877 - DNA, 20 bp, Artificial
  CRISPR gRNA sequence
cctgagatgggggacatggc

SEQ ID NO: 579878 - DNA, 20 bp, Artificial
  CRISPR gRNA sequence
agatgggggacatggcgggg

SEQ ID NO: 579879 - DNA, 20 bp, Artificial
  CRISPR gRNA sequence
gattgggtgcaaaagtgcag

SEQ ID NO: 579880 - DNA, 20 bp, Artificial
  CRISPR gRNA sequence
ggtgcaaaagtgcaggtgta

SEQ ID NO: 579881 - DNA, 20 bp, Artificial
  CRISPR gRNA sequence
gcattaaatatgtgagtgga

SEQ ID NO: 579882 - DNA, 20 bp, Artificial
  CRISPR gRNA sequence
aatatgtgagtggaggagct

SEQ ID NO: 579883 - DNA, 20 bp, Artificial
  CRISPR gRNA sequence
agggggcagctgaatacggg

SEQ ID NO: 579884 - DNA, 20 bp, Artificial
  CRISPR gRNA sequence
aatacgggggtctggatctc

SEQ ID NO: 579885 - DNA, 20 bp, Artificial
  CRISPR gRNA sequence
gatctcagggcaaggaggcg

SEQ ID NO: 579886 - DNA, 20 bp, Artificial
  CRISPR gRNA sequence
agggcaaggaggcgagtcca

SEQ ID NO: 579887 - DNA, 20 bp, Artificial
  CRISPR gRNA sequence
ttgagctggggcctgtagaa

SEQ ID NO: 579888 - DNA, 20 bp, Artificial
  CRISPR gRNA sequence
gagctggggcctgtagaagc

SEQ ID NO: 579889 - DNA, 20 bp, Artificial
  CRISPR gRNA sequence
agctggggcctgtagaagct

SEQ ID NO: 579890 - DNA, 20 bp, Artificial
  CRISPR gRNA sequence
gggcctgtagaagcttctct

SEQ ID NO: 579891 - DNA, 20 bp, Artificial
  CRISPR gRNA sequence
tagaagcttctctacccagc

SEQ ID NO: 579892 - DNA, 20 bp, Artificial
  CRISPR gRNA sequence
ctctacccagcccccatcag

SEQ ID NO: 579893 - DNA, 20 bp, Artificial
  CRISPR gRNA sequence
tctacccagcccccatcaga

SEQ ID NO: 579894 - DNA, 20 bp, Artificial
  CRISPR gRNA sequence
tacccagcccccatcagagt

SEQ ID NO: 579895 - DNA, 20 bp, Artificial
  CRISPR gRNA sequence
cccagcccccatcagagttc

SEQ ID NO: 579896 - DNA, 20 bp, Artificial
  CRISPR gRNA sequence
accccaatttctggccctca

SEQ ID NO: 579897 - DNA, 20 bp, Artificial
  CRISPR gRNA sequence
ctggccctcaagcctggctc

SEQ ID NO: 579898 - DNA, 20 bp, Artificial
  CRISPR gRNA sequence
tggccctcaagcctggctca

SEQ ID NO: 579899 - DNA, 20 bp, Artificial
  CRISPR gRNA sequence
gccctcaagcctggctcatg

SEQ ID NO: 579900 - DNA, 20 bp, Artificial
  CRISPR gRNA sequence
aagcctggctcatgctacac

SEQ ID NO: 579901 - DNA, 20 bp, Artificial
  CRISPR gRNA sequence
gctcatgctacaccccctgc

SEQ ID NO: 579902 - DNA, 20 bp, Artificial
  CRISPR gRNA sequence
atgctacaccccctgcctca

SEQ ID NO: 579903 - DNA, 20 bp, Artificial
  CRISPR gRNA sequence
caccccctgcctcaaatgcc

SEQ ID NO: 579904 - DNA, 20 bp, Artificial
  CRISPR gRNA sequence
cctcaaatgcccactccttc

SEQ ID NO: 579905 - DNA, 20 bp, Artificial
  CRISPR gRNA sequence
aaatgcccactccttctcct

SEQ ID NO: 579906 - DNA, 20 bp, Artificial
  CRISPR gRNA sequence
cttctcctctttccctgtcc

SEQ ID NO: 579907 - DNA, 20 bp, Artificial
  CRISPR gRNA sequence
ctcctctttccctgtccaag

SEQ ID NO: 579908 - DNA, 20 bp, Artificial
  CRISPR gRNA sequence
tcctctttccctgtccaagc

SEQ ID NO: 579909 - DNA, 20 bp, Artificial
  CRISPR gRNA sequence
ctctttccctgtccaagcca

SEQ ID NO: 579910 - DNA, 20 bp, Artificial
  CRISPR gRNA sequence
tttccctgtccaagccacgc

SEQ ID NO: 579911 - DNA, 20 bp, Artificial
  CRISPR gRNA sequence
tccctgtccaagccacgcaa

SEQ ID NO: 579912 - DNA, 20 bp, Artificial
  CRISPR gRNA sequence
ccctgtccaagccacgcaag

SEQ ID NO: 579913 - DNA, 20 bp, Artificial
  CRISPR gRNA sequence
cctgtccaagccacgcaaga

SEQ ID NO: 579914 - DNA, 20 bp, Artificial
  CRISPR gRNA sequence
tccaagccacgcaagacctg

SEQ ID NO: 579915 - DNA, 20 bp, Artificial
  CRISPR gRNA sequence
ctcttctattgtcctcacct

SEQ ID NO: 579916 - DNA, 20 bp, Artificial
  CRISPR gRNA sequence
ttctattgtcctcaccttga

SEQ ID NO: 579917 - DNA, 20 bp, Artificial
  CRISPR gRNA sequence
ctattgtcctcaccttgaaa

SEQ ID NO: 579918 - DNA, 20 bp, Artificial
  CRISPR gRNA sequence
tattgtcctcaccttgaaag

SEQ ID NO: 579919 - DNA, 20 bp, Artificial
  CRISPR gRNA sequence
ttgtcctcaccttgaaagcc

SEQ ID NO: 579920 - DNA, 20 bp, Artificial
  CRISPR gRNA sequence
tcctcaccttgaaagccctc

SEQ ID NO: 579921 - DNA, 20 bp, Artificial
  CRISPR gRNA sequence
accttgaaagccctccacaa

SEQ ID NO: 579922 - DNA, 20 bp, Artificial
  CRISPR gRNA sequence
gaaagccctccacaatggct

SEQ ID NO: 579923 - DNA, 20 bp, Artificial
  CRISPR gRNA sequence
aaagccctccacaatggctc

SEQ ID NO: 579924 - DNA, 20 bp, Artificial
  CRISPR gRNA sequence
cacaatggctccgggccccc

SEQ ID NO: 579925 - DNA, 20 bp, Artificial
  CRISPR gRNA sequence
cgggccccctgctgagcccc

SEQ ID NO: 579926 - DNA, 20 bp, Artificial
  CRISPR gRNA sequence
ctgagccccagaaccttcca

SEQ ID NO: 579927 - DNA, 20 bp, Artificial
  CRISPR gRNA sequence
agccccagaaccttccactc

SEQ ID NO: 579928 - DNA, 20 bp, Artificial
  CRISPR gRNA sequence
ccactccctgagggaagcac

SEQ ID NO: 579929 - DNA, 20 bp, Artificial
  CRISPR gRNA sequence
cactccctgagggaagcact

SEQ ID NO: 579930 - DNA, 20 bp, Artificial
  CRISPR gRNA sequence
cctgagggaagcactggctt

SEQ ID NO: 579931 - DNA, 20 bp, Artificial
  CRISPR gRNA sequence
agggaagcactggcttttca

SEQ ID NO: 579932 - DNA, 20 bp, Artificial
  CRISPR gRNA sequence
gcttttcaggatcctataat

SEQ ID NO: 579933 - DNA, 20 bp, Artificial
  CRISPR gRNA sequence
ttcaggatcctataatcctg

SEQ ID NO: 579934 - DNA, 20 bp, Artificial
  CRISPR gRNA sequence
tcaggatcctataatcctgg

SEQ ID NO: 579935 - DNA, 20 bp, Artificial
  CRISPR gRNA sequence
caggatcctataatcctggt

SEQ ID NO: 579936 - DNA, 20 bp, Artificial
  CRISPR gRNA sequence
aggatcctataatcctggtc

SEQ ID NO: 579937 - DNA, 20 bp, Artificial
  CRISPR gRNA sequence
taatcctggtctgagaggaa

SEQ ID NO: 579938 - DNA, 20 bp, Artificial
  CRISPR gRNA sequence
gtctgagaggaagccagagc

SEQ ID NO: 579939 - DNA, 20 bp, Artificial
  CRISPR gRNA sequence
agaggaagccagagctggaa

SEQ ID NO: 579940 - DNA, 20 bp, Artificial
  CRISPR gRNA sequence
gaagggactgcccagccaac

SEQ ID NO: 579941 - DNA, 20 bp, Artificial
  CRISPR gRNA sequence
cccagccaaccccattatac

SEQ ID NO: 579942 - DNA, 20 bp, Artificial
  CRISPR gRNA sequence
tacagaaggggatgctcaga

SEQ ID NO: 579943 - DNA, 20 bp, Artificial
  CRISPR gRNA sequence
agatgccgagttccgtagtc

SEQ ID NO: 579944 - DNA, 20 bp, Artificial
  CRISPR gRNA sequence
cgtagtcccatagtgacttg

SEQ ID NO: 579945 - DNA, 20 bp, Artificial
  CRISPR gRNA sequence
gagaactccacttctttctt

SEQ ID NO: 579946 - DNA, 20 bp, Artificial
  CRISPR gRNA sequence
agaactccacttctttcttt

SEQ ID NO: 579947 - DNA, 20 bp, Artificial
  CRISPR gRNA sequence
cacttctttctttaggaagt

SEQ ID NO: 579948 - DNA, 20 bp, Artificial
  CRISPR gRNA sequence
ctttctttaggaagtgtttc

SEQ ID NO: 579949 - DNA, 20 bp, Artificial
  CRISPR gRNA sequence
tttctttaggaagtgtttcc

SEQ ID NO: 579950 - DNA, 20 bp, Artificial
  CRISPR gRNA sequence
tctttaggaagtgtttccgt

SEQ ID NO: 579951 - DNA, 20 bp, Artificial
  CRISPR gRNA sequence
ctttaggaagtgtttccgtg

SEQ ID NO: 579952 - DNA, 20 bp, Artificial
  CRISPR gRNA sequence
tttaggaagtgtttccgtgt

SEQ ID NO: 579953 - DNA, 20 bp, Artificial
  CRISPR gRNA sequence
taggaagtgtttccgtgtgc

SEQ ID NO: 579954 - DNA, 20 bp, Artificial
  CRISPR gRNA sequence
aggaagtgtttccgtgtgca

SEQ ID NO: 579955 - DNA, 20 bp, Artificial
  CRISPR gRNA sequence
ggaagtgtttccgtgtgcac

SEQ ID NO: 579956 - DNA, 20 bp, Artificial
  CRISPR gRNA sequence
ccgtgtgcacattttataaa

SEQ ID NO: 579957 - DNA, 20 bp, Artificial
  CRISPR gRNA sequence
cgtgtgcacattttataaac

SEQ ID NO: 579958 - DNA, 20 bp, Artificial
  CRISPR gRNA sequence
tataaactctctggtgtgtg

SEQ ID NO: 579959 - DNA, 20 bp, Artificial
  CRISPR gRNA sequence
ataaactctctggtgtgtgt

SEQ ID NO: 579960 - DNA, 20 bp, Artificial
  CRISPR gRNA sequence
taaactctctggtgtgtgtg

SEQ ID NO: 579961 - DNA, 20 bp, Artificial
  CRISPR gRNA sequence
tctggtgtgtgtgtgtgtgt

SEQ ID NO: 579962 - DNA, 20 bp, Artificial
  CRISPR gRNA sequence
tggtgtgtgtgtgtgtgtgt

SEQ ID NO: 579963 - DNA, 20 bp, Artificial
  CRISPR gRNA sequence
gtgtgtgtgtgtgtgtgtct

SEQ ID NO: 579964 - DNA, 20 bp, Artificial
  CRISPR gRNA sequence
catctccccgttccacctca

SEQ ID NO: 579965 - DNA, 20 bp, Artificial
  CRISPR gRNA sequence
cccgttccacctcacagcac

SEQ ID NO: 579966 - DNA, 20 bp, Artificial
  CRISPR gRNA sequence
cacctcacagcactgagttg

SEQ ID NO: 579967 - DNA, 20 bp, Artificial
  CRISPR gRNA sequence
acagcactgagttgggcaca

SEQ ID NO: 579968 - DNA, 20 bp, Artificial
  CRISPR gRNA sequence
agttgggcacacagctgctg

SEQ ID NO: 579969 - DNA, 20 bp, Artificial
  CRISPR gRNA sequence
ggcacacagctgctgagagc

SEQ ID NO: 579970 - DNA, 20 bp, Artificial
  CRISPR gRNA sequence
ctgagagcagcccgggggag

SEQ ID NO: 579971 - DNA, 20 bp, Artificial
  CRISPR gRNA sequence
agagcagcccgggggagtat

SEQ ID NO: 579972 - DNA, 20 bp, Artificial
  CRISPR gRNA sequence
tgggggagcagttgctcctt

SEQ ID NO: 579973 - DNA, 20 bp, Artificial
  CRISPR gRNA sequence
ggggagcagttgctccttcc

SEQ ID NO: 579974 - DNA, 20 bp, Artificial
  CRISPR gRNA sequence
ctccttcctttctttgctgt

SEQ ID NO: 579975 - DNA, 20 bp, Artificial
  CRISPR gRNA sequence
cttcctttctttgctgtcac

SEQ ID NO: 579976 - DNA, 20 bp, Artificial
  CRISPR gRNA sequence
cctttctttgctgtcacctc

SEQ ID NO: 579977 - DNA, 20 bp, Artificial
  CRISPR gRNA sequence
ctttctttgctgtcacctcc

SEQ ID NO: 579978 - DNA, 20 bp, Artificial
  CRISPR gRNA sequence
tctttgctgtcacctcctgg

SEQ ID NO: 579979 - DNA, 20 bp, Artificial
  CRISPR gRNA sequence
ctttgctgtcacctcctggg

SEQ ID NO: 579980 - DNA, 20 bp, Artificial
  CRISPR gRNA sequence
tttgctgtcacctcctgggg

SEQ ID NO: 579981 - DNA, 20 bp, Artificial
  CRISPR gRNA sequence
tgctgtcacctcctgggggt

SEQ ID NO: 579982 - DNA, 20 bp, Artificial
  CRISPR gRNA sequence
gctgtcacctcctgggggtg

SEQ ID NO: 579983 - DNA, 20 bp, Artificial
  CRISPR gRNA sequence
ctgtcacctcctgggggtgg

SEQ ID NO: 579984 - DNA, 20 bp, Artificial
  CRISPR gRNA sequence
tcacctcctgggggtggttg

SEQ ID NO: 579985 - DNA, 20 bp, Artificial
  CRISPR gRNA sequence
ctgggggtggttgtcagagc

SEQ ID NO: 579986 - DNA, 20 bp, Artificial
  CRISPR gRNA sequence
ggggtggttgtcagagctgt

SEQ ID NO: 579987 - DNA, 20 bp, Artificial
  CRISPR gRNA sequence
tcagagctgtggtgctgagg

SEQ ID NO: 579988 - DNA, 20 bp, Artificial
  CRISPR gRNA sequence
tggtgctgagggagatgagt

SEQ ID NO: 579989 - DNA, 20 bp, Artificial
  CRISPR gRNA sequence
agggagatgagtgtgagaat

SEQ ID NO: 579990 - DNA, 20 bp, Artificial
  CRISPR gRNA sequence
agttcttagtctcctggggg

SEQ ID NO: 579991 - DNA, 20 bp, Artificial
  CRISPR gRNA sequence
ttagtctcctgggggcttag

SEQ ID NO: 579992 - DNA, 20 bp, Artificial
  CRISPR gRNA sequence
agtctcctgggggcttagaa

SEQ ID NO: 579993 - DNA, 20 bp, Artificial
  CRISPR gRNA sequence
gtctcctgggggcttagaac

SEQ ID NO: 579994 - DNA, 20 bp, Artificial
  CRISPR gRNA sequence
ctgggggcttagaacattac

SEQ ID NO: 579995 - DNA, 20 bp, Artificial
  CRISPR gRNA sequence
ggggcttagaacattactgc

SEQ ID NO: 579996 - DNA, 20 bp, Artificial
  CRISPR gRNA sequence
agaacattactgcgtgagaa

SEQ ID NO: 579997 - DNA, 20 bp, Artificial
  CRISPR gRNA sequence
gaacattactgcgtgagaaa

SEQ ID NO: 579998 - DNA, 20 bp, Artificial
  CRISPR gRNA sequence
ctgcgtgagaaacaggagtg

SEQ ID NO: 579999 - DNA, 20 bp, Artificial
  CRISPR gRNA sequence
cgtgagaaacaggagtgtgg

SEQ ID NO: 580000 - DNA, 20 bp, Artificial
  CRISPR gRNA sequence
tggaggctccgaacaagggc

SEQ ID NO: 580001 - DNA, 20 bp, Artificial
  CRISPR gRNA sequence
cgaacaagggcctgggagag

SEQ ID NO: 580002 - DNA, 20 bp, Artificial
  CRISPR gRNA sequence
ggagagcactggtgagatga

SEQ ID NO: 580003 - DNA, 20 bp, Artificial
  CRISPR gRNA sequence
gtgagatgagaaggtgagtg

SEQ ID NO: 580004 - DNA, 20 bp, Artificial
  CRISPR gRNA sequence
cttcaagccaagaaataaca

SEQ ID NO: 580005 - DNA, 20 bp, Artificial
  CRISPR gRNA sequence
caagccaagaaataacaaag

SEQ ID NO: 580006 - DNA, 20 bp, Artificial
  CRISPR gRNA sequence
aagccaagaaataacaaaga

SEQ ID NO: 580007 - DNA, 20 bp, Artificial
  CRISPR gRNA sequence
ccagcaaccaccagaagctg

SEQ ID NO: 580008 - DNA, 20 bp, Artificial
  CRISPR gRNA sequence
ggggagaggcctggagcagc

SEQ ID NO: 580009 - DNA, 20 bp, Artificial
  CRISPR gRNA sequence
gagcagcttctcccttatgg

SEQ ID NO: 580010 - DNA, 20 bp, Artificial
  CRISPR gRNA sequence
ctcccttatggcccccagaa

SEQ ID NO: 580011 - DNA, 20 bp, Artificial
  CRISPR gRNA sequence
tcccttatggcccccagaag

SEQ ID NO: 580012 - DNA, 20 bp, Artificial
  CRISPR gRNA sequence
ccttatggcccccagaagga

SEQ ID NO: 580013 - DNA, 20 bp, Artificial
  CRISPR gRNA sequence
atggcccccagaaggaacca

SEQ ID NO: 580014 - DNA, 20 bp, Artificial
  CRISPR gRNA sequence
tggcccccagaaggaaccaa

SEQ ID NO: 580015 - DNA, 20 bp, Artificial
  CRISPR gRNA sequence
gcaacaccttgatcttggac

SEQ ID NO: 580016 - DNA, 20 bp, Artificial
  CRISPR gRNA sequence
gatcttggactctggcctcc

SEQ ID NO: 580017 - DNA, 20 bp, Artificial
  CRISPR gRNA sequence
atcttggactctggcctcca

SEQ ID NO: 580018 - DNA, 20 bp, Artificial
  CRISPR gRNA sequence
ggactctggcctccagaact

SEQ ID NO: 580019 - DNA, 20 bp, Artificial
  CRISPR gRNA sequence
gactctggcctccagaactg

SEQ ID NO: 580020 - DNA, 20 bp, Artificial
  CRISPR gRNA sequence
tggcctccagaactgtgaga

SEQ ID NO: 580021 - DNA, 20 bp, Artificial
  CRISPR gRNA sequence
gcctccagaactgtgagatg

SEQ ID NO: 580022 - DNA, 20 bp, Artificial
  CRISPR gRNA sequence
cagaactgtgagatgatcaa

SEQ ID NO: 580023 - DNA, 20 bp, Artificial
  CRISPR gRNA sequence
tgagatgatcaatttctgtt

SEQ ID NO: 580024 - DNA, 20 bp, Artificial
  CRISPR gRNA sequence
ctgttgctgaagccactcag

SEQ ID NO: 580025 - DNA, 20 bp, Artificial
  CRISPR gRNA sequence
tgttgctgaagccactcagt

SEQ ID NO: 580026 - DNA, 20 bp, Artificial
  CRISPR gRNA sequence
ttgctgaagccactcagttg

SEQ ID NO: 580027 - DNA, 20 bp, Artificial
  CRISPR gRNA sequence
ctgaagccactcagttgtgg

SEQ ID NO: 580028 - DNA, 20 bp, Artificial
  CRISPR gRNA sequence
aagccactcagttgtggtac

SEQ ID NO: 580029 - DNA, 20 bp, Artificial
  CRISPR gRNA sequence
agttgtggtactttgttata

SEQ ID NO: 580030 - DNA, 20 bp, Artificial
  CRISPR gRNA sequence
tggtactttgttatagcagc

SEQ ID NO: 580031 - DNA, 20 bp, Artificial
  CRISPR gRNA sequence
tgttatagcagccagaacaa

SEQ ID NO: 580032 - DNA, 20 bp, Artificial
  CRISPR gRNA sequence
gttatagcagccagaacaaa

SEQ ID NO: 580033 - DNA, 20 bp, Artificial
  CRISPR gRNA sequence
ttatagcagccagaacaaac

SEQ ID NO: 580034 - DNA, 20 bp, Artificial
  CRISPR gRNA sequence
tagcagccagaacaaactaa

SEQ ID NO: 580035 - DNA, 20 bp, Artificial
  CRISPR gRNA sequence
ataccgatttcggtgcaaat

SEQ ID NO: 580036 - DNA, 20 bp, Artificial
  CRISPR gRNA sequence
cggtgcaaatggatgttttc

SEQ ID NO: 580037 - DNA, 20 bp, Artificial
  CRISPR gRNA sequence
ggtgcaaatggatgttttcc

SEQ ID NO: 580038 - DNA, 20 bp, Artificial
  CRISPR gRNA sequence
tccaccactctggcctggcc

SEQ ID NO: 580039 - DNA, 20 bp, Artificial
  CRISPR gRNA sequence
ccaccactctggcctggccc

SEQ ID NO: 580040 - DNA, 20 bp, Artificial
  CRISPR gRNA sequence
caccactctggcctggccca

SEQ ID NO: 580041 - DNA, 20 bp, Artificial
  CRISPR gRNA sequence
tggcctggcccatgtggctg

SEQ ID NO: 580042 - DNA, 20 bp, Artificial
  CRISPR gRNA sequence
gcctggcccatgtggctggc

SEQ ID NO: 580043 - DNA, 20 bp, Artificial
  CRISPR gRNA sequence
gcccatgtggctggcctgtg

SEQ ID NO: 580044 - DNA, 20 bp, Artificial
  CRISPR gRNA sequence
gcctgtggtcacttctgaag

SEQ ID NO: 580045 - DNA, 20 bp, Artificial
  CRISPR gRNA sequence
tggtcacttctgaagctgcc

SEQ ID NO: 580046 - DNA, 20 bp, Artificial
  CRISPR gRNA sequence
ctgaagctgcctggacactt

SEQ ID NO: 580047 - DNA, 20 bp, Artificial
  CRISPR gRNA sequence
tgaagctgcctggacacttg

SEQ ID NO: 580048 - DNA, 20 bp, Artificial
  CRISPR gRNA sequence
aagctgcctggacacttggc

SEQ ID NO: 580049 - DNA, 20 bp, Artificial
  CRISPR gRNA sequence
cctggacacttggccagagc

SEQ ID NO: 580050 - DNA, 20 bp, Artificial
  CRISPR gRNA sequence
gacacttggccagagctaag

SEQ ID NO: 580051 - DNA, 20 bp, Artificial
  CRISPR gRNA sequence
ggccagagctaagaattctc

SEQ ID NO: 580052 - DNA, 20 bp, Artificial
  CRISPR gRNA sequence
gccagagctaagaattctcc

SEQ ID NO: 580053 - DNA, 20 bp, Artificial
  CRISPR gRNA sequence
agaattctccccaaacacat

SEQ ID NO: 580054 - DNA, 20 bp, Artificial
  CRISPR gRNA sequence
tccccaaacacatgtgggat

SEQ ID NO: 580055 - DNA, 20 bp, Artificial
  CRISPR gRNA sequence
cccaaacacatgtgggatgg

SEQ ID NO: 580056 - DNA, 20 bp, Artificial
  CRISPR gRNA sequence
actcagcaaagcatagatac

SEQ ID NO: 580057 - DNA, 20 bp, Artificial
  CRISPR gRNA sequence
agcaaagcatagatacattc

SEQ ID NO: 580058 - DNA, 20 bp, Artificial
  CRISPR gRNA sequence
tcagacagggacatggagat

SEQ ID NO: 580059 - DNA, 20 bp, Artificial
  CRISPR gRNA sequence
agacagggacatggagatga

SEQ ID NO: 580060 - DNA, 20 bp, Artificial
  CRISPR gRNA sequence
tctgggggtagaggacctag

SEQ ID NO: 580061 - DNA, 20 bp, Artificial
  CRISPR gRNA sequence
ggggtagaggacctagaggg

SEQ ID NO: 580062 - DNA, 20 bp, Artificial
  CRISPR gRNA sequence
gagggccgggctgggcagcc

SEQ ID NO: 580063 - DNA, 20 bp, Artificial
  CRISPR gRNA sequence
ggcagccggcttcctgcact

SEQ ID NO: 580064 - DNA, 20 bp, Artificial
  CRISPR gRNA sequence
cctgcactgtctgttgggac

SEQ ID NO: 580065 - DNA, 20 bp, Artificial
  CRISPR gRNA sequence
ctgcactgtctgttgggacg

SEQ ID NO: 580066 - DNA, 20 bp, Artificial
  CRISPR gRNA sequence
cactgtctgttgggacgtcc

SEQ ID NO: 580067 - DNA, 20 bp, Artificial
  CRISPR gRNA sequence
tctgttgggacgtccctttc

SEQ ID NO: 580068 - DNA, 20 bp, Artificial
  CRISPR gRNA sequence
ttgggacgtccctttctgac

SEQ ID NO: 580069 - DNA, 20 bp, Artificial
  CRISPR gRNA sequence
ggacgtccctttctgactgg

SEQ ID NO: 580070 - DNA, 20 bp, Artificial
  CRISPR gRNA sequence
tctgactgggtttctcagaa

SEQ ID NO: 580071 - DNA, 20 bp, Artificial
  CRISPR gRNA sequence
ctgactgggtttctcagaag

SEQ ID NO: 580072 - DNA, 20 bp, Artificial
  CRISPR gRNA sequence
tgactgggtttctcagaagc

SEQ ID NO: 580073 - DNA, 20 bp, Artificial
  CRISPR gRNA sequence
actgggtttctcagaagctg

SEQ ID NO: 580074 - DNA, 20 bp, Artificial
  CRISPR gRNA sequence
ggtttctcagaagctgaatg

SEQ ID NO: 580075 - DNA, 20 bp, Artificial
  CRISPR gRNA sequence
ctcagaagctgaatggggga

SEQ ID NO: 580076 - DNA, 20 bp, Artificial
  CRISPR gRNA sequence
tcagaagctgaatgggggat

SEQ ID NO: 580077 - DNA, 20 bp, Artificial
  CRISPR gRNA sequence
agaagctgaatgggggatgt

SEQ ID NO: 580078 - DNA, 20 bp, Artificial
  CRISPR gRNA sequence
aatgggggatgtttctggga

SEQ ID NO: 580079 - DNA, 20 bp, Artificial
  CRISPR gRNA sequence
ctgggacacagattatgttt

SEQ ID NO: 580080 - DNA, 20 bp, Artificial
  CRISPR gRNA sequence
tgggacacagattatgtttt

SEQ ID NO: 580081 - DNA, 20 bp, Artificial
  CRISPR gRNA sequence
ggacacagattatgttttca

SEQ ID NO: 580082 - DNA, 20 bp, Artificial
  CRISPR gRNA sequence
tgttttcatatcggggtctg

SEQ ID NO: 580083 - DNA, 20 bp, Artificial
  CRISPR gRNA sequence
tcatatcggggtctgcatct

SEQ ID NO: 580084 - DNA, 20 bp, Artificial
  CRISPR gRNA sequence
catatcggggtctgcatctg

SEQ ID NO: 580085 - DNA, 20 bp, Artificial
  CRISPR gRNA sequence
atatcggggtctgcatctgg

SEQ ID NO: 580086 - DNA, 20 bp, Artificial
  CRISPR gRNA sequence
catctgggccctgttgtcac

SEQ ID NO: 580087 - DNA, 20 bp, Artificial
  CRISPR gRNA sequence
ggccctgttgtcacagcccc

SEQ ID NO: 580088 - DNA, 20 bp, Artificial
  CRISPR gRNA sequence
ttgtcacagcccccgacttg

SEQ ID NO: 580089 - DNA, 20 bp, Artificial
  CRISPR gRNA sequence
tcacagcccccgacttgccc

SEQ ID NO: 580090 - DNA, 20 bp, Artificial
  CRISPR gRNA sequence
gcccagatttttccgccatt

SEQ ID NO: 580091 - DNA, 20 bp, Artificial
  CRISPR gRNA sequence
cccagatttttccgccattg

SEQ ID NO: 580092 - DNA, 20 bp, Artificial
  CRISPR gRNA sequence
ttccgccattgacgtcatgg

SEQ ID NO: 580093 - DNA, 20 bp, Artificial
  CRISPR gRNA sequence
tccgccattgacgtcatggc

SEQ ID NO: 580094 - DNA, 20 bp, Artificial
  CRISPR gRNA sequence
ccgccattgacgtcatggcg

SEQ ID NO: 580095 - DNA, 20 bp, Artificial
  CRISPR gRNA sequence
cgccattgacgtcatggcgg

SEQ ID NO: 580096 - DNA, 20 bp, Artificial
  CRISPR gRNA sequence
acgtcatggcggccggatgc

SEQ ID NO: 580097 - DNA, 20 bp, Artificial
  CRISPR gRNA sequence
catcgacaccacggaggaag

SEQ ID NO: 580098 - DNA, 20 bp, Artificial
  CRISPR gRNA sequence
atcgacaccacggaggaaga

SEQ ID NO: 580099 - DNA, 20 bp, Artificial
  CRISPR gRNA sequence
cgttccgagaactggctgcc

SEQ ID NO: 580100 - DNA, 20 bp, Artificial
  CRISPR gRNA sequence
gttccgagaactggctgccc

SEQ ID NO: 580101 - DNA, 20 bp, Artificial
  CRISPR gRNA sequence
cgagaactggctgccctgtc

SEQ ID NO: 580102 - DNA, 20 bp, Artificial
  CRISPR gRNA sequence
gctgccctgtcctgcagcag

SEQ ID NO: 580103 - DNA, 20 bp, Artificial
  CRISPR gRNA sequence
ccctgtcctgcagcaggctt

SEQ ID NO: 580104 - DNA, 20 bp, Artificial
  CRISPR gRNA sequence
tcctgcagcaggcttggccc

SEQ ID NO: 580105 - DNA, 20 bp, Artificial
  CRISPR gRNA sequence
cagcaggcttggcccaggtg

SEQ ID NO: 580106 - DNA, 20 bp, Artificial
  CRISPR gRNA sequence
ggcccaggtggggtgacatg

SEQ ID NO: 580107 - DNA, 20 bp, Artificial
  CRISPR gRNA sequence
gcccaggtggggtgacatgg

SEQ ID NO: 580108 - DNA, 20 bp, Artificial
  CRISPR gRNA sequence
gtggatgtggtaggtgatgt

SEQ ID NO: 580109 - DNA, 20 bp, Artificial
  CRISPR gRNA sequence
gccactatgacaagccccta

SEQ ID NO: 580110 - DNA, 20 bp, Artificial
  CRISPR gRNA sequence
tgacaagcccctagctctga

SEQ ID NO: 580111 - DNA, 20 bp, Artificial
  CRISPR gRNA sequence
gctctgaagacctggccctt

SEQ ID NO: 580112 - DNA, 20 bp, Artificial
  CRISPR gRNA sequence
tgaagacctggcccttcttg

SEQ ID NO: 580113 - DNA, 20 bp, Artificial
  CRISPR gRNA sequence
aagacctggcccttcttggg

SEQ ID NO: 580114 - DNA, 20 bp, Artificial
  CRISPR gRNA sequence
gcccttcttgggttgtggag

SEQ ID NO: 580115 - DNA, 20 bp, Artificial
  CRISPR gRNA sequence
cttgggttgtggagaggacc

SEQ ID NO: 580116 - DNA, 20 bp, Artificial
  CRISPR gRNA sequence
ttgggttgtggagaggaccc

SEQ ID NO: 580117 - DNA, 20 bp, Artificial
  CRISPR gRNA sequence
gggttgtggagaggacccag

SEQ ID NO: 580118 - DNA, 20 bp, Artificial
  CRISPR gRNA sequence
ggttgtggagaggacccagg

SEQ ID NO: 580119 - DNA, 20 bp, Artificial
  CRISPR gRNA sequence
tggagaggacccaggtttga

SEQ ID NO: 580120 - DNA, 20 bp, Artificial
  CRISPR gRNA sequence
gaagctctgagagtgccagg

SEQ ID NO: 580121 - DNA, 20 bp, Artificial
  CRISPR gRNA sequence
aagctctgagagtgccaggc

SEQ ID NO: 580122 - DNA, 20 bp, Artificial
  CRISPR gRNA sequence
tgagagtgccaggcaggctc

SEQ ID NO: 580123 - DNA, 20 bp, Artificial
  CRISPR gRNA sequence
agagtgccaggcaggctcca

SEQ ID NO: 580124 - DNA, 20 bp, Artificial
  CRISPR gRNA sequence
cacagatactgggacccctg

SEQ ID NO: 580125 - DNA, 20 bp, Artificial
  CRISPR gRNA sequence
ggacccctggggtcttcaaa

SEQ ID NO: 580126 - DNA, 20 bp, Artificial
  CRISPR gRNA sequence
gggtcttcaaatagtataac

SEQ ID NO: 580127 - DNA, 20 bp, Artificial
  CRISPR gRNA sequence
caaatagtataacaccagga

SEQ ID NO: 580128 - DNA, 20 bp, Artificial
  CRISPR gRNA sequence
aaatagtataacaccaggac

SEQ ID NO: 580129 - DNA, 20 bp, Artificial
  CRISPR gRNA sequence
agaatcatagaacagcattt

SEQ ID NO: 580130 - DNA, 20 bp, Artificial
  CRISPR gRNA sequence
cttagatttaaaggatccta

SEQ ID NO: 580131 - DNA, 20 bp, Artificial
  CRISPR gRNA sequence
ttagatttaaaggatcctag

SEQ ID NO: 580132 - DNA, 20 bp, Artificial
  CRISPR gRNA sequence
agatttaaaggatcctagaa

SEQ ID NO: 580133 - DNA, 20 bp, Artificial
  CRISPR gRNA sequence
gatttaaaggatcctagaat

SEQ ID NO: 580134 - DNA, 20 bp, Artificial
  CRISPR gRNA sequence
aaaggatcctagaatctcaa

SEQ ID NO: 580135 - DNA, 20 bp, Artificial
  CRISPR gRNA sequence
aaggatcctagaatctcaaa

SEQ ID NO: 580136 - DNA, 20 bp, Artificial
  CRISPR gRNA sequence
gaatctcaaaaccacagact

SEQ ID NO: 580137 - DNA, 20 bp, Artificial
  CRISPR gRNA sequence
aaaaccacagactgtggggt

SEQ ID NO: 580138 - DNA, 20 bp, Artificial
  CRISPR gRNA sequence
tggggtctacggtcccaaag

SEQ ID NO: 580139 - DNA, 20 bp, Artificial
  CRISPR gRNA sequence
cggtcccaaagtctcagtat

SEQ ID NO: 580140 - DNA, 20 bp, Artificial
  CRISPR gRNA sequence
agtatgtgtaggccagtgtc

SEQ ID NO: 580141 - DNA, 20 bp, Artificial
  CRISPR gRNA sequence
gtgtccaaactccttggaac

SEQ ID NO: 580142 - DNA, 20 bp, Artificial
  CRISPR gRNA sequence
cttggaaccatctgaaagtc

SEQ ID NO: 580143 - DNA, 20 bp, Artificial
  CRISPR gRNA sequence
ggaaccatctgaaagtcagg

SEQ ID NO: 580144 - DNA, 20 bp, Artificial
  CRISPR gRNA sequence
gaaccatctgaaagtcaggc

SEQ ID NO: 580145 - DNA, 20 bp, Artificial
  CRISPR gRNA sequence
aaagtcaggcagcttgctgc

SEQ ID NO: 580146 - DNA, 20 bp, Artificial
  CRISPR gRNA sequence
gctgcttcatagggcctctt

SEQ ID NO: 580147 - DNA, 20 bp, Artificial
  CRISPR gRNA sequence
ctgcttcatagggcctcttg

SEQ ID NO: 580148 - DNA, 20 bp, Artificial
  CRISPR gRNA sequence
cttcatagggcctcttgcct

SEQ ID NO: 580149 - DNA, 20 bp, Artificial
  CRISPR gRNA sequence
catagggcctcttgcctacc

SEQ ID NO: 580150 - DNA, 20 bp, Artificial
  CRISPR gRNA sequence
atagggcctcttgcctacca

SEQ ID NO: 580151 - DNA, 20 bp, Artificial
  CRISPR gRNA sequence
ttgcctaccaggcctggaaa

SEQ ID NO: 580152 - DNA, 20 bp, Artificial
  CRISPR gRNA sequence
gcctaccaggcctggaaaca

SEQ ID NO: 580153 - DNA, 20 bp, Artificial
  CRISPR gRNA sequence
cctaccaggcctggaaacag

SEQ ID NO: 580154 - DNA, 20 bp, Artificial
  CRISPR gRNA sequence
ccaggcctggaaacagagcc

SEQ ID NO: 580155 - DNA, 20 bp, Artificial
  CRISPR gRNA sequence
gaaacagagccagcctccct

SEQ ID NO: 580156 - DNA, 20 bp, Artificial
  CRISPR gRNA sequence
cctagggcctcagtctccct

SEQ ID NO: 580157 - DNA, 20 bp, Artificial
  CRISPR gRNA sequence
gggcctcagtctccctgtcc

SEQ ID NO: 580158 - DNA, 20 bp, Artificial
  CRISPR gRNA sequence
agtctccctgtccactctgg

SEQ ID NO: 580159 - DNA, 20 bp, Artificial
  CRISPR gRNA sequence
cctgtccactctggaacaac

SEQ ID NO: 580160 - DNA, 20 bp, Artificial
  CRISPR gRNA sequence
tccactctggaacaacgttc

SEQ ID NO: 580161 - DNA, 20 bp, Artificial
  CRISPR gRNA sequence
tggaacaacgttcccaaata

SEQ ID NO: 580162 - DNA, 20 bp, Artificial
  CRISPR gRNA sequence
gaacaacgttcccaaataca

SEQ ID NO: 580163 - DNA, 20 bp, Artificial
  CRISPR gRNA sequence
ccaaatacatggccactccg

SEQ ID NO: 580164 - DNA, 20 bp, Artificial
  CRISPR gRNA sequence
cgccagagatggcaacaggg

SEQ ID NO: 580165 - DNA, 20 bp, Artificial
  CRISPR gRNA sequence
aggctggtgtgcctttggtc

SEQ ID NO: 580166 - DNA, 20 bp, Artificial
  CRISPR gRNA sequence
gtgtgcctttggtctgggcc

SEQ ID NO: 580167 - DNA, 20 bp, Artificial
  CRISPR gRNA sequence
tggtctgggcctcatggggg

SEQ ID NO: 580168 - DNA, 20 bp, Artificial
  CRISPR gRNA sequence
ggtctgggcctcatgggggg

SEQ ID NO: 580169 - DNA, 20 bp, Artificial
  CRISPR gRNA sequence
gtctgggcctcatgggggga

SEQ ID NO: 580170 - DNA, 20 bp, Artificial
  CRISPR gRNA sequence
ggcctcatggggggagctgg

SEQ ID NO: 580171 - DNA, 20 bp, Artificial
  CRISPR gRNA sequence
atggggggagctggaaaagc

SEQ ID NO: 580172 - DNA, 20 bp, Artificial
  CRISPR gRNA sequence
gaaaagcctcagccttcgcc

SEQ ID NO: 580173 - DNA, 20 bp, Artificial
  CRISPR gRNA sequence
agccttcgccaatacagagc

SEQ ID NO: 580174 - DNA, 20 bp, Artificial
  CRISPR gRNA sequence
cgccaatacagagcccatca

SEQ ID NO: 580175 - DNA, 20 bp, Artificial
  CRISPR gRNA sequence
gccaatacagagcccatcat

SEQ ID NO: 580176 - DNA, 20 bp, Artificial
  CRISPR gRNA sequence
tctagaggggccccacaatc

SEQ ID NO: 580177 - DNA, 20 bp, Artificial
  CRISPR gRNA sequence
tagaggggccccacaatcaa

SEQ ID NO: 580178 - DNA, 20 bp, Artificial
  CRISPR gRNA sequence
gaggggccccacaatcaagg

SEQ ID NO: 580179 - DNA, 20 bp, Artificial
  CRISPR gRNA sequence
tcggggaccagcaccagctc

SEQ ID NO: 580180 - DNA, 20 bp, Artificial
  CRISPR gRNA sequence
cggggaccagcaccagctct

SEQ ID NO: 580181 - DNA, 20 bp, Artificial
  CRISPR gRNA sequence
ggggaccagcaccagctctg

SEQ ID NO: 580182 - DNA, 20 bp, Artificial
  CRISPR gRNA sequence
tggggacacacagcctgact

SEQ ID NO: 580183 - DNA, 20 bp, Artificial
  CRISPR gRNA sequence
gggacacacagcctgactga

SEQ ID NO: 580184 - DNA, 20 bp, Artificial
  CRISPR gRNA sequence
actgactgacatgcctccat

SEQ ID NO: 580185 - DNA, 20 bp, Artificial
  CRISPR gRNA sequence
actgacatgcctccatcatc

SEQ ID NO: 580186 - DNA, 20 bp, Artificial
  CRISPR gRNA sequence
acatgcctccatcatcacca

SEQ ID NO: 580187 - DNA, 20 bp, Artificial
  CRISPR gRNA sequence
catcatcaccacgctctggc

SEQ ID NO: 580188 - DNA, 20 bp, Artificial
  CRISPR gRNA sequence
tggccaactaggcctcctga

SEQ ID NO: 580189 - DNA, 20 bp, Artificial
  CRISPR gRNA sequence
gccaactaggcctcctgacc

SEQ ID NO: 580190 - DNA, 20 bp, Artificial
  CRISPR gRNA sequence
ggcctcctgacctatggagt

SEQ ID NO: 580191 - DNA, 20 bp, Artificial
  CRISPR gRNA sequence
ctgacctatggagtccgggg

SEQ ID NO: 580192 - DNA, 20 bp, Artificial
  CRISPR gRNA sequence
acctatggagtccggggcct

SEQ ID NO: 580193 - DNA, 20 bp, Artificial
  CRISPR gRNA sequence
tggagtccggggcctcacct

SEQ ID NO: 580194 - DNA, 20 bp, Artificial
  CRISPR gRNA sequence
acctagcccagctcttgtga

SEQ ID NO: 580195 - DNA, 20 bp, Artificial
  CRISPR gRNA sequence
gcccagctcttgtgaggctg

SEQ ID NO: 580196 - DNA, 20 bp, Artificial
  CRISPR gRNA sequence
ttgtgaggctgggccccaca

SEQ ID NO: 580197 - DNA, 20 bp, Artificial
  CRISPR gRNA sequence
gtgaggctgggccccacact

SEQ ID NO: 580198 - DNA, 20 bp, Artificial
  CRISPR gRNA sequence
tgaggctgggccccacactg

SEQ ID NO: 580199 - DNA, 20 bp, Artificial
  CRISPR gRNA sequence
ggccccacactgtgatcgtg

SEQ ID NO: 580200 - DNA, 20 bp, Artificial
  CRISPR gRNA sequence
tgatcgtggatcgtccaacc

SEQ ID NO: 580201 - DNA, 20 bp, Artificial
  CRISPR gRNA sequence
tgggaagttggggtccaacg

SEQ ID NO: 580202 - DNA, 20 bp, Artificial
  CRISPR gRNA sequence
gggtccaacgtgtgagaagg

SEQ ID NO: 580203 - DNA, 20 bp, Artificial
  CRISPR gRNA sequence
cccttcccccttctgggtgc

SEQ ID NO: 580204 - DNA, 20 bp, Artificial
  CRISPR gRNA sequence
cccccttctgggtgctgagg

SEQ ID NO: 580205 - DNA, 20 bp, Artificial
  CRISPR gRNA sequence
ccccttctgggtgctgaggg

SEQ ID NO: 580206 - DNA, 20 bp, Artificial
  CRISPR gRNA sequence
ctgggtgctgaggggtaaac

SEQ ID NO: 580207 - DNA, 20 bp, Artificial
  CRISPR gRNA sequence
tgggtgctgaggggtaaact

SEQ ID NO: 580208 - DNA, 20 bp, Artificial
  CRISPR gRNA sequence
ggtgctgaggggtaaactga

SEQ ID NO: 580209 - DNA, 20 bp, Artificial
  CRISPR gRNA sequence
aggggtaaactgaggcctgc

SEQ ID NO: 580210 - DNA, 20 bp, Artificial
  CRISPR gRNA sequence
aggcctgcagttggggagag

SEQ ID NO: 580211 - DNA, 20 bp, Artificial
  CRISPR gRNA sequence
cagttggggagagagccaga

SEQ ID NO: 580212 - DNA, 20 bp, Artificial
  CRISPR gRNA sequence
gggagagagccagaaccagg

SEQ ID NO: 580213 - DNA, 20 bp, Artificial
  CRISPR gRNA sequence
gagtcctgagatctaggctt

SEQ ID NO: 580214 - DNA, 20 bp, Artificial
  CRISPR gRNA sequence
agatctaggcttggatttca

SEQ ID NO: 580215 - DNA, 20 bp, Artificial
  CRISPR gRNA sequence
ggcttggatttcaactctgc

SEQ ID NO: 580216 - DNA, 20 bp, Artificial
  CRISPR gRNA sequence
ggatttcaactctgccgctg

SEQ ID NO: 580217 - DNA, 20 bp, Artificial
  CRISPR gRNA sequence
gatttcaactctgccgctgc

SEQ ID NO: 580218 - DNA, 20 bp, Artificial
  CRISPR gRNA sequence
caactctgccgctgcatttc

SEQ ID NO: 580219 - DNA, 20 bp, Artificial
  CRISPR gRNA sequence
aactctgccgctgcatttcg

SEQ ID NO: 580220 - DNA, 20 bp, Artificial
  CRISPR gRNA sequence
tgccgctgcatttcggtgag

SEQ ID NO: 580221 - DNA, 20 bp, Artificial
  CRISPR gRNA sequence
ccgctgcatttcggtgaggc

SEQ ID NO: 580222 - DNA, 20 bp, Artificial
  CRISPR gRNA sequence
catttcggtgaggccctgag

SEQ ID NO: 580223 - DNA, 20 bp, Artificial
  CRISPR gRNA sequence
cggtgaggccctgagatctc

SEQ ID NO: 580224 - DNA, 20 bp, Artificial
  CRISPR gRNA sequence
ggtgaggccctgagatctct

SEQ ID NO: 580225 - DNA, 20 bp, Artificial
  CRISPR gRNA sequence
agatctctggtcttcaattt

SEQ ID NO: 580226 - DNA, 20 bp, Artificial
  CRISPR gRNA sequence
tggtcttcaatttgcccttc

SEQ ID NO: 580227 - DNA, 20 bp, Artificial
  CRISPR gRNA sequence
gtcttcaatttgcccttcta

SEQ ID NO: 580228 - DNA, 20 bp, Artificial
  CRISPR gRNA sequence
caatttgcccttctacactg

SEQ ID NO: 580229 - DNA, 20 bp, Artificial
  CRISPR gRNA sequence
aatttgcccttctacactga

SEQ ID NO: 580230 - DNA, 20 bp, Artificial
  CRISPR gRNA sequence
gcccttctacactgagcacg

SEQ ID NO: 580231 - DNA, 20 bp, Artificial
  CRISPR gRNA sequence
cccttctacactgagcacgg

SEQ ID NO: 580232 - DNA, 20 bp, Artificial
  CRISPR gRNA sequence
ctacactgagcacggagagg

SEQ ID NO: 580233 - DNA, 20 bp, Artificial
  CRISPR gRNA sequence
tacactgagcacggagaggc

SEQ ID NO: 580234 - DNA, 20 bp, Artificial
  CRISPR gRNA sequence
cactgagcacggagaggcgt

SEQ ID NO: 580235 - DNA, 20 bp, Artificial
  CRISPR gRNA sequence
agcacggagaggcgtggagt

SEQ ID NO: 580236 - DNA, 20 bp, Artificial
  CRISPR gRNA sequence
ctacgctgtctggttaagtc

SEQ ID NO: 580237 - DNA, 20 bp, Artificial
  CRISPR gRNA sequence
tacgctgtctggttaagtca

SEQ ID NO: 580238 - DNA, 20 bp, Artificial
  CRISPR gRNA sequence
cgctgtctggttaagtcatt

SEQ ID NO: 580239 - DNA, 20 bp, Artificial
  CRISPR gRNA sequence
tctggttaagtcattaggtg

SEQ ID NO: 580240 - DNA, 20 bp, Artificial
  CRISPR gRNA sequence
gttaagtcattaggtgtctg

SEQ ID NO: 580241 - DNA, 20 bp, Artificial
  CRISPR gRNA sequence
agtcattaggtgtctgcagg

SEQ ID NO: 580242 - DNA, 20 bp, Artificial
  CRISPR gRNA sequence
ggtgtctgcagggcttcaag

SEQ ID NO: 580243 - DNA, 20 bp, Artificial
  CRISPR gRNA sequence
cagggcttcaagttgacaat

SEQ ID NO: 580244 - DNA, 20 bp, Artificial
  CRISPR gRNA sequence
caagttgacaattgcccctc

SEQ ID NO: 580245 - DNA, 20 bp, Artificial
  CRISPR gRNA sequence
aagttgacaattgcccctct

SEQ ID NO: 580246 - DNA, 20 bp, Artificial
  CRISPR gRNA sequence
acaattgcccctctatccag

SEQ ID NO: 580247 - DNA, 20 bp, Artificial
  CRISPR gRNA sequence
cccctctatccaggggactg

SEQ ID NO: 580248 - DNA, 20 bp, Artificial
  CRISPR gRNA sequence
tatccaggggactggctgag

SEQ ID NO: 580249 - DNA, 20 bp, Artificial
  CRISPR gRNA sequence
tccaggggactggctgagag

SEQ ID NO: 580250 - DNA, 20 bp, Artificial
  CRISPR gRNA sequence
gctgagagatagggatacat

SEQ ID NO: 580251 - DNA, 20 bp, Artificial
  CRISPR gRNA sequence
agagatagggatacatagag

SEQ ID NO: 580252 - DNA, 20 bp, Artificial
  CRISPR gRNA sequence
agagaaatggacacatgcat

SEQ ID NO: 580253 - DNA, 20 bp, Artificial
  CRISPR gRNA sequence
cctcaaataagaacatttgc

SEQ ID NO: 580254 - DNA, 20 bp, Artificial
  CRISPR gRNA sequence
aaataagaacatttgctggt

SEQ ID NO: 580255 - DNA, 20 bp, Artificial
  CRISPR gRNA sequence
gctggtctctggctggttca

SEQ ID NO: 580256 - DNA, 20 bp, Artificial
  CRISPR gRNA sequence
ctggtctctggctggttcaa

SEQ ID NO: 580257 - DNA, 20 bp, Artificial
  CRISPR gRNA sequence
gtctctggctggttcaactg

SEQ ID NO: 580258 - DNA, 20 bp, Artificial
  CRISPR gRNA sequence
tggctggttcaactgatgct

SEQ ID NO: 580259 - DNA, 20 bp, Artificial
  CRISPR gRNA sequence
gctggttcaactgatgctgc

SEQ ID NO: 580260 - DNA, 20 bp, Artificial
  CRISPR gRNA sequence
gttcaactgatgctgcctga

SEQ ID NO: 580261 - DNA, 20 bp, Artificial
  CRISPR gRNA sequence
aactgatgctgcctgaaata

SEQ ID NO: 580262 - DNA, 20 bp, Artificial
  CRISPR gRNA sequence
atgctgcctgaaataatcaa

SEQ ID NO: 580263 - DNA, 20 bp, Artificial
  CRISPR gRNA sequence
cctgaaataatcaagaataa

SEQ ID NO: 580264 - DNA, 20 bp, Artificial
  CRISPR gRNA sequence
aaataatcaagaataaagaa

SEQ ID NO: 580265 - DNA, 20 bp, Artificial
  CRISPR gRNA sequence
ggtattgaattgtattgcaa

SEQ ID NO: 580266 - DNA, 20 bp, Artificial
  CRISPR gRNA sequence
aattgtattgcaaagcaaca

SEQ ID NO: 580267 - DNA, 20 bp, Artificial
  CRISPR gRNA sequence
tattgcaaagcaacaatcag

SEQ ID NO: 580268 - DNA, 20 bp, Artificial
  CRISPR gRNA sequence
caaagcaacaatcagcaaaa

SEQ ID NO: 580269 - DNA, 20 bp, Artificial
  CRISPR gRNA sequence
gtataagaacagatactggg

SEQ ID NO: 580270 - DNA, 20 bp, Artificial
  CRISPR gRNA sequence
gggaagagaacagaatagaa

SEQ ID NO: 580271 - DNA, 20 bp, Artificial
  CRISPR gRNA sequence
ggacatggacccacatatgg

SEQ ID NO: 580272 - DNA, 20 bp, Artificial
  CRISPR gRNA sequence
gacatggacccacatatgga

SEQ ID NO: 580273 - DNA, 20 bp, Artificial
  CRISPR gRNA sequence
aatttgtgatgaatgtggca

SEQ ID NO: 580274 - DNA, 20 bp, Artificial
  CRISPR gRNA sequence
gtgatgaatgtggcatttca

SEQ ID NO: 580275 - DNA, 20 bp, Artificial
  CRISPR gRNA sequence
tgatgaatgtggcatttcaa

SEQ ID NO: 580276 - DNA, 20 bp, Artificial
  CRISPR gRNA sequence
caaactggaggaccatggag

SEQ ID NO: 580277 - DNA, 20 bp, Artificial
  CRISPR gRNA sequence
aaactggaggaccatggagt

SEQ ID NO: 580278 - DNA, 20 bp, Artificial
  CRISPR gRNA sequence
gaggaccatggagtatggtt

SEQ ID NO: 580279 - DNA, 20 bp, Artificial
  CRISPR gRNA sequence
aacaaatgtgtctgagataa

SEQ ID NO: 580280 - DNA, 20 bp, Artificial
  CRISPR gRNA sequence
acaaatgtgtctgagataat

SEQ ID NO: 580281 - DNA, 20 bp, Artificial
  CRISPR gRNA sequence
agataattagggagaagata

SEQ ID NO: 580282 - DNA, 20 bp, Artificial
  CRISPR gRNA sequence
gggagaagataaagttattg

SEQ ID NO: 580283 - DNA, 20 bp, Artificial
  CRISPR gRNA sequence
ttgagtgaatagtcagtcca

SEQ ID NO: 580284 - DNA, 20 bp, Artificial
  CRISPR gRNA sequence
agtgaatagtcagtccatta

SEQ ID NO: 580285 - DNA, 20 bp, Artificial
  CRISPR gRNA sequence
tcccaacaacccctccctgc

SEQ ID NO: 580286 - DNA, 20 bp, Artificial
  CRISPR gRNA sequence
cctgcccagtttgaaatgtc

SEQ ID NO: 580287 - DNA, 20 bp, Artificial
  CRISPR gRNA sequence
cccagtttgaaatgtcacca

SEQ ID NO: 580288 - DNA, 20 bp, Artificial
  CRISPR gRNA sequence
gaaatgtcaccatcatcata

SEQ ID NO: 580289 - DNA, 20 bp, Artificial
  CRISPR gRNA sequence
aaatgtcaccatcatcatat

SEQ ID NO: 580290 - DNA, 20 bp, Artificial
  CRISPR gRNA sequence
aaatgcccagatccattcaa

SEQ ID NO: 580291 - DNA, 20 bp, Artificial
  CRISPR gRNA sequence
aagatataagttttaacacc

SEQ ID NO: 580292 - DNA, 20 bp, Artificial
  CRISPR gRNA sequence
taacacctaatgctgatctt

SEQ ID NO: 580293 - DNA, 20 bp, Artificial
  CRISPR gRNA sequence
aacacctaatgctgatcttg

SEQ ID NO: 580294 - DNA, 20 bp, Artificial
  CRISPR gRNA sequence
acacctaatgctgatcttgg

SEQ ID NO: 580295 - DNA, 20 bp, Artificial
  CRISPR gRNA sequence
atgctgatcttgggtttatt

SEQ ID NO: 580296 - DNA, 20 bp, Artificial
  CRISPR gRNA sequence
atcttgggtttattgtgtgt

SEQ ID NO: 580297 - DNA, 20 bp, Artificial
  CRISPR gRNA sequence
gggtttattgtgtgtcaggc

SEQ ID NO: 580298 - DNA, 20 bp, Artificial
  CRISPR gRNA sequence
ggtttattgtgtgtcaggcc

SEQ ID NO: 580299 - DNA, 20 bp, Artificial
  CRISPR gRNA sequence
attgtgtgtcaggccttgtg

SEQ ID NO: 580300 - DNA, 20 bp, Artificial
  CRISPR gRNA sequence
ttgtgtgtcaggccttgtgc

SEQ ID NO: 580301 - DNA, 20 bp, Artificial
  CRISPR gRNA sequence
tgtgtcaggccttgtgctaa

SEQ ID NO: 580302 - DNA, 20 bp, Artificial
  CRISPR gRNA sequence
gtgctaagtatttactgtgg

SEQ ID NO: 580303 - DNA, 20 bp, Artificial
  CRISPR gRNA sequence
tgctaagtatttactgtggt

SEQ ID NO: 580304 - DNA, 20 bp, Artificial
  CRISPR gRNA sequence
agtatttactgtggttaaaa

SEQ ID NO: 580305 - DNA, 20 bp, Artificial
  CRISPR gRNA sequence
actgtggttaaaaattttaa

SEQ ID NO: 580306 - DNA, 20 bp, Artificial
  CRISPR gRNA sequence
ctgtggttaaaaattttaat

SEQ ID NO: 580307 - DNA, 20 bp, Artificial
  CRISPR gRNA sequence
tggttaaaaattttaatcta

SEQ ID NO: 580308 - DNA, 20 bp, Artificial
  CRISPR gRNA sequence
aaaattttaatctaaacaaa

SEQ ID NO: 580309 - DNA, 20 bp, Artificial
  CRISPR gRNA sequence
taatctaaacaaagactcct

SEQ ID NO: 580310 - DNA, 20 bp, Artificial
  CRISPR gRNA sequence
aatctaaacaaagactcctg

SEQ ID NO: 580311 - DNA, 20 bp, Artificial
  CRISPR gRNA sequence
atctaaacaaagactcctga

SEQ ID NO: 580312 - DNA, 20 bp, Artificial
  CRISPR gRNA sequence
aacaaagactcctgaggaag

SEQ ID NO: 580313 - DNA, 20 bp, Artificial
  CRISPR gRNA sequence
ctgaggaaggtactattata

SEQ ID NO: 580314 - DNA, 20 bp, Artificial
  CRISPR gRNA sequence
aggaaggtactattataacc

SEQ ID NO: 580315 - DNA, 20 bp, Artificial
  CRISPR gRNA sequence
ttataaccattgcagtacat

SEQ ID NO: 580316 - DNA, 20 bp, Artificial
  CRISPR gRNA sequence
taaccattgcagtacatatg

SEQ ID NO: 580317 - DNA, 20 bp, Artificial
  CRISPR gRNA sequence
cagtacatatgaggaaatgg

SEQ ID NO: 580318 - DNA, 20 bp, Artificial
  CRISPR gRNA sequence
agtgcctggctaaaaatcac

SEQ ID NO: 580319 - DNA, 20 bp, Artificial
  CRISPR gRNA sequence
gctaaaaatcacacataggg

SEQ ID NO: 580320 - DNA, 20 bp, Artificial
  CRISPR gRNA sequence
aaaatcacacatagggcttg

SEQ ID NO: 580321 - DNA, 20 bp, Artificial
  CRISPR gRNA sequence
ggggtgacgctgggtttgtc

SEQ ID NO: 580322 - DNA, 20 bp, Artificial
  CRISPR gRNA sequence
gggtgacgctgggtttgtcc

SEQ ID NO: 580323 - DNA, 20 bp, Artificial
  CRISPR gRNA sequence
ggtttgtcccagacagtctg

SEQ ID NO: 580324 - DNA, 20 bp, Artificial
  CRISPR gRNA sequence
gtcccagacagtctggctcc

SEQ ID NO: 580325 - DNA, 20 bp, Artificial
  CRISPR gRNA sequence
tcccagacagtctggctcca

SEQ ID NO: 580326 - DNA, 20 bp, Artificial
  CRISPR gRNA sequence
gctccagtacccacactctt

SEQ ID NO: 580327 - DNA, 20 bp, Artificial
  CRISPR gRNA sequence
cagtacccacactcttaacc

SEQ ID NO: 580328 - DNA, 20 bp, Artificial
  CRISPR gRNA sequence
ttaacctctatagtaaatgg

SEQ ID NO: 580329 - DNA, 20 bp, Artificial
  CRISPR gRNA sequence
aacctctatagtaaatggaa

SEQ ID NO: 580330 - DNA, 20 bp, Artificial
  CRISPR gRNA sequence
acctctatagtaaatggaaa

SEQ ID NO: 580331 - DNA, 20 bp, Artificial
  CRISPR gRNA sequence
tatagtaaatggaaaaaatg

SEQ ID NO: 580332 - DNA, 20 bp, Artificial
  CRISPR gRNA sequence
tagtaaatggaaaaaatgaa

SEQ ID NO: 580333 - DNA, 20 bp, Artificial
  CRISPR gRNA sequence
gaagccaacataggtgaaca

SEQ ID NO: 580334 - DNA, 20 bp, Artificial
  CRISPR gRNA sequence
atctcattttcaagtaggaa

SEQ ID NO: 580335 - DNA, 20 bp, Artificial
  CRISPR gRNA sequence
tctcattttcaagtaggaaa

SEQ ID NO: 580336 - DNA, 20 bp, Artificial
  CRISPR gRNA sequence
attttcaagtaggaaaggac

SEQ ID NO: 580337 - DNA, 20 bp, Artificial
  CRISPR gRNA sequence
tcaagtaggaaaggactttc

SEQ ID NO: 580338 - DNA, 20 bp, Artificial
  CRISPR gRNA sequence
caagtaggaaaggactttct

SEQ ID NO: 580339 - DNA, 20 bp, Artificial
  CRISPR gRNA sequence
aagtaggaaaggactttcta

SEQ ID NO: 580340 - DNA, 20 bp, Artificial
  CRISPR gRNA sequence
tctaagcacaaaaccagaga

SEQ ID NO: 580341 - DNA, 20 bp, Artificial
  CRISPR gRNA sequence
ctaagcacaaaaccagagac

SEQ ID NO: 580342 - DNA, 20 bp, Artificial
  CRISPR gRNA sequence
taagcacaaaaccagagaca

SEQ ID NO: 580343 - DNA, 20 bp, Artificial
  CRISPR gRNA sequence
agcacaaaaccagagacaga

SEQ ID NO: 580344 - DNA, 20 bp, Artificial
  CRISPR gRNA sequence
acctatttgactgtataaaa

SEQ ID NO: 580345 - DNA, 20 bp, Artificial
  CRISPR gRNA sequence
tttgactgtataaaaccatc

SEQ ID NO: 580346 - DNA, 20 bp, Artificial
  CRISPR gRNA sequence
gactgtataaaaccatcata

SEQ ID NO: 580347 - DNA, 20 bp, Artificial
  CRISPR gRNA sequence
actgtataaaaccatcataa

SEQ ID NO: 580348 - DNA, 20 bp, Artificial
  CRISPR gRNA sequence
tataaaaccatcataagcat

SEQ ID NO: 580349 - DNA, 20 bp, Artificial
  CRISPR gRNA sequence
gggaaaatatttgctatata

SEQ ID NO: 580350 - DNA, 20 bp, Artificial
  CRISPR gRNA sequence
gctatatatgtaatggctga

SEQ ID NO: 580351 - DNA, 20 bp, Artificial
  CRISPR gRNA sequence
ctatatatgtaatggctgat

SEQ ID NO: 580352 - DNA, 20 bp, Artificial
  CRISPR gRNA sequence
tatatgtaatggctgatgaa

SEQ ID NO: 580353 - DNA, 20 bp, Artificial
  CRISPR gRNA sequence
atgaaaggttaataaccatt

SEQ ID NO: 580354 - DNA, 20 bp, Artificial
  CRISPR gRNA sequence
ataaccattccaaataaaga

SEQ ID NO: 580355 - DNA, 20 bp, Artificial
  CRISPR gRNA sequence
caaataaagagctgtggcaa

SEQ ID NO: 580356 - DNA, 20 bp, Artificial
  CRISPR gRNA sequence
tggcaaatcaataagggaaa

SEQ ID NO: 580357 - DNA, 20 bp, Artificial
  CRISPR gRNA sequence
ttaggagtaaggacatgacc

SEQ ID NO: 580358 - DNA, 20 bp, Artificial
  CRISPR gRNA sequence
ggagtaaggacatgaccaga

SEQ ID NO: 580359 - DNA, 20 bp, Artificial
  CRISPR gRNA sequence
caacaatgtgataatgtgtt

SEQ ID NO: 580360 - DNA, 20 bp, Artificial
  CRISPR gRNA sequence
aacaatgtgataatgtgttt

SEQ ID NO: 580361 - DNA, 20 bp, Artificial
  CRISPR gRNA sequence
ttcttacctgtcatgttggg

SEQ ID NO: 580362 - DNA, 20 bp, Artificial
  CRISPR gRNA sequence
tcttacctgtcatgttggga

SEQ ID NO: 580363 - DNA, 20 bp, Artificial
  CRISPR gRNA sequence
cttacctgtcatgttgggaa

SEQ ID NO: 580364 - DNA, 20 bp, Artificial
  CRISPR gRNA sequence
ttacctgtcatgttgggaaa

SEQ ID NO: 580365 - DNA, 20 bp, Artificial
  CRISPR gRNA sequence
acctgtcatgttgggaaata

SEQ ID NO: 580366 - DNA, 20 bp, Artificial
  CRISPR gRNA sequence
cctgtcatgttgggaaataa

SEQ ID NO: 580367 - DNA, 20 bp, Artificial
  CRISPR gRNA sequence
tcatgttgggaaataattaa

SEQ ID NO: 580368 - DNA, 20 bp, Artificial
  CRISPR gRNA sequence
ggaaataattaaaacataat

SEQ ID NO: 580369 - DNA, 20 bp, Artificial
  CRISPR gRNA sequence
aaacataataatactcacct

SEQ ID NO: 580370 - DNA, 20 bp, Artificial
  CRISPR gRNA sequence
acctagggttagcttaagta

SEQ ID NO: 580371 - DNA, 20 bp, Artificial
  CRISPR gRNA sequence
gggttagcttaagtagaggg

SEQ ID NO: 580372 - DNA, 20 bp, Artificial
  CRISPR gRNA sequence
gcttaagtagagggagcata

SEQ ID NO: 580373 - DNA, 20 bp, Artificial
  CRISPR gRNA sequence
aagtagagggagcataaaat

SEQ ID NO: 580374 - DNA, 20 bp, Artificial
  CRISPR gRNA sequence
agtagagggagcataaaata

SEQ ID NO: 580375 - DNA, 20 bp, Artificial
  CRISPR gRNA sequence
ttggaaggagaattagcaga

SEQ ID NO: 580376 - DNA, 20 bp, Artificial
  CRISPR gRNA sequence
tggaaggagaattagcagag

SEQ ID NO: 580377 - DNA, 20 bp, Artificial
  CRISPR gRNA sequence
ggaaggagaattagcagaga

SEQ ID NO: 580378 - DNA, 20 bp, Artificial
  CRISPR gRNA sequence
gaaggagaattagcagagag

SEQ ID NO: 580379 - DNA, 20 bp, Artificial
  CRISPR gRNA sequence
gcagagagggtcataaactt

SEQ ID NO: 580380 - DNA, 20 bp, Artificial
  CRISPR gRNA sequence
taaaaatgcacgcccccttt

SEQ ID NO: 580381 - DNA, 20 bp, Artificial
  CRISPR gRNA sequence
aaaaatgcacgccccctttg

SEQ ID NO: 580382 - DNA, 20 bp, Artificial
  CRISPR gRNA sequence
aaaatgcacgccccctttgc

SEQ ID NO: 580383 - DNA, 20 bp, Artificial
  CRISPR gRNA sequence
tgccccagcaactccctttt

SEQ ID NO: 580384 - DNA, 20 bp, Artificial
  CRISPR gRNA sequence
gccccagcaactcccttttc

SEQ ID NO: 580385 - DNA, 20 bp, Artificial
  CRISPR gRNA sequence
ccccagcaactcccttttca

SEQ ID NO: 580386 - DNA, 20 bp, Artificial
  CRISPR gRNA sequence
ccttttcaggaatccaagga

SEQ ID NO: 580387 - DNA, 20 bp, Artificial
  CRISPR gRNA sequence
ttcaggaatccaaggaagca

SEQ ID NO: 580388 - DNA, 20 bp, Artificial
  CRISPR gRNA sequence
tcaggaatccaaggaagcag

SEQ ID NO: 580389 - DNA, 20 bp, Artificial
  CRISPR gRNA sequence
caggaatccaaggaagcagt

SEQ ID NO: 580390 - DNA, 20 bp, Artificial
  CRISPR gRNA sequence
aggaatccaaggaagcagtc

SEQ ID NO: 580391 - DNA, 20 bp, Artificial
  CRISPR gRNA sequence
atagaaaaaaacgagaaaca

SEQ ID NO: 580392 - DNA, 20 bp, Artificial
  CRISPR gRNA sequence
tagaaaaaaacgagaaacaa

SEQ ID NO: 580393 - DNA, 20 bp, Artificial
  CRISPR gRNA sequence
ggtcaaatcaatcaaagttc

SEQ ID NO: 580394 - DNA, 20 bp, Artificial
  CRISPR gRNA sequence
gtcaaatcaatcaaagttca

SEQ ID NO: 580395 - DNA, 20 bp, Artificial
  CRISPR gRNA sequence
atgctgatgtgaggacagtc

SEQ ID NO: 580396 - DNA, 20 bp, Artificial
  CRISPR gRNA sequence
atgtgaggacagtcttgtcc

SEQ ID NO: 580397 - DNA, 20 bp, Artificial
  CRISPR gRNA sequence
gtccatcatgaaagatcatg

SEQ ID NO: 580398 - DNA, 20 bp, Artificial
  CRISPR gRNA sequence
tccatcatgaaagatcatgt

SEQ ID NO: 580399 - DNA, 20 bp, Artificial
  CRISPR gRNA sequence
aaacaatttttagtaagctt

SEQ ID NO: 580400 - DNA, 20 bp, Artificial
  CRISPR gRNA sequence
ttagtaagcttcaaaaacac

SEQ ID NO: 580401 - DNA, 20 bp, Artificial
  CRISPR gRNA sequence
tagtaagcttcaaaaacact

SEQ ID NO: 580402 - DNA, 20 bp, Artificial
  CRISPR gRNA sequence
agtaagcttcaaaaacacta

SEQ ID NO: 580403 - DNA, 20 bp, Artificial
  CRISPR gRNA sequence
gtaagcttcaaaaacactac

SEQ ID NO: 580404 - DNA, 20 bp, Artificial
  CRISPR gRNA sequence
caaaaacactactgttaatt

SEQ ID NO: 580405 - DNA, 20 bp, Artificial
  CRISPR gRNA sequence
aaaaacactactgttaattg

SEQ ID NO: 580406 - DNA, 20 bp, Artificial
  CRISPR gRNA sequence
ctgttaattgaataaagcag

SEQ ID NO: 580407 - DNA, 20 bp, Artificial
  CRISPR gRNA sequence
ttaattgaataaagcaggaa

SEQ ID NO: 580408 - DNA, 20 bp, Artificial
  CRISPR gRNA sequence
attgaataaagcaggaacaa

SEQ ID NO: 580409 - DNA, 20 bp, Artificial
  CRISPR gRNA sequence
aataaagcaggaacaaaacc

SEQ ID NO: 580410 - DNA, 20 bp, Artificial
  CRISPR gRNA sequence
taatttggttacagaaatac

SEQ ID NO: 580411 - DNA, 20 bp, Artificial
  CRISPR gRNA sequence
atttggttacagaaatacta

SEQ ID NO: 580412 - DNA, 20 bp, Artificial
  CRISPR gRNA sequence
ggttacagaaatactaatag

SEQ ID NO: 580413 - DNA, 20 bp, Artificial
  CRISPR gRNA sequence
gttacagaaatactaatagc

SEQ ID NO: 580414 - DNA, 20 bp, Artificial
  CRISPR gRNA sequence
cagaaatactaatagctaac

SEQ ID NO: 580415 - DNA, 20 bp, Artificial
  CRISPR gRNA sequence
atagctaacacttcgtgagc

SEQ ID NO: 580416 - DNA, 20 bp, Artificial
  CRISPR gRNA sequence
acacttcgtgagcacttact

SEQ ID NO: 580417 - DNA, 20 bp, Artificial
  CRISPR gRNA sequence
cgtgagcacttactttgtgc

SEQ ID NO: 580418 - DNA, 20 bp, Artificial
  CRISPR gRNA sequence
gtgagcacttactttgtgcc

SEQ ID NO: 580419 - DNA, 20 bp, Artificial
  CRISPR gRNA sequence
actttgtgccaaacgctgtg

SEQ ID NO: 580420 - DNA, 20 bp, Artificial
  CRISPR gRNA sequence
ctttgtgccaaacgctgtgc

SEQ ID NO: 580421 - DNA, 20 bp, Artificial
  CRISPR gRNA sequence
tgtgccaaacgctgtgctaa

SEQ ID NO: 580422 - DNA, 20 bp, Artificial
  CRISPR gRNA sequence
gtgccaaacgctgtgctaag

SEQ ID NO: 580423 - DNA, 20 bp, Artificial
  CRISPR gRNA sequence
tgccaaacgctgtgctaagc

SEQ ID NO: 580424 - DNA, 20 bp, Artificial
  CRISPR gRNA sequence
tgctaagcctgcagaatcga

SEQ ID NO: 580425 - DNA, 20 bp, Artificial
  CRISPR gRNA sequence
agcctgcagaatcgagctca

SEQ ID NO: 580426 - DNA, 20 bp, Artificial
  CRISPR gRNA sequence
cagaatcgagctcaccccag

SEQ ID NO: 580427 - DNA, 20 bp, Artificial
  CRISPR gRNA sequence
accccagccctgaacaacct

SEQ ID NO: 580428 - DNA, 20 bp, Artificial
  CRISPR gRNA sequence
aacaacctgtttgcttcctg

SEQ ID NO: 580429 - DNA, 20 bp, Artificial
  CRISPR gRNA sequence
tttgcttcctgaatatggac

SEQ ID NO: 580430 - DNA, 20 bp, Artificial
  CRISPR gRNA sequence
gcttcctgaatatggactct

SEQ ID NO: 580431 - DNA, 20 bp, Artificial
  CRISPR gRNA sequence
cttcctgaatatggactctg

SEQ ID NO: 580432 - DNA, 20 bp, Artificial
  CRISPR gRNA sequence
cctgaatatggactctggtc

SEQ ID NO: 580433 - DNA, 20 bp, Artificial
  CRISPR gRNA sequence
ctgaatatggactctggtca

SEQ ID NO: 580434 - DNA, 20 bp, Artificial
  CRISPR gRNA sequence
aatatggactctggtcacac

SEQ ID NO: 580435 - DNA, 20 bp, Artificial
  CRISPR gRNA sequence
tggtcacacacatgcagtcc

SEQ ID NO: 580436 - DNA, 20 bp, Artificial
  CRISPR gRNA sequence
gtcacacacatgcagtcctg

SEQ ID NO: 580437 - DNA, 20 bp, Artificial
  CRISPR gRNA sequence
gggtaggtccacacagctaa

SEQ ID NO: 580438 - DNA, 20 bp, Artificial
  CRISPR gRNA sequence
aactacggttgacaatggtg

SEQ ID NO: 580439 - DNA, 20 bp, Artificial
  CRISPR gRNA sequence
cggttgacaatggtgtgaag

SEQ ID NO: 580440 - DNA, 20 bp, Artificial
  CRISPR gRNA sequence
acaatggtgtgaagtgctcc

SEQ ID NO: 580441 - DNA, 20 bp, Artificial
  CRISPR gRNA sequence
cctgcccccccgccccaagg

SEQ ID NO: 580442 - DNA, 20 bp, Artificial
  CRISPR gRNA sequence
cccccccgccccaagggtct

SEQ ID NO: 580443 - DNA, 20 bp, Artificial
  CRISPR gRNA sequence
ctctaaagcgatacaagcaa

SEQ ID NO: 580444 - DNA, 20 bp, Artificial
  CRISPR gRNA sequence
taaagcgatacaagcaaagt

SEQ ID NO: 580445 - DNA, 20 bp, Artificial
  CRISPR gRNA sequence
aagcgatacaagcaaagttc

SEQ ID NO: 580446 - DNA, 20 bp, Artificial
  CRISPR gRNA sequence
agttaagtgctcagcttgcc

SEQ ID NO: 580447 - DNA, 20 bp, Artificial
  CRISPR gRNA sequence
agtgctcagcttgccccggc

SEQ ID NO: 580448 - DNA, 20 bp, Artificial
  CRISPR gRNA sequence
agcttgccccggcaccttgc

SEQ ID NO: 580449 - DNA, 20 bp, Artificial
  CRISPR gRNA sequence
gccccggcaccttgcaatcc

SEQ ID NO: 580450 - DNA, 20 bp, Artificial
  CRISPR gRNA sequence
ccccggcaccttgcaatcct

SEQ ID NO: 580451 - DNA, 20 bp, Artificial
  CRISPR gRNA sequence
gcaatcctcctgctactagg

SEQ ID NO: 580452 - DNA, 20 bp, Artificial
  CRISPR gRNA sequence
caatcctcctgctactaggg

SEQ ID NO: 580453 - DNA, 20 bp, Artificial
  CRISPR gRNA sequence
ctgctactagggtgaacaga

SEQ ID NO: 580454 - DNA, 20 bp, Artificial
  CRISPR gRNA sequence
ctactagggtgaacagaact

SEQ ID NO: 580455 - DNA, 20 bp, Artificial
  CRISPR gRNA sequence
ctagggtgaacagaactgat

SEQ ID NO: 580456 - DNA, 20 bp, Artificial
  CRISPR gRNA sequence
gggtgaacagaactgatgct

SEQ ID NO: 580457 - DNA, 20 bp, Artificial
  CRISPR gRNA sequence
atgctcactctcataaaatg

SEQ ID NO: 580458 - DNA, 20 bp, Artificial
  CRISPR gRNA sequence
actctcataaaatgtaaagg

SEQ ID NO: 580459 - DNA, 20 bp, Artificial
  CRISPR gRNA sequence
tcataaaatgtaaaggtcct

SEQ ID NO: 580460 - DNA, 20 bp, Artificial
  CRISPR gRNA sequence
ataaaatgtaaaggtcctcg

SEQ ID NO: 580461 - DNA, 20 bp, Artificial
  CRISPR gRNA sequence
ggcgacattactattattaa

SEQ ID NO: 580462 - DNA, 20 bp, Artificial
  CRISPR gRNA sequence
ctattattaaacgccagctg

SEQ ID NO: 580463 - DNA, 20 bp, Artificial
  CRISPR gRNA sequence
ttattaaacgccagctgtgt

SEQ ID NO: 580464 - DNA, 20 bp, Artificial
  CRISPR gRNA sequence
ttaaacgccagctgtgtaca

SEQ ID NO: 580465 - DNA, 20 bp, Artificial
  CRISPR gRNA sequence
aacgccagctgtgtacaaag

SEQ ID NO: 580466 - DNA, 20 bp, Artificial
  CRISPR gRNA sequence
tgtacaaagctctaggctgg

SEQ ID NO: 580467 - DNA, 20 bp, Artificial
  CRISPR gRNA sequence
taggctggatgctggctggg

SEQ ID NO: 580468 - DNA, 20 bp, Artificial
  CRISPR gRNA sequence
ggctggatgctggctgggaa

SEQ ID NO: 580469 - DNA, 20 bp, Artificial
  CRISPR gRNA sequence
gatgctggctgggaaggcag

SEQ ID NO: 580470 - DNA, 20 bp, Artificial
  CRISPR gRNA sequence
gctgggaaggcaggtggggg

SEQ ID NO: 580471 - DNA, 20 bp, Artificial
  CRISPR gRNA sequence
ggaaggcaggtgggggaagg

SEQ ID NO: 580472 - DNA, 20 bp, Artificial
  CRISPR gRNA sequence
agtgtagcgacagacagatg

SEQ ID NO: 580473 - DNA, 20 bp, Artificial
  CRISPR gRNA sequence
agagacaaagagatgagaga

SEQ ID NO: 580474 - DNA, 20 bp, Artificial
  CRISPR gRNA sequence
aaattttcagttgcacctgg

SEQ ID NO: 580475 - DNA, 20 bp, Artificial
  CRISPR gRNA sequence
tcagttgcacctggacagca

SEQ ID NO: 580476 - DNA, 20 bp, Artificial
  CRISPR gRNA sequence
cagttgcacctggacagcat

SEQ ID NO: 580477 - DNA, 20 bp, Artificial
  CRISPR gRNA sequence
agttgcacctggacagcatt

SEQ ID NO: 580478 - DNA, 20 bp, Artificial
  CRISPR gRNA sequence
cacctggacagcatttcaag

SEQ ID NO: 580479 - DNA, 20 bp, Artificial
  CRISPR gRNA sequence
gacagcatttcaagttgttc

SEQ ID NO: 580480 - DNA, 20 bp, Artificial
  CRISPR gRNA sequence
caagttgttcaaagctctga

SEQ ID NO: 580481 - DNA, 20 bp, Artificial
  CRISPR gRNA sequence
aagttgttcaaagctctgaa

SEQ ID NO: 580482 - DNA, 20 bp, Artificial
  CRISPR gRNA sequence
ttcaaagctctgaaatccat

SEQ ID NO: 580483 - DNA, 20 bp, Artificial
  CRISPR gRNA sequence
aaagctctgaaatccataaa

SEQ ID NO: 580484 - DNA, 20 bp, Artificial
  CRISPR gRNA sequence
tgaaatccataaagactggc

SEQ ID NO: 580485 - DNA, 20 bp, Artificial
  CRISPR gRNA sequence
aaatccataaagactggcag

SEQ ID NO: 580486 - DNA, 20 bp, Artificial
  CRISPR gRNA sequence
gcagctgacatattttaaaa

SEQ ID NO: 580487 - DNA, 20 bp, Artificial
  CRISPR gRNA sequence
acatattttaaaaatcctat

SEQ ID NO: 580488 - DNA, 20 bp, Artificial
  CRISPR gRNA sequence
taaaaatcctatccatctac

SEQ ID NO: 580489 - DNA, 20 bp, Artificial
  CRISPR gRNA sequence
aaaaatcctatccatctacg

SEQ ID NO: 580490 - DNA, 20 bp, Artificial
  CRISPR gRNA sequence
aaaatcctatccatctacgt

SEQ ID NO: 580491 - DNA, 20 bp, Artificial
  CRISPR gRNA sequence
tccatctacgtatcaattga

SEQ ID NO: 580492 - DNA, 20 bp, Artificial
  CRISPR gRNA sequence
cgtatcaattgatgaattca

SEQ ID NO: 580493 - DNA, 20 bp, Artificial
  CRISPR gRNA sequence
atgaattcatttatttttgc

SEQ ID NO: 580494 - DNA, 20 bp, Artificial
  CRISPR gRNA sequence
atttatttttgcccctgccc

SEQ ID NO: 580495 - DNA, 20 bp, Artificial
  CRISPR gRNA sequence
atttttgcccctgcccatgc

SEQ ID NO: 580496 - DNA, 20 bp, Artificial
  CRISPR gRNA sequence
tttttgcccctgcccatgca

SEQ ID NO: 580497 - DNA, 20 bp, Artificial
  CRISPR gRNA sequence
ttgcccctgcccatgcatta

SEQ ID NO: 580498 - DNA, 20 bp, Artificial
  CRISPR gRNA sequence
tgcccctgcccatgcattaa

SEQ ID NO: 580499 - DNA, 20 bp, Artificial
  CRISPR gRNA sequence
gcccctgcccatgcattaag

SEQ ID NO: 580500 - DNA, 20 bp, Artificial
  CRISPR gRNA sequence
cccctgcccatgcattaagt

SEQ ID NO: 580501 - DNA, 20 bp, Artificial
  CRISPR gRNA sequence
cccatgcattaagtacttca

SEQ ID NO: 580502 - DNA, 20 bp, Artificial
  CRISPR gRNA sequence
agtacttcacctttaagtct

SEQ ID NO: 580503 - DNA, 20 bp, Artificial
  CRISPR gRNA sequence
cacctttaagtcttctgcca

SEQ ID NO: 580504 - DNA, 20 bp, Artificial
  CRISPR gRNA sequence
acctttaagtcttctgccat

SEQ ID NO: 580505 - DNA, 20 bp, Artificial
  CRISPR gRNA sequence
taagtcttctgccatttatt

SEQ ID NO: 580506 - DNA, 20 bp, Artificial
  CRISPR gRNA sequence
aagtcttctgccatttattc

SEQ ID NO: 580507 - DNA, 20 bp, Artificial
  CRISPR gRNA sequence
agtcttctgccatttattct

SEQ ID NO: 580508 - DNA, 20 bp, Artificial
  CRISPR gRNA sequence
ctgccatttattctattatt

SEQ ID NO: 580509 - DNA, 20 bp, Artificial
  CRISPR gRNA sequence
tgccatttattctattattt

SEQ ID NO: 580510 - DNA, 20 bp, Artificial
  CRISPR gRNA sequence
ccatttattctattattttt

SEQ ID NO: 580511 - DNA, 20 bp, Artificial
  CRISPR gRNA sequence
attctattatttttttaaag

SEQ ID NO: 580512 - DNA, 20 bp, Artificial
  CRISPR gRNA sequence
ttctattatttttttaaaga

SEQ ID NO: 580513 - DNA, 20 bp, Artificial
  CRISPR gRNA sequence
tattatttttttaaagacct

SEQ ID NO: 580514 - DNA, 20 bp, Artificial
  CRISPR gRNA sequence
ttatttttttaaagacctta

SEQ ID NO: 580515 - DNA, 20 bp, Artificial
  CRISPR gRNA sequence
tttttttaaagaccttacct

SEQ ID NO: 580516 - DNA, 20 bp, Artificial
  CRISPR gRNA sequence
ttttaaagaccttacctggc

SEQ ID NO: 580517 - DNA, 20 bp, Artificial
  CRISPR gRNA sequence
tttaaagaccttacctggct

SEQ ID NO: 580518 - DNA, 20 bp, Artificial
  CRISPR gRNA sequence
ttaaagaccttacctggctg

SEQ ID NO: 580519 - DNA, 20 bp, Artificial
  CRISPR gRNA sequence
taaagaccttacctggctgg

SEQ ID NO: 580520 - DNA, 20 bp, Artificial
  CRISPR gRNA sequence
aaagaccttacctggctgga

SEQ ID NO: 580521 - DNA, 20 bp, Artificial
  CRISPR gRNA sequence
aagaccttacctggctggaa

SEQ ID NO: 580522 - DNA, 20 bp, Artificial
  CRISPR gRNA sequence
acctggctggaatcacggta

SEQ ID NO: 580523 - DNA, 20 bp, Artificial
  CRISPR gRNA sequence
cctggctggaatcacggtag

SEQ ID NO: 580524 - DNA, 20 bp, Artificial
  CRISPR gRNA sequence
gctggaatcacggtagctgg

SEQ ID NO: 580525 - DNA, 20 bp, Artificial
  CRISPR gRNA sequence
gaatcacggtagctgggtac

SEQ ID NO: 580526 - DNA, 20 bp, Artificial
  CRISPR gRNA sequence
ggtacatcccactgtaccag

SEQ ID NO: 580527 - DNA, 20 bp, Artificial
  CRISPR gRNA sequence
taccagagggcccctgaccc

SEQ ID NO: 580528 - DNA, 20 bp, Artificial
  CRISPR gRNA sequence
acccccccgccgtgcctacc

SEQ ID NO: 580529 - DNA, 20 bp, Artificial
  CRISPR gRNA sequence
cctccctgccatctcctcca

SEQ ID NO: 580530 - DNA, 20 bp, Artificial
  CRISPR gRNA sequence
cctgccatctcctccaatgg

SEQ ID NO: 580531 - DNA, 20 bp, Artificial
  CRISPR gRNA sequence
ccatctcctccaatggggcc

SEQ ID NO: 580532 - DNA, 20 bp, Artificial
  CRISPR gRNA sequence
ctccaatggggcccacatct

SEQ ID NO: 580533 - DNA, 20 bp, Artificial
  CRISPR gRNA sequence
caatggggcccacatctggt

SEQ ID NO: 580534 - DNA, 20 bp, Artificial
  CRISPR gRNA sequence
gtaggggagagcagggacac

SEQ ID NO: 580535 - DNA, 20 bp, Artificial
  CRISPR gRNA sequence
accttggtgaagtggactga

SEQ ID NO: 580536 - DNA, 20 bp, Artificial
  CRISPR gRNA sequence
ggtgaagtggactgacagaa

SEQ ID NO: 580537 - DNA, 20 bp, Artificial
  CRISPR gRNA sequence
gtgaagtggactgacagaaa

SEQ ID NO: 580538 - DNA, 20 bp, Artificial
  CRISPR gRNA sequence
acagaaaaggatcagcctgg

SEQ ID NO: 580539 - DNA, 20 bp, Artificial
  CRISPR gRNA sequence
gcttgtgggaaactgtcacg

SEQ ID NO: 580540 - DNA, 20 bp, Artificial
  CRISPR gRNA sequence
gtgggaaactgtcacgtatc

SEQ ID NO: 580541 - DNA, 20 bp, Artificial
  CRISPR gRNA sequence
tgggaaactgtcacgtatca

SEQ ID NO: 580542 - DNA, 20 bp, Artificial
  CRISPR gRNA sequence
tcacgtatcaaaaacaactt

SEQ ID NO: 580543 - DNA, 20 bp, Artificial
  CRISPR gRNA sequence
tgcttttataccgagaagaa

SEQ ID NO: 580544 - DNA, 20 bp, Artificial
  CRISPR gRNA sequence
gcttttataccgagaagaaa

SEQ ID NO: 580545 - DNA, 20 bp, Artificial
  CRISPR gRNA sequence
cttttataccgagaagaaaa

SEQ ID NO: 580546 - DNA, 20 bp, Artificial
  CRISPR gRNA sequence
ttataccgagaagaaaaacc

SEQ ID NO: 580547 - DNA, 20 bp, Artificial
  CRISPR gRNA sequence
tataccgagaagaaaaacca

SEQ ID NO: 580548 - DNA, 20 bp, Artificial
  CRISPR gRNA sequence
ataccgagaagaaaaaccac

SEQ ID NO: 580549 - DNA, 20 bp, Artificial
  CRISPR gRNA sequence
taccgagaagaaaaaccacg

SEQ ID NO: 580550 - DNA, 20 bp, Artificial
  CRISPR gRNA sequence
tacggtgtggaagccgcaga

SEQ ID NO: 580551 - DNA, 20 bp, Artificial
  CRISPR gRNA sequence
tctcttctaataatccaaat

SEQ ID NO: 580552 - DNA, 20 bp, Artificial
  CRISPR gRNA sequence
tcttctaataatccaaattt

SEQ ID NO: 580553 - DNA, 20 bp, Artificial
  CRISPR gRNA sequence
ttctaataatccaaattttt

SEQ ID NO: 580554 - DNA, 20 bp, Artificial
  CRISPR gRNA sequence
ctaataatccaaattttttt

SEQ ID NO: 580555 - DNA, 20 bp, Artificial
  CRISPR gRNA sequence
taataatccaaatttttttc

SEQ ID NO: 580556 - DNA, 20 bp, Artificial
  CRISPR gRNA sequence
ataatccaaatttttttcga

SEQ ID NO: 580557 - DNA, 20 bp, Artificial
  CRISPR gRNA sequence
ttttcgatgagtgtgtgcgc

SEQ ID NO: 580558 - DNA, 20 bp, Artificial
  CRISPR gRNA sequence
tttcgatgagtgtgtgcgct

SEQ ID NO: 580559 - DNA, 20 bp, Artificial
  CRISPR gRNA sequence
ttcgatgagtgtgtgcgctg

SEQ ID NO: 580560 - DNA, 20 bp, Artificial
  CRISPR gRNA sequence
tcgatgagtgtgtgcgctga

SEQ ID NO: 580561 - DNA, 20 bp, Artificial
  CRISPR gRNA sequence
cgatgagtgtgtgcgctgat

SEQ ID NO: 580562 - DNA, 20 bp, Artificial
  CRISPR gRNA sequence
gatgagtgtgtgcgctgata

SEQ ID NO: 580563 - DNA, 20 bp, Artificial
  CRISPR gRNA sequence
ataatcacggggtggggagg

SEQ ID NO: 580564 - DNA, 20 bp, Artificial
  CRISPR gRNA sequence
tcatagttttttttttctct

SEQ ID NO: 580565 - DNA, 20 bp, Artificial
  CRISPR gRNA sequence
atagttttttttttctctct

SEQ ID NO: 580566 - DNA, 20 bp, Artificial
  CRISPR gRNA sequence
tttttttctctctctctgtg

SEQ ID NO: 580567 - DNA, 20 bp, Artificial
  CRISPR gRNA sequence
ttttttctctctctctgtgt

SEQ ID NO: 580568 - DNA, 20 bp, Artificial
  CRISPR gRNA sequence
tttttctctctctctgtgtt

SEQ ID NO: 580569 - DNA, 20 bp, Artificial
  CRISPR gRNA sequence
ttttctctctctctgtgttt

SEQ ID NO: 580570 - DNA, 20 bp, Artificial
  CRISPR gRNA sequence
tttctctctctctgtgtttc

SEQ ID NO: 580571 - DNA, 20 bp, Artificial
  CRISPR gRNA sequence
ttctctctctctgtgtttct

SEQ ID NO: 580572 - DNA, 20 bp, Artificial
  CRISPR gRNA sequence
tctctctctctgtgtttctc

SEQ ID NO: 580573 - DNA, 20 bp, Artificial
  CRISPR gRNA sequence
ctctctctctgtgtttctcc

SEQ ID NO: 580574 - DNA, 20 bp, Artificial
  CRISPR gRNA sequence
tctctctctgtgtttctcct

SEQ ID NO: 580575 - DNA, 20 bp, Artificial
  CRISPR gRNA sequence
tctctctgtgtttctccttt

SEQ ID NO: 580576 - DNA, 20 bp, Artificial
  CRISPR gRNA sequence
tctctgtgtttctccttttc

SEQ ID NO: 580577 - DNA, 20 bp, Artificial
  CRISPR gRNA sequence
tctgtgtttctccttttctt

SEQ ID NO: 580578 - DNA, 20 bp, Artificial
  CRISPR gRNA sequence
tgtgtttctccttttcttga

SEQ ID NO: 580579 - DNA, 20 bp, Artificial
  CRISPR gRNA sequence
tgtttctccttttcttgatt

SEQ ID NO: 580580 - DNA, 20 bp, Artificial
  CRISPR gRNA sequence
ctccttttcttgattatgag

SEQ ID NO: 580581 - DNA, 20 bp, Artificial
  CRISPR gRNA sequence
tccttttcttgattatgaga

SEQ ID NO: 580582 - DNA, 20 bp, Artificial
  CRISPR gRNA sequence
cttttcttgattatgagact

SEQ ID NO: 580583 - DNA, 20 bp, Artificial
  CRISPR gRNA sequence
ttcttgattatgagacttaa

SEQ ID NO: 580584 - DNA, 20 bp, Artificial
  CRISPR gRNA sequence
tcttgattatgagacttaaa

SEQ ID NO: 580585 - DNA, 20 bp, Artificial
  CRISPR gRNA sequence
cttgattatgagacttaaac

SEQ ID NO: 580586 - DNA, 20 bp, Artificial
  CRISPR gRNA sequence
ttgattatgagacttaaacg

SEQ ID NO: 580587 - DNA, 20 bp, Artificial
  CRISPR gRNA sequence
gattatgagacttaaacgga

SEQ ID NO: 580588 - DNA, 20 bp, Artificial
  CRISPR gRNA sequence
attatgagacttaaacggaa

SEQ ID NO: 580589 - DNA, 20 bp, Artificial
  CRISPR gRNA sequence
tgagacttaaacggaaattt

SEQ ID NO: 580590 - DNA, 20 bp, Artificial
  CRISPR gRNA sequence
aaacggaaattttgaaattt

SEQ ID NO: 580591 - DNA, 20 bp, Artificial
  CRISPR gRNA sequence
aacggaaattttgaaatttt

SEQ ID NO: 580592 - DNA, 20 bp, Artificial
  CRISPR gRNA sequence
tgaaattttgggtttttttc

SEQ ID NO: 580593 - DNA, 20 bp, Artificial
  CRISPR gRNA sequence
gaaattttgggtttttttct

SEQ ID NO: 580594 - DNA, 20 bp, Artificial
  CRISPR gRNA sequence
aaattttgggtttttttctt

SEQ ID NO: 580595 - DNA, 20 bp, Artificial
  CRISPR gRNA sequence
tgggtttttttctttgccct

SEQ ID NO: 580596 - DNA, 20 bp, Artificial
  CRISPR gRNA sequence
gggtttttttctttgccctt

SEQ ID NO: 580597 - DNA, 20 bp, Artificial
  CRISPR gRNA sequence
ggtttttttctttgcccttt

SEQ ID NO: 580598 - DNA, 20 bp, Artificial
  CRISPR gRNA sequence
ttttctttgccctttacgag

SEQ ID NO: 580599 - DNA, 20 bp, Artificial
  CRISPR gRNA sequence
tttctttgccctttacgagt

SEQ ID NO: 580600 - DNA, 20 bp, Artificial
  CRISPR gRNA sequence
ttctttgccctttacgagtc

SEQ ID NO: 580601 - DNA, 20 bp, Artificial
  CRISPR gRNA sequence
tctttgccctttacgagtca

SEQ ID NO: 580602 - DNA, 20 bp, Artificial
  CRISPR gRNA sequence
ctttgccctttacgagtcat

SEQ ID NO: 580603 - DNA, 20 bp, Artificial
  CRISPR gRNA sequence
tttgccctttacgagtcatc

SEQ ID NO: 580604 - DNA, 20 bp, Artificial
  CRISPR gRNA sequence
tgccctttacgagtcatctg

SEQ ID NO: 580605 - DNA, 20 bp, Artificial
  CRISPR gRNA sequence
gccctttacgagtcatctga

SEQ ID NO: 580606 - DNA, 20 bp, Artificial
  CRISPR gRNA sequence
ccctttacgagtcatctgaa

SEQ ID NO: 580607 - DNA, 20 bp, Artificial
  CRISPR gRNA sequence
tacgagtcatctgaaaatat

SEQ ID NO: 580608 - DNA, 20 bp, Artificial
  CRISPR gRNA sequence
acgagtcatctgaaaatatg

SEQ ID NO: 580609 - DNA, 20 bp, Artificial
  CRISPR gRNA sequence
cgagtcatctgaaaatatga

SEQ ID NO: 580610 - DNA, 20 bp, Artificial
  CRISPR gRNA sequence
aaaatatgatttcttcccct

SEQ ID NO: 580611 - DNA, 20 bp, Artificial
  CRISPR gRNA sequence
cttcccctcaccacagaggt

SEQ ID NO: 580612 - DNA, 20 bp, Artificial
  CRISPR gRNA sequence
ttcccctcaccacagaggtg

SEQ ID NO: 580613 - DNA, 20 bp, Artificial
  CRISPR gRNA sequence
cccctcaccacagaggtgag

SEQ ID NO: 580614 - DNA, 20 bp, Artificial
  CRISPR gRNA sequence
ccctcaccacagaggtgaga

SEQ ID NO: 580615 - DNA, 20 bp, Artificial
  CRISPR gRNA sequence
accacagaggtgagaggtat

SEQ ID NO: 580616 - DNA, 20 bp, Artificial
  CRISPR gRNA sequence
atgagaaaccacagttttta

SEQ ID NO: 580617 - DNA, 20 bp, Artificial
  CRISPR gRNA sequence
ttaaaacaaaagtgtataga

SEQ ID NO: 580618 - DNA, 20 bp, Artificial
  CRISPR gRNA sequence
taaaacaaaagtgtatagag

SEQ ID NO: 580619 - DNA, 20 bp, Artificial
  CRISPR gRNA sequence
aaaacaaaagtgtatagagt

SEQ ID NO: 580620 - DNA, 20 bp, Artificial
  CRISPR gRNA sequence
aaacaaaagtgtatagagtt

SEQ ID NO: 580621 - DNA, 20 bp, Artificial
  CRISPR gRNA sequence
gaaaaaaaaaaaacaaggga

SEQ ID NO: 580622 - DNA, 20 bp, Artificial
  CRISPR gRNA sequence
aaaaaaaaaaaacaagggaa

SEQ ID NO: 580623 - DNA, 20 bp, Artificial
  CRISPR gRNA sequence
aaataaatcacagggccaac

SEQ ID NO: 580624 - DNA, 20 bp, Artificial
  CRISPR gRNA sequence
tgtgagtgagaggatatttg

SEQ ID NO: 580625 - DNA, 20 bp, Artificial
  CRISPR gRNA sequence
tgagtgagaggatatttgag

SEQ ID NO: 580626 - DNA, 20 bp, Artificial
  CRISPR gRNA sequence
gagggtctctggggaaagaa

SEQ ID NO: 580627 - DNA, 20 bp, Artificial
  CRISPR gRNA sequence
agggtctctggggaaagaaa

SEQ ID NO: 580628 - DNA, 20 bp, Artificial
  CRISPR gRNA sequence
tggggaaagaaagagaatct

SEQ ID NO: 580629 - DNA, 20 bp, Artificial
  CRISPR gRNA sequence
gggaaagaaagagaatctga

SEQ ID NO: 580630 - DNA, 20 bp, Artificial
  CRISPR gRNA sequence
aagctctatgtgtggatggg

SEQ ID NO: 580631 - DNA, 20 bp, Artificial
  CRISPR gRNA sequence
tatgtgtggatgggaaatgc

SEQ ID NO: 580632 - DNA, 20 bp, Artificial
  CRISPR gRNA sequence
tgtgtggatgggaaatgcca

SEQ ID NO: 580633 - DNA, 20 bp, Artificial
  CRISPR gRNA sequence
ggttcccagaggcctcgccc

SEQ ID NO: 580634 - DNA, 20 bp, Artificial
  CRISPR gRNA sequence
ccagaggcctcgccctactc

SEQ ID NO: 580635 - DNA, 20 bp, Artificial
  CRISPR gRNA sequence
gccctactccaggcctcagt

SEQ ID NO: 580636 - DNA, 20 bp, Artificial
  CRISPR gRNA sequence
ctccaggcctcagtttccct

SEQ ID NO: 580637 - DNA, 20 bp, Artificial
  CRISPR gRNA sequence
caggcctcagtttccctata

SEQ ID NO: 580638 - DNA, 20 bp, Artificial
  CRISPR gRNA sequence
agtttccctatagatggaat

SEQ ID NO: 580639 - DNA, 20 bp, Artificial
  CRISPR gRNA sequence
ccctatagatggaattgata

SEQ ID NO: 580640 - DNA, 20 bp, Artificial
  CRISPR gRNA sequence
cctatagatggaattgatat

SEQ ID NO: 580641 - DNA, 20 bp, Artificial
  CRISPR gRNA sequence
tagatggaattgatatggtc

SEQ ID NO: 580642 - DNA, 20 bp, Artificial
  CRISPR gRNA sequence
atatggtccccattgcttga

SEQ ID NO: 580643 - DNA, 20 bp, Artificial
  CRISPR gRNA sequence
cttgaactacccggcgaggg

SEQ ID NO: 580644 - DNA, 20 bp, Artificial
  CRISPR gRNA sequence
gaactacccggcgaggggag

SEQ ID NO: 580645 - DNA, 20 bp, Artificial
  CRISPR gRNA sequence
aactacccggcgaggggagt

SEQ ID NO: 580646 - DNA, 20 bp, Artificial
  CRISPR gRNA sequence
cccggcgaggggagttctgc

SEQ ID NO: 580647 - DNA, 20 bp, Artificial
  CRISPR gRNA sequence
tgcaccccctgcaacacccc

SEQ ID NO: 580648 - DNA, 20 bp, Artificial
  CRISPR gRNA sequence
caccccctgcaacacccctc

SEQ ID NO: 580649 - DNA, 20 bp, Artificial
  CRISPR gRNA sequence
caacacccctcccacagagg

SEQ ID NO: 580650 - DNA, 20 bp, Artificial
  CRISPR gRNA sequence
ccacagagggtgaggggcat

SEQ ID NO: 580651 - DNA, 20 bp, Artificial
  CRISPR gRNA sequence
cttcatggaggagaaagcgg

SEQ ID NO: 580652 - DNA, 20 bp, Artificial
  CRISPR gRNA sequence
catggaggagaaagcggaga

SEQ ID NO: 580653 - DNA, 20 bp, Artificial
  CRISPR gRNA sequence
atggaggagaaagcggagag

SEQ ID NO: 580654 - DNA, 20 bp, Artificial
  CRISPR gRNA sequence
tcatcccctaaaattcatgg

SEQ ID NO: 580655 - DNA, 20 bp, Artificial
  CRISPR gRNA sequence
aaattcatggacttgaagag

SEQ ID NO: 580656 - DNA, 20 bp, Artificial
  CRISPR gRNA sequence
atggacttgaagagtcggag

SEQ ID NO: 580657 - DNA, 20 bp, Artificial
  CRISPR gRNA sequence
gaagagtcggagaatccctg

SEQ ID NO: 580658 - DNA, 20 bp, Artificial
  CRISPR gRNA sequence
aagagtcggagaatccctgg

SEQ ID NO: 580659 - DNA, 20 bp, Artificial
  CRISPR gRNA sequence
gctcccagaatctactgaca

SEQ ID NO: 580660 - DNA, 20 bp, Artificial
  CRISPR gRNA sequence
ccagaatctactgacagtta

SEQ ID NO: 580661 - DNA, 20 bp, Artificial
  CRISPR gRNA sequence
ctgacagttactgaatgagg

SEQ ID NO: 580662 - DNA, 20 bp, Artificial
  CRISPR gRNA sequence
acagttactgaatgaggaaa

SEQ ID NO: 580663 - DNA, 20 bp, Artificial
  CRISPR gRNA sequence
ctgaatgaggaaagagagaa

SEQ ID NO: 580664 - DNA, 20 bp, Artificial
  CRISPR gRNA sequence
aatgaggaaagagagaaaag

SEQ ID NO: 580665 - DNA, 20 bp, Artificial
  CRISPR gRNA sequence
gcctcatcacgttttagggc

SEQ ID NO: 580666 - DNA, 20 bp, Artificial
  CRISPR gRNA sequence
atcacgttttagggcttgag

SEQ ID NO: 580667 - DNA, 20 bp, Artificial
  CRISPR gRNA sequence
tagggcttgagtgccctgac

SEQ ID NO: 580668 - DNA, 20 bp, Artificial
  CRISPR gRNA sequence
agggcttgagtgccctgacc

SEQ ID NO: 580669 - DNA, 20 bp, Artificial
  CRISPR gRNA sequence
gggcttgagtgccctgaccc

SEQ ID NO: 580670 - DNA, 20 bp, Artificial
  CRISPR gRNA sequence
gagtgccctgacccagccac

SEQ ID NO: 580671 - DNA, 20 bp, Artificial
  CRISPR gRNA sequence
agtgccctgacccagccact

SEQ ID NO: 580672 - DNA, 20 bp, Artificial
  CRISPR gRNA sequence
acccagccactgtcccactg

SEQ ID NO: 580673 - DNA, 20 bp, Artificial
  CRISPR gRNA sequence
tcccactgggaaggtcccta

SEQ ID NO: 580674 - DNA, 20 bp, Artificial
  CRISPR gRNA sequence
ggaaggtccctagcaggtcc

SEQ ID NO: 580675 - DNA, 20 bp, Artificial
  CRISPR gRNA sequence
gcaggtccccaatattaatg

SEQ ID NO: 580676 - DNA, 20 bp, Artificial
  CRISPR gRNA sequence
atgcatccatcctcacgatg

SEQ ID NO: 580677 - DNA, 20 bp, Artificial
  CRISPR gRNA sequence
acgatgaaccccagaggccc

SEQ ID NO: 580678 - DNA, 20 bp, Artificial
  CRISPR gRNA sequence
ggaccctgaccctcttgttt

SEQ ID NO: 580679 - DNA, 20 bp, Artificial
  CRISPR gRNA sequence
accctcttgtttcaggaaca

SEQ ID NO: 580680 - DNA, 20 bp, Artificial
  CRISPR gRNA sequence
ttgtttcaggaacatcatgg

SEQ ID NO: 580681 - DNA, 20 bp, Artificial
  CRISPR gRNA sequence
gtttcaggaacatcatggcc

SEQ ID NO: 580682 - DNA, 20 bp, Artificial
  CRISPR gRNA sequence
tttcaggaacatcatggcct

SEQ ID NO: 580683 - DNA, 20 bp, Artificial
  CRISPR gRNA sequence
caggaacatcatggcctgat

SEQ ID NO: 580684 - DNA, 20 bp, Artificial
  CRISPR gRNA sequence
aggaacatcatggcctgatg

SEQ ID NO: 580685 - DNA, 20 bp, Artificial
  CRISPR gRNA sequence
atgcttctgaggccctcagc

SEQ ID NO: 580686 - DNA, 20 bp, Artificial
  CRISPR gRNA sequence
ctgaggccctcagcctttgg

SEQ ID NO: 580687 - DNA, 20 bp, Artificial
  CRISPR gRNA sequence
tgaggccctcagcctttggg

SEQ ID NO: 580688 - DNA, 20 bp, Artificial
  CRISPR gRNA sequence
aggccctcagcctttggggt

SEQ ID NO: 580689 - DNA, 20 bp, Artificial
  CRISPR gRNA sequence
agcctttggggtcttttact

SEQ ID NO: 580690 - DNA, 20 bp, Artificial
  CRISPR gRNA sequence
tggggtcttttacttcaaaa

SEQ ID NO: 580691 - DNA, 20 bp, Artificial
  CRISPR gRNA sequence
ggggtcttttacttcaaaaa

SEQ ID NO: 580692 - DNA, 20 bp, Artificial
  CRISPR gRNA sequence
gggtcttttacttcaaaaag

SEQ ID NO: 580693 - DNA, 20 bp, Artificial
  CRISPR gRNA sequence
ttacttcaaaaagccccagt

SEQ ID NO: 580694 - DNA, 20 bp, Artificial
  CRISPR gRNA sequence
tacttcaaaaagccccagtt

SEQ ID NO: 580695 - DNA, 20 bp, Artificial
  CRISPR gRNA sequence
acttcaaaaagccccagttt

SEQ ID NO: 580696 - DNA, 20 bp, Artificial
  CRISPR gRNA sequence
cttcaaaaagccccagtttc

SEQ ID NO: 580697 - DNA, 20 bp, Artificial
  CRISPR gRNA sequence
caaaaagccccagtttccaa

SEQ ID NO: 580698 - DNA, 20 bp, Artificial
  CRISPR gRNA sequence
aaaaagccccagtttccaag

SEQ ID NO: 580699 - DNA, 20 bp, Artificial
  CRISPR gRNA sequence
ccaaggatttaggattccaa

SEQ ID NO: 580700 - DNA, 20 bp, Artificial
  CRISPR gRNA sequence
caaggatttaggattccaaa

SEQ ID NO: 580701 - DNA, 20 bp, Artificial
  CRISPR gRNA sequence
aggattccaaatatccgcca

SEQ ID NO: 580702 - DNA, 20 bp, Artificial
  CRISPR gRNA sequence
ggattccaaatatccgccat

SEQ ID NO: 580703 - DNA, 20 bp, Artificial
  CRISPR gRNA sequence
caaatatccgccatcatctc

SEQ ID NO: 580704 - DNA, 20 bp, Artificial
  CRISPR gRNA sequence
agtagctgatgtttatcttg

SEQ ID NO: 580705 - DNA, 20 bp, Artificial
  CRISPR gRNA sequence
atgtttatcttgaattttcc

SEQ ID NO: 580706 - DNA, 20 bp, Artificial
  CRISPR gRNA sequence
atcttgaattttccatgggt

SEQ ID NO: 580707 - DNA, 20 bp, Artificial
  CRISPR gRNA sequence
tcttgaattttccatgggtc

SEQ ID NO: 580708 - DNA, 20 bp, Artificial
  CRISPR gRNA sequence
gaattttccatgggtcagat

SEQ ID NO: 580709 - DNA, 20 bp, Artificial
  CRISPR gRNA sequence
aattttccatgggtcagata

SEQ ID NO: 580710 - DNA, 20 bp, Artificial
  CRISPR gRNA sequence
tccatgggtcagatacagtg

SEQ ID NO: 580711 - DNA, 20 bp, Artificial
  CRISPR gRNA sequence
ccatgggtcagatacagtgc

SEQ ID NO: 580712 - DNA, 20 bp, Artificial
  CRISPR gRNA sequence
catgggtcagatacagtgct

SEQ ID NO: 580713 - DNA, 20 bp, Artificial
  CRISPR gRNA sequence
aacatgtctcacaagtgatc

SEQ ID NO: 580714 - DNA, 20 bp, Artificial
  CRISPR gRNA sequence
acaagtgatcatgttcaatc

SEQ ID NO: 580715 - DNA, 20 bp, Artificial
  CRISPR gRNA sequence
aatcctcaccatggcccctt

SEQ ID NO: 580716 - DNA, 20 bp, Artificial
  CRISPR gRNA sequence
accatggccccttgagctcc

SEQ ID NO: 580717 - DNA, 20 bp, Artificial
  CRISPR gRNA sequence
gagctccatctcatcattat

SEQ ID NO: 580718 - DNA, 20 bp, Artificial
  CRISPR gRNA sequence
agctccatctcatcattatt

SEQ ID NO: 580719 - DNA, 20 bp, Artificial
  CRISPR gRNA sequence
catctcatcattattgtatt

SEQ ID NO: 580720 - DNA, 20 bp, Artificial
  CRISPR gRNA sequence
atcattattgtattcctgtt

SEQ ID NO: 580721 - DNA, 20 bp, Artificial
  CRISPR gRNA sequence
ttgtattcctgttatacaga

SEQ ID NO: 580722 - DNA, 20 bp, Artificial
  CRISPR gRNA sequence
tattcctgttatacagatga

SEQ ID NO: 580723 - DNA, 20 bp, Artificial
  CRISPR gRNA sequence
ctgttatacagatgagggaa

SEQ ID NO: 580724 - DNA, 20 bp, Artificial
  CRISPR gRNA sequence
ttatacagatgagggaaacg

SEQ ID NO: 580725 - DNA, 20 bp, Artificial
  CRISPR gRNA sequence
tacagatgagggaaacggag

SEQ ID NO: 580726 - DNA, 20 bp, Artificial
  CRISPR gRNA sequence
gcccaagatcacagagctgg

SEQ ID NO: 580727 - DNA, 20 bp, Artificial
  CRISPR gRNA sequence
cccaagatcacagagctggc

SEQ ID NO: 580728 - DNA, 20 bp, Artificial
  CRISPR gRNA sequence
gcgagtgtgggtcccgcttt

SEQ ID NO: 580729 - DNA, 20 bp, Artificial
  CRISPR gRNA sequence
tctttggtgctgggctttga

SEQ ID NO: 580730 - DNA, 20 bp, Artificial
  CRISPR gRNA sequence
ctttggtgctgggctttgaa

SEQ ID NO: 580731 - DNA, 20 bp, Artificial
  CRISPR gRNA sequence
tttggtgctgggctttgaaa

SEQ ID NO: 580732 - DNA, 20 bp, Artificial
  CRISPR gRNA sequence
tggtgctgggctttgaaatc

SEQ ID NO: 580733 - DNA, 20 bp, Artificial
  CRISPR gRNA sequence
ggtgctgggctttgaaatcc

SEQ ID NO: 580734 - DNA, 20 bp, Artificial
  CRISPR gRNA sequence
gtgctgggctttgaaatccc

SEQ ID NO: 580735 - DNA, 20 bp, Artificial
  CRISPR gRNA sequence
ggctttgaaatccccaagct

SEQ ID NO: 580736 - DNA, 20 bp, Artificial
  CRISPR gRNA sequence
tgaaatccccaagctttcct

SEQ ID NO: 580737 - DNA, 20 bp, Artificial
  CRISPR gRNA sequence
gaaatccccaagctttcctg

SEQ ID NO: 580738 - DNA, 20 bp, Artificial
  CRISPR gRNA sequence
aaatccccaagctttcctga

SEQ ID NO: 580739 - DNA, 20 bp, Artificial
  CRISPR gRNA sequence
tcctgaacttgatgttctca

SEQ ID NO: 580740 - DNA, 20 bp, Artificial
  CRISPR gRNA sequence
cctgaacttgatgttctcag

SEQ ID NO: 580741 - DNA, 20 bp, Artificial
  CRISPR gRNA sequence
ctgaacttgatgttctcagg

SEQ ID NO: 580742 - DNA, 20 bp, Artificial
  CRISPR gRNA sequence
aacttgatgttctcaggttt

SEQ ID NO: 580743 - DNA, 20 bp, Artificial
  CRISPR gRNA sequence
gatgttctcaggttttaaat

SEQ ID NO: 580744 - DNA, 20 bp, Artificial
  CRISPR gRNA sequence
atgttctcaggttttaaatt

SEQ ID NO: 580745 - DNA, 20 bp, Artificial
  CRISPR gRNA sequence
tcaggttttaaattctagga

SEQ ID NO: 580746 - DNA, 20 bp, Artificial
  CRISPR gRNA sequence
aggttttaaattctaggatg

SEQ ID NO: 580747 - DNA, 20 bp, Artificial
  CRISPR gRNA sequence
taaattctaggatgtgatgg

SEQ ID NO: 580748 - DNA, 20 bp, Artificial
  CRISPR gRNA sequence
aaattctaggatgtgatggc

SEQ ID NO: 580749 - DNA, 20 bp, Artificial
  CRISPR gRNA sequence
aattctaggatgtgatggca

SEQ ID NO: 580750 - DNA, 20 bp, Artificial
  CRISPR gRNA sequence
taggatgtgatggcagggag

SEQ ID NO: 580751 - DNA, 20 bp, Artificial
  CRISPR gRNA sequence
ggatgtgatggcagggagat

SEQ ID NO: 580752 - DNA, 20 bp, Artificial
  CRISPR gRNA sequence
ggatttggagagtccttgga

SEQ ID NO: 580753 - DNA, 20 bp, Artificial
  CRISPR gRNA sequence
ggagagtccttggagacttg

SEQ ID NO: 580754 - DNA, 20 bp, Artificial
  CRISPR gRNA sequence
gagagtccttggagacttga

SEQ ID NO: 580755 - DNA, 20 bp, Artificial
  CRISPR gRNA sequence
ggagacttgaagcttgtgag

SEQ ID NO: 580756 - DNA, 20 bp, Artificial
  CRISPR gRNA sequence
gagacttgaagcttgtgagg

SEQ ID NO: 580757 - DNA, 20 bp, Artificial
  CRISPR gRNA sequence
gaagcttgtgaggcttttag

SEQ ID NO: 580758 - DNA, 20 bp, Artificial
  CRISPR gRNA sequence
aagcttgtgaggcttttagg

SEQ ID NO: 580759 - DNA, 20 bp, Artificial
  CRISPR gRNA sequence
gtgaggcttttaggttgtcc

SEQ ID NO: 580760 - DNA, 20 bp, Artificial
  CRISPR gRNA sequence
tgaggcttttaggttgtcca

SEQ ID NO: 580761 - DNA, 20 bp, Artificial
  CRISPR gRNA sequence
ttaggttgtccaggaattgg

SEQ ID NO: 580762 - DNA, 20 bp, Artificial
  CRISPR gRNA sequence
taggttgtccaggaattggc

SEQ ID NO: 580763 - DNA, 20 bp, Artificial
  CRISPR gRNA sequence
aggttgtccaggaattggcg

SEQ ID NO: 580764 - DNA, 20 bp, Artificial
  CRISPR gRNA sequence
ggttgtccaggaattggcgg

SEQ ID NO: 580765 - DNA, 20 bp, Artificial
  CRISPR gRNA sequence
tccaggaattggcggctgca

SEQ ID NO: 580766 - DNA, 20 bp, Artificial
  CRISPR gRNA sequence
gcggctgcatctcttgacct

SEQ ID NO: 580767 - DNA, 20 bp, Artificial
  CRISPR gRNA sequence
catctcttgacctcagcagg

SEQ ID NO: 580768 - DNA, 20 bp, Artificial
  CRISPR gRNA sequence
ttgacctcagcaggcactct

SEQ ID NO: 580769 - DNA, 20 bp, Artificial
  CRISPR gRNA sequence
gacctcagcaggcactctat

SEQ ID NO: 580770 - DNA, 20 bp, Artificial
  CRISPR gRNA sequence
acctcagcaggcactctatt

SEQ ID NO: 580771 - DNA, 20 bp, Artificial
  CRISPR gRNA sequence
agcaggcactctattcaacc

SEQ ID NO: 580772 - DNA, 20 bp, Artificial
  CRISPR gRNA sequence
tattcaaccactggtcagca

SEQ ID NO: 580773 - DNA, 20 bp, Artificial
  CRISPR gRNA sequence
ttcaaccactggtcagcatg

SEQ ID NO: 580774 - DNA, 20 bp, Artificial
  CRISPR gRNA sequence
aaccactggtcagcatggta

SEQ ID NO: 580775 - DNA, 20 bp, Artificial
  CRISPR gRNA sequence
gtcagcatggtagaccagcc

SEQ ID NO: 580776 - DNA, 20 bp, Artificial
  CRISPR gRNA sequence
ctcctgacaggccatggtga

SEQ ID NO: 580777 - DNA, 20 bp, Artificial
  CRISPR gRNA sequence
tcctgacaggccatggtgaa

SEQ ID NO: 580778 - DNA, 20 bp, Artificial
  CRISPR gRNA sequence
ctgacaggccatggtgaaga

SEQ ID NO: 580779 - DNA, 20 bp, Artificial
  CRISPR gRNA sequence
acaggccatggtgaagactt

SEQ ID NO: 580780 - DNA, 20 bp, Artificial
  CRISPR gRNA sequence
ccagctcccagcaccctgca

SEQ ID NO: 580781 - DNA, 20 bp, Artificial
  CRISPR gRNA sequence
cagctcccagcaccctgcaa

SEQ ID NO: 580782 - DNA, 20 bp, Artificial
  CRISPR gRNA sequence
ccagcaccctgcaaagccca

SEQ ID NO: 580783 - DNA, 20 bp, Artificial
  CRISPR gRNA sequence
caaagcccagggttctagtc

SEQ ID NO: 580784 - DNA, 20 bp, Artificial
  CRISPR gRNA sequence
tagtcgtccaacaaccactc

SEQ ID NO: 580785 - DNA, 20 bp, Artificial
  CRISPR gRNA sequence
gtcgtccaacaaccactcca

SEQ ID NO: 580786 - DNA, 20 bp, Artificial
  CRISPR gRNA sequence
cagccctctacaagactggc

SEQ ID NO: 580787 - DNA, 20 bp, Artificial
  CRISPR gRNA sequence
tacaagactggcttcagacc

SEQ ID NO: 580788 - DNA, 20 bp, Artificial
  CRISPR gRNA sequence
caagactggcttcagacctg

SEQ ID NO: 580789 - DNA, 20 bp, Artificial
  CRISPR gRNA sequence
gcttcagacctggggaagag

SEQ ID NO: 580790 - DNA, 20 bp, Artificial
  CRISPR gRNA sequence
cagacctggggaagagaaat

SEQ ID NO: 580791 - DNA, 20 bp, Artificial
  CRISPR gRNA sequence
agacctggggaagagaaatt

SEQ ID NO: 580792 - DNA, 20 bp, Artificial
  CRISPR gRNA sequence
gggaagagaaattggaaagg

SEQ ID NO: 580793 - DNA, 20 bp, Artificial
  CRISPR gRNA sequence
gaaagggctttttatttaca

SEQ ID NO: 580794 - DNA, 20 bp, Artificial
  CRISPR gRNA sequence
tttatttacatggtacaaat

SEQ ID NO: 580795 - DNA, 20 bp, Artificial
  CRISPR gRNA sequence
ttatttacatggtacaaatc

SEQ ID NO: 580796 - DNA, 20 bp, Artificial
  CRISPR gRNA sequence
tatttacatggtacaaatct

SEQ ID NO: 580797 - DNA, 20 bp, Artificial
  CRISPR gRNA sequence
atttacatggtacaaatctg

SEQ ID NO: 580798 - DNA, 20 bp, Artificial
  CRISPR gRNA sequence
tttacatggtacaaatctgg

SEQ ID NO: 580799 - DNA, 20 bp, Artificial
  CRISPR gRNA sequence
acatggtacaaatctggtgg

SEQ ID NO: 580800 - DNA, 20 bp, Artificial
  CRISPR gRNA sequence
catggtacaaatctggtggc

SEQ ID NO: 580801 - DNA, 20 bp, Artificial
  CRISPR gRNA sequence
gtggccaagatccacccctt

SEQ ID NO: 580802 - DNA, 20 bp, Artificial
  CRISPR gRNA sequence
cacccctttgccccctttcc

SEQ ID NO: 580803 - DNA, 20 bp, Artificial
  CRISPR gRNA sequence
acccctttgccccctttcct

SEQ ID NO: 580804 - DNA, 20 bp, Artificial
  CRISPR gRNA sequence
tgccccctttcctcccccaa

SEQ ID NO: 580805 - DNA, 20 bp, Artificial
  CRISPR gRNA sequence
gccccctttcctcccccaac

SEQ ID NO: 580806 - DNA, 20 bp, Artificial
  CRISPR gRNA sequence
ccccctttcctcccccaacc

SEQ ID NO: 580807 - DNA, 20 bp, Artificial
  CRISPR gRNA sequence
tcctcccccaaccttctaag

SEQ ID NO: 580808 - DNA, 20 bp, Artificial
  CRISPR gRNA sequence
cctcccccaaccttctaagc

SEQ ID NO: 580809 - DNA, 20 bp, Artificial
  CRISPR gRNA sequence
ctcccccaaccttctaagcc

SEQ ID NO: 580810 - DNA, 20 bp, Artificial
  CRISPR gRNA sequence
ccccaaccttctaagccctc

SEQ ID NO: 580811 - DNA, 20 bp, Artificial
  CRISPR gRNA sequence
ctaagccctcgtaaaaagga

SEQ ID NO: 580812 - DNA, 20 bp, Artificial
  CRISPR gRNA sequence
taagccctcgtaaaaaggag

SEQ ID NO: 580813 - DNA, 20 bp, Artificial
  CRISPR gRNA sequence
agccctcgtaaaaaggaggg

SEQ ID NO: 580814 - DNA, 20 bp, Artificial
  CRISPR gRNA sequence
gtaaaaaggagggcctcttt

SEQ ID NO: 580815 - DNA, 20 bp, Artificial
  CRISPR gRNA sequence
tttcctcaactcagactcac

SEQ ID NO: 580816 - DNA, 20 bp, Artificial
  CRISPR gRNA sequence
tcctcaactcagactcaccc

SEQ ID NO: 580817 - DNA, 20 bp, Artificial
  CRISPR gRNA sequence
cctcaactcagactcaccct

SEQ ID NO: 580818 - DNA, 20 bp, Artificial
  CRISPR gRNA sequence
ctcaactcagactcaccctt

SEQ ID NO: 580819 - DNA, 20 bp, Artificial
  CRISPR gRNA sequence
aactcagactcacccttctg

SEQ ID NO: 580820 - DNA, 20 bp, Artificial
  CRISPR gRNA sequence
agactcacccttctggaaaa

SEQ ID NO: 580821 - DNA, 20 bp, Artificial
  CRISPR gRNA sequence
acccttctggaaaagcccag

SEQ ID NO: 580822 - DNA, 20 bp, Artificial
  CRISPR gRNA sequence
ctggaaaagcccagaatggg

SEQ ID NO: 580823 - DNA, 20 bp, Artificial
  CRISPR gRNA sequence
tggaaaagcccagaatgggc

SEQ ID NO: 580824 - DNA, 20 bp, Artificial
  CRISPR gRNA sequence
gaaaagcccagaatgggcct

SEQ ID NO: 580825 - DNA, 20 bp, Artificial
  CRISPR gRNA sequence
atggcctggctttgtgaaga

SEQ ID NO: 580826 - DNA, 20 bp, Artificial
  CRISPR gRNA sequence
gctttgtgaagacaagaaaa

SEQ ID NO: 580827 - DNA, 20 bp, Artificial
  CRISPR gRNA sequence
tgtgaagacaagaaaaaaaa

SEQ ID NO: 580828 - DNA, 20 bp, Artificial
  CRISPR gRNA sequence
gtgaagacaagaaaaaaaaa

SEQ ID NO: 580829 - DNA, 20 bp, Artificial
  CRISPR gRNA sequence
tgaagacaagaaaaaaaaaa

SEQ ID NO: 580830 - DNA, 20 bp, Artificial
  CRISPR gRNA sequence
aaaaaaatcagccaacaaca

SEQ ID NO: 580831 - DNA, 20 bp, Artificial
  CRISPR gRNA sequence
aaaaaatcagccaacaacaa

SEQ ID NO: 580832 - DNA, 20 bp, Artificial
  CRISPR gRNA sequence
aaaaaaaaaaaaaacaccca

SEQ ID NO: 580833 - DNA, 20 bp, Artificial
  CRISPR gRNA sequence
cccaccattagttcaaaaca

SEQ ID NO: 580834 - DNA, 20 bp, Artificial
  CRISPR gRNA sequence
gttcaaaacaaaactttcgc

SEQ ID NO: 580835 - DNA, 20 bp, Artificial
  CRISPR gRNA sequence
aaaacaaaactttcgctggt

SEQ ID NO: 580836 - DNA, 20 bp, Artificial
  CRISPR gRNA sequence
tcgctggttgaggcttctga

SEQ ID NO: 580837 - DNA, 20 bp, Artificial
  CRISPR gRNA sequence
cgctggttgaggcttctgag

SEQ ID NO: 580838 - DNA, 20 bp, Artificial
  CRISPR gRNA sequence
gctggttgaggcttctgagt

SEQ ID NO: 580839 - DNA, 20 bp, Artificial
  CRISPR gRNA sequence
gttgaggcttctgagttggt

SEQ ID NO: 580840 - DNA, 20 bp, Artificial
  CRISPR gRNA sequence
aggcttctgagttggtggga

SEQ ID NO: 580841 - DNA, 20 bp, Artificial
  CRISPR gRNA sequence
ctgagttggtgggacacatc

SEQ ID NO: 580842 - DNA, 20 bp, Artificial
  CRISPR gRNA sequence
tgagttggtgggacacatct

SEQ ID NO: 580843 - DNA, 20 bp, Artificial
  CRISPR gRNA sequence
agttggtgggacacatctga

SEQ ID NO: 580844 - DNA, 20 bp, Artificial
  CRISPR gRNA sequence
gtgggacacatctgagaccc

SEQ ID NO: 580845 - DNA, 20 bp, Artificial
  CRISPR gRNA sequence
agacccaaaaatggcttggg

SEQ ID NO: 580846 - DNA, 20 bp, Artificial
  CRISPR gRNA sequence
gggtgtgttggacagccagg

SEQ ID NO: 580847 - DNA, 20 bp, Artificial
  CRISPR gRNA sequence
ggtgtgttggacagccaggg

SEQ ID NO: 580848 - DNA, 20 bp, Artificial
  CRISPR gRNA sequence
gacagccaggggaggcacca

SEQ ID NO: 580849 - DNA, 20 bp, Artificial
  CRISPR gRNA sequence
cttggaggcctgcagggacc

SEQ ID NO: 580850 - DNA, 20 bp, Artificial
  CRISPR gRNA sequence
ggaggcctgcagggaccctg

SEQ ID NO: 580851 - DNA, 20 bp, Artificial
  CRISPR gRNA sequence
gaggcctgcagggaccctgt

SEQ ID NO: 580852 - DNA, 20 bp, Artificial
  CRISPR gRNA sequence
cagggaccctgtgaacagca

SEQ ID NO: 580853 - DNA, 20 bp, Artificial
  CRISPR gRNA sequence
tgaacagcaggtgtttaaca

SEQ ID NO: 580854 - DNA, 20 bp, Artificial
  CRISPR gRNA sequence
aacagatgtcacggcatgtg

SEQ ID NO: 580855 - DNA, 20 bp, Artificial
  CRISPR gRNA sequence
acagatgtcacggcatgtgg

SEQ ID NO: 580856 - DNA, 20 bp, Artificial
  CRISPR gRNA sequence
gggagctgattctagtgatg

SEQ ID NO: 580857 - DNA, 20 bp, Artificial
  CRISPR gRNA sequence
attctagtgatggccccaag

SEQ ID NO: 580858 - DNA, 20 bp, Artificial
  CRISPR gRNA sequence
tagtgatggccccaaggtta

SEQ ID NO: 580859 - DNA, 20 bp, Artificial
  CRISPR gRNA sequence
gtgatggccccaaggttaat

SEQ ID NO: 580860 - DNA, 20 bp, Artificial
  CRISPR gRNA sequence
atgaccccttgcagtgatgg

SEQ ID NO: 580861 - DNA, 20 bp, Artificial
  CRISPR gRNA sequence
gcagtgatggtcctaaggtt

SEQ ID NO: 580862 - DNA, 20 bp, Artificial
  CRISPR gRNA sequence
cagtgatggtcctaaggtta

SEQ ID NO: 580863 - DNA, 20 bp, Artificial
  CRISPR gRNA sequence
aggttaatgatcccttgcac

SEQ ID NO: 580864 - DNA, 20 bp, Artificial
  CRISPR gRNA sequence
atgatcccttgcactgatgt

SEQ ID NO: 580865 - DNA, 20 bp, Artificial
  CRISPR gRNA sequence
gcactgatgttcccatagtt

SEQ ID NO: 580866 - DNA, 20 bp, Artificial
  CRISPR gRNA sequence
cactgatgttcccatagtta

SEQ ID NO: 580867 - DNA, 20 bp, Artificial
  CRISPR gRNA sequence
atgttcccatagttaataac

SEQ ID NO: 580868 - DNA, 20 bp, Artificial
  CRISPR gRNA sequence
ccatagttaataaccccttg

SEQ ID NO: 580869 - DNA, 20 bp, Artificial
  CRISPR gRNA sequence
ataaccccttgctccctgca

SEQ ID NO: 580870 - DNA, 20 bp, Artificial
  CRISPR gRNA sequence
gctccctgcagacttgggtc

SEQ ID NO: 580871 - DNA, 20 bp, Artificial
  CRISPR gRNA sequence
ctccctgcagacttgggtcg

SEQ ID NO: 580872 - DNA, 20 bp, Artificial
  CRISPR gRNA sequence
cctgcagacttgggtcggaa

SEQ ID NO: 580873 - DNA, 20 bp, Artificial
  CRISPR gRNA sequence
cagacttgggtcggaatgtt

SEQ ID NO: 580874 - DNA, 20 bp, Artificial
  CRISPR gRNA sequence
gggtcggaatgttccctaca

SEQ ID NO: 580875 - DNA, 20 bp, Artificial
  CRISPR gRNA sequence
ggtcggaatgttccctacac

SEQ ID NO: 580876 - DNA, 20 bp, Artificial
  CRISPR gRNA sequence
cctacacctcctgcgtaatt

SEQ ID NO: 580877 - DNA, 20 bp, Artificial
  CRISPR gRNA sequence
cacctcctgcgtaattataa

SEQ ID NO: 580878 - DNA, 20 bp, Artificial
  CRISPR gRNA sequence
ctgcgtaattataaaccagg

SEQ ID NO: 580879 - DNA, 20 bp, Artificial
  CRISPR gRNA sequence
cgtaattataaaccaggcca

SEQ ID NO: 580880 - DNA, 20 bp, Artificial
  CRISPR gRNA sequence
taaaccaggccagttctatc

SEQ ID NO: 580881 - DNA, 20 bp, Artificial
  CRISPR gRNA sequence
tatcagcagaggcattgttc

SEQ ID NO: 580882 - DNA, 20 bp, Artificial
  CRISPR gRNA sequence
tcagcagaggcattgttccc

SEQ ID NO: 580883 - DNA, 20 bp, Artificial
  CRISPR gRNA sequence
ttccctgccccagcacctgt

SEQ ID NO: 580884 - DNA, 20 bp, Artificial
  CRISPR gRNA sequence
cctgccccagcacctgtccc

SEQ ID NO: 580885 - DNA, 20 bp, Artificial
  CRISPR gRNA sequence
ccccagcacctgtccccctc

SEQ ID NO: 580886 - DNA, 20 bp, Artificial
  CRISPR gRNA sequence
tccccctcctggaaaagggg

SEQ ID NO: 580887 - DNA, 20 bp, Artificial
  CRISPR gRNA sequence
ctggaaaagggggctagttt

SEQ ID NO: 580888 - DNA, 20 bp, Artificial
  CRISPR gRNA sequence
gaaaagggggctagttttct

SEQ ID NO: 580889 - DNA, 20 bp, Artificial
  CRISPR gRNA sequence
gttttctctctcaggatcag

SEQ ID NO: 580890 - DNA, 20 bp, Artificial
  CRISPR gRNA sequence
tctctctcaggatcagaggt

SEQ ID NO: 580891 - DNA, 20 bp, Artificial
  CRISPR gRNA sequence
ctctctcaggatcagaggtg

SEQ ID NO: 580892 - DNA, 20 bp, Artificial
  CRISPR gRNA sequence
tctctcaggatcagaggtgt

SEQ ID NO: 580893 - DNA, 20 bp, Artificial
  CRISPR gRNA sequence
tctcaggatcagaggtgtgg

SEQ ID NO: 580894 - DNA, 20 bp, Artificial
  CRISPR gRNA sequence
tcaggatcagaggtgtgggc

SEQ ID NO: 580895 - DNA, 20 bp, Artificial
  CRISPR gRNA sequence
aggatcagaggtgtgggctg

SEQ ID NO: 580896 - DNA, 20 bp, Artificial
  CRISPR gRNA sequence
cattctccttataccttccc

SEQ ID NO: 580897 - DNA, 20 bp, Artificial
  CRISPR gRNA sequence
tccttataccttccccagac

SEQ ID NO: 580898 - DNA, 20 bp, Artificial
  CRISPR gRNA sequence
cttataccttccccagacca

SEQ ID NO: 580899 - DNA, 20 bp, Artificial
  CRISPR gRNA sequence
ataccttccccagaccatct

SEQ ID NO: 580900 - DNA, 20 bp, Artificial
  CRISPR gRNA sequence
taccttccccagaccatctg

SEQ ID NO: 580901 - DNA, 20 bp, Artificial
  CRISPR gRNA sequence
ccccagaccatctgtccctt

SEQ ID NO: 580902 - DNA, 20 bp, Artificial
  CRISPR gRNA sequence
cccagaccatctgtccctta

SEQ ID NO: 580903 - DNA, 20 bp, Artificial
  CRISPR gRNA sequence
tcccttactgtcactcactc

SEQ ID NO: 580904 - DNA, 20 bp, Artificial
  CRISPR gRNA sequence
actgtcactcactccatgaa

SEQ ID NO: 580905 - DNA, 20 bp, Artificial
  CRISPR gRNA sequence
ctgtcactcactccatgaaa

SEQ ID NO: 580906 - DNA, 20 bp, Artificial
  CRISPR gRNA sequence
tcactcactccatgaaagag

SEQ ID NO: 580907 - DNA, 20 bp, Artificial
  CRISPR gRNA sequence
actccatgaaagagagtggc

SEQ ID NO: 580908 - DNA, 20 bp, Artificial
  CRISPR gRNA sequence
catgaaagagagtggccaga

SEQ ID NO: 580909 - DNA, 20 bp, Artificial
  CRISPR gRNA sequence
gccccttgggcaggcccagg

SEQ ID NO: 580910 - DNA, 20 bp, Artificial
  CRISPR gRNA sequence
gggcaggcccagggtgtgag

SEQ ID NO: 580911 - DNA, 20 bp, Artificial
  CRISPR gRNA sequence
ggcaggcccagggtgtgaga

SEQ ID NO: 580912 - DNA, 20 bp, Artificial
  CRISPR gRNA sequence
cggctgctgaaagccaagat

SEQ ID NO: 580913 - DNA, 20 bp, Artificial
  CRISPR gRNA sequence
ctgaaagccaagatccttgc

SEQ ID NO: 580914 - DNA, 20 bp, Artificial
  CRISPR gRNA sequence
aaagccaagatccttgcaga

SEQ ID NO: 580915 - DNA, 20 bp, Artificial
  CRISPR gRNA sequence
gcagaatgggggctggggtc

SEQ ID NO: 580916 - DNA, 20 bp, Artificial
  CRISPR gRNA sequence
cagaatgggggctggggtca

SEQ ID NO: 580917 - DNA, 20 bp, Artificial
  CRISPR gRNA sequence
gggtcaggagggcagagagg

SEQ ID NO: 580918 - DNA, 20 bp, Artificial
  CRISPR gRNA sequence
cctcccctctatactggact

SEQ ID NO: 580919 - DNA, 20 bp, Artificial
  CRISPR gRNA sequence
ccctctatactggactatat

SEQ ID NO: 580920 - DNA, 20 bp, Artificial
  CRISPR gRNA sequence
tatactggactatatcctct

SEQ ID NO: 580921 - DNA, 20 bp, Artificial
  CRISPR gRNA sequence
tactggactatatcctctct

SEQ ID NO: 580922 - DNA, 20 bp, Artificial
  CRISPR gRNA sequence
gactatatcctctctcatgg

SEQ ID NO: 580923 - DNA, 20 bp, Artificial
  CRISPR gRNA sequence
tatcctctctcatggagggc

SEQ ID NO: 580924 - DNA, 20 bp, Artificial
  CRISPR gRNA sequence
tctcatggagggcttctcgg

SEQ ID NO: 580925 - DNA, 20 bp, Artificial
  CRISPR gRNA sequence
tcatggagggcttctcggga

SEQ ID NO: 580926 - DNA, 20 bp, Artificial
  CRISPR gRNA sequence
atggagggcttctcgggaag

SEQ ID NO: 580927 - DNA, 20 bp, Artificial
  CRISPR gRNA sequence
ctcgggaaggagactgggag

SEQ ID NO: 580928 - DNA, 20 bp, Artificial
  CRISPR gRNA sequence
tcgggaaggagactgggagg

SEQ ID NO: 580929 - DNA, 20 bp, Artificial
  CRISPR gRNA sequence
gggaaggagactgggagggc

SEQ ID NO: 580930 - DNA, 20 bp, Artificial
  CRISPR gRNA sequence
ggagggctgggagttggggg

SEQ ID NO: 580931 - DNA, 20 bp, Artificial
  CRISPR gRNA sequence
ggagttgggggtgagtaggc

SEQ ID NO: 580932 - DNA, 20 bp, Artificial
  CRISPR gRNA sequence
ggggtgagtaggcaagatta

SEQ ID NO: 580933 - DNA, 20 bp, Artificial
  CRISPR gRNA sequence
aacgggtcaggaaaagtccc

SEQ ID NO: 580934 - DNA, 20 bp, Artificial
  CRISPR gRNA sequence
tgacaaagacttgaaggaga

SEQ ID NO: 580935 - DNA, 20 bp, Artificial
  CRISPR gRNA sequence
acaaagacttgaaggagatg

SEQ ID NO: 580936 - DNA, 20 bp, Artificial
  CRISPR gRNA sequence
gaaggagatgagggagggag

SEQ ID NO: 580937 - DNA, 20 bp, Artificial
  CRISPR gRNA sequence
aaggagatgagggagggagc

SEQ ID NO: 580938 - DNA, 20 bp, Artificial
  CRISPR gRNA sequence
gatatctgaggaactccaaa

SEQ ID NO: 580939 - DNA, 20 bp, Artificial
  CRISPR gRNA sequence
aggaactccaaaggaaacag

SEQ ID NO: 580940 - DNA, 20 bp, Artificial
  CRISPR gRNA sequence
caaaggaaacagccagggca

SEQ ID NO: 580941 - DNA, 20 bp, Artificial
  CRISPR gRNA sequence
aggtgggaatgtacctgatt

SEQ ID NO: 580942 - DNA, 20 bp, Artificial
  CRISPR gRNA sequence
atttgttcaaggtctacaag

SEQ ID NO: 580943 - DNA, 20 bp, Artificial
  CRISPR gRNA sequence
gttcaaggtctacaaggggg

SEQ ID NO: 580944 - DNA, 20 bp, Artificial
  CRISPR gRNA sequence
ttcaaggtctacaagggggc

SEQ ID NO: 580945 - DNA, 20 bp, Artificial
  CRISPR gRNA sequence
aaggtctacaagggggctgg

SEQ ID NO: 580946 - DNA, 20 bp, Artificial
  CRISPR gRNA sequence
caagggggctggtgtggtta

SEQ ID NO: 580947 - DNA, 20 bp, Artificial
  CRISPR gRNA sequence
gtgtggttagtgtggagaga

SEQ ID NO: 580948 - DNA, 20 bp, Artificial
  CRISPR gRNA sequence
gtgtggagagagcaagaaga

SEQ ID NO: 580949 - DNA, 20 bp, Artificial
  CRISPR gRNA sequence
gaggtgaggtcagaaagggg

SEQ ID NO: 580950 - DNA, 20 bp, Artificial
  CRISPR gRNA sequence
ggaggttagaccacgcagga

SEQ ID NO: 580951 - DNA, 20 bp, Artificial
  CRISPR gRNA sequence
gaccacgcaggaccttgtag

SEQ ID NO: 580952 - DNA, 20 bp, Artificial
  CRISPR gRNA sequence
gtaggccatggtaaggactt

SEQ ID NO: 580953 - DNA, 20 bp, Artificial
  CRISPR gRNA sequence
taggccatggtaaggacttt

SEQ ID NO: 580954 - DNA, 20 bp, Artificial
  CRISPR gRNA sequence
tggcttcaacgctgagtgag

SEQ ID NO: 580955 - DNA, 20 bp, Artificial
  CRISPR gRNA sequence
ggcttcaacgctgagtgagg

SEQ ID NO: 580956 - DNA, 20 bp, Artificial
  CRISPR gRNA sequence
gcttcaacgctgagtgagga

SEQ ID NO: 580957 - DNA, 20 bp, Artificial
  CRISPR gRNA sequence
caacgctgagtgaggaggaa

SEQ ID NO: 580958 - DNA, 20 bp, Artificial
  CRISPR gRNA sequence
aacgctgagtgaggaggaag

SEQ ID NO: 580959 - DNA, 20 bp, Artificial
  CRISPR gRNA sequence
agtgaggaggaaggcatgac

SEQ ID NO: 580960 - DNA, 20 bp, Artificial
  CRISPR gRNA sequence
caagcagaggagaaacacaa

SEQ ID NO: 580961 - DNA, 20 bp, Artificial
  CRISPR gRNA sequence
ggatttaacaggaagcccct

SEQ ID NO: 580962 - DNA, 20 bp, Artificial
  CRISPR gRNA sequence
aacaggaagcccctgaatgc

SEQ ID NO: 580963 - DNA, 20 bp, Artificial
  CRISPR gRNA sequence
acaggaagcccctgaatgct

SEQ ID NO: 580964 - DNA, 20 bp, Artificial
  CRISPR gRNA sequence
aatgctgagtgtacaatggg

SEQ ID NO: 580965 - DNA, 20 bp, Artificial
  CRISPR gRNA sequence
agtgtacaatggggtctagg

SEQ ID NO: 580966 - DNA, 20 bp, Artificial
  CRISPR gRNA sequence
gggcctgaatgtggaagcag

SEQ ID NO: 580967 - DNA, 20 bp, Artificial
  CRISPR gRNA sequence
aatgtggaagcaggggacca

SEQ ID NO: 580968 - DNA, 20 bp, Artificial
  CRISPR gRNA sequence
gctactgcagtagtctaggt

SEQ ID NO: 580969 - DNA, 20 bp, Artificial
  CRISPR gRNA sequence
ctgcagtagtctaggtgact

SEQ ID NO: 580970 - DNA, 20 bp, Artificial
  CRISPR gRNA sequence
cagtagtctaggtgactggt

SEQ ID NO: 580971 - DNA, 20 bp, Artificial
  CRISPR gRNA sequence
ggtgactggtgatagtgctg

SEQ ID NO: 580972 - DNA, 20 bp, Artificial
  CRISPR gRNA sequence
gtgatagtgctggcagtgga

SEQ ID NO: 580973 - DNA, 20 bp, Artificial
  CRISPR gRNA sequence
gcagtggaggtggtgagaag

SEQ ID NO: 580974 - DNA, 20 bp, Artificial
  CRISPR gRNA sequence
ggtaaatatttttaatagac

SEQ ID NO: 580975 - DNA, 20 bp, Artificial
  CRISPR gRNA sequence
gtaaatatttttaatagaca

SEQ ID NO: 580976 - DNA, 20 bp, Artificial
  CRISPR gRNA sequence
ttaatagacagccaaaagga

SEQ ID NO: 580977 - DNA, 20 bp, Artificial
  CRISPR gRNA sequence
taatagacagccaaaaggat

SEQ ID NO: 580978 - DNA, 20 bp, Artificial
  CRISPR gRNA sequence
aatagacagccaaaaggatt

SEQ ID NO: 580979 - DNA, 20 bp, Artificial
  CRISPR gRNA sequence
atagacagccaaaaggattt

SEQ ID NO: 580980 - DNA, 20 bp, Artificial
  CRISPR gRNA sequence
gttgaagactgagagtcttg

SEQ ID NO: 580981 - DNA, 20 bp, Artificial
  CRISPR gRNA sequence
ttgaagactgagagtcttgg

SEQ ID NO: 580982 - DNA, 20 bp, Artificial
  CRISPR gRNA sequence
aagactgagagtcttggagc

SEQ ID NO: 580983 - DNA, 20 bp, Artificial
  CRISPR gRNA sequence
agagtcttggagccagatcg

SEQ ID NO: 580984 - DNA, 20 bp, Artificial
  CRISPR gRNA sequence
ggagccagatcgggacagac

SEQ ID NO: 580985 - DNA, 20 bp, Artificial
  CRISPR gRNA sequence
gagccagatcgggacagaca

SEQ ID NO: 580986 - DNA, 20 bp, Artificial
  CRISPR gRNA sequence
gactatttgccagcttgaac

SEQ ID NO: 580987 - DNA, 20 bp, Artificial
  CRISPR gRNA sequence
tttgccagcttgaactttta

SEQ ID NO: 580988 - DNA, 20 bp, Artificial
  CRISPR gRNA sequence
gccagcttgaacttttaggt

SEQ ID NO: 580989 - DNA, 20 bp, Artificial
  CRISPR gRNA sequence
ccagcttgaacttttaggtg

SEQ ID NO: 580990 - DNA, 20 bp, Artificial
  CRISPR gRNA sequence
gaacttttaggtgagaaaaa

SEQ ID NO: 580991 - DNA, 20 bp, Artificial
  CRISPR gRNA sequence
aacttttaggtgagaaaaaa

SEQ ID NO: 580992 - DNA, 20 bp, Artificial
  CRISPR gRNA sequence
ttaggtgagaaaaaaataaa

SEQ ID NO: 580993 - DNA, 20 bp, Artificial
  CRISPR gRNA sequence
taggtgagaaaaaaataaag

SEQ ID NO: 580994 - DNA, 20 bp, Artificial
  CRISPR gRNA sequence
aggtgagaaaaaaataaagt

SEQ ID NO: 580995 - DNA, 20 bp, Artificial
  CRISPR gRNA sequence
ggtgagaaaaaaataaagtt

SEQ ID NO: 580996 - DNA, 20 bp, Artificial
  CRISPR gRNA sequence
tgtcttgcttaagcccccat

SEQ ID NO: 580997 - DNA, 20 bp, Artificial
  CRISPR gRNA sequence
tcttgcttaagcccccatta

SEQ ID NO: 580998 - DNA, 20 bp, Artificial
  CRISPR gRNA sequence
gcttaagcccccattatttt

SEQ ID NO: 580999 - DNA, 20 bp, Artificial
  CRISPR gRNA sequence
cttaagcccccattatttta

SEQ ID NO: 581000 - DNA, 20 bp, Artificial
  CRISPR gRNA sequence
aagcccccattattttatga

SEQ ID NO: 581001 - DNA, 20 bp, Artificial
  CRISPR gRNA sequence
agcccccattattttatgat

SEQ ID NO: 581002 - DNA, 20 bp, Artificial
  CRISPR gRNA sequence
ttttatgatttttctgttac

SEQ ID NO: 581003 - DNA, 20 bp, Artificial
  CRISPR gRNA sequence
tatgatttttctgttacttg

SEQ ID NO: 581004 - DNA, 20 bp, Artificial
  CRISPR gRNA sequence
atgatttttctgttacttgc

SEQ ID NO: 581005 - DNA, 20 bp, Artificial
  CRISPR gRNA sequence
tgatttttctgttacttgca

SEQ ID NO: 581006 - DNA, 20 bp, Artificial
  CRISPR gRNA sequence
ttctgttacttgcagctgaa

SEQ ID NO: 581007 - DNA, 20 bp, Artificial
  CRISPR gRNA sequence
tctgttacttgcagctgaac

SEQ ID NO: 581008 - DNA, 20 bp, Artificial
  CRISPR gRNA sequence
ctgttacttgcagctgaaca

SEQ ID NO: 581009 - DNA, 20 bp, Artificial
  CRISPR gRNA sequence
tgttacttgcagctgaacat

SEQ ID NO: 581010 - DNA, 20 bp, Artificial
  CRISPR gRNA sequence
ttacttgcagctgaacatat

SEQ ID NO: 581011 - DNA, 20 bp, Artificial
  CRISPR gRNA sequence
cttgcagctgaacatattca

SEQ ID NO: 581012 - DNA, 20 bp, Artificial
  CRISPR gRNA sequence
gcagctgaacatattcattt

SEQ ID NO: 581013 - DNA, 20 bp, Artificial
  CRISPR gRNA sequence
cagctgaacatattcatttc

SEQ ID NO: 581014 - DNA, 20 bp, Artificial
  CRISPR gRNA sequence
aacatattcatttctaactc

SEQ ID NO: 581015 - DNA, 20 bp, Artificial
  CRISPR gRNA sequence
atttctaactcatggacatc

SEQ ID NO: 581016 - DNA, 20 bp, Artificial
  CRISPR gRNA sequence
ctaactcatggacatcctga

SEQ ID NO: 581017 - DNA, 20 bp, Artificial
  CRISPR gRNA sequence
taactcatggacatcctgaa

SEQ ID NO: 581018 - DNA, 20 bp, Artificial
  CRISPR gRNA sequence
actcatggacatcctgaaca

SEQ ID NO: 581019 - DNA, 20 bp, Artificial
  CRISPR gRNA sequence
atggacatcctgaacatgga

SEQ ID NO: 581020 - DNA, 20 bp, Artificial
  CRISPR gRNA sequence
aacatggagacctggggaga

SEQ ID NO: 581021 - DNA, 20 bp, Artificial
  CRISPR gRNA sequence
gggagaggggctgctggaag

SEQ ID NO: 581022 - DNA, 20 bp, Artificial
  CRISPR gRNA sequence
ctggaaggatcacctccctc

SEQ ID NO: 581023 - DNA, 20 bp, Artificial
  CRISPR gRNA sequence
gaaggatcacctccctccta

SEQ ID NO: 581024 - DNA, 20 bp, Artificial
  CRISPR gRNA sequence
cctcctaggatgctgtgagg

SEQ ID NO: 581025 - DNA, 20 bp, Artificial
  CRISPR gRNA sequence
ctaggatgctgtgaggttct

SEQ ID NO: 581026 - DNA, 20 bp, Artificial
  CRISPR gRNA sequence
ggatgctgtgaggttctaat

SEQ ID NO: 581027 - DNA, 20 bp, Artificial
  CRISPR gRNA sequence
tgaggttctaatgagataac

SEQ ID NO: 581028 - DNA, 20 bp, Artificial
  CRISPR gRNA sequence
taatgagataacagcatgct

SEQ ID NO: 581029 - DNA, 20 bp, Artificial
  CRISPR gRNA sequence
atgagataacagcatgctca

SEQ ID NO: 581030 - DNA, 20 bp, Artificial
  CRISPR gRNA sequence
agaacctggcactcagtagg

SEQ ID NO: 581031 - DNA, 20 bp, Artificial
  CRISPR gRNA sequence
gcactcagtaggtgttcagt

SEQ ID NO: 581032 - DNA, 20 bp, Artificial
  CRISPR gRNA sequence
agtaggtgttcagtaaatct

SEQ ID NO: 581033 - DNA, 20 bp, Artificial
  CRISPR gRNA sequence
agtaaatcttcccaggatgg

SEQ ID NO: 581034 - DNA, 20 bp, Artificial
  CRISPR gRNA sequence
cccaggatggagaaggaatg

SEQ ID NO: 581035 - DNA, 20 bp, Artificial
  CRISPR gRNA sequence
ccaggatggagaaggaatgt

SEQ ID NO: 581036 - DNA, 20 bp, Artificial
  CRISPR gRNA sequence
agcggacaaaagctgcagtt

SEQ ID NO: 581037 - DNA, 20 bp, Artificial
  CRISPR gRNA sequence
cagttgagttcccacagaag

SEQ ID NO: 581038 - DNA, 20 bp, Artificial
  CRISPR gRNA sequence
agttcccacagaaggtgaga

SEQ ID NO: 581039 - DNA, 20 bp, Artificial
  CRISPR gRNA sequence
ccacagaaggtgagacccca

SEQ ID NO: 581040 - DNA, 20 bp, Artificial
  CRISPR gRNA sequence
actagatggaagcagcagaa

SEQ ID NO: 581041 - DNA, 20 bp, Artificial
  CRISPR gRNA sequence
ctagatggaagcagcagaag

SEQ ID NO: 581042 - DNA, 20 bp, Artificial
  CRISPR gRNA sequence
gatggaagcagcagaaggaa

SEQ ID NO: 581043 - DNA, 20 bp, Artificial
  CRISPR gRNA sequence
ttgggagagggaacagtaga

SEQ ID NO: 581044 - DNA, 20 bp, Artificial
  CRISPR gRNA sequence
gggagagggaacagtagaag

SEQ ID NO: 581045 - DNA, 20 bp, Artificial
  CRISPR gRNA sequence
ggagagggaacagtagaagc

SEQ ID NO: 581046 - DNA, 20 bp, Artificial
  CRISPR gRNA sequence
tggggtgtggagtgtcaggt

SEQ ID NO: 581047 - DNA, 20 bp, Artificial
  CRISPR gRNA sequence
ggcaagaaggacagggcttt

SEQ ID NO: 581048 - DNA, 20 bp, Artificial
  CRISPR gRNA sequence
tgattgtgattccattagtc

SEQ ID NO: 581049 - DNA, 20 bp, Artificial
  CRISPR gRNA sequence
gattgtgattccattagtca

SEQ ID NO: 581050 - DNA, 20 bp, Artificial
  CRISPR gRNA sequence
attgtgattccattagtcag

SEQ ID NO: 581051 - DNA, 20 bp, Artificial
  CRISPR gRNA sequence
tgattccattagtcagaagc

SEQ ID NO: 581052 - DNA, 20 bp, Artificial
  CRISPR gRNA sequence
cattagtcagaagctaccca

SEQ ID NO: 581053 - DNA, 20 bp, Artificial
  CRISPR gRNA sequence
gtcagaagctacccatatgc

SEQ ID NO: 581054 - DNA, 20 bp, Artificial
  CRISPR gRNA sequence
cccatatgcccaatcaactt

SEQ ID NO: 581055 - DNA, 20 bp, Artificial
  CRISPR gRNA sequence
ctggtagcacacagtcaggt

SEQ ID NO: 581056 - DNA, 20 bp, Artificial
  CRISPR gRNA sequence
tggtagcacacagtcaggtc

SEQ ID NO: 581057 - DNA, 20 bp, Artificial
  CRISPR gRNA sequence
gtagcacacagtcaggtcag

SEQ ID NO: 581058 - DNA, 20 bp, Artificial
  CRISPR gRNA sequence
gctgagctgaaatttaaaaa

SEQ ID NO: 581059 - DNA, 20 bp, Artificial
  CRISPR gRNA sequence
ctgagctgaaatttaaaaaa

SEQ ID NO: 581060 - DNA, 20 bp, Artificial
  CRISPR gRNA sequence
agctgaaatttaaaaaagtg

SEQ ID NO: 581061 - DNA, 20 bp, Artificial
  CRISPR gRNA sequence
aaatttaaaaaagtgaatcc

SEQ ID NO: 581062 - DNA, 20 bp, Artificial
  CRISPR gRNA sequence
aaaaaagtgaatccttcaga

SEQ ID NO: 581063 - DNA, 20 bp, Artificial
  CRISPR gRNA sequence
aaaaagtgaatccttcagaa

SEQ ID NO: 581064 - DNA, 20 bp, Artificial
  CRISPR gRNA sequence
cagaaagttaaatttcctat

SEQ ID NO: 581065 - DNA, 20 bp, Artificial
  CRISPR gRNA sequence
agaaagttaaatttcctatt

SEQ ID NO: 581066 - DNA, 20 bp, Artificial
  CRISPR gRNA sequence
aatttcctattcggccattc

SEQ ID NO: 581067 - DNA, 20 bp, Artificial
  CRISPR gRNA sequence
cctattcggccattcattca

SEQ ID NO: 581068 - DNA, 20 bp, Artificial
  CRISPR gRNA sequence
ctattcggccattcattcaa

SEQ ID NO: 581069 - DNA, 20 bp, Artificial
  CRISPR gRNA sequence
ttcggccattcattcaacaa

SEQ ID NO: 581070 - DNA, 20 bp, Artificial
  CRISPR gRNA sequence
ggccattcattcaacaatag

SEQ ID NO: 581071 - DNA, 20 bp, Artificial
  CRISPR gRNA sequence
attcaacaatagtatcaagt

SEQ ID NO: 581072 - DNA, 20 bp, Artificial
  CRISPR gRNA sequence
aacaatagtatcaagtcctg

SEQ ID NO: 581073 - DNA, 20 bp, Artificial
  CRISPR gRNA sequence
gagagtgcttgcggctaaca

SEQ ID NO: 581074 - DNA, 20 bp, Artificial
  CRISPR gRNA sequence
gcggctaacaatcaggggca

SEQ ID NO: 581075 - DNA, 20 bp, Artificial
  CRISPR gRNA sequence
cggctaacaatcaggggcat

SEQ ID NO: 581076 - DNA, 20 bp, Artificial
  CRISPR gRNA sequence
acaatcaggggcattcttgg

SEQ ID NO: 581077 - DNA, 20 bp, Artificial
  CRISPR gRNA sequence
ttggcttgtggcactgctca

SEQ ID NO: 581078 - DNA, 20 bp, Artificial
  CRISPR gRNA sequence
ggcttgtggcactgctcaag

SEQ ID NO: 581079 - DNA, 20 bp, Artificial
  CRISPR gRNA sequence
gcttgtggcactgctcaaga

SEQ ID NO: 581080 - DNA, 20 bp, Artificial
  CRISPR gRNA sequence
gtggcactgctcaagaaaag

SEQ ID NO: 581081 - DNA, 20 bp, Artificial
  CRISPR gRNA sequence
tggcactgctcaagaaaagg

SEQ ID NO: 581082 - DNA, 20 bp, Artificial
  CRISPR gRNA sequence
ctcaagaaaaggttgtagtt

SEQ ID NO: 581083 - DNA, 20 bp, Artificial
  CRISPR gRNA sequence
aagaaaaggttgtagttggg

SEQ ID NO: 581084 - DNA, 20 bp, Artificial
  CRISPR gRNA sequence
tagttgggcagggaggaccc

SEQ ID NO: 581085 - DNA, 20 bp, Artificial
  CRISPR gRNA sequence
ggcagggaggacccagtaag

SEQ ID NO: 581086 - DNA, 20 bp, Artificial
  CRISPR gRNA sequence
actgcaacaggacagtcatt

SEQ ID NO: 581087 - DNA, 20 bp, Artificial
  CRISPR gRNA sequence
caacaggacagtcattttca

SEQ ID NO: 581088 - DNA, 20 bp, Artificial
  CRISPR gRNA sequence
tcactttcctagttcacaca

SEQ ID NO: 581089 - DNA, 20 bp, Artificial
  CRISPR gRNA sequence
cactttcctagttcacacac

SEQ ID NO: 581090 - DNA, 20 bp, Artificial
  CRISPR gRNA sequence
actttcctagttcacacacc

SEQ ID NO: 581091 - DNA, 20 bp, Artificial
  CRISPR gRNA sequence
tcctagttcacacaccaagg

SEQ ID NO: 581092 - DNA, 20 bp, Artificial
  CRISPR gRNA sequence
cctagttcacacaccaaggt

SEQ ID NO: 581093 - DNA, 20 bp, Artificial
  CRISPR gRNA sequence
ctagttcacacaccaaggtg

SEQ ID NO: 581094 - DNA, 20 bp, Artificial
  CRISPR gRNA sequence
gttcacacaccaaggtgtgg

SEQ ID NO: 581095 - DNA, 20 bp, Artificial
  CRISPR gRNA sequence
acacaccaaggtgtggtcta

SEQ ID NO: 581096 - DNA, 20 bp, Artificial
  CRISPR gRNA sequence
ggccttcaggggctctgggt

SEQ ID NO: 581097 - DNA, 20 bp, Artificial
  CRISPR gRNA sequence
caggggctctgggtattcct

SEQ ID NO: 581098 - DNA, 20 bp, Artificial
  CRISPR gRNA sequence
aggggctctgggtattcctg

SEQ ID NO: 581099 - DNA, 20 bp, Artificial
  CRISPR gRNA sequence
tgggtattcctggggcaatg

SEQ ID NO: 581100 - DNA, 20 bp, Artificial
  CRISPR gRNA sequence
ggtattcctggggcaatggg

SEQ ID NO: 581101 - DNA, 20 bp, Artificial
  CRISPR gRNA sequence
ctggggcaatggggagtcac

SEQ ID NO: 581102 - DNA, 20 bp, Artificial
  CRISPR gRNA sequence
gggcaatggggagtcacgga

SEQ ID NO: 581103 - DNA, 20 bp, Artificial
  CRISPR gRNA sequence
gggagagggtaaccccatcc

SEQ ID NO: 581104 - DNA, 20 bp, Artificial
  CRISPR gRNA sequence
agaagcacatttttcctaat

SEQ ID NO: 581105 - DNA, 20 bp, Artificial
  CRISPR gRNA sequence
ttcctaatggctgcctgcgt

SEQ ID NO: 581106 - DNA, 20 bp, Artificial
  CRISPR gRNA sequence
tcctaatggctgcctgcgtt

SEQ ID NO: 581107 - DNA, 20 bp, Artificial
  CRISPR gRNA sequence
cctaatggctgcctgcgttc

SEQ ID NO: 581108 - DNA, 20 bp, Artificial
  CRISPR gRNA sequence
ctaatggctgcctgcgttct

SEQ ID NO: 581109 - DNA, 20 bp, Artificial
  CRISPR gRNA sequence
atggctgcctgcgttctatg

SEQ ID NO: 581110 - DNA, 20 bp, Artificial
  CRISPR gRNA sequence
cctgcgttctatggttctgc

SEQ ID NO: 581111 - DNA, 20 bp, Artificial
  CRISPR gRNA sequence
cgttctatggttctgctgtc

SEQ ID NO: 581112 - DNA, 20 bp, Artificial
  CRISPR gRNA sequence
tatggttctgctgtccggcc

SEQ ID NO: 581113 - DNA, 20 bp, Artificial
  CRISPR gRNA sequence
tggttctgctgtccggccac

SEQ ID NO: 581114 - DNA, 20 bp, Artificial
  CRISPR gRNA sequence
tgctgtccggccacccaata

SEQ ID NO: 581115 - DNA, 20 bp, Artificial
  CRISPR gRNA sequence
ctgtccggccacccaatacc

SEQ ID NO: 581116 - DNA, 20 bp, Artificial
  CRISPR gRNA sequence
tccggccacccaatacctca

SEQ ID NO: 581117 - DNA, 20 bp, Artificial
  CRISPR gRNA sequence
agactctgtctacacagcgt

SEQ ID NO: 581118 - DNA, 20 bp, Artificial
  CRISPR gRNA sequence
tgtctacacagcgtcctcct

SEQ ID NO: 581119 - DNA, 20 bp, Artificial
  CRISPR gRNA sequence
tctacacagcgtcctcctct

SEQ ID NO: 581120 - DNA, 20 bp, Artificial
  CRISPR gRNA sequence
cacagcgtcctcctctccag

SEQ ID NO: 581121 - DNA, 20 bp, Artificial
  CRISPR gRNA sequence
ctctccagcctccttattgg

SEQ ID NO: 581122 - DNA, 20 bp, Artificial
  CRISPR gRNA sequence
tccagcctccttattggcta

SEQ ID NO: 581123 - DNA, 20 bp, Artificial
  CRISPR gRNA sequence
cagcctccttattggctact

SEQ ID NO: 581124 - DNA, 20 bp, Artificial
  CRISPR gRNA sequence
cttattggctactcatgcct

SEQ ID NO: 581125 - DNA, 20 bp, Artificial
  CRISPR gRNA sequence
attggctactcatgcctccc

SEQ ID NO: 581126 - DNA, 20 bp, Artificial
  CRISPR gRNA sequence
ttggctactcatgcctccct

SEQ ID NO: 581127 - DNA, 20 bp, Artificial
  CRISPR gRNA sequence
gctactcatgcctcccttca

SEQ ID NO: 581128 - DNA, 20 bp, Artificial
  CRISPR gRNA sequence
ctcatgcctcccttcacacc

SEQ ID NO: 581129 - DNA, 20 bp, Artificial
  CRISPR gRNA sequence
atgcctcccttcacaccacc

SEQ ID NO: 581130 - DNA, 20 bp, Artificial
  CRISPR gRNA sequence
ccttcacaccacctacactg

SEQ ID NO: 581131 - DNA, 20 bp, Artificial
  CRISPR gRNA sequence
cacaccacctacactgcccc

SEQ ID NO: 581132 - DNA, 20 bp, Artificial
  CRISPR gRNA sequence
acaccacctacactgccccc

SEQ ID NO: 581133 - DNA, 20 bp, Artificial
  CRISPR gRNA sequence
cactgcccccgtcggctctg

SEQ ID NO: 581134 - DNA, 20 bp, Artificial
  CRISPR gRNA sequence
cccccgtcggctctgctttt

SEQ ID NO: 581135 - DNA, 20 bp, Artificial
  CRISPR gRNA sequence
tgcttttttccccatcttgc

SEQ ID NO: 581136 - DNA, 20 bp, Artificial
  CRISPR gRNA sequence
cttttttccccatcttgcct

SEQ ID NO: 581137 - DNA, 20 bp, Artificial
  CRISPR gRNA sequence
ttttccccatcttgcctcca

SEQ ID NO: 581138 - DNA, 20 bp, Artificial
  CRISPR gRNA sequence
tttccccatcttgcctccaa

SEQ ID NO: 581139 - DNA, 20 bp, Artificial
  CRISPR gRNA sequence
ttccccatcttgcctccaag

SEQ ID NO: 581140 - DNA, 20 bp, Artificial
  CRISPR gRNA sequence
tccccatcttgcctccaagt

SEQ ID NO: 581141 - DNA, 20 bp, Artificial
  CRISPR gRNA sequence
ccccatcttgcctccaagtc

SEQ ID NO: 581142 - DNA, 20 bp, Artificial
  CRISPR gRNA sequence
cccatcttgcctccaagtcc

SEQ ID NO: 581143 - DNA, 20 bp, Artificial
  CRISPR gRNA sequence
gcctccaagtcctccctccg

SEQ ID NO: 581144 - DNA, 20 bp, Artificial
  CRISPR gRNA sequence
cctccaagtcctccctccgt

SEQ ID NO: 581145 - DNA, 20 bp, Artificial
  CRISPR gRNA sequence
caagtcctccctccgtcccg

SEQ ID NO: 581146 - DNA, 20 bp, Artificial
  CRISPR gRNA sequence
cctccgtcccgctgcactat

SEQ ID NO: 581147 - DNA, 20 bp, Artificial
  CRISPR gRNA sequence
cgtcccgctgcactatctag

SEQ ID NO: 581148 - DNA, 20 bp, Artificial
  CRISPR gRNA sequence
cactatctagcctcggcatt

SEQ ID NO: 581149 - DNA, 20 bp, Artificial
  CRISPR gRNA sequence
tctagcctcggcattggctc

SEQ ID NO: 581150 - DNA, 20 bp, Artificial
  CRISPR gRNA sequence
gcctcggcattggctcatcc

SEQ ID NO: 581151 - DNA, 20 bp, Artificial
  CRISPR gRNA sequence
ggcattggctcatcccatac

SEQ ID NO: 581152 - DNA, 20 bp, Artificial
  CRISPR gRNA sequence
gctcatcccatactagtact

SEQ ID NO: 581153 - DNA, 20 bp, Artificial
  CRISPR gRNA sequence
atcccatactagtactgtcc

SEQ ID NO: 581154 - DNA, 20 bp, Artificial
  CRISPR gRNA sequence
gtactgtcctttgaggtctc

SEQ ID NO: 581155 - DNA, 20 bp, Artificial
  CRISPR gRNA sequence
tcctttgaggtctctacgcc

SEQ ID NO: 581156 - DNA, 20 bp, Artificial
  CRISPR gRNA sequence
tgaggtctctacgccttcac

SEQ ID NO: 581157 - DNA, 20 bp, Artificial
  CRISPR gRNA sequence
gaggtctctacgccttcacc

SEQ ID NO: 581158 - DNA, 20 bp, Artificial
  CRISPR gRNA sequence
aggtctctacgccttcaccc

SEQ ID NO: 581159 - DNA, 20 bp, Artificial
  CRISPR gRNA sequence
tacgccttcaccctggctcc

SEQ ID NO: 581160 - DNA, 20 bp, Artificial
  CRISPR gRNA sequence
cgccttcaccctggctccct

SEQ ID NO: 581161 - DNA, 20 bp, Artificial
  CRISPR gRNA sequence
caccctggctccctcattgg

SEQ ID NO: 581162 - DNA, 20 bp, Artificial
  CRISPR gRNA sequence
accctggctccctcattggc

SEQ ID NO: 581163 - DNA, 20 bp, Artificial
  CRISPR gRNA sequence
gctccctcattggctatccg

SEQ ID NO: 581164 - DNA, 20 bp, Artificial
  CRISPR gRNA sequence
cctcattggctatccgccag

SEQ ID NO: 581165 - DNA, 20 bp, Artificial
  CRISPR gRNA sequence
attggctatccgccagctct

SEQ ID NO: 581166 - DNA, 20 bp, Artificial
  CRISPR gRNA sequence
gctatccgccagctctcgtc

SEQ ID NO: 581167 - DNA, 20 bp, Artificial
  CRISPR gRNA sequence
tccgccagctctcgtcctcg

SEQ ID NO: 581168 - DNA, 20 bp, Artificial
  CRISPR gRNA sequence
tcgtcctcgctcccgccttc

SEQ ID NO: 581169 - DNA, 20 bp, Artificial
  CRISPR gRNA sequence
gtcctcgctcccgccttcag

SEQ ID NO: 581170 - DNA, 20 bp, Artificial
  CRISPR gRNA sequence
gctcccgccttcagcctcca

SEQ ID NO: 581171 - DNA, 20 bp, Artificial
  CRISPR gRNA sequence
ccgccttcagcctccacctc

SEQ ID NO: 581172 - DNA, 20 bp, Artificial
  CRISPR gRNA sequence
cagcctccacctccattggc

SEQ ID NO: 581173 - DNA, 20 bp, Artificial
  CRISPR gRNA sequence
agcctccacctccattggct

SEQ ID NO: 581174 - DNA, 20 bp, Artificial
  CRISPR gRNA sequence
cacctccattggctcggctc

SEQ ID NO: 581175 - DNA, 20 bp, Artificial
  CRISPR gRNA sequence
cattggctcggctccctaca

SEQ ID NO: 581176 - DNA, 20 bp, Artificial
  CRISPR gRNA sequence
gctcggctccctacacaccc

SEQ ID NO: 581177 - DNA, 20 bp, Artificial
  CRISPR gRNA sequence
ggctccctacacacccgcct

SEQ ID NO: 581178 - DNA, 20 bp, Artificial
  CRISPR gRNA sequence
cctacacacccgcctcttgg

SEQ ID NO: 581179 - DNA, 20 bp, Artificial
  CRISPR gRNA sequence
cacacccgcctcttggtctc

SEQ ID NO: 581180 - DNA, 20 bp, Artificial
  CRISPR gRNA sequence
ttggtctccttttagccttc

SEQ ID NO: 581181 - DNA, 20 bp, Artificial
  CRISPR gRNA sequence
ggtctccttttagccttcgt

SEQ ID NO: 581182 - DNA, 20 bp, Artificial
  CRISPR gRNA sequence
gtctccttttagccttcgta

SEQ ID NO: 581183 - DNA, 20 bp, Artificial
  CRISPR gRNA sequence
cttttagccttcgtattggc

SEQ ID NO: 581184 - DNA, 20 bp, Artificial
  CRISPR gRNA sequence
ttagccttcgtattggctag

SEQ ID NO: 581185 - DNA, 20 bp, Artificial
  CRISPR gRNA sequence
tagccttcgtattggctagc

SEQ ID NO: 581186 - DNA, 20 bp, Artificial
  CRISPR gRNA sequence
agccttcgtattggctagct

SEQ ID NO: 581187 - DNA, 20 bp, Artificial
  CRISPR gRNA sequence
gccttcgtattggctagctc

SEQ ID NO: 581188 - DNA, 20 bp, Artificial
  CRISPR gRNA sequence
cgtattggctagctccacct

SEQ ID NO: 581189 - DNA, 20 bp, Artificial
  CRISPR gRNA sequence
gtattggctagctccacctt

SEQ ID NO: 581190 - DNA, 20 bp, Artificial
  CRISPR gRNA sequence
gctagctccaccttggcacc

SEQ ID NO: 581191 - DNA, 20 bp, Artificial
  CRISPR gRNA sequence
gctccaccttggcaccaccc

SEQ ID NO: 581192 - DNA, 20 bp, Artificial
  CRISPR gRNA sequence
caccttggcaccaccccttc

SEQ ID NO: 581193 - DNA, 20 bp, Artificial
  CRISPR gRNA sequence
ggcaccaccccttcgaagcc

SEQ ID NO: 581194 - DNA, 20 bp, Artificial
  CRISPR gRNA sequence
gcaccaccccttcgaagccg

SEQ ID NO: 581195 - DNA, 20 bp, Artificial
  CRISPR gRNA sequence
cgaagccgcagtgcacgctc

SEQ ID NO: 581196 - DNA, 20 bp, Artificial
  CRISPR gRNA sequence
gaagccgcagtgcacgctca

SEQ ID NO: 581197 - DNA, 20 bp, Artificial
  CRISPR gRNA sequence
acaagcctccccattggctc

SEQ ID NO: 581198 - DNA, 20 bp, Artificial
  CRISPR gRNA sequence
cccattggctcgctgcagcc

SEQ ID NO: 581199 - DNA, 20 bp, Artificial
  CRISPR gRNA sequence
gctcgctgcagccattgtcg

SEQ ID NO: 581200 - DNA, 20 bp, Artificial
  CRISPR gRNA sequence
gctgcagccattgtcgtcat

SEQ ID NO: 581201 - DNA, 20 bp, Artificial
  CRISPR gRNA sequence
cagccattgtcgtcatccca

SEQ ID NO: 581202 - DNA, 20 bp, Artificial
  CRISPR gRNA sequence
tcgtcatcccacgcgtggct

SEQ ID NO: 581203 - DNA, 20 bp, Artificial
  CRISPR gRNA sequence
tccattggctgttctctctc

SEQ ID NO: 581204 - DNA, 20 bp, Artificial
  CRISPR gRNA sequence
cattggctgttctctctctc

SEQ ID NO: 581205 - DNA, 20 bp, Artificial
  CRISPR gRNA sequence
gctgttctctctctctagct

SEQ ID NO: 581206 - DNA, 20 bp, Artificial
  CRISPR gRNA sequence
ttctctctctctagctaccg

SEQ ID NO: 581207 - DNA, 20 bp, Artificial
  CRISPR gRNA sequence
tctctctctagctaccgttc

SEQ ID NO: 581208 - DNA, 20 bp, Artificial
  CRISPR gRNA sequence
tctctctagctaccgttcca

SEQ ID NO: 581209 - DNA, 20 bp, Artificial
  CRISPR gRNA sequence
tctctagctaccgttccacc

SEQ ID NO: 581210 - DNA, 20 bp, Artificial
  CRISPR gRNA sequence
tctagctaccgttccaccgc

SEQ ID NO: 581211 - DNA, 20 bp, Artificial
  CRISPR gRNA sequence
tagctaccgttccaccgcct

SEQ ID NO: 581212 - DNA, 20 bp, Artificial
  CRISPR gRNA sequence
gctaccgttccaccgcctac

SEQ ID NO: 581213 - DNA, 20 bp, Artificial
  CRISPR gRNA sequence
ccgttccaccgcctacgcaa

SEQ ID NO: 581214 - DNA, 20 bp, Artificial
  CRISPR gRNA sequence
caccgcctacgcaacccgcg

SEQ ID NO: 581215 - DNA, 20 bp, Artificial
  CRISPR gRNA sequence
cgcaacccgcgggatctccc

SEQ ID NO: 581216 - DNA, 20 bp, Artificial
  CRISPR gRNA sequence
ccactttttgggcctctgcg

SEQ ID NO: 581217 - DNA, 20 bp, Artificial
  CRISPR gRNA sequence
tttgggcctctgcgttcgtt

SEQ ID NO: 581218 - DNA, 20 bp, Artificial
  CRISPR gRNA sequence
ttgggcctctgcgttcgttc

SEQ ID NO: 581219 - DNA, 20 bp, Artificial
  CRISPR gRNA sequence
tgggcctctgcgttcgttcc

SEQ ID NO: 581220 - DNA, 20 bp, Artificial
  CRISPR gRNA sequence
gggcctctgcgttcgttccc

SEQ ID NO: 581221 - DNA, 20 bp, Artificial
  CRISPR gRNA sequence
ggcctctgcgttcgttcccg

SEQ ID NO: 581222 - DNA, 20 bp, Artificial
  CRISPR gRNA sequence
tgcgttcgttcccggctgcc

SEQ ID NO: 581223 - DNA, 20 bp, Artificial
  CRISPR gRNA sequence
cgttcgttcccggctgccct

SEQ ID NO: 581224 - DNA, 20 bp, Artificial
  CRISPR gRNA sequence
gttcccggctgccctcatcg

SEQ ID NO: 581225 - DNA, 20 bp, Artificial
  CRISPR gRNA sequence
ccggctgccctcatcgcctg

SEQ ID NO: 581226 - DNA, 20 bp, Artificial
  CRISPR gRNA sequence
ccctcatcgcctgtagccat

SEQ ID NO: 581227 - DNA, 20 bp, Artificial
  CRISPR gRNA sequence
atcgcctgtagccattccac

SEQ ID NO: 581228 - DNA, 20 bp, Artificial
  CRISPR gRNA sequence
tagccattccacttttccca

SEQ ID NO: 581229 - DNA, 20 bp, Artificial
  CRISPR gRNA sequence
cacttttcccaccgcccaca

SEQ ID NO: 581230 - DNA, 20 bp, Artificial
  CRISPR gRNA sequence
ttcccaccgcccacatgcct

SEQ ID NO: 581231 - DNA, 20 bp, Artificial
  CRISPR gRNA sequence
tcccaccgcccacatgcctc

SEQ ID NO: 581232 - DNA, 20 bp, Artificial
  CRISPR gRNA sequence
cccaccgcccacatgcctct

SEQ ID NO: 581233 - DNA, 20 bp, Artificial
  CRISPR gRNA sequence
ccaccgcccacatgcctctc

SEQ ID NO: 581234 - DNA, 20 bp, Artificial
  CRISPR gRNA sequence
tctcgctcagacttccgcat

SEQ ID NO: 581235 - DNA, 20 bp, Artificial
  CRISPR gRNA sequence
tcgctcagacttccgcatta

SEQ ID NO: 581236 - DNA, 20 bp, Artificial
  CRISPR gRNA sequence
gctcagacttccgcattagc

SEQ ID NO: 581237 - DNA, 20 bp, Artificial
  CRISPR gRNA sequence
agacttccgcattagctgtc

SEQ ID NO: 581238 - DNA, 20 bp, Artificial
  CRISPR gRNA sequence
ccgcattagctgtctgcttc

SEQ ID NO: 581239 - DNA, 20 bp, Artificial
  CRISPR gRNA sequence
cgcattagctgtctgcttct

SEQ ID NO: 581240 - DNA, 20 bp, Artificial
  CRISPR gRNA sequence
gctgtctgcttctgttttct

SEQ ID NO: 581241 - DNA, 20 bp, Artificial
  CRISPR gRNA sequence
tctgcttctgttttcttcat

SEQ ID NO: 581242 - DNA, 20 bp, Artificial
  CRISPR gRNA sequence
cttctgttttcttcatcatg

SEQ ID NO: 581243 - DNA, 20 bp, Artificial
  CRISPR gRNA sequence
ctgttttcttcatcatggat

SEQ ID NO: 581244 - DNA, 20 bp, Artificial
  CRISPR gRNA sequence
tgttttcttcatcatggatt

SEQ ID NO: 581245 - DNA, 20 bp, Artificial
  CRISPR gRNA sequence
ttttcttcatcatggatttc

SEQ ID NO: 581246 - DNA, 20 bp, Artificial
  CRISPR gRNA sequence
tcttcatcatggatttcgca

SEQ ID NO: 581247 - DNA, 20 bp, Artificial
  CRISPR gRNA sequence
cttcatcatggatttcgcac

SEQ ID NO: 581248 - DNA, 20 bp, Artificial
  CRISPR gRNA sequence
ttcatcatggatttcgcacc

SEQ ID NO: 581249 - DNA, 20 bp, Artificial
  CRISPR gRNA sequence
catcatggatttcgcaccac

SEQ ID NO: 581250 - DNA, 20 bp, Artificial
  CRISPR gRNA sequence
atcatggatttcgcaccacc

SEQ ID NO: 581251 - DNA, 20 bp, Artificial
  CRISPR gRNA sequence
cgcaccacccccattccggc

SEQ ID NO: 581252 - DNA, 20 bp, Artificial
  CRISPR gRNA sequence
gcaccacccccattccggcc

SEQ ID NO: 581253 - DNA, 20 bp, Artificial
  CRISPR gRNA sequence
cggcctctccattgattcct

SEQ ID NO: 581254 - DNA, 20 bp, Artificial
  CRISPR gRNA sequence
tccattgattcctcgatcat

SEQ ID NO: 581255 - DNA, 20 bp, Artificial
  CRISPR gRNA sequence
cattgattcctcgatcatcc

SEQ ID NO: 581256 - DNA, 20 bp, Artificial
  CRISPR gRNA sequence
attcctcgatcatcccgccc

SEQ ID NO: 581257 - DNA, 20 bp, Artificial
  CRISPR gRNA sequence
ctcgatcatcccgcccccta

SEQ ID NO: 581258 - DNA, 20 bp, Artificial
  CRISPR gRNA sequence
gatcatcccgccccctacac

SEQ ID NO: 581259 - DNA, 20 bp, Artificial
  CRISPR gRNA sequence
caccgcccactcccgggcat

SEQ ID NO: 581260 - DNA, 20 bp, Artificial
  CRISPR gRNA sequence
ccgggcatccccattggctg

SEQ ID NO: 581261 - DNA, 20 bp, Artificial
  CRISPR gRNA sequence
gctgcgtgcttctccggctc

SEQ ID NO: 581262 - DNA, 20 bp, Artificial
  CRISPR gRNA sequence
cgtgcttctccggctctcaa

SEQ ID NO: 581263 - DNA, 20 bp, Artificial
  CRISPR gRNA sequence
ctccggctctcaattcgctg

SEQ ID NO: 581264 - DNA, 20 bp, Artificial
  CRISPR gRNA sequence
tccggctctcaattcgctgt

SEQ ID NO: 581265 - DNA, 20 bp, Artificial
  CRISPR gRNA sequence
cggctctcaattcgctgtac

SEQ ID NO: 581266 - DNA, 20 bp, Artificial
  CRISPR gRNA sequence
tcaattcgctgtacgtcatc

SEQ ID NO: 581267 - DNA, 20 bp, Artificial
  CRISPR gRNA sequence
aattcgctgtacgtcatccg

SEQ ID NO: 581268 - DNA, 20 bp, Artificial
  CRISPR gRNA sequence
gctgtacgtcatccgtgcat

SEQ ID NO: 581269 - DNA, 20 bp, Artificial
  CRISPR gRNA sequence
tacgtcatccgtgcatggct

SEQ ID NO: 581270 - DNA, 20 bp, Artificial
  CRISPR gRNA sequence
cccattggccctctgcaata

SEQ ID NO: 581271 - DNA, 20 bp, Artificial
  CRISPR gRNA sequence
gccctctgcaatacttgtct

SEQ ID NO: 581272 - DNA, 20 bp, Artificial
  CRISPR gRNA sequence
tgcaatacttgtcttcatct

SEQ ID NO: 581273 - DNA, 20 bp, Artificial
  CRISPR gRNA sequence
caatacttgtcttcatctca

SEQ ID NO: 581274 - DNA, 20 bp, Artificial
  CRISPR gRNA sequence
gtcttcatctcaccgcctat

SEQ ID NO: 581275 - DNA, 20 bp, Artificial
  CRISPR gRNA sequence
tcttcatctcaccgcctatg

SEQ ID NO: 581276 - DNA, 20 bp, Artificial
  CRISPR gRNA sequence
catctcaccgcctatgcccc

SEQ ID NO: 581277 - DNA, 20 bp, Artificial
  CRISPR gRNA sequence
atctcaccgcctatgccccc

SEQ ID NO: 581278 - DNA, 20 bp, Artificial
  CRISPR gRNA sequence
accgcctatgcccccgtgag

SEQ ID NO: 581279 - DNA, 20 bp, Artificial
  CRISPR gRNA sequence
tgcccccgtgagccgtaccc

SEQ ID NO: 581280 - DNA, 20 bp, Artificial
  CRISPR gRNA sequence
cgcgctggccttcccattgg

SEQ ID NO: 581281 - DNA, 20 bp, Artificial
  CRISPR gRNA sequence
gccttcccattggctgcccg

SEQ ID NO: 581282 - DNA, 20 bp, Artificial
  CRISPR gRNA sequence
cccattggctgcccgcccct

SEQ ID NO: 581283 - DNA, 20 bp, Artificial
  CRISPR gRNA sequence
ccattggctgcccgcccctt

SEQ ID NO: 581284 - DNA, 20 bp, Artificial
  CRISPR gRNA sequence
gctgcccgccccttcaggcc

SEQ ID NO: 581285 - DNA, 20 bp, Artificial
  CRISPR gRNA sequence
cccgccccttcaggccctgc

SEQ ID NO: 581286 - DNA, 20 bp, Artificial
  CRISPR gRNA sequence
aaggggcgggcagccaatgg

SEQ ID NO: 581287 - DNA, 20 bp, Artificial
  CRISPR gRNA sequence
acgggggcataggcggtgag

SEQ ID NO: 581288 - DNA, 20 bp, Artificial
  CRISPR gRNA sequence
cagagggccaatgggcagcc

SEQ ID NO: 581289 - DNA, 20 bp, Artificial
  CRISPR gRNA sequence
agagccggagaagcacgcag

SEQ ID NO: 581290 - DNA, 20 bp, Artificial
  CRISPR gRNA sequence
atgcggaagtctgagcgaga

SEQ ID NO: 581291 - DNA, 20 bp, Artificial
  CRISPR gRNA sequence
agcgagagaggcatgtgggc

SEQ ID NO: 581292 - DNA, 20 bp, Artificial
  CRISPR gRNA sequence
caggcgatgagggcagccgg

SEQ ID NO: 581293 - DNA, 20 bp, Artificial
  CRISPR gRNA sequence
cgtaggcggtggaacggtag

SEQ ID NO: 581294 - DNA, 20 bp, Artificial
  CRISPR gRNA sequence
gagagagagaacagccaatg

SEQ ID NO: 581295 - DNA, 20 bp, Artificial
  CRISPR gRNA sequence
cagcgagccaatggggaggc

SEQ ID NO: 581296 - DNA, 20 bp, Artificial
  CRISPR gRNA sequence
gtgagcgtgcactgcggctt

SEQ ID NO: 581297 - DNA, 20 bp, Artificial
  CRISPR gRNA sequence
tgagcgtgcactgcggcttc

SEQ ID NO: 581298 - DNA, 20 bp, Artificial
  CRISPR gRNA sequence
cggcttcgaaggggtggtgc

SEQ ID NO: 581299 - DNA, 20 bp, Artificial
  CRISPR gRNA sequence
cgaaggggtggtgccaaggt

SEQ ID NO: 581300 - DNA, 20 bp, Artificial
  CRISPR gRNA sequence
gaaggggtggtgccaaggtg

SEQ ID NO: 581301 - DNA, 20 bp, Artificial
  CRISPR gRNA sequence
gccaatacgaaggctaaaag

SEQ ID NO: 581302 - DNA, 20 bp, Artificial
  CRISPR gRNA sequence
aaaggagaccaagaggcggg

SEQ ID NO: 581303 - DNA, 20 bp, Artificial
  CRISPR gRNA sequence
aaggcgggagcgaggacgag

SEQ ID NO: 581304 - DNA, 20 bp, Artificial
  CRISPR gRNA sequence
gcggatagccaatgagggag

SEQ ID NO: 581305 - DNA, 20 bp, Artificial
  CRISPR gRNA sequence
aaaggacagtactagtatgg

SEQ ID NO: 581306 - DNA, 20 bp, Artificial
  CRISPR gRNA sequence
gtatgggatgagccaatgcc

SEQ ID NO: 581307 - DNA, 20 bp, Artificial
  CRISPR gRNA sequence
gatagtgcagcgggacggag

SEQ ID NO: 581308 - DNA, 20 bp, Artificial
  CRISPR gRNA sequence
ggaggcaagatggggaaaaa

SEQ ID NO: 581309 - DNA, 20 bp, Artificial
  CRISPR gRNA sequence
gaggcaagatggggaaaaaa

SEQ ID NO: 581310 - DNA, 20 bp, Artificial
  CRISPR gRNA sequence
gagaggaggacgctgtgtag

SEQ ID NO: 581311 - DNA, 20 bp, Artificial
  CRISPR gRNA sequence
tgtagacagagtctgaggta

SEQ ID NO: 581312 - DNA, 20 bp, Artificial
  CRISPR gRNA sequence
aggtattgggtggccggaca

SEQ ID NO: 581313 - DNA, 20 bp, Artificial
  CRISPR gRNA sequence
ggtggccggacagcagaacc

SEQ ID NO: 581314 - DNA, 20 bp, Artificial
  CRISPR gRNA sequence
ggaaaaatgtgcttctcagg

SEQ ID NO: 581315 - DNA, 20 bp, Artificial
  CRISPR gRNA sequence
ctcagggatggggttaccct

SEQ ID NO: 581316 - DNA, 20 bp, Artificial
  CRISPR gRNA sequence
tcagggatggggttaccctc

SEQ ID NO: 581317 - DNA, 20 bp, Artificial
  CRISPR gRNA sequence
agggatggggttaccctctc

SEQ ID NO: 581318 - DNA, 20 bp, Artificial
  CRISPR gRNA sequence
ccctctccctaaccctccgt

SEQ ID NO: 581319 - DNA, 20 bp, Artificial
  CRISPR gRNA sequence
tccctaaccctccgtgactc

SEQ ID NO: 581320 - DNA, 20 bp, Artificial
  CRISPR gRNA sequence
cctaaccctccgtgactccc

SEQ ID NO: 581321 - DNA, 20 bp, Artificial
  CRISPR gRNA sequence
accctccgtgactccccatt

SEQ ID NO: 581322 - DNA, 20 bp, Artificial
  CRISPR gRNA sequence
cgtgactccccattgcccca

SEQ ID NO: 581323 - DNA, 20 bp, Artificial
  CRISPR gRNA sequence
cccattgccccaggaatacc

SEQ ID NO: 581324 - DNA, 20 bp, Artificial
  CRISPR gRNA sequence
ccccaggaatacccagagcc

SEQ ID NO: 581325 - DNA, 20 bp, Artificial
  CRISPR gRNA sequence
aaggcctagaccacaccttg

SEQ ID NO: 581326 - DNA, 20 bp, Artificial
  CRISPR gRNA sequence
gaccacaccttggtgtgtga

SEQ ID NO: 581327 - DNA, 20 bp, Artificial
  CRISPR gRNA sequence
ggtgtgtgaactaggaaagt

SEQ ID NO: 581328 - DNA, 20 bp, Artificial
  CRISPR gRNA sequence
gtgtgtgaactaggaaagtg

SEQ ID NO: 581329 - DNA, 20 bp, Artificial
  CRISPR gRNA sequence
ggaaagtgaaaatgactgtc

SEQ ID NO: 581330 - DNA, 20 bp, Artificial
  CRISPR gRNA sequence
tcctgttgcagttagttact

SEQ ID NO: 581331 - DNA, 20 bp, Artificial
  CRISPR gRNA sequence
ttgcagttagttacttactg

SEQ ID NO: 581332 - DNA, 20 bp, Artificial
  CRISPR gRNA sequence
cagttagttacttactgggt

SEQ ID NO: 581333 - DNA, 20 bp, Artificial
  CRISPR gRNA sequence
gttacttactgggtcctccc

SEQ ID NO: 581334 - DNA, 20 bp, Artificial
  CRISPR gRNA sequence
cttactgggtcctccctgcc

SEQ ID NO: 581335 - DNA, 20 bp, Artificial
  CRISPR gRNA sequence
actgggtcctccctgcccaa

SEQ ID NO: 581336 - DNA, 20 bp, Artificial
  CRISPR gRNA sequence
ctgggtcctccctgcccaac

SEQ ID NO: 581337 - DNA, 20 bp, Artificial
  CRISPR gRNA sequence
ggtcctccctgcccaactac

SEQ ID NO: 581338 - DNA, 20 bp, Artificial
  CRISPR gRNA sequence
cctgcccaactacaaccttt

SEQ ID NO: 581339 - DNA, 20 bp, Artificial
  CRISPR gRNA sequence
cccaactacaaccttttctt

SEQ ID NO: 581340 - DNA, 20 bp, Artificial
  CRISPR gRNA sequence
caaccttttcttgagcagtg

SEQ ID NO: 581341 - DNA, 20 bp, Artificial
  CRISPR gRNA sequence
ttcttgagcagtgccacaag

SEQ ID NO: 581342 - DNA, 20 bp, Artificial
  CRISPR gRNA sequence
tcttgagcagtgccacaagc

SEQ ID NO: 581343 - DNA, 20 bp, Artificial
  CRISPR gRNA sequence
cttgagcagtgccacaagcc

SEQ ID NO: 581344 - DNA, 20 bp, Artificial
  CRISPR gRNA sequence
ttgagcagtgccacaagcca

SEQ ID NO: 581345 - DNA, 20 bp, Artificial
  CRISPR gRNA sequence
gagcagtgccacaagccaag

SEQ ID NO: 581346 - DNA, 20 bp, Artificial
  CRISPR gRNA sequence
agcagtgccacaagccaaga

SEQ ID NO: 581347 - DNA, 20 bp, Artificial
  CRISPR gRNA sequence
attgttagccgcaagcactc

SEQ ID NO: 581348 - DNA, 20 bp, Artificial
  CRISPR gRNA sequence
ttagccgcaagcactctcca

SEQ ID NO: 581349 - DNA, 20 bp, Artificial
  CRISPR gRNA sequence
gccgcaagcactctccagga

SEQ ID NO: 581350 - DNA, 20 bp, Artificial
  CRISPR gRNA sequence
tccaggacttgatactattg

SEQ ID NO: 581351 - DNA, 20 bp, Artificial
  CRISPR gRNA sequence
caggacttgatactattgtt

SEQ ID NO: 581352 - DNA, 20 bp, Artificial
  CRISPR gRNA sequence
gatactattgttgaatgaat

SEQ ID NO: 581353 - DNA, 20 bp, Artificial
  CRISPR gRNA sequence
atactattgttgaatgaatg

SEQ ID NO: 581354 - DNA, 20 bp, Artificial
  CRISPR gRNA sequence
ttgttgaatgaatggccgaa

SEQ ID NO: 581355 - DNA, 20 bp, Artificial
  CRISPR gRNA sequence
ttgaatgaatggccgaatag

SEQ ID NO: 581356 - DNA, 20 bp, Artificial
  CRISPR gRNA sequence
aatgaatggccgaataggaa

SEQ ID NO: 581357 - DNA, 20 bp, Artificial
  CRISPR gRNA sequence
aactttctgaaggattcact

SEQ ID NO: 581358 - DNA, 20 bp, Artificial
  CRISPR gRNA sequence
actttctgaaggattcactt

SEQ ID NO: 581359 - DNA, 20 bp, Artificial
  CRISPR gRNA sequence
tctgaaggattcactttttt

SEQ ID NO: 581360 - DNA, 20 bp, Artificial
  CRISPR gRNA sequence
ctgaaggattcactttttta

SEQ ID NO: 581361 - DNA, 20 bp, Artificial
  CRISPR gRNA sequence
tgaaggattcacttttttaa

SEQ ID NO: 581362 - DNA, 20 bp, Artificial
  CRISPR gRNA sequence
aaggattcacttttttaaat

SEQ ID NO: 581363 - DNA, 20 bp, Artificial
  CRISPR gRNA sequence
acttttttaaatttcagctc

SEQ ID NO: 581364 - DNA, 20 bp, Artificial
  CRISPR gRNA sequence
ttttaaatttcagctcagca

SEQ ID NO: 581365 - DNA, 20 bp, Artificial
  CRISPR gRNA sequence
tttaaatttcagctcagcaa

SEQ ID NO: 581366 - DNA, 20 bp, Artificial
  CRISPR gRNA sequence
ttaaatttcagctcagcaaa

SEQ ID NO: 581367 - DNA, 20 bp, Artificial
  CRISPR gRNA sequence
taaatttcagctcagcaaac

SEQ ID NO: 581368 - DNA, 20 bp, Artificial
  CRISPR gRNA sequence
aaatttcagctcagcaaaca

SEQ ID NO: 581369 - DNA, 20 bp, Artificial
  CRISPR gRNA sequence
aatttcagctcagcaaacac

SEQ ID NO: 581370 - DNA, 20 bp, Artificial
  CRISPR gRNA sequence
cagctcagcaaacactgacc

SEQ ID NO: 581371 - DNA, 20 bp, Artificial
  CRISPR gRNA sequence
agctcagcaaacactgacct

SEQ ID NO: 581372 - DNA, 20 bp, Artificial
  CRISPR gRNA sequence
agcaaacactgacctgactg

SEQ ID NO: 581373 - DNA, 20 bp, Artificial
  CRISPR gRNA sequence
acctgactgtgtgctaccag

SEQ ID NO: 581374 - DNA, 20 bp, Artificial
  CRISPR gRNA sequence
actgtgtgctaccagaagtt

SEQ ID NO: 581375 - DNA, 20 bp, Artificial
  CRISPR gRNA sequence
tgtgctaccagaagttgatt

SEQ ID NO: 581376 - DNA, 20 bp, Artificial
  CRISPR gRNA sequence
ccagaagttgattgggcata

SEQ ID NO: 581377 - DNA, 20 bp, Artificial
  CRISPR gRNA sequence
attgggcatatgggtagctt

SEQ ID NO: 581378 - DNA, 20 bp, Artificial
  CRISPR gRNA sequence
ggcatatgggtagcttctga

SEQ ID NO: 581379 - DNA, 20 bp, Artificial
  CRISPR gRNA sequence
ctgactaatggaatcacaat

SEQ ID NO: 581380 - DNA, 20 bp, Artificial
  CRISPR gRNA sequence
tgactaatggaatcacaatc

SEQ ID NO: 581381 - DNA, 20 bp, Artificial
  CRISPR gRNA sequence
actaatggaatcacaatcaa

SEQ ID NO: 581382 - DNA, 20 bp, Artificial
  CRISPR gRNA sequence
atggaatcacaatcaaagcc

SEQ ID NO: 581383 - DNA, 20 bp, Artificial
  CRISPR gRNA sequence
tccttcttgcccaacctgac

SEQ ID NO: 581384 - DNA, 20 bp, Artificial
  CRISPR gRNA sequence
cttgcccaacctgacactcc

SEQ ID NO: 581385 - DNA, 20 bp, Artificial
  CRISPR gRNA sequence
ttgcccaacctgacactcca

SEQ ID NO: 581386 - DNA, 20 bp, Artificial
  CRISPR gRNA sequence
gcccaacctgacactccaca

SEQ ID NO: 581387 - DNA, 20 bp, Artificial
  CRISPR gRNA sequence
cccaacctgacactccacac

SEQ ID NO: 581388 - DNA, 20 bp, Artificial
  CRISPR gRNA sequence
acactccacaccccacaggg

SEQ ID NO: 581389 - DNA, 20 bp, Artificial
  CRISPR gRNA sequence
cacaccccacaggggcctca

SEQ ID NO: 581390 - DNA, 20 bp, Artificial
  CRISPR gRNA sequence
acctcccttctttctgtccc

SEQ ID NO: 581391 - DNA, 20 bp, Artificial
  CRISPR gRNA sequence
ccttctttctgtccccccat

SEQ ID NO: 581392 - DNA, 20 bp, Artificial
  CRISPR gRNA sequence
ctttctgtccccccatctct

SEQ ID NO: 581393 - DNA, 20 bp, Artificial
  CRISPR gRNA sequence
tttctgtccccccatctctg

SEQ ID NO: 581394 - DNA, 20 bp, Artificial
  CRISPR gRNA sequence
tctgtccccccatctctgct

SEQ ID NO: 581395 - DNA, 20 bp, Artificial
  CRISPR gRNA sequence
ctgtccccccatctctgctt

SEQ ID NO: 581396 - DNA, 20 bp, Artificial
  CRISPR gRNA sequence
tgtccccccatctctgcttc

SEQ ID NO: 581397 - DNA, 20 bp, Artificial
  CRISPR gRNA sequence
tccccccatctctgcttcta

SEQ ID NO: 581398 - DNA, 20 bp, Artificial
  CRISPR gRNA sequence
tgcttctactgttccctctc

SEQ ID NO: 581399 - DNA, 20 bp, Artificial
  CRISPR gRNA sequence
cttctactgttccctctccc

SEQ ID NO: 581400 - DNA, 20 bp, Artificial
  CRISPR gRNA sequence
ctactgttccctctcccaag

SEQ ID NO: 581401 - DNA, 20 bp, Artificial
  CRISPR gRNA sequence
tactgttccctctcccaaga

SEQ ID NO: 581402 - DNA, 20 bp, Artificial
  CRISPR gRNA sequence
ctgttccctctcccaagagt

SEQ ID NO: 581403 - DNA, 20 bp, Artificial
  CRISPR gRNA sequence
ttccctctcccaagagtgct

SEQ ID NO: 581404 - DNA, 20 bp, Artificial
  CRISPR gRNA sequence
cctctcccaagagtgctgtt

SEQ ID NO: 581405 - DNA, 20 bp, Artificial
  CRISPR gRNA sequence
tcccaagagtgctgttcctt

SEQ ID NO: 581406 - DNA, 20 bp, Artificial
  CRISPR gRNA sequence
ccaagagtgctgttccttct

SEQ ID NO: 581407 - DNA, 20 bp, Artificial
  CRISPR gRNA sequence
ttccttctgctgcttccatc

SEQ ID NO: 581408 - DNA, 20 bp, Artificial
  CRISPR gRNA sequence
cttctgctgcttccatctag

SEQ ID NO: 581409 - DNA, 20 bp, Artificial
  CRISPR gRNA sequence
ctgctgcttccatctagtaa

SEQ ID NO: 581410 - DNA, 20 bp, Artificial
  CRISPR gRNA sequence
tgctgcttccatctagtaaa

SEQ ID NO: 581411 - DNA, 20 bp, Artificial
  CRISPR gRNA sequence
ctgcttccatctagtaaact

SEQ ID NO: 581412 - DNA, 20 bp, Artificial
  CRISPR gRNA sequence
cttccatctagtaaactcct

SEQ ID NO: 581413 - DNA, 20 bp, Artificial
  CRISPR gRNA sequence
ccatctagtaaactcctttc

SEQ ID NO: 581414 - DNA, 20 bp, Artificial
  CRISPR gRNA sequence
catctagtaaactcctttcg

SEQ ID NO: 581415 - DNA, 20 bp, Artificial
  CRISPR gRNA sequence
gtaaactcctttcgctctcc

SEQ ID NO: 581416 - DNA, 20 bp, Artificial
  CRISPR gRNA sequence
ctttcgctctccctttgggg

SEQ ID NO: 581417 - DNA, 20 bp, Artificial
  CRISPR gRNA sequence
tcgctctccctttggggtct

SEQ ID NO: 581418 - DNA, 20 bp, Artificial
  CRISPR gRNA sequence
cgctctccctttggggtctc

SEQ ID NO: 581419 - DNA, 20 bp, Artificial
  CRISPR gRNA sequence
gctctccctttggggtctca

SEQ ID NO: 581420 - DNA, 20 bp, Artificial
  CRISPR gRNA sequence
tccctttggggtctcacctt

SEQ ID NO: 581421 - DNA, 20 bp, Artificial
  CRISPR gRNA sequence
cctttggggtctcaccttct

SEQ ID NO: 581422 - DNA, 20 bp, Artificial
  CRISPR gRNA sequence
tggggtctcaccttctgtgg

SEQ ID NO: 581423 - DNA, 20 bp, Artificial
  CRISPR gRNA sequence
ggggtctcaccttctgtggg

SEQ ID NO: 581424 - DNA, 20 bp, Artificial
  CRISPR gRNA sequence
gggtctcaccttctgtggga

SEQ ID NO: 581425 - DNA, 20 bp, Artificial
  CRISPR gRNA sequence
accttctgtgggaactcaac

SEQ ID NO: 581426 - DNA, 20 bp, Artificial
  CRISPR gRNA sequence
ctgtgggaactcaactgcag

SEQ ID NO: 581427 - DNA, 20 bp, Artificial
  CRISPR gRNA sequence
tgtgggaactcaactgcagc

SEQ ID NO: 581428 - DNA, 20 bp, Artificial
  CRISPR gRNA sequence
tgggaactcaactgcagctt

SEQ ID NO: 581429 - DNA, 20 bp, Artificial
  CRISPR gRNA sequence
aactgcagcttttgtccgct

SEQ ID NO: 581430 - DNA, 20 bp, Artificial
  CRISPR gRNA sequence
cagcttttgtccgctgaaca

SEQ ID NO: 581431 - DNA, 20 bp, Artificial
  CRISPR gRNA sequence
ttgtccgctgaacacatcca

SEQ ID NO: 581432 - DNA, 20 bp, Artificial
  CRISPR gRNA sequence
tgtccgctgaacacatccat

SEQ ID NO: 581433 - DNA, 20 bp, Artificial
  CRISPR gRNA sequence
gtccgctgaacacatccatt

SEQ ID NO: 581434 - DNA, 20 bp, Artificial
  CRISPR gRNA sequence
tccgctgaacacatccattc

SEQ ID NO: 581435 - DNA, 20 bp, Artificial
  CRISPR gRNA sequence
aacacatccattcatacatt

SEQ ID NO: 581436 - DNA, 20 bp, Artificial
  CRISPR gRNA sequence
atacattccttctccatcct

SEQ ID NO: 581437 - DNA, 20 bp, Artificial
  CRISPR gRNA sequence
cttctccatcctgggaagat

SEQ ID NO: 581438 - DNA, 20 bp, Artificial
  CRISPR gRNA sequence
ctccatcctgggaagattta

SEQ ID NO: 581439 - DNA, 20 bp, Artificial
  CRISPR gRNA sequence
tccatcctgggaagatttac

SEQ ID NO: 581440 - DNA, 20 bp, Artificial
  CRISPR gRNA sequence
catcctgggaagatttactg

SEQ ID NO: 581441 - DNA, 20 bp, Artificial
  CRISPR gRNA sequence
ggaagatttactgaacacct

SEQ ID NO: 581442 - DNA, 20 bp, Artificial
  CRISPR gRNA sequence
actgaacacctactgagtgc

SEQ ID NO: 581443 - DNA, 20 bp, Artificial
  CRISPR gRNA sequence
ctgaacacctactgagtgcc

SEQ ID NO: 581444 - DNA, 20 bp, Artificial
  CRISPR gRNA sequence
aacacctactgagtgccagg

SEQ ID NO: 581445 - DNA, 20 bp, Artificial
  CRISPR gRNA sequence
ctgagtgccaggttctgagc

SEQ ID NO: 581446 - DNA, 20 bp, Artificial
  CRISPR gRNA sequence
agtgccaggttctgagcatg

SEQ ID NO: 581447 - DNA, 20 bp, Artificial
  CRISPR gRNA sequence
tgagcatgctgttatctcat

SEQ ID NO: 581448 - DNA, 20 bp, Artificial
  CRISPR gRNA sequence
agcatgctgttatctcatta

SEQ ID NO: 581449 - DNA, 20 bp, Artificial
  CRISPR gRNA sequence
ttatctcattagaacctcac

SEQ ID NO: 581450 - DNA, 20 bp, Artificial
  CRISPR gRNA sequence
tctcattagaacctcacagc

SEQ ID NO: 581451 - DNA, 20 bp, Artificial
  CRISPR gRNA sequence
attagaacctcacagcatcc

SEQ ID NO: 581452 - DNA, 20 bp, Artificial
  CRISPR gRNA sequence
gaacctcacagcatcctagg

SEQ ID NO: 581453 - DNA, 20 bp, Artificial
  CRISPR gRNA sequence
acagcatcctaggagggagg

SEQ ID NO: 581454 - DNA, 20 bp, Artificial
  CRISPR gRNA sequence
ggagggaggtgatccttcca

SEQ ID NO: 581455 - DNA, 20 bp, Artificial
  CRISPR gRNA sequence
ccagcagcccctctccccag

SEQ ID NO: 581456 - DNA, 20 bp, Artificial
  CRISPR gRNA sequence
cagcagcccctctccccagg

SEQ ID NO: 581457 - DNA, 20 bp, Artificial
  CRISPR gRNA sequence
tccccaggtctccatgttca

SEQ ID NO: 581458 - DNA, 20 bp, Artificial
  CRISPR gRNA sequence
cccaggtctccatgttcagg

SEQ ID NO: 581459 - DNA, 20 bp, Artificial
  CRISPR gRNA sequence
catgttcaggatgtccatga

SEQ ID NO: 581460 - DNA, 20 bp, Artificial
  CRISPR gRNA sequence
aggatgtccatgagttagaa

SEQ ID NO: 581461 - DNA, 20 bp, Artificial
  CRISPR gRNA sequence
gaaatgaatatgttcagctg

SEQ ID NO: 581462 - DNA, 20 bp, Artificial
  CRISPR gRNA sequence
agctgcaagtaacagaaaaa

SEQ ID NO: 581463 - DNA, 20 bp, Artificial
  CRISPR gRNA sequence
caagtaacagaaaaatcata

SEQ ID NO: 581464 - DNA, 20 bp, Artificial
  CRISPR gRNA sequence
aagcaagacagaactttatt

SEQ ID NO: 581465 - DNA, 20 bp, Artificial
  CRISPR gRNA sequence
agcaagacagaactttattt

SEQ ID NO: 581466 - DNA, 20 bp, Artificial
  CRISPR gRNA sequence
tatttttttctcacctaaaa

SEQ ID NO: 581467 - DNA, 20 bp, Artificial
  CRISPR gRNA sequence
atttttttctcacctaaaag

SEQ ID NO: 581468 - DNA, 20 bp, Artificial
  CRISPR gRNA sequence
tttttttctcacctaaaagt

SEQ ID NO: 581469 - DNA, 20 bp, Artificial
  CRISPR gRNA sequence
ttttctcacctaaaagttca

SEQ ID NO: 581470 - DNA, 20 bp, Artificial
  CRISPR gRNA sequence
tttctcacctaaaagttcaa

SEQ ID NO: 581471 - DNA, 20 bp, Artificial
  CRISPR gRNA sequence
ttctcacctaaaagttcaag

SEQ ID NO: 581472 - DNA, 20 bp, Artificial
  CRISPR gRNA sequence
tctcacctaaaagttcaagc

SEQ ID NO: 581473 - DNA, 20 bp, Artificial
  CRISPR gRNA sequence
ctcacctaaaagttcaagct

SEQ ID NO: 581474 - DNA, 20 bp, Artificial
  CRISPR gRNA sequence
tcacctaaaagttcaagctg

SEQ ID NO: 581475 - DNA, 20 bp, Artificial
  CRISPR gRNA sequence
acctaaaagttcaagctggc

SEQ ID NO: 581476 - DNA, 20 bp, Artificial
  CRISPR gRNA sequence
aaagttcaagctggcaaata

SEQ ID NO: 581477 - DNA, 20 bp, Artificial
  CRISPR gRNA sequence
aagctggcaaatagtccagg

SEQ ID NO: 581478 - DNA, 20 bp, Artificial
  CRISPR gRNA sequence
gcaaatagtccagggactcc

SEQ ID NO: 581479 - DNA, 20 bp, Artificial
  CRISPR gRNA sequence
cttcctgcccacctggtttg

SEQ ID NO: 581480 - DNA, 20 bp, Artificial
  CRISPR gRNA sequence
cctgcccacctggtttgggc

SEQ ID NO: 581481 - DNA, 20 bp, Artificial
  CRISPR gRNA sequence
ctgcccacctggtttgggca

SEQ ID NO: 581482 - DNA, 20 bp, Artificial
  CRISPR gRNA sequence
cccacctggtttgggcattg

SEQ ID NO: 581483 - DNA, 20 bp, Artificial
  CRISPR gRNA sequence
gtttgggcattgtctgtccc

SEQ ID NO: 581484 - DNA, 20 bp, Artificial
  CRISPR gRNA sequence
gggcattgtctgtcccgatc

SEQ ID NO: 581485 - DNA, 20 bp, Artificial
  CRISPR gRNA sequence
ggcattgtctgtcccgatct

SEQ ID NO: 581486 - DNA, 20 bp, Artificial
  CRISPR gRNA sequence
tctgtcccgatctggctcca

SEQ ID NO: 581487 - DNA, 20 bp, Artificial
  CRISPR gRNA sequence
tcccgatctggctccaagac

SEQ ID NO: 581488 - DNA, 20 bp, Artificial
  CRISPR gRNA sequence
gctccaagactctcagtctt

SEQ ID NO: 581489 - DNA, 20 bp, Artificial
  CRISPR gRNA sequence
caagactctcagtcttcaac

SEQ ID NO: 581490 - DNA, 20 bp, Artificial
  CRISPR gRNA sequence
tcagtcttcaacaaatcctt

SEQ ID NO: 581491 - DNA, 20 bp, Artificial
  CRISPR gRNA sequence
agtcttcaacaaatcctttt

SEQ ID NO: 581492 - DNA, 20 bp, Artificial
  CRISPR gRNA sequence
caacaaatccttttggctgt

SEQ ID NO: 581493 - DNA, 20 bp, Artificial
  CRISPR gRNA sequence
aacaaatccttttggctgtc

SEQ ID NO: 581494 - DNA, 20 bp, Artificial
  CRISPR gRNA sequence
ttggctgtctattaaaaata

SEQ ID NO: 581495 - DNA, 20 bp, Artificial
  CRISPR gRNA sequence
tggctgtctattaaaaatat

SEQ ID NO: 581496 - DNA, 20 bp, Artificial
  CRISPR gRNA sequence
ggctgtctattaaaaatatt

SEQ ID NO: 581497 - DNA, 20 bp, Artificial
  CRISPR gRNA sequence
gctgtctattaaaaatattt

SEQ ID NO: 581498 - DNA, 20 bp, Artificial
  CRISPR gRNA sequence
tctattaaaaatatttacca

SEQ ID NO: 581499 - DNA, 20 bp, Artificial
  CRISPR gRNA sequence
ttaaaaatatttaccaaatc

SEQ ID NO: 581500 - DNA, 20 bp, Artificial
  CRISPR gRNA sequence
aaaatatttaccaaatccat

SEQ ID NO: 581501 - DNA, 20 bp, Artificial
  CRISPR gRNA sequence
accaaatccatcctcttctc

SEQ ID NO: 581502 - DNA, 20 bp, Artificial
  CRISPR gRNA sequence
ccaaatccatcctcttctca

SEQ ID NO: 581503 - DNA, 20 bp, Artificial
  CRISPR gRNA sequence
ttctcaccacctccactgcc

SEQ ID NO: 581504 - DNA, 20 bp, Artificial
  CRISPR gRNA sequence
ctcaccacctccactgccag

SEQ ID NO: 581505 - DNA, 20 bp, Artificial
  CRISPR gRNA sequence
tcaccacctccactgccagc

SEQ ID NO: 581506 - DNA, 20 bp, Artificial
  CRISPR gRNA sequence
accacctccactgccagcac

SEQ ID NO: 581507 - DNA, 20 bp, Artificial
  CRISPR gRNA sequence
cactgccagcactatcacca

SEQ ID NO: 581508 - DNA, 20 bp, Artificial
  CRISPR gRNA sequence
ccagcactatcaccagtcac

SEQ ID NO: 581509 - DNA, 20 bp, Artificial
  CRISPR gRNA sequence
tcaccagtcacctagactac

SEQ ID NO: 581510 - DNA, 20 bp, Artificial
  CRISPR gRNA sequence
gactactgcagtagccagct

SEQ ID NO: 581511 - DNA, 20 bp, Artificial
  CRISPR gRNA sequence
ctgcagtagccagctccttg

SEQ ID NO: 581512 - DNA, 20 bp, Artificial
  CRISPR gRNA sequence
cagtagccagctccttgctg

SEQ ID NO: 581513 - DNA, 20 bp, Artificial
  CRISPR gRNA sequence
cttgctggtcccctgcttcc

SEQ ID NO: 581514 - DNA, 20 bp, Artificial
  CRISPR gRNA sequence
gctggtcccctgcttccaca

SEQ ID NO: 581515 - DNA, 20 bp, Artificial
  CRISPR gRNA sequence
ctggtcccctgcttccacat

SEQ ID NO: 581516 - DNA, 20 bp, Artificial
  CRISPR gRNA sequence
gtcccctgcttccacattca

SEQ ID NO: 581517 - DNA, 20 bp, Artificial
  CRISPR gRNA sequence
cttccacattcaggccctag

SEQ ID NO: 581518 - DNA, 20 bp, Artificial
  CRISPR gRNA sequence
ccacattcaggccctagacc

SEQ ID NO: 581519 - DNA, 20 bp, Artificial
  CRISPR gRNA sequence
cacattcaggccctagaccc

SEQ ID NO: 581520 - DNA, 20 bp, Artificial
  CRISPR gRNA sequence
aggccctagaccccattgta

SEQ ID NO: 581521 - DNA, 20 bp, Artificial
  CRISPR gRNA sequence
gaccccattgtacactcagc

SEQ ID NO: 581522 - DNA, 20 bp, Artificial
  CRISPR gRNA sequence
tacactcagcattcaggggc

SEQ ID NO: 581523 - DNA, 20 bp, Artificial
  CRISPR gRNA sequence
agcattcaggggcttcctgt

SEQ ID NO: 581524 - DNA, 20 bp, Artificial
  CRISPR gRNA sequence
aggggcttcctgttaaatcc

SEQ ID NO: 581525 - DNA, 20 bp, Artificial
  CRISPR gRNA sequence
cctgttaaatcctaacacgg

SEQ ID NO: 581526 - DNA, 20 bp, Artificial
  CRISPR gRNA sequence
ctgttaaatcctaacacggt

SEQ ID NO: 581527 - DNA, 20 bp, Artificial
  CRISPR gRNA sequence
ttaaatcctaacacggtttg

SEQ ID NO: 581528 - DNA, 20 bp, Artificial
  CRISPR gRNA sequence
aatcctaacacggtttgtgt

SEQ ID NO: 581529 - DNA, 20 bp, Artificial
  CRISPR gRNA sequence
acacggtttgtgtttctcct

SEQ ID NO: 581530 - DNA, 20 bp, Artificial
  CRISPR gRNA sequence
gtgtttctcctctgcttgca

SEQ ID NO: 581531 - DNA, 20 bp, Artificial
  CRISPR gRNA sequence
tgtttctcctctgcttgcaa

SEQ ID NO: 581532 - DNA, 20 bp, Artificial
  CRISPR gRNA sequence
ctcctctgcttgcaaccctg

SEQ ID NO: 581533 - DNA, 20 bp, Artificial
  CRISPR gRNA sequence
tcctctgcttgcaaccctgt

SEQ ID NO: 581534 - DNA, 20 bp, Artificial
  CRISPR gRNA sequence
ctctgcttgcaaccctgtca

SEQ ID NO: 581535 - DNA, 20 bp, Artificial
  CRISPR gRNA sequence
tgcttgcaaccctgtcatgc

SEQ ID NO: 581536 - DNA, 20 bp, Artificial
  CRISPR gRNA sequence
cttgcaaccctgtcatgcct

SEQ ID NO: 581537 - DNA, 20 bp, Artificial
  CRISPR gRNA sequence
gcaaccctgtcatgccttcc

SEQ ID NO: 581538 - DNA, 20 bp, Artificial
  CRISPR gRNA sequence
caaccctgtcatgccttcct

SEQ ID NO: 581539 - DNA, 20 bp, Artificial
  CRISPR gRNA sequence
tcatgccttcctcctcactc

SEQ ID NO: 581540 - DNA, 20 bp, Artificial
  CRISPR gRNA sequence
cctcctcactcagcgttgaa

SEQ ID NO: 581541 - DNA, 20 bp, Artificial
  CRISPR gRNA sequence
ctcctcactcagcgttgaag

SEQ ID NO: 581542 - DNA, 20 bp, Artificial
  CRISPR gRNA sequence
ctcactcagcgttgaagcca

SEQ ID NO: 581543 - DNA, 20 bp, Artificial
  CRISPR gRNA sequence
actcagcgttgaagccaaag

SEQ ID NO: 581544 - DNA, 20 bp, Artificial
  CRISPR gRNA sequence
agcgttgaagccaaagtcct

SEQ ID NO: 581545 - DNA, 20 bp, Artificial
  CRISPR gRNA sequence
aagccaaagtccttaccatg

SEQ ID NO: 581546 - DNA, 20 bp, Artificial
  CRISPR gRNA sequence
accatggcctacaaggtcct

SEQ ID NO: 581547 - DNA, 20 bp, Artificial
  CRISPR gRNA sequence
ccatggcctacaaggtcctg

SEQ ID NO: 581548 - DNA, 20 bp, Artificial
  CRISPR gRNA sequence
caaggtcctgcgtggtctaa

SEQ ID NO: 581549 - DNA, 20 bp, Artificial
  CRISPR gRNA sequence
cgtggtctaacctccgagtc

SEQ ID NO: 581550 - DNA, 20 bp, Artificial
  CRISPR gRNA sequence
acctccgagtcccctttctg

SEQ ID NO: 581551 - DNA, 20 bp, Artificial
  CRISPR gRNA sequence
cgagtcccctttctgacctc

SEQ ID NO: 581552 - DNA, 20 bp, Artificial
  CRISPR gRNA sequence
tctgacctcacctccagctt

SEQ ID NO: 581553 - DNA, 20 bp, Artificial
  CRISPR gRNA sequence
ctgacctcacctccagcttc

SEQ ID NO: 581554 - DNA, 20 bp, Artificial
  CRISPR gRNA sequence
tgacctcacctccagcttct

SEQ ID NO: 581555 - DNA, 20 bp, Artificial
  CRISPR gRNA sequence
acctcacctccagcttctct

SEQ ID NO: 581556 - DNA, 20 bp, Artificial
  CRISPR gRNA sequence
acctccagcttctcttcttg

SEQ ID NO: 581557 - DNA, 20 bp, Artificial
  CRISPR gRNA sequence
cagcttctcttcttgctctc

SEQ ID NO: 581558 - DNA, 20 bp, Artificial
  CRISPR gRNA sequence
ctcttcttgctctctccaca

SEQ ID NO: 581559 - DNA, 20 bp, Artificial
  CRISPR gRNA sequence
tcttcttgctctctccacac

SEQ ID NO: 581560 - DNA, 20 bp, Artificial
  CRISPR gRNA sequence
ttcttgctctctccacacta

SEQ ID NO: 581561 - DNA, 20 bp, Artificial
  CRISPR gRNA sequence
cttgctctctccacactaac

SEQ ID NO: 581562 - DNA, 20 bp, Artificial
  CRISPR gRNA sequence
ttgctctctccacactaacc

SEQ ID NO: 581563 - DNA, 20 bp, Artificial
  CRISPR gRNA sequence
gctctctccacactaaccac

SEQ ID NO: 581564 - DNA, 20 bp, Artificial
  CRISPR gRNA sequence
ctctctccacactaaccaca

SEQ ID NO: 581565 - DNA, 20 bp, Artificial
  CRISPR gRNA sequence
tctccacactaaccacacca

SEQ ID NO: 581566 - DNA, 20 bp, Artificial
  CRISPR gRNA sequence
tccacactaaccacaccagc

SEQ ID NO: 581567 - DNA, 20 bp, Artificial
  CRISPR gRNA sequence
cacactaaccacaccagccc

SEQ ID NO: 581568 - DNA, 20 bp, Artificial
  CRISPR gRNA sequence
accacaccagcccccttgta

SEQ ID NO: 581569 - DNA, 20 bp, Artificial
  CRISPR gRNA sequence
gtagaccttgaacaaatcag

SEQ ID NO: 581570 - DNA, 20 bp, Artificial
  CRISPR gRNA sequence
tagaccttgaacaaatcagg

SEQ ID NO: 581571 - DNA, 20 bp, Artificial
  CRISPR gRNA sequence
gaacaaatcaggtacattcc

SEQ ID NO: 581572 - DNA, 20 bp, Artificial
  CRISPR gRNA sequence
aacaaatcaggtacattccc

SEQ ID NO: 581573 - DNA, 20 bp, Artificial
  CRISPR gRNA sequence
ccacctcaggacctttgccc

SEQ ID NO: 581574 - DNA, 20 bp, Artificial
  CRISPR gRNA sequence
aggacctttgccctggctgt

SEQ ID NO: 581575 - DNA, 20 bp, Artificial
  CRISPR gRNA sequence
tgccctggctgtttcctttg

SEQ ID NO: 581576 - DNA, 20 bp, Artificial
  CRISPR gRNA sequence
gccctggctgtttcctttgg

SEQ ID NO: 581577 - DNA, 20 bp, Artificial
  CRISPR gRNA sequence
ccctggctgtttcctttgga

SEQ ID NO: 581578 - DNA, 20 bp, Artificial
  CRISPR gRNA sequence
gctgtttcctttggagttcc

SEQ ID NO: 581579 - DNA, 20 bp, Artificial
  CRISPR gRNA sequence
tttcctttggagttcctcag

SEQ ID NO: 581580 - DNA, 20 bp, Artificial
  CRISPR gRNA sequence
cctttggagttcctcagata

SEQ ID NO: 581581 - DNA, 20 bp, Artificial
  CRISPR gRNA sequence
ctttggagttcctcagatat

SEQ ID NO: 581582 - DNA, 20 bp, Artificial
  CRISPR gRNA sequence
tggagttcctcagatatcta

SEQ ID NO: 581583 - DNA, 20 bp, Artificial
  CRISPR gRNA sequence
ggagttcctcagatatctag

SEQ ID NO: 581584 - DNA, 20 bp, Artificial
  CRISPR gRNA sequence
gagttcctcagatatctagc

SEQ ID NO: 581585 - DNA, 20 bp, Artificial
  CRISPR gRNA sequence
ctcagatatctagctggctc

SEQ ID NO: 581586 - DNA, 20 bp, Artificial
  CRISPR gRNA sequence
agatatctagctggctccct

SEQ ID NO: 581587 - DNA, 20 bp, Artificial
  CRISPR gRNA sequence
gctggctccctccctcatct

SEQ ID NO: 581588 - DNA, 20 bp, Artificial
  CRISPR gRNA sequence
gctccctccctcatctcctt

SEQ ID NO: 581589 - DNA, 20 bp, Artificial
  CRISPR gRNA sequence
cctccctcatctccttcaag

SEQ ID NO: 581590 - DNA, 20 bp, Artificial
  CRISPR gRNA sequence
cctcatctccttcaagtctt

SEQ ID NO: 581591 - DNA, 20 bp, Artificial
  CRISPR gRNA sequence
atctccttcaagtctttgtc

SEQ ID NO: 581592 - DNA, 20 bp, Artificial
  CRISPR gRNA sequence
cttcaagtctttgtcagagg

SEQ ID NO: 581593 - DNA, 20 bp, Artificial
  CRISPR gRNA sequence
caagtctttgtcagaggccc

SEQ ID NO: 581594 - DNA, 20 bp, Artificial
  CRISPR gRNA sequence
aagtctttgtcagaggcccc

SEQ ID NO: 581595 - DNA, 20 bp, Artificial
  CRISPR gRNA sequence
tgtcagaggcccctgtctct

SEQ ID NO: 581596 - DNA, 20 bp, Artificial
  CRISPR gRNA sequence
gtcagaggcccctgtctctg

SEQ ID NO: 581597 - DNA, 20 bp, Artificial
  CRISPR gRNA sequence
tcagaggcccctgtctctgg

SEQ ID NO: 581598 - DNA, 20 bp, Artificial
  CRISPR gRNA sequence
tctctggggacttttcctga

SEQ ID NO: 581599 - DNA, 20 bp, Artificial
  CRISPR gRNA sequence
tggggacttttcctgacccg

SEQ ID NO: 581600 - DNA, 20 bp, Artificial
  CRISPR gRNA sequence
gggacttttcctgacccgtt

SEQ ID NO: 581601 - DNA, 20 bp, Artificial
  CRISPR gRNA sequence
ttcctgacccgtttaatctt

SEQ ID NO: 581602 - DNA, 20 bp, Artificial
  CRISPR gRNA sequence
tcctgacccgtttaatcttg

SEQ ID NO: 581603 - DNA, 20 bp, Artificial
  CRISPR gRNA sequence
cctgacccgtttaatcttgc

SEQ ID NO: 581604 - DNA, 20 bp, Artificial
  CRISPR gRNA sequence
ctgacccgtttaatcttgcc

SEQ ID NO: 581605 - DNA, 20 bp, Artificial
  CRISPR gRNA sequence
acccgtttaatcttgcctac

SEQ ID NO: 581606 - DNA, 20 bp, Artificial
  CRISPR gRNA sequence
aatcttgcctactcaccccc

SEQ ID NO: 581607 - DNA, 20 bp, Artificial
  CRISPR gRNA sequence
atcttgcctactcaccccca

SEQ ID NO: 581608 - DNA, 20 bp, Artificial
  CRISPR gRNA sequence
gcctactcacccccaactcc

SEQ ID NO: 581609 - DNA, 20 bp, Artificial
  CRISPR gRNA sequence
cctactcacccccaactccc

SEQ ID NO: 581610 - DNA, 20 bp, Artificial
  CRISPR gRNA sequence
ctcacccccaactcccagcc

SEQ ID NO: 581611 - DNA, 20 bp, Artificial
  CRISPR gRNA sequence
acccccaactcccagccctc

SEQ ID NO: 581612 - DNA, 20 bp, Artificial
  CRISPR gRNA sequence
ccagccctcccagtctcctt

SEQ ID NO: 581613 - DNA, 20 bp, Artificial
  CRISPR gRNA sequence
ccagtctccttcccgagaag

SEQ ID NO: 581614 - DNA, 20 bp, Artificial
  CRISPR gRNA sequence
cttcccgagaagccctccat

SEQ ID NO: 581615 - DNA, 20 bp, Artificial
  CRISPR gRNA sequence
cccgagaagccctccatgag

SEQ ID NO: 581616 - DNA, 20 bp, Artificial
  CRISPR gRNA sequence
ccgagaagccctccatgaga

SEQ ID NO: 581617 - DNA, 20 bp, Artificial
  CRISPR gRNA sequence
catgagagaggatatagtcc

SEQ ID NO: 581618 - DNA, 20 bp, Artificial
  CRISPR gRNA sequence
tacccctctctgccctcctg

SEQ ID NO: 581619 - DNA, 20 bp, Artificial
  CRISPR gRNA sequence
cccctctctgccctcctgac

SEQ ID NO: 581620 - DNA, 20 bp, Artificial
  CRISPR gRNA sequence
tctgccctcctgaccccagc

SEQ ID NO: 581621 - DNA, 20 bp, Artificial
  CRISPR gRNA sequence
tgccctcctgaccccagccc

SEQ ID NO: 581622 - DNA, 20 bp, Artificial
  CRISPR gRNA sequence
ccctcctgaccccagccccc

SEQ ID NO: 581623 - DNA, 20 bp, Artificial
  CRISPR gRNA sequence
ctgaccccagcccccattct

SEQ ID NO: 581624 - DNA, 20 bp, Artificial
  CRISPR gRNA sequence
accccagcccccattctgca

SEQ ID NO: 581625 - DNA, 20 bp, Artificial
  CRISPR gRNA sequence
tgcaaggatcttggctttca

SEQ ID NO: 581626 - DNA, 20 bp, Artificial
  CRISPR gRNA sequence
caaggatcttggctttcagc

SEQ ID NO: 581627 - DNA, 20 bp, Artificial
  CRISPR gRNA sequence
ggctttcagcagccgtagca

SEQ ID NO: 581628 - DNA, 20 bp, Artificial
  CRISPR gRNA sequence
gctttcagcagccgtagcat

SEQ ID NO: 581629 - DNA, 20 bp, Artificial
  CRISPR gRNA sequence
tcagcagccgtagcatttcc

SEQ ID NO: 581630 - DNA, 20 bp, Artificial
  CRISPR gRNA sequence
cagcagccgtagcatttccc

SEQ ID NO: 581631 - DNA, 20 bp, Artificial
  CRISPR gRNA sequence
agcagccgtagcatttccct

SEQ ID NO: 581632 - DNA, 20 bp, Artificial
  CRISPR gRNA sequence
ccctctcacaccctgggcct

SEQ ID NO: 581633 - DNA, 20 bp, Artificial
  CRISPR gRNA sequence
cctctcacaccctgggcctg

SEQ ID NO: 581634 - DNA, 20 bp, Artificial
  CRISPR gRNA sequence
tcacaccctgggcctgccca

SEQ ID NO: 581635 - DNA, 20 bp, Artificial
  CRISPR gRNA sequence
acaccctgggcctgcccaag

SEQ ID NO: 581636 - DNA, 20 bp, Artificial
  CRISPR gRNA sequence
ggcctgcccaaggggccagc

SEQ ID NO: 581637 - DNA, 20 bp, Artificial
  CRISPR gRNA sequence
cccaaggggccagctcacat

SEQ ID NO: 581638 - DNA, 20 bp, Artificial
  CRISPR gRNA sequence
acattctcggccaccatcct

SEQ ID NO: 581639 - DNA, 20 bp, Artificial
  CRISPR gRNA sequence
tcggccaccatcctcacttc

SEQ ID NO: 581640 - DNA, 20 bp, Artificial
  CRISPR gRNA sequence
ggccaccatcctcacttcgt

SEQ ID NO: 581641 - DNA, 20 bp, Artificial
  CRISPR gRNA sequence
acttcgtttgcctcctatat

SEQ ID NO: 581642 - DNA, 20 bp, Artificial
  CRISPR gRNA sequence
cgtttgcctcctatatctct

SEQ ID NO: 581643 - DNA, 20 bp, Artificial
  CRISPR gRNA sequence
gtttgcctcctatatctctg

SEQ ID NO: 581644 - DNA, 20 bp, Artificial
  CRISPR gRNA sequence
gcctcctatatctctggcca

SEQ ID NO: 581645 - DNA, 20 bp, Artificial
  CRISPR gRNA sequence
cctcctatatctctggccac

SEQ ID NO: 581646 - DNA, 20 bp, Artificial
  CRISPR gRNA sequence
ctatatctctggccactctc

SEQ ID NO: 581647 - DNA, 20 bp, Artificial
  CRISPR gRNA sequence
tatctctggccactctcttt

SEQ ID NO: 581648 - DNA, 20 bp, Artificial
  CRISPR gRNA sequence
tggccactctctttcatgga

SEQ ID NO: 581649 - DNA, 20 bp, Artificial
  CRISPR gRNA sequence
gccactctctttcatggagt

SEQ ID NO: 581650 - DNA, 20 bp, Artificial
  CRISPR gRNA sequence
tctttcatggagtgagtgac

SEQ ID NO: 581651 - DNA, 20 bp, Artificial
  CRISPR gRNA sequence
tttcatggagtgagtgacag

SEQ ID NO: 581652 - DNA, 20 bp, Artificial
  CRISPR gRNA sequence
tcatggagtgagtgacagta

SEQ ID NO: 581653 - DNA, 20 bp, Artificial
  CRISPR gRNA sequence
catggagtgagtgacagtaa

SEQ ID NO: 581654 - DNA, 20 bp, Artificial
  CRISPR gRNA sequence
atggagtgagtgacagtaag

SEQ ID NO: 581655 - DNA, 20 bp, Artificial
  CRISPR gRNA sequence
gggaaggtataaggagaatg

SEQ ID NO: 581656 - DNA, 20 bp, Artificial
  CRISPR gRNA sequence
tgatcctgagagagaaaact

SEQ ID NO: 581657 - DNA, 20 bp, Artificial
  CRISPR gRNA sequence
atcctgagagagaaaactag

SEQ ID NO: 581658 - DNA, 20 bp, Artificial
  CRISPR gRNA sequence
agagagaaaactagccccct

SEQ ID NO: 581659 - DNA, 20 bp, Artificial
  CRISPR gRNA sequence
gcccccttttccaggagggg

SEQ ID NO: 581660 - DNA, 20 bp, Artificial
  CRISPR gRNA sequence
ttccaggagggggacaggtg

SEQ ID NO: 581661 - DNA, 20 bp, Artificial
  CRISPR gRNA sequence
tccaggagggggacaggtgc

SEQ ID NO: 581662 - DNA, 20 bp, Artificial
  CRISPR gRNA sequence
ccaggagggggacaggtgct

SEQ ID NO: 581663 - DNA, 20 bp, Artificial
  CRISPR gRNA sequence
caggagggggacaggtgctg

SEQ ID NO: 581664 - DNA, 20 bp, Artificial
  CRISPR gRNA sequence
gggcagggaacaatgcctct

SEQ ID NO: 581665 - DNA, 20 bp, Artificial
  CRISPR gRNA sequence
tgctgatagaactggcctgg

SEQ ID NO: 581666 - DNA, 20 bp, Artificial
  CRISPR gRNA sequence
ctgatagaactggcctggtt

SEQ ID NO: 581667 - DNA, 20 bp, Artificial
  CRISPR gRNA sequence
atagaactggcctggtttat

SEQ ID NO: 581668 - DNA, 20 bp, Artificial
  CRISPR gRNA sequence
gcctggtttataattacgca

SEQ ID NO: 581669 - DNA, 20 bp, Artificial
  CRISPR gRNA sequence
gtttataattacgcaggagg

SEQ ID NO: 581670 - DNA, 20 bp, Artificial
  CRISPR gRNA sequence
ataattacgcaggaggtgta

SEQ ID NO: 581671 - DNA, 20 bp, Artificial
  CRISPR gRNA sequence
taattacgcaggaggtgtag

SEQ ID NO: 581672 - DNA, 20 bp, Artificial
  CRISPR gRNA sequence
cgcaggaggtgtagggaaca

SEQ ID NO: 581673 - DNA, 20 bp, Artificial
  CRISPR gRNA sequence
cgacccaagtctgcagggag

SEQ ID NO: 581674 - DNA, 20 bp, Artificial
  CRISPR gRNA sequence
cagggagcaaggggttatta

SEQ ID NO: 581675 - DNA, 20 bp, Artificial
  CRISPR gRNA sequence
ttaactatgggaacatcagt

SEQ ID NO: 581676 - DNA, 20 bp, Artificial
  CRISPR gRNA sequence
actatgggaacatcagtgca

SEQ ID NO: 581677 - DNA, 20 bp, Artificial
  CRISPR gRNA sequence
tgggaacatcagtgcaaggg

SEQ ID NO: 581678 - DNA, 20 bp, Artificial
  CRISPR gRNA sequence
accttaggaccatcactgca

SEQ ID NO: 581679 - DNA, 20 bp, Artificial
  CRISPR gRNA sequence
aggaccatcactgcaagggg

SEQ ID NO: 581680 - DNA, 20 bp, Artificial
  CRISPR gRNA sequence
ggaccatcactgcaaggggt

SEQ ID NO: 581681 - DNA, 20 bp, Artificial
  CRISPR gRNA sequence
caaggggtcattaaccttgg

SEQ ID NO: 581682 - DNA, 20 bp, Artificial
  CRISPR gRNA sequence
accttggggccatcactaga

SEQ ID NO: 581683 - DNA, 20 bp, Artificial
  CRISPR gRNA sequence
ggggccatcactagaatcag

SEQ ID NO: 581684 - DNA, 20 bp, Artificial
  CRISPR gRNA sequence
gggccatcactagaatcagc

SEQ ID NO: 581685 - DNA, 20 bp, Artificial
  CRISPR gRNA sequence
gaatcagctccccaggactc

SEQ ID NO: 581686 - DNA, 20 bp, Artificial
  CRISPR gRNA sequence
cccaggactccttcctgaca

SEQ ID NO: 581687 - DNA, 20 bp, Artificial
  CRISPR gRNA sequence
cttcctgacatgcatgctcc

SEQ ID NO: 581688 - DNA, 20 bp, Artificial
  CRISPR gRNA sequence
cctgacatgcatgctcctca

SEQ ID NO: 581689 - DNA, 20 bp, Artificial
  CRISPR gRNA sequence
ctgacatgcatgctcctcac

SEQ ID NO: 581690 - DNA, 20 bp, Artificial
  CRISPR gRNA sequence
acatgcatgctcctcacccc

SEQ ID NO: 581691 - DNA, 20 bp, Artificial
  CRISPR gRNA sequence
ctcaccccctcccttgctcc

SEQ ID NO: 581692 - DNA, 20 bp, Artificial
  CRISPR gRNA sequence
accccctcccttgctccctc

SEQ ID NO: 581693 - DNA, 20 bp, Artificial
  CRISPR gRNA sequence
ccttgctccctcccacatgc

SEQ ID NO: 581694 - DNA, 20 bp, Artificial
  CRISPR gRNA sequence
gctccctcccacatgccgtg

SEQ ID NO: 581695 - DNA, 20 bp, Artificial
  CRISPR gRNA sequence
ctccctcccacatgccgtga

SEQ ID NO: 581696 - DNA, 20 bp, Artificial
  CRISPR gRNA sequence
cctcccacatgccgtgacat

SEQ ID NO: 581697 - DNA, 20 bp, Artificial
  CRISPR gRNA sequence
ccacatgccgtgacatctgt

SEQ ID NO: 581698 - DNA, 20 bp, Artificial
  CRISPR gRNA sequence
ttaaacacctgctgttcaca

SEQ ID NO: 581699 - DNA, 20 bp, Artificial
  CRISPR gRNA sequence
aacacctgctgttcacaggg

SEQ ID NO: 581700 - DNA, 20 bp, Artificial
  CRISPR gRNA sequence
ctgttcacagggtccctgca

SEQ ID NO: 581701 - DNA, 20 bp, Artificial
  CRISPR gRNA sequence
ttcacagggtccctgcaggc

SEQ ID NO: 581702 - DNA, 20 bp, Artificial
  CRISPR gRNA sequence
acagggtccctgcaggcctc

SEQ ID NO: 581703 - DNA, 20 bp, Artificial
  CRISPR gRNA sequence
caggcctccaagcaggggac

SEQ ID NO: 581704 - DNA, 20 bp, Artificial
  CRISPR gRNA sequence
caagcaggggacctcatccc

SEQ ID NO: 581705 - DNA, 20 bp, Artificial
  CRISPR gRNA sequence
atcccaccttggtgcctccc

SEQ ID NO: 581706 - DNA, 20 bp, Artificial
  CRISPR gRNA sequence
ggtgcctcccctggctgtcc

SEQ ID NO: 581707 - DNA, 20 bp, Artificial
  CRISPR gRNA sequence
gtgcctcccctggctgtcca

SEQ ID NO: 581708 - DNA, 20 bp, Artificial
  CRISPR gRNA sequence
ccctggctgtccaacacacc

SEQ ID NO: 581709 - DNA, 20 bp, Artificial
  CRISPR gRNA sequence
gctgtccaacacacccaagc

SEQ ID NO: 581710 - DNA, 20 bp, Artificial
  CRISPR gRNA sequence
tccaacacacccaagccatt

SEQ ID NO: 581711 - DNA, 20 bp, Artificial
  CRISPR gRNA sequence
ttgggtctcagatgtgtccc

SEQ ID NO: 581712 - DNA, 20 bp, Artificial
  CRISPR gRNA sequence
tgggtctcagatgtgtccca

SEQ ID NO: 581713 - DNA, 20 bp, Artificial
  CRISPR gRNA sequence
gggtctcagatgtgtcccac

SEQ ID NO: 581714 - DNA, 20 bp, Artificial
  CRISPR gRNA sequence
ggtctcagatgtgtcccacc

SEQ ID NO: 581715 - DNA, 20 bp, Artificial
  CRISPR gRNA sequence
agatgtgtcccaccaactca

SEQ ID NO: 581716 - DNA, 20 bp, Artificial
  CRISPR gRNA sequence
agaagcctcaaccagcgaaa

SEQ ID NO: 581717 - DNA, 20 bp, Artificial
  CRISPR gRNA sequence
aaccagcgaaagttttgttt

SEQ ID NO: 581718 - DNA, 20 bp, Artificial
  CRISPR gRNA sequence
tgttttgaactaatggtggg

SEQ ID NO: 581719 - DNA, 20 bp, Artificial
  CRISPR gRNA sequence
gttttgaactaatggtgggg

SEQ ID NO: 581720 - DNA, 20 bp, Artificial
  CRISPR gRNA sequence
ttttgaactaatggtgggga

SEQ ID NO: 581721 - DNA, 20 bp, Artificial
  CRISPR gRNA sequence
tgaactaatggtggggaggg

SEQ ID NO: 581722 - DNA, 20 bp, Artificial
  CRISPR gRNA sequence
gaactaatggtggggagggt

SEQ ID NO: 581723 - DNA, 20 bp, Artificial
  CRISPR gRNA sequence
aactaatggtggggagggtt

SEQ ID NO: 581724 - DNA, 20 bp, Artificial
  CRISPR gRNA sequence
atggtggggagggttgggtg

SEQ ID NO: 581725 - DNA, 20 bp, Artificial
  CRISPR gRNA sequence
ggtgttttttttttttttta

SEQ ID NO: 581726 - DNA, 20 bp, Artificial
  CRISPR gRNA sequence
ttttttttttttaattgttg

SEQ ID NO: 581727 - DNA, 20 bp, Artificial
  CRISPR gRNA sequence
tttttttttttaattgttgt

SEQ ID NO: 581728 - DNA, 20 bp, Artificial
  CRISPR gRNA sequence
ttttttttttaattgttgtt

SEQ ID NO: 581729 - DNA, 20 bp, Artificial
  CRISPR gRNA sequence
tttttttttaattgttgttg

SEQ ID NO: 581730 - DNA, 20 bp, Artificial
  CRISPR gRNA sequence
ttttttttaattgttgttgg

SEQ ID NO: 581731 - DNA, 20 bp, Artificial
  CRISPR gRNA sequence
tttttttaattgttgttggc

SEQ ID NO: 581732 - DNA, 20 bp, Artificial
  CRISPR gRNA sequence
ttttttaattgttgttggct

SEQ ID NO: 581733 - DNA, 20 bp, Artificial
  CRISPR gRNA sequence
tttttaattgttgttggctg

SEQ ID NO: 581734 - DNA, 20 bp, Artificial
  CRISPR gRNA sequence
ttttaattgttgttggctga

SEQ ID NO: 581735 - DNA, 20 bp, Artificial
  CRISPR gRNA sequence
tttaattgttgttggctgat

SEQ ID NO: 581736 - DNA, 20 bp, Artificial
  CRISPR gRNA sequence
ttaattgttgttggctgatt

SEQ ID NO: 581737 - DNA, 20 bp, Artificial
  CRISPR gRNA sequence
taattgttgttggctgattt

SEQ ID NO: 581738 - DNA, 20 bp, Artificial
  CRISPR gRNA sequence
aattgttgttggctgatttt

SEQ ID NO: 581739 - DNA, 20 bp, Artificial
  CRISPR gRNA sequence
attgttgttggctgattttt

SEQ ID NO: 581740 - DNA, 20 bp, Artificial
  CRISPR gRNA sequence
ttgttggctgatttttttaa

SEQ ID NO: 581741 - DNA, 20 bp, Artificial
  CRISPR gRNA sequence
ttggctgatttttttaaggt

SEQ ID NO: 581742 - DNA, 20 bp, Artificial
  CRISPR gRNA sequence
gctgatttttttaaggtctt

SEQ ID NO: 581743 - DNA, 20 bp, Artificial
  CRISPR gRNA sequence
atttttttaaggtctttttt

SEQ ID NO: 581744 - DNA, 20 bp, Artificial
  CRISPR gRNA sequence
ttttaaggtctttttttttc

SEQ ID NO: 581745 - DNA, 20 bp, Artificial
  CRISPR gRNA sequence
tttaaggtctttttttttct

SEQ ID NO: 581746 - DNA, 20 bp, Artificial
  CRISPR gRNA sequence
ttaaggtctttttttttcta

SEQ ID NO: 581747 - DNA, 20 bp, Artificial
  CRISPR gRNA sequence
taaggtctttttttttctat

SEQ ID NO: 581748 - DNA, 20 bp, Artificial
  CRISPR gRNA sequence
aaggtctttttttttctatt

SEQ ID NO: 581749 - DNA, 20 bp, Artificial
  CRISPR gRNA sequence
aggtctttttttttctattc

SEQ ID NO: 581750 - DNA, 20 bp, Artificial
  CRISPR gRNA sequence
tttttttctattcttttttt

SEQ ID NO: 581751 - DNA, 20 bp, Artificial
  CRISPR gRNA sequence
ttttttctattctttttttt

SEQ ID NO: 581752 - DNA, 20 bp, Artificial
  CRISPR gRNA sequence
tttttctattcttttttttt

SEQ ID NO: 581753 - DNA, 20 bp, Artificial
  CRISPR gRNA sequence
ttttctattctttttttttt

SEQ ID NO: 581754 - DNA, 20 bp, Artificial
  CRISPR gRNA sequence
tttctattcttttttttttt

SEQ ID NO: 581755 - DNA, 20 bp, Artificial
  CRISPR gRNA sequence
ttctattctttttttttttt

SEQ ID NO: 581756 - DNA, 20 bp, Artificial
  CRISPR gRNA sequence
tctattcttttttttttttt

SEQ ID NO: 581757 - DNA, 20 bp, Artificial
  CRISPR gRNA sequence
ctattctttttttttttttt

SEQ ID NO: 581758 - DNA, 20 bp, Artificial
  CRISPR gRNA sequence
tattcttttttttttttttt

SEQ ID NO: 581759 - DNA, 20 bp, Artificial
  CRISPR gRNA sequence
ttctttttttttttttttct

SEQ ID NO: 581760 - DNA, 20 bp, Artificial
  CRISPR gRNA sequence
tttttttttttttttcttgt

SEQ ID NO: 581761 - DNA, 20 bp, Artificial
  CRISPR gRNA sequence
tttttttttttttcttgtct

SEQ ID NO: 581762 - DNA, 20 bp, Artificial
  CRISPR gRNA sequence
ttttttttttttcttgtctt

SEQ ID NO: 581763 - DNA, 20 bp, Artificial
  CRISPR gRNA sequence
tttttttttttcttgtcttc

SEQ ID NO: 581764 - DNA, 20 bp, Artificial
  CRISPR gRNA sequence
ttttttttttcttgtcttca

SEQ ID NO: 581765 - DNA, 20 bp, Artificial
  CRISPR gRNA sequence
tttttttttcttgtcttcac

SEQ ID NO: 581766 - DNA, 20 bp, Artificial
  CRISPR gRNA sequence
ttttttttcttgtcttcaca

SEQ ID NO: 581767 - DNA, 20 bp, Artificial
  CRISPR gRNA sequence
tttttttcttgtcttcacaa

SEQ ID NO: 581768 - DNA, 20 bp, Artificial
  CRISPR gRNA sequence
ttttttcttgtcttcacaaa

SEQ ID NO: 581769 - DNA, 20 bp, Artificial
  CRISPR gRNA sequence
tttttcttgtcttcacaaag

SEQ ID NO: 581770 - DNA, 20 bp, Artificial
  CRISPR gRNA sequence
ttttcttgtcttcacaaagc

SEQ ID NO: 581771 - DNA, 20 bp, Artificial
  CRISPR gRNA sequence
tttcttgtcttcacaaagcc

SEQ ID NO: 581772 - DNA, 20 bp, Artificial
  CRISPR gRNA sequence
ttcttgtcttcacaaagcca

SEQ ID NO: 581773 - DNA, 20 bp, Artificial
  CRISPR gRNA sequence
tcttgtcttcacaaagccag

SEQ ID NO: 581774 - DNA, 20 bp, Artificial
  CRISPR gRNA sequence
cttgtcttcacaaagccagg

SEQ ID NO: 581775 - DNA, 20 bp, Artificial
  CRISPR gRNA sequence
ttgtcttcacaaagccaggc

SEQ ID NO: 581776 - DNA, 20 bp, Artificial
  CRISPR gRNA sequence
gtcttcacaaagccaggcca

SEQ ID NO: 581777 - DNA, 20 bp, Artificial
  CRISPR gRNA sequence
tcttcacaaagccaggccat

SEQ ID NO: 581778 - DNA, 20 bp, Artificial
  CRISPR gRNA sequence
cacaaagccaggccatcagg

SEQ ID NO: 581779 - DNA, 20 bp, Artificial
  CRISPR gRNA sequence
acaaagccaggccatcaggc

SEQ ID NO: 581780 - DNA, 20 bp, Artificial
  CRISPR gRNA sequence
tgggcttttccagaagggtg

SEQ ID NO: 581781 - DNA, 20 bp, Artificial
  CRISPR gRNA sequence
ggcttttccagaagggtgag

SEQ ID NO: 581782 - DNA, 20 bp, Artificial
  CRISPR gRNA sequence
ttccagaagggtgagtctga

SEQ ID NO: 581783 - DNA, 20 bp, Artificial
  CRISPR gRNA sequence
tccagaagggtgagtctgag

SEQ ID NO: 581784 - DNA, 20 bp, Artificial
  CRISPR gRNA sequence
ccagaagggtgagtctgagt

SEQ ID NO: 581785 - DNA, 20 bp, Artificial
  CRISPR gRNA sequence
cagaagggtgagtctgagtt

SEQ ID NO: 581786 - DNA, 20 bp, Artificial
  CRISPR gRNA sequence
agttgaggaaagaggccctc

SEQ ID NO: 581787 - DNA, 20 bp, Artificial
  CRISPR gRNA sequence
aggaaagaggccctcctttt

SEQ ID NO: 581788 - DNA, 20 bp, Artificial
  CRISPR gRNA sequence
ctttttacgagggcttagaa

SEQ ID NO: 581789 - DNA, 20 bp, Artificial
  CRISPR gRNA sequence
tttacgagggcttagaaggt

SEQ ID NO: 581790 - DNA, 20 bp, Artificial
  CRISPR gRNA sequence
ttacgagggcttagaaggtt

SEQ ID NO: 581791 - DNA, 20 bp, Artificial
  CRISPR gRNA sequence
tacgagggcttagaaggttg

SEQ ID NO: 581792 - DNA, 20 bp, Artificial
  CRISPR gRNA sequence
acgagggcttagaaggttgg

SEQ ID NO: 581793 - DNA, 20 bp, Artificial
  CRISPR gRNA sequence
cgagggcttagaaggttggg

SEQ ID NO: 581794 - DNA, 20 bp, Artificial
  CRISPR gRNA sequence
agaaggttgggggaggaaag

SEQ ID NO: 581795 - DNA, 20 bp, Artificial
  CRISPR gRNA sequence
gaaggttgggggaggaaagg

SEQ ID NO: 581796 - DNA, 20 bp, Artificial
  CRISPR gRNA sequence
ggggaggaaagggggcaaag

SEQ ID NO: 581797 - DNA, 20 bp, Artificial
  CRISPR gRNA sequence
ggccaccagatttgtaccat

SEQ ID NO: 581798 - DNA, 20 bp, Artificial
  CRISPR gRNA sequence
gccaccagatttgtaccatg

SEQ ID NO: 581799 - DNA, 20 bp, Artificial
  CRISPR gRNA sequence
gtaccatgtaaataaaaagc

SEQ ID NO: 581800 - DNA, 20 bp, Artificial
  CRISPR gRNA sequence
taccatgtaaataaaaagcc

SEQ ID NO: 581801 - DNA, 20 bp, Artificial
  CRISPR gRNA sequence
tccaatttctcttccccagg

SEQ ID NO: 581802 - DNA, 20 bp, Artificial
  CRISPR gRNA sequence
ccaatttctcttccccaggt

SEQ ID NO: 581803 - DNA, 20 bp, Artificial
  CRISPR gRNA sequence
caatttctcttccccaggtc

SEQ ID NO: 581804 - DNA, 20 bp, Artificial
  CRISPR gRNA sequence
ctcttccccaggtctgaagc

SEQ ID NO: 581805 - DNA, 20 bp, Artificial
  CRISPR gRNA sequence
tcttccccaggtctgaagcc

SEQ ID NO: 581806 - DNA, 20 bp, Artificial
  CRISPR gRNA sequence
ttccccaggtctgaagccag

SEQ ID NO: 581807 - DNA, 20 bp, Artificial
  CRISPR gRNA sequence
ccccaggtctgaagccagtc

SEQ ID NO: 581808 - DNA, 20 bp, Artificial
  CRISPR gRNA sequence
cccaggtctgaagccagtct

SEQ ID NO: 581809 - DNA, 20 bp, Artificial
  CRISPR gRNA sequence
aagccagtcttgtagagggc

SEQ ID NO: 581810 - DNA, 20 bp, Artificial
  CRISPR gRNA sequence
gtagagggctggagtggttg

SEQ ID NO: 581811 - DNA, 20 bp, Artificial
  CRISPR gRNA sequence
tagagggctggagtggttgt

SEQ ID NO: 581812 - DNA, 20 bp, Artificial
  CRISPR gRNA sequence
gagtggttgttggacgacta

SEQ ID NO: 581813 - DNA, 20 bp, Artificial
  CRISPR gRNA sequence
ttggacgactagaaccctgg

SEQ ID NO: 581814 - DNA, 20 bp, Artificial
  CRISPR gRNA sequence
gacgactagaaccctgggct

SEQ ID NO: 581815 - DNA, 20 bp, Artificial
  CRISPR gRNA sequence
gaaccctgggctttgcaggg

SEQ ID NO: 581816 - DNA, 20 bp, Artificial
  CRISPR gRNA sequence
ggctttgcagggtgctggga

SEQ ID NO: 581817 - DNA, 20 bp, Artificial
  CRISPR gRNA sequence
tgcagggtgctgggagctgg

SEQ ID NO: 581818 - DNA, 20 bp, Artificial
  CRISPR gRNA sequence
gcagggtgctgggagctgga

SEQ ID NO: 581819 - DNA, 20 bp, Artificial
  CRISPR gRNA sequence
cagggtgctgggagctggaa

SEQ ID NO: 581820 - DNA, 20 bp, Artificial
  CRISPR gRNA sequence
ggagctggaagtcttcacca

SEQ ID NO: 581821 - DNA, 20 bp, Artificial
  CRISPR gRNA sequence
gaagtcttcaccatggcctg

SEQ ID NO: 581822 - DNA, 20 bp, Artificial
  CRISPR gRNA sequence
caccatggcctgtcaggaga

SEQ ID NO: 581823 - DNA, 20 bp, Artificial
  CRISPR gRNA sequence
accatggcctgtcaggagaa

SEQ ID NO: 581824 - DNA, 20 bp, Artificial
  CRISPR gRNA sequence
tcaggagaagcccctggggg

SEQ ID NO: 581825 - DNA, 20 bp, Artificial
  CRISPR gRNA sequence
ggggctggtctaccatgctg

SEQ ID NO: 581826 - DNA, 20 bp, Artificial
  CRISPR gRNA sequence
gtctaccatgctgaccagtg

SEQ ID NO: 581827 - DNA, 20 bp, Artificial
  CRISPR gRNA sequence
ccatgctgaccagtggttga

SEQ ID NO: 581828 - DNA, 20 bp, Artificial
  CRISPR gRNA sequence
accagtggttgaatagagtg

SEQ ID NO: 581829 - DNA, 20 bp, Artificial
  CRISPR gRNA sequence
aatagagtgcctgctgaggt

SEQ ID NO: 581830 - DNA, 20 bp, Artificial
  CRISPR gRNA sequence
ctgaggtcaagagatgcagc

SEQ ID NO: 581831 - DNA, 20 bp, Artificial
  CRISPR gRNA sequence
aggtcaagagatgcagccgc

SEQ ID NO: 581832 - DNA, 20 bp, Artificial
  CRISPR gRNA sequence
ctggacaacctaaaagcctc

SEQ ID NO: 581833 - DNA, 20 bp, Artificial
  CRISPR gRNA sequence
gacaacctaaaagcctcaca

SEQ ID NO: 581834 - DNA, 20 bp, Artificial
  CRISPR gRNA sequence
aaagcctcacaagcttcaag

SEQ ID NO: 581835 - DNA, 20 bp, Artificial
  CRISPR gRNA sequence
acaagcttcaagtctccaag

SEQ ID NO: 581836 - DNA, 20 bp, Artificial
  CRISPR gRNA sequence
caagtctccaaggactctcc

SEQ ID NO: 581837 - DNA, 20 bp, Artificial
  CRISPR gRNA sequence
aagtctccaaggactctcca

SEQ ID NO: 581838 - DNA, 20 bp, Artificial
  CRISPR gRNA sequence
caaggactctccaaatccca

SEQ ID NO: 581839 - DNA, 20 bp, Artificial
  CRISPR gRNA sequence
tccaaatcccaggatctccc

SEQ ID NO: 581840 - DNA, 20 bp, Artificial
  CRISPR gRNA sequence
caaatcccaggatctccctg

SEQ ID NO: 581841 - DNA, 20 bp, Artificial
  CRISPR gRNA sequence
cctgccatcacatcctagaa

SEQ ID NO: 581842 - DNA, 20 bp, Artificial
  CRISPR gRNA sequence
ccatcacatcctagaattta

SEQ ID NO: 581843 - DNA, 20 bp, Artificial
  CRISPR gRNA sequence
gaatttaaaacctgagaaca

SEQ ID NO: 581844 - DNA, 20 bp, Artificial
  CRISPR gRNA sequence
aaaacctgagaacatcaagt

SEQ ID NO: 581845 - DNA, 20 bp, Artificial
  CRISPR gRNA sequence
aaacctgagaacatcaagtt

SEQ ID NO: 581846 - DNA, 20 bp, Artificial
  CRISPR gRNA sequence
agaacatcaagttcaggaaa

SEQ ID NO: 581847 - DNA, 20 bp, Artificial
  CRISPR gRNA sequence
aggaaagcttggggatttca

SEQ ID NO: 581848 - DNA, 20 bp, Artificial
  CRISPR gRNA sequence
ggggatttcaaagcccagca

SEQ ID NO: 581849 - DNA, 20 bp, Artificial
  CRISPR gRNA sequence
gggatttcaaagcccagcac

SEQ ID NO: 581850 - DNA, 20 bp, Artificial
  CRISPR gRNA sequence
caaagcccagcaccaaagaa

SEQ ID NO: 581851 - DNA, 20 bp, Artificial
  CRISPR gRNA sequence
aaagcccagcaccaaagaaa

SEQ ID NO: 581852 - DNA, 20 bp, Artificial
  CRISPR gRNA sequence
gccagctctgtgatcttggg

SEQ ID NO: 581853 - DNA, 20 bp, Artificial
  CRISPR gRNA sequence
tgtgatcttgggcaagttgc

SEQ ID NO: 581854 - DNA, 20 bp, Artificial
  CRISPR gRNA sequence
tgatcttgggcaagttgctt

SEQ ID NO: 581855 - DNA, 20 bp, Artificial
  CRISPR gRNA sequence
gggcaagttgcttgactact

SEQ ID NO: 581856 - DNA, 20 bp, Artificial
  CRISPR gRNA sequence
ggcaagttgcttgactactt

SEQ ID NO: 581857 - DNA, 20 bp, Artificial
  CRISPR gRNA sequence
cttgactacttatacctccg

SEQ ID NO: 581858 - DNA, 20 bp, Artificial
  CRISPR gRNA sequence
gactacttatacctccgttt

SEQ ID NO: 581859 - DNA, 20 bp, Artificial
  CRISPR gRNA sequence
actacttatacctccgtttc

SEQ ID NO: 581860 - DNA, 20 bp, Artificial
  CRISPR gRNA sequence
cttatacctccgtttccctc

SEQ ID NO: 581861 - DNA, 20 bp, Artificial
  CRISPR gRNA sequence
atacctccgtttccctcatc

SEQ ID NO: 581862 - DNA, 20 bp, Artificial
  CRISPR gRNA sequence
tacctccgtttccctcatct

SEQ ID NO: 581863 - DNA, 20 bp, Artificial
  CRISPR gRNA sequence
cgtttccctcatctgtataa

SEQ ID NO: 581864 - DNA, 20 bp, Artificial
  CRISPR gRNA sequence
ccctcatctgtataacagga

SEQ ID NO: 581865 - DNA, 20 bp, Artificial
  CRISPR gRNA sequence
cctcatctgtataacaggaa

SEQ ID NO: 581866 - DNA, 20 bp, Artificial
  CRISPR gRNA sequence
atctgtataacaggaataca

SEQ ID NO: 581867 - DNA, 20 bp, Artificial
  CRISPR gRNA sequence
tataacaggaatacaataat

SEQ ID NO: 581868 - DNA, 20 bp, Artificial
  CRISPR gRNA sequence
aaggggccatggtgaggatt

SEQ ID NO: 581869 - DNA, 20 bp, Artificial
  CRISPR gRNA sequence
aacatgatcacttgtgagac

SEQ ID NO: 581870 - DNA, 20 bp, Artificial
  CRISPR gRNA sequence
gtgagacatgttcagcactg

SEQ ID NO: 581871 - DNA, 20 bp, Artificial
  CRISPR gRNA sequence
tgagacatgttcagcactgt

SEQ ID NO: 581872 - DNA, 20 bp, Artificial
  CRISPR gRNA sequence
agcactgtatctgacccatg

SEQ ID NO: 581873 - DNA, 20 bp, Artificial
  CRISPR gRNA sequence
tatctgacccatggaaaatt

SEQ ID NO: 581874 - DNA, 20 bp, Artificial
  CRISPR gRNA sequence
acccatggaaaattcaagat

SEQ ID NO: 581875 - DNA, 20 bp, Artificial
  CRISPR gRNA sequence
aagataaacatcagctactg

SEQ ID NO: 581876 - DNA, 20 bp, Artificial
  CRISPR gRNA sequence
ctgagatgatggcggatatt

SEQ ID NO: 581877 - DNA, 20 bp, Artificial
  CRISPR gRNA sequence
agatgatggcggatatttgg

SEQ ID NO: 581878 - DNA, 20 bp, Artificial
  CRISPR gRNA sequence
ggaatcctaaatccttggaa

SEQ ID NO: 581879 - DNA, 20 bp, Artificial
  CRISPR gRNA sequence
gaatcctaaatccttggaaa

SEQ ID NO: 581880 - DNA, 20 bp, Artificial
  CRISPR gRNA sequence
aatccttggaaactggggct

SEQ ID NO: 581881 - DNA, 20 bp, Artificial
  CRISPR gRNA sequence
ggaaactggggctttttgaa

SEQ ID NO: 581882 - DNA, 20 bp, Artificial
  CRISPR gRNA sequence
gaaactggggctttttgaag

SEQ ID NO: 581883 - DNA, 20 bp, Artificial
  CRISPR gRNA sequence
gggctttttgaagtaaaaga

SEQ ID NO: 581884 - DNA, 20 bp, Artificial
  CRISPR gRNA sequence
tttgaagtaaaagaccccaa

SEQ ID NO: 581885 - DNA, 20 bp, Artificial
  CRISPR gRNA sequence
ttgaagtaaaagaccccaaa

SEQ ID NO: 581886 - DNA, 20 bp, Artificial
  CRISPR gRNA sequence
tgaagtaaaagaccccaaag

SEQ ID NO: 581887 - DNA, 20 bp, Artificial
  CRISPR gRNA sequence
gaagtaaaagaccccaaagg

SEQ ID NO: 581888 - DNA, 20 bp, Artificial
  CRISPR gRNA sequence
aagtaaaagaccccaaaggc

SEQ ID NO: 581889 - DNA, 20 bp, Artificial
  CRISPR gRNA sequence
agggcctcagaagcatcagg

SEQ ID NO: 581890 - DNA, 20 bp, Artificial
  CRISPR gRNA sequence
agaagcatcaggccatgatg

SEQ ID NO: 581891 - DNA, 20 bp, Artificial
  CRISPR gRNA sequence
ctgaaacaagagggtcaggg

SEQ ID NO: 581892 - DNA, 20 bp, Artificial
  CRISPR gRNA sequence
aaacaagagggtcagggtcc

SEQ ID NO: 581893 - DNA, 20 bp, Artificial
  CRISPR gRNA sequence
tggggttcatcgtgaggatg

SEQ ID NO: 581894 - DNA, 20 bp, Artificial
  CRISPR gRNA sequence
gggttcatcgtgaggatgga

SEQ ID NO: 581895 - DNA, 20 bp, Artificial
  CRISPR gRNA sequence
atcgtgaggatggatgcatt

SEQ ID NO: 581896 - DNA, 20 bp, Artificial
  CRISPR gRNA sequence
atattggggacctgctaggg

SEQ ID NO: 581897 - DNA, 20 bp, Artificial
  CRISPR gRNA sequence
gggacctgctagggaccttc

SEQ ID NO: 581898 - DNA, 20 bp, Artificial
  CRISPR gRNA sequence
ctagggaccttcccagtggg

SEQ ID NO: 581899 - DNA, 20 bp, Artificial
  CRISPR gRNA sequence
gggaccttcccagtgggaca

SEQ ID NO: 581900 - DNA, 20 bp, Artificial
  CRISPR gRNA sequence
cccagtgggacagtggctgg

SEQ ID NO: 581901 - DNA, 20 bp, Artificial
  CRISPR gRNA sequence
ccagtgggacagtggctggg

SEQ ID NO: 581902 - DNA, 20 bp, Artificial
  CRISPR gRNA sequence
ggtcagggcactcaagccct

SEQ ID NO: 581903 - DNA, 20 bp, Artificial
  CRISPR gRNA sequence
aagccctaaaacgtgatgag

SEQ ID NO: 581904 - DNA, 20 bp, Artificial
  CRISPR gRNA sequence
aaacgtgatgaggcgagact

SEQ ID NO: 581905 - DNA, 20 bp, Artificial
  CRISPR gRNA sequence
ttctctctttcctcattcag

SEQ ID NO: 581906 - DNA, 20 bp, Artificial
  CRISPR gRNA sequence
tctctctttcctcattcagt

SEQ ID NO: 581907 - DNA, 20 bp, Artificial
  CRISPR gRNA sequence
ctctctttcctcattcagta

SEQ ID NO: 581908 - DNA, 20 bp, Artificial
  CRISPR gRNA sequence
tctctttcctcattcagtaa

SEQ ID NO: 581909 - DNA, 20 bp, Artificial
  CRISPR gRNA sequence
tctttcctcattcagtaact

SEQ ID NO: 581910 - DNA, 20 bp, Artificial
  CRISPR gRNA sequence
tttcctcattcagtaactgt

SEQ ID NO: 581911 - DNA, 20 bp, Artificial
  CRISPR gRNA sequence
tcctcattcagtaactgtca

SEQ ID NO: 581912 - DNA, 20 bp, Artificial
  CRISPR gRNA sequence
cctcattcagtaactgtcag

SEQ ID NO: 581913 - DNA, 20 bp, Artificial
  CRISPR gRNA sequence
ctcattcagtaactgtcagt

SEQ ID NO: 581914 - DNA, 20 bp, Artificial
  CRISPR gRNA sequence
attcagtaactgtcagtaga

SEQ ID NO: 581915 - DNA, 20 bp, Artificial
  CRISPR gRNA sequence
agtaactgtcagtagattct

SEQ ID NO: 581916 - DNA, 20 bp, Artificial
  CRISPR gRNA sequence
tcagtagattctgggagcca

SEQ ID NO: 581917 - DNA, 20 bp, Artificial
  CRISPR gRNA sequence
tgggagccagggattctccg

SEQ ID NO: 581918 - DNA, 20 bp, Artificial
  CRISPR gRNA sequence
ggagccagggattctccgac

SEQ ID NO: 581919 - DNA, 20 bp, Artificial
  CRISPR gRNA sequence
tccgactcttcaagtccatg

SEQ ID NO: 581920 - DNA, 20 bp, Artificial
  CRISPR gRNA sequence
cgactcttcaagtccatgaa

SEQ ID NO: 581921 - DNA, 20 bp, Artificial
  CRISPR gRNA sequence
ttcaagtccatgaattttag

SEQ ID NO: 581922 - DNA, 20 bp, Artificial
  CRISPR gRNA sequence
caagtccatgaattttaggg

SEQ ID NO: 581923 - DNA, 20 bp, Artificial
  CRISPR gRNA sequence
aagtccatgaattttagggg

SEQ ID NO: 581924 - DNA, 20 bp, Artificial
  CRISPR gRNA sequence
taggggatgacagtgggctc

SEQ ID NO: 581925 - DNA, 20 bp, Artificial
  CRISPR gRNA sequence
aggggatgacagtgggctct

SEQ ID NO: 581926 - DNA, 20 bp, Artificial
  CRISPR gRNA sequence
ggggatgacagtgggctctc

SEQ ID NO: 581927 - DNA, 20 bp, Artificial
  CRISPR gRNA sequence
tccgctttctcctccatgaa

SEQ ID NO: 581928 - DNA, 20 bp, Artificial
  CRISPR gRNA sequence
cgctttctcctccatgaagt

SEQ ID NO: 581929 - DNA, 20 bp, Artificial
  CRISPR gRNA sequence
tctcctccatgaagtaactt

SEQ ID NO: 581930 - DNA, 20 bp, Artificial
  CRISPR gRNA sequence
ctcctccatgaagtaactta

SEQ ID NO: 581931 - DNA, 20 bp, Artificial
  CRISPR gRNA sequence
tcctccatgaagtaacttac

SEQ ID NO: 581932 - DNA, 20 bp, Artificial
  CRISPR gRNA sequence
ctccatgaagtaacttacat

SEQ ID NO: 581933 - DNA, 20 bp, Artificial
  CRISPR gRNA sequence
catgaagtaacttacatgcc

SEQ ID NO: 581934 - DNA, 20 bp, Artificial
  CRISPR gRNA sequence
acatgcccctcaccctctgt

SEQ ID NO: 581935 - DNA, 20 bp, Artificial
  CRISPR gRNA sequence
catgcccctcaccctctgtg

SEQ ID NO: 581936 - DNA, 20 bp, Artificial
  CRISPR gRNA sequence
accctctgtgggaggggtgt

SEQ ID NO: 581937 - DNA, 20 bp, Artificial
  CRISPR gRNA sequence
tgtgggaggggtgttgcagg

SEQ ID NO: 581938 - DNA, 20 bp, Artificial
  CRISPR gRNA sequence
tgggaggggtgttgcagggg

SEQ ID NO: 581939 - DNA, 20 bp, Artificial
  CRISPR gRNA sequence
cagggggtgcagaactcccc

SEQ ID NO: 581940 - DNA, 20 bp, Artificial
  CRISPR gRNA sequence
ccctcgccgggtagttcaag

SEQ ID NO: 581941 - DNA, 20 bp, Artificial
  CRISPR gRNA sequence
gccgggtagttcaagcaatg

SEQ ID NO: 581942 - DNA, 20 bp, Artificial
  CRISPR gRNA sequence
aagcaatggggaccatatca

SEQ ID NO: 581943 - DNA, 20 bp, Artificial
  CRISPR gRNA sequence
catctatagggaaactgagg

SEQ ID NO: 581944 - DNA, 20 bp, Artificial
  CRISPR gRNA sequence
tagggaaactgaggcctgga

SEQ ID NO: 581945 - DNA, 20 bp, Artificial
  CRISPR gRNA sequence
aggcctggagtagggcgagg

SEQ ID NO: 581946 - DNA, 20 bp, Artificial
  CRISPR gRNA sequence
gagtagggcgaggcctctgg

SEQ ID NO: 581947 - DNA, 20 bp, Artificial
  CRISPR gRNA sequence
tgggaacccagccctattct

SEQ ID NO: 581948 - DNA, 20 bp, Artificial
  CRISPR gRNA sequence
ggaacccagccctattctgt

SEQ ID NO: 581949 - DNA, 20 bp, Artificial
  CRISPR gRNA sequence
ttctgtctctttccctggca

SEQ ID NO: 581950 - DNA, 20 bp, Artificial
  CRISPR gRNA sequence
tgtctctttccctggcattt

SEQ ID NO: 581951 - DNA, 20 bp, Artificial
  CRISPR gRNA sequence
tctctttccctggcatttcc

SEQ ID NO: 581952 - DNA, 20 bp, Artificial
  CRISPR gRNA sequence
tttccctggcatttcccatc

SEQ ID NO: 581953 - DNA, 20 bp, Artificial
  CRISPR gRNA sequence
tccctggcatttcccatcca

SEQ ID NO: 581954 - DNA, 20 bp, Artificial
  CRISPR gRNA sequence
ccctggcatttcccatccac

SEQ ID NO: 581955 - DNA, 20 bp, Artificial
  CRISPR gRNA sequence
cctggcatttcccatccaca

SEQ ID NO: 581956 - DNA, 20 bp, Artificial
  CRISPR gRNA sequence
gcatttcccatccacacata

SEQ ID NO: 581957 - DNA, 20 bp, Artificial
  CRISPR gRNA sequence
cccatccacacatagagctt

SEQ ID NO: 581958 - DNA, 20 bp, Artificial
  CRISPR gRNA sequence
ccatccacacatagagcttc

SEQ ID NO: 581959 - DNA, 20 bp, Artificial
  CRISPR gRNA sequence
cagattctctttctttcccc

SEQ ID NO: 581960 - DNA, 20 bp, Artificial
  CRISPR gRNA sequence
agattctctttctttcccca

SEQ ID NO: 581961 - DNA, 20 bp, Artificial
  CRISPR gRNA sequence
tctttctttccccagagacc

SEQ ID NO: 581962 - DNA, 20 bp, Artificial
  CRISPR gRNA sequence
tttctttccccagagaccct

SEQ ID NO: 581963 - DNA, 20 bp, Artificial
  CRISPR gRNA sequence
tctttccccagagaccctca

SEQ ID NO: 581964 - DNA, 20 bp, Artificial
  CRISPR gRNA sequence
ctttccccagagaccctcaa

SEQ ID NO: 581965 - DNA, 20 bp, Artificial
  CRISPR gRNA sequence
tttccccagagaccctcaaa

SEQ ID NO: 581966 - DNA, 20 bp, Artificial
  CRISPR gRNA sequence
tccccagagaccctcaaata

SEQ ID NO: 581967 - DNA, 20 bp, Artificial
  CRISPR gRNA sequence
ccccagagaccctcaaatat

SEQ ID NO: 581968 - DNA, 20 bp, Artificial
  CRISPR gRNA sequence
cccagagaccctcaaatatc

SEQ ID NO: 581969 - DNA, 20 bp, Artificial
  CRISPR gRNA sequence
aaatatcctctcactcacag

SEQ ID NO: 581970 - DNA, 20 bp, Artificial
  CRISPR gRNA sequence
tcactcacagaatggtgtct

SEQ ID NO: 581971 - DNA, 20 bp, Artificial
  CRISPR gRNA sequence
actcacagaatggtgtctct

SEQ ID NO: 581972 - DNA, 20 bp, Artificial
  CRISPR gRNA sequence
acagaatggtgtctctgcct

SEQ ID NO: 581973 - DNA, 20 bp, Artificial
  CRISPR gRNA sequence
tgcctgcctcgggttggccc

SEQ ID NO: 581974 - DNA, 20 bp, Artificial
  CRISPR gRNA sequence
cctgcctcgggttggccctg

SEQ ID NO: 581975 - DNA, 20 bp, Artificial
  CRISPR gRNA sequence
cctcgggttggccctgtgat

SEQ ID NO: 581976 - DNA, 20 bp, Artificial
  CRISPR gRNA sequence
gggttggccctgtgatttat

SEQ ID NO: 581977 - DNA, 20 bp, Artificial
  CRISPR gRNA sequence
gccctgtgatttattttagt

SEQ ID NO: 581978 - DNA, 20 bp, Artificial
  CRISPR gRNA sequence
tgatttattttagttctttt

SEQ ID NO: 581979 - DNA, 20 bp, Artificial
  CRISPR gRNA sequence
attttagttcttttcccttg

SEQ ID NO: 581980 - DNA, 20 bp, Artificial
  CRISPR gRNA sequence
ttttagttcttttcccttgt

SEQ ID NO: 581981 - DNA, 20 bp, Artificial
  CRISPR gRNA sequence
tagttcttttcccttgtttt

SEQ ID NO: 581982 - DNA, 20 bp, Artificial
  CRISPR gRNA sequence
agttcttttcccttgttttt

SEQ ID NO: 581983 - DNA, 20 bp, Artificial
  CRISPR gRNA sequence
gttcttttcccttgtttttt

SEQ ID NO: 581984 - DNA, 20 bp, Artificial
  CRISPR gRNA sequence
ttttcccttgtttttttttt

SEQ ID NO: 581985 - DNA, 20 bp, Artificial
  CRISPR gRNA sequence
ttcccttgtttttttttttt

SEQ ID NO: 581986 - DNA, 20 bp, Artificial
  CRISPR gRNA sequence
tcccttgttttttttttttc

SEQ ID NO: 581987 - DNA, 20 bp, Artificial
  CRISPR gRNA sequence
cccttgttttttttttttca

SEQ ID NO: 581988 - DNA, 20 bp, Artificial
  CRISPR gRNA sequence
ccttgttttttttttttcaa

SEQ ID NO: 581989 - DNA, 20 bp, Artificial
  CRISPR gRNA sequence
gttttttttttttcaaactc

SEQ ID NO: 581990 - DNA, 20 bp, Artificial
  CRISPR gRNA sequence
ttttttttttttcaaactct

SEQ ID NO: 581991 - DNA, 20 bp, Artificial
  CRISPR gRNA sequence
tttttttttcaaactctata

SEQ ID NO: 581992 - DNA, 20 bp, Artificial
  CRISPR gRNA sequence
ttttttttcaaactctatac

SEQ ID NO: 581993 - DNA, 20 bp, Artificial
  CRISPR gRNA sequence
tttttttcaaactctataca

SEQ ID NO: 581994 - DNA, 20 bp, Artificial
  CRISPR gRNA sequence
ttttttcaaactctatacac

SEQ ID NO: 581995 - DNA, 20 bp, Artificial
  CRISPR gRNA sequence
tttttcaaactctatacact

SEQ ID NO: 581996 - DNA, 20 bp, Artificial
  CRISPR gRNA sequence
ttttcaaactctatacactt

SEQ ID NO: 581997 - DNA, 20 bp, Artificial
  CRISPR gRNA sequence
tttcaaactctatacacttt

SEQ ID NO: 581998 - DNA, 20 bp, Artificial
  CRISPR gRNA sequence
ttcaaactctatacactttt

SEQ ID NO: 581999 - DNA, 20 bp, Artificial
  CRISPR gRNA sequence
tcaaactctatacacttttg

SEQ ID NO: 582000 - DNA, 20 bp, Artificial
  CRISPR gRNA sequence
caaactctatacacttttgt

SEQ ID NO: 582001 - DNA, 20 bp, Artificial
  CRISPR gRNA sequence
aaactctatacacttttgtt

SEQ ID NO: 582002 - DNA, 20 bp, Artificial
  CRISPR gRNA sequence
tatacacttttgttttaaaa

SEQ ID NO: 582003 - DNA, 20 bp, Artificial
  CRISPR gRNA sequence
tacacttttgttttaaaaac

SEQ ID NO: 582004 - DNA, 20 bp, Artificial
  CRISPR gRNA sequence
ttgttttaaaaactgtggtt

SEQ ID NO: 582005 - DNA, 20 bp, Artificial
  CRISPR gRNA sequence
tgttttaaaaactgtggttt

SEQ ID NO: 582006 - DNA, 20 bp, Artificial
  CRISPR gRNA sequence
gttttaaaaactgtggtttc

SEQ ID NO: 582007 - DNA, 20 bp, Artificial
  CRISPR gRNA sequence
ttttaaaaactgtggtttct

SEQ ID NO: 582008 - DNA, 20 bp, Artificial
  CRISPR gRNA sequence
taaaaactgtggtttctcat

SEQ ID NO: 582009 - DNA, 20 bp, Artificial
  CRISPR gRNA sequence
aaaaactgtggtttctcatg

SEQ ID NO: 582010 - DNA, 20 bp, Artificial
  CRISPR gRNA sequence
aaaactgtggtttctcatga

SEQ ID NO: 582011 - DNA, 20 bp, Artificial
  CRISPR gRNA sequence
tggtttctcatgagccctat

SEQ ID NO: 582012 - DNA, 20 bp, Artificial
  CRISPR gRNA sequence
ctcatgagccctattatctc

SEQ ID NO: 582013 - DNA, 20 bp, Artificial
  CRISPR gRNA sequence
tcatgagccctattatctca

SEQ ID NO: 582014 - DNA, 20 bp, Artificial
  CRISPR gRNA sequence
atgagccctattatctcatt

SEQ ID NO: 582015 - DNA, 20 bp, Artificial
  CRISPR gRNA sequence
ttatctcattgatacctctc

SEQ ID NO: 582016 - DNA, 20 bp, Artificial
  CRISPR gRNA sequence
tctcattgatacctctcacc

SEQ ID NO: 582017 - DNA, 20 bp, Artificial
  CRISPR gRNA sequence
attgatacctctcacctctg

SEQ ID NO: 582018 - DNA, 20 bp, Artificial
  CRISPR gRNA sequence
atacctctcacctctgtggt

SEQ ID NO: 582019 - DNA, 20 bp, Artificial
  CRISPR gRNA sequence
tcacctctgtggtgagggga

SEQ ID NO: 582020 - DNA, 20 bp, Artificial
  CRISPR gRNA sequence
acctctgtggtgaggggaag

SEQ ID NO: 582021 - DNA, 20 bp, Artificial
  CRISPR gRNA sequence
tgtggtgaggggaagaaatc

SEQ ID NO: 582022 - DNA, 20 bp, Artificial
  CRISPR gRNA sequence
tggtgaggggaagaaatcat

SEQ ID NO: 582023 - DNA, 20 bp, Artificial
  CRISPR gRNA sequence
tcagatgactcgtaaagggc

SEQ ID NO: 582024 - DNA, 20 bp, Artificial
  CRISPR gRNA sequence
cagatgactcgtaaagggca

SEQ ID NO: 582025 - DNA, 20 bp, Artificial
  CRISPR gRNA sequence
agatgactcgtaaagggcaa

SEQ ID NO: 582026 - DNA, 20 bp, Artificial
  CRISPR gRNA sequence
gtaaagggcaaagaaaaaaa

SEQ ID NO: 582027 - DNA, 20 bp, Artificial
  CRISPR gRNA sequence
caaaatttccgtttaagtct

SEQ ID NO: 582028 - DNA, 20 bp, Artificial
  CRISPR gRNA sequence
aaaatttccgtttaagtctc

SEQ ID NO: 582029 - DNA, 20 bp, Artificial
  CRISPR gRNA sequence
ccgtttaagtctcataatca

SEQ ID NO: 582030 - DNA, 20 bp, Artificial
  CRISPR gRNA sequence
cgtttaagtctcataatcaa

SEQ ID NO: 582031 - DNA, 20 bp, Artificial
  CRISPR gRNA sequence
aagtctcataatcaagaaaa

SEQ ID NO: 582032 - DNA, 20 bp, Artificial
  CRISPR gRNA sequence
agtctcataatcaagaaaag

SEQ ID NO: 582033 - DNA, 20 bp, Artificial
  CRISPR gRNA sequence
ataatcaagaaaaggagaaa

SEQ ID NO: 582034 - DNA, 20 bp, Artificial
  CRISPR gRNA sequence
tgagaacccctccccacccc

SEQ ID NO: 582035 - DNA, 20 bp, Artificial
  CRISPR gRNA sequence
cccaccccgtgattatcagc

SEQ ID NO: 582036 - DNA, 20 bp, Artificial
  CRISPR gRNA sequence
tcagcgcacacactcatcga

SEQ ID NO: 582037 - DNA, 20 bp, Artificial
  CRISPR gRNA sequence
atcgaaaaaaatttggatta

SEQ ID NO: 582038 - DNA, 20 bp, Artificial
  CRISPR gRNA sequence
ggattattagaagagagagg

SEQ ID NO: 582039 - DNA, 20 bp, Artificial
  CRISPR gRNA sequence
gattattagaagagagaggt

SEQ ID NO: 582040 - DNA, 20 bp, Artificial
  CRISPR gRNA sequence
ttagaagagagaggtctgcg

SEQ ID NO: 582041 - DNA, 20 bp, Artificial
  CRISPR gRNA sequence
gaagagagaggtctgcggct

SEQ ID NO: 582042 - DNA, 20 bp, Artificial
  CRISPR gRNA sequence
cggcttccacaccgtacagc

SEQ ID NO: 582043 - DNA, 20 bp, Artificial
  CRISPR gRNA sequence
ccacaccgtacagcgtggtt

SEQ ID NO: 582044 - DNA, 20 bp, Artificial
  CRISPR gRNA sequence
cacaccgtacagcgtggttt

SEQ ID NO: 582045 - DNA, 20 bp, Artificial
  CRISPR gRNA sequence
ttcttctcggtataaaagca

SEQ ID NO: 582046 - DNA, 20 bp, Artificial
  CRISPR gRNA sequence
tcttctcggtataaaagcaa

SEQ ID NO: 582047 - DNA, 20 bp, Artificial
  CRISPR gRNA sequence
cttctcggtataaaagcaaa

SEQ ID NO: 582048 - DNA, 20 bp, Artificial
  CRISPR gRNA sequence
ttctcggtataaaagcaaag

SEQ ID NO: 582049 - DNA, 20 bp, Artificial
  CRISPR gRNA sequence
ctcggtataaaagcaaagtt

SEQ ID NO: 582050 - DNA, 20 bp, Artificial
  CRISPR gRNA sequence
tcggtataaaagcaaagttg

SEQ ID NO: 582051 - DNA, 20 bp, Artificial
  CRISPR gRNA sequence
ggtataaaagcaaagttgtt

SEQ ID NO: 582052 - DNA, 20 bp, Artificial
  CRISPR gRNA sequence
tttttgatacgtgacagttt

SEQ ID NO: 582053 - DNA, 20 bp, Artificial
  CRISPR gRNA sequence
ttgatacgtgacagtttccc

SEQ ID NO: 582054 - DNA, 20 bp, Artificial
  CRISPR gRNA sequence
tgatacgtgacagtttccca

SEQ ID NO: 582055 - DNA, 20 bp, Artificial
  CRISPR gRNA sequence
gatacgtgacagtttcccac

SEQ ID NO: 582056 - DNA, 20 bp, Artificial
  CRISPR gRNA sequence
atacgtgacagtttcccaca

SEQ ID NO: 582057 - DNA, 20 bp, Artificial
  CRISPR gRNA sequence
cccacaagccaggctgatcc

SEQ ID NO: 582058 - DNA, 20 bp, Artificial
  CRISPR gRNA sequence
ccacaagccaggctgatcct

SEQ ID NO: 582059 - DNA, 20 bp, Artificial
  CRISPR gRNA sequence
atccttttctgtcagtccac

SEQ ID NO: 582060 - DNA, 20 bp, Artificial
  CRISPR gRNA sequence
ttctgtcagtccacttcacc

SEQ ID NO: 582061 - DNA, 20 bp, Artificial
  CRISPR gRNA sequence
tctgtcagtccacttcacca

SEQ ID NO: 582062 - DNA, 20 bp, Artificial
  CRISPR gRNA sequence
ctgtcagtccacttcaccaa

SEQ ID NO: 582063 - DNA, 20 bp, Artificial
  CRISPR gRNA sequence
tgtcagtccacttcaccaag

SEQ ID NO: 582064 - DNA, 20 bp, Artificial
  CRISPR gRNA sequence
tcagtccacttcaccaaggt

SEQ ID NO: 582065 - DNA, 20 bp, Artificial
  CRISPR gRNA sequence
caccaaggtgagtgtccctg

SEQ ID NO: 582066 - DNA, 20 bp, Artificial
  CRISPR gRNA sequence
accaaggtgagtgtccctgc

SEQ ID NO: 582067 - DNA, 20 bp, Artificial
  CRISPR gRNA sequence
ctctcccctaccagatgtgg

SEQ ID NO: 582068 - DNA, 20 bp, Artificial
  CRISPR gRNA sequence
tcccctaccagatgtgggcc

SEQ ID NO: 582069 - DNA, 20 bp, Artificial
  CRISPR gRNA sequence
ccctaccagatgtgggcccc

SEQ ID NO: 582070 - DNA, 20 bp, Artificial
  CRISPR gRNA sequence
ccagatgtgggccccattgg

SEQ ID NO: 582071 - DNA, 20 bp, Artificial
  CRISPR gRNA sequence
gaggagatggcagggaggta

SEQ ID NO: 582072 - DNA, 20 bp, Artificial
  CRISPR gRNA sequence
tggtacagtgggatgtaccc

SEQ ID NO: 582073 - DNA, 20 bp, Artificial
  CRISPR gRNA sequence
gtacagtgggatgtacccag

SEQ ID NO: 582074 - DNA, 20 bp, Artificial
  CRISPR gRNA sequence
ccgtgattccagccaggtaa

SEQ ID NO: 582075 - DNA, 20 bp, Artificial
  CRISPR gRNA sequence
cagccaggtaaggtctttaa

SEQ ID NO: 582076 - DNA, 20 bp, Artificial
  CRISPR gRNA sequence
taaaaaaataatagaataaa

SEQ ID NO: 582077 - DNA, 20 bp, Artificial
  CRISPR gRNA sequence
aaaaaaataatagaataaat

SEQ ID NO: 582078 - DNA, 20 bp, Artificial
  CRISPR gRNA sequence
aaaaaataatagaataaatg

SEQ ID NO: 582079 - DNA, 20 bp, Artificial
  CRISPR gRNA sequence
aaaggtgaagtacttaatgc

SEQ ID NO: 582080 - DNA, 20 bp, Artificial
  CRISPR gRNA sequence
aaggtgaagtacttaatgca

SEQ ID NO: 582081 - DNA, 20 bp, Artificial
  CRISPR gRNA sequence
aatgcatgggcaggggcaaa

SEQ ID NO: 582082 - DNA, 20 bp, Artificial
  CRISPR gRNA sequence
atgcatgggcaggggcaaaa

SEQ ID NO: 582083 - DNA, 20 bp, Artificial
  CRISPR gRNA sequence
atcaattgatacgtagatgg

SEQ ID NO: 582084 - DNA, 20 bp, Artificial
  CRISPR gRNA sequence
atacgtagatggataggatt

SEQ ID NO: 582085 - DNA, 20 bp, Artificial
  CRISPR gRNA sequence
ttaaaatatgtcagctgcca

SEQ ID NO: 582086 - DNA, 20 bp, Artificial
  CRISPR gRNA sequence
taaaatatgtcagctgccag

SEQ ID NO: 582087 - DNA, 20 bp, Artificial
  CRISPR gRNA sequence
aaaatatgtcagctgccagt

SEQ ID NO: 582088 - DNA, 20 bp, Artificial
  CRISPR gRNA sequence
aaatatgtcagctgccagtc

SEQ ID NO: 582089 - DNA, 20 bp, Artificial
  CRISPR gRNA sequence
ccagtctttatggatttcag

SEQ ID NO: 582090 - DNA, 20 bp, Artificial
  CRISPR gRNA sequence
tatggatttcagagctttga

SEQ ID NO: 582091 - DNA, 20 bp, Artificial
  CRISPR gRNA sequence
atggatttcagagctttgaa

SEQ ID NO: 582092 - DNA, 20 bp, Artificial
  CRISPR gRNA sequence
tggatttcagagctttgaac

SEQ ID NO: 582093 - DNA, 20 bp, Artificial
  CRISPR gRNA sequence
cagagctttgaacaacttga

SEQ ID NO: 582094 - DNA, 20 bp, Artificial
  CRISPR gRNA sequence
agagctttgaacaacttgaa

SEQ ID NO: 582095 - DNA, 20 bp, Artificial
  CRISPR gRNA sequence
tgaacaacttgaaatgctgt

SEQ ID NO: 582096 - DNA, 20 bp, Artificial
  CRISPR gRNA sequence
gaacaacttgaaatgctgtc

SEQ ID NO: 582097 - DNA, 20 bp, Artificial
  CRISPR gRNA sequence
aacaacttgaaatgctgtcc

SEQ ID NO: 582098 - DNA, 20 bp, Artificial
  CRISPR gRNA sequence
gaaatgctgtccaggtgcaa

SEQ ID NO: 582099 - DNA, 20 bp, Artificial
  CRISPR gRNA sequence
aaatgctgtccaggtgcaac

SEQ ID NO: 582100 - DNA, 20 bp, Artificial
  CRISPR gRNA sequence
tccaggtgcaactgaaaatt

SEQ ID NO: 582101 - DNA, 20 bp, Artificial
  CRISPR gRNA sequence
aaaatttcaactgcatctct

SEQ ID NO: 582102 - DNA, 20 bp, Artificial
  CRISPR gRNA sequence
caactgcatctctctcatct

SEQ ID NO: 582103 - DNA, 20 bp, Artificial
  CRISPR gRNA sequence
aactgcatctctctcatctc

SEQ ID NO: 582104 - DNA, 20 bp, Artificial
  CRISPR gRNA sequence
catctctctcatctctttgt

SEQ ID NO: 582105 - DNA, 20 bp, Artificial
  CRISPR gRNA sequence
tctcatctctttgtctctta

SEQ ID NO: 582106 - DNA, 20 bp, Artificial
  CRISPR gRNA sequence
tcatctctttgtctcttagc

SEQ ID NO: 582107 - DNA, 20 bp, Artificial
  CRISPR gRNA sequence
atctctttgtctcttagctc

SEQ ID NO: 582108 - DNA, 20 bp, Artificial
  CRISPR gRNA sequence
tttgtctcttagctcttgat

SEQ ID NO: 582109 - DNA, 20 bp, Artificial
  CRISPR gRNA sequence
tgtctcttagctcttgatgc

SEQ ID NO: 582110 - DNA, 20 bp, Artificial
  CRISPR gRNA sequence
gtctcttagctcttgatgcc

SEQ ID NO: 582111 - DNA, 20 bp, Artificial
  CRISPR gRNA sequence
tctcttagctcttgatgcct

SEQ ID NO: 582112 - DNA, 20 bp, Artificial
  CRISPR gRNA sequence
ttagctcttgatgcctctca

SEQ ID NO: 582113 - DNA, 20 bp, Artificial
  CRISPR gRNA sequence
agctcttgatgcctctcatc

SEQ ID NO: 582114 - DNA, 20 bp, Artificial
  CRISPR gRNA sequence
gctcttgatgcctctcatcc

SEQ ID NO: 582115 - DNA, 20 bp, Artificial
  CRISPR gRNA sequence
ttgatgcctctcatccttct

SEQ ID NO: 582116 - DNA, 20 bp, Artificial
  CRISPR gRNA sequence
gatgcctctcatccttctct

SEQ ID NO: 582117 - DNA, 20 bp, Artificial
  CRISPR gRNA sequence
atgcctctcatccttctctg

SEQ ID NO: 582118 - DNA, 20 bp, Artificial
  CRISPR gRNA sequence
tcatccttctctgtctctct

SEQ ID NO: 582119 - DNA, 20 bp, Artificial
  CRISPR gRNA sequence
atccttctctgtctctctgc

SEQ ID NO: 582120 - DNA, 20 bp, Artificial
  CRISPR gRNA sequence
ctctgtctctctgctcaccc

SEQ ID NO: 582121 - DNA, 20 bp, Artificial
  CRISPR gRNA sequence
tctgtctctctgctcaccct

SEQ ID NO: 582122 - DNA, 20 bp, Artificial
  CRISPR gRNA sequence
tgtctctctgctcaccctgt

SEQ ID NO: 582123 - DNA, 20 bp, Artificial
  CRISPR gRNA sequence
tctctctgctcaccctgtct

SEQ ID NO: 582124 - DNA, 20 bp, Artificial
  CRISPR gRNA sequence
tctgctcaccctgtcttgct

SEQ ID NO: 582125 - DNA, 20 bp, Artificial
  CRISPR gRNA sequence
tgctcaccctgtcttgctct

SEQ ID NO: 582126 - DNA, 20 bp, Artificial
  CRISPR gRNA sequence
ctcaccctgtcttgctcttt

SEQ ID NO: 582127 - DNA, 20 bp, Artificial
  CRISPR gRNA sequence
accctgtcttgctcttttac

SEQ ID NO: 582128 - DNA, 20 bp, Artificial
  CRISPR gRNA sequence
tcttgctcttttacatgttt

SEQ ID NO: 582129 - DNA, 20 bp, Artificial
  CRISPR gRNA sequence
gctcttttacatgtttctct

SEQ ID NO: 582130 - DNA, 20 bp, Artificial
  CRISPR gRNA sequence
ctcttttacatgtttctctg

SEQ ID NO: 582131 - DNA, 20 bp, Artificial
  CRISPR gRNA sequence
ttttacatgtttctctgcct

SEQ ID NO: 582132 - DNA, 20 bp, Artificial
  CRISPR gRNA sequence
ttacatgtttctctgcctct

SEQ ID NO: 582133 - DNA, 20 bp, Artificial
  CRISPR gRNA sequence
tacatgtttctctgcctctc

SEQ ID NO: 582134 - DNA, 20 bp, Artificial
  CRISPR gRNA sequence
acatgtttctctgcctctct

SEQ ID NO: 582135 - DNA, 20 bp, Artificial
  CRISPR gRNA sequence
catgtttctctgcctctctt

SEQ ID NO: 582136 - DNA, 20 bp, Artificial
  CRISPR gRNA sequence
ctctgcctctctttctcccg

SEQ ID NO: 582137 - DNA, 20 bp, Artificial
  CRISPR gRNA sequence
tctgcctctctttctcccgc

SEQ ID NO: 582138 - DNA, 20 bp, Artificial
  CRISPR gRNA sequence
tgcctctctttctcccgcca

SEQ ID NO: 582139 - DNA, 20 bp, Artificial
  CRISPR gRNA sequence
cctctctttctcccgccatc

SEQ ID NO: 582140 - DNA, 20 bp, Artificial
  CRISPR gRNA sequence
tctttctcccgccatctgtc

SEQ ID NO: 582141 - DNA, 20 bp, Artificial
  CRISPR gRNA sequence
tttctcccgccatctgtctg

SEQ ID NO: 582142 - DNA, 20 bp, Artificial
  CRISPR gRNA sequence
tctcccgccatctgtctgtc

SEQ ID NO: 582143 - DNA, 20 bp, Artificial
  CRISPR gRNA sequence
ctcccgccatctgtctgtcg

SEQ ID NO: 582144 - DNA, 20 bp, Artificial
  CRISPR gRNA sequence
tcccgccatctgtctgtcgc

SEQ ID NO: 582145 - DNA, 20 bp, Artificial
  CRISPR gRNA sequence
ccgccatctgtctgtcgcta

SEQ ID NO: 582146 - DNA, 20 bp, Artificial
  CRISPR gRNA sequence
tctgtcgctacactcagact

SEQ ID NO: 582147 - DNA, 20 bp, Artificial
  CRISPR gRNA sequence
tcgctacactcagactctct

SEQ ID NO: 582148 - DNA, 20 bp, Artificial
  CRISPR gRNA sequence
cactcagactctctttcccc

SEQ ID NO: 582149 - DNA, 20 bp, Artificial
  CRISPR gRNA sequence
agactctctttccccgcatc

SEQ ID NO: 582150 - DNA, 20 bp, Artificial
  CRISPR gRNA sequence
tctttccccgcatctctcct

SEQ ID NO: 582151 - DNA, 20 bp, Artificial
  CRISPR gRNA sequence
tttccccgcatctctcctgg

SEQ ID NO: 582152 - DNA, 20 bp, Artificial
  CRISPR gRNA sequence
tccccgcatctctcctggcc

SEQ ID NO: 582153 - DNA, 20 bp, Artificial
  CRISPR gRNA sequence
ccccgcatctctcctggcct

SEQ ID NO: 582154 - DNA, 20 bp, Artificial
  CRISPR gRNA sequence
cccgcatctctcctggcctc

SEQ ID NO: 582155 - DNA, 20 bp, Artificial
  CRISPR gRNA sequence
tcctggcctctgaccatctc

SEQ ID NO: 582156 - DNA, 20 bp, Artificial
  CRISPR gRNA sequence
ctggcctctgaccatctccc

SEQ ID NO: 582157 - DNA, 20 bp, Artificial
  CRISPR gRNA sequence
gcctctgaccatctccccta

SEQ ID NO: 582158 - DNA, 20 bp, Artificial
  CRISPR gRNA sequence
tgaccatctcccctatctct

SEQ ID NO: 582159 - DNA, 20 bp, Artificial
  CRISPR gRNA sequence
accatctcccctatctctgt

SEQ ID NO: 582160 - DNA, 20 bp, Artificial
  CRISPR gRNA sequence
ccctatctctgtctcctcca

SEQ ID NO: 582161 - DNA, 20 bp, Artificial
  CRISPR gRNA sequence
tctctgtctcctccatcttg

SEQ ID NO: 582162 - DNA, 20 bp, Artificial
  CRISPR gRNA sequence
tgtctcctccatcttgacca

SEQ ID NO: 582163 - DNA, 20 bp, Artificial
  CRISPR gRNA sequence
tctcctccatcttgaccaca

SEQ ID NO: 582164 - DNA, 20 bp, Artificial
  CRISPR gRNA sequence
ctccatcttgaccacactcc

SEQ ID NO: 582165 - DNA, 20 bp, Artificial
  CRISPR gRNA sequence
catcttgaccacactccatc

SEQ ID NO: 582166 - DNA, 20 bp, Artificial
  CRISPR gRNA sequence
gaccacactccatcgatctc

SEQ ID NO: 582167 - DNA, 20 bp, Artificial
  CRISPR gRNA sequence
accacactccatcgatctcc

SEQ ID NO: 582168 - DNA, 20 bp, Artificial
  CRISPR gRNA sequence
catcgatctcctttcctcca

SEQ ID NO: 582169 - DNA, 20 bp, Artificial
  CRISPR gRNA sequence
ctttcctccatctctcccgc

SEQ ID NO: 582170 - DNA, 20 bp, Artificial
  CRISPR gRNA sequence
tcctccatctctcccgctct

SEQ ID NO: 582171 - DNA, 20 bp, Artificial
  CRISPR gRNA sequence
cctccatctctcccgctctc

SEQ ID NO: 582172 - DNA, 20 bp, Artificial
  CRISPR gRNA sequence
ctccatctctcccgctctct

SEQ ID NO: 582173 - DNA, 20 bp, Artificial
  CRISPR gRNA sequence
catctctcccgctctctttt

SEQ ID NO: 582174 - DNA, 20 bp, Artificial
  CRISPR gRNA sequence
tcccgctctcttttcttgcc

SEQ ID NO: 582175 - DNA, 20 bp, Artificial
  CRISPR gRNA sequence
ccgctctcttttcttgcctt

SEQ ID NO: 582176 - DNA, 20 bp, Artificial
  CRISPR gRNA sequence
tcttttcttgccttccccca

SEQ ID NO: 582177 - DNA, 20 bp, Artificial
  CRISPR gRNA sequence
ttttcttgccttcccccacc

SEQ ID NO: 582178 - DNA, 20 bp, Artificial
  CRISPR gRNA sequence
ttcttgccttcccccacctg

SEQ ID NO: 582179 - DNA, 20 bp, Artificial
  CRISPR gRNA sequence
tcttgccttcccccacctgc

SEQ ID NO: 582180 - DNA, 20 bp, Artificial
  CRISPR gRNA sequence
cttgccttcccccacctgcc

SEQ ID NO: 582181 - DNA, 20 bp, Artificial
  CRISPR gRNA sequence
ttgccttcccccacctgcct

SEQ ID NO: 582182 - DNA, 20 bp, Artificial
  CRISPR gRNA sequence
gccttcccccacctgccttc

SEQ ID NO: 582183 - DNA, 20 bp, Artificial
  CRISPR gRNA sequence
ccttcccccacctgccttcc

SEQ ID NO: 582184 - DNA, 20 bp, Artificial
  CRISPR gRNA sequence
cccccacctgccttcccagc

SEQ ID NO: 582185 - DNA, 20 bp, Artificial
  CRISPR gRNA sequence
ccccacctgccttcccagcc

SEQ ID NO: 582186 - DNA, 20 bp, Artificial
  CRISPR gRNA sequence
ccttcccagccagcatccag

SEQ ID NO: 582187 - DNA, 20 bp, Artificial
  CRISPR gRNA sequence
cccagccagcatccagccta

SEQ ID NO: 582188 - DNA, 20 bp, Artificial
  CRISPR gRNA sequence
ccagccagcatccagcctag

SEQ ID NO: 582189 - DNA, 20 bp, Artificial
  CRISPR gRNA sequence
gagctttgtacacagctggc

SEQ ID NO: 582190 - DNA, 20 bp, Artificial
  CRISPR gRNA sequence
tgtacacagctggcgtttaa

SEQ ID NO: 582191 - DNA, 20 bp, Artificial
  CRISPR gRNA sequence
gtacacagctggcgtttaat

SEQ ID NO: 582192 - DNA, 20 bp, Artificial
  CRISPR gRNA sequence
tacacagctggcgtttaata

SEQ ID NO: 582193 - DNA, 20 bp, Artificial
  CRISPR gRNA sequence
gcgtttaataatagtaatgt

SEQ ID NO: 582194 - DNA, 20 bp, Artificial
  CRISPR gRNA sequence
aataatagtaatgtcgccga

SEQ ID NO: 582195 - DNA, 20 bp, Artificial
  CRISPR gRNA sequence
ataatagtaatgtcgccgag

SEQ ID NO: 582196 - DNA, 20 bp, Artificial
  CRISPR gRNA sequence
tacattttatgagagtgagc

SEQ ID NO: 582197 - DNA, 20 bp, Artificial
  CRISPR gRNA sequence
acattttatgagagtgagca

SEQ ID NO: 582198 - DNA, 20 bp, Artificial
  CRISPR gRNA sequence
cattttatgagagtgagcat

SEQ ID NO: 582199 - DNA, 20 bp, Artificial
  CRISPR gRNA sequence
tatgagagtgagcatcagtt

SEQ ID NO: 582200 - DNA, 20 bp, Artificial
  CRISPR gRNA sequence
atgagagtgagcatcagttc

SEQ ID NO: 582201 - DNA, 20 bp, Artificial
  CRISPR gRNA sequence
tgagagtgagcatcagttct

SEQ ID NO: 582202 - DNA, 20 bp, Artificial
  CRISPR gRNA sequence
tgttcaccctagtagcagga

SEQ ID NO: 582203 - DNA, 20 bp, Artificial
  CRISPR gRNA sequence
ttcaccctagtagcaggagg

SEQ ID NO: 582204 - DNA, 20 bp, Artificial
  CRISPR gRNA sequence
accctagtagcaggaggatt

SEQ ID NO: 582205 - DNA, 20 bp, Artificial
  CRISPR gRNA sequence
gtagcaggaggattgcaagg

SEQ ID NO: 582206 - DNA, 20 bp, Artificial
  CRISPR gRNA sequence
caaggtgccggggcaagctg

SEQ ID NO: 582207 - DNA, 20 bp, Artificial
  CRISPR gRNA sequence
agcacttaactgaactttgc

SEQ ID NO: 582208 - DNA, 20 bp, Artificial
  CRISPR gRNA sequence
aactgaactttgcttgtatc

SEQ ID NO: 582209 - DNA, 20 bp, Artificial
  CRISPR gRNA sequence
actgaactttgcttgtatcg

SEQ ID NO: 582210 - DNA, 20 bp, Artificial
  CRISPR gRNA sequence
aactttgcttgtatcgcttt

SEQ ID NO: 582211 - DNA, 20 bp, Artificial
  CRISPR gRNA sequence
tgcttgtatcgctttagagg

SEQ ID NO: 582212 - DNA, 20 bp, Artificial
  CRISPR gRNA sequence
gcttgtatcgctttagagga

SEQ ID NO: 582213 - DNA, 20 bp, Artificial
  CRISPR gRNA sequence
cttgtatcgctttagaggag

SEQ ID NO: 582214 - DNA, 20 bp, Artificial
  CRISPR gRNA sequence
gtatcgctttagaggagacc

SEQ ID NO: 582215 - DNA, 20 bp, Artificial
  CRISPR gRNA sequence
tatcgctttagaggagaccc

SEQ ID NO: 582216 - DNA, 20 bp, Artificial
  CRISPR gRNA sequence
tagaggagacccttggggcg

SEQ ID NO: 582217 - DNA, 20 bp, Artificial
  CRISPR gRNA sequence
agaggagacccttggggcgg

SEQ ID NO: 582218 - DNA, 20 bp, Artificial
  CRISPR gRNA sequence
gaggagacccttggggcggg

SEQ ID NO: 582219 - DNA, 20 bp, Artificial
  CRISPR gRNA sequence
ggggcgggggggcagggagc

SEQ ID NO: 582220 - DNA, 20 bp, Artificial
  CRISPR gRNA sequence
gggcgggggggcagggagca

SEQ ID NO: 582221 - DNA, 20 bp, Artificial
  CRISPR gRNA sequence
cacaccattgtcaaccgtag

SEQ ID NO: 582222 - DNA, 20 bp, Artificial
  CRISPR gRNA sequence
acaccattgtcaaccgtagt

SEQ ID NO: 582223 - DNA, 20 bp, Artificial
  CRISPR gRNA sequence
tcaaccgtagtttagctgtg

SEQ ID NO: 582224 - DNA, 20 bp, Artificial
  CRISPR gRNA sequence
agctgtgtggacctacccca

SEQ ID NO: 582225 - DNA, 20 bp, Artificial
  CRISPR gRNA sequence
gctgtgtggacctaccccag

SEQ ID NO: 582226 - DNA, 20 bp, Artificial
  CRISPR gRNA sequence
tgtggacctaccccaggact

SEQ ID NO: 582227 - DNA, 20 bp, Artificial
  CRISPR gRNA sequence
ccccaggactgcatgtgtgt

SEQ ID NO: 582228 - DNA, 20 bp, Artificial
  CRISPR gRNA sequence
catgtgtgtgaccagagtcc

SEQ ID NO: 582229 - DNA, 20 bp, Artificial
  CRISPR gRNA sequence
aggaagcaaacaggttgttc

SEQ ID NO: 582230 - DNA, 20 bp, Artificial
  CRISPR gRNA sequence
ttcagggctggggtgagctc

SEQ ID NO: 582231 - DNA, 20 bp, Artificial
  CRISPR gRNA sequence
agggctggggtgagctcgat

SEQ ID NO: 582232 - DNA, 20 bp, Artificial
  CRISPR gRNA sequence
gggtgagctcgattctgcag

SEQ ID NO: 582233 - DNA, 20 bp, Artificial
  CRISPR gRNA sequence
gattctgcaggcttagcaca

SEQ ID NO: 582234 - DNA, 20 bp, Artificial
  CRISPR gRNA sequence
tgcaggcttagcacagcgtt

SEQ ID NO: 582235 - DNA, 20 bp, Artificial
  CRISPR gRNA sequence
caggcttagcacagcgtttg

SEQ ID NO: 582236 - DNA, 20 bp, Artificial
  CRISPR gRNA sequence
agcacagcgtttggcacaaa

SEQ ID NO: 582237 - DNA, 20 bp, Artificial
  CRISPR gRNA sequence
gcacagcgtttggcacaaag

SEQ ID NO: 582238 - DNA, 20 bp, Artificial
  CRISPR gRNA sequence
ggcacaaagtaagtgctcac

SEQ ID NO: 582239 - DNA, 20 bp, Artificial
  CRISPR gRNA sequence
gcacaaagtaagtgctcacg

SEQ ID NO: 582240 - DNA, 20 bp, Artificial
  CRISPR gRNA sequence
acgaagtgttagctattagt

SEQ ID NO: 582241 - DNA, 20 bp, Artificial
  CRISPR gRNA sequence
gctattagtatttctgtaac

SEQ ID NO: 582242 - DNA, 20 bp, Artificial
  CRISPR gRNA sequence
ttagtatttctgtaaccaaa

SEQ ID NO: 582243 - DNA, 20 bp, Artificial
  CRISPR gRNA sequence
gtatttctgtaaccaaatta

SEQ ID NO: 582244 - DNA, 20 bp, Artificial
  CRISPR gRNA sequence
ctgtaaccaaattagaatca

SEQ ID NO: 582245 - DNA, 20 bp, Artificial
  CRISPR gRNA sequence
tgtaaccaaattagaatcat

SEQ ID NO: 582246 - DNA, 20 bp, Artificial
  CRISPR gRNA sequence
taaccaaattagaatcatgc

SEQ ID NO: 582247 - DNA, 20 bp, Artificial
  CRISPR gRNA sequence
gaatcatgctatatattggt

SEQ ID NO: 582248 - DNA, 20 bp, Artificial
  CRISPR gRNA sequence
tatattggttttgttcctgc

SEQ ID NO: 582249 - DNA, 20 bp, Artificial
  CRISPR gRNA sequence
gttttgttcctgctttattc

SEQ ID NO: 582250 - DNA, 20 bp, Artificial
  CRISPR gRNA sequence
tgttcctgctttattcaatt

SEQ ID NO: 582251 - DNA, 20 bp, Artificial
  CRISPR gRNA sequence
gttcctgctttattcaatta

SEQ ID NO: 582252 - DNA, 20 bp, Artificial
  CRISPR gRNA sequence
ttcctgctttattcaattaa

SEQ ID NO: 582253 - DNA, 20 bp, Artificial
  CRISPR gRNA sequence
ctgctttattcaattaacag

SEQ ID NO: 582254 - DNA, 20 bp, Artificial
  CRISPR gRNA sequence
ctttattcaattaacagtag

SEQ ID NO: 582255 - DNA, 20 bp, Artificial
  CRISPR gRNA sequence
tattcaattaacagtagtgt

SEQ ID NO: 582256 - DNA, 20 bp, Artificial
  CRISPR gRNA sequence
attcaattaacagtagtgtt

SEQ ID NO: 582257 - DNA, 20 bp, Artificial
  CRISPR gRNA sequence
ttcaattaacagtagtgttt

SEQ ID NO: 582258 - DNA, 20 bp, Artificial
  CRISPR gRNA sequence
aattaacagtagtgtttttg

SEQ ID NO: 582259 - DNA, 20 bp, Artificial
  CRISPR gRNA sequence
acagtagtgtttttgaagct

SEQ ID NO: 582260 - DNA, 20 bp, Artificial
  CRISPR gRNA sequence
ttgaagcttactaaaaattg

SEQ ID NO: 582261 - DNA, 20 bp, Artificial
  CRISPR gRNA sequence
tgaagcttactaaaaattgt

SEQ ID NO: 582262 - DNA, 20 bp, Artificial
  CRISPR gRNA sequence
gaagcttactaaaaattgtt

SEQ ID NO: 582263 - DNA, 20 bp, Artificial
  CRISPR gRNA sequence
aagcttactaaaaattgttt

SEQ ID NO: 582264 - DNA, 20 bp, Artificial
  CRISPR gRNA sequence
actaaaaattgtttgaacac

SEQ ID NO: 582265 - DNA, 20 bp, Artificial
  CRISPR gRNA sequence
ctaaaaattgtttgaacaca

SEQ ID NO: 582266 - DNA, 20 bp, Artificial
  CRISPR gRNA sequence
aaaattgtttgaacacatga

SEQ ID NO: 582267 - DNA, 20 bp, Artificial
  CRISPR gRNA sequence
tttgaacacatgatctttca

SEQ ID NO: 582268 - DNA, 20 bp, Artificial
  CRISPR gRNA sequence
gaacacatgatctttcatga

SEQ ID NO: 582269 - DNA, 20 bp, Artificial
  CRISPR gRNA sequence
aacacatgatctttcatgat

SEQ ID NO: 582270 - DNA, 20 bp, Artificial
  CRISPR gRNA sequence
tcatgatggacaagactgtc

SEQ ID NO: 582271 - DNA, 20 bp, Artificial
  CRISPR gRNA sequence
catgatggacaagactgtcc

SEQ ID NO: 582272 - DNA, 20 bp, Artificial
  CRISPR gRNA sequence
atgatggacaagactgtcct

SEQ ID NO: 582273 - DNA, 20 bp, Artificial
  CRISPR gRNA sequence
tcctcacatcagcatgaact

SEQ ID NO: 582274 - DNA, 20 bp, Artificial
  CRISPR gRNA sequence
acatcagcatgaactttgat

SEQ ID NO: 582275 - DNA, 20 bp, Artificial
  CRISPR gRNA sequence
tgattgatttgaccaagtgc

SEQ ID NO: 582276 - DNA, 20 bp, Artificial
  CRISPR gRNA sequence
gattgatttgaccaagtgcc

SEQ ID NO: 582277 - DNA, 20 bp, Artificial
  CRISPR gRNA sequence
attgatttgaccaagtgccg

SEQ ID NO: 582278 - DNA, 20 bp, Artificial
  CRISPR gRNA sequence
atttgaccaagtgccgattg

SEQ ID NO: 582279 - DNA, 20 bp, Artificial
  CRISPR gRNA sequence
gaccaagtgccgattgttgg

SEQ ID NO: 582280 - DNA, 20 bp, Artificial
  CRISPR gRNA sequence
accaagtgccgattgttgga

SEQ ID NO: 582281 - DNA, 20 bp, Artificial
  CRISPR gRNA sequence
ttggacattccggttgtttc

SEQ ID NO: 582282 - DNA, 20 bp, Artificial
  CRISPR gRNA sequence
gacattccggttgtttctcg

SEQ ID NO: 582283 - DNA, 20 bp, Artificial
  CRISPR gRNA sequence
cggttgtttctcgttttttt

SEQ ID NO: 582284 - DNA, 20 bp, Artificial
  CRISPR gRNA sequence
tttctcgtttttttctataa

SEQ ID NO: 582285 - DNA, 20 bp, Artificial
  CRISPR gRNA sequence
ctcgtttttttctataaaca

SEQ ID NO: 582286 - DNA, 20 bp, Artificial
  CRISPR gRNA sequence
tcgtttttttctataaacat

SEQ ID NO: 582287 - DNA, 20 bp, Artificial
  CRISPR gRNA sequence
gtttttttctataaacatcc

SEQ ID NO: 582288 - DNA, 20 bp, Artificial
  CRISPR gRNA sequence
ttttctataaacatccctga

SEQ ID NO: 582289 - DNA, 20 bp, Artificial
  CRISPR gRNA sequence
tttctataaacatccctgac

SEQ ID NO: 582290 - DNA, 20 bp, Artificial
  CRISPR gRNA sequence
ttctataaacatccctgact

SEQ ID NO: 582291 - DNA, 20 bp, Artificial
  CRISPR gRNA sequence
tctataaacatccctgactg

SEQ ID NO: 582292 - DNA, 20 bp, Artificial
  CRISPR gRNA sequence
ctataaacatccctgactgc

SEQ ID NO: 582293 - DNA, 20 bp, Artificial
  CRISPR gRNA sequence
tataaacatccctgactgct

SEQ ID NO: 582294 - DNA, 20 bp, Artificial
  CRISPR gRNA sequence
taaacatccctgactgcttc

SEQ ID NO: 582295 - DNA, 20 bp, Artificial
  CRISPR gRNA sequence
actgcttccttggattcctg

SEQ ID NO: 582296 - DNA, 20 bp, Artificial
  CRISPR gRNA sequence
cttccttggattcctgaaaa

SEQ ID NO: 582297 - DNA, 20 bp, Artificial
  CRISPR gRNA sequence
ccttggattcctgaaaaggg

SEQ ID NO: 582298 - DNA, 20 bp, Artificial
  CRISPR gRNA sequence
cttggattcctgaaaaggga

SEQ ID NO: 582299 - DNA, 20 bp, Artificial
  CRISPR gRNA sequence
ggattcctgaaaagggagtt

SEQ ID NO: 582300 - DNA, 20 bp, Artificial
  CRISPR gRNA sequence
gattcctgaaaagggagttg

SEQ ID NO: 582301 - DNA, 20 bp, Artificial
  CRISPR gRNA sequence
ctgaaaagggagttgctggg

SEQ ID NO: 582302 - DNA, 20 bp, Artificial
  CRISPR gRNA sequence
aaaagggagttgctggggca

SEQ ID NO: 582303 - DNA, 20 bp, Artificial
  CRISPR gRNA sequence
ctggggcaaagggggcgtgc

SEQ ID NO: 582304 - DNA, 20 bp, Artificial
  CRISPR gRNA sequence
gggcaaagggggcgtgcatt

SEQ ID NO: 582305 - DNA, 20 bp, Artificial
  CRISPR gRNA sequence
ttaaagtttatgaccctctc

SEQ ID NO: 582306 - DNA, 20 bp, Artificial
  CRISPR gRNA sequence
taaagtttatgaccctctct

SEQ ID NO: 582307 - DNA, 20 bp, Artificial
  CRISPR gRNA sequence
aaagtttatgaccctctctg

SEQ ID NO: 582308 - DNA, 20 bp, Artificial
  CRISPR gRNA sequence
aagtttatgaccctctctgc

SEQ ID NO: 582309 - DNA, 20 bp, Artificial
  CRISPR gRNA sequence
atgaccctctctgctaattc

SEQ ID NO: 582310 - DNA, 20 bp, Artificial
  CRISPR gRNA sequence
tgaccctctctgctaattct

SEQ ID NO: 582311 - DNA, 20 bp, Artificial
  CRISPR gRNA sequence
tctgctaattctccttccaa

SEQ ID NO: 582312 - DNA, 20 bp, Artificial
  CRISPR gRNA sequence
tgctaattctccttccaaaa

SEQ ID NO: 582313 - DNA, 20 bp, Artificial
  CRISPR gRNA sequence
ctaattctccttccaaaagg

SEQ ID NO: 582314 - DNA, 20 bp, Artificial
  CRISPR gRNA sequence
attctccttccaaaaggttg

SEQ ID NO: 582315 - DNA, 20 bp, Artificial
  CRISPR gRNA sequence
tccttccaaaaggttgtcct

SEQ ID NO: 582316 - DNA, 20 bp, Artificial
  CRISPR gRNA sequence
cttccaaaaggttgtcctat

SEQ ID NO: 582317 - DNA, 20 bp, Artificial
  CRISPR gRNA sequence
ccaaaaggttgtcctatttt

SEQ ID NO: 582318 - DNA, 20 bp, Artificial
  CRISPR gRNA sequence
caaaaggttgtcctatttta

SEQ ID NO: 582319 - DNA, 20 bp, Artificial
  CRISPR gRNA sequence
tcctattttatgctccctct

SEQ ID NO: 582320 - DNA, 20 bp, Artificial
  CRISPR gRNA sequence
ttttatgctccctctactta

SEQ ID NO: 582321 - DNA, 20 bp, Artificial
  CRISPR gRNA sequence
tatgctccctctacttaagc

SEQ ID NO: 582322 - DNA, 20 bp, Artificial
  CRISPR gRNA sequence
atgctccctctacttaagct

SEQ ID NO: 582323 - DNA, 20 bp, Artificial
  CRISPR gRNA sequence
tgctccctctacttaagcta

SEQ ID NO: 582324 - DNA, 20 bp, Artificial
  CRISPR gRNA sequence
cctctacttaagctaaccct

SEQ ID NO: 582325 - DNA, 20 bp, Artificial
  CRISPR gRNA sequence
tacttaagctaaccctaggt

SEQ ID NO: 582326 - DNA, 20 bp, Artificial
  CRISPR gRNA sequence
cttaagctaaccctaggtga

SEQ ID NO: 582327 - DNA, 20 bp, Artificial
  CRISPR gRNA sequence
aagctaaccctaggtgagta

SEQ ID NO: 582328 - DNA, 20 bp, Artificial
  CRISPR gRNA sequence
agctaaccctaggtgagtat

SEQ ID NO: 582329 - DNA, 20 bp, Artificial
  CRISPR gRNA sequence
accctaggtgagtattatta

SEQ ID NO: 582330 - DNA, 20 bp, Artificial
  CRISPR gRNA sequence
ggtgagtattattatgtttt

SEQ ID NO: 582331 - DNA, 20 bp, Artificial
  CRISPR gRNA sequence
ttatgttttaattatttccc

SEQ ID NO: 582332 - DNA, 20 bp, Artificial
  CRISPR gRNA sequence
tgttttaattatttcccaac

SEQ ID NO: 582333 - DNA, 20 bp, Artificial
  CRISPR gRNA sequence
taattatttcccaacatgac

SEQ ID NO: 582334 - DNA, 20 bp, Artificial
  CRISPR gRNA sequence
aattatttcccaacatgaca

SEQ ID NO: 582335 - DNA, 20 bp, Artificial
  CRISPR gRNA sequence
attatttcccaacatgacag

SEQ ID NO: 582336 - DNA, 20 bp, Artificial
  CRISPR gRNA sequence
tttcccaacatgacaggtaa

SEQ ID NO: 582337 - DNA, 20 bp, Artificial
  CRISPR gRNA sequence
cccaacatgacaggtaagaa

SEQ ID NO: 582338 - DNA, 20 bp, Artificial
  CRISPR gRNA sequence
ccaacatgacaggtaagaaa

SEQ ID NO: 582339 - DNA, 20 bp, Artificial
  CRISPR gRNA sequence
tcacattgttgaaatttgca

SEQ ID NO: 582340 - DNA, 20 bp, Artificial
  CRISPR gRNA sequence
ttgaaatttgcatcttgtga

SEQ ID NO: 582341 - DNA, 20 bp, Artificial
  CRISPR gRNA sequence
aaatttgcatcttgtgatta

SEQ ID NO: 582342 - DNA, 20 bp, Artificial
  CRISPR gRNA sequence
gcatcttgtgattactttta

SEQ ID NO: 582343 - DNA, 20 bp, Artificial
  CRISPR gRNA sequence
catcttgtgattacttttac

SEQ ID NO: 582344 - DNA, 20 bp, Artificial
  CRISPR gRNA sequence
gtgattacttttactattca

SEQ ID NO: 582345 - DNA, 20 bp, Artificial
  CRISPR gRNA sequence
tgattacttttactattcat

SEQ ID NO: 582346 - DNA, 20 bp, Artificial
  CRISPR gRNA sequence
cttttactattcattggcca

SEQ ID NO: 582347 - DNA, 20 bp, Artificial
  CRISPR gRNA sequence
ttactattcattggccattc

SEQ ID NO: 582348 - DNA, 20 bp, Artificial
  CRISPR gRNA sequence
tactattcattggccattca

SEQ ID NO: 582349 - DNA, 20 bp, Artificial
  CRISPR gRNA sequence
actattcattggccattcat

SEQ ID NO: 582350 - DNA, 20 bp, Artificial
  CRISPR gRNA sequence
ctattcattggccattcatg

SEQ ID NO: 582351 - DNA, 20 bp, Artificial
  CRISPR gRNA sequence
ttcattggccattcatgctt

SEQ ID NO: 582352 - DNA, 20 bp, Artificial
  CRISPR gRNA sequence
attggccattcatgcttttt

SEQ ID NO: 582353 - DNA, 20 bp, Artificial
  CRISPR gRNA sequence
gccattcatgcttttttttt

SEQ ID NO: 582354 - DNA, 20 bp, Artificial
  CRISPR gRNA sequence
atgctttttttttttttttt

SEQ ID NO: 582355 - DNA, 20 bp, Artificial
  CRISPR gRNA sequence
ttttttttttttttttggtt

SEQ ID NO: 582356 - DNA, 20 bp, Artificial
  CRISPR gRNA sequence
tttttttttttttttggttg

SEQ ID NO: 582357 - DNA, 20 bp, Artificial
  CRISPR gRNA sequence
ttttttttttttttggttgt

SEQ ID NO: 582358 - DNA, 20 bp, Artificial
  CRISPR gRNA sequence
tttttttttttttggttgtc

SEQ ID NO: 582359 - DNA, 20 bp, Artificial
  CRISPR gRNA sequence
ttttttttttttggttgtct

SEQ ID NO: 582360 - DNA, 20 bp, Artificial
  CRISPR gRNA sequence
tttttttttttggttgtctg

SEQ ID NO: 582361 - DNA, 20 bp, Artificial
  CRISPR gRNA sequence
ttttttttttggttgtctgg

SEQ ID NO: 582362 - DNA, 20 bp, Artificial
  CRISPR gRNA sequence
tttttttttggttgtctggt

SEQ ID NO: 582363 - DNA, 20 bp, Artificial
  CRISPR gRNA sequence
ttttttttggttgtctggtc

SEQ ID NO: 582364 - DNA, 20 bp, Artificial
  CRISPR gRNA sequence
tttttttggttgtctggtca

SEQ ID NO: 582365 - DNA, 20 bp, Artificial
  CRISPR gRNA sequence
ttttttggttgtctggtcat

SEQ ID NO: 582366 - DNA, 20 bp, Artificial
  CRISPR gRNA sequence
tttttggttgtctggtcatg

SEQ ID NO: 582367 - DNA, 20 bp, Artificial
  CRISPR gRNA sequence
ttttggttgtctggtcatgt

SEQ ID NO: 582368 - DNA, 20 bp, Artificial
  CRISPR gRNA sequence
tttggttgtctggtcatgtc

SEQ ID NO: 582369 - DNA, 20 bp, Artificial
  CRISPR gRNA sequence
ttggttgtctggtcatgtcc

SEQ ID NO: 582370 - DNA, 20 bp, Artificial
  CRISPR gRNA sequence
tggttgtctggtcatgtcct

SEQ ID NO: 582371 - DNA, 20 bp, Artificial
  CRISPR gRNA sequence
ggttgtctggtcatgtcctt

SEQ ID NO: 582372 - DNA, 20 bp, Artificial
  CRISPR gRNA sequence
gttgtctggtcatgtcctta

SEQ ID NO: 582373 - DNA, 20 bp, Artificial
  CRISPR gRNA sequence
tctggtcatgtccttactcc

SEQ ID NO: 582374 - DNA, 20 bp, Artificial
  CRISPR gRNA sequence
gtcatgtccttactcctaat

SEQ ID NO: 582375 - DNA, 20 bp, Artificial
  CRISPR gRNA sequence
actcctaatagggtgttcat

SEQ ID NO: 582376 - DNA, 20 bp, Artificial
  CRISPR gRNA sequence
ctcctaatagggtgttcatc

SEQ ID NO: 582377 - DNA, 20 bp, Artificial
  CRISPR gRNA sequence
ctaatagggtgttcatctta

SEQ ID NO: 582378 - DNA, 20 bp, Artificial
  CRISPR gRNA sequence
atagggtgttcatcttattt

SEQ ID NO: 582379 - DNA, 20 bp, Artificial
  CRISPR gRNA sequence
atcttatttttcccttattg

SEQ ID NO: 582380 - DNA, 20 bp, Artificial
  CRISPR gRNA sequence
atttttcccttattgatttg

SEQ ID NO: 582381 - DNA, 20 bp, Artificial
  CRISPR gRNA sequence
tttttcccttattgatttgc

SEQ ID NO: 582382 - DNA, 20 bp, Artificial
  CRISPR gRNA sequence
ttcccttattgatttgccac

SEQ ID NO: 582383 - DNA, 20 bp, Artificial
  CRISPR gRNA sequence
tcccttattgatttgccaca

SEQ ID NO: 582384 - DNA, 20 bp, Artificial
  CRISPR gRNA sequence
cccttattgatttgccacag

SEQ ID NO: 582385 - DNA, 20 bp, Artificial
  CRISPR gRNA sequence
ccttattgatttgccacagc

SEQ ID NO: 582386 - DNA, 20 bp, Artificial
  CRISPR gRNA sequence
attgatttgccacagctctt

SEQ ID NO: 582387 - DNA, 20 bp, Artificial
  CRISPR gRNA sequence
ttgatttgccacagctcttt

SEQ ID NO: 582388 - DNA, 20 bp, Artificial
  CRISPR gRNA sequence
atttgccacagctctttatt

SEQ ID NO: 582389 - DNA, 20 bp, Artificial
  CRISPR gRNA sequence
gccacagctctttatttgga

SEQ ID NO: 582390 - DNA, 20 bp, Artificial
  CRISPR gRNA sequence
ccacagctctttatttggaa

SEQ ID NO: 582391 - DNA, 20 bp, Artificial
  CRISPR gRNA sequence
tttatttggaatggttatta

SEQ ID NO: 582392 - DNA, 20 bp, Artificial
  CRISPR gRNA sequence
tatttggaatggttattaac

SEQ ID NO: 582393 - DNA, 20 bp, Artificial
  CRISPR gRNA sequence
atttggaatggttattaacc

SEQ ID NO: 582394 - DNA, 20 bp, Artificial
  CRISPR gRNA sequence
tttggaatggttattaacct

SEQ ID NO: 582395 - DNA, 20 bp, Artificial
  CRISPR gRNA sequence
ggaatggttattaacctttc

SEQ ID NO: 582396 - DNA, 20 bp, Artificial
  CRISPR gRNA sequence
gaatggttattaacctttca

SEQ ID NO: 582397 - DNA, 20 bp, Artificial
  CRISPR gRNA sequence
ttaacctttcatcagccatt

SEQ ID NO: 582398 - DNA, 20 bp, Artificial
  CRISPR gRNA sequence
acctttcatcagccattaca

SEQ ID NO: 582399 - DNA, 20 bp, Artificial
  CRISPR gRNA sequence
tcatcagccattacatatat

SEQ ID NO: 582400 - DNA, 20 bp, Artificial
  CRISPR gRNA sequence
catcagccattacatatata

SEQ ID NO: 582401 - DNA, 20 bp, Artificial
  CRISPR gRNA sequence
atcagccattacatatatag

SEQ ID NO: 582402 - DNA, 20 bp, Artificial
  CRISPR gRNA sequence
catatatagcaaatattttc

SEQ ID NO: 582403 - DNA, 20 bp, Artificial
  CRISPR gRNA sequence
tccccaattcatcatttgct

SEQ ID NO: 582404 - DNA, 20 bp, Artificial
  CRISPR gRNA sequence
ccccaattcatcatttgctt

SEQ ID NO: 582405 - DNA, 20 bp, Artificial
  CRISPR gRNA sequence
cccaattcatcatttgcttt

SEQ ID NO: 582406 - DNA, 20 bp, Artificial
  CRISPR gRNA sequence
atcatttgctttttttctat

SEQ ID NO: 582407 - DNA, 20 bp, Artificial
  CRISPR gRNA sequence
gctttttttctatttgttta

SEQ ID NO: 582408 - DNA, 20 bp, Artificial
  CRISPR gRNA sequence
ctttttttctatttgtttat

SEQ ID NO: 582409 - DNA, 20 bp, Artificial
  CRISPR gRNA sequence
tttttctatttgtttatggt

SEQ ID NO: 582410 - DNA, 20 bp, Artificial
  CRISPR gRNA sequence
ttttctatttgtttatggtg

SEQ ID NO: 582411 - DNA, 20 bp, Artificial
  CRISPR gRNA sequence
tttctatttgtttatggtgt

SEQ ID NO: 582412 - DNA, 20 bp, Artificial
  CRISPR gRNA sequence
ttctatttgtttatggtgtt

SEQ ID NO: 582413 - DNA, 20 bp, Artificial
  CRISPR gRNA sequence
tctatttgtttatggtgttt

SEQ ID NO: 582414 - DNA, 20 bp, Artificial
  CRISPR gRNA sequence
ctatttgtttatggtgtttt

SEQ ID NO: 582415 - DNA, 20 bp, Artificial
  CRISPR gRNA sequence
tatttgtttatggtgttttt

SEQ ID NO: 582416 - DNA, 20 bp, Artificial
  CRISPR gRNA sequence
tttgtttatggtgttttttg

SEQ ID NO: 582417 - DNA, 20 bp, Artificial
  CRISPR gRNA sequence
gtttatggtgttttttgtga

SEQ ID NO: 582418 - DNA, 20 bp, Artificial
  CRISPR gRNA sequence
tttatggtgttttttgtgat

SEQ ID NO: 582419 - DNA, 20 bp, Artificial
  CRISPR gRNA sequence
atggtgttttttgtgatgct

SEQ ID NO: 582420 - DNA, 20 bp, Artificial
  CRISPR gRNA sequence
tggtgttttttgtgatgctt

SEQ ID NO: 582421 - DNA, 20 bp, Artificial
  CRISPR gRNA sequence
tttgtgatgcttatgatggt

SEQ ID NO: 582422 - DNA, 20 bp, Artificial
  CRISPR gRNA sequence
ttgtgatgcttatgatggtt

SEQ ID NO: 582423 - DNA, 20 bp, Artificial
  CRISPR gRNA sequence
tgtgatgcttatgatggttt

SEQ ID NO: 582424 - DNA, 20 bp, Artificial
  CRISPR gRNA sequence
gtgatgcttatgatggtttt

SEQ ID NO: 582425 - DNA, 20 bp, Artificial
  CRISPR gRNA sequence
tgatgcttatgatggtttta

SEQ ID NO: 582426 - DNA, 20 bp, Artificial
  CRISPR gRNA sequence
atgatggttttatacagtca

SEQ ID NO: 582427 - DNA, 20 bp, Artificial
  CRISPR gRNA sequence
tgatggttttatacagtcaa

SEQ ID NO: 582428 - DNA, 20 bp, Artificial
  CRISPR gRNA sequence
tatacagtcaaataggttag

SEQ ID NO: 582429 - DNA, 20 bp, Artificial
  CRISPR gRNA sequence
atacagtcaaataggttagt

SEQ ID NO: 582430 - DNA, 20 bp, Artificial
  CRISPR gRNA sequence
tacagtcaaataggttagtc

SEQ ID NO: 582431 - DNA, 20 bp, Artificial
  CRISPR gRNA sequence
gtctttttttctgtggcttc

SEQ ID NO: 582432 - DNA, 20 bp, Artificial
  CRISPR gRNA sequence
tttttctgtggcttctgtct

SEQ ID NO: 582433 - DNA, 20 bp, Artificial
  CRISPR gRNA sequence
ttttctgtggcttctgtctc

SEQ ID NO: 582434 - DNA, 20 bp, Artificial
  CRISPR gRNA sequence
tttctgtggcttctgtctct

SEQ ID NO: 582435 - DNA, 20 bp, Artificial
  CRISPR gRNA sequence
ttctgtggcttctgtctctg

SEQ ID NO: 582436 - DNA, 20 bp, Artificial
  CRISPR gRNA sequence
tctgtggcttctgtctctgg

SEQ ID NO: 582437 - DNA, 20 bp, Artificial
  CRISPR gRNA sequence
ctgtggcttctgtctctggt

SEQ ID NO: 582438 - DNA, 20 bp, Artificial
  CRISPR gRNA sequence
tgtggcttctgtctctggtt

SEQ ID NO: 582439 - DNA, 20 bp, Artificial
  CRISPR gRNA sequence
tggcttctgtctctggtttt

SEQ ID NO: 582440 - DNA, 20 bp, Artificial
  CRISPR gRNA sequence
ctgtctctggttttgtgctt

SEQ ID NO: 582441 - DNA, 20 bp, Artificial
  CRISPR gRNA sequence
tgtctctggttttgtgctta

SEQ ID NO: 582442 - DNA, 20 bp, Artificial
  CRISPR gRNA sequence
tctctggttttgtgcttaga

SEQ ID NO: 582443 - DNA, 20 bp, Artificial
  CRISPR gRNA sequence
tggttttgtgcttagaaagt

SEQ ID NO: 582444 - DNA, 20 bp, Artificial
  CRISPR gRNA sequence
gttttgtgcttagaaagtcc

SEQ ID NO: 582445 - DNA, 20 bp, Artificial
  CRISPR gRNA sequence
tgtgcttagaaagtcctttc

SEQ ID NO: 582446 - DNA, 20 bp, Artificial
  CRISPR gRNA sequence
gtgcttagaaagtcctttcc

SEQ ID NO: 582447 - DNA, 20 bp, Artificial
  CRISPR gRNA sequence
tgcttagaaagtcctttcct

SEQ ID NO: 582448 - DNA, 20 bp, Artificial
  CRISPR gRNA sequence
agaaagtcctttcctacttg

SEQ ID NO: 582449 - DNA, 20 bp, Artificial
  CRISPR gRNA sequence
gaaagtcctttcctacttga

SEQ ID NO: 582450 - DNA, 20 bp, Artificial
  CRISPR gRNA sequence
tcctacttgaaaatgagata

SEQ ID NO: 582451 - DNA, 20 bp, Artificial
  CRISPR gRNA sequence
cctacttgaaaatgagataa

SEQ ID NO: 582452 - DNA, 20 bp, Artificial
  CRISPR gRNA sequence
ctacttgaaaatgagataaa

SEQ ID NO: 582453 - DNA, 20 bp, Artificial
  CRISPR gRNA sequence
cttgaaaatgagataaatgt

SEQ ID NO: 582454 - DNA, 20 bp, Artificial
  CRISPR gRNA sequence
gaaaatgagataaatgttca

SEQ ID NO: 582455 - DNA, 20 bp, Artificial
  CRISPR gRNA sequence
aaaatgagataaatgttcac

SEQ ID NO: 582456 - DNA, 20 bp, Artificial
  CRISPR gRNA sequence
acctatgttggcttctagtc

SEQ ID NO: 582457 - DNA, 20 bp, Artificial
  CRISPR gRNA sequence
tgttggcttctagtctcttt

SEQ ID NO: 582458 - DNA, 20 bp, Artificial
  CRISPR gRNA sequence
gcttctagtctcttttatgg

SEQ ID NO: 582459 - DNA, 20 bp, Artificial
  CRISPR gRNA sequence
ctagtctcttttatggcttc

SEQ ID NO: 582460 - DNA, 20 bp, Artificial
  CRISPR gRNA sequence
tagtctcttttatggcttca

SEQ ID NO: 582461 - DNA, 20 bp, Artificial
  CRISPR gRNA sequence
gtctcttttatggcttcatt

SEQ ID NO: 582462 - DNA, 20 bp, Artificial
  CRISPR gRNA sequence
ttttatggcttcattttttc

SEQ ID NO: 582463 - DNA, 20 bp, Artificial
  CRISPR gRNA sequence
ttatggcttcattttttcca

SEQ ID NO: 582464 - DNA, 20 bp, Artificial
  CRISPR gRNA sequence
tatggcttcattttttccat

SEQ ID NO: 582465 - DNA, 20 bp, Artificial
  CRISPR gRNA sequence
atggcttcattttttccatt

SEQ ID NO: 582466 - DNA, 20 bp, Artificial
  CRISPR gRNA sequence
tggcttcattttttccattt

SEQ ID NO: 582467 - DNA, 20 bp, Artificial
  CRISPR gRNA sequence
cattttttccatttactata

SEQ ID NO: 582468 - DNA, 20 bp, Artificial
  CRISPR gRNA sequence
attttttccatttactatag

SEQ ID NO: 582469 - DNA, 20 bp, Artificial
  CRISPR gRNA sequence
tttccatttactatagaggt

SEQ ID NO: 582470 - DNA, 20 bp, Artificial
  CRISPR gRNA sequence
ttccatttactatagaggtt

SEQ ID NO: 582471 - DNA, 20 bp, Artificial
  CRISPR gRNA sequence
tccatttactatagaggtta

SEQ ID NO: 582472 - DNA, 20 bp, Artificial
  CRISPR gRNA sequence
ccatttactatagaggttaa

SEQ ID NO: 582473 - DNA, 20 bp, Artificial
  CRISPR gRNA sequence
catttactatagaggttaag

SEQ ID NO: 582474 - DNA, 20 bp, Artificial
  CRISPR gRNA sequence
actatagaggttaagagtgt

SEQ ID NO: 582475 - DNA, 20 bp, Artificial
  CRISPR gRNA sequence
ctatagaggttaagagtgtg

SEQ ID NO: 582476 - DNA, 20 bp, Artificial
  CRISPR gRNA sequence
tagaggttaagagtgtgggt

SEQ ID NO: 582477 - DNA, 20 bp, Artificial
  CRISPR gRNA sequence
agagtgtgggtactggagcc

SEQ ID NO: 582478 - DNA, 20 bp, Artificial
  CRISPR gRNA sequence
gagccagactgtctgggaca

SEQ ID NO: 582479 - DNA, 20 bp, Artificial
  CRISPR gRNA sequence
tctgggacaaacccagcgtc

SEQ ID NO: 582480 - DNA, 20 bp, Artificial
  CRISPR gRNA sequence
ggacaaacccagcgtcaccc

SEQ ID NO: 582481 - DNA, 20 bp, Artificial
  CRISPR gRNA sequence
tgtgtgatttttagccaggc

SEQ ID NO: 582482 - DNA, 20 bp, Artificial
  CRISPR gRNA sequence
ttagccaggcacttaacctc

SEQ ID NO: 582483 - DNA, 20 bp, Artificial
  CRISPR gRNA sequence
tagccaggcacttaacctct

SEQ ID NO: 582484 - DNA, 20 bp, Artificial
  CRISPR gRNA sequence
agccaggcacttaacctctc

SEQ ID NO: 582485 - DNA, 20 bp, Artificial
  CRISPR gRNA sequence
gccaggcacttaacctctcc

SEQ ID NO: 582486 - DNA, 20 bp, Artificial
  CRISPR gRNA sequence
aacctctccatacctccatt

SEQ ID NO: 582487 - DNA, 20 bp, Artificial
  CRISPR gRNA sequence
acctctccatacctccattt

SEQ ID NO: 582488 - DNA, 20 bp, Artificial
  CRISPR gRNA sequence
tccatacctccatttcctca

SEQ ID NO: 582489 - DNA, 20 bp, Artificial
  CRISPR gRNA sequence
catacctccatttcctcata

SEQ ID NO: 582490 - DNA, 20 bp, Artificial
  CRISPR gRNA sequence
catttcctcatatgtactgc

SEQ ID NO: 582491 - DNA, 20 bp, Artificial
  CRISPR gRNA sequence
cctcatatgtactgcaatgg

SEQ ID NO: 582492 - DNA, 20 bp, Artificial
  CRISPR gRNA sequence
ctcatatgtactgcaatggt

SEQ ID NO: 582493 - DNA, 20 bp, Artificial
  CRISPR gRNA sequence
atatgtactgcaatggttat

SEQ ID NO: 582494 - DNA, 20 bp, Artificial
  CRISPR gRNA sequence
caatggttataatagtacct

SEQ ID NO: 582495 - DNA, 20 bp, Artificial
  CRISPR gRNA sequence
taatagtaccttcctcagga

SEQ ID NO: 582496 - DNA, 20 bp, Artificial
  CRISPR gRNA sequence
cctcaggagtctttgtttag

SEQ ID NO: 582497 - DNA, 20 bp, Artificial
  CRISPR gRNA sequence
ctcaggagtctttgtttaga

SEQ ID NO: 582498 - DNA, 20 bp, Artificial
  CRISPR gRNA sequence
aggagtctttgtttagatta

SEQ ID NO: 582499 - DNA, 20 bp, Artificial
  CRISPR gRNA sequence
tgtttagattaaaattttta

SEQ ID NO: 582500 - DNA, 20 bp, Artificial
  CRISPR gRNA sequence
gtttagattaaaatttttaa

SEQ ID NO: 582501 - DNA, 20 bp, Artificial
  CRISPR gRNA sequence
tttagattaaaatttttaac

SEQ ID NO: 582502 - DNA, 20 bp, Artificial
  CRISPR gRNA sequence
agattaaaatttttaaccac

SEQ ID NO: 582503 - DNA, 20 bp, Artificial
  CRISPR gRNA sequence
gattaaaatttttaaccaca

SEQ ID NO: 582504 - DNA, 20 bp, Artificial
  CRISPR gRNA sequence
aaatttttaaccacagtaaa

SEQ ID NO: 582505 - DNA, 20 bp, Artificial
  CRISPR gRNA sequence
ttaaccacagtaaatactta

SEQ ID NO: 582506 - DNA, 20 bp, Artificial
  CRISPR gRNA sequence
taaccacagtaaatacttag

SEQ ID NO: 582507 - DNA, 20 bp, Artificial
  CRISPR gRNA sequence
aaccacagtaaatacttagc

SEQ ID NO: 582508 - DNA, 20 bp, Artificial
  CRISPR gRNA sequence
accacagtaaatacttagca

SEQ ID NO: 582509 - DNA, 20 bp, Artificial
  CRISPR gRNA sequence
agcacaaggcctgacacaca

SEQ ID NO: 582510 - DNA, 20 bp, Artificial
  CRISPR gRNA sequence
gcacaaggcctgacacacaa

SEQ ID NO: 582511 - DNA, 20 bp, Artificial
  CRISPR gRNA sequence
acacacaataaacccaagat

SEQ ID NO: 582512 - DNA, 20 bp, Artificial
  CRISPR gRNA sequence
ggtgttaaaacttatatctt

SEQ ID NO: 582513 - DNA, 20 bp, Artificial
  CRISPR gRNA sequence
aaacttatatcttgaatgga

SEQ ID NO: 582514 - DNA, 20 bp, Artificial
  CRISPR gRNA sequence
atatcttgaatggatctggg

SEQ ID NO: 582515 - DNA, 20 bp, Artificial
  CRISPR gRNA sequence
tatcttgaatggatctgggc

SEQ ID NO: 582516 - DNA, 20 bp, Artificial
  CRISPR gRNA sequence
gaatggatctgggcatttta

SEQ ID NO: 582517 - DNA, 20 bp, Artificial
  CRISPR gRNA sequence
aatggatctgggcattttag

SEQ ID NO: 582518 - DNA, 20 bp, Artificial
  CRISPR gRNA sequence
ggcattttagggtatatgat

SEQ ID NO: 582519 - DNA, 20 bp, Artificial
  CRISPR gRNA sequence
tagggtatatgatgatggtg

SEQ ID NO: 582520 - DNA, 20 bp, Artificial
  CRISPR gRNA sequence
agggtatatgatgatggtga

SEQ ID NO: 582521 - DNA, 20 bp, Artificial
  CRISPR gRNA sequence
gggtatatgatgatggtgac

SEQ ID NO: 582522 - DNA, 20 bp, Artificial
  CRISPR gRNA sequence
caaactgggcagggaggggt

SEQ ID NO: 582523 - DNA, 20 bp, Artificial
  CRISPR gRNA sequence
aaactgggcagggaggggtt

SEQ ID NO: 582524 - DNA, 20 bp, Artificial
  CRISPR gRNA sequence
ggcagggaggggttgttggg

SEQ ID NO: 582525 - DNA, 20 bp, Artificial
  CRISPR gRNA sequence
ttgggataatggactgacta

SEQ ID NO: 582526 - DNA, 20 bp, Artificial
  CRISPR gRNA sequence
ggataatggactgactattc

SEQ ID NO: 582527 - DNA, 20 bp, Artificial
  CRISPR gRNA sequence
actattcactcaataacttt

SEQ ID NO: 582528 - DNA, 20 bp, Artificial
  CRISPR gRNA sequence
ttcactcaataactttatct

SEQ ID NO: 582529 - DNA, 20 bp, Artificial
  CRISPR gRNA sequence
actcaataactttatcttct

SEQ ID NO: 582530 - DNA, 20 bp, Artificial
  CRISPR gRNA sequence
aataactttatcttctccct

SEQ ID NO: 582531 - DNA, 20 bp, Artificial
  CRISPR gRNA sequence
tatcttctccctaattatct

SEQ ID NO: 582532 - DNA, 20 bp, Artificial
  CRISPR gRNA sequence
atcttctccctaattatctc

SEQ ID NO: 582533 - DNA, 20 bp, Artificial
  CRISPR gRNA sequence
tcttctccctaattatctca

SEQ ID NO: 582534 - DNA, 20 bp, Artificial
  CRISPR gRNA sequence
ctccctaattatctcagaca

SEQ ID NO: 582535 - DNA, 20 bp, Artificial
  CRISPR gRNA sequence
tccctaattatctcagacac

SEQ ID NO: 582536 - DNA, 20 bp, Artificial
  CRISPR gRNA sequence
cctaattatctcagacacat

SEQ ID NO: 582537 - DNA, 20 bp, Artificial
  CRISPR gRNA sequence
attatctcagacacatttgt

SEQ ID NO: 582538 - DNA, 20 bp, Artificial
  CRISPR gRNA sequence
tctcagacacatttgttaaa

SEQ ID NO: 582539 - DNA, 20 bp, Artificial
  CRISPR gRNA sequence
agacacatttgttaaaccat

SEQ ID NO: 582540 - DNA, 20 bp, Artificial
  CRISPR gRNA sequence
gttaaaccatactccatggt

SEQ ID NO: 582541 - DNA, 20 bp, Artificial
  CRISPR gRNA sequence
ttaaaccatactccatggtc

SEQ ID NO: 582542 - DNA, 20 bp, Artificial
  CRISPR gRNA sequence
aaccatactccatggtcctc

SEQ ID NO: 582543 - DNA, 20 bp, Artificial
  CRISPR gRNA sequence
catggtcctccagtttgaaa

SEQ ID NO: 582544 - DNA, 20 bp, Artificial
  CRISPR gRNA sequence
cagtttgaaatgccacattc

SEQ ID NO: 582545 - DNA, 20 bp, Artificial
  CRISPR gRNA sequence
gaaatgccacattcatcaca

SEQ ID NO: 582546 - DNA, 20 bp, Artificial
  CRISPR gRNA sequence
aaatgccacattcatcacaa

SEQ ID NO: 582547 - DNA, 20 bp, Artificial
  CRISPR gRNA sequence
atcacaaattcagttctctc

SEQ ID NO: 582548 - DNA, 20 bp, Artificial
  CRISPR gRNA sequence
agttctctccatatgtgggt

SEQ ID NO: 582549 - DNA, 20 bp, Artificial
  CRISPR gRNA sequence
tctccatatgtgggtccatg

SEQ ID NO: 582550 - DNA, 20 bp, Artificial
  CRISPR gRNA sequence
tccatatgtgggtccatgtc

SEQ ID NO: 582551 - DNA, 20 bp, Artificial
  CRISPR gRNA sequence
catatgtgggtccatgtcca

SEQ ID NO: 582552 - DNA, 20 bp, Artificial
  CRISPR gRNA sequence
tctattctgttctcttcccc

SEQ ID NO: 582553 - DNA, 20 bp, Artificial
  CRISPR gRNA sequence
ctattctgttctcttcccca

SEQ ID NO: 582554 - DNA, 20 bp, Artificial
  CRISPR gRNA sequence
tattctgttctcttccccag

SEQ ID NO: 582555 - DNA, 20 bp, Artificial
  CRISPR gRNA sequence
ttctgttctcttccccagta

SEQ ID NO: 582556 - DNA, 20 bp, Artificial
  CRISPR gRNA sequence
tgttctcttccccagtatct

SEQ ID NO: 582557 - DNA, 20 bp, Artificial
  CRISPR gRNA sequence
ttctcttccccagtatctgt

SEQ ID NO: 582558 - DNA, 20 bp, Artificial
  CRISPR gRNA sequence
tcttccccagtatctgttct

SEQ ID NO: 582559 - DNA, 20 bp, Artificial
  CRISPR gRNA sequence
ttccccagtatctgttctta

SEQ ID NO: 582560 - DNA, 20 bp, Artificial
  CRISPR gRNA sequence
ccccagtatctgttcttata

SEQ ID NO: 582561 - DNA, 20 bp, Artificial
  CRISPR gRNA sequence
cccagtatctgttcttatac

SEQ ID NO: 582562 - DNA, 20 bp, Artificial
  CRISPR gRNA sequence
ttcttataccagggccacac

SEQ ID NO: 582563 - DNA, 20 bp, Artificial
  CRISPR gRNA sequence
ttataccagggccacactgt

SEQ ID NO: 582564 - DNA, 20 bp, Artificial
  CRISPR gRNA sequence
ataccagggccacactgttt

SEQ ID NO: 582565 - DNA, 20 bp, Artificial
  CRISPR gRNA sequence
taccagggccacactgtttt

SEQ ID NO: 582566 - DNA, 20 bp, Artificial
  CRISPR gRNA sequence
ttttgctgattgttgctttg

SEQ ID NO: 582567 - DNA, 20 bp, Artificial
  CRISPR gRNA sequence
tgctgattgttgctttgcaa

SEQ ID NO: 582568 - DNA, 20 bp, Artificial
  CRISPR gRNA sequence
gctgattgttgctttgcaat

SEQ ID NO: 582569 - DNA, 20 bp, Artificial
  CRISPR gRNA sequence
ctgattgttgctttgcaata

SEQ ID NO: 582570 - DNA, 20 bp, Artificial
  CRISPR gRNA sequence
attgttgctttgcaatacaa

SEQ ID NO: 582571 - DNA, 20 bp, Artificial
  CRISPR gRNA sequence
ttgctttgcaatacaattca

SEQ ID NO: 582572 - DNA, 20 bp, Artificial
  CRISPR gRNA sequence
ctttgcaatacaattcaata

SEQ ID NO: 582573 - DNA, 20 bp, Artificial
  CRISPR gRNA sequence
tgcaatacaattcaataccc

SEQ ID NO: 582574 - DNA, 20 bp, Artificial
  CRISPR gRNA sequence
gcaatacaattcaataccca

SEQ ID NO: 582575 - DNA, 20 bp, Artificial
  CRISPR gRNA sequence
caatacaattcaatacccag

SEQ ID NO: 582576 - DNA, 20 bp, Artificial
  CRISPR gRNA sequence
aatacccagccatgggtgtc

SEQ ID NO: 582577 - DNA, 20 bp, Artificial
  CRISPR gRNA sequence
gcaccttgcccttctttatt

SEQ ID NO: 582578 - DNA, 20 bp, Artificial
  CRISPR gRNA sequence
gcccttctttattcttgatt

SEQ ID NO: 582579 - DNA, 20 bp, Artificial
  CRISPR gRNA sequence
cccttctttattcttgatta

SEQ ID NO: 582580 - DNA, 20 bp, Artificial
  CRISPR gRNA sequence
ctttattcttgattatttca

SEQ ID NO: 582581 - DNA, 20 bp, Artificial
  CRISPR gRNA sequence
tttattcttgattatttcag

SEQ ID NO: 582582 - DNA, 20 bp, Artificial
  CRISPR gRNA sequence
tattcttgattatttcaggc

SEQ ID NO: 582583 - DNA, 20 bp, Artificial
  CRISPR gRNA sequence
attcttgattatttcaggca

SEQ ID NO: 582584 - DNA, 20 bp, Artificial
  CRISPR gRNA sequence
ttcttgattatttcaggcag

SEQ ID NO: 582585 - DNA, 20 bp, Artificial
  CRISPR gRNA sequence
ttgattatttcaggcagcat

SEQ ID NO: 582586 - DNA, 20 bp, Artificial
  CRISPR gRNA sequence
gattatttcaggcagcatca

SEQ ID NO: 582587 - DNA, 20 bp, Artificial
  CRISPR gRNA sequence
attatttcaggcagcatcag

SEQ ID NO: 582588 - DNA, 20 bp, Artificial
  CRISPR gRNA sequence
tttcaggcagcatcagttga

SEQ ID NO: 582589 - DNA, 20 bp, Artificial
  CRISPR gRNA sequence
caggcagcatcagttgaacc

SEQ ID NO: 582590 - DNA, 20 bp, Artificial
  CRISPR gRNA sequence
aggcagcatcagttgaacca

SEQ ID NO: 582591 - DNA, 20 bp, Artificial
  CRISPR gRNA sequence
aaccagccagagaccagcaa

SEQ ID NO: 582592 - DNA, 20 bp, Artificial
  CRISPR gRNA sequence
ttatttgaggcaatcctcct

SEQ ID NO: 582593 - DNA, 20 bp, Artificial
  CRISPR gRNA sequence
atttgaggcaatcctcctct

SEQ ID NO: 582594 - DNA, 20 bp, Artificial
  CRISPR gRNA sequence
tttgaggcaatcctcctctc

SEQ ID NO: 582595 - DNA, 20 bp, Artificial
  CRISPR gRNA sequence
gaggcaatcctcctctcgca

SEQ ID NO: 582596 - DNA, 20 bp, Artificial
  CRISPR gRNA sequence
aggcaatcctcctctcgcac

SEQ ID NO: 582597 - DNA, 20 bp, Artificial
  CRISPR gRNA sequence
ctctcgcacacatgcactct

SEQ ID NO: 582598 - DNA, 20 bp, Artificial
  CRISPR gRNA sequence
tcgcacacatgcactctggc

SEQ ID NO: 582599 - DNA, 20 bp, Artificial
  CRISPR gRNA sequence
gcacacatgcactctggctc

SEQ ID NO: 582600 - DNA, 20 bp, Artificial
  CRISPR gRNA sequence
tggctctccatgcatgtgtc

SEQ ID NO: 582601 - DNA, 20 bp, Artificial
  CRISPR gRNA sequence
gctctccatgcatgtgtcca

SEQ ID NO: 582602 - DNA, 20 bp, Artificial
  CRISPR gRNA sequence
tccatgcatgtgtccatttc

SEQ ID NO: 582603 - DNA, 20 bp, Artificial
  CRISPR gRNA sequence
catgcatgtgtccatttctc

SEQ ID NO: 582604 - DNA, 20 bp, Artificial
  CRISPR gRNA sequence
ctctcaatgtctctcactat

SEQ ID NO: 582605 - DNA, 20 bp, Artificial
  CRISPR gRNA sequence
tctcaatgtctctcactatc

SEQ ID NO: 582606 - DNA, 20 bp, Artificial
  CRISPR gRNA sequence
tcaatgtctctcactatctc

SEQ ID NO: 582607 - DNA, 20 bp, Artificial
  CRISPR gRNA sequence
aatgtctctcactatctctt

SEQ ID NO: 582608 - DNA, 20 bp, Artificial
  CRISPR gRNA sequence
tcactatctcttgttctctc

SEQ ID NO: 582609 - DNA, 20 bp, Artificial
  CRISPR gRNA sequence
actatctcttgttctctctt

SEQ ID NO: 582610 - DNA, 20 bp, Artificial
  CRISPR gRNA sequence
tctcttgttctctcttgctc

SEQ ID NO: 582611 - DNA, 20 bp, Artificial
  CRISPR gRNA sequence
ttgttctctcttgctcgctc

SEQ ID NO: 582612 - DNA, 20 bp, Artificial
  CRISPR gRNA sequence
gttctctcttgctcgctctt

SEQ ID NO: 582613 - DNA, 20 bp, Artificial
  CRISPR gRNA sequence
ttctctcttgctcgctcttt

SEQ ID NO: 582614 - DNA, 20 bp, Artificial
  CRISPR gRNA sequence
tctcttgctcgctctttgtg

SEQ ID NO: 582615 - DNA, 20 bp, Artificial
  CRISPR gRNA sequence
tcttgctcgctctttgtgtg

SEQ ID NO: 582616 - DNA, 20 bp, Artificial
  CRISPR gRNA sequence
ttgctcgctctttgtgtgtg

SEQ ID NO: 582617 - DNA, 20 bp, Artificial
  CRISPR gRNA sequence
gctcgctctttgtgtgtgtc

SEQ ID NO: 582618 - DNA, 20 bp, Artificial
  CRISPR gRNA sequence
ctcgctctttgtgtgtgtct

SEQ ID NO: 582619 - DNA, 20 bp, Artificial
  CRISPR gRNA sequence
gctctttgtgtgtgtctctt

SEQ ID NO: 582620 - DNA, 20 bp, Artificial
  CRISPR gRNA sequence
tttgtgtgtgtctctttgtc

SEQ ID NO: 582621 - DNA, 20 bp, Artificial
  CRISPR gRNA sequence
tgtgtgtgtctctttgtctc

SEQ ID NO: 582622 - DNA, 20 bp, Artificial
  CRISPR gRNA sequence
gtgtgtgtctctttgtctct

SEQ ID NO: 582623 - DNA, 20 bp, Artificial
  CRISPR gRNA sequence
tgtgtgtctctttgtctcta

SEQ ID NO: 582624 - DNA, 20 bp, Artificial
  CRISPR gRNA sequence
tttgtctctatgtatcccta

SEQ ID NO: 582625 - DNA, 20 bp, Artificial
  CRISPR gRNA sequence
tgtctctatgtatccctatc

SEQ ID NO: 582626 - DNA, 20 bp, Artificial
  CRISPR gRNA sequence
gtctctatgtatccctatct

SEQ ID NO: 582627 - DNA, 20 bp, Artificial
  CRISPR gRNA sequence
tctctatgtatccctatctc

SEQ ID NO: 582628 - DNA, 20 bp, Artificial
  CRISPR gRNA sequence
tatgtatccctatctctcag

SEQ ID NO: 582629 - DNA, 20 bp, Artificial
  CRISPR gRNA sequence
tgtatccctatctctcagcc

SEQ ID NO: 582630 - DNA, 20 bp, Artificial
  CRISPR gRNA sequence
tctctcagccagtcccctgg

SEQ ID NO: 582631 - DNA, 20 bp, Artificial
  CRISPR gRNA sequence
tcagccagtcccctggatag

SEQ ID NO: 582632 - DNA, 20 bp, Artificial
  CRISPR gRNA sequence
agccagtcccctggatagag

SEQ ID NO: 582633 - DNA, 20 bp, Artificial
  CRISPR gRNA sequence
gatagaggggcaattgtcaa

SEQ ID NO: 582634 - DNA, 20 bp, Artificial
  CRISPR gRNA sequence
tcaacttgaagccctgcaga

SEQ ID NO: 582635 - DNA, 20 bp, Artificial
  CRISPR gRNA sequence
gaagccctgcagacacctaa

SEQ ID NO: 582636 - DNA, 20 bp, Artificial
  CRISPR gRNA sequence
aagccctgcagacacctaat

SEQ ID NO: 582637 - DNA, 20 bp, Artificial
  CRISPR gRNA sequence
cagacacctaatgacttaac

SEQ ID NO: 582638 - DNA, 20 bp, Artificial
  CRISPR gRNA sequence
atgacttaaccagacagcgt

SEQ ID NO: 582639 - DNA, 20 bp, Artificial
  CRISPR gRNA sequence
aaccagacagcgtagaaggg

SEQ ID NO: 582640 - DNA, 20 bp, Artificial
  CRISPR gRNA sequence
accagacagcgtagaagggc

SEQ ID NO: 582641 - DNA, 20 bp, Artificial
  CRISPR gRNA sequence
gcccttgtctactccacgcc

SEQ ID NO: 582642 - DNA, 20 bp, Artificial
  CRISPR gRNA sequence
gtctactccacgcctctccg

SEQ ID NO: 582643 - DNA, 20 bp, Artificial
  CRISPR gRNA sequence
tctactccacgcctctccgt

SEQ ID NO: 582644 - DNA, 20 bp, Artificial
  CRISPR gRNA sequence
ctccacgcctctccgtgctc

SEQ ID NO: 582645 - DNA, 20 bp, Artificial
  CRISPR gRNA sequence
cacgcctctccgtgctcagt

SEQ ID NO: 582646 - DNA, 20 bp, Artificial
  CRISPR gRNA sequence
tccgtgctcagtgtagaagg

SEQ ID NO: 582647 - DNA, 20 bp, Artificial
  CRISPR gRNA sequence
cgtgctcagtgtagaagggc

SEQ ID NO: 582648 - DNA, 20 bp, Artificial
  CRISPR gRNA sequence
agtgtagaagggcaaattga

SEQ ID NO: 582649 - DNA, 20 bp, Artificial
  CRISPR gRNA sequence
aagaccagagatctcagggc

SEQ ID NO: 582650 - DNA, 20 bp, Artificial
  CRISPR gRNA sequence
agggcctcaccgaaatgcag

SEQ ID NO: 582651 - DNA, 20 bp, Artificial
  CRISPR gRNA sequence
accgaaatgcagcggcagag

SEQ ID NO: 582652 - DNA, 20 bp, Artificial
  CRISPR gRNA sequence
aaatccaagcctagatctca

SEQ ID NO: 582653 - DNA, 20 bp, Artificial
  CRISPR gRNA sequence
gatctcaggactctaggtgg

SEQ ID NO: 582654 - DNA, 20 bp, Artificial
  CRISPR gRNA sequence
aggactctaggtgggaccct

SEQ ID NO: 582655 - DNA, 20 bp, Artificial
  CRISPR gRNA sequence
taggtgggaccctggttctg

SEQ ID NO: 582656 - DNA, 20 bp, Artificial
  CRISPR gRNA sequence
ggtgggaccctggttctggc

SEQ ID NO: 582657 - DNA, 20 bp, Artificial
  CRISPR gRNA sequence
gttctggctctctccccaac

SEQ ID NO: 582658 - DNA, 20 bp, Artificial
  CRISPR gRNA sequence
tggctctctccccaactgca

SEQ ID NO: 582659 - DNA, 20 bp, Artificial
  CRISPR gRNA sequence
gctctctccccaactgcagg

SEQ ID NO: 582660 - DNA, 20 bp, Artificial
  CRISPR gRNA sequence
tctccccaactgcaggcctc

SEQ ID NO: 582661 - DNA, 20 bp, Artificial
  CRISPR gRNA sequence
tccccaactgcaggcctcag

SEQ ID NO: 582662 - DNA, 20 bp, Artificial
  CRISPR gRNA sequence
cccaactgcaggcctcagtt

SEQ ID NO: 582663 - DNA, 20 bp, Artificial
  CRISPR gRNA sequence
caggcctcagtttacccctc

SEQ ID NO: 582664 - DNA, 20 bp, Artificial
  CRISPR gRNA sequence
agtttacccctcagcaccca

SEQ ID NO: 582665 - DNA, 20 bp, Artificial
  CRISPR gRNA sequence
acccctcagcacccagaagg

SEQ ID NO: 582666 - DNA, 20 bp, Artificial
  CRISPR gRNA sequence
cccctcagcacccagaaggg

SEQ ID NO: 582667 - DNA, 20 bp, Artificial
  CRISPR gRNA sequence
agcacccagaagggggaagg

SEQ ID NO: 582668 - DNA, 20 bp, Artificial
  CRISPR gRNA sequence
ggctaccattcccccttctg

SEQ ID NO: 582669 - DNA, 20 bp, Artificial
  CRISPR gRNA sequence
ccattcccccttctgccttc

SEQ ID NO: 582670 - DNA, 20 bp, Artificial
  CRISPR gRNA sequence
ccccttctgccttctcacac

SEQ ID NO: 582671 - DNA, 20 bp, Artificial
  CRISPR gRNA sequence
ctgccttctcacacgttgga

SEQ ID NO: 582672 - DNA, 20 bp, Artificial
  CRISPR gRNA sequence
tgccttctcacacgttggac

SEQ ID NO: 582673 - DNA, 20 bp, Artificial
  CRISPR gRNA sequence
ccttctcacacgttggaccc

SEQ ID NO: 582674 - DNA, 20 bp, Artificial
  CRISPR gRNA sequence
ctcacacgttggaccccaac

SEQ ID NO: 582675 - DNA, 20 bp, Artificial
  CRISPR gRNA sequence
tcacacgttggaccccaact

SEQ ID NO: 582676 - DNA, 20 bp, Artificial
  CRISPR gRNA sequence
acacgttggaccccaacttc

SEQ ID NO: 582677 - DNA, 20 bp, Artificial
  CRISPR gRNA sequence
gaccccaacttcccacaggt

SEQ ID NO: 582678 - DNA, 20 bp, Artificial
  CRISPR gRNA sequence
cccacaggttggacgatcca

SEQ ID NO: 582679 - DNA, 20 bp, Artificial
  CRISPR gRNA sequence
ccacaggttggacgatccac

SEQ ID NO: 582680 - DNA, 20 bp, Artificial
  CRISPR gRNA sequence
gacgatccacgatcacagtg

SEQ ID NO: 582681 - DNA, 20 bp, Artificial
  CRISPR gRNA sequence
acaagagctgggctaggtga

SEQ ID NO: 582682 - DNA, 20 bp, Artificial
  CRISPR gRNA sequence
ggctaggtgaggccccggac

SEQ ID NO: 582683 - DNA, 20 bp, Artificial
  CRISPR gRNA sequence
ggtgaggccccggactccat

SEQ ID NO: 582684 - DNA, 20 bp, Artificial
  CRISPR gRNA sequence
cataggtcaggaggcctagt

SEQ ID NO: 582685 - DNA, 20 bp, Artificial
  CRISPR gRNA sequence
gttggccagagcgtggtgat

SEQ ID NO: 582686 - DNA, 20 bp, Artificial
  CRISPR gRNA sequence
gccagagcgtggtgatgatg

SEQ ID NO: 582687 - DNA, 20 bp, Artificial
  CRISPR gRNA sequence
tgtgtccccagagctggtgc

SEQ ID NO: 582688 - DNA, 20 bp, Artificial
  CRISPR gRNA sequence
gtgctggtccccgaaaacct

SEQ ID NO: 582689 - DNA, 20 bp, Artificial
  CRISPR gRNA sequence
gtccccgaaaaccttgattg

SEQ ID NO: 582690 - DNA, 20 bp, Artificial
  CRISPR gRNA sequence
gattgtggggcccctctaga

SEQ ID NO: 582691 - DNA, 20 bp, Artificial
  CRISPR gRNA sequence
attgtggggcccctctagag

SEQ ID NO: 582692 - DNA, 20 bp, Artificial
  CRISPR gRNA sequence
tggggcccctctagagagtc

SEQ ID NO: 582693 - DNA, 20 bp, Artificial
  CRISPR gRNA sequence
tagagagtctgatgatgggc

SEQ ID NO: 582694 - DNA, 20 bp, Artificial
  CRISPR gRNA sequence
gagagtctgatgatgggctc

SEQ ID NO: 582695 - DNA, 20 bp, Artificial
  CRISPR gRNA sequence
atgatgggctctgtattggc

SEQ ID NO: 582696 - DNA, 20 bp, Artificial
  CRISPR gRNA sequence
tgtattggcgaaggctgagg

SEQ ID NO: 582697 - DNA, 20 bp, Artificial
  CRISPR gRNA sequence
tattggcgaaggctgaggct

SEQ ID NO: 582698 - DNA, 20 bp, Artificial
  CRISPR gRNA sequence
gcgaaggctgaggcttttcc

SEQ ID NO: 582699 - DNA, 20 bp, Artificial
  CRISPR gRNA sequence
aggcttttccagctcccccc

SEQ ID NO: 582700 - DNA, 20 bp, Artificial
  CRISPR gRNA sequence
ttccagctccccccatgagg

SEQ ID NO: 582701 - DNA, 20 bp, Artificial
  CRISPR gRNA sequence
tccagctccccccatgaggc

SEQ ID NO: 582702 - DNA, 20 bp, Artificial
  CRISPR gRNA sequence
ccagctccccccatgaggcc

SEQ ID NO: 582703 - DNA, 20 bp, Artificial
  CRISPR gRNA sequence
cagctccccccatgaggccc

SEQ ID NO: 582704 - DNA, 20 bp, Artificial
  CRISPR gRNA sequence
cccccatgaggcccagacca

SEQ ID NO: 582705 - DNA, 20 bp, Artificial
  CRISPR gRNA sequence
aacctcctcctccccctgtt

SEQ ID NO: 582706 - DNA, 20 bp, Artificial
  CRISPR gRNA sequence
ctcctccccctgttgccatc

SEQ ID NO: 582707 - DNA, 20 bp, Artificial
  CRISPR gRNA sequence
ctccccctgttgccatctct

SEQ ID NO: 582708 - DNA, 20 bp, Artificial
  CRISPR gRNA sequence
cccctgttgccatctctggc

SEQ ID NO: 582709 - DNA, 20 bp, Artificial
  CRISPR gRNA sequence
ttgccatctctggcggagtg

SEQ ID NO: 582710 - DNA, 20 bp, Artificial
  CRISPR gRNA sequence
ccatctctggcggagtggcc

SEQ ID NO: 582711 - DNA, 20 bp, Artificial
  CRISPR gRNA sequence
tggcggagtggccatgtatt

SEQ ID NO: 582712 - DNA, 20 bp, Artificial
  CRISPR gRNA sequence
gcggagtggccatgtatttg

SEQ ID NO: 582713 - DNA, 20 bp, Artificial
  CRISPR gRNA sequence
gggaacgttgttccagagtg

SEQ ID NO: 582714 - DNA, 20 bp, Artificial
  CRISPR gRNA sequence
ggaacgttgttccagagtgg

SEQ ID NO: 582715 - DNA, 20 bp, Artificial
  CRISPR gRNA sequence
ttccagagtggacagggaga

SEQ ID NO: 582716 - DNA, 20 bp, Artificial
  CRISPR gRNA sequence
cagagtggacagggagactg

SEQ ID NO: 582717 - DNA, 20 bp, Artificial
  CRISPR gRNA sequence
aggccctagggaggctggct

SEQ ID NO: 582718 - DNA, 20 bp, Artificial
  CRISPR gRNA sequence
gggaggctggctctgtttcc

SEQ ID NO: 582719 - DNA, 20 bp, Artificial
  CRISPR gRNA sequence
gctctgtttccaggcctggt

SEQ ID NO: 582720 - DNA, 20 bp, Artificial
  CRISPR gRNA sequence
tgtttccaggcctggtaggc

SEQ ID NO: 582721 - DNA, 20 bp, Artificial
  CRISPR gRNA sequence
tttccaggcctggtaggcaa

SEQ ID NO: 582722 - DNA, 20 bp, Artificial
  CRISPR gRNA sequence
ccaggcctggtaggcaagag

SEQ ID NO: 582723 - DNA, 20 bp, Artificial
  CRISPR gRNA sequence
caggcctggtaggcaagagg

SEQ ID NO: 582724 - DNA, 20 bp, Artificial
  CRISPR gRNA sequence
gtaggcaagaggccctatga

SEQ ID NO: 582725 - DNA, 20 bp, Artificial
  CRISPR gRNA sequence
tgaagcagcaagctgcctga

SEQ ID NO: 582726 - DNA, 20 bp, Artificial
  CRISPR gRNA sequence
cctgactttcagatggttcc

SEQ ID NO: 582727 - DNA, 20 bp, Artificial
  CRISPR gRNA sequence
actttcagatggttccaagg

SEQ ID NO: 582728 - DNA, 20 bp, Artificial
  CRISPR gRNA sequence
tcagatggttccaaggagtt

SEQ ID NO: 582729 - DNA, 20 bp, Artificial
  CRISPR gRNA sequence
cagatggttccaaggagttt

SEQ ID NO: 582730 - DNA, 20 bp, Artificial
  CRISPR gRNA sequence
agatggttccaaggagtttg

SEQ ID NO: 582731 - DNA, 20 bp, Artificial
  CRISPR gRNA sequence
caaggagtttggacaccagg

SEQ ID NO: 582732 - DNA, 20 bp, Artificial
  CRISPR gRNA sequence
ggacaccagggacactggcc

SEQ ID NO: 582733 - DNA, 20 bp, Artificial
  CRISPR gRNA sequence
gacaccagggacactggcct

SEQ ID NO: 582734 - DNA, 20 bp, Artificial
  CRISPR gRNA sequence
gcctacacatactgagactt

SEQ ID NO: 582735 - DNA, 20 bp, Artificial
  CRISPR gRNA sequence
cacatactgagactttggga

SEQ ID NO: 582736 - DNA, 20 bp, Artificial
  CRISPR gRNA sequence
agactttgggaccgtagacc

SEQ ID NO: 582737 - DNA, 20 bp, Artificial
  CRISPR gRNA sequence
tgggaccgtagaccccacag

SEQ ID NO: 582738 - DNA, 20 bp, Artificial
  CRISPR gRNA sequence
gggaccgtagaccccacagt

SEQ ID NO: 582739 - DNA, 20 bp, Artificial
  CRISPR gRNA sequence
ggaccgtagaccccacagtc

SEQ ID NO: 582740 - DNA, 20 bp, Artificial
  CRISPR gRNA sequence
tggttttgagattctaggat

SEQ ID NO: 582741 - DNA, 20 bp, Artificial
  CRISPR gRNA sequence
tgagattctaggatccttta

SEQ ID NO: 582742 - DNA, 20 bp, Artificial
  CRISPR gRNA sequence
gagattctaggatcctttaa

SEQ ID NO: 582743 - DNA, 20 bp, Artificial
  CRISPR gRNA sequence
agattctaggatcctttaaa

SEQ ID NO: 582744 - DNA, 20 bp, Artificial
  CRISPR gRNA sequence
taggatcctttaaatctaag

SEQ ID NO: 582745 - DNA, 20 bp, Artificial
  CRISPR gRNA sequence
ggatcctttaaatctaagaa

SEQ ID NO: 582746 - DNA, 20 bp, Artificial
  CRISPR gRNA sequence
taaatctaagaaatgctgtt

SEQ ID NO: 582747 - DNA, 20 bp, Artificial
  CRISPR gRNA sequence
aaatctaagaaatgctgttc

SEQ ID NO: 582748 - DNA, 20 bp, Artificial
  CRISPR gRNA sequence
aatctaagaaatgctgttct

SEQ ID NO: 582749 - DNA, 20 bp, Artificial
  CRISPR gRNA sequence
agaaatgctgttctatgatt

SEQ ID NO: 582750 - DNA, 20 bp, Artificial
  CRISPR gRNA sequence
ttctatgattctgaggtcct

SEQ ID NO: 582751 - DNA, 20 bp, Artificial
  CRISPR gRNA sequence
tatgattctgaggtcctggt

SEQ ID NO: 582752 - DNA, 20 bp, Artificial
  CRISPR gRNA sequence
tgattctgaggtcctggtgt

SEQ ID NO: 582753 - DNA, 20 bp, Artificial
  CRISPR gRNA sequence
tgaggtcctggtgttatact

SEQ ID NO: 582754 - DNA, 20 bp, Artificial
  CRISPR gRNA sequence
aggtcctggtgttatactat

SEQ ID NO: 582755 - DNA, 20 bp, Artificial
  CRISPR gRNA sequence
gtgttatactatttgaagac

SEQ ID NO: 582756 - DNA, 20 bp, Artificial
  CRISPR gRNA sequence
tactatttgaagaccccagg

SEQ ID NO: 582757 - DNA, 20 bp, Artificial
  CRISPR gRNA sequence
tttgaagaccccaggggtcc

SEQ ID NO: 582758 - DNA, 20 bp, Artificial
  CRISPR gRNA sequence
gaagaccccaggggtcccag

SEQ ID NO: 582759 - DNA, 20 bp, Artificial
  CRISPR gRNA sequence
aagaccccaggggtcccagt

SEQ ID NO: 582760 - DNA, 20 bp, Artificial
  CRISPR gRNA sequence
tggagcctgcctggcactct

SEQ ID NO: 582761 - DNA, 20 bp, Artificial
  CRISPR gRNA sequence
cctggcactctcagagcttc

SEQ ID NO: 582762 - DNA, 20 bp, Artificial
  CRISPR gRNA sequence
gcactctcagagcttcaaac

SEQ ID NO: 582763 - DNA, 20 bp, Artificial
  CRISPR gRNA sequence
tcagagcttcaaacctgggt

SEQ ID NO: 582764 - DNA, 20 bp, Artificial
  CRISPR gRNA sequence
agagcttcaaacctgggtcc

SEQ ID NO: 582765 - DNA, 20 bp, Artificial
  CRISPR gRNA sequence
caaacctgggtcctctccac

SEQ ID NO: 582766 - DNA, 20 bp, Artificial
  CRISPR gRNA sequence
aaacctgggtcctctccaca

SEQ ID NO: 582767 - DNA, 20 bp, Artificial
  CRISPR gRNA sequence
ggtcctctccacaacccaag

SEQ ID NO: 582768 - DNA, 20 bp, Artificial
  CRISPR gRNA sequence
tccacaacccaagaagggcc

SEQ ID NO: 582769 - DNA, 20 bp, Artificial
  CRISPR gRNA sequence
cacaacccaagaagggccag

SEQ ID NO: 582770 - DNA, 20 bp, Artificial
  CRISPR gRNA sequence
cagagctaggggcttgtcat

SEQ ID NO: 582771 - DNA, 20 bp, Artificial
  CRISPR gRNA sequence
agagctaggggcttgtcata

SEQ ID NO: 582772 - DNA, 20 bp, Artificial
  CRISPR gRNA sequence
ggggcttgtcatagtggcca

SEQ ID NO: 582773 - DNA, 20 bp, Artificial
  CRISPR gRNA sequence
gtcatagtggccagatggac

SEQ ID NO: 582774 - DNA, 20 bp, Artificial
  CRISPR gRNA sequence
tcatagtggccagatggaca

SEQ ID NO: 582775 - DNA, 20 bp, Artificial
  CRISPR gRNA sequence
ccacatccaccagcacccat

SEQ ID NO: 582776 - DNA, 20 bp, Artificial
  CRISPR gRNA sequence
ggccaagcctgctgcaggac

SEQ ID NO: 582777 - DNA, 20 bp, Artificial
  CRISPR gRNA sequence
ctgcaggacagggcagccag

SEQ ID NO: 582778 - DNA, 20 bp, Artificial
  CRISPR gRNA sequence
caggacagggcagccagttc

SEQ ID NO: 582779 - DNA, 20 bp, Artificial
  CRISPR gRNA sequence
tcggaacgaaacctgtgggg

SEQ ID NO: 582780 - DNA, 20 bp, Artificial
  CRISPR gRNA sequence
ggaacgaaacctgtggggtg

SEQ ID NO: 582781 - DNA, 20 bp, Artificial
  CRISPR gRNA sequence
tggggtggggtatctgccct

SEQ ID NO: 582782 - DNA, 20 bp, Artificial
  CRISPR gRNA sequence
ccctcttctcttcctccgtg

SEQ ID NO: 582783 - DNA, 20 bp, Artificial
  CRISPR gRNA sequence
ttctcttcctccgtggtgtc

SEQ ID NO: 582784 - DNA, 20 bp, Artificial
  CRISPR gRNA sequence
ctcttcctccgtggtgtcga

SEQ ID NO: 582785 - DNA, 20 bp, Artificial
  CRISPR gRNA sequence
tcttcctccgtggtgtcgat

SEQ ID NO: 582786 - DNA, 20 bp, Artificial
  CRISPR gRNA sequence
ttcctccgtggtgtcgatga

SEQ ID NO: 582787 - DNA, 20 bp, Artificial
  CRISPR gRNA sequence
cctccgtggtgtcgatgaag

SEQ ID NO: 582788 - DNA, 20 bp, Artificial
  CRISPR gRNA sequence
ctccgtggtgtcgatgaagc

SEQ ID NO: 582789 - DNA, 20 bp, Artificial
  CRISPR gRNA sequence
cgtggtgtcgatgaagcccg

SEQ ID NO: 582790 - DNA, 20 bp, Artificial
  CRISPR gRNA sequence
ggcaagtcgggggctgtgac

SEQ ID NO: 582791 - DNA, 20 bp, Artificial
  CRISPR gRNA sequence
tgacaacagggcccagatgc

SEQ ID NO: 582792 - DNA, 20 bp, Artificial
  CRISPR gRNA sequence
tgtcccagaaacatccccca

SEQ ID NO: 582793 - DNA, 20 bp, Artificial
  CRISPR gRNA sequence
agcttctgagaaacccagtc

SEQ ID NO: 582794 - DNA, 20 bp, Artificial
  CRISPR gRNA sequence
ctgagaaacccagtcagaaa

SEQ ID NO: 582795 - DNA, 20 bp, Artificial
  CRISPR gRNA sequence
tgagaaacccagtcagaaag

SEQ ID NO: 582796 - DNA, 20 bp, Artificial
  CRISPR gRNA sequence
agaaacccagtcagaaaggg

SEQ ID NO: 582797 - DNA, 20 bp, Artificial
  CRISPR gRNA sequence
cccagcccggccctctaggt

SEQ ID NO: 582798 - DNA, 20 bp, Artificial
  CRISPR gRNA sequence
taggtcctctacccccagac

SEQ ID NO: 582799 - DNA, 20 bp, Artificial
  CRISPR gRNA sequence
ggtcctctacccccagacag

SEQ ID NO: 582800 - DNA, 20 bp, Artificial
  CRISPR gRNA sequence
tacccccagacagatcatct

SEQ ID NO: 582801 - DNA, 20 bp, Artificial
  CRISPR gRNA sequence
cccccagacagatcatctcc

SEQ ID NO: 582802 - DNA, 20 bp, Artificial
  CRISPR gRNA sequence
catgtccctgtctgagaatg

SEQ ID NO: 582803 - DNA, 20 bp, Artificial
  CRISPR gRNA sequence
tctgagaatgtatctatgct

SEQ ID NO: 582804 - DNA, 20 bp, Artificial
  CRISPR gRNA sequence
agaatgtatctatgctttgc

SEQ ID NO: 582805 - DNA, 20 bp, Artificial
  CRISPR gRNA sequence
tgctttgctgagtcaggcca

SEQ ID NO: 582806 - DNA, 20 bp, Artificial
  CRISPR gRNA sequence
tgctgagtcaggccatccca

SEQ ID NO: 582807 - DNA, 20 bp, Artificial
  CRISPR gRNA sequence
gctgagtcaggccatcccac

SEQ ID NO: 582808 - DNA, 20 bp, Artificial
  CRISPR gRNA sequence
ctgagtcaggccatcccaca

SEQ ID NO: 582809 - DNA, 20 bp, Artificial
  CRISPR gRNA sequence
agtcaggccatcccacatgt

SEQ ID NO: 582810 - DNA, 20 bp, Artificial
  CRISPR gRNA sequence
ggggagaattcttagctctg

SEQ ID NO: 582811 - DNA, 20 bp, Artificial
  CRISPR gRNA sequence
gggagaattcttagctctgg

SEQ ID NO: 582812 - DNA, 20 bp, Artificial
  CRISPR gRNA sequence
ttagctctggccaagtgtcc

SEQ ID NO: 582813 - DNA, 20 bp, Artificial
  CRISPR gRNA sequence
agctctggccaagtgtccag

SEQ ID NO: 582814 - DNA, 20 bp, Artificial
  CRISPR gRNA sequence
gctctggccaagtgtccagg

SEQ ID NO: 582815 - DNA, 20 bp, Artificial
  CRISPR gRNA sequence
tggccaagtgtccaggcagc

SEQ ID NO: 582816 - DNA, 20 bp, Artificial
  CRISPR gRNA sequence
gccaagtgtccaggcagctt

SEQ ID NO: 582817 - DNA, 20 bp, Artificial
  CRISPR gRNA sequence
cagaagtgaccacaggccag

SEQ ID NO: 582818 - DNA, 20 bp, Artificial
  CRISPR gRNA sequence
agaagtgaccacaggccagc

SEQ ID NO: 582819 - DNA, 20 bp, Artificial
  CRISPR gRNA sequence
gcaccgaaatcggtattagt

SEQ ID NO: 582820 - DNA, 20 bp, Artificial
  CRISPR gRNA sequence
caccgaaatcggtattagtt

SEQ ID NO: 582821 - DNA, 20 bp, Artificial
  CRISPR gRNA sequence
gtttgttctggctgctataa

SEQ ID NO: 582822 - DNA, 20 bp, Artificial
  CRISPR gRNA sequence
gttctggctgctataacaaa

SEQ ID NO: 582823 - DNA, 20 bp, Artificial
  CRISPR gRNA sequence
ttctggctgctataacaaag

SEQ ID NO: 582824 - DNA, 20 bp, Artificial
  CRISPR gRNA sequence
tggctgctataacaaagtac

SEQ ID NO: 582825 - DNA, 20 bp, Artificial
  CRISPR gRNA sequence
gctgctataacaaagtacca

SEQ ID NO: 582826 - DNA, 20 bp, Artificial
  CRISPR gRNA sequence
ctataacaaagtaccacaac

SEQ ID NO: 582827 - DNA, 20 bp, Artificial
  CRISPR gRNA sequence
taacaaagtaccacaactga

SEQ ID NO: 582828 - DNA, 20 bp, Artificial
  CRISPR gRNA sequence
agtggcttcagcaacagaaa

SEQ ID NO: 582829 - DNA, 20 bp, Artificial
  CRISPR gRNA sequence
cagcaacagaaattgatcat

SEQ ID NO: 582830 - DNA, 20 bp, Artificial
  CRISPR gRNA sequence
agcaacagaaattgatcatc

SEQ ID NO: 582831 - DNA, 20 bp, Artificial
  CRISPR gRNA sequence
atcatctcacagttctggag

SEQ ID NO: 582832 - DNA, 20 bp, Artificial
  CRISPR gRNA sequence
acagttctggaggccagagt

SEQ ID NO: 582833 - DNA, 20 bp, Artificial
  CRISPR gRNA sequence
tggaggccagagtccaagat

SEQ ID NO: 582834 - DNA, 20 bp, Artificial
  CRISPR gRNA sequence
gaggccagagtccaagatca

SEQ ID NO: 582835 - DNA, 20 bp, Artificial
  CRISPR gRNA sequence
ccagggttggttccttctgg

SEQ ID NO: 582836 - DNA, 20 bp, Artificial
  CRISPR gRNA sequence
gttccttctgggggccataa

SEQ ID NO: 582837 - DNA, 20 bp, Artificial
  CRISPR gRNA sequence
cttctgggggccataaggga

SEQ ID NO: 582838 - DNA, 20 bp, Artificial
  CRISPR gRNA sequence
ctgggggccataagggagaa

SEQ ID NO: 582839 - DNA, 20 bp, Artificial
  CRISPR gRNA sequence
tgggggccataagggagaag

SEQ ID NO: 582840 - DNA, 20 bp, Artificial
  CRISPR gRNA sequence
ggggccataagggagaagct

SEQ ID NO: 582841 - DNA, 20 bp, Artificial
  CRISPR gRNA sequence
ctccaggcctctcccccagc

SEQ ID NO: 582842 - DNA, 20 bp, Artificial
  CRISPR gRNA sequence
caggcctctcccccagcttc

SEQ ID NO: 582843 - DNA, 20 bp, Artificial
  CRISPR gRNA sequence
tcccccagcttctggtggtt

SEQ ID NO: 582844 - DNA, 20 bp, Artificial
  CRISPR gRNA sequence
ccccagcttctggtggttgc

SEQ ID NO: 582845 - DNA, 20 bp, Artificial
  CRISPR gRNA sequence
ctggtggttgctggcaatct

SEQ ID NO: 582846 - DNA, 20 bp, Artificial
  CRISPR gRNA sequence
tggtggttgctggcaatctt

SEQ ID NO: 582847 - DNA, 20 bp, Artificial
  CRISPR gRNA sequence
gtggttgctggcaatctttg

SEQ ID NO: 582848 - DNA, 20 bp, Artificial
  CRISPR gRNA sequence
ctggcaatctttgttatttc

SEQ ID NO: 582849 - DNA, 20 bp, Artificial
  CRISPR gRNA sequence
gcaatctttgttatttcttg

SEQ ID NO: 582850 - DNA, 20 bp, Artificial
  CRISPR gRNA sequence
tgttatttcttggcttgaag

SEQ ID NO: 582851 - DNA, 20 bp, Artificial
  CRISPR gRNA sequence
gttatttcttggcttgaagg

SEQ ID NO: 582852 - DNA, 20 bp, Artificial
  CRISPR gRNA sequence
ttatttcttggcttgaagga

SEQ ID NO: 582853 - DNA, 20 bp, Artificial
  CRISPR gRNA sequence
tttcttggcttgaaggagca

SEQ ID NO: 582854 - DNA, 20 bp, Artificial
  CRISPR gRNA sequence
cttggcttgaaggagcatca

SEQ ID NO: 582855 - DNA, 20 bp, Artificial
  CRISPR gRNA sequence
ttggcttgaaggagcatcac

SEQ ID NO: 582856 - DNA, 20 bp, Artificial
  CRISPR gRNA sequence
ggcttgaaggagcatcaccc

SEQ ID NO: 582857 - DNA, 20 bp, Artificial
  CRISPR gRNA sequence
gcttgaaggagcatcacccc

SEQ ID NO: 582858 - DNA, 20 bp, Artificial
  CRISPR gRNA sequence
gaaggagcatcaccccatct

SEQ ID NO: 582859 - DNA, 20 bp, Artificial
  CRISPR gRNA sequence
aaggagcatcaccccatctc

SEQ ID NO: 582860 - DNA, 20 bp, Artificial
  CRISPR gRNA sequence
tggcttcattcattcactca

SEQ ID NO: 582861 - DNA, 20 bp, Artificial
  CRISPR gRNA sequence
gcttcattcattcactcacc

SEQ ID NO: 582862 - DNA, 20 bp, Artificial
  CRISPR gRNA sequence
cattcattcactcaccttct

SEQ ID NO: 582863 - DNA, 20 bp, Artificial
  CRISPR gRNA sequence
attcattcactcaccttctc

SEQ ID NO: 582864 - DNA, 20 bp, Artificial
  CRISPR gRNA sequence
attcactcaccttctcatct

SEQ ID NO: 582865 - DNA, 20 bp, Artificial
  CRISPR gRNA sequence
actcaccttctcatctcacc

SEQ ID NO: 582866 - DNA, 20 bp, Artificial
  CRISPR gRNA sequence
accttctcatctcaccagtg

SEQ ID NO: 582867 - DNA, 20 bp, Artificial
  CRISPR gRNA sequence
ctcatctcaccagtgctctc

SEQ ID NO: 582868 - DNA, 20 bp, Artificial
  CRISPR gRNA sequence
tcatctcaccagtgctctcc

SEQ ID NO: 582869 - DNA, 20 bp, Artificial
  CRISPR gRNA sequence
atctcaccagtgctctccca

SEQ ID NO: 582870 - DNA, 20 bp, Artificial
  CRISPR gRNA sequence
accagtgctctcccaggccc

SEQ ID NO: 582871 - DNA, 20 bp, Artificial
  CRISPR gRNA sequence
tcccaggcccttgttcggag

SEQ ID NO: 582872 - DNA, 20 bp, Artificial
  CRISPR gRNA sequence
ccaggcccttgttcggagcc

SEQ ID NO: 582873 - DNA, 20 bp, Artificial
  CRISPR gRNA sequence
gttcggagcctccacagacc

SEQ ID NO: 582874 - DNA, 20 bp, Artificial
  CRISPR gRNA sequence
ttcggagcctccacagaccc

SEQ ID NO: 582875 - DNA, 20 bp, Artificial
  CRISPR gRNA sequence
ggagcctccacagacccaca

SEQ ID NO: 582876 - DNA, 20 bp, Artificial
  CRISPR gRNA sequence
cacagacccacactcctgtt

SEQ ID NO: 582877 - DNA, 20 bp, Artificial
  CRISPR gRNA sequence
ctgtttctcacgcagtaatg

SEQ ID NO: 582878 - DNA, 20 bp, Artificial
  CRISPR gRNA sequence
tttctcacgcagtaatgttc

SEQ ID NO: 582879 - DNA, 20 bp, Artificial
  CRISPR gRNA sequence
ctcacgcagtaatgttctaa

SEQ ID NO: 582880 - DNA, 20 bp, Artificial
  CRISPR gRNA sequence
tcacgcagtaatgttctaag

SEQ ID NO: 582881 - DNA, 20 bp, Artificial
  CRISPR gRNA sequence
acgcagtaatgttctaagcc

SEQ ID NO: 582882 - DNA, 20 bp, Artificial
  CRISPR gRNA sequence
taagcccccaggagactaag

SEQ ID NO: 582883 - DNA, 20 bp, Artificial
  CRISPR gRNA sequence
agcccccaggagactaagaa

SEQ ID NO: 582884 - DNA, 20 bp, Artificial
  CRISPR gRNA sequence
agaacttaatacctggattc

SEQ ID NO: 582885 - DNA, 20 bp, Artificial
  CRISPR gRNA sequence
aatacctggattctcacact

SEQ ID NO: 582886 - DNA, 20 bp, Artificial
  CRISPR gRNA sequence
atacctggattctcacactc

SEQ ID NO: 582887 - DNA, 20 bp, Artificial
  CRISPR gRNA sequence
gattctcacactcatctccc

SEQ ID NO: 582888 - DNA, 20 bp, Artificial
  CRISPR gRNA sequence
tcacactcatctccctcagc

SEQ ID NO: 582889 - DNA, 20 bp, Artificial
  CRISPR gRNA sequence
acactcatctccctcagcac

SEQ ID NO: 582890 - DNA, 20 bp, Artificial
  CRISPR gRNA sequence
atctccctcagcaccacagc

SEQ ID NO: 582891 - DNA, 20 bp, Artificial
  CRISPR gRNA sequence
cctcagcaccacagctctga

SEQ ID NO: 582892 - DNA, 20 bp, Artificial
  CRISPR gRNA sequence
agcaccacagctctgacaac

SEQ ID NO: 582893 - DNA, 20 bp, Artificial
  CRISPR gRNA sequence
tgacaaccacccccaggagg

SEQ ID NO: 582894 - DNA, 20 bp, Artificial
  CRISPR gRNA sequence
acaaccacccccaggaggtg

SEQ ID NO: 582895 - DNA, 20 bp, Artificial
  CRISPR gRNA sequence
ctcccccagaacccttctat

SEQ ID NO: 582896 - DNA, 20 bp, Artificial
  CRISPR gRNA sequence
ccccagaacccttctatact

SEQ ID NO: 582897 - DNA, 20 bp, Artificial
  CRISPR gRNA sequence
ctatactcccccgggctgct

SEQ ID NO: 582898 - DNA, 20 bp, Artificial
  CRISPR gRNA sequence
tatactcccccgggctgctc

SEQ ID NO: 582899 - DNA, 20 bp, Artificial
  CRISPR gRNA sequence
tactcccccgggctgctctc

SEQ ID NO: 582900 - DNA, 20 bp, Artificial
  CRISPR gRNA sequence
ccccgggctgctctcagcag

SEQ ID NO: 582901 - DNA, 20 bp, Artificial
  CRISPR gRNA sequence
ctctcagcagctgtgtgccc

SEQ ID NO: 582902 - DNA, 20 bp, Artificial
  CRISPR gRNA sequence
tcagcagctgtgtgcccaac

SEQ ID NO: 582903 - DNA, 20 bp, Artificial
  CRISPR gRNA sequence
agcagctgtgtgcccaactc

SEQ ID NO: 582904 - DNA, 20 bp, Artificial
  CRISPR gRNA sequence
tgtgcccaactcagtgctgt

SEQ ID NO: 582905 - DNA, 20 bp, Artificial
  CRISPR gRNA sequence
agtgctgtgaggtggaacgg

SEQ ID NO: 582906 - DNA, 20 bp, Artificial
  CRISPR gRNA sequence
tgaggtggaacggggagatg

SEQ ID NO: 582907 - DNA, 20 bp, Artificial
  CRISPR gRNA sequence
ataaaatgtgcacacggaaa

SEQ ID NO: 582908 - DNA, 20 bp, Artificial
  CRISPR gRNA sequence
taaaatgtgcacacggaaac

SEQ ID NO: 582909 - DNA, 20 bp, Artificial
  CRISPR gRNA sequence
cctaaagaaagaagtggagt

SEQ ID NO: 582910 - DNA, 20 bp, Artificial
  CRISPR gRNA sequence
ctaaagaaagaagtggagtt

SEQ ID NO: 582911 - DNA, 20 bp, Artificial
  CRISPR gRNA sequence
aagaaagaagtggagttctc

SEQ ID NO: 582912 - DNA, 20 bp, Artificial
  CRISPR gRNA sequence
tcaagtcactatgggactac

SEQ ID NO: 582913 - DNA, 20 bp, Artificial
  CRISPR gRNA sequence
aagtcactatgggactacgg

SEQ ID NO: 582914 - DNA, 20 bp, Artificial
  CRISPR gRNA sequence
tgggactacggaactcggca

SEQ ID NO: 582915 - DNA, 20 bp, Artificial
  CRISPR gRNA sequence
cggaactcggcatctgagca

SEQ ID NO: 582916 - DNA, 20 bp, Artificial
  CRISPR gRNA sequence
ggcatctgagcatccccttc

SEQ ID NO: 582917 - DNA, 20 bp, Artificial
  CRISPR gRNA sequence
agcatccccttctgtataat

SEQ ID NO: 582918 - DNA, 20 bp, Artificial
  CRISPR gRNA sequence
ctgtataatggggttggctg

SEQ ID NO: 582919 - DNA, 20 bp, Artificial
  CRISPR gRNA sequence
tgtataatggggttggctgg

SEQ ID NO: 582920 - DNA, 20 bp, Artificial
  CRISPR gRNA sequence
tataatggggttggctgggc

SEQ ID NO: 582921 - DNA, 20 bp, Artificial
  CRISPR gRNA sequence
gctgggcagtcccttccagc

SEQ ID NO: 582922 - DNA, 20 bp, Artificial
  CRISPR gRNA sequence
ggcagtcccttccagctctg

SEQ ID NO: 582923 - DNA, 20 bp, Artificial
  CRISPR gRNA sequence
ccagctctggcttcctctca

SEQ ID NO: 582924 - DNA, 20 bp, Artificial
  CRISPR gRNA sequence
cagctctggcttcctctcag

SEQ ID NO: 582925 - DNA, 20 bp, Artificial
  CRISPR gRNA sequence
tggcttcctctcagaccagg

SEQ ID NO: 582926 - DNA, 20 bp, Artificial
  CRISPR gRNA sequence
gcttcctctcagaccaggat

SEQ ID NO: 582927 - DNA, 20 bp, Artificial
  CRISPR gRNA sequence
cctctcagaccaggattata

SEQ ID NO: 582928 - DNA, 20 bp, Artificial
  CRISPR gRNA sequence
ctctcagaccaggattatag

SEQ ID NO: 582929 - DNA, 20 bp, Artificial
  CRISPR gRNA sequence
tcagaccaggattataggat

SEQ ID NO: 582930 - DNA, 20 bp, Artificial
  CRISPR gRNA sequence
agaccaggattataggatcc

SEQ ID NO: 582931 - DNA, 20 bp, Artificial
  CRISPR gRNA sequence
taggatcctgaaaagccagt

SEQ ID NO: 582932 - DNA, 20 bp, Artificial
  CRISPR gRNA sequence
aaaagccagtgcttccctca

SEQ ID NO: 582933 - DNA, 20 bp, Artificial
  CRISPR gRNA sequence
ccctcagggagtggaaggtt

SEQ ID NO: 582934 - DNA, 20 bp, Artificial
  CRISPR gRNA sequence
cctcagggagtggaaggttc

SEQ ID NO: 582935 - DNA, 20 bp, Artificial
  CRISPR gRNA sequence
agggagtggaaggttctggg

SEQ ID NO: 582936 - DNA, 20 bp, Artificial
  CRISPR gRNA sequence
tggggctcagcagggggccc

SEQ ID NO: 582937 - DNA, 20 bp, Artificial
  CRISPR gRNA sequence
gggctcagcagggggcccgg

SEQ ID NO: 582938 - DNA, 20 bp, Artificial
  CRISPR gRNA sequence
agcagggggcccggagccat

SEQ ID NO: 582939 - DNA, 20 bp, Artificial
  CRISPR gRNA sequence
tggagggctttcaaggtgag

SEQ ID NO: 582940 - DNA, 20 bp, Artificial
  CRISPR gRNA sequence
tcaaggtgaggacaatagaa

SEQ ID NO: 582941 - DNA, 20 bp, Artificial
  CRISPR gRNA sequence
caaggtgaggacaatagaag

SEQ ID NO: 582942 - DNA, 20 bp, Artificial
  CRISPR gRNA sequence
aaggtgaggacaatagaaga

SEQ ID NO: 582943 - DNA, 20 bp, Artificial
  CRISPR gRNA sequence
gcgtggcttggacagggaaa

SEQ ID NO: 582944 - DNA, 20 bp, Artificial
  CRISPR gRNA sequence
cgtggcttggacagggaaag

SEQ ID NO: 582945 - DNA, 20 bp, Artificial
  CRISPR gRNA sequence
ggacagggaaagaggagaag

SEQ ID NO: 582946 - DNA, 20 bp, Artificial
  CRISPR gRNA sequence
gacagggaaagaggagaagg

SEQ ID NO: 582947 - DNA, 20 bp, Artificial
  CRISPR gRNA sequence
gaggcagggggtgtagcatg

SEQ ID NO: 582948 - DNA, 20 bp, Artificial
  CRISPR gRNA sequence
aggcagggggtgtagcatga

SEQ ID NO: 582949 - DNA, 20 bp, Artificial
  CRISPR gRNA sequence
gagggccagaaattggggtg

SEQ ID NO: 582950 - DNA, 20 bp, Artificial
  CRISPR gRNA sequence
agggccagaaattggggtga

SEQ ID NO: 582951 - DNA, 20 bp, Artificial
  CRISPR gRNA sequence
gggtgaactctgatgggggc

SEQ ID NO: 582952 - DNA, 20 bp, Artificial
  CRISPR gRNA sequence
tgatgggggctgggtagaga

SEQ ID NO: 582953 - DNA, 20 bp, Artificial
  CRISPR gRNA sequence
atgggggctgggtagagaag

SEQ ID NO: 582954 - DNA, 20 bp, Artificial
  CRISPR gRNA sequence
ggtagagaagcttctacagg

SEQ ID NO: 582955 - DNA, 20 bp, Artificial
  CRISPR gRNA sequence
ctacaggccccagctcaaga

SEQ ID NO: 582956 - DNA, 20 bp, Artificial
  CRISPR gRNA sequence
tacaggccccagctcaagag

SEQ ID NO: 582957 - DNA, 20 bp, Artificial
  CRISPR gRNA sequence
caggccccagctcaagagac

SEQ ID NO: 582958 - DNA, 20 bp, Artificial
  CRISPR gRNA sequence
aagagaccccatctctcctc

SEQ ID NO: 582959 - DNA, 20 bp, Artificial
  CRISPR gRNA sequence
tcctcctctctgtcacttgc

SEQ ID NO: 582960 - DNA, 20 bp, Artificial
  CRISPR gRNA sequence
ctcctctctgtcacttgcca

SEQ ID NO: 582961 - DNA, 20 bp, Artificial
  CRISPR gRNA sequence
ctctctgtcacttgccatgc

SEQ ID NO: 582962 - DNA, 20 bp, Artificial
  CRISPR gRNA sequence
tctgtcacttgccatgctgg

SEQ ID NO: 582963 - DNA, 20 bp, Artificial
  CRISPR gRNA sequence
tgtcacttgccatgctggat

SEQ ID NO: 582964 - DNA, 20 bp, Artificial
  CRISPR gRNA sequence
tcacttgccatgctggatcc

SEQ ID NO: 582965 - DNA, 20 bp, Artificial
  CRISPR gRNA sequence
gccatgctggatccgtgcat

SEQ ID NO: 582966 - DNA, 20 bp, Artificial
  CRISPR gRNA sequence
ccatgctggatccgtgcatg

SEQ ID NO: 582967 - DNA, 20 bp, Artificial
  CRISPR gRNA sequence
gatccgtgcatgatcacact

SEQ ID NO: 582968 - DNA, 20 bp, Artificial
  CRISPR gRNA sequence
ctggactcgcctccttgccc

SEQ ID NO: 582969 - DNA, 20 bp, Artificial
  CRISPR gRNA sequence
gactcgcctccttgccctga

SEQ ID NO: 582970 - DNA, 20 bp, Artificial
  CRISPR gRNA sequence
gcctccttgccctgagatcc

SEQ ID NO: 582971 - DNA, 20 bp, Artificial
  CRISPR gRNA sequence
cttgccctgagatccagacc

SEQ ID NO: 582972 - DNA, 20 bp, Artificial
  CRISPR gRNA sequence
gccctgagatccagaccccc

SEQ ID NO: 582973 - DNA, 20 bp, Artificial
  CRISPR gRNA sequence
ccctgagatccagacccccg

SEQ ID NO: 582974 - DNA, 20 bp, Artificial
  CRISPR gRNA sequence
agatccagacccccgtattc

SEQ ID NO: 582975 - DNA, 20 bp, Artificial
  CRISPR gRNA sequence
agctgccccctcagctcctc

SEQ ID NO: 582976 - DNA, 20 bp, Artificial
  CRISPR gRNA sequence
ccccctcagctcctccactc

SEQ ID NO: 582977 - DNA, 20 bp, Artificial
  CRISPR gRNA sequence
agctcctccactcacatatt

SEQ ID NO: 582978 - DNA, 20 bp, Artificial
  CRISPR gRNA sequence
ctccactcacatatttaatg

SEQ ID NO: 582979 - DNA, 20 bp, Artificial
  CRISPR gRNA sequence
cactcacatatttaatgcca

SEQ ID NO: 582980 - DNA, 20 bp, Artificial
  CRISPR gRNA sequence
acatatttaatgccagactc

SEQ ID NO: 582981 - DNA, 20 bp, Artificial
  CRISPR gRNA sequence
aatgccagactcttcatgtc

SEQ ID NO: 582982 - DNA, 20 bp, Artificial
  CRISPR gRNA sequence
atgccagactcttcatgtct

SEQ ID NO: 582983 - DNA, 20 bp, Artificial
  CRISPR gRNA sequence
ttcatgtctatctacacctg

SEQ ID NO: 582984 - DNA, 20 bp, Artificial
  CRISPR gRNA sequence
catgtctatctacacctgca

SEQ ID NO: 582985 - DNA, 20 bp, Artificial
  CRISPR gRNA sequence
atgtctatctacacctgcac

SEQ ID NO: 582986 - DNA, 20 bp, Artificial
  CRISPR gRNA sequence
tctacacctgcacttttgca

SEQ ID NO: 582987 - DNA, 20 bp, Artificial
  CRISPR gRNA sequence
cacctgcacttttgcaccca

SEQ ID NO: 582988 - DNA, 20 bp, Artificial
  CRISPR gRNA sequence
cacttttgcacccaatccaa

SEQ ID NO: 582989 - DNA, 20 bp, Artificial
  CRISPR gRNA sequence
ttgcacccaatccaactccc

SEQ ID NO: 582990 - DNA, 20 bp, Artificial
  CRISPR gRNA sequence
tgcacccaatccaactcccc

SEQ ID NO: 582991 - DNA, 20 bp, Artificial
  CRISPR gRNA sequence
gcacccaatccaactccccg

SEQ ID NO: 582992 - DNA, 20 bp, Artificial
  CRISPR gRNA sequence
cacccaatccaactccccgc

SEQ ID NO: 582993 - DNA, 20 bp, Artificial
  CRISPR gRNA sequence
cccgccatgtcccccatctc

SEQ ID NO: 582994 - DNA, 20 bp, Artificial
  CRISPR gRNA sequence
aggtaatgtcagctcggtcc

SEQ ID NO: 582995 - DNA, 20 bp, Artificial
  CRISPR gRNA sequence
ggtccttccagctgctcaag

SEQ ID NO: 582996 - DNA, 20 bp, Artificial
  CRISPR gRNA sequence
ccagctgctcaagctaaaac

SEQ ID NO: 582997 - DNA, 20 bp, Artificial
  CRISPR gRNA sequence
cagctgctcaagctaaaacc

SEQ ID NO: 582998 - DNA, 20 bp, Artificial
  CRISPR gRNA sequence
ctcaagctaaaacccatgtc

SEQ ID NO: 582999 - DNA, 20 bp, Artificial
  CRISPR gRNA sequence
aagctaaaacccatgtcact

SEQ ID NO: 583000 - DNA, 20 bp, Artificial
  CRISPR gRNA sequence
aaacccatgtcactttgact

SEQ ID NO: 583001 - DNA, 20 bp, Artificial
  CRISPR gRNA sequence
tgactctccctcttgcccac

SEQ ID NO: 583002 - DNA, 20 bp, Artificial
  CRISPR gRNA sequence
gactctccctcttgcccact

SEQ ID NO: 583003 - DNA, 20 bp, Artificial
  CRISPR gRNA sequence
actctccctcttgcccacta

SEQ ID NO: 583004 - DNA, 20 bp, Artificial
  CRISPR gRNA sequence
tccctcttgcccactacatc

SEQ ID NO: 583005 - DNA, 20 bp, Artificial
  CRISPR gRNA sequence
cctcttgcccactacatcca

SEQ ID NO: 583006 - DNA, 20 bp, Artificial
  CRISPR gRNA sequence
ttgcccactacatccaagct

SEQ ID NO: 583007 - DNA, 20 bp, Artificial
  CRISPR gRNA sequence
gcccactacatccaagctgc

SEQ ID NO: 583008 - DNA, 20 bp, Artificial
  CRISPR gRNA sequence
cccactacatccaagctgct

SEQ ID NO: 583009 - DNA, 20 bp, Artificial
  CRISPR gRNA sequence
catccaagctgctagcactg

SEQ ID NO: 583010 - DNA, 20 bp, Artificial
  CRISPR gRNA sequence
ctagcactgctcctgatcca

SEQ ID NO: 583011 - DNA, 20 bp, Artificial
  CRISPR gRNA sequence
gcactgctcctgatccagct

SEQ ID NO: 583012 - DNA, 20 bp, Artificial
  CRISPR gRNA sequence
ctcctgatccagcttcagat

SEQ ID NO: 583013 - DNA, 20 bp, Artificial
  CRISPR gRNA sequence
ctgatccagcttcagattaa

SEQ ID NO: 583014 - DNA, 20 bp, Artificial
  CRISPR gRNA sequence
atccagcttcagattaagtc

SEQ ID NO: 583015 - DNA, 20 bp, Artificial
  CRISPR gRNA sequence
cagattaagtctcagaatct

SEQ ID NO: 583016 - DNA, 20 bp, Artificial
  CRISPR gRNA sequence
agattaagtctcagaatcta

SEQ ID NO: 583017 - DNA, 20 bp, Artificial
  CRISPR gRNA sequence
agtctcagaatctacccact

SEQ ID NO: 583018 - DNA, 20 bp, Artificial
  CRISPR gRNA sequence
agaatctacccacttctcgc

SEQ ID NO: 583019 - DNA, 20 bp, Artificial
  CRISPR gRNA sequence
cccacttctcgccttctcca

SEQ ID NO: 583020 - DNA, 20 bp, Artificial
  CRISPR gRNA sequence
ctcgccttctccactgccac

SEQ ID NO: 583021 - DNA, 20 bp, Artificial
  CRISPR gRNA sequence
tcgccttctccactgccacc

SEQ ID NO: 583022 - DNA, 20 bp, Artificial
  CRISPR gRNA sequence
gccttctccactgccaccag

SEQ ID NO: 583023 - DNA, 20 bp, Artificial
  CRISPR gRNA sequence
ctccactgccaccagcccat

SEQ ID NO: 583024 - DNA, 20 bp, Artificial
  CRISPR gRNA sequence
tccactgccaccagcccatt

SEQ ID NO: 583025 - DNA, 20 bp, Artificial
  CRISPR gRNA sequence
cactgccaccagcccattct

SEQ ID NO: 583026 - DNA, 20 bp, Artificial
  CRISPR gRNA sequence
ccaccagcccattctgtgcc

SEQ ID NO: 583027 - DNA, 20 bp, Artificial
  CRISPR gRNA sequence
tgtgccagcatcatcacttg

SEQ ID NO: 583028 - DNA, 20 bp, Artificial
  CRISPR gRNA sequence
tgccagcatcatcacttgcc

SEQ ID NO: 583029 - DNA, 20 bp, Artificial
  CRISPR gRNA sequence
gccaggactgttacaatagc

SEQ ID NO: 583030 - DNA, 20 bp, Artificial
  CRISPR gRNA sequence
ccaggactgttacaatagcc

SEQ ID NO: 583031 - DNA, 20 bp, Artificial
  CRISPR gRNA sequence
ttacaatagcctcctcacta

SEQ ID NO: 583032 - DNA, 20 bp, Artificial
  CRISPR gRNA sequence
caatagcctcctcactagcc

SEQ ID NO: 583033 - DNA, 20 bp, Artificial
  CRISPR gRNA sequence
ctcactagccccactcacag

SEQ ID NO: 583034 - DNA, 20 bp, Artificial
  CRISPR gRNA sequence
actagccccactcacagcag

SEQ ID NO: 583035 - DNA, 20 bp, Artificial
  CRISPR gRNA sequence
gccccactcacagcagccag

SEQ ID NO: 583036 - DNA, 20 bp, Artificial
  CRISPR gRNA sequence
acagcagccagatgaatctt

SEQ ID NO: 583037 - DNA, 20 bp, Artificial
  CRISPR gRNA sequence
ttgagtccatgcctagtcac

SEQ ID NO: 583038 - DNA, 20 bp, Artificial
  CRISPR gRNA sequence
tgagtccatgcctagtcact

SEQ ID NO: 583039 - DNA, 20 bp, Artificial
  CRISPR gRNA sequence
gagtccatgcctagtcactg

SEQ ID NO: 583040 - DNA, 20 bp, Artificial
  CRISPR gRNA sequence
agtccatgcctagtcactgg

SEQ ID NO: 583041 - DNA, 20 bp, Artificial
  CRISPR gRNA sequence
gtcactggggcaaaatagga

SEQ ID NO: 583042 - DNA, 20 bp, Artificial
  CRISPR gRNA sequence
gggcaaaataggactccgag

SEQ ID NO: 583043 - DNA, 20 bp, Artificial
  CRISPR gRNA sequence
cgaggagaaagtccgagacc

SEQ ID NO: 583044 - DNA, 20 bp, Artificial
  CRISPR gRNA sequence
cggcaagatgagcaaacaca

SEQ ID NO: 583045 - DNA, 20 bp, Artificial
  CRISPR gRNA sequence
tgcagggtgcagggagggct

SEQ ID NO: 583046 - DNA, 20 bp, Artificial
  CRISPR gRNA sequence
gaggcctgaggcttgaaaca

SEQ ID NO: 583047 - DNA, 20 bp, Artificial
  CRISPR gRNA sequence
aggcttgaaacagctctcaa

SEQ ID NO: 583048 - DNA, 20 bp, Artificial
  CRISPR gRNA sequence
gaaacagctctcaagtggag

SEQ ID NO: 583049 - DNA, 20 bp, Artificial
  CRISPR gRNA sequence
aaacagctctcaagtggagg

SEQ ID NO: 583050 - DNA, 20 bp, Artificial
  CRISPR gRNA sequence
tcaagtggagggggaaacaa

SEQ ID NO: 583051 - DNA, 20 bp, Artificial
  CRISPR gRNA sequence
aagtggagggggaaacaacc

SEQ ID NO: 583052 - DNA, 20 bp, Artificial
  CRISPR gRNA sequence
ccctcatagaggacacatcc

SEQ ID NO: 583053 - DNA, 20 bp, Artificial
  CRISPR gRNA sequence
atagaggacacatccacacc

SEQ ID NO: 583054 - DNA, 20 bp, Artificial
  CRISPR gRNA sequence
tgctagcgtgggcaggcaag

SEQ ID NO: 583055 - DNA, 20 bp, Artificial
  CRISPR gRNA sequence
gcgtgggcaggcaagccagg

SEQ ID NO: 583056 - DNA, 20 bp, Artificial
  CRISPR gRNA sequence
gacctctgcacgtggggcat

SEQ ID NO: 583057 - DNA, 20 bp, Artificial
  CRISPR gRNA sequence
tgcacgtggggcatgtgtgg

SEQ ID NO: 583058 - DNA, 20 bp, Artificial
  CRISPR gRNA sequence
cacgtggggcatgtgtgggt

SEQ ID NO: 583059 - DNA, 20 bp, Artificial
  CRISPR gRNA sequence
tgttcttggtgtgtgtgtgt

SEQ ID NO: 583060 - DNA, 20 bp, Artificial
  CRISPR gRNA sequence
ttggtgtgtgtgtgtgtgtg

SEQ ID NO: 583061 - DNA, 20 bp, Artificial
  CRISPR gRNA sequence
ggtgtgtgtgtgtgtgtgtg

SEQ ID NO: 583062 - DNA, 20 bp, Artificial
  CRISPR gRNA sequence
gtgtgtgtgtgtgtgtgtgt

SEQ ID NO: 583063 - DNA, 20 bp, Artificial
  CRISPR gRNA sequence
gagctggggtgcaactatgg

SEQ ID NO: 583064 - DNA, 20 bp, Artificial
  CRISPR gRNA sequence
gggtgcaactatggggcccc

SEQ ID NO: 583065 - DNA, 20 bp, Artificial
  CRISPR gRNA sequence
tggggcccctcgggacatgt

SEQ ID NO: 583066 - DNA, 20 bp, Artificial
  CRISPR gRNA sequence
gggacatgtcccagccaatg

SEQ ID NO: 583067 - DNA, 20 bp, Artificial
  CRISPR gRNA sequence
ctttgaccagaggagtgtcc

SEQ ID NO: 583068 - DNA, 20 bp, Artificial
  CRISPR gRNA sequence
tgaccagaggagtgtccacg

SEQ ID NO: 583069 - DNA, 20 bp, Artificial
  CRISPR gRNA sequence
gaccagaggagtgtccacgt

SEQ ID NO: 583070 - DNA, 20 bp, Artificial
  CRISPR gRNA sequence
accagaggagtgtccacgtg

SEQ ID NO: 583071 - DNA, 20 bp, Artificial
  CRISPR gRNA sequence
aggtggtcgagtatctcata

SEQ ID NO: 583072 - DNA, 20 bp, Artificial
  CRISPR gRNA sequence
ataccgccctagcacacgtg

SEQ ID NO: 583073 - DNA, 20 bp, Artificial
  CRISPR gRNA sequence
gcacacgtgtgactcctttc

SEQ ID NO: 583074 - DNA, 20 bp, Artificial
  CRISPR gRNA sequence
ctttcccctattgtctacgc

SEQ ID NO: 583075 - DNA, 20 bp, Artificial
  CRISPR gRNA sequence
tcccctattgtctacgcagc

SEQ ID NO: 583076 - DNA, 20 bp, Artificial
  CRISPR gRNA sequence
cccctattgtctacgcagcc

SEQ ID NO: 583077 - DNA, 20 bp, Artificial
  CRISPR gRNA sequence
ccctattgtctacgcagcct

SEQ ID NO: 583078 - DNA, 20 bp, Artificial
  CRISPR gRNA sequence
ttgtctacgcagcctgccct

SEQ ID NO: 583079 - DNA, 20 bp, Artificial
  CRISPR gRNA sequence
tctacgcagcctgcccttgg

SEQ ID NO: 583080 - DNA, 20 bp, Artificial
  CRISPR gRNA sequence
cgcagcctgcccttggacaa

SEQ ID NO: 583081 - DNA, 20 bp, Artificial
  CRISPR gRNA sequence
cccttggacaaggacccgat

SEQ ID NO: 583082 - DNA, 20 bp, Artificial
  CRISPR gRNA sequence
ggacaaggacccgatgccca

SEQ ID NO: 583083 - DNA, 20 bp, Artificial
  CRISPR gRNA sequence
gacaaggacccgatgcccaa

SEQ ID NO: 583084 - DNA, 20 bp, Artificial
  CRISPR gRNA sequence
gcaagccctcggccccttcc

SEQ ID NO: 583085 - DNA, 20 bp, Artificial
  CRISPR gRNA sequence
ggccccttccttggcccttg

SEQ ID NO: 583086 - DNA, 20 bp, Artificial
  CRISPR gRNA sequence
ccttggcccttggcccatcc

SEQ ID NO: 583087 - DNA, 20 bp, Artificial
  CRISPR gRNA sequence
cttggcccttggcccatccc

SEQ ID NO: 583088 - DNA, 20 bp, Artificial
  CRISPR gRNA sequence
ggcccttggcccatccccag

SEQ ID NO: 583089 - DNA, 20 bp, Artificial
  CRISPR gRNA sequence
gcccttggcccatccccagg

SEQ ID NO: 583090 - DNA, 20 bp, Artificial
  CRISPR gRNA sequence
ggcccatccccaggagcctc

SEQ ID NO: 583091 - DNA, 20 bp, Artificial
  CRISPR gRNA sequence
gcccatccccaggagcctcg

SEQ ID NO: 583092 - DNA, 20 bp, Artificial
  CRISPR gRNA sequence
gcccagctggagggctgcac

SEQ ID NO: 583093 - DNA, 20 bp, Artificial
  CRISPR gRNA sequence
gagggctgcacccaaagcct

SEQ ID NO: 583094 - DNA, 20 bp, Artificial
  CRISPR gRNA sequence
cacccaaagcctcagacctg

SEQ ID NO: 583095 - DNA, 20 bp, Artificial
  CRISPR gRNA sequence
agacctgctgggggcccggg

SEQ ID NO: 583096 - DNA, 20 bp, Artificial
  CRISPR gRNA sequence
ctgggggcccggggcccagg

SEQ ID NO: 583097 - DNA, 20 bp, Artificial
  CRISPR gRNA sequence
ggggcccggggcccaggggg

SEQ ID NO: 583098 - DNA, 20 bp, Artificial
  CRISPR gRNA sequence
ccagggccgagatcttcgag

SEQ ID NO: 583099 - DNA, 20 bp, Artificial
  CRISPR gRNA sequence
cagggccgagatcttcgagg

SEQ ID NO: 583100 - DNA, 20 bp, Artificial
  CRISPR gRNA sequence
cgaggcggggcccatgcctc

SEQ ID NO: 583101 - DNA, 20 bp, Artificial
  CRISPR gRNA sequence
gaggcggggcccatgcctcc

SEQ ID NO: 583102 - DNA, 20 bp, Artificial
  CRISPR gRNA sequence
ctcttcttccttgaacccca

SEQ ID NO: 583103 - DNA, 20 bp, Artificial
  CRISPR gRNA sequence
ttcttccttgaaccccatgc

SEQ ID NO: 583104 - DNA, 20 bp, Artificial
  CRISPR gRNA sequence
cttccttgaaccccatgcca

SEQ ID NO: 583105 - DNA, 20 bp, Artificial
  CRISPR gRNA sequence
ttccttgaaccccatgccac

SEQ ID NO: 583106 - DNA, 20 bp, Artificial
  CRISPR gRNA sequence
ccttgaaccccatgccacca

SEQ ID NO: 583107 - DNA, 20 bp, Artificial
  CRISPR gRNA sequence
cttgaaccccatgccaccat

SEQ ID NO: 583108 - DNA, 20 bp, Artificial
  CRISPR gRNA sequence
gaaccccatgccaccatcgc

SEQ ID NO: 583109 - DNA, 20 bp, Artificial
  CRISPR gRNA sequence
aaccccatgccaccatcgca

SEQ ID NO: 583110 - DNA, 20 bp, Artificial
  CRISPR gRNA sequence
caggtgaggccctgggccca

SEQ ID NO: 583111 - DNA, 20 bp, Artificial
  CRISPR gRNA sequence
ggcccaggatggggcaggca

SEQ ID NO: 583112 - DNA, 20 bp, Artificial
  CRISPR gRNA sequence
gacctacaggtgccgacctt

SEQ ID NO: 583113 - DNA, 20 bp, Artificial
  CRISPR gRNA sequence
caggtgccgacctttactgt

SEQ ID NO: 583114 - DNA, 20 bp, Artificial
  CRISPR gRNA sequence
tactgtggcactgggcggga

SEQ ID NO: 583115 - DNA, 20 bp, Artificial
  CRISPR gRNA sequence
actgtggcactgggcgggag

SEQ ID NO: 583116 - DNA, 20 bp, Artificial
  CRISPR gRNA sequence
ctgtggcactgggcgggagg

SEQ ID NO: 583117 - DNA, 20 bp, Artificial
  CRISPR gRNA sequence
tggcactgggcgggaggggg

SEQ ID NO: 583118 - DNA, 20 bp, Artificial
  CRISPR gRNA sequence
ggcgggaggggggctggctg

SEQ ID NO: 583119 - DNA, 20 bp, Artificial
  CRISPR gRNA sequence
gctggggcacaggaagtggt

SEQ ID NO: 583120 - DNA, 20 bp, Artificial
  CRISPR gRNA sequence
gggcacaggaagtggtttct

SEQ ID NO: 583121 - DNA, 20 bp, Artificial
  CRISPR gRNA sequence
ctgggtcccaggcaagtctg

SEQ ID NO: 583122 - DNA, 20 bp, Artificial
  CRISPR gRNA sequence
tgggtcccaggcaagtctgt

SEQ ID NO: 583123 - DNA, 20 bp, Artificial
  CRISPR gRNA sequence
ggtcccaggcaagtctgtga

SEQ ID NO: 583124 - DNA, 20 bp, Artificial
  CRISPR gRNA sequence
tgacttatgcagatgttgca

SEQ ID NO: 583125 - DNA, 20 bp, Artificial
  CRISPR gRNA sequence
atgcagatgttgcagggcca

SEQ ID NO: 583126 - DNA, 20 bp, Artificial
  CRISPR gRNA sequence
tgcagatgttgcagggccaa

SEQ ID NO: 583127 - DNA, 20 bp, Artificial
  CRISPR gRNA sequence
cagggccaagaaaatcccca

SEQ ID NO: 583128 - DNA, 20 bp, Artificial
  CRISPR gRNA sequence
ccaggcctcagagattggag

SEQ ID NO: 583129 - DNA, 20 bp, Artificial
  CRISPR gRNA sequence
agagattggaggctctcccc

SEQ ID NO: 583130 - DNA, 20 bp, Artificial
  CRISPR gRNA sequence
gaggctctccccgacctccc

SEQ ID NO: 583131 - DNA, 20 bp, Artificial
  CRISPR gRNA sequence
tccccgacctcccaatccct

SEQ ID NO: 583132 - DNA, 20 bp, Artificial
  CRISPR gRNA sequence
cccgacctcccaatccctgt

SEQ ID NO: 583133 - DNA, 20 bp, Artificial
  CRISPR gRNA sequence
ccaatccctgtctcaggaga

SEQ ID NO: 583134 - DNA, 20 bp, Artificial
  CRISPR gRNA sequence
tctcaggagaggaggaggcc

SEQ ID NO: 583135 - DNA, 20 bp, Artificial
  CRISPR gRNA sequence
aggagaggaggaggccgtat

SEQ ID NO: 583136 - DNA, 20 bp, Artificial
  CRISPR gRNA sequence
tagtcccatgagcatagcta

SEQ ID NO: 583137 - DNA, 20 bp, Artificial
  CRISPR gRNA sequence
tgtgtccccatccccatgtg

SEQ ID NO: 583138 - DNA, 20 bp, Artificial
  CRISPR gRNA sequence
gggccaagtaggtgaggtga

SEQ ID NO: 583139 - DNA, 20 bp, Artificial
  CRISPR gRNA sequence
aggccagctctgcaacttat

SEQ ID NO: 583140 - DNA, 20 bp, Artificial
  CRISPR gRNA sequence
tgcaacttattagctgtttg

SEQ ID NO: 583141 - DNA, 20 bp, Artificial
  CRISPR gRNA sequence
caacttattagctgtttgat

SEQ ID NO: 583142 - DNA, 20 bp, Artificial
  CRISPR gRNA sequence
attagctgtttgatctttaa

SEQ ID NO: 583143 - DNA, 20 bp, Artificial
  CRISPR gRNA sequence
ttagctgtttgatctttaaa

SEQ ID NO: 583144 - DNA, 20 bp, Artificial
  CRISPR gRNA sequence
gctgtttgatctttaaaaag

SEQ ID NO: 583145 - DNA, 20 bp, Artificial
  CRISPR gRNA sequence
tttgatctttaaaaagttac

SEQ ID NO: 583146 - DNA, 20 bp, Artificial
  CRISPR gRNA sequence
gatctttaaaaagttactcg

SEQ ID NO: 583147 - DNA, 20 bp, Artificial
  CRISPR gRNA sequence
atctttaaaaagttactcga

SEQ ID NO: 583148 - DNA, 20 bp, Artificial
  CRISPR gRNA sequence
taaaaagttactcgatctcc

SEQ ID NO: 583149 - DNA, 20 bp, Artificial
  CRISPR gRNA sequence
aaaaagttactcgatctcca

SEQ ID NO: 583150 - DNA, 20 bp, Artificial
  CRISPR gRNA sequence
aaaagttactcgatctccat

SEQ ID NO: 583151 - DNA, 20 bp, Artificial
  CRISPR gRNA sequence
ctcgatctccatgagcctca

SEQ ID NO: 583152 - DNA, 20 bp, Artificial
  CRISPR gRNA sequence
gatctccatgagcctcagtt

SEQ ID NO: 583153 - DNA, 20 bp, Artificial
  CRISPR gRNA sequence
catgagcctcagtttccata

SEQ ID NO: 583154 - DNA, 20 bp, Artificial
  CRISPR gRNA sequence
agtttccatacgtgtaaaag

SEQ ID NO: 583155 - DNA, 20 bp, Artificial
  CRISPR gRNA sequence
ccatacgtgtaaaaggggga

SEQ ID NO: 583156 - DNA, 20 bp, Artificial
  CRISPR gRNA sequence
catacgtgtaaaagggggat

SEQ ID NO: 583157 - DNA, 20 bp, Artificial
  CRISPR gRNA sequence
ccatgtgggcttgcagtgca

SEQ ID NO: 583158 - DNA, 20 bp, Artificial
  CRISPR gRNA sequence
gcagtgcagagtatttgaat

SEQ ID NO: 583159 - DNA, 20 bp, Artificial
  CRISPR gRNA sequence
cagtgcagagtatttgaatt

SEQ ID NO: 583160 - DNA, 20 bp, Artificial
  CRISPR gRNA sequence
gaattagacacagaacagtg

SEQ ID NO: 583161 - DNA, 20 bp, Artificial
  CRISPR gRNA sequence
aattagacacagaacagtga

SEQ ID NO: 583162 - DNA, 20 bp, Artificial
  CRISPR gRNA sequence
gacacagaacagtgaggatc

SEQ ID NO: 583163 - DNA, 20 bp, Artificial
  CRISPR gRNA sequence
tcacccacctgcctttctgc

SEQ ID NO: 583164 - DNA, 20 bp, Artificial
  CRISPR gRNA sequence
acccacctgcctttctgccc

SEQ ID NO: 583165 - DNA, 20 bp, Artificial
  CRISPR gRNA sequence
cctttctgcccagctgccca

SEQ ID NO: 583166 - DNA, 20 bp, Artificial
  CRISPR gRNA sequence
tctgcccagctgcccacact

SEQ ID NO: 583167 - DNA, 20 bp, Artificial
  CRISPR gRNA sequence
ctgcccagctgcccacactg

SEQ ID NO: 583168 - DNA, 20 bp, Artificial
  CRISPR gRNA sequence
tgcccagctgcccacactgc

SEQ ID NO: 583169 - DNA, 20 bp, Artificial
  CRISPR gRNA sequence
cccagctgcccacactgccc

SEQ ID NO: 583170 - DNA, 20 bp, Artificial
  CRISPR gRNA sequence
cccacactgcccctagtcat

SEQ ID NO: 583171 - DNA, 20 bp, Artificial
  CRISPR gRNA sequence
cccctagtcatggtggcacc

SEQ ID NO: 583172 - DNA, 20 bp, Artificial
  CRISPR gRNA sequence
gtcatggtggcaccctccgg

SEQ ID NO: 583173 - DNA, 20 bp, Artificial
  CRISPR gRNA sequence
cggggcacggctgggcccct

SEQ ID NO: 583174 - DNA, 20 bp, Artificial
  CRISPR gRNA sequence
ggccccttgccccacttaca

SEQ ID NO: 583175 - DNA, 20 bp, Artificial
  CRISPR gRNA sequence
gccccacttacaggcactcc

SEQ ID NO: 583176 - DNA, 20 bp, Artificial
  CRISPR gRNA sequence
ccccacttacaggcactcct

SEQ ID NO: 583177 - DNA, 20 bp, Artificial
  CRISPR gRNA sequence
acaggcactcctccaggaca

SEQ ID NO: 583178 - DNA, 20 bp, Artificial
  CRISPR gRNA sequence
caggcactcctccaggacag

SEQ ID NO: 583179 - DNA, 20 bp, Artificial
  CRISPR gRNA sequence
ctccaggacaggccacattt

SEQ ID NO: 583180 - DNA, 20 bp, Artificial
  CRISPR gRNA sequence
caggacaggccacatttcat

SEQ ID NO: 583181 - DNA, 20 bp, Artificial
  CRISPR gRNA sequence
catgcaccaggtatggacgg

SEQ ID NO: 583182 - DNA, 20 bp, Artificial
  CRISPR gRNA sequence
atgcaccaggtatggacggt

SEQ ID NO: 583183 - DNA, 20 bp, Artificial
  CRISPR gRNA sequence
tggggaggggccccgagtca

SEQ ID NO: 583184 - DNA, 20 bp, Artificial
  CRISPR gRNA sequence
aaccacagcccacatgtgcc

SEQ ID NO: 583185 - DNA, 20 bp, Artificial
  CRISPR gRNA sequence
tcaacggtggatgcccacgc

SEQ ID NO: 583186 - DNA, 20 bp, Artificial
  CRISPR gRNA sequence
aacggtggatgcccacgccc

SEQ ID NO: 583187 - DNA, 20 bp, Artificial
  CRISPR gRNA sequence
tgctgcaggtgcaccccctg

SEQ ID NO: 583188 - DNA, 20 bp, Artificial
  CRISPR gRNA sequence
caggtgcaccccctggagag

SEQ ID NO: 583189 - DNA, 20 bp, Artificial
  CRISPR gRNA sequence
gagagcccagccatgatcag

SEQ ID NO: 583190 - DNA, 20 bp, Artificial
  CRISPR gRNA sequence
acaccacccaccaccgccac

SEQ ID NO: 583191 - DNA, 20 bp, Artificial
  CRISPR gRNA sequence
gggtcttctccctcaaggcc

SEQ ID NO: 583192 - DNA, 20 bp, Artificial
  CRISPR gRNA sequence
ctccctcaaggcccggcctg

SEQ ID NO: 583193 - DNA, 20 bp, Artificial
  CRISPR gRNA sequence
tccctcaaggcccggcctgg

SEQ ID NO: 583194 - DNA, 20 bp, Artificial
  CRISPR gRNA sequence
cctcaaggcccggcctggcc

SEQ ID NO: 583195 - DNA, 20 bp, Artificial
  CRISPR gRNA sequence
aaggcccggcctggcctccc

SEQ ID NO: 583196 - DNA, 20 bp, Artificial
  CRISPR gRNA sequence
gcctcccacctggtaacacc

SEQ ID NO: 583197 - DNA, 20 bp, Artificial
  CRISPR gRNA sequence
ccacctggtaacacctcagc

SEQ ID NO: 583198 - DNA, 20 bp, Artificial
  CRISPR gRNA sequence
gtaacacctcagcccgtacc

SEQ ID NO: 583199 - DNA, 20 bp, Artificial
  CRISPR gRNA sequence
agcccgtaccccatggcttc

SEQ ID NO: 583200 - DNA, 20 bp, Artificial
  CRISPR gRNA sequence
cacagaacccccaagtcccc

SEQ ID NO: 583201 - DNA, 20 bp, Artificial
  CRISPR gRNA sequence
acagaacccccaagtcccca

SEQ ID NO: 583202 - DNA, 20 bp, Artificial
  CRISPR gRNA sequence
ggctgtgagcagtgtaggct

SEQ ID NO: 583203 - DNA, 20 bp, Artificial
  CRISPR gRNA sequence
gctgtgagcagtgtaggcta

SEQ ID NO: 583204 - DNA, 20 bp, Artificial
  CRISPR gRNA sequence
tgagcagtgtaggctattct

SEQ ID NO: 583205 - DNA, 20 bp, Artificial
  CRISPR gRNA sequence
ttctgaattgcagtactctg

SEQ ID NO: 583206 - DNA, 20 bp, Artificial
  CRISPR gRNA sequence
tgaattgcagtactctgggg

SEQ ID NO: 583207 - DNA, 20 bp, Artificial
  CRISPR gRNA sequence
aattgcagtactctgggggt

SEQ ID NO: 583208 - DNA, 20 bp, Artificial
  CRISPR gRNA sequence
cagtactctgggggtcaaag

SEQ ID NO: 583209 - DNA, 20 bp, Artificial
  CRISPR gRNA sequence
tgggggtcaaaggtgtcagg

SEQ ID NO: 583210 - DNA, 20 bp, Artificial
  CRISPR gRNA sequence
ggggtcaaaggtgtcaggtc

SEQ ID NO: 583211 - DNA, 20 bp, Artificial
  CRISPR gRNA sequence
agaggcttggaaactccacc

SEQ ID NO: 583212 - DNA, 20 bp, Artificial
  CRISPR gRNA sequence
ggaaactccaccctccaaaa

SEQ ID NO: 583213 - DNA, 20 bp, Artificial
  CRISPR gRNA sequence
gaaactccaccctccaaaaa

SEQ ID NO: 583214 - DNA, 20 bp, Artificial
  CRISPR gRNA sequence
caccctccaaaaaacgtcag

SEQ ID NO: 583215 - DNA, 20 bp, Artificial
  CRISPR gRNA sequence
caaaaaacgtcaggtgcaga

SEQ ID NO: 583216 - DNA, 20 bp, Artificial
  CRISPR gRNA sequence
aaagatgcagaatgtcaaaa

SEQ ID NO: 583217 - DNA, 20 bp, Artificial
  CRISPR gRNA sequence
aagatgcagaatgtcaaaat

SEQ ID NO: 583218 - DNA, 20 bp, Artificial
  CRISPR gRNA sequence
tacaaagctagtcaaaatgt

SEQ ID NO: 583219 - DNA, 20 bp, Artificial
  CRISPR gRNA sequence
acaaagctagtcaaaatgtc

SEQ ID NO: 583220 - DNA, 20 bp, Artificial
  CRISPR gRNA sequence
caaagctagtcaaaatgtca

SEQ ID NO: 583221 - DNA, 20 bp, Artificial
  CRISPR gRNA sequence
gtcaaaatgtcagcacctgc

SEQ ID NO: 583222 - DNA, 20 bp, Artificial
  CRISPR gRNA sequence
cgaatggccgtctttaagct

SEQ ID NO: 583223 - DNA, 20 bp, Artificial
  CRISPR gRNA sequence
taagcttctctgccagaagc

SEQ ID NO: 583224 - DNA, 20 bp, Artificial
  CRISPR gRNA sequence
aagcttctctgccagaagcc

SEQ ID NO: 583225 - DNA, 20 bp, Artificial
  CRISPR gRNA sequence
agcttctctgccagaagcct

SEQ ID NO: 583226 - DNA, 20 bp, Artificial
  CRISPR gRNA sequence
ctctgccagaagcctgggac

SEQ ID NO: 583227 - DNA, 20 bp, Artificial
  CRISPR gRNA sequence
tctgccagaagcctgggact

SEQ ID NO: 583228 - DNA, 20 bp, Artificial
  CRISPR gRNA sequence
tgccagaagcctgggacttt

SEQ ID NO: 583229 - DNA, 20 bp, Artificial
  CRISPR gRNA sequence
ccagaagcctgggactttgg

SEQ ID NO: 583230 - DNA, 20 bp, Artificial
  CRISPR gRNA sequence
ggactttggggacagcagag

SEQ ID NO: 583231 - DNA, 20 bp, Artificial
  CRISPR gRNA sequence
tggggacagcagagccccct

SEQ ID NO: 583232 - DNA, 20 bp, Artificial
  CRISPR gRNA sequence
ggggacagcagagccccctg

SEQ ID NO: 583233 - DNA, 20 bp, Artificial
  CRISPR gRNA sequence
gggacagcagagccccctgg

SEQ ID NO: 583234 - DNA, 20 bp, Artificial
  CRISPR gRNA sequence
ggagtcagggttttcgaggc

SEQ ID NO: 583235 - DNA, 20 bp, Artificial
  CRISPR gRNA sequence
tcgaggctcaggagggtggg

SEQ ID NO: 583236 - DNA, 20 bp, Artificial
  CRISPR gRNA sequence
cgaggctcaggagggtggga

SEQ ID NO: 583237 - DNA, 20 bp, Artificial
  CRISPR gRNA sequence
gaggctcaggagggtgggaa

SEQ ID NO: 583238 - DNA, 20 bp, Artificial
  CRISPR gRNA sequence
aggagggtgggaagctcaaa

SEQ ID NO: 583239 - DNA, 20 bp, Artificial
  CRISPR gRNA sequence
aaaatgagaggccttgtggg

SEQ ID NO: 583240 - DNA, 20 bp, Artificial
  CRISPR gRNA sequence
gtgggccaagctccagagcc

SEQ ID NO: 583241 - DNA, 20 bp, Artificial
  CRISPR gRNA sequence
tgggccaagctccagagccc

SEQ ID NO: 583242 - DNA, 20 bp, Artificial
  CRISPR gRNA sequence
cagagcccagcccacagcct

SEQ ID NO: 583243 - DNA, 20 bp, Artificial
  CRISPR gRNA sequence
cataggtgccctgtccccac

SEQ ID NO: 583244 - DNA, 20 bp, Artificial
  CRISPR gRNA sequence
tccccacccacagggatcaa

SEQ ID NO: 583245 - DNA, 20 bp, Artificial
  CRISPR gRNA sequence
gaatgggtgtccagggagcc

SEQ ID NO: 583246 - DNA, 20 bp, Artificial
  CRISPR gRNA sequence
ctctgcaccttcccaaatcc

SEQ ID NO: 583247 - DNA, 20 bp, Artificial
  CRISPR gRNA sequence
tgcaccttcccaaatcccag

SEQ ID NO: 583248 - DNA, 20 bp, Artificial
  CRISPR gRNA sequence
caccttcccaaatcccagtg

SEQ ID NO: 583249 - DNA, 20 bp, Artificial
  CRISPR gRNA sequence
cccaaatcccagtgcaccca

SEQ ID NO: 583250 - DNA, 20 bp, Artificial
  CRISPR gRNA sequence
ccaaatcccagtgcacccag

SEQ ID NO: 583251 - DNA, 20 bp, Artificial
  CRISPR gRNA sequence
ggaaggatcctcgccctcct

SEQ ID NO: 583252 - DNA, 20 bp, Artificial
  CRISPR gRNA sequence
gccctcctatcccctcccct

SEQ ID NO: 583253 - DNA, 20 bp, Artificial
  CRISPR gRNA sequence
ctatcccctcccctgacacc

SEQ ID NO: 583254 - DNA, 20 bp, Artificial
  CRISPR gRNA sequence
tcccctcccctgacaccctc

SEQ ID NO: 583255 - DNA, 20 bp, Artificial
  CRISPR gRNA sequence
ccctgacaccctctgtcccc

SEQ ID NO: 583256 - DNA, 20 bp, Artificial
  CRISPR gRNA sequence
acaccctctgtccccccagc

SEQ ID NO: 583257 - DNA, 20 bp, Artificial
  CRISPR gRNA sequence
tgtccccccagcaccctttc

SEQ ID NO: 583258 - DNA, 20 bp, Artificial
  CRISPR gRNA sequence
tccccccagcaccctttcgg

SEQ ID NO: 583259 - DNA, 20 bp, Artificial
  CRISPR gRNA sequence
tcggctgtgccccagagctc

SEQ ID NO: 583260 - DNA, 20 bp, Artificial
  CRISPR gRNA sequence
cggctgtgccccagagctcc

SEQ ID NO: 583261 - DNA, 20 bp, Artificial
  CRISPR gRNA sequence
ggctgtgccccagagctcct

SEQ ID NO: 583262 - DNA, 20 bp, Artificial
  CRISPR gRNA sequence
tgccccagagctcctaccca

SEQ ID NO: 583263 - DNA, 20 bp, Artificial
  CRISPR gRNA sequence
ctacccactgctggcaaatg

SEQ ID NO: 583264 - DNA, 20 bp, Artificial
  CRISPR gRNA sequence
cccactgctggcaaatggtg

SEQ ID NO: 583265 - DNA, 20 bp, Artificial
  CRISPR gRNA sequence
ctggcaaatggtgtctgcaa

SEQ ID NO: 583266 - DNA, 20 bp, Artificial
  CRISPR gRNA sequence
gcaaatggtgtctgcaagtg

SEQ ID NO: 583267 - DNA, 20 bp, Artificial
  CRISPR gRNA sequence
caagtggcccggatgtgaga

SEQ ID NO: 583268 - DNA, 20 bp, Artificial
  CRISPR gRNA sequence
cgaagagccagaggacttcc

SEQ ID NO: 583269 - DNA, 20 bp, Artificial
  CRISPR gRNA sequence
gaagagccagaggacttcct

SEQ ID NO: 583270 - DNA, 20 bp, Artificial
  CRISPR gRNA sequence
cctcaagtgagtggcccagg

SEQ ID NO: 583271 - DNA, 20 bp, Artificial
  CRISPR gRNA sequence
ctcaagtgagtggcccaggc

SEQ ID NO: 583272 - DNA, 20 bp, Artificial
  CRISPR gRNA sequence
aagtgagtggcccaggcctg

SEQ ID NO: 583273 - DNA, 20 bp, Artificial
  CRISPR gRNA sequence
tgccagtctaccggccctgg

SEQ ID NO: 583274 - DNA, 20 bp, Artificial
  CRISPR gRNA sequence
ccggccctggcttgtgggga

SEQ ID NO: 583275 - DNA, 20 bp, Artificial
  CRISPR gRNA sequence
gcttgtggggagaggtctag

SEQ ID NO: 583276 - DNA, 20 bp, Artificial
  CRISPR gRNA sequence
gtggggagaggtctagggtg

SEQ ID NO: 583277 - DNA, 20 bp, Artificial
  CRISPR gRNA sequence
tggggagaggtctagggtgc

SEQ ID NO: 583278 - DNA, 20 bp, Artificial
  CRISPR gRNA sequence
gggtgcagatctcagctcag

SEQ ID NO: 583279 - DNA, 20 bp, Artificial
  CRISPR gRNA sequence
agctcaggcttcatcccaat

SEQ ID NO: 583280 - DNA, 20 bp, Artificial
  CRISPR gRNA sequence
aggcttcatcccaataagta

SEQ ID NO: 583281 - DNA, 20 bp, Artificial
  CRISPR gRNA sequence
catcccaataagtagtaaga

SEQ ID NO: 583282 - DNA, 20 bp, Artificial
  CRISPR gRNA sequence
atcccaataagtagtaagat

SEQ ID NO: 583283 - DNA, 20 bp, Artificial
  CRISPR gRNA sequence
aactctgagactgtgggttc

SEQ ID NO: 583284 - DNA, 20 bp, Artificial
  CRISPR gRNA sequence
tgagactgtgggttcaaatc

SEQ ID NO: 583285 - DNA, 20 bp, Artificial
  CRISPR gRNA sequence
agactgtgggttcaaatccc

SEQ ID NO: 583286 - DNA, 20 bp, Artificial
  CRISPR gRNA sequence
tgggttcaaatcccagctcc

SEQ ID NO: 583287 - DNA, 20 bp, Artificial
  CRISPR gRNA sequence
aaatcccagctccatccctg

SEQ ID NO: 583288 - DNA, 20 bp, Artificial
  CRISPR gRNA sequence
catccctgactggctgtgtg

SEQ ID NO: 583289 - DNA, 20 bp, Artificial
  CRISPR gRNA sequence
actggctgtgtgaccttgga

SEQ ID NO: 583290 - DNA, 20 bp, Artificial
  CRISPR gRNA sequence
gctgtgtgaccttggacaaa

SEQ ID NO: 583291 - DNA, 20 bp, Artificial
  CRISPR gRNA sequence
tgtgaccttggacaaattac

SEQ ID NO: 583292 - DNA, 20 bp, Artificial
  CRISPR gRNA sequence
ggacaaattacttagcttct

SEQ ID NO: 583293 - DNA, 20 bp, Artificial
  CRISPR gRNA sequence
gacaaattacttagcttctc

SEQ ID NO: 583294 - DNA, 20 bp, Artificial
  CRISPR gRNA sequence
cttagcttctctcgacctca

SEQ ID NO: 583295 - DNA, 20 bp, Artificial
  CRISPR gRNA sequence
agcttctctcgacctcagtt

SEQ ID NO: 583296 - DNA, 20 bp, Artificial
  CRISPR gRNA sequence
gcttctctcgacctcagttt

SEQ ID NO: 583297 - DNA, 20 bp, Artificial
  CRISPR gRNA sequence
ctctcgacctcagttttctc

SEQ ID NO: 583298 - DNA, 20 bp, Artificial
  CRISPR gRNA sequence
tctcgacctcagttttctcg

SEQ ID NO: 583299 - DNA, 20 bp, Artificial
  CRISPR gRNA sequence
tcgacctcagttttctcgta

SEQ ID NO: 583300 - DNA, 20 bp, Artificial
  CRISPR gRNA sequence
gacctcagttttctcgtatg

SEQ ID NO: 583301 - DNA, 20 bp, Artificial
  CRISPR gRNA sequence
agttttctcgtatgtataat

SEQ ID NO: 583302 - DNA, 20 bp, Artificial
  CRISPR gRNA sequence
tctcgtatgtataataagaa

SEQ ID NO: 583303 - DNA, 20 bp, Artificial
  CRISPR gRNA sequence
ctcgtatgtataataagaaa

SEQ ID NO: 583304 - DNA, 20 bp, Artificial
  CRISPR gRNA sequence
tcgtatgtataataagaaac

SEQ ID NO: 583305 - DNA, 20 bp, Artificial
  CRISPR gRNA sequence
gtatgtataataagaaacgt

SEQ ID NO: 583306 - DNA, 20 bp, Artificial
  CRISPR gRNA sequence
gtgctgttatttacccccat

SEQ ID NO: 583307 - DNA, 20 bp, Artificial
  CRISPR gRNA sequence
tgctgttatttacccccatt

SEQ ID NO: 583308 - DNA, 20 bp, Artificial
  CRISPR gRNA sequence
ttatttacccccattttaca

SEQ ID NO: 583309 - DNA, 20 bp, Artificial
  CRISPR gRNA sequence
tttacccccattttacagac

SEQ ID NO: 583310 - DNA, 20 bp, Artificial
  CRISPR gRNA sequence
acccccattttacagacaag

SEQ ID NO: 583311 - DNA, 20 bp, Artificial
  CRISPR gRNA sequence
cccccattttacagacaagg

SEQ ID NO: 583312 - DNA, 20 bp, Artificial
  CRISPR gRNA sequence
tacagacaaggagactgagg

SEQ ID NO: 583313 - DNA, 20 bp, Artificial
  CRISPR gRNA sequence
acagacaaggagactgaggc

SEQ ID NO: 583314 - DNA, 20 bp, Artificial
  CRISPR gRNA sequence
cagacaaggagactgaggcc

SEQ ID NO: 583315 - DNA, 20 bp, Artificial
  CRISPR gRNA sequence
aggccaaagaggttaagtgt

SEQ ID NO: 583316 - DNA, 20 bp, Artificial
  CRISPR gRNA sequence
agtgtcttgatcaaaatctc

SEQ ID NO: 583317 - DNA, 20 bp, Artificial
  CRISPR gRNA sequence
gatcaaaatctcccagttcc

SEQ ID NO: 583318 - DNA, 20 bp, Artificial
  CRISPR gRNA sequence
atcaaaatctcccagttcct

SEQ ID NO: 583319 - DNA, 20 bp, Artificial
  CRISPR gRNA sequence
ccagttcctgagtgacagag

SEQ ID NO: 583320 - DNA, 20 bp, Artificial
  CRISPR gRNA sequence
ctgagtgacagagctgggat

SEQ ID NO: 583321 - DNA, 20 bp, Artificial
  CRISPR gRNA sequence
agtgacagagctgggatttg

SEQ ID NO: 583322 - DNA, 20 bp, Artificial
  CRISPR gRNA sequence
ggatttgaacccatgtagcc

SEQ ID NO: 583323 - DNA, 20 bp, Artificial
  CRISPR gRNA sequence
gaacccatgtagccaggctc

SEQ ID NO: 583324 - DNA, 20 bp, Artificial
  CRISPR gRNA sequence
aacccatgtagccaggctct

SEQ ID NO: 583325 - DNA, 20 bp, Artificial
  CRISPR gRNA sequence
tagaatctgcactcctgctt

SEQ ID NO: 583326 - DNA, 20 bp, Artificial
  CRISPR gRNA sequence
gaatctgcactcctgctttg

SEQ ID NO: 583327 - DNA, 20 bp, Artificial
  CRISPR gRNA sequence
cactcctgctttgccctgct

SEQ ID NO: 583328 - DNA, 20 bp, Artificial
  CRISPR gRNA sequence
ctgctttgccctgctactcc

SEQ ID NO: 583329 - DNA, 20 bp, Artificial
  CRISPR gRNA sequence
ctttgccctgctactcctca

SEQ ID NO: 583330 - DNA, 20 bp, Artificial
  CRISPR gRNA sequence
tgccctgctactcctcatgc

SEQ ID NO: 583331 - DNA, 20 bp, Artificial
  CRISPR gRNA sequence
gccctgctactcctcatgcc

SEQ ID NO: 583332 - DNA, 20 bp, Artificial
  CRISPR gRNA sequence
ccctgctactcctcatgcca

SEQ ID NO: 583333 - DNA, 20 bp, Artificial
  CRISPR gRNA sequence
ctactcctcatgccaacatg

SEQ ID NO: 583334 - DNA, 20 bp, Artificial
  CRISPR gRNA sequence
ctcctcatgccaacatgcca

SEQ ID NO: 583335 - DNA, 20 bp, Artificial
  CRISPR gRNA sequence
ctcatgccaacatgccagcc

SEQ ID NO: 583336 - DNA, 20 bp, Artificial
  CRISPR gRNA sequence
atgccaacatgccagcctta

SEQ ID NO: 583337 - DNA, 20 bp, Artificial
  CRISPR gRNA sequence
attccactgttcccaaagtt

SEQ ID NO: 583338 - DNA, 20 bp, Artificial
  CRISPR gRNA sequence
ttccactgttcccaaagttc

SEQ ID NO: 583339 - DNA, 20 bp, Artificial
  CRISPR gRNA sequence
cactgttcccaaagttctag

SEQ ID NO: 583340 - DNA, 20 bp, Artificial
  CRISPR gRNA sequence
ttcccaaagttctagctcct

SEQ ID NO: 583341 - DNA, 20 bp, Artificial
  CRISPR gRNA sequence
ccaaagttctagctcctcta

SEQ ID NO: 583342 - DNA, 20 bp, Artificial
  CRISPR gRNA sequence
tagctcctctagatggctgc

SEQ ID NO: 583343 - DNA, 20 bp, Artificial
  CRISPR gRNA sequence
gctcctctagatggctgctg

SEQ ID NO: 583344 - DNA, 20 bp, Artificial
  CRISPR gRNA sequence
ctctagatggctgctgctgc

SEQ ID NO: 583345 - DNA, 20 bp, Artificial
  CRISPR gRNA sequence
tagatggctgctgctgcctc

SEQ ID NO: 583346 - DNA, 20 bp, Artificial
  CRISPR gRNA sequence
gatggctgctgctgcctccc

SEQ ID NO: 583347 - DNA, 20 bp, Artificial
  CRISPR gRNA sequence
ctgctgcctcccctcagtcc

SEQ ID NO: 583348 - DNA, 20 bp, Artificial
  CRISPR gRNA sequence
ctgcctcccctcagtccccc

SEQ ID NO: 583349 - DNA, 20 bp, Artificial
  CRISPR gRNA sequence
cctcccctcagtccccccat

SEQ ID NO: 583350 - DNA, 20 bp, Artificial
  CRISPR gRNA sequence
ccctcagtccccccatatgt

SEQ ID NO: 583351 - DNA, 20 bp, Artificial
  CRISPR gRNA sequence
agtccccccatatgtctctc

SEQ ID NO: 583352 - DNA, 20 bp, Artificial
  CRISPR gRNA sequence
tctctctctctctctctctc

SEQ ID NO: 583353 - DNA, 20 bp, Artificial
  CRISPR gRNA sequence
tctctctctctctctctctc

SEQ ID NO: 583354 - DNA, 20 bp, Artificial
  CRISPR gRNA sequence
tctctctctctctctctctc

SEQ ID NO: 583355 - DNA, 20 bp, Artificial
  CRISPR gRNA sequence
tctctctctctctctctctc

SEQ ID NO: 583356 - DNA, 20 bp, Artificial
  CRISPR gRNA sequence
tctctctctctctctctctc

SEQ ID NO: 583357 - DNA, 20 bp, Artificial
  CRISPR gRNA sequence
tctctctctctctctctctc

SEQ ID NO: 583358 - DNA, 20 bp, Artificial
  CRISPR gRNA sequence
tctctctctctctctctctc

SEQ ID NO: 583359 - DNA, 20 bp, Artificial
  CRISPR gRNA sequence
tctctctctctctctctctc

SEQ ID NO: 583360 - DNA, 20 bp, Artificial
  CRISPR gRNA sequence
tctctctctctctctctctc

SEQ ID NO: 583361 - DNA, 20 bp, Artificial
  CRISPR gRNA sequence
tctctctctctctctctctc

SEQ ID NO: 583362 - DNA, 20 bp, Artificial
  CRISPR gRNA sequence
tctctctctctctctctctc

SEQ ID NO: 583363 - DNA, 20 bp, Artificial
  CRISPR gRNA sequence
tctctctctctctctctctc

SEQ ID NO: 583364 - DNA, 20 bp, Artificial
  CRISPR gRNA sequence
tctctctctctctctctctc

SEQ ID NO: 583365 - DNA, 20 bp, Artificial
  CRISPR gRNA sequence
tctctctctctctctctctc

SEQ ID NO: 583366 - DNA, 20 bp, Artificial
  CRISPR gRNA sequence
tctctctctctctctctctc

SEQ ID NO: 583367 - DNA, 20 bp, Artificial
  CRISPR gRNA sequence
tctctctctctctctctctc

SEQ ID NO: 583368 - DNA, 20 bp, Artificial
  CRISPR gRNA sequence
tctctctctctctctctctt

SEQ ID NO: 583369 - DNA, 20 bp, Artificial
  CRISPR gRNA sequence
tctctctctctctctctttc

SEQ ID NO: 583370 - DNA, 20 bp, Artificial
  CRISPR gRNA sequence
tctctctctctctctttctc

SEQ ID NO: 583371 - DNA, 20 bp, Artificial
  CRISPR gRNA sequence
tctctctctctctttctctc

SEQ ID NO: 583372 - DNA, 20 bp, Artificial
  CRISPR gRNA sequence
tctctctctctttctctctc

SEQ ID NO: 583373 - DNA, 20 bp, Artificial
  CRISPR gRNA sequence
tctctctctttctctctctc

SEQ ID NO: 583374 - DNA, 20 bp, Artificial
  CRISPR gRNA sequence
tctctctttctctctctctc

SEQ ID NO: 583375 - DNA, 20 bp, Artificial
  CRISPR gRNA sequence
tctctttctctctctctcac

SEQ ID NO: 583376 - DNA, 20 bp, Artificial
  CRISPR gRNA sequence
tctttctctctctctcacac

SEQ ID NO: 583377 - DNA, 20 bp, Artificial
  CRISPR gRNA sequence
tttctctctctctcacacac

SEQ ID NO: 583378 - DNA, 20 bp, Artificial
  CRISPR gRNA sequence
tctctctctctcacacacac

SEQ ID NO: 583379 - DNA, 20 bp, Artificial
  CRISPR gRNA sequence
ctctctctctcacacacaca

SEQ ID NO: 583380 - DNA, 20 bp, Artificial
  CRISPR gRNA sequence
tctctctctcacacacacac

SEQ ID NO: 583381 - DNA, 20 bp, Artificial
  CRISPR gRNA sequence
tctctctcacacacacacac

SEQ ID NO: 583382 - DNA, 20 bp, Artificial
  CRISPR gRNA sequence
tctctcacacacacacacac

SEQ ID NO: 583383 - DNA, 20 bp, Artificial
  CRISPR gRNA sequence
tctcacacacacacacacac

SEQ ID NO: 583384 - DNA, 20 bp, Artificial
  CRISPR gRNA sequence
tcacacacacacacacacaa

SEQ ID NO: 583385 - DNA, 20 bp, Artificial
  CRISPR gRNA sequence
acacacacacacacacaaat

SEQ ID NO: 583386 - DNA, 20 bp, Artificial
  CRISPR gRNA sequence
cacacaacccttagcagcaa

SEQ ID NO: 583387 - DNA, 20 bp, Artificial
  CRISPR gRNA sequence
agcagcaaccccacatgtcc

SEQ ID NO: 583388 - DNA, 20 bp, Artificial
  CRISPR gRNA sequence
gcagcaaccccacatgtcct

SEQ ID NO: 583389 - DNA, 20 bp, Artificial
  CRISPR gRNA sequence
tcctccttgcagccaggcct

SEQ ID NO: 583390 - DNA, 20 bp, Artificial
  CRISPR gRNA sequence
cttgcagccaggcctttgca

SEQ ID NO: 583391 - DNA, 20 bp, Artificial
  CRISPR gRNA sequence
gcagccaggcctttgcacag

SEQ ID NO: 583392 - DNA, 20 bp, Artificial
  CRISPR gRNA sequence
cagccaggcctttgcacagg

SEQ ID NO: 583393 - DNA, 20 bp, Artificial
  CRISPR gRNA sequence
tgcacaggccgtccctccac

SEQ ID NO: 583394 - DNA, 20 bp, Artificial
  CRISPR gRNA sequence
gcacaggccgtccctccacc

SEQ ID NO: 583395 - DNA, 20 bp, Artificial
  CRISPR gRNA sequence
cacaggccgtccctccaccc

SEQ ID NO: 583396 - DNA, 20 bp, Artificial
  CRISPR gRNA sequence
cacccagaatgctttgccca

SEQ ID NO: 583397 - DNA, 20 bp, Artificial
  CRISPR gRNA sequence
tgcccactctcacctccctg

SEQ ID NO: 583398 - DNA, 20 bp, Artificial
  CRISPR gRNA sequence
gcccactctcacctccctgg

SEQ ID NO: 583399 - DNA, 20 bp, Artificial
  CRISPR gRNA sequence
cccactctcacctccctggc

SEQ ID NO: 583400 - DNA, 20 bp, Artificial
  CRISPR gRNA sequence
tcacctccctggcccattct

SEQ ID NO: 583401 - DNA, 20 bp, Artificial
  CRISPR gRNA sequence
acctccctggcccattctca

SEQ ID NO: 583402 - DNA, 20 bp, Artificial
  CRISPR gRNA sequence
cctggcccattctcaactca

SEQ ID NO: 583403 - DNA, 20 bp, Artificial
  CRISPR gRNA sequence
gcccattctcaactcaccac

SEQ ID NO: 583404 - DNA, 20 bp, Artificial
  CRISPR gRNA sequence
tcaactcaccacacttccaa

SEQ ID NO: 583405 - DNA, 20 bp, Artificial
  CRISPR gRNA sequence
aactcaccacacttccaaca

SEQ ID NO: 583406 - DNA, 20 bp, Artificial
  CRISPR gRNA sequence
accacacttccaacattatc

SEQ ID NO: 583407 - DNA, 20 bp, Artificial
  CRISPR gRNA sequence
ccaacattatctccagcact

SEQ ID NO: 583408 - DNA, 20 bp, Artificial
  CRISPR gRNA sequence
caacattatctccagcactc

SEQ ID NO: 583409 - DNA, 20 bp, Artificial
  CRISPR gRNA sequence
tctccagcactctggccagg

SEQ ID NO: 583410 - DNA, 20 bp, Artificial
  CRISPR gRNA sequence
cagcactctggccaggctca

SEQ ID NO: 583411 - DNA, 20 bp, Artificial
  CRISPR gRNA sequence
tggccaggctcaagtggtga

SEQ ID NO: 583412 - DNA, 20 bp, Artificial
  CRISPR gRNA sequence
gccaggctcaagtggtgagt

SEQ ID NO: 583413 - DNA, 20 bp, Artificial
  CRISPR gRNA sequence
aagtggtgagttcaggcctg

SEQ ID NO: 583414 - DNA, 20 bp, Artificial
  CRISPR gRNA sequence
aggcctgacatgcagtaggt

SEQ ID NO: 583415 - DNA, 20 bp, Artificial
  CRISPR gRNA sequence
acatgcagtaggtgctgagg

SEQ ID NO: 583416 - DNA, 20 bp, Artificial
  CRISPR gRNA sequence
aggggcatgtgttaagggaa

SEQ ID NO: 583417 - DNA, 20 bp, Artificial
  CRISPR gRNA sequence
agggaacgaggggtgtgaga

SEQ ID NO: 583418 - DNA, 20 bp, Artificial
  CRISPR gRNA sequence
aggtagagaggggaggggag

SEQ ID NO: 583419 - DNA, 20 bp, Artificial
  CRISPR gRNA sequence
gggctcagaggagagaactc

SEQ ID NO: 583420 - DNA, 20 bp, Artificial
  CRISPR gRNA sequence
agaggagagaactcccagag

SEQ ID NO: 583421 - DNA, 20 bp, Artificial
  CRISPR gRNA sequence
ccagagggtctgggccctcc

SEQ ID NO: 583422 - DNA, 20 bp, Artificial
  CRISPR gRNA sequence
ggccctccccattcagagca

SEQ ID NO: 583423 - DNA, 20 bp, Artificial
  CRISPR gRNA sequence
cccattcagagcattgagcc

SEQ ID NO: 583424 - DNA, 20 bp, Artificial
  CRISPR gRNA sequence
agagcattgagccagaccag

SEQ ID NO: 583425 - DNA, 20 bp, Artificial
  CRISPR gRNA sequence
agccagaccaggcctgtcgt

SEQ ID NO: 583426 - DNA, 20 bp, Artificial
  CRISPR gRNA sequence
tcgtggtcacctgcatggaa

SEQ ID NO: 583427 - DNA, 20 bp, Artificial
  CRISPR gRNA sequence
catggaatcttctccctact

SEQ ID NO: 583428 - DNA, 20 bp, Artificial
  CRISPR gRNA sequence
ctccctacttaggcactgcc

SEQ ID NO: 583429 - DNA, 20 bp, Artificial
  CRISPR gRNA sequence
tccctacttaggcactgcca

SEQ ID NO: 583430 - DNA, 20 bp, Artificial
  CRISPR gRNA sequence
cctacttaggcactgccagg

SEQ ID NO: 583431 - DNA, 20 bp, Artificial
  CRISPR gRNA sequence
cttaggcactgccaggcgga

SEQ ID NO: 583432 - DNA, 20 bp, Artificial
  CRISPR gRNA sequence
aggcactgccaggcggacca

SEQ ID NO: 583433 - DNA, 20 bp, Artificial
  CRISPR gRNA sequence
ggcactgccaggcggaccat

SEQ ID NO: 583434 - DNA, 20 bp, Artificial
  CRISPR gRNA sequence
ccaggcggaccatcttctgg

SEQ ID NO: 583435 - DNA, 20 bp, Artificial
  CRISPR gRNA sequence
ctggatgagaagggcagggc

SEQ ID NO: 583436 - DNA, 20 bp, Artificial
  CRISPR gRNA sequence
tggatgagaagggcagggca

SEQ ID NO: 583437 - DNA, 20 bp, Artificial
  CRISPR gRNA sequence
gatgagaagggcagggcaca

SEQ ID NO: 583438 - DNA, 20 bp, Artificial
  CRISPR gRNA sequence
ctccagagagagatggtaca

SEQ ID NO: 583439 - DNA, 20 bp, Artificial
  CRISPR gRNA sequence
cagagagagatggtacagtc

SEQ ID NO: 583440 - DNA, 20 bp, Artificial
  CRISPR gRNA sequence
tggagcagcaggtaatgcca

SEQ ID NO: 583441 - DNA, 20 bp, Artificial
  CRISPR gRNA sequence
gagcagcaggtaatgccagg

SEQ ID NO: 583442 - DNA, 20 bp, Artificial
  CRISPR gRNA sequence
ctgtccaccatgtgccagaa

SEQ ID NO: 583443 - DNA, 20 bp, Artificial
  CRISPR gRNA sequence
tgtccaccatgtgccagaaa

SEQ ID NO: 583444 - DNA, 20 bp, Artificial
  CRISPR gRNA sequence
tccaccatgtgccagaaacc

SEQ ID NO: 583445 - DNA, 20 bp, Artificial
  CRISPR gRNA sequence
acctgggacgagggctggta

SEQ ID NO: 583446 - DNA, 20 bp, Artificial
  CRISPR gRNA sequence
ggacgagggctggtataaag

SEQ ID NO: 583447 - DNA, 20 bp, Artificial
  CRISPR gRNA sequence
gtataaaggaaggaagagga

SEQ ID NO: 583448 - DNA, 20 bp, Artificial
  CRISPR gRNA sequence
ccagggaagaccgtagcctg

SEQ ID NO: 583449 - DNA, 20 bp, Artificial
  CRISPR gRNA sequence
ggcaaagatgtggcagagaa

SEQ ID NO: 583450 - DNA, 20 bp, Artificial
  CRISPR gRNA sequence
aggcctcatgtttgtgccat

SEQ ID NO: 583451 - DNA, 20 bp, Artificial
  CRISPR gRNA sequence
atgtttgtgccatttcacag

SEQ ID NO: 583452 - DNA, 20 bp, Artificial
  CRISPR gRNA sequence
gtgccatttcacagctggtg

SEQ ID NO: 583453 - DNA, 20 bp, Artificial
  CRISPR gRNA sequence
tgccatttcacagctggtgc

SEQ ID NO: 583454 - DNA, 20 bp, Artificial
  CRISPR gRNA sequence
cacagctggtgctggagaag

SEQ ID NO: 583455 - DNA, 20 bp, Artificial
  CRISPR gRNA sequence
acagctggtgctggagaagg

SEQ ID NO: 583456 - DNA, 20 bp, Artificial
  CRISPR gRNA sequence
gtgctggagaaggagaagct

SEQ ID NO: 583457 - DNA, 20 bp, Artificial
  CRISPR gRNA sequence
gagaaggagaagctgagtgc

SEQ ID NO: 583458 - DNA, 20 bp, Artificial
  CRISPR gRNA sequence
agtgccatgcaggcccacct

SEQ ID NO: 583459 - DNA, 20 bp, Artificial
  CRISPR gRNA sequence
gctgggaaaatggcactgac

SEQ ID NO: 583460 - DNA, 20 bp, Artificial
  CRISPR gRNA sequence
ggaaaatggcactgaccaag

SEQ ID NO: 583461 - DNA, 20 bp, Artificial
  CRISPR gRNA sequence
accaaggcttcatctgtggt

SEQ ID NO: 583462 - DNA, 20 bp, Artificial
  CRISPR gRNA sequence
catctgtggtgagcgacccc

SEQ ID NO: 583463 - DNA, 20 bp, Artificial
  CRISPR gRNA sequence
atctgtggtgagcgacccca

SEQ ID NO: 583464 - DNA, 20 bp, Artificial
  CRISPR gRNA sequence
tggtgagcgaccccaggact

SEQ ID NO: 583465 - DNA, 20 bp, Artificial
  CRISPR gRNA sequence
gtggtggcagactcagactg

SEQ ID NO: 583466 - DNA, 20 bp, Artificial
  CRISPR gRNA sequence
agactgctggggggcaggga

SEQ ID NO: 583467 - DNA, 20 bp, Artificial
  CRISPR gRNA sequence
ctggggggcagggaggaggt

SEQ ID NO: 583468 - DNA, 20 bp, Artificial
  CRISPR gRNA sequence
gggggcagggaggaggtctg

SEQ ID NO: 583469 - DNA, 20 bp, Artificial
  CRISPR gRNA sequence
cacggtgcagggaacctaac

SEQ ID NO: 583470 - DNA, 20 bp, Artificial
  CRISPR gRNA sequence
acctcacattcaggtcctga

SEQ ID NO: 583471 - DNA, 20 bp, Artificial
  CRISPR gRNA sequence
acattcaggtcctgagagct

SEQ ID NO: 583472 - DNA, 20 bp, Artificial
  CRISPR gRNA sequence
aggtcctgagagctaggggc

SEQ ID NO: 583473 - DNA, 20 bp, Artificial
  CRISPR gRNA sequence
agagctaggggcccctgtcc

SEQ ID NO: 583474 - DNA, 20 bp, Artificial
  CRISPR gRNA sequence
ggggcccctgtccccagctc

SEQ ID NO: 583475 - DNA, 20 bp, Artificial
  CRISPR gRNA sequence
tccccagctccaaacatgcc

SEQ ID NO: 583476 - DNA, 20 bp, Artificial
  CRISPR gRNA sequence
caaacatgcccagacctgga

SEQ ID NO: 583477 - DNA, 20 bp, Artificial
  CRISPR gRNA sequence
gaaatctgtccccttctact

SEQ ID NO: 583478 - DNA, 20 bp, Artificial
  CRISPR gRNA sequence
tccccttctacttacaaacc

SEQ ID NO: 583479 - DNA, 20 bp, Artificial
  CRISPR gRNA sequence
ctacttacaaaccctctgac

SEQ ID NO: 583480 - DNA, 20 bp, Artificial
  CRISPR gRNA sequence
tacttacaaaccctctgacc

SEQ ID NO: 583481 - DNA, 20 bp, Artificial
  CRISPR gRNA sequence
cttacaaaccctctgacccc

SEQ ID NO: 583482 - DNA, 20 bp, Artificial
  CRISPR gRNA sequence
acaaaccctctgaccccggc

SEQ ID NO: 583483 - DNA, 20 bp, Artificial
  CRISPR gRNA sequence
caaaccctctgaccccggct

SEQ ID NO: 583484 - DNA, 20 bp, Artificial
  CRISPR gRNA sequence
tgaccccggctgggcgtggt

SEQ ID NO: 583485 - DNA, 20 bp, Artificial
  CRISPR gRNA sequence
accccggctgggcgtggtgg

SEQ ID NO: 583486 - DNA, 20 bp, Artificial
  CRISPR gRNA sequence
ggcgtggtggctcacgcctg

SEQ ID NO: 583487 - DNA, 20 bp, Artificial
  CRISPR gRNA sequence
acgcctgtaatcccagcact

SEQ ID NO: 583488 - DNA, 20 bp, Artificial
  CRISPR gRNA sequence
taatcccagcactttgggag

SEQ ID NO: 583489 - DNA, 20 bp, Artificial
  CRISPR gRNA sequence
tgggaggccgaggcgggtgg

SEQ ID NO: 583490 - DNA, 20 bp, Artificial
  CRISPR gRNA sequence
gggaggccgaggcgggtgga

SEQ ID NO: 583491 - DNA, 20 bp, Artificial
  CRISPR gRNA sequence
ggaggccgaggcgggtggat

SEQ ID NO: 583492 - DNA, 20 bp, Artificial
  CRISPR gRNA sequence
aagaccagcctcgccaagat

SEQ ID NO: 583493 - DNA, 20 bp, Artificial
  CRISPR gRNA sequence
gccaagatggtgaaaccctg

SEQ ID NO: 583494 - DNA, 20 bp, Artificial
  CRISPR gRNA sequence
tgtctactaaaagtacaaaa

SEQ ID NO: 583495 - DNA, 20 bp, Artificial
  CRISPR gRNA sequence
ctaaaagtacaaaaaattag

SEQ ID NO: 583496 - DNA, 20 bp, Artificial
  CRISPR gRNA sequence
aaagtacaaaaaattagcca

SEQ ID NO: 583497 - DNA, 20 bp, Artificial
  CRISPR gRNA sequence
gccaggcgtggtggcaggtg

SEQ ID NO: 583498 - DNA, 20 bp, Artificial
  CRISPR gRNA sequence
tagtcccaactacttgggag

SEQ ID NO: 583499 - DNA, 20 bp, Artificial
  CRISPR gRNA sequence
cttgggaggctgaggcagag

SEQ ID NO: 583500 - DNA, 20 bp, Artificial
  CRISPR gRNA sequence
gggaggctgaggcagagaat

SEQ ID NO: 583501 - DNA, 20 bp, Artificial
  CRISPR gRNA sequence
ggaggctgaggcagagaatt

SEQ ID NO: 583502 - DNA, 20 bp, Artificial
  CRISPR gRNA sequence
aggcagagaattgcttgaac

SEQ ID NO: 583503 - DNA, 20 bp, Artificial
  CRISPR gRNA sequence
cttgaacctgggaggcggag

SEQ ID NO: 583504 - DNA, 20 bp, Artificial
  CRISPR gRNA sequence
gaacctgggaggcggagttt

SEQ ID NO: 583505 - DNA, 20 bp, Artificial
  CRISPR gRNA sequence
aacctgggaggcggagtttg

SEQ ID NO: 583506 - DNA, 20 bp, Artificial
  CRISPR gRNA sequence
ggaggcggagtttgcagtga

SEQ ID NO: 583507 - DNA, 20 bp, Artificial
  CRISPR gRNA sequence
gcagtgagctgagatcatac

SEQ ID NO: 583508 - DNA, 20 bp, Artificial
  CRISPR gRNA sequence
cagtgagctgagatcatacc

SEQ ID NO: 583509 - DNA, 20 bp, Artificial
  CRISPR gRNA sequence
agatcataccactgcactcc

SEQ ID NO: 583510 - DNA, 20 bp, Artificial
  CRISPR gRNA sequence
cactccagcctaggcgacag

SEQ ID NO: 583511 - DNA, 20 bp, Artificial
  CRISPR gRNA sequence
cagcctaggcgacagatcaa

SEQ ID NO: 583512 - DNA, 20 bp, Artificial
  CRISPR gRNA sequence
ggcgacagatcaagactccg

SEQ ID NO: 583513 - DNA, 20 bp, Artificial
  CRISPR gRNA sequence
cgtctcaagaaaaaaaaaaa

SEQ ID NO: 583514 - DNA, 20 bp, Artificial
  CRISPR gRNA sequence
aagaaaaaaaaaaaaaaaaa

SEQ ID NO: 583515 - DNA, 20 bp, Artificial
  CRISPR gRNA sequence
tgactctaagatccccaaac

SEQ ID NO: 583516 - DNA, 20 bp, Artificial
  CRISPR gRNA sequence
actctaagatccccaaacac

SEQ ID NO: 583517 - DNA, 20 bp, Artificial
  CRISPR gRNA sequence
taagatccccaaacactgtg

SEQ ID NO: 583518 - DNA, 20 bp, Artificial
  CRISPR gRNA sequence
agatccccaaacactgtgat

SEQ ID NO: 583519 - DNA, 20 bp, Artificial
  CRISPR gRNA sequence
tgatcctgagttgttaaagc

SEQ ID NO: 583520 - DNA, 20 bp, Artificial
  CRISPR gRNA sequence
agttgttaaagcaaatgcaa

SEQ ID NO: 583521 - DNA, 20 bp, Artificial
  CRISPR gRNA sequence
ttaaagcaaatgcaaatagc

SEQ ID NO: 583522 - DNA, 20 bp, Artificial
  CRISPR gRNA sequence
aagcaaatgcaaatagccag

SEQ ID NO: 583523 - DNA, 20 bp, Artificial
  CRISPR gRNA sequence
gccagatgcaggctgtgtgc

SEQ ID NO: 583524 - DNA, 20 bp, Artificial
  CRISPR gRNA sequence
ccagatgcaggctgtgtgcc

SEQ ID NO: 583525 - DNA, 20 bp, Artificial
  CRISPR gRNA sequence
tgtgccagcaggaccagcta

SEQ ID NO: 583526 - DNA, 20 bp, Artificial
  CRISPR gRNA sequence
tgtaacctgcagggcccctt

SEQ ID NO: 583527 - DNA, 20 bp, Artificial
  CRISPR gRNA sequence
cagggccccttgttcagatt

SEQ ID NO: 583528 - DNA, 20 bp, Artificial
  CRISPR gRNA sequence
gttcagatttcaagatggcg

SEQ ID NO: 583529 - DNA, 20 bp, Artificial
  CRISPR gRNA sequence
ttcagatttcaagatggcga

SEQ ID NO: 583530 - DNA, 20 bp, Artificial
  CRISPR gRNA sequence
agatttcaagatggcgacca

SEQ ID NO: 583531 - DNA, 20 bp, Artificial
  CRISPR gRNA sequence
caagatggcgaccacagagc

SEQ ID NO: 583532 - DNA, 20 bp, Artificial
  CRISPR gRNA sequence
aagatggcgaccacagagca

SEQ ID NO: 583533 - DNA, 20 bp, Artificial
  CRISPR gRNA sequence
aacaaagcacagggtgccac

SEQ ID NO: 583534 - DNA, 20 bp, Artificial
  CRISPR gRNA sequence
gaggccaggcactgtttctg

SEQ ID NO: 583535 - DNA, 20 bp, Artificial
  CRISPR gRNA sequence
tttctgagcgctttgctggt

SEQ ID NO: 583536 - DNA, 20 bp, Artificial
  CRISPR gRNA sequence
ctgagcgctttgctggtggt

SEQ ID NO: 583537 - DNA, 20 bp, Artificial
  CRISPR gRNA sequence
tgagcgctttgctggtggta

SEQ ID NO: 583538 - DNA, 20 bp, Artificial
  CRISPR gRNA sequence
agcgctttgctggtggtaat

SEQ ID NO: 583539 - DNA, 20 bp, Artificial
  CRISPR gRNA sequence
tgctggtggtaatttatttc

SEQ ID NO: 583540 - DNA, 20 bp, Artificial
  CRISPR gRNA sequence
gctggtggtaatttatttct

SEQ ID NO: 583541 - DNA, 20 bp, Artificial
  CRISPR gRNA sequence
ctggtggtaatttatttctc

SEQ ID NO: 583542 - DNA, 20 bp, Artificial
  CRISPR gRNA sequence
gtggtaatttatttctcatg

SEQ ID NO: 583543 - DNA, 20 bp, Artificial
  CRISPR gRNA sequence
atttctcatgatgcgaatgt

SEQ ID NO: 583544 - DNA, 20 bp, Artificial
  CRISPR gRNA sequence
tttctcatgatgcgaatgta

SEQ ID NO: 583545 - DNA, 20 bp, Artificial
  CRISPR gRNA sequence
ctcatgatgcgaatgtacag

SEQ ID NO: 583546 - DNA, 20 bp, Artificial
  CRISPR gRNA sequence
tcatgatgcgaatgtacaga

SEQ ID NO: 583547 - DNA, 20 bp, Artificial
  CRISPR gRNA sequence
atgatgcgaatgtacagatg

SEQ ID NO: 583548 - DNA, 20 bp, Artificial
  CRISPR gRNA sequence
aggccaggggggtttaggtg

SEQ ID NO: 583549 - DNA, 20 bp, Artificial
  CRISPR gRNA sequence
aggtgactttcccaaggtca

SEQ ID NO: 583550 - DNA, 20 bp, Artificial
  CRISPR gRNA sequence
ggtgactttcccaaggtcac

SEQ ID NO: 583551 - DNA, 20 bp, Artificial
  CRISPR gRNA sequence
tcccaaggtcacagttgggt

SEQ ID NO: 583552 - DNA, 20 bp, Artificial
  CRISPR gRNA sequence
cccaaggtcacagttgggtg

SEQ ID NO: 583553 - DNA, 20 bp, Artificial
  CRISPR gRNA sequence
ccaaggtcacagttgggtgg

SEQ ID NO: 583554 - DNA, 20 bp, Artificial
  CRISPR gRNA sequence
ggtggtaaagagccctattc

SEQ ID NO: 583555 - DNA, 20 bp, Artificial
  CRISPR gRNA sequence
ttcaaccccagttcatggtc

SEQ ID NO: 583556 - DNA, 20 bp, Artificial
  CRISPR gRNA sequence
aaccccagttcatggtccca

SEQ ID NO: 583557 - DNA, 20 bp, Artificial
  CRISPR gRNA sequence
atggtcccagcatcagtggc

SEQ ID NO: 583558 - DNA, 20 bp, Artificial
  CRISPR gRNA sequence
tgctctaataaatacggctc

SEQ ID NO: 583559 - DNA, 20 bp, Artificial
  CRISPR gRNA sequence
taataaatacggctcatgct

SEQ ID NO: 583560 - DNA, 20 bp, Artificial
  CRISPR gRNA sequence
ataaatacggctcatgctgt

SEQ ID NO: 583561 - DNA, 20 bp, Artificial
  CRISPR gRNA sequence
atgctgttttgtgggattcc

SEQ ID NO: 583562 - DNA, 20 bp, Artificial
  CRISPR gRNA sequence
ttttgtgggattccacctca

SEQ ID NO: 583563 - DNA, 20 bp, Artificial
  CRISPR gRNA sequence
tgtgggattccacctcagac

SEQ ID NO: 583564 - DNA, 20 bp, Artificial
  CRISPR gRNA sequence
gtgggattccacctcagact

SEQ ID NO: 583565 - DNA, 20 bp, Artificial
  CRISPR gRNA sequence
tgggattccacctcagactg

SEQ ID NO: 583566 - DNA, 20 bp, Artificial
  CRISPR gRNA sequence
cacctcagactggaatttag

SEQ ID NO: 583567 - DNA, 20 bp, Artificial
  CRISPR gRNA sequence
agactggaatttagaagagg

SEQ ID NO: 583568 - DNA, 20 bp, Artificial
  CRISPR gRNA sequence
gaatttagaagagggcgtcc

SEQ ID NO: 583569 - DNA, 20 bp, Artificial
  CRISPR gRNA sequence
agaagagggcgtccttgctt

SEQ ID NO: 583570 - DNA, 20 bp, Artificial
  CRISPR gRNA sequence
gaagagggcgtccttgcttt

SEQ ID NO: 583571 - DNA, 20 bp, Artificial
  CRISPR gRNA sequence
gctttgaaaaacactgattt

SEQ ID NO: 583572 - DNA, 20 bp, Artificial
  CRISPR gRNA sequence
ctttgaaaaacactgattta

SEQ ID NO: 583573 - DNA, 20 bp, Artificial
  CRISPR gRNA sequence
tgaaaaacactgatttaaaa

SEQ ID NO: 583574 - DNA, 20 bp, Artificial
  CRISPR gRNA sequence
gaaaaacactgatttaaaaa

SEQ ID NO: 583575 - DNA, 20 bp, Artificial
  CRISPR gRNA sequence
aaaaacactgatttaaaaat

SEQ ID NO: 583576 - DNA, 20 bp, Artificial
  CRISPR gRNA sequence
atttaaaaataaagtggagc

SEQ ID NO: 583577 - DNA, 20 bp, Artificial
  CRISPR gRNA sequence
aaaaataaagtggagccagg

SEQ ID NO: 583578 - DNA, 20 bp, Artificial
  CRISPR gRNA sequence
aaaataaagtggagccaggc

SEQ ID NO: 583579 - DNA, 20 bp, Artificial
  CRISPR gRNA sequence
atgcctgtaatcccagcact

SEQ ID NO: 583580 - DNA, 20 bp, Artificial
  CRISPR gRNA sequence
taatcccagcactttgggag

SEQ ID NO: 583581 - DNA, 20 bp, Artificial
  CRISPR gRNA sequence
tgggaggctgaagcgggtgg

SEQ ID NO: 583582 - DNA, 20 bp, Artificial
  CRISPR gRNA sequence
gggaggctgaagcgggtgga

SEQ ID NO: 583583 - DNA, 20 bp, Artificial
  CRISPR gRNA sequence
ggaggctgaagcgggtggat

SEQ ID NO: 583584 - DNA, 20 bp, Artificial
  CRISPR gRNA sequence
aagcgggtggatcacatgag

SEQ ID NO: 583585 - DNA, 20 bp, Artificial
  CRISPR gRNA sequence
gagaccagcctggctaacat

SEQ ID NO: 583586 - DNA, 20 bp, Artificial
  CRISPR gRNA sequence
gctaacatggtgaaacccca

SEQ ID NO: 583587 - DNA, 20 bp, Artificial
  CRISPR gRNA sequence
acatggtgaaaccccatctc

SEQ ID NO: 583588 - DNA, 20 bp, Artificial
  CRISPR gRNA sequence
taccaaaaatacaaaaatta

SEQ ID NO: 583589 - DNA, 20 bp, Artificial
  CRISPR gRNA sequence
ccaaaaatacaaaaattagc

SEQ ID NO: 583590 - DNA, 20 bp, Artificial
  CRISPR gRNA sequence
gctgggcgtagtgacgggca

SEQ ID NO: 583591 - DNA, 20 bp, Artificial
  CRISPR gRNA sequence
ggcgtagtgacgggcacctg

SEQ ID NO: 583592 - DNA, 20 bp, Artificial
  CRISPR gRNA sequence
tagtcccagctactcgggag

SEQ ID NO: 583593 - DNA, 20 bp, Artificial
  CRISPR gRNA sequence
ctcgggaggctgaggcagaa

SEQ ID NO: 583594 - DNA, 20 bp, Artificial
  CRISPR gRNA sequence
gggaggctgaggcagaagac

SEQ ID NO: 583595 - DNA, 20 bp, Artificial
  CRISPR gRNA sequence
aggcagaagacttgcttgaa

SEQ ID NO: 583596 - DNA, 20 bp, Artificial
  CRISPR gRNA sequence
gcttgaatctgggaggtggg

SEQ ID NO: 583597 - DNA, 20 bp, Artificial
  CRISPR gRNA sequence
cttgaatctgggaggtgggg

SEQ ID NO: 583598 - DNA, 20 bp, Artificial
  CRISPR gRNA sequence
gaatctgggaggtgggggtt

SEQ ID NO: 583599 - DNA, 20 bp, Artificial
  CRISPR gRNA sequence
aatctgggaggtgggggttg

SEQ ID NO: 583600 - DNA, 20 bp, Artificial
  CRISPR gRNA sequence
ggaggtgggggttgcagtga

SEQ ID NO: 583601 - DNA, 20 bp, Artificial
  CRISPR gRNA sequence
cagtgagccgagattgcacc

SEQ ID NO: 583602 - DNA, 20 bp, Artificial
  CRISPR gRNA sequence
caccactgcactccagcctg

SEQ ID NO: 583603 - DNA, 20 bp, Artificial
  CRISPR gRNA sequence
cactccagcctgggcgacag

SEQ ID NO: 583604 - DNA, 20 bp, Artificial
  CRISPR gRNA sequence
cagcctgggcgacagagcaa

SEQ ID NO: 583605 - DNA, 20 bp, Artificial
  CRISPR gRNA sequence
ggcgacagagcaagactcag

SEQ ID NO: 583606 - DNA, 20 bp, Artificial
  CRISPR gRNA sequence
agtatcaaaaaaaataaaaa

SEQ ID NO: 583607 - DNA, 20 bp, Artificial
  CRISPR gRNA sequence
aagcctctgggtcaccagcc

SEQ ID NO: 583608 - DNA, 20 bp, Artificial
  CRISPR gRNA sequence
agcctctgggtcaccagcct

SEQ ID NO: 583609 - DNA, 20 bp, Artificial
  CRISPR gRNA sequence
tgggtcaccagcctctcccc

SEQ ID NO: 583610 - DNA, 20 bp, Artificial
  CRISPR gRNA sequence
ggtcaccagcctctccccct

SEQ ID NO: 583611 - DNA, 20 bp, Artificial
  CRISPR gRNA sequence
tccccctcacccaggcatca

SEQ ID NO: 583612 - DNA, 20 bp, Artificial
  CRISPR gRNA sequence
cccctcacccaggcatcatc

SEQ ID NO: 583613 - DNA, 20 bp, Artificial
  CRISPR gRNA sequence
acccaggcatcatccgacaa

SEQ ID NO: 583614 - DNA, 20 bp, Artificial
  CRISPR gRNA sequence
ctgctgcatcgtagctgctg

SEQ ID NO: 583615 - DNA, 20 bp, Artificial
  CRISPR gRNA sequence
ctgcatcgtagctgctggca

SEQ ID NO: 583616 - DNA, 20 bp, Artificial
  CRISPR gRNA sequence
catcgtagctgctggcagcc

SEQ ID NO: 583617 - DNA, 20 bp, Artificial
  CRISPR gRNA sequence
ctggcagccaaggccctgtc

SEQ ID NO: 583618 - DNA, 20 bp, Artificial
  CRISPR gRNA sequence
gcagccaaggccctgtcgtc

SEQ ID NO: 583619 - DNA, 20 bp, Artificial
  CRISPR gRNA sequence
tcgtcccagcctggtctggc

SEQ ID NO: 583620 - DNA, 20 bp, Artificial
  CRISPR gRNA sequence
gtctggcccccgggaggccc

SEQ ID NO: 583621 - DNA, 20 bp, Artificial
  CRISPR gRNA sequence
gcccccgggaggcccctgac

SEQ ID NO: 583622 - DNA, 20 bp, Artificial
  CRISPR gRNA sequence
acagcctgtttgctgtccgg

SEQ ID NO: 583623 - DNA, 20 bp, Artificial
  CRISPR gRNA sequence
tttgctgtccggaggcacct

SEQ ID NO: 583624 - DNA, 20 bp, Artificial
  CRISPR gRNA sequence
gctgtccggaggcacctgtg

SEQ ID NO: 583625 - DNA, 20 bp, Artificial
  CRISPR gRNA sequence
ctgtccggaggcacctgtgg

SEQ ID NO: 583626 - DNA, 20 bp, Artificial
  CRISPR gRNA sequence
tccggaggcacctgtggggt

SEQ ID NO: 583627 - DNA, 20 bp, Artificial
  CRISPR gRNA sequence
tggggtagccatggaaacag

SEQ ID NO: 583628 - DNA, 20 bp, Artificial
  CRISPR gRNA sequence
ccaggtaagaatggtccttg

SEQ ID NO: 583629 - DNA, 20 bp, Artificial
  CRISPR gRNA sequence
gcactacacggtgcccccaa

SEQ ID NO: 583630 - DNA, 20 bp, Artificial
  CRISPR gRNA sequence
cactacacggtgcccccaag

SEQ ID NO: 583631 - DNA, 20 bp, Artificial
  CRISPR gRNA sequence
cacggtgcccccaagctcct

SEQ ID NO: 583632 - DNA, 20 bp, Artificial
  CRISPR gRNA sequence
ctaatcctgacaggctctgg

SEQ ID NO: 583633 - DNA, 20 bp, Artificial
  CRISPR gRNA sequence
atcctgacaggctctgggtg

SEQ ID NO: 583634 - DNA, 20 bp, Artificial
  CRISPR gRNA sequence
acaggctctgggtggagggt

SEQ ID NO: 583635 - DNA, 20 bp, Artificial
  CRISPR gRNA sequence
tgggtggagggtgcaaagga

SEQ ID NO: 583636 - DNA, 20 bp, Artificial
  CRISPR gRNA sequence
ggtggagggtgcaaaggagc

SEQ ID NO: 583637 - DNA, 20 bp, Artificial
  CRISPR gRNA sequence
catgctgccccttcccacca

SEQ ID NO: 583638 - DNA, 20 bp, Artificial
  CRISPR gRNA sequence
ccccttcccaccaccaccac

SEQ ID NO: 583639 - DNA, 20 bp, Artificial
  CRISPR gRNA sequence
cccaccaccaccaccactgc

SEQ ID NO: 583640 - DNA, 20 bp, Artificial
  CRISPR gRNA sequence
ccaccaccaccaccactgca

SEQ ID NO: 583641 - DNA, 20 bp, Artificial
  CRISPR gRNA sequence
cagctgccgccactcagcct

SEQ ID NO: 583642 - DNA, 20 bp, Artificial
  CRISPR gRNA sequence
ccgccactcagcctttggga

SEQ ID NO: 583643 - DNA, 20 bp, Artificial
  CRISPR gRNA sequence
agcctttgggaaaatgcatc

SEQ ID NO: 583644 - DNA, 20 bp, Artificial
  CRISPR gRNA sequence
tgggaaaatgcatccgctca

SEQ ID NO: 583645 - DNA, 20 bp, Artificial
  CRISPR gRNA sequence
gggaaaatgcatccgctcac

SEQ ID NO: 583646 - DNA, 20 bp, Artificial
  CRISPR gRNA sequence
ggaaaatgcatccgctcaca

SEQ ID NO: 583647 - DNA, 20 bp, Artificial
  CRISPR gRNA sequence
acaaaagcttcctttcggga

SEQ ID NO: 583648 - DNA, 20 bp, Artificial
  CRISPR gRNA sequence
cctttcgggatgtccgtggc

SEQ ID NO: 583649 - DNA, 20 bp, Artificial
  CRISPR gRNA sequence
ctttcgggatgtccgtggcc

SEQ ID NO: 583650 - DNA, 20 bp, Artificial
  CRISPR gRNA sequence
tcgggatgtccgtggcctga

SEQ ID NO: 583651 - DNA, 20 bp, Artificial
  CRISPR gRNA sequence
cgggatgtccgtggcctgaa

SEQ ID NO: 583652 - DNA, 20 bp, Artificial
  CRISPR gRNA sequence
gggatgtccgtggcctgaaa

SEQ ID NO: 583653 - DNA, 20 bp, Artificial
  CRISPR gRNA sequence
aaagccccccatatggtctc

SEQ ID NO: 583654 - DNA, 20 bp, Artificial
  CRISPR gRNA sequence
gagtgtcgggcccctagccc

SEQ ID NO: 583655 - DNA, 20 bp, Artificial
  CRISPR gRNA sequence
gccctgactcccttggggat

SEQ ID NO: 583656 - DNA, 20 bp, Artificial
  CRISPR gRNA sequence
actcccttggggattggggc

SEQ ID NO: 583657 - DNA, 20 bp, Artificial
  CRISPR gRNA sequence
ccttggggattggggccatg

SEQ ID NO: 583658 - DNA, 20 bp, Artificial
  CRISPR gRNA sequence
ggggattggggccatgcctc

SEQ ID NO: 583659 - DNA, 20 bp, Artificial
  CRISPR gRNA sequence
gggattggggccatgcctca

SEQ ID NO: 583660 - DNA, 20 bp, Artificial
  CRISPR gRNA sequence
gggccatgcctcacccactc

SEQ ID NO: 583661 - DNA, 20 bp, Artificial
  CRISPR gRNA sequence
acccactctggactccagct

SEQ ID NO: 583662 - DNA, 20 bp, Artificial
  CRISPR gRNA sequence
tggactccagctactatatt

SEQ ID NO: 583663 - DNA, 20 bp, Artificial
  CRISPR gRNA sequence
gactccagctactatattcg

SEQ ID NO: 583664 - DNA, 20 bp, Artificial
  CRISPR gRNA sequence
cagctactatattcggccat

SEQ ID NO: 583665 - DNA, 20 bp, Artificial
  CRISPR gRNA sequence
ctatattcggccatcagaag

SEQ ID NO: 583666 - DNA, 20 bp, Artificial
  CRISPR gRNA sequence
tattcggccatcagaaggga

SEQ ID NO: 583667 - DNA, 20 bp, Artificial
  CRISPR gRNA sequence
ggccatcagaagggagggac

SEQ ID NO: 583668 - DNA, 20 bp, Artificial
  CRISPR gRNA sequence
ctaagtaattccaggagcac

SEQ ID NO: 583669 - DNA, 20 bp, Artificial
  CRISPR gRNA sequence
agtaattccaggagcacctc

SEQ ID NO: 583670 - DNA, 20 bp, Artificial
  CRISPR gRNA sequence
caggagcacctcctttcctc

SEQ ID NO: 583671 - DNA, 20 bp, Artificial
  CRISPR gRNA sequence
ctttcctcccctgaccaagg

SEQ ID NO: 583672 - DNA, 20 bp, Artificial
  CRISPR gRNA sequence
tcctcccctgaccaaggaaa

SEQ ID NO: 583673 - DNA, 20 bp, Artificial
  CRISPR gRNA sequence
cctcccctgaccaaggaaaa

SEQ ID NO: 583674 - DNA, 20 bp, Artificial
  CRISPR gRNA sequence
ctcccctgaccaaggaaaat

SEQ ID NO: 583675 - DNA, 20 bp, Artificial
  CRISPR gRNA sequence
ccctgaccaaggaaaatcgg

SEQ ID NO: 583676 - DNA, 20 bp, Artificial
  CRISPR gRNA sequence
accaaggaaaatcggggtgg

SEQ ID NO: 583677 - DNA, 20 bp, Artificial
  CRISPR gRNA sequence
gcccgagctcacctatccac

SEQ ID NO: 583678 - DNA, 20 bp, Artificial
  CRISPR gRNA sequence
acctatccactgctctccac

SEQ ID NO: 583679 - DNA, 20 bp, Artificial
  CRISPR gRNA sequence
tccactgctctccaccaggc

SEQ ID NO: 583680 - DNA, 20 bp, Artificial
  CRISPR gRNA sequence
ctctccaccaggcctggcct

SEQ ID NO: 583681 - DNA, 20 bp, Artificial
  CRISPR gRNA sequence
tccaccaggcctggcctgtg

SEQ ID NO: 583682 - DNA, 20 bp, Artificial
  CRISPR gRNA sequence
caccaggcctggcctgtggg

SEQ ID NO: 583683 - DNA, 20 bp, Artificial
  CRISPR gRNA sequence
gcctgtgggcttagcaggga

SEQ ID NO: 583684 - DNA, 20 bp, Artificial
  CRISPR gRNA sequence
tgggcttagcagggatcaga

SEQ ID NO: 583685 - DNA, 20 bp, Artificial
  CRISPR gRNA sequence
agcagggatcagagaccttg

SEQ ID NO: 583686 - DNA, 20 bp, Artificial
  CRISPR gRNA sequence
gcagggatcagagaccttga

SEQ ID NO: 583687 - DNA, 20 bp, Artificial
  CRISPR gRNA sequence
gactgtcatcctggctctgc

SEQ ID NO: 583688 - DNA, 20 bp, Artificial
  CRISPR gRNA sequence
actgtcatcctggctctgcc

SEQ ID NO: 583689 - DNA, 20 bp, Artificial
  CRISPR gRNA sequence
tcatcctggctctgccattt

SEQ ID NO: 583690 - DNA, 20 bp, Artificial
  CRISPR gRNA sequence
gctctgccatttaacctctt

SEQ ID NO: 583691 - DNA, 20 bp, Artificial
  CRISPR gRNA sequence
tgccatttaacctcttgcat

SEQ ID NO: 583692 - DNA, 20 bp, Artificial
  CRISPR gRNA sequence
ccatttaacctcttgcatcc

SEQ ID NO: 583693 - DNA, 20 bp, Artificial
  CRISPR gRNA sequence
aacctcttgcatcctttggt

SEQ ID NO: 583694 - DNA, 20 bp, Artificial
  CRISPR gRNA sequence
acctcttgcatcctttggtg

SEQ ID NO: 583695 - DNA, 20 bp, Artificial
  CRISPR gRNA sequence
ttgcatcctttggtgtgcaa

SEQ ID NO: 583696 - DNA, 20 bp, Artificial
  CRISPR gRNA sequence
gcatcctttggtgtgcaagt

SEQ ID NO: 583697 - DNA, 20 bp, Artificial
  CRISPR gRNA sequence
catcctttggtgtgcaagtt

SEQ ID NO: 583698 - DNA, 20 bp, Artificial
  CRISPR gRNA sequence
tggtgtgcaagttactccgc

SEQ ID NO: 583699 - DNA, 20 bp, Artificial
  CRISPR gRNA sequence
ggtgtgcaagttactccgct

SEQ ID NO: 583700 - DNA, 20 bp, Artificial
  CRISPR gRNA sequence
gtgtgcaagttactccgctt

SEQ ID NO: 583701 - DNA, 20 bp, Artificial
  CRISPR gRNA sequence
ctccgcttcttttcaacctc

SEQ ID NO: 583702 - DNA, 20 bp, Artificial
  CRISPR gRNA sequence
cgcttcttttcaacctcggg

SEQ ID NO: 583703 - DNA, 20 bp, Artificial
  CRISPR gRNA sequence
cttttcaacctcggggagaa

SEQ ID NO: 583704 - DNA, 20 bp, Artificial
  CRISPR gRNA sequence
ttttcaacctcggggagaac

SEQ ID NO: 583705 - DNA, 20 bp, Artificial
  CRISPR gRNA sequence
ttcaacctcggggagaacta

SEQ ID NO: 583706 - DNA, 20 bp, Artificial
  CRISPR gRNA sequence
tcaacctcggggagaactat

SEQ ID NO: 583707 - DNA, 20 bp, Artificial
  CRISPR gRNA sequence
caacctcggggagaactatt

SEQ ID NO: 583708 - DNA, 20 bp, Artificial
  CRISPR gRNA sequence
aacctcggggagaactattt

SEQ ID NO: 583709 - DNA, 20 bp, Artificial
  CRISPR gRNA sequence
ggggagaactattttggcag

SEQ ID NO: 583710 - DNA, 20 bp, Artificial
  CRISPR gRNA sequence
ttttggcagaagtggtgcaa

SEQ ID NO: 583711 - DNA, 20 bp, Artificial
  CRISPR gRNA sequence
tggcagaagtggtgcaaaga

SEQ ID NO: 583712 - DNA, 20 bp, Artificial
  CRISPR gRNA sequence
ggcagaagtggtgcaaagaa

SEQ ID NO: 583713 - DNA, 20 bp, Artificial
  CRISPR gRNA sequence
gcagaagtggtgcaaagaat

SEQ ID NO: 583714 - DNA, 20 bp, Artificial
  CRISPR gRNA sequence
atgtcaggtgctcagcaaac

SEQ ID NO: 583715 - DNA, 20 bp, Artificial
  CRISPR gRNA sequence
tgtcaggtgctcagcaaaca

SEQ ID NO: 583716 - DNA, 20 bp, Artificial
  CRISPR gRNA sequence
agcaaacagtacctgtgccc

SEQ ID NO: 583717 - DNA, 20 bp, Artificial
  CRISPR gRNA sequence
tgcccgtggacacgggtgtt

SEQ ID NO: 583718 - DNA, 20 bp, Artificial
  CRISPR gRNA sequence
acggtgagatctcaggcctg

SEQ ID NO: 583719 - DNA, 20 bp, Artificial
  CRISPR gRNA sequence
aggcctgtagactcaccttg

SEQ ID NO: 583720 - DNA, 20 bp, Artificial
  CRISPR gRNA sequence
tagactcaccttgtaggggg

SEQ ID NO: 583721 - DNA, 20 bp, Artificial
  CRISPR gRNA sequence
accttgtagggggaggggac

SEQ ID NO: 583722 - DNA, 20 bp, Artificial
  CRISPR gRNA sequence
gtagggggaggggacaggga

SEQ ID NO: 583723 - DNA, 20 bp, Artificial
  CRISPR gRNA sequence
tagggggaggggacagggag

SEQ ID NO: 583724 - DNA, 20 bp, Artificial
  CRISPR gRNA sequence
gctaggaggtcctgcatggg

SEQ ID NO: 583725 - DNA, 20 bp, Artificial
  CRISPR gRNA sequence
ggaggtcctgcatggggctt

SEQ ID NO: 583726 - DNA, 20 bp, Artificial
  CRISPR gRNA sequence
catggggcttgattcatccc

SEQ ID NO: 583727 - DNA, 20 bp, Artificial
  CRISPR gRNA sequence
gattcatccccaccctctga

SEQ ID NO: 583728 - DNA, 20 bp, Artificial
  CRISPR gRNA sequence
attcatccccaccctctgac

SEQ ID NO: 583729 - DNA, 20 bp, Artificial
  CRISPR gRNA sequence
atccccaccctctgacagag

SEQ ID NO: 583730 - DNA, 20 bp, Artificial
  CRISPR gRNA sequence
tgacagagttcctccacaac

SEQ ID NO: 583731 - DNA, 20 bp, Artificial
  CRISPR gRNA sequence
acagagttcctccacaacat

SEQ ID NO: 583732 - DNA, 20 bp, Artificial
  CRISPR gRNA sequence
ctccacaacatggactactt

SEQ ID NO: 583733 - DNA, 20 bp, Artificial
  CRISPR gRNA sequence
cacaacatggactacttcaa

SEQ ID NO: 583734 - DNA, 20 bp, Artificial
  CRISPR gRNA sequence
cttcaagttccacaacatgc

SEQ ID NO: 583735 - DNA, 20 bp, Artificial
  CRISPR gRNA sequence
caagttccacaacatgcgac

SEQ ID NO: 583736 - DNA, 20 bp, Artificial
  CRISPR gRNA sequence
aagttccacaacatgcgacc

SEQ ID NO: 583737 - DNA, 20 bp, Artificial
  CRISPR gRNA sequence
cacaacatgcgacccccttt

SEQ ID NO: 583738 - DNA, 20 bp, Artificial
  CRISPR gRNA sequence
tcacctacgccacgctcatc

SEQ ID NO: 583739 - DNA, 20 bp, Artificial
  CRISPR gRNA sequence
cacctacgccacgctcatcc

SEQ ID NO: 583740 - DNA, 20 bp, Artificial
  CRISPR gRNA sequence
acctacgccacgctcatccg

SEQ ID NO: 583741 - DNA, 20 bp, Artificial
  CRISPR gRNA sequence
cgccacgctcatccgctggg

SEQ ID NO: 583742 - DNA, 20 bp, Artificial
  CRISPR gRNA sequence
atccgctgggtaagcagggc

SEQ ID NO: 583743 - DNA, 20 bp, Artificial
  CRISPR gRNA sequence
ggtaagcagggcagctcggc

SEQ ID NO: 583744 - DNA, 20 bp, Artificial
  CRISPR gRNA sequence
ggccccaaggaggaggaaga

SEQ ID NO: 583745 - DNA, 20 bp, Artificial
  CRISPR gRNA sequence
cctcccaaactcctgtctcc

SEQ ID NO: 583746 - DNA, 20 bp, Artificial
  CRISPR gRNA sequence
ccaaactcctgtctccctct

SEQ ID NO: 583747 - DNA, 20 bp, Artificial
  CRISPR gRNA sequence
ctgtctccctctgagtgccc

SEQ ID NO: 583748 - DNA, 20 bp, Artificial
  CRISPR gRNA sequence
tctccctctgagtgccctca

SEQ ID NO: 583749 - DNA, 20 bp, Artificial
  CRISPR gRNA sequence
cctctgagtgccctcagagt

SEQ ID NO: 583750 - DNA, 20 bp, Artificial
  CRISPR gRNA sequence
tgagtgccctcagagtgggt

SEQ ID NO: 583751 - DNA, 20 bp, Artificial
  CRISPR gRNA sequence
agtgccctcagagtgggttc

SEQ ID NO: 583752 - DNA, 20 bp, Artificial
  CRISPR gRNA sequence
agagtgggttcctccattcc

SEQ ID NO: 583753 - DNA, 20 bp, Artificial
  CRISPR gRNA sequence
ctccattcccaagccccagc

SEQ ID NO: 583754 - DNA, 20 bp, Artificial
  CRISPR gRNA sequence
cattcccaagccccagcccc

SEQ ID NO: 583755 - DNA, 20 bp, Artificial
  CRISPR gRNA sequence
ccaagccccagccccaagga

SEQ ID NO: 583756 - DNA, 20 bp, Artificial
  CRISPR gRNA sequence
aaatgtgacccctcatgctg

SEQ ID NO: 583757 - DNA, 20 bp, Artificial
  CRISPR gRNA sequence
atgctggcttcaccccaaac

SEQ ID NO: 583758 - DNA, 20 bp, Artificial
  CRISPR gRNA sequence
gcttcaccccaaacctgtcc

SEQ ID NO: 583759 - DNA, 20 bp, Artificial
  CRISPR gRNA sequence
caccccaaacctgtccgcaa

SEQ ID NO: 583760 - DNA, 20 bp, Artificial
  CRISPR gRNA sequence
accccaaacctgtccgcaaa

SEQ ID NO: 583761 - DNA, 20 bp, Artificial
  CRISPR gRNA sequence
tccgcaaatccaaacctaaa

SEQ ID NO: 583762 - DNA, 20 bp, Artificial
  CRISPR gRNA sequence
aaccaccatccaggccagag

SEQ ID NO: 583763 - DNA, 20 bp, Artificial
  CRISPR gRNA sequence
tgaccctaaacctacccctt

SEQ ID NO: 583764 - DNA, 20 bp, Artificial
  CRISPR gRNA sequence
accctaaacctacccctttc

SEQ ID NO: 583765 - DNA, 20 bp, Artificial
  CRISPR gRNA sequence
aacctacccctttccagatg

SEQ ID NO: 583766 - DNA, 20 bp, Artificial
  CRISPR gRNA sequence
cccctttccagatgtccacc

SEQ ID NO: 583767 - DNA, 20 bp, Artificial
  CRISPR gRNA sequence
tccagatgtccacctcagcc

SEQ ID NO: 583768 - DNA, 20 bp, Artificial
  CRISPR gRNA sequence
ccagatgtccacctcagccc

SEQ ID NO: 583769 - DNA, 20 bp, Artificial
  CRISPR gRNA sequence
cagatgtccacctcagcccc

SEQ ID NO: 583770 - DNA, 20 bp, Artificial
  CRISPR gRNA sequence
agccccatacctaaccctct

SEQ ID NO: 583771 - DNA, 20 bp, Artificial
  CRISPR gRNA sequence
accctctcctggacccataa

SEQ ID NO: 583772 - DNA, 20 bp, Artificial
  CRISPR gRNA sequence
tcctggacccataaaatagc

SEQ ID NO: 583773 - DNA, 20 bp, Artificial
  CRISPR gRNA sequence
ctggacccataaaatagcct

SEQ ID NO: 583774 - DNA, 20 bp, Artificial
  CRISPR gRNA sequence
gacccataaaatagcctaaa

SEQ ID NO: 583775 - DNA, 20 bp, Artificial
  CRISPR gRNA sequence
aagctaaccccatctctgca

SEQ ID NO: 583776 - DNA, 20 bp, Artificial
  CRISPR gRNA sequence
accccatctctgcaccttgc

SEQ ID NO: 583777 - DNA, 20 bp, Artificial
  CRISPR gRNA sequence
tgcaccttgccctaaacgta

SEQ ID NO: 583778 - DNA, 20 bp, Artificial
  CRISPR gRNA sequence
caccttgccctaaacgtacc

SEQ ID NO: 583779 - DNA, 20 bp, Artificial
  CRISPR gRNA sequence
gccctaaacgtaccccagct

SEQ ID NO: 583780 - DNA, 20 bp, Artificial
  CRISPR gRNA sequence
ccctaaacgtaccccagctc

SEQ ID NO: 583781 - DNA, 20 bp, Artificial
  CRISPR gRNA sequence
aacgtaccccagctcttact

SEQ ID NO: 583782 - DNA, 20 bp, Artificial
  CRISPR gRNA sequence
ttactctaactccttcccca

SEQ ID NO: 583783 - DNA, 20 bp, Artificial
  CRISPR gRNA sequence
actctaactccttccccagc

SEQ ID NO: 583784 - DNA, 20 bp, Artificial
  CRISPR gRNA sequence
ctctaactccttccccagcc

SEQ ID NO: 583785 - DNA, 20 bp, Artificial
  CRISPR gRNA sequence
taactccttccccagccttt

SEQ ID NO: 583786 - DNA, 20 bp, Artificial
  CRISPR gRNA sequence
actccttccccagcctttat

SEQ ID NO: 583787 - DNA, 20 bp, Artificial
  CRISPR gRNA sequence
cttccccagcctttatgcca

SEQ ID NO: 583788 - DNA, 20 bp, Artificial
  CRISPR gRNA sequence
ccccagcctttatgccaacc

SEQ ID NO: 583789 - DNA, 20 bp, Artificial
  CRISPR gRNA sequence
cccagcctttatgccaaccc

SEQ ID NO: 583790 - DNA, 20 bp, Artificial
  CRISPR gRNA sequence
tatgccaacccaaccccatc

SEQ ID NO: 583791 - DNA, 20 bp, Artificial
  CRISPR gRNA sequence
atgccaacccaaccccatct

SEQ ID NO: 583792 - DNA, 20 bp, Artificial
  CRISPR gRNA sequence
tgccaacccaaccccatctc

SEQ ID NO: 583793 - DNA, 20 bp, Artificial
  CRISPR gRNA sequence
cttccctggccccaacgtac

SEQ ID NO: 583794 - DNA, 20 bp, Artificial
  CRISPR gRNA sequence
ccctggccccaacgtacccc

SEQ ID NO: 583795 - DNA, 20 bp, Artificial
  CRISPR gRNA sequence
cctggccccaacgtacccca

SEQ ID NO: 583796 - DNA, 20 bp, Artificial
  CRISPR gRNA sequence
gccccaacgtaccccagtat

SEQ ID NO: 583797 - DNA, 20 bp, Artificial
  CRISPR gRNA sequence
ggcaccattcccaacctttc

SEQ ID NO: 583798 - DNA, 20 bp, Artificial
  CRISPR gRNA sequence
ccaacctttccttgtaacac

SEQ ID NO: 583799 - DNA, 20 bp, Artificial
  CRISPR gRNA sequence
tccttgtaacacccatttga

SEQ ID NO: 583800 - DNA, 20 bp, Artificial
  CRISPR gRNA sequence
ccttgtaacacccatttgat

SEQ ID NO: 583801 - DNA, 20 bp, Artificial
  CRISPR gRNA sequence
cttgtaacacccatttgatc

SEQ ID NO: 583802 - DNA, 20 bp, Artificial
  CRISPR gRNA sequence
gtaacacccatttgatcctt

SEQ ID NO: 583803 - DNA, 20 bp, Artificial
  CRISPR gRNA sequence
taacacccatttgatcctta

SEQ ID NO: 583804 - DNA, 20 bp, Artificial
  CRISPR gRNA sequence
gatccttaacttcatcaccc

SEQ ID NO: 583805 - DNA, 20 bp, Artificial
  CRISPR gRNA sequence
atccttaacttcatcacccc

SEQ ID NO: 583806 - DNA, 20 bp, Artificial
  CRISPR gRNA sequence
aacttcatcaccccatccca

SEQ ID NO: 583807 - DNA, 20 bp, Artificial
  CRISPR gRNA sequence
acttcatcaccccatcccaa

SEQ ID NO: 583808 - DNA, 20 bp, Artificial
  CRISPR gRNA sequence
catcaccccatcccaactcc

SEQ ID NO: 583809 - DNA, 20 bp, Artificial
  CRISPR gRNA sequence
atcaccccatcccaactcct

SEQ ID NO: 583810 - DNA, 20 bp, Artificial
  CRISPR gRNA sequence
cttcatctcagcctccccaa

SEQ ID NO: 583811 - DNA, 20 bp, Artificial
  CRISPR gRNA sequence
catctcagcctccccaatgc

SEQ ID NO: 583812 - DNA, 20 bp, Artificial
  CRISPR gRNA sequence
atctcagcctccccaatgcc

SEQ ID NO: 583813 - DNA, 20 bp, Artificial
  CRISPR gRNA sequence
agcctccccaatgccttctc

SEQ ID NO: 583814 - DNA, 20 bp, Artificial
  CRISPR gRNA sequence
cccaatgccttctcagaacc

SEQ ID NO: 583815 - DNA, 20 bp, Artificial
  CRISPR gRNA sequence
ctcagaaccttcatcctagc

SEQ ID NO: 583816 - DNA, 20 bp, Artificial
  CRISPR gRNA sequence
tcagaaccttcatcctagcg

SEQ ID NO: 583817 - DNA, 20 bp, Artificial
  CRISPR gRNA sequence
agaaccttcatcctagcgcc

SEQ ID NO: 583818 - DNA, 20 bp, Artificial
  CRISPR gRNA sequence
catcctagcgccacacctaa

SEQ ID NO: 583819 - DNA, 20 bp, Artificial
  CRISPR gRNA sequence
atcctagcgccacacctaac

SEQ ID NO: 583820 - DNA, 20 bp, Artificial
  CRISPR gRNA sequence
gcgccacacctaaccccaaa

SEQ ID NO: 583821 - DNA, 20 bp, Artificial
  CRISPR gRNA sequence
accccaaacctgaacctcac

SEQ ID NO: 583822 - DNA, 20 bp, Artificial
  CRISPR gRNA sequence
aacctcacccctacatgata

SEQ ID NO: 583823 - DNA, 20 bp, Artificial
  CRISPR gRNA sequence
acccctacatgataccagat

SEQ ID NO: 583824 - DNA, 20 bp, Artificial
  CRISPR gRNA sequence
catgataccagatattcccc

SEQ ID NO: 583825 - DNA, 20 bp, Artificial
  CRISPR gRNA sequence
cccgactgtctctgaactga

SEQ ID NO: 583826 - DNA, 20 bp, Artificial
  CRISPR gRNA sequence
tctctgaactgaaaccctga

SEQ ID NO: 583827 - DNA, 20 bp, Artificial
  CRISPR gRNA sequence
tgaactgaaaccctgaccta

SEQ ID NO: 583828 - DNA, 20 bp, Artificial
  CRISPR gRNA sequence
aactgaaaccctgacctagc

SEQ ID NO: 583829 - DNA, 20 bp, Artificial
  CRISPR gRNA sequence
aaaccctgacctagccccat

SEQ ID NO: 583830 - DNA, 20 bp, Artificial
  CRISPR gRNA sequence
acctagccccatcctgactg

SEQ ID NO: 583831 - DNA, 20 bp, Artificial
  CRISPR gRNA sequence
gccccatcctgactgatagc

SEQ ID NO: 583832 - DNA, 20 bp, Artificial
  CRISPR gRNA sequence
actgatagcctcactgcaat

SEQ ID NO: 583833 - DNA, 20 bp, Artificial
  CRISPR gRNA sequence
atagcctcactgcaatcatc

SEQ ID NO: 583834 - DNA, 20 bp, Artificial
  CRISPR gRNA sequence
actgcaatcatcatcgctga

SEQ ID NO: 583835 - DNA, 20 bp, Artificial
  CRISPR gRNA sequence
caatcatcatcgctgactct

SEQ ID NO: 583836 - DNA, 20 bp, Artificial
  CRISPR gRNA sequence
actctgtaatcccattcctg

SEQ ID NO: 583837 - DNA, 20 bp, Artificial
  CRISPR gRNA sequence
tgtaatcccattcctgaatc

SEQ ID NO: 583838 - DNA, 20 bp, Artificial
  CRISPR gRNA sequence
taatcccattcctgaatcca

SEQ ID NO: 583839 - DNA, 20 bp, Artificial
  CRISPR gRNA sequence
ctgaatccaaactgatcaaa

SEQ ID NO: 583840 - DNA, 20 bp, Artificial
  CRISPR gRNA sequence
aatccaaactgatcaaattc

SEQ ID NO: 583841 - DNA, 20 bp, Artificial
  CRISPR gRNA sequence
atcaaattccctgaccctca

SEQ ID NO: 583842 - DNA, 20 bp, Artificial
  CRISPR gRNA sequence
cctgaccctcagcctcactc

SEQ ID NO: 583843 - DNA, 20 bp, Artificial
  CRISPR gRNA sequence
accctcagcctcactccaca

SEQ ID NO: 583844 - DNA, 20 bp, Artificial
  CRISPR gRNA sequence
agcctcactccacaccgaac

SEQ ID NO: 583845 - DNA, 20 bp, Artificial
  CRISPR gRNA sequence
actccacaccgaaccccaca

SEQ ID NO: 583846 - DNA, 20 bp, Artificial
  CRISPR gRNA sequence
cacaccgaaccccacaacta

SEQ ID NO: 583847 - DNA, 20 bp, Artificial
  CRISPR gRNA sequence
acctcatccttgccctgagc

SEQ ID NO: 583848 - DNA, 20 bp, Artificial
  CRISPR gRNA sequence
atccttgccctgagcctaac

SEQ ID NO: 583849 - DNA, 20 bp, Artificial
  CRISPR gRNA sequence
gccctgagcctaaccaccta

SEQ ID NO: 583850 - DNA, 20 bp, Artificial
  CRISPR gRNA sequence
ccctgagcctaaccacctaa

SEQ ID NO: 583851 - DNA, 20 bp, Artificial
  CRISPR gRNA sequence
agcctaaccacctaaccatg

SEQ ID NO: 583852 - DNA, 20 bp, Artificial
  CRISPR gRNA sequence
accacctaaccatgtccctg

SEQ ID NO: 583853 - DNA, 20 bp, Artificial
  CRISPR gRNA sequence
accatgtccctgacacgtaa

SEQ ID NO: 583854 - DNA, 20 bp, Artificial
  CRISPR gRNA sequence
acacgtaagatactcgataa

SEQ ID NO: 583855 - DNA, 20 bp, Artificial
  CRISPR gRNA sequence
gataattcaaaccatctctg

SEQ ID NO: 583856 - DNA, 20 bp, Artificial
  CRISPR gRNA sequence
aaaccatctctggcttctga

SEQ ID NO: 583857 - DNA, 20 bp, Artificial
  CRISPR gRNA sequence
tggcttctgacctaaagcca

SEQ ID NO: 583858 - DNA, 20 bp, Artificial
  CRISPR gRNA sequence
gcttctgacctaaagccaag

SEQ ID NO: 583859 - DNA, 20 bp, Artificial
  CRISPR gRNA sequence
ctgacctaaagccaagtcat

SEQ ID NO: 583860 - DNA, 20 bp, Artificial
  CRISPR gRNA sequence
tgacctaaagccaagtcatc

SEQ ID NO: 583861 - DNA, 20 bp, Artificial
  CRISPR gRNA sequence
acctaaagccaagtcatccc

SEQ ID NO: 583862 - DNA, 20 bp, Artificial
  CRISPR gRNA sequence
aagccaagtcatcccatccc

SEQ ID NO: 583863 - DNA, 20 bp, Artificial
  CRISPR gRNA sequence
acccctagaccccccacctg

SEQ ID NO: 583864 - DNA, 20 bp, Artificial
  CRISPR gRNA sequence
gaccccccacctgagtccac

SEQ ID NO: 583865 - DNA, 20 bp, Artificial
  CRISPR gRNA sequence
agtccaccccagcctgactc

SEQ ID NO: 583866 - DNA, 20 bp, Artificial
  CRISPR gRNA sequence
actcttaacccaccccttcc

SEQ ID NO: 583867 - DNA, 20 bp, Artificial
  CRISPR gRNA sequence
ttaacccaccccttccctga

SEQ ID NO: 583868 - DNA, 20 bp, Artificial
  CRISPR gRNA sequence
aacccaccccttccctgacc

SEQ ID NO: 583869 - DNA, 20 bp, Artificial
  CRISPR gRNA sequence
acccaccccttccctgaccc

SEQ ID NO: 583870 - DNA, 20 bp, Artificial
  CRISPR gRNA sequence
ccctgacccttaagttggcc

SEQ ID NO: 583871 - DNA, 20 bp, Artificial
  CRISPR gRNA sequence
cctgacccttaagttggcct

SEQ ID NO: 583872 - DNA, 20 bp, Artificial
  CRISPR gRNA sequence
acccttaagttggcctggcc

SEQ ID NO: 583873 - DNA, 20 bp, Artificial
  CRISPR gRNA sequence
aagttggcctggccctttac

SEQ ID NO: 583874 - DNA, 20 bp, Artificial
  CRISPR gRNA sequence
agttggcctggccctttacc

SEQ ID NO: 583875 - DNA, 20 bp, Artificial
  CRISPR gRNA sequence
gcctggccctttaccccttc

SEQ ID NO: 583876 - DNA, 20 bp, Artificial
  CRISPR gRNA sequence
gccctttaccccttccaaat

SEQ ID NO: 583877 - DNA, 20 bp, Artificial
  CRISPR gRNA sequence
taccccttccaaatccttga

SEQ ID NO: 583878 - DNA, 20 bp, Artificial
  CRISPR gRNA sequence
accccttccaaatccttgac

SEQ ID NO: 583879 - DNA, 20 bp, Artificial
  CRISPR gRNA sequence
ccccttccaaatccttgacc

SEQ ID NO: 583880 - DNA, 20 bp, Artificial
  CRISPR gRNA sequence
ccaaatccttgaccccactt

SEQ ID NO: 583881 - DNA, 20 bp, Artificial
  CRISPR gRNA sequence
caaatccttgaccccacttc

SEQ ID NO: 583882 - DNA, 20 bp, Artificial
  CRISPR gRNA sequence
gaccccacttctgacccttc

SEQ ID NO: 583883 - DNA, 20 bp, Artificial
  CRISPR gRNA sequence
accccacttctgacccttca

SEQ ID NO: 583884 - DNA, 20 bp, Artificial
  CRISPR gRNA sequence
ctgacccttcaccttcccca

SEQ ID NO: 583885 - DNA, 20 bp, Artificial
  CRISPR gRNA sequence
tgacccttcaccttccccaa

SEQ ID NO: 583886 - DNA, 20 bp, Artificial
  CRISPR gRNA sequence
acccttcaccttccccaacc

SEQ ID NO: 583887 - DNA, 20 bp, Artificial
  CRISPR gRNA sequence
caccttccccaaccctgaaa

SEQ ID NO: 583888 - DNA, 20 bp, Artificial
  CRISPR gRNA sequence
accttccccaaccctgaaat

SEQ ID NO: 583889 - DNA, 20 bp, Artificial
  CRISPR gRNA sequence
ccccaaccctgaaatgtcac

SEQ ID NO: 583890 - DNA, 20 bp, Artificial
  CRISPR gRNA sequence
cccaaccctgaaatgtcacc

SEQ ID NO: 583891 - DNA, 20 bp, Artificial
  CRISPR gRNA sequence
aaatgtcacctccacagaga

SEQ ID NO: 583892 - DNA, 20 bp, Artificial
  CRISPR gRNA sequence
cacagagaaccccaactcca

SEQ ID NO: 583893 - DNA, 20 bp, Artificial
  CRISPR gRNA sequence
caactccatcccagaccttt

SEQ ID NO: 583894 - DNA, 20 bp, Artificial
  CRISPR gRNA sequence
catcccagacctttcacctc

SEQ ID NO: 583895 - DNA, 20 bp, Artificial
  CRISPR gRNA sequence
tcacctcacttcagccctag

SEQ ID NO: 583896 - DNA, 20 bp, Artificial
  CRISPR gRNA sequence
cacctcacttcagccctagc

SEQ ID NO: 583897 - DNA, 20 bp, Artificial
  CRISPR gRNA sequence
acctcacttcagccctagcc

SEQ ID NO: 583898 - DNA, 20 bp, Artificial
  CRISPR gRNA sequence
acttcagccctagccctgaa

SEQ ID NO: 583899 - DNA, 20 bp, Artificial
  CRISPR gRNA sequence
cagccctagccctgaacaag

SEQ ID NO: 583900 - DNA, 20 bp, Artificial
  CRISPR gRNA sequence
agccctagccctgaacaaga

SEQ ID NO: 583901 - DNA, 20 bp, Artificial
  CRISPR gRNA sequence
gccctgaacaagaccccact

SEQ ID NO: 583902 - DNA, 20 bp, Artificial
  CRISPR gRNA sequence
aacaagaccccactcccaac

SEQ ID NO: 583903 - DNA, 20 bp, Artificial
  CRISPR gRNA sequence
ccaacctcagtcctgatccc

SEQ ID NO: 583904 - DNA, 20 bp, Artificial
  CRISPR gRNA sequence
agtcctgatcccttacctaa

SEQ ID NO: 583905 - DNA, 20 bp, Artificial
  CRISPR gRNA sequence
atcccttacctaatcccaga

SEQ ID NO: 583906 - DNA, 20 bp, Artificial
  CRISPR gRNA sequence
acctaatcccagaacaacca

SEQ ID NO: 583907 - DNA, 20 bp, Artificial
  CRISPR gRNA sequence
cctaatcccagaacaaccat

SEQ ID NO: 583908 - DNA, 20 bp, Artificial
  CRISPR gRNA sequence
atcccagaacaaccataccc

SEQ ID NO: 583909 - DNA, 20 bp, Artificial
  CRISPR gRNA sequence
accctgcccaacccgacact

SEQ ID NO: 583910 - DNA, 20 bp, Artificial
  CRISPR gRNA sequence
cccaacccgacacttcaccc

SEQ ID NO: 583911 - DNA, 20 bp, Artificial
  CRISPR gRNA sequence
caccccttttctaaccccat

SEQ ID NO: 583912 - DNA, 20 bp, Artificial
  CRISPR gRNA sequence
accccttttctaaccccatc

SEQ ID NO: 583913 - DNA, 20 bp, Artificial
  CRISPR gRNA sequence
ttctaaccccatctttgacc

SEQ ID NO: 583914 - DNA, 20 bp, Artificial
  CRISPR gRNA sequence
tctaaccccatctttgaccc

SEQ ID NO: 583915 - DNA, 20 bp, Artificial
  CRISPR gRNA sequence
ctaaccccatctttgacccc

SEQ ID NO: 583916 - DNA, 20 bp, Artificial
  CRISPR gRNA sequence
taaccccatctttgacccca

SEQ ID NO: 583917 - DNA, 20 bp, Artificial
  CRISPR gRNA sequence
accccatctttgaccccatg

SEQ ID NO: 583918 - DNA, 20 bp, Artificial
  CRISPR gRNA sequence
tgaccccatgcttcacccca

SEQ ID NO: 583919 - DNA, 20 bp, Artificial
  CRISPR gRNA sequence
gaccccatgcttcaccccac

SEQ ID NO: 583920 - DNA, 20 bp, Artificial
  CRISPR gRNA sequence
accccatgcttcaccccaca

SEQ ID NO: 583921 - DNA, 20 bp, Artificial
  CRISPR gRNA sequence
caccccacatctagtcctgt

SEQ ID NO: 583922 - DNA, 20 bp, Artificial
  CRISPR gRNA sequence
accccacatctagtcctgtc

SEQ ID NO: 583923 - DNA, 20 bp, Artificial
  CRISPR gRNA sequence
gtcctgtccctgattacctg

SEQ ID NO: 583924 - DNA, 20 bp, Artificial
  CRISPR gRNA sequence
tccctgattacctgccccta

SEQ ID NO: 583925 - DNA, 20 bp, Artificial
  CRISPR gRNA sequence
attacctgcccctacaattc

SEQ ID NO: 583926 - DNA, 20 bp, Artificial
  CRISPR gRNA sequence
cctgcccctacaattccgcc

SEQ ID NO: 583927 - DNA, 20 bp, Artificial
  CRISPR gRNA sequence
cccctacaattccgccccca

SEQ ID NO: 583928 - DNA, 20 bp, Artificial
  CRISPR gRNA sequence
caattccgcccccatgtcag

SEQ ID NO: 583929 - DNA, 20 bp, Artificial
  CRISPR gRNA sequence
cgcccccatgtcagatggct

SEQ ID NO: 583930 - DNA, 20 bp, Artificial
  CRISPR gRNA sequence
ggggtaggtcatagcccctc

SEQ ID NO: 583931 - DNA, 20 bp, Artificial
  CRISPR gRNA sequence
taaaccccaagtttggggaa

SEQ ID NO: 583932 - DNA, 20 bp, Artificial
  CRISPR gRNA sequence
aaccccaagtttggggaatg

SEQ ID NO: 583933 - DNA, 20 bp, Artificial
  CRISPR gRNA sequence
ggggaatgtgccccttaccc

SEQ ID NO: 583934 - DNA, 20 bp, Artificial
  CRISPR gRNA sequence
gggaatgtgccccttacccc

SEQ ID NO: 583935 - DNA, 20 bp, Artificial
  CRISPR gRNA sequence
accccaccccccaacttcca

SEQ ID NO: 583936 - DNA, 20 bp, Artificial
  CRISPR gRNA sequence
ccccaccccccaacttccag

SEQ ID NO: 583937 - DNA, 20 bp, Artificial
  CRISPR gRNA sequence
ccaggccatcctggaggctc

SEQ ID NO: 583938 - DNA, 20 bp, Artificial
  CRISPR gRNA sequence
caggccatcctggaggctcc

SEQ ID NO: 583939 - DNA, 20 bp, Artificial
  CRISPR gRNA sequence
gaggctccagagaagcagcg

SEQ ID NO: 583940 - DNA, 20 bp, Artificial
  CRISPR gRNA sequence
cagagaagcagcggacactc

SEQ ID NO: 583941 - DNA, 20 bp, Artificial
  CRISPR gRNA sequence
aatgagatctaccactggtt

SEQ ID NO: 583942 - DNA, 20 bp, Artificial
  CRISPR gRNA sequence
ccactggttcacacgcatgt

SEQ ID NO: 583943 - DNA, 20 bp, Artificial
  CRISPR gRNA sequence
gttcacacgcatgtttgcct

SEQ ID NO: 583944 - DNA, 20 bp, Artificial
  CRISPR gRNA sequence
acacgcatgtttgccttctt

SEQ ID NO: 583945 - DNA, 20 bp, Artificial
  CRISPR gRNA sequence
gccttcttcagaaaccatcc

SEQ ID NO: 583946 - DNA, 20 bp, Artificial
  CRISPR gRNA sequence
ccttcttcagaaaccatcct

SEQ ID NO: 583947 - DNA, 20 bp, Artificial
  CRISPR gRNA sequence
cttcagaaaccatcctgcca

SEQ ID NO: 583948 - DNA, 20 bp, Artificial
  CRISPR gRNA sequence
ttcagaaaccatcctgccac

SEQ ID NO: 583949 - DNA, 20 bp, Artificial
  CRISPR gRNA sequence
cagaaaccatcctgccacct

SEQ ID NO: 583950 - DNA, 20 bp, Artificial
  CRISPR gRNA sequence
agaaaccatcctgccacctg

SEQ ID NO: 583951 - DNA, 20 bp, Artificial
  CRISPR gRNA sequence
ccacctggaaggtgagctcc

SEQ ID NO: 583952 - DNA, 20 bp, Artificial
  CRISPR gRNA sequence
gaaggtgagctcctctgagg

SEQ ID NO: 583953 - DNA, 20 bp, Artificial
  CRISPR gRNA sequence
ctctgaggtggcggtgactg

SEQ ID NO: 583954 - DNA, 20 bp, Artificial
  CRISPR gRNA sequence
tgaggtggcggtgactggga

SEQ ID NO: 583955 - DNA, 20 bp, Artificial
  CRISPR gRNA sequence
aggtggcggtgactgggatg

SEQ ID NO: 583956 - DNA, 20 bp, Artificial
  CRISPR gRNA sequence
ggatggcctcaagtgccatc

SEQ ID NO: 583957 - DNA, 20 bp, Artificial
  CRISPR gRNA sequence
aagtgccatcgcagctcaaa

SEQ ID NO: 583958 - DNA, 20 bp, Artificial
  CRISPR gRNA sequence
aaagtgggcaggcctgggtc

SEQ ID NO: 583959 - DNA, 20 bp, Artificial
  CRISPR gRNA sequence
ggtctgggctcataggcaca

SEQ ID NO: 583960 - DNA, 20 bp, Artificial
  CRISPR gRNA sequence
ggctcataggcacattgggg

SEQ ID NO: 583961 - DNA, 20 bp, Artificial
  CRISPR gRNA sequence
ataggcacattggggaggaa

SEQ ID NO: 583962 - DNA, 20 bp, Artificial
  CRISPR gRNA sequence
gggaggaacgggatgtgggt

SEQ ID NO: 583963 - DNA, 20 bp, Artificial
  CRISPR gRNA sequence
ttggtggtggctgctggcct

SEQ ID NO: 583964 - DNA, 20 bp, Artificial
  CRISPR gRNA sequence
gtggtggctgctggcctcag

SEQ ID NO: 583965 - DNA, 20 bp, Artificial
  CRISPR gRNA sequence
ctggcctcagaggttgacgc

SEQ ID NO: 583966 - DNA, 20 bp, Artificial
  CRISPR gRNA sequence
gcctcagaggttgacgccca

SEQ ID NO: 583967 - DNA, 20 bp, Artificial
  CRISPR gRNA sequence
agaggttgacgcccacctgc

SEQ ID NO: 583968 - DNA, 20 bp, Artificial
  CRISPR gRNA sequence
acgcccacctgctccctgtc

SEQ ID NO: 583969 - DNA, 20 bp, Artificial
  CRISPR gRNA sequence
ctccctgtccccggccttcc

SEQ ID NO: 583970 - DNA, 20 bp, Artificial
  CRISPR gRNA sequence
cctgtccccggccttccaca

SEQ ID NO: 583971 - DNA, 20 bp, Artificial
  CRISPR gRNA sequence
tccccggccttccacagaac

SEQ ID NO: 583972 - DNA, 20 bp, Artificial
  CRISPR gRNA sequence
ccacagaacgccatccgcca

SEQ ID NO: 583973 - DNA, 20 bp, Artificial
  CRISPR gRNA sequence
cacagaacgccatccgccac

SEQ ID NO: 583974 - DNA, 20 bp, Artificial
  CRISPR gRNA sequence
agtctgcacaagtgctttgt

SEQ ID NO: 583975 - DNA, 20 bp, Artificial
  CRISPR gRNA sequence
cacaagtgctttgtgcgggt

SEQ ID NO: 583976 - DNA, 20 bp, Artificial
  CRISPR gRNA sequence
tgtgcgggtggagagcgaga

SEQ ID NO: 583977 - DNA, 20 bp, Artificial
  CRISPR gRNA sequence
gtgcgggtggagagcgagaa

SEQ ID NO: 583978 - DNA, 20 bp, Artificial
  CRISPR gRNA sequence
tgcgggtggagagcgagaag

SEQ ID NO: 583979 - DNA, 20 bp, Artificial
  CRISPR gRNA sequence
tgtggaccgtggatgagctg

SEQ ID NO: 583980 - DNA, 20 bp, Artificial
  CRISPR gRNA sequence
gagttccgcaagaaacggag

SEQ ID NO: 583981 - DNA, 20 bp, Artificial
  CRISPR gRNA sequence
cgcaagaaacggagccagag

SEQ ID NO: 583982 - DNA, 20 bp, Artificial
  CRISPR gRNA sequence
caaccctacacctggcccct

SEQ ID NO: 583983 - DNA, 20 bp, Artificial
  CRISPR gRNA sequence
cacctggcccctgacctcaa

SEQ ID NO: 583984 - DNA, 20 bp, Artificial
  CRISPR gRNA sequence
gcccctgacctcaagatcaa

SEQ ID NO: 583985 - DNA, 20 bp, Artificial
  CRISPR gRNA sequence
acctcaagatcaaggaaagg

SEQ ID NO: 583986 - DNA, 20 bp, Artificial
  CRISPR gRNA sequence
aagatcaaggaaaggaggat

SEQ ID NO: 583987 - DNA, 20 bp, Artificial
  CRISPR gRNA sequence
gtgggaggcagaggtggtgg

SEQ ID NO: 583988 - DNA, 20 bp, Artificial
  CRISPR gRNA sequence
gatgtgcccacagggaccaa

SEQ ID NO: 583989 - DNA, 20 bp, Artificial
  CRISPR gRNA sequence
ccactgtcttgcctgccagg

SEQ ID NO: 583990 - DNA, 20 bp, Artificial
  CRISPR gRNA sequence
cactgtcttgcctgccaggg

SEQ ID NO: 583991 - DNA, 20 bp, Artificial
  CRISPR gRNA sequence
tcttgcctgccagggcccct

SEQ ID NO: 583992 - DNA, 20 bp, Artificial
  CRISPR gRNA sequence
gcctgccagggcccctgttc

SEQ ID NO: 583993 - DNA, 20 bp, Artificial
  CRISPR gRNA sequence
cctgccagggcccctgttcc

SEQ ID NO: 583994 - DNA, 20 bp, Artificial
  CRISPR gRNA sequence
ccagggcccctgttcccccg

SEQ ID NO: 583995 - DNA, 20 bp, Artificial
  CRISPR gRNA sequence
ttcccccgctggcagccacc

SEQ ID NO: 583996 - DNA, 20 bp, Artificial
  CRISPR gRNA sequence
ccccgctggcagccaccccc

SEQ ID NO: 583997 - DNA, 20 bp, Artificial
  CRISPR gRNA sequence
gcagccaccccctcccccat

SEQ ID NO: 583998 - DNA, 20 bp, Artificial
  CRISPR gRNA sequence
ccccatcatatcctttgccc

SEQ ID NO: 583999 - DNA, 20 bp, Artificial
  CRISPR gRNA sequence
tgccccaaggctgctcagag

SEQ ID NO: 584000 - DNA, 20 bp, Artificial
  CRISPR gRNA sequence
gccccaaggctgctcagagg

SEQ ID NO: 584001 - DNA, 20 bp, Artificial
  CRISPR gRNA sequence
ccccaaggctgctcagaggg

SEQ ID NO: 584002 - DNA, 20 bp, Artificial
  CRISPR gRNA sequence
ctcagaggggccccggtcct

SEQ ID NO: 584003 - DNA, 20 bp, Artificial
  CRISPR gRNA sequence
agaggggccccggtcctggc

SEQ ID NO: 584004 - DNA, 20 bp, Artificial
  CRISPR gRNA sequence
gccccagcccccacctccgc

SEQ ID NO: 584005 - DNA, 20 bp, Artificial
  CRISPR gRNA sequence
cgccccagacacacccccca

SEQ ID NO: 584006 - DNA, 20 bp, Artificial
  CRISPR gRNA sequence
cagccaaacagagccttcac

SEQ ID NO: 584007 - DNA, 20 bp, Artificial
  CRISPR gRNA sequence
cacaaccagccacacagagc

SEQ ID NO: 584008 - DNA, 20 bp, Artificial
  CRISPR gRNA sequence
acaaccagccacacagagcc

SEQ ID NO: 584009 - DNA, 20 bp, Artificial
  CRISPR gRNA sequence
cctcagctgctcgcacagat

SEQ ID NO: 584010 - DNA, 20 bp, Artificial
  CRISPR gRNA sequence
agctgctcgcacagattact

SEQ ID NO: 584011 - DNA, 20 bp, Artificial
  CRISPR gRNA sequence
ctcgcacagattacttcagg

SEQ ID NO: 584012 - DNA, 20 bp, Artificial
  CRISPR gRNA sequence
gcacagattacttcagggct

SEQ ID NO: 584013 - DNA, 20 bp, Artificial
  CRISPR gRNA sequence
cttcagggctggaaaagtca

SEQ ID NO: 584014 - DNA, 20 bp, Artificial
  CRISPR gRNA sequence
cagggctggaaaagtcacac

SEQ ID NO: 584015 - DNA, 20 bp, Artificial
  CRISPR gRNA sequence
agggctggaaaagtcacaca

SEQ ID NO: 584016 - DNA, 20 bp, Artificial
  CRISPR gRNA sequence
gaaaagtcacacagacacac

SEQ ID NO: 584017 - DNA, 20 bp, Artificial
  CRISPR gRNA sequence
tccctcactcaacacaaacc

SEQ ID NO: 584018 - DNA, 20 bp, Artificial
  CRISPR gRNA sequence
actcaacacaaaccccaaaa

SEQ ID NO: 584019 - DNA, 20 bp, Artificial
  CRISPR gRNA sequence
aacacaaaccccaaaacaca

SEQ ID NO: 584020 - DNA, 20 bp, Artificial
  CRISPR gRNA sequence
cctcagtacactcaaacaac

SEQ ID NO: 584021 - DNA, 20 bp, Artificial
  CRISPR gRNA sequence
agtacactcaaacaacctca

SEQ ID NO: 584022 - DNA, 20 bp, Artificial
  CRISPR gRNA sequence
aaacaacctcaaagctgcat

SEQ ID NO: 584023 - DNA, 20 bp, Artificial
  CRISPR gRNA sequence
aaagctgcatcatcacacaa

SEQ ID NO: 584024 - DNA, 20 bp, Artificial
  CRISPR gRNA sequence
catcatcacacaatcacaca

SEQ ID NO: 584025 - DNA, 20 bp, Artificial
  CRISPR gRNA sequence
acaacccacacaccccaagg

SEQ ID NO: 584026 - DNA, 20 bp, Artificial
  CRISPR gRNA sequence
agggcccacaggggcactgt

SEQ ID NO: 584027 - DNA, 20 bp, Artificial
  CRISPR gRNA sequence
tcaacacaggggtgtgccca

SEQ ID NO: 584028 - DNA, 20 bp, Artificial
  CRISPR gRNA sequence
cacagaagcagcgtcagtac

SEQ ID NO: 584029 - DNA, 20 bp, Artificial
  CRISPR gRNA sequence
aggatctgaggtcccaacac

SEQ ID NO: 584030 - DNA, 20 bp, Artificial
  CRISPR gRNA sequence
aggtcccaacacgtgctcgc

SEQ ID NO: 584031 - DNA, 20 bp, Artificial
  CRISPR gRNA sequence
gctcacacacacggcctgtt

SEQ ID NO: 584032 - DNA, 20 bp, Artificial
  CRISPR gRNA sequence
acacacacggcctgttagaa

SEQ ID NO: 584033 - DNA, 20 bp, Artificial
  CRISPR gRNA sequence
ttagaattcacctgtgtatc

SEQ ID NO: 584034 - DNA, 20 bp, Artificial
  CRISPR gRNA sequence
gaattcacctgtgtatctca

SEQ ID NO: 584035 - DNA, 20 bp, Artificial
  CRISPR gRNA sequence
acctgtgtatctcacgcata

SEQ ID NO: 584036 - DNA, 20 bp, Artificial
  CRISPR gRNA sequence
tgtatctcacgcatatgcac

SEQ ID NO: 584037 - DNA, 20 bp, Artificial
  CRISPR gRNA sequence
acgcatatgcacacgcacag

SEQ ID NO: 584038 - DNA, 20 bp, Artificial
  CRISPR gRNA sequence
ttgagtcccgtgcagacaca

SEQ ID NO: 584039 - DNA, 20 bp, Artificial
  CRISPR gRNA sequence
gagtcccgtgcagacacaca

SEQ ID NO: 584040 - DNA, 20 bp, Artificial
  CRISPR gRNA sequence
agtcccgtgcagacacacac

SEQ ID NO: 584041 - DNA, 20 bp, Artificial
  CRISPR gRNA sequence
ccttgccaaaaataccccgt

SEQ ID NO: 584042 - DNA, 20 bp, Artificial
  CRISPR gRNA sequence
gccaaaaataccccgtgtct

SEQ ID NO: 584043 - DNA, 20 bp, Artificial
  CRISPR gRNA sequence
ccaaaaataccccgtgtctc

SEQ ID NO: 584044 - DNA, 20 bp, Artificial
  CRISPR gRNA sequence
ccctgccactcacctcactc

SEQ ID NO: 584045 - DNA, 20 bp, Artificial
  CRISPR gRNA sequence
ccactcacctcactcccatt

SEQ ID NO: 584046 - DNA, 20 bp, Artificial
  CRISPR gRNA sequence
acctcactcccattccctga

SEQ ID NO: 584047 - DNA, 20 bp, Artificial
  CRISPR gRNA sequence
actcccattccctgagccct

SEQ ID NO: 584048 - DNA, 20 bp, Artificial
  CRISPR gRNA sequence
ccattccctgagccctgatc

SEQ ID NO: 584049 - DNA, 20 bp, Artificial
  CRISPR gRNA sequence
cctgagccctgatccatgcc

SEQ ID NO: 584050 - DNA, 20 bp, Artificial
  CRISPR gRNA sequence
agccctgatccatgcctcag

SEQ ID NO: 584051 - DNA, 20 bp, Artificial
  CRISPR gRNA sequence
atccatgcctcagcttagac

SEQ ID NO: 584052 - DNA, 20 bp, Artificial
  CRISPR gRNA sequence
agcttagactgcagaggaac

SEQ ID NO: 584053 - DNA, 20 bp, Artificial
  CRISPR gRNA sequence
agactgcagaggaactactc

SEQ ID NO: 584054 - DNA, 20 bp, Artificial
  CRISPR gRNA sequence
gactgcagaggaactactca

SEQ ID NO: 584055 - DNA, 20 bp, Artificial
  CRISPR gRNA sequence
cagaggaactactcatttat

SEQ ID NO: 584056 - DNA, 20 bp, Artificial
  CRISPR gRNA sequence
ctcatttatttgggatccaa

SEQ ID NO: 584057 - DNA, 20 bp, Artificial
  CRISPR gRNA sequence
atttatttgggatccaaggc

SEQ ID NO: 584058 - DNA, 20 bp, Artificial
  CRISPR gRNA sequence
atttgggatccaaggccccc

SEQ ID NO: 584059 - DNA, 20 bp, Artificial
  CRISPR gRNA sequence
tttgggatccaaggccccca

SEQ ID NO: 584060 - DNA, 20 bp, Artificial
  CRISPR gRNA sequence
gggatccaaggcccccaacc

SEQ ID NO: 584061 - DNA, 20 bp, Artificial
  CRISPR gRNA sequence
ggatccaaggcccccaaccc

SEQ ID NO: 584062 - DNA, 20 bp, Artificial
  CRISPR gRNA sequence
cagccgagctccccacatgc

SEQ ID NO: 584063 - DNA, 20 bp, Artificial
  CRISPR gRNA sequence
cccacatgctggactatcac

SEQ ID NO: 584064 - DNA, 20 bp, Artificial
  CRISPR gRNA sequence
gactatcaccccatataagg

SEQ ID NO: 584065 - DNA, 20 bp, Artificial
  CRISPR gRNA sequence
tcaccccatataagggttgc

SEQ ID NO: 584066 - DNA, 20 bp, Artificial
  CRISPR gRNA sequence
cggtcagtgggcaggggtct

SEQ ID NO: 584067 - DNA, 20 bp, Artificial
  CRISPR gRNA sequence
ggtccaaggccgcagcagga

SEQ ID NO: 584068 - DNA, 20 bp, Artificial
  CRISPR gRNA sequence
gacagcggaggaagtagcta

SEQ ID NO: 584069 - DNA, 20 bp, Artificial
  CRISPR gRNA sequence
atgataatttaagcctggta

SEQ ID NO: 584070 - DNA, 20 bp, Artificial
  CRISPR gRNA sequence
gcctggtatagtcaacaatt

SEQ ID NO: 584071 - DNA, 20 bp, Artificial
  CRISPR gRNA sequence
acaatttagtcttctgtatt

SEQ ID NO: 584072 - DNA, 20 bp, Artificial
  CRISPR gRNA sequence
atttagtcttctgtatttgg

SEQ ID NO: 584073 - DNA, 20 bp, Artificial
  CRISPR gRNA sequence
ttggaagacatgtttgtgta

SEQ ID NO: 584074 - DNA, 20 bp, Artificial
  CRISPR gRNA sequence
tttgtgtacagaattttcac

SEQ ID NO: 584075 - DNA, 20 bp, Artificial
  CRISPR gRNA sequence
tgtacagaattttcaccaga

SEQ ID NO: 584076 - DNA, 20 bp, Artificial
  CRISPR gRNA sequence
ttttcaccagaaagttttta

SEQ ID NO: 584077 - DNA, 20 bp, Artificial
  CRISPR gRNA sequence
ttatagcaaactttttatgt

SEQ ID NO: 584078 - DNA, 20 bp, Artificial
  CRISPR gRNA sequence
tagcaaactttttatgtcag

SEQ ID NO: 584079 - DNA, 20 bp, Artificial
  CRISPR gRNA sequence
atgtcagaagtttattttat

SEQ ID NO: 584080 - DNA, 20 bp, Artificial
  CRISPR gRNA sequence
gtaaaatattaaataatata

SEQ ID NO: 584081 - DNA, 20 bp, Artificial
  CRISPR gRNA sequence
aaaactgcacttacacttct

SEQ ID NO: 584082 - DNA, 20 bp, Artificial
  CRISPR gRNA sequence
actgcacttacacttctgag

SEQ ID NO: 584083 - DNA, 20 bp, Artificial
  CRISPR gRNA sequence
ttctgagaagaaataaatct

SEQ ID NO: 584084 - DNA, 20 bp, Artificial
  CRISPR gRNA sequence
caaattatatgcttgttcct

SEQ ID NO: 584085 - DNA, 20 bp, Artificial
  CRISPR gRNA sequence
gagattccctaaatttattc

SEQ ID NO: 584086 - DNA, 20 bp, Artificial
  CRISPR gRNA sequence
attccctaaatttattccag

SEQ ID NO: 584087 - DNA, 20 bp, Artificial
  CRISPR gRNA sequence
tattccagtagctgtgcact

SEQ ID NO: 584088 - DNA, 20 bp, Artificial
  CRISPR gRNA sequence
ccagtagctgtgcactcaga

SEQ ID NO: 584089 - DNA, 20 bp, Artificial
  CRISPR gRNA sequence
ataatataatccttttcaca

SEQ ID NO: 584090 - DNA, 20 bp, Artificial
  CRISPR gRNA sequence
ccttttcacaaagtattaca

SEQ ID NO: 584091 - DNA, 20 bp, Artificial
  CRISPR gRNA sequence
aaagtattacaaagtttctg

SEQ ID NO: 584092 - DNA, 20 bp, Artificial
  CRISPR gRNA sequence
caaagtttctgcagcttctt

SEQ ID NO: 584093 - DNA, 20 bp, Artificial
  CRISPR gRNA sequence
tctttagttgtacacacata

SEQ ID NO: 584094 - DNA, 20 bp, Artificial
  CRISPR gRNA sequence
aacactcatacacatataca

SEQ ID NO: 584095 - DNA, 20 bp, Artificial
  CRISPR gRNA sequence
acagtaaccacatacatgca

SEQ ID NO: 584096 - DNA, 20 bp, Artificial
  CRISPR gRNA sequence
atgtgtgtgcattaaaaaca

SEQ ID NO: 584097 - DNA, 20 bp, Artificial
  CRISPR gRNA sequence
tgtgtgcattaaaaacaaag

SEQ ID NO: 584098 - DNA, 20 bp, Artificial
  CRISPR gRNA sequence
attaaaaacaaagaagatac

SEQ ID NO: 584099 - DNA, 20 bp, Artificial
  CRISPR gRNA sequence
aagatacaagtcccacattt

SEQ ID NO: 584100 - DNA, 20 bp, Artificial
  CRISPR gRNA sequence
aagtcccacattttagtctg

SEQ ID NO: 584101 - DNA, 20 bp, Artificial
  CRISPR gRNA sequence
tctgcagtgataaaactatt

SEQ ID NO: 584102 - DNA, 20 bp, Artificial
  CRISPR gRNA sequence
gcagtgataaaactatttag

SEQ ID NO: 584103 - DNA, 20 bp, Artificial
  CRISPR gRNA sequence
agtgataaaactatttagcg

SEQ ID NO: 584104 - DNA, 20 bp, Artificial
  CRISPR gRNA sequence
gtgataaaactatttagcgg

SEQ ID NO: 584105 - DNA, 20 bp, Artificial
  CRISPR gRNA sequence
tttagcggaggtctccaaat

SEQ ID NO: 584106 - DNA, 20 bp, Artificial
  CRISPR gRNA sequence
gaggtctccaaatcagtatg

SEQ ID NO: 584107 - DNA, 20 bp, Artificial
  CRISPR gRNA sequence
gtctccaaatcagtatgtag

SEQ ID NO: 584108 - DNA, 20 bp, Artificial
  CRISPR gRNA sequence
ctccaaatcagtatgtagta

SEQ ID NO: 584109 - DNA, 20 bp, Artificial
  CRISPR gRNA sequence
tagtagagtgacttgtcaca

SEQ ID NO: 584110 - DNA, 20 bp, Artificial
  CRISPR gRNA sequence
tgacttgtcacacagctgca

SEQ ID NO: 584111 - DNA, 20 bp, Artificial
  CRISPR gRNA sequence
cacagctgcaaagactgttt

SEQ ID NO: 584112 - DNA, 20 bp, Artificial
  CRISPR gRNA sequence
agactgtttcagtatttcca

SEQ ID NO: 584113 - DNA, 20 bp, Artificial
  CRISPR gRNA sequence
catagtaaacctcattttct

SEQ ID NO: 584114 - DNA, 20 bp, Artificial
  CRISPR gRNA sequence
atagtaaacctcattttctg

SEQ ID NO: 584115 - DNA, 20 bp, Artificial
  CRISPR gRNA sequence
aaacctcattttctgaggta

SEQ ID NO: 584116 - DNA, 20 bp, Artificial
  CRISPR gRNA sequence
ttttctgaggtatggtattt

SEQ ID NO: 584117 - DNA, 20 bp, Artificial
  CRISPR gRNA sequence
taaaaaaactacattacact

SEQ ID NO: 584118 - DNA, 20 bp, Artificial
  CRISPR gRNA sequence
acttagcaaacctgacatac

SEQ ID NO: 584119 - DNA, 20 bp, Artificial
  CRISPR gRNA sequence
cttagcaaacctgacataca

SEQ ID NO: 584120 - DNA, 20 bp, Artificial
  CRISPR gRNA sequence
caaacctgacatacaaggta

SEQ ID NO: 584121 - DNA, 20 bp, Artificial
  CRISPR gRNA sequence
tatatttcttttttaaacaa

SEQ ID NO: 584122 - DNA, 20 bp, Artificial
  CRISPR gRNA sequence
tttttatttccccaaattat

SEQ ID NO: 584123 - DNA, 20 bp, Artificial
  CRISPR gRNA sequence
ttattagtttgaaaaaaaat

SEQ ID NO: 584124 - DNA, 20 bp, Artificial
  CRISPR gRNA sequence
tattagtttgaaaaaaaatg

SEQ ID NO: 584125 - DNA, 20 bp, Artificial
  CRISPR gRNA sequence
tgaaaaaaaatgaggtttac

SEQ ID NO: 584126 - DNA, 20 bp, Artificial
  CRISPR gRNA sequence
ttctaaaacacaaaataccc

SEQ ID NO: 584127 - DNA, 20 bp, Artificial
  CRISPR gRNA sequence
aaaataccctagaaactgtc

SEQ ID NO: 584128 - DNA, 20 bp, Artificial
  CRISPR gRNA sequence
cctagaaactgtcaagcaat

SEQ ID NO: 584129 - DNA, 20 bp, Artificial
  CRISPR gRNA sequence
caagcaattagtctttaaaa

SEQ ID NO: 584130 - DNA, 20 bp, Artificial
  CRISPR gRNA sequence
taaaatagtctaattacctt

SEQ ID NO: 584131 - DNA, 20 bp, Artificial
  CRISPR gRNA sequence
aattacctttggtattgtta

SEQ ID NO: 584132 - DNA, 20 bp, Artificial
  CRISPR gRNA sequence
acctttggtattgttaaaga

SEQ ID NO: 584133 - DNA, 20 bp, Artificial
  CRISPR gRNA sequence
taaagaaagaatatctaaaa

SEQ ID NO: 584134 - DNA, 20 bp, Artificial
  CRISPR gRNA sequence
aaagaatatctaaaatggcc

SEQ ID NO: 584135 - DNA, 20 bp, Artificial
  CRISPR gRNA sequence
agacacatactgtacaaatg

SEQ ID NO: 584136 - DNA, 20 bp, Artificial
  CRISPR gRNA sequence
actgtacaaatgcagaaatg

SEQ ID NO: 584137 - DNA, 20 bp, Artificial
  CRISPR gRNA sequence
aatgcagtaactgcctttaa

SEQ ID NO: 584138 - DNA, 20 bp, Artificial
  CRISPR gRNA sequence
tgcctttaaaagaaatgcca

SEQ ID NO: 584139 - DNA, 20 bp, Artificial
  CRISPR gRNA sequence
caaaacatgtatttatatta

SEQ ID NO: 584140 - DNA, 20 bp, Artificial
  CRISPR gRNA sequence
aacatgtatttatattacag

SEQ ID NO: 584141 - DNA, 20 bp, Artificial
  CRISPR gRNA sequence
atattacagcagttttacta

SEQ ID NO: 584142 - DNA, 20 bp, Artificial
  CRISPR gRNA sequence
tattacagcagttttactac

SEQ ID NO: 584143 - DNA, 20 bp, Artificial
  CRISPR gRNA sequence
attacagcagttttactaca

SEQ ID NO: 584144 - DNA, 20 bp, Artificial
  CRISPR gRNA sequence
gcagttttactacagggaca

SEQ ID NO: 584145 - DNA, 20 bp, Artificial
  CRISPR gRNA sequence
cagttttactacagggacac

SEQ ID NO: 584146 - DNA, 20 bp, Artificial
  CRISPR gRNA sequence
cagggacacaggtataaaaa

SEQ ID NO: 584147 - DNA, 20 bp, Artificial
  CRISPR gRNA sequence
caggtataaaaaaagaaaat

SEQ ID NO: 584148 - DNA, 20 bp, Artificial
  CRISPR gRNA sequence
cactacatataaatatgtat

SEQ ID NO: 584149 - DNA, 20 bp, Artificial
  CRISPR gRNA sequence
tacttaaatttgtatgaaaa

SEQ ID NO: 584150 - DNA, 20 bp, Artificial
  CRISPR gRNA sequence
acttaaatttgtatgaaaac

SEQ ID NO: 584151 - DNA, 20 bp, Artificial
  CRISPR gRNA sequence
tttaaaaaaaatttctccaa

SEQ ID NO: 584152 - DNA, 20 bp, Artificial
  CRISPR gRNA sequence
ttaaaaaaaatttctccaat

SEQ ID NO: 584153 - DNA, 20 bp, Artificial
  CRISPR gRNA sequence
ttctccaataggtgatatgt

SEQ ID NO: 584154 - DNA, 20 bp, Artificial
  CRISPR gRNA sequence
atatgtaagtgtttaaaact

SEQ ID NO: 584155 - DNA, 20 bp, Artificial
  CRISPR gRNA sequence
taagtgtttaaaactcagct

SEQ ID NO: 584156 - DNA, 20 bp, Artificial
  CRISPR gRNA sequence
agtgctttgcttttatttaa

SEQ ID NO: 584157 - DNA, 20 bp, Artificial
  CRISPR gRNA sequence
atttaaaagtttatttctaa

SEQ ID NO: 584158 - DNA, 20 bp, Artificial
  CRISPR gRNA sequence
tttaaaagtttatttctaaa

SEQ ID NO: 584159 - DNA, 20 bp, Artificial
  CRISPR gRNA sequence
ttaaaagtttatttctaaaa

SEQ ID NO: 584160 - DNA, 20 bp, Artificial
  CRISPR gRNA sequence
taaaagtttatttctaaaag

SEQ ID NO: 584161 - DNA, 20 bp, Artificial
  CRISPR gRNA sequence
aaagtttatttctaaaaggg

SEQ ID NO: 584162 - DNA, 20 bp, Artificial
  CRISPR gRNA sequence
gtttatttctaaaaggggag

SEQ ID NO: 584163 - DNA, 20 bp, Artificial
  CRISPR gRNA sequence
agaagtaaaataaaaatatt

SEQ ID NO: 584164 - DNA, 20 bp, Artificial
  CRISPR gRNA sequence
aaaataaaaatattaagtat

SEQ ID NO: 584165 - DNA, 20 bp, Artificial
  CRISPR gRNA sequence
aaataaaaatattaagtatt

SEQ ID NO: 584166 - DNA, 20 bp, Artificial
  CRISPR gRNA sequence
taagtattaggttcttaatt

SEQ ID NO: 584167 - DNA, 20 bp, Artificial
  CRISPR gRNA sequence
agtattaggttcttaattta

SEQ ID NO: 584168 - DNA, 20 bp, Artificial
  CRISPR gRNA sequence
aggttcttaatttagagcat

SEQ ID NO: 584169 - DNA, 20 bp, Artificial
  CRISPR gRNA sequence
ggttcttaatttagagcatt

SEQ ID NO: 584170 - DNA, 20 bp, Artificial
  CRISPR gRNA sequence
cttaatttagagcattgggc

SEQ ID NO: 584171 - DNA, 20 bp, Artificial
  CRISPR gRNA sequence
ttaatttagagcattgggcg

SEQ ID NO: 584172 - DNA, 20 bp, Artificial
  CRISPR gRNA sequence
taatttagagcattgggcga

SEQ ID NO: 584173 - DNA, 20 bp, Artificial
  CRISPR gRNA sequence
agagcattgggcgagggtct

SEQ ID NO: 584174 - DNA, 20 bp, Artificial
  CRISPR gRNA sequence
gcattgggcgagggtctaag

SEQ ID NO: 584175 - DNA, 20 bp, Artificial
  CRISPR gRNA sequence
aagaagattcaatctgtaaa

SEQ ID NO: 584176 - DNA, 20 bp, Artificial
  CRISPR gRNA sequence
atctgtaaaaagttcaactt

SEQ ID NO: 584177 - DNA, 20 bp, Artificial
  CRISPR gRNA sequence
tctgtaaaaagttcaacttt

SEQ ID NO: 584178 - DNA, 20 bp, Artificial
  CRISPR gRNA sequence
aactttaggacacatttttc

SEQ ID NO: 584179 - DNA, 20 bp, Artificial
  CRISPR gRNA sequence
aggacacatttttcaagcaa

SEQ ID NO: 584180 - DNA, 20 bp, Artificial
  CRISPR gRNA sequence
caaaagattactaatttcca

SEQ ID NO: 584181 - DNA, 20 bp, Artificial
  CRISPR gRNA sequence
tactaatttccatggaaatt

SEQ ID NO: 584182 - DNA, 20 bp, Artificial
  CRISPR gRNA sequence
atggaaatttagcttaaata

SEQ ID NO: 584183 - DNA, 20 bp, Artificial
  CRISPR gRNA sequence
agcttaaataaagataccat

SEQ ID NO: 584184 - DNA, 20 bp, Artificial
  CRISPR gRNA sequence
aaataaagataccatgagat

SEQ ID NO: 584185 - DNA, 20 bp, Artificial
  CRISPR gRNA sequence
aagataccatgagatcagac

SEQ ID NO: 584186 - DNA, 20 bp, Artificial
  CRISPR gRNA sequence
ataccatgagatcagactag

SEQ ID NO: 584187 - DNA, 20 bp, Artificial
  CRISPR gRNA sequence
attctgtaatcttttgattg

SEQ ID NO: 584188 - DNA, 20 bp, Artificial
  CRISPR gRNA sequence
tctgtaatcttttgattgtg

SEQ ID NO: 584189 - DNA, 20 bp, Artificial
  CRISPR gRNA sequence
taacatactatgacttttat

SEQ ID NO: 584190 - DNA, 20 bp, Artificial
  CRISPR gRNA sequence
tatgagtttctttttgtcat

SEQ ID NO: 584191 - DNA, 20 bp, Artificial
  CRISPR gRNA sequence
tttctttttgtcattagcta

SEQ ID NO: 584192 - DNA, 20 bp, Artificial
  CRISPR gRNA sequence
ttctttttgtcattagctaa

SEQ ID NO: 584193 - DNA, 20 bp, Artificial
  CRISPR gRNA sequence
tttttgtcattagctaaagg

SEQ ID NO: 584194 - DNA, 20 bp, Artificial
  CRISPR gRNA sequence
gtcattagctaaaggaagaa

SEQ ID NO: 584195 - DNA, 20 bp, Artificial
  CRISPR gRNA sequence
tcattagctaaaggaagaat

SEQ ID NO: 584196 - DNA, 20 bp, Artificial
  CRISPR gRNA sequence
tagctaaaggaagaataggt

SEQ ID NO: 584197 - DNA, 20 bp, Artificial
  CRISPR gRNA sequence
aaaggaagaataggtcagaa

SEQ ID NO: 584198 - DNA, 20 bp, Artificial
  CRISPR gRNA sequence
aaaagaaaaaaaaatcacca

SEQ ID NO: 584199 - DNA, 20 bp, Artificial
  CRISPR gRNA sequence
aaaaaatcaccatagttttt

SEQ ID NO: 584200 - DNA, 20 bp, Artificial
  CRISPR gRNA sequence
accatagtttttaagacttc

SEQ ID NO: 584201 - DNA, 20 bp, Artificial
  CRISPR gRNA sequence
ccatagtttttaagacttca

SEQ ID NO: 584202 - DNA, 20 bp, Artificial
  CRISPR gRNA sequence
catagtttttaagacttcaa

SEQ ID NO: 584203 - DNA, 20 bp, Artificial
  CRISPR gRNA sequence
atagtttttaagacttcaag

SEQ ID NO: 584204 - DNA, 20 bp, Artificial
  CRISPR gRNA sequence
agtttttaagacttcaaggg

SEQ ID NO: 584205 - DNA, 20 bp, Artificial
  CRISPR gRNA sequence
aggggagtattgcacttgta

SEQ ID NO: 584206 - DNA, 20 bp, Artificial
  CRISPR gRNA sequence
gagtattgcacttgtacaga

SEQ ID NO: 584207 - DNA, 20 bp, Artificial
  CRISPR gRNA sequence
ttgcacttgtacagaaagaa

SEQ ID NO: 584208 - DNA, 20 bp, Artificial
  CRISPR gRNA sequence
cttgtacagaaagaaaagaa

SEQ ID NO: 584209 - DNA, 20 bp, Artificial
  CRISPR gRNA sequence
aatagtatctttttaactaa

SEQ ID NO: 584210 - DNA, 20 bp, Artificial
  CRISPR gRNA sequence
agtatctttttaactaatag

SEQ ID NO: 584211 - DNA, 20 bp, Artificial
  CRISPR gRNA sequence
atctttttaactaatagcag

SEQ ID NO: 584212 - DNA, 20 bp, Artificial
  CRISPR gRNA sequence
aatagcagaagcaatcattc

SEQ ID NO: 584213 - DNA, 20 bp, Artificial
  CRISPR gRNA sequence
atagcagaagcaatcattct

SEQ ID NO: 584214 - DNA, 20 bp, Artificial
  CRISPR gRNA sequence
ctgggattgcaaataacaca

SEQ ID NO: 584215 - DNA, 20 bp, Artificial
  CRISPR gRNA sequence
gcaaataacacatggtctaa

SEQ ID NO: 584216 - DNA, 20 bp, Artificial
  CRISPR gRNA sequence
caaataacacatggtctaaa

SEQ ID NO: 584217 - DNA, 20 bp, Artificial
  CRISPR gRNA sequence
ctaaaaggtccaactattaa

SEQ ID NO: 584218 - DNA, 20 bp, Artificial
  CRISPR gRNA sequence
ccaactattaacagcaaata

SEQ ID NO: 584219 - DNA, 20 bp, Artificial
  CRISPR gRNA sequence
caactattaacagcaaatat

SEQ ID NO: 584220 - DNA, 20 bp, Artificial
  CRISPR gRNA sequence
aactattaacagcaaatatg

SEQ ID NO: 584221 - DNA, 20 bp, Artificial
  CRISPR gRNA sequence
ttaacagcaaatatggggcc

SEQ ID NO: 584222 - DNA, 20 bp, Artificial
  CRISPR gRNA sequence
aacagcaaatatggggcctg

SEQ ID NO: 584223 - DNA, 20 bp, Artificial
  CRISPR gRNA sequence
ctggagaccccctccaaacc

SEQ ID NO: 584224 - DNA, 20 bp, Artificial
  CRISPR gRNA sequence
ccaaacctggaatattatta

SEQ ID NO: 584225 - DNA, 20 bp, Artificial
  CRISPR gRNA sequence
atattattatagtaatgtta

SEQ ID NO: 584226 - DNA, 20 bp, Artificial
  CRISPR gRNA sequence
taaagcatttttctcccaat

SEQ ID NO: 584227 - DNA, 20 bp, Artificial
  CRISPR gRNA sequence
aaagcatttttctcccaatt

SEQ ID NO: 584228 - DNA, 20 bp, Artificial
  CRISPR gRNA sequence
agcatttttctcccaattag

SEQ ID NO: 584229 - DNA, 20 bp, Artificial
  CRISPR gRNA sequence
tttttctcccaattaggaga

SEQ ID NO: 584230 - DNA, 20 bp, Artificial
  CRISPR gRNA sequence
ctcccaattaggagaaagtt

SEQ ID NO: 584231 - DNA, 20 bp, Artificial
  CRISPR gRNA sequence
aacacttgcaaataactgtc

SEQ ID NO: 584232 - DNA, 20 bp, Artificial
  CRISPR gRNA sequence
ctttcatgatatacattttt

SEQ ID NO: 584233 - DNA, 20 bp, Artificial
  CRISPR gRNA sequence
ttcatgatatacattttttg

SEQ ID NO: 584234 - DNA, 20 bp, Artificial
  CRISPR gRNA sequence
tcatgatatacattttttgg

SEQ ID NO: 584235 - DNA, 20 bp, Artificial
  CRISPR gRNA sequence
gatatacattttttggagga

SEQ ID NO: 584236 - DNA, 20 bp, Artificial
  CRISPR gRNA sequence
tttttggaggaaagccaaat

SEQ ID NO: 584237 - DNA, 20 bp, Artificial
  CRISPR gRNA sequence
gaatgtaaaatccaacaata

SEQ ID NO: 584238 - DNA, 20 bp, Artificial
  CRISPR gRNA sequence
aatgtaaaatccaacaataa

SEQ ID NO: 584239 - DNA, 20 bp, Artificial
  CRISPR gRNA sequence
taaaatccaacaataaagga

SEQ ID NO: 584240 - DNA, 20 bp, Artificial
  CRISPR gRNA sequence
ggaaagcaaacatactataa

SEQ ID NO: 584241 - DNA, 20 bp, Artificial
  CRISPR gRNA sequence
gaaagcaaacatactataat

SEQ ID NO: 584242 - DNA, 20 bp, Artificial
  CRISPR gRNA sequence
ataggattacataatctctg

SEQ ID NO: 584243 - DNA, 20 bp, Artificial
  CRISPR gRNA sequence
taatctctgaagtaatgttt

SEQ ID NO: 584244 - DNA, 20 bp, Artificial
  CRISPR gRNA sequence
aatctctgaagtaatgtttt

SEQ ID NO: 584245 - DNA, 20 bp, Artificial
  CRISPR gRNA sequence
tttaggtacccaatatttga

SEQ ID NO: 584246 - DNA, 20 bp, Artificial
  CRISPR gRNA sequence
tacccaatatttgaaagtga

SEQ ID NO: 584247 - DNA, 20 bp, Artificial
  CRISPR gRNA sequence
tttgaaagtgaaagtaacat

SEQ ID NO: 584248 - DNA, 20 bp, Artificial
  CRISPR gRNA sequence
ttgaaagtgaaagtaacatg

SEQ ID NO: 584249 - DNA, 20 bp, Artificial
  CRISPR gRNA sequence
tgaaagtgaaagtaacatga

SEQ ID NO: 584250 - DNA, 20 bp, Artificial
  CRISPR gRNA sequence
aaagtaacatgagggttaca

SEQ ID NO: 584251 - DNA, 20 bp, Artificial
  CRISPR gRNA sequence
ccaaccacttttctttttaa

SEQ ID NO: 584252 - DNA, 20 bp, Artificial
  CRISPR gRNA sequence
tttaatagaaaactacactt

SEQ ID NO: 584253 - DNA, 20 bp, Artificial
  CRISPR gRNA sequence
acttgagtataaaaatacgt

SEQ ID NO: 584254 - DNA, 20 bp, Artificial
  CRISPR gRNA sequence
tgagtataaaaatacgtcag

SEQ ID NO: 584255 - DNA, 20 bp, Artificial
  CRISPR gRNA sequence
aaaatcacgaaaaaaaaatt

SEQ ID NO: 584256 - DNA, 20 bp, Artificial
  CRISPR gRNA sequence
agattaaattaccaatgaac

SEQ ID NO: 584257 - DNA, 20 bp, Artificial
  CRISPR gRNA sequence
attaccaatgaactagaaat

SEQ ID NO: 584258 - DNA, 20 bp, Artificial
  CRISPR gRNA sequence
taccaatgaactagaaataa

SEQ ID NO: 584259 - DNA, 20 bp, Artificial
  CRISPR gRNA sequence
tgacctaatcttcaaacttt

SEQ ID NO: 584260 - DNA, 20 bp, Artificial
  CRISPR gRNA sequence
gacctaatcttcaaactttt

SEQ ID NO: 584261 - DNA, 20 bp, Artificial
  CRISPR gRNA sequence
cctaatcttcaaacttttag

SEQ ID NO: 584262 - DNA, 20 bp, Artificial
  CRISPR gRNA sequence
tcttcaaacttttaggagaa

SEQ ID NO: 584263 - DNA, 20 bp, Artificial
  CRISPR gRNA sequence
ttcaaacttttaggagaaca

SEQ ID NO: 584264 - DNA, 20 bp, Artificial
  CRISPR gRNA sequence
caaacttttaggagaacaga

SEQ ID NO: 584265 - DNA, 20 bp, Artificial
  CRISPR gRNA sequence
aaacttttaggagaacagag

SEQ ID NO: 584266 - DNA, 20 bp, Artificial
  CRISPR gRNA sequence
aacagagaggtaaacatcca

SEQ ID NO: 584267 - DNA, 20 bp, Artificial
  CRISPR gRNA sequence
taaacatccatagacaatga

SEQ ID NO: 584268 - DNA, 20 bp, Artificial
  CRISPR gRNA sequence
acatccatagacaatgacag

SEQ ID NO: 584269 - DNA, 20 bp, Artificial
  CRISPR gRNA sequence
catccatagacaatgacaga

SEQ ID NO: 584270 - DNA, 20 bp, Artificial
  CRISPR gRNA sequence
atccatagacaatgacagaa

SEQ ID NO: 584271 - DNA, 20 bp, Artificial
  CRISPR gRNA sequence
ccatagacaatgacagaagg

SEQ ID NO: 584272 - DNA, 20 bp, Artificial
  CRISPR gRNA sequence
agacaatgacagaagggaga

SEQ ID NO: 584273 - DNA, 20 bp, Artificial
  CRISPR gRNA sequence
tgacagaagggagacggaca

SEQ ID NO: 584274 - DNA, 20 bp, Artificial
  CRISPR gRNA sequence
agaagggagacggacaaaga

SEQ ID NO: 584275 - DNA, 20 bp, Artificial
  CRISPR gRNA sequence
aagggagacggacaaagaaa

SEQ ID NO: 584276 - DNA, 20 bp, Artificial
  CRISPR gRNA sequence
agggagacggacaaagaaag

SEQ ID NO: 584277 - DNA, 20 bp, Artificial
  CRISPR gRNA sequence
gacggacaaagaaagaggct

SEQ ID NO: 584278 - DNA, 20 bp, Artificial
  CRISPR gRNA sequence
acggacaaagaaagaggctg

SEQ ID NO: 584279 - DNA, 20 bp, Artificial
  CRISPR gRNA sequence
cggacaaagaaagaggctga

SEQ ID NO: 584280 - DNA, 20 bp, Artificial
  CRISPR gRNA sequence
gacaaagaaagaggctgagg

SEQ ID NO: 584281 - DNA, 20 bp, Artificial
  CRISPR gRNA sequence
agggagatgtaacaaaattt

SEQ ID NO: 584282 - DNA, 20 bp, Artificial
  CRISPR gRNA sequence
ggagatgtaacaaaatttaa

SEQ ID NO: 584283 - DNA, 20 bp, Artificial
  CRISPR gRNA sequence
taacaaaatttaagagataa

SEQ ID NO: 584284 - DNA, 20 bp, Artificial
  CRISPR gRNA sequence
acaaaatttaagagataaca

SEQ ID NO: 584285 - DNA, 20 bp, Artificial
  CRISPR gRNA sequence
aaaatttaagagataacaga

SEQ ID NO: 584286 - DNA, 20 bp, Artificial
  CRISPR gRNA sequence
acagagagacctttgttaca

SEQ ID NO: 584287 - DNA, 20 bp, Artificial
  CRISPR gRNA sequence
agagacctttgttacacaga

SEQ ID NO: 584288 - DNA, 20 bp, Artificial
  CRISPR gRNA sequence
gagacctttgttacacagaa

SEQ ID NO: 584289 - DNA, 20 bp, Artificial
  CRISPR gRNA sequence
agacctttgttacacagaaa

SEQ ID NO: 584290 - DNA, 20 bp, Artificial
  CRISPR gRNA sequence
cctttgttacacagaaaggg

SEQ ID NO: 584291 - DNA, 20 bp, Artificial
  CRISPR gRNA sequence
ctttgttacacagaaaggga

SEQ ID NO: 584292 - DNA, 20 bp, Artificial
  CRISPR gRNA sequence
tttgttacacagaaagggaa

SEQ ID NO: 584293 - DNA, 20 bp, Artificial
  CRISPR gRNA sequence
tgttacacagaaagggaagg

SEQ ID NO: 584294 - DNA, 20 bp, Artificial
  CRISPR gRNA sequence
aagggagttatgttcaaaat

SEQ ID NO: 584295 - DNA, 20 bp, Artificial
  CRISPR gRNA sequence
tgtaaaaaatttttaaatca

SEQ ID NO: 584296 - DNA, 20 bp, Artificial
  CRISPR gRNA sequence
aaatttttaaatcacagttt

SEQ ID NO: 584297 - DNA, 20 bp, Artificial
  CRISPR gRNA sequence
ttgaactacttaaaaaaaac

SEQ ID NO: 584298 - DNA, 20 bp, Artificial
  CRISPR gRNA sequence
aataaaacaacaaaaaaacc

SEQ ID NO: 584299 - DNA, 20 bp, Artificial
  CRISPR gRNA sequence
ccagatcccttcccttgtta

SEQ ID NO: 584300 - DNA, 20 bp, Artificial
  CRISPR gRNA sequence
tcccttcccttgttacagtg

SEQ ID NO: 584301 - DNA, 20 bp, Artificial
  CRISPR gRNA sequence
ttttttaaaaaatcaatttc

SEQ ID NO: 584302 - DNA, 20 bp, Artificial
  CRISPR gRNA sequence
aatcaatttccagtaaatta

SEQ ID NO: 584303 - DNA, 20 bp, Artificial
  CRISPR gRNA sequence
aatttccagtaaattaaagt

SEQ ID NO: 584304 - DNA, 20 bp, Artificial
  CRISPR gRNA sequence
aattaaagtaagtaaaatct

SEQ ID NO: 584305 - DNA, 20 bp, Artificial
  CRISPR gRNA sequence
aaagtaagtaaaatcttggt

SEQ ID NO: 584306 - DNA, 20 bp, Artificial
  CRISPR gRNA sequence
gtaaaatcttggtaagtgca

SEQ ID NO: 584307 - DNA, 20 bp, Artificial
  CRISPR gRNA sequence
aaatcttggtaagtgcatag

SEQ ID NO: 584308 - DNA, 20 bp, Artificial
  CRISPR gRNA sequence
aatcttggtaagtgcatagt

SEQ ID NO: 584309 - DNA, 20 bp, Artificial
  CRISPR gRNA sequence
atcttggtaagtgcatagta

SEQ ID NO: 584310 - DNA, 20 bp, Artificial
  CRISPR gRNA sequence
tcttggtaagtgcatagtag

SEQ ID NO: 584311 - DNA, 20 bp, Artificial
  CRISPR gRNA sequence
taagtgcatagtaggggatt

SEQ ID NO: 584312 - DNA, 20 bp, Artificial
  CRISPR gRNA sequence
tcagtgacctccacctgctc

SEQ ID NO: 584313 - DNA, 20 bp, Artificial
  CRISPR gRNA sequence
gtgacctccacctgctcaag

SEQ ID NO: 584314 - DNA, 20 bp, Artificial
  CRISPR gRNA sequence
tttcttactatctgtcactt

SEQ ID NO: 584315 - DNA, 20 bp, Artificial
  CRISPR gRNA sequence
ttcttactatctgtcacttg

SEQ ID NO: 584316 - DNA, 20 bp, Artificial
  CRISPR gRNA sequence
ctgtcacttgaggtaatttg

SEQ ID NO: 584317 - DNA, 20 bp, Artificial
  CRISPR gRNA sequence
tgtcacttgaggtaatttga

SEQ ID NO: 584318 - DNA, 20 bp, Artificial
  CRISPR gRNA sequence
atgctgtactttatgtgact

SEQ ID NO: 584319 - DNA, 20 bp, Artificial
  CRISPR gRNA sequence
ctgtactttatgtgacttag

SEQ ID NO: 584320 - DNA, 20 bp, Artificial
  CRISPR gRNA sequence
gtactttatgtgacttagca

SEQ ID NO: 584321 - DNA, 20 bp, Artificial
  CRISPR gRNA sequence
tactttatgtgacttagcag

SEQ ID NO: 584322 - DNA, 20 bp, Artificial
  CRISPR gRNA sequence
actttatgtgacttagcaga

SEQ ID NO: 584323 - DNA, 20 bp, Artificial
  CRISPR gRNA sequence
tatattttattcacaataaa

SEQ ID NO: 584324 - DNA, 20 bp, Artificial
  CRISPR gRNA sequence
atattttattcacaataaaa

SEQ ID NO: 584325 - DNA, 20 bp, Artificial
  CRISPR gRNA sequence
tcacaataaaaaggacatct

SEQ ID NO: 584326 - DNA, 20 bp, Artificial
  CRISPR gRNA sequence
aaaaggacatcttagaaaac

SEQ ID NO: 584327 - DNA, 20 bp, Artificial
  CRISPR gRNA sequence
ttcatgtaccactctctgta

SEQ ID NO: 584328 - DNA, 20 bp, Artificial
  CRISPR gRNA sequence
tcatgtaccactctctgtat

SEQ ID NO: 584329 - DNA, 20 bp, Artificial
  CRISPR gRNA sequence
accactctctgtatgggata

SEQ ID NO: 584330 - DNA, 20 bp, Artificial
  CRISPR gRNA sequence
ccactctctgtatgggataa

SEQ ID NO: 584331 - DNA, 20 bp, Artificial
  CRISPR gRNA sequence
tacacaacacatattttata

SEQ ID NO: 584332 - DNA, 20 bp, Artificial
  CRISPR gRNA sequence
atacagaaaatatacaaatg

SEQ ID NO: 584333 - DNA, 20 bp, Artificial
  CRISPR gRNA sequence
aatatacaaatgcagtgtta

SEQ ID NO: 584334 - DNA, 20 bp, Artificial
  CRISPR gRNA sequence
atatacaaatgcagtgttat

SEQ ID NO: 584335 - DNA, 20 bp, Artificial
  CRISPR gRNA sequence
atacaaatgcagtgttatgg

SEQ ID NO: 584336 - DNA, 20 bp, Artificial
  CRISPR gRNA sequence
tacaaatgcagtgttatggg

SEQ ID NO: 584337 - DNA, 20 bp, Artificial
  CRISPR gRNA sequence
aatgcagtgttatgggagga

SEQ ID NO: 584338 - DNA, 20 bp, Artificial
  CRISPR gRNA sequence
tgggaggaaagccccataaa

SEQ ID NO: 584339 - DNA, 20 bp, Artificial
  CRISPR gRNA sequence
agaattatgaacttattcct

SEQ ID NO: 584340 - DNA, 20 bp, Artificial
  CRISPR gRNA sequence
aattatgaacttattcctaa

SEQ ID NO: 584341 - DNA, 20 bp, Artificial
  CRISPR gRNA sequence
tgaacttattcctaagagtg

SEQ ID NO: 584342 - DNA, 20 bp, Artificial
  CRISPR gRNA sequence
gaacttattcctaagagtgc

SEQ ID NO: 584343 - DNA, 20 bp, Artificial
  CRISPR gRNA sequence
gaaaaatatcctcaaactta

SEQ ID NO: 584344 - DNA, 20 bp, Artificial
  CRISPR gRNA sequence
atatcctcaaacttacagta

SEQ ID NO: 584345 - DNA, 20 bp, Artificial
  CRISPR gRNA sequence
cctcaaacttacagtacagc

SEQ ID NO: 584346 - DNA, 20 bp, Artificial
  CRISPR gRNA sequence
tacagcaagataaaactaaa

SEQ ID NO: 584347 - DNA, 20 bp, Artificial
  CRISPR gRNA sequence
gcaagataaaactaaaaagc

SEQ ID NO: 584348 - DNA, 20 bp, Artificial
  CRISPR gRNA sequence
taaaactaaaaagctagaaa

SEQ ID NO: 584349 - DNA, 20 bp, Artificial
  CRISPR gRNA sequence
aatattacataaaaacctta

SEQ ID NO: 584350 - DNA, 20 bp, Artificial
  CRISPR gRNA sequence
aaaaccttatggaaattcca

SEQ ID NO: 584351 - DNA, 20 bp, Artificial
  CRISPR gRNA sequence
ttatggaaattccaaagttt

SEQ ID NO: 584352 - DNA, 20 bp, Artificial
  CRISPR gRNA sequence
tatggaaattccaaagttta

SEQ ID NO: 584353 - DNA, 20 bp, Artificial
  CRISPR gRNA sequence
caataaatgtaaaaatattc

SEQ ID NO: 584354 - DNA, 20 bp, Artificial
  CRISPR gRNA sequence
aataaatgtaaaaatattca

SEQ ID NO: 584355 - DNA, 20 bp, Artificial
  CRISPR gRNA sequence
atattcaaggtgtcattatt

SEQ ID NO: 584356 - DNA, 20 bp, Artificial
  CRISPR gRNA sequence
caaggtgtcattatttggcc

SEQ ID NO: 584357 - DNA, 20 bp, Artificial
  CRISPR gRNA sequence
tagtaatacactatgataaa

SEQ ID NO: 584358 - DNA, 20 bp, Artificial
  CRISPR gRNA sequence
actatgataaaaagaaacac

SEQ ID NO: 584359 - DNA, 20 bp, Artificial
  CRISPR gRNA sequence
aaagaaacactagcatatca

SEQ ID NO: 584360 - DNA, 20 bp, Artificial
  CRISPR gRNA sequence
actagcatatcacagcttct

SEQ ID NO: 584361 - DNA, 20 bp, Artificial
  CRISPR gRNA sequence
tgccatttgctttgtataac

SEQ ID NO: 584362 - DNA, 20 bp, Artificial
  CRISPR gRNA sequence
catttgctttgtataaccag

SEQ ID NO: 584363 - DNA, 20 bp, Artificial
  CRISPR gRNA sequence
cagcagctcatttttttaaa

SEQ ID NO: 584364 - DNA, 20 bp, Artificial
  CRISPR gRNA sequence
tatcctaacacacccattgc

SEQ ID NO: 584365 - DNA, 20 bp, Artificial
  CRISPR gRNA sequence
accatgatatgaaaccattt

SEQ ID NO: 584366 - DNA, 20 bp, Artificial
  CRISPR gRNA sequence
aaccatttgagattatgctt

SEQ ID NO: 584367 - DNA, 20 bp, Artificial
  CRISPR gRNA sequence
ccatttgagattatgctttg

SEQ ID NO: 584368 - DNA, 20 bp, Artificial
  CRISPR gRNA sequence
tgagattatgctttggagaa

SEQ ID NO: 584369 - DNA, 20 bp, Artificial
  CRISPR gRNA sequence
agcaatgtgatatgactgtt

SEQ ID NO: 584370 - DNA, 20 bp, Artificial
  CRISPR gRNA sequence
tgttcagttttgctttgttc

SEQ ID NO: 584371 - DNA, 20 bp, Artificial
  CRISPR gRNA sequence
gttcagttttgctttgttca

SEQ ID NO: 584372 - DNA, 20 bp, Artificial
  CRISPR gRNA sequence
tcagttttgctttgttcaag

SEQ ID NO: 584373 - DNA, 20 bp, Artificial
  CRISPR gRNA sequence
tttcaatctctattttctaa

SEQ ID NO: 584374 - DNA, 20 bp, Artificial
  CRISPR gRNA sequence
atctctattttctaacagat

SEQ ID NO: 584375 - DNA, 20 bp, Artificial
  CRISPR gRNA sequence
ttctaacagattagaaaata

SEQ ID NO: 584376 - DNA, 20 bp, Artificial
  CRISPR gRNA sequence
gattagaaaatacagattcc

SEQ ID NO: 584377 - DNA, 20 bp, Artificial
  CRISPR gRNA sequence
gaaaatacagattccaagac

SEQ ID NO: 584378 - DNA, 20 bp, Artificial
  CRISPR gRNA sequence
ttccaagactagaacaatac

SEQ ID NO: 584379 - DNA, 20 bp, Artificial
  CRISPR gRNA sequence
agactagaacaatactagtc

SEQ ID NO: 584380 - DNA, 20 bp, Artificial
  CRISPR gRNA sequence
actagaacaatactagtctg

SEQ ID NO: 584381 - DNA, 20 bp, Artificial
  CRISPR gRNA sequence
taataaattcttgtttgata

SEQ ID NO: 584382 - DNA, 20 bp, Artificial
  CRISPR gRNA sequence
acaaattataattcaattca

SEQ ID NO: 584383 - DNA, 20 bp, Artificial
  CRISPR gRNA sequence
caaattataattcaattcac

SEQ ID NO: 584384 - DNA, 20 bp, Artificial
  CRISPR gRNA sequence
tataattcaattcacaggta

SEQ ID NO: 584385 - DNA, 20 bp, Artificial
  CRISPR gRNA sequence
cataatcttgtaatcatatt

SEQ ID NO: 584386 - DNA, 20 bp, Artificial
  CRISPR gRNA sequence
agaaatactatgaaactaaa

SEQ ID NO: 584387 - DNA, 20 bp, Artificial
  CRISPR gRNA sequence
gaaatactatgaaactaaaa

SEQ ID NO: 584388 - DNA, 20 bp, Artificial
  CRISPR gRNA sequence
atactatgaaactaaaaagg

SEQ ID NO: 584389 - DNA, 20 bp, Artificial
  CRISPR gRNA sequence
atgaaactaaaaaggtagta

SEQ ID NO: 584390 - DNA, 20 bp, Artificial
  CRISPR gRNA sequence
actaaaaaggtagtaaagtc

SEQ ID NO: 584391 - DNA, 20 bp, Artificial
  CRISPR gRNA sequence
ggtagtaaagtctagtttca

SEQ ID NO: 584392 - DNA, 20 bp, Artificial
  CRISPR gRNA sequence
aagtttccttttccttttaa

SEQ ID NO: 584393 - DNA, 20 bp, Artificial
  CRISPR gRNA sequence
tccttttccttttaacagct

SEQ ID NO: 584394 - DNA, 20 bp, Artificial
  CRISPR gRNA sequence
tgagctgaaaatttctctat

SEQ ID NO: 584395 - DNA, 20 bp, Artificial
  CRISPR gRNA sequence
ctctattagaaattgctcta

SEQ ID NO: 584396 - DNA, 20 bp, Artificial
  CRISPR gRNA sequence
aaagatttgcactaaaaatg

SEQ ID NO: 584397 - DNA, 20 bp, Artificial
  CRISPR gRNA sequence
agatttgcactaaaaatgca

SEQ ID NO: 584398 - DNA, 20 bp, Artificial
  CRISPR gRNA sequence
aaatgcagagatgaattata

SEQ ID NO: 584399 - DNA, 20 bp, Artificial
  CRISPR gRNA sequence
attatatagtactcaatttt

SEQ ID NO: 584400 - DNA, 20 bp, Artificial
  CRISPR gRNA sequence
tttttaaaaatgcatattaa

SEQ ID NO: 584401 - DNA, 20 bp, Artificial
  CRISPR gRNA sequence
tgcatattaaaagtgttgta

SEQ ID NO: 584402 - DNA, 20 bp, Artificial
  CRISPR gRNA sequence
aaagtgttgtacagctgcaa

SEQ ID NO: 584403 - DNA, 20 bp, Artificial
  CRISPR gRNA sequence
cactctcaatgcattttaaa

SEQ ID NO: 584404 - DNA, 20 bp, Artificial
  CRISPR gRNA sequence
actctcaatgcattttaaaa

SEQ ID NO: 584405 - DNA, 20 bp, Artificial
  CRISPR gRNA sequence
tttaaaaaggcaccaatata

SEQ ID NO: 584406 - DNA, 20 bp, Artificial
  CRISPR gRNA sequence
ggcaccaatataaagaacat

SEQ ID NO: 584407 - DNA, 20 bp, Artificial
  CRISPR gRNA sequence
agtatttaatacattaaatt

SEQ ID NO: 584408 - DNA, 20 bp, Artificial
  CRISPR gRNA sequence
gtatttaatacattaaattc

SEQ ID NO: 584409 - DNA, 20 bp, Artificial
  CRISPR gRNA sequence
aatacattaaattcaggatt

SEQ ID NO: 584410 - DNA, 20 bp, Artificial
  CRISPR gRNA sequence
atacattaaattcaggattt

SEQ ID NO: 584411 - DNA, 20 bp, Artificial
  CRISPR gRNA sequence
acattaaattcaggatttag

SEQ ID NO: 584412 - DNA, 20 bp, Artificial
  CRISPR gRNA sequence
aaattcaggatttaggagac

SEQ ID NO: 584413 - DNA, 20 bp, Artificial
  CRISPR gRNA sequence
tgtatattttaattattttg

SEQ ID NO: 584414 - DNA, 20 bp, Artificial
  CRISPR gRNA sequence
tttaattattttgcagaaac

SEQ ID NO: 584415 - DNA, 20 bp, Artificial
  CRISPR gRNA sequence
taattattttgcagaaactg

SEQ ID NO: 584416 - DNA, 20 bp, Artificial
  CRISPR gRNA sequence
ggagaattaaaaatatgtct

SEQ ID NO: 584417 - DNA, 20 bp, Artificial
  CRISPR gRNA sequence
ttcccactttttttttcttt

SEQ ID NO: 584418 - DNA, 20 bp, Artificial
  CRISPR gRNA sequence
ctttttttttcttttggatt

SEQ ID NO: 584419 - DNA, 20 bp, Artificial
  CRISPR gRNA sequence
tttttttttcttttggattt

SEQ ID NO: 584420 - DNA, 20 bp, Artificial
  CRISPR gRNA sequence
ttttttttcttttggatttg

SEQ ID NO: 584421 - DNA, 20 bp, Artificial
  CRISPR gRNA sequence
tttggatttggggaattttc

SEQ ID NO: 584422 - DNA, 20 bp, Artificial
  CRISPR gRNA sequence
atttggggaattttctggtt

SEQ ID NO: 584423 - DNA, 20 bp, Artificial
  CRISPR gRNA sequence
gggaattttctggtttagaa

SEQ ID NO: 584424 - DNA, 20 bp, Artificial
  CRISPR gRNA sequence
ggtttagaatagtcttcatt

SEQ ID NO: 584425 - DNA, 20 bp, Artificial
  CRISPR gRNA sequence
tagaatagtcttcattcaga

SEQ ID NO: 584426 - DNA, 20 bp, Artificial
  CRISPR gRNA sequence
aaatgtaatttatccatttt

SEQ ID NO: 584427 - DNA, 20 bp, Artificial
  CRISPR gRNA sequence
ttttggacgtgaacaatcca

SEQ ID NO: 584428 - DNA, 20 bp, Artificial
  CRISPR gRNA sequence
aagttaaaaaacaaatcatg

SEQ ID NO: 584429 - DNA, 20 bp, Artificial
  CRISPR gRNA sequence
taaaaaacaaatcatgtagc

SEQ ID NO: 584430 - DNA, 20 bp, Artificial
  CRISPR gRNA sequence
catgtagctagtacctctga

SEQ ID NO: 584431 - DNA, 20 bp, Artificial
  CRISPR gRNA sequence
gctagtacctctgacagttt

SEQ ID NO: 584432 - DNA, 20 bp, Artificial
  CRISPR gRNA sequence
gtttaagttctgcctgaaac

SEQ ID NO: 584433 - DNA, 20 bp, Artificial
  CRISPR gRNA sequence
tttaagttctgcctgaaact

SEQ ID NO: 584434 - DNA, 20 bp, Artificial
  CRISPR gRNA sequence
ttaagttctgcctgaaacta

SEQ ID NO: 584435 - DNA, 20 bp, Artificial
  CRISPR gRNA sequence
taagttctgcctgaaactag

SEQ ID NO: 584436 - DNA, 20 bp, Artificial
  CRISPR gRNA sequence
tgcctgaaactaggggcaca

SEQ ID NO: 584437 - DNA, 20 bp, Artificial
  CRISPR gRNA sequence
gttttttgcttgtattttta

SEQ ID NO: 584438 - DNA, 20 bp, Artificial
  CRISPR gRNA sequence
gtctgctctttttgtaccct

SEQ ID NO: 584439 - DNA, 20 bp, Artificial
  CRISPR gRNA sequence
tgtaccctaagaaatcattt

SEQ ID NO: 584440 - DNA, 20 bp, Artificial
  CRISPR gRNA sequence
taccctaagaaatcattttg

SEQ ID NO: 584441 - DNA, 20 bp, Artificial
  CRISPR gRNA sequence
ctaagaaatcattttggaga

SEQ ID NO: 584442 - DNA, 20 bp, Artificial
  CRISPR gRNA sequence
taagaaatcattttggagat

SEQ ID NO: 584443 - DNA, 20 bp, Artificial
  CRISPR gRNA sequence
agataggatgaaataaaatt

SEQ ID NO: 584444 - DNA, 20 bp, Artificial
  CRISPR gRNA sequence
taggatgaaataaaatttgg

SEQ ID NO: 584445 - DNA, 20 bp, Artificial
  CRISPR gRNA sequence
atgaaataaaatttggaaga

SEQ ID NO: 584446 - DNA, 20 bp, Artificial
  CRISPR gRNA sequence
aataaaatttggaagatagt

SEQ ID NO: 584447 - DNA, 20 bp, Artificial
  CRISPR gRNA sequence
taaacatttataaaatacca

SEQ ID NO: 584448 - DNA, 20 bp, Artificial
  CRISPR gRNA sequence
ataaaataccaaagacttca

SEQ ID NO: 584449 - DNA, 20 bp, Artificial
  CRISPR gRNA sequence
caaagacttcatggttttgt

SEQ ID NO: 584450 - DNA, 20 bp, Artificial
  CRISPR gRNA sequence
gttttgtgagttgtacaact

SEQ ID NO: 584451 - DNA, 20 bp, Artificial
  CRISPR gRNA sequence
aaactataaaaacaaaatac

SEQ ID NO: 584452 - DNA, 20 bp, Artificial
  CRISPR gRNA sequence
aactataaaaacaaaatacc

SEQ ID NO: 584453 - DNA, 20 bp, Artificial
  CRISPR gRNA sequence
gtctttctctatttgccaat

SEQ ID NO: 584454 - DNA, 20 bp, Artificial
  CRISPR gRNA sequence
tctttgaatgtatatccaat

SEQ ID NO: 584455 - DNA, 20 bp, Artificial
  CRISPR gRNA sequence
tttgtttcactttgttctgt

SEQ ID NO: 584456 - DNA, 20 bp, Artificial
  CRISPR gRNA sequence
gtttcactttgttctgtaag

SEQ ID NO: 584457 - DNA, 20 bp, Artificial
  CRISPR gRNA sequence
ttgttctgtaagtagataat

SEQ ID NO: 584458 - DNA, 20 bp, Artificial
  CRISPR gRNA sequence
tgttctgtaagtagataata

SEQ ID NO: 584459 - DNA, 20 bp, Artificial
  CRISPR gRNA sequence
aagtagataataaggaccca

SEQ ID NO: 584460 - DNA, 20 bp, Artificial
  CRISPR gRNA sequence
ataataaggacccaaagttt

SEQ ID NO: 584461 - DNA, 20 bp, Artificial
  CRISPR gRNA sequence
aggacccaaagttttagttt

SEQ ID NO: 584462 - DNA, 20 bp, Artificial
  CRISPR gRNA sequence
gacccaaagttttagtttaa

SEQ ID NO: 584463 - DNA, 20 bp, Artificial
  CRISPR gRNA sequence
tttagtttaagagttgccac

SEQ ID NO: 584464 - DNA, 20 bp, Artificial
  CRISPR gRNA sequence
aagagttgccactggtccta

SEQ ID NO: 584465 - DNA, 20 bp, Artificial
  CRISPR gRNA sequence
cactggtcctaaagacacac

SEQ ID NO: 584466 - DNA, 20 bp, Artificial
  CRISPR gRNA sequence
agacacactagtaacttctt

SEQ ID NO: 584467 - DNA, 20 bp, Artificial
  CRISPR gRNA sequence
attcctattacgacctgata

SEQ ID NO: 584468 - DNA, 20 bp, Artificial
  CRISPR gRNA sequence
agtaaacccaactaatttct

SEQ ID NO: 584469 - DNA, 20 bp, Artificial
  CRISPR gRNA sequence
tttccatgaattctctttaa

SEQ ID NO: 584470 - DNA, 20 bp, Artificial
  CRISPR gRNA sequence
tctttaaaagaatgtgtgtg

SEQ ID NO: 584471 - DNA, 20 bp, Artificial
  CRISPR gRNA sequence
tacaattgcctgtatgtatg

SEQ ID NO: 584472 - DNA, 20 bp, Artificial
  CRISPR gRNA sequence
acaattgcctgtatgtatgt

SEQ ID NO: 584473 - DNA, 20 bp, Artificial
  CRISPR gRNA sequence
caattgcctgtatgtatgta

SEQ ID NO: 584474 - DNA, 20 bp, Artificial
  CRISPR gRNA sequence
aattgcctgtatgtatgtag

SEQ ID NO: 584475 - DNA, 20 bp, Artificial
  CRISPR gRNA sequence
ttgcctgtatgtatgtaggg

SEQ ID NO: 584476 - DNA, 20 bp, Artificial
  CRISPR gRNA sequence
gggagatactttctactacg

SEQ ID NO: 584477 - DNA, 20 bp, Artificial
  CRISPR gRNA sequence
tctactacgtagccaaatct

SEQ ID NO: 584478 - DNA, 20 bp, Artificial
  CRISPR gRNA sequence
acgtagccaaatctaagtcg

SEQ ID NO: 584479 - DNA, 20 bp, Artificial
  CRISPR gRNA sequence
ttttcccaattttgtccctt

SEQ ID NO: 584480 - DNA, 20 bp, Artificial
  CRISPR gRNA sequence
tttcccaattttgtcccttt

SEQ ID NO: 584481 - DNA, 20 bp, Artificial
  CRISPR gRNA sequence
gtccctttaggaaatctcaa

SEQ ID NO: 584482 - DNA, 20 bp, Artificial
  CRISPR gRNA sequence
atccctttccctgtcttaaa

SEQ ID NO: 584483 - DNA, 20 bp, Artificial
  CRISPR gRNA sequence
tccctttccctgtcttaaaa

SEQ ID NO: 584484 - DNA, 20 bp, Artificial
  CRISPR gRNA sequence
ctgtcttaaaaaggtccaat

SEQ ID NO: 584485 - DNA, 20 bp, Artificial
  CRISPR gRNA sequence
ttaaaaaggtccaattagaa

SEQ ID NO: 584486 - DNA, 20 bp, Artificial
  CRISPR gRNA sequence
gtccaattagaatggctttt

SEQ ID NO: 584487 - DNA, 20 bp, Artificial
  CRISPR gRNA sequence
tgagcatgattcatcactgt

SEQ ID NO: 584488 - DNA, 20 bp, Artificial
  CRISPR gRNA sequence
agcatgattcatcactgtca

SEQ ID NO: 584489 - DNA, 20 bp, Artificial
  CRISPR gRNA sequence
catgattcatcactgtcaga

SEQ ID NO: 584490 - DNA, 20 bp, Artificial
  CRISPR gRNA sequence
tgattcatcactgtcagaga

SEQ ID NO: 584491 - DNA, 20 bp, Artificial
  CRISPR gRNA sequence
gattcatcactgtcagagag

SEQ ID NO: 584492 - DNA, 20 bp, Artificial
  CRISPR gRNA sequence
atcactgtcagagagaggct

SEQ ID NO: 584493 - DNA, 20 bp, Artificial
  CRISPR gRNA sequence
gagaggctaagataaaattc

SEQ ID NO: 584494 - DNA, 20 bp, Artificial
  CRISPR gRNA sequence
agaggctaagataaaattct

SEQ ID NO: 584495 - DNA, 20 bp, Artificial
  CRISPR gRNA sequence
gataaaattctgggcaaaat

SEQ ID NO: 584496 - DNA, 20 bp, Artificial
  CRISPR gRNA sequence
ataaaattctgggcaaaatt

SEQ ID NO: 584497 - DNA, 20 bp, Artificial
  CRISPR gRNA sequence
taaaattctgggcaaaatta

SEQ ID NO: 584498 - DNA, 20 bp, Artificial
  CRISPR gRNA sequence
ttctgggcaaaattagggca

SEQ ID NO: 584499 - DNA, 20 bp, Artificial
  CRISPR gRNA sequence
attctgaacttttgccaaac

SEQ ID NO: 584500 - DNA, 20 bp, Artificial
  CRISPR gRNA sequence
ttttgccaaactggaaaata

SEQ ID NO: 584501 - DNA, 20 bp, Artificial
  CRISPR gRNA sequence
tgccaaactggaaaatacag

SEQ ID NO: 584502 - DNA, 20 bp, Artificial
  CRISPR gRNA sequence
gaaatctcacctaaacaaac

SEQ ID NO: 584503 - DNA, 20 bp, Artificial
  CRISPR gRNA sequence
aaatctcacctaaacaaact

SEQ ID NO: 584504 - DNA, 20 bp, Artificial
  CRISPR gRNA sequence
tatgtaaaacttgatttatt

SEQ ID NO: 584505 - DNA, 20 bp, Artificial
  CRISPR gRNA sequence
ctgactcttatgtttatttt

SEQ ID NO: 584506 - DNA, 20 bp, Artificial
  CRISPR gRNA sequence
accttgcgtatttccttttg

SEQ ID NO: 584507 - DNA, 20 bp, Artificial
  CRISPR gRNA sequence
gcgtatttccttttgaagaa

SEQ ID NO: 584508 - DNA, 20 bp, Artificial
  CRISPR gRNA sequence
cgtatttccttttgaagaaa

SEQ ID NO: 584509 - DNA, 20 bp, Artificial
  CRISPR gRNA sequence
ggcatgcacatataaccatc

SEQ ID NO: 584510 - DNA, 20 bp, Artificial
  CRISPR gRNA sequence
catgcacatataaccatcca

SEQ ID NO: 584511 - DNA, 20 bp, Artificial
  CRISPR gRNA sequence
aattgtccctgccacaccct

SEQ ID NO: 584512 - DNA, 20 bp, Artificial
  CRISPR gRNA sequence
acctctttctgttcctcatg

SEQ ID NO: 584513 - DNA, 20 bp, Artificial
  CRISPR gRNA sequence
ctttctgttcctcatgaagc

SEQ ID NO: 584514 - DNA, 20 bp, Artificial
  CRISPR gRNA sequence
tttctgttcctcatgaagct

SEQ ID NO: 584515 - DNA, 20 bp, Artificial
  CRISPR gRNA sequence
ctgttcctcatgaagctagg

SEQ ID NO: 584516 - DNA, 20 bp, Artificial
  CRISPR gRNA sequence
tcatgaagctaggaagatac

SEQ ID NO: 584517 - DNA, 20 bp, Artificial
  CRISPR gRNA sequence
aagatacaagtatatgcttg

SEQ ID NO: 584518 - DNA, 20 bp, Artificial
  CRISPR gRNA sequence
actaactaccttcaataaaa

SEQ ID NO: 584519 - DNA, 20 bp, Artificial
  CRISPR gRNA sequence
caataaaacagattcccaaa

SEQ ID NO: 584520 - DNA, 20 bp, Artificial
  CRISPR gRNA sequence
gattcccaaaaagatgaaat

SEQ ID NO: 584521 - DNA, 20 bp, Artificial
  CRISPR gRNA sequence
ccaaaaagatgaaatcagaa

SEQ ID NO: 584522 - DNA, 20 bp, Artificial
  CRISPR gRNA sequence
caaaaagatgaaatcagaaa

SEQ ID NO: 584523 - DNA, 20 bp, Artificial
  CRISPR gRNA sequence
aagatgaaatcagaaaagga

SEQ ID NO: 584524 - DNA, 20 bp, Artificial
  CRISPR gRNA sequence
atcagaaaaggaaagtgcct

SEQ ID NO: 584525 - DNA, 20 bp, Artificial
  CRISPR gRNA sequence
tgcctcagcactgtcttcat

SEQ ID NO: 584526 - DNA, 20 bp, Artificial
  CRISPR gRNA sequence
gcctcagcactgtcttcata

SEQ ID NO: 584527 - DNA, 20 bp, Artificial
  CRISPR gRNA sequence
agcactgtcttcataaggtt

SEQ ID NO: 584528 - DNA, 20 bp, Artificial
  CRISPR gRNA sequence
gcactgtcttcataaggttt

SEQ ID NO: 584529 - DNA, 20 bp, Artificial
  CRISPR gRNA sequence
cactgtcttcataaggttta

SEQ ID NO: 584530 - DNA, 20 bp, Artificial
  CRISPR gRNA sequence
gtttagggtccacctaaatt

SEQ ID NO: 584531 - DNA, 20 bp, Artificial
  CRISPR gRNA sequence
acctaaatttagtttcatcc

SEQ ID NO: 584532 - DNA, 20 bp, Artificial
  CRISPR gRNA sequence
cctaaatttagtttcatcct

SEQ ID NO: 584533 - DNA, 20 bp, Artificial
  CRISPR gRNA sequence
ctaaatttagtttcatcctg

SEQ ID NO: 584534 - DNA, 20 bp, Artificial
  CRISPR gRNA sequence
aatttagtttcatcctgggg

SEQ ID NO: 584535 - DNA, 20 bp, Artificial
  CRISPR gRNA sequence
atttagtttcatcctggggc

SEQ ID NO: 584536 - DNA, 20 bp, Artificial
  CRISPR gRNA sequence
tagtttcatcctggggcagg

SEQ ID NO: 584537 - DNA, 20 bp, Artificial
  CRISPR gRNA sequence
tcatatactgaaaaaaaaat

SEQ ID NO: 584538 - DNA, 20 bp, Artificial
  CRISPR gRNA sequence
tatactgaaaaaaaaataag

SEQ ID NO: 584539 - DNA, 20 bp, Artificial
  CRISPR gRNA sequence
atactgaaaaaaaaataagt

SEQ ID NO: 584540 - DNA, 20 bp, Artificial
  CRISPR gRNA sequence
ctgaaaaaaaaataagtagg

SEQ ID NO: 584541 - DNA, 20 bp, Artificial
  CRISPR gRNA sequence
ataagtaggaagaaaattca

SEQ ID NO: 584542 - DNA, 20 bp, Artificial
  CRISPR gRNA sequence
agaaaattcatagataatgc

SEQ ID NO: 584543 - DNA, 20 bp, Artificial
  CRISPR gRNA sequence
aaattcatagataatgccag

SEQ ID NO: 584544 - DNA, 20 bp, Artificial
  CRISPR gRNA sequence
tgccagcagaaattcgcaca

SEQ ID NO: 584545 - DNA, 20 bp, Artificial
  CRISPR gRNA sequence
ccaaatgtttccttaaattg

SEQ ID NO: 584546 - DNA, 20 bp, Artificial
  CRISPR gRNA sequence
gtttccttaaattgcagtaa

SEQ ID NO: 584547 - DNA, 20 bp, Artificial
  CRISPR gRNA sequence
aaattatttacctcatccaa

SEQ ID NO: 584548 - DNA, 20 bp, Artificial
  CRISPR gRNA sequence
aattatttacctcatccaaa

SEQ ID NO: 584549 - DNA, 20 bp, Artificial
  CRISPR gRNA sequence
tcatccaaaaggaaaaaaaa

SEQ ID NO: 584550 - DNA, 20 bp, Artificial
  CRISPR gRNA sequence
atggcatcccaattattatt

SEQ ID NO: 584551 - DNA, 20 bp, Artificial
  CRISPR gRNA sequence
tggcatcccaattattattt

SEQ ID NO: 584552 - DNA, 20 bp, Artificial
  CRISPR gRNA sequence
gcatcccaattattatttgg

SEQ ID NO: 584553 - DNA, 20 bp, Artificial
  CRISPR gRNA sequence
tcccaattattatttgggag

SEQ ID NO: 584554 - DNA, 20 bp, Artificial
  CRISPR gRNA sequence
aattattatttgggagtggt

SEQ ID NO: 584555 - DNA, 20 bp, Artificial
  CRISPR gRNA sequence
attattatttgggagtggtt

SEQ ID NO: 584556 - DNA, 20 bp, Artificial
  CRISPR gRNA sequence
attatttgggagtggttggg

SEQ ID NO: 584557 - DNA, 20 bp, Artificial
  CRISPR gRNA sequence
ttatttgggagtggttgggt

SEQ ID NO: 584558 - DNA, 20 bp, Artificial
  CRISPR gRNA sequence
tatttgggagtggttgggtg

SEQ ID NO: 584559 - DNA, 20 bp, Artificial
  CRISPR gRNA sequence
atttgggagtggttgggtgg

SEQ ID NO: 584560 - DNA, 20 bp, Artificial
  CRISPR gRNA sequence
tttgggagtggttgggtggg

SEQ ID NO: 584561 - DNA, 20 bp, Artificial
  CRISPR gRNA sequence
ttgggagtggttgggtgggg

SEQ ID NO: 584562 - DNA, 20 bp, Artificial
  CRISPR gRNA sequence
tgggagtggttgggtggggg

SEQ ID NO: 584563 - DNA, 20 bp, Artificial
  CRISPR gRNA sequence
gggagtggttgggtgggggg

SEQ ID NO: 584564 - DNA, 20 bp, Artificial
  CRISPR gRNA sequence
gtggttgggtgggggggggt

SEQ ID NO: 584565 - DNA, 20 bp, Artificial
  CRISPR gRNA sequence
ttgggtgggggggggtgagc

SEQ ID NO: 584566 - DNA, 20 bp, Artificial
  CRISPR gRNA sequence
aaacatgctttatctttaaa

SEQ ID NO: 584567 - DNA, 20 bp, Artificial
  CRISPR gRNA sequence
aacatgctttatctttaaat

SEQ ID NO: 584568 - DNA, 20 bp, Artificial
  CRISPR gRNA sequence
ttgtatgttcactatgtacc

SEQ ID NO: 584569 - DNA, 20 bp, Artificial
  CRISPR gRNA sequence
tgtatgttcactatgtacca

SEQ ID NO: 584570 - DNA, 20 bp, Artificial
  CRISPR gRNA sequence
tcactatgtaccaaggcatg

SEQ ID NO: 584571 - DNA, 20 bp, Artificial
  CRISPR gRNA sequence
gcagaaaaaaaaaaatgaaa

SEQ ID NO: 584572 - DNA, 20 bp, Artificial
  CRISPR gRNA sequence
cattctatatatctctgttt

SEQ ID NO: 584573 - DNA, 20 bp, Artificial
  CRISPR gRNA sequence
tctgttttggtgcattccct

SEQ ID NO: 584574 - DNA, 20 bp, Artificial
  CRISPR gRNA sequence
ggtgcattcccttagattta

SEQ ID NO: 584575 - DNA, 20 bp, Artificial
  CRISPR gRNA sequence
gtgcattcccttagatttaa

SEQ ID NO: 584576 - DNA, 20 bp, Artificial
  CRISPR gRNA sequence
tgcattcccttagatttaaa

SEQ ID NO: 584577 - DNA, 20 bp, Artificial
  CRISPR gRNA sequence
gcattcccttagatttaaag

SEQ ID NO: 584578 - DNA, 20 bp, Artificial
  CRISPR gRNA sequence
cattcccttagatttaaagg

SEQ ID NO: 584579 - DNA, 20 bp, Artificial
  CRISPR gRNA sequence
tcccttagatttaaaggggg

SEQ ID NO: 584580 - DNA, 20 bp, Artificial
  CRISPR gRNA sequence
tagatttaaagggggcagtt

SEQ ID NO: 584581 - DNA, 20 bp, Artificial
  CRISPR gRNA sequence
tttcccaaaaataattatga

SEQ ID NO: 584582 - DNA, 20 bp, Artificial
  CRISPR gRNA sequence
ttcccaaaaataattatgac

SEQ ID NO: 584583 - DNA, 20 bp, Artificial
  CRISPR gRNA sequence
tcccaaaaataattatgaca

SEQ ID NO: 584584 - DNA, 20 bp, Artificial
  CRISPR gRNA sequence
aaaataattatgacagggac

SEQ ID NO: 584585 - DNA, 20 bp, Artificial
  CRISPR gRNA sequence
ataattatgacagggactag

SEQ ID NO: 584586 - DNA, 20 bp, Artificial
  CRISPR gRNA sequence
attatgacagggactagtag

SEQ ID NO: 584587 - DNA, 20 bp, Artificial
  CRISPR gRNA sequence
tatgacagggactagtagaa

SEQ ID NO: 584588 - DNA, 20 bp, Artificial
  CRISPR gRNA sequence
tgacagggactagtagaaga

SEQ ID NO: 584589 - DNA, 20 bp, Artificial
  CRISPR gRNA sequence
gggactagtagaagagagct

SEQ ID NO: 584590 - DNA, 20 bp, Artificial
  CRISPR gRNA sequence
gagttctaaccatttttgcc

SEQ ID NO: 584591 - DNA, 20 bp, Artificial
  CRISPR gRNA sequence
taaccatttttgcctagttc

SEQ ID NO: 584592 - DNA, 20 bp, Artificial
  CRISPR gRNA sequence
ttgcctagttctagctgtgt

SEQ ID NO: 584593 - DNA, 20 bp, Artificial
  CRISPR gRNA sequence
gttctagctgtgttagtgct

SEQ ID NO: 584594 - DNA, 20 bp, Artificial
  CRISPR gRNA sequence
ctagctgtgttagtgcttag

SEQ ID NO: 584595 - DNA, 20 bp, Artificial
  CRISPR gRNA sequence
tgttagtgcttagaagtgct

SEQ ID NO: 584596 - DNA, 20 bp, Artificial
  CRISPR gRNA sequence
agtgcttagaagtgcttagc

SEQ ID NO: 584597 - DNA, 20 bp, Artificial
  CRISPR gRNA sequence
gctggtgcctaccatttaaa

SEQ ID NO: 584598 - DNA, 20 bp, Artificial
  CRISPR gRNA sequence
cctaccatttaaatagcaaa

SEQ ID NO: 584599 - DNA, 20 bp, Artificial
  CRISPR gRNA sequence
ccatttaaatagcaaatagt

SEQ ID NO: 584600 - DNA, 20 bp, Artificial
  CRISPR gRNA sequence
ttaaatagcaaatagtaagc

SEQ ID NO: 584601 - DNA, 20 bp, Artificial
  CRISPR gRNA sequence
caaatagtaagctggaaaat

SEQ ID NO: 584602 - DNA, 20 bp, Artificial
  CRISPR gRNA sequence
agtaagctggaaaatgagtt

SEQ ID NO: 584603 - DNA, 20 bp, Artificial
  CRISPR gRNA sequence
taagctggaaaatgagttaa

SEQ ID NO: 584604 - DNA, 20 bp, Artificial
  CRISPR gRNA sequence
gctggaaaatgagttaagag

SEQ ID NO: 584605 - DNA, 20 bp, Artificial
  CRISPR gRNA sequence
aaatgagttaagagcagtat

SEQ ID NO: 584606 - DNA, 20 bp, Artificial
  CRISPR gRNA sequence
aatgagttaagagcagtatt

SEQ ID NO: 584607 - DNA, 20 bp, Artificial
  CRISPR gRNA sequence
atgagttaagagcagtattg

SEQ ID NO: 584608 - DNA, 20 bp, Artificial
  CRISPR gRNA sequence
tgtccacaattctcttgact

SEQ ID NO: 584609 - DNA, 20 bp, Artificial
  CRISPR gRNA sequence
ttctcataccacactgtatt

SEQ ID NO: 584610 - DNA, 20 bp, Artificial
  CRISPR gRNA sequence
tgtattaagatacataattt

SEQ ID NO: 584611 - DNA, 20 bp, Artificial
  CRISPR gRNA sequence
catcctatttaatgatcctt

SEQ ID NO: 584612 - DNA, 20 bp, Artificial
  CRISPR gRNA sequence
tcctatttaatgatccttta

SEQ ID NO: 584613 - DNA, 20 bp, Artificial
  CRISPR gRNA sequence
tatttaatgatcctttagag

SEQ ID NO: 584614 - DNA, 20 bp, Artificial
  CRISPR gRNA sequence
tgatcctttagagcagttat

SEQ ID NO: 584615 - DNA, 20 bp, Artificial
  CRISPR gRNA sequence
agttatcagttactgcctaa

SEQ ID NO: 584616 - DNA, 20 bp, Artificial
  CRISPR gRNA sequence
gttactgcctaacagaattt

SEQ ID NO: 584617 - DNA, 20 bp, Artificial
  CRISPR gRNA sequence
agaatttcagtattcacaaa

SEQ ID NO: 584618 - DNA, 20 bp, Artificial
  CRISPR gRNA sequence
cagtattcacaaatggttat

SEQ ID NO: 584619 - DNA, 20 bp, Artificial
  CRISPR gRNA sequence
caaatggttatcagataatc

SEQ ID NO: 584620 - DNA, 20 bp, Artificial
  CRISPR gRNA sequence
gttatcagataatccagtca

SEQ ID NO: 584621 - DNA, 20 bp, Artificial
  CRISPR gRNA sequence
tcagataatccagtcacagt

SEQ ID NO: 584622 - DNA, 20 bp, Artificial
  CRISPR gRNA sequence
cagataatccagtcacagtc

SEQ ID NO: 584623 - DNA, 20 bp, Artificial
  CRISPR gRNA sequence
tcaggtctgtcctccccaaa

SEQ ID NO: 584624 - DNA, 20 bp, Artificial
  CRISPR gRNA sequence
ggtctgtcctccccaaacag

SEQ ID NO: 584625 - DNA, 20 bp, Artificial
  CRISPR gRNA sequence
ctgtcctccccaaacagaag

SEQ ID NO: 584626 - DNA, 20 bp, Artificial
  CRISPR gRNA sequence
cctccccaaacagaagcagc

SEQ ID NO: 584627 - DNA, 20 bp, Artificial
  CRISPR gRNA sequence
agcagcaagttctgccttcc

SEQ ID NO: 584628 - DNA, 20 bp, Artificial
  CRISPR gRNA sequence
tgacttgaatcaatatcact

SEQ ID NO: 584629 - DNA, 20 bp, Artificial
  CRISPR gRNA sequence
tcggttcctcccctctaatg

SEQ ID NO: 584630 - DNA, 20 bp, Artificial
  CRISPR gRNA sequence
ttcctcccctctaatgtggc

SEQ ID NO: 584631 - DNA, 20 bp, Artificial
  CRISPR gRNA sequence
tctaatgtggctggactgca

SEQ ID NO: 584632 - DNA, 20 bp, Artificial
  CRISPR gRNA sequence
gctggactgcaaagaaaaaa

SEQ ID NO: 584633 - DNA, 20 bp, Artificial
  CRISPR gRNA sequence
tggactgcaaagaaaaaaca

SEQ ID NO: 584634 - DNA, 20 bp, Artificial
  CRISPR gRNA sequence
taaaatctgcacatgaaata

SEQ ID NO: 584635 - DNA, 20 bp, Artificial
  CRISPR gRNA sequence
tatggcaacctataccatgt

SEQ ID NO: 584636 - DNA, 20 bp, Artificial
  CRISPR gRNA sequence
atggcaacctataccatgta

SEQ ID NO: 584637 - DNA, 20 bp, Artificial
  CRISPR gRNA sequence
tggcaacctataccatgtaa

SEQ ID NO: 584638 - DNA, 20 bp, Artificial
  CRISPR gRNA sequence
ggcaacctataccatgtaag

SEQ ID NO: 584639 - DNA, 20 bp, Artificial
  CRISPR gRNA sequence
tgtaaggggaattctatact

SEQ ID NO: 584640 - DNA, 20 bp, Artificial
  CRISPR gRNA sequence
gtaaggggaattctatacta

SEQ ID NO: 584641 - DNA, 20 bp, Artificial
  CRISPR gRNA sequence
taaggggaattctatactaa

SEQ ID NO: 584642 - DNA, 20 bp, Artificial
  CRISPR gRNA sequence
gaattctatactaagggatt

SEQ ID NO: 584643 - DNA, 20 bp, Artificial
  CRISPR gRNA sequence
gattgagattcatttctgac

SEQ ID NO: 584644 - DNA, 20 bp, Artificial
  CRISPR gRNA sequence
attgagattcatttctgaca

SEQ ID NO: 584645 - DNA, 20 bp, Artificial
  CRISPR gRNA sequence
acttacacaattaaatgttt

SEQ ID NO: 584646 - DNA, 20 bp, Artificial
  CRISPR gRNA sequence
acaattaaatgttttggaaa

SEQ ID NO: 584647 - DNA, 20 bp, Artificial
  CRISPR gRNA sequence
tttggaaacagaaaaatgtg

SEQ ID NO: 584648 - DNA, 20 bp, Artificial
  CRISPR gRNA sequence
ttggaaacagaaaaatgtgc

SEQ ID NO: 584649 - DNA, 20 bp, Artificial
  CRISPR gRNA sequence
aaatgtgcaggactttcctt

SEQ ID NO: 584650 - DNA, 20 bp, Artificial
  CRISPR gRNA sequence
aatgtgcaggactttccttt

SEQ ID NO: 584651 - DNA, 20 bp, Artificial
  CRISPR gRNA sequence
atgtgcaggactttcctttg

SEQ ID NO: 584652 - DNA, 20 bp, Artificial
  CRISPR gRNA sequence
tgtgcaggactttcctttgg

SEQ ID NO: 584653 - DNA, 20 bp, Artificial
  CRISPR gRNA sequence
ttgggggttctgtcacattc

SEQ ID NO: 584654 - DNA, 20 bp, Artificial
  CRISPR gRNA sequence
tctgtcacattctagactcc

SEQ ID NO: 584655 - DNA, 20 bp, Artificial
  CRISPR gRNA sequence
gtcacattctagactccaag

SEQ ID NO: 584656 - DNA, 20 bp, Artificial
  CRISPR gRNA sequence
tcacattctagactccaaga

SEQ ID NO: 584657 - DNA, 20 bp, Artificial
  CRISPR gRNA sequence
cacattctagactccaagaa

SEQ ID NO: 584658 - DNA, 20 bp, Artificial
  CRISPR gRNA sequence
ctagactccaagaagggtaa

SEQ ID NO: 584659 - DNA, 20 bp, Artificial
  CRISPR gRNA sequence
gtttcttttatctgttgtcc

SEQ ID NO: 584660 - DNA, 20 bp, Artificial
  CRISPR gRNA sequence
tttcttttatctgttgtcca

SEQ ID NO: 584661 - DNA, 20 bp, Artificial
  CRISPR gRNA sequence
tttatctgttgtccaaggta

SEQ ID NO: 584662 - DNA, 20 bp, Artificial
  CRISPR gRNA sequence
ttatctgttgtccaaggtac

SEQ ID NO: 584663 - DNA, 20 bp, Artificial
  CRISPR gRNA sequence
tgtccaaggtacaggttaca

SEQ ID NO: 584664 - DNA, 20 bp, Artificial
  CRISPR gRNA sequence
ccaaggtacaggttacaaag

SEQ ID NO: 584665 - DNA, 20 bp, Artificial
  CRISPR gRNA sequence
cattcccttttctttgcaac

SEQ ID NO: 584666 - DNA, 20 bp, Artificial
  CRISPR gRNA sequence
ttcccttttctttgcaacaa

SEQ ID NO: 584667 - DNA, 20 bp, Artificial
  CRISPR gRNA sequence
ccttttctttgcaacaagag

SEQ ID NO: 584668 - DNA, 20 bp, Artificial
  CRISPR gRNA sequence
aagagtagtaaatactactg

SEQ ID NO: 584669 - DNA, 20 bp, Artificial
  CRISPR gRNA sequence
tgaagaaatgctaaaataaa

SEQ ID NO: 584670 - DNA, 20 bp, Artificial
  CRISPR gRNA sequence
aatgctaaaataaatagccc

SEQ ID NO: 584671 - DNA, 20 bp, Artificial
  CRISPR gRNA sequence
gccctagttctgtaacctta

SEQ ID NO: 584672 - DNA, 20 bp, Artificial
  CRISPR gRNA sequence
ccctagttctgtaaccttac

SEQ ID NO: 584673 - DNA, 20 bp, Artificial
  CRISPR gRNA sequence
cctagttctgtaaccttaca

SEQ ID NO: 584674 - DNA, 20 bp, Artificial
  CRISPR gRNA sequence
tctgtaaccttacagggttc

SEQ ID NO: 584675 - DNA, 20 bp, Artificial
  CRISPR gRNA sequence
ccttacagggttcaagttac

SEQ ID NO: 584676 - DNA, 20 bp, Artificial
  CRISPR gRNA sequence
agggttcaagttaccagatt

SEQ ID NO: 584677 - DNA, 20 bp, Artificial
  CRISPR gRNA sequence
gggttcaagttaccagattc

SEQ ID NO: 584678 - DNA, 20 bp, Artificial
  CRISPR gRNA sequence
ttaccagattcaggccaaat

SEQ ID NO: 584679 - DNA, 20 bp, Artificial
  CRISPR gRNA sequence
gccaaattagcaattgctct

SEQ ID NO: 584680 - DNA, 20 bp, Artificial
  CRISPR gRNA sequence
ccaaattagcaattgctctg

SEQ ID NO: 584681 - DNA, 20 bp, Artificial
  CRISPR gRNA sequence
aaattagcaattgctctgag

SEQ ID NO: 584682 - DNA, 20 bp, Artificial
  CRISPR gRNA sequence
ttgctctgaggagattttga

SEQ ID NO: 584683 - DNA, 20 bp, Artificial
  CRISPR gRNA sequence
tgaggagattttgaaagaaa

SEQ ID NO: 584684 - DNA, 20 bp, Artificial
  CRISPR gRNA sequence
attttgaaagaaacagccga

SEQ ID NO: 584685 - DNA, 20 bp, Artificial
  CRISPR gRNA sequence
ttttgaaagaaacagccgac

SEQ ID NO: 584686 - DNA, 20 bp, Artificial
  CRISPR gRNA sequence
tgaaagaaacagccgacagg

SEQ ID NO: 584687 - DNA, 20 bp, Artificial
  CRISPR gRNA sequence
cagccgacaggaagactttt

SEQ ID NO: 584688 - DNA, 20 bp, Artificial
  CRISPR gRNA sequence
cttttaagaccttctactcg

SEQ ID NO: 584689 - DNA, 20 bp, Artificial
  CRISPR gRNA sequence
tttaagaccttctactcgaa

SEQ ID NO: 584690 - DNA, 20 bp, Artificial
  CRISPR gRNA sequence
gaccttctactcgaagagta

SEQ ID NO: 584691 - DNA, 20 bp, Artificial
  CRISPR gRNA sequence
accttctactcgaagagtaa

SEQ ID NO: 584692 - DNA, 20 bp, Artificial
  CRISPR gRNA sequence
agtaaaggatgaatgaacta

SEQ ID NO: 584693 - DNA, 20 bp, Artificial
  CRISPR gRNA sequence
aaggatgaatgaactatgga

SEQ ID NO: 584694 - DNA, 20 bp, Artificial
  CRISPR gRNA sequence
atgaactatggacagaacac

SEQ ID NO: 584695 - DNA, 20 bp, Artificial
  CRISPR gRNA sequence
tgaactatggacagaacacc

SEQ ID NO: 584696 - DNA, 20 bp, Artificial
  CRISPR gRNA sequence
aactatggacagaacaccgg

SEQ ID NO: 584697 - DNA, 20 bp, Artificial
  CRISPR gRNA sequence
actatggacagaacaccggg

SEQ ID NO: 584698 - DNA, 20 bp, Artificial
  CRISPR gRNA sequence
ggtcacatcttgaaaaaaac

SEQ ID NO: 584699 - DNA, 20 bp, Artificial
  CRISPR gRNA sequence
tcttgaaaaaaactagtgaa

SEQ ID NO: 584700 - DNA, 20 bp, Artificial
  CRISPR gRNA sequence
ttgaaaaaaactagtgaaaa

SEQ ID NO: 584701 - DNA, 20 bp, Artificial
  CRISPR gRNA sequence
actagtgaaaagagaaatac

SEQ ID NO: 584702 - DNA, 20 bp, Artificial
  CRISPR gRNA sequence
tgaaaagagaaataccagaa

SEQ ID NO: 584703 - DNA, 20 bp, Artificial
  CRISPR gRNA sequence
gaaaagagaaataccagaaa

SEQ ID NO: 584704 - DNA, 20 bp, Artificial
  CRISPR gRNA sequence
aaaagagaaataccagaaaa

SEQ ID NO: 584705 - DNA, 20 bp, Artificial
  CRISPR gRNA sequence
ataccagaaaagggatttct

SEQ ID NO: 584706 - DNA, 20 bp, Artificial
  CRISPR gRNA sequence
ccagaaaagggatttctaag

SEQ ID NO: 584707 - DNA, 20 bp, Artificial
  CRISPR gRNA sequence
cagaaaagggatttctaagt

SEQ ID NO: 584708 - DNA, 20 bp, Artificial
  CRISPR gRNA sequence
gggttttctccccctactgt

SEQ ID NO: 584709 - DNA, 20 bp, Artificial
  CRISPR gRNA sequence
aattatatttttctgctgac

SEQ ID NO: 584710 - DNA, 20 bp, Artificial
  CRISPR gRNA sequence
acactgattaaatgctgata

SEQ ID NO: 584711 - DNA, 20 bp, Artificial
  CRISPR gRNA sequence
gctgataaagtgacaatcgt

SEQ ID NO: 584712 - DNA, 20 bp, Artificial
  CRISPR gRNA sequence
gacaatcgtaagcatacttt

SEQ ID NO: 584713 - DNA, 20 bp, Artificial
  CRISPR gRNA sequence
ccatcacattacaactttaa

SEQ ID NO: 584714 - DNA, 20 bp, Artificial
  CRISPR gRNA sequence
cctctcaaacaaatttatga

SEQ ID NO: 584715 - DNA, 20 bp, Artificial
  CRISPR gRNA sequence
ctcaaacaaatttatgaaag

SEQ ID NO: 584716 - DNA, 20 bp, Artificial
  CRISPR gRNA sequence
aaacaaatttatgaaagtag

SEQ ID NO: 584717 - DNA, 20 bp, Artificial
  CRISPR gRNA sequence
atgaaagtagaagtccctcc

SEQ ID NO: 584718 - DNA, 20 bp, Artificial
  CRISPR gRNA sequence
gactgccttttatccactct

SEQ ID NO: 584719 - DNA, 20 bp, Artificial
  CRISPR gRNA sequence
cataaaaatactattcctta

SEQ ID NO: 584720 - DNA, 20 bp, Artificial
  CRISPR gRNA sequence
ataaaaatactattccttaa

SEQ ID NO: 584721 - DNA, 20 bp, Artificial
  CRISPR gRNA sequence
ctattccttaaaggtgttaa

SEQ ID NO: 584722 - DNA, 20 bp, Artificial
  CRISPR gRNA sequence
tccttaaaggtgttaaaagt

SEQ ID NO: 584723 - DNA, 20 bp, Artificial
  CRISPR gRNA sequence
ccttaaaggtgttaaaagta

SEQ ID NO: 584724 - DNA, 20 bp, Artificial
  CRISPR gRNA sequence
ggtgttaaaagtaaggctgc

SEQ ID NO: 584725 - DNA, 20 bp, Artificial
  CRISPR gRNA sequence
gtgttaaaagtaaggctgcc

SEQ ID NO: 584726 - DNA, 20 bp, Artificial
  CRISPR gRNA sequence
tgttaaaagtaaggctgcca

SEQ ID NO: 584727 - DNA, 20 bp, Artificial
  CRISPR gRNA sequence
ccagggtgtctataaaatgc

SEQ ID NO: 584728 - DNA, 20 bp, Artificial
  CRISPR gRNA sequence
aatgccagtcatcaaaacta

SEQ ID NO: 584729 - DNA, 20 bp, Artificial
  CRISPR gRNA sequence
tcatcaaaactatggaaaaa

SEQ ID NO: 584730 - DNA, 20 bp, Artificial
  CRISPR gRNA sequence
ggaaaaacagtgcttacgtt

SEQ ID NO: 584731 - DNA, 20 bp, Artificial
  CRISPR gRNA sequence
gtgcttacgtttagaaaaat

SEQ ID NO: 584732 - DNA, 20 bp, Artificial
  CRISPR gRNA sequence
cgtttagaaaaataagatca

SEQ ID NO: 584733 - DNA, 20 bp, Artificial
  CRISPR gRNA sequence
gtttagaaaaataagatcac

SEQ ID NO: 584734 - DNA, 20 bp, Artificial
  CRISPR gRNA sequence
aaaataagatcacaggacct

SEQ ID NO: 584735 - DNA, 20 bp, Artificial
  CRISPR gRNA sequence
acaggacctcagatgtattg

SEQ ID NO: 584736 - DNA, 20 bp, Artificial
  CRISPR gRNA sequence
caggacctcagatgtattgt

SEQ ID NO: 584737 - DNA, 20 bp, Artificial
  CRISPR gRNA sequence
gacctcagatgtattgtagg

SEQ ID NO: 584738 - DNA, 20 bp, Artificial
  CRISPR gRNA sequence
aggtggcccttaactacctg

SEQ ID NO: 584739 - DNA, 20 bp, Artificial
  CRISPR gRNA sequence
cttaactacctgtagtttaa

SEQ ID NO: 584740 - DNA, 20 bp, Artificial
  CRISPR gRNA sequence
agtttaaaagttttgctata

SEQ ID NO: 584741 - DNA, 20 bp, Artificial
  CRISPR gRNA sequence
aaaagttttgctatatggta

SEQ ID NO: 584742 - DNA, 20 bp, Artificial
  CRISPR gRNA sequence
atactgaattataaattcca

SEQ ID NO: 584743 - DNA, 20 bp, Artificial
  CRISPR gRNA sequence
tactgaattataaattccat

SEQ ID NO: 584744 - DNA, 20 bp, Artificial
  CRISPR gRNA sequence
actgaattataaattccata

SEQ ID NO: 584745 - DNA, 20 bp, Artificial
  CRISPR gRNA sequence
ctgaattataaattccatag

SEQ ID NO: 584746 - DNA, 20 bp, Artificial
  CRISPR gRNA sequence
aattataaattccatagggg

SEQ ID NO: 584747 - DNA, 20 bp, Artificial
  CRISPR gRNA sequence
ttccataggggaagtaaaca

SEQ ID NO: 584748 - DNA, 20 bp, Artificial
  CRISPR gRNA sequence
acatagaacccacaacaact

SEQ ID NO: 584749 - DNA, 20 bp, Artificial
  CRISPR gRNA sequence
cacaacaactcagctcctct

SEQ ID NO: 584750 - DNA, 20 bp, Artificial
  CRISPR gRNA sequence
acaacaactcagctcctctt

SEQ ID NO: 584751 - DNA, 20 bp, Artificial
  CRISPR gRNA sequence
aacaactcagctcctcttag

SEQ ID NO: 584752 - DNA, 20 bp, Artificial
  CRISPR gRNA sequence
tttgtgttccatgatctctg

SEQ ID NO: 584753 - DNA, 20 bp, Artificial
  CRISPR gRNA sequence
atctctgaagaacaaaaaat

SEQ ID NO: 584754 - DNA, 20 bp, Artificial
  CRISPR gRNA sequence
aagaacaaaaaattggttta

SEQ ID NO: 584755 - DNA, 20 bp, Artificial
  CRISPR gRNA sequence
ttgaaacacattcttctttc

SEQ ID NO: 584756 - DNA, 20 bp, Artificial
  CRISPR gRNA sequence
acattcttctttcaagaata

SEQ ID NO: 584757 - DNA, 20 bp, Artificial
  CRISPR gRNA sequence
ataccatttttaaaccacca

SEQ ID NO: 584758 - DNA, 20 bp, Artificial
  CRISPR gRNA sequence
taaaccaccaaagtcctacc

SEQ ID NO: 584759 - DNA, 20 bp, Artificial
  CRISPR gRNA sequence
tccatcataattctgaatat

SEQ ID NO: 584760 - DNA, 20 bp, Artificial
  CRISPR gRNA sequence
atcataattctgaatatcag

SEQ ID NO: 584761 - DNA, 20 bp, Artificial
  CRISPR gRNA sequence
tctgaatatcagtggcaaat

SEQ ID NO: 584762 - DNA, 20 bp, Artificial
  CRISPR gRNA sequence
agtggcaaatcagaatctct

SEQ ID NO: 584763 - DNA, 20 bp, Artificial
  CRISPR gRNA sequence
gtggcaaatcagaatctctt

SEQ ID NO: 584764 - DNA, 20 bp, Artificial
  CRISPR gRNA sequence
taggtgaatctttatgaatc

SEQ ID NO: 584765 - DNA, 20 bp, Artificial
  CRISPR gRNA sequence
atgaatcaagtgatttttca

SEQ ID NO: 584766 - DNA, 20 bp, Artificial
  CRISPR gRNA sequence
tttcaaagcatgatatgcct

SEQ ID NO: 584767 - DNA, 20 bp, Artificial
  CRISPR gRNA sequence
caaagcatgatatgccttgg

SEQ ID NO: 584768 - DNA, 20 bp, Artificial
  CRISPR gRNA sequence
atgatatgccttggtagaaa

SEQ ID NO: 584769 - DNA, 20 bp, Artificial
  CRISPR gRNA sequence
taaattcccacaaaataaac

SEQ ID NO: 584770 - DNA, 20 bp, Artificial
  CRISPR gRNA sequence
ttcccacaaaataaacaagc

SEQ ID NO: 584771 - DNA, 20 bp, Artificial
  CRISPR gRNA sequence
tcccacaaaataaacaagcc

SEQ ID NO: 584772 - DNA, 20 bp, Artificial
  CRISPR gRNA sequence
aataaacaagccaggtgata

SEQ ID NO: 584773 - DNA, 20 bp, Artificial
  CRISPR gRNA sequence
tgtttcttccttatcgtaat

SEQ ID NO: 584774 - DNA, 20 bp, Artificial
  CRISPR gRNA sequence
gtttcttccttatcgtaatt

SEQ ID NO: 584775 - DNA, 20 bp, Artificial
  CRISPR gRNA sequence
tcttccttatcgtaattagg

SEQ ID NO: 584776 - DNA, 20 bp, Artificial
  CRISPR gRNA sequence
ttccttatcgtaattaggca

SEQ ID NO: 584777 - DNA, 20 bp, Artificial
  CRISPR gRNA sequence
tgacactgcctccacaaaat

SEQ ID NO: 584778 - DNA, 20 bp, Artificial
  CRISPR gRNA sequence
cacaaaataagaattatcaa

SEQ ID NO: 584779 - DNA, 20 bp, Artificial
  CRISPR gRNA sequence
aataatattaaaaaaaataa

SEQ ID NO: 584780 - DNA, 20 bp, Artificial
  CRISPR gRNA sequence
ataatattaaaaaaaataaa

SEQ ID NO: 584781 - DNA, 20 bp, Artificial
  CRISPR gRNA sequence
taaaaggtatgtcaacattt

SEQ ID NO: 584782 - DNA, 20 bp, Artificial
  CRISPR gRNA sequence
aaaaggtatgtcaacatttg

SEQ ID NO: 584783 - DNA, 20 bp, Artificial
  CRISPR gRNA sequence
ggtatgtcaacatttgagga

SEQ ID NO: 584784 - DNA, 20 bp, Artificial
  CRISPR gRNA sequence
gtatgtcaacatttgaggaa

SEQ ID NO: 584785 - DNA, 20 bp, Artificial
  CRISPR gRNA sequence
tgtcaacatttgaggaaagg

SEQ ID NO: 584786 - DNA, 20 bp, Artificial
  CRISPR gRNA sequence
gtcaacatttgaggaaaggt

SEQ ID NO: 584787 - DNA, 20 bp, Artificial
  CRISPR gRNA sequence
ttgaggaaaggtgggattgt

SEQ ID NO: 584788 - DNA, 20 bp, Artificial
  CRISPR gRNA sequence
gaaaggtgggattgtaagtg

SEQ ID NO: 584789 - DNA, 20 bp, Artificial
  CRISPR gRNA sequence
gtgcagtatttcttcatgtg

SEQ ID NO: 584790 - DNA, 20 bp, Artificial
  CRISPR gRNA sequence
atgtgcagttctttacttca

SEQ ID NO: 584791 - DNA, 20 bp, Artificial
  CRISPR gRNA sequence
tgtgcagttctttacttcat

SEQ ID NO: 584792 - DNA, 20 bp, Artificial
  CRISPR gRNA sequence
gtgcagttctttacttcata

SEQ ID NO: 584793 - DNA, 20 bp, Artificial
  CRISPR gRNA sequence
tgcagttctttacttcatag

SEQ ID NO: 584794 - DNA, 20 bp, Artificial
  CRISPR gRNA sequence
tacttcataggggtcccctt

SEQ ID NO: 584795 - DNA, 20 bp, Artificial
  CRISPR gRNA sequence
ggggtcccctttggaatgaa

SEQ ID NO: 584796 - DNA, 20 bp, Artificial
  CRISPR gRNA sequence
gggtcccctttggaatgaaa

SEQ ID NO: 584797 - DNA, 20 bp, Artificial
  CRISPR gRNA sequence
ccctttggaatgaaaaggcc

SEQ ID NO: 584798 - DNA, 20 bp, Artificial
  CRISPR gRNA sequence
tttggaatgaaaaggcctag

SEQ ID NO: 584799 - DNA, 20 bp, Artificial
  CRISPR gRNA sequence
tgtgtgatgaaaactcataa

SEQ ID NO: 584800 - DNA, 20 bp, Artificial
  CRISPR gRNA sequence
atgaaaactcataacggtcc

SEQ ID NO: 584801 - DNA, 20 bp, Artificial
  CRISPR gRNA sequence
cataacggtcctggcttctg

SEQ ID NO: 584802 - DNA, 20 bp, Artificial
  CRISPR gRNA sequence
ggtcctggcttctgtagcca

SEQ ID NO: 584803 - DNA, 20 bp, Artificial
  CRISPR gRNA sequence
tagccacagatgttgcattc

SEQ ID NO: 584804 - DNA, 20 bp, Artificial
  CRISPR gRNA sequence
ccacagatgttgcattccag

SEQ ID NO: 584805 - DNA, 20 bp, Artificial
  CRISPR gRNA sequence
cacagatgttgcattccagt

SEQ ID NO: 584806 - DNA, 20 bp, Artificial
  CRISPR gRNA sequence
tgttgcattccagtgggtcc

SEQ ID NO: 584807 - DNA, 20 bp, Artificial
  CRISPR gRNA sequence
tgcattccagtgggtcccgg

SEQ ID NO: 584808 - DNA, 20 bp, Artificial
  CRISPR gRNA sequence
ccagtgggtcccggtagcca

SEQ ID NO: 584809 - DNA, 20 bp, Artificial
  CRISPR gRNA sequence
gccatggcaacccatgtgaa

SEQ ID NO: 584810 - DNA, 20 bp, Artificial
  CRISPR gRNA sequence
tgtgaatggtgtacatgaca

SEQ ID NO: 584811 - DNA, 20 bp, Artificial
  CRISPR gRNA sequence
atggtgtacatgacatggtc

SEQ ID NO: 584812 - DNA, 20 bp, Artificial
  CRISPR gRNA sequence
tggtgtacatgacatggtct

SEQ ID NO: 584813 - DNA, 20 bp, Artificial
  CRISPR gRNA sequence
tacatgacatggtctaggaa

SEQ ID NO: 584814 - DNA, 20 bp, Artificial
  CRISPR gRNA sequence
acatgacatggtctaggaaa

SEQ ID NO: 584815 - DNA, 20 bp, Artificial
  CRISPR gRNA sequence
catggtctaggaaaaggact

SEQ ID NO: 584816 - DNA, 20 bp, Artificial
  CRISPR gRNA sequence
ggtctaggaaaaggactcgg

SEQ ID NO: 584817 - DNA, 20 bp, Artificial
  CRISPR gRNA sequence
ctcggcagtgctcacacttg

SEQ ID NO: 584818 - DNA, 20 bp, Artificial
  CRISPR gRNA sequence
tcggcagtgctcacacttga

SEQ ID NO: 584819 - DNA, 20 bp, Artificial
  CRISPR gRNA sequence
tctgttctccttctccattg

SEQ ID NO: 584820 - DNA, 20 bp, Artificial
  CRISPR gRNA sequence
cttctccattgaagaccttg

SEQ ID NO: 584821 - DNA, 20 bp, Artificial
  CRISPR gRNA sequence
aagaccttgtagatgtcctt

SEQ ID NO: 584822 - DNA, 20 bp, Artificial
  CRISPR gRNA sequence
gaccttgtagatgtccttca

SEQ ID NO: 584823 - DNA, 20 bp, Artificial
  CRISPR gRNA sequence
ccttgtagatgtccttcaga

SEQ ID NO: 584824 - DNA, 20 bp, Artificial
  CRISPR gRNA sequence
gatgtccttcagagagccct

SEQ ID NO: 584825 - DNA, 20 bp, Artificial
  CRISPR gRNA sequence
atgtccttcagagagccctt

SEQ ID NO: 584826 - DNA, 20 bp, Artificial
  CRISPR gRNA sequence
gtccttcagagagcccttag

SEQ ID NO: 584827 - DNA, 20 bp, Artificial
  CRISPR gRNA sequence
cagagagcccttaggagcct

SEQ ID NO: 584828 - DNA, 20 bp, Artificial
  CRISPR gRNA sequence
agagcccttaggagccttgg

SEQ ID NO: 584829 - DNA, 20 bp, Artificial
  CRISPR gRNA sequence
aggagccttggtagtatcca

SEQ ID NO: 584830 - DNA, 20 bp, Artificial
  CRISPR gRNA sequence
tttgacatcctccttcatgt

SEQ ID NO: 584831 - DNA, 20 bp, Artificial
  CRISPR gRNA sequence
acatcctccttcatgtaagc

SEQ ID NO: 584832 - DNA, 20 bp, Artificial
  CRISPR gRNA sequence
catcctccttcatgtaagct

SEQ ID NO: 584833 - DNA, 20 bp, Artificial
  CRISPR gRNA sequence
agctgggctttgtttcctct

SEQ ID NO: 584834 - DNA, 20 bp, Artificial
  CRISPR gRNA sequence
gctgggctttgtttcctctt

SEQ ID NO: 584835 - DNA, 20 bp, Artificial
  CRISPR gRNA sequence
tttgtttcctcttgggattt

SEQ ID NO: 584836 - DNA, 20 bp, Artificial
  CRISPR gRNA sequence
ttgtttcctcttgggattta

SEQ ID NO: 584837 - DNA, 20 bp, Artificial
  CRISPR gRNA sequence
tttcctcttgggatttaagg

SEQ ID NO: 584838 - DNA, 20 bp, Artificial
  CRISPR gRNA sequence
ttcctcttgggatttaaggc

SEQ ID NO: 584839 - DNA, 20 bp, Artificial
  CRISPR gRNA sequence
tcctcttgggatttaaggca

SEQ ID NO: 584840 - DNA, 20 bp, Artificial
  CRISPR gRNA sequence
gatttaaggcagggtgtcct

SEQ ID NO: 584841 - DNA, 20 bp, Artificial
  CRISPR gRNA sequence
ttaaggcagggtgtccttgg

SEQ ID NO: 584842 - DNA, 20 bp, Artificial
  CRISPR gRNA sequence
taaggcagggtgtccttggt

SEQ ID NO: 584843 - DNA, 20 bp, Artificial
  CRISPR gRNA sequence
cagggtgtccttggtaggac

SEQ ID NO: 584844 - DNA, 20 bp, Artificial
  CRISPR gRNA sequence
ggtgtccttggtaggactgg

SEQ ID NO: 584845 - DNA, 20 bp, Artificial
  CRISPR gRNA sequence
ggtaggactggtggtcatca

SEQ ID NO: 584846 - DNA, 20 bp, Artificial
  CRISPR gRNA sequence
ggtcatcatggctgctttct

SEQ ID NO: 584847 - DNA, 20 bp, Artificial
  CRISPR gRNA sequence
atcatggctgctttctgagt

SEQ ID NO: 584848 - DNA, 20 bp, Artificial
  CRISPR gRNA sequence
atggctgctttctgagtcag

SEQ ID NO: 584849 - DNA, 20 bp, Artificial
  CRISPR gRNA sequence
ctttctgagtcagtggaatc

SEQ ID NO: 584850 - DNA, 20 bp, Artificial
  CRISPR gRNA sequence
tttctgagtcagtggaatcc

SEQ ID NO: 584851 - DNA, 20 bp, Artificial
  CRISPR gRNA sequence
ctgagtcagtggaatccagg

SEQ ID NO: 584852 - DNA, 20 bp, Artificial
  CRISPR gRNA sequence
ggaatccaggcagctattgc

SEQ ID NO: 584853 - DNA, 20 bp, Artificial
  CRISPR gRNA sequence
gaatccaggcagctattgct

SEQ ID NO: 584854 - DNA, 20 bp, Artificial
  CRISPR gRNA sequence
atccaggcagctattgctgg

SEQ ID NO: 584855 - DNA, 20 bp, Artificial
  CRISPR gRNA sequence
ccaggcagctattgctggga

SEQ ID NO: 584856 - DNA, 20 bp, Artificial
  CRISPR gRNA sequence
caggcagctattgctgggag

SEQ ID NO: 584857 - DNA, 20 bp, Artificial
  CRISPR gRNA sequence
tgggagaggcctctctttcc

SEQ ID NO: 584858 - DNA, 20 bp, Artificial
  CRISPR gRNA sequence
gggagaggcctctctttcct

SEQ ID NO: 584859 - DNA, 20 bp, Artificial
  CRISPR gRNA sequence
ggagaggcctctctttcctg

SEQ ID NO: 584860 - DNA, 20 bp, Artificial
  CRISPR gRNA sequence
ctttcctggggtcgactctt

SEQ ID NO: 584861 - DNA, 20 bp, Artificial
  CRISPR gRNA sequence
ggtcgactctttggtctgat

SEQ ID NO: 584862 - DNA, 20 bp, Artificial
  CRISPR gRNA sequence
tcgactctttggtctgatga

SEQ ID NO: 584863 - DNA, 20 bp, Artificial
  CRISPR gRNA sequence
gactctttggtctgatgaga

SEQ ID NO: 584864 - DNA, 20 bp, Artificial
  CRISPR gRNA sequence
ctttggtctgatgagagaga

SEQ ID NO: 584865 - DNA, 20 bp, Artificial
  CRISPR gRNA sequence
tttggtctgatgagagagat

SEQ ID NO: 584866 - DNA, 20 bp, Artificial
  CRISPR gRNA sequence
ttggtctgatgagagagatg

SEQ ID NO: 584867 - DNA, 20 bp, Artificial
  CRISPR gRNA sequence
catgttgttttcatgactat

SEQ ID NO: 584868 - DNA, 20 bp, Artificial
  CRISPR gRNA sequence
gttgttttcatgactatcag

SEQ ID NO: 584869 - DNA, 20 bp, Artificial
  CRISPR gRNA sequence
atcagcagtttccctgctaa

SEQ ID NO: 584870 - DNA, 20 bp, Artificial
  CRISPR gRNA sequence
tcagcagtttccctgctaat

SEQ ID NO: 584871 - DNA, 20 bp, Artificial
  CRISPR gRNA sequence
atgggtctttctatcctatt

SEQ ID NO: 584872 - DNA, 20 bp, Artificial
  CRISPR gRNA sequence
tttctatcctatttggatga

SEQ ID NO: 584873 - DNA, 20 bp, Artificial
  CRISPR gRNA sequence
cctatttggatgatagacct

SEQ ID NO: 584874 - DNA, 20 bp, Artificial
  CRISPR gRNA sequence
tggatgatagacctgagaat

SEQ ID NO: 584875 - DNA, 20 bp, Artificial
  CRISPR gRNA sequence
gatagacctgagaataagct

SEQ ID NO: 584876 - DNA, 20 bp, Artificial
  CRISPR gRNA sequence
gaataagctgagcttataac

SEQ ID NO: 584877 - DNA, 20 bp, Artificial
  CRISPR gRNA sequence
aataagctgagcttataact

SEQ ID NO: 584878 - DNA, 20 bp, Artificial
  CRISPR gRNA sequence
ataagctgagcttataactg

SEQ ID NO: 584879 - DNA, 20 bp, Artificial
  CRISPR gRNA sequence
gcttataactggggccactt

SEQ ID NO: 584880 - DNA, 20 bp, Artificial
  CRISPR gRNA sequence
gccacttcagcgattgtgct

SEQ ID NO: 584881 - DNA, 20 bp, Artificial
  CRISPR gRNA sequence
acttcagcgattgtgcttgg

SEQ ID NO: 584882 - DNA, 20 bp, Artificial
  CRISPR gRNA sequence
cttcagcgattgtgcttggc

SEQ ID NO: 584883 - DNA, 20 bp, Artificial
  CRISPR gRNA sequence
gtgcttggcgggtgctgcat

SEQ ID NO: 584884 - DNA, 20 bp, Artificial
  CRISPR gRNA sequence
gcttggcgggtgctgcatca

SEQ ID NO: 584885 - DNA, 20 bp, Artificial
  CRISPR gRNA sequence
cttggcgggtgctgcatcag

SEQ ID NO: 584886 - DNA, 20 bp, Artificial
  CRISPR gRNA sequence
ttggcgggtgctgcatcaga

SEQ ID NO: 584887 - DNA, 20 bp, Artificial
  CRISPR gRNA sequence
gggtgctgcatcagagggtg

SEQ ID NO: 584888 - DNA, 20 bp, Artificial
  CRISPR gRNA sequence
ggtgctgcatcagagggtga

SEQ ID NO: 584889 - DNA, 20 bp, Artificial
  CRISPR gRNA sequence
gtgctgcatcagagggtgaa

SEQ ID NO: 584890 - DNA, 20 bp, Artificial
  CRISPR gRNA sequence
catcagagggtgaagggcct

SEQ ID NO: 584891 - DNA, 20 bp, Artificial
  CRISPR gRNA sequence
gggtgaagggcctcagctcc

SEQ ID NO: 584892 - DNA, 20 bp, Artificial
  CRISPR gRNA sequence
ggtgaagggcctcagctcca

SEQ ID NO: 584893 - DNA, 20 bp, Artificial
  CRISPR gRNA sequence
gaagggcctcagctccaagg

SEQ ID NO: 584894 - DNA, 20 bp, Artificial
  CRISPR gRNA sequence
aagggcctcagctccaaggt

SEQ ID NO: 584895 - DNA, 20 bp, Artificial
  CRISPR gRNA sequence
gtaggtgattgcattgttga

SEQ ID NO: 584896 - DNA, 20 bp, Artificial
  CRISPR gRNA sequence
tgattgcattgttgatggct

SEQ ID NO: 584897 - DNA, 20 bp, Artificial
  CRISPR gRNA sequence
gatggcttggtccatcatat

SEQ ID NO: 584898 - DNA, 20 bp, Artificial
  CRISPR gRNA sequence
tccatcatatgagactgcat

SEQ ID NO: 584899 - DNA, 20 bp, Artificial
  CRISPR gRNA sequence
catatgagactgcatcagct

SEQ ID NO: 584900 - DNA, 20 bp, Artificial
  CRISPR gRNA sequence
cagcctccttctcatatgtt

SEQ ID NO: 584901 - DNA, 20 bp, Artificial
  CRISPR gRNA sequence
catatgttaagttcatatca

SEQ ID NO: 584902 - DNA, 20 bp, Artificial
  CRISPR gRNA sequence
ttcatatcaaagtgaatatc

SEQ ID NO: 584903 - DNA, 20 bp, Artificial
  CRISPR gRNA sequence
tcatatcaaagtgaatatct

SEQ ID NO: 584904 - DNA, 20 bp, Artificial
  CRISPR gRNA sequence
tatcaaagtgaatatctggg

SEQ ID NO: 584905 - DNA, 20 bp, Artificial
  CRISPR gRNA sequence
tctgggtagctgaatcgcat

SEQ ID NO: 584906 - DNA, 20 bp, Artificial
  CRISPR gRNA sequence
aatcgcatgagcttttcccc

SEQ ID NO: 584907 - DNA, 20 bp, Artificial
  CRISPR gRNA sequence
cgcatgagcttttcccctgg

SEQ ID NO: 584908 - DNA, 20 bp, Artificial
  CRISPR gRNA sequence
gcatgagcttttcccctgga

SEQ ID NO: 584909 - DNA, 20 bp, Artificial
  CRISPR gRNA sequence
catgagcttttcccctggaa

SEQ ID NO: 584910 - DNA, 20 bp, Artificial
  CRISPR gRNA sequence
tgagcttttcccctggaagg

SEQ ID NO: 584911 - DNA, 20 bp, Artificial
  CRISPR gRNA sequence
gcttttcccctggaagggag

SEQ ID NO: 584912 - DNA, 20 bp, Artificial
  CRISPR gRNA sequence
cttttcccctggaagggagt

SEQ ID NO: 584913 - DNA, 20 bp, Artificial
  CRISPR gRNA sequence
tttcccctggaagggagtgg

SEQ ID NO: 584914 - DNA, 20 bp, Artificial
  CRISPR gRNA sequence
ttcccctggaagggagtggg

SEQ ID NO: 584915 - DNA, 20 bp, Artificial
  CRISPR gRNA sequence
tggaagggagtgggaggtga

SEQ ID NO: 584916 - DNA, 20 bp, Artificial
  CRISPR gRNA sequence
aagggagtgggaggtgaaag

SEQ ID NO: 584917 - DNA, 20 bp, Artificial
  CRISPR gRNA sequence
aaaaaaaaatacaacaacat

SEQ ID NO: 584918 - DNA, 20 bp, Artificial
  CRISPR gRNA sequence
aaatacaacaacattagtat

SEQ ID NO: 584919 - DNA, 20 bp, Artificial
  CRISPR gRNA sequence
gtatcagattaaaaatatga

SEQ ID NO: 584920 - DNA, 20 bp, Artificial
  CRISPR gRNA sequence
tatcagattaaaaatatgaa

SEQ ID NO: 584921 - DNA, 20 bp, Artificial
  CRISPR gRNA sequence
atcagattaaaaatatgaaa

SEQ ID NO: 584922 - DNA, 20 bp, Artificial
  CRISPR gRNA sequence
taaaaatatgaaagggtacg

SEQ ID NO: 584923 - DNA, 20 bp, Artificial
  CRISPR gRNA sequence
tgcctccatttttcataatt

SEQ ID NO: 584924 - DNA, 20 bp, Artificial
  CRISPR gRNA sequence
tttggtatatattactctat

SEQ ID NO: 584925 - DNA, 20 bp, Artificial
  CRISPR gRNA sequence
tatatattactctataagtc

SEQ ID NO: 584926 - DNA, 20 bp, Artificial
  CRISPR gRNA sequence
tactctataagtcaagtatt

SEQ ID NO: 584927 - DNA, 20 bp, Artificial
  CRISPR gRNA sequence
actctataagtcaagtattt

SEQ ID NO: 584928 - DNA, 20 bp, Artificial
  CRISPR gRNA sequence
cacacatttttttttttttt

SEQ ID NO: 584929 - DNA, 20 bp, Artificial
  CRISPR gRNA sequence
cattttttttttttttgaga

SEQ ID NO: 584930 - DNA, 20 bp, Artificial
  CRISPR gRNA sequence
ttttttttttttttgagaca

SEQ ID NO: 584931 - DNA, 20 bp, Artificial
  CRISPR gRNA sequence
ttttttttgagacagagtct

SEQ ID NO: 584932 - DNA, 20 bp, Artificial
  CRISPR gRNA sequence
tttttttgagacagagtctc

SEQ ID NO: 584933 - DNA, 20 bp, Artificial
  CRISPR gRNA sequence
ttttttgagacagagtctca

SEQ ID NO: 584934 - DNA, 20 bp, Artificial
  CRISPR gRNA sequence
cactgcaacctccacctctc

SEQ ID NO: 584935 - DNA, 20 bp, Artificial
  CRISPR gRNA sequence
aacctccacctctccagttc

SEQ ID NO: 584936 - DNA, 20 bp, Artificial
  CRISPR gRNA sequence
acctccacctctccagttca

SEQ ID NO: 584937 - DNA, 20 bp, Artificial
  CRISPR gRNA sequence
cctccacctctccagttcaa

SEQ ID NO: 584938 - DNA, 20 bp, Artificial
  CRISPR gRNA sequence
ttcaagggattctcatgcct

SEQ ID NO: 584939 - DNA, 20 bp, Artificial
  CRISPR gRNA sequence
ttctcatgcctcagccacct

SEQ ID NO: 584940 - DNA, 20 bp, Artificial
  CRISPR gRNA sequence
tcatgcctcagccacctgag

SEQ ID NO: 584941 - DNA, 20 bp, Artificial
  CRISPR gRNA sequence
gcctcagccacctgagtagc

SEQ ID NO: 584942 - DNA, 20 bp, Artificial
  CRISPR gRNA sequence
cacctgagtagctggaatta

SEQ ID NO: 584943 - DNA, 20 bp, Artificial
  CRISPR gRNA sequence
acctgagtagctggaattac

SEQ ID NO: 584944 - DNA, 20 bp, Artificial
  CRISPR gRNA sequence
caggcatgcgcccccatacc

SEQ ID NO: 584945 - DNA, 20 bp, Artificial
  CRISPR gRNA sequence
ctggctaatttttgtatttt

SEQ ID NO: 584946 - DNA, 20 bp, Artificial
  CRISPR gRNA sequence
gctaatttttgtatttttag

SEQ ID NO: 584947 - DNA, 20 bp, Artificial
  CRISPR gRNA sequence
taatttttgtatttttagta

SEQ ID NO: 584948 - DNA, 20 bp, Artificial
  CRISPR gRNA sequence
ttttgtatttttagtagaga

SEQ ID NO: 584949 - DNA, 20 bp, Artificial
  CRISPR gRNA sequence
tttgtatttttagtagagat

SEQ ID NO: 584950 - DNA, 20 bp, Artificial
  CRISPR gRNA sequence
ttgtatttttagtagagata

SEQ ID NO: 584951 - DNA, 20 bp, Artificial
  CRISPR gRNA sequence
gagatagggttttgccctgt

SEQ ID NO: 584952 - DNA, 20 bp, Artificial
  CRISPR gRNA sequence
tagggttttgccctgttagc

SEQ ID NO: 584953 - DNA, 20 bp, Artificial
  CRISPR gRNA sequence
agggttttgccctgttagcc

SEQ ID NO: 584954 - DNA, 20 bp, Artificial
  CRISPR gRNA sequence
ttttgccctgttagccaggc

SEQ ID NO: 584955 - DNA, 20 bp, Artificial
  CRISPR gRNA sequence
ccctgttagccaggctggtc

SEQ ID NO: 584956 - DNA, 20 bp, Artificial
  CRISPR gRNA sequence
ccaggctggtctagaactcc

SEQ ID NO: 584957 - DNA, 20 bp, Artificial
  CRISPR gRNA sequence
ggtctagaactcctggcctc

SEQ ID NO: 584958 - DNA, 20 bp, Artificial
  CRISPR gRNA sequence
ctcaagtgatccacccacct

SEQ ID NO: 584959 - DNA, 20 bp, Artificial
  CRISPR gRNA sequence
ccacccaccttggcctccca

SEQ ID NO: 584960 - DNA, 20 bp, Artificial
  CRISPR gRNA sequence
ctcccaaagtgttacgatta

SEQ ID NO: 584961 - DNA, 20 bp, Artificial
  CRISPR gRNA sequence
tcccaaagtgttacgattac

SEQ ID NO: 584962 - DNA, 20 bp, Artificial
  CRISPR gRNA sequence
agtgttacgattacaggcat

SEQ ID NO: 584963 - DNA, 20 bp, Artificial
  CRISPR gRNA sequence
cgattacaggcatgagacac

SEQ ID NO: 584964 - DNA, 20 bp, Artificial
  CRISPR gRNA sequence
gattacaggcatgagacact

SEQ ID NO: 584965 - DNA, 20 bp, Artificial
  CRISPR gRNA sequence
caggcatgagacactgggtc

SEQ ID NO: 584966 - DNA, 20 bp, Artificial
  CRISPR gRNA sequence
ttgacatgaaaaaaatataa

SEQ ID NO: 584967 - DNA, 20 bp, Artificial
  CRISPR gRNA sequence
aaaagcaataaaaattttgt

SEQ ID NO: 584968 - DNA, 20 bp, Artificial
  CRISPR gRNA sequence
atttgttctgatgccatcat

SEQ ID NO: 584969 - DNA, 20 bp, Artificial
  CRISPR gRNA sequence
tgccatcatgagaatgcatc

SEQ ID NO: 584970 - DNA, 20 bp, Artificial
  CRISPR gRNA sequence
tgagaatgcatctagtctga

SEQ ID NO: 584971 - DNA, 20 bp, Artificial
  CRISPR gRNA sequence
ctagtctgaaagatatgatt

SEQ ID NO: 584972 - DNA, 20 bp, Artificial
  CRISPR gRNA sequence
ttttaaaattctcacttgaa

SEQ ID NO: 584973 - DNA, 20 bp, Artificial
  CRISPR gRNA sequence
ttaaaattctcacttgaata

SEQ ID NO: 584974 - DNA, 20 bp, Artificial
  CRISPR gRNA sequence
ttctcacttgaatagagctc

SEQ ID NO: 584975 - DNA, 20 bp, Artificial
  CRISPR gRNA sequence
tctcacttgaatagagctca

SEQ ID NO: 584976 - DNA, 20 bp, Artificial
  CRISPR gRNA sequence
tcacttgaatagagctcaag

SEQ ID NO: 584977 - DNA, 20 bp, Artificial
  CRISPR gRNA sequence
tgaatagagctcaaggagaa

SEQ ID NO: 584978 - DNA, 20 bp, Artificial
  CRISPR gRNA sequence
gaatagagctcaaggagaat

SEQ ID NO: 584979 - DNA, 20 bp, Artificial
  CRISPR gRNA sequence
atagagctcaaggagaatag

SEQ ID NO: 584980 - DNA, 20 bp, Artificial
  CRISPR gRNA sequence
tagagctcaaggagaatagg

SEQ ID NO: 584981 - DNA, 20 bp, Artificial
  CRISPR gRNA sequence
agctcaaggagaataggagg

SEQ ID NO: 584982 - DNA, 20 bp, Artificial
  CRISPR gRNA sequence
agaataggaggaagaatacc

SEQ ID NO: 584983 - DNA, 20 bp, Artificial
  CRISPR gRNA sequence
gaagaatacccagtaaaaac

SEQ ID NO: 584984 - DNA, 20 bp, Artificial
  CRISPR gRNA sequence
aatacccagtaaaaacaagt

SEQ ID NO: 584985 - DNA, 20 bp, Artificial
  CRISPR gRNA sequence
tacccagtaaaaacaagtca

SEQ ID NO: 584986 - DNA, 20 bp, Artificial
  CRISPR gRNA sequence
attttgcatattttaaacat

SEQ ID NO: 584987 - DNA, 20 bp, Artificial
  CRISPR gRNA sequence
tattttaaacattagtgacc

SEQ ID NO: 584988 - DNA, 20 bp, Artificial
  CRISPR gRNA sequence
acattagtgaccaagctaca

SEQ ID NO: 584989 - DNA, 20 bp, Artificial
  CRISPR gRNA sequence
ccaagctacaaagatcataa

SEQ ID NO: 584990 - DNA, 20 bp, Artificial
  CRISPR gRNA sequence
gctacaaagatcataaaagt

SEQ ID NO: 584991 - DNA, 20 bp, Artificial
  CRISPR gRNA sequence
tacaaagatcataaaagtga

SEQ ID NO: 584992 - DNA, 20 bp, Artificial
  CRISPR gRNA sequence
tcataaaagtgagagtgatc

SEQ ID NO: 584993 - DNA, 20 bp, Artificial
  CRISPR gRNA sequence
agtgatctggttataacata

SEQ ID NO: 584994 - DNA, 20 bp, Artificial
  CRISPR gRNA sequence
tatggcacctcactgttgtg

SEQ ID NO: 584995 - DNA, 20 bp, Artificial
  CRISPR gRNA sequence
atggcacctcactgttgtgt

SEQ ID NO: 584996 - DNA, 20 bp, Artificial
  CRISPR gRNA sequence
tggcacctcactgttgtgta

SEQ ID NO: 584997 - DNA, 20 bp, Artificial
  CRISPR gRNA sequence
cctcactgttgtgtagggtt

SEQ ID NO: 584998 - DNA, 20 bp, Artificial
  CRISPR gRNA sequence
actgttgtgtagggttaagt

SEQ ID NO: 584999 - DNA, 20 bp, Artificial
  CRISPR gRNA sequence
tagggttaagttggttgatt

SEQ ID NO: 585000 - DNA, 20 bp, Artificial
  CRISPR gRNA sequence
ggttgattcggccactattt

SEQ ID NO: 585001 - DNA, 20 bp, Artificial
  CRISPR gRNA sequence
ataacccatatatgtcattc

SEQ ID NO: 585002 - DNA, 20 bp, Artificial
  CRISPR gRNA sequence
aacccatatatgtcattctg

SEQ ID NO: 585003 - DNA, 20 bp, Artificial
  CRISPR gRNA sequence
tcattctggagattttttaa

SEQ ID NO: 585004 - DNA, 20 bp, Artificial
  CRISPR gRNA sequence
cattattaaaatacttttaa

SEQ ID NO: 585005 - DNA, 20 bp, Artificial
  CRISPR gRNA sequence
tattaaaatacttttaaaag

SEQ ID NO: 585006 - DNA, 20 bp, Artificial
  CRISPR gRNA sequence
taataaaaatgaatgaaatg

SEQ ID NO: 585007 - DNA, 20 bp, Artificial
  CRISPR gRNA sequence
aataaaaatgaatgaaatgt

SEQ ID NO: 585008 - DNA, 20 bp, Artificial
  CRISPR gRNA sequence
ataaaaatgaatgaaatgta

SEQ ID NO: 585009 - DNA, 20 bp, Artificial
  CRISPR gRNA sequence
ggttatttaaaaataaaatt

SEQ ID NO: 585010 - DNA, 20 bp, Artificial
  CRISPR gRNA sequence
ttatttaaaaataaaattaa

SEQ ID NO: 585011 - DNA, 20 bp, Artificial
  CRISPR gRNA sequence
aaattaagagttatttcaaa

SEQ ID NO: 585012 - DNA, 20 bp, Artificial
  CRISPR gRNA sequence
aaagtatttgctcataaact

SEQ ID NO: 585013 - DNA, 20 bp, Artificial
  CRISPR gRNA sequence
ttatatcatcctttcttatt

SEQ ID NO: 585014 - DNA, 20 bp, Artificial
  CRISPR gRNA sequence
atttagacatgtgtatgtga

SEQ ID NO: 585015 - DNA, 20 bp, Artificial
  CRISPR gRNA sequence
acatgtgtatgtgatagtgc

SEQ ID NO: 585016 - DNA, 20 bp, Artificial
  CRISPR gRNA sequence
ctggtacgtacacccattgc

SEQ ID NO: 585017 - DNA, 20 bp, Artificial
  CRISPR gRNA sequence
cccatactttttcttgattg

SEQ ID NO: 585018 - DNA, 20 bp, Artificial
  CRISPR gRNA sequence
tcttgattgaagcatgtttg

SEQ ID NO: 585019 - DNA, 20 bp, Artificial
  CRISPR gRNA sequence
tgtctgactgttaactataa

SEQ ID NO: 585020 - DNA, 20 bp, Artificial
  CRISPR gRNA sequence
tctgactgttaactataaaa

SEQ ID NO: 585021 - DNA, 20 bp, Artificial
  CRISPR gRNA sequence
tgttaactataaaagagttt

SEQ ID NO: 585022 - DNA, 20 bp, Artificial
  CRISPR gRNA sequence
aagagttttggtgcttgcaa

SEQ ID NO: 585023 - DNA, 20 bp, Artificial
  CRISPR gRNA sequence
agagttttggtgcttgcaac

SEQ ID NO: 585024 - DNA, 20 bp, Artificial
  CRISPR gRNA sequence
tttggtgcttgcaacgggaa

SEQ ID NO: 585025 - DNA, 20 bp, Artificial
  CRISPR gRNA sequence
ggtgcttgcaacgggaaaag

SEQ ID NO: 585026 - DNA, 20 bp, Artificial
  CRISPR gRNA sequence
ggaaaagtagttttgatttt

SEQ ID NO: 585027 - DNA, 20 bp, Artificial
  CRISPR gRNA sequence
aagtagttttgatttttagc

SEQ ID NO: 585028 - DNA, 20 bp, Artificial
  CRISPR gRNA sequence
gatttttagccagatattgc

SEQ ID NO: 585029 - DNA, 20 bp, Artificial
  CRISPR gRNA sequence
cagatattgctggttttgaa

SEQ ID NO: 585030 - DNA, 20 bp, Artificial
  CRISPR gRNA sequence
ctggttttgaacagaatatt

SEQ ID NO: 585031 - DNA, 20 bp, Artificial
  CRISPR gRNA sequence
cttttacaaattctgtccct

SEQ ID NO: 585032 - DNA, 20 bp, Artificial
  CRISPR gRNA sequence
attctgtccctaagacaatg

SEQ ID NO: 585033 - DNA, 20 bp, Artificial
  CRISPR gRNA sequence
acaatgtggtctctatttac

SEQ ID NO: 585034 - DNA, 20 bp, Artificial
  CRISPR gRNA sequence
ctatttaccagttactttca

SEQ ID NO: 585035 - DNA, 20 bp, Artificial
  CRISPR gRNA sequence
tatttaccagttactttcat

SEQ ID NO: 585036 - DNA, 20 bp, Artificial
  CRISPR gRNA sequence
actttcataggtaaatctta

SEQ ID NO: 585037 - DNA, 20 bp, Artificial
  CRISPR gRNA sequence
atgcttcttaaaaacatatg

SEQ ID NO: 585038 - DNA, 20 bp, Artificial
  CRISPR gRNA sequence
tgcttcttaaaaacatatgt

SEQ ID NO: 585039 - DNA, 20 bp, Artificial
  CRISPR gRNA sequence
atatgtgggtttcccataaa

SEQ ID NO: 585040 - DNA, 20 bp, Artificial
  CRISPR gRNA sequence
aaatggttaatatgttgttg

SEQ ID NO: 585041 - DNA, 20 bp, Artificial
  CRISPR gRNA sequence
ggttaatatgttgttgtgga

SEQ ID NO: 585042 - DNA, 20 bp, Artificial
  CRISPR gRNA sequence
ggatgcttaacttgtaattt

SEQ ID NO: 585043 - DNA, 20 bp, Artificial
  CRISPR gRNA sequence
tgcttaacttgtaattttgg

SEQ ID NO: 585044 - DNA, 20 bp, Artificial
  CRISPR gRNA sequence
gtaattttggcagatactct

SEQ ID NO: 585045 - DNA, 20 bp, Artificial
  CRISPR gRNA sequence
tttggcagatactctcagat

SEQ ID NO: 585046 - DNA, 20 bp, Artificial
  CRISPR gRNA sequence
ggcagatactctcagattgg

SEQ ID NO: 585047 - DNA, 20 bp, Artificial
  CRISPR gRNA sequence
tactctcagattggaagaaa

SEQ ID NO: 585048 - DNA, 20 bp, Artificial
  CRISPR gRNA sequence
ggaagaaatggcccctacgt

SEQ ID NO: 585049 - DNA, 20 bp, Artificial
  CRISPR gRNA sequence
aaatggcccctacgtgagat

SEQ ID NO: 585050 - DNA, 20 bp, Artificial
  CRISPR gRNA sequence
cgtgagatcagtgtaatgat

SEQ ID NO: 585051 - DNA, 20 bp, Artificial
  CRISPR gRNA sequence
tgagatcagtgtaatgatta

SEQ ID NO: 585052 - DNA, 20 bp, Artificial
  CRISPR gRNA sequence
aatgattagagtaacaaaaa

SEQ ID NO: 585053 - DNA, 20 bp, Artificial
  CRISPR gRNA sequence
caaaaatggaaacacaaaac

SEQ ID NO: 585054 - DNA, 20 bp, Artificial
  CRISPR gRNA sequence
aaaaatggaaacacaaaacg

SEQ ID NO: 585055 - DNA, 20 bp, Artificial
  CRISPR gRNA sequence
aaatggaaacacaaaacgag

SEQ ID NO: 585056 - DNA, 20 bp, Artificial
  CRISPR gRNA sequence
aacgaggagaaattatttca

SEQ ID NO: 585057 - DNA, 20 bp, Artificial
  CRISPR gRNA sequence
tatttcatggcactcaactt

SEQ ID NO: 585058 - DNA, 20 bp, Artificial
  CRISPR gRNA sequence
atgtcaaacatttccaaatt

SEQ ID NO: 585059 - DNA, 20 bp, Artificial
  CRISPR gRNA sequence
caaacatttccaaattaagc

SEQ ID NO: 585060 - DNA, 20 bp, Artificial
  CRISPR gRNA sequence
aaacctgatctatattctta

SEQ ID NO: 585061 - DNA, 20 bp, Artificial
  CRISPR gRNA sequence
ctatattcttaaagaactta

SEQ ID NO: 585062 - DNA, 20 bp, Artificial
  CRISPR gRNA sequence
ttcttaaagaacttacagtt

SEQ ID NO: 585063 - DNA, 20 bp, Artificial
  CRISPR gRNA sequence
ttaaagaacttacagtttgg

SEQ ID NO: 585064 - DNA, 20 bp, Artificial
  CRISPR gRNA sequence
taaagaacttacagtttgga

SEQ ID NO: 585065 - DNA, 20 bp, Artificial
  CRISPR gRNA sequence
ttacagtttggaaggaacaa

SEQ ID NO: 585066 - DNA, 20 bp, Artificial
  CRISPR gRNA sequence
ggaaggaacaatagcaattt

SEQ ID NO: 585067 - DNA, 20 bp, Artificial
  CRISPR gRNA sequence
gaaggaacaatagcaattta

SEQ ID NO: 585068 - DNA, 20 bp, Artificial
  CRISPR gRNA sequence
tttaaggatcatttacaaca

SEQ ID NO: 585069 - DNA, 20 bp, Artificial
  CRISPR gRNA sequence
ggatcatttacaacatagtg

SEQ ID NO: 585070 - DNA, 20 bp, Artificial
  CRISPR gRNA sequence
acatagtgtggtatgtgtga

SEQ ID NO: 585071 - DNA, 20 bp, Artificial
  CRISPR gRNA sequence
catagtgtggtatgtgtgat

SEQ ID NO: 585072 - DNA, 20 bp, Artificial
  CRISPR gRNA sequence
atagtgtggtatgtgtgatg

SEQ ID NO: 585073 - DNA, 20 bp, Artificial
  CRISPR gRNA sequence
tatgtgtgatggggtcaaat

SEQ ID NO: 585074 - DNA, 20 bp, Artificial
  CRISPR gRNA sequence
tgtgtgatggggtcaaataa

SEQ ID NO: 585075 - DNA, 20 bp, Artificial
  CRISPR gRNA sequence
gtgtgatggggtcaaataag

SEQ ID NO: 585076 - DNA, 20 bp, Artificial
  CRISPR gRNA sequence
ggtcaaataagaggaatatt

SEQ ID NO: 585077 - DNA, 20 bp, Artificial
  CRISPR gRNA sequence
gaggaatatttagctcatac

SEQ ID NO: 585078 - DNA, 20 bp, Artificial
  CRISPR gRNA sequence
aggaatatttagctcatacc

SEQ ID NO: 585079 - DNA, 20 bp, Artificial
  CRISPR gRNA sequence
ggaatatttagctcatacca

SEQ ID NO: 585080 - DNA, 20 bp, Artificial
  CRISPR gRNA sequence
gaatatttagctcataccag

SEQ ID NO: 585081 - DNA, 20 bp, Artificial
  CRISPR gRNA sequence
tagctcataccaggggacta

SEQ ID NO: 585082 - DNA, 20 bp, Artificial
  CRISPR gRNA sequence
agctcataccaggggactaa

SEQ ID NO: 585083 - DNA, 20 bp, Artificial
  CRISPR gRNA sequence
gactaaaggaacacttcttg

SEQ ID NO: 585084 - DNA, 20 bp, Artificial
  CRISPR gRNA sequence
actaaaggaacacttcttga

SEQ ID NO: 585085 - DNA, 20 bp, Artificial
  CRISPR gRNA sequence
ggaacacttcttgaaggaaa

SEQ ID NO: 585086 - DNA, 20 bp, Artificial
  CRISPR gRNA sequence
ttcttgaaggaaatggaatc

SEQ ID NO: 585087 - DNA, 20 bp, Artificial
  CRISPR gRNA sequence
tcttgaaggaaatggaatca

SEQ ID NO: 585088 - DNA, 20 bp, Artificial
  CRISPR gRNA sequence
caataatgtgattgtaaaca

SEQ ID NO: 585089 - DNA, 20 bp, Artificial
  CRISPR gRNA sequence
atgtgattgtaaacatagcc

SEQ ID NO: 585090 - DNA, 20 bp, Artificial
  CRISPR gRNA sequence
attgtaaacatagccaagtg

SEQ ID NO: 585091 - DNA, 20 bp, Artificial
  CRISPR gRNA sequence
atagccaagtgaagaaacat

SEQ ID NO: 585092 - DNA, 20 bp, Artificial
  CRISPR gRNA sequence
tagccaagtgaagaaacatg

SEQ ID NO: 585093 - DNA, 20 bp, Artificial
  CRISPR gRNA sequence
ccaagtgaagaaacatgagg

SEQ ID NO: 585094 - DNA, 20 bp, Artificial
  CRISPR gRNA sequence
aagtgaagaaacatgaggtg

SEQ ID NO: 585095 - DNA, 20 bp, Artificial
  CRISPR gRNA sequence
tgaagaaacatgaggtggag

SEQ ID NO: 585096 - DNA, 20 bp, Artificial
  CRISPR gRNA sequence
gaaacatgaggtggagtagc

SEQ ID NO: 585097 - DNA, 20 bp, Artificial
  CRISPR gRNA sequence
acatgaggtggagtagctgg

SEQ ID NO: 585098 - DNA, 20 bp, Artificial
  CRISPR gRNA sequence
gaggtggagtagctggtaga

SEQ ID NO: 585099 - DNA, 20 bp, Artificial
  CRISPR gRNA sequence
aggtggagtagctggtagaa

SEQ ID NO: 585100 - DNA, 20 bp, Artificial
  CRISPR gRNA sequence
gagtagctggtagaaaggat

SEQ ID NO: 585101 - DNA, 20 bp, Artificial
  CRISPR gRNA sequence
gtagctggtagaaaggatca

SEQ ID NO: 585102 - DNA, 20 bp, Artificial
  CRISPR gRNA sequence
tagctggtagaaaggatcag

SEQ ID NO: 585103 - DNA, 20 bp, Artificial
  CRISPR gRNA sequence
tggtagaaaggatcagaggc

SEQ ID NO: 585104 - DNA, 20 bp, Artificial
  CRISPR gRNA sequence
gtagaaaggatcagaggcaa

SEQ ID NO: 585105 - DNA, 20 bp, Artificial
  CRISPR gRNA sequence
tagaaaggatcagaggcaag

SEQ ID NO: 585106 - DNA, 20 bp, Artificial
  CRISPR gRNA sequence
agaaaggatcagaggcaaga

SEQ ID NO: 585107 - DNA, 20 bp, Artificial
  CRISPR gRNA sequence
gcaagagggcatcacttata

SEQ ID NO: 585108 - DNA, 20 bp, Artificial
  CRISPR gRNA sequence
caagagggcatcacttataa

SEQ ID NO: 585109 - DNA, 20 bp, Artificial
  CRISPR gRNA sequence
agagggcatcacttataaag

SEQ ID NO: 585110 - DNA, 20 bp, Artificial
  CRISPR gRNA sequence
gagggcatcacttataaagg

SEQ ID NO: 585111 - DNA, 20 bp, Artificial
  CRISPR gRNA sequence
ggaattacttatacttcaat

SEQ ID NO: 585112 - DNA, 20 bp, Artificial
  CRISPR gRNA sequence
gaattacttatacttcaata

SEQ ID NO: 585113 - DNA, 20 bp, Artificial
  CRISPR gRNA sequence
acttatacttcaataaggct

SEQ ID NO: 585114 - DNA, 20 bp, Artificial
  CRISPR gRNA sequence
ttatacttcaataaggctga

SEQ ID NO: 585115 - DNA, 20 bp, Artificial
  CRISPR gRNA sequence
tacttcaataaggctgagag

SEQ ID NO: 585116 - DNA, 20 bp, Artificial
  CRISPR gRNA sequence
ataaggctgagagtagaaac

SEQ ID NO: 585117 - DNA, 20 bp, Artificial
  CRISPR gRNA sequence
gagagtagaaacaagtgcga

SEQ ID NO: 585118 - DNA, 20 bp, Artificial
  CRISPR gRNA sequence
tagaaacaagtgcgaaagac

SEQ ID NO: 585119 - DNA, 20 bp, Artificial
  CRISPR gRNA sequence
aacaagtgcgaaagacaagt

SEQ ID NO: 585120 - DNA, 20 bp, Artificial
  CRISPR gRNA sequence
aaagacaagttagataatat

SEQ ID NO: 585121 - DNA, 20 bp, Artificial
  CRISPR gRNA sequence
aagacaagttagataatata

SEQ ID NO: 585122 - DNA, 20 bp, Artificial
  CRISPR gRNA sequence
aaaatttgaatatttcccta

SEQ ID NO: 585123 - DNA, 20 bp, Artificial
  CRISPR gRNA sequence
aaatttgaatatttccctaa

SEQ ID NO: 585124 - DNA, 20 bp, Artificial
  CRISPR gRNA sequence
aatatttccctaaaggaata

SEQ ID NO: 585125 - DNA, 20 bp, Artificial
  CRISPR gRNA sequence
ccctaaaggaatacagattg

SEQ ID NO: 585126 - DNA, 20 bp, Artificial
  CRISPR gRNA sequence
cctaaaggaatacagattga

SEQ ID NO: 585127 - DNA, 20 bp, Artificial
  CRISPR gRNA sequence
ctaaaggaatacagattgaa

SEQ ID NO: 585128 - DNA, 20 bp, Artificial
  CRISPR gRNA sequence
taaaggaatacagattgaag

SEQ ID NO: 585129 - DNA, 20 bp, Artificial
  CRISPR gRNA sequence
acagattgaaggggataaac

SEQ ID NO: 585130 - DNA, 20 bp, Artificial
  CRISPR gRNA sequence
cagattgaaggggataaaca

SEQ ID NO: 585131 - DNA, 20 bp, Artificial
  CRISPR gRNA sequence
attgaaggggataaacaagg

SEQ ID NO: 585132 - DNA, 20 bp, Artificial
  CRISPR gRNA sequence
ataaacaaggaagtgccctg

SEQ ID NO: 585133 - DNA, 20 bp, Artificial
  CRISPR gRNA sequence
taaacaaggaagtgccctga

SEQ ID NO: 585134 - DNA, 20 bp, Artificial
  CRISPR gRNA sequence
gtgccctgaaggtattcatt

SEQ ID NO: 585135 - DNA, 20 bp, Artificial
  CRISPR gRNA sequence
ctgaaggtattcatttagca

SEQ ID NO: 585136 - DNA, 20 bp, Artificial
  CRISPR gRNA sequence
tgaaggtattcatttagcaa

SEQ ID NO: 585137 - DNA, 20 bp, Artificial
  CRISPR gRNA sequence
gaaggtattcatttagcaaa

SEQ ID NO: 585138 - DNA, 20 bp, Artificial
  CRISPR gRNA sequence
aaggtattcatttagcaaag

SEQ ID NO: 585139 - DNA, 20 bp, Artificial
  CRISPR gRNA sequence
attcatttagcaaaggggtt

SEQ ID NO: 585140 - DNA, 20 bp, Artificial
  CRISPR gRNA sequence
ttcatttagcaaaggggttt

SEQ ID NO: 585141 - DNA, 20 bp, Artificial
  CRISPR gRNA sequence
ggtttaggaaattgctgctc

SEQ ID NO: 585142 - DNA, 20 bp, Artificial
  CRISPR gRNA sequence
gtttaggaaattgctgctct

SEQ ID NO: 585143 - DNA, 20 bp, Artificial
  CRISPR gRNA sequence
aaattgctgctctaggtttc

SEQ ID NO: 585144 - DNA, 20 bp, Artificial
  CRISPR gRNA sequence
gctgctctaggtttctggcc

SEQ ID NO: 585145 - DNA, 20 bp, Artificial
  CRISPR gRNA sequence
ctgctctaggtttctggcct

SEQ ID NO: 585146 - DNA, 20 bp, Artificial
  CRISPR gRNA sequence
ggtttctggcctaggaaatt

SEQ ID NO: 585147 - DNA, 20 bp, Artificial
  CRISPR gRNA sequence
ttctggcctaggaaatttag

SEQ ID NO: 585148 - DNA, 20 bp, Artificial
  CRISPR gRNA sequence
gaaatttagtagatgacaat

SEQ ID NO: 585149 - DNA, 20 bp, Artificial
  CRISPR gRNA sequence
tttagtagatgacaatgaga

SEQ ID NO: 585150 - DNA, 20 bp, Artificial
  CRISPR gRNA sequence
tagatgacaatgagatagaa

SEQ ID NO: 585151 - DNA, 20 bp, Artificial
  CRISPR gRNA sequence
gatagaaaagatgatgaatt

SEQ ID NO: 585152 - DNA, 20 bp, Artificial
  CRISPR gRNA sequence
aaaagatgatgaattcagtt

SEQ ID NO: 585153 - DNA, 20 bp, Artificial
  CRISPR gRNA sequence
aaagatgatgaattcagttt

SEQ ID NO: 585154 - DNA, 20 bp, Artificial
  CRISPR gRNA sequence
agatgatgaattcagtttgg

SEQ ID NO: 585155 - DNA, 20 bp, Artificial
  CRISPR gRNA sequence
gatgatgaattcagtttggg

SEQ ID NO: 585156 - DNA, 20 bp, Artificial
  CRISPR gRNA sequence
attcagtttgggaggactat

SEQ ID NO: 585157 - DNA, 20 bp, Artificial
  CRISPR gRNA sequence
ctatgagtaataataatgtc

SEQ ID NO: 585158 - DNA, 20 bp, Artificial
  CRISPR gRNA sequence
gagtaataataatgtccagt

SEQ ID NO: 585159 - DNA, 20 bp, Artificial
  CRISPR gRNA sequence
ataataatgtccagtaagtt

SEQ ID NO: 585160 - DNA, 20 bp, Artificial
  CRISPR gRNA sequence
agtaagtttagtctcaaatt

SEQ ID NO: 585161 - DNA, 20 bp, Artificial
  CRISPR gRNA sequence
aagtttagtctcaaattcag

SEQ ID NO: 585162 - DNA, 20 bp, Artificial
  CRISPR gRNA sequence
gtttagtctcaaattcagaa

SEQ ID NO: 585163 - DNA, 20 bp, Artificial
  CRISPR gRNA sequence
ttagtctcaaattcagaaga

SEQ ID NO: 585164 - DNA, 20 bp, Artificial
  CRISPR gRNA sequence
tcaaattcagaagagagacc

SEQ ID NO: 585165 - DNA, 20 bp, Artificial
  CRISPR gRNA sequence
caaattcagaagagagacct

SEQ ID NO: 585166 - DNA, 20 bp, Artificial
  CRISPR gRNA sequence
cagaagagagacctgggctt

SEQ ID NO: 585167 - DNA, 20 bp, Artificial
  CRISPR gRNA sequence
agagacctgggcttgagatg

SEQ ID NO: 585168 - DNA, 20 bp, Artificial
  CRISPR gRNA sequence
tgggcttgagatgtagaaat

SEQ ID NO: 585169 - DNA, 20 bp, Artificial
  CRISPR gRNA sequence
gagatgtagaaatgagtcat

SEQ ID NO: 585170 - DNA, 20 bp, Artificial
  CRISPR gRNA sequence
agaaatgagtcatcagttga

SEQ ID NO: 585171 - DNA, 20 bp, Artificial
  CRISPR gRNA sequence
atgagtcatcagttgataga

SEQ ID NO: 585172 - DNA, 20 bp, Artificial
  CRISPR gRNA sequence
ttgatagaaagcaacttctg

SEQ ID NO: 585173 - DNA, 20 bp, Artificial
  CRISPR gRNA sequence
agaaagcaacttctgaagcc

SEQ ID NO: 585174 - DNA, 20 bp, Artificial
  CRISPR gRNA sequence
gaaagcaacttctgaagcca

SEQ ID NO: 585175 - DNA, 20 bp, Artificial
  CRISPR gRNA sequence
aggaaataactgatatcacc

SEQ ID NO: 585176 - DNA, 20 bp, Artificial
  CRISPR gRNA sequence
ggaaataactgatatcaccc

SEQ ID NO: 585177 - DNA, 20 bp, Artificial
  CRISPR gRNA sequence
aataactgatatcacccagg

SEQ ID NO: 585178 - DNA, 20 bp, Artificial
  CRISPR gRNA sequence
taactgatatcacccaggta

SEQ ID NO: 585179 - DNA, 20 bp, Artificial
  CRISPR gRNA sequence
tatcacccaggtagagtgtg

SEQ ID NO: 585180 - DNA, 20 bp, Artificial
  CRISPR gRNA sequence
atcacccaggtagagtgtga

SEQ ID NO: 585181 - DNA, 20 bp, Artificial
  CRISPR gRNA sequence
tcacccaggtagagtgtgaa

SEQ ID NO: 585182 - DNA, 20 bp, Artificial
  CRISPR gRNA sequence
cacccaggtagagtgtgaag

SEQ ID NO: 585183 - DNA, 20 bp, Artificial
  CRISPR gRNA sequence
caggtagagtgtgaagggga

SEQ ID NO: 585184 - DNA, 20 bp, Artificial
  CRISPR gRNA sequence
aggtagagtgtgaaggggat

SEQ ID NO: 585185 - DNA, 20 bp, Artificial
  CRISPR gRNA sequence
tgaaggggatgggtcaaaaa

SEQ ID NO: 585186 - DNA, 20 bp, Artificial
  CRISPR gRNA sequence
gatgggtcaaaaatagaacc

SEQ ID NO: 585187 - DNA, 20 bp, Artificial
  CRISPR gRNA sequence
atagaacctggaataacact

SEQ ID NO: 585188 - DNA, 20 bp, Artificial
  CRISPR gRNA sequence
aagatttgtctgcctactca

SEQ ID NO: 585189 - DNA, 20 bp, Artificial
  CRISPR gRNA sequence
ttgtctgcctactcatagat

SEQ ID NO: 585190 - DNA, 20 bp, Artificial
  CRISPR gRNA sequence
tgtctgcctactcatagatc

SEQ ID NO: 585191 - DNA, 20 bp, Artificial
  CRISPR gRNA sequence
gtctgcctactcatagatca

SEQ ID NO: 585192 - DNA, 20 bp, Artificial
  CRISPR gRNA sequence
gcctactcatagatcaggga

SEQ ID NO: 585193 - DNA, 20 bp, Artificial
  CRISPR gRNA sequence
tactcatagatcagggaaag

SEQ ID NO: 585194 - DNA, 20 bp, Artificial
  CRISPR gRNA sequence
actcatagatcagggaaagt

SEQ ID NO: 585195 - DNA, 20 bp, Artificial
  CRISPR gRNA sequence
ctcatagatcagggaaagtg

SEQ ID NO: 585196 - DNA, 20 bp, Artificial
  CRISPR gRNA sequence
agggaaagtggggtttgcac

SEQ ID NO: 585197 - DNA, 20 bp, Artificial
  CRISPR gRNA sequence
gggaaagtggggtttgcact

SEQ ID NO: 585198 - DNA, 20 bp, Artificial
  CRISPR gRNA sequence
tttgcactgggccccatgtt

SEQ ID NO: 585199 - DNA, 20 bp, Artificial
  CRISPR gRNA sequence
ttgcactgggccccatgttt

SEQ ID NO: 585200 - DNA, 20 bp, Artificial
  CRISPR gRNA sequence
tgcactgggccccatgttta

SEQ ID NO: 585201 - DNA, 20 bp, Artificial
  CRISPR gRNA sequence
cactgggccccatgtttagg

SEQ ID NO: 585202 - DNA, 20 bp, Artificial
  CRISPR gRNA sequence
gccccatgtttagggagccc

SEQ ID NO: 585203 - DNA, 20 bp, Artificial
  CRISPR gRNA sequence
ccccatgtttagggagccct

SEQ ID NO: 585204 - DNA, 20 bp, Artificial
  CRISPR gRNA sequence
gagccctgggcctttcttct

SEQ ID NO: 585205 - DNA, 20 bp, Artificial
  CRISPR gRNA sequence
agccctgggcctttcttctc

SEQ ID NO: 585206 - DNA, 20 bp, Artificial
  CRISPR gRNA sequence
ggcctttcttctcaggaaat

SEQ ID NO: 585207 - DNA, 20 bp, Artificial
  CRISPR gRNA sequence
gcctttcttctcaggaaatg

SEQ ID NO: 585208 - DNA, 20 bp, Artificial
  CRISPR gRNA sequence
ctttcttctcaggaaatgag

SEQ ID NO: 585209 - DNA, 20 bp, Artificial
  CRISPR gRNA sequence
ctcaggaaatgaggagcttc

SEQ ID NO: 585210 - DNA, 20 bp, Artificial
  CRISPR gRNA sequence
tcaggaaatgaggagcttct

SEQ ID NO: 585211 - DNA, 20 bp, Artificial
  CRISPR gRNA sequence
caggaaatgaggagcttcta

SEQ ID NO: 585212 - DNA, 20 bp, Artificial
  CRISPR gRNA sequence
aatgaggagcttctagggcc

SEQ ID NO: 585213 - DNA, 20 bp, Artificial
  CRISPR gRNA sequence
atgaggagcttctagggcca

SEQ ID NO: 585214 - DNA, 20 bp, Artificial
  CRISPR gRNA sequence
tgaggagcttctagggccaa

SEQ ID NO: 585215 - DNA, 20 bp, Artificial
  CRISPR gRNA sequence
caagggaatgtgctgatctg

SEQ ID NO: 585216 - DNA, 20 bp, Artificial
  CRISPR gRNA sequence
gtgctgatctgaagctcact

SEQ ID NO: 585217 - DNA, 20 bp, Artificial
  CRISPR gRNA sequence
tctgaagctcactcagaccc

SEQ ID NO: 585218 - DNA, 20 bp, Artificial
  CRISPR gRNA sequence
cccagaattccttgcccaaa

SEQ ID NO: 585219 - DNA, 20 bp, Artificial
  CRISPR gRNA sequence
ttccttgcccaaatggttct

SEQ ID NO: 585220 - DNA, 20 bp, Artificial
  CRISPR gRNA sequence
aatggttctgagcctgcttc

SEQ ID NO: 585221 - DNA, 20 bp, Artificial
  CRISPR gRNA sequence
atggttctgagcctgcttct

SEQ ID NO: 585222 - DNA, 20 bp, Artificial
  CRISPR gRNA sequence
tggttctgagcctgcttcta

SEQ ID NO: 585223 - DNA, 20 bp, Artificial
  CRISPR gRNA sequence
gcctgcttctagggactaca

SEQ ID NO: 585224 - DNA, 20 bp, Artificial
  CRISPR gRNA sequence
ggactacacagtcctcttca

SEQ ID NO: 585225 - DNA, 20 bp, Artificial
  CRISPR gRNA sequence
gactacacagtcctcttcat

SEQ ID NO: 585226 - DNA, 20 bp, Artificial
  CRISPR gRNA sequence
actacacagtcctcttcata

SEQ ID NO: 585227 - DNA, 20 bp, Artificial
  CRISPR gRNA sequence
cttcataccaactgtgctac

SEQ ID NO: 585228 - DNA, 20 bp, Artificial
  CRISPR gRNA sequence
ataccaactgtgctactggt

SEQ ID NO: 585229 - DNA, 20 bp, Artificial
  CRISPR gRNA sequence
gctactggtaagcacacacc

SEQ ID NO: 585230 - DNA, 20 bp, Artificial
  CRISPR gRNA sequence
ctactggtaagcacacacct

SEQ ID NO: 585231 - DNA, 20 bp, Artificial
  CRISPR gRNA sequence
aagcacacacctaggcctga

SEQ ID NO: 585232 - DNA, 20 bp, Artificial
  CRISPR gRNA sequence
cacacctaggcctgatggcc

SEQ ID NO: 585233 - DNA, 20 bp, Artificial
  CRISPR gRNA sequence
acacctaggcctgatggcca

SEQ ID NO: 585234 - DNA, 20 bp, Artificial
  CRISPR gRNA sequence
aggcctgatggccaaggcac

SEQ ID NO: 585235 - DNA, 20 bp, Artificial
  CRISPR gRNA sequence
gtctttatgtgcaatgtaaa

SEQ ID NO: 585236 - DNA, 20 bp, Artificial
  CRISPR gRNA sequence
tgtgcaatgtaaaaagaacc

SEQ ID NO: 585237 - DNA, 20 bp, Artificial
  CRISPR gRNA sequence
gtaaaaagaacctggatatg

SEQ ID NO: 585238 - DNA, 20 bp, Artificial
  CRISPR gRNA sequence
taaaaagaacctggatatgc

SEQ ID NO: 585239 - DNA, 20 bp, Artificial
  CRISPR gRNA sequence
aagaacctggatatgcaggc

SEQ ID NO: 585240 - DNA, 20 bp, Artificial
  CRISPR gRNA sequence
agaacctggatatgcaggct

SEQ ID NO: 585241 - DNA, 20 bp, Artificial
  CRISPR gRNA sequence
gaacctggatatgcaggctg

SEQ ID NO: 585242 - DNA, 20 bp, Artificial
  CRISPR gRNA sequence
gtgtccatacatgtgtgtgt

SEQ ID NO: 585243 - DNA, 20 bp, Artificial
  CRISPR gRNA sequence
tgtgtgtgtgagaccccctt

SEQ ID NO: 585244 - DNA, 20 bp, Artificial
  CRISPR gRNA sequence
tgtgagaccccctttggtaa

SEQ ID NO: 585245 - DNA, 20 bp, Artificial
  CRISPR gRNA sequence
tgagaccccctttggtaatg

SEQ ID NO: 585246 - DNA, 20 bp, Artificial
  CRISPR gRNA sequence
agaccccctttggtaatgga

SEQ ID NO: 585247 - DNA, 20 bp, Artificial
  CRISPR gRNA sequence
cctttggtaatggagagaac

SEQ ID NO: 585248 - DNA, 20 bp, Artificial
  CRISPR gRNA sequence
ctttggtaatggagagaact

SEQ ID NO: 585249 - DNA, 20 bp, Artificial
  CRISPR gRNA sequence
ttggtaatggagagaactag

SEQ ID NO: 585250 - DNA, 20 bp, Artificial
  CRISPR gRNA sequence
gtaatggagagaactaggag

SEQ ID NO: 585251 - DNA, 20 bp, Artificial
  CRISPR gRNA sequence
taatggagagaactaggagt

SEQ ID NO: 585252 - DNA, 20 bp, Artificial
  CRISPR gRNA sequence
agagaactaggagtgggtct

SEQ ID NO: 585253 - DNA, 20 bp, Artificial
  CRISPR gRNA sequence
agaactaggagtgggtctaa

SEQ ID NO: 585254 - DNA, 20 bp, Artificial
  CRISPR gRNA sequence
aactaggagtgggtctaaga

SEQ ID NO: 585255 - DNA, 20 bp, Artificial
  CRISPR gRNA sequence
actaggagtgggtctaagag

SEQ ID NO: 585256 - DNA, 20 bp, Artificial
  CRISPR gRNA sequence
taggagtgggtctaagagag

SEQ ID NO: 585257 - DNA, 20 bp, Artificial
  CRISPR gRNA sequence
gtgggtctaagagaggagcc

SEQ ID NO: 585258 - DNA, 20 bp, Artificial
  CRISPR gRNA sequence
taagagaggagcctagctgt

SEQ ID NO: 585259 - DNA, 20 bp, Artificial
  CRISPR gRNA sequence
agaggagcctagctgtaagc

SEQ ID NO: 585260 - DNA, 20 bp, Artificial
  CRISPR gRNA sequence
ggagcctagctgtaagccag

SEQ ID NO: 585261 - DNA, 20 bp, Artificial
  CRISPR gRNA sequence
gagcctagctgtaagccagt

SEQ ID NO: 585262 - DNA, 20 bp, Artificial
  CRISPR gRNA sequence
cctagctgtaagccagtggg

SEQ ID NO: 585263 - DNA, 20 bp, Artificial
  CRISPR gRNA sequence
gtggttctgctcgtgctgcc

SEQ ID NO: 585264 - DNA, 20 bp, Artificial
  CRISPR gRNA sequence
tggttctgctcgtgctgcca

SEQ ID NO: 585265 - DNA, 20 bp, Artificial
  CRISPR gRNA sequence
ctgctcgtgctgccaaggtg

SEQ ID NO: 585266 - DNA, 20 bp, Artificial
  CRISPR gRNA sequence
cgtgctgccaaggtgtagtg

SEQ ID NO: 585267 - DNA, 20 bp, Artificial
  CRISPR gRNA sequence
tgctgccaaggtgtagtgta

SEQ ID NO: 585268 - DNA, 20 bp, Artificial
  CRISPR gRNA sequence
caaggtgtagtgtagagcta

SEQ ID NO: 585269 - DNA, 20 bp, Artificial
  CRISPR gRNA sequence
aaggtgtagtgtagagctac

SEQ ID NO: 585270 - DNA, 20 bp, Artificial
  CRISPR gRNA sequence
tgtagagctacaggaaatct

SEQ ID NO: 585271 - DNA, 20 bp, Artificial
  CRISPR gRNA sequence
attgcatatttatttgaact

SEQ ID NO: 585272 - DNA, 20 bp, Artificial
  CRISPR gRNA sequence
atatttatttgaacttagtc

SEQ ID NO: 585273 - DNA, 20 bp, Artificial
  CRISPR gRNA sequence
ttatttgaacttagtcaagt

SEQ ID NO: 585274 - DNA, 20 bp, Artificial
  CRISPR gRNA sequence
tttgaacttagtcaagttgg

SEQ ID NO: 585275 - DNA, 20 bp, Artificial
  CRISPR gRNA sequence
ttgaacttagtcaagttgga

SEQ ID NO: 585276 - DNA, 20 bp, Artificial
  CRISPR gRNA sequence
tgaacttagtcaagttggaa

SEQ ID NO: 585277 - DNA, 20 bp, Artificial
  CRISPR gRNA sequence
acttagtcaagttggaaggg

SEQ ID NO: 585278 - DNA, 20 bp, Artificial
  CRISPR gRNA sequence
aagttggaagggtagaaaat

SEQ ID NO: 585279 - DNA, 20 bp, Artificial
  CRISPR gRNA sequence
agggtagaaaataagtttta

SEQ ID NO: 585280 - DNA, 20 bp, Artificial
  CRISPR gRNA sequence
tagaaaataagttttacagt

SEQ ID NO: 585281 - DNA, 20 bp, Artificial
  CRISPR gRNA sequence
atttataatataaaaatatt

SEQ ID NO: 585282 - DNA, 20 bp, Artificial
  CRISPR gRNA sequence
tttataatataaaaatattt

SEQ ID NO: 585283 - DNA, 20 bp, Artificial
  CRISPR gRNA sequence
aaaatatttaggcatatgaa

SEQ ID NO: 585284 - DNA, 20 bp, Artificial
  CRISPR gRNA sequence
aaatatttaggcatatgaat

SEQ ID NO: 585285 - DNA, 20 bp, Artificial
  CRISPR gRNA sequence
aatatttaggcatatgaatg

SEQ ID NO: 585286 - DNA, 20 bp, Artificial
  CRISPR gRNA sequence
atatttaggcatatgaatgg

SEQ ID NO: 585287 - DNA, 20 bp, Artificial
  CRISPR gRNA sequence
gggggcctccatttgtactt

SEQ ID NO: 585288 - DNA, 20 bp, Artificial
  CRISPR gRNA sequence
tgtactttggccaacttgca

SEQ ID NO: 585289 - DNA, 20 bp, Artificial
  CRISPR gRNA sequence
ggccaacttgcatagctgtt

SEQ ID NO: 585290 - DNA, 20 bp, Artificial
  CRISPR gRNA sequence
gccaacttgcatagctgtta

SEQ ID NO: 585291 - DNA, 20 bp, Artificial
  CRISPR gRNA sequence
cttgcatagctgttaaggat

SEQ ID NO: 585292 - DNA, 20 bp, Artificial
  CRISPR gRNA sequence
gctgttaaggataagtctga

SEQ ID NO: 585293 - DNA, 20 bp, Artificial
  CRISPR gRNA sequence
gtctgaaagaatactgaaca

SEQ ID NO: 585294 - DNA, 20 bp, Artificial
  CRISPR gRNA sequence
gaaagaatactgaacacagt

SEQ ID NO: 585295 - DNA, 20 bp, Artificial
  CRISPR gRNA sequence
aagaatactgaacacagtca

SEQ ID NO: 585296 - DNA, 20 bp, Artificial
  CRISPR gRNA sequence
gaatactgaacacagtcaga

SEQ ID NO: 585297 - DNA, 20 bp, Artificial
  CRISPR gRNA sequence
atactgaacacagtcagaga

SEQ ID NO: 585298 - DNA, 20 bp, Artificial
  CRISPR gRNA sequence
actgaacacagtcagagaga

SEQ ID NO: 585299 - DNA, 20 bp, Artificial
  CRISPR gRNA sequence
agaacaatgtcataaaaacc

SEQ ID NO: 585300 - DNA, 20 bp, Artificial
  CRISPR gRNA sequence
aatgtcataaaaaccaagaa

SEQ ID NO: 585301 - DNA, 20 bp, Artificial
  CRISPR gRNA sequence
tgtcataaaaaccaagaaaa

SEQ ID NO: 585302 - DNA, 20 bp, Artificial
  CRISPR gRNA sequence
aagaaaagagtgtgtttcca

SEQ ID NO: 585303 - DNA, 20 bp, Artificial
  CRISPR gRNA sequence
agaaaagagtgtgtttccaa

SEQ ID NO: 585304 - DNA, 20 bp, Artificial
  CRISPR gRNA sequence
caaaggaattgactattcaa

SEQ ID NO: 585305 - DNA, 20 bp, Artificial
  CRISPR gRNA sequence
aggaattgactattcaatag

SEQ ID NO: 585306 - DNA, 20 bp, Artificial
  CRISPR gRNA sequence
aattgactattcaatagtgg

SEQ ID NO: 585307 - DNA, 20 bp, Artificial
  CRISPR gRNA sequence
caatagtggcagatactctc

SEQ ID NO: 585308 - DNA, 20 bp, Artificial
  CRISPR gRNA sequence
aatagtggcagatactctct

SEQ ID NO: 585309 - DNA, 20 bp, Artificial
  CRISPR gRNA sequence
tagtggcagatactctctag

SEQ ID NO: 585310 - DNA, 20 bp, Artificial
  CRISPR gRNA sequence
atactctctaggagctgtgt

SEQ ID NO: 585311 - DNA, 20 bp, Artificial
  CRISPR gRNA sequence
tgtgtaagatactgtcttaa

SEQ ID NO: 585312 - DNA, 20 bp, Artificial
  CRISPR gRNA sequence
tgtaagatactgtcttaaaa

SEQ ID NO: 585313 - DNA, 20 bp, Artificial
  CRISPR gRNA sequence
ttaaaagagtctactcgatt

SEQ ID NO: 585314 - DNA, 20 bp, Artificial
  CRISPR gRNA sequence
gtctactcgatttggcacta

SEQ ID NO: 585315 - DNA, 20 bp, Artificial
  CRISPR gRNA sequence
tactcgatttggcactacag

SEQ ID NO: 585316 - DNA, 20 bp, Artificial
  CRISPR gRNA sequence
cgatttggcactacagaagc

SEQ ID NO: 585317 - DNA, 20 bp, Artificial
  CRISPR gRNA sequence
acagaagctagttgtgacct

SEQ ID NO: 585318 - DNA, 20 bp, Artificial
  CRISPR gRNA sequence
aagctagttgtgacctcagt

SEQ ID NO: 585319 - DNA, 20 bp, Artificial
  CRISPR gRNA sequence
ctcagtgagaataattttaa

SEQ ID NO: 585320 - DNA, 20 bp, Artificial
  CRISPR gRNA sequence
cagtgagaataattttaatg

SEQ ID NO: 585321 - DNA, 20 bp, Artificial
  CRISPR gRNA sequence
agaataattttaatggagtg

SEQ ID NO: 585322 - DNA, 20 bp, Artificial
  CRISPR gRNA sequence
gaataattttaatggagtgt

SEQ ID NO: 585323 - DNA, 20 bp, Artificial
  CRISPR gRNA sequence
aattttaatggagtgtggga

SEQ ID NO: 585324 - DNA, 20 bp, Artificial
  CRISPR gRNA sequence
tggagtgtgggaaagaaaaa

SEQ ID NO: 585325 - DNA, 20 bp, Artificial
  CRISPR gRNA sequence
ggagtgtgggaaagaaaaac

SEQ ID NO: 585326 - DNA, 20 bp, Artificial
  CRISPR gRNA sequence
ggaaagaaaaacaggttgca

SEQ ID NO: 585327 - DNA, 20 bp, Artificial
  CRISPR gRNA sequence
aaaaacaggttgcatggact

SEQ ID NO: 585328 - DNA, 20 bp, Artificial
  CRISPR gRNA sequence
tgcatggacttggaaatgaa

SEQ ID NO: 585329 - DNA, 20 bp, Artificial
  CRISPR gRNA sequence
aaaaaaaaatcattgaaaac

SEQ ID NO: 585330 - DNA, 20 bp, Artificial
  CRISPR gRNA sequence
aaaatcattgaaaacaagca

SEQ ID NO: 585331 - DNA, 20 bp, Artificial
  CRISPR gRNA sequence
aatcattgaaaacaagcaca

SEQ ID NO: 585332 - DNA, 20 bp, Artificial
  CRISPR gRNA sequence
tttcaacaatttcatctttg

SEQ ID NO: 585333 - DNA, 20 bp, Artificial
  CRISPR gRNA sequence
acaatttcatctttgaagaa

SEQ ID NO: 585334 - DNA, 20 bp, Artificial
  CRISPR gRNA sequence
caatttcatctttgaagaaa

SEQ ID NO: 585335 - DNA, 20 bp, Artificial
  CRISPR gRNA sequence
atttcatctttgaagaaaag

SEQ ID NO: 585336 - DNA, 20 bp, Artificial
  CRISPR gRNA sequence
ctttgaagaaaaggagacta

SEQ ID NO: 585337 - DNA, 20 bp, Artificial
  CRISPR gRNA sequence
tttgaagaaaaggagactac

SEQ ID NO: 585338 - DNA, 20 bp, Artificial
  CRISPR gRNA sequence
aaggagactacaggtgtacc

SEQ ID NO: 585339 - DNA, 20 bp, Artificial
  CRISPR gRNA sequence
gagactacaggtgtacctgg

SEQ ID NO: 585340 - DNA, 20 bp, Artificial
  CRISPR gRNA sequence
agactacaggtgtacctgga

SEQ ID NO: 585341 - DNA, 20 bp, Artificial
  CRISPR gRNA sequence
actacaggtgtacctggaag

SEQ ID NO: 585342 - DNA, 20 bp, Artificial
  CRISPR gRNA sequence
caggtgtacctggaaggaga

SEQ ID NO: 585343 - DNA, 20 bp, Artificial
  CRISPR gRNA sequence
aggtgtacctggaaggagat

SEQ ID NO: 585344 - DNA, 20 bp, Artificial
  CRISPR gRNA sequence
ggtgtacctggaaggagatg

SEQ ID NO: 585345 - DNA, 20 bp, Artificial
  CRISPR gRNA sequence
ctggaaggagatggggctta

SEQ ID NO: 585346 - DNA, 20 bp, Artificial
  CRISPR gRNA sequence
tggaaggagatggggcttaa

SEQ ID NO: 585347 - DNA, 20 bp, Artificial
  CRISPR gRNA sequence
aaggagatggggcttaaagg

SEQ ID NO: 585348 - DNA, 20 bp, Artificial
  CRISPR gRNA sequence
ggaagattttttttaattat

SEQ ID NO: 585349 - DNA, 20 bp, Artificial
  CRISPR gRNA sequence
tttattgcattaaatgctga

SEQ ID NO: 585350 - DNA, 20 bp, Artificial
  CRISPR gRNA sequence
ttattgcattaaatgctgat

SEQ ID NO: 585351 - DNA, 20 bp, Artificial
  CRISPR gRNA sequence
tgctgataggaaatgcccaa

SEQ ID NO: 585352 - DNA, 20 bp, Artificial
  CRISPR gRNA sequence
ctgataggaaatgcccaata

SEQ ID NO: 585353 - DNA, 20 bp, Artificial
  CRISPR gRNA sequence
tgataggaaatgcccaatag

SEQ ID NO: 585354 - DNA, 20 bp, Artificial
  CRISPR gRNA sequence
gataggaaatgcccaataga

SEQ ID NO: 585355 - DNA, 20 bp, Artificial
  CRISPR gRNA sequence
ataggaaatgcccaatagag

SEQ ID NO: 585356 - DNA, 20 bp, Artificial
  CRISPR gRNA sequence
aggaaatgcccaatagaggg

SEQ ID NO: 585357 - DNA, 20 bp, Artificial
  CRISPR gRNA sequence
gaaatgcccaatagagggga

SEQ ID NO: 585358 - DNA, 20 bp, Artificial
  CRISPR gRNA sequence
aaatgcccaatagaggggag

SEQ ID NO: 585359 - DNA, 20 bp, Artificial
  CRISPR gRNA sequence
aggggagaggttaaaaatgt

SEQ ID NO: 585360 - DNA, 20 bp, Artificial
  CRISPR gRNA sequence
gagaggttaaaaatgtaagt

SEQ ID NO: 585361 - DNA, 20 bp, Artificial
  CRISPR gRNA sequence
ggttaaaaatgtaagtgaga

SEQ ID NO: 585362 - DNA, 20 bp, Artificial
  CRISPR gRNA sequence
ttaaaaatgtaagtgagaaa

SEQ ID NO: 585363 - DNA, 20 bp, Artificial
  CRISPR gRNA sequence
taaaaatgtaagtgagaaag

SEQ ID NO: 585364 - DNA, 20 bp, Artificial
  CRISPR gRNA sequence
tgagaaagaggaaaaaataa

SEQ ID NO: 585365 - DNA, 20 bp, Artificial
  CRISPR gRNA sequence
agaggaaaaaataatagcgt

SEQ ID NO: 585366 - DNA, 20 bp, Artificial
  CRISPR gRNA sequence
gaggaaaaaataatagcgtg

SEQ ID NO: 585367 - DNA, 20 bp, Artificial
  CRISPR gRNA sequence
aaataatagcgtgaggtatc

SEQ ID NO: 585368 - DNA, 20 bp, Artificial
  CRISPR gRNA sequence
aataatagcgtgaggtatct

SEQ ID NO: 585369 - DNA, 20 bp, Artificial
  CRISPR gRNA sequence
ataatagcgtgaggtatctg

SEQ ID NO: 585370 - DNA, 20 bp, Artificial
  CRISPR gRNA sequence
taatagcgtgaggtatctgg

SEQ ID NO: 585371 - DNA, 20 bp, Artificial
  CRISPR gRNA sequence
aatagcgtgaggtatctggg

SEQ ID NO: 585372 - DNA, 20 bp, Artificial
  CRISPR gRNA sequence
gcgtgaggtatctggggggc

SEQ ID NO: 585373 - DNA, 20 bp, Artificial
  CRISPR gRNA sequence
cgtgaggtatctggggggcc

SEQ ID NO: 585374 - DNA, 20 bp, Artificial
  CRISPR gRNA sequence
aggtatctggggggccagga

SEQ ID NO: 585375 - DNA, 20 bp, Artificial
  CRISPR gRNA sequence
ggtatctggggggccaggat

SEQ ID NO: 585376 - DNA, 20 bp, Artificial
  CRISPR gRNA sequence
tatctggggggccaggatag

SEQ ID NO: 585377 - DNA, 20 bp, Artificial
  CRISPR gRNA sequence
ataggagaattcctgtgcac

SEQ ID NO: 585378 - DNA, 20 bp, Artificial
  CRISPR gRNA sequence
aggagaattcctgtgcacaa

SEQ ID NO: 585379 - DNA, 20 bp, Artificial
  CRISPR gRNA sequence
ggagaattcctgtgcacaag

SEQ ID NO: 585380 - DNA, 20 bp, Artificial
  CRISPR gRNA sequence
gagaattcctgtgcacaaga

SEQ ID NO: 585381 - DNA, 20 bp, Artificial
  CRISPR gRNA sequence
agaattcctgtgcacaagag

SEQ ID NO: 585382 - DNA, 20 bp, Artificial
  CRISPR gRNA sequence
gaattcctgtgcacaagagg

SEQ ID NO: 585383 - DNA, 20 bp, Artificial
  CRISPR gRNA sequence
gagggggaatgaactttaat

SEQ ID NO: 585384 - DNA, 20 bp, Artificial
  CRISPR gRNA sequence
gggaatgaactttaattaga

SEQ ID NO: 585385 - DNA, 20 bp, Artificial
  CRISPR gRNA sequence
gaatgaactttaattagaaa

SEQ ID NO: 585386 - DNA, 20 bp, Artificial
  CRISPR gRNA sequence
aatgaactttaattagaaag

SEQ ID NO: 585387 - DNA, 20 bp, Artificial
  CRISPR gRNA sequence
atgaactttaattagaaaga

SEQ ID NO: 585388 - DNA, 20 bp, Artificial
  CRISPR gRNA sequence
actttaattagaaagaggga

SEQ ID NO: 585389 - DNA, 20 bp, Artificial
  CRISPR gRNA sequence
gatagttgtttcattgaaat

SEQ ID NO: 585390 - DNA, 20 bp, Artificial
  CRISPR gRNA sequence
atagttgtttcattgaaata

SEQ ID NO: 585391 - DNA, 20 bp, Artificial
  CRISPR gRNA sequence
tttcattgaaataaggaaaa

SEQ ID NO: 585392 - DNA, 20 bp, Artificial
  CRISPR gRNA sequence
gaaataaggaaaaaagataa

SEQ ID NO: 585393 - DNA, 20 bp, Artificial
  CRISPR gRNA sequence
aaaagataaaagcatttaca

SEQ ID NO: 585394 - DNA, 20 bp, Artificial
  CRISPR gRNA sequence
catggatgcatacaatccta

SEQ ID NO: 585395 - DNA, 20 bp, Artificial
  CRISPR gRNA sequence
tgcatacaatcctatagaat

SEQ ID NO: 585396 - DNA, 20 bp, Artificial
  CRISPR gRNA sequence
tggtaatattatgttgaaat

SEQ ID NO: 585397 - DNA, 20 bp, Artificial
  CRISPR gRNA sequence
tattatgttgaaatcagttc

SEQ ID NO: 585398 - DNA, 20 bp, Artificial
  CRISPR gRNA sequence
gattttatcccctgtgaata

SEQ ID NO: 585399 - DNA, 20 bp, Artificial
  CRISPR gRNA sequence
tcccctgtgaatatagatat

SEQ ID NO: 585400 - DNA, 20 bp, Artificial
  CRISPR gRNA sequence
aatatagatataagatcacc

SEQ ID NO: 585401 - DNA, 20 bp, Artificial
  CRISPR gRNA sequence
atatagatataagatcacca

SEQ ID NO: 585402 - DNA, 20 bp, Artificial
  CRISPR gRNA sequence
atagatataagatcaccaag

SEQ ID NO: 585403 - DNA, 20 bp, Artificial
  CRISPR gRNA sequence
atataagatcaccaaggagt

SEQ ID NO: 585404 - DNA, 20 bp, Artificial
  CRISPR gRNA sequence
aagatcaccaaggagtgaga

SEQ ID NO: 585405 - DNA, 20 bp, Artificial
  CRISPR gRNA sequence
ggagtgagacagcatgtttg

SEQ ID NO: 585406 - DNA, 20 bp, Artificial
  CRISPR gRNA sequence
agtgagacagcatgtttgca

SEQ ID NO: 585407 - DNA, 20 bp, Artificial
  CRISPR gRNA sequence
tgagacagcatgtttgcaga

SEQ ID NO: 585408 - DNA, 20 bp, Artificial
  CRISPR gRNA sequence
cagcatgtttgcagagagta

SEQ ID NO: 585409 - DNA, 20 bp, Artificial
  CRISPR gRNA sequence
catgtttgcagagagtacag

SEQ ID NO: 585410 - DNA, 20 bp, Artificial
  CRISPR gRNA sequence
atgtttgcagagagtacaga

SEQ ID NO: 585411 - DNA, 20 bp, Artificial
  CRISPR gRNA sequence
ttgcagagagtacagaaggt

SEQ ID NO: 585412 - DNA, 20 bp, Artificial
  CRISPR gRNA sequence
acagaaggttggcactgtca

SEQ ID NO: 585413 - DNA, 20 bp, Artificial
  CRISPR gRNA sequence
gaaggttggcactgtcatgg

SEQ ID NO: 585414 - DNA, 20 bp, Artificial
  CRISPR gRNA sequence
aggttggcactgtcatggtg

SEQ ID NO: 585415 - DNA, 20 bp, Artificial
  CRISPR gRNA sequence
gttggcactgtcatggtgga

SEQ ID NO: 585416 - DNA, 20 bp, Artificial
  CRISPR gRNA sequence
ggcactgtcatggtggagag

SEQ ID NO: 585417 - DNA, 20 bp, Artificial
  CRISPR gRNA sequence
gcactgtcatggtggagagc

SEQ ID NO: 585418 - DNA, 20 bp, Artificial
  CRISPR gRNA sequence
actgtcatggtggagagcag

SEQ ID NO: 585419 - DNA, 20 bp, Artificial
  CRISPR gRNA sequence
tgtcatggtggagagcagga

SEQ ID NO: 585420 - DNA, 20 bp, Artificial
  CRISPR gRNA sequence
gagcaggagagatgattctt

SEQ ID NO: 585421 - DNA, 20 bp, Artificial
  CRISPR gRNA sequence
agcaggagagatgattcttc

SEQ ID NO: 585422 - DNA, 20 bp, Artificial
  CRISPR gRNA sequence
gcaggagagatgattcttca

SEQ ID NO: 585423 - DNA, 20 bp, Artificial
  CRISPR gRNA sequence
tcttcagggatgctgctcca

SEQ ID NO: 585424 - DNA, 20 bp, Artificial
  CRISPR gRNA sequence
cttcagggatgctgctccat

SEQ ID NO: 585425 - DNA, 20 bp, Artificial
  CRISPR gRNA sequence
agggatgctgctccatagga

SEQ ID NO: 585426 - DNA, 20 bp, Artificial
  CRISPR gRNA sequence
atgctgctccataggatgga

SEQ ID NO: 585427 - DNA, 20 bp, Artificial
  CRISPR gRNA sequence
tgctgctccataggatggat

SEQ ID NO: 585428 - DNA, 20 bp, Artificial
  CRISPR gRNA sequence
gctccataggatggataggc

SEQ ID NO: 585429 - DNA, 20 bp, Artificial
  CRISPR gRNA sequence
tggataggccagctgatatt

SEQ ID NO: 585430 - DNA, 20 bp, Artificial
  CRISPR gRNA sequence
ggataggccagctgatattt

SEQ ID NO: 585431 - DNA, 20 bp, Artificial
  CRISPR gRNA sequence
ggccagctgatatttgggat

SEQ ID NO: 585432 - DNA, 20 bp, Artificial
  CRISPR gRNA sequence
atatattgatgccaactcat

SEQ ID NO: 585433 - DNA, 20 bp, Artificial
  CRISPR gRNA sequence
gatgccaactcatcagcctg

SEQ ID NO: 585434 - DNA, 20 bp, Artificial
  CRISPR gRNA sequence
gcctgtggaattttctccaa

SEQ ID NO: 585435 - DNA, 20 bp, Artificial
  CRISPR gRNA sequence
ggaattttctccaaaagtac

SEQ ID NO: 585436 - DNA, 20 bp, Artificial
  CRISPR gRNA sequence
ctccaaaagtaccagatgtg

SEQ ID NO: 585437 - DNA, 20 bp, Artificial
  CRISPR gRNA sequence
tccaaaagtaccagatgtgc

SEQ ID NO: 585438 - DNA, 20 bp, Artificial
  CRISPR gRNA sequence
aaagtaccagatgtgcaggc

SEQ ID NO: 585439 - DNA, 20 bp, Artificial
  CRISPR gRNA sequence
aagtaccagatgtgcaggct

SEQ ID NO: 585440 - DNA, 20 bp, Artificial
  CRISPR gRNA sequence
agtaccagatgtgcaggctg

SEQ ID NO: 585441 - DNA, 20 bp, Artificial
  CRISPR gRNA sequence
tgcaggctggggtgcacatc

SEQ ID NO: 585442 - DNA, 20 bp, Artificial
  CRISPR gRNA sequence
ggctggggtgcacatctagt

SEQ ID NO: 585443 - DNA, 20 bp, Artificial
  CRISPR gRNA sequence
gtgcacatctagtgagatat

SEQ ID NO: 585444 - DNA, 20 bp, Artificial
  CRISPR gRNA sequence
catctagtgagatataagta

SEQ ID NO: 585445 - DNA, 20 bp, Artificial
  CRISPR gRNA sequence
tagtgagatataagtatgga

SEQ ID NO: 585446 - DNA, 20 bp, Artificial
  CRISPR gRNA sequence
agtgagatataagtatggaa

SEQ ID NO: 585447 - DNA, 20 bp, Artificial
  CRISPR gRNA sequence
ataagtatggaaaggatgct

SEQ ID NO: 585448 - DNA, 20 bp, Artificial
  CRISPR gRNA sequence
gtatggaaaggatgctcagt

SEQ ID NO: 585449 - DNA, 20 bp, Artificial
  CRISPR gRNA sequence
ggatgctcagtcagctttac

SEQ ID NO: 585450 - DNA, 20 bp, Artificial
  CRISPR gRNA sequence
gctcagtcagctttacaaga

SEQ ID NO: 585451 - DNA, 20 bp, Artificial
  CRISPR gRNA sequence
cagtcagctttacaagacag

SEQ ID NO: 585452 - DNA, 20 bp, Artificial
  CRISPR gRNA sequence
agtcagctttacaagacagt

SEQ ID NO: 585453 - DNA, 20 bp, Artificial
  CRISPR gRNA sequence
gtcagctttacaagacagta

SEQ ID NO: 585454 - DNA, 20 bp, Artificial
  CRISPR gRNA sequence
acaagacagtagggtttcat

SEQ ID NO: 585455 - DNA, 20 bp, Artificial
  CRISPR gRNA sequence
caagacagtagggtttcatc

SEQ ID NO: 585456 - DNA, 20 bp, Artificial
  CRISPR gRNA sequence
agacagtagggtttcatcag

SEQ ID NO: 585457 - DNA, 20 bp, Artificial
  CRISPR gRNA sequence
cagtagggtttcatcaggag

SEQ ID NO: 585458 - DNA, 20 bp, Artificial
  CRISPR gRNA sequence
agtagggtttcatcaggaga

SEQ ID NO: 585459 - DNA, 20 bp, Artificial
  CRISPR gRNA sequence
gtagggtttcatcaggagaa

SEQ ID NO: 585460 - DNA, 20 bp, Artificial
  CRISPR gRNA sequence
tagggtttcatcaggagaag

SEQ ID NO: 585461 - DNA, 20 bp, Artificial
  CRISPR gRNA sequence
tcatcaggagaaggggatga

SEQ ID NO: 585462 - DNA, 20 bp, Artificial
  CRISPR gRNA sequence
aggagaaggggatgatagat

SEQ ID NO: 585463 - DNA, 20 bp, Artificial
  CRISPR gRNA sequence
gggatgatagatcagccaac

SEQ ID NO: 585464 - DNA, 20 bp, Artificial
  CRISPR gRNA sequence
ggatgatagatcagccaaca

SEQ ID NO: 585465 - DNA, 20 bp, Artificial
  CRISPR gRNA sequence
gatagatcagccaacaaggc

SEQ ID NO: 585466 - DNA, 20 bp, Artificial
  CRISPR gRNA sequence
gatcagccaacaaggcaaga

SEQ ID NO: 585467 - DNA, 20 bp, Artificial
  CRISPR gRNA sequence
atcagccaacaaggcaagaa

SEQ ID NO: 585468 - DNA, 20 bp, Artificial
  CRISPR gRNA sequence
gccaacaaggcaagaaaggc

SEQ ID NO: 585469 - DNA, 20 bp, Artificial
  CRISPR gRNA sequence
ggcaagaaaggcaagaatat

SEQ ID NO: 585470 - DNA, 20 bp, Artificial
  CRISPR gRNA sequence
agaaaggcaagaatattggc

SEQ ID NO: 585471 - DNA, 20 bp, Artificial
  CRISPR gRNA sequence
aaaggcaagaatattggcaa

SEQ ID NO: 585472 - DNA, 20 bp, Artificial
  CRISPR gRNA sequence
aggcaagaatattggcaaga

SEQ ID NO: 585473 - DNA, 20 bp, Artificial
  CRISPR gRNA sequence
gaatattggcaagagagatg

SEQ ID NO: 585474 - DNA, 20 bp, Artificial
  CRISPR gRNA sequence
tattggcaagagagatgtag

SEQ ID NO: 585475 - DNA, 20 bp, Artificial
  CRISPR gRNA sequence
aagagagatgtagaagtgat

SEQ ID NO: 585476 - DNA, 20 bp, Artificial
  CRISPR gRNA sequence
gatgtagaagtgatgagcca

SEQ ID NO: 585477 - DNA, 20 bp, Artificial
  CRISPR gRNA sequence
agtgatgagccatggaatct

SEQ ID NO: 585478 - DNA, 20 bp, Artificial
  CRISPR gRNA sequence
ccatggaatctaagctgaat

SEQ ID NO: 585479 - DNA, 20 bp, Artificial
  CRISPR gRNA sequence
gaatctaagctgaataagaa

SEQ ID NO: 585480 - DNA, 20 bp, Artificial
  CRISPR gRNA sequence
atctaagctgaataagaaaa

SEQ ID NO: 585481 - DNA, 20 bp, Artificial
  CRISPR gRNA sequence
ctaagctgaataagaaaaga

SEQ ID NO: 585482 - DNA, 20 bp, Artificial
  CRISPR gRNA sequence
taagctgaataagaaaagag

SEQ ID NO: 585483 - DNA, 20 bp, Artificial
  CRISPR gRNA sequence
aagctgaataagaaaagaga

SEQ ID NO: 585484 - DNA, 20 bp, Artificial
  CRISPR gRNA sequence
gctgaataagaaaagagagg

SEQ ID NO: 585485 - DNA, 20 bp, Artificial
  CRISPR gRNA sequence
tgaataagaaaagagaggga

SEQ ID NO: 585486 - DNA, 20 bp, Artificial
  CRISPR gRNA sequence
aagaaaagagagggagagac

SEQ ID NO: 585487 - DNA, 20 bp, Artificial
  CRISPR gRNA sequence
aaaagagagggagagacaag

SEQ ID NO: 585488 - DNA, 20 bp, Artificial
  CRISPR gRNA sequence
gggagagacaagtagatatg

SEQ ID NO: 585489 - DNA, 20 bp, Artificial
  CRISPR gRNA sequence
ggagagacaagtagatatgc

SEQ ID NO: 585490 - DNA, 20 bp, Artificial
  CRISPR gRNA sequence
gagacaagtagatatgcagg

SEQ ID NO: 585491 - DNA, 20 bp, Artificial
  CRISPR gRNA sequence
aagtagatatgcaggaagtt

SEQ ID NO: 585492 - DNA, 20 bp, Artificial
  CRISPR gRNA sequence
agtagatatgcaggaagttc

SEQ ID NO: 585493 - DNA, 20 bp, Artificial
  CRISPR gRNA sequence
gtagatatgcaggaagttca

SEQ ID NO: 585494 - DNA, 20 bp, Artificial
  CRISPR gRNA sequence
gcaggaagttcagggatcat

SEQ ID NO: 585495 - DNA, 20 bp, Artificial
  CRISPR gRNA sequence
aagttcagggatcattggtc

SEQ ID NO: 585496 - DNA, 20 bp, Artificial
  CRISPR gRNA sequence
gttcagggatcattggtctg

SEQ ID NO: 585497 - DNA, 20 bp, Artificial
  CRISPR gRNA sequence
attggtctggagaatttgat

SEQ ID NO: 585498 - DNA, 20 bp, Artificial
  CRISPR gRNA sequence
ttggtctggagaatttgata

SEQ ID NO: 585499 - DNA, 20 bp, Artificial
  CRISPR gRNA sequence
tggagaatttgataaggtca

SEQ ID NO: 585500 - DNA, 20 bp, Artificial
  CRISPR gRNA sequence
aatttgataaggtcaaagaa

SEQ ID NO: 585501 - DNA, 20 bp, Artificial
  CRISPR gRNA sequence
tcaaagaatagtatttaact

SEQ ID NO: 585502 - DNA, 20 bp, Artificial
  CRISPR gRNA sequence
caaagaatagtatttaactg

SEQ ID NO: 585503 - DNA, 20 bp, Artificial
  CRISPR gRNA sequence
tagtatttaactgaggcaca

SEQ ID NO: 585504 - DNA, 20 bp, Artificial
  CRISPR gRNA sequence
gtatttaactgaggcacatg

SEQ ID NO: 585505 - DNA, 20 bp, Artificial
  CRISPR gRNA sequence
tttaactgaggcacatggag

SEQ ID NO: 585506 - DNA, 20 bp, Artificial
  CRISPR gRNA sequence
ttaactgaggcacatggaga

SEQ ID NO: 585507 - DNA, 20 bp, Artificial
  CRISPR gRNA sequence
tggagaaggcaatttataat

SEQ ID NO: 585508 - DNA, 20 bp, Artificial
  CRISPR gRNA sequence
aaggcaatttataataagtg

SEQ ID NO: 585509 - DNA, 20 bp, Artificial
  CRISPR gRNA sequence
atgatgaaattttttgtttc

SEQ ID NO: 585510 - DNA, 20 bp, Artificial
  CRISPR gRNA sequence
ttttgtttcaagaacaataa

SEQ ID NO: 585511 - DNA, 20 bp, Artificial
  CRISPR gRNA sequence
tgtttcaagaacaataacag

SEQ ID NO: 585512 - DNA, 20 bp, Artificial
  CRISPR gRNA sequence
ttcaagaacaataacagaag

SEQ ID NO: 585513 - DNA, 20 bp, Artificial
  CRISPR gRNA sequence
aataacagaagtagttacta

SEQ ID NO: 585514 - DNA, 20 bp, Artificial
  CRISPR gRNA sequence
tactgtttgttatatattac

SEQ ID NO: 585515 - DNA, 20 bp, Artificial
  CRISPR gRNA sequence
actgtttgttatatattact

SEQ ID NO: 585516 - DNA, 20 bp, Artificial
  CRISPR gRNA sequence
tttgttatatattactagga

SEQ ID NO: 585517 - DNA, 20 bp, Artificial
  CRISPR gRNA sequence
actaggatagaatccaaata

SEQ ID NO: 585518 - DNA, 20 bp, Artificial
  CRISPR gRNA sequence
aaaatataatataaatattt

SEQ ID NO: 585519 - DNA, 20 bp, Artificial
  CRISPR gRNA sequence
tcataatgtaattttctaaa

SEQ ID NO: 585520 - DNA, 20 bp, Artificial
  CRISPR gRNA sequence
aaaagctgtccctcttttct

SEQ ID NO: 585521 - DNA, 20 bp, Artificial
  CRISPR gRNA sequence
aaagctgtccctcttttcta

SEQ ID NO: 585522 - DNA, 20 bp, Artificial
  CRISPR gRNA sequence
tccctcttttctaaggaatg

SEQ ID NO: 585523 - DNA, 20 bp, Artificial
  CRISPR gRNA sequence
gaatgcagtgaaataaaatt

SEQ ID NO: 585524 - DNA, 20 bp, Artificial
  CRISPR gRNA sequence
atgcagtgaaataaaattga

SEQ ID NO: 585525 - DNA, 20 bp, Artificial
  CRISPR gRNA sequence
aaattgagagtaacatctct

SEQ ID NO: 585526 - DNA, 20 bp, Artificial
  CRISPR gRNA sequence
tgagagtaacatctctaagt

SEQ ID NO: 585527 - DNA, 20 bp, Artificial
  CRISPR gRNA sequence
gagagtaacatctctaagtc

SEQ ID NO: 585528 - DNA, 20 bp, Artificial
  CRISPR gRNA sequence
acatgacaaaaaacgttaca

SEQ ID NO: 585529 - DNA, 20 bp, Artificial
  CRISPR gRNA sequence
atgacaaaaaacgttacaaa

SEQ ID NO: 585530 - DNA, 20 bp, Artificial
  CRISPR gRNA sequence
acaaaaaacgttacaaagag

SEQ ID NO: 585531 - DNA, 20 bp, Artificial
  CRISPR gRNA sequence
aagagtagactatataaatt

SEQ ID NO: 585532 - DNA, 20 bp, Artificial
  CRISPR gRNA sequence
agtagactatataaattcag

SEQ ID NO: 585533 - DNA, 20 bp, Artificial
  CRISPR gRNA sequence
gactatataaattcagaaga

SEQ ID NO: 585534 - DNA, 20 bp, Artificial
  CRISPR gRNA sequence
atataaattcagaagacaga

SEQ ID NO: 585535 - DNA, 20 bp, Artificial
  CRISPR gRNA sequence
tttattttttccaactacat

SEQ ID NO: 585536 - DNA, 20 bp, Artificial
  CRISPR gRNA sequence
tattttttccaactacatta

SEQ ID NO: 585537 - DNA, 20 bp, Artificial
  CRISPR gRNA sequence
tttccaactacattagagtc

SEQ ID NO: 585538 - DNA, 20 bp, Artificial
  CRISPR gRNA sequence
caactacattagagtctagt

SEQ ID NO: 585539 - DNA, 20 bp, Artificial
  CRISPR gRNA sequence
attagagtctagttagattt

SEQ ID NO: 585540 - DNA, 20 bp, Artificial
  CRISPR gRNA sequence
aaaaaatcaatattaaaaat

SEQ ID NO: 585541 - DNA, 20 bp, Artificial
  CRISPR gRNA sequence
aatattaaaaataagtaaac

SEQ ID NO: 585542 - DNA, 20 bp, Artificial
  CRISPR gRNA sequence
tctttatttcttttttttca

SEQ ID NO: 585543 - DNA, 20 bp, Artificial
  CRISPR gRNA sequence
tttttttcatagttacccac

SEQ ID NO: 585544 - DNA, 20 bp, Artificial
  CRISPR gRNA sequence
ttcatagttacccacaagaa

SEQ ID NO: 585545 - DNA, 20 bp, Artificial
  CRISPR gRNA sequence
tacccacaagaacagaaaaa

SEQ ID NO: 585546 - DNA, 20 bp, Artificial
  CRISPR gRNA sequence
gaacagaaaaaaagttacca

SEQ ID NO: 585547 - DNA, 20 bp, Artificial
  CRISPR gRNA sequence
aacagaaaaaaagttaccaa

SEQ ID NO: 585548 - DNA, 20 bp, Artificial
  CRISPR gRNA sequence
aaaaaagttaccaaaggcct

SEQ ID NO: 585549 - DNA, 20 bp, Artificial
  CRISPR gRNA sequence
aaaaagttaccaaaggcctg

SEQ ID NO: 585550 - DNA, 20 bp, Artificial
  CRISPR gRNA sequence
aagttaccaaaggcctgagg

SEQ ID NO: 585551 - DNA, 20 bp, Artificial
  CRISPR gRNA sequence
gcagtcctttgtgtataact

SEQ ID NO: 585552 - DNA, 20 bp, Artificial
  CRISPR gRNA sequence
cagtcctttgtgtataactc

SEQ ID NO: 585553 - DNA, 20 bp, Artificial
  CRISPR gRNA sequence
agtcctttgtgtataactca

SEQ ID NO: 585554 - DNA, 20 bp, Artificial
  CRISPR gRNA sequence
gtcctttgtgtataactcag

SEQ ID NO: 585555 - DNA, 20 bp, Artificial
  CRISPR gRNA sequence
aactgacataatataaacta

SEQ ID NO: 585556 - DNA, 20 bp, Artificial
  CRISPR gRNA sequence
aatataaactatggccctta

SEQ ID NO: 585557 - DNA, 20 bp, Artificial
  CRISPR gRNA sequence
atggcccttatagtcaccct

SEQ ID NO: 585558 - DNA, 20 bp, Artificial
  CRISPR gRNA sequence
tggcccttatagtcaccctt

SEQ ID NO: 585559 - DNA, 20 bp, Artificial
  CRISPR gRNA sequence
cccttaggccttctttcaat

SEQ ID NO: 585560 - DNA, 20 bp, Artificial
  CRISPR gRNA sequence
gagttctcaataaatccctc

SEQ ID NO: 585561 - DNA, 20 bp, Artificial
  CRISPR gRNA sequence
tctcaataaatccctccagc

SEQ ID NO: 585562 - DNA, 20 bp, Artificial
  CRISPR gRNA sequence
taaatccctccagctagtct

SEQ ID NO: 585563 - DNA, 20 bp, Artificial
  CRISPR gRNA sequence
aatccctccagctagtctta

SEQ ID NO: 585564 - DNA, 20 bp, Artificial
  CRISPR gRNA sequence
ctagtcttagagtgctattt

SEQ ID NO: 585565 - DNA, 20 bp, Artificial
  CRISPR gRNA sequence
gtgctattttggtgatgtgt

SEQ ID NO: 585566 - DNA, 20 bp, Artificial
  CRISPR gRNA sequence
atgtgttagttcttcaattt

SEQ ID NO: 585567 - DNA, 20 bp, Artificial
  CRISPR gRNA sequence
gttcttcaatttcagattga

SEQ ID NO: 585568 - DNA, 20 bp, Artificial
  CRISPR gRNA sequence
ttcttcaatttcagattgaa

SEQ ID NO: 585569 - DNA, 20 bp, Artificial
  CRISPR gRNA sequence
attgaaaggaaaccttcttt

SEQ ID NO: 585570 - DNA, 20 bp, Artificial
  CRISPR gRNA sequence
ccttctttaagtgtttattg

SEQ ID NO: 585571 - DNA, 20 bp, Artificial
  CRISPR gRNA sequence
ttaagtgtttattgaagtaa

SEQ ID NO: 585572 - DNA, 20 bp, Artificial
  CRISPR gRNA sequence
tctcctccctgaaataacca

SEQ ID NO: 585573 - DNA, 20 bp, Artificial
  CRISPR gRNA sequence
tccctgaaataaccaaagca

SEQ ID NO: 585574 - DNA, 20 bp, Artificial
  CRISPR gRNA sequence
tgtctcaatcaccatttaat

SEQ ID NO: 585575 - DNA, 20 bp, Artificial
  CRISPR gRNA sequence
gtctcaatcaccatttaatc

SEQ ID NO: 585576 - DNA, 20 bp, Artificial
  CRISPR gRNA sequence
atgtcccacaatgctgacac

SEQ ID NO: 585577 - DNA, 20 bp, Artificial
  CRISPR gRNA sequence
caatgctgacactagaatgt

SEQ ID NO: 585578 - DNA, 20 bp, Artificial
  CRISPR gRNA sequence
tttgaatatttttatcctaa

SEQ ID NO: 585579 - DNA, 20 bp, Artificial
  CRISPR gRNA sequence
ttattcatatttcttttaaa

SEQ ID NO: 585580 - DNA, 20 bp, Artificial
  CRISPR gRNA sequence
gtccatgctttttgtatcct

SEQ ID NO: 585581 - DNA, 20 bp, Artificial
  CRISPR gRNA sequence
ccatgctttttgtatcctca

SEQ ID NO: 585582 - DNA, 20 bp, Artificial
  CRISPR gRNA sequence
cagagacaatctatgactta

SEQ ID NO: 585583 - DNA, 20 bp, Artificial
  CRISPR gRNA sequence
tatgacttacagcatgcatc

SEQ ID NO: 585584 - DNA, 20 bp, Artificial
  CRISPR gRNA sequence
atccagaatgatgccaacat

SEQ ID NO: 585585 - DNA, 20 bp, Artificial
  CRISPR gRNA sequence
tccagaatgatgccaacatt

SEQ ID NO: 585586 - DNA, 20 bp, Artificial
  CRISPR gRNA sequence
tgccaacattgggcgtatca

SEQ ID NO: 585587 - DNA, 20 bp, Artificial
  CRISPR gRNA sequence
gggcgtatcaaagaatatct

SEQ ID NO: 585588 - DNA, 20 bp, Artificial
  CRISPR gRNA sequence
ggcgtatcaaagaatatcta

SEQ ID NO: 585589 - DNA, 20 bp, Artificial
  CRISPR gRNA sequence
gcgtatcaaagaatatctaa

SEQ ID NO: 585590 - DNA, 20 bp, Artificial
  CRISPR gRNA sequence
tcaaagaatatctaagggtt

SEQ ID NO: 585591 - DNA, 20 bp, Artificial
  CRISPR gRNA sequence
tctaagggttcggaaatgaa

SEQ ID NO: 585592 - DNA, 20 bp, Artificial
  CRISPR gRNA sequence
ctaagggttcggaaatgaaa

SEQ ID NO: 585593 - DNA, 20 bp, Artificial
  CRISPR gRNA sequence
taagggttcggaaatgaaaa

SEQ ID NO: 585594 - DNA, 20 bp, Artificial
  CRISPR gRNA sequence
ggttcggaaatgaaaaggga

SEQ ID NO: 585595 - DNA, 20 bp, Artificial
  CRISPR gRNA sequence
tatatgatatttaatctttt

SEQ ID NO: 585596 - DNA, 20 bp, Artificial
  CRISPR gRNA sequence
atcttttcagttcaaaatca

SEQ ID NO: 585597 - DNA, 20 bp, Artificial
  CRISPR gRNA sequence
tcttttcagttcaaaatcat

SEQ ID NO: 585598 - DNA, 20 bp, Artificial
  CRISPR gRNA sequence
ttcagttcaaaatcataggc

SEQ ID NO: 585599 - DNA, 20 bp, Artificial
  CRISPR gRNA sequence
ataggctggatgaaaaaaca

SEQ ID NO: 585600 - DNA, 20 bp, Artificial
  CRISPR gRNA sequence
aaagattaaaatatgaaata

SEQ ID NO: 585601 - DNA, 20 bp, Artificial
  CRISPR gRNA sequence
aatatgaaacatcttgaatg

SEQ ID NO: 585602 - DNA, 20 bp, Artificial
  CRISPR gRNA sequence
atatgaaacatcttgaatgt

SEQ ID NO: 585603 - DNA, 20 bp, Artificial
  CRISPR gRNA sequence
gctgcattatttttccaatg

SEQ ID NO: 585604 - DNA, 20 bp, Artificial
  CRISPR gRNA sequence
caatgcagaattttgaaaaa

SEQ ID NO: 585605 - DNA, 20 bp, Artificial
  CRISPR gRNA sequence
aagaaaaattatcttcattc

SEQ ID NO: 585606 - DNA, 20 bp, Artificial
  CRISPR gRNA sequence
taattaacccatttatgcct

SEQ ID NO: 585607 - DNA, 20 bp, Artificial
  CRISPR gRNA sequence
aattaacccatttatgcctg

SEQ ID NO: 585608 - DNA, 20 bp, Artificial
  CRISPR gRNA sequence
tttgttttaatttttgcaat

SEQ ID NO: 585609 - DNA, 20 bp, Artificial
  CRISPR gRNA sequence
taatttttgcaatcagacct

SEQ ID NO: 585610 - DNA, 20 bp, Artificial
  CRISPR gRNA sequence
cagaccttggcgatgacctt

SEQ ID NO: 585611 - DNA, 20 bp, Artificial
  CRISPR gRNA sequence
accttggcgatgaccttgag

SEQ ID NO: 585612 - DNA, 20 bp, Artificial
  CRISPR gRNA sequence
ttggcgatgaccttgagcag

SEQ ID NO: 585613 - DNA, 20 bp, Artificial
  CRISPR gRNA sequence
tggcgatgaccttgagcagt

SEQ ID NO: 585614 - DNA, 20 bp, Artificial
  CRISPR gRNA sequence
ataaataactcccacatgct

SEQ ID NO: 585615 - DNA, 20 bp, Artificial
  CRISPR gRNA sequence
catgcttagcgttccaataa

SEQ ID NO: 585616 - DNA, 20 bp, Artificial
  CRISPR gRNA sequence
atgcttagcgttccaataat

SEQ ID NO: 585617 - DNA, 20 bp, Artificial
  CRISPR gRNA sequence
gcgttccaataatgggacac

SEQ ID NO: 585618 - DNA, 20 bp, Artificial
  CRISPR gRNA sequence
cgttccaataatgggacact

SEQ ID NO: 585619 - DNA, 20 bp, Artificial
  CRISPR gRNA sequence
acactaggcataaatgttaa

SEQ ID NO: 585620 - DNA, 20 bp, Artificial
  CRISPR gRNA sequence
cactaggcataaatgttaat

SEQ ID NO: 585621 - DNA, 20 bp, Artificial
  CRISPR gRNA sequence
ttaataggttaaaaaaaaaa

SEQ ID NO: 585622 - DNA, 20 bp, Artificial
  CRISPR gRNA sequence
cactaatgaaaattttaaaa

SEQ ID NO: 585623 - DNA, 20 bp, Artificial
  CRISPR gRNA sequence
tttaaaacagattacaaaac

SEQ ID NO: 585624 - DNA, 20 bp, Artificial
  CRISPR gRNA sequence
cagattacaaaactggccaa

SEQ ID NO: 585625 - DNA, 20 bp, Artificial
  CRISPR gRNA sequence
agattacaaaactggccaat

SEQ ID NO: 585626 - DNA, 20 bp, Artificial
  CRISPR gRNA sequence
tacaaaactggccaataggc

SEQ ID NO: 585627 - DNA, 20 bp, Artificial
  CRISPR gRNA sequence
ttctgtatgactatttttta

SEQ ID NO: 585628 - DNA, 20 bp, Artificial
  CRISPR gRNA sequence
tttatatatcatcatatttt

SEQ ID NO: 585629 - DNA, 20 bp, Artificial
  CRISPR gRNA sequence
tatatcatcatattttgaga

SEQ ID NO: 585630 - DNA, 20 bp, Artificial
  CRISPR gRNA sequence
tttgagatggtgaccactat

SEQ ID NO: 585631 - DNA, 20 bp, Artificial
  CRISPR gRNA sequence
tcatatgtatttgtgtgtgt

SEQ ID NO: 585632 - DNA, 20 bp, Artificial
  CRISPR gRNA sequence
gtatttgtgtgtgttggtgt

SEQ ID NO: 585633 - DNA, 20 bp, Artificial
  CRISPR gRNA sequence
tgtgtgtgttggtgtaagtg

SEQ ID NO: 585634 - DNA, 20 bp, Artificial
  CRISPR gRNA sequence
tggtgtaagtgtggtgtaca

SEQ ID NO: 585635 - DNA, 20 bp, Artificial
  CRISPR gRNA sequence
gtgtggtgtacacagaatgt

SEQ ID NO: 585636 - DNA, 20 bp, Artificial
  CRISPR gRNA sequence
gtggtgtacacagaatgtca

SEQ ID NO: 585637 - DNA, 20 bp, Artificial
  CRISPR gRNA sequence
ggtgtacacagaatgtcaga

SEQ ID NO: 585638 - DNA, 20 bp, Artificial
  CRISPR gRNA sequence
cagaatgtcagagagtaaaa

SEQ ID NO: 585639 - DNA, 20 bp, Artificial
  CRISPR gRNA sequence
gagagtaaaaaagaataatg

SEQ ID NO: 585640 - DNA, 20 bp, Artificial
  CRISPR gRNA sequence
taaaaaagaataatgaagaa

SEQ ID NO: 585641 - DNA, 20 bp, Artificial
  CRISPR gRNA sequence
aaaaagaataatgaagaaaa

SEQ ID NO: 585642 - DNA, 20 bp, Artificial
  CRISPR gRNA sequence
agaataatgaagaaaagaga

SEQ ID NO: 585643 - DNA, 20 bp, Artificial
  CRISPR gRNA sequence
gaataatgaagaaaagagat

SEQ ID NO: 585644 - DNA, 20 bp, Artificial
  CRISPR gRNA sequence
ccatatatatttctaataca

SEQ ID NO: 585645 - DNA, 20 bp, Artificial
  CRISPR gRNA sequence
catatatatttctaatacat

SEQ ID NO: 585646 - DNA, 20 bp, Artificial
  CRISPR gRNA sequence
cctattaacatcaccttgca

SEQ ID NO: 585647 - DNA, 20 bp, Artificial
  CRISPR gRNA sequence
atcaccttgcaaagaaacaa

SEQ ID NO: 585648 - DNA, 20 bp, Artificial
  CRISPR gRNA sequence
tgcttacccacaaacttttg

SEQ ID NO: 585649 - DNA, 20 bp, Artificial
  CRISPR gRNA sequence
cttacccacaaacttttgtg

SEQ ID NO: 585650 - DNA, 20 bp, Artificial
  CRISPR gRNA sequence
acccacaaacttttgtggag

SEQ ID NO: 585651 - DNA, 20 bp, Artificial
  CRISPR gRNA sequence
ccacaaacttttgtggagtg

SEQ ID NO: 585652 - DNA, 20 bp, Artificial
  CRISPR gRNA sequence
cgttttcccatattccccgt

SEQ ID NO: 585653 - DNA, 20 bp, Artificial
  CRISPR gRNA sequence
ccccgtgagcttctctatga

SEQ ID NO: 585654 - DNA, 20 bp, Artificial
  CRISPR gRNA sequence
cgtgagcttctctatgacag

SEQ ID NO: 585655 - DNA, 20 bp, Artificial
  CRISPR gRNA sequence
gtgagcttctctatgacagc

SEQ ID NO: 585656 - DNA, 20 bp, Artificial
  CRISPR gRNA sequence
tatgacagcaggtctctcaa

SEQ ID NO: 585657 - DNA, 20 bp, Artificial
  CRISPR gRNA sequence
atgacagcaggtctctcaaa

SEQ ID NO: 585658 - DNA, 20 bp, Artificial
  CRISPR gRNA sequence
gcaggtctctcaaaaggcac

SEQ ID NO: 585659 - DNA, 20 bp, Artificial
  CRISPR gRNA sequence
aggtctctcaaaaggcacca

SEQ ID NO: 585660 - DNA, 20 bp, Artificial
  CRISPR gRNA sequence
agaaatattgttgtccataa

SEQ ID NO: 585661 - DNA, 20 bp, Artificial
  CRISPR gRNA sequence
gaaatattgttgtccataat

SEQ ID NO: 585662 - DNA, 20 bp, Artificial
  CRISPR gRNA sequence
ttgttccttacaatcttcca

SEQ ID NO: 585663 - DNA, 20 bp, Artificial
  CRISPR gRNA sequence
tgttccttacaatcttccat

SEQ ID NO: 585664 - DNA, 20 bp, Artificial
  CRISPR gRNA sequence
ttccttacaatcttccatag

SEQ ID NO: 585665 - DNA, 20 bp, Artificial
  CRISPR gRNA sequence
tccttacaatcttccatagg

SEQ ID NO: 585666 - DNA, 20 bp, Artificial
  CRISPR gRNA sequence
ggaggtactatacaaaacca

SEQ ID NO: 585667 - DNA, 20 bp, Artificial
  CRISPR gRNA sequence
tgataatttcttcaacattt

SEQ ID NO: 585668 - DNA, 20 bp, Artificial
  CRISPR gRNA sequence
tcaacattttggatgataca

SEQ ID NO: 585669 - DNA, 20 bp, Artificial
  CRISPR gRNA sequence
cattttggatgatacaaagc

SEQ ID NO: 585670 - DNA, 20 bp, Artificial
  CRISPR gRNA sequence
catctcgatatgtgttataa

SEQ ID NO: 585671 - DNA, 20 bp, Artificial
  CRISPR gRNA sequence
tcgatatgtgttataaaagc

SEQ ID NO: 585672 - DNA, 20 bp, Artificial
  CRISPR gRNA sequence
ttataaaagctagtatgctt

SEQ ID NO: 585673 - DNA, 20 bp, Artificial
  CRISPR gRNA sequence
taaaagctagtatgcttcag

SEQ ID NO: 585674 - DNA, 20 bp, Artificial
  CRISPR gRNA sequence
aagctagtatgcttcagtag

SEQ ID NO: 585675 - DNA, 20 bp, Artificial
  CRISPR gRNA sequence
tagtatgcttcagtagaagc

SEQ ID NO: 585676 - DNA, 20 bp, Artificial
  CRISPR gRNA sequence
tatgcttcagtagaagcaag

SEQ ID NO: 585677 - DNA, 20 bp, Artificial
  CRISPR gRNA sequence
cttcagtagaagcaagtaga

SEQ ID NO: 585678 - DNA, 20 bp, Artificial
  CRISPR gRNA sequence
caagtagaaagaataccctc

SEQ ID NO: 585679 - DNA, 20 bp, Artificial
  CRISPR gRNA sequence
aagaataccctctagtgtga

SEQ ID NO: 585680 - DNA, 20 bp, Artificial
  CRISPR gRNA sequence
ttgcacacacacatatacac

SEQ ID NO: 585681 - DNA, 20 bp, Artificial
  CRISPR gRNA sequence
gcacacacacatatacacca

SEQ ID NO: 585682 - DNA, 20 bp, Artificial
  CRISPR gRNA sequence
cacacacacatatacaccag

SEQ ID NO: 585683 - DNA, 20 bp, Artificial
  CRISPR gRNA sequence
cagaggatttgtttttattt

SEQ ID NO: 585684 - DNA, 20 bp, Artificial
  CRISPR gRNA sequence
acatacactgttgccactat

SEQ ID NO: 585685 - DNA, 20 bp, Artificial
  CRISPR gRNA sequence
tacactgttgccactattgg

SEQ ID NO: 585686 - DNA, 20 bp, Artificial
  CRISPR gRNA sequence
tggtggcaaacttgttcatg

SEQ ID NO: 585687 - DNA, 20 bp, Artificial
  CRISPR gRNA sequence
ttctcatcttattcccctga

SEQ ID NO: 585688 - DNA, 20 bp, Artificial
  CRISPR gRNA sequence
tattcccctgaaagtgtttt

SEQ ID NO: 585689 - DNA, 20 bp, Artificial
  CRISPR gRNA sequence
ctaaaatcaatactactttt

SEQ ID NO: 585690 - DNA, 20 bp, Artificial
  CRISPR gRNA sequence
tttaagactgcactattttc

SEQ ID NO: 585691 - DNA, 20 bp, Artificial
  CRISPR gRNA sequence
ttaagactgcactattttca

SEQ ID NO: 585692 - DNA, 20 bp, Artificial
  CRISPR gRNA sequence
tgcactattttcaaggcttt

SEQ ID NO: 585693 - DNA, 20 bp, Artificial
  CRISPR gRNA sequence
cactattttcaaggctttta

SEQ ID NO: 585694 - DNA, 20 bp, Artificial
  CRISPR gRNA sequence
ttatttttaaaaaacaattt

SEQ ID NO: 585695 - DNA, 20 bp, Artificial
  CRISPR gRNA sequence
ttttaaaaaacaatttaagt

SEQ ID NO: 585696 - DNA, 20 bp, Artificial
  CRISPR gRNA sequence
ttaagtaagtcaacttgttt

SEQ ID NO: 585697 - DNA, 20 bp, Artificial
  CRISPR gRNA sequence
aagtaagtcaacttgtttga

SEQ ID NO: 585698 - DNA, 20 bp, Artificial
  CRISPR gRNA sequence
agtcaacttgtttgagagaa

SEQ ID NO: 585699 - DNA, 20 bp, Artificial
  CRISPR gRNA sequence
gtttgagagaaaagcttaaa

SEQ ID NO: 585700 - DNA, 20 bp, Artificial
  CRISPR gRNA sequence
taaacagacatacaaaataa

SEQ ID NO: 585701 - DNA, 20 bp, Artificial
  CRISPR gRNA sequence
agacatacaaaataacagca

SEQ ID NO: 585702 - DNA, 20 bp, Artificial
  CRISPR gRNA sequence
ttaacccatgtattttcctg

SEQ ID NO: 585703 - DNA, 20 bp, Artificial
  CRISPR gRNA sequence
cagcgtattttctatttgat

SEQ ID NO: 585704 - DNA, 20 bp, Artificial
  CRISPR gRNA sequence
ttttctatttgatgagctgt

SEQ ID NO: 585705 - DNA, 20 bp, Artificial
  CRISPR gRNA sequence
tgatgagctgttagccttat

SEQ ID NO: 585706 - DNA, 20 bp, Artificial
  CRISPR gRNA sequence
tgagctgttagccttattgg

SEQ ID NO: 585707 - DNA, 20 bp, Artificial
  CRISPR gRNA sequence
gctgttagccttattggcag

SEQ ID NO: 585708 - DNA, 20 bp, Artificial
  CRISPR gRNA sequence
gtagcttaaatacctgcacc

SEQ ID NO: 585709 - DNA, 20 bp, Artificial
  CRISPR gRNA sequence
gcttaaatacctgcaccaag

SEQ ID NO: 585710 - DNA, 20 bp, Artificial
  CRISPR gRNA sequence
tgcaccaagcagccctcatg

SEQ ID NO: 585711 - DNA, 20 bp, Artificial
  CRISPR gRNA sequence
accaagcagccctcatgaag

SEQ ID NO: 585712 - DNA, 20 bp, Artificial
  CRISPR gRNA sequence
caagcagccctcatgaagaa

SEQ ID NO: 585713 - DNA, 20 bp, Artificial
  CRISPR gRNA sequence
attctgaacatgtctatgca

SEQ ID NO: 585714 - DNA, 20 bp, Artificial
  CRISPR gRNA sequence
tgtctatgcacagtaaactg

SEQ ID NO: 585715 - DNA, 20 bp, Artificial
  CRISPR gRNA sequence
ctatgcacagtaaactgtgg

SEQ ID NO: 585716 - DNA, 20 bp, Artificial
  CRISPR gRNA sequence
tgattgtaatttattttaaa

SEQ ID NO: 585717 - DNA, 20 bp, Artificial
  CRISPR gRNA sequence
attgtaatttattttaaaaa

SEQ ID NO: 585718 - DNA, 20 bp, Artificial
  CRISPR gRNA sequence
ttattttaaaaagagctctt

SEQ ID NO: 585719 - DNA, 20 bp, Artificial
  CRISPR gRNA sequence
ttttaaaaagagctcttcag

SEQ ID NO: 585720 - DNA, 20 bp, Artificial
  CRISPR gRNA sequence
tttaaaaagagctcttcagc

SEQ ID NO: 585721 - DNA, 20 bp, Artificial
  CRISPR gRNA sequence
aaaaagagctcttcagcagg

SEQ ID NO: 585722 - DNA, 20 bp, Artificial
  CRISPR gRNA sequence
aagagctcttcagcaggaag

SEQ ID NO: 585723 - DNA, 20 bp, Artificial
  CRISPR gRNA sequence
agaagaatccatttctaaat

SEQ ID NO: 585724 - DNA, 20 bp, Artificial
  CRISPR gRNA sequence
ccatttctaaattggcacat

SEQ ID NO: 585725 - DNA, 20 bp, Artificial
  CRISPR gRNA sequence
cctattcatcccttttttct

SEQ ID NO: 585726 - DNA, 20 bp, Artificial
  CRISPR gRNA sequence
cccttttttctaagttgcta

SEQ ID NO: 585727 - DNA, 20 bp, Artificial
  CRISPR gRNA sequence
gttgctatggactaatctgt

SEQ ID NO: 585728 - DNA, 20 bp, Artificial
  CRISPR gRNA sequence
tggactaatctgttagccct

SEQ ID NO: 585729 - DNA, 20 bp, Artificial
  CRISPR gRNA sequence
cccttagacactgacattca

SEQ ID NO: 585730 - DNA, 20 bp, Artificial
  CRISPR gRNA sequence
agacactgacattcatagtg

SEQ ID NO: 585731 - DNA, 20 bp, Artificial
  CRISPR gRNA sequence
tgacattcatagtgcagaca

SEQ ID NO: 585732 - DNA, 20 bp, Artificial
  CRISPR gRNA sequence
tgcagacaaagaacttaaaa

SEQ ID NO: 585733 - DNA, 20 bp, Artificial
  CRISPR gRNA sequence
acttaaaacagttgtttttt

SEQ ID NO: 585734 - DNA, 20 bp, Artificial
  CRISPR gRNA sequence
taaaacagttgttttttgag

SEQ ID NO: 585735 - DNA, 20 bp, Artificial
  CRISPR gRNA sequence
tttgagtagaaatactgccc

SEQ ID NO: 585736 - DNA, 20 bp, Artificial
  CRISPR gRNA sequence
ttgagtagaaatactgccca

SEQ ID NO: 585737 - DNA, 20 bp, Artificial
  CRISPR gRNA sequence
ctgcccaaggatgtttaatt

SEQ ID NO: 585738 - DNA, 20 bp, Artificial
  CRISPR gRNA sequence
tgcccaaggatgtttaatta

SEQ ID NO: 585739 - DNA, 20 bp, Artificial
  CRISPR gRNA sequence
caaggatgtttaattaagga

SEQ ID NO: 585740 - DNA, 20 bp, Artificial
  CRISPR gRNA sequence
aaggatgtttaattaaggat

SEQ ID NO: 585741 - DNA, 20 bp, Artificial
  CRISPR gRNA sequence
aggatgtttaattaaggata

SEQ ID NO: 585742 - DNA, 20 bp, Artificial
  CRISPR gRNA sequence
ttaaggatagggtaacaact

SEQ ID NO: 585743 - DNA, 20 bp, Artificial
  CRISPR gRNA sequence
gatagggtaacaactcagac

SEQ ID NO: 585744 - DNA, 20 bp, Artificial
  CRISPR gRNA sequence
atagggtaacaactcagaca

SEQ ID NO: 585745 - DNA, 20 bp, Artificial
  CRISPR gRNA sequence
acaactcagacaaggcgaat

SEQ ID NO: 585746 - DNA, 20 bp, Artificial
  CRISPR gRNA sequence
gcgaatcagttgattaaaaa

SEQ ID NO: 585747 - DNA, 20 bp, Artificial
  CRISPR gRNA sequence
ttgattaaaaacagtgttct

SEQ ID NO: 585748 - DNA, 20 bp, Artificial
  CRISPR gRNA sequence
tgattaaaaacagtgttctc

SEQ ID NO: 585749 - DNA, 20 bp, Artificial
  CRISPR gRNA sequence
taaaaacagtgttctcagga

SEQ ID NO: 585750 - DNA, 20 bp, Artificial
  CRISPR gRNA sequence
ttgtttattgttgctttctc

SEQ ID NO: 585751 - DNA, 20 bp, Artificial
  CRISPR gRNA sequence
ttctccagttgcacttgtgc

SEQ ID NO: 585752 - DNA, 20 bp, Artificial
  CRISPR gRNA sequence
gcacttgtgccagtactgtt

SEQ ID NO: 585753 - DNA, 20 bp, Artificial
  CRISPR gRNA sequence
cagtactgtttggaaaccta

SEQ ID NO: 585754 - DNA, 20 bp, Artificial
  CRISPR gRNA sequence
aacctaaagctttcatttct

SEQ ID NO: 585755 - DNA, 20 bp, Artificial
  CRISPR gRNA sequence
ttagaataactttacttgtt

SEQ ID NO: 585756 - DNA, 20 bp, Artificial
  CRISPR gRNA sequence
tctgatcctttcatttgtat

SEQ ID NO: 585757 - DNA, 20 bp, Artificial
  CRISPR gRNA sequence
atcctttcatttgtataaga

SEQ ID NO: 585758 - DNA, 20 bp, Artificial
  CRISPR gRNA sequence
ccactgtgtacaaaaaaatg

SEQ ID NO: 585759 - DNA, 20 bp, Artificial
  CRISPR gRNA sequence
aaaaatgtagtctcatttat

SEQ ID NO: 585760 - DNA, 20 bp, Artificial
  CRISPR gRNA sequence
aaaatgtagtctcatttata

SEQ ID NO: 585761 - DNA, 20 bp, Artificial
  CRISPR gRNA sequence
aaatgtagtctcatttataa

SEQ ID NO: 585762 - DNA, 20 bp, Artificial
  CRISPR gRNA sequence
aatgtagtctcatttataag

SEQ ID NO: 585763 - DNA, 20 bp, Artificial
  CRISPR gRNA sequence
catttataaggggatcctct

SEQ ID NO: 585764 - DNA, 20 bp, Artificial
  CRISPR gRNA sequence
ttataaggggatcctcttgg

SEQ ID NO: 585765 - DNA, 20 bp, Artificial
  CRISPR gRNA sequence
ctcttggcagacacaaaaat

SEQ ID NO: 585766 - DNA, 20 bp, Artificial
  CRISPR gRNA sequence
tggcagacacaaaaataagt

SEQ ID NO: 585767 - DNA, 20 bp, Artificial
  CRISPR gRNA sequence
agacacaaaaataagtgaga

SEQ ID NO: 585768 - DNA, 20 bp, Artificial
  CRISPR gRNA sequence
acaaaaataagtgagaaagc

SEQ ID NO: 585769 - DNA, 20 bp, Artificial
  CRISPR gRNA sequence
aaaaataagtgagaaagcaa

SEQ ID NO: 585770 - DNA, 20 bp, Artificial
  CRISPR gRNA sequence
agtgagaaagcaagagatga

SEQ ID NO: 585771 - DNA, 20 bp, Artificial
  CRISPR gRNA sequence
gtgagaaagcaagagatgaa

SEQ ID NO: 585772 - DNA, 20 bp, Artificial
  CRISPR gRNA sequence
agaaagcaagagatgaaagg

SEQ ID NO: 585773 - DNA, 20 bp, Artificial
  CRISPR gRNA sequence
gaaagcaagagatgaaaggt

SEQ ID NO: 585774 - DNA, 20 bp, Artificial
  CRISPR gRNA sequence
agatgaaaggtaggaaaatt

SEQ ID NO: 585775 - DNA, 20 bp, Artificial
  CRISPR gRNA sequence
ggaaaattcagtgcacaatt

SEQ ID NO: 585776 - DNA, 20 bp, Artificial
  CRISPR gRNA sequence
ttgatgtatttaataaccaa

SEQ ID NO: 585777 - DNA, 20 bp, Artificial
  CRISPR gRNA sequence
tgatgtatttaataaccaat

SEQ ID NO: 585778 - DNA, 20 bp, Artificial
  CRISPR gRNA sequence
ccaataggttaccaattttg

SEQ ID NO: 585779 - DNA, 20 bp, Artificial
  CRISPR gRNA sequence
attttgaagaaaatgaaaca

SEQ ID NO: 585780 - DNA, 20 bp, Artificial
  CRISPR gRNA sequence
gaaaaaatgttttcatgatt

SEQ ID NO: 585781 - DNA, 20 bp, Artificial
  CRISPR gRNA sequence
tcatgatttggacatgttta

SEQ ID NO: 585782 - DNA, 20 bp, Artificial
  CRISPR gRNA sequence
aagaaatcaacattccatcc

SEQ ID NO: 585783 - DNA, 20 bp, Artificial
  CRISPR gRNA sequence
tccaagttttgattaaccta

SEQ ID NO: 585784 - DNA, 20 bp, Artificial
  CRISPR gRNA sequence
agttttgattaacctataga

SEQ ID NO: 585785 - DNA, 20 bp, Artificial
  CRISPR gRNA sequence
gttttgattaacctatagat

SEQ ID NO: 585786 - DNA, 20 bp, Artificial
  CRISPR gRNA sequence
aattgtaatctacatttaat

SEQ ID NO: 585787 - DNA, 20 bp, Artificial
  CRISPR gRNA sequence
tgtaatctacatttaataag

SEQ ID NO: 585788 - DNA, 20 bp, Artificial
  CRISPR gRNA sequence
acatttaataagaagtcctc

SEQ ID NO: 585789 - DNA, 20 bp, Artificial
  CRISPR gRNA sequence
agaagtcctctggctatgaa

SEQ ID NO: 585790 - DNA, 20 bp, Artificial
  CRISPR gRNA sequence
gtcctctggctatgaatagc

SEQ ID NO: 585791 - DNA, 20 bp, Artificial
  CRISPR gRNA sequence
tcctctggctatgaatagca

SEQ ID NO: 585792 - DNA, 20 bp, Artificial
  CRISPR gRNA sequence
cctctggctatgaatagcaa

SEQ ID NO: 585793 - DNA, 20 bp, Artificial
  CRISPR gRNA sequence
gcaagggattgtgcaattat

SEQ ID NO: 585794 - DNA, 20 bp, Artificial
  CRISPR gRNA sequence
gcaattattagatgttaatt

SEQ ID NO: 585795 - DNA, 20 bp, Artificial
  CRISPR gRNA sequence
ttagatgttaatttggaaaa

SEQ ID NO: 585796 - DNA, 20 bp, Artificial
  CRISPR gRNA sequence
ttaatttggaaaaaagtttc

SEQ ID NO: 585797 - DNA, 20 bp, Artificial
  CRISPR gRNA sequence
taatttggaaaaaagtttca

SEQ ID NO: 585798 - DNA, 20 bp, Artificial
  CRISPR gRNA sequence
ttggaaaaaagtttcaaggt

SEQ ID NO: 585799 - DNA, 20 bp, Artificial
  CRISPR gRNA sequence
aaaagtttcaaggtgagact

SEQ ID NO: 585800 - DNA, 20 bp, Artificial
  CRISPR gRNA sequence
aaagtttcaaggtgagactg

SEQ ID NO: 585801 - DNA, 20 bp, Artificial
  CRISPR gRNA sequence
tcaaggtgagactgaggaac

SEQ ID NO: 585802 - DNA, 20 bp, Artificial
  CRISPR gRNA sequence
caaggtgagactgaggaaca

SEQ ID NO: 585803 - DNA, 20 bp, Artificial
  CRISPR gRNA sequence
gagactgaggaacaaggaaa

SEQ ID NO: 585804 - DNA, 20 bp, Artificial
  CRISPR gRNA sequence
atgatgttatcacattgaaa

SEQ ID NO: 585805 - DNA, 20 bp, Artificial
  CRISPR gRNA sequence
acattgaaaaagtatgtccc

SEQ ID NO: 585806 - DNA, 20 bp, Artificial
  CRISPR gRNA sequence
taaaacattatattctcttt

SEQ ID NO: 585807 - DNA, 20 bp, Artificial
  CRISPR gRNA sequence
tcttttagtaacaactaaaa

SEQ ID NO: 585808 - DNA, 20 bp, Artificial
  CRISPR gRNA sequence
caactaaaaaagtgacacaa

SEQ ID NO: 585809 - DNA, 20 bp, Artificial
  CRISPR gRNA sequence
aaaaagtgacacaaaagtaa

SEQ ID NO: 585810 - DNA, 20 bp, Artificial
  CRISPR gRNA sequence
aaagtgacacaaaagtaaaa

SEQ ID NO: 585811 - DNA, 20 bp, Artificial
  CRISPR gRNA sequence
aagtaaaagagtcaacaaaa

SEQ ID NO: 585812 - DNA, 20 bp, Artificial
  CRISPR gRNA sequence
aaagagtcaacaaaaaagca

SEQ ID NO: 585813 - DNA, 20 bp, Artificial
  CRISPR gRNA sequence
aaagaatttcaaaaacattc

SEQ ID NO: 585814 - DNA, 20 bp, Artificial
  CRISPR gRNA sequence
aagaatttcaaaaacattca

SEQ ID NO: 585815 - DNA, 20 bp, Artificial
  CRISPR gRNA sequence
caaggatgaccaattcacgt

SEQ ID NO: 585816 - DNA, 20 bp, Artificial
  CRISPR gRNA sequence
aaggatgaccaattcacgta

SEQ ID NO: 585817 - DNA, 20 bp, Artificial
  CRISPR gRNA sequence
aggatgaccaattcacgtaa

SEQ ID NO: 585818 - DNA, 20 bp, Artificial
  CRISPR gRNA sequence
ggatgaccaattcacgtaag

SEQ ID NO: 585819 - DNA, 20 bp, Artificial
  CRISPR gRNA sequence
atgaccaattcacgtaaggg

SEQ ID NO: 585820 - DNA, 20 bp, Artificial
  CRISPR gRNA sequence
ccaattcacgtaaggggagt

SEQ ID NO: 585821 - DNA, 20 bp, Artificial
  CRISPR gRNA sequence
attcacgtaaggggagtcag

SEQ ID NO: 585822 - DNA, 20 bp, Artificial
  CRISPR gRNA sequence
cgtaaggggagtcagaagaa

SEQ ID NO: 585823 - DNA, 20 bp, Artificial
  CRISPR gRNA sequence
ggggagtcagaagaatggca

SEQ ID NO: 585824 - DNA, 20 bp, Artificial
  CRISPR gRNA sequence
gagtcagaagaatggcacag

SEQ ID NO: 585825 - DNA, 20 bp, Artificial
  CRISPR gRNA sequence
tcagaagaatggcacagtgg

SEQ ID NO: 585826 - DNA, 20 bp, Artificial
  CRISPR gRNA sequence
gaagaatggcacagtggtgg

SEQ ID NO: 585827 - DNA, 20 bp, Artificial
  CRISPR gRNA sequence
atggcacagtggtggtggtg

SEQ ID NO: 585828 - DNA, 20 bp, Artificial
  CRISPR gRNA sequence
gcacagtggtggtggtgtgg

SEQ ID NO: 585829 - DNA, 20 bp, Artificial
  CRISPR gRNA sequence
acagtggtggtggtgtggtg

SEQ ID NO: 585830 - DNA, 20 bp, Artificial
  CRISPR gRNA sequence
gtggtggtgtggtggagaac

SEQ ID NO: 585831 - DNA, 20 bp, Artificial
  CRISPR gRNA sequence
tggtggtgtggtggagaacc

SEQ ID NO: 585832 - DNA, 20 bp, Artificial
  CRISPR gRNA sequence
gtggtggagaaccaggtaat

SEQ ID NO: 585833 - DNA, 20 bp, Artificial
  CRISPR gRNA sequence
aggtaatgagatacaaattg

SEQ ID NO: 585834 - DNA, 20 bp, Artificial
  CRISPR gRNA sequence
caaaatcttaactttttgtt

SEQ ID NO: 585835 - DNA, 20 bp, Artificial
  CRISPR gRNA sequence
ttaactttttgtttggatga

SEQ ID NO: 585836 - DNA, 20 bp, Artificial
  CRISPR gRNA sequence
tgtttggatgatggatttac

SEQ ID NO: 585837 - DNA, 20 bp, Artificial
  CRISPR gRNA sequence
acaagcacttactacattat

SEQ ID NO: 585838 - DNA, 20 bp, Artificial
  CRISPR gRNA sequence
gaaataacaataaaactaaa

SEQ ID NO: 585839 - DNA, 20 bp, Artificial
  CRISPR gRNA sequence
ataacaataaaactaaaaag

SEQ ID NO: 585840 - DNA, 20 bp, Artificial
  CRISPR gRNA sequence
ataaaactaaaaagcagtcc

SEQ ID NO: 585841 - DNA, 20 bp, Artificial
  CRISPR gRNA sequence
actaaaaagcagtccaagta

SEQ ID NO: 585842 - DNA, 20 bp, Artificial
  CRISPR gRNA sequence
agcagtccaagtatggacca

SEQ ID NO: 585843 - DNA, 20 bp, Artificial
  CRISPR gRNA sequence
gaccaaagatgaaaatatgt

SEQ ID NO: 585844 - DNA, 20 bp, Artificial
  CRISPR gRNA sequence
agatgaaaatatgtcagacc

SEQ ID NO: 585845 - DNA, 20 bp, Artificial
  CRISPR gRNA sequence
cagaccaagatccaaaatga

SEQ ID NO: 585846 - DNA, 20 bp, Artificial
  CRISPR gRNA sequence
agatccaaaatgaaagaatt

SEQ ID NO: 585847 - DNA, 20 bp, Artificial
  CRISPR gRNA sequence
ccaaaatgaaagaatttggc

SEQ ID NO: 585848 - DNA, 20 bp, Artificial
  CRISPR gRNA sequence
tgtaaattttgctaaaaaac

SEQ ID NO: 585849 - DNA, 20 bp, Artificial
  CRISPR gRNA sequence
tgctaaaaaactagcaaaac

SEQ ID NO: 585850 - DNA, 20 bp, Artificial
  CRISPR gRNA sequence
aaactagcaaaactggttaa

SEQ ID NO: 585851 - DNA, 20 bp, Artificial
  CRISPR gRNA sequence
aactagcaaaactggttaac

SEQ ID NO: 585852 - DNA, 20 bp, Artificial
  CRISPR gRNA sequence
atgctaatttgttctgaaat

SEQ ID NO: 585853 - DNA, 20 bp, Artificial
  CRISPR gRNA sequence
ctaatttgttctgaaatgag

SEQ ID NO: 585854 - DNA, 20 bp, Artificial
  CRISPR gRNA sequence
gaaatgagtagtccaaaacc

SEQ ID NO: 585855 - DNA, 20 bp, Artificial
  CRISPR gRNA sequence
atgagtagtccaaaacctgg

SEQ ID NO: 585856 - DNA, 20 bp, Artificial
  CRISPR gRNA sequence
aaacctggcagttttgctct

SEQ ID NO: 585857 - DNA, 20 bp, Artificial
  CRISPR gRNA sequence
ttaacactcaaaacgaaacc

SEQ ID NO: 585858 - DNA, 20 bp, Artificial
  CRISPR gRNA sequence
taacactcaaaacgaaacct

SEQ ID NO: 585859 - DNA, 20 bp, Artificial
  CRISPR gRNA sequence
ctcaaaacgaaacctgggtg

SEQ ID NO: 585860 - DNA, 20 bp, Artificial
  CRISPR gRNA sequence
tcaaaacgaaacctgggtgt

SEQ ID NO: 585861 - DNA, 20 bp, Artificial
  CRISPR gRNA sequence
acaccacatccacctcaatt

SEQ ID NO: 585862 - DNA, 20 bp, Artificial
  CRISPR gRNA sequence
caattcagatgatttgtccc

SEQ ID NO: 585863 - DNA, 20 bp, Artificial
  CRISPR gRNA sequence
gatttgtcccgagttcaatg

SEQ ID NO: 585864 - DNA, 20 bp, Artificial
  CRISPR gRNA sequence
tgaactgaaaatgatgattt

SEQ ID NO: 585865 - DNA, 20 bp, Artificial
  CRISPR gRNA sequence
actgaaaatgatgattttgg

SEQ ID NO: 585866 - DNA, 20 bp, Artificial
  CRISPR gRNA sequence
tgaaaatgatgattttggca

SEQ ID NO: 585867 - DNA, 20 bp, Artificial
  CRISPR gRNA sequence
atctaatttctactttacaa

SEQ ID NO: 585868 - DNA, 20 bp, Artificial
  CRISPR gRNA sequence
tgatcttgtttctaccacat

SEQ ID NO: 585869 - DNA, 20 bp, Artificial
  CRISPR gRNA sequence
tatgtgctgtgtgctgtttt

SEQ ID NO: 585870 - DNA, 20 bp, Artificial
  CRISPR gRNA sequence
atgtgctgtgtgctgtttta

SEQ ID NO: 585871 - DNA, 20 bp, Artificial
  CRISPR gRNA sequence
aataattaatttaattcatc

SEQ ID NO: 585872 - DNA, 20 bp, Artificial
  CRISPR gRNA sequence
catccagaaactccatgaaa

SEQ ID NO: 585873 - DNA, 20 bp, Artificial
  CRISPR gRNA sequence
atccagaaactccatgaaat

SEQ ID NO: 585874 - DNA, 20 bp, Artificial
  CRISPR gRNA sequence
gtaataccatcttcactgta

SEQ ID NO: 585875 - DNA, 20 bp, Artificial
  CRISPR gRNA sequence
accatcttcactgtacagat

SEQ ID NO: 585876 - DNA, 20 bp, Artificial
  CRISPR gRNA sequence
cttcactgtacagatgagaa

SEQ ID NO: 585877 - DNA, 20 bp, Artificial
  CRISPR gRNA sequence
actgtacagatgagaacaga

SEQ ID NO: 585878 - DNA, 20 bp, Artificial
  CRISPR gRNA sequence
cagatgagaacagaaagacc

SEQ ID NO: 585879 - DNA, 20 bp, Artificial
  CRISPR gRNA sequence
gatgagaacagaaagaccca

SEQ ID NO: 585880 - DNA, 20 bp, Artificial
  CRISPR gRNA sequence
cagaaagacccagagatgtt

SEQ ID NO: 585881 - DNA, 20 bp, Artificial
  CRISPR gRNA sequence
gagatgttaagtaatttcct

SEQ ID NO: 585882 - DNA, 20 bp, Artificial
  CRISPR gRNA sequence
agatgttaagtaatttcctc

SEQ ID NO: 585883 - DNA, 20 bp, Artificial
  CRISPR gRNA sequence
gatgttaagtaatttcctca

SEQ ID NO: 585884 - DNA, 20 bp, Artificial
  CRISPR gRNA sequence
atttcctcagggtttacatc

SEQ ID NO: 585885 - DNA, 20 bp, Artificial
  CRISPR gRNA sequence
cctcagggtttacatctagt

SEQ ID NO: 585886 - DNA, 20 bp, Artificial
  CRISPR gRNA sequence
cagggtttacatctagttag

SEQ ID NO: 585887 - DNA, 20 bp, Artificial
  CRISPR gRNA sequence
gggtttacatctagttagta

SEQ ID NO: 585888 - DNA, 20 bp, Artificial
  CRISPR gRNA sequence
gtagagaatgttattactac

SEQ ID NO: 585889 - DNA, 20 bp, Artificial
  CRISPR gRNA sequence
tagagaatgttattactact

SEQ ID NO: 585890 - DNA, 20 bp, Artificial
  CRISPR gRNA sequence
gagaatgttattactactag

SEQ ID NO: 585891 - DNA, 20 bp, Artificial
  CRISPR gRNA sequence
tgttattactactaggagtc

SEQ ID NO: 585892 - DNA, 20 bp, Artificial
  CRISPR gRNA sequence
tactactaggagtctggctc

SEQ ID NO: 585893 - DNA, 20 bp, Artificial
  CRISPR gRNA sequence
ctactaggagtctggctcca

SEQ ID NO: 585894 - DNA, 20 bp, Artificial
  CRISPR gRNA sequence
aggagtctggctccagagcc

SEQ ID NO: 585895 - DNA, 20 bp, Artificial
  CRISPR gRNA sequence
ttacgctatactactctttg

SEQ ID NO: 585896 - DNA, 20 bp, Artificial
  CRISPR gRNA sequence
acgctatactactctttgta

SEQ ID NO: 585897 - DNA, 20 bp, Artificial
  CRISPR gRNA sequence
cgctatactactctttgtag

SEQ ID NO: 585898 - DNA, 20 bp, Artificial
  CRISPR gRNA sequence
actctttgtagaggtatttt

SEQ ID NO: 585899 - DNA, 20 bp, Artificial
  CRISPR gRNA sequence
agcattgactttttgtaaac

SEQ ID NO: 585900 - DNA, 20 bp, Artificial
  CRISPR gRNA sequence
ttgactttttgtaaaccagt

SEQ ID NO: 585901 - DNA, 20 bp, Artificial
  CRISPR gRNA sequence
aaccagtcagacatatttgt

SEQ ID NO: 585902 - DNA, 20 bp, Artificial
  CRISPR gRNA sequence
accagtcagacatatttgta

SEQ ID NO: 585903 - DNA, 20 bp, Artificial
  CRISPR gRNA sequence
atatttgtaaggtctgccat

SEQ ID NO: 585904 - DNA, 20 bp, Artificial
  CRISPR gRNA sequence
tatttgtaaggtctgccatt

SEQ ID NO: 585905 - DNA, 20 bp, Artificial
  CRISPR gRNA sequence
gtaaggtctgccattgggta

SEQ ID NO: 585906 - DNA, 20 bp, Artificial
  CRISPR gRNA sequence
tctgattttgttttgcttca

SEQ ID NO: 585907 - DNA, 20 bp, Artificial
  CRISPR gRNA sequence
tttgttttgcttcatggatc

SEQ ID NO: 585908 - DNA, 20 bp, Artificial
  CRISPR gRNA sequence
ttgttttgcttcatggatct

SEQ ID NO: 585909 - DNA, 20 bp, Artificial
  CRISPR gRNA sequence
tatttctgtgtatacattgc

SEQ ID NO: 585910 - DNA, 20 bp, Artificial
  CRISPR gRNA sequence
gaaacataaaacaaattctc

SEQ ID NO: 585911 - DNA, 20 bp, Artificial
  CRISPR gRNA sequence
tcaataatgcattaatcaca

SEQ ID NO: 585912 - DNA, 20 bp, Artificial
  CRISPR gRNA sequence
taatcacatagacattaatc

SEQ ID NO: 585913 - DNA, 20 bp, Artificial
  CRISPR gRNA sequence
aatcacatagacattaatct

SEQ ID NO: 585914 - DNA, 20 bp, Artificial
  CRISPR gRNA sequence
atagacattaatctgggcta

SEQ ID NO: 585915 - DNA, 20 bp, Artificial
  CRISPR gRNA sequence
tgggctaaagatataccaat

SEQ ID NO: 585916 - DNA, 20 bp, Artificial
  CRISPR gRNA sequence
gggctaaagatataccaata

SEQ ID NO: 585917 - DNA, 20 bp, Artificial
  CRISPR gRNA sequence
tcctctttgaccttatattt

SEQ ID NO: 585918 - DNA, 20 bp, Artificial
  CRISPR gRNA sequence
cctctttgaccttatatttg

SEQ ID NO: 585919 - DNA, 20 bp, Artificial
  CRISPR gRNA sequence
ttatatttgaggttataacc

SEQ ID NO: 585920 - DNA, 20 bp, Artificial
  CRISPR gRNA sequence
agataaaaacataattccat

SEQ ID NO: 585921 - DNA, 20 bp, Artificial
  CRISPR gRNA sequence
catcacgttgataaccataa

SEQ ID NO: 585922 - DNA, 20 bp, Artificial
  CRISPR gRNA sequence
aaccataacggcaaaaccat

SEQ ID NO: 585923 - DNA, 20 bp, Artificial
  CRISPR gRNA sequence
tattcttttgaaaaaccaaa

SEQ ID NO: 585924 - DNA, 20 bp, Artificial
  CRISPR gRNA sequence
ttcacccaaattcaaattcc

SEQ ID NO: 585925 - DNA, 20 bp, Artificial
  CRISPR gRNA sequence
caaattcaaattccaagtct

SEQ ID NO: 585926 - DNA, 20 bp, Artificial
  CRISPR gRNA sequence
aaattcaaattccaagtctg

SEQ ID NO: 585927 - DNA, 20 bp, Artificial
  CRISPR gRNA sequence
aattcaaattccaagtctga

SEQ ID NO: 585928 - DNA, 20 bp, Artificial
  CRISPR gRNA sequence
aattccaagtctgagggacc

SEQ ID NO: 585929 - DNA, 20 bp, Artificial
  CRISPR gRNA sequence
attccaagtctgagggacct

SEQ ID NO: 585930 - DNA, 20 bp, Artificial
  CRISPR gRNA sequence
caagtctgagggacctaggt

SEQ ID NO: 585931 - DNA, 20 bp, Artificial
  CRISPR gRNA sequence
cctaggttagatcacatgtc

SEQ ID NO: 585932 - DNA, 20 bp, Artificial
  CRISPR gRNA sequence
agatcacatgtctagctcct

SEQ ID NO: 585933 - DNA, 20 bp, Artificial
  CRISPR gRNA sequence
tcacatgtctagctcctgag

SEQ ID NO: 585934 - DNA, 20 bp, Artificial
  CRISPR gRNA sequence
cacatgtctagctcctgagc

SEQ ID NO: 585935 - DNA, 20 bp, Artificial
  CRISPR gRNA sequence
catgtctagctcctgagcag

SEQ ID NO: 585936 - DNA, 20 bp, Artificial
  CRISPR gRNA sequence
tgtctagctcctgagcagga

SEQ ID NO: 585937 - DNA, 20 bp, Artificial
  CRISPR gRNA sequence
gtctagctcctgagcaggag

SEQ ID NO: 585938 - DNA, 20 bp, Artificial
  CRISPR gRNA sequence
tctagctcctgagcaggaga

SEQ ID NO: 585939 - DNA, 20 bp, Artificial
  CRISPR gRNA sequence
agctcctgagcaggagaggg

SEQ ID NO: 585940 - DNA, 20 bp, Artificial
  CRISPR gRNA sequence
ctcctgagcaggagagggca

SEQ ID NO: 585941 - DNA, 20 bp, Artificial
  CRISPR gRNA sequence
gcaggagagggcagagtacc

SEQ ID NO: 585942 - DNA, 20 bp, Artificial
  CRISPR gRNA sequence
gagggcagagtacctggact

SEQ ID NO: 585943 - DNA, 20 bp, Artificial
  CRISPR gRNA sequence
agggcagagtacctggactg

SEQ ID NO: 585944 - DNA, 20 bp, Artificial
  CRISPR gRNA sequence
gggcagagtacctggactga

SEQ ID NO: 585945 - DNA, 20 bp, Artificial
  CRISPR gRNA sequence
ctggactgagggtcccacca

SEQ ID NO: 585946 - DNA, 20 bp, Artificial
  CRISPR gRNA sequence
cccaccacagctacatgcaa

SEQ ID NO: 585947 - DNA, 20 bp, Artificial
  CRISPR gRNA sequence
ccaccacagctacatgcaac

SEQ ID NO: 585948 - DNA, 20 bp, Artificial
  CRISPR gRNA sequence
cacagctacatgcaacagga

SEQ ID NO: 585949 - DNA, 20 bp, Artificial
  CRISPR gRNA sequence
tgcaacaggaaagttctcta

SEQ ID NO: 585950 - DNA, 20 bp, Artificial
  CRISPR gRNA sequence
gcaacaggaaagttctctaa

SEQ ID NO: 585951 - DNA, 20 bp, Artificial
  CRISPR gRNA sequence
gaaagttctctaaaggtaaa

SEQ ID NO: 585952 - DNA, 20 bp, Artificial
  CRISPR gRNA sequence
aaagttctctaaaggtaaat

SEQ ID NO: 585953 - DNA, 20 bp, Artificial
  CRISPR gRNA sequence
aaatgggcactcttgttatc

SEQ ID NO: 585954 - DNA, 20 bp, Artificial
  CRISPR gRNA sequence
atgggcactcttgttatcaa

SEQ ID NO: 585955 - DNA, 20 bp, Artificial
  CRISPR gRNA sequence
ggcactcttgttatcaagag

SEQ ID NO: 585956 - DNA, 20 bp, Artificial
  CRISPR gRNA sequence
gcactcttgttatcaagaga

SEQ ID NO: 585957 - DNA, 20 bp, Artificial
  CRISPR gRNA sequence
actcttgttatcaagagaag

SEQ ID NO: 585958 - DNA, 20 bp, Artificial
  CRISPR gRNA sequence
ctcttgttatcaagagaagg

SEQ ID NO: 585959 - DNA, 20 bp, Artificial
  CRISPR gRNA sequence
ttgttatcaagagaaggagg

SEQ ID NO: 585960 - DNA, 20 bp, Artificial
  CRISPR gRNA sequence
tgttatcaagagaaggagga

SEQ ID NO: 585961 - DNA, 20 bp, Artificial
  CRISPR gRNA sequence
gttatcaagagaaggaggaa

SEQ ID NO: 585962 - DNA, 20 bp, Artificial
  CRISPR gRNA sequence
agagaaggaggaagggatgt

SEQ ID NO: 585963 - DNA, 20 bp, Artificial
  CRISPR gRNA sequence
gagaaggaggaagggatgtc

SEQ ID NO: 585964 - DNA, 20 bp, Artificial
  CRISPR gRNA sequence
aaggaggaagggatgtcagg

SEQ ID NO: 585965 - DNA, 20 bp, Artificial
  CRISPR gRNA sequence
aggaggaagggatgtcaggc

SEQ ID NO: 585966 - DNA, 20 bp, Artificial
  CRISPR gRNA sequence
tgtcaggcaggcaaaaacaa

SEQ ID NO: 585967 - DNA, 20 bp, Artificial
  CRISPR gRNA sequence
gatctaaaaaaaaaacttta

SEQ ID NO: 585968 - DNA, 20 bp, Artificial
  CRISPR gRNA sequence
aaaaaactttacagttatct

SEQ ID NO: 585969 - DNA, 20 bp, Artificial
  CRISPR gRNA sequence
tatcttagttattttcttga

SEQ ID NO: 585970 - DNA, 20 bp, Artificial
  CRISPR gRNA sequence
gttattttcttgacagcatt

SEQ ID NO: 585971 - DNA, 20 bp, Artificial
  CRISPR gRNA sequence
attttcttgacagcatttgg

SEQ ID NO: 585972 - DNA, 20 bp, Artificial
  CRISPR gRNA sequence
ggcagtgctgacacttgctt

SEQ ID NO: 585973 - DNA, 20 bp, Artificial
  CRISPR gRNA sequence
tcatgaaatttttttcctgc

SEQ ID NO: 585974 - DNA, 20 bp, Artificial
  CRISPR gRNA sequence
ttttcctgctagtgtgttct

SEQ ID NO: 585975 - DNA, 20 bp, Artificial
  CRISPR gRNA sequence
cttattaaaaactactacgt

SEQ ID NO: 585976 - DNA, 20 bp, Artificial
  CRISPR gRNA sequence
ttattaaaaactactacgtt

SEQ ID NO: 585977 - DNA, 20 bp, Artificial
  CRISPR gRNA sequence
ggccactacataaattatga

SEQ ID NO: 585978 - DNA, 20 bp, Artificial
  CRISPR gRNA sequence
ctgcatctttgtttcctact

SEQ ID NO: 585979 - DNA, 20 bp, Artificial
  CRISPR gRNA sequence
ttcctactcagacccctctc

SEQ ID NO: 585980 - DNA, 20 bp, Artificial
  CRISPR gRNA sequence
cctactcagacccctctcaa

SEQ ID NO: 585981 - DNA, 20 bp, Artificial
  CRISPR gRNA sequence
cagacccctctcaagagctt

SEQ ID NO: 585982 - DNA, 20 bp, Artificial
  CRISPR gRNA sequence
ctatatatttaacatcttcc

SEQ ID NO: 585983 - DNA, 20 bp, Artificial
  CRISPR gRNA sequence
atatttaacatcttcctaga

SEQ ID NO: 585984 - DNA, 20 bp, Artificial
  CRISPR gRNA sequence
agttttatttgcctatttca

SEQ ID NO: 585985 - DNA, 20 bp, Artificial
  CRISPR gRNA sequence
ttttatttgcctatttcatg

SEQ ID NO: 585986 - DNA, 20 bp, Artificial
  CRISPR gRNA sequence
cctatttcatggagacataa

SEQ ID NO: 585987 - DNA, 20 bp, Artificial
  CRISPR gRNA sequence
catggagacataaaagaata

SEQ ID NO: 585988 - DNA, 20 bp, Artificial
  CRISPR gRNA sequence
gacataaaagaatatagtaa

SEQ ID NO: 585989 - DNA, 20 bp, Artificial
  CRISPR gRNA sequence
ataaaagaatatagtaaaag

SEQ ID NO: 585990 - DNA, 20 bp, Artificial
  CRISPR gRNA sequence
gacactactatttactccat

SEQ ID NO: 585991 - DNA, 20 bp, Artificial
  CRISPR gRNA sequence
atttactccatcagccatgc

SEQ ID NO: 585992 - DNA, 20 bp, Artificial
  CRISPR gRNA sequence
tcagccatgctggtcacctg

SEQ ID NO: 585993 - DNA, 20 bp, Artificial
  CRISPR gRNA sequence
tggtcacctgtggaaaatcc

SEQ ID NO: 585994 - DNA, 20 bp, Artificial
  CRISPR gRNA sequence
ctagatttcttcctttcatc

SEQ ID NO: 585995 - DNA, 20 bp, Artificial
  CRISPR gRNA sequence
catctctttacaaacacaca

SEQ ID NO: 585996 - DNA, 20 bp, Artificial
  CRISPR gRNA sequence
tctctttacaaacacacatg

SEQ ID NO: 585997 - DNA, 20 bp, Artificial
  CRISPR gRNA sequence
ctctttacaaacacacatgg

SEQ ID NO: 585998 - DNA, 20 bp, Artificial
  CRISPR gRNA sequence
aacacacatggaggtacccc

SEQ ID NO: 585999 - DNA, 20 bp, Artificial
  CRISPR gRNA sequence
tggaggtaccccaagtgttt

SEQ ID NO: 586000 - DNA, 20 bp, Artificial
  CRISPR gRNA sequence
aagtgttttagatgctacat

SEQ ID NO: 586001 - DNA, 20 bp, Artificial
  CRISPR gRNA sequence
tgttttagatgctacattgg

SEQ ID NO: 586002 - DNA, 20 bp, Artificial
  CRISPR gRNA sequence
cacatatgttgttctttctg

SEQ ID NO: 586003 - DNA, 20 bp, Artificial
  CRISPR gRNA sequence
acatatgttgttctttctgc

SEQ ID NO: 586004 - DNA, 20 bp, Artificial
  CRISPR gRNA sequence
aaacacccttctccatttat

SEQ ID NO: 586005 - DNA, 20 bp, Artificial
  CRISPR gRNA sequence
catttttgctttttaaaact

SEQ ID NO: 586006 - DNA, 20 bp, Artificial
  CRISPR gRNA sequence
tttaaaactaagctcaatcc

SEQ ID NO: 586007 - DNA, 20 bp, Artificial
  CRISPR gRNA sequence
ttaaaactaagctcaatccc

SEQ ID NO: 586008 - DNA, 20 bp, Artificial
  CRISPR gRNA sequence
caatcccgggaaattcctct

SEQ ID NO: 586009 - DNA, 20 bp, Artificial
  CRISPR gRNA sequence
tcttggatgttctgctgatt

SEQ ID NO: 586010 - DNA, 20 bp, Artificial
  CRISPR gRNA sequence
cttggatgttctgctgattt

SEQ ID NO: 586011 - DNA, 20 bp, Artificial
  CRISPR gRNA sequence
tctccataatgcttatcaca

SEQ ID NO: 586012 - DNA, 20 bp, Artificial
  CRISPR gRNA sequence
tactataattgttgttttac

SEQ ID NO: 586013 - DNA, 20 bp, Artificial
  CRISPR gRNA sequence
tttactggtctatcttccaa

SEQ ID NO: 586014 - DNA, 20 bp, Artificial
  CRISPR gRNA sequence
ctggtctatcttccaatagc

SEQ ID NO: 586015 - DNA, 20 bp, Artificial
  CRISPR gRNA sequence
caatagctggtaaataacct

SEQ ID NO: 586016 - DNA, 20 bp, Artificial
  CRISPR gRNA sequence
aatagctggtaaataacctc

SEQ ID NO: 586017 - DNA, 20 bp, Artificial
  CRISPR gRNA sequence
atagctggtaaataacctca

SEQ ID NO: 586018 - DNA, 20 bp, Artificial
  CRISPR gRNA sequence
tagctggtaaataacctcag

SEQ ID NO: 586019 - DNA, 20 bp, Artificial
  CRISPR gRNA sequence
tctaataccttttatgatac

SEQ ID NO: 586020 - DNA, 20 bp, Artificial
  CRISPR gRNA sequence
taataccttttatgatacaa

SEQ ID NO: 586021 - DNA, 20 bp, Artificial
  CRISPR gRNA sequence
ataccttttatgatacaaga

SEQ ID NO: 586022 - DNA, 20 bp, Artificial
  CRISPR gRNA sequence
aagagagatataatattcaa

SEQ ID NO: 586023 - DNA, 20 bp, Artificial
  CRISPR gRNA sequence
cactgaatgatgtcacccaa

SEQ ID NO: 586024 - DNA, 20 bp, Artificial
  CRISPR gRNA sequence
tgatgtcacccaatagaaat

SEQ ID NO: 586025 - DNA, 20 bp, Artificial
  CRISPR gRNA sequence
ccaatagaaataagtcaaaa

SEQ ID NO: 586026 - DNA, 20 bp, Artificial
  CRISPR gRNA sequence
agtcaaaaaagcttattcca

SEQ ID NO: 586027 - DNA, 20 bp, Artificial
  CRISPR gRNA sequence
aaaaagcttattccaaagtt

SEQ ID NO: 586028 - DNA, 20 bp, Artificial
  CRISPR gRNA sequence
aaaagcttattccaaagttt

SEQ ID NO: 586029 - DNA, 20 bp, Artificial
  CRISPR gRNA sequence
aaagcttattccaaagtttg

SEQ ID NO: 586030 - DNA, 20 bp, Artificial
  CRISPR gRNA sequence
aagcttattccaaagtttgg

SEQ ID NO: 586031 - DNA, 20 bp, Artificial
  CRISPR gRNA sequence
aatgcctctatactgtgaaa

SEQ ID NO: 586032 - DNA, 20 bp, Artificial
  CRISPR gRNA sequence
tccctttcctaaacaattca

SEQ ID NO: 586033 - DNA, 20 bp, Artificial
  CRISPR gRNA sequence
cataaacctaacaatatata

SEQ ID NO: 586034 - DNA, 20 bp, Artificial
  CRISPR gRNA sequence
taacaatatatatagatttt

SEQ ID NO: 586035 - DNA, 20 bp, Artificial
  CRISPR gRNA sequence
aatatatatagattttaagc

SEQ ID NO: 586036 - DNA, 20 bp, Artificial
  CRISPR gRNA sequence
tgcactttcatttttgtctt

SEQ ID NO: 586037 - DNA, 20 bp, Artificial
  CRISPR gRNA sequence
gcactttcatttttgtcttt

SEQ ID NO: 586038 - DNA, 20 bp, Artificial
  CRISPR gRNA sequence
ttcatttttgtctttaggtt

SEQ ID NO: 586039 - DNA, 20 bp, Artificial
  CRISPR gRNA sequence
tcatttttgtctttaggttt

SEQ ID NO: 586040 - DNA, 20 bp, Artificial
  CRISPR gRNA sequence
gtctttaggtttaggtaaaa

SEQ ID NO: 586041 - DNA, 20 bp, Artificial
  CRISPR gRNA sequence
tctttaggtttaggtaaaac

SEQ ID NO: 586042 - DNA, 20 bp, Artificial
  CRISPR gRNA sequence
aggtaaaacaggtaataaca

SEQ ID NO: 586043 - DNA, 20 bp, Artificial
  CRISPR gRNA sequence
aataacatagtttgatttta

SEQ ID NO: 586044 - DNA, 20 bp, Artificial
  CRISPR gRNA sequence
gattttaaagcttttccttc

SEQ ID NO: 586045 - DNA, 20 bp, Artificial
  CRISPR gRNA sequence
taaagcttttccttcaagct

SEQ ID NO: 586046 - DNA, 20 bp, Artificial
  CRISPR gRNA sequence
agcttttccttcaagctaag

SEQ ID NO: 586047 - DNA, 20 bp, Artificial
  CRISPR gRNA sequence
caagctaagcagacttgaaa

SEQ ID NO: 586048 - DNA, 20 bp, Artificial
  CRISPR gRNA sequence
agacttgaaaaagcaacata

SEQ ID NO: 586049 - DNA, 20 bp, Artificial
  CRISPR gRNA sequence
acataaagataatattgaac

SEQ ID NO: 586050 - DNA, 20 bp, Artificial
  CRISPR gRNA sequence
gccataaaacctaattaaat

SEQ ID NO: 586051 - DNA, 20 bp, Artificial
  CRISPR gRNA sequence
taaaacccaataaaataaat

SEQ ID NO: 586052 - DNA, 20 bp, Artificial
  CRISPR gRNA sequence
attattatttccaaaactat

SEQ ID NO: 586053 - DNA, 20 bp, Artificial
  CRISPR gRNA sequence
caaactcaatcaacttttct

SEQ ID NO: 586054 - DNA, 20 bp, Artificial
  CRISPR gRNA sequence
tttcaccttgttctcttctg

SEQ ID NO: 586055 - DNA, 20 bp, Artificial
  CRISPR gRNA sequence
cctcttcatctttttctttt

SEQ ID NO: 586056 - DNA, 20 bp, Artificial
  CRISPR gRNA sequence
ctttttggcattgtcatttc

SEQ ID NO: 586057 - DNA, 20 bp, Artificial
  CRISPR gRNA sequence
tcacaccataccccctgccc

SEQ ID NO: 586058 - DNA, 20 bp, Artificial
  CRISPR gRNA sequence
cacaccataccccctgcccc

SEQ ID NO: 586059 - DNA, 20 bp, Artificial
  CRISPR gRNA sequence
accataccccctgccccagg

SEQ ID NO: 586060 - DNA, 20 bp, Artificial
  CRISPR gRNA sequence
ccataccccctgccccaggt

SEQ ID NO: 586061 - DNA, 20 bp, Artificial
  CRISPR gRNA sequence
catttatcatgtatcctcat

SEQ ID NO: 586062 - DNA, 20 bp, Artificial
  CRISPR gRNA sequence
tttatcatgtatcctcattg

SEQ ID NO: 586063 - DNA, 20 bp, Artificial
  CRISPR gRNA sequence
tacctcattaataacaaatt

SEQ ID NO: 586064 - DNA, 20 bp, Artificial
  CRISPR gRNA sequence
aataacaaatttggttaccc

SEQ ID NO: 586065 - DNA, 20 bp, Artificial
  CRISPR gRNA sequence
aacaaatttggttaccctag

SEQ ID NO: 586066 - DNA, 20 bp, Artificial
  CRISPR gRNA sequence
ttaccctagtggccccccat

SEQ ID NO: 586067 - DNA, 20 bp, Artificial
  CRISPR gRNA sequence
acacaatgaaattcaaacac

SEQ ID NO: 586068 - DNA, 20 bp, Artificial
  CRISPR gRNA sequence
atgaaattcaaacactagct

SEQ ID NO: 586069 - DNA, 20 bp, Artificial
  CRISPR gRNA sequence
aaattcaaacactagcttag

SEQ ID NO: 586070 - DNA, 20 bp, Artificial
  CRISPR gRNA sequence
attcaaacactagcttagca

SEQ ID NO: 586071 - DNA, 20 bp, Artificial
  CRISPR gRNA sequence
caaacactagcttagcagag

SEQ ID NO: 586072 - DNA, 20 bp, Artificial
  CRISPR gRNA sequence
tgcatcacaacctactaatt

SEQ ID NO: 586073 - DNA, 20 bp, Artificial
  CRISPR gRNA sequence
atcacaacctactaattcag

SEQ ID NO: 586074 - DNA, 20 bp, Artificial
  CRISPR gRNA sequence
tcctaccactccttaaactg

SEQ ID NO: 586075 - DNA, 20 bp, Artificial
  CRISPR gRNA sequence
actgcagttacactcaacat

SEQ ID NO: 586076 - DNA, 20 bp, Artificial
  CRISPR gRNA sequence
ctgcagttacactcaacatc

SEQ ID NO: 586077 - DNA, 20 bp, Artificial
  CRISPR gRNA sequence
tgcagttacactcaacatca

SEQ ID NO: 586078 - DNA, 20 bp, Artificial
  CRISPR gRNA sequence
agttacactcaacatcaggg

SEQ ID NO: 586079 - DNA, 20 bp, Artificial
  CRISPR gRNA sequence
taattatcttttatatctcc

SEQ ID NO: 586080 - DNA, 20 bp, Artificial
  CRISPR gRNA sequence
ttttactcatccctcatgtt

SEQ ID NO: 586081 - DNA, 20 bp, Artificial
  CRISPR gRNA sequence
gattgaacactcctgcatgt

SEQ ID NO: 586082 - DNA, 20 bp, Artificial
  CRISPR gRNA sequence
tgaacactcctgcatgtaag

SEQ ID NO: 586083 - DNA, 20 bp, Artificial
  CRISPR gRNA sequence
gaagcctctcttgacttttc

SEQ ID NO: 586084 - DNA, 20 bp, Artificial
  CRISPR gRNA sequence
agcctctcttgacttttcca

SEQ ID NO: 586085 - DNA, 20 bp, Artificial
  CRISPR gRNA sequence
tctcttgacttttccagagt

SEQ ID NO: 586086 - DNA, 20 bp, Artificial
  CRISPR gRNA sequence
ctcttgacttttccagagtt

SEQ ID NO: 586087 - DNA, 20 bp, Artificial
  CRISPR gRNA sequence
taattctacatctatgttcc

SEQ ID NO: 586088 - DNA, 20 bp, Artificial
  CRISPR gRNA sequence
attctacatctatgttccca

SEQ ID NO: 586089 - DNA, 20 bp, Artificial
  CRISPR gRNA sequence
aactgtgtatgcatccttat

SEQ ID NO: 586090 - DNA, 20 bp, Artificial
  CRISPR gRNA sequence
ctgtgtatgcatccttatta

SEQ ID NO: 586091 - DNA, 20 bp, Artificial
  CRISPR gRNA sequence
cattttattttattttttta

SEQ ID NO: 586092 - DNA, 20 bp, Artificial
  CRISPR gRNA sequence
ttaaagtatgtatttcctac

SEQ ID NO: 586093 - DNA, 20 bp, Artificial
  CRISPR gRNA sequence
gtatttcctaccagactata

SEQ ID NO: 586094 - DNA, 20 bp, Artificial
  CRISPR gRNA sequence
ttcctaccagactataaagt

SEQ ID NO: 586095 - DNA, 20 bp, Artificial
  CRISPR gRNA sequence
ctataaagtaagtgtattaa

SEQ ID NO: 586096 - DNA, 20 bp, Artificial
  CRISPR gRNA sequence
aagtaagtgtattaaaagac

SEQ ID NO: 586097 - DNA, 20 bp, Artificial
  CRISPR gRNA sequence
agtaagtgtattaaaagact

SEQ ID NO: 586098 - DNA, 20 bp, Artificial
  CRISPR gRNA sequence
gtccatttatttttataccc

SEQ ID NO: 586099 - DNA, 20 bp, Artificial
  CRISPR gRNA sequence
ccagaatgttctatataact

SEQ ID NO: 586100 - DNA, 20 bp, Artificial
  CRISPR gRNA sequence
gttctatataacttggcaca

SEQ ID NO: 586101 - DNA, 20 bp, Artificial
  CRISPR gRNA sequence
tatataacttggcacatagt

SEQ ID NO: 586102 - DNA, 20 bp, Artificial
  CRISPR gRNA sequence
gctcttgataaatgttttct

SEQ ID NO: 586103 - DNA, 20 bp, Artificial
  CRISPR gRNA sequence
tgataaatgttttctgagta

SEQ ID NO: 586104 - DNA, 20 bp, Artificial
  CRISPR gRNA sequence
tcctttaaaaaattccatac

SEQ ID NO: 586105 - DNA, 20 bp, Artificial
  CRISPR gRNA sequence
tttaaaaaattccatactag

SEQ ID NO: 586106 - DNA, 20 bp, Artificial
  CRISPR gRNA sequence
tccatactagaagaacaaca

SEQ ID NO: 586107 - DNA, 20 bp, Artificial
  CRISPR gRNA sequence
ccatactagaagaacaacac

SEQ ID NO: 586108 - DNA, 20 bp, Artificial
  CRISPR gRNA sequence
catactagaagaacaacaca

SEQ ID NO: 586109 - DNA, 20 bp, Artificial
  CRISPR gRNA sequence
acacagggaaaaacatgttt

SEQ ID NO: 586110 - DNA, 20 bp, Artificial
  CRISPR gRNA sequence
gggaaaaacatgttttagaa

SEQ ID NO: 586111 - DNA, 20 bp, Artificial
  CRISPR gRNA sequence
aaaacatgttttagaaaaga

SEQ ID NO: 586112 - DNA, 20 bp, Artificial
  CRISPR gRNA sequence
atgttttagaaaagaaagac

SEQ ID NO: 586113 - DNA, 20 bp, Artificial
  CRISPR gRNA sequence
tgttttagaaaagaaagact

SEQ ID NO: 586114 - DNA, 20 bp, Artificial
  CRISPR gRNA sequence
actaggaaatataactatgt

SEQ ID NO: 586115 - DNA, 20 bp, Artificial
  CRISPR gRNA sequence
gtcagatattttttaaaaac

SEQ ID NO: 586116 - DNA, 20 bp, Artificial
  CRISPR gRNA sequence
tattttttaaaaacaagtaa

SEQ ID NO: 586117 - DNA, 20 bp, Artificial
  CRISPR gRNA sequence
gtaatagttaaatcatttca

SEQ ID NO: 586118 - DNA, 20 bp, Artificial
  CRISPR gRNA sequence
aatagttaaatcatttcatg

SEQ ID NO: 586119 - DNA, 20 bp, Artificial
  CRISPR gRNA sequence
aaatcatttcatggagctaa

SEQ ID NO: 586120 - DNA, 20 bp, Artificial
  CRISPR gRNA sequence
gctaatggcaaccaaaatga

SEQ ID NO: 586121 - DNA, 20 bp, Artificial
  CRISPR gRNA sequence
ctctcatatctaccacaaaa

SEQ ID NO: 586122 - DNA, 20 bp, Artificial
  CRISPR gRNA sequence
tctcatatctaccacaaaaa

SEQ ID NO: 586123 - DNA, 20 bp, Artificial
  CRISPR gRNA sequence
gaaaacaaataaataacata

SEQ ID NO: 586124 - DNA, 20 bp, Artificial
  CRISPR gRNA sequence
acaaataaataacatacagc

SEQ ID NO: 586125 - DNA, 20 bp, Artificial
  CRISPR gRNA sequence
aaataaataacatacagcaa

SEQ ID NO: 586126 - DNA, 20 bp, Artificial
  CRISPR gRNA sequence
taaataacatacagcaagag

SEQ ID NO: 586127 - DNA, 20 bp, Artificial
  CRISPR gRNA sequence
aaataacatacagcaagaga

SEQ ID NO: 586128 - DNA, 20 bp, Artificial
  CRISPR gRNA sequence
aataacatacagcaagagaa

SEQ ID NO: 586129 - DNA, 20 bp, Artificial
  CRISPR gRNA sequence
catacagcaagagaagggaa

SEQ ID NO: 586130 - DNA, 20 bp, Artificial
  CRISPR gRNA sequence
caagagaagggaatagatat

SEQ ID NO: 586131 - DNA, 20 bp, Artificial
  CRISPR gRNA sequence
aatagatataagtttcatca

SEQ ID NO: 586132 - DNA, 20 bp, Artificial
  CRISPR gRNA sequence
tcatcatggttctgtttaaa

SEQ ID NO: 586133 - DNA, 20 bp, Artificial
  CRISPR gRNA sequence
atcatggttctgtttaaaaa

SEQ ID NO: 586134 - DNA, 20 bp, Artificial
  CRISPR gRNA sequence
tttaaaaagagacatatgcc

SEQ ID NO: 586135 - DNA, 20 bp, Artificial
  CRISPR gRNA sequence
atatgccaagctatttatat

SEQ ID NO: 586136 - DNA, 20 bp, Artificial
  CRISPR gRNA sequence
cgtatgttaatgatgaactc

SEQ ID NO: 586137 - DNA, 20 bp, Artificial
  CRISPR gRNA sequence
atgttaatgatgaactctag

SEQ ID NO: 586138 - DNA, 20 bp, Artificial
  CRISPR gRNA sequence
tgaactctagcagcatttta

SEQ ID NO: 586139 - DNA, 20 bp, Artificial
  CRISPR gRNA sequence
agaaccatgtttttctctta

SEQ ID NO: 586140 - DNA, 20 bp, Artificial
  CRISPR gRNA sequence
ttatcaactcctacctcgta

SEQ ID NO: 586141 - DNA, 20 bp, Artificial
  CRISPR gRNA sequence
tcgtatggccaatttcccat

SEQ ID NO: 586142 - DNA, 20 bp, Artificial
  CRISPR gRNA sequence
cgtatggccaatttcccatt

SEQ ID NO: 586143 - DNA, 20 bp, Artificial
  CRISPR gRNA sequence
cccattaggcatgttaacaa

SEQ ID NO: 586144 - DNA, 20 bp, Artificial
  CRISPR gRNA sequence
ttaggcatgttaacaacaga

SEQ ID NO: 586145 - DNA, 20 bp, Artificial
  CRISPR gRNA sequence
aggcatgttaacaacagata

SEQ ID NO: 586146 - DNA, 20 bp, Artificial
  CRISPR gRNA sequence
ggcatgttaacaacagatag

SEQ ID NO: 586147 - DNA, 20 bp, Artificial
  CRISPR gRNA sequence
catgttaacaacagatagag

SEQ ID NO: 586148 - DNA, 20 bp, Artificial
  CRISPR gRNA sequence
aacaacagatagaggagatt

SEQ ID NO: 586149 - DNA, 20 bp, Artificial
  CRISPR gRNA sequence
acaacagatagaggagatta

SEQ ID NO: 586150 - DNA, 20 bp, Artificial
  CRISPR gRNA sequence
aattattgttataacaaacc

SEQ ID NO: 586151 - DNA, 20 bp, Artificial
  CRISPR gRNA sequence
tgttataacaaacccagaaa

SEQ ID NO: 586152 - DNA, 20 bp, Artificial
  CRISPR gRNA sequence
taacaaacccagaaaaagta

SEQ ID NO: 586153 - DNA, 20 bp, Artificial
  CRISPR gRNA sequence
agaaaaagtatggtatgaaa

SEQ ID NO: 586154 - DNA, 20 bp, Artificial
  CRISPR gRNA sequence
ggcatgaatgtaaacttatg

SEQ ID NO: 586155 - DNA, 20 bp, Artificial
  CRISPR gRNA sequence
tatgtggttaaaatgatatc

SEQ ID NO: 586156 - DNA, 20 bp, Artificial
  CRISPR gRNA sequence
taaaatgatatccagtattt

SEQ ID NO: 586157 - DNA, 20 bp, Artificial
  CRISPR gRNA sequence
agaatatttgtttctataaa

SEQ ID NO: 586158 - DNA, 20 bp, Artificial
  CRISPR gRNA sequence
tttgtttctataaatggtat

SEQ ID NO: 586159 - DNA, 20 bp, Artificial
  CRISPR gRNA sequence
gtttctataaatggtatcag

SEQ ID NO: 586160 - DNA, 20 bp, Artificial
  CRISPR gRNA sequence
cctcaatcccttctcctctt

SEQ ID NO: 586161 - DNA, 20 bp, Artificial
  CRISPR gRNA sequence
taccctctgctctacctacc

SEQ ID NO: 586162 - DNA, 20 bp, Artificial
  CRISPR gRNA sequence
ctttcccactttcccccact

SEQ ID NO: 586163 - DNA, 20 bp, Artificial
  CRISPR gRNA sequence
cactttcccccacttggttc

SEQ ID NO: 586164 - DNA, 20 bp, Artificial
  CRISPR gRNA sequence
cccccacttggttccagctt

SEQ ID NO: 586165 - DNA, 20 bp, Artificial
  CRISPR gRNA sequence
cagcttcagcaccacctgta

SEQ ID NO: 586166 - DNA, 20 bp, Artificial
  CRISPR gRNA sequence
agcttcagcaccacctgtaa

SEQ ID NO: 586167 - DNA, 20 bp, Artificial
  CRISPR gRNA sequence
gcttcagcaccacctgtaaa

SEQ ID NO: 586168 - DNA, 20 bp, Artificial
  CRISPR gRNA sequence
ctgtaaagggcctgtgccta

SEQ ID NO: 586169 - DNA, 20 bp, Artificial
  CRISPR gRNA sequence
gtaaagggcctgtgcctacg

SEQ ID NO: 586170 - DNA, 20 bp, Artificial
  CRISPR gRNA sequence
taaagggcctgtgcctacgg

SEQ ID NO: 586171 - DNA, 20 bp, Artificial
  CRISPR gRNA sequence
aaagggcctgtgcctacgga

SEQ ID NO: 586172 - DNA, 20 bp, Artificial
  CRISPR gRNA sequence
gcctgtgcctacggagggct

SEQ ID NO: 586173 - DNA, 20 bp, Artificial
  CRISPR gRNA sequence
ctacggagggctaagcaatc

SEQ ID NO: 586174 - DNA, 20 bp, Artificial
  CRISPR gRNA sequence
tacggagggctaagcaatct

SEQ ID NO: 586175 - DNA, 20 bp, Artificial
  CRISPR gRNA sequence
acggagggctaagcaatctg

SEQ ID NO: 586176 - DNA, 20 bp, Artificial
  CRISPR gRNA sequence
gggctaagcaatctggggaa

SEQ ID NO: 586177 - DNA, 20 bp, Artificial
  CRISPR gRNA sequence
ggctaagcaatctggggaat

SEQ ID NO: 586178 - DNA, 20 bp, Artificial
  CRISPR gRNA sequence
gctaagcaatctggggaata

SEQ ID NO: 586179 - DNA, 20 bp, Artificial
  CRISPR gRNA sequence
ctaagcaatctggggaatag

SEQ ID NO: 586180 - DNA, 20 bp, Artificial
  CRISPR gRNA sequence
taagcaatctggggaatagg

SEQ ID NO: 586181 - DNA, 20 bp, Artificial
  CRISPR gRNA sequence
caatctggggaatagggggt

SEQ ID NO: 586182 - DNA, 20 bp, Artificial
  CRISPR gRNA sequence
ggggaatagggggtaagact

SEQ ID NO: 586183 - DNA, 20 bp, Artificial
  CRISPR gRNA sequence
gggaatagggggtaagactg

SEQ ID NO: 586184 - DNA, 20 bp, Artificial
  CRISPR gRNA sequence
agggggtaagactgaggccc

SEQ ID NO: 586185 - DNA, 20 bp, Artificial
  CRISPR gRNA sequence
agactgaggccccagttgtt

SEQ ID NO: 586186 - DNA, 20 bp, Artificial
  CRISPR gRNA sequence
gactgaggccccagttgttt

SEQ ID NO: 586187 - DNA, 20 bp, Artificial
  CRISPR gRNA sequence
actgaggccccagttgttta

SEQ ID NO: 586188 - DNA, 20 bp, Artificial
  CRISPR gRNA sequence
ctgaggccccagttgtttag

SEQ ID NO: 586189 - DNA, 20 bp, Artificial
  CRISPR gRNA sequence
tacttgtttaaatttttcgt

SEQ ID NO: 586190 - DNA, 20 bp, Artificial
  CRISPR gRNA sequence
gttagcatttgattctctaa

SEQ ID NO: 586191 - DNA, 20 bp, Artificial
  CRISPR gRNA sequence
ctaaaagttcaatctgccaa

SEQ ID NO: 586192 - DNA, 20 bp, Artificial
  CRISPR gRNA sequence
tttacctccctattaccata

SEQ ID NO: 586193 - DNA, 20 bp, Artificial
  CRISPR gRNA sequence
cctattaccatatagtcttt

SEQ ID NO: 586194 - DNA, 20 bp, Artificial
  CRISPR gRNA sequence
ctattaccatatagtctttt

SEQ ID NO: 586195 - DNA, 20 bp, Artificial
  CRISPR gRNA sequence
attaccatatagtcttttag

SEQ ID NO: 586196 - DNA, 20 bp, Artificial
  CRISPR gRNA sequence
ttaggagtatgtatgcaata

SEQ ID NO: 586197 - DNA, 20 bp, Artificial
  CRISPR gRNA sequence
tacagaattccataaataac

SEQ ID NO: 586198 - DNA, 20 bp, Artificial
  CRISPR gRNA sequence
acagaattccataaataact

SEQ ID NO: 586199 - DNA, 20 bp, Artificial
  CRISPR gRNA sequence
gaatgcaaaaataataaata

SEQ ID NO: 586200 - DNA, 20 bp, Artificial
  CRISPR gRNA sequence
gcaaaaataataaataaagt

SEQ ID NO: 586201 - DNA, 20 bp, Artificial
  CRISPR gRNA sequence
tgcataacgccatcaaatgt

SEQ ID NO: 586202 - DNA, 20 bp, Artificial
  CRISPR gRNA sequence
atcaaatgtcagaactgcaa

SEQ ID NO: 586203 - DNA, 20 bp, Artificial
  CRISPR gRNA sequence
tcaaatgtcagaactgcaat

SEQ ID NO: 586204 - DNA, 20 bp, Artificial
  CRISPR gRNA sequence
aaatgtcagaactgcaatgg

SEQ ID NO: 586205 - DNA, 20 bp, Artificial
  CRISPR gRNA sequence
tgcaatgggagaatataata

SEQ ID NO: 586206 - DNA, 20 bp, Artificial
  CRISPR gRNA sequence
agaatataatatagaaaaac

SEQ ID NO: 586207 - DNA, 20 bp, Artificial
  CRISPR gRNA sequence
atataatatagaaaaactag

SEQ ID NO: 586208 - DNA, 20 bp, Artificial
  CRISPR gRNA sequence
aaaactagtagcaatgccat

SEQ ID NO: 586209 - DNA, 20 bp, Artificial
  CRISPR gRNA sequence
aaactagtagcaatgccata

SEQ ID NO: 586210 - DNA, 20 bp, Artificial
  CRISPR gRNA sequence
agcaatgccataaggtgttt

SEQ ID NO: 586211 - DNA, 20 bp, Artificial
  CRISPR gRNA sequence
gcaatgccataaggtgtttt

SEQ ID NO: 586212 - DNA, 20 bp, Artificial
  CRISPR gRNA sequence
caatgccataaggtgttttg

SEQ ID NO: 586213 - DNA, 20 bp, Artificial
  CRISPR gRNA sequence
tgccataaggtgttttgggg

SEQ ID NO: 586214 - DNA, 20 bp, Artificial
  CRISPR gRNA sequence
aaggtgttttggggaagatt

SEQ ID NO: 586215 - DNA, 20 bp, Artificial
  CRISPR gRNA sequence
ggaagatttggtattccccc

SEQ ID NO: 586216 - DNA, 20 bp, Artificial
  CRISPR gRNA sequence
gtattcccccaagcttccat

SEQ ID NO: 586217 - DNA, 20 bp, Artificial
  CRISPR gRNA sequence
cccaagcttccatcagcttc

SEQ ID NO: 586218 - DNA, 20 bp, Artificial
  CRISPR gRNA sequence
cttaaatccatcaatttaaa

SEQ ID NO: 586219 - DNA, 20 bp, Artificial
  CRISPR gRNA sequence
tccatcaatttaaatagtaa

SEQ ID NO: 586220 - DNA, 20 bp, Artificial
  CRISPR gRNA sequence
ttaaatagtaacagtgtatt

SEQ ID NO: 586221 - DNA, 20 bp, Artificial
  CRISPR gRNA sequence
atagtaacagtgtatttggt

SEQ ID NO: 586222 - DNA, 20 bp, Artificial
  CRISPR gRNA sequence
aaatgaaacttctaatgctt

SEQ ID NO: 586223 - DNA, 20 bp, Artificial
  CRISPR gRNA sequence
tctaatgcttaagttactgc

SEQ ID NO: 586224 - DNA, 20 bp, Artificial
  CRISPR gRNA sequence
gctggtaaataacaaattta

SEQ ID NO: 586225 - DNA, 20 bp, Artificial
  CRISPR gRNA sequence
ctggtaaataacaaatttat

SEQ ID NO: 586226 - DNA, 20 bp, Artificial
  CRISPR gRNA sequence
tggtaaataacaaatttata

SEQ ID NO: 586227 - DNA, 20 bp, Artificial
  CRISPR gRNA sequence
aataacaaatttatagggaa

SEQ ID NO: 586228 - DNA, 20 bp, Artificial
  CRISPR gRNA sequence
atagcacatttactgttatt

SEQ ID NO: 586229 - DNA, 20 bp, Artificial
  CRISPR gRNA sequence
ttaatgttctcaaatgttaa

SEQ ID NO: 586230 - DNA, 20 bp, Artificial
  CRISPR gRNA sequence
gttctcaaatgttaacagta

SEQ ID NO: 586231 - DNA, 20 bp, Artificial
  CRISPR gRNA sequence
cagtaaagcaaaccatttat

SEQ ID NO: 586232 - DNA, 20 bp, Artificial
  CRISPR gRNA sequence
agtaaagcaaaccatttatt

SEQ ID NO: 586233 - DNA, 20 bp, Artificial
  CRISPR gRNA sequence
ttgggcatttattacatatc

SEQ ID NO: 586234 - DNA, 20 bp, Artificial
  CRISPR gRNA sequence
tcacatttaatcctcaaacc

SEQ ID NO: 586235 - DNA, 20 bp, Artificial
  CRISPR gRNA sequence
aatcctcaaacccagcctat

SEQ ID NO: 586236 - DNA, 20 bp, Artificial
  CRISPR gRNA sequence
cagcctatgagtgacacacc

SEQ ID NO: 586237 - DNA, 20 bp, Artificial
  CRISPR gRNA sequence
gagtgacacacccagacacg

SEQ ID NO: 586238 - DNA, 20 bp, Artificial
  CRISPR gRNA sequence
tgacacacccagacacgaag

SEQ ID NO: 586239 - DNA, 20 bp, Artificial
  CRISPR gRNA sequence
acacccagacacgaagtagc

SEQ ID NO: 586240 - DNA, 20 bp, Artificial
  CRISPR gRNA sequence
acccagacacgaagtagcca

SEQ ID NO: 586241 - DNA, 20 bp, Artificial
  CRISPR gRNA sequence
cagacacgaagtagccagag

SEQ ID NO: 586242 - DNA, 20 bp, Artificial
  CRISPR gRNA sequence
agacacgaagtagccagagc

SEQ ID NO: 586243 - DNA, 20 bp, Artificial
  CRISPR gRNA sequence
cgaagtagccagagcaggtt

SEQ ID NO: 586244 - DNA, 20 bp, Artificial
  CRISPR gRNA sequence
agtagccagagcaggtttgg

SEQ ID NO: 586245 - DNA, 20 bp, Artificial
  CRISPR gRNA sequence
gagcaggtttggcagactcc

SEQ ID NO: 586246 - DNA, 20 bp, Artificial
  CRISPR gRNA sequence
attttgtaatctctatgttc

SEQ ID NO: 586247 - DNA, 20 bp, Artificial
  CRISPR gRNA sequence
agatcctatgctatcatcat

SEQ ID NO: 586248 - DNA, 20 bp, Artificial
  CRISPR gRNA sequence
ctatgctatcatcatcagcc

SEQ ID NO: 586249 - DNA, 20 bp, Artificial
  CRISPR gRNA sequence
tatgctatcatcatcagccc

SEQ ID NO: 586250 - DNA, 20 bp, Artificial
  CRISPR gRNA sequence
atcatcagcccaggtaatgc

SEQ ID NO: 586251 - DNA, 20 bp, Artificial
  CRISPR gRNA sequence
cttgaaatatcaaatttacc

SEQ ID NO: 586252 - DNA, 20 bp, Artificial
  CRISPR gRNA sequence
atttaccaagacttgataca

SEQ ID NO: 586253 - DNA, 20 bp, Artificial
  CRISPR gRNA sequence
accaagacttgatacacaga

SEQ ID NO: 586254 - DNA, 20 bp, Artificial
  CRISPR gRNA sequence
ccaagacttgatacacagat

SEQ ID NO: 586255 - DNA, 20 bp, Artificial
  CRISPR gRNA sequence
gatgataatataaaaataaa

SEQ ID NO: 586256 - DNA, 20 bp, Artificial
  CRISPR gRNA sequence
tggacttgatcacaaatcaa

SEQ ID NO: 586257 - DNA, 20 bp, Artificial
  CRISPR gRNA sequence
tgatcacaaatcaatagaat

SEQ ID NO: 586258 - DNA, 20 bp, Artificial
  CRISPR gRNA sequence
atcaatagaattagattctt

SEQ ID NO: 586259 - DNA, 20 bp, Artificial
  CRISPR gRNA sequence
gaattagattctttagatta

SEQ ID NO: 586260 - DNA, 20 bp, Artificial
  CRISPR gRNA sequence
attctttagattatagaaac

SEQ ID NO: 586261 - DNA, 20 bp, Artificial
  CRISPR gRNA sequence
ctttagattatagaaactag

SEQ ID NO: 586262 - DNA, 20 bp, Artificial
  CRISPR gRNA sequence
tttagattatagaaactaga

SEQ ID NO: 586263 - DNA, 20 bp, Artificial
  CRISPR gRNA sequence
gaaactagaaggaaatgctt

SEQ ID NO: 586264 - DNA, 20 bp, Artificial
  CRISPR gRNA sequence
aaggaaatgcttcagttgtt

SEQ ID NO: 586265 - DNA, 20 bp, Artificial
  CRISPR gRNA sequence
aggaaatgcttcagttgttc

SEQ ID NO: 586266 - DNA, 20 bp, Artificial
  CRISPR gRNA sequence
cttcagttgttcaggataac

SEQ ID NO: 586267 - DNA, 20 bp, Artificial
  CRISPR gRNA sequence
actcaacaacacataatcac

SEQ ID NO: 586268 - DNA, 20 bp, Artificial
  CRISPR gRNA sequence
cactagctgtccaacaaaca

SEQ ID NO: 586269 - DNA, 20 bp, Artificial
  CRISPR gRNA sequence
gtccaacaaacacagttcca

SEQ ID NO: 586270 - DNA, 20 bp, Artificial
  CRISPR gRNA sequence
tatatactctataaaacaaa

SEQ ID NO: 586271 - DNA, 20 bp, Artificial
  CRISPR gRNA sequence
ataaaacaaacagaaaaccc

SEQ ID NO: 586272 - DNA, 20 bp, Artificial
  CRISPR gRNA sequence
cccagaaataatccttgacc

SEQ ID NO: 586273 - DNA, 20 bp, Artificial
  CRISPR gRNA sequence
tccttgacctggctatgtat

SEQ ID NO: 586274 - DNA, 20 bp, Artificial
  CRISPR gRNA sequence
gctatgtataagccaataca

SEQ ID NO: 586275 - DNA, 20 bp, Artificial
  CRISPR gRNA sequence
catagatatttatattttaa

SEQ ID NO: 586276 - DNA, 20 bp, Artificial
  CRISPR gRNA sequence
ccaactataccatttaatac

SEQ ID NO: 586277 - DNA, 20 bp, Artificial
  CRISPR gRNA sequence
caactataccatttaatact

SEQ ID NO: 586278 - DNA, 20 bp, Artificial
  CRISPR gRNA sequence
ggcaaaccttttttaaataa

SEQ ID NO: 586279 - DNA, 20 bp, Artificial
  CRISPR gRNA sequence
tttttaaataaaagatatac

SEQ ID NO: 586280 - DNA, 20 bp, Artificial
  CRISPR gRNA sequence
ttaaataaaagatatacaag

SEQ ID NO: 586281 - DNA, 20 bp, Artificial
  CRISPR gRNA sequence
ataaaagatatacaagtggc

SEQ ID NO: 586282 - DNA, 20 bp, Artificial
  CRISPR gRNA sequence
taaaagatatacaagtggcc

SEQ ID NO: 586283 - DNA, 20 bp, Artificial
  CRISPR gRNA sequence
atacaagtggccaggtgcaa

SEQ ID NO: 586284 - DNA, 20 bp, Artificial
  CRISPR gRNA sequence
atggttcacacctgtaatcc

SEQ ID NO: 586285 - DNA, 20 bp, Artificial
  CRISPR gRNA sequence
cacctgtaatcccagaactt

SEQ ID NO: 586286 - DNA, 20 bp, Artificial
  CRISPR gRNA sequence
acctgtaatcccagaacttt

SEQ ID NO: 586287 - DNA, 20 bp, Artificial
  CRISPR gRNA sequence
tgtaatcccagaactttggg

SEQ ID NO: 586288 - DNA, 20 bp, Artificial
  CRISPR gRNA sequence
gtaatcccagaactttggga

SEQ ID NO: 586289 - DNA, 20 bp, Artificial
  CRISPR gRNA sequence
tcccagaactttgggaaggc

SEQ ID NO: 586290 - DNA, 20 bp, Artificial
  CRISPR gRNA sequence
cccagaactttgggaaggca

SEQ ID NO: 586291 - DNA, 20 bp, Artificial
  CRISPR gRNA sequence
agaactttgggaaggcaagg

SEQ ID NO: 586292 - DNA, 20 bp, Artificial
  CRISPR gRNA sequence
gaactttgggaaggcaaggc

SEQ ID NO: 586293 - DNA, 20 bp, Artificial
  CRISPR gRNA sequence
ctttgggaaggcaaggcggg

SEQ ID NO: 586294 - DNA, 20 bp, Artificial
  CRISPR gRNA sequence
gcaaggcgggcagctcacct

SEQ ID NO: 586295 - DNA, 20 bp, Artificial
  CRISPR gRNA sequence
caaggcgggcagctcacctg

SEQ ID NO: 586296 - DNA, 20 bp, Artificial
  CRISPR gRNA sequence
gcgggcagctcacctgaggt

SEQ ID NO: 586297 - DNA, 20 bp, Artificial
  CRISPR gRNA sequence
cgggcagctcacctgaggtc

SEQ ID NO: 586298 - DNA, 20 bp, Artificial
  CRISPR gRNA sequence
ggcagctcacctgaggtcag

SEQ ID NO: 586299 - DNA, 20 bp, Artificial
  CRISPR gRNA sequence
tcacctgaggtcaggagttt

SEQ ID NO: 586300 - DNA, 20 bp, Artificial
  CRISPR gRNA sequence
tgaggtcaggagtttgagac

SEQ ID NO: 586301 - DNA, 20 bp, Artificial
  CRISPR gRNA sequence
tcaggagtttgagaccagcc

SEQ ID NO: 586302 - DNA, 20 bp, Artificial
  CRISPR gRNA sequence
tgagaccagcctggccaaca

SEQ ID NO: 586303 - DNA, 20 bp, Artificial
  CRISPR gRNA sequence
tctactaaaaatacaaaaac

SEQ ID NO: 586304 - DNA, 20 bp, Artificial
  CRISPR gRNA sequence
ctaaaaatacaaaaactagc

SEQ ID NO: 586305 - DNA, 20 bp, Artificial
  CRISPR gRNA sequence
taaaaatacaaaaactagcc

SEQ ID NO: 586306 - DNA, 20 bp, Artificial
  CRISPR gRNA sequence
atacaaaaactagccaggcc

SEQ ID NO: 586307 - DNA, 20 bp, Artificial
  CRISPR gRNA sequence
caaaaactagccaggcctgg

SEQ ID NO: 586308 - DNA, 20 bp, Artificial
  CRISPR gRNA sequence
gtggtacatgcctgtaatcc

SEQ ID NO: 586309 - DNA, 20 bp, Artificial
  CRISPR gRNA sequence
tgcctgtaatcccagttact

SEQ ID NO: 586310 - DNA, 20 bp, Artificial
  CRISPR gRNA sequence
ctgtaatcccagttacttgg

SEQ ID NO: 586311 - DNA, 20 bp, Artificial
  CRISPR gRNA sequence
tgtaatcccagttacttggc

SEQ ID NO: 586312 - DNA, 20 bp, Artificial
  CRISPR gRNA sequence
cccagttacttggcaggctg

SEQ ID NO: 586313 - DNA, 20 bp, Artificial
  CRISPR gRNA sequence
agttacttggcaggctgaag

SEQ ID NO: 586314 - DNA, 20 bp, Artificial
  CRISPR gRNA sequence
gttacttggcaggctgaagc

SEQ ID NO: 586315 - DNA, 20 bp, Artificial
  CRISPR gRNA sequence
tacttggcaggctgaagcag

SEQ ID NO: 586316 - DNA, 20 bp, Artificial
  CRISPR gRNA sequence
agcaggagaatcgcttgaac

SEQ ID NO: 586317 - DNA, 20 bp, Artificial
  CRISPR gRNA sequence
gcaggagaatcgcttgaacc

SEQ ID NO: 586318 - DNA, 20 bp, Artificial
  CRISPR gRNA sequence
caggagaatcgcttgaaccg

SEQ ID NO: 586319 - DNA, 20 bp, Artificial
  CRISPR gRNA sequence
ggagaatcgcttgaaccggg

SEQ ID NO: 586320 - DNA, 20 bp, Artificial
  CRISPR gRNA sequence
gagaatcgcttgaaccgggg

SEQ ID NO: 586321 - DNA, 20 bp, Artificial
  CRISPR gRNA sequence
aatcgcttgaaccggggagg

SEQ ID NO: 586322 - DNA, 20 bp, Artificial
  CRISPR gRNA sequence
tcgcttgaaccggggaggca

SEQ ID NO: 586323 - DNA, 20 bp, Artificial
  CRISPR gRNA sequence
cgcttgaaccggggaggcag

SEQ ID NO: 586324 - DNA, 20 bp, Artificial
  CRISPR gRNA sequence
aaccggggaggcagaggttg

SEQ ID NO: 586325 - DNA, 20 bp, Artificial
  CRISPR gRNA sequence
ggggaggcagaggttgtggt

SEQ ID NO: 586326 - DNA, 20 bp, Artificial
  CRISPR gRNA sequence
ggcagaggttgtggtgagct

SEQ ID NO: 586327 - DNA, 20 bp, Artificial
  CRISPR gRNA sequence
gagatcgtgccactgcactc

SEQ ID NO: 586328 - DNA, 20 bp, Artificial
  CRISPR gRNA sequence
cgtgccactgcactccagcc

SEQ ID NO: 586329 - DNA, 20 bp, Artificial
  CRISPR gRNA sequence
gtgccactgcactccagcct

SEQ ID NO: 586330 - DNA, 20 bp, Artificial
  CRISPR gRNA sequence
ccactgcactccagcctggg

SEQ ID NO: 586331 - DNA, 20 bp, Artificial
  CRISPR gRNA sequence
gcactccagcctgggtggca

SEQ ID NO: 586332 - DNA, 20 bp, Artificial
  CRISPR gRNA sequence
tccagcctgggtggcaaagt

SEQ ID NO: 586333 - DNA, 20 bp, Artificial
  CRISPR gRNA sequence
cagcctgggtggcaaagtga

SEQ ID NO: 586334 - DNA, 20 bp, Artificial
  CRISPR gRNA sequence
taatttaaaaaaataaataa

SEQ ID NO: 586335 - DNA, 20 bp, Artificial
  CRISPR gRNA sequence
aaagatatacatgtactaat

SEQ ID NO: 586336 - DNA, 20 bp, Artificial
  CRISPR gRNA sequence
tatacatgtactaataagtt

SEQ ID NO: 586337 - DNA, 20 bp, Artificial
  CRISPR gRNA sequence
tttgtataaataaaacttat

SEQ ID NO: 586338 - DNA, 20 bp, Artificial
  CRISPR gRNA sequence
gtataaataaaacttatcag

SEQ ID NO: 586339 - DNA, 20 bp, Artificial
  CRISPR gRNA sequence
tatcagtagacaaatctaat

SEQ ID NO: 586340 - DNA, 20 bp, Artificial
  CRISPR gRNA sequence
agtagacaaatctaattagt

SEQ ID NO: 586341 - DNA, 20 bp, Artificial
  CRISPR gRNA sequence
acaaatctaattagtaagac

SEQ ID NO: 586342 - DNA, 20 bp, Artificial
  CRISPR gRNA sequence
atctaattagtaagacaaga

SEQ ID NO: 586343 - DNA, 20 bp, Artificial
  CRISPR gRNA sequence
agatagacattacaaatctt

SEQ ID NO: 586344 - DNA, 20 bp, Artificial
  CRISPR gRNA sequence
aattcattattttcctatat

SEQ ID NO: 586345 - DNA, 20 bp, Artificial
  CRISPR gRNA sequence
attcattattttcctatata

SEQ ID NO: 586346 - DNA, 20 bp, Artificial
  CRISPR gRNA sequence
gattattaaaattaactttt

SEQ ID NO: 586347 - DNA, 20 bp, Artificial
  CRISPR gRNA sequence
attattaaaattaacttttc

SEQ ID NO: 586348 - DNA, 20 bp, Artificial
  CRISPR gRNA sequence
taaaattaacttttcaggaa

SEQ ID NO: 586349 - DNA, 20 bp, Artificial
  CRISPR gRNA sequence
aaattaacttttcaggaaca

SEQ ID NO: 586350 - DNA, 20 bp, Artificial
  CRISPR gRNA sequence
aattattcattgataaacct

SEQ ID NO: 586351 - DNA, 20 bp, Artificial
  CRISPR gRNA sequence
attattcattgataaacctt

SEQ ID NO: 586352 - DNA, 20 bp, Artificial
  CRISPR gRNA sequence
ttattcattgataaacctta

SEQ ID NO: 586353 - DNA, 20 bp, Artificial
  CRISPR gRNA sequence
gattgccttcctacctgccg

SEQ ID NO: 586354 - DNA, 20 bp, Artificial
  CRISPR gRNA sequence
cctacctgccgtagtgtatt

SEQ ID NO: 586355 - DNA, 20 bp, Artificial
  CRISPR gRNA sequence
tacctgccgtagtgtattta

SEQ ID NO: 586356 - DNA, 20 bp, Artificial
  CRISPR gRNA sequence
gccgtagtgtatttagagat

SEQ ID NO: 586357 - DNA, 20 bp, Artificial
  CRISPR gRNA sequence
ccgtagtgtatttagagatc

SEQ ID NO: 586358 - DNA, 20 bp, Artificial
  CRISPR gRNA sequence
agagatcaggatgttttgct

SEQ ID NO: 586359 - DNA, 20 bp, Artificial
  CRISPR gRNA sequence
agatcaggatgttttgcttg

SEQ ID NO: 586360 - DNA, 20 bp, Artificial
  CRISPR gRNA sequence
tgcttggagaatgttttttg

SEQ ID NO: 586361 - DNA, 20 bp, Artificial
  CRISPR gRNA sequence
cttggagaatgttttttgtg

SEQ ID NO: 586362 - DNA, 20 bp, Artificial
  CRISPR gRNA sequence
tggagaatgttttttgtgga

SEQ ID NO: 586363 - DNA, 20 bp, Artificial
  CRISPR gRNA sequence
gagaatgttttttgtggaga

SEQ ID NO: 586364 - DNA, 20 bp, Artificial
  CRISPR gRNA sequence
atgttttttgtggagagaga

SEQ ID NO: 586365 - DNA, 20 bp, Artificial
  CRISPR gRNA sequence
agagagatggtgtctaatgt

SEQ ID NO: 586366 - DNA, 20 bp, Artificial
  CRISPR gRNA sequence
gatggtgtctaatgttggtc

SEQ ID NO: 586367 - DNA, 20 bp, Artificial
  CRISPR gRNA sequence
ctagattgttttgcacattg

SEQ ID NO: 586368 - DNA, 20 bp, Artificial
  CRISPR gRNA sequence
attgttttgcacattgtaga

SEQ ID NO: 586369 - DNA, 20 bp, Artificial
  CRISPR gRNA sequence
cacattgtagaaagcaaaat

SEQ ID NO: 586370 - DNA, 20 bp, Artificial
  CRISPR gRNA sequence
gtaatttctcataaaaatta

SEQ ID NO: 586371 - DNA, 20 bp, Artificial
  CRISPR gRNA sequence
taatttctcataaaaattaa

SEQ ID NO: 586372 - DNA, 20 bp, Artificial
  CRISPR gRNA sequence
aatttctcataaaaattaaa

SEQ ID NO: 586373 - DNA, 20 bp, Artificial
  CRISPR gRNA sequence
ataaaaattaaagggccgat

SEQ ID NO: 586374 - DNA, 20 bp, Artificial
  CRISPR gRNA sequence
aaaaattaaagggccgattg

SEQ ID NO: 586375 - DNA, 20 bp, Artificial
  CRISPR gRNA sequence
atatgactgatcacttacct

SEQ ID NO: 586376 - DNA, 20 bp, Artificial
  CRISPR gRNA sequence
aaataaccaattcattcttt

SEQ ID NO: 586377 - DNA, 20 bp, Artificial
  CRISPR gRNA sequence
aataaccaattcattctttt

SEQ ID NO: 586378 - DNA, 20 bp, Artificial
  CRISPR gRNA sequence
aaccaattcattcttttagg

SEQ ID NO: 586379 - DNA, 20 bp, Artificial
  CRISPR gRNA sequence
tcattcttttaggcagccta

SEQ ID NO: 586380 - DNA, 20 bp, Artificial
  CRISPR gRNA sequence
aggcagcctacagactaatg

SEQ ID NO: 586381 - DNA, 20 bp, Artificial
  CRISPR gRNA sequence
cctacagactaatgtggaat

SEQ ID NO: 586382 - DNA, 20 bp, Artificial
  CRISPR gRNA sequence
tggaatcagctctaactatc

SEQ ID NO: 586383 - DNA, 20 bp, Artificial
  CRISPR gRNA sequence
atcagctctaactatctggt

SEQ ID NO: 586384 - DNA, 20 bp, Artificial
  CRISPR gRNA sequence
atctggttagaaaaatgaaa

SEQ ID NO: 586385 - DNA, 20 bp, Artificial
  CRISPR gRNA sequence
tggttagaaaaatgaaaaag

SEQ ID NO: 586386 - DNA, 20 bp, Artificial
  CRISPR gRNA sequence
gttagaaaaatgaaaaagaa

SEQ ID NO: 586387 - DNA, 20 bp, Artificial
  CRISPR gRNA sequence
aaatgaaaaagaagagtaaa

SEQ ID NO: 586388 - DNA, 20 bp, Artificial
  CRISPR gRNA sequence
gagtaaatagtaccttcctt

SEQ ID NO: 586389 - DNA, 20 bp, Artificial
  CRISPR gRNA sequence
taccttcctttggtatatga

SEQ ID NO: 586390 - DNA, 20 bp, Artificial
  CRISPR gRNA sequence
accttcctttggtatatgaa

SEQ ID NO: 586391 - DNA, 20 bp, Artificial
  CRISPR gRNA sequence
tcctttggtatatgaaaggt

SEQ ID NO: 586392 - DNA, 20 bp, Artificial
  CRISPR gRNA sequence
tatgctaattcaaacattat

SEQ ID NO: 586393 - DNA, 20 bp, Artificial
  CRISPR gRNA sequence
aaacattatcagaaataatt

SEQ ID NO: 586394 - DNA, 20 bp, Artificial
  CRISPR gRNA sequence
aacattatcagaaataattt

SEQ ID NO: 586395 - DNA, 20 bp, Artificial
  CRISPR gRNA sequence
cattatcagaaataatttgg

SEQ ID NO: 586396 - DNA, 20 bp, Artificial
  CRISPR gRNA sequence
agtattgcaaaatttcaata

SEQ ID NO: 586397 - DNA, 20 bp, Artificial
  CRISPR gRNA sequence
attatttgcaatgtatccca

SEQ ID NO: 586398 - DNA, 20 bp, Artificial
  CRISPR gRNA sequence
tcccaaagctcaactcattt

SEQ ID NO: 586399 - DNA, 20 bp, Artificial
  CRISPR gRNA sequence
agctcaactcatttaagtta

SEQ ID NO: 586400 - DNA, 20 bp, Artificial
  CRISPR gRNA sequence
taagttaaagtgatctaaaa

SEQ ID NO: 586401 - DNA, 20 bp, Artificial
  CRISPR gRNA sequence
tgatctaaaatagttttaaa

SEQ ID NO: 586402 - DNA, 20 bp, Artificial
  CRISPR gRNA sequence
aaaatagttttaaacagcat

SEQ ID NO: 586403 - DNA, 20 bp, Artificial
  CRISPR gRNA sequence
atcttcatgttgaactacaa

SEQ ID NO: 586404 - DNA, 20 bp, Artificial
  CRISPR gRNA sequence
ttcatgttgaactacaaaag

SEQ ID NO: 586405 - DNA, 20 bp, Artificial
  CRISPR gRNA sequence
atgttgaactacaaaagcag

SEQ ID NO: 586406 - DNA, 20 bp, Artificial
  CRISPR gRNA sequence
tgttgaactacaaaagcagt

SEQ ID NO: 586407 - DNA, 20 bp, Artificial
  CRISPR gRNA sequence
gttgaactacaaaagcagta

SEQ ID NO: 586408 - DNA, 20 bp, Artificial
  CRISPR gRNA sequence
ttgaactacaaaagcagtag

SEQ ID NO: 586409 - DNA, 20 bp, Artificial
  CRISPR gRNA sequence
tgaactacaaaagcagtagg

SEQ ID NO: 586410 - DNA, 20 bp, Artificial
  CRISPR gRNA sequence
ggaaataaaaatgatgaatc

SEQ ID NO: 586411 - DNA, 20 bp, Artificial
  CRISPR gRNA sequence
aatccagtttctacccacca

SEQ ID NO: 586412 - DNA, 20 bp, Artificial
  CRISPR gRNA sequence
atggtgactcatgacctgcc

SEQ ID NO: 586413 - DNA, 20 bp, Artificial
  CRISPR gRNA sequence
gtgactcatgacctgcccag

SEQ ID NO: 586414 - DNA, 20 bp, Artificial
  CRISPR gRNA sequence
cagcctccatgctgacattc

SEQ ID NO: 586415 - DNA, 20 bp, Artificial
  CRISPR gRNA sequence
gcctccatgctgacattctg

SEQ ID NO: 586416 - DNA, 20 bp, Artificial
  CRISPR gRNA sequence
ccatgctgacattctggaga

SEQ ID NO: 586417 - DNA, 20 bp, Artificial
  CRISPR gRNA sequence
tgacattctggagatagttg

SEQ ID NO: 586418 - DNA, 20 bp, Artificial
  CRISPR gRNA sequence
cattctggagatagttgtgg

SEQ ID NO: 586419 - DNA, 20 bp, Artificial
  CRISPR gRNA sequence
cagcgttccttgtgctcctc

SEQ ID NO: 586420 - DNA, 20 bp, Artificial
  CRISPR gRNA sequence
ccagtgaactgcgctgcttg

SEQ ID NO: 586421 - DNA, 20 bp, Artificial
  CRISPR gRNA sequence
gctgcttgtagcttcgtcca

SEQ ID NO: 586422 - DNA, 20 bp, Artificial
  CRISPR gRNA sequence
gcttgtagcttcgtccacag

SEQ ID NO: 586423 - DNA, 20 bp, Artificial
  CRISPR gRNA sequence
tccacagtagttgcacttgt

SEQ ID NO: 586424 - DNA, 20 bp, Artificial
  CRISPR gRNA sequence
ccacagtagttgcacttgtg

SEQ ID NO: 586425 - DNA, 20 bp, Artificial
  CRISPR gRNA sequence
tgtgaggtttacccactgtg

SEQ ID NO: 586426 - DNA, 20 bp, Artificial
  CRISPR gRNA sequence
tgaggtttacccactgtgaa

SEQ ID NO: 586427 - DNA, 20 bp, Artificial
  CRISPR gRNA sequence
acccactgtgaagagaactc

SEQ ID NO: 586428 - DNA, 20 bp, Artificial
  CRISPR gRNA sequence
cccactgtgaagagaactca

SEQ ID NO: 586429 - DNA, 20 bp, Artificial
  CRISPR gRNA sequence
ctgtgaagagaactcaaggt

SEQ ID NO: 586430 - DNA, 20 bp, Artificial
  CRISPR gRNA sequence
actcaaggtcagtgtgctgt

SEQ ID NO: 586431 - DNA, 20 bp, Artificial
  CRISPR gRNA sequence
gttagtctcatcaacattca

SEQ ID NO: 586432 - DNA, 20 bp, Artificial
  CRISPR gRNA sequence
aacattcaaagcaaaatcaa

SEQ ID NO: 586433 - DNA, 20 bp, Artificial
  CRISPR gRNA sequence
aatcaatagctaacttttga

SEQ ID NO: 586434 - DNA, 20 bp, Artificial
  CRISPR gRNA sequence
atagctaacttttgatagtc

SEQ ID NO: 586435 - DNA, 20 bp, Artificial
  CRISPR gRNA sequence
agctaacttttgatagtctg

SEQ ID NO: 586436 - DNA, 20 bp, Artificial
  CRISPR gRNA sequence
gctaacttttgatagtctgg

SEQ ID NO: 586437 - DNA, 20 bp, Artificial
  CRISPR gRNA sequence
aacttttgatagtctggagg

SEQ ID NO: 586438 - DNA, 20 bp, Artificial
  CRISPR gRNA sequence
ggaagcactcatataatttt

SEQ ID NO: 586439 - DNA, 20 bp, Artificial
  CRISPR gRNA sequence
cctcctttacattccaattt

SEQ ID NO: 586440 - DNA, 20 bp, Artificial
  CRISPR gRNA sequence
ctttacattccaattttggt

SEQ ID NO: 586441 - DNA, 20 bp, Artificial
  CRISPR gRNA sequence
cattccaattttggtaagaa

SEQ ID NO: 586442 - DNA, 20 bp, Artificial
  CRISPR gRNA sequence
aaagataatacatttctacc

SEQ ID NO: 586443 - DNA, 20 bp, Artificial
  CRISPR gRNA sequence
aatacatttctaccaagaca

SEQ ID NO: 586444 - DNA, 20 bp, Artificial
  CRISPR gRNA sequence
atttctaccaagacaaagac

SEQ ID NO: 586445 - DNA, 20 bp, Artificial
  CRISPR gRNA sequence
tctaccaagacaaagacaag

SEQ ID NO: 586446 - DNA, 20 bp, Artificial
  CRISPR gRNA sequence
ccaagacaaagacaagaaga

SEQ ID NO: 586447 - DNA, 20 bp, Artificial
  CRISPR gRNA sequence
caagacaaagacaagaagac

SEQ ID NO: 586448 - DNA, 20 bp, Artificial
  CRISPR gRNA sequence
gacaaagacaagaagacagg

SEQ ID NO: 586449 - DNA, 20 bp, Artificial
  CRISPR gRNA sequence
agacaggtggatcgtacctc

SEQ ID NO: 586450 - DNA, 20 bp, Artificial
  CRISPR gRNA sequence
gtggatcgtacctctggcaa

SEQ ID NO: 586451 - DNA, 20 bp, Artificial
  CRISPR gRNA sequence
tggatcgtacctctggcaac

SEQ ID NO: 586452 - DNA, 20 bp, Artificial
  CRISPR gRNA sequence
ggatcgtacctctggcaaca

SEQ ID NO: 586453 - DNA, 20 bp, Artificial
  CRISPR gRNA sequence
gatcgtacctctggcaacag

SEQ ID NO: 586454 - DNA, 20 bp, Artificial
  CRISPR gRNA sequence
ttcttgctctgactgtattc

SEQ ID NO: 586455 - DNA, 20 bp, Artificial
  CRISPR gRNA sequence
ctgactgtattctagacctt

SEQ ID NO: 586456 - DNA, 20 bp, Artificial
  CRISPR gRNA sequence
tgactgtattctagaccttg

SEQ ID NO: 586457 - DNA, 20 bp, Artificial
  CRISPR gRNA sequence
gactgtattctagaccttga

SEQ ID NO: 586458 - DNA, 20 bp, Artificial
  CRISPR gRNA sequence
tattctagaccttgagggcc

SEQ ID NO: 586459 - DNA, 20 bp, Artificial
  CRISPR gRNA sequence
gaccttgagggcctggtgat

SEQ ID NO: 586460 - DNA, 20 bp, Artificial
  CRISPR gRNA sequence
actcttaatacactgactct

SEQ ID NO: 586461 - DNA, 20 bp, Artificial
  CRISPR gRNA sequence
ctctcagctttgactcattc

SEQ ID NO: 586462 - DNA, 20 bp, Artificial
  CRISPR gRNA sequence
ttgactcattcaagacaaat

SEQ ID NO: 586463 - DNA, 20 bp, Artificial
  CRISPR gRNA sequence
tgactcattcaagacaaatc

SEQ ID NO: 586464 - DNA, 20 bp, Artificial
  CRISPR gRNA sequence
actcattcaagacaaatcag

SEQ ID NO: 586465 - DNA, 20 bp, Artificial
  CRISPR gRNA sequence
aagacaaatcaggagtatcc

SEQ ID NO: 586466 - DNA, 20 bp, Artificial
  CRISPR gRNA sequence
aggagtatcctagatacatc

SEQ ID NO: 586467 - DNA, 20 bp, Artificial
  CRISPR gRNA sequence
gagtatcctagatacatcaa

SEQ ID NO: 586468 - DNA, 20 bp, Artificial
  CRISPR gRNA sequence
cctagatacatcaagagttg

SEQ ID NO: 586469 - DNA, 20 bp, Artificial
  CRISPR gRNA sequence
ttttttgtttgttttctttt

SEQ ID NO: 586470 - DNA, 20 bp, Artificial
  CRISPR gRNA sequence
tttttgtttgttttcttttc

SEQ ID NO: 586471 - DNA, 20 bp, Artificial
  CRISPR gRNA sequence
tgtttgttttcttttcgggt

SEQ ID NO: 586472 - DNA, 20 bp, Artificial
  CRISPR gRNA sequence
gtttgttttcttttcgggta

SEQ ID NO: 586473 - DNA, 20 bp, Artificial
  CRISPR gRNA sequence
tttgttttcttttcgggtaa

SEQ ID NO: 586474 - DNA, 20 bp, Artificial
  CRISPR gRNA sequence
gttttcttttcgggtaaggg

SEQ ID NO: 586475 - DNA, 20 bp, Artificial
  CRISPR gRNA sequence
tttcttttcgggtaagggca

SEQ ID NO: 586476 - DNA, 20 bp, Artificial
  CRISPR gRNA sequence
ggtaagggcagagaatttta

SEQ ID NO: 586477 - DNA, 20 bp, Artificial
  CRISPR gRNA sequence
aagggcagagaattttacag

SEQ ID NO: 586478 - DNA, 20 bp, Artificial
  CRISPR gRNA sequence
tgcaacaacttgaaatgtca

SEQ ID NO: 586479 - DNA, 20 bp, Artificial
  CRISPR gRNA sequence
tgaaatgtcacagtttaata

SEQ ID NO: 586480 - DNA, 20 bp, Artificial
  CRISPR gRNA sequence
aaatgtcacagtttaataaa

SEQ ID NO: 586481 - DNA, 20 bp, Artificial
  CRISPR gRNA sequence
tttaataaagagattattct

SEQ ID NO: 586482 - DNA, 20 bp, Artificial
  CRISPR gRNA sequence
ttaataaagagattattctt

SEQ ID NO: 586483 - DNA, 20 bp, Artificial
  CRISPR gRNA sequence
agagattattcttgggtacc

SEQ ID NO: 586484 - DNA, 20 bp, Artificial
  CRISPR gRNA sequence
gattattcttgggtaccaag

SEQ ID NO: 586485 - DNA, 20 bp, Artificial
  CRISPR gRNA sequence
tgggtaccaagaagattaaa

SEQ ID NO: 586486 - DNA, 20 bp, Artificial
  CRISPR gRNA sequence
aagaagattaaaaagaactc

SEQ ID NO: 586487 - DNA, 20 bp, Artificial
  CRISPR gRNA sequence
aagattaaaaagaactcaag

SEQ ID NO: 586488 - DNA, 20 bp, Artificial
  CRISPR gRNA sequence
ttaaaaagaactcaagtggt

SEQ ID NO: 586489 - DNA, 20 bp, Artificial
  CRISPR gRNA sequence
agaactcaagtggtgagaaa

SEQ ID NO: 586490 - DNA, 20 bp, Artificial
  CRISPR gRNA sequence
tcaagtggtgagaaaaagta

SEQ ID NO: 586491 - DNA, 20 bp, Artificial
  CRISPR gRNA sequence
gtgagaaaaagtacagatga

SEQ ID NO: 586492 - DNA, 20 bp, Artificial
  CRISPR gRNA sequence
agaaaaagtacagatgaaag

SEQ ID NO: 586493 - DNA, 20 bp, Artificial
  CRISPR gRNA sequence
aaaaagtacagatgaaagta

SEQ ID NO: 586494 - DNA, 20 bp, Artificial
  CRISPR gRNA sequence
agtttcctttcctttcacct

SEQ ID NO: 586495 - DNA, 20 bp, Artificial
  CRISPR gRNA sequence
ttcacacatgcaaaattttg

SEQ ID NO: 586496 - DNA, 20 bp, Artificial
  CRISPR gRNA sequence
acacatgcaaaattttgtgg

SEQ ID NO: 586497 - DNA, 20 bp, Artificial
  CRISPR gRNA sequence
cacatgcaaaattttgtggc

SEQ ID NO: 586498 - DNA, 20 bp, Artificial
  CRISPR gRNA sequence
tgcaaaattttgtggcaggt

SEQ ID NO: 586499 - DNA, 20 bp, Artificial
  CRISPR gRNA sequence
gtaagtatattctccctcat

SEQ ID NO: 586500 - DNA, 20 bp, Artificial
  CRISPR gRNA sequence
tcatcagcttttataatacc

SEQ ID NO: 586501 - DNA, 20 bp, Artificial
  CRISPR gRNA sequence
aataccaagaattaacctac

SEQ ID NO: 586502 - DNA, 20 bp, Artificial
  CRISPR gRNA sequence
ataccaagaattaacctact

SEQ ID NO: 586503 - DNA, 20 bp, Artificial
  CRISPR gRNA sequence
attaacctactaggtgcttt

SEQ ID NO: 586504 - DNA, 20 bp, Artificial
  CRISPR gRNA sequence
acctactaggtgctttgagt

SEQ ID NO: 586505 - DNA, 20 bp, Artificial
  CRISPR gRNA sequence
cctactaggtgctttgagtc

SEQ ID NO: 586506 - DNA, 20 bp, Artificial
  CRISPR gRNA sequence
caggattattacacaatatg

SEQ ID NO: 586507 - DNA, 20 bp, Artificial
  CRISPR gRNA sequence
aatatgtagttacaaaatga

SEQ ID NO: 586508 - DNA, 20 bp, Artificial
  CRISPR gRNA sequence
tttccaaaacatctcacatt

SEQ ID NO: 586509 - DNA, 20 bp, Artificial
  CRISPR gRNA sequence
ttccaaaacatctcacatta

SEQ ID NO: 586510 - DNA, 20 bp, Artificial
  CRISPR gRNA sequence
ggaaatgaattattccctaa

SEQ ID NO: 586511 - DNA, 20 bp, Artificial
  CRISPR gRNA sequence
atgaattattccctaatagc

SEQ ID NO: 586512 - DNA, 20 bp, Artificial
  CRISPR gRNA sequence
tgaattattccctaatagct

SEQ ID NO: 586513 - DNA, 20 bp, Artificial
  CRISPR gRNA sequence
gaattattccctaatagcta

SEQ ID NO: 586514 - DNA, 20 bp, Artificial
  CRISPR gRNA sequence
attattccctaatagctagg

SEQ ID NO: 586515 - DNA, 20 bp, Artificial
  CRISPR gRNA sequence
tagctagggagccattatct

SEQ ID NO: 586516 - DNA, 20 bp, Artificial
  CRISPR gRNA sequence
aatacatctgttaaaatact

SEQ ID NO: 586517 - DNA, 20 bp, Artificial
  CRISPR gRNA sequence
tgttaaaatactaagatgtt

SEQ ID NO: 586518 - DNA, 20 bp, Artificial
  CRISPR gRNA sequence
aaaaaaaaccttaaaaaaca

SEQ ID NO: 586519 - DNA, 20 bp, Artificial
  CRISPR gRNA sequence
aaaaaccttaaaaaacaaag

SEQ ID NO: 586520 - DNA, 20 bp, Artificial
  CRISPR gRNA sequence
gaagaaaaatataatctcta

SEQ ID NO: 586521 - DNA, 20 bp, Artificial
  CRISPR gRNA sequence
aaaaatataatctctatgga

SEQ ID NO: 586522 - DNA, 20 bp, Artificial
  CRISPR gRNA sequence
aatataatctctatggaaag

SEQ ID NO: 586523 - DNA, 20 bp, Artificial
  CRISPR gRNA sequence
tttaatgcatgactcttcat

SEQ ID NO: 586524 - DNA, 20 bp, Artificial
  CRISPR gRNA sequence
ttaatgcatgactcttcata

SEQ ID NO: 586525 - DNA, 20 bp, Artificial
  CRISPR gRNA sequence
gactcttcataaggacatca

SEQ ID NO: 586526 - DNA, 20 bp, Artificial
  CRISPR gRNA sequence
ctcttcataaggacatcaca

SEQ ID NO: 586527 - DNA, 20 bp, Artificial
  CRISPR gRNA sequence
tcacagagcactttgactct

SEQ ID NO: 586528 - DNA, 20 bp, Artificial
  CRISPR gRNA sequence
ctcttggttttgaatgaata

SEQ ID NO: 586529 - DNA, 20 bp, Artificial
  CRISPR gRNA sequence
tacagaacaacataaaaccc

SEQ ID NO: 586530 - DNA, 20 bp, Artificial
  CRISPR gRNA sequence
acagaacaacataaaacccc

SEQ ID NO: 586531 - DNA, 20 bp, Artificial
  CRISPR gRNA sequence
gaacaacataaaaccccagg

SEQ ID NO: 586532 - DNA, 20 bp, Artificial
  CRISPR gRNA sequence
accccaggtggtctgtgcca

SEQ ID NO: 586533 - DNA, 20 bp, Artificial
  CRISPR gRNA sequence
gtctgtgccaaagccctcaa

SEQ ID NO: 586534 - DNA, 20 bp, Artificial
  CRISPR gRNA sequence
tgccaaagccctcaatagta

SEQ ID NO: 586535 - DNA, 20 bp, Artificial
  CRISPR gRNA sequence
tagtaaagcaccgtgtgatc

SEQ ID NO: 586536 - DNA, 20 bp, Artificial
  CRISPR gRNA sequence
agtaaagcaccgtgtgatcc

SEQ ID NO: 586537 - DNA, 20 bp, Artificial
  CRISPR gRNA sequence
ccgtgtctctatttgactcc

SEQ ID NO: 586538 - DNA, 20 bp, Artificial
  CRISPR gRNA sequence
gtgtctctatttgactccca

SEQ ID NO: 586539 - DNA, 20 bp, Artificial
  CRISPR gRNA sequence
tgtctctatttgactcccag

SEQ ID NO: 586540 - DNA, 20 bp, Artificial
  CRISPR gRNA sequence
tgactcccagaggaattatt

SEQ ID NO: 586541 - DNA, 20 bp, Artificial
  CRISPR gRNA sequence
aggaattatttagttttgct

SEQ ID NO: 586542 - DNA, 20 bp, Artificial
  CRISPR gRNA sequence
gaattatttagttttgctca

SEQ ID NO: 586543 - DNA, 20 bp, Artificial
  CRISPR gRNA sequence
tagttttgctcagagaataa

SEQ ID NO: 586544 - DNA, 20 bp, Artificial
  CRISPR gRNA sequence
acaactctttttcatgacca

SEQ ID NO: 586545 - DNA, 20 bp, Artificial
  CRISPR gRNA sequence
ctctttttcatgaccaaaga

SEQ ID NO: 586546 - DNA, 20 bp, Artificial
  CRISPR gRNA sequence
aaagatagcatccctaactc

SEQ ID NO: 586547 - DNA, 20 bp, Artificial
  CRISPR gRNA sequence
ataaacccatgctatgacac

SEQ ID NO: 586548 - DNA, 20 bp, Artificial
  CRISPR gRNA sequence
catgctatgacactggtcac

SEQ ID NO: 586549 - DNA, 20 bp, Artificial
  CRISPR gRNA sequence
tgctatgacactggtcacaa

SEQ ID NO: 586550 - DNA, 20 bp, Artificial
  CRISPR gRNA sequence
gctatgacactggtcacaag

SEQ ID NO: 586551 - DNA, 20 bp, Artificial
  CRISPR gRNA sequence
aggaactgaaatactataac

SEQ ID NO: 586552 - DNA, 20 bp, Artificial
  CRISPR gRNA sequence
ggaactgaaatactataaca

SEQ ID NO: 586553 - DNA, 20 bp, Artificial
  CRISPR gRNA sequence
ctgaaatactataacaaggc

SEQ ID NO: 586554 - DNA, 20 bp, Artificial
  CRISPR gRNA sequence
tgaaatactataacaaggca

SEQ ID NO: 586555 - DNA, 20 bp, Artificial
  CRISPR gRNA sequence
ataacaaggcaaggtattca

SEQ ID NO: 586556 - DNA, 20 bp, Artificial
  CRISPR gRNA sequence
aggtattcatggctgcctga

SEQ ID NO: 586557 - DNA, 20 bp, Artificial
  CRISPR gRNA sequence
gtttcactgtactgatgaaa

SEQ ID NO: 586558 - DNA, 20 bp, Artificial
  CRISPR gRNA sequence
cactgtactgatgaaaaaga

SEQ ID NO: 586559 - DNA, 20 bp, Artificial
  CRISPR gRNA sequence
agaaagctacaccaaacctt

SEQ ID NO: 586560 - DNA, 20 bp, Artificial
  CRISPR gRNA sequence
caaacctttagattgtaatt

SEQ ID NO: 586561 - DNA, 20 bp, Artificial
  CRISPR gRNA sequence
aaacctttagattgtaattg

SEQ ID NO: 586562 - DNA, 20 bp, Artificial
  CRISPR gRNA sequence
aattgaggtacacataaatt

SEQ ID NO: 586563 - DNA, 20 bp, Artificial
  CRISPR gRNA sequence
aggtacacataaattaagat

SEQ ID NO: 586564 - DNA, 20 bp, Artificial
  CRISPR gRNA sequence
ttgtttgtaaactatcataa

SEQ ID NO: 586565 - DNA, 20 bp, Artificial
  CRISPR gRNA sequence
actatcataaaagttattta

SEQ ID NO: 586566 - DNA, 20 bp, Artificial
  CRISPR gRNA sequence
tatcataaaagttatttatg

SEQ ID NO: 586567 - DNA, 20 bp, Artificial
  CRISPR gRNA sequence
ttcatttttttaaaaatgct

SEQ ID NO: 586568 - DNA, 20 bp, Artificial
  CRISPR gRNA sequence
tttaaaaatgcttggcaaac

SEQ ID NO: 586569 - DNA, 20 bp, Artificial
  CRISPR gRNA sequence
gcaaaccagcttctattttt

SEQ ID NO: 586570 - DNA, 20 bp, Artificial
  CRISPR gRNA sequence
gcttctattttttggaacca

SEQ ID NO: 586571 - DNA, 20 bp, Artificial
  CRISPR gRNA sequence
tttttggaaccatggatttc

SEQ ID NO: 586572 - DNA, 20 bp, Artificial
  CRISPR gRNA sequence
ttttggaaccatggatttct

SEQ ID NO: 586573 - DNA, 20 bp, Artificial
  CRISPR gRNA sequence
tggaaccatggatttctggg

SEQ ID NO: 586574 - DNA, 20 bp, Artificial
  CRISPR gRNA sequence
aaccatggatttctgggaag

SEQ ID NO: 586575 - DNA, 20 bp, Artificial
  CRISPR gRNA sequence
tggatttctgggaagtagct

SEQ ID NO: 586576 - DNA, 20 bp, Artificial
  CRISPR gRNA sequence
aagtagctgagaatactgtg

SEQ ID NO: 586577 - DNA, 20 bp, Artificial
  CRISPR gRNA sequence
gaacttgtatcaccatgtga

SEQ ID NO: 586578 - DNA, 20 bp, Artificial
  CRISPR gRNA sequence
gcattaaaaatacaaaaaat

SEQ ID NO: 586579 - DNA, 20 bp, Artificial
  CRISPR gRNA sequence
taagttttgctgaaatcatc

SEQ ID NO: 586580 - DNA, 20 bp, Artificial
  CRISPR gRNA sequence
tttacatgtaattatgttcc

SEQ ID NO: 586581 - DNA, 20 bp, Artificial
  CRISPR gRNA sequence
tgtaattatgttccaagata

SEQ ID NO: 586582 - DNA, 20 bp, Artificial
  CRISPR gRNA sequence
gtaattatgttccaagatat

SEQ ID NO: 586583 - DNA, 20 bp, Artificial
  CRISPR gRNA sequence
atatgggactacataacaaa

SEQ ID NO: 586584 - DNA, 20 bp, Artificial
  CRISPR gRNA sequence
aaaaagtatctgtttactat

SEQ ID NO: 586585 - DNA, 20 bp, Artificial
  CRISPR gRNA sequence
tgtttactattagcattact

SEQ ID NO: 586586 - DNA, 20 bp, Artificial
  CRISPR gRNA sequence
ctattagcattactcagttt

SEQ ID NO: 586587 - DNA, 20 bp, Artificial
  CRISPR gRNA sequence
tattagcattactcagtttt

SEQ ID NO: 586588 - DNA, 20 bp, Artificial
  CRISPR gRNA sequence
gttcttctgtaatatttctc

SEQ ID NO: 586589 - DNA, 20 bp, Artificial
  CRISPR gRNA sequence
ctgtaatatttctctagaaa

SEQ ID NO: 586590 - DNA, 20 bp, Artificial
  CRISPR gRNA sequence
gtaatgaatttatactgaac

SEQ ID NO: 586591 - DNA, 20 bp, Artificial
  CRISPR gRNA sequence
ttaaccaattaatacttatt

SEQ ID NO: 586592 - DNA, 20 bp, Artificial
  CRISPR gRNA sequence
cttattaagcacttacattg

SEQ ID NO: 586593 - DNA, 20 bp, Artificial
  CRISPR gRNA sequence
agcacttacattgaagctaa

SEQ ID NO: 586594 - DNA, 20 bp, Artificial
  CRISPR gRNA sequence
tagcccgctgtaaactactt

SEQ ID NO: 586595 - DNA, 20 bp, Artificial
  CRISPR gRNA sequence
taaactacttcagtcatttc

SEQ ID NO: 586596 - DNA, 20 bp, Artificial
  CRISPR gRNA sequence
aaactacttcagtcatttcc

SEQ ID NO: 586597 - DNA, 20 bp, Artificial
  CRISPR gRNA sequence
agtcatttccgggtcttccc

SEQ ID NO: 586598 - DNA, 20 bp, Artificial
  CRISPR gRNA sequence
ttccgggtcttccctggtat

SEQ ID NO: 586599 - DNA, 20 bp, Artificial
  CRISPR gRNA sequence
tgatgcctctgttgtactat

SEQ ID NO: 586600 - DNA, 20 bp, Artificial
  CRISPR gRNA sequence
tttcttccccttatttctgt

SEQ ID NO: 586601 - DNA, 20 bp, Artificial
  CRISPR gRNA sequence
ttctcaatttaattgaaaca

SEQ ID NO: 586602 - DNA, 20 bp, Artificial
  CRISPR gRNA sequence
gtttttcattctattcccct

SEQ ID NO: 586603 - DNA, 20 bp, Artificial
  CRISPR gRNA sequence
cttggctcacaaccctctaa

SEQ ID NO: 586604 - DNA, 20 bp, Artificial
  CRISPR gRNA sequence
aaagtcccaactcacctgat

SEQ ID NO: 586605 - DNA, 20 bp, Artificial
  CRISPR gRNA sequence
gtcccaactcacctgataag

SEQ ID NO: 586606 - DNA, 20 bp, Artificial
  CRISPR gRNA sequence
tcccaactcacctgataaga

SEQ ID NO: 586607 - DNA, 20 bp, Artificial
  CRISPR gRNA sequence
caactcacctgataagaagg

SEQ ID NO: 586608 - DNA, 20 bp, Artificial
  CRISPR gRNA sequence
actcacctgataagaaggaa

SEQ ID NO: 586609 - DNA, 20 bp, Artificial
  CRISPR gRNA sequence
gataagaaggaagagacatg

SEQ ID NO: 586610 - DNA, 20 bp, Artificial
  CRISPR gRNA sequence
ctatcccatctgctttattt

SEQ ID NO: 586611 - DNA, 20 bp, Artificial
  CRISPR gRNA sequence
ccattttgtcctctatttta

SEQ ID NO: 586612 - DNA, 20 bp, Artificial
  CRISPR gRNA sequence
ttcctcttcatcccatcatt

SEQ ID NO: 586613 - DNA, 20 bp, Artificial
  CRISPR gRNA sequence
catcccatcattgagtccaa

SEQ ID NO: 586614 - DNA, 20 bp, Artificial
  CRISPR gRNA sequence
atcccatcattgagtccaac

SEQ ID NO: 586615 - DNA, 20 bp, Artificial
  CRISPR gRNA sequence
tcccatcattgagtccaaca

SEQ ID NO: 586616 - DNA, 20 bp, Artificial
  CRISPR gRNA sequence
attgagtccaacagggatct

SEQ ID NO: 586617 - DNA, 20 bp, Artificial
  CRISPR gRNA sequence
agtccaacagggatctgagt

SEQ ID NO: 586618 - DNA, 20 bp, Artificial
  CRISPR gRNA sequence
gtccaacagggatctgagtt

SEQ ID NO: 586619 - DNA, 20 bp, Artificial
  CRISPR gRNA sequence
tcttcatctccattctattc

SEQ ID NO: 586620 - DNA, 20 bp, Artificial
  CRISPR gRNA sequence
tattccagcaacccaattat

SEQ ID NO: 586621 - DNA, 20 bp, Artificial
  CRISPR gRNA sequence
attccagcaacccaattatt

SEQ ID NO: 586622 - DNA, 20 bp, Artificial
  CRISPR gRNA sequence
ccaattattaggtgacatgt

SEQ ID NO: 586623 - DNA, 20 bp, Artificial
  CRISPR gRNA sequence
attaggtgacatgttggatt

SEQ ID NO: 586624 - DNA, 20 bp, Artificial
  CRISPR gRNA sequence
tatttccaataaatttgctc

SEQ ID NO: 586625 - DNA, 20 bp, Artificial
  CRISPR gRNA sequence
tttccaataaatttgctctg

SEQ ID NO: 586626 - DNA, 20 bp, Artificial
  CRISPR gRNA sequence
ctctctcattcattcaataa

SEQ ID NO: 586627 - DNA, 20 bp, Artificial
  CRISPR gRNA sequence
tactatgtaccaatgctcat

SEQ ID NO: 586628 - DNA, 20 bp, Artificial
  CRISPR gRNA sequence
actatgtaccaatgctcatg

SEQ ID NO: 586629 - DNA, 20 bp, Artificial
  CRISPR gRNA sequence
gctcatgaggctaaaatgta

SEQ ID NO: 586630 - DNA, 20 bp, Artificial
  CRISPR gRNA sequence
catgaggctaaaatgtaaag

SEQ ID NO: 586631 - DNA, 20 bp, Artificial
  CRISPR gRNA sequence
aagtggaaaacaaattccca

SEQ ID NO: 586632 - DNA, 20 bp, Artificial
  CRISPR gRNA sequence
gcctatccgtatgcaactga

SEQ ID NO: 586633 - DNA, 20 bp, Artificial
  CRISPR gRNA sequence
tccgtatgcaactgacagtc

SEQ ID NO: 586634 - DNA, 20 bp, Artificial
  CRISPR gRNA sequence
tatgcaactgacagtctggt

SEQ ID NO: 586635 - DNA, 20 bp, Artificial
  CRISPR gRNA sequence
atgcaactgacagtctggtg

SEQ ID NO: 586636 - DNA, 20 bp, Artificial
  CRISPR gRNA sequence
caactgacagtctggtgagg

SEQ ID NO: 586637 - DNA, 20 bp, Artificial
  CRISPR gRNA sequence
tgacagtctggtgaggcaga

SEQ ID NO: 586638 - DNA, 20 bp, Artificial
  CRISPR gRNA sequence
cagacatttaaaaaatacac

SEQ ID NO: 586639 - DNA, 20 bp, Artificial
  CRISPR gRNA sequence
aagcaatgtattacaaattg

SEQ ID NO: 586640 - DNA, 20 bp, Artificial
  CRISPR gRNA sequence
agcaatgtattacaaattgt

SEQ ID NO: 586641 - DNA, 20 bp, Artificial
  CRISPR gRNA sequence
aatgtattacaaattgtggg

SEQ ID NO: 586642 - DNA, 20 bp, Artificial
  CRISPR gRNA sequence
acaaattgtgggcagttgca

SEQ ID NO: 586643 - DNA, 20 bp, Artificial
  CRISPR gRNA sequence
aaattgtgggcagttgcatg

SEQ ID NO: 586644 - DNA, 20 bp, Artificial
  CRISPR gRNA sequence
tgggcagttgcatggagcaa

SEQ ID NO: 586645 - DNA, 20 bp, Artificial
  CRISPR gRNA sequence
agttgcatggagcaaaagaa

SEQ ID NO: 586646 - DNA, 20 bp, Artificial
  CRISPR gRNA sequence
tgcatggagcaaaagaatgg

SEQ ID NO: 586647 - DNA, 20 bp, Artificial
  CRISPR gRNA sequence
ggagcaaaagaatggtggtg

SEQ ID NO: 586648 - DNA, 20 bp, Artificial
  CRISPR gRNA sequence
aatggtggtgtagtataaca

SEQ ID NO: 586649 - DNA, 20 bp, Artificial
  CRISPR gRNA sequence
atggtggtgtagtataacat

SEQ ID NO: 586650 - DNA, 20 bp, Artificial
  CRISPR gRNA sequence
tggtggtgtagtataacatg

SEQ ID NO: 586651 - DNA, 20 bp, Artificial
  CRISPR gRNA sequence
gtagtataacatggggaaac

SEQ ID NO: 586652 - DNA, 20 bp, Artificial
  CRISPR gRNA sequence
catggggaaactagtttgaa

SEQ ID NO: 586653 - DNA, 20 bp, Artificial
  CRISPR gRNA sequence
atggggaaactagtttgaaa

SEQ ID NO: 586654 - DNA, 20 bp, Artificial
  CRISPR gRNA sequence
ctagtttgaaaaggttgaac

SEQ ID NO: 586655 - DNA, 20 bp, Artificial
  CRISPR gRNA sequence
gtttgaaaaggttgaacaag

SEQ ID NO: 586656 - DNA, 20 bp, Artificial
  CRISPR gRNA sequence
tttgaaaaggttgaacaaga

SEQ ID NO: 586657 - DNA, 20 bp, Artificial
  CRISPR gRNA sequence
tgaacaagaaggtctgtttg

SEQ ID NO: 586658 - DNA, 20 bp, Artificial
  CRISPR gRNA sequence
acaagaaggtctgtttgaag

SEQ ID NO: 586659 - DNA, 20 bp, Artificial
  CRISPR gRNA sequence
caagaaggtctgtttgaagt

SEQ ID NO: 586660 - DNA, 20 bp, Artificial
  CRISPR gRNA sequence
tgtttgaagtaggaacattt

SEQ ID NO: 586661 - DNA, 20 bp, Artificial
  CRISPR gRNA sequence
gtttgaagtaggaacatttc

SEQ ID NO: 586662 - DNA, 20 bp, Artificial
  CRISPR gRNA sequence
aacatttcaggtgacaactg

SEQ ID NO: 586663 - DNA, 20 bp, Artificial
  CRISPR gRNA sequence
tcaggtgacaactgaagaaa

SEQ ID NO: 586664 - DNA, 20 bp, Artificial
  CRISPR gRNA sequence
ggtgacaactgaagaaaaag

SEQ ID NO: 586665 - DNA, 20 bp, Artificial
  CRISPR gRNA sequence
aaaagtagtcattatataat

SEQ ID NO: 586666 - DNA, 20 bp, Artificial
  CRISPR gRNA sequence
aaagtagtcattatataatt

SEQ ID NO: 586667 - DNA, 20 bp, Artificial
  CRISPR gRNA sequence
aagtagtcattatataattg

SEQ ID NO: 586668 - DNA, 20 bp, Artificial
  CRISPR gRNA sequence
gtagtcattatataattggg

SEQ ID NO: 586669 - DNA, 20 bp, Artificial
  CRISPR gRNA sequence
tcattatataattggggagt

SEQ ID NO: 586670 - DNA, 20 bp, Artificial
  CRISPR gRNA sequence
cattatataattggggagtg

SEQ ID NO: 586671 - DNA, 20 bp, Artificial
  CRISPR gRNA sequence
attatataattggggagtga

SEQ ID NO: 586672 - DNA, 20 bp, Artificial
  CRISPR gRNA sequence
atataattggggagtgaggg

SEQ ID NO: 586673 - DNA, 20 bp, Artificial
  CRISPR gRNA sequence
aattggggagtgagggtgga

SEQ ID NO: 586674 - DNA, 20 bp, Artificial
  CRISPR gRNA sequence
attggggagtgagggtggaa

SEQ ID NO: 586675 - DNA, 20 bp, Artificial
  CRISPR gRNA sequence
ggggagtgagggtggaaagg

SEQ ID NO: 586676 - DNA, 20 bp, Artificial
  CRISPR gRNA sequence
gggagtgagggtggaaaggc

SEQ ID NO: 586677 - DNA, 20 bp, Artificial
  CRISPR gRNA sequence
agggtggaaaggcaggattt

SEQ ID NO: 586678 - DNA, 20 bp, Artificial
  CRISPR gRNA sequence
gggtggaaaggcaggatttc

SEQ ID NO: 586679 - DNA, 20 bp, Artificial
  CRISPR gRNA sequence
ggcaggatttcaggatttct

SEQ ID NO: 586680 - DNA, 20 bp, Artificial
  CRISPR gRNA sequence
ttcaggatttctgagacctg

SEQ ID NO: 586681 - DNA, 20 bp, Artificial
  CRISPR gRNA sequence
tttattttcctctatatact

SEQ ID NO: 586682 - DNA, 20 bp, Artificial
  CRISPR gRNA sequence
ctatatacttagctccttca

SEQ ID NO: 586683 - DNA, 20 bp, Artificial
  CRISPR gRNA sequence
actcctttgaaaattgtttt

SEQ ID NO: 586684 - DNA, 20 bp, Artificial
  CRISPR gRNA sequence
aacaatccctgcaaattcaa

SEQ ID NO: 586685 - DNA, 20 bp, Artificial
  CRISPR gRNA sequence
aatggctctgctatctccac

SEQ ID NO: 586686 - DNA, 20 bp, Artificial
  CRISPR gRNA sequence
catactatttcttaaaaata

SEQ ID NO: 586687 - DNA, 20 bp, Artificial
  CRISPR gRNA sequence
acatgtgtttatctgtacat

SEQ ID NO: 586688 - DNA, 20 bp, Artificial
  CRISPR gRNA sequence
tgtacatgagtttatcttta

SEQ ID NO: 586689 - DNA, 20 bp, Artificial
  CRISPR gRNA sequence
taacatatatattcatataa

SEQ ID NO: 586690 - DNA, 20 bp, Artificial
  CRISPR gRNA sequence
aacatatatattcatataaa

SEQ ID NO: 586691 - DNA, 20 bp, Artificial
  CRISPR gRNA sequence
cactacctttatttttataa

SEQ ID NO: 586692 - DNA, 20 bp, Artificial
  CRISPR gRNA sequence
cttcatattgttaccaactg

SEQ ID NO: 586693 - DNA, 20 bp, Artificial
  CRISPR gRNA sequence
catattgttaccaactgaag

SEQ ID NO: 586694 - DNA, 20 bp, Artificial
  CRISPR gRNA sequence
attattgaaacatttttgaa

SEQ ID NO: 586695 - DNA, 20 bp, Artificial
  CRISPR gRNA sequence
ttgaaacatttttgaaaagt

SEQ ID NO: 586696 - DNA, 20 bp, Artificial
  CRISPR gRNA sequence
aaacatttttgaaaagtcag

SEQ ID NO: 586697 - DNA, 20 bp, Artificial
  CRISPR gRNA sequence
tctctgaatcactaaatcca

SEQ ID NO: 586698 - DNA, 20 bp, Artificial
  CRISPR gRNA sequence
ctctgaatcactaaatccat

SEQ ID NO: 586699 - DNA, 20 bp, Artificial
  CRISPR gRNA sequence
cctctgtcttcctaatctct

SEQ ID NO: 586700 - DNA, 20 bp, Artificial
  CRISPR gRNA sequence
ctaatctcttggccactatc

SEQ ID NO: 586701 - DNA, 20 bp, Artificial
  CRISPR gRNA sequence
tatcaagctttcttgtgtct

SEQ ID NO: 586702 - DNA, 20 bp, Artificial
  CRISPR gRNA sequence
atcaagctttcttgtgtctt

SEQ ID NO: 586703 - DNA, 20 bp, Artificial
  CRISPR gRNA sequence
gtgtcttgggtctcctgttt

SEQ ID NO: 586704 - DNA, 20 bp, Artificial
  CRISPR gRNA sequence
ggtctcctgttttagcgtct

SEQ ID NO: 586705 - DNA, 20 bp, Artificial
  CRISPR gRNA sequence
cctgttttagcgtctgagat

SEQ ID NO: 586706 - DNA, 20 bp, Artificial
  CRISPR gRNA sequence
cattcgccctcactgcttct

SEQ ID NO: 586707 - DNA, 20 bp, Artificial
  CRISPR gRNA sequence
atatgttatatgcatccctt

SEQ ID NO: 586708 - DNA, 20 bp, Artificial
  CRISPR gRNA sequence
atcccttcagatattgttct

SEQ ID NO: 586709 - DNA, 20 bp, Artificial
  CRISPR gRNA sequence
ccctctttgctctctaaatg

SEQ ID NO: 586710 - DNA, 20 bp, Artificial
  CRISPR gRNA sequence
tttttatgaaacatccacat

SEQ ID NO: 586711 - DNA, 20 bp, Artificial
  CRISPR gRNA sequence
ttttatgaaacatccacatc

SEQ ID NO: 586712 - DNA, 20 bp, Artificial
  CRISPR gRNA sequence
tgaaacatccacatcaggtc

SEQ ID NO: 586713 - DNA, 20 bp, Artificial
  CRISPR gRNA sequence
gaataatttcccatgtttgt

SEQ ID NO: 586714 - DNA, 20 bp, Artificial
  CRISPR gRNA sequence
ccatgtttgtaagctccaac

SEQ ID NO: 586715 - DNA, 20 bp, Artificial
  CRISPR gRNA sequence
atgtacatctttcaatgtct

SEQ ID NO: 586716 - DNA, 20 bp, Artificial
  CRISPR gRNA sequence
ccttccctacaaccaaaacg

SEQ ID NO: 586717 - DNA, 20 bp, Artificial
  CRISPR gRNA sequence
ttccctacaaccaaaacgaa

SEQ ID NO: 586718 - DNA, 20 bp, Artificial
  CRISPR gRNA sequence
acaaccaaaacgaagagcat

SEQ ID NO: 586719 - DNA, 20 bp, Artificial
  CRISPR gRNA sequence
caaccaaaacgaagagcatc

SEQ ID NO: 586720 - DNA, 20 bp, Artificial
  CRISPR gRNA sequence
aaacgaagagcatcaggaca

SEQ ID NO: 586721 - DNA, 20 bp, Artificial
  CRISPR gRNA sequence
agctgtctcctctgctctca

SEQ ID NO: 586722 - DNA, 20 bp, Artificial
  CRISPR gRNA sequence
actgtgttgtaattaaccat

SEQ ID NO: 586723 - DNA, 20 bp, Artificial
  CRISPR gRNA sequence
cggatacctatttatttccc

SEQ ID NO: 586724 - DNA, 20 bp, Artificial
  CRISPR gRNA sequence
atttccctagtccaaacgat

SEQ ID NO: 586725 - DNA, 20 bp, Artificial
  CRISPR gRNA sequence
gtccaaacgatgagcttcat

SEQ ID NO: 586726 - DNA, 20 bp, Artificial
  CRISPR gRNA sequence
tccaaacgatgagcttcatg

SEQ ID NO: 586727 - DNA, 20 bp, Artificial
  CRISPR gRNA sequence
caaacgatgagcttcatgag

SEQ ID NO: 586728 - DNA, 20 bp, Artificial
  CRISPR gRNA sequence
aacgatgagcttcatgagga

SEQ ID NO: 586729 - DNA, 20 bp, Artificial
  CRISPR gRNA sequence
cgatgagcttcatgaggaga

SEQ ID NO: 586730 - DNA, 20 bp, Artificial
  CRISPR gRNA sequence
ttaaattgataatacatatc

SEQ ID NO: 586731 - DNA, 20 bp, Artificial
  CRISPR gRNA sequence
acatatcgagttattaaaca

SEQ ID NO: 586732 - DNA, 20 bp, Artificial
  CRISPR gRNA sequence
catatcgagttattaaacac

SEQ ID NO: 586733 - DNA, 20 bp, Artificial
  CRISPR gRNA sequence
tatcgagttattaaacacag

SEQ ID NO: 586734 - DNA, 20 bp, Artificial
  CRISPR gRNA sequence
catacttgcaactgcctttt

SEQ ID NO: 586735 - DNA, 20 bp, Artificial
  CRISPR gRNA sequence
gccttttgagtcttgcctca

SEQ ID NO: 586736 - DNA, 20 bp, Artificial
  CRISPR gRNA sequence
caaaaccaaatcaaacattc

SEQ ID NO: 586737 - DNA, 20 bp, Artificial
  CRISPR gRNA sequence
ttctgactgcccttctttgc

SEQ ID NO: 586738 - DNA, 20 bp, Artificial
  CRISPR gRNA sequence
ttaccactgttctaatactc

SEQ ID NO: 586739 - DNA, 20 bp, Artificial
  CRISPR gRNA sequence
cctcttttcctacttccaaa

SEQ ID NO: 586740 - DNA, 20 bp, Artificial
  CRISPR gRNA sequence
agctgctaaattctatatac

SEQ ID NO: 586741 - DNA, 20 bp, Artificial
  CRISPR gRNA sequence
ggactcgtaaaatgattctc

SEQ ID NO: 586742 - DNA, 20 bp, Artificial
  CRISPR gRNA sequence
cattctcacaatcaacgtcc

SEQ ID NO: 586743 - DNA, 20 bp, Artificial
  CRISPR gRNA sequence
tcacaatcaacgtcctagtt

SEQ ID NO: 586744 - DNA, 20 bp, Artificial
  CRISPR gRNA sequence
cacaatcaacgtcctagttc

SEQ ID NO: 586745 - DNA, 20 bp, Artificial
  CRISPR gRNA sequence
ggccttcattattgctcacc

SEQ ID NO: 586746 - DNA, 20 bp, Artificial
  CRISPR gRNA sequence
gccttcattattgctcacct

SEQ ID NO: 586747 - DNA, 20 bp, Artificial
  CRISPR gRNA sequence
cattattgctcacctgggcc

SEQ ID NO: 586748 - DNA, 20 bp, Artificial
  CRISPR gRNA sequence
ctcacctgggcctggcataa

SEQ ID NO: 586749 - DNA, 20 bp, Artificial
  CRISPR gRNA sequence
ctggcataatagacttcaaa

SEQ ID NO: 586750 - DNA, 20 bp, Artificial
  CRISPR gRNA sequence
tggcataatagacttcaaat

SEQ ID NO: 586751 - DNA, 20 bp, Artificial
  CRISPR gRNA sequence
aacaactttcaataactgtt

SEQ ID NO: 586752 - DNA, 20 bp, Artificial
  CRISPR gRNA sequence
ctgttaagttttattgaact

SEQ ID NO: 586753 - DNA, 20 bp, Artificial
  CRISPR gRNA sequence
taagttgaaatccctttacc

SEQ ID NO: 586754 - DNA, 20 bp, Artificial
  CRISPR gRNA sequence
aaatccctttacctggcatt

SEQ ID NO: 586755 - DNA, 20 bp, Artificial
  CRISPR gRNA sequence
attcagcaccctataccatc

SEQ ID NO: 586756 - DNA, 20 bp, Artificial
  CRISPR gRNA sequence
ccctataccatctggtccca

SEQ ID NO: 586757 - DNA, 20 bp, Artificial
  CRISPR gRNA sequence
cacacatcccactcctaccc

SEQ ID NO: 586758 - DNA, 20 bp, Artificial
  CRISPR gRNA sequence
acacatcccactcctacccc

SEQ ID NO: 586759 - DNA, 20 bp, Artificial
  CRISPR gRNA sequence
cccactcctaccccaggccc

SEQ ID NO: 586760 - DNA, 20 bp, Artificial
  CRISPR gRNA sequence
tactttacacctacacttct

SEQ ID NO: 586761 - DNA, 20 bp, Artificial
  CRISPR gRNA sequence
taacgtgatctttctcacta

SEQ ID NO: 586762 - DNA, 20 bp, Artificial
  CRISPR gRNA sequence
cctgtattgaccctcatgct

SEQ ID NO: 586763 - DNA, 20 bp, Artificial
  CRISPR gRNA sequence
attatctgtgacttttatac

SEQ ID NO: 586764 - DNA, 20 bp, Artificial
  CRISPR gRNA sequence
actaattttcatctccatgt

SEQ ID NO: 586765 - DNA, 20 bp, Artificial
  CRISPR gRNA sequence
tgttagatcttgaccttttt

SEQ ID NO: 586766 - DNA, 20 bp, Artificial
  CRISPR gRNA sequence
atgtgtctttgtaacttccg

SEQ ID NO: 586767 - DNA, 20 bp, Artificial
  CRISPR gRNA sequence
gtgtctttgtaacttccgaa

SEQ ID NO: 586768 - DNA, 20 bp, Artificial
  CRISPR gRNA sequence
tttgtaacttccgaagagtt

SEQ ID NO: 586769 - DNA, 20 bp, Artificial
  CRISPR gRNA sequence
gtaacttccgaagagtttag

SEQ ID NO: 586770 - DNA, 20 bp, Artificial
  CRISPR gRNA sequence
taacttccgaagagtttagc

SEQ ID NO: 586771 - DNA, 20 bp, Artificial
  CRISPR gRNA sequence
aacttccgaagagtttagca

SEQ ID NO: 586772 - DNA, 20 bp, Artificial
  CRISPR gRNA sequence
ttagcagggtgctttgctca

SEQ ID NO: 586773 - DNA, 20 bp, Artificial
  CRISPR gRNA sequence
cagggtgctttgctcataga

SEQ ID NO: 586774 - DNA, 20 bp, Artificial
  CRISPR gRNA sequence
tgctcatagaaagaactaat

SEQ ID NO: 586775 - DNA, 20 bp, Artificial
  CRISPR gRNA sequence
tcatagaaagaactaataag

SEQ ID NO: 586776 - DNA, 20 bp, Artificial
  CRISPR gRNA sequence
atagaaagaactaataagtg

SEQ ID NO: 586777 - DNA, 20 bp, Artificial
  CRISPR gRNA sequence
taatttccaaactctttaaa

SEQ ID NO: 586778 - DNA, 20 bp, Artificial
  CRISPR gRNA sequence
tttaaatagctttttctcat

SEQ ID NO: 586779 - DNA, 20 bp, Artificial
  CRISPR gRNA sequence
tataaaatttttttaatcac

SEQ ID NO: 586780 - DNA, 20 bp, Artificial
  CRISPR gRNA sequence
aaatccataattatatcatt

SEQ ID NO: 586781 - DNA, 20 bp, Artificial
  CRISPR gRNA sequence
catttagaaataactgtctt

SEQ ID NO: 586782 - DNA, 20 bp, Artificial
  CRISPR gRNA sequence
gcatttttttaatgcatgca

SEQ ID NO: 586783 - DNA, 20 bp, Artificial
  CRISPR gRNA sequence
atgcatgcaaagataaattt

SEQ ID NO: 586784 - DNA, 20 bp, Artificial
  CRISPR gRNA sequence
ataaattttggtatgaaaat

SEQ ID NO: 586785 - DNA, 20 bp, Artificial
  CRISPR gRNA sequence
gatatttttgttgctgctgt

SEQ ID NO: 586786 - DNA, 20 bp, Artificial
  CRISPR gRNA sequence
atatttttgttgctgctgtt

SEQ ID NO: 586787 - DNA, 20 bp, Artificial
  CRISPR gRNA sequence
tgttaggtaacactttctcc

SEQ ID NO: 586788 - DNA, 20 bp, Artificial
  CRISPR gRNA sequence
taacactttctcccagattc

SEQ ID NO: 586789 - DNA, 20 bp, Artificial
  CRISPR gRNA sequence
tctcccagattctagattta

SEQ ID NO: 586790 - DNA, 20 bp, Artificial
  CRISPR gRNA sequence
tatggtaatgctgaattatt

SEQ ID NO: 586791 - DNA, 20 bp, Artificial
  CRISPR gRNA sequence
gctgaattattcagtttgct

SEQ ID NO: 586792 - DNA, 20 bp, Artificial
  CRISPR gRNA sequence
ttcagtttgctcagcattct

SEQ ID NO: 586793 - DNA, 20 bp, Artificial
  CRISPR gRNA sequence
gattatttttctttttacca

SEQ ID NO: 586794 - DNA, 20 bp, Artificial
  CRISPR gRNA sequence
atttttctttttaccatagt

SEQ ID NO: 586795 - DNA, 20 bp, Artificial
  CRISPR gRNA sequence
tgcccataaaaaaaatcaaa

SEQ ID NO: 586796 - DNA, 20 bp, Artificial
  CRISPR gRNA sequence
aaaaaaaatcaaatagtccc

SEQ ID NO: 586797 - DNA, 20 bp, Artificial
  CRISPR gRNA sequence
aaaaatcaaatagtcccaag

SEQ ID NO: 586798 - DNA, 20 bp, Artificial
  CRISPR gRNA sequence
gtggcatttaatgaaataca

SEQ ID NO: 586799 - DNA, 20 bp, Artificial
  CRISPR gRNA sequence
atgctgccctacctgccccc

SEQ ID NO: 586800 - DNA, 20 bp, Artificial
  CRISPR gRNA sequence
aatctaatcaaaatcccaaa

SEQ ID NO: 586801 - DNA, 20 bp, Artificial
  CRISPR gRNA sequence
tcccaaaaagcaaccatttt

SEQ ID NO: 586802 - DNA, 20 bp, Artificial
  CRISPR gRNA sequence
ccattttcagctccttcttt

SEQ ID NO: 586803 - DNA, 20 bp, Artificial
  CRISPR gRNA sequence
tcatatttctaaataatatg

SEQ ID NO: 586804 - DNA, 20 bp, Artificial
  CRISPR gRNA sequence
catatttctaaataatatgt

SEQ ID NO: 586805 - DNA, 20 bp, Artificial
  CRISPR gRNA sequence
tgtgggttatttttattcat

SEQ ID NO: 586806 - DNA, 20 bp, Artificial
  CRISPR gRNA sequence
gtgggttatttttattcatc

SEQ ID NO: 586807 - DNA, 20 bp, Artificial
  CRISPR gRNA sequence
ttatttttattcatcaggtt

SEQ ID NO: 586808 - DNA, 20 bp, Artificial
  CRISPR gRNA sequence
atttttattcatcaggttta

SEQ ID NO: 586809 - DNA, 20 bp, Artificial
  CRISPR gRNA sequence
aatctattgcttctctgtcc

SEQ ID NO: 586810 - DNA, 20 bp, Artificial
  CRISPR gRNA sequence
ctattgcttctctgtcctgg

SEQ ID NO: 586811 - DNA, 20 bp, Artificial
  CRISPR gRNA sequence
gcttctctgtcctggtagtt

SEQ ID NO: 586812 - DNA, 20 bp, Artificial
  CRISPR gRNA sequence
cttctctgtcctggtagtta

SEQ ID NO: 586813 - DNA, 20 bp, Artificial
  CRISPR gRNA sequence
tgtcctggtagttaaggatt

SEQ ID NO: 586814 - DNA, 20 bp, Artificial
  CRISPR gRNA sequence
cctctcaattctcacttctg

SEQ ID NO: 586815 - DNA, 20 bp, Artificial
  CRISPR gRNA sequence
tcacttctgtggtctttcaa

SEQ ID NO: 586816 - DNA, 20 bp, Artificial
  CRISPR gRNA sequence
acataatcatttctgattaa

SEQ ID NO: 586817 - DNA, 20 bp, Artificial
  CRISPR gRNA sequence
atcatttctgattaatagta

SEQ ID NO: 586818 - DNA, 20 bp, Artificial
  CRISPR gRNA sequence
tctgattaatagtatagaaa

SEQ ID NO: 586819 - DNA, 20 bp, Artificial
  CRISPR gRNA sequence
agtatagaaatggaaatttc

SEQ ID NO: 586820 - DNA, 20 bp, Artificial
  CRISPR gRNA sequence
atagaaatggaaatttccag

SEQ ID NO: 586821 - DNA, 20 bp, Artificial
  CRISPR gRNA sequence
atggaaatttccagtagtca

SEQ ID NO: 586822 - DNA, 20 bp, Artificial
  CRISPR gRNA sequence
attaatcataacatactatt

SEQ ID NO: 586823 - DNA, 20 bp, Artificial
  CRISPR gRNA sequence
taacatactatttggctcaa

SEQ ID NO: 586824 - DNA, 20 bp, Artificial
  CRISPR gRNA sequence
attacatttccttttttgtg

SEQ ID NO: 586825 - DNA, 20 bp, Artificial
  CRISPR gRNA sequence
gtgcagcttttaatttttcc

SEQ ID NO: 586826 - DNA, 20 bp, Artificial
  CRISPR gRNA sequence
gcagcttttaatttttccta

SEQ ID NO: 586827 - DNA, 20 bp, Artificial
  CRISPR gRNA sequence
tttgcttgtgtttctgtatc

SEQ ID NO: 586828 - DNA, 20 bp, Artificial
  CRISPR gRNA sequence
tgccacttaccccttcctct

SEQ ID NO: 586829 - DNA, 20 bp, Artificial
  CRISPR gRNA sequence
gccacttaccccttcctctg

SEQ ID NO: 586830 - DNA, 20 bp, Artificial
  CRISPR gRNA sequence
ctcacaccttactgataact

SEQ ID NO: 586831 - DNA, 20 bp, Artificial
  CRISPR gRNA sequence
cacaccttactgataactca

SEQ ID NO: 586832 - DNA, 20 bp, Artificial
  CRISPR gRNA sequence
cttactgataactcagagtc

SEQ ID NO: 586833 - DNA, 20 bp, Artificial
  CRISPR gRNA sequence
cagagtccagaacaatgtca

SEQ ID NO: 586834 - DNA, 20 bp, Artificial
  CRISPR gRNA sequence
agagtccagaacaatgtcat

SEQ ID NO: 586835 - DNA, 20 bp, Artificial
  CRISPR gRNA sequence
acaatgtcataggtccttgc

SEQ ID NO: 586836 - DNA, 20 bp, Artificial
  CRISPR gRNA sequence
tcttgccttctcacaaccat

SEQ ID NO: 586837 - DNA, 20 bp, Artificial
  CRISPR gRNA sequence
accattggcacccctttctc

SEQ ID NO: 586838 - DNA, 20 bp, Artificial
  CRISPR gRNA sequence
ttggcacccctttctccagt

SEQ ID NO: 586839 - DNA, 20 bp, Artificial
  CRISPR gRNA sequence
ctttctccagttggaactga

SEQ ID NO: 586840 - DNA, 20 bp, Artificial
  CRISPR gRNA sequence
agttggaactgatggtaccc

SEQ ID NO: 586841 - DNA, 20 bp, Artificial
  CRISPR gRNA sequence
gttggaactgatggtaccct

SEQ ID NO: 586842 - DNA, 20 bp, Artificial
  CRISPR gRNA sequence
atggtaccctgggtttatta

SEQ ID NO: 586843 - DNA, 20 bp, Artificial
  CRISPR gRNA sequence
ggtaccctgggtttattaca

SEQ ID NO: 586844 - DNA, 20 bp, Artificial
  CRISPR gRNA sequence
tttattacagagttgttatc

SEQ ID NO: 586845 - DNA, 20 bp, Artificial
  CRISPR gRNA sequence
tcctttgtccccctcatgat

SEQ ID NO: 586846 - DNA, 20 bp, Artificial
  CRISPR gRNA sequence
tcccatgttttcctcttcgt

SEQ ID NO: 586847 - DNA, 20 bp, Artificial
  CRISPR gRNA sequence
cccatgttttcctcttcgtt

SEQ ID NO: 586848 - DNA, 20 bp, Artificial
  CRISPR gRNA sequence
gttttcctcttcgttgggtt

SEQ ID NO: 586849 - DNA, 20 bp, Artificial
  CRISPR gRNA sequence
ttcgttgggtttagaatttc

SEQ ID NO: 586850 - DNA, 20 bp, Artificial
  CRISPR gRNA sequence
tcgttgggtttagaatttcc

SEQ ID NO: 586851 - DNA, 20 bp, Artificial
  CRISPR gRNA sequence
cattttctcttaacattttg

SEQ ID NO: 586852 - DNA, 20 bp, Artificial
  CRISPR gRNA sequence
ttttgaagcctttttttcac

SEQ ID NO: 586853 - DNA, 20 bp, Artificial
  CRISPR gRNA sequence
tttgaagcctttttttcact

SEQ ID NO: 586854 - DNA, 20 bp, Artificial
  CRISPR gRNA sequence
cactgggctactaacctcca

SEQ ID NO: 586855 - DNA, 20 bp, Artificial
  CRISPR gRNA sequence
cctccaaagtttctttttaa

SEQ ID NO: 586856 - DNA, 20 bp, Artificial
  CRISPR gRNA sequence
ttaaaagtattatataaata

SEQ ID NO: 586857 - DNA, 20 bp, Artificial
  CRISPR gRNA sequence
tataaatatagctttatatg

SEQ ID NO: 586858 - DNA, 20 bp, Artificial
  CRISPR gRNA sequence
tatgtggcctgtttgtctga

SEQ ID NO: 586859 - DNA, 20 bp, Artificial
  CRISPR gRNA sequence
cctgtttgtctgaaagctct

SEQ ID NO: 586860 - DNA, 20 bp, Artificial
  CRISPR gRNA sequence
ctgaaagctcttagtaactt

SEQ ID NO: 586861 - DNA, 20 bp, Artificial
  CRISPR gRNA sequence
gttctgaaattctgaaatat

SEQ ID NO: 586862 - DNA, 20 bp, Artificial
  CRISPR gRNA sequence
gaaatatgagcgtatgtctc

SEQ ID NO: 586863 - DNA, 20 bp, Artificial
  CRISPR gRNA sequence
gagcgtatgtctctggtcta

SEQ ID NO: 586864 - DNA, 20 bp, Artificial
  CRISPR gRNA sequence
ctggtctaaagtctctaatt

SEQ ID NO: 586865 - DNA, 20 bp, Artificial
  CRISPR gRNA sequence
atgtttgtcccttacctctc

SEQ ID NO: 586866 - DNA, 20 bp, Artificial
  CRISPR gRNA sequence
gtgtctgtactatatataat

SEQ ID NO: 586867 - DNA, 20 bp, Artificial
  CRISPR gRNA sequence
tatatataataagtatatac

SEQ ID NO: 586868 - DNA, 20 bp, Artificial
  CRISPR gRNA sequence
atatactagttcacatattg

SEQ ID NO: 586869 - DNA, 20 bp, Artificial
  CRISPR gRNA sequence
gcagaatatttacatatata

SEQ ID NO: 586870 - DNA, 20 bp, Artificial
  CRISPR gRNA sequence
atcgattcacataattacta

SEQ ID NO: 586871 - DNA, 20 bp, Artificial
  CRISPR gRNA sequence
ataattactatagttgtcaa

SEQ ID NO: 586872 - DNA, 20 bp, Artificial
  CRISPR gRNA sequence
ctatagttgtcaaaagtcta

SEQ ID NO: 586873 - DNA, 20 bp, Artificial
  CRISPR gRNA sequence
ttcaacttaatttttatata

SEQ ID NO: 586874 - DNA, 20 bp, Artificial
  CRISPR gRNA sequence
ttaatttttatatatggcat

SEQ ID NO: 586875 - DNA, 20 bp, Artificial
  CRISPR gRNA sequence
aatttttatatatggcataa

SEQ ID NO: 586876 - DNA, 20 bp, Artificial
  CRISPR gRNA sequence
tatatatggcataagagtct

SEQ ID NO: 586877 - DNA, 20 bp, Artificial
  CRISPR gRNA sequence
gaccatttttttcaaaaata

SEQ ID NO: 586878 - DNA, 20 bp, Artificial
  CRISPR gRNA sequence
accatttttttcaaaaatat

SEQ ID NO: 586879 - DNA, 20 bp, Artificial
  CRISPR gRNA sequence
ttttcaaaaatatgggtatt

SEQ ID NO: 586880 - DNA, 20 bp, Artificial
  CRISPR gRNA sequence
atatgggtattcagttgttc

SEQ ID NO: 586881 - DNA, 20 bp, Artificial
  CRISPR gRNA sequence
agttgttctagacccattta

SEQ ID NO: 586882 - DNA, 20 bp, Artificial
  CRISPR gRNA sequence
tttccccccttaaattatct

SEQ ID NO: 586883 - DNA, 20 bp, Artificial
  CRISPR gRNA sequence
tgaaaatcaactgaccaatt

SEQ ID NO: 586884 - DNA, 20 bp, Artificial
  CRISPR gRNA sequence
gaaaatcaactgaccaattt

SEQ ID NO: 586885 - DNA, 20 bp, Artificial
  CRISPR gRNA sequence
accaatttgggttctatttc

SEQ ID NO: 586886 - DNA, 20 bp, Artificial
  CRISPR gRNA sequence
tatgtctatacttaaaccaa

SEQ ID NO: 586887 - DNA, 20 bp, Artificial
  CRISPR gRNA sequence
tgtctatacttaaaccaaca

SEQ ID NO: 586888 - DNA, 20 bp, Artificial
  CRISPR gRNA sequence
tatacttaaaccaacagagc

SEQ ID NO: 586889 - DNA, 20 bp, Artificial
  CRISPR gRNA sequence
taaaccaacagagcaagtct

SEQ ID NO: 586890 - DNA, 20 bp, Artificial
  CRISPR gRNA sequence
aaaccaacagagcaagtctt

SEQ ID NO: 586891 - DNA, 20 bp, Artificial
  CRISPR gRNA sequence
aacagagcaagtcttaggaa

SEQ ID NO: 586892 - DNA, 20 bp, Artificial
  CRISPR gRNA sequence
gcaagtcttaggaatagatt

SEQ ID NO: 586893 - DNA, 20 bp, Artificial
  CRISPR gRNA sequence
cttaggaatagatttggaat

SEQ ID NO: 586894 - DNA, 20 bp, Artificial
  CRISPR gRNA sequence
ttaggaatagatttggaatc

SEQ ID NO: 586895 - DNA, 20 bp, Artificial
  CRISPR gRNA sequence
ggaatagatttggaatcagg

SEQ ID NO: 586896 - DNA, 20 bp, Artificial
  CRISPR gRNA sequence
gatttggaatcaggcagtgc

SEQ ID NO: 586897 - DNA, 20 bp, Artificial
  CRISPR gRNA sequence
cagtgcaagtcatccaaatt

SEQ ID NO: 586898 - DNA, 20 bp, Artificial
  CRISPR gRNA sequence
ttggcttttcaaaattattt

SEQ ID NO: 586899 - DNA, 20 bp, Artificial
  CRISPR gRNA sequence
caaaattattttggctattt

SEQ ID NO: 586900 - DNA, 20 bp, Artificial
  CRISPR gRNA sequence
aaaattattttggctatttt

SEQ ID NO: 586901 - DNA, 20 bp, Artificial
  CRISPR gRNA sequence
taggtctacatttccaaaca

SEQ ID NO: 586902 - DNA, 20 bp, Artificial
  CRISPR gRNA sequence
ttccaaacaaagtttgtaat

SEQ ID NO: 586903 - DNA, 20 bp, Artificial
  CRISPR gRNA sequence
gtttgccaatttctgttaaa

SEQ ID NO: 586904 - DNA, 20 bp, Artificial
  CRISPR gRNA sequence
atttctgttaaaaagcttgt

SEQ ID NO: 586905 - DNA, 20 bp, Artificial
  CRISPR gRNA sequence
tttctgttaaaaagcttgtt

SEQ ID NO: 586906 - DNA, 20 bp, Artificial
  CRISPR gRNA sequence
ctgaaattgccctgaactga

SEQ ID NO: 586907 - DNA, 20 bp, Artificial
  CRISPR gRNA sequence
tgaactgacagactcgattt

SEQ ID NO: 586908 - DNA, 20 bp, Artificial
  CRISPR gRNA sequence
gaactgacagactcgatttc

SEQ ID NO: 586909 - DNA, 20 bp, Artificial
  CRISPR gRNA sequence
actgacagactcgatttcag

SEQ ID NO: 586910 - DNA, 20 bp, Artificial
  CRISPR gRNA sequence
tctcatctctgcatttattg

SEQ ID NO: 586911 - DNA, 20 bp, Artificial
  CRISPR gRNA sequence
ttgaagtctttaatttatct

SEQ ID NO: 586912 - DNA, 20 bp, Artificial
  CRISPR gRNA sequence
gtgttatgattttacgtaca

SEQ ID NO: 586913 - DNA, 20 bp, Artificial
  CRISPR gRNA sequence
atattacttaatttaactct

SEQ ID NO: 586914 - DNA, 20 bp, Artificial
  CRISPR gRNA sequence
tctaagtatttcatacattt

SEQ ID NO: 586915 - DNA, 20 bp, Artificial
  CRISPR gRNA sequence
ctaagtatttcatacatttt

SEQ ID NO: 586916 - DNA, 20 bp, Artificial
  CRISPR gRNA sequence
ttttgggatgttataatcaa

SEQ ID NO: 586917 - DNA, 20 bp, Artificial
  CRISPR gRNA sequence
aatgtccaactgttcattcc

SEQ ID NO: 586918 - DNA, 20 bp, Artificial
  CRISPR gRNA sequence
aactgttcattcctagcata

SEQ ID NO: 586919 - DNA, 20 bp, Artificial
  CRISPR gRNA sequence
aaatacatttgatttaatct

SEQ ID NO: 586920 - DNA, 20 bp, Artificial
  CRISPR gRNA sequence
gatttaatctcagtatgtca

SEQ ID NO: 586921 - DNA, 20 bp, Artificial
  CRISPR gRNA sequence
tttattacatcatttcacaa

SEQ ID NO: 586922 - DNA, 20 bp, Artificial
  CRISPR gRNA sequence
tacatcatttcacaatagcc

SEQ ID NO: 586923 - DNA, 20 bp, Artificial
  CRISPR gRNA sequence
atttcacaatagccaagata

SEQ ID NO: 586924 - DNA, 20 bp, Artificial
  CRISPR gRNA sequence
ccaagatatggcatcaacct

SEQ ID NO: 586925 - DNA, 20 bp, Artificial
  CRISPR gRNA sequence
caaatgataaccatcatgat

SEQ ID NO: 586926 - DNA, 20 bp, Artificial
  CRISPR gRNA sequence
aaatgataaccatcatgatg

SEQ ID NO: 586927 - DNA, 20 bp, Artificial
  CRISPR gRNA sequence
tgataaccatcatgatgagg

SEQ ID NO: 586928 - DNA, 20 bp, Artificial
  CRISPR gRNA sequence
tgaggaagttcttttctact

SEQ ID NO: 586929 - DNA, 20 bp, Artificial
  CRISPR gRNA sequence
agttcttttctactcagttg

SEQ ID NO: 586930 - DNA, 20 bp, Artificial
  CRISPR gRNA sequence
ttcttttctactcagttgca

SEQ ID NO: 586931 - DNA, 20 bp, Artificial
  CRISPR gRNA sequence
agaatttttataatatgtga

SEQ ID NO: 586932 - DNA, 20 bp, Artificial
  CRISPR gRNA sequence
atactttttctgaaacttta

SEQ ID NO: 586933 - DNA, 20 bp, Artificial
  CRISPR gRNA sequence
tttttctgaaactttaaaga

SEQ ID NO: 586934 - DNA, 20 bp, Artificial
  CRISPR gRNA sequence
gactaaaatcttttcttttt

SEQ ID NO: 586935 - DNA, 20 bp, Artificial
  CRISPR gRNA sequence
tcttttttagtctgttaata

SEQ ID NO: 586936 - DNA, 20 bp, Artificial
  CRISPR gRNA sequence
taaaccaactttaaattcct

SEQ ID NO: 586937 - DNA, 20 bp, Artificial
  CRISPR gRNA sequence
ttcctaagataaatcccact

SEQ ID NO: 586938 - DNA, 20 bp, Artificial
  CRISPR gRNA sequence
attatcctttttatatattc

SEQ ID NO: 586939 - DNA, 20 bp, Artificial
  CRISPR gRNA sequence
attcaatgtgttaaaatttt

SEQ ID NO: 586940 - DNA, 20 bp, Artificial
  CRISPR gRNA sequence
ttcaatgtgttaaaatttta

SEQ ID NO: 586941 - DNA, 20 bp, Artificial
  CRISPR gRNA sequence
acttttgcatctgcatcatg

SEQ ID NO: 586942 - DNA, 20 bp, Artificial
  CRISPR gRNA sequence
tcatgaagaataccgttatg

SEQ ID NO: 586943 - DNA, 20 bp, Artificial
  CRISPR gRNA sequence
tcttgtaatgtctttgattt

SEQ ID NO: 586944 - DNA, 20 bp, Artificial
  CRISPR gRNA sequence
aatgtctttgattttggtgt

SEQ ID NO: 586945 - DNA, 20 bp, Artificial
  CRISPR gRNA sequence
tgtctttgattttggtgtca

SEQ ID NO: 586946 - DNA, 20 bp, Artificial
  CRISPR gRNA sequence
gctgaatataataatttgtt

SEQ ID NO: 586947 - DNA, 20 bp, Artificial
  CRISPR gRNA sequence
tgaatataataatttgtttg

SEQ ID NO: 586948 - DNA, 20 bp, Artificial
  CRISPR gRNA sequence
gaatataataatttgtttgg

SEQ ID NO: 586949 - DNA, 20 bp, Artificial
  CRISPR gRNA sequence
ctcctcccttttctattgtc

SEQ ID NO: 586950 - DNA, 20 bp, Artificial
  CRISPR gRNA sequence
cctcccttttctattgtctg

SEQ ID NO: 586951 - DNA, 20 bp, Artificial
  CRISPR gRNA sequence
ctcccttttctattgtctgg

SEQ ID NO: 586952 - DNA, 20 bp, Artificial
  CRISPR gRNA sequence
tctggaggaatttgttcctt

SEQ ID NO: 586953 - DNA, 20 bp, Artificial
  CRISPR gRNA sequence
cattttccttaaatatttga

SEQ ID NO: 586954 - DNA, 20 bp, Artificial
  CRISPR gRNA sequence
aaatatttgacagaatttac

SEQ ID NO: 586955 - DNA, 20 bp, Artificial
  CRISPR gRNA sequence
tttgacagaatttaccagtg

SEQ ID NO: 586956 - DNA, 20 bp, Artificial
  CRISPR gRNA sequence
aatttaccagtgaagtcatc

SEQ ID NO: 586957 - DNA, 20 bp, Artificial
  CRISPR gRNA sequence
tttaccagtgaagtcatctg

SEQ ID NO: 586958 - DNA, 20 bp, Artificial
  CRISPR gRNA sequence
gtcatctggagttttctttg

SEQ ID NO: 586959 - DNA, 20 bp, Artificial
  CRISPR gRNA sequence
tcatctggagttttctttgt

SEQ ID NO: 586960 - DNA, 20 bp, Artificial
  CRISPR gRNA sequence
tctggagttttctttgtggg

SEQ ID NO: 586961 - DNA, 20 bp, Artificial
  CRISPR gRNA sequence
ctggagttttctttgtggga

SEQ ID NO: 586962 - DNA, 20 bp, Artificial
  CRISPR gRNA sequence
ttaacttcaatttcaattcc

SEQ ID NO: 586963 - DNA, 20 bp, Artificial
  CRISPR gRNA sequence
ttcaattcctggaataaatg

SEQ ID NO: 586964 - DNA, 20 bp, Artificial
  CRISPR gRNA sequence
tcaattcctggaataaatgt

SEQ ID NO: 586965 - DNA, 20 bp, Artificial
  CRISPR gRNA sequence
tggaataaatgtgggctatt

SEQ ID NO: 586966 - DNA, 20 bp, Artificial
  CRISPR gRNA sequence
gaataaatgtgggctattca

SEQ ID NO: 586967 - DNA, 20 bp, Artificial
  CRISPR gRNA sequence
gtgtatatttcttcctgaat

SEQ ID NO: 586968 - DNA, 20 bp, Artificial
  CRISPR gRNA sequence
gtatatttcttcctgaatga

SEQ ID NO: 586969 - DNA, 20 bp, Artificial
  CRISPR gRNA sequence
tttctattttttatttcatc

SEQ ID NO: 586970 - DNA, 20 bp, Artificial
  CRISPR gRNA sequence
atctagctgaatttgacata

SEQ ID NO: 586971 - DNA, 20 bp, Artificial
  CRISPR gRNA sequence
tccccatattatgcctccaa

SEQ ID NO: 586972 - DNA, 20 bp, Artificial
  CRISPR gRNA sequence
tattatgcctccaatggcta

SEQ ID NO: 586973 - DNA, 20 bp, Artificial
  CRISPR gRNA sequence
attatgcctccaatggctac

SEQ ID NO: 586974 - DNA, 20 bp, Artificial
  CRISPR gRNA sequence
tccaatggctacaggatttt

SEQ ID NO: 586975 - DNA, 20 bp, Artificial
  CRISPR gRNA sequence
acaggatttttagtgatttc

SEQ ID NO: 586976 - DNA, 20 bp, Artificial
  CRISPR gRNA sequence
gtgatttccggtttttattc

SEQ ID NO: 586977 - DNA, 20 bp, Artificial
  CRISPR gRNA sequence
ttaatattgattgatcttgc

SEQ ID NO: 586978 - DNA, 20 bp, Artificial
  CRISPR gRNA sequence
aatattgattgatcttgcta

SEQ ID NO: 586979 - DNA, 20 bp, Artificial
  CRISPR gRNA sequence
atattgattgatcttgctag

SEQ ID NO: 586980 - DNA, 20 bp, Artificial
  CRISPR gRNA sequence
tattgatcttctcatataat

SEQ ID NO: 586981 - DNA, 20 bp, Artificial
  CRISPR gRNA sequence
tcttcgatttcacttactaa

SEQ ID NO: 586982 - DNA, 20 bp, Artificial
  CRISPR gRNA sequence
ttactaatggtatgcccaac

SEQ ID NO: 586983 - DNA, 20 bp, Artificial
  CRISPR gRNA sequence
tactaatggtatgcccaaca

SEQ ID NO: 586984 - DNA, 20 bp, Artificial
  CRISPR gRNA sequence
aacaaggcataccatcccat

SEQ ID NO: 586985 - DNA, 20 bp, Artificial
  CRISPR gRNA sequence
aggcataccatcccattagt

SEQ ID NO: 586986 - DNA, 20 bp, Artificial
  CRISPR gRNA sequence
atcccattagtaagtaactg

SEQ ID NO: 586987 - DNA, 20 bp, Artificial
  CRISPR gRNA sequence
gtaagtaactgtggccatct

SEQ ID NO: 586988 - DNA, 20 bp, Artificial
  CRISPR gRNA sequence
aacaaaacaaaaccctgttt

SEQ ID NO: 586989 - DNA, 20 bp, Artificial
  CRISPR gRNA sequence
acaaaacaaaaccctgtttt

SEQ ID NO: 586990 - DNA, 20 bp, Artificial
  CRISPR gRNA sequence
tatattataattttcccaaa

SEQ ID NO: 586991 - DNA, 20 bp, Artificial
  CRISPR gRNA sequence
aattttcccaaatggataaa

SEQ ID NO: 586992 - DNA, 20 bp, Artificial
  CRISPR gRNA sequence
ccaaatggataaaaagttgt

SEQ ID NO: 586993 - DNA, 20 bp, Artificial
  CRISPR gRNA sequence
caaatggataaaaagttgtt

SEQ ID NO: 586994 - DNA, 20 bp, Artificial
  CRISPR gRNA sequence
aaatggataaaaagttgtta

SEQ ID NO: 586995 - DNA, 20 bp, Artificial
  CRISPR gRNA sequence
ttagggcacaaatcattatt

SEQ ID NO: 586996 - DNA, 20 bp, Artificial
  CRISPR gRNA sequence
caaatcattattaagttgtt

SEQ ID NO: 586997 - DNA, 20 bp, Artificial
  CRISPR gRNA sequence
cttaataaaatgaaactttt

SEQ ID NO: 586998 - DNA, 20 bp, Artificial
  CRISPR gRNA sequence
aaacttttcagtattacttt

SEQ ID NO: 586999 - DNA, 20 bp, Artificial
  CRISPR gRNA sequence
tgaactttgacaaaattatt

SEQ ID NO: 587000 - DNA, 20 bp, Artificial
  CRISPR gRNA sequence
acaaaattattaagacacta

SEQ ID NO: 587001 - DNA, 20 bp, Artificial
  CRISPR gRNA sequence
cactacagtcacaatgaacc

SEQ ID NO: 587002 - DNA, 20 bp, Artificial
  CRISPR gRNA sequence
acagtcacaatgaaccaaga

SEQ ID NO: 587003 - DNA, 20 bp, Artificial
  CRISPR gRNA sequence
cacaatgaaccaagaaagtt

SEQ ID NO: 587004 - DNA, 20 bp, Artificial
  CRISPR gRNA sequence
acaatgaaccaagaaagttt

SEQ ID NO: 587005 - DNA, 20 bp, Artificial
  CRISPR gRNA sequence
aagaaagtttgggaaacact

SEQ ID NO: 587006 - DNA, 20 bp, Artificial
  CRISPR gRNA sequence
aagtttgggaaacactgagc

SEQ ID NO: 587007 - DNA, 20 bp, Artificial
  CRISPR gRNA sequence
agtttgggaaacactgagct

SEQ ID NO: 587008 - DNA, 20 bp, Artificial
  CRISPR gRNA sequence
tatttcttttacacttgcat

SEQ ID NO: 587009 - DNA, 20 bp, Artificial
  CRISPR gRNA sequence
atattaaacaaaaaaatcat

SEQ ID NO: 587010 - DNA, 20 bp, Artificial
  CRISPR gRNA sequence
cttcacctatttttaaatta

SEQ ID NO: 587011 - DNA, 20 bp, Artificial
  CRISPR gRNA sequence
gtctttctgaataaattgat

SEQ ID NO: 587012 - DNA, 20 bp, Artificial
  CRISPR gRNA sequence
atttgacttatgcttttttt

SEQ ID NO: 587013 - DNA, 20 bp, Artificial
  CRISPR gRNA sequence
tttgacttatgctttttttg

SEQ ID NO: 587014 - DNA, 20 bp, Artificial
  CRISPR gRNA sequence
cttatgctttttttgaggtt

SEQ ID NO: 587015 - DNA, 20 bp, Artificial
  CRISPR gRNA sequence
tatgctttttttgaggttta

SEQ ID NO: 587016 - DNA, 20 bp, Artificial
  CRISPR gRNA sequence
atgctttttttgaggtttag

SEQ ID NO: 587017 - DNA, 20 bp, Artificial
  CRISPR gRNA sequence
agaggttttacattttcttg

SEQ ID NO: 587018 - DNA, 20 bp, Artificial
  CRISPR gRNA sequence
tttcttgtggtcaaaattgt

SEQ ID NO: 587019 - DNA, 20 bp, Artificial
  CRISPR gRNA sequence
cttgtggtcaaaattgttgg

SEQ ID NO: 587020 - DNA, 20 bp, Artificial
  CRISPR gRNA sequence
tgtgatttctttactgtttt

SEQ ID NO: 587021 - DNA, 20 bp, Artificial
  CRISPR gRNA sequence
ttttaaaattctgcctgata

SEQ ID NO: 587022 - DNA, 20 bp, Artificial
  CRISPR gRNA sequence
ctgcctgatatggaattttt

SEQ ID NO: 587023 - DNA, 20 bp, Artificial
  CRISPR gRNA sequence
actttttttttctaaatctt

SEQ ID NO: 587024 - DNA, 20 bp, Artificial
  CRISPR gRNA sequence
ttttttttctaaatctttag

SEQ ID NO: 587025 - DNA, 20 bp, Artificial
  CRISPR gRNA sequence
tttagaagtcttaatgactc

SEQ ID NO: 587026 - DNA, 20 bp, Artificial
  CRISPR gRNA sequence
ttagaagtcttaatgactct

SEQ ID NO: 587027 - DNA, 20 bp, Artificial
  CRISPR gRNA sequence
atttttttaatgaaatgatt

SEQ ID NO: 587028 - DNA, 20 bp, Artificial
  CRISPR gRNA sequence
tttttaatgaaatgattaag

SEQ ID NO: 587029 - DNA, 20 bp, Artificial
  CRISPR gRNA sequence
ttttaatgaaatgattaagt

SEQ ID NO: 587030 - DNA, 20 bp, Artificial
  CRISPR gRNA sequence
atgaaatgattaagtgggaa

SEQ ID NO: 587031 - DNA, 20 bp, Artificial
  CRISPR gRNA sequence
taagtgggaaaagaatattt

SEQ ID NO: 587032 - DNA, 20 bp, Artificial
  CRISPR gRNA sequence
tgggaaaagaatattttaga

SEQ ID NO: 587033 - DNA, 20 bp, Artificial
  CRISPR gRNA sequence
gggaaaagaatattttagaa

SEQ ID NO: 587034 - DNA, 20 bp, Artificial
  CRISPR gRNA sequence
agaatattttagaaaggaaa

SEQ ID NO: 587035 - DNA, 20 bp, Artificial
  CRISPR gRNA sequence
gaaacagatctctacctgaa

SEQ ID NO: 587036 - DNA, 20 bp, Artificial
  CRISPR gRNA sequence
cagatctctacctgaaaagt

SEQ ID NO: 587037 - DNA, 20 bp, Artificial
  CRISPR gRNA sequence
gaaaagtgagatatctttca

SEQ ID NO: 587038 - DNA, 20 bp, Artificial
  CRISPR gRNA sequence
aaagtgagatatctttcaaa

SEQ ID NO: 587039 - DNA, 20 bp, Artificial
  CRISPR gRNA sequence
ctctttatatgaaatcattt

SEQ ID NO: 587040 - DNA, 20 bp, Artificial
  CRISPR gRNA sequence
tctttatatgaaatcatttc

SEQ ID NO: 587041 - DNA, 20 bp, Artificial
  CRISPR gRNA sequence
tgaaatcatttcaggataat

SEQ ID NO: 587042 - DNA, 20 bp, Artificial
  CRISPR gRNA sequence
gaaatcatttcaggataatt

SEQ ID NO: 587043 - DNA, 20 bp, Artificial
  CRISPR gRNA sequence
gtgtctgtcaaaaatcatta

SEQ ID NO: 587044 - DNA, 20 bp, Artificial
  CRISPR gRNA sequence
aaaataacttttatctctct

SEQ ID NO: 587045 - DNA, 20 bp, Artificial
  CRISPR gRNA sequence
aaataacttttatctctcta

SEQ ID NO: 587046 - DNA, 20 bp, Artificial
  CRISPR gRNA sequence
aacttttatctctctaagga

SEQ ID NO: 587047 - DNA, 20 bp, Artificial
  CRISPR gRNA sequence
tctctaaggacagtttacta

SEQ ID NO: 587048 - DNA, 20 bp, Artificial
  CRISPR gRNA sequence
ctaaggacagtttactaaag

SEQ ID NO: 587049 - DNA, 20 bp, Artificial
  CRISPR gRNA sequence
gacagtttactaaagtagtt

SEQ ID NO: 587050 - DNA, 20 bp, Artificial
  CRISPR gRNA sequence
acagtttactaaagtagttg

SEQ ID NO: 587051 - DNA, 20 bp, Artificial
  CRISPR gRNA sequence
cagtttactaaagtagttga

SEQ ID NO: 587052 - DNA, 20 bp, Artificial
  CRISPR gRNA sequence
tttactaaagtagttgaggg

SEQ ID NO: 587053 - DNA, 20 bp, Artificial
  CRISPR gRNA sequence
ttactaaagtagttgagggt

SEQ ID NO: 587054 - DNA, 20 bp, Artificial
  CRISPR gRNA sequence
tactaaagtagttgagggtg

SEQ ID NO: 587055 - DNA, 20 bp, Artificial
  CRISPR gRNA sequence
actaaagtagttgagggtgg

SEQ ID NO: 587056 - DNA, 20 bp, Artificial
  CRISPR gRNA sequence
ctaaagtagttgagggtggg

SEQ ID NO: 587057 - DNA, 20 bp, Artificial
  CRISPR gRNA sequence
tgaatgttaaatgtttaaac

SEQ ID NO: 587058 - DNA, 20 bp, Artificial
  CRISPR gRNA sequence
aaatgtttaaacaagtctgt

SEQ ID NO: 587059 - DNA, 20 bp, Artificial
  CRISPR gRNA sequence
gtttaaacaagtctgtgaga

SEQ ID NO: 587060 - DNA, 20 bp, Artificial
  CRISPR gRNA sequence
gtgagacagtatatttaatg

SEQ ID NO: 587061 - DNA, 20 bp, Artificial
  CRISPR gRNA sequence
tatatttaatgcagatttct

SEQ ID NO: 587062 - DNA, 20 bp, Artificial
  CRISPR gRNA sequence
tatttaatgcagatttctta

SEQ ID NO: 587063 - DNA, 20 bp, Artificial
  CRISPR gRNA sequence
tagagatttacaatgtatat

SEQ ID NO: 587064 - DNA, 20 bp, Artificial
  CRISPR gRNA sequence
acaatgtatatgagcattat

SEQ ID NO: 587065 - DNA, 20 bp, Artificial
  CRISPR gRNA sequence
aatgtatatgagcattatca

SEQ ID NO: 587066 - DNA, 20 bp, Artificial
  CRISPR gRNA sequence
atgtatatgagcattatcag

SEQ ID NO: 587067 - DNA, 20 bp, Artificial
  CRISPR gRNA sequence
agcattatcagaggttcttt

SEQ ID NO: 587068 - DNA, 20 bp, Artificial
  CRISPR gRNA sequence
cagaggttcttttggatgtt

SEQ ID NO: 587069 - DNA, 20 bp, Artificial
  CRISPR gRNA sequence
gtttagcttcaataacaaaa

SEQ ID NO: 587070 - DNA, 20 bp, Artificial
  CRISPR gRNA sequence
ttcaataacaaaaaagcaaa

SEQ ID NO: 587071 - DNA, 20 bp, Artificial
  CRISPR gRNA sequence
ttttccaaaaaaactaaata

SEQ ID NO: 587072 - DNA, 20 bp, Artificial
  CRISPR gRNA sequence
tatagtacaattttttattt

SEQ ID NO: 587073 - DNA, 20 bp, Artificial
  CRISPR gRNA sequence
ttagcaactattaatttcgc

SEQ ID NO: 587074 - DNA, 20 bp, Artificial
  CRISPR gRNA sequence
ttttttgtgaacatactgtg

SEQ ID NO: 587075 - DNA, 20 bp, Artificial
  CRISPR gRNA sequence
acactgcattatgacaataa

SEQ ID NO: 587076 - DNA, 20 bp, Artificial
  CRISPR gRNA sequence
actgcattatgacaataaaa

SEQ ID NO: 587077 - DNA, 20 bp, Artificial
  CRISPR gRNA sequence
ctgcattatgacaataaaag

SEQ ID NO: 587078 - DNA, 20 bp, Artificial
  CRISPR gRNA sequence
caataaaagaggcaaaaaaa

SEQ ID NO: 587079 - DNA, 20 bp, Artificial
  CRISPR gRNA sequence
aaaagaggcaaaaaaaaagc

SEQ ID NO: 587080 - DNA, 20 bp, Artificial
  CRISPR gRNA sequence
ggcaaaaaaaaagccagcat

SEQ ID NO: 587081 - DNA, 20 bp, Artificial
  CRISPR gRNA sequence
cttttttttttttttttgtt

SEQ ID NO: 587082 - DNA, 20 bp, Artificial
  CRISPR gRNA sequence
tttttttttttttgtttggt

SEQ ID NO: 587083 - DNA, 20 bp, Artificial
  CRISPR gRNA sequence
tttttttttgtttggtgaga

SEQ ID NO: 587084 - DNA, 20 bp, Artificial
  CRISPR gRNA sequence
tttttttgtttggtgagatg

SEQ ID NO: 587085 - DNA, 20 bp, Artificial
  CRISPR gRNA sequence
tggagtctcgctctgtcgcc

SEQ ID NO: 587086 - DNA, 20 bp, Artificial
  CRISPR gRNA sequence
tctcgctctgtcgcccagac

SEQ ID NO: 587087 - DNA, 20 bp, Artificial
  CRISPR gRNA sequence
tcgctctgtcgcccagactg

SEQ ID NO: 587088 - DNA, 20 bp, Artificial
  CRISPR gRNA sequence
cgctctgtcgcccagactgg

SEQ ID NO: 587089 - DNA, 20 bp, Artificial
  CRISPR gRNA sequence
gctctgtcgcccagactgga

SEQ ID NO: 587090 - DNA, 20 bp, Artificial
  CRISPR gRNA sequence
ctgtcgcccagactggaggg

SEQ ID NO: 587091 - DNA, 20 bp, Artificial
  CRISPR gRNA sequence
tgtcgcccagactggagggc

SEQ ID NO: 587092 - DNA, 20 bp, Artificial
  CRISPR gRNA sequence
tcgcccagactggagggcag

SEQ ID NO: 587093 - DNA, 20 bp, Artificial
  CRISPR gRNA sequence
actggagggcaggagtgcac

SEQ ID NO: 587094 - DNA, 20 bp, Artificial
  CRISPR gRNA sequence
ggagtgcactggtgccacct

SEQ ID NO: 587095 - DNA, 20 bp, Artificial
  CRISPR gRNA sequence
tcactgcaacctccacctcc

SEQ ID NO: 587096 - DNA, 20 bp, Artificial
  CRISPR gRNA sequence
cactgcaacctccacctcct

SEQ ID NO: 587097 - DNA, 20 bp, Artificial
  CRISPR gRNA sequence
cctgggttcaaatgattctc

SEQ ID NO: 587098 - DNA, 20 bp, Artificial
  CRISPR gRNA sequence
ttcaaatgattctccagcct

SEQ ID NO: 587099 - DNA, 20 bp, Artificial
  CRISPR gRNA sequence
ttctccagcctcagcctcct

SEQ ID NO: 587100 - DNA, 20 bp, Artificial
  CRISPR gRNA sequence
tccagcctcagcctcctgag

SEQ ID NO: 587101 - DNA, 20 bp, Artificial
  CRISPR gRNA sequence
gcctcagcctcctgagtagc

SEQ ID NO: 587102 - DNA, 20 bp, Artificial
  CRISPR gRNA sequence
cctcagcctcctgagtagct

SEQ ID NO: 587103 - DNA, 20 bp, Artificial
  CRISPR gRNA sequence
ctcctgagtagctgggacta

SEQ ID NO: 587104 - DNA, 20 bp, Artificial
  CRISPR gRNA sequence
tcctgagtagctgggactac

SEQ ID NO: 587105 - DNA, 20 bp, Artificial
  CRISPR gRNA sequence
caggcacgtgccaccacgtc

SEQ ID NO: 587106 - DNA, 20 bp, Artificial
  CRISPR gRNA sequence
ctggctaatttttgtatttt

SEQ ID NO: 587107 - DNA, 20 bp, Artificial
  CRISPR gRNA sequence
gctaatttttgtatttttag

SEQ ID NO: 587108 - DNA, 20 bp, Artificial
  CRISPR gRNA sequence
taatttttgtatttttagta

SEQ ID NO: 587109 - DNA, 20 bp, Artificial
  CRISPR gRNA sequence
ttttgtatttttagtagaga

SEQ ID NO: 587110 - DNA, 20 bp, Artificial
  CRISPR gRNA sequence
tttgtatttttagtagagac

SEQ ID NO: 587111 - DNA, 20 bp, Artificial
  CRISPR gRNA sequence
ttgtatttttagtagagacg

SEQ ID NO: 587112 - DNA, 20 bp, Artificial
  CRISPR gRNA sequence
gagacggggtttcaccacgt

SEQ ID NO: 587113 - DNA, 20 bp, Artificial
  CRISPR gRNA sequence
cggggtttcaccacgttggc

SEQ ID NO: 587114 - DNA, 20 bp, Artificial
  CRISPR gRNA sequence
ggggtttcaccacgttggcc

SEQ ID NO: 587115 - DNA, 20 bp, Artificial
  CRISPR gRNA sequence
tttcaccacgttggccaggc

SEQ ID NO: 587116 - DNA, 20 bp, Artificial
  CRISPR gRNA sequence
ggtcttgaactcctgacctc

SEQ ID NO: 587117 - DNA, 20 bp, Artificial
  CRISPR gRNA sequence
ctcaagtgatccgcccgcct

SEQ ID NO: 587118 - DNA, 20 bp, Artificial
  CRISPR gRNA sequence
ccgcccgcctcagcctccca

SEQ ID NO: 587119 - DNA, 20 bp, Artificial
  CRISPR gRNA sequence
gcctcagcctcccaaagtgc

SEQ ID NO: 587120 - DNA, 20 bp, Artificial
  CRISPR gRNA sequence
cctcagcctcccaaagtgct

SEQ ID NO: 587121 - DNA, 20 bp, Artificial
  CRISPR gRNA sequence
ctcccaaagtgctgggatta

SEQ ID NO: 587122 - DNA, 20 bp, Artificial
  CRISPR gRNA sequence
tcccaaagtgctgggattac

SEQ ID NO: 587123 - DNA, 20 bp, Artificial
  CRISPR gRNA sequence
acaggcgtgtgccactgcgc

SEQ ID NO: 587124 - DNA, 20 bp, Artificial
  CRISPR gRNA sequence
caggcgtgtgccactgcgcc

SEQ ID NO: 587125 - DNA, 20 bp, Artificial
  CRISPR gRNA sequence
tactgtttactcttctttaa

SEQ ID NO: 587126 - DNA, 20 bp, Artificial
  CRISPR gRNA sequence
actgtttactcttctttaac

SEQ ID NO: 587127 - DNA, 20 bp, Artificial
  CRISPR gRNA sequence
tcttctttaacaggatgtgc

SEQ ID NO: 587128 - DNA, 20 bp, Artificial
  CRISPR gRNA sequence
cttctttaacaggatgtgcc

SEQ ID NO: 587129 - DNA, 20 bp, Artificial
  CRISPR gRNA sequence
aacaggatgtgccaggtgtt

SEQ ID NO: 587130 - DNA, 20 bp, Artificial
  CRISPR gRNA sequence
gatgtgccaggtgttgagca

SEQ ID NO: 587131 - DNA, 20 bp, Artificial
  CRISPR gRNA sequence
aggtgttgagcaaagacatc

SEQ ID NO: 587132 - DNA, 20 bp, Artificial
  CRISPR gRNA sequence
tcctttaacataaatttctt

SEQ ID NO: 587133 - DNA, 20 bp, Artificial
  CRISPR gRNA sequence
ataaatttcttgagcacctc

SEQ ID NO: 587134 - DNA, 20 bp, Artificial
  CRISPR gRNA sequence
agtattccatgtccacgttc

SEQ ID NO: 587135 - DNA, 20 bp, Artificial
  CRISPR gRNA sequence
gtattccatgtccacgttct

SEQ ID NO: 587136 - DNA, 20 bp, Artificial
  CRISPR gRNA sequence
tgtccacgttctaggtgctg

SEQ ID NO: 587137 - DNA, 20 bp, Artificial
  CRISPR gRNA sequence
cgttctaggtgctgtagata

SEQ ID NO: 587138 - DNA, 20 bp, Artificial
  CRISPR gRNA sequence
ctgtagatacagcactgaac

SEQ ID NO: 587139 - DNA, 20 bp, Artificial
  CRISPR gRNA sequence
aaatgtcattcctgcatcca

SEQ ID NO: 587140 - DNA, 20 bp, Artificial
  CRISPR gRNA sequence
atgtcattcctgcatccaca

SEQ ID NO: 587141 - DNA, 20 bp, Artificial
  CRISPR gRNA sequence
taatgtaataacaatgttca

SEQ ID NO: 587142 - DNA, 20 bp, Artificial
  CRISPR gRNA sequence
agtaaactgaaaatcttata

SEQ ID NO: 587143 - DNA, 20 bp, Artificial
  CRISPR gRNA sequence
gtaaactgaaaatcttatac

SEQ ID NO: 587144 - DNA, 20 bp, Artificial
  CRISPR gRNA sequence
cttatacaggacacaaacac

SEQ ID NO: 587145 - DNA, 20 bp, Artificial
  CRISPR gRNA sequence
ttatacaggacacaaacacc

SEQ ID NO: 587146 - DNA, 20 bp, Artificial
  CRISPR gRNA sequence
aggaaaaattgtatataaaa

SEQ ID NO: 587147 - DNA, 20 bp, Artificial
  CRISPR gRNA sequence
tgtatataaaaaagtatgta

SEQ ID NO: 587148 - DNA, 20 bp, Artificial
  CRISPR gRNA sequence
gtatataaaaaagtatgtat

SEQ ID NO: 587149 - DNA, 20 bp, Artificial
  CRISPR gRNA sequence
aagtatgtatgggaccttta

SEQ ID NO: 587150 - DNA, 20 bp, Artificial
  CRISPR gRNA sequence
ggacctttaaagtaaaatca

SEQ ID NO: 587151 - DNA, 20 bp, Artificial
  CRISPR gRNA sequence
gtaaaatcacagacatttga

SEQ ID NO: 587152 - DNA, 20 bp, Artificial
  CRISPR gRNA sequence
tcacagacatttgaaagcaa

SEQ ID NO: 587153 - DNA, 20 bp, Artificial
  CRISPR gRNA sequence
aaaactgctttttattgttt

SEQ ID NO: 587154 - DNA, 20 bp, Artificial
  CRISPR gRNA sequence
aaactgctttttattgtttt

SEQ ID NO: 587155 - DNA, 20 bp, Artificial
  CRISPR gRNA sequence
ttttattgttttgggcactc

SEQ ID NO: 587156 - DNA, 20 bp, Artificial
  CRISPR gRNA sequence
tattgttttgggcactctgg

SEQ ID NO: 587157 - DNA, 20 bp, Artificial
  CRISPR gRNA sequence
tgggcactctggaagaaaaa

SEQ ID NO: 587158 - DNA, 20 bp, Artificial
  CRISPR gRNA sequence
aaaatagtcacaattcaaac

SEQ ID NO: 587159 - DNA, 20 bp, Artificial
  CRISPR gRNA sequence
aacaagaaaatgtcttatgt

SEQ ID NO: 587160 - DNA, 20 bp, Artificial
  CRISPR gRNA sequence
ttatgtaagattatttttat

SEQ ID NO: 587161 - DNA, 20 bp, Artificial
  CRISPR gRNA sequence
atgtaagattatttttataa

SEQ ID NO: 587162 - DNA, 20 bp, Artificial
  CRISPR gRNA sequence
gattatttttataagagtct

SEQ ID NO: 587163 - DNA, 20 bp, Artificial
  CRISPR gRNA sequence
tttataagagtctaagttgt

SEQ ID NO: 587164 - DNA, 20 bp, Artificial
  CRISPR gRNA sequence
atctacttttctatcacttt

SEQ ID NO: 587165 - DNA, 20 bp, Artificial
  CRISPR gRNA sequence
tttaagttaacacatttcct

SEQ ID NO: 587166 - DNA, 20 bp, Artificial
  CRISPR gRNA sequence
ttgaacttaacacctaaaat

SEQ ID NO: 587167 - DNA, 20 bp, Artificial
  CRISPR gRNA sequence
tgaacttaacacctaaaata

SEQ ID NO: 587168 - DNA, 20 bp, Artificial
  CRISPR gRNA sequence
acttaacacctaaaataagg

SEQ ID NO: 587169 - DNA, 20 bp, Artificial
  CRISPR gRNA sequence
cctaaaataaggaagcaaaa

SEQ ID NO: 587170 - DNA, 20 bp, Artificial
  CRISPR gRNA sequence
ctaaaataaggaagcaaaat

SEQ ID NO: 587171 - DNA, 20 bp, Artificial
  CRISPR gRNA sequence
taaggaagcaaaatgggacg

SEQ ID NO: 587172 - DNA, 20 bp, Artificial
  CRISPR gRNA sequence
atatacattgtaacatattt

SEQ ID NO: 587173 - DNA, 20 bp, Artificial
  CRISPR gRNA sequence
tacattgtaacatattttgg

SEQ ID NO: 587174 - DNA, 20 bp, Artificial
  CRISPR gRNA sequence
aacatattttggcagtgtaa

SEQ ID NO: 587175 - DNA, 20 bp, Artificial
  CRISPR gRNA sequence
gtgtaacagttatgcttccc

SEQ ID NO: 587176 - DNA, 20 bp, Artificial
  CRISPR gRNA sequence
taaaataattaaacaataaa

SEQ ID NO: 587177 - DNA, 20 bp, Artificial
  CRISPR gRNA sequence
aataattaaacaataaatgg

SEQ ID NO: 587178 - DNA, 20 bp, Artificial
  CRISPR gRNA sequence
aattaaacaataaatggaag

SEQ ID NO: 587179 - DNA, 20 bp, Artificial
  CRISPR gRNA sequence
ttcatacaacatgtatttac

SEQ ID NO: 587180 - DNA, 20 bp, Artificial
  CRISPR gRNA sequence
tttaccagctgcctaaaatg

SEQ ID NO: 587181 - DNA, 20 bp, Artificial
  CRISPR gRNA sequence
ttcaaaaaccatttaacccc

SEQ ID NO: 587182 - DNA, 20 bp, Artificial
  CRISPR gRNA sequence
tcaaaaaccatttaacccct

SEQ ID NO: 587183 - DNA, 20 bp, Artificial
  CRISPR gRNA sequence
caaaaaccatttaaccccta

SEQ ID NO: 587184 - DNA, 20 bp, Artificial
  CRISPR gRNA sequence
atgctcacttctttcactgt

SEQ ID NO: 587185 - DNA, 20 bp, Artificial
  CRISPR gRNA sequence
tttcactgtaagtgtaacat

SEQ ID NO: 587186 - DNA, 20 bp, Artificial
  CRISPR gRNA sequence
gtgtaacataagtcatttaa

SEQ ID NO: 587187 - DNA, 20 bp, Artificial
  CRISPR gRNA sequence
acataagtcatttaacagat

SEQ ID NO: 587188 - DNA, 20 bp, Artificial
  CRISPR gRNA sequence
aacagattggttgatgaatt

SEQ ID NO: 587189 - DNA, 20 bp, Artificial
  CRISPR gRNA sequence
acagattggttgatgaattt

SEQ ID NO: 587190 - DNA, 20 bp, Artificial
  CRISPR gRNA sequence
tggttgatgaatttaggaaa

SEQ ID NO: 587191 - DNA, 20 bp, Artificial
  CRISPR gRNA sequence
gttgatgaatttaggaaaaa

SEQ ID NO: 587192 - DNA, 20 bp, Artificial
  CRISPR gRNA sequence
atgaatttaggaaaaagagc

SEQ ID NO: 587193 - DNA, 20 bp, Artificial
  CRISPR gRNA sequence
gaatttaggaaaaagagcta

SEQ ID NO: 587194 - DNA, 20 bp, Artificial
  CRISPR gRNA sequence
ttaggaaaaagagctagaga

SEQ ID NO: 587195 - DNA, 20 bp, Artificial
  CRISPR gRNA sequence
aaagagctagagaaagtata

SEQ ID NO: 587196 - DNA, 20 bp, Artificial
  CRISPR gRNA sequence
aagagctagagaaagtataa

SEQ ID NO: 587197 - DNA, 20 bp, Artificial
  CRISPR gRNA sequence
agaaagtataaaggtgcaaa

SEQ ID NO: 587198 - DNA, 20 bp, Artificial
  CRISPR gRNA sequence
aggtgcaaaaagttttaatg

SEQ ID NO: 587199 - DNA, 20 bp, Artificial
  CRISPR gRNA sequence
gcaaaaagttttaatgtggc

SEQ ID NO: 587200 - DNA, 20 bp, Artificial
  CRISPR gRNA sequence
caaaaagttttaatgtggcc

SEQ ID NO: 587201 - DNA, 20 bp, Artificial
  CRISPR gRNA sequence
aaaagttttaatgtggccag

SEQ ID NO: 587202 - DNA, 20 bp, Artificial
  CRISPR gRNA sequence
gttttaatgtggccaggaga

SEQ ID NO: 587203 - DNA, 20 bp, Artificial
  CRISPR gRNA sequence
aatgtggccaggagatggta

SEQ ID NO: 587204 - DNA, 20 bp, Artificial
  CRISPR gRNA sequence
gagatggtacagtaaaatct

SEQ ID NO: 587205 - DNA, 20 bp, Artificial
  CRISPR gRNA sequence
tacagtaaaatctaagacac

SEQ ID NO: 587206 - DNA, 20 bp, Artificial
  CRISPR gRNA sequence
acagtaaaatctaagacaca

SEQ ID NO: 587207 - DNA, 20 bp, Artificial
  CRISPR gRNA sequence
cagtaaaatctaagacacaa

SEQ ID NO: 587208 - DNA, 20 bp, Artificial
  CRISPR gRNA sequence
aatctaagacacaagggaaa

SEQ ID NO: 587209 - DNA, 20 bp, Artificial
  CRISPR gRNA sequence
ctaagacacaagggaaacag

SEQ ID NO: 587210 - DNA, 20 bp, Artificial
  CRISPR gRNA sequence
aatgtgcaaaatattcatta

SEQ ID NO: 587211 - DNA, 20 bp, Artificial
  CRISPR gRNA sequence
atgtgcaaaatattcattat

SEQ ID NO: 587212 - DNA, 20 bp, Artificial
  CRISPR gRNA sequence
tgtgcaaaatattcattatg

SEQ ID NO: 587213 - DNA, 20 bp, Artificial
  CRISPR gRNA sequence
tattcattatggggaataaa

SEQ ID NO: 587214 - DNA, 20 bp, Artificial
  CRISPR gRNA sequence
tatggggaataaaaagtaaa

SEQ ID NO: 587215 - DNA, 20 bp, Artificial
  CRISPR gRNA sequence
gggaataaaaagtaaacaga

SEQ ID NO: 587216 - DNA, 20 bp, Artificial
  CRISPR gRNA sequence
ggaataaaaagtaaacagaa

SEQ ID NO: 587217 - DNA, 20 bp, Artificial
  CRISPR gRNA sequence
taaaaagtaaacagaaaggc

SEQ ID NO: 587218 - DNA, 20 bp, Artificial
  CRISPR gRNA sequence
aagtaaacagaaaggctagt

SEQ ID NO: 587219 - DNA, 20 bp, Artificial
  CRISPR gRNA sequence
aaaggctagtaagaatttac

SEQ ID NO: 587220 - DNA, 20 bp, Artificial
  CRISPR gRNA sequence
aaggctagtaagaatttact

SEQ ID NO: 587221 - DNA, 20 bp, Artificial
  CRISPR gRNA sequence
gtaagaatttactaggcata

SEQ ID NO: 587222 - DNA, 20 bp, Artificial
  CRISPR gRNA sequence
aatgaataatccaaattata

SEQ ID NO: 587223 - DNA, 20 bp, Artificial
  CRISPR gRNA sequence
tatagactcttccttttaat

SEQ ID NO: 587224 - DNA, 20 bp, Artificial
  CRISPR gRNA sequence
atttcaattaatcaaaccac

SEQ ID NO: 587225 - DNA, 20 bp, Artificial
  CRISPR gRNA sequence
atcaaaccactggcatatct

SEQ ID NO: 587226 - DNA, 20 bp, Artificial
  CRISPR gRNA sequence
caaaccactggcatatcttg

SEQ ID NO: 587227 - DNA, 20 bp, Artificial
  CRISPR gRNA sequence
ggcatatcttggagatattg

SEQ ID NO: 587228 - DNA, 20 bp, Artificial
  CRISPR gRNA sequence
gcatatcttggagatattgc

SEQ ID NO: 587229 - DNA, 20 bp, Artificial
  CRISPR gRNA sequence
tcttggagatattgcaggtt

SEQ ID NO: 587230 - DNA, 20 bp, Artificial
  CRISPR gRNA sequence
agttccaccccatcacaata

SEQ ID NO: 587231 - DNA, 20 bp, Artificial
  CRISPR gRNA sequence
ataaagaatatatcctgata

SEQ ID NO: 587232 - DNA, 20 bp, Artificial
  CRISPR gRNA sequence
aagaatatatcctgataaag

SEQ ID NO: 587233 - DNA, 20 bp, Artificial
  CRISPR gRNA sequence
agaatatatcctgataaagt

SEQ ID NO: 587234 - DNA, 20 bp, Artificial
  CRISPR gRNA sequence
tcctgataaagtgggtcact

SEQ ID NO: 587235 - DNA, 20 bp, Artificial
  CRISPR gRNA sequence
gataaagtgggtcactcaga

SEQ ID NO: 587236 - DNA, 20 bp, Artificial
  CRISPR gRNA sequence
aaagtgggtcactcagatag

SEQ ID NO: 587237 - DNA, 20 bp, Artificial
  CRISPR gRNA sequence
atatcataccataatctatt

SEQ ID NO: 587238 - DNA, 20 bp, Artificial
  CRISPR gRNA sequence
ataatctattaagtgtgcaa

SEQ ID NO: 587239 - DNA, 20 bp, Artificial
  CRISPR gRNA sequence
tttgctgctaaaaaatgcta

SEQ ID NO: 587240 - DNA, 20 bp, Artificial
  CRISPR gRNA sequence
tgctgctaaaaaatgctaaa

SEQ ID NO: 587241 - DNA, 20 bp, Artificial
  CRISPR gRNA sequence
gctgctaaaaaatgctaaag

SEQ ID NO: 587242 - DNA, 20 bp, Artificial
  CRISPR gRNA sequence
ctaaaaaatgctaaagaggc

SEQ ID NO: 587243 - DNA, 20 bp, Artificial
  CRISPR gRNA sequence
taaaaaatgctaaagaggcc

SEQ ID NO: 587244 - DNA, 20 bp, Artificial
  CRISPR gRNA sequence
aatgctaaagaggccaggtg

SEQ ID NO: 587245 - DNA, 20 bp, Artificial
  CRISPR gRNA sequence
gctaaagaggccaggtgcag

SEQ ID NO: 587246 - DNA, 20 bp, Artificial
  CRISPR gRNA sequence
gtggctcacacctgtaatac

SEQ ID NO: 587247 - DNA, 20 bp, Artificial
  CRISPR gRNA sequence
cacctgtaatacaagcactt

SEQ ID NO: 587248 - DNA, 20 bp, Artificial
  CRISPR gRNA sequence
acctgtaatacaagcacttt

SEQ ID NO: 587249 - DNA, 20 bp, Artificial
  CRISPR gRNA sequence
tgtaatacaagcactttggg

SEQ ID NO: 587250 - DNA, 20 bp, Artificial
  CRISPR gRNA sequence
aatacaagcactttgggaag

SEQ ID NO: 587251 - DNA, 20 bp, Artificial
  CRISPR gRNA sequence
tacaagcactttgggaagtg

SEQ ID NO: 587252 - DNA, 20 bp, Artificial
  CRISPR gRNA sequence
acaagcactttgggaagtgg

SEQ ID NO: 587253 - DNA, 20 bp, Artificial
  CRISPR gRNA sequence
agcactttgggaagtggagg

SEQ ID NO: 587254 - DNA, 20 bp, Artificial
  CRISPR gRNA sequence
gcactttgggaagtggaggc

SEQ ID NO: 587255 - DNA, 20 bp, Artificial
  CRISPR gRNA sequence
actttgggaagtggaggcag

SEQ ID NO: 587256 - DNA, 20 bp, Artificial
  CRISPR gRNA sequence
ctttgggaagtggaggcagg

SEQ ID NO: 587257 - DNA, 20 bp, Artificial
  CRISPR gRNA sequence
tggaggcaggaggatcacta

SEQ ID NO: 587258 - DNA, 20 bp, Artificial
  CRISPR gRNA sequence
gcaggaggatcactaaagcc

SEQ ID NO: 587259 - DNA, 20 bp, Artificial
  CRISPR gRNA sequence
caggaggatcactaaagccc

SEQ ID NO: 587260 - DNA, 20 bp, Artificial
  CRISPR gRNA sequence
ggaggatcactaaagcccag

SEQ ID NO: 587261 - DNA, 20 bp, Artificial
  CRISPR gRNA sequence
tcactaaagcccaggagttc

SEQ ID NO: 587262 - DNA, 20 bp, Artificial
  CRISPR gRNA sequence
aaagcccaggagttctagac

SEQ ID NO: 587263 - DNA, 20 bp, Artificial
  CRISPR gRNA sequence
ccaggagttctagaccagcc

SEQ ID NO: 587264 - DNA, 20 bp, Artificial
  CRISPR gRNA sequence
caggagttctagaccagcct

SEQ ID NO: 587265 - DNA, 20 bp, Artificial
  CRISPR gRNA sequence
ctctataaacaatacaaaac

SEQ ID NO: 587266 - DNA, 20 bp, Artificial
  CRISPR gRNA sequence
caatacaaaactagcaaaat

SEQ ID NO: 587267 - DNA, 20 bp, Artificial
  CRISPR gRNA sequence
acaaaactagcaaaattagc

SEQ ID NO: 587268 - DNA, 20 bp, Artificial
  CRISPR gRNA sequence
caaaactagcaaaattagcc

SEQ ID NO: 587269 - DNA, 20 bp, Artificial
  CRISPR gRNA sequence
aaaactagcaaaattagcca

SEQ ID NO: 587270 - DNA, 20 bp, Artificial
  CRISPR gRNA sequence
tagcaaaattagccagggtg

SEQ ID NO: 587271 - DNA, 20 bp, Artificial
  CRISPR gRNA sequence
caaaattagccagggtgtgg

SEQ ID NO: 587272 - DNA, 20 bp, Artificial
  CRISPR gRNA sequence
cagggtgtggtagcatgcac

SEQ ID NO: 587273 - DNA, 20 bp, Artificial
  CRISPR gRNA sequence
ggtgtggtagcatgcaccag

SEQ ID NO: 587274 - DNA, 20 bp, Artificial
  CRISPR gRNA sequence
gtagcatgcaccagtggtcc

SEQ ID NO: 587275 - DNA, 20 bp, Artificial
  CRISPR gRNA sequence
caccagtggtcccagttact

SEQ ID NO: 587276 - DNA, 20 bp, Artificial
  CRISPR gRNA sequence
accagtggtcccagttactc

SEQ ID NO: 587277 - DNA, 20 bp, Artificial
  CRISPR gRNA sequence
cagtggtcccagttactcgg

SEQ ID NO: 587278 - DNA, 20 bp, Artificial
  CRISPR gRNA sequence
agtggtcccagttactcggg

SEQ ID NO: 587279 - DNA, 20 bp, Artificial
  CRISPR gRNA sequence
tcccagttactcgggaggct

SEQ ID NO: 587280 - DNA, 20 bp, Artificial
  CRISPR gRNA sequence
ccagttactcgggaggctga

SEQ ID NO: 587281 - DNA, 20 bp, Artificial
  CRISPR gRNA sequence
cagttactcgggaggctgag

SEQ ID NO: 587282 - DNA, 20 bp, Artificial
  CRISPR gRNA sequence
actcgggaggctgagaggct

SEQ ID NO: 587283 - DNA, 20 bp, Artificial
  CRISPR gRNA sequence
ctcgggaggctgagaggctg

SEQ ID NO: 587284 - DNA, 20 bp, Artificial
  CRISPR gRNA sequence
gggaggctgagaggctgagg

SEQ ID NO: 587285 - DNA, 20 bp, Artificial
  CRISPR gRNA sequence
ggaggctgagaggctgaggt

SEQ ID NO: 587286 - DNA, 20 bp, Artificial
  CRISPR gRNA sequence
aggctgagaggctgaggtgg

SEQ ID NO: 587287 - DNA, 20 bp, Artificial
  CRISPR gRNA sequence
ggctgagaggctgaggtggg

SEQ ID NO: 587288 - DNA, 20 bp, Artificial
  CRISPR gRNA sequence
ctgaggtgggaggatcactt

SEQ ID NO: 587289 - DNA, 20 bp, Artificial
  CRISPR gRNA sequence
gtgggaggatcacttgagcc

SEQ ID NO: 587290 - DNA, 20 bp, Artificial
  CRISPR gRNA sequence
gaggatcacttgagcccaga

SEQ ID NO: 587291 - DNA, 20 bp, Artificial
  CRISPR gRNA sequence
tcacttgagcccagacagtc

SEQ ID NO: 587292 - DNA, 20 bp, Artificial
  CRISPR gRNA sequence
cacttgagcccagacagtca

SEQ ID NO: 587293 - DNA, 20 bp, Artificial
  CRISPR gRNA sequence
agcccagacagtcaaggcta

SEQ ID NO: 587294 - DNA, 20 bp, Artificial
  CRISPR gRNA sequence
cagacagtcaaggctacagt

SEQ ID NO: 587295 - DNA, 20 bp, Artificial
  CRISPR gRNA sequence
atacatacacatacactgta

SEQ ID NO: 587296 - DNA, 20 bp, Artificial
  CRISPR gRNA sequence
atacactgtaaagataatct

SEQ ID NO: 587297 - DNA, 20 bp, Artificial
  CRISPR gRNA sequence
gtaaagataatctgagcctt

SEQ ID NO: 587298 - DNA, 20 bp, Artificial
  CRISPR gRNA sequence
cagactcatcatctttccac

SEQ ID NO: 587299 - DNA, 20 bp, Artificial
  CRISPR gRNA sequence
actcatcatctttccactgg

SEQ ID NO: 587300 - DNA, 20 bp, Artificial
  CRISPR gRNA sequence
tcatcatctttccactggtg

SEQ ID NO: 587301 - DNA, 20 bp, Artificial
  CRISPR gRNA sequence
catcatctttccactggtgg

SEQ ID NO: 587302 - DNA, 20 bp, Artificial
  CRISPR gRNA sequence
tcatctttccactggtggag

SEQ ID NO: 587303 - DNA, 20 bp, Artificial
  CRISPR gRNA sequence
catctttccactggtggagg

SEQ ID NO: 587304 - DNA, 20 bp, Artificial
  CRISPR gRNA sequence
atctttccactggtggagga

SEQ ID NO: 587305 - DNA, 20 bp, Artificial
  CRISPR gRNA sequence
gggtgttgccttgatgtcga

SEQ ID NO: 587306 - DNA, 20 bp, Artificial
  CRISPR gRNA sequence
gtcgatggctactgattgat

SEQ ID NO: 587307 - DNA, 20 bp, Artificial
  CRISPR gRNA sequence
tcgatggctactgattgata

SEQ ID NO: 587308 - DNA, 20 bp, Artificial
  CRISPR gRNA sequence
tggctactgattgataaggc

SEQ ID NO: 587309 - DNA, 20 bp, Artificial
  CRISPR gRNA sequence
ctactgattgataaggctgg

SEQ ID NO: 587310 - DNA, 20 bp, Artificial
  CRISPR gRNA sequence
gataaggctggtggttgttg

SEQ ID NO: 587311 - DNA, 20 bp, Artificial
  CRISPR gRNA sequence
ataaggctggtggttgttga

SEQ ID NO: 587312 - DNA, 20 bp, Artificial
  CRISPR gRNA sequence
ggctggtggttgttgaaggc

SEQ ID NO: 587313 - DNA, 20 bp, Artificial
  CRISPR gRNA sequence
gctggtggttgttgaaggct

SEQ ID NO: 587314 - DNA, 20 bp, Artificial
  CRISPR gRNA sequence
gtggttgttgaaggctggga

SEQ ID NO: 587315 - DNA, 20 bp, Artificial
  CRISPR gRNA sequence
gttgaaggctgggatggatg

SEQ ID NO: 587316 - DNA, 20 bp, Artificial
  CRISPR gRNA sequence
atgtggcaattccttaacat

SEQ ID NO: 587317 - DNA, 20 bp, Artificial
  CRISPR gRNA sequence
tgtggcaattccttaacata

SEQ ID NO: 587318 - DNA, 20 bp, Artificial
  CRISPR gRNA sequence
cttaacataaggcaacaatg

SEQ ID NO: 587319 - DNA, 20 bp, Artificial
  CRISPR gRNA sequence
aacaatgaagtttgccacat

SEQ ID NO: 587320 - DNA, 20 bp, Artificial
  CRISPR gRNA sequence
agtcaacacttcctttcaca

SEQ ID NO: 587321 - DNA, 20 bp, Artificial
  CRISPR gRNA sequence
gtcaacacttcctttcacaa

SEQ ID NO: 587322 - DNA, 20 bp, Artificial
  CRISPR gRNA sequence
tttcacaaaggacttctctg

SEQ ID NO: 587323 - DNA, 20 bp, Artificial
  CRISPR gRNA sequence
ctatttgatacgattttacc

SEQ ID NO: 587324 - DNA, 20 bp, Artificial
  CRISPR gRNA sequence
atttgatacgattttaccca

SEQ ID NO: 587325 - DNA, 20 bp, Artificial
  CRISPR gRNA sequence
tgatacgattttacccagag

SEQ ID NO: 587326 - DNA, 20 bp, Artificial
  CRISPR gRNA sequence
agtagaatttctttcaaaat

SEQ ID NO: 587327 - DNA, 20 bp, Artificial
  CRISPR gRNA sequence
ctgctactgctttgtcaact

SEQ ID NO: 587328 - DNA, 20 bp, Artificial
  CRISPR gRNA sequence
tgtcatttcaacaatattca

SEQ ID NO: 587329 - DNA, 20 bp, Artificial
  CRISPR gRNA sequence
gtcatttcaacaatattcac

SEQ ID NO: 587330 - DNA, 20 bp, Artificial
  CRISPR gRNA sequence
aatattcacaggatctacac

SEQ ID NO: 587331 - DNA, 20 bp, Artificial
  CRISPR gRNA sequence
attcacaggatctacactag

SEQ ID NO: 587332 - DNA, 20 bp, Artificial
  CRISPR gRNA sequence
acactagaagattcgatctc

SEQ ID NO: 587333 - DNA, 20 bp, Artificial
  CRISPR gRNA sequence
ccactttctttgcccattgt

SEQ ID NO: 587334 - DNA, 20 bp, Artificial
  CRISPR gRNA sequence
ctttctttgcccattgtaag

SEQ ID NO: 587335 - DNA, 20 bp, Artificial
  CRISPR gRNA sequence
atccattcacattttataac

SEQ ID NO: 587336 - DNA, 20 bp, Artificial
  CRISPR gRNA sequence
cacattttataacgagactg

SEQ ID NO: 587337 - DNA, 20 bp, Artificial
  CRISPR gRNA sequence
ataacgagactgcagtaatt

SEQ ID NO: 587338 - DNA, 20 bp, Artificial
  CRISPR gRNA sequence
cagtaattcagtcacatctt

SEQ ID NO: 587339 - DNA, 20 bp, Artificial
  CRISPR gRNA sequence
agtaattcagtcacatcttc

SEQ ID NO: 587340 - DNA, 20 bp, Artificial
  CRISPR gRNA sequence
tcaggctccacttctaactc

SEQ ID NO: 587341 - DNA, 20 bp, Artificial
  CRISPR gRNA sequence
tgctgtttctatcacatctg

SEQ ID NO: 587342 - DNA, 20 bp, Artificial
  CRISPR gRNA sequence
tgcagttcctttatccactg

SEQ ID NO: 587343 - DNA, 20 bp, Artificial
  CRISPR gRNA sequence
tgaagtcctgaacctcctga

SEQ ID NO: 587344 - DNA, 20 bp, Artificial
  CRISPR gRNA sequence
acctcctgaaagtcatccat

SEQ ID NO: 587345 - DNA, 20 bp, Artificial
  CRISPR gRNA sequence
cctcctgaaagtcatccatg

SEQ ID NO: 587346 - DNA, 20 bp, Artificial
  CRISPR gRNA sequence
tgttaatatcttgaccttct

SEQ ID NO: 587347 - DNA, 20 bp, Artificial
  CRISPR gRNA sequence
caaatgttctcaatgacatc

SEQ ID NO: 587348 - DNA, 20 bp, Artificial
  CRISPR gRNA sequence
ctagaattctgaatcctttc

SEQ ID NO: 587349 - DNA, 20 bp, Artificial
  CRISPR gRNA sequence
gaattctgaatcctttccag

SEQ ID NO: 587350 - DNA, 20 bp, Artificial
  CRISPR gRNA sequence
aattctgaatcctttccaga

SEQ ID NO: 587351 - DNA, 20 bp, Artificial
  CRISPR gRNA sequence
aatcctttccagaaggtttt

SEQ ID NO: 587352 - DNA, 20 bp, Artificial
  CRISPR gRNA sequence
tactttgcccacatccatca

SEQ ID NO: 587353 - DNA, 20 bp, Artificial
  CRISPR gRNA sequence
atcatagaaatcactgtcta

SEQ ID NO: 587354 - DNA, 20 bp, Artificial
  CRISPR gRNA sequence
atcactgtctatggcacctc

SEQ ID NO: 587355 - DNA, 20 bp, Artificial
  CRISPR gRNA sequence
ccttataaaatgtatgtctt

SEQ ID NO: 587356 - DNA, 20 bp, Artificial
  CRISPR gRNA sequence
aaatgtatgtcttaagtaat

SEQ ID NO: 587357 - DNA, 20 bp, Artificial
  CRISPR gRNA sequence
tcttaagtaataagacttga

SEQ ID NO: 587358 - DNA, 20 bp, Artificial
  CRISPR gRNA sequence
gaaagtttaaattaaccctt

SEQ ID NO: 587359 - DNA, 20 bp, Artificial
  CRISPR gRNA sequence
tttaaattaacccttgagcg

SEQ ID NO: 587360 - DNA, 20 bp, Artificial
  CRISPR gRNA sequence
ttaaattaacccttgagcgt

SEQ ID NO: 587361 - DNA, 20 bp, Artificial
  CRISPR gRNA sequence
taacccttgagcgtgggctg

SEQ ID NO: 587362 - DNA, 20 bp, Artificial
  CRISPR gRNA sequence
aagaatatatgctgtattaa

SEQ ID NO: 587363 - DNA, 20 bp, Artificial
  CRISPR gRNA sequence
atctgcttgtacatctccat

SEQ ID NO: 587364 - DNA, 20 bp, Artificial
  CRISPR gRNA sequence
tgcttgtacatctccatcag

SEQ ID NO: 587365 - DNA, 20 bp, Artificial
  CRISPR gRNA sequence
tacatctccatcagaagttt

SEQ ID NO: 587366 - DNA, 20 bp, Artificial
  CRISPR gRNA sequence
acatctccatcagaagtttt

SEQ ID NO: 587367 - DNA, 20 bp, Artificial
  CRISPR gRNA sequence
catcagaagttttgggtgac

SEQ ID NO: 587368 - DNA, 20 bp, Artificial
  CRISPR gRNA sequence
atcagaagttttgggtgaca

SEQ ID NO: 587369 - DNA, 20 bp, Artificial
  CRISPR gRNA sequence
aatgaactgtaatattttga

SEQ ID NO: 587370 - DNA, 20 bp, Artificial
  CRISPR gRNA sequence
atgaactgtaatattttgaa

SEQ ID NO: 587371 - DNA, 20 bp, Artificial
  CRISPR gRNA sequence
tgaaaggaatttttgtttct

SEQ ID NO: 587372 - DNA, 20 bp, Artificial
  CRISPR gRNA sequence
aaggaatttttgtttctgag

SEQ ID NO: 587373 - DNA, 20 bp, Artificial
  CRISPR gRNA sequence
tctgagcagtgtctaaacaa

SEQ ID NO: 587374 - DNA, 20 bp, Artificial
  CRISPR gRNA sequence
ctgagcagtgtctaaacaat

SEQ ID NO: 587375 - DNA, 20 bp, Artificial
  CRISPR gRNA sequence
taaacaaatgtgctgtcacc

SEQ ID NO: 587376 - DNA, 20 bp, Artificial
  CRISPR gRNA sequence
agactttgctgttccattta

SEQ ID NO: 587377 - DNA, 20 bp, Artificial
  CRISPR gRNA sequence
actttgctgttccatttata

SEQ ID NO: 587378 - DNA, 20 bp, Artificial
  CRISPR gRNA sequence
gctgttccatttatagagca

SEQ ID NO: 587379 - DNA, 20 bp, Artificial
  CRISPR gRNA sequence
ctgttccatttatagagcac

SEQ ID NO: 587380 - DNA, 20 bp, Artificial
  CRISPR gRNA sequence
ttccatttatagagcacagg

SEQ ID NO: 587381 - DNA, 20 bp, Artificial
  CRISPR gRNA sequence
ccatttatagagcacaggca

SEQ ID NO: 587382 - DNA, 20 bp, Artificial
  CRISPR gRNA sequence
tttatagagcacaggcagag

SEQ ID NO: 587383 - DNA, 20 bp, Artificial
  CRISPR gRNA sequence
gagcacaggcagagtagata

SEQ ID NO: 587384 - DNA, 20 bp, Artificial
  CRISPR gRNA sequence
gtagatatagcataattctt

SEQ ID NO: 587385 - DNA, 20 bp, Artificial
  CRISPR gRNA sequence
tagatatagcataattctta

SEQ ID NO: 587386 - DNA, 20 bp, Artificial
  CRISPR gRNA sequence
agcataattcttaaggacct

SEQ ID NO: 587387 - DNA, 20 bp, Artificial
  CRISPR gRNA sequence
cttaaggaccttagaatttt

SEQ ID NO: 587388 - DNA, 20 bp, Artificial
  CRISPR gRNA sequence
ggaccttagaatttttggaa

SEQ ID NO: 587389 - DNA, 20 bp, Artificial
  CRISPR gRNA sequence
gaatttttggaatggtcaat

SEQ ID NO: 587390 - DNA, 20 bp, Artificial
  CRISPR gRNA sequence
ttggaatggtcaatgagcat

SEQ ID NO: 587391 - DNA, 20 bp, Artificial
  CRISPR gRNA sequence
tgagcattggctacaacttt

SEQ ID NO: 587392 - DNA, 20 bp, Artificial
  CRISPR gRNA sequence
tggctacaactttaagtcac

SEQ ID NO: 587393 - DNA, 20 bp, Artificial
  CRISPR gRNA sequence
accagctgcattgtcctacc

SEQ ID NO: 587394 - DNA, 20 bp, Artificial
  CRISPR gRNA sequence
cagctgcattgtcctaccaa

SEQ ID NO: 587395 - DNA, 20 bp, Artificial
  CRISPR gRNA sequence
gctgcattgtcctaccaaga

SEQ ID NO: 587396 - DNA, 20 bp, Artificial
  CRISPR gRNA sequence
cattgtcctaccaagagagt

SEQ ID NO: 587397 - DNA, 20 bp, Artificial
  CRISPR gRNA sequence
gagagtcagcctgtcctttg

SEQ ID NO: 587398 - DNA, 20 bp, Artificial
  CRISPR gRNA sequence
gtcctttgaagcttttaacc

SEQ ID NO: 587399 - DNA, 20 bp, Artificial
  CRISPR gRNA sequence
tcctttgaagcttttaaccc

SEQ ID NO: 587400 - DNA, 20 bp, Artificial
  CRISPR gRNA sequence
aggcactgacttctcctctc

SEQ ID NO: 587401 - DNA, 20 bp, Artificial
  CRISPR gRNA sequence
actgacttctcctctctaga

SEQ ID NO: 587402 - DNA, 20 bp, Artificial
  CRISPR gRNA sequence
tagatggcctcttcttctaa

SEQ ID NO: 587403 - DNA, 20 bp, Artificial
  CRISPR gRNA sequence
atggcctcttcttctaatag

SEQ ID NO: 587404 - DNA, 20 bp, Artificial
  CRISPR gRNA sequence
tggcctcttcttctaataga

SEQ ID NO: 587405 - DNA, 20 bp, Artificial
  CRISPR gRNA sequence
tcacaaccaccttcattaat

SEQ ID NO: 587406 - DNA, 20 bp, Artificial
  CRISPR gRNA sequence
accaccttcattaattagct

SEQ ID NO: 587407 - DNA, 20 bp, Artificial
  CRISPR gRNA sequence
ccttcattaattagcttagc

SEQ ID NO: 587408 - DNA, 20 bp, Artificial
  CRISPR gRNA sequence
attagcttagctagttcttc

SEQ ID NO: 587409 - DNA, 20 bp, Artificial
  CRISPR gRNA sequence
ttcttctggatgaattactg

SEQ ID NO: 587410 - DNA, 20 bp, Artificial
  CRISPR gRNA sequence
aattactgtagcctctacat

SEQ ID NO: 587411 - DNA, 20 bp, Artificial
  CRISPR gRNA sequence
caccttgcacttttatgtta

SEQ ID NO: 587412 - DNA, 20 bp, Artificial
  CRISPR gRNA sequence
ccttgcacttttatgttata

SEQ ID NO: 587413 - DNA, 20 bp, Artificial
  CRISPR gRNA sequence
gcacttttatgttatagaga

SEQ ID NO: 587414 - DNA, 20 bp, Artificial
  CRISPR gRNA sequence
cctcatgaaccaacctctgc

SEQ ID NO: 587415 - DNA, 20 bp, Artificial
  CRISPR gRNA sequence
agcttccaacttttcttctg

SEQ ID NO: 587416 - DNA, 20 bp, Artificial
  CRISPR gRNA sequence
tgcagtttcctcacatctcg

SEQ ID NO: 587417 - DNA, 20 bp, Artificial
  CRISPR gRNA sequence
tcctcacatctcgtggcctt

SEQ ID NO: 587418 - DNA, 20 bp, Artificial
  CRISPR gRNA sequence
ttcagaaaattgaatattgt

SEQ ID NO: 587419 - DNA, 20 bp, Artificial
  CRISPR gRNA sequence
tcagaaaattgaatattgtt

SEQ ID NO: 587420 - DNA, 20 bp, Artificial
  CRISPR gRNA sequence
cagaaaattgaatattgtta

SEQ ID NO: 587421 - DNA, 20 bp, Artificial
  CRISPR gRNA sequence
aatattgttagggtcttcct

SEQ ID NO: 587422 - DNA, 20 bp, Artificial
  CRISPR gRNA sequence
atattgttagggtcttcctc

SEQ ID NO: 587423 - DNA, 20 bp, Artificial
  CRISPR gRNA sequence
gttagggtcttcctcaggat

SEQ ID NO: 587424 - DNA, 20 bp, Artificial
  CRISPR gRNA sequence
ttagggtcttcctcaggatt

SEQ ID NO: 587425 - DNA, 20 bp, Artificial
  CRISPR gRNA sequence
tcaggattaggctttgattt

SEQ ID NO: 587426 - DNA, 20 bp, Artificial
  CRISPR gRNA sequence
aggattaggctttgatttaa

SEQ ID NO: 587427 - DNA, 20 bp, Artificial
  CRISPR gRNA sequence
tttgatttaagagaatgttg

SEQ ID NO: 587428 - DNA, 20 bp, Artificial
  CRISPR gRNA sequence
atttaagagaatgttgtggc

SEQ ID NO: 587429 - DNA, 20 bp, Artificial
  CRISPR gRNA sequence
ggctggtttgatcttctatc

SEQ ID NO: 587430 - DNA, 20 bp, Artificial
  CRISPR gRNA sequence
actgaaactttctccataat

SEQ ID NO: 587431 - DNA, 20 bp, Artificial
  CRISPR gRNA sequence
gaaactttctccataatcag

SEQ ID NO: 587432 - DNA, 20 bp, Artificial
  CRISPR gRNA sequence
ctttctccataatcagaagt

SEQ ID NO: 587433 - DNA, 20 bp, Artificial
  CRISPR gRNA sequence
tttctccataatcagaagta

SEQ ID NO: 587434 - DNA, 20 bp, Artificial
  CRISPR gRNA sequence
ctccataatcagaagtaagg

SEQ ID NO: 587435 - DNA, 20 bp, Artificial
  CRISPR gRNA sequence
cttatcacttgtgtgttcac

SEQ ID NO: 587436 - DNA, 20 bp, Artificial
  CRISPR gRNA sequence
tatcacttgtgtgttcactg

SEQ ID NO: 587437 - DNA, 20 bp, Artificial
  CRISPR gRNA sequence
cacttgtgtgttcactggag

SEQ ID NO: 587438 - DNA, 20 bp, Artificial
  CRISPR gRNA sequence
tttcctttgcattcacaatg

SEQ ID NO: 587439 - DNA, 20 bp, Artificial
  CRISPR gRNA sequence
gcattcacaatgtggctgtt

SEQ ID NO: 587440 - DNA, 20 bp, Artificial
  CRISPR gRNA sequence
cacaatgtggctgtttggca

SEQ ID NO: 587441 - DNA, 20 bp, Artificial
  CRISPR gRNA sequence
acaatgtggctgtttggcac

SEQ ID NO: 587442 - DNA, 20 bp, Artificial
  CRISPR gRNA sequence
aatgtggctgtttggcacag

SEQ ID NO: 587443 - DNA, 20 bp, Artificial
  CRISPR gRNA sequence
atgtggctgtttggcacagg

SEQ ID NO: 587444 - DNA, 20 bp, Artificial
  CRISPR gRNA sequence
ggcacaggaggcctatcttt

SEQ ID NO: 587445 - DNA, 20 bp, Artificial
  CRISPR gRNA sequence
gttgacataccttcctcact

SEQ ID NO: 587446 - DNA, 20 bp, Artificial
  CRISPR gRNA sequence
tcactaagcctcatcatttc

SEQ ID NO: 587447 - DNA, 20 bp, Artificial
  CRISPR gRNA sequence
catttctagcttttgattta

SEQ ID NO: 587448 - DNA, 20 bp, Artificial
  CRISPR gRNA sequence
tctagcttttgatttaaagt

SEQ ID NO: 587449 - DNA, 20 bp, Artificial
  CRISPR gRNA sequence
tgatttaaagtgagaaatgt

SEQ ID NO: 587450 - DNA, 20 bp, Artificial
  CRISPR gRNA sequence
cttcctttaacttgaacact

SEQ ID NO: 587451 - DNA, 20 bp, Artificial
  CRISPR gRNA sequence
tcctttaacttgaacactta

SEQ ID NO: 587452 - DNA, 20 bp, Artificial
  CRISPR gRNA sequence
cctttaacttgaacacttag

SEQ ID NO: 587453 - DNA, 20 bp, Artificial
  CRISPR gRNA sequence
aacacttagaggccattgta

SEQ ID NO: 587454 - DNA, 20 bp, Artificial
  CRISPR gRNA sequence
gaggccattgtacagttatt

SEQ ID NO: 587455 - DNA, 20 bp, Artificial
  CRISPR gRNA sequence
gccattgtacagttattaag

SEQ ID NO: 587456 - DNA, 20 bp, Artificial
  CRISPR gRNA sequence
gttattaagtggcctaattt

SEQ ID NO: 587457 - DNA, 20 bp, Artificial
  CRISPR gRNA sequence
atttcagtatttttgcattt

SEQ ID NO: 587458 - DNA, 20 bp, Artificial
  CRISPR gRNA sequence
tttcagtatttttgcatttc

SEQ ID NO: 587459 - DNA, 20 bp, Artificial
  CRISPR gRNA sequence
atttttgcatttcaggaata

SEQ ID NO: 587460 - DNA, 20 bp, Artificial
  CRISPR gRNA sequence
ttttgcatttcaggaatata

SEQ ID NO: 587461 - DNA, 20 bp, Artificial
  CRISPR gRNA sequence
tttgcatttcaggaatatag

SEQ ID NO: 587462 - DNA, 20 bp, Artificial
  CRISPR gRNA sequence
catttcaggaatatagaggc

SEQ ID NO: 587463 - DNA, 20 bp, Artificial
  CRISPR gRNA sequence
atttcaggaatatagaggcc

SEQ ID NO: 587464 - DNA, 20 bp, Artificial
  CRISPR gRNA sequence
caggaatatagaggccaggt

SEQ ID NO: 587465 - DNA, 20 bp, Artificial
  CRISPR gRNA sequence
aggaatatagaggccaggtg

SEQ ID NO: 587466 - DNA, 20 bp, Artificial
  CRISPR gRNA sequence
ggaatatagaggccaggtga

SEQ ID NO: 587467 - DNA, 20 bp, Artificial
  CRISPR gRNA sequence
tatagaggccaggtgaggga

SEQ ID NO: 587468 - DNA, 20 bp, Artificial
  CRISPR gRNA sequence
tagaggccaggtgagggaca

SEQ ID NO: 587469 - DNA, 20 bp, Artificial
  CRISPR gRNA sequence
agaggccaggtgagggacag

SEQ ID NO: 587470 - DNA, 20 bp, Artificial
  CRISPR gRNA sequence
gaggccaggtgagggacaga

SEQ ID NO: 587471 - DNA, 20 bp, Artificial
  CRISPR gRNA sequence
ccaggtgagggacagaggga

SEQ ID NO: 587472 - DNA, 20 bp, Artificial
  CRISPR gRNA sequence
aggtgagggacagagggaca

SEQ ID NO: 587473 - DNA, 20 bp, Artificial
  CRISPR gRNA sequence
ggacagagggacagagaaac

SEQ ID NO: 587474 - DNA, 20 bp, Artificial
  CRISPR gRNA sequence
agagggacagagaaactggc

SEQ ID NO: 587475 - DNA, 20 bp, Artificial
  CRISPR gRNA sequence
ggacagagaaactggccagt

SEQ ID NO: 587476 - DNA, 20 bp, Artificial
  CRISPR gRNA sequence
gagaaactggccagttggtg

SEQ ID NO: 587477 - DNA, 20 bp, Artificial
  CRISPR gRNA sequence
aaactggccagttggtgaag

SEQ ID NO: 587478 - DNA, 20 bp, Artificial
  CRISPR gRNA sequence
tggccagttggtgaagcagt

SEQ ID NO: 587479 - DNA, 20 bp, Artificial
  CRISPR gRNA sequence
gccagttggtgaagcagtca

SEQ ID NO: 587480 - DNA, 20 bp, Artificial
  CRISPR gRNA sequence
atttatcaacacaaaaattc

SEQ ID NO: 587481 - DNA, 20 bp, Artificial
  CRISPR gRNA sequence
acacaaaaattcaagtttgc

SEQ ID NO: 587482 - DNA, 20 bp, Artificial
  CRISPR gRNA sequence
ttcaagtttgccagcctgta

SEQ ID NO: 587483 - DNA, 20 bp, Artificial
  CRISPR gRNA sequence
tcaagtttgccagcctgtat

SEQ ID NO: 587484 - DNA, 20 bp, Artificial
  CRISPR gRNA sequence
tttgccagcctgtataggtg

SEQ ID NO: 587485 - DNA, 20 bp, Artificial
  CRISPR gRNA sequence
gcctgtataggtgtggttcg

SEQ ID NO: 587486 - DNA, 20 bp, Artificial
  CRISPR gRNA sequence
tggttcgtggtatcctaaaa

SEQ ID NO: 587487 - DNA, 20 bp, Artificial
  CRISPR gRNA sequence
aaaacagttataataataac

SEQ ID NO: 587488 - DNA, 20 bp, Artificial
  CRISPR gRNA sequence
cagttataataataacaaga

SEQ ID NO: 587489 - DNA, 20 bp, Artificial
  CRISPR gRNA sequence
aataataacaagaaagatca

SEQ ID NO: 587490 - DNA, 20 bp, Artificial
  CRISPR gRNA sequence
aaagatcacagatcacaaaa

SEQ ID NO: 587491 - DNA, 20 bp, Artificial
  CRISPR gRNA sequence
cacaaaacagacataataat

SEQ ID NO: 587492 - DNA, 20 bp, Artificial
  CRISPR gRNA sequence
gagcaaatgtgaaatattgc

SEQ ID NO: 587493 - DNA, 20 bp, Artificial
  CRISPR gRNA sequence
caagaattatttaaatgtga

SEQ ID NO: 587494 - DNA, 20 bp, Artificial
  CRISPR gRNA sequence
agaattatttaaatgtgaca

SEQ ID NO: 587495 - DNA, 20 bp, Artificial
  CRISPR gRNA sequence
aattatttaaatgtgacaga

SEQ ID NO: 587496 - DNA, 20 bp, Artificial
  CRISPR gRNA sequence
taaatgtgacagagagacat

SEQ ID NO: 587497 - DNA, 20 bp, Artificial
  CRISPR gRNA sequence
aaatgtgacagagagacatg

SEQ ID NO: 587498 - DNA, 20 bp, Artificial
  CRISPR gRNA sequence
gtgacagagagacatgaggt

SEQ ID NO: 587499 - DNA, 20 bp, Artificial
  CRISPR gRNA sequence
atgaggtgagcatgtgtcat

SEQ ID NO: 587500 - DNA, 20 bp, Artificial
  CRISPR gRNA sequence
agcatgtgtcattggaaaaa

SEQ ID NO: 587501 - DNA, 20 bp, Artificial
  CRISPR gRNA sequence
atggtatcaaccgacttgct

SEQ ID NO: 587502 - DNA, 20 bp, Artificial
  CRISPR gRNA sequence
tcaaccgacttgcttggaat

SEQ ID NO: 587503 - DNA, 20 bp, Artificial
  CRISPR gRNA sequence
caaccgacttgcttggaatt

SEQ ID NO: 587504 - DNA, 20 bp, Artificial
  CRISPR gRNA sequence
aaccgacttgcttggaatta

SEQ ID NO: 587505 - DNA, 20 bp, Artificial
  CRISPR gRNA sequence
ctttcaatttgtaaaaaacg

SEQ ID NO: 587506 - DNA, 20 bp, Artificial
  CRISPR gRNA sequence
aaaaaacgcagttatctgtg

SEQ ID NO: 587507 - DNA, 20 bp, Artificial
  CRISPR gRNA sequence
gttatctgtgaagtgcaata

SEQ ID NO: 587508 - DNA, 20 bp, Artificial
  CRISPR gRNA sequence
tctgtgaagtgcaataaagt

SEQ ID NO: 587509 - DNA, 20 bp, Artificial
  CRISPR gRNA sequence
ctgtgaagtgcaataaagta

SEQ ID NO: 587510 - DNA, 20 bp, Artificial
  CRISPR gRNA sequence
caataaagtaaggcacaata

SEQ ID NO: 587511 - DNA, 20 bp, Artificial
  CRISPR gRNA sequence
aataaagtaaggcacaataa

SEQ ID NO: 587512 - DNA, 20 bp, Artificial
  CRISPR gRNA sequence
aaagtaaggcacaataaagg

SEQ ID NO: 587513 - DNA, 20 bp, Artificial
  CRISPR gRNA sequence
catctgactttctatattac

SEQ ID NO: 587514 - DNA, 20 bp, Artificial
  CRISPR gRNA sequence
ctttctatattacaagaact

SEQ ID NO: 587515 - DNA, 20 bp, Artificial
  CRISPR gRNA sequence
tttctatattacaagaactc

SEQ ID NO: 587516 - DNA, 20 bp, Artificial
  CRISPR gRNA sequence
ttacaagaactcaggcttat

SEQ ID NO: 587517 - DNA, 20 bp, Artificial
  CRISPR gRNA sequence
aagaactcaggcttatgagt

SEQ ID NO: 587518 - DNA, 20 bp, Artificial
  CRISPR gRNA sequence
ttatgagtaagcaaataatt

SEQ ID NO: 587519 - DNA, 20 bp, Artificial
  CRISPR gRNA sequence
gagtaagcaaataatttgga

SEQ ID NO: 587520 - DNA, 20 bp, Artificial
  CRISPR gRNA sequence
caaataatttggatagcaaa

SEQ ID NO: 587521 - DNA, 20 bp, Artificial
  CRISPR gRNA sequence
agctcccaaaataatcaatt

SEQ ID NO: 587522 - DNA, 20 bp, Artificial
  CRISPR gRNA sequence
tcccaaaataatcaattcag

SEQ ID NO: 587523 - DNA, 20 bp, Artificial
  CRISPR gRNA sequence
ataatcaattcagaagcaaa

SEQ ID NO: 587524 - DNA, 20 bp, Artificial
  CRISPR gRNA sequence
aaatagcttgctctaactta

SEQ ID NO: 587525 - DNA, 20 bp, Artificial
  CRISPR gRNA sequence
acttatggaatattcatata

SEQ ID NO: 587526 - DNA, 20 bp, Artificial
  CRISPR gRNA sequence
agaatatgtatttgtatatc

SEQ ID NO: 587527 - DNA, 20 bp, Artificial
  CRISPR gRNA sequence
gtatttgtatatccagaatg

SEQ ID NO: 587528 - DNA, 20 bp, Artificial
  CRISPR gRNA sequence
ccagaatgtggtttcttact

SEQ ID NO: 587529 - DNA, 20 bp, Artificial
  CRISPR gRNA sequence
tcaaattctaaccctaatgc

SEQ ID NO: 587530 - DNA, 20 bp, Artificial
  CRISPR gRNA sequence
cctaatgccagttgtgtgtg

SEQ ID NO: 587531 - DNA, 20 bp, Artificial
  CRISPR gRNA sequence
tgccagttgtgtgtgaagcc

SEQ ID NO: 587532 - DNA, 20 bp, Artificial
  CRISPR gRNA sequence
gccagttgtgtgtgaagcct

SEQ ID NO: 587533 - DNA, 20 bp, Artificial
  CRISPR gRNA sequence
aagcctaggttacgttaaat

SEQ ID NO: 587534 - DNA, 20 bp, Artificial
  CRISPR gRNA sequence
agcctaggttacgttaaatt

SEQ ID NO: 587535 - DNA, 20 bp, Artificial
  CRISPR gRNA sequence
ggttacgttaaattaggaaa

SEQ ID NO: 587536 - DNA, 20 bp, Artificial
  CRISPR gRNA sequence
aaatagttgtacctaactca

SEQ ID NO: 587537 - DNA, 20 bp, Artificial
  CRISPR gRNA sequence
ctaactcacagcatttctgt

SEQ ID NO: 587538 - DNA, 20 bp, Artificial
  CRISPR gRNA sequence
tatattttttttaatccata

SEQ ID NO: 587539 - DNA, 20 bp, Artificial
  CRISPR gRNA sequence
ttaatccatatggaaaactc

SEQ ID NO: 587540 - DNA, 20 bp, Artificial
  CRISPR gRNA sequence
taatccatatggaaaactca

SEQ ID NO: 587541 - DNA, 20 bp, Artificial
  CRISPR gRNA sequence
acacacaataaatgatcaat

SEQ ID NO: 587542 - DNA, 20 bp, Artificial
  CRISPR gRNA sequence
cacaataaatgatcaataag

SEQ ID NO: 587543 - DNA, 20 bp, Artificial
  CRISPR gRNA sequence
aaaatctttttttttccctg

SEQ ID NO: 587544 - DNA, 20 bp, Artificial
  CRISPR gRNA sequence
atctttttttttccctgtag

SEQ ID NO: 587545 - DNA, 20 bp, Artificial
  CRISPR gRNA sequence
gtctccccttattaaaatgt

SEQ ID NO: 587546 - DNA, 20 bp, Artificial
  CRISPR gRNA sequence
attaaaatgtaagctccaca

SEQ ID NO: 587547 - DNA, 20 bp, Artificial
  CRISPR gRNA sequence
aaatgtaagctccacaaaga

SEQ ID NO: 587548 - DNA, 20 bp, Artificial
  CRISPR gRNA sequence
gctccacaaagacagtcttg

SEQ ID NO: 587549 - DNA, 20 bp, Artificial
  CRISPR gRNA sequence
tcttgcagtccacaatctca

SEQ ID NO: 587550 - DNA, 20 bp, Artificial
  CRISPR gRNA sequence
ttgcagtccacaatctcaca

SEQ ID NO: 587551 - DNA, 20 bp, Artificial
  CRISPR gRNA sequence
atctcacagagcttacattc

SEQ ID NO: 587552 - DNA, 20 bp, Artificial
  CRISPR gRNA sequence
cacagagcttacattcgagt

SEQ ID NO: 587553 - DNA, 20 bp, Artificial
  CRISPR gRNA sequence
acagagcttacattcgagtg

SEQ ID NO: 587554 - DNA, 20 bp, Artificial
  CRISPR gRNA sequence
gagcttacattcgagtgagg

SEQ ID NO: 587555 - DNA, 20 bp, Artificial
  CRISPR gRNA sequence
agcttacattcgagtgaggt

SEQ ID NO: 587556 - DNA, 20 bp, Artificial
  CRISPR gRNA sequence
tacattcgagtgaggtggga

SEQ ID NO: 587557 - DNA, 20 bp, Artificial
  CRISPR gRNA sequence
tcgagtgaggtgggatggca

SEQ ID NO: 587558 - DNA, 20 bp, Artificial
  CRISPR gRNA sequence
actaaacaccaacataacca

SEQ ID NO: 587559 - DNA, 20 bp, Artificial
  CRISPR gRNA sequence
ataaccacagattctgattc

SEQ ID NO: 587560 - DNA, 20 bp, Artificial
  CRISPR gRNA sequence
tctgattcaagctttttatt

SEQ ID NO: 587561 - DNA, 20 bp, Artificial
  CRISPR gRNA sequence
attcaagctttttattaaga

SEQ ID NO: 587562 - DNA, 20 bp, Artificial
  CRISPR gRNA sequence
tcaagctttttattaagata

SEQ ID NO: 587563 - DNA, 20 bp, Artificial
  CRISPR gRNA sequence
gctttttattaagatagaga

SEQ ID NO: 587564 - DNA, 20 bp, Artificial
  CRISPR gRNA sequence
ttaagatagagatagcaaaa

SEQ ID NO: 587565 - DNA, 20 bp, Artificial
  CRISPR gRNA sequence
agagatagcaaaatagaact

SEQ ID NO: 587566 - DNA, 20 bp, Artificial
  CRISPR gRNA sequence
gagatagcaaaatagaacta

SEQ ID NO: 587567 - DNA, 20 bp, Artificial
  CRISPR gRNA sequence
agatagcaaaatagaactaa

SEQ ID NO: 587568 - DNA, 20 bp, Artificial
  CRISPR gRNA sequence
gatagcaaaatagaactaag

SEQ ID NO: 587569 - DNA, 20 bp, Artificial
  CRISPR gRNA sequence
tagaactaaggggatgcttc

SEQ ID NO: 587570 - DNA, 20 bp, Artificial
  CRISPR gRNA sequence
aactaaggggatgcttctgg

SEQ ID NO: 587571 - DNA, 20 bp, Artificial
  CRISPR gRNA sequence
actaaggggatgcttctggt

SEQ ID NO: 587572 - DNA, 20 bp, Artificial
  CRISPR gRNA sequence
tgcttctggtaggttgctta

SEQ ID NO: 587573 - DNA, 20 bp, Artificial
  CRISPR gRNA sequence
tatggatgccactattttca

SEQ ID NO: 587574 - DNA, 20 bp, Artificial
  CRISPR gRNA sequence
tggatgccactattttcaaa

SEQ ID NO: 587575 - DNA, 20 bp, Artificial
  CRISPR gRNA sequence
acatttaaactaacatctga

SEQ ID NO: 587576 - DNA, 20 bp, Artificial
  CRISPR gRNA sequence
actaacatctgaaagataat

SEQ ID NO: 587577 - DNA, 20 bp, Artificial
  CRISPR gRNA sequence
ctaacatctgaaagataata

SEQ ID NO: 587578 - DNA, 20 bp, Artificial
  CRISPR gRNA sequence
gataataaggcaactatgcc

SEQ ID NO: 587579 - DNA, 20 bp, Artificial
  CRISPR gRNA sequence
aggcaactatgccaagatct

SEQ ID NO: 587580 - DNA, 20 bp, Artificial
  CRISPR gRNA sequence
ggcaactatgccaagatctt

SEQ ID NO: 587581 - DNA, 20 bp, Artificial
  CRISPR gRNA sequence
aagatcttgggaaaacgctg

SEQ ID NO: 587582 - DNA, 20 bp, Artificial
  CRISPR gRNA sequence
agatcttgggaaaacgctga

SEQ ID NO: 587583 - DNA, 20 bp, Artificial
  CRISPR gRNA sequence
acgctgaaggtgttgacttc

SEQ ID NO: 587584 - DNA, 20 bp, Artificial
  CRISPR gRNA sequence
cgctgaaggtgttgacttct

SEQ ID NO: 587585 - DNA, 20 bp, Artificial
  CRISPR gRNA sequence
tgacttctaggatcatccat

SEQ ID NO: 587586 - DNA, 20 bp, Artificial
  CRISPR gRNA sequence
atcatccattagttcaaaaa

SEQ ID NO: 587587 - DNA, 20 bp, Artificial
  CRISPR gRNA sequence
atccattagttcaaaaacag

SEQ ID NO: 587588 - DNA, 20 bp, Artificial
  CRISPR gRNA sequence
tccattagttcaaaaacagt

SEQ ID NO: 587589 - DNA, 20 bp, Artificial
  CRISPR gRNA sequence
ttagttcaaaaacagtagga

SEQ ID NO: 587590 - DNA, 20 bp, Artificial
  CRISPR gRNA sequence
aaaaacagtaggaaagaata

SEQ ID NO: 587591 - DNA, 20 bp, Artificial
  CRISPR gRNA sequence
aggaaagaataaagaaacct

SEQ ID NO: 587592 - DNA, 20 bp, Artificial
  CRISPR gRNA sequence
ggaaagaataaagaaacctc

SEQ ID NO: 587593 - DNA, 20 bp, Artificial
  CRISPR gRNA sequence
taaagaaacctcgggttgca

SEQ ID NO: 587594 - DNA, 20 bp, Artificial
  CRISPR gRNA sequence
acctcgggttgcaaagaacc

SEQ ID NO: 587595 - DNA, 20 bp, Artificial
  CRISPR gRNA sequence
ctcgggttgcaaagaaccca

SEQ ID NO: 587596 - DNA, 20 bp, Artificial
  CRISPR gRNA sequence
ggttgcaaagaacccagagt

SEQ ID NO: 587597 - DNA, 20 bp, Artificial
  CRISPR gRNA sequence
gttgcaaagaacccagagtg

SEQ ID NO: 587598 - DNA, 20 bp, Artificial
  CRISPR gRNA sequence
agaacccagagtgaggcgta

SEQ ID NO: 587599 - DNA, 20 bp, Artificial
  CRISPR gRNA sequence
acccagagtgaggcgtaaag

SEQ ID NO: 587600 - DNA, 20 bp, Artificial
  CRISPR gRNA sequence
cagagtgaggcgtaaagtag

SEQ ID NO: 587601 - DNA, 20 bp, Artificial
  CRISPR gRNA sequence
agtgaggcgtaaagtagtag

SEQ ID NO: 587602 - DNA, 20 bp, Artificial
  CRISPR gRNA sequence
ggcgtaaagtagtagaagat

SEQ ID NO: 587603 - DNA, 20 bp, Artificial
  CRISPR gRNA sequence
taaagtagtagaagatcaga

SEQ ID NO: 587604 - DNA, 20 bp, Artificial
  CRISPR gRNA sequence
agtagtagaagatcagacag

SEQ ID NO: 587605 - DNA, 20 bp, Artificial
  CRISPR gRNA sequence
agtagaagatcagacagtag

SEQ ID NO: 587606 - DNA, 20 bp, Artificial
  CRISPR gRNA sequence
agaagatcagacagtagaag

SEQ ID NO: 587607 - DNA, 20 bp, Artificial
  CRISPR gRNA sequence
gaagatcagacagtagaagt

SEQ ID NO: 587608 - DNA, 20 bp, Artificial
  CRISPR gRNA sequence
gatcagacagtagaagtggg

SEQ ID NO: 587609 - DNA, 20 bp, Artificial
  CRISPR gRNA sequence
gaagtgggcagaaccaccaa

SEQ ID NO: 587610 - DNA, 20 bp, Artificial
  CRISPR gRNA sequence
gaaccaccaatggccatgat

SEQ ID NO: 587611 - DNA, 20 bp, Artificial
  CRISPR gRNA sequence
ccaccaatggccatgattag

SEQ ID NO: 587612 - DNA, 20 bp, Artificial
  CRISPR gRNA sequence
gtagtttgattttattataa

SEQ ID NO: 587613 - DNA, 20 bp, Artificial
  CRISPR gRNA sequence
tgattttattataaaagcaa

SEQ ID NO: 587614 - DNA, 20 bp, Artificial
  CRISPR gRNA sequence
gaaaaccattaaaatatttt

SEQ ID NO: 587615 - DNA, 20 bp, Artificial
  CRISPR gRNA sequence
aaccattaaaatattttaag

SEQ ID NO: 587616 - DNA, 20 bp, Artificial
  CRISPR gRNA sequence
ccattaaaatattttaagaa

SEQ ID NO: 587617 - DNA, 20 bp, Artificial
  CRISPR gRNA sequence
cattaaaatattttaagaag

SEQ ID NO: 587618 - DNA, 20 bp, Artificial
  CRISPR gRNA sequence
ttaaaatattttaagaagag

SEQ ID NO: 587619 - DNA, 20 bp, Artificial
  CRISPR gRNA sequence
ttttaagaagaggagtgaca

SEQ ID NO: 587620 - DNA, 20 bp, Artificial
  CRISPR gRNA sequence
aggagtgacatggtttaaat

SEQ ID NO: 587621 - DNA, 20 bp, Artificial
  CRISPR gRNA sequence
atggtttaaatcagatttta

SEQ ID NO: 587622 - DNA, 20 bp, Artificial
  CRISPR gRNA sequence
cagattttaaagtaacattc

SEQ ID NO: 587623 - DNA, 20 bp, Artificial
  CRISPR gRNA sequence
gtaacattctggttgctatc

SEQ ID NO: 587624 - DNA, 20 bp, Artificial
  CRISPR gRNA sequence
aacattctggttgctatctg

SEQ ID NO: 587625 - DNA, 20 bp, Artificial
  CRISPR gRNA sequence
tctggttgctatctggagaa

SEQ ID NO: 587626 - DNA, 20 bp, Artificial
  CRISPR gRNA sequence
ttgctatctggagaatagat

SEQ ID NO: 587627 - DNA, 20 bp, Artificial
  CRISPR gRNA sequence
tgctatctggagaatagatt

SEQ ID NO: 587628 - DNA, 20 bp, Artificial
  CRISPR gRNA sequence
tatctggagaatagattggg

SEQ ID NO: 587629 - DNA, 20 bp, Artificial
  CRISPR gRNA sequence
ctggagaatagattgggaag

SEQ ID NO: 587630 - DNA, 20 bp, Artificial
  CRISPR gRNA sequence
tggagaatagattgggaagc

SEQ ID NO: 587631 - DNA, 20 bp, Artificial
  CRISPR gRNA sequence
gagaatagattgggaagcag

SEQ ID NO: 587632 - DNA, 20 bp, Artificial
  CRISPR gRNA sequence
tagattgggaagcaggagta

SEQ ID NO: 587633 - DNA, 20 bp, Artificial
  CRISPR gRNA sequence
attgggaagcaggagtatag

SEQ ID NO: 587634 - DNA, 20 bp, Artificial
  CRISPR gRNA sequence
gaagcaggagtatagtggct

SEQ ID NO: 587635 - DNA, 20 bp, Artificial
  CRISPR gRNA sequence
agcaggagtatagtggctga

SEQ ID NO: 587636 - DNA, 20 bp, Artificial
  CRISPR gRNA sequence
aggagtatagtggctgagag

SEQ ID NO: 587637 - DNA, 20 bp, Artificial
  CRISPR gRNA sequence
gagtatagtggctgagagca

SEQ ID NO: 587638 - DNA, 20 bp, Artificial
  CRISPR gRNA sequence
gtggctgagagcagagaccc

SEQ ID NO: 587639 - DNA, 20 bp, Artificial
  CRISPR gRNA sequence
gagagcagagaccctagatt

SEQ ID NO: 587640 - DNA, 20 bp, Artificial
  CRISPR gRNA sequence
gcagagaccctagattcaga

SEQ ID NO: 587641 - DNA, 20 bp, Artificial
  CRISPR gRNA sequence
gaccctagattcagacagac

SEQ ID NO: 587642 - DNA, 20 bp, Artificial
  CRISPR gRNA sequence
ccctagattcagacagacca

SEQ ID NO: 587643 - DNA, 20 bp, Artificial
  CRISPR gRNA sequence
acagaccagagcttatatct

SEQ ID NO: 587644 - DNA, 20 bp, Artificial
  CRISPR gRNA sequence
gcttatatctcagctttcat

SEQ ID NO: 587645 - DNA, 20 bp, Artificial
  CRISPR gRNA sequence
ctcagctttcatgagtatat

SEQ ID NO: 587646 - DNA, 20 bp, Artificial
  CRISPR gRNA sequence
agctttcatgagtatattgg

SEQ ID NO: 587647 - DNA, 20 bp, Artificial
  CRISPR gRNA sequence
ttcatgagtatattggaagt

SEQ ID NO: 587648 - DNA, 20 bp, Artificial
  CRISPR gRNA sequence
ttggataaaatgtaaacata

SEQ ID NO: 587649 - DNA, 20 bp, Artificial
  CRISPR gRNA sequence
aatgtaaacatatagttatc

SEQ ID NO: 587650 - DNA, 20 bp, Artificial
  CRISPR gRNA sequence
atgtaaacatatagttatca

SEQ ID NO: 587651 - DNA, 20 bp, Artificial
  CRISPR gRNA sequence
tatgattttttttgctatat

SEQ ID NO: 587652 - DNA, 20 bp, Artificial
  CRISPR gRNA sequence
atatcagatcataattttta

SEQ ID NO: 587653 - DNA, 20 bp, Artificial
  CRISPR gRNA sequence
aatataatttatactattgt

SEQ ID NO: 587654 - DNA, 20 bp, Artificial
  CRISPR gRNA sequence
tgttagatttattttgttct

SEQ ID NO: 587655 - DNA, 20 bp, Artificial
  CRISPR gRNA sequence
ctaagctgctatatgtcttc

SEQ ID NO: 587656 - DNA, 20 bp, Artificial
  CRISPR gRNA sequence
tatgtcttcaagcctcatga

SEQ ID NO: 587657 - DNA, 20 bp, Artificial
  CRISPR gRNA sequence
catgatagatttttgtttat

SEQ ID NO: 587658 - DNA, 20 bp, Artificial
  CRISPR gRNA sequence
tgatagatttttgtttataa

SEQ ID NO: 587659 - DNA, 20 bp, Artificial
  CRISPR gRNA sequence
attcttgttttattgtgctg

SEQ ID NO: 587660 - DNA, 20 bp, Artificial
  CRISPR gRNA sequence
ttcttgttttattgtgctgt

SEQ ID NO: 587661 - DNA, 20 bp, Artificial
  CRISPR gRNA sequence
aatacattgttgccaaacca

SEQ ID NO: 587662 - DNA, 20 bp, Artificial
  CRISPR gRNA sequence
tgccaaaccatggaaaataa

SEQ ID NO: 587663 - DNA, 20 bp, Artificial
  CRISPR gRNA sequence
atggaaaataaaagaaaaat

SEQ ID NO: 587664 - DNA, 20 bp, Artificial
  CRISPR gRNA sequence
tggaaaataaaagaaaaata

SEQ ID NO: 587665 - DNA, 20 bp, Artificial
  CRISPR gRNA sequence
ataaaagaaaaataaggtga

SEQ ID NO: 587666 - DNA, 20 bp, Artificial
  CRISPR gRNA sequence
ggtgaaagtataatctgtat

SEQ ID NO: 587667 - DNA, 20 bp, Artificial
  CRISPR gRNA sequence
aagtataatctgtataagct

SEQ ID NO: 587668 - DNA, 20 bp, Artificial
  CRISPR gRNA sequence
agtataatctgtataagctg

SEQ ID NO: 587669 - DNA, 20 bp, Artificial
  CRISPR gRNA sequence
tataatctgtataagctgag

SEQ ID NO: 587670 - DNA, 20 bp, Artificial
  CRISPR gRNA sequence
ataatctgtataagctgagg

SEQ ID NO: 587671 - DNA, 20 bp, Artificial
  CRISPR gRNA sequence
aatatgtaaaatgactgcgt

SEQ ID NO: 587672 - DNA, 20 bp, Artificial
  CRISPR gRNA sequence
atatgtaaaatgactgcgtg

SEQ ID NO: 587673 - DNA, 20 bp, Artificial
  CRISPR gRNA sequence
aaatgactgcgtgaggacat

SEQ ID NO: 587674 - DNA, 20 bp, Artificial
  CRISPR gRNA sequence
aatgactgcgtgaggacatt

SEQ ID NO: 587675 - DNA, 20 bp, Artificial
  CRISPR gRNA sequence
actctacttatctgcaaaat

SEQ ID NO: 587676 - DNA, 20 bp, Artificial
  CRISPR gRNA sequence
ctctacttatctgcaaaata

SEQ ID NO: 587677 - DNA, 20 bp, Artificial
  CRISPR gRNA sequence
cataatgcttgtcacaaaat

SEQ ID NO: 587678 - DNA, 20 bp, Artificial
  CRISPR gRNA sequence
ataatttttaatttttgtaa

SEQ ID NO: 587679 - DNA, 20 bp, Artificial
  CRISPR gRNA sequence
gactaatacttatcatgtac

SEQ ID NO: 587680 - DNA, 20 bp, Artificial
  CRISPR gRNA sequence
actaatacttatcatgtact

SEQ ID NO: 587681 - DNA, 20 bp, Artificial
  CRISPR gRNA sequence
atgaatctttaaaacctttc

SEQ ID NO: 587682 - DNA, 20 bp, Artificial
  CRISPR gRNA sequence
aaaacctttctagttaatat

SEQ ID NO: 587683 - DNA, 20 bp, Artificial
  CRISPR gRNA sequence
attaattcattcaatcaata

SEQ ID NO: 587684 - DNA, 20 bp, Artificial
  CRISPR gRNA sequence
attcaatcaatatggtatat

SEQ ID NO: 587685 - DNA, 20 bp, Artificial
  CRISPR gRNA sequence
ttcaatcaatatggtatata

SEQ ID NO: 587686 - DNA, 20 bp, Artificial
  CRISPR gRNA sequence
tcaatcaatatggtatataa

SEQ ID NO: 587687 - DNA, 20 bp, Artificial
  CRISPR gRNA sequence
aatatggtatataagggatg

SEQ ID NO: 587688 - DNA, 20 bp, Artificial
  CRISPR gRNA sequence
agatgcaaaatctcttcttt

SEQ ID NO: 587689 - DNA, 20 bp, Artificial
  CRISPR gRNA sequence
aaatctcttctttgagatgc

SEQ ID NO: 587690 - DNA, 20 bp, Artificial
  CRISPR gRNA sequence
cttctttgagatgctggatc

SEQ ID NO: 587691 - DNA, 20 bp, Artificial
  CRISPR gRNA sequence
ttctttgagatgctggatct

SEQ ID NO: 587692 - DNA, 20 bp, Artificial
  CRISPR gRNA sequence
taggaccttttattcttatc

SEQ ID NO: 587693 - DNA, 20 bp, Artificial
  CRISPR gRNA sequence
catatttctatacaatttaa

SEQ ID NO: 587694 - DNA, 20 bp, Artificial
  CRISPR gRNA sequence
atatttctatacaatttaaa

SEQ ID NO: 587695 - DNA, 20 bp, Artificial
  CRISPR gRNA sequence
ttaaaaggactccactctga

SEQ ID NO: 587696 - DNA, 20 bp, Artificial
  CRISPR gRNA sequence
tgcttatgatgaatgatact

SEQ ID NO: 587697 - DNA, 20 bp, Artificial
  CRISPR gRNA sequence
tgtctgattttctaccattt

SEQ ID NO: 587698 - DNA, 20 bp, Artificial
  CRISPR gRNA sequence
tctgattttctaccatttga

SEQ ID NO: 587699 - DNA, 20 bp, Artificial
  CRISPR gRNA sequence
accatttgagagttttctta

SEQ ID NO: 587700 - DNA, 20 bp, Artificial
  CRISPR gRNA sequence
gagagttttcttacagtatt

SEQ ID NO: 587701 - DNA, 20 bp, Artificial
  CRISPR gRNA sequence
gttttcttacagtatttggc

SEQ ID NO: 587702 - DNA, 20 bp, Artificial
  CRISPR gRNA sequence
tcttacagtatttggcaaga

SEQ ID NO: 587703 - DNA, 20 bp, Artificial
  CRISPR gRNA sequence
cagtatttggcaagatagta

SEQ ID NO: 587704 - DNA, 20 bp, Artificial
  CRISPR gRNA sequence
agtatttggcaagatagtat

SEQ ID NO: 587705 - DNA, 20 bp, Artificial
  CRISPR gRNA sequence
tggcaagatagtataggctg

SEQ ID NO: 587706 - DNA, 20 bp, Artificial
  CRISPR gRNA sequence
tagtataggctgtggatgaa

SEQ ID NO: 587707 - DNA, 20 bp, Artificial
  CRISPR gRNA sequence
agtataggctgtggatgaac

SEQ ID NO: 587708 - DNA, 20 bp, Artificial
  CRISPR gRNA sequence
gtttctttgactcacataca

SEQ ID NO: 587709 - DNA, 20 bp, Artificial
  CRISPR gRNA sequence
ttgactcacatacacagatc

SEQ ID NO: 587710 - DNA, 20 bp, Artificial
  CRISPR gRNA sequence
actcacatacacagatcaag

SEQ ID NO: 587711 - DNA, 20 bp, Artificial
  CRISPR gRNA sequence
ctcacatacacagatcaagt

SEQ ID NO: 587712 - DNA, 20 bp, Artificial
  CRISPR gRNA sequence
gatcaagtaggaaaaattga

SEQ ID NO: 587713 - DNA, 20 bp, Artificial
  CRISPR gRNA sequence
gtaggaaaaattgaaagaaa

SEQ ID NO: 587714 - DNA, 20 bp, Artificial
  CRISPR gRNA sequence
aaaaattgaaagaaatggta

SEQ ID NO: 587715 - DNA, 20 bp, Artificial
  CRISPR gRNA sequence
aaaattgaaagaaatggtaa

SEQ ID NO: 587716 - DNA, 20 bp, Artificial
  CRISPR gRNA sequence
ttgaaagaaatggtaaaggt

SEQ ID NO: 587717 - DNA, 20 bp, Artificial
  CRISPR gRNA sequence
tgaaagaaatggtaaaggtt

SEQ ID NO: 587718 - DNA, 20 bp, Artificial
  CRISPR gRNA sequence
agaaatggtaaaggttaggt

SEQ ID NO: 587719 - DNA, 20 bp, Artificial
  CRISPR gRNA sequence
caccacacacacacacacac

SEQ ID NO: 587720 - DNA, 20 bp, Artificial
  CRISPR gRNA sequence
acacacacacacacaagtcc

SEQ ID NO: 587721 - DNA, 20 bp, Artificial
  CRISPR gRNA sequence
cccagtgtgtcatgcccttc

SEQ ID NO: 587722 - DNA, 20 bp, Artificial
  CRISPR gRNA sequence
tgtcatgcccttctggatac

SEQ ID NO: 587723 - DNA, 20 bp, Artificial
  CRISPR gRNA sequence
gtcatgcccttctggatact

SEQ ID NO: 587724 - DNA, 20 bp, Artificial
  CRISPR gRNA sequence
tgcccttctggatactaggt

SEQ ID NO: 587725 - DNA, 20 bp, Artificial
  CRISPR gRNA sequence
tggatactaggtgagtaata

SEQ ID NO: 587726 - DNA, 20 bp, Artificial
  CRISPR gRNA sequence
tgagtaataaagtttgcgtg

SEQ ID NO: 587727 - DNA, 20 bp, Artificial
  CRISPR gRNA sequence
cagcctctccacttctgttg

SEQ ID NO: 587728 - DNA, 20 bp, Artificial
  CRISPR gRNA sequence
gcctctccacttctgttgtg

SEQ ID NO: 587729 - DNA, 20 bp, Artificial
  CRISPR gRNA sequence
ttgtggagttccaaacatgc

SEQ ID NO: 587730 - DNA, 20 bp, Artificial
  CRISPR gRNA sequence
tgtggagttccaaacatgcc

SEQ ID NO: 587731 - DNA, 20 bp, Artificial
  CRISPR gRNA sequence
ttccaaacatgccaggcctg

SEQ ID NO: 587732 - DNA, 20 bp, Artificial
  CRISPR gRNA sequence
atgccaggcctgcagactca

SEQ ID NO: 587733 - DNA, 20 bp, Artificial
  CRISPR gRNA sequence
aggcctgcagactcatggtg

SEQ ID NO: 587734 - DNA, 20 bp, Artificial
  CRISPR gRNA sequence
cctgcagactcatggtgtgg

SEQ ID NO: 587735 - DNA, 20 bp, Artificial
  CRISPR gRNA sequence
ctgcagactcatggtgtgga

SEQ ID NO: 587736 - DNA, 20 bp, Artificial
  CRISPR gRNA sequence
tgcagactcatggtgtggaa

SEQ ID NO: 587737 - DNA, 20 bp, Artificial
  CRISPR gRNA sequence
gtggaagggaaaatgtgaaa

SEQ ID NO: 587738 - DNA, 20 bp, Artificial
  CRISPR gRNA sequence
gggaaaatgtgaaatggcca

SEQ ID NO: 587739 - DNA, 20 bp, Artificial
  CRISPR gRNA sequence
aatgtgaaatggccaaagtt

SEQ ID NO: 587740 - DNA, 20 bp, Artificial
  CRISPR gRNA sequence
ctgtccacactaaatccatg

SEQ ID NO: 587741 - DNA, 20 bp, Artificial
  CRISPR gRNA sequence
tgtccacactaaatccatgc

SEQ ID NO: 587742 - DNA, 20 bp, Artificial
  CRISPR gRNA sequence
gtccacactaaatccatgca

SEQ ID NO: 587743 - DNA, 20 bp, Artificial
  CRISPR gRNA sequence
ccatgcagggtacaaaactg

SEQ ID NO: 587744 - DNA, 20 bp, Artificial
  CRISPR gRNA sequence
tgcagggtacaaaactgtgg

SEQ ID NO: 587745 - DNA, 20 bp, Artificial
  CRISPR gRNA sequence
gggtacaaaactgtggtagc

SEQ ID NO: 587746 - DNA, 20 bp, Artificial
  CRISPR gRNA sequence
aaaactgtggtagcaagctt

SEQ ID NO: 587747 - DNA, 20 bp, Artificial
  CRISPR gRNA sequence
gtggtagcaagctttggaat

SEQ ID NO: 587748 - DNA, 20 bp, Artificial
  CRISPR gRNA sequence
tggtagcaagctttggaatg

SEQ ID NO: 587749 - DNA, 20 bp, Artificial
  CRISPR gRNA sequence
agcaagctttggaatgagga

SEQ ID NO: 587750 - DNA, 20 bp, Artificial
  CRISPR gRNA sequence
gctttggaatgaggacagtg

SEQ ID NO: 587751 - DNA, 20 bp, Artificial
  CRISPR gRNA sequence
tgaggacagtgtagattatt

SEQ ID NO: 587752 - DNA, 20 bp, Artificial
  CRISPR gRNA sequence
tgtagattattcagaacaat

SEQ ID NO: 587753 - DNA, 20 bp, Artificial
  CRISPR gRNA sequence
gattattcagaacaatgaga

SEQ ID NO: 587754 - DNA, 20 bp, Artificial
  CRISPR gRNA sequence
tattcagaacaatgagaaag

SEQ ID NO: 587755 - DNA, 20 bp, Artificial
  CRISPR gRNA sequence
agaacaatgagaaagcagct

SEQ ID NO: 587756 - DNA, 20 bp, Artificial
  CRISPR gRNA sequence
aagaatcttgtccatttctt

SEQ ID NO: 587757 - DNA, 20 bp, Artificial
  CRISPR gRNA sequence
ctttagaactcctgataata

SEQ ID NO: 587758 - DNA, 20 bp, Artificial
  CRISPR gRNA sequence
tttagaactcctgataataa

SEQ ID NO: 587759 - DNA, 20 bp, Artificial
  CRISPR gRNA sequence
tagaactcctgataataaag

SEQ ID NO: 587760 - DNA, 20 bp, Artificial
  CRISPR gRNA sequence
agaactcctgataataaagg

SEQ ID NO: 587761 - DNA, 20 bp, Artificial
  CRISPR gRNA sequence
actcctgataataaaggagg

SEQ ID NO: 587762 - DNA, 20 bp, Artificial
  CRISPR gRNA sequence
ctcctgataataaaggagga

SEQ ID NO: 587763 - DNA, 20 bp, Artificial
  CRISPR gRNA sequence
tgataataaaggaggaagga

SEQ ID NO: 587764 - DNA, 20 bp, Artificial
  CRISPR gRNA sequence
cttctaaatgacttgcacca

SEQ ID NO: 587765 - DNA, 20 bp, Artificial
  CRISPR gRNA sequence
atgacttgcaccaaagtgaa

SEQ ID NO: 587766 - DNA, 20 bp, Artificial
  CRISPR gRNA sequence
gacttgcaccaaagtgaaaa

SEQ ID NO: 587767 - DNA, 20 bp, Artificial
  CRISPR gRNA sequence
ccaaagtgaaaagagctgca

SEQ ID NO: 587768 - DNA, 20 bp, Artificial
  CRISPR gRNA sequence
agagctgcatagaattataa

SEQ ID NO: 587769 - DNA, 20 bp, Artificial
  CRISPR gRNA sequence
ctgcatagaattataaaaga

SEQ ID NO: 587770 - DNA, 20 bp, Artificial
  CRISPR gRNA sequence
tgcatagaattataaaagaa

SEQ ID NO: 587771 - DNA, 20 bp, Artificial
  CRISPR gRNA sequence
aaaggcttattaattccttc

SEQ ID NO: 587772 - DNA, 20 bp, Artificial
  CRISPR gRNA sequence
ttattaattccttctagaaa

SEQ ID NO: 587773 - DNA, 20 bp, Artificial
  CRISPR gRNA sequence
tattaattccttctagaaat

SEQ ID NO: 587774 - DNA, 20 bp, Artificial
  CRISPR gRNA sequence
attaattccttctagaaata

SEQ ID NO: 587775 - DNA, 20 bp, Artificial
  CRISPR gRNA sequence
cttctagaaatagggtctga

SEQ ID NO: 587776 - DNA, 20 bp, Artificial
  CRISPR gRNA sequence
ctagaaatagggtctgaaag

SEQ ID NO: 587777 - DNA, 20 bp, Artificial
  CRISPR gRNA sequence
atgactactacaattcataa

SEQ ID NO: 587778 - DNA, 20 bp, Artificial
  CRISPR gRNA sequence
gtgattgtatatgctattaa

SEQ ID NO: 587779 - DNA, 20 bp, Artificial
  CRISPR gRNA sequence
aaagttttactttcttttat

SEQ ID NO: 587780 - DNA, 20 bp, Artificial
  CRISPR gRNA sequence
ttttattagaaacaataacg

SEQ ID NO: 587781 - DNA, 20 bp, Artificial
  CRISPR gRNA sequence
ttattagaaacaataacgaa

SEQ ID NO: 587782 - DNA, 20 bp, Artificial
  CRISPR gRNA sequence
ttagaaacaataacgaagag

SEQ ID NO: 587783 - DNA, 20 bp, Artificial
  CRISPR gRNA sequence
aacgaagagtagatacataa

SEQ ID NO: 587784 - DNA, 20 bp, Artificial
  CRISPR gRNA sequence
agtagatacataatggttat

SEQ ID NO: 587785 - DNA, 20 bp, Artificial
  CRISPR gRNA sequence
atacataatggttattggtc

SEQ ID NO: 587786 - DNA, 20 bp, Artificial
  CRISPR gRNA sequence
tacataatggttattggtct

SEQ ID NO: 587787 - DNA, 20 bp, Artificial
  CRISPR gRNA sequence
acataatggttattggtctg

SEQ ID NO: 587788 - DNA, 20 bp, Artificial
  CRISPR gRNA sequence
taatggttattggtctgggg

SEQ ID NO: 587789 - DNA, 20 bp, Artificial
  CRISPR gRNA sequence
aatggttattggtctggggt

SEQ ID NO: 587790 - DNA, 20 bp, Artificial
  CRISPR gRNA sequence
atggttattggtctggggta

SEQ ID NO: 587791 - DNA, 20 bp, Artificial
  CRISPR gRNA sequence
tggttattggtctggggtag

SEQ ID NO: 587792 - DNA, 20 bp, Artificial
  CRISPR gRNA sequence
ggttattggtctggggtagg

SEQ ID NO: 587793 - DNA, 20 bp, Artificial
  CRISPR gRNA sequence
attggtctggggtaggggga

SEQ ID NO: 587794 - DNA, 20 bp, Artificial
  CRISPR gRNA sequence
tggtctggggtagggggaaa

SEQ ID NO: 587795 - DNA, 20 bp, Artificial
  CRISPR gRNA sequence
ggtctggggtagggggaaag

SEQ ID NO: 587796 - DNA, 20 bp, Artificial
  CRISPR gRNA sequence
ggggaaagaggcgttctacc

SEQ ID NO: 587797 - DNA, 20 bp, Artificial
  CRISPR gRNA sequence
gaaagaggcgttctacctgg

SEQ ID NO: 587798 - DNA, 20 bp, Artificial
  CRISPR gRNA sequence
tctacctggtggaaatcaaa

SEQ ID NO: 587799 - DNA, 20 bp, Artificial
  CRISPR gRNA sequence
ctacctggtggaaatcaaat

SEQ ID NO: 587800 - DNA, 20 bp, Artificial
  CRISPR gRNA sequence
aaatcaaatgggctgtctta

SEQ ID NO: 587801 - DNA, 20 bp, Artificial
  CRISPR gRNA sequence
caaatgggctgtcttacagc

SEQ ID NO: 587802 - DNA, 20 bp, Artificial
  CRISPR gRNA sequence
cttacagccggcctgactga

SEQ ID NO: 587803 - DNA, 20 bp, Artificial
  CRISPR gRNA sequence
acagccggcctgactgaaag

SEQ ID NO: 587804 - DNA, 20 bp, Artificial
  CRISPR gRNA sequence
tgaaagtggcttttaccttc

SEQ ID NO: 587805 - DNA, 20 bp, Artificial
  CRISPR gRNA sequence
gaaagtggcttttaccttct

SEQ ID NO: 587806 - DNA, 20 bp, Artificial
  CRISPR gRNA sequence
ccttctaggtaaatttcaat

SEQ ID NO: 587807 - DNA, 20 bp, Artificial
  CRISPR gRNA sequence
tctaggtaaatttcaatgag

SEQ ID NO: 587808 - DNA, 20 bp, Artificial
  CRISPR gRNA sequence
ctaggtaaatttcaatgagt

SEQ ID NO: 587809 - DNA, 20 bp, Artificial
  CRISPR gRNA sequence
atttcaatgagtaggacctc

SEQ ID NO: 587810 - DNA, 20 bp, Artificial
  CRISPR gRNA sequence
ggacctcaagtgtgtgtttt

SEQ ID NO: 587811 - DNA, 20 bp, Artificial
  CRISPR gRNA sequence
acctcaagtgtgtgttttaa

SEQ ID NO: 587812 - DNA, 20 bp, Artificial
  CRISPR gRNA sequence
aagtgtgtgttttaagagtc

SEQ ID NO: 587813 - DNA, 20 bp, Artificial
  CRISPR gRNA sequence
ttaatcccatctcctttctt

SEQ ID NO: 587814 - DNA, 20 bp, Artificial
  CRISPR gRNA sequence
tttcttcagtgtttattgca

SEQ ID NO: 587815 - DNA, 20 bp, Artificial
  CRISPR gRNA sequence
agtgtttattgcaaagcata

SEQ ID NO: 587816 - DNA, 20 bp, Artificial
  CRISPR gRNA sequence
tttattgcaaagcatacagt

SEQ ID NO: 587817 - DNA, 20 bp, Artificial
  CRISPR gRNA sequence
ttattgcaaagcatacagtg

SEQ ID NO: 587818 - DNA, 20 bp, Artificial
  CRISPR gRNA sequence
aagcatacagtgaggcacca

SEQ ID NO: 587819 - DNA, 20 bp, Artificial
  CRISPR gRNA sequence
agcatacagtgaggcaccaa

SEQ ID NO: 587820 - DNA, 20 bp, Artificial
  CRISPR gRNA sequence
cagtgaggcaccaaaggcat

SEQ ID NO: 587821 - DNA, 20 bp, Artificial
  CRISPR gRNA sequence
ggcaccaaaggcatcagtat

SEQ ID NO: 587822 - DNA, 20 bp, Artificial
  CRISPR gRNA sequence
gcatcagtatcagaatttga

SEQ ID NO: 587823 - DNA, 20 bp, Artificial
  CRISPR gRNA sequence
cagaatttgatggatgaaat

SEQ ID NO: 587824 - DNA, 20 bp, Artificial
  CRISPR gRNA sequence
tttgatggatgaaatcagca

SEQ ID NO: 587825 - DNA, 20 bp, Artificial
  CRISPR gRNA sequence
tggatgaaatcagcacagca

SEQ ID NO: 587826 - DNA, 20 bp, Artificial
  CRISPR gRNA sequence
gacactgcttgtgtaattat

SEQ ID NO: 587827 - DNA, 20 bp, Artificial
  CRISPR gRNA sequence
tcagtataatccacctctat

SEQ ID NO: 587828 - DNA, 20 bp, Artificial
  CRISPR gRNA sequence
ccacctctatcagccacctc

SEQ ID NO: 587829 - DNA, 20 bp, Artificial
  CRISPR gRNA sequence
cacctctatcagccacctcc

SEQ ID NO: 587830 - DNA, 20 bp, Artificial
  CRISPR gRNA sequence
ctctatcagccacctccagg

SEQ ID NO: 587831 - DNA, 20 bp, Artificial
  CRISPR gRNA sequence
tctatcagccacctccagga

SEQ ID NO: 587832 - DNA, 20 bp, Artificial
  CRISPR gRNA sequence
tcagccacctccaggaagga

SEQ ID NO: 587833 - DNA, 20 bp, Artificial
  CRISPR gRNA sequence
cagccacctccaggaaggaa

SEQ ID NO: 587834 - DNA, 20 bp, Artificial
  CRISPR gRNA sequence
gccacctccaggaaggaaag

SEQ ID NO: 587835 - DNA, 20 bp, Artificial
  CRISPR gRNA sequence
ccacctccaggaaggaaagg

SEQ ID NO: 587836 - DNA, 20 bp, Artificial
  CRISPR gRNA sequence
cacctccaggaaggaaagga

SEQ ID NO: 587837 - DNA, 20 bp, Artificial
  CRISPR gRNA sequence
acctccaggaaggaaaggag

SEQ ID NO: 587838 - DNA, 20 bp, Artificial
  CRISPR gRNA sequence
caggaaggaaaggaggggct

SEQ ID NO: 587839 - DNA, 20 bp, Artificial
  CRISPR gRNA sequence
aggaaggaaaggaggggcta

SEQ ID NO: 587840 - DNA, 20 bp, Artificial
  CRISPR gRNA sequence
ggaaggaaaggaggggctaa

SEQ ID NO: 587841 - DNA, 20 bp, Artificial
  CRISPR gRNA sequence
aggaaaggaggggctaaggg

SEQ ID NO: 587842 - DNA, 20 bp, Artificial
  CRISPR gRNA sequence
ggaaaggaggggctaagggt

SEQ ID NO: 587843 - DNA, 20 bp, Artificial
  CRISPR gRNA sequence
gaaaggaggggctaagggta

SEQ ID NO: 587844 - DNA, 20 bp, Artificial
  CRISPR gRNA sequence
ggaggggctaagggtaggga

SEQ ID NO: 587845 - DNA, 20 bp, Artificial
  CRISPR gRNA sequence
gggtagggaaagttcacact

SEQ ID NO: 587846 - DNA, 20 bp, Artificial
  CRISPR gRNA sequence
ggtagggaaagttcacactt

SEQ ID NO: 587847 - DNA, 20 bp, Artificial
  CRISPR gRNA sequence
tagggaaagttcacacttgg

SEQ ID NO: 587848 - DNA, 20 bp, Artificial
  CRISPR gRNA sequence
ttcacacttgggagatcacc

SEQ ID NO: 587849 - DNA, 20 bp, Artificial
  CRISPR gRNA sequence
cacttgggagatcacccaga

SEQ ID NO: 587850 - DNA, 20 bp, Artificial
  CRISPR gRNA sequence
ttgggagatcacccagaaag

SEQ ID NO: 587851 - DNA, 20 bp, Artificial
  CRISPR gRNA sequence
tgggagatcacccagaaagt

SEQ ID NO: 587852 - DNA, 20 bp, Artificial
  CRISPR gRNA sequence
agatcacccagaaagtgggc

SEQ ID NO: 587853 - DNA, 20 bp, Artificial
  CRISPR gRNA sequence
gatcacccagaaagtgggcc

SEQ ID NO: 587854 - DNA, 20 bp, Artificial
  CRISPR gRNA sequence
ccagaaagtgggccaggtgc

SEQ ID NO: 587855 - DNA, 20 bp, Artificial
  CRISPR gRNA sequence
cagaaagtgggccaggtgcc

SEQ ID NO: 587856 - DNA, 20 bp, Artificial
  CRISPR gRNA sequence
ccaggtgccaggtctacaat

SEQ ID NO: 587857 - DNA, 20 bp, Artificial
  CRISPR gRNA sequence
ggtctacaatcagtttaaaa

SEQ ID NO: 587858 - DNA, 20 bp, Artificial
  CRISPR gRNA sequence
ttaaaatagttccttctcat

SEQ ID NO: 587859 - DNA, 20 bp, Artificial
  CRISPR gRNA sequence
aaatagttccttctcatgag

SEQ ID NO: 587860 - DNA, 20 bp, Artificial
  CRISPR gRNA sequence
ccttctcatgagaagcctgc

SEQ ID NO: 587861 - DNA, 20 bp, Artificial
  CRISPR gRNA sequence
gcaccatcactattatgaat

SEQ ID NO: 587862 - DNA, 20 bp, Artificial
  CRISPR gRNA sequence
ctattatgaatgagctgcac

SEQ ID NO: 587863 - DNA, 20 bp, Artificial
  CRISPR gRNA sequence
actggattcaatttctaaac

SEQ ID NO: 587864 - DNA, 20 bp, Artificial
  CRISPR gRNA sequence
tatccttaaaaaaaaaaaaa

SEQ ID NO: 587865 - DNA, 20 bp, Artificial
  CRISPR gRNA sequence
taaaaaaaaaaaaaaagtca

SEQ ID NO: 587866 - DNA, 20 bp, Artificial
  CRISPR gRNA sequence
aaaaaaaaaaaaagtcatgg

SEQ ID NO: 587867 - DNA, 20 bp, Artificial
  CRISPR gRNA sequence
tttcttttcttttctttttt

SEQ ID NO: 587868 - DNA, 20 bp, Artificial
  CRISPR gRNA sequence
ttttcttttcttttttgaga

SEQ ID NO: 587869 - DNA, 20 bp, Artificial
  CRISPR gRNA sequence
ttcttttcttttttgagaca

SEQ ID NO: 587870 - DNA, 20 bp, Artificial
  CRISPR gRNA sequence
cagagtctcactctgtcacc

SEQ ID NO: 587871 - DNA, 20 bp, Artificial
  CRISPR gRNA sequence
agagtctcactctgtcaccc

SEQ ID NO: 587872 - DNA, 20 bp, Artificial
  CRISPR gRNA sequence
tctcactctgtcacccaggc

SEQ ID NO: 587873 - DNA, 20 bp, Artificial
  CRISPR gRNA sequence
tcactctgtcacccaggctg

SEQ ID NO: 587874 - DNA, 20 bp, Artificial
  CRISPR gRNA sequence
ctgtcacccaggctggagtg

SEQ ID NO: 587875 - DNA, 20 bp, Artificial
  CRISPR gRNA sequence
tcacccaggctggagtgcag

SEQ ID NO: 587876 - DNA, 20 bp, Artificial
  CRISPR gRNA sequence
cccaggctggagtgcagtgg

SEQ ID NO: 587877 - DNA, 20 bp, Artificial
  CRISPR gRNA sequence
ccaggctggagtgcagtggc

SEQ ID NO: 587878 - DNA, 20 bp, Artificial
  CRISPR gRNA sequence
gcaggatctctgttcactac

SEQ ID NO: 587879 - DNA, 20 bp, Artificial
  CRISPR gRNA sequence
tcactacaagctccgcctcc

SEQ ID NO: 587880 - DNA, 20 bp, Artificial
  CRISPR gRNA sequence
tgcacgccgttctcctgcct

SEQ ID NO: 587881 - DNA, 20 bp, Artificial
  CRISPR gRNA sequence
tctcctgcctcagcctcccg

SEQ ID NO: 587882 - DNA, 20 bp, Artificial
  CRISPR gRNA sequence
ctgcctcagcctcccgtagc

SEQ ID NO: 587883 - DNA, 20 bp, Artificial
  CRISPR gRNA sequence
gcctcccgtagctggaacta

SEQ ID NO: 587884 - DNA, 20 bp, Artificial
  CRISPR gRNA sequence
cctcccgtagctggaactac

SEQ ID NO: 587885 - DNA, 20 bp, Artificial
  CRISPR gRNA sequence
ctcccgtagctggaactaca

SEQ ID NO: 587886 - DNA, 20 bp, Artificial
  CRISPR gRNA sequence
tcccgtagctggaactacag

SEQ ID NO: 587887 - DNA, 20 bp, Artificial
  CRISPR gRNA sequence
caggggcctgccaccacgcc

SEQ ID NO: 587888 - DNA, 20 bp, Artificial
  CRISPR gRNA sequence
agctaatttttttgtatttt

SEQ ID NO: 587889 - DNA, 20 bp, Artificial
  CRISPR gRNA sequence
taatttttttgtattttgag

SEQ ID NO: 587890 - DNA, 20 bp, Artificial
  CRISPR gRNA sequence
atttttttgtattttgagta

SEQ ID NO: 587891 - DNA, 20 bp, Artificial
  CRISPR gRNA sequence
ttttgtattttgagtagaga

SEQ ID NO: 587892 - DNA, 20 bp, Artificial
  CRISPR gRNA sequence
tttgtattttgagtagagac

SEQ ID NO: 587893 - DNA, 20 bp, Artificial
  CRISPR gRNA sequence
ttgtattttgagtagagacg

SEQ ID NO: 587894 - DNA, 20 bp, Artificial
  CRISPR gRNA sequence
gagacggggtttcaccgtgt

SEQ ID NO: 587895 - DNA, 20 bp, Artificial
  CRISPR gRNA sequence
cggggtttcaccgtgttagc

SEQ ID NO: 587896 - DNA, 20 bp, Artificial
  CRISPR gRNA sequence
ggggtttcaccgtgttagcc

SEQ ID NO: 587897 - DNA, 20 bp, Artificial
  CRISPR gRNA sequence
tttcaccgtgttagccagga

SEQ ID NO: 587898 - DNA, 20 bp, Artificial
  CRISPR gRNA sequence
ccaggatggtctcgatctcc

SEQ ID NO: 587899 - DNA, 20 bp, Artificial
  CRISPR gRNA sequence
gcctcgtgatctgcccgtct

SEQ ID NO: 587900 - DNA, 20 bp, Artificial
  CRISPR gRNA sequence
ctgcccgtctcggcctccca

SEQ ID NO: 587901 - DNA, 20 bp, Artificial
  CRISPR gRNA sequence
tctcggcctcccaaagtgct

SEQ ID NO: 587902 - DNA, 20 bp, Artificial
  CRISPR gRNA sequence
ctcccaaagtgctgagacta

SEQ ID NO: 587903 - DNA, 20 bp, Artificial
  CRISPR gRNA sequence
tcccaaagtgctgagactac

SEQ ID NO: 587904 - DNA, 20 bp, Artificial
  CRISPR gRNA sequence
agtgctgagactacaggcgt

SEQ ID NO: 587905 - DNA, 20 bp, Artificial
  CRISPR gRNA sequence
caggcgtgagccaccgtgtc

SEQ ID NO: 587906 - DNA, 20 bp, Artificial
  CRISPR gRNA sequence
cgtgagccaccgtgtccagc

SEQ ID NO: 587907 - DNA, 20 bp, Artificial
  CRISPR gRNA sequence
gccaccgtgtccagctggtc

SEQ ID NO: 587908 - DNA, 20 bp, Artificial
  CRISPR gRNA sequence
tggttttaaaataatgtaaa

SEQ ID NO: 587909 - DNA, 20 bp, Artificial
  CRISPR gRNA sequence
ggttttaaaataatgtaaat

SEQ ID NO: 587910 - DNA, 20 bp, Artificial
  CRISPR gRNA sequence
aaccgattatcataatcttc

SEQ ID NO: 587911 - DNA, 20 bp, Artificial
  CRISPR gRNA sequence
attatcataatcttctggcc

SEQ ID NO: 587912 - DNA, 20 bp, Artificial
  CRISPR gRNA sequence
ctggccaagtacctaatttt

SEQ ID NO: 587913 - DNA, 20 bp, Artificial
  CRISPR gRNA sequence
atcactactattaatatcca

SEQ ID NO: 587914 - DNA, 20 bp, Artificial
  CRISPR gRNA sequence
tcactactattaatatccaa

SEQ ID NO: 587915 - DNA, 20 bp, Artificial
  CRISPR gRNA sequence
atccaaaggtgtataacttg

SEQ ID NO: 587916 - DNA, 20 bp, Artificial
  CRISPR gRNA sequence
tttgcatgatacatacactg

SEQ ID NO: 587917 - DNA, 20 bp, Artificial
  CRISPR gRNA sequence
gcatgatacatacactgaag

SEQ ID NO: 587918 - DNA, 20 bp, Artificial
  CRISPR gRNA sequence
ttatttatgtactttttttc

SEQ ID NO: 587919 - DNA, 20 bp, Artificial
  CRISPR gRNA sequence
tttatgtactttttttctgg

SEQ ID NO: 587920 - DNA, 20 bp, Artificial
  CRISPR gRNA sequence
gaagtcattacaaaaaaaaa

SEQ ID NO: 587921 - DNA, 20 bp, Artificial
  CRISPR gRNA sequence
cattacaaaaaaaaaaagtg

SEQ ID NO: 587922 - DNA, 20 bp, Artificial
  CRISPR gRNA sequence
aaaaaaaaagtgaagtaata

SEQ ID NO: 587923 - DNA, 20 bp, Artificial
  CRISPR gRNA sequence
aaaaaagtgaagtaatatgg

SEQ ID NO: 587924 - DNA, 20 bp, Artificial
  CRISPR gRNA sequence
tgaagtaatatggaagcaaa

SEQ ID NO: 587925 - DNA, 20 bp, Artificial
  CRISPR gRNA sequence
aatatggaagcaaatggatg

SEQ ID NO: 587926 - DNA, 20 bp, Artificial
  CRISPR gRNA sequence
atatggaagcaaatggatga

SEQ ID NO: 587927 - DNA, 20 bp, Artificial
  CRISPR gRNA sequence
aagcaaatggatgaaggatt

SEQ ID NO: 587928 - DNA, 20 bp, Artificial
  CRISPR gRNA sequence
agcaaatggatgaaggattg

SEQ ID NO: 587929 - DNA, 20 bp, Artificial
  CRISPR gRNA sequence
gcaaatggatgaaggattga

SEQ ID NO: 587930 - DNA, 20 bp, Artificial
  CRISPR gRNA sequence
ggatgaaggattgagggaaa

SEQ ID NO: 587931 - DNA, 20 bp, Artificial
  CRISPR gRNA sequence
attgagggaaaaagaattat

SEQ ID NO: 587932 - DNA, 20 bp, Artificial
  CRISPR gRNA sequence
agggaaaaagaattataaga

SEQ ID NO: 587933 - DNA, 20 bp, Artificial
  CRISPR gRNA sequence
aaaagaattataagaaagac

SEQ ID NO: 587934 - DNA, 20 bp, Artificial
  CRISPR gRNA sequence
gaattataagaaagacaaga

SEQ ID NO: 587935 - DNA, 20 bp, Artificial
  CRISPR gRNA sequence
attataagaaagacaagaaa

SEQ ID NO: 587936 - DNA, 20 bp, Artificial
  CRISPR gRNA sequence
ataagaaagacaagaaagag

SEQ ID NO: 587937 - DNA, 20 bp, Artificial
  CRISPR gRNA sequence
gagcagaccacaacactcaa

SEQ ID NO: 587938 - DNA, 20 bp, Artificial
  CRISPR gRNA sequence
cagaccacaacactcaaaag

SEQ ID NO: 587939 - DNA, 20 bp, Artificial
  CRISPR gRNA sequence
accacaacactcaaaagaag

SEQ ID NO: 587940 - DNA, 20 bp, Artificial
  CRISPR gRNA sequence
ccacaacactcaaaagaaga

SEQ ID NO: 587941 - DNA, 20 bp, Artificial
  CRISPR gRNA sequence
cacaacactcaaaagaagaa

SEQ ID NO: 587942 - DNA, 20 bp, Artificial
  CRISPR gRNA sequence
aacactcaaaagaagaaggg

SEQ ID NO: 587943 - DNA, 20 bp, Artificial
  CRISPR gRNA sequence
ataatttaaataaaacaaaa

SEQ ID NO: 587944 - DNA, 20 bp, Artificial
  CRISPR gRNA sequence
aaataaaacaaaatagaaac

SEQ ID NO: 587945 - DNA, 20 bp, Artificial
  CRISPR gRNA sequence
tagaaactggtgtattataa

SEQ ID NO: 587946 - DNA, 20 bp, Artificial
  CRISPR gRNA sequence
gaaactggtgtattataaaa

SEQ ID NO: 587947 - DNA, 20 bp, Artificial
  CRISPR gRNA sequence
aactggtgtattataaaaga

SEQ ID NO: 587948 - DNA, 20 bp, Artificial
  CRISPR gRNA sequence
ggtgtattataaaagagagt

SEQ ID NO: 587949 - DNA, 20 bp, Artificial
  CRISPR gRNA sequence
gtaagtgatgacaaatgcta

SEQ ID NO: 587950 - DNA, 20 bp, Artificial
  CRISPR gRNA sequence
tgacaaatgctacagtacat

SEQ ID NO: 587951 - DNA, 20 bp, Artificial
  CRISPR gRNA sequence
cagtacattagaaaatactt

SEQ ID NO: 587952 - DNA, 20 bp, Artificial
  CRISPR gRNA sequence
tagcttatgaaatcactgat

SEQ ID NO: 587953 - DNA, 20 bp, Artificial
  CRISPR gRNA sequence
actgatcagttgtcaattta

SEQ ID NO: 587954 - DNA, 20 bp, Artificial
  CRISPR gRNA sequence
gattgtgataataaattcct

SEQ ID NO: 587955 - DNA, 20 bp, Artificial
  CRISPR gRNA sequence
gtgataataaattccttagt

SEQ ID NO: 587956 - DNA, 20 bp, Artificial
  CRISPR gRNA sequence
gataataaattccttagtaa

SEQ ID NO: 587957 - DNA, 20 bp, Artificial
  CRISPR gRNA sequence
taagagacaacaatgcgttt

SEQ ID NO: 587958 - DNA, 20 bp, Artificial
  CRISPR gRNA sequence
aagagacaacaatgcgtttg

SEQ ID NO: 587959 - DNA, 20 bp, Artificial
  CRISPR gRNA sequence
agagacaacaatgcgtttga

SEQ ID NO: 587960 - DNA, 20 bp, Artificial
  CRISPR gRNA sequence
cactactctcatgacaaatt

SEQ ID NO: 587961 - DNA, 20 bp, Artificial
  CRISPR gRNA sequence
ctactctcatgacaaattaa

SEQ ID NO: 587962 - DNA, 20 bp, Artificial
  CRISPR gRNA sequence
aattaagagactatttctat

SEQ ID NO: 587963 - DNA, 20 bp, Artificial
  CRISPR gRNA sequence
atttctatgagatttaaaac

SEQ ID NO: 587964 - DNA, 20 bp, Artificial
  CRISPR gRNA sequence
ttctatgagatttaaaacta

SEQ ID NO: 587965 - DNA, 20 bp, Artificial
  CRISPR gRNA sequence
tgttgtttctttaaacaata

SEQ ID NO: 587966 - DNA, 20 bp, Artificial
  CRISPR gRNA sequence
ttctttaaacaatatggtca

SEQ ID NO: 587967 - DNA, 20 bp, Artificial
  CRISPR gRNA sequence
taaacaatatggtcaaagat

SEQ ID NO: 587968 - DNA, 20 bp, Artificial
  CRISPR gRNA sequence
gatgagctccatcttgatcc

SEQ ID NO: 587969 - DNA, 20 bp, Artificial
  CRISPR gRNA sequence
ccatcttgatccaagccaca

SEQ ID NO: 587970 - DNA, 20 bp, Artificial
  CRISPR gRNA sequence
aattttttttttttattttt

SEQ ID NO: 587971 - DNA, 20 bp, Artificial
  CRISPR gRNA sequence
ttttatttttaagaaatttg

SEQ ID NO: 587972 - DNA, 20 bp, Artificial
  CRISPR gRNA sequence
ttaagaaatttgaagatatg

SEQ ID NO: 587973 - DNA, 20 bp, Artificial
  CRISPR gRNA sequence
agaaatttgaagatatgaag

SEQ ID NO: 587974 - DNA, 20 bp, Artificial
  CRISPR gRNA sequence
agaagaccatcttgtcttac

SEQ ID NO: 587975 - DNA, 20 bp, Artificial
  CRISPR gRNA sequence
cttgtcttaccagtttctct

SEQ ID NO: 587976 - DNA, 20 bp, Artificial
  CRISPR gRNA sequence
ttgtcttaccagtttctctg

SEQ ID NO: 587977 - DNA, 20 bp, Artificial
  CRISPR gRNA sequence
tgtcttaccagtttctctga

SEQ ID NO: 587978 - DNA, 20 bp, Artificial
  CRISPR gRNA sequence
ccagtttctctgagggcatg

SEQ ID NO: 587979 - DNA, 20 bp, Artificial
  CRISPR gRNA sequence
tataccttaaaaatgcatgt

SEQ ID NO: 587980 - DNA, 20 bp, Artificial
  CRISPR gRNA sequence
gttagtttgaaattctatta

SEQ ID NO: 587981 - DNA, 20 bp, Artificial
  CRISPR gRNA sequence
aattctattaaagataaatg

SEQ ID NO: 587982 - DNA, 20 bp, Artificial
  CRISPR gRNA sequence
tgtggaaatatatttaaaca

SEQ ID NO: 587983 - DNA, 20 bp, Artificial
  CRISPR gRNA sequence
gtggaaatatatttaaacat

SEQ ID NO: 587984 - DNA, 20 bp, Artificial
  CRISPR gRNA sequence
aatatatttaaacataggat

SEQ ID NO: 587985 - DNA, 20 bp, Artificial
  CRISPR gRNA sequence
ggatgagtcataatacttta

SEQ ID NO: 587986 - DNA, 20 bp, Artificial
  CRISPR gRNA sequence
gatgagtcataatactttac

SEQ ID NO: 587987 - DNA, 20 bp, Artificial
  CRISPR gRNA sequence
ttacaggaattttctcataa

SEQ ID NO: 587988 - DNA, 20 bp, Artificial
  CRISPR gRNA sequence
tacaggaattttctcataat

SEQ ID NO: 587989 - DNA, 20 bp, Artificial
  CRISPR gRNA sequence
gaattttctcataataggtg

SEQ ID NO: 587990 - DNA, 20 bp, Artificial
  CRISPR gRNA sequence
aattttctcataataggtga

SEQ ID NO: 587991 - DNA, 20 bp, Artificial
  CRISPR gRNA sequence
taactgaacaaaatataaac

SEQ ID NO: 587992 - DNA, 20 bp, Artificial
  CRISPR gRNA sequence
aactgaacaaaatataaact

SEQ ID NO: 587993 - DNA, 20 bp, Artificial
  CRISPR gRNA sequence
tataaactaggctatttaat

SEQ ID NO: 587994 - DNA, 20 bp, Artificial
  CRISPR gRNA sequence
ataaactaggctatttaatt

SEQ ID NO: 587995 - DNA, 20 bp, Artificial
  CRISPR gRNA sequence
tatttaattgggatttttaa

SEQ ID NO: 587996 - DNA, 20 bp, Artificial
  CRISPR gRNA sequence
ggatttttaaaagtcaatat

SEQ ID NO: 587997 - DNA, 20 bp, Artificial
  CRISPR gRNA sequence
gatttttaaaagtcaatatt

SEQ ID NO: 587998 - DNA, 20 bp, Artificial
  CRISPR gRNA sequence
taaaagtcaatattaggaac

SEQ ID NO: 587999 - DNA, 20 bp, Artificial
  CRISPR gRNA sequence
tcaatattaggaactagtat

SEQ ID NO: 588000 - DNA, 20 bp, Artificial
  CRISPR gRNA sequence
tataagcattcaatatttct

SEQ ID NO: 588001 - DNA, 20 bp, Artificial
  CRISPR gRNA sequence
atatttctgagctatttttg

SEQ ID NO: 588002 - DNA, 20 bp, Artificial
  CRISPR gRNA sequence
ctatttttgtggataaaata

SEQ ID NO: 588003 - DNA, 20 bp, Artificial
  CRISPR gRNA sequence
tgtggataaaatatagtcct

SEQ ID NO: 588004 - DNA, 20 bp, Artificial
  CRISPR gRNA sequence
aaatatagtccttggaacta

SEQ ID NO: 588005 - DNA, 20 bp, Artificial
  CRISPR gRNA sequence
aatatagtccttggaactat

SEQ ID NO: 588006 - DNA, 20 bp, Artificial
  CRISPR gRNA sequence
atatagtccttggaactata

SEQ ID NO: 588007 - DNA, 20 bp, Artificial
  CRISPR gRNA sequence
ctatagggacttgaaaaata

SEQ ID NO: 588008 - DNA, 20 bp, Artificial
  CRISPR gRNA sequence
agggacttgaaaaataaaga

SEQ ID NO: 588009 - DNA, 20 bp, Artificial
  CRISPR gRNA sequence
tatatactaaaaatgttttt

SEQ ID NO: 588010 - DNA, 20 bp, Artificial
  CRISPR gRNA sequence
tactaaaaatgttttttagt

SEQ ID NO: 588011 - DNA, 20 bp, Artificial
  CRISPR gRNA sequence
actaaaaatgttttttagtt

SEQ ID NO: 588012 - DNA, 20 bp, Artificial
  CRISPR gRNA sequence
taaaaatgttttttagttgg

SEQ ID NO: 588013 - DNA, 20 bp, Artificial
  CRISPR gRNA sequence
aaaaatgttttttagttggg

SEQ ID NO: 588014 - DNA, 20 bp, Artificial
  CRISPR gRNA sequence
aatgttttttagttgggagg

SEQ ID NO: 588015 - DNA, 20 bp, Artificial
  CRISPR gRNA sequence
ggaggaagttgttgttttaa

SEQ ID NO: 588016 - DNA, 20 bp, Artificial
  CRISPR gRNA sequence
gaagttgttgttttaacaga

SEQ ID NO: 588017 - DNA, 20 bp, Artificial
  CRISPR gRNA sequence
aagttgttgttttaacagat

SEQ ID NO: 588018 - DNA, 20 bp, Artificial
  CRISPR gRNA sequence
agttgttgttttaacagatg

SEQ ID NO: 588019 - DNA, 20 bp, Artificial
  CRISPR gRNA sequence
ttaacagatggggatttata

SEQ ID NO: 588020 - DNA, 20 bp, Artificial
  CRISPR gRNA sequence
ggggatttatatggtacatc

SEQ ID NO: 588021 - DNA, 20 bp, Artificial
  CRISPR gRNA sequence
tttatatggtacatctggtc

SEQ ID NO: 588022 - DNA, 20 bp, Artificial
  CRISPR gRNA sequence
tctggtccagttccttttta

SEQ ID NO: 588023 - DNA, 20 bp, Artificial
  CRISPR gRNA sequence
tccagttcctttttatggaa

SEQ ID NO: 588024 - DNA, 20 bp, Artificial
  CRISPR gRNA sequence
ttcctttttatggaacagaa

SEQ ID NO: 588025 - DNA, 20 bp, Artificial
  CRISPR gRNA sequence
aatagctttaaactgacaat

SEQ ID NO: 588026 - DNA, 20 bp, Artificial
  CRISPR gRNA sequence
acataaacaacaaacttcat

SEQ ID NO: 588027 - DNA, 20 bp, Artificial
  CRISPR gRNA sequence
gctgaaaattgtcaaacact

SEQ ID NO: 588028 - DNA, 20 bp, Artificial
  CRISPR gRNA sequence
gaaaattgtcaaacactgag

SEQ ID NO: 588029 - DNA, 20 bp, Artificial
  CRISPR gRNA sequence
aaaattgtcaaacactgagt

SEQ ID NO: 588030 - DNA, 20 bp, Artificial
  CRISPR gRNA sequence
caaacactgagtaggtcaca

SEQ ID NO: 588031 - DNA, 20 bp, Artificial
  CRISPR gRNA sequence
acactgagtaggtcacaaag

SEQ ID NO: 588032 - DNA, 20 bp, Artificial
  CRISPR gRNA sequence
tgtaaaaatcaacattccta

SEQ ID NO: 588033 - DNA, 20 bp, Artificial
  CRISPR gRNA sequence
atcaacattcctaaagtgtt

SEQ ID NO: 588034 - DNA, 20 bp, Artificial
  CRISPR gRNA sequence
aacattcctaaagtgtttgg

SEQ ID NO: 588035 - DNA, 20 bp, Artificial
  CRISPR gRNA sequence
ttcctaaagtgtttggaagt

SEQ ID NO: 588036 - DNA, 20 bp, Artificial
  CRISPR gRNA sequence
taaagtgtttggaagtaaga

SEQ ID NO: 588037 - DNA, 20 bp, Artificial
  CRISPR gRNA sequence
aagtaagatagatacatgtt

SEQ ID NO: 588038 - DNA, 20 bp, Artificial
  CRISPR gRNA sequence
agatagatacatgttcagaa

SEQ ID NO: 588039 - DNA, 20 bp, Artificial
  CRISPR gRNA sequence
gatacatgttcagaatagtt

SEQ ID NO: 588040 - DNA, 20 bp, Artificial
  CRISPR gRNA sequence
atacatgttcagaatagttt

SEQ ID NO: 588041 - DNA, 20 bp, Artificial
  CRISPR gRNA sequence
agtttaggcatatcaaccct

SEQ ID NO: 588042 - DNA, 20 bp, Artificial
  CRISPR gRNA sequence
gcatatcaaccctaagtcaa

SEQ ID NO: 588043 - DNA, 20 bp, Artificial
  CRISPR gRNA sequence
caaaagaactttgacattgt

SEQ ID NO: 588044 - DNA, 20 bp, Artificial
  CRISPR gRNA sequence
aaaagaactttgacattgta

SEQ ID NO: 588045 - DNA, 20 bp, Artificial
  CRISPR gRNA sequence
ctcaaatctctcttactcca

SEQ ID NO: 588046 - DNA, 20 bp, Artificial
  CRISPR gRNA sequence
tactccaaagttatgtgata

SEQ ID NO: 588047 - DNA, 20 bp, Artificial
  CRISPR gRNA sequence
tacagataactaattttaca

SEQ ID NO: 588048 - DNA, 20 bp, Artificial
  CRISPR gRNA sequence
agataactaattttacaaag

SEQ ID NO: 588049 - DNA, 20 bp, Artificial
  CRISPR gRNA sequence
tttacaaagtagttattttt

SEQ ID NO: 588050 - DNA, 20 bp, Artificial
  CRISPR gRNA sequence
ttatatcatatgctcaatgc

SEQ ID NO: 588051 - DNA, 20 bp, Artificial
  CRISPR gRNA sequence
ctcaatgctggttcaattga

SEQ ID NO: 588052 - DNA, 20 bp, Artificial
  CRISPR gRNA sequence
tgctggttcaattgaaagct

SEQ ID NO: 588053 - DNA, 20 bp, Artificial
  CRISPR gRNA sequence
gctggttcaattgaaagctg

SEQ ID NO: 588054 - DNA, 20 bp, Artificial
  CRISPR gRNA sequence
ttgaaagctgaggttttact

SEQ ID NO: 588055 - DNA, 20 bp, Artificial
  CRISPR gRNA sequence
aggttttacttagaatttaa

SEQ ID NO: 588056 - DNA, 20 bp, Artificial
  CRISPR gRNA sequence
aataattattttcttaaaat

SEQ ID NO: 588057 - DNA, 20 bp, Artificial
  CRISPR gRNA sequence
ataattattttcttaaaatg

SEQ ID NO: 588058 - DNA, 20 bp, Artificial
  CRISPR gRNA sequence
atgaggatgaacaaaaatat

SEQ ID NO: 588059 - DNA, 20 bp, Artificial
  CRISPR gRNA sequence
ctttacttattttcttactt

SEQ ID NO: 588060 - DNA, 20 bp, Artificial
  CRISPR gRNA sequence
tttacttattttcttactta

SEQ ID NO: 588061 - DNA, 20 bp, Artificial
  CRISPR gRNA sequence
taaatctttgaaaaataact

SEQ ID NO: 588062 - DNA, 20 bp, Artificial
  CRISPR gRNA sequence
tttgaaaaataacttagttt

SEQ ID NO: 588063 - DNA, 20 bp, Artificial
  CRISPR gRNA sequence
aaataacttagttttagaac

SEQ ID NO: 588064 - DNA, 20 bp, Artificial
  CRISPR gRNA sequence
gaacaagtatcttaaatata

SEQ ID NO: 588065 - DNA, 20 bp, Artificial
  CRISPR gRNA sequence
aaatatatggttctcttaat

SEQ ID NO: 588066 - DNA, 20 bp, Artificial
  CRISPR gRNA sequence
tggttctcttaataagtatt

SEQ ID NO: 588067 - DNA, 20 bp, Artificial
  CRISPR gRNA sequence
taataagtatttggcttttt

SEQ ID NO: 588068 - DNA, 20 bp, Artificial
  CRISPR gRNA sequence
tttggcttttttagatttat

SEQ ID NO: 588069 - DNA, 20 bp, Artificial
  CRISPR gRNA sequence
tggcttttttagatttataa

SEQ ID NO: 588070 - DNA, 20 bp, Artificial
  CRISPR gRNA sequence
agacaatgaataaatgtctt

SEQ ID NO: 588071 - DNA, 20 bp, Artificial
  CRISPR gRNA sequence
gacaatgaataaatgtcttt

SEQ ID NO: 588072 - DNA, 20 bp, Artificial
  CRISPR gRNA sequence
ataaatgtctttgggaaatt

SEQ ID NO: 588073 - DNA, 20 bp, Artificial
  CRISPR gRNA sequence
ttttaattttcaaatgtatt

SEQ ID NO: 588074 - DNA, 20 bp, Artificial
  CRISPR gRNA sequence
atttggatgattccgttttt

SEQ ID NO: 588075 - DNA, 20 bp, Artificial
  CRISPR gRNA sequence
tgagcaatacataattttca

SEQ ID NO: 588076 - DNA, 20 bp, Artificial
  CRISPR gRNA sequence
attttcatagtaatctgaac

SEQ ID NO: 588077 - DNA, 20 bp, Artificial
  CRISPR gRNA sequence
atctgaaccagtataattct

SEQ ID NO: 588078 - DNA, 20 bp, Artificial
  CRISPR gRNA sequence
ccaaaattgaatttttcatc

SEQ ID NO: 588079 - DNA, 20 bp, Artificial
  CRISPR gRNA sequence
aaattgaatttttcatctgg

SEQ ID NO: 588080 - DNA, 20 bp, Artificial
  CRISPR gRNA sequence
atctggtagaaaaatatttt

SEQ ID NO: 588081 - DNA, 20 bp, Artificial
  CRISPR gRNA sequence
aaaatattttgagactctat

SEQ ID NO: 588082 - DNA, 20 bp, Artificial
  CRISPR gRNA sequence
gtttttttaacttttatttt

SEQ ID NO: 588083 - DNA, 20 bp, Artificial
  CRISPR gRNA sequence
tttaacttttattttaagtt

SEQ ID NO: 588084 - DNA, 20 bp, Artificial
  CRISPR gRNA sequence
taacttttattttaagttca

SEQ ID NO: 588085 - DNA, 20 bp, Artificial
  CRISPR gRNA sequence
aacttttattttaagttcag

SEQ ID NO: 588086 - DNA, 20 bp, Artificial
  CRISPR gRNA sequence
taagttcagaggtacatgtg

SEQ ID NO: 588087 - DNA, 20 bp, Artificial
  CRISPR gRNA sequence
aagttcagaggtacatgtgc

SEQ ID NO: 588088 - DNA, 20 bp, Artificial
  CRISPR gRNA sequence
acatgtgcaggtttgttata

SEQ ID NO: 588089 - DNA, 20 bp, Artificial
  CRISPR gRNA sequence
catgtgcaggtttgttatat

SEQ ID NO: 588090 - DNA, 20 bp, Artificial
  CRISPR gRNA sequence
atataggtaaacttgtgtca

SEQ ID NO: 588091 - DNA, 20 bp, Artificial
  CRISPR gRNA sequence
tataggtaaacttgtgtcat

SEQ ID NO: 588092 - DNA, 20 bp, Artificial
  CRISPR gRNA sequence
catgggtttttttttttttt

SEQ ID NO: 588093 - DNA, 20 bp, Artificial
  CRISPR gRNA sequence
gtataaattattttgtcatc

SEQ ID NO: 588094 - DNA, 20 bp, Artificial
  CRISPR gRNA sequence
tataaattattttgtcatcc

SEQ ID NO: 588095 - DNA, 20 bp, Artificial
  CRISPR gRNA sequence
tattttgtcatccaggtatt

SEQ ID NO: 588096 - DNA, 20 bp, Artificial
  CRISPR gRNA sequence
attttgtcatccaggtatta

SEQ ID NO: 588097 - DNA, 20 bp, Artificial
  CRISPR gRNA sequence
tgtcatccaggtattaaggc

SEQ ID NO: 588098 - DNA, 20 bp, Artificial
  CRISPR gRNA sequence
ggtattaaggctagcaccat

SEQ ID NO: 588099 - DNA, 20 bp, Artificial
  CRISPR gRNA sequence
tcccaccctctactctccaa

SEQ ID NO: 588100 - DNA, 20 bp, Artificial
  CRISPR gRNA sequence
cccaccctctactctccaat

SEQ ID NO: 588101 - DNA, 20 bp, Artificial
  CRISPR gRNA sequence
ctctactctccaataggccc

SEQ ID NO: 588102 - DNA, 20 bp, Artificial
  CRISPR gRNA sequence
gtatgtgttgttcccctcta

SEQ ID NO: 588103 - DNA, 20 bp, Artificial
  CRISPR gRNA sequence
atgtgttgttcccctctatg

SEQ ID NO: 588104 - DNA, 20 bp, Artificial
  CRISPR gRNA sequence
ttctctttataatttataaa

SEQ ID NO: 588105 - DNA, 20 bp, Artificial
  CRISPR gRNA sequence
tctgttttaaacctttaatt

SEQ ID NO: 588106 - DNA, 20 bp, Artificial
  CRISPR gRNA sequence
ctgttttaaacctttaattt

SEQ ID NO: 588107 - DNA, 20 bp, Artificial
  CRISPR gRNA sequence
ttaaacctttaatttgggta

SEQ ID NO: 588108 - DNA, 20 bp, Artificial
  CRISPR gRNA sequence
ctttaatttgggtacagcat

SEQ ID NO: 588109 - DNA, 20 bp, Artificial
  CRISPR gRNA sequence
ttaatttgggtacagcataa

SEQ ID NO: 588110 - DNA, 20 bp, Artificial
  CRISPR gRNA sequence
aatatacctgaaatgctaat

SEQ ID NO: 588111 - DNA, 20 bp, Artificial
  CRISPR gRNA sequence
catgtaattctatttcctcc

SEQ ID NO: 588112 - DNA, 20 bp, Artificial
  CRISPR gRNA sequence
cctagaatttttaaaataac

SEQ ID NO: 588113 - DNA, 20 bp, Artificial
  CRISPR gRNA sequence
ctaaatattattttgactaa

SEQ ID NO: 588114 - DNA, 20 bp, Artificial
  CRISPR gRNA sequence
taaatattattttgactaat

SEQ ID NO: 588115 - DNA, 20 bp, Artificial
  CRISPR gRNA sequence
aaatattattttgactaata

SEQ ID NO: 588116 - DNA, 20 bp, Artificial
  CRISPR gRNA sequence
aatattattttgactaatag

SEQ ID NO: 588117 - DNA, 20 bp, Artificial
  CRISPR gRNA sequence
tattttgactaataggggtc

SEQ ID NO: 588118 - DNA, 20 bp, Artificial
  CRISPR gRNA sequence
attttgactaataggggtcc

SEQ ID NO: 588119 - DNA, 20 bp, Artificial
  CRISPR gRNA sequence
ttttgactaataggggtcca

SEQ ID NO: 588120 - DNA, 20 bp, Artificial
  CRISPR gRNA sequence
taatttaaacactatcccct

SEQ ID NO: 588121 - DNA, 20 bp, Artificial
  CRISPR gRNA sequence
atttaaacactatcccctca

SEQ ID NO: 588122 - DNA, 20 bp, Artificial
  CRISPR gRNA sequence
acactatcccctcagagtat

SEQ ID NO: 588123 - DNA, 20 bp, Artificial
  CRISPR gRNA sequence
cactatcccctcagagtatt

SEQ ID NO: 588124 - DNA, 20 bp, Artificial
  CRISPR gRNA sequence
tcagagtattaggtataata

SEQ ID NO: 588125 - DNA, 20 bp, Artificial
  CRISPR gRNA sequence
agtattaggtataataaaga

SEQ ID NO: 588126 - DNA, 20 bp, Artificial
  CRISPR gRNA sequence
aggtataataaagaaagtaa

SEQ ID NO: 588127 - DNA, 20 bp, Artificial
  CRISPR gRNA sequence
ggtataataaagaaagtaaa

SEQ ID NO: 588128 - DNA, 20 bp, Artificial
  CRISPR gRNA sequence
tatatataatgtacaaaata

SEQ ID NO: 588129 - DNA, 20 bp, Artificial
  CRISPR gRNA sequence
aatatagtaatcaaatttat

SEQ ID NO: 588130 - DNA, 20 bp, Artificial
  CRISPR gRNA sequence
aatcaaatttataagaatga

SEQ ID NO: 588131 - DNA, 20 bp, Artificial
  CRISPR gRNA sequence
cctataaaactgaaaaatct

SEQ ID NO: 588132 - DNA, 20 bp, Artificial
  CRISPR gRNA sequence
actaataaaaatcatttttg

SEQ ID NO: 588133 - DNA, 20 bp, Artificial
  CRISPR gRNA sequence
aataaaaatcatttttgtag

SEQ ID NO: 588134 - DNA, 20 bp, Artificial
  CRISPR gRNA sequence
aaaaatcatttttgtagcag

SEQ ID NO: 588135 - DNA, 20 bp, Artificial
  CRISPR gRNA sequence
agcattgattcatcattaaa

SEQ ID NO: 588136 - DNA, 20 bp, Artificial
  CRISPR gRNA sequence
tcatcattaaatagtcactt

SEQ ID NO: 588137 - DNA, 20 bp, Artificial
  CRISPR gRNA sequence
catcattaaatagtcactta

SEQ ID NO: 588138 - DNA, 20 bp, Artificial
  CRISPR gRNA sequence
atcattaaatagtcacttaa

SEQ ID NO: 588139 - DNA, 20 bp, Artificial
  CRISPR gRNA sequence
attaaatagtcacttaaggg

SEQ ID NO: 588140 - DNA, 20 bp, Artificial
  CRISPR gRNA sequence
ttaaatagtcacttaagggt

SEQ ID NO: 588141 - DNA, 20 bp, Artificial
  CRISPR gRNA sequence
tagtcacttaagggtgggcg

SEQ ID NO: 588142 - DNA, 20 bp, Artificial
  CRISPR gRNA sequence
tcacttaagggtgggcgcag

SEQ ID NO: 588143 - DNA, 20 bp, Artificial
  CRISPR gRNA sequence
gtggctcacgcctgtaatcc

SEQ ID NO: 588144 - DNA, 20 bp, Artificial
  CRISPR gRNA sequence
cgcctgtaatcccagcactt

SEQ ID NO: 588145 - DNA, 20 bp, Artificial
  CRISPR gRNA sequence
gcctgtaatcccagcacttt

SEQ ID NO: 588146 - DNA, 20 bp, Artificial
  CRISPR gRNA sequence
ctgtaatcccagcactttgg

SEQ ID NO: 588147 - DNA, 20 bp, Artificial
  CRISPR gRNA sequence
tgtaatcccagcactttggg

SEQ ID NO: 588148 - DNA, 20 bp, Artificial
  CRISPR gRNA sequence
tcccagcactttgggaggct

SEQ ID NO: 588149 - DNA, 20 bp, Artificial
  CRISPR gRNA sequence
cccagcactttgggaggctg

SEQ ID NO: 588150 - DNA, 20 bp, Artificial
  CRISPR gRNA sequence
agcactttgggaggctgagg

SEQ ID NO: 588151 - DNA, 20 bp, Artificial
  CRISPR gRNA sequence
gcactttgggaggctgaggc

SEQ ID NO: 588152 - DNA, 20 bp, Artificial
  CRISPR gRNA sequence
ctgaggcaggcgaatcacct

SEQ ID NO: 588153 - DNA, 20 bp, Artificial
  CRISPR gRNA sequence
tgaggcaggcgaatcacctg

SEQ ID NO: 588154 - DNA, 20 bp, Artificial
  CRISPR gRNA sequence
gcaggcgaatcacctgaggt

SEQ ID NO: 588155 - DNA, 20 bp, Artificial
  CRISPR gRNA sequence
caggcgaatcacctgaggtc

SEQ ID NO: 588156 - DNA, 20 bp, Artificial
  CRISPR gRNA sequence
ggcgaatcacctgaggtcag

SEQ ID NO: 588157 - DNA, 20 bp, Artificial
  CRISPR gRNA sequence
tcacctgaggtcaggagttc

SEQ ID NO: 588158 - DNA, 20 bp, Artificial
  CRISPR gRNA sequence
tgaggtcaggagttcaagac

SEQ ID NO: 588159 - DNA, 20 bp, Artificial
  CRISPR gRNA sequence
tcaggagttcaagaccagcc

SEQ ID NO: 588160 - DNA, 20 bp, Artificial
  CRISPR gRNA sequence
caagaccagcctggccaaca

SEQ ID NO: 588161 - DNA, 20 bp, Artificial
  CRISPR gRNA sequence
tctactaaaaatacaaaaat

SEQ ID NO: 588162 - DNA, 20 bp, Artificial
  CRISPR gRNA sequence
ctaaaaatacaaaaattagt

SEQ ID NO: 588163 - DNA, 20 bp, Artificial
  CRISPR gRNA sequence
taaaaatacaaaaattagtt

SEQ ID NO: 588164 - DNA, 20 bp, Artificial
  CRISPR gRNA sequence
atacaaaaattagttgggcg

SEQ ID NO: 588165 - DNA, 20 bp, Artificial
  CRISPR gRNA sequence
caaaaattagttgggcgtgg

SEQ ID NO: 588166 - DNA, 20 bp, Artificial
  CRISPR gRNA sequence
gtggtgcacgcctgtaattc

SEQ ID NO: 588167 - DNA, 20 bp, Artificial
  CRISPR gRNA sequence
cgcctgtaattccagctact

SEQ ID NO: 588168 - DNA, 20 bp, Artificial
  CRISPR gRNA sequence
gcctgtaattccagctactt

SEQ ID NO: 588169 - DNA, 20 bp, Artificial
  CRISPR gRNA sequence
ctgtaattccagctacttgg

SEQ ID NO: 588170 - DNA, 20 bp, Artificial
  CRISPR gRNA sequence
tgtaattccagctacttggg

SEQ ID NO: 588171 - DNA, 20 bp, Artificial
  CRISPR gRNA sequence
ttccagctacttgggaggct

SEQ ID NO: 588172 - DNA, 20 bp, Artificial
  CRISPR gRNA sequence
tccagctacttgggaggctg

SEQ ID NO: 588173 - DNA, 20 bp, Artificial
  CRISPR gRNA sequence
agctacttgggaggctgagg

SEQ ID NO: 588174 - DNA, 20 bp, Artificial
  CRISPR gRNA sequence
gctacttgggaggctgaggc

SEQ ID NO: 588175 - DNA, 20 bp, Artificial
  CRISPR gRNA sequence
ctacttgggaggctgaggcg

SEQ ID NO: 588176 - DNA, 20 bp, Artificial
  CRISPR gRNA sequence
tacttgggaggctgaggcgg

SEQ ID NO: 588177 - DNA, 20 bp, Artificial
  CRISPR gRNA sequence
gcgggggaaccacttaaacc

SEQ ID NO: 588178 - DNA, 20 bp, Artificial
  CRISPR gRNA sequence
cgggggaaccacttaaaccc

SEQ ID NO: 588179 - DNA, 20 bp, Artificial
  CRISPR gRNA sequence
ggggaaccacttaaacccag

SEQ ID NO: 588180 - DNA, 20 bp, Artificial
  CRISPR gRNA sequence
gggaaccacttaaacccagg

SEQ ID NO: 588181 - DNA, 20 bp, Artificial
  CRISPR gRNA sequence
aaccacttaaacccaggagg

SEQ ID NO: 588182 - DNA, 20 bp, Artificial
  CRISPR gRNA sequence
ccacttaaacccaggaggcg

SEQ ID NO: 588183 - DNA, 20 bp, Artificial
  CRISPR gRNA sequence
cacttaaacccaggaggcgg

SEQ ID NO: 588184 - DNA, 20 bp, Artificial
  CRISPR gRNA sequence
aacccaggaggcggaggttg

SEQ ID NO: 588185 - DNA, 20 bp, Artificial
  CRISPR gRNA sequence
caggaggcggaggttgcagt

SEQ ID NO: 588186 - DNA, 20 bp, Artificial
  CRISPR gRNA sequence
ggcggaggttgcagtgagcc

SEQ ID NO: 588187 - DNA, 20 bp, Artificial
  CRISPR gRNA sequence
gagatcacgccactgcactc

SEQ ID NO: 588188 - DNA, 20 bp, Artificial
  CRISPR gRNA sequence
cacgccactgcactccagcc

SEQ ID NO: 588189 - DNA, 20 bp, Artificial
  CRISPR gRNA sequence
acgccactgcactccagcct

SEQ ID NO: 588190 - DNA, 20 bp, Artificial
  CRISPR gRNA sequence
ctgcactccagcctgggcca

SEQ ID NO: 588191 - DNA, 20 bp, Artificial
  CRISPR gRNA sequence
gcactccagcctgggccaca

SEQ ID NO: 588192 - DNA, 20 bp, Artificial
  CRISPR gRNA sequence
tccagcctgggccacagagt

SEQ ID NO: 588193 - DNA, 20 bp, Artificial
  CRISPR gRNA sequence
cacagagtgagaccctgtct

SEQ ID NO: 588194 - DNA, 20 bp, Artificial
  CRISPR gRNA sequence
cctgtctcagaaaaaaaaaa

SEQ ID NO: 588195 - DNA, 20 bp, Artificial
  CRISPR gRNA sequence
tcacttaaatactatgttaa

SEQ ID NO: 588196 - DNA, 20 bp, Artificial
  CRISPR gRNA sequence
ctatgttaaaagttcacatg

SEQ ID NO: 588197 - DNA, 20 bp, Artificial
  CRISPR gRNA sequence
ttaaaagttcacatgaagca

SEQ ID NO: 588198 - DNA, 20 bp, Artificial
  CRISPR gRNA sequence
aaagttcacatgaagcaaag

SEQ ID NO: 588199 - DNA, 20 bp, Artificial
  CRISPR gRNA sequence
agcaaagtagatgatttgta

SEQ ID NO: 588200 - DNA, 20 bp, Artificial
  CRISPR gRNA sequence
tgatttgtatagtaaatctc

SEQ ID NO: 588201 - DNA, 20 bp, Artificial
  CRISPR gRNA sequence
taaatctcaagattactgaa

SEQ ID NO: 588202 - DNA, 20 bp, Artificial
  CRISPR gRNA sequence
tctcaagattactgaatagc

SEQ ID NO: 588203 - DNA, 20 bp, Artificial
  CRISPR gRNA sequence
tcaagattactgaatagcaa

SEQ ID NO: 588204 - DNA, 20 bp, Artificial
  CRISPR gRNA sequence
tactgaatagcaagagtttc

SEQ ID NO: 588205 - DNA, 20 bp, Artificial
  CRISPR gRNA sequence
aatagcaagagtttcaagta

SEQ ID NO: 588206 - DNA, 20 bp, Artificial
  CRISPR gRNA sequence
aactttatgtaatgtatctc

SEQ ID NO: 588207 - DNA, 20 bp, Artificial
  CRISPR gRNA sequence
actttatgtaatgtatctct

SEQ ID NO: 588208 - DNA, 20 bp, Artificial
  CRISPR gRNA sequence
tctctgggacatgtttttaa

SEQ ID NO: 588209 - DNA, 20 bp, Artificial
  CRISPR gRNA sequence
gggacatgtttttaaaagtg

SEQ ID NO: 588210 - DNA, 20 bp, Artificial
  CRISPR gRNA sequence
aaaagtgcagttcactttct

SEQ ID NO: 588211 - DNA, 20 bp, Artificial
  CRISPR gRNA sequence
agtgcagttcactttctcag

SEQ ID NO: 588212 - DNA, 20 bp, Artificial
  CRISPR gRNA sequence
gtgcagttcactttctcagt

SEQ ID NO: 588213 - DNA, 20 bp, Artificial
  CRISPR gRNA sequence
acttgactgtaatctttttt

SEQ ID NO: 588214 - DNA, 20 bp, Artificial
  CRISPR gRNA sequence
cttgactgtaatcttttttt

SEQ ID NO: 588215 - DNA, 20 bp, Artificial
  CRISPR gRNA sequence
ttgactgtaatctttttttg

SEQ ID NO: 588216 - DNA, 20 bp, Artificial
  CRISPR gRNA sequence
tgactgtaatctttttttgg

SEQ ID NO: 588217 - DNA, 20 bp, Artificial
  CRISPR gRNA sequence
gactgtaatctttttttggg

SEQ ID NO: 588218 - DNA, 20 bp, Artificial
  CRISPR gRNA sequence
actgtaatctttttttgggg

SEQ ID NO: 588219 - DNA, 20 bp, Artificial
  CRISPR gRNA sequence
ctgtaatctttttttggggg

SEQ ID NO: 588220 - DNA, 20 bp, Artificial
  CRISPR gRNA sequence
taatctttttttgggggggg

SEQ ID NO: 588221 - DNA, 20 bp, Artificial
  CRISPR gRNA sequence
aatctttttttggggggggt

SEQ ID NO: 588222 - DNA, 20 bp, Artificial
  CRISPR gRNA sequence
tctttttttggggggggtgg

SEQ ID NO: 588223 - DNA, 20 bp, Artificial
  CRISPR gRNA sequence
ctttttttggggggggtggg

SEQ ID NO: 588224 - DNA, 20 bp, Artificial
  CRISPR gRNA sequence
ttttggggggggtgggagga

SEQ ID NO: 588225 - DNA, 20 bp, Artificial
  CRISPR gRNA sequence
ttggggggggtgggaggatg

SEQ ID NO: 588226 - DNA, 20 bp, Artificial
  CRISPR gRNA sequence
tggagtttcgctctgtcacc

SEQ ID NO: 588227 - DNA, 20 bp, Artificial
  CRISPR gRNA sequence
ggagtttcgctctgtcaccc

SEQ ID NO: 588228 - DNA, 20 bp, Artificial
  CRISPR gRNA sequence
tttcgctctgtcacccaggc

SEQ ID NO: 588229 - DNA, 20 bp, Artificial
  CRISPR gRNA sequence
ccaggctggtgtccgcctcc

SEQ ID NO: 588230 - DNA, 20 bp, Artificial
  CRISPR gRNA sequence
caggctggtgtccgcctccc

SEQ ID NO: 588231 - DNA, 20 bp, Artificial
  CRISPR gRNA sequence
ggtgtccgcctcccgggatc

SEQ ID NO: 588232 - DNA, 20 bp, Artificial
  CRISPR gRNA sequence
atcaagcaatcctcctgcct

SEQ ID NO: 588233 - DNA, 20 bp, Artificial
  CRISPR gRNA sequence
tcctcctgcctcagcctccc

SEQ ID NO: 588234 - DNA, 20 bp, Artificial
  CRISPR gRNA sequence
tcctgcctcagcctcccgag

SEQ ID NO: 588235 - DNA, 20 bp, Artificial
  CRISPR gRNA sequence
gcctcagcctcccgagtagc

SEQ ID NO: 588236 - DNA, 20 bp, Artificial
  CRISPR gRNA sequence
cctcagcctcccgagtagct

SEQ ID NO: 588237 - DNA, 20 bp, Artificial
  CRISPR gRNA sequence
ctcccgagtagctgggacta

SEQ ID NO: 588238 - DNA, 20 bp, Artificial
  CRISPR gRNA sequence
tcccgagtagctgggactac

SEQ ID NO: 588239 - DNA, 20 bp, Artificial
  CRISPR gRNA sequence
caggcgtgtgctatcacgcc

SEQ ID NO: 588240 - DNA, 20 bp, Artificial
  CRISPR gRNA sequence
cagataattttttgtatttt

SEQ ID NO: 588241 - DNA, 20 bp, Artificial
  CRISPR gRNA sequence
ataattttttgtatttttag

SEQ ID NO: 588242 - DNA, 20 bp, Artificial
  CRISPR gRNA sequence
ttgtatttttagtagaaaca

SEQ ID NO: 588243 - DNA, 20 bp, Artificial
  CRISPR gRNA sequence
cacggtttcaccatgttaac

SEQ ID NO: 588244 - DNA, 20 bp, Artificial
  CRISPR gRNA sequence
tttcaccatgttaaccagaa

SEQ ID NO: 588245 - DNA, 20 bp, Artificial
  CRISPR gRNA sequence
acctcatgatccgcccacct

SEQ ID NO: 588246 - DNA, 20 bp, Artificial
  CRISPR gRNA sequence
ccgcccacctcggcctccca

SEQ ID NO: 588247 - DNA, 20 bp, Artificial
  CRISPR gRNA sequence
acctcggcctcccaaagtgt

SEQ ID NO: 588248 - DNA, 20 bp, Artificial
  CRISPR gRNA sequence
cctcggcctcccaaagtgtt

SEQ ID NO: 588249 - DNA, 20 bp, Artificial
  CRISPR gRNA sequence
ctcccaaagtgttaggatta

SEQ ID NO: 588250 - DNA, 20 bp, Artificial
  CRISPR gRNA sequence
tcccaaagtgttaggattac

SEQ ID NO: 588251 - DNA, 20 bp, Artificial
  CRISPR gRNA sequence
agtgttaggattacaggtgt

SEQ ID NO: 588252 - DNA, 20 bp, Artificial
  CRISPR gRNA sequence
caggtgtgagccaccgtgcc

SEQ ID NO: 588253 - DNA, 20 bp, Artificial
  CRISPR gRNA sequence
cacaacttgactgtaatctt

SEQ ID NO: 588254 - DNA, 20 bp, Artificial
  CRISPR gRNA sequence
atttacatttcacataaaaa

SEQ ID NO: 588255 - DNA, 20 bp, Artificial
  CRISPR gRNA sequence
gttattatttttttctttct

SEQ ID NO: 588256 - DNA, 20 bp, Artificial
  CRISPR gRNA sequence
ttttctttcttagacacttc

SEQ ID NO: 588257 - DNA, 20 bp, Artificial
  CRISPR gRNA sequence
tttctttcttagacacttca

SEQ ID NO: 588258 - DNA, 20 bp, Artificial
  CRISPR gRNA sequence
cttagacacttcaaggctat

SEQ ID NO: 588259 - DNA, 20 bp, Artificial
  CRISPR gRNA sequence
cacttcaaggctatcagatg

SEQ ID NO: 588260 - DNA, 20 bp, Artificial
  CRISPR gRNA sequence
acttcaaggctatcagatgt

SEQ ID NO: 588261 - DNA, 20 bp, Artificial
  CRISPR gRNA sequence
ggctatcagatgtaggatat

SEQ ID NO: 588262 - DNA, 20 bp, Artificial
  CRISPR gRNA sequence
agatgtaggatatcagacat

SEQ ID NO: 588263 - DNA, 20 bp, Artificial
  CRISPR gRNA sequence
tgtaggatatcagacattag

SEQ ID NO: 588264 - DNA, 20 bp, Artificial
  CRISPR gRNA sequence
gatatcagacattagtagac

SEQ ID NO: 588265 - DNA, 20 bp, Artificial
  CRISPR gRNA sequence
cattagtagacaagaaatat

SEQ ID NO: 588266 - DNA, 20 bp, Artificial
  CRISPR gRNA sequence
caagaaatattggcactgtg

SEQ ID NO: 588267 - DNA, 20 bp, Artificial
  CRISPR gRNA sequence
gaagactcaatataaacctt

SEQ ID NO: 588268 - DNA, 20 bp, Artificial
  CRISPR gRNA sequence
taaaccttaagatgttaatt

SEQ ID NO: 588269 - DNA, 20 bp, Artificial
  CRISPR gRNA sequence
aaacttattttaaaataaac

SEQ ID NO: 588270 - DNA, 20 bp, Artificial
  CRISPR gRNA sequence
aacttattttaaaataaact

SEQ ID NO: 588271 - DNA, 20 bp, Artificial
  CRISPR gRNA sequence
acttattttaaaataaacta

SEQ ID NO: 588272 - DNA, 20 bp, Artificial
  CRISPR gRNA sequence
caaacaaacaaacaaacaaa

SEQ ID NO: 588273 - DNA, 20 bp, Artificial
  CRISPR gRNA sequence
acaaacaaacaaacaaaaag

SEQ ID NO: 588274 - DNA, 20 bp, Artificial
  CRISPR gRNA sequence
acaaacaaaaagaagtaatt

SEQ ID NO: 588275 - DNA, 20 bp, Artificial
  CRISPR gRNA sequence
aaacaaaaagaagtaatttg

SEQ ID NO: 588276 - DNA, 20 bp, Artificial
  CRISPR gRNA sequence
aacaaaaagaagtaatttgg

SEQ ID NO: 588277 - DNA, 20 bp, Artificial
  CRISPR gRNA sequence
acaaaaagaagtaatttgga

SEQ ID NO: 588278 - DNA, 20 bp, Artificial
  CRISPR gRNA sequence
aaaaagaagtaatttggagg

SEQ ID NO: 588279 - DNA, 20 bp, Artificial
  CRISPR gRNA sequence
aagaagtaatttggagggag

SEQ ID NO: 588280 - DNA, 20 bp, Artificial
  CRISPR gRNA sequence
gaagtaatttggagggagtg

SEQ ID NO: 588281 - DNA, 20 bp, Artificial
  CRISPR gRNA sequence
gggagtggagactactcttt

SEQ ID NO: 588282 - DNA, 20 bp, Artificial
  CRISPR gRNA sequence
ggagtggagactactcttta

SEQ ID NO: 588283 - DNA, 20 bp, Artificial
  CRISPR gRNA sequence
ggagactactctttaaggtg

SEQ ID NO: 588284 - DNA, 20 bp, Artificial
  CRISPR gRNA sequence
gactactctttaaggtgtgg

SEQ ID NO: 588285 - DNA, 20 bp, Artificial
  CRISPR gRNA sequence
tactctttaaggtgtggtag

SEQ ID NO: 588286 - DNA, 20 bp, Artificial
  CRISPR gRNA sequence
gtgtggtagtagtgactgat

SEQ ID NO: 588287 - DNA, 20 bp, Artificial
  CRISPR gRNA sequence
agtgactgattagcaaaatc

SEQ ID NO: 588288 - DNA, 20 bp, Artificial
  CRISPR gRNA sequence
gtgactgattagcaaaatcc

SEQ ID NO: 588289 - DNA, 20 bp, Artificial
  CRISPR gRNA sequence
tgactgattagcaaaatcca

SEQ ID NO: 588290 - DNA, 20 bp, Artificial
  CRISPR gRNA sequence
actgattagcaaaatccagg

SEQ ID NO: 588291 - DNA, 20 bp, Artificial
  CRISPR gRNA sequence
ttagcaaaatccagggagaa

SEQ ID NO: 588292 - DNA, 20 bp, Artificial
  CRISPR gRNA sequence
ggagaaaagataacacattg

SEQ ID NO: 588293 - DNA, 20 bp, Artificial
  CRISPR gRNA sequence
ttgtagttcgcatcatataa

SEQ ID NO: 588294 - DNA, 20 bp, Artificial
  CRISPR gRNA sequence
tagttcgcatcatataatag

SEQ ID NO: 588295 - DNA, 20 bp, Artificial
  CRISPR gRNA sequence
gcatcatataatagcagcac

SEQ ID NO: 588296 - DNA, 20 bp, Artificial
  CRISPR gRNA sequence
catcatataatagcagcacc

SEQ ID NO: 588297 - DNA, 20 bp, Artificial
  CRISPR gRNA sequence
tcatataatagcagcaccag

SEQ ID NO: 588298 - DNA, 20 bp, Artificial
  CRISPR gRNA sequence
tagcagcaccaggagattta

SEQ ID NO: 588299 - DNA, 20 bp, Artificial
  CRISPR gRNA sequence
gcagcaccaggagatttaaa

SEQ ID NO: 588300 - DNA, 20 bp, Artificial
  CRISPR gRNA sequence
ggagatttaaagagtaaatt

SEQ ID NO: 588301 - DNA, 20 bp, Artificial
  CRISPR gRNA sequence
agtgacttgacaacgtccca

SEQ ID NO: 588302 - DNA, 20 bp, Artificial
  CRISPR gRNA sequence
aacgtcccatagctaatttg

SEQ ID NO: 588303 - DNA, 20 bp, Artificial
  CRISPR gRNA sequence
tcccatagctaatttgcagc

SEQ ID NO: 588304 - DNA, 20 bp, Artificial
  CRISPR gRNA sequence
cccatagctaatttgcagca

SEQ ID NO: 588305 - DNA, 20 bp, Artificial
  CRISPR gRNA sequence
tgccttgatctcctgacttc

SEQ ID NO: 588306 - DNA, 20 bp, Artificial
  CRISPR gRNA sequence
ttgatctcctgacttctaga

SEQ ID NO: 588307 - DNA, 20 bp, Artificial
  CRISPR gRNA sequence
acattttttttttcaatcat

SEQ ID NO: 588308 - DNA, 20 bp, Artificial
  CRISPR gRNA sequence
cattttttttttcaatcatt

SEQ ID NO: 588309 - DNA, 20 bp, Artificial
  CRISPR gRNA sequence
ttttttttttcaatcattag

SEQ ID NO: 588310 - DNA, 20 bp, Artificial
  CRISPR gRNA sequence
tcaatcattaggagttactt

SEQ ID NO: 588311 - DNA, 20 bp, Artificial
  CRISPR gRNA sequence
atcattaggagttacttcag

SEQ ID NO: 588312 - DNA, 20 bp, Artificial
  CRISPR gRNA sequence
cattaggagttacttcagta

SEQ ID NO: 588313 - DNA, 20 bp, Artificial
  CRISPR gRNA sequence
gagttacttcagtagagtta

SEQ ID NO: 588314 - DNA, 20 bp, Artificial
  CRISPR gRNA sequence
tcagtagagttaaagcttta

SEQ ID NO: 588315 - DNA, 20 bp, Artificial
  CRISPR gRNA sequence
gctttatagaataaacatac

SEQ ID NO: 588316 - DNA, 20 bp, Artificial
  CRISPR gRNA sequence
gagctgtgtcatttatcact

SEQ ID NO: 588317 - DNA, 20 bp, Artificial
  CRISPR gRNA sequence
ctgtgtcatttatcacttag

SEQ ID NO: 588318 - DNA, 20 bp, Artificial
  CRISPR gRNA sequence
tgtgtcatttatcacttagc

SEQ ID NO: 588319 - DNA, 20 bp, Artificial
  CRISPR gRNA sequence
gtgtcatttatcacttagca

SEQ ID NO: 588320 - DNA, 20 bp, Artificial
  CRISPR gRNA sequence
atcacttagcagggtgtgat

SEQ ID NO: 588321 - DNA, 20 bp, Artificial
  CRISPR gRNA sequence
ggtgtgatgagcacaaattg

SEQ ID NO: 588322 - DNA, 20 bp, Artificial
  CRISPR gRNA sequence
tgtgatgagcacaaattgtg

SEQ ID NO: 588323 - DNA, 20 bp, Artificial
  CRISPR gRNA sequence
aattgtggagtttgctgcct

SEQ ID NO: 588324 - DNA, 20 bp, Artificial
  CRISPR gRNA sequence
ttgctgccttagtttaaatc

SEQ ID NO: 588325 - DNA, 20 bp, Artificial
  CRISPR gRNA sequence
tgctgccttagtttaaatcc

SEQ ID NO: 588326 - DNA, 20 bp, Artificial
  CRISPR gRNA sequence
gctgccttagtttaaatcca

SEQ ID NO: 588327 - DNA, 20 bp, Artificial
  CRISPR gRNA sequence
gtgtgacttcttttctgcct

SEQ ID NO: 588328 - DNA, 20 bp, Artificial
  CRISPR gRNA sequence
ttttctgcctcagtgtacaa

SEQ ID NO: 588329 - DNA, 20 bp, Artificial
  CRISPR gRNA sequence
tttctgcctcagtgtacaat

SEQ ID NO: 588330 - DNA, 20 bp, Artificial
  CRISPR gRNA sequence
gtgtacaataggaataacca

SEQ ID NO: 588331 - DNA, 20 bp, Artificial
  CRISPR gRNA sequence
acaataggaataaccaaagt

SEQ ID NO: 588332 - DNA, 20 bp, Artificial
  CRISPR gRNA sequence
aataggaataaccaaagtga

SEQ ID NO: 588333 - DNA, 20 bp, Artificial
  CRISPR gRNA sequence
ataggaataaccaaagtgag

SEQ ID NO: 588334 - DNA, 20 bp, Artificial
  CRISPR gRNA sequence
ctctttgtaaaacatactaa

SEQ ID NO: 588335 - DNA, 20 bp, Artificial
  CRISPR gRNA sequence
aaccaaaaacactgaattct

SEQ ID NO: 588336 - DNA, 20 bp, Artificial
  CRISPR gRNA sequence
ccaaaaacactgaattcttg

SEQ ID NO: 588337 - DNA, 20 bp, Artificial
  CRISPR gRNA sequence
ggagctcatacgttcttctt

SEQ ID NO: 588338 - DNA, 20 bp, Artificial
  CRISPR gRNA sequence
cgttcttctttggtacgtcc

SEQ ID NO: 588339 - DNA, 20 bp, Artificial
  CRISPR gRNA sequence
ggtacgtccgagtatacttc

SEQ ID NO: 588340 - DNA, 20 bp, Artificial
  CRISPR gRNA sequence
acgtccgagtatacttctag

SEQ ID NO: 588341 - DNA, 20 bp, Artificial
  CRISPR gRNA sequence
cgagtatacttctagcagtt

SEQ ID NO: 588342 - DNA, 20 bp, Artificial
  CRISPR gRNA sequence
tagcagttgagctgtatgtg

SEQ ID NO: 588343 - DNA, 20 bp, Artificial
  CRISPR gRNA sequence
gagctgtatgtgtagtcact

SEQ ID NO: 588344 - DNA, 20 bp, Artificial
  CRISPR gRNA sequence
gctgtatgtgtagtcactaa

SEQ ID NO: 588345 - DNA, 20 bp, Artificial
  CRISPR gRNA sequence
tatgtgtagtcactaagagt

SEQ ID NO: 588346 - DNA, 20 bp, Artificial
  CRISPR gRNA sequence
atgtgtagtcactaagagtc

SEQ ID NO: 588347 - DNA, 20 bp, Artificial
  CRISPR gRNA sequence
ctaagagtcaggtatgactg

SEQ ID NO: 588348 - DNA, 20 bp, Artificial
  CRISPR gRNA sequence
gtagcaaaacctatttatgc

SEQ ID NO: 588349 - DNA, 20 bp, Artificial
  CRISPR gRNA sequence
tccaacgaaataattacaaa

SEQ ID NO: 588350 - DNA, 20 bp, Artificial
  CRISPR gRNA sequence
ccaaattttaccactttgaa

SEQ ID NO: 588351 - DNA, 20 bp, Artificial
  CRISPR gRNA sequence
cactttgaaaagattcaata

SEQ ID NO: 588352 - DNA, 20 bp, Artificial
  CRISPR gRNA sequence
tgaaaagattcaataaagat

SEQ ID NO: 588353 - DNA, 20 bp, Artificial
  CRISPR gRNA sequence
agctgataaaaatatttcta

SEQ ID NO: 588354 - DNA, 20 bp, Artificial
  CRISPR gRNA sequence
tgataaaaatatttctaaag

SEQ ID NO: 588355 - DNA, 20 bp, Artificial
  CRISPR gRNA sequence
tatttctaaagaagtgaatg

SEQ ID NO: 588356 - DNA, 20 bp, Artificial
  CRISPR gRNA sequence
atttctaaagaagtgaatgt

SEQ ID NO: 588357 - DNA, 20 bp, Artificial
  CRISPR gRNA sequence
gcaaaaataatcataaaaat

SEQ ID NO: 588358 - DNA, 20 bp, Artificial
  CRISPR gRNA sequence
aaaaaatctttaaaaatgaa

SEQ ID NO: 588359 - DNA, 20 bp, Artificial
  CRISPR gRNA sequence
aaatctttaaaaatgaatag

SEQ ID NO: 588360 - DNA, 20 bp, Artificial
  CRISPR gRNA sequence
atagaagtctgactgcttca

SEQ ID NO: 588361 - DNA, 20 bp, Artificial
  CRISPR gRNA sequence
tagaagtctgactgcttcac

SEQ ID NO: 588362 - DNA, 20 bp, Artificial
  CRISPR gRNA sequence
gactgcttcacaggatcttt

SEQ ID NO: 588363 - DNA, 20 bp, Artificial
  CRISPR gRNA sequence
acaggatctttaagttctta

SEQ ID NO: 588364 - DNA, 20 bp, Artificial
  CRISPR gRNA sequence
agacactgaaaatgtaacta

SEQ ID NO: 588365 - DNA, 20 bp, Artificial
  CRISPR gRNA sequence
taactaaagataatgtgtta

SEQ ID NO: 588366 - DNA, 20 bp, Artificial
  CRISPR gRNA sequence
aactaaagataatgtgttat

SEQ ID NO: 588367 - DNA, 20 bp, Artificial
  CRISPR gRNA sequence
aagataatgtgttatgggta

SEQ ID NO: 588368 - DNA, 20 bp, Artificial
  CRISPR gRNA sequence
aatgtgttatgggtatggtt

SEQ ID NO: 588369 - DNA, 20 bp, Artificial
  CRISPR gRNA sequence
gttatgggtatggtttagac

SEQ ID NO: 588370 - DNA, 20 bp, Artificial
  CRISPR gRNA sequence
acaaccaaatttctcactga

SEQ ID NO: 588371 - DNA, 20 bp, Artificial
  CRISPR gRNA sequence
caaatttctcactgaaagaa

SEQ ID NO: 588372 - DNA, 20 bp, Artificial
  CRISPR gRNA sequence
aatttctcactgaaagaaaa

SEQ ID NO: 588373 - DNA, 20 bp, Artificial
  CRISPR gRNA sequence
ctcactgaaagaaaagagct

SEQ ID NO: 588374 - DNA, 20 bp, Artificial
  CRISPR gRNA sequence
tattacatttatatttttta

SEQ ID NO: 588375 - DNA, 20 bp, Artificial
  CRISPR gRNA sequence
aactgcattttccatgttac

SEQ ID NO: 588376 - DNA, 20 bp, Artificial
  CRISPR gRNA sequence
caatctctttttgcttatgt

SEQ ID NO: 588377 - DNA, 20 bp, Artificial
  CRISPR gRNA sequence
ttttgcttatgttagataaa

SEQ ID NO: 588378 - DNA, 20 bp, Artificial
  CRISPR gRNA sequence
tttgcttatgttagataaaa

SEQ ID NO: 588379 - DNA, 20 bp, Artificial
  CRISPR gRNA sequence
gataaaaaggttttttatta

SEQ ID NO: 588380 - DNA, 20 bp, Artificial
  CRISPR gRNA sequence
gttttttattaaagaaacca

SEQ ID NO: 588381 - DNA, 20 bp, Artificial
  CRISPR gRNA sequence
aagaaaccatggaaaatgct

SEQ ID NO: 588382 - DNA, 20 bp, Artificial
  CRISPR gRNA sequence
accatggaaaatgcttagta

SEQ ID NO: 588383 - DNA, 20 bp, Artificial
  CRISPR gRNA sequence
ttagtacagtgtctactgtc

SEQ ID NO: 588384 - DNA, 20 bp, Artificial
  CRISPR gRNA sequence
tagtacagtgtctactgtct

SEQ ID NO: 588385 - DNA, 20 bp, Artificial
  CRISPR gRNA sequence
agtacagtgtctactgtcta

SEQ ID NO: 588386 - DNA, 20 bp, Artificial
  CRISPR gRNA sequence
cagtgtctactgtctaggga

SEQ ID NO: 588387 - DNA, 20 bp, Artificial
  CRISPR gRNA sequence
ctactgtctagggaaagctc

SEQ ID NO: 588388 - DNA, 20 bp, Artificial
  CRISPR gRNA sequence
agggaaagctcaagaaattc

SEQ ID NO: 588389 - DNA, 20 bp, Artificial
  CRISPR gRNA sequence
cagataaataacctaactac

SEQ ID NO: 588390 - DNA, 20 bp, Artificial
  CRISPR gRNA sequence
agataaataacctaactacc

SEQ ID NO: 588391 - DNA, 20 bp, Artificial
  CRISPR gRNA sequence
aggcctatgcaataaaaacc

SEQ ID NO: 588392 - DNA, 20 bp, Artificial
  CRISPR gRNA sequence
ataaaaaccaagacactact

SEQ ID NO: 588393 - DNA, 20 bp, Artificial
  CRISPR gRNA sequence
agacactacttggtgtcctc

SEQ ID NO: 588394 - DNA, 20 bp, Artificial
  CRISPR gRNA sequence
acactacttggtgtcctcta

SEQ ID NO: 588395 - DNA, 20 bp, Artificial
  CRISPR gRNA sequence
cactacttggtgtcctctag

SEQ ID NO: 588396 - DNA, 20 bp, Artificial
  CRISPR gRNA sequence
cttggtgtcctctagaggac

SEQ ID NO: 588397 - DNA, 20 bp, Artificial
  CRISPR gRNA sequence
ggtgtcctctagaggacaag

SEQ ID NO: 588398 - DNA, 20 bp, Artificial
  CRISPR gRNA sequence
tgtcctctagaggacaagaa

SEQ ID NO: 588399 - DNA, 20 bp, Artificial
  CRISPR gRNA sequence
agaggacaagaagagttcct

SEQ ID NO: 588400 - DNA, 20 bp, Artificial
  CRISPR gRNA sequence
ggacaagaagagttcctaag

SEQ ID NO: 588401 - DNA, 20 bp, Artificial
  CRISPR gRNA sequence
cagaaaaataccaccttgta

SEQ ID NO: 588402 - DNA, 20 bp, Artificial
  CRISPR gRNA sequence
agaaaaataccaccttgtac

SEQ ID NO: 588403 - DNA, 20 bp, Artificial
  CRISPR gRNA sequence
gaaaaataccaccttgtaca

SEQ ID NO: 588404 - DNA, 20 bp, Artificial
  CRISPR gRNA sequence
accttgtacagggatcatgc

SEQ ID NO: 588405 - DNA, 20 bp, Artificial
  CRISPR gRNA sequence
ccttgtacagggatcatgca

SEQ ID NO: 588406 - DNA, 20 bp, Artificial
  CRISPR gRNA sequence
cacacacacacacacacccc

SEQ ID NO: 588407 - DNA, 20 bp, Artificial
  CRISPR gRNA sequence
acttaatacatattgtattc

SEQ ID NO: 588408 - DNA, 20 bp, Artificial
  CRISPR gRNA sequence
tgtattccagatatttttca

SEQ ID NO: 588409 - DNA, 20 bp, Artificial
  CRISPR gRNA sequence
ttaaactgtaacatctatca

SEQ ID NO: 588410 - DNA, 20 bp, Artificial
  CRISPR gRNA sequence
gtattcatgcacatctgtgc

SEQ ID NO: 588411 - DNA, 20 bp, Artificial
  CRISPR gRNA sequence
tattcatgcacatctgtgct

SEQ ID NO: 588412 - DNA, 20 bp, Artificial
  CRISPR gRNA sequence
caacctactaaatgaaaatc

SEQ ID NO: 588413 - DNA, 20 bp, Artificial
  CRISPR gRNA sequence
tactaaatgaaaatcaagat

SEQ ID NO: 588414 - DNA, 20 bp, Artificial
  CRISPR gRNA sequence
aatcaagatgagaaattttt

SEQ ID NO: 588415 - DNA, 20 bp, Artificial
  CRISPR gRNA sequence
aaatttttaagtctacaata

SEQ ID NO: 588416 - DNA, 20 bp, Artificial
  CRISPR gRNA sequence
aatttttaagtctacaatat

SEQ ID NO: 588417 - DNA, 20 bp, Artificial
  CRISPR gRNA sequence
ttttaagtctacaatatagg

SEQ ID NO: 588418 - DNA, 20 bp, Artificial
  CRISPR gRNA sequence
taagtctacaatataggaag

SEQ ID NO: 588419 - DNA, 20 bp, Artificial
  CRISPR gRNA sequence
caatataggaagcagaaatg

SEQ ID NO: 588420 - DNA, 20 bp, Artificial
  CRISPR gRNA sequence
ataacaatacaataaaacaa

SEQ ID NO: 588421 - DNA, 20 bp, Artificial
  CRISPR gRNA sequence
caatacaataaaacaatgga

SEQ ID NO: 588422 - DNA, 20 bp, Artificial
  CRISPR gRNA sequence
aacaatggacagttattacc

SEQ ID NO: 588423 - DNA, 20 bp, Artificial
  CRISPR gRNA sequence
caatggacagttattacctg

SEQ ID NO: 588424 - DNA, 20 bp, Artificial
  CRISPR gRNA sequence
aatggacagttattacctgg

SEQ ID NO: 588425 - DNA, 20 bp, Artificial
  CRISPR gRNA sequence
cagttattacctggaggaaa

SEQ ID NO: 588426 - DNA, 20 bp, Artificial
  CRISPR gRNA sequence
agttattacctggaggaaaa

SEQ ID NO: 588427 - DNA, 20 bp, Artificial
  CRISPR gRNA sequence
gttattacctggaggaaaaa

SEQ ID NO: 588428 - DNA, 20 bp, Artificial
  CRISPR gRNA sequence
tattacctggaggaaaaagg

SEQ ID NO: 588429 - DNA, 20 bp, Artificial
  CRISPR gRNA sequence
attacctggaggaaaaaggg

SEQ ID NO: 588430 - DNA, 20 bp, Artificial
  CRISPR gRNA sequence
aataataatattcataaaaa

SEQ ID NO: 588431 - DNA, 20 bp, Artificial
  CRISPR gRNA sequence
taataatattcataaaaaca

SEQ ID NO: 588432 - DNA, 20 bp, Artificial
  CRISPR gRNA sequence
ttccccttaatactctatat

SEQ ID NO: 588433 - DNA, 20 bp, Artificial
  CRISPR gRNA sequence
cccttaatactctatatcag

SEQ ID NO: 588434 - DNA, 20 bp, Artificial
  CRISPR gRNA sequence
gttcccaaccttttcaccac

SEQ ID NO: 588435 - DNA, 20 bp, Artificial
  CRISPR gRNA sequence
ttcccaaccttttcaccacc

SEQ ID NO: 588436 - DNA, 20 bp, Artificial
  CRISPR gRNA sequence
tcccaaccttttcaccacca

SEQ ID NO: 588437 - DNA, 20 bp, Artificial
  CRISPR gRNA sequence
accttttcaccaccagggac

SEQ ID NO: 588438 - DNA, 20 bp, Artificial
  CRISPR gRNA sequence
accaccagggaccagtttca

SEQ ID NO: 588439 - DNA, 20 bp, Artificial
  CRISPR gRNA sequence
accagggaccagtttcatgg

SEQ ID NO: 588440 - DNA, 20 bp, Artificial
  CRISPR gRNA sequence
gggaccagtttcatggaaga

SEQ ID NO: 588441 - DNA, 20 bp, Artificial
  CRISPR gRNA sequence
gacagtttttccacaaatga

SEQ ID NO: 588442 - DNA, 20 bp, Artificial
  CRISPR gRNA sequence
acagtttttccacaaatgac

SEQ ID NO: 588443 - DNA, 20 bp, Artificial
  CRISPR gRNA sequence
gtttttccacaaatgacagg

SEQ ID NO: 588444 - DNA, 20 bp, Artificial
  CRISPR gRNA sequence
tttccacaaatgacaggtgg

SEQ ID NO: 588445 - DNA, 20 bp, Artificial
  CRISPR gRNA sequence
ttccacaaatgacaggtggt

SEQ ID NO: 588446 - DNA, 20 bp, Artificial
  CRISPR gRNA sequence
tccacaaatgacaggtggtg

SEQ ID NO: 588447 - DNA, 20 bp, Artificial
  CRISPR gRNA sequence
ccacaaatgacaggtggtgg

SEQ ID NO: 588448 - DNA, 20 bp, Artificial
  CRISPR gRNA sequence
aggtggtgggggaatgattt

SEQ ID NO: 588449 - DNA, 20 bp, Artificial
  CRISPR gRNA sequence
agaatgaaactattccacct

SEQ ID NO: 588450 - DNA, 20 bp, Artificial
  CRISPR gRNA sequence
actattccacctcagatcat

SEQ ID NO: 588451 - DNA, 20 bp, Artificial
  CRISPR gRNA sequence
ctattccacctcagatcatc

SEQ ID NO: 588452 - DNA, 20 bp, Artificial
  CRISPR gRNA sequence
cacctcagatcatcaggcat

SEQ ID NO: 588453 - DNA, 20 bp, Artificial
  CRISPR gRNA sequence
atcaggcattagattctcat

SEQ ID NO: 588454 - DNA, 20 bp, Artificial
  CRISPR gRNA sequence
tcaggcattagattctcata

SEQ ID NO: 588455 - DNA, 20 bp, Artificial
  CRISPR gRNA sequence
aggcattagattctcataag

SEQ ID NO: 588456 - DNA, 20 bp, Artificial
  CRISPR gRNA sequence
attctcataaggagcacacc

SEQ ID NO: 588457 - DNA, 20 bp, Artificial
  CRISPR gRNA sequence
ctcataaggagcacaccaag

SEQ ID NO: 588458 - DNA, 20 bp, Artificial
  CRISPR gRNA sequence
tcataaggagcacaccaagt

SEQ ID NO: 588459 - DNA, 20 bp, Artificial
  CRISPR gRNA sequence
aagtaggtcccttgcatgcg

SEQ ID NO: 588460 - DNA, 20 bp, Artificial
  CRISPR gRNA sequence
cttgcatgcgcagttcacaa

SEQ ID NO: 588461 - DNA, 20 bp, Artificial
  CRISPR gRNA sequence
ttgcatgcgcagttcacaat

SEQ ID NO: 588462 - DNA, 20 bp, Artificial
  CRISPR gRNA sequence
tgcatgcgcagttcacaata

SEQ ID NO: 588463 - DNA, 20 bp, Artificial
  CRISPR gRNA sequence
acaatagggtgcgtgcctat

SEQ ID NO: 588464 - DNA, 20 bp, Artificial
  CRISPR gRNA sequence
taatgctgtcactgatctga

SEQ ID NO: 588465 - DNA, 20 bp, Artificial
  CRISPR gRNA sequence
aatgctgtcactgatctgac

SEQ ID NO: 588466 - DNA, 20 bp, Artificial
  CRISPR gRNA sequence
gctgtcactgatctgacagg

SEQ ID NO: 588467 - DNA, 20 bp, Artificial
  CRISPR gRNA sequence
tgtcactgatctgacaggaa

SEQ ID NO: 588468 - DNA, 20 bp, Artificial
  CRISPR gRNA sequence
gtcactgatctgacaggaag

SEQ ID NO: 588469 - DNA, 20 bp, Artificial
  CRISPR gRNA sequence
cactgatctgacaggaagag

SEQ ID NO: 588470 - DNA, 20 bp, Artificial
  CRISPR gRNA sequence
atctgacaggaagaggagct

SEQ ID NO: 588471 - DNA, 20 bp, Artificial
  CRISPR gRNA sequence
tctgacaggaagaggagctc

SEQ ID NO: 588472 - DNA, 20 bp, Artificial
  CRISPR gRNA sequence
gacaggaagaggagctcagg

SEQ ID NO: 588473 - DNA, 20 bp, Artificial
  CRISPR gRNA sequence
gctgctcacctcctgctatg

SEQ ID NO: 588474 - DNA, 20 bp, Artificial
  CRISPR gRNA sequence
tgctatgcggctcaatttgt

SEQ ID NO: 588475 - DNA, 20 bp, Artificial
  CRISPR gRNA sequence
ctatgcggctcaatttgtaa

SEQ ID NO: 588476 - DNA, 20 bp, Artificial
  CRISPR gRNA sequence
tatgcggctcaatttgtaag

SEQ ID NO: 588477 - DNA, 20 bp, Artificial
  CRISPR gRNA sequence
tcaatttgtaagaggccacc

SEQ ID NO: 588478 - DNA, 20 bp, Artificial
  CRISPR gRNA sequence
gtaagaggccacccagtgac

SEQ ID NO: 588479 - DNA, 20 bp, Artificial
  CRISPR gRNA sequence
ggccacccagtgactggtac

SEQ ID NO: 588480 - DNA, 20 bp, Artificial
  CRISPR gRNA sequence
cagtgactggtactggtctg

SEQ ID NO: 588481 - DNA, 20 bp, Artificial
  CRISPR gRNA sequence
gactggtactggtctgcagc

SEQ ID NO: 588482 - DNA, 20 bp, Artificial
  CRISPR gRNA sequence
actggtactggtctgcagcc

SEQ ID NO: 588483 - DNA, 20 bp, Artificial
  CRISPR gRNA sequence
tggtactggtctgcagccag

SEQ ID NO: 588484 - DNA, 20 bp, Artificial
  CRISPR gRNA sequence
ggtactggtctgcagccagg

SEQ ID NO: 588485 - DNA, 20 bp, Artificial
  CRISPR gRNA sequence
tggtctgcagccaggaggtt

SEQ ID NO: 588486 - DNA, 20 bp, Artificial
  CRISPR gRNA sequence
ggtctgcagccaggaggttg

SEQ ID NO: 588487 - DNA, 20 bp, Artificial
  CRISPR gRNA sequence
tgaggacccctgctctatac

SEQ ID NO: 588488 - DNA, 20 bp, Artificial
  CRISPR gRNA sequence
tgctctatactagtaatttt

SEQ ID NO: 588489 - DNA, 20 bp, Artificial
  CRISPR gRNA sequence
atactagtaattttaagcac

SEQ ID NO: 588490 - DNA, 20 bp, Artificial
  CRISPR gRNA sequence
aagcactagttcttaaattt

SEQ ID NO: 588491 - DNA, 20 bp, Artificial
  CRISPR gRNA sequence
cttaaattttagttaatctg

SEQ ID NO: 588492 - DNA, 20 bp, Artificial
  CRISPR gRNA sequence
tctgtggcacattctctgtt

SEQ ID NO: 588493 - DNA, 20 bp, Artificial
  CRISPR gRNA sequence
cattctctgtttggctgcca

SEQ ID NO: 588494 - DNA, 20 bp, Artificial
  CRISPR gRNA sequence
tctttgctctgctcccgcaa

SEQ ID NO: 588495 - DNA, 20 bp, Artificial
  CRISPR gRNA sequence
ccgcaaaagctaatttttat

SEQ ID NO: 588496 - DNA, 20 bp, Artificial
  CRISPR gRNA sequence
ttttattggctttaatcaat

SEQ ID NO: 588497 - DNA, 20 bp, Artificial
  CRISPR gRNA sequence
caattggctccgttgtcctc

SEQ ID NO: 588498 - DNA, 20 bp, Artificial
  CRISPR gRNA sequence
ctccgttgtcctctggcttc

SEQ ID NO: 588499 - DNA, 20 bp, Artificial
  CRISPR gRNA sequence
ttgtcctctggcttctggtt

SEQ ID NO: 588500 - DNA, 20 bp, Artificial
  CRISPR gRNA sequence
ctctggcttctggttaagtt

SEQ ID NO: 588501 - DNA, 20 bp, Artificial
  CRISPR gRNA sequence
tggttaagtttagtcaatgt

SEQ ID NO: 588502 - DNA, 20 bp, Artificial
  CRISPR gRNA sequence
ggttaagtttagtcaatgtg

SEQ ID NO: 588503 - DNA, 20 bp, Artificial
  CRISPR gRNA sequence
gtttagtcaatgtgaggcac

SEQ ID NO: 588504 - DNA, 20 bp, Artificial
  CRISPR gRNA sequence
agtcaatgtgaggcaccagt

SEQ ID NO: 588505 - DNA, 20 bp, Artificial
  CRISPR gRNA sequence
tcaatgtgaggcaccagtaa

SEQ ID NO: 588506 - DNA, 20 bp, Artificial
  CRISPR gRNA sequence
gaggcaccagtaagagactg

SEQ ID NO: 588507 - DNA, 20 bp, Artificial
  CRISPR gRNA sequence
aggcaccagtaagagactga

SEQ ID NO: 588508 - DNA, 20 bp, Artificial
  CRISPR gRNA sequence
ggcaccagtaagagactgaa

SEQ ID NO: 588509 - DNA, 20 bp, Artificial
  CRISPR gRNA sequence
accagtaagagactgaaggg

SEQ ID NO: 588510 - DNA, 20 bp, Artificial
  CRISPR gRNA sequence
gtaagagactgaagggtgga

SEQ ID NO: 588511 - DNA, 20 bp, Artificial
  CRISPR gRNA sequence
aagagactgaagggtggaaa

SEQ ID NO: 588512 - DNA, 20 bp, Artificial
  CRISPR gRNA sequence
gactgaagggtggaaagagt

SEQ ID NO: 588513 - DNA, 20 bp, Artificial
  CRISPR gRNA sequence
actgaagggtggaaagagtg

SEQ ID NO: 588514 - DNA, 20 bp, Artificial
  CRISPR gRNA sequence
aagggtggaaagagtgaggt

SEQ ID NO: 588515 - DNA, 20 bp, Artificial
  CRISPR gRNA sequence
agggtggaaagagtgaggtc

SEQ ID NO: 588516 - DNA, 20 bp, Artificial
  CRISPR gRNA sequence
gggtggaaagagtgaggtca

SEQ ID NO: 588517 - DNA, 20 bp, Artificial
  CRISPR gRNA sequence
ggtcagggtgtttattcccc

SEQ ID NO: 588518 - DNA, 20 bp, Artificial
  CRISPR gRNA sequence
ggtgtttattccccaagtca

SEQ ID NO: 588519 - DNA, 20 bp, Artificial
  CRISPR gRNA sequence
gtgtttattccccaagtcac

SEQ ID NO: 588520 - DNA, 20 bp, Artificial
  CRISPR gRNA sequence
ttattccccaagtcacaggt

SEQ ID NO: 588521 - DNA, 20 bp, Artificial
  CRISPR gRNA sequence
ccccaagtcacaggttagca

SEQ ID NO: 588522 - DNA, 20 bp, Artificial
  CRISPR gRNA sequence
cccaagtcacaggttagcaa

SEQ ID NO: 588523 - DNA, 20 bp, Artificial
  CRISPR gRNA sequence
aaggctacattcttctaccg

SEQ ID NO: 588524 - DNA, 20 bp, Artificial
  CRISPR gRNA sequence
aggctacattcttctaccga

SEQ ID NO: 588525 - DNA, 20 bp, Artificial
  CRISPR gRNA sequence
tacattcttctaccgaaggt

SEQ ID NO: 588526 - DNA, 20 bp, Artificial
  CRISPR gRNA sequence
tctaccgaaggtcagtgctc

SEQ ID NO: 588527 - DNA, 20 bp, Artificial
  CRISPR gRNA sequence
tttcctatttctcttaattc

SEQ ID NO: 588528 - DNA, 20 bp, Artificial
  CRISPR gRNA sequence
ctcttaattccagtgacctc

SEQ ID NO: 588529 - DNA, 20 bp, Artificial
  CRISPR gRNA sequence
tctagatcccctttctcttt

SEQ ID NO: 588530 - DNA, 20 bp, Artificial
  CRISPR gRNA sequence
ctagatcccctttctctttc

SEQ ID NO: 588531 - DNA, 20 bp, Artificial
  CRISPR gRNA sequence
atcccctttctctttcaggc

SEQ ID NO: 588532 - DNA, 20 bp, Artificial
  CRISPR gRNA sequence
cccctttctctttcaggcta

SEQ ID NO: 588533 - DNA, 20 bp, Artificial
  CRISPR gRNA sequence
tttctctttcaggctagagc

SEQ ID NO: 588534 - DNA, 20 bp, Artificial
  CRISPR gRNA sequence
ttcaggctagagctagtaaa

SEQ ID NO: 588535 - DNA, 20 bp, Artificial
  CRISPR gRNA sequence
gcttcctactactgtaaacc

SEQ ID NO: 588536 - DNA, 20 bp, Artificial
  CRISPR gRNA sequence
taaacccagccatctttttg

SEQ ID NO: 588537 - DNA, 20 bp, Artificial
  CRISPR gRNA sequence
tccccaaattttccccactt

SEQ ID NO: 588538 - DNA, 20 bp, Artificial
  CRISPR gRNA sequence
gtgtcttactgttttcttgt

SEQ ID NO: 588539 - DNA, 20 bp, Artificial
  CRISPR gRNA sequence
tgtcttactgttttcttgtc

SEQ ID NO: 588540 - DNA, 20 bp, Artificial
  CRISPR gRNA sequence
tgtcaggatcctgactgata

SEQ ID NO: 588541 - DNA, 20 bp, Artificial
  CRISPR gRNA sequence
tcaggatcctgactgataaa

SEQ ID NO: 588542 - DNA, 20 bp, Artificial
  CRISPR gRNA sequence
tgataaagagttactgatat

SEQ ID NO: 588543 - DNA, 20 bp, Artificial
  CRISPR gRNA sequence
agagttactgatatcagaaa

SEQ ID NO: 588544 - DNA, 20 bp, Artificial
  CRISPR gRNA sequence
ctgatatcagaaatggccca

SEQ ID NO: 588545 - DNA, 20 bp, Artificial
  CRISPR gRNA sequence
tcagaaatggcccaaagctc

SEQ ID NO: 588546 - DNA, 20 bp, Artificial
  CRISPR gRNA sequence
gcccaaagctccagtcaaaa

SEQ ID NO: 588547 - DNA, 20 bp, Artificial
  CRISPR gRNA sequence
ctccagtcaaaatggaattc

SEQ ID NO: 588548 - DNA, 20 bp, Artificial
  CRISPR gRNA sequence
tccagtcaaaatggaattca

SEQ ID NO: 588549 - DNA, 20 bp, Artificial
  CRISPR gRNA sequence
gtcaaaatggaattcaagga

SEQ ID NO: 588550 - DNA, 20 bp, Artificial
  CRISPR gRNA sequence
aaaatggaattcaaggatag

SEQ ID NO: 588551 - DNA, 20 bp, Artificial
  CRISPR gRNA sequence
aaatggaattcaaggatagc

SEQ ID NO: 588552 - DNA, 20 bp, Artificial
  CRISPR gRNA sequence
ggaattcaaggatagcagga

SEQ ID NO: 588553 - DNA, 20 bp, Artificial
  CRISPR gRNA sequence
gcaggatagcctccttatca

SEQ ID NO: 588554 - DNA, 20 bp, Artificial
  CRISPR gRNA sequence
aggatagcctccttatcaca

SEQ ID NO: 588555 - DNA, 20 bp, Artificial
  CRISPR gRNA sequence
cctccttatcacagagttaa

SEQ ID NO: 588556 - DNA, 20 bp, Artificial
  CRISPR gRNA sequence
ctccttatcacagagttaat

SEQ ID NO: 588557 - DNA, 20 bp, Artificial
  CRISPR gRNA sequence
ttatcacagagttaatggga

SEQ ID NO: 588558 - DNA, 20 bp, Artificial
  CRISPR gRNA sequence
tcacagagttaatgggacag

SEQ ID NO: 588559 - DNA, 20 bp, Artificial
  CRISPR gRNA sequence
taatgggacagtagtgatcc

SEQ ID NO: 588560 - DNA, 20 bp, Artificial
  CRISPR gRNA sequence
aatgggacagtagtgatcca

SEQ ID NO: 588561 - DNA, 20 bp, Artificial
  CRISPR gRNA sequence
tagtgatccaaggcatgtgc

SEQ ID NO: 588562 - DNA, 20 bp, Artificial
  CRISPR gRNA sequence
gatccaaggcatgtgctggc

SEQ ID NO: 588563 - DNA, 20 bp, Artificial
  CRISPR gRNA sequence
atgattattcaaattgtcac

SEQ ID NO: 588564 - DNA, 20 bp, Artificial
  CRISPR gRNA sequence
attattcaaattgtcactgg

SEQ ID NO: 588565 - DNA, 20 bp, Artificial
  CRISPR gRNA sequence
attcaaattgtcactggtgg

SEQ ID NO: 588566 - DNA, 20 bp, Artificial
  CRISPR gRNA sequence
aattgtcactggtggtagca

SEQ ID NO: 588567 - DNA, 20 bp, Artificial
  CRISPR gRNA sequence
tgtcactggtggtagcatgg

SEQ ID NO: 588568 - DNA, 20 bp, Artificial
  CRISPR gRNA sequence
gtcactggtggtagcatgga

SEQ ID NO: 588569 - DNA, 20 bp, Artificial
  CRISPR gRNA sequence
gcatggaaggatgtacgacg

SEQ ID NO: 588570 - DNA, 20 bp, Artificial
  CRISPR gRNA sequence
catggaaggatgtacgacgc

SEQ ID NO: 588571 - DNA, 20 bp, Artificial
  CRISPR gRNA sequence
atggaaggatgtacgacgca

SEQ ID NO: 588572 - DNA, 20 bp, Artificial
  CRISPR gRNA sequence
aaggatgtacgacgcagggt

SEQ ID NO: 588573 - DNA, 20 bp, Artificial
  CRISPR gRNA sequence
aggatgtacgacgcagggta

SEQ ID NO: 588574 - DNA, 20 bp, Artificial
  CRISPR gRNA sequence
tacgacgcagggtaaggctt

SEQ ID NO: 588575 - DNA, 20 bp, Artificial
  CRISPR gRNA sequence
acgacgcagggtaaggcttt

SEQ ID NO: 588576 - DNA, 20 bp, Artificial
  CRISPR gRNA sequence
gacgcagggtaaggctttgg

SEQ ID NO: 588577 - DNA, 20 bp, Artificial
  CRISPR gRNA sequence
gggtaaggctttgggagcca

SEQ ID NO: 588578 - DNA, 20 bp, Artificial
  CRISPR gRNA sequence
agccatggcattacttgcta

SEQ ID NO: 588579 - DNA, 20 bp, Artificial
  CRISPR gRNA sequence
catggcattacttgctaaag

SEQ ID NO: 588580 - DNA, 20 bp, Artificial
  CRISPR gRNA sequence
attacttgctaaagcagcaa

SEQ ID NO: 588581 - DNA, 20 bp, Artificial
  CRISPR gRNA sequence
acttgctaaagcagcaatgg

SEQ ID NO: 588582 - DNA, 20 bp, Artificial
  CRISPR gRNA sequence
agcagcaatggtagtgtata

SEQ ID NO: 588583 - DNA, 20 bp, Artificial
  CRISPR gRNA sequence
atggtagtgtataaagatta

SEQ ID NO: 588584 - DNA, 20 bp, Artificial
  CRISPR gRNA sequence
ataaagattacagcatgata

SEQ ID NO: 588585 - DNA, 20 bp, Artificial
  CRISPR gRNA sequence
ttacagcatgatatggctga

SEQ ID NO: 588586 - DNA, 20 bp, Artificial
  CRISPR gRNA sequence
atgatatggctgatggccct

SEQ ID NO: 588587 - DNA, 20 bp, Artificial
  CRISPR gRNA sequence
tgatatggctgatggcccta

SEQ ID NO: 588588 - DNA, 20 bp, Artificial
  CRISPR gRNA sequence
atatggctgatggccctaag

SEQ ID NO: 588589 - DNA, 20 bp, Artificial
  CRISPR gRNA sequence
atggccctaaggagcacaca

SEQ ID NO: 588590 - DNA, 20 bp, Artificial
  CRISPR gRNA sequence
tggccctaaggagcacacaa

SEQ ID NO: 588591 - DNA, 20 bp, Artificial
  CRISPR gRNA sequence
ccctaaggagcacacaaagg

SEQ ID NO: 588592 - DNA, 20 bp, Artificial
  CRISPR gRNA sequence
taaggagcacacaaaggtgg

SEQ ID NO: 588593 - DNA, 20 bp, Artificial
  CRISPR gRNA sequence
acaaaggtggaagacaaact

SEQ ID NO: 588594 - DNA, 20 bp, Artificial
  CRISPR gRNA sequence
tggaagacaaactgagtgcc

SEQ ID NO: 588595 - DNA, 20 bp, Artificial
  CRISPR gRNA sequence
actgagtgcctggaatactc

SEQ ID NO: 588596 - DNA, 20 bp, Artificial
  CRISPR gRNA sequence
agtgcctggaatactcaagt

SEQ ID NO: 588597 - DNA, 20 bp, Artificial
  CRISPR gRNA sequence
ggaatactcaagtcagaata

SEQ ID NO: 588598 - DNA, 20 bp, Artificial
  CRISPR gRNA sequence
gaatactcaagtcagaatac

SEQ ID NO: 588599 - DNA, 20 bp, Artificial
  CRISPR gRNA sequence
tcagaatacaggcaaaatac

SEQ ID NO: 588600 - DNA, 20 bp, Artificial
  CRISPR gRNA sequence
aatacaggcaaaatacaaga

SEQ ID NO: 588601 - DNA, 20 bp, Artificial
  CRISPR gRNA sequence
aaatacaagaaagtttatgt

SEQ ID NO: 588602 - DNA, 20 bp, Artificial
  CRISPR gRNA sequence
aaagtttatgtcagctttaa

SEQ ID NO: 588603 - DNA, 20 bp, Artificial
  CRISPR gRNA sequence
aagtttatgtcagctttaaa

SEQ ID NO: 588604 - DNA, 20 bp, Artificial
  CRISPR gRNA sequence
agtttatgtcagctttaaaa

SEQ ID NO: 588605 - DNA, 20 bp, Artificial
  CRISPR gRNA sequence
aaagggtcccttatccactt

SEQ ID NO: 588606 - DNA, 20 bp, Artificial
  CRISPR gRNA sequence
cccttatccacttaagcctc

SEQ ID NO: 588607 - DNA, 20 bp, Artificial
  CRISPR gRNA sequence
ccttatccacttaagcctca

SEQ ID NO: 588608 - DNA, 20 bp, Artificial
  CRISPR gRNA sequence
acttaagcctcaaggcaaat

SEQ ID NO: 588609 - DNA, 20 bp, Artificial
  CRISPR gRNA sequence
cttaagcctcaaggcaaata

SEQ ID NO: 588610 - DNA, 20 bp, Artificial
  CRISPR gRNA sequence
cctcaaggcaaataaggctg

SEQ ID NO: 588611 - DNA, 20 bp, Artificial
  CRISPR gRNA sequence
ataaggctgaagaccaactc

SEQ ID NO: 588612 - DNA, 20 bp, Artificial
  CRISPR gRNA sequence
caactccagaatctgatttg

SEQ ID NO: 588613 - DNA, 20 bp, Artificial
  CRISPR gRNA sequence
aactccagaatctgatttga

SEQ ID NO: 588614 - DNA, 20 bp, Artificial
  CRISPR gRNA sequence
actccagaatctgatttgaa

SEQ ID NO: 588615 - DNA, 20 bp, Artificial
  CRISPR gRNA sequence
gaatctgatttgaagggtta

SEQ ID NO: 588616 - DNA, 20 bp, Artificial
  CRISPR gRNA sequence
aattgcaatgctaaatacaa

SEQ ID NO: 588617 - DNA, 20 bp, Artificial
  CRISPR gRNA sequence
taaatacaatggacaatact

SEQ ID NO: 588618 - DNA, 20 bp, Artificial
  CRISPR gRNA sequence
atggacaatactaagaccat

SEQ ID NO: 588619 - DNA, 20 bp, Artificial
  CRISPR gRNA sequence
atactaagaccattagtttt

SEQ ID NO: 588620 - DNA, 20 bp, Artificial
  CRISPR gRNA sequence
ctaagaccattagtttttgg

SEQ ID NO: 588621 - DNA, 20 bp, Artificial
  CRISPR gRNA sequence
agaccattagtttttggtag

SEQ ID NO: 588622 - DNA, 20 bp, Artificial
  CRISPR gRNA sequence
gaccattagtttttggtagt

SEQ ID NO: 588623 - DNA, 20 bp, Artificial
  CRISPR gRNA sequence
accattagtttttggtagtg

SEQ ID NO: 588624 - DNA, 20 bp, Artificial
  CRISPR gRNA sequence
tttggtagtggggcaatgat

SEQ ID NO: 588625 - DNA, 20 bp, Artificial
  CRISPR gRNA sequence
gtagtggggcaatgatgaga

SEQ ID NO: 588626 - DNA, 20 bp, Artificial
  CRISPR gRNA sequence
gtggggcaatgatgagaaag

SEQ ID NO: 588627 - DNA, 20 bp, Artificial
  CRISPR gRNA sequence
ggggcaatgatgagaaagca

SEQ ID NO: 588628 - DNA, 20 bp, Artificial
  CRISPR gRNA sequence
gatgagaaagcagagaaaca

SEQ ID NO: 588629 - DNA, 20 bp, Artificial
  CRISPR gRNA sequence
atgagaaagcagagaaacat

SEQ ID NO: 588630 - DNA, 20 bp, Artificial
  CRISPR gRNA sequence
gaaagcagagaaacatggga

SEQ ID NO: 588631 - DNA, 20 bp, Artificial
  CRISPR gRNA sequence
agcagagaaacatgggatgg

SEQ ID NO: 588632 - DNA, 20 bp, Artificial
  CRISPR gRNA sequence
tccccctcaacaacttcatt

SEQ ID NO: 588633 - DNA, 20 bp, Artificial
  CRISPR gRNA sequence
ccccctcaacaacttcattg

SEQ ID NO: 588634 - DNA, 20 bp, Artificial
  CRISPR gRNA sequence
tcaacaacttcattgaggta

SEQ ID NO: 588635 - DNA, 20 bp, Artificial
  CRISPR gRNA sequence
agttaatatacataaaactg

SEQ ID NO: 588636 - DNA, 20 bp, Artificial
  CRISPR gRNA sequence
taaaactgtagtaaaaaaac

SEQ ID NO: 588637 - DNA, 20 bp, Artificial
  CRISPR gRNA sequence
aaaaatattatttcaacatg

SEQ ID NO: 588638 - DNA, 20 bp, Artificial
  CRISPR gRNA sequence
attatttcaacatgtagcac

SEQ ID NO: 588639 - DNA, 20 bp, Artificial
  CRISPR gRNA sequence
catgtagcactagccatatt

SEQ ID NO: 588640 - DNA, 20 bp, Artificial
  CRISPR gRNA sequence
atgtagcactagccatattt

SEQ ID NO: 588641 - DNA, 20 bp, Artificial
  CRISPR gRNA sequence
actagccatatttaggtgtt

SEQ ID NO: 588642 - DNA, 20 bp, Artificial
  CRISPR gRNA sequence
taggtgtttagtaaccacat

SEQ ID NO: 588643 - DNA, 20 bp, Artificial
  CRISPR gRNA sequence
aggtgtttagtaaccacatg

SEQ ID NO: 588644 - DNA, 20 bp, Artificial
  CRISPR gRNA sequence
gtttagtaaccacatgaggc

SEQ ID NO: 588645 - DNA, 20 bp, Artificial
  CRISPR gRNA sequence
tagtaaccacatgaggctag

SEQ ID NO: 588646 - DNA, 20 bp, Artificial
  CRISPR gRNA sequence
gaggctagtggctaccatat

SEQ ID NO: 588647 - DNA, 20 bp, Artificial
  CRISPR gRNA sequence
ctagtggctaccatattgga

SEQ ID NO: 588648 - DNA, 20 bp, Artificial
  CRISPR gRNA sequence
ggctaccatattggacagcg

SEQ ID NO: 588649 - DNA, 20 bp, Artificial
  CRISPR gRNA sequence
ctacaactatcacctctccc

SEQ ID NO: 588650 - DNA, 20 bp, Artificial
  CRISPR gRNA sequence
aactatcacctctcccaaga

SEQ ID NO: 588651 - DNA, 20 bp, Artificial
  CRISPR gRNA sequence
ctcccaagacagcaaactaa

SEQ ID NO: 588652 - DNA, 20 bp, Artificial
  CRISPR gRNA sequence
taaaagaaataataattcta

SEQ ID NO: 588653 - DNA, 20 bp, Artificial
  CRISPR gRNA sequence
ataattctatggatgaataa

SEQ ID NO: 588654 - DNA, 20 bp, Artificial
  CRISPR gRNA sequence
ttctatggatgaataacaga

SEQ ID NO: 588655 - DNA, 20 bp, Artificial
  CRISPR gRNA sequence
tatggatgaataacagacag

SEQ ID NO: 588656 - DNA, 20 bp, Artificial
  CRISPR gRNA sequence
acagacagtagtgaaaccat

SEQ ID NO: 588657 - DNA, 20 bp, Artificial
  CRISPR gRNA sequence
tgaaaccatcagaaaactga

SEQ ID NO: 588658 - DNA, 20 bp, Artificial
  CRISPR gRNA sequence
atcagaaaactgaaagatgt

SEQ ID NO: 588659 - DNA, 20 bp, Artificial
  CRISPR gRNA sequence
tcagaaaactgaaagatgtt

SEQ ID NO: 588660 - DNA, 20 bp, Artificial
  CRISPR gRNA sequence
cagaaaactgaaagatgtta

SEQ ID NO: 588661 - DNA, 20 bp, Artificial
  CRISPR gRNA sequence
agaaaactgaaagatgttag

SEQ ID NO: 588662 - DNA, 20 bp, Artificial
  CRISPR gRNA sequence
cacccatttaaactgtttat

SEQ ID NO: 588663 - DNA, 20 bp, Artificial
  CRISPR gRNA sequence
acccatttaaactgtttatt

SEQ ID NO: 588664 - DNA, 20 bp, Artificial
  CRISPR gRNA sequence
tttaaactgtttattaggct

SEQ ID NO: 588665 - DNA, 20 bp, Artificial
  CRISPR gRNA sequence
ttaaactgtttattaggcta

SEQ ID NO: 588666 - DNA, 20 bp, Artificial
  CRISPR gRNA sequence
ctgtttattaggctaaggca

SEQ ID NO: 588667 - DNA, 20 bp, Artificial
  CRISPR gRNA sequence
gctaaggcatggcattgatg

SEQ ID NO: 588668 - DNA, 20 bp, Artificial
  CRISPR gRNA sequence
tcatttcataatgctaactg

SEQ ID NO: 588669 - DNA, 20 bp, Artificial
  CRISPR gRNA sequence
cataatgctaactgtagatg

SEQ ID NO: 588670 - DNA, 20 bp, Artificial
  CRISPR gRNA sequence
gctaactgtagatgcagttt

SEQ ID NO: 588671 - DNA, 20 bp, Artificial
  CRISPR gRNA sequence
tttagctgtacaatctttac

SEQ ID NO: 588672 - DNA, 20 bp, Artificial
  CRISPR gRNA sequence
tagctgtacaatctttactg

SEQ ID NO: 588673 - DNA, 20 bp, Artificial
  CRISPR gRNA sequence
tttactggagcatattaaca

SEQ ID NO: 588674 - DNA, 20 bp, Artificial
  CRISPR gRNA sequence
attaacatagccactgacac

SEQ ID NO: 588675 - DNA, 20 bp, Artificial
  CRISPR gRNA sequence
ttaacatagccactgacact

SEQ ID NO: 588676 - DNA, 20 bp, Artificial
  CRISPR gRNA sequence
agccactgacactaggtatg

SEQ ID NO: 588677 - DNA, 20 bp, Artificial
  CRISPR gRNA sequence
aatgaacttgatttctgttt

SEQ ID NO: 588678 - DNA, 20 bp, Artificial
  CRISPR gRNA sequence
atgaacttgatttctgttta

SEQ ID NO: 588679 - DNA, 20 bp, Artificial
  CRISPR gRNA sequence
ttaaggtaatttgtataaca

SEQ ID NO: 588680 - DNA, 20 bp, Artificial
  CRISPR gRNA sequence
atttgtataacaaagataat

SEQ ID NO: 588681 - DNA, 20 bp, Artificial
  CRISPR gRNA sequence
tgtataacaaagataatcag

SEQ ID NO: 588682 - DNA, 20 bp, Artificial
  CRISPR gRNA sequence
ataacaaagataatcagaag

SEQ ID NO: 588683 - DNA, 20 bp, Artificial
  CRISPR gRNA sequence
gcagttttttcccttcacac

SEQ ID NO: 588684 - DNA, 20 bp, Artificial
  CRISPR gRNA sequence
agttttttcccttcacacta

SEQ ID NO: 588685 - DNA, 20 bp, Artificial
  CRISPR gRNA sequence
gttttttcccttcacactag

SEQ ID NO: 588686 - DNA, 20 bp, Artificial
  CRISPR gRNA sequence
tttttcccttcacactagag

SEQ ID NO: 588687 - DNA, 20 bp, Artificial
  CRISPR gRNA sequence
tacttttactctcttacctt

SEQ ID NO: 588688 - DNA, 20 bp, Artificial
  CRISPR gRNA sequence
acttttactctcttacctta

SEQ ID NO: 588689 - DNA, 20 bp, Artificial
  CRISPR gRNA sequence
ttactctcttaccttaaggc

SEQ ID NO: 588690 - DNA, 20 bp, Artificial
  CRISPR gRNA sequence
tactctcttaccttaaggct

SEQ ID NO: 588691 - DNA, 20 bp, Artificial
  CRISPR gRNA sequence
ctgctctctttgtcataaca

SEQ ID NO: 588692 - DNA, 20 bp, Artificial
  CRISPR gRNA sequence
ctctttgtcataacatagtc

SEQ ID NO: 588693 - DNA, 20 bp, Artificial
  CRISPR gRNA sequence
ctttgtcataacatagtctg

SEQ ID NO: 588694 - DNA, 20 bp, Artificial
  CRISPR gRNA sequence
ttgacattccaaaaaacatc

SEQ ID NO: 588695 - DNA, 20 bp, Artificial
  CRISPR gRNA sequence
cattccaaaaaacatcaagc

SEQ ID NO: 588696 - DNA, 20 bp, Artificial
  CRISPR gRNA sequence
tatattcatgacattacact

SEQ ID NO: 588697 - DNA, 20 bp, Artificial
  CRISPR gRNA sequence
gacattacactgagtgaact

SEQ ID NO: 588698 - DNA, 20 bp, Artificial
  CRISPR gRNA sequence
acattacactgagtgaactt

SEQ ID NO: 588699 - DNA, 20 bp, Artificial
  CRISPR gRNA sequence
attacactgagtgaacttgg

SEQ ID NO: 588700 - DNA, 20 bp, Artificial
  CRISPR gRNA sequence
acactgagtgaacttgggag

SEQ ID NO: 588701 - DNA, 20 bp, Artificial
  CRISPR gRNA sequence
cactgagtgaacttgggagc

SEQ ID NO: 588702 - DNA, 20 bp, Artificial
  CRISPR gRNA sequence
gtgaacttgggagcaggata

SEQ ID NO: 588703 - DNA, 20 bp, Artificial
  CRISPR gRNA sequence
gcaggatatagtaaatacct

SEQ ID NO: 588704 - DNA, 20 bp, Artificial
  CRISPR gRNA sequence
agtaaatacctgagatgcct

SEQ ID NO: 588705 - DNA, 20 bp, Artificial
  CRISPR gRNA sequence
aatacctgagatgcctcagt

SEQ ID NO: 588706 - DNA, 20 bp, Artificial
  CRISPR gRNA sequence
tacctgagatgcctcagtaa

SEQ ID NO: 588707 - DNA, 20 bp, Artificial
  CRISPR gRNA sequence
tcagtaagagatatatgcta

SEQ ID NO: 588708 - DNA, 20 bp, Artificial
  CRISPR gRNA sequence
aagagatatatgctatagaa

SEQ ID NO: 588709 - DNA, 20 bp, Artificial
  CRISPR gRNA sequence
agagatatatgctatagaat

SEQ ID NO: 588710 - DNA, 20 bp, Artificial
  CRISPR gRNA sequence
agatatatgctatagaatag

SEQ ID NO: 588711 - DNA, 20 bp, Artificial
  CRISPR gRNA sequence
tagaataggagataaactcc

SEQ ID NO: 588712 - DNA, 20 bp, Artificial
  CRISPR gRNA sequence
ataggagataaactccaaga

SEQ ID NO: 588713 - DNA, 20 bp, Artificial
  CRISPR gRNA sequence
agataaactccaagaaagtt

SEQ ID NO: 588714 - DNA, 20 bp, Artificial
  CRISPR gRNA sequence
gataaactccaagaaagttc

SEQ ID NO: 588715 - DNA, 20 bp, Artificial
  CRISPR gRNA sequence
ataaactccaagaaagttca

SEQ ID NO: 588716 - DNA, 20 bp, Artificial
  CRISPR gRNA sequence
caagaaagttcagggacttt

SEQ ID NO: 588717 - DNA, 20 bp, Artificial
  CRISPR gRNA sequence
agttcagggactttcagcat

SEQ ID NO: 588718 - DNA, 20 bp, Artificial
  CRISPR gRNA sequence
tcagcattggtaaaatttta

SEQ ID NO: 588719 - DNA, 20 bp, Artificial
  CRISPR gRNA sequence
cagcattggtaaaattttac

SEQ ID NO: 588720 - DNA, 20 bp, Artificial
  CRISPR gRNA sequence
ctgatctgtgcatgctgaaa

SEQ ID NO: 588721 - DNA, 20 bp, Artificial
  CRISPR gRNA sequence
tgaaatagatcctccattgt

SEQ ID NO: 588722 - DNA, 20 bp, Artificial
  CRISPR gRNA sequence
atagatcctccattgtaagt

SEQ ID NO: 588723 - DNA, 20 bp, Artificial
  CRISPR gRNA sequence
caccttccttcgtgaaaatg

SEQ ID NO: 588724 - DNA, 20 bp, Artificial
  CRISPR gRNA sequence
tgaaaatgaagcacaaaatg

SEQ ID NO: 588725 - DNA, 20 bp, Artificial
  CRISPR gRNA sequence
aaatgaagcacaaaatgtgg

SEQ ID NO: 588726 - DNA, 20 bp, Artificial
  CRISPR gRNA sequence
acaaaatgtggtggcctctc

SEQ ID NO: 588727 - DNA, 20 bp, Artificial
  CRISPR gRNA sequence
gtggtggcctctctagattt

SEQ ID NO: 588728 - DNA, 20 bp, Artificial
  CRISPR gRNA sequence
gtggcctctctagattttag

SEQ ID NO: 588729 - DNA, 20 bp, Artificial
  CRISPR gRNA sequence
tctagattttagaagcaaca

SEQ ID NO: 588730 - DNA, 20 bp, Artificial
  CRISPR gRNA sequence
gaagcaacatagaccatatt

SEQ ID NO: 588731 - DNA, 20 bp, Artificial
  CRISPR gRNA sequence
aagcaacatagaccatattt

SEQ ID NO: 588732 - DNA, 20 bp, Artificial
  CRISPR gRNA sequence
catatttgggtatacttctg

SEQ ID NO: 588733 - DNA, 20 bp, Artificial
  CRISPR gRNA sequence
tacttctgtggtgcatatac

SEQ ID NO: 588734 - DNA, 20 bp, Artificial
  CRISPR gRNA sequence
acttctgtggtgcatatact

SEQ ID NO: 588735 - DNA, 20 bp, Artificial
  CRISPR gRNA sequence
tgcatatactaggtaatcca

SEQ ID NO: 588736 - DNA, 20 bp, Artificial
  CRISPR gRNA sequence
gcatatactaggtaatccac

SEQ ID NO: 588737 - DNA, 20 bp, Artificial
  CRISPR gRNA sequence
atccacaggctgtccatttt

SEQ ID NO: 588738 - DNA, 20 bp, Artificial
  CRISPR gRNA sequence
ccacaggctgtccattttga

SEQ ID NO: 588739 - DNA, 20 bp, Artificial
  CRISPR gRNA sequence
caggctgtccattttgagag

SEQ ID NO: 588740 - DNA, 20 bp, Artificial
  CRISPR gRNA sequence
tgtccattttgagagcagcc

SEQ ID NO: 588741 - DNA, 20 bp, Artificial
  CRISPR gRNA sequence
gtccattttgagagcagcct

SEQ ID NO: 588742 - DNA, 20 bp, Artificial
  CRISPR gRNA sequence
tccattttgagagcagcctg

SEQ ID NO: 588743 - DNA, 20 bp, Artificial
  CRISPR gRNA sequence
ttttgagagcagcctggggc

SEQ ID NO: 588744 - DNA, 20 bp, Artificial
  CRISPR gRNA sequence
agagcagcctggggcaagaa

SEQ ID NO: 588745 - DNA, 20 bp, Artificial
  CRISPR gRNA sequence
gagcagcctggggcaagaaa

SEQ ID NO: 588746 - DNA, 20 bp, Artificial
  CRISPR gRNA sequence
atcataccctgccatgatga

SEQ ID NO: 588747 - DNA, 20 bp, Artificial
  CRISPR gRNA sequence
ctccctctacttttgactct

SEQ ID NO: 588748 - DNA, 20 bp, Artificial
  CRISPR gRNA sequence
ctacttttgactctaagatt

SEQ ID NO: 588749 - DNA, 20 bp, Artificial
  CRISPR gRNA sequence
cttttgactctaagattcag

SEQ ID NO: 588750 - DNA, 20 bp, Artificial
  CRISPR gRNA sequence
tcagcagatgcaatgatttt

SEQ ID NO: 588751 - DNA, 20 bp, Artificial
  CRISPR gRNA sequence
atgatttttggaaatgtctg

SEQ ID NO: 588752 - DNA, 20 bp, Artificial
  CRISPR gRNA sequence
ttggaaatgtctgtggcaaa

SEQ ID NO: 588753 - DNA, 20 bp, Artificial
  CRISPR gRNA sequence
ggaaatgtctgtggcaaatg

SEQ ID NO: 588754 - DNA, 20 bp, Artificial
  CRISPR gRNA sequence
ctgtatgacatctctgtcaa

SEQ ID NO: 588755 - DNA, 20 bp, Artificial
  CRISPR gRNA sequence
tatgacatctctgtcaatgg

SEQ ID NO: 588756 - DNA, 20 bp, Artificial
  CRISPR gRNA sequence
atctctgtcaatggaagcct

SEQ ID NO: 588757 - DNA, 20 bp, Artificial
  CRISPR gRNA sequence
tcaatggaagcctcagtgtg

SEQ ID NO: 588758 - DNA, 20 bp, Artificial
  CRISPR gRNA sequence
ctcagtgtgtagatccctcg

SEQ ID NO: 588759 - DNA, 20 bp, Artificial
  CRISPR gRNA sequence
gtagatccctcgtggtttta

SEQ ID NO: 588760 - DNA, 20 bp, Artificial
  CRISPR gRNA sequence
tccctcgtggttttatagta

SEQ ID NO: 588761 - DNA, 20 bp, Artificial
  CRISPR gRNA sequence
ggttttatagtaaagacatg

SEQ ID NO: 588762 - DNA, 20 bp, Artificial
  CRISPR gRNA sequence
ataactaatctccatttgaa

SEQ ID NO: 588763 - DNA, 20 bp, Artificial
  CRISPR gRNA sequence
ccttacttgctaatgaactt

SEQ ID NO: 588764 - DNA, 20 bp, Artificial
  CRISPR gRNA sequence
cttgctaatgaactttggtt

SEQ ID NO: 588765 - DNA, 20 bp, Artificial
  CRISPR gRNA sequence
ctttggttaagactgtgtac

SEQ ID NO: 588766 - DNA, 20 bp, Artificial
  CRISPR gRNA sequence
tttggttaagactgtgtact

SEQ ID NO: 588767 - DNA, 20 bp, Artificial
  CRISPR gRNA sequence
taagactgtgtactgggcca

SEQ ID NO: 588768 - DNA, 20 bp, Artificial
  CRISPR gRNA sequence
aagactgtgtactgggccat

SEQ ID NO: 588769 - DNA, 20 bp, Artificial
  CRISPR gRNA sequence
gtgtactgggccataggact

SEQ ID NO: 588770 - DNA, 20 bp, Artificial
  CRISPR gRNA sequence
taggactcggaatgacaatg

SEQ ID NO: 588771 - DNA, 20 bp, Artificial
  CRISPR gRNA sequence
ccaaaccgtgcatcatgaac

SEQ ID NO: 588772 - DNA, 20 bp, Artificial
  CRISPR gRNA sequence
caaaccgtgcatcatgaact

SEQ ID NO: 588773 - DNA, 20 bp, Artificial
  CRISPR gRNA sequence
catatcaaaaatgtacacaa

SEQ ID NO: 588774 - DNA, 20 bp, Artificial
  CRISPR gRNA sequence
tgtacacaacagcatttcct

SEQ ID NO: 588775 - DNA, 20 bp, Artificial
  CRISPR gRNA sequence
tggtatattttccttccctg

SEQ ID NO: 588776 - DNA, 20 bp, Artificial
  CRISPR gRNA sequence
tccctgcagccttcttatgc

SEQ ID NO: 588777 - DNA, 20 bp, Artificial
  CRISPR gRNA sequence
gcagccttcttatgctagtt

SEQ ID NO: 588778 - DNA, 20 bp, Artificial
  CRISPR gRNA sequence
cagccttcttatgctagttg

SEQ ID NO: 588779 - DNA, 20 bp, Artificial
  CRISPR gRNA sequence
ccttcttatgctagttgagg

SEQ ID NO: 588780 - DNA, 20 bp, Artificial
  CRISPR gRNA sequence
tatgctagttgaggaagccc

SEQ ID NO: 588781 - DNA, 20 bp, Artificial
  CRISPR gRNA sequence
gaagcccaagtatactgtat

SEQ ID NO: 588782 - DNA, 20 bp, Artificial
  CRISPR gRNA sequence
cccaagtatactgtatgagc

SEQ ID NO: 588783 - DNA, 20 bp, Artificial
  CRISPR gRNA sequence
aagtatactgtatgagcaag

SEQ ID NO: 588784 - DNA, 20 bp, Artificial
  CRISPR gRNA sequence
tactgtatgagcaagtagct

SEQ ID NO: 588785 - DNA, 20 bp, Artificial
  CRISPR gRNA sequence
ctgtatgagcaagtagctca

SEQ ID NO: 588786 - DNA, 20 bp, Artificial
  CRISPR gRNA sequence
tgtatgagcaagtagctcag

SEQ ID NO: 588787 - DNA, 20 bp, Artificial
  CRISPR gRNA sequence
tttgcttcaacccgtatgta

SEQ ID NO: 588788 - DNA, 20 bp, Artificial
  CRISPR gRNA sequence
aacccgtatgtatggcctca

SEQ ID NO: 588789 - DNA, 20 bp, Artificial
  CRISPR gRNA sequence
acccgtatgtatggcctcat

SEQ ID NO: 588790 - DNA, 20 bp, Artificial
  CRISPR gRNA sequence
cccgtatgtatggcctcatg

SEQ ID NO: 588791 - DNA, 20 bp, Artificial
  CRISPR gRNA sequence
atggcctcatggggtattct

SEQ ID NO: 588792 - DNA, 20 bp, Artificial
  CRISPR gRNA sequence
catggggtattctcagtgac

SEQ ID NO: 588793 - DNA, 20 bp, Artificial
  CRISPR gRNA sequence
attctcagtgactagttgat

SEQ ID NO: 588794 - DNA, 20 bp, Artificial
  CRISPR gRNA sequence
ttctcagtgactagttgatg

SEQ ID NO: 588795 - DNA, 20 bp, Artificial
  CRISPR gRNA sequence
actagttgatgaggatgaaa

SEQ ID NO: 588796 - DNA, 20 bp, Artificial
  CRISPR gRNA sequence
ttgatgaggatgaaacagtg

SEQ ID NO: 588797 - DNA, 20 bp, Artificial
  CRISPR gRNA sequence
aggatgaaacagtgtggatc

SEQ ID NO: 588798 - DNA, 20 bp, Artificial
  CRISPR gRNA sequence
gtgtggatctggtttgtaaa

SEQ ID NO: 588799 - DNA, 20 bp, Artificial
  CRISPR gRNA sequence
tggtttgtaaatagaatgtc

SEQ ID NO: 588800 - DNA, 20 bp, Artificial
  CRISPR gRNA sequence
gaatgtctggaattcaatac

SEQ ID NO: 588801 - DNA, 20 bp, Artificial
  CRISPR gRNA sequence
ttcaataccagctatgacta

SEQ ID NO: 588802 - DNA, 20 bp, Artificial
  CRISPR gRNA sequence
agctatgactatggtgttta

SEQ ID NO: 588803 - DNA, 20 bp, Artificial
  CRISPR gRNA sequence
gctatgactatggtgtttac

SEQ ID NO: 588804 - DNA, 20 bp, Artificial
  CRISPR gRNA sequence
tggtgtttacaggtccactt

SEQ ID NO: 588805 - DNA, 20 bp, Artificial
  CRISPR gRNA sequence
ggtgtttacaggtccactta

SEQ ID NO: 588806 - DNA, 20 bp, Artificial
  CRISPR gRNA sequence
gtgtttacaggtccacttaa

SEQ ID NO: 588807 - DNA, 20 bp, Artificial
  CRISPR gRNA sequence
gtttacaggtccacttaagg

SEQ ID NO: 588808 - DNA, 20 bp, Artificial
  CRISPR gRNA sequence
ttacaggtccacttaaggga

SEQ ID NO: 588809 - DNA, 20 bp, Artificial
  CRISPR gRNA sequence
tacaggtccacttaagggag

SEQ ID NO: 588810 - DNA, 20 bp, Artificial
  CRISPR gRNA sequence
acaggtccacttaagggaga

SEQ ID NO: 588811 - DNA, 20 bp, Artificial
  CRISPR gRNA sequence
agggagagggccctgaaata

SEQ ID NO: 588812 - DNA, 20 bp, Artificial
  CRISPR gRNA sequence
gagagggccctgaaatacag

SEQ ID NO: 588813 - DNA, 20 bp, Artificial
  CRISPR gRNA sequence
aaatacagtggctatcccac

SEQ ID NO: 588814 - DNA, 20 bp, Artificial
  CRISPR gRNA sequence
tacagtggctatcccaccag

SEQ ID NO: 588815 - DNA, 20 bp, Artificial
  CRISPR gRNA sequence
gtggctatcccaccagcagc

SEQ ID NO: 588816 - DNA, 20 bp, Artificial
  CRISPR gRNA sequence
ccagcagccagaatttcatt

SEQ ID NO: 588817 - DNA, 20 bp, Artificial
  CRISPR gRNA sequence
cagccagaatttcattcagc

SEQ ID NO: 588818 - DNA, 20 bp, Artificial
  CRISPR gRNA sequence
atttaactgcacactttgca

SEQ ID NO: 588819 - DNA, 20 bp, Artificial
  CRISPR gRNA sequence
taactgcacactttgcatgg

SEQ ID NO: 588820 - DNA, 20 bp, Artificial
  CRISPR gRNA sequence
ctgcacactttgcatggaag

SEQ ID NO: 588821 - DNA, 20 bp, Artificial
  CRISPR gRNA sequence
gcacactttgcatggaagaa

SEQ ID NO: 588822 - DNA, 20 bp, Artificial
  CRISPR gRNA sequence
actttgcatggaagaagaga

SEQ ID NO: 588823 - DNA, 20 bp, Artificial
  CRISPR gRNA sequence
gcatggaagaagagatagtt

SEQ ID NO: 588824 - DNA, 20 bp, Artificial
  CRISPR gRNA sequence
catggaagaagagatagttg

SEQ ID NO: 588825 - DNA, 20 bp, Artificial
  CRISPR gRNA sequence
atagttgaggtaatgacata

SEQ ID NO: 588826 - DNA, 20 bp, Artificial
  CRISPR gRNA sequence
tgaggtaatgacatatggca

SEQ ID NO: 588827 - DNA, 20 bp, Artificial
  CRISPR gRNA sequence
tgacatatggcatggccata

SEQ ID NO: 588828 - DNA, 20 bp, Artificial
  CRISPR gRNA sequence
tatggcatggccatatggtc

SEQ ID NO: 588829 - DNA, 20 bp, Artificial
  CRISPR gRNA sequence
atggcatggccatatggtca

SEQ ID NO: 588830 - DNA, 20 bp, Artificial
  CRISPR gRNA sequence
ccatatggtcaaggacttca

SEQ ID NO: 588831 - DNA, 20 bp, Artificial
  CRISPR gRNA sequence
aggacttcaaagaacaaaat

SEQ ID NO: 588832 - DNA, 20 bp, Artificial
  CRISPR gRNA sequence
aaagaacaaaattggacgac

SEQ ID NO: 588833 - DNA, 20 bp, Artificial
  CRISPR gRNA sequence
caaaattggacgactggtga

SEQ ID NO: 588834 - DNA, 20 bp, Artificial
  CRISPR gRNA sequence
attggacgactggtgacaga

SEQ ID NO: 588835 - DNA, 20 bp, Artificial
  CRISPR gRNA sequence
acgactggtgacagaaagtc

SEQ ID NO: 588836 - DNA, 20 bp, Artificial
  CRISPR gRNA sequence
cgactggtgacagaaagtct

SEQ ID NO: 588837 - DNA, 20 bp, Artificial
  CRISPR gRNA sequence
gactggtgacagaaagtcta

SEQ ID NO: 588838 - DNA, 20 bp, Artificial
  CRISPR gRNA sequence
tggtgacagaaagtctaggg

SEQ ID NO: 588839 - DNA, 20 bp, Artificial
  CRISPR gRNA sequence
gtgacagaaagtctagggaa

SEQ ID NO: 588840 - DNA, 20 bp, Artificial
  CRISPR gRNA sequence
aaagtctagggaagagttat

SEQ ID NO: 588841 - DNA, 20 bp, Artificial
  CRISPR gRNA sequence
aagtctagggaagagttatg

SEQ ID NO: 588842 - DNA, 20 bp, Artificial
  CRISPR gRNA sequence
agttatgaggatatatcctt

SEQ ID NO: 588843 - DNA, 20 bp, Artificial
  CRISPR gRNA sequence
gaggatatatccttcagaat

SEQ ID NO: 588844 - DNA, 20 bp, Artificial
  CRISPR gRNA sequence
tggtacaaaatgtaatgata

SEQ ID NO: 588845 - DNA, 20 bp, Artificial
  CRISPR gRNA sequence
tattctatgtaaattctctc

SEQ ID NO: 588846 - DNA, 20 bp, Artificial
  CRISPR gRNA sequence
ttctatgtaaattctctcca

SEQ ID NO: 588847 - DNA, 20 bp, Artificial
  CRISPR gRNA sequence
tctatgtaaattctctccag

SEQ ID NO: 588848 - DNA, 20 bp, Artificial
  CRISPR gRNA sequence
ctatgtaaattctctccaga

SEQ ID NO: 588849 - DNA, 20 bp, Artificial
  CRISPR gRNA sequence
tctccagagggcattcactg

SEQ ID NO: 588850 - DNA, 20 bp, Artificial
  CRISPR gRNA sequence
agagggcattcactgtagtg

SEQ ID NO: 588851 - DNA, 20 bp, Artificial
  CRISPR gRNA sequence
gagggcattcactgtagtga

SEQ ID NO: 588852 - DNA, 20 bp, Artificial
  CRISPR gRNA sequence
ttcactgtagtgaaggctgt

SEQ ID NO: 588853 - DNA, 20 bp, Artificial
  CRISPR gRNA sequence
tgaaggctgttagtaatctg

SEQ ID NO: 588854 - DNA, 20 bp, Artificial
  CRISPR gRNA sequence
gaaggctgttagtaatctga

SEQ ID NO: 588855 - DNA, 20 bp, Artificial
  CRISPR gRNA sequence
aaggctgttagtaatctgaa

SEQ ID NO: 588856 - DNA, 20 bp, Artificial
  CRISPR gRNA sequence
aggctgttagtaatctgaag

SEQ ID NO: 588857 - DNA, 20 bp, Artificial
  CRISPR gRNA sequence
ggctgttagtaatctgaagg

SEQ ID NO: 588858 - DNA, 20 bp, Artificial
  CRISPR gRNA sequence
gggggtaatctcatgaatct

SEQ ID NO: 588859 - DNA, 20 bp, Artificial
  CRISPR gRNA sequence
atgaatctcagactctttac

SEQ ID NO: 588860 - DNA, 20 bp, Artificial
  CRISPR gRNA sequence
tgaatctcagactctttacc

SEQ ID NO: 588861 - DNA, 20 bp, Artificial
  CRISPR gRNA sequence
gactctttaccaggcttacc

SEQ ID NO: 588862 - DNA, 20 bp, Artificial
  CRISPR gRNA sequence
aggcttacctggtactttct

SEQ ID NO: 588863 - DNA, 20 bp, Artificial
  CRISPR gRNA sequence
cttacctggtactttctcag

SEQ ID NO: 588864 - DNA, 20 bp, Artificial
  CRISPR gRNA sequence
ttacctggtactttctcagt

SEQ ID NO: 588865 - DNA, 20 bp, Artificial
  CRISPR gRNA sequence
tctcagtgggccaatgtaca

SEQ ID NO: 588866 - DNA, 20 bp, Artificial
  CRISPR gRNA sequence
gccaatgtacaaagtgacaa

SEQ ID NO: 588867 - DNA, 20 bp, Artificial
  CRISPR gRNA sequence
ccaatgtacaaagtgacaat

SEQ ID NO: 588868 - DNA, 20 bp, Artificial
  CRISPR gRNA sequence
aatgtacaaagtgacaatgg

SEQ ID NO: 588869 - DNA, 20 bp, Artificial
  CRISPR gRNA sequence
gtacaaagtgacaatgggag

SEQ ID NO: 588870 - DNA, 20 bp, Artificial
  CRISPR gRNA sequence
tacaaagtgacaatgggagt

SEQ ID NO: 588871 - DNA, 20 bp, Artificial
  CRISPR gRNA sequence
acaaagtgacaatgggagta

SEQ ID NO: 588872 - DNA, 20 bp, Artificial
  CRISPR gRNA sequence
tgacaatgggagtagggaca

SEQ ID NO: 588873 - DNA, 20 bp, Artificial
  CRISPR gRNA sequence
agggacacagaaactatgaa

SEQ ID NO: 588874 - DNA, 20 bp, Artificial
  CRISPR gRNA sequence
tatgaacagattcaattaca

SEQ ID NO: 588875 - DNA, 20 bp, Artificial
  CRISPR gRNA sequence
atttaactaccaccactgct

SEQ ID NO: 588876 - DNA, 20 bp, Artificial
  CRISPR gRNA sequence
ctgctgagctcacaattttc

SEQ ID NO: 588877 - DNA, 20 bp, Artificial
  CRISPR gRNA sequence
gctcacaattttccagtgct

SEQ ID NO: 588878 - DNA, 20 bp, Artificial
  CRISPR gRNA sequence
ccagtgctgagaccctgata

SEQ ID NO: 588879 - DNA, 20 bp, Artificial
  CRISPR gRNA sequence
cctgatatggcaccattcct

SEQ ID NO: 588880 - DNA, 20 bp, Artificial
  CRISPR gRNA sequence
tgatatggcaccattcctga

SEQ ID NO: 588881 - DNA, 20 bp, Artificial
  CRISPR gRNA sequence
atatggcaccattcctgaga

SEQ ID NO: 588882 - DNA, 20 bp, Artificial
  CRISPR gRNA sequence
attcctgagagagatcaacc

SEQ ID NO: 588883 - DNA, 20 bp, Artificial
  CRISPR gRNA sequence
ctgagagagatcaaccaagc

SEQ ID NO: 588884 - DNA, 20 bp, Artificial
  CRISPR gRNA sequence
agagagatcaaccaagcaag

SEQ ID NO: 588885 - DNA, 20 bp, Artificial
  CRISPR gRNA sequence
gagatcaaccaagcaagtag

SEQ ID NO: 588886 - DNA, 20 bp, Artificial
  CRISPR gRNA sequence
atcaaccaagcaagtagtgg

SEQ ID NO: 588887 - DNA, 20 bp, Artificial
  CRISPR gRNA sequence
tcaaccaagcaagtagtggc

SEQ ID NO: 588888 - DNA, 20 bp, Artificial
  CRISPR gRNA sequence
accaagcaagtagtggcagg

SEQ ID NO: 588889 - DNA, 20 bp, Artificial
  CRISPR gRNA sequence
ccaagcaagtagtggcaggc

SEQ ID NO: 588890 - DNA, 20 bp, Artificial
  CRISPR gRNA sequence
acatttgactctttccaaca

SEQ ID NO: 588891 - DNA, 20 bp, Artificial
  CRISPR gRNA sequence
tttgactctttccaacatgg

SEQ ID NO: 588892 - DNA, 20 bp, Artificial
  CRISPR gRNA sequence
tgactctttccaacatggaa

SEQ ID NO: 588893 - DNA, 20 bp, Artificial
  CRISPR gRNA sequence
gactctttccaacatggaag

SEQ ID NO: 588894 - DNA, 20 bp, Artificial
  CRISPR gRNA sequence
tctttccaacatggaagagg

SEQ ID NO: 588895 - DNA, 20 bp, Artificial
  CRISPR gRNA sequence
gaggcagaaatatatcctaa

SEQ ID NO: 588896 - DNA, 20 bp, Artificial
  CRISPR gRNA sequence
aggcagaaatatatcctaat

SEQ ID NO: 588897 - DNA, 20 bp, Artificial
  CRISPR gRNA sequence
tttctcttcaatatttttgc

SEQ ID NO: 588898 - DNA, 20 bp, Artificial
  CRISPR gRNA sequence
tttgcaagctccctcaaata

SEQ ID NO: 588899 - DNA, 20 bp, Artificial
  CRISPR gRNA sequence
tccctcaaatatggatttaa

SEQ ID NO: 588900 - DNA, 20 bp, Artificial
  CRISPR gRNA sequence
cttgctatactgccttcaac

SEQ ID NO: 588901 - DNA, 20 bp, Artificial
  CRISPR gRNA sequence
ttgctatactgccttcaacc

SEQ ID NO: 588902 - DNA, 20 bp, Artificial
  CRISPR gRNA sequence
aaccaggaaactccttttta

SEQ ID NO: 588903 - DNA, 20 bp, Artificial
  CRISPR gRNA sequence
aggaaactcctttttatggc

SEQ ID NO: 588904 - DNA, 20 bp, Artificial
  CRISPR gRNA sequence
tatggcaagacaaatacaat

SEQ ID NO: 588905 - DNA, 20 bp, Artificial
  CRISPR gRNA sequence
atacaattagcgcaaatcta

SEQ ID NO: 588906 - DNA, 20 bp, Artificial
  CRISPR gRNA sequence
gcgcaaatctatagaatgca

SEQ ID NO: 588907 - DNA, 20 bp, Artificial
  CRISPR gRNA sequence
cgcaaatctatagaatgcat

SEQ ID NO: 588908 - DNA, 20 bp, Artificial
  CRISPR gRNA sequence
ataccccatgtatcaccaca

SEQ ID NO: 588909 - DNA, 20 bp, Artificial
  CRISPR gRNA sequence
catgtatcaccacacagaat

SEQ ID NO: 588910 - DNA, 20 bp, Artificial
  CRISPR gRNA sequence
tatcaccacacagaatcagc

SEQ ID NO: 588911 - DNA, 20 bp, Artificial
  CRISPR gRNA sequence
cacagaatcagctggctaca

SEQ ID NO: 588912 - DNA, 20 bp, Artificial
  CRISPR gRNA sequence
cagaatcagctggctacatg

SEQ ID NO: 588913 - DNA, 20 bp, Artificial
  CRISPR gRNA sequence
aatcagctggctacatggag

SEQ ID NO: 588914 - DNA, 20 bp, Artificial
  CRISPR gRNA sequence
ggctacatggagtggtgaaa

SEQ ID NO: 588915 - DNA, 20 bp, Artificial
  CRISPR gRNA sequence
agtggtgaaatggcctacca

SEQ ID NO: 588916 - DNA, 20 bp, Artificial
  CRISPR gRNA sequence
gtggtgaaatggcctaccaa

SEQ ID NO: 588917 - DNA, 20 bp, Artificial
  CRISPR gRNA sequence
ggtgaaatggcctaccaaag

SEQ ID NO: 588918 - DNA, 20 bp, Artificial
  CRISPR gRNA sequence
gaaatggcctaccaaaggag

SEQ ID NO: 588919 - DNA, 20 bp, Artificial
  CRISPR gRNA sequence
ccaaaggagtggttcatgta

SEQ ID NO: 588920 - DNA, 20 bp, Artificial
  CRISPR gRNA sequence
agtggttcatgtatggttgc

SEQ ID NO: 588921 - DNA, 20 bp, Artificial
  CRISPR gRNA sequence
gttcatgtatggttgccagc

SEQ ID NO: 588922 - DNA, 20 bp, Artificial
  CRISPR gRNA sequence
ttcatgtatggttgccagct

SEQ ID NO: 588923 - DNA, 20 bp, Artificial
  CRISPR gRNA sequence
catgtatggttgccagctgg

SEQ ID NO: 588924 - DNA, 20 bp, Artificial
  CRISPR gRNA sequence
atgtatggttgccagctggg

SEQ ID NO: 588925 - DNA, 20 bp, Artificial
  CRISPR gRNA sequence
gtatggttgccagctgggag

SEQ ID NO: 588926 - DNA, 20 bp, Artificial
  CRISPR gRNA sequence
gttgccagctgggaggagtt

SEQ ID NO: 588927 - DNA, 20 bp, Artificial
  CRISPR gRNA sequence
ttgccagctgggaggagttt

SEQ ID NO: 588928 - DNA, 20 bp, Artificial
  CRISPR gRNA sequence
aggagtttgggtgtgttcta

SEQ ID NO: 588929 - DNA, 20 bp, Artificial
  CRISPR gRNA sequence
ggagtttgggtgtgttctac

SEQ ID NO: 588930 - DNA, 20 bp, Artificial
  CRISPR gRNA sequence
gttctacaggatattatata

SEQ ID NO: 588931 - DNA, 20 bp, Artificial
  CRISPR gRNA sequence
ggccaacatcatctcctcca

SEQ ID NO: 588932 - DNA, 20 bp, Artificial
  CRISPR gRNA sequence
aacatcatctcctccatagc

SEQ ID NO: 588933 - DNA, 20 bp, Artificial
  CRISPR gRNA sequence
atcatctcctccatagccag

SEQ ID NO: 588934 - DNA, 20 bp, Artificial
  CRISPR gRNA sequence
tcatctcctccatagccaga

SEQ ID NO: 588935 - DNA, 20 bp, Artificial
  CRISPR gRNA sequence
cctccatagccagaaggcat

SEQ ID NO: 588936 - DNA, 20 bp, Artificial
  CRISPR gRNA sequence
tagccagaaggcatgagtct

SEQ ID NO: 588937 - DNA, 20 bp, Artificial
  CRISPR gRNA sequence
aaggcatgagtctgagaaca

SEQ ID NO: 588938 - DNA, 20 bp, Artificial
  CRISPR gRNA sequence
ggcatgagtctgagaacaaa

SEQ ID NO: 588939 - DNA, 20 bp, Artificial
  CRISPR gRNA sequence
gcatgagtctgagaacaaag

SEQ ID NO: 588940 - DNA, 20 bp, Artificial
  CRISPR gRNA sequence
agtctgagaacaaagaggtt

SEQ ID NO: 588941 - DNA, 20 bp, Artificial
  CRISPR gRNA sequence
gtctgagaacaaagaggtta

SEQ ID NO: 588942 - DNA, 20 bp, Artificial
  CRISPR gRNA sequence
tgagaacaaagaggttaagg

SEQ ID NO: 588943 - DNA, 20 bp, Artificial
  CRISPR gRNA sequence
agaacaaagaggttaaggta

SEQ ID NO: 588944 - DNA, 20 bp, Artificial
  CRISPR gRNA sequence
gaacaaagaggttaaggtag

SEQ ID NO: 588945 - DNA, 20 bp, Artificial
  CRISPR gRNA sequence
caaagaggttaaggtagagg

SEQ ID NO: 588946 - DNA, 20 bp, Artificial
  CRISPR gRNA sequence
aacatcaaataacccattta

SEQ ID NO: 588947 - DNA, 20 bp, Artificial
  CRISPR gRNA sequence
acatcaaataacccatttaa

SEQ ID NO: 588948 - DNA, 20 bp, Artificial
  CRISPR gRNA sequence
actctgtgtcctgaaacctt

SEQ ID NO: 588949 - DNA, 20 bp, Artificial
  CRISPR gRNA sequence
gtgtcctgaaaccttcagat

SEQ ID NO: 588950 - DNA, 20 bp, Artificial
  CRISPR gRNA sequence
tcctgaaaccttcagattgg

SEQ ID NO: 588951 - DNA, 20 bp, Artificial
  CRISPR gRNA sequence
aaccttcagattggtggttt

SEQ ID NO: 588952 - DNA, 20 bp, Artificial
  CRISPR gRNA sequence
ccttcagattggtggttttg

SEQ ID NO: 588953 - DNA, 20 bp, Artificial
  CRISPR gRNA sequence
attggtggttttggagatct

SEQ ID NO: 588954 - DNA, 20 bp, Artificial
  CRISPR gRNA sequence
ttggagatctcagttcccaa

SEQ ID NO: 588955 - DNA, 20 bp, Artificial
  CRISPR gRNA sequence
gagatctcagttcccaaaag

SEQ ID NO: 588956 - DNA, 20 bp, Artificial
  CRISPR gRNA sequence
caaaagaagaatgttttctc

SEQ ID NO: 588957 - DNA, 20 bp, Artificial
  CRISPR gRNA sequence
aaaagaagaatgttttctcc

SEQ ID NO: 588958 - DNA, 20 bp, Artificial
  CRISPR gRNA sequence
agaatgttttctccaggttt

SEQ ID NO: 588959 - DNA, 20 bp, Artificial
  CRISPR gRNA sequence
aatgttttctccaggtttca

SEQ ID NO: 588960 - DNA, 20 bp, Artificial
  CRISPR gRNA sequence
ttctccaggtttcagagatc

SEQ ID NO: 588961 - DNA, 20 bp, Artificial
  CRISPR gRNA sequence
gagatctggtcctgttgtat

SEQ ID NO: 588962 - DNA, 20 bp, Artificial
  CRISPR gRNA sequence
atctggtcctgttgtattgg

SEQ ID NO: 588963 - DNA, 20 bp, Artificial
  CRISPR gRNA sequence
gtcctgttgtattggaagct

SEQ ID NO: 588964 - DNA, 20 bp, Artificial
  CRISPR gRNA sequence
tggaagctgagaatactcac

SEQ ID NO: 588965 - DNA, 20 bp, Artificial
  CRISPR gRNA sequence
agaatactcactagctattt

SEQ ID NO: 588966 - DNA, 20 bp, Artificial
  CRISPR gRNA sequence
gaatactcactagctatttt

SEQ ID NO: 588967 - DNA, 20 bp, Artificial
  CRISPR gRNA sequence
ctagctattttgggcatgtc

SEQ ID NO: 588968 - DNA, 20 bp, Artificial
  CRISPR gRNA sequence
atgtcaagctgctaaataaa

SEQ ID NO: 588969 - DNA, 20 bp, Artificial
  CRISPR gRNA sequence
tgtcaagctgctaaataaac

SEQ ID NO: 588970 - DNA, 20 bp, Artificial
  CRISPR gRNA sequence
gtcaagctgctaaataaaca

SEQ ID NO: 588971 - DNA, 20 bp, Artificial
  CRISPR gRNA sequence
gctgctaaataaacagggac

SEQ ID NO: 588972 - DNA, 20 bp, Artificial
  CRISPR gRNA sequence
ggactggcttataatttttc

SEQ ID NO: 588973 - DNA, 20 bp, Artificial
  CRISPR gRNA sequence
ttataatttttccagactac

SEQ ID NO: 588974 - DNA, 20 bp, Artificial
  CRISPR gRNA sequence
tccagactaccagaatgatt

SEQ ID NO: 588975 - DNA, 20 bp, Artificial
  CRISPR gRNA sequence
cagactaccagaatgatttg

SEQ ID NO: 588976 - DNA, 20 bp, Artificial
  CRISPR gRNA sequence
tggagctgttgctatacaat

SEQ ID NO: 588977 - DNA, 20 bp, Artificial
  CRISPR gRNA sequence
ggagctgttgctatacaatg

SEQ ID NO: 588978 - DNA, 20 bp, Artificial
  CRISPR gRNA sequence
tgttgctatacaatgaggac

SEQ ID NO: 588979 - DNA, 20 bp, Artificial
  CRISPR gRNA sequence
tgctatacaatgaggacaag

SEQ ID NO: 588980 - DNA, 20 bp, Artificial
  CRISPR gRNA sequence
aggacaagaagaactatgct

SEQ ID NO: 588981 - DNA, 20 bp, Artificial
  CRISPR gRNA sequence
gaagaactatgcttggaact

SEQ ID NO: 588982 - DNA, 20 bp, Artificial
  CRISPR gRNA sequence
aagaactatgcttggaactc

SEQ ID NO: 588983 - DNA, 20 bp, Artificial
  CRISPR gRNA sequence
agaactatgcttggaactca

SEQ ID NO: 588984 - DNA, 20 bp, Artificial
  CRISPR gRNA sequence
gaactatgcttggaactcag

SEQ ID NO: 588985 - DNA, 20 bp, Artificial
  CRISPR gRNA sequence
ttggaactcaggggatttac

SEQ ID NO: 588986 - DNA, 20 bp, Artificial
  CRISPR gRNA sequence
tggaactcaggggatttact

SEQ ID NO: 588987 - DNA, 20 bp, Artificial
  CRISPR gRNA sequence
ggaactcaggggatttactg

SEQ ID NO: 588988 - DNA, 20 bp, Artificial
  CRISPR gRNA sequence
gatttactggggcatctctt

SEQ ID NO: 588989 - DNA, 20 bp, Artificial
  CRISPR gRNA sequence
aaatacttacctcataattt

SEQ ID NO: 588990 - DNA, 20 bp, Artificial
  CRISPR gRNA sequence
ttttggttattgaaaaatta

SEQ ID NO: 588991 - DNA, 20 bp, Artificial
  CRISPR gRNA sequence
ttgaaaaattatagtaatat

SEQ ID NO: 588992 - DNA, 20 bp, Artificial
  CRISPR gRNA sequence
aaaattatagtaatataaga

SEQ ID NO: 588993 - DNA, 20 bp, Artificial
  CRISPR gRNA sequence
ttatagtaatataagaaaga

SEQ ID NO: 588994 - DNA, 20 bp, Artificial
  CRISPR gRNA sequence
tatagtaatataagaaagac

SEQ ID NO: 588995 - DNA, 20 bp, Artificial
  CRISPR gRNA sequence
taagaaagacaggaccaccg

SEQ ID NO: 588996 - DNA, 20 bp, Artificial
  CRISPR gRNA sequence
agacaggaccaccgaagact

SEQ ID NO: 588997 - DNA, 20 bp, Artificial
  CRISPR gRNA sequence
actcagaacctataaaattt

SEQ ID NO: 588998 - DNA, 20 bp, Artificial
  CRISPR gRNA sequence
ataaaattttagtcacctat

SEQ ID NO: 588999 - DNA, 20 bp, Artificial
  CRISPR gRNA sequence
ttttagtcacctatcagata

SEQ ID NO: 589000 - DNA, 20 bp, Artificial
  CRISPR gRNA sequence
atcagataaagaaccttatt

SEQ ID NO: 589001 - DNA, 20 bp, Artificial
  CRISPR gRNA sequence
tatttagccgatgtgctaaa

SEQ ID NO: 589002 - DNA, 20 bp, Artificial
  CRISPR gRNA sequence
tttagccgatgtgctaaaca

SEQ ID NO: 589003 - DNA, 20 bp, Artificial
  CRISPR gRNA sequence
gccgatgtgctaaacagagt

SEQ ID NO: 589004 - DNA, 20 bp, Artificial
  CRISPR gRNA sequence
cgatgtgctaaacagagtaa

SEQ ID NO: 589005 - DNA, 20 bp, Artificial
  CRISPR gRNA sequence
gtgctaaacagagtaagagt

SEQ ID NO: 589006 - DNA, 20 bp, Artificial
  CRISPR gRNA sequence
tgctaaacagagtaagagta

SEQ ID NO: 589007 - DNA, 20 bp, Artificial
  CRISPR gRNA sequence
gctaaacagagtaagagtaa

SEQ ID NO: 589008 - DNA, 20 bp, Artificial
  CRISPR gRNA sequence
ctaaacagagtaagagtaag

SEQ ID NO: 589009 - DNA, 20 bp, Artificial
  CRISPR gRNA sequence
aacagagtaagagtaagggg

SEQ ID NO: 589010 - DNA, 20 bp, Artificial
  CRISPR gRNA sequence
aaggggaagatgtatttgat

SEQ ID NO: 589011 - DNA, 20 bp, Artificial
  CRISPR gRNA sequence
gggaagatgtatttgattgg

SEQ ID NO: 589012 - DNA, 20 bp, Artificial
  CRISPR gRNA sequence
aagatgtatttgattggaag

SEQ ID NO: 589013 - DNA, 20 bp, Artificial
  CRISPR gRNA sequence
acactataatgatcaatttt

SEQ ID NO: 589014 - DNA, 20 bp, Artificial
  CRISPR gRNA sequence
atgatcaattttgagctttc

SEQ ID NO: 589015 - DNA, 20 bp, Artificial
  CRISPR gRNA sequence
ttttgagctttctggcaact

SEQ ID NO: 589016 - DNA, 20 bp, Artificial
  CRISPR gRNA sequence
ttgagctttctggcaactta

SEQ ID NO: 589017 - DNA, 20 bp, Artificial
  CRISPR gRNA sequence
tgagctttctggcaacttag

SEQ ID NO: 589018 - DNA, 20 bp, Artificial
  CRISPR gRNA sequence
agctttctggcaacttagag

SEQ ID NO: 589019 - DNA, 20 bp, Artificial
  CRISPR gRNA sequence
acttagaggagcaaaaactg

SEQ ID NO: 589020 - DNA, 20 bp, Artificial
  CRISPR gRNA sequence
tttatgttctatctattatg

SEQ ID NO: 589021 - DNA, 20 bp, Artificial
  CRISPR gRNA sequence
ctatctattatgaagaaaat

SEQ ID NO: 589022 - DNA, 20 bp, Artificial
  CRISPR gRNA sequence
tatctattatgaagaaaatt

SEQ ID NO: 589023 - DNA, 20 bp, Artificial
  CRISPR gRNA sequence
atctattatgaagaaaatta

SEQ ID NO: 589024 - DNA, 20 bp, Artificial
  CRISPR gRNA sequence
attatgaagaaaattaggga

SEQ ID NO: 589025 - DNA, 20 bp, Artificial
  CRISPR gRNA sequence
tgaagaaaattagggatggc

SEQ ID NO: 589026 - DNA, 20 bp, Artificial
  CRISPR gRNA sequence
attagggatggctagtattt

SEQ ID NO: 589027 - DNA, 20 bp, Artificial
  CRISPR gRNA sequence
ctagtattttagattccaat

SEQ ID NO: 589028 - DNA, 20 bp, Artificial
  CRISPR gRNA sequence
gtattttagattccaattgg

SEQ ID NO: 589029 - DNA, 20 bp, Artificial
  CRISPR gRNA sequence
aattggaagcatgattgaat

SEQ ID NO: 589030 - DNA, 20 bp, Artificial
  CRISPR gRNA sequence
aagcatgattgaattggtat

SEQ ID NO: 589031 - DNA, 20 bp, Artificial
  CRISPR gRNA sequence
attgaattggtatcagctct

SEQ ID NO: 589032 - DNA, 20 bp, Artificial
  CRISPR gRNA sequence
ggtatcagctcttggtgatg

SEQ ID NO: 589033 - DNA, 20 bp, Artificial
  CRISPR gRNA sequence
atcagctcttggtgatgcag

SEQ ID NO: 589034 - DNA, 20 bp, Artificial
  CRISPR gRNA sequence
gctcttggtgatgcagtagc

SEQ ID NO: 589035 - DNA, 20 bp, Artificial
  CRISPR gRNA sequence
gctggatgccccctctccaa

SEQ ID NO: 589036 - DNA, 20 bp, Artificial
  CRISPR gRNA sequence
ctggatgccccctctccaat

SEQ ID NO: 589037 - DNA, 20 bp, Artificial
  CRISPR gRNA sequence
tggatgccccctctccaata

SEQ ID NO: 589038 - DNA, 20 bp, Artificial
  CRISPR gRNA sequence
gatatactaaattgcaaaat

SEQ ID NO: 589039 - DNA, 20 bp, Artificial
  CRISPR gRNA sequence
aaattgcaaaatgagcacga

SEQ ID NO: 589040 - DNA, 20 bp, Artificial
  CRISPR gRNA sequence
ttgcaaaatgagcacgatgg

SEQ ID NO: 589041 - DNA, 20 bp, Artificial
  CRISPR gRNA sequence
atgagcacgatggcagttat

SEQ ID NO: 589042 - DNA, 20 bp, Artificial
  CRISPR gRNA sequence
tgagcacgatggcagttata

SEQ ID NO: 589043 - DNA, 20 bp, Artificial
  CRISPR gRNA sequence
ggaccatgtctttgtttatg

SEQ ID NO: 589044 - DNA, 20 bp, Artificial
  CRISPR gRNA sequence
catgtctttgtttatgaaga

SEQ ID NO: 589045 - DNA, 20 bp, Artificial
  CRISPR gRNA sequence
aacatgatttcaacaaaaat

SEQ ID NO: 589046 - DNA, 20 bp, Artificial
  CRISPR gRNA sequence
tgatttcaacaaaaataaga

SEQ ID NO: 589047 - DNA, 20 bp, Artificial
  CRISPR gRNA sequence
aaaaataagatggatgttta

SEQ ID NO: 589048 - DNA, 20 bp, Artificial
  CRISPR gRNA sequence
ttaaagttatttattacatg

SEQ ID NO: 589049 - DNA, 20 bp, Artificial
  CRISPR gRNA sequence
gttatttattacatgaagtt

SEQ ID NO: 589050 - DNA, 20 bp, Artificial
  CRISPR gRNA sequence
ttatttattacatgaagttg

SEQ ID NO: 589051 - DNA, 20 bp, Artificial
  CRISPR gRNA sequence
ggcaaaactatatgttcacg

SEQ ID NO: 589052 - DNA, 20 bp, Artificial
  CRISPR gRNA sequence
tctatttgttatataatgtt

SEQ ID NO: 589053 - DNA, 20 bp, Artificial
  CRISPR gRNA sequence
actcaataataatttaactc

SEQ ID NO: 589054 - DNA, 20 bp, Artificial
  CRISPR gRNA sequence
aataataatttaactctggc

SEQ ID NO: 589055 - DNA, 20 bp, Artificial
  CRISPR gRNA sequence
taataatttaactctggcta

SEQ ID NO: 589056 - DNA, 20 bp, Artificial
  CRISPR gRNA sequence
ctctggctagagtacatgac

SEQ ID NO: 589057 - DNA, 20 bp, Artificial
  CRISPR gRNA sequence
tagagtacatgacaagctaa

SEQ ID NO: 589058 - DNA, 20 bp, Artificial
  CRISPR gRNA sequence
tggaaatgcctatcatgtcc

SEQ ID NO: 589059 - DNA, 20 bp, Artificial
  CRISPR gRNA sequence
aaatgcctatcatgtcctag

SEQ ID NO: 589060 - DNA, 20 bp, Artificial
  CRISPR gRNA sequence
cctagaagtatatttcaata

SEQ ID NO: 589061 - DNA, 20 bp, Artificial
  CRISPR gRNA sequence
ttcaataaagaacttttcat

SEQ ID NO: 589062 - DNA, 20 bp, Artificial
  CRISPR gRNA sequence
tcataagaaaacactgcttt

SEQ ID NO: 589063 - DNA, 20 bp, Artificial
  CRISPR gRNA sequence
gctttaagatataattttga

SEQ ID NO: 589064 - DNA, 20 bp, Artificial
  CRISPR gRNA sequence
aaataaaacataaaatgttg

SEQ ID NO: 589065 - DNA, 20 bp, Artificial
  CRISPR gRNA sequence
aaaacataaaatgttgtagt

SEQ ID NO: 589066 - DNA, 20 bp, Artificial
  CRISPR gRNA sequence
acataaaatgttgtagttgg

SEQ ID NO: 589067 - DNA, 20 bp, Artificial
  CRISPR gRNA sequence
aaaatgttgtagttggaagt

SEQ ID NO: 589068 - DNA, 20 bp, Artificial
  CRISPR gRNA sequence
gtaagtgaattcctttaact

SEQ ID NO: 589069 - DNA, 20 bp, Artificial
  CRISPR gRNA sequence
taagtgaattcctttaactc

SEQ ID NO: 589070 - DNA, 20 bp, Artificial
  CRISPR gRNA sequence
aagtgaattcctttaactca

SEQ ID NO: 589071 - DNA, 20 bp, Artificial
  CRISPR gRNA sequence
gtgaattcctttaactcagg

SEQ ID NO: 589072 - DNA, 20 bp, Artificial
  CRISPR gRNA sequence
tgaattcctttaactcaggg

SEQ ID NO: 589073 - DNA, 20 bp, Artificial
  CRISPR gRNA sequence
ttcctttaactcagggagga

SEQ ID NO: 589074 - DNA, 20 bp, Artificial
  CRISPR gRNA sequence
tttgtaactgccccaaattt

SEQ ID NO: 589075 - DNA, 20 bp, Artificial
  CRISPR gRNA sequence
tgtaactgccccaaatttaa

SEQ ID NO: 589076 - DNA, 20 bp, Artificial
  CRISPR gRNA sequence
ttaagagttaatgtttaaaa

SEQ ID NO: 589077 - DNA, 20 bp, Artificial
  CRISPR gRNA sequence
cacattcatgtttaaaaact

SEQ ID NO: 589078 - DNA, 20 bp, Artificial
  CRISPR gRNA sequence
tcatgtttaaaaacttagta

SEQ ID NO: 589079 - DNA, 20 bp, Artificial
  CRISPR gRNA sequence
taaaaacttagtacagcctt

SEQ ID NO: 589080 - DNA, 20 bp, Artificial
  CRISPR gRNA sequence
aaaaacttagtacagcctta

SEQ ID NO: 589081 - DNA, 20 bp, Artificial
  CRISPR gRNA sequence
agtacagccttaaggataaa

SEQ ID NO: 589082 - DNA, 20 bp, Artificial
  CRISPR gRNA sequence
gtacagccttaaggataaaa

SEQ ID NO: 589083 - DNA, 20 bp, Artificial
  CRISPR gRNA sequence
ggataaaaaggaaaaatgta

SEQ ID NO: 589084 - DNA, 20 bp, Artificial
  CRISPR gRNA sequence
ataaaaaggaaaaatgtaaa

SEQ ID NO: 589085 - DNA, 20 bp, Artificial
  CRISPR gRNA sequence
aaaaaggaaaaatgtaaaga

SEQ ID NO: 589086 - DNA, 20 bp, Artificial
  CRISPR gRNA sequence
gtaaagagagataatacaat

SEQ ID NO: 589087 - DNA, 20 bp, Artificial
  CRISPR gRNA sequence
taagcattatctcacaacct

SEQ ID NO: 589088 - DNA, 20 bp, Artificial
  CRISPR gRNA sequence
tctaatacgatttgtcaatg

SEQ ID NO: 589089 - DNA, 20 bp, Artificial
  CRISPR gRNA sequence
ttcatattaaaattaaaatt

SEQ ID NO: 589090 - DNA, 20 bp, Artificial
  CRISPR gRNA sequence
atttagtatgtcattatgaa

SEQ ID NO: 589091 - DNA, 20 bp, Artificial
  CRISPR gRNA sequence
tagtatgtcattatgaacag

SEQ ID NO: 589092 - DNA, 20 bp, Artificial
  CRISPR gRNA sequence
acagaagaaacaaataaaac

SEQ ID NO: 589093 - DNA, 20 bp, Artificial
  CRISPR gRNA sequence
gaaacaaataaaactagctt

SEQ ID NO: 589094 - DNA, 20 bp, Artificial
  CRISPR gRNA sequence
aacaaataaaactagcttga

SEQ ID NO: 589095 - DNA, 20 bp, Artificial
  CRISPR gRNA sequence
attttccacctttaacttct

SEQ ID NO: 589096 - DNA, 20 bp, Artificial
  CRISPR gRNA sequence
gttatgaaaatttatgctaa

SEQ ID NO: 589097 - DNA, 20 bp, Artificial
  CRISPR gRNA sequence
atttatgctaaaagtcaaat

SEQ ID NO: 589098 - DNA, 20 bp, Artificial
  CRISPR gRNA sequence
aaagtcaaatgagattcatt

SEQ ID NO: 589099 - DNA, 20 bp, Artificial
  CRISPR gRNA sequence
ctcttttatgtgttatattc

SEQ ID NO: 589100 - DNA, 20 bp, Artificial
  CRISPR gRNA sequence
tatttttttcttttattccc

SEQ ID NO: 589101 - DNA, 20 bp, Artificial
  CRISPR gRNA sequence
tttaaatgatttatgaaaca

SEQ ID NO: 589102 - DNA, 20 bp, Artificial
  CRISPR gRNA sequence
atgatttatgaaacacagca

SEQ ID NO: 589103 - DNA, 20 bp, Artificial
  CRISPR gRNA sequence
tatgaaacacagcaaagttt

SEQ ID NO: 589104 - DNA, 20 bp, Artificial
  CRISPR gRNA sequence
tgaaacacagcaaagtttca

SEQ ID NO: 589105 - DNA, 20 bp, Artificial
  CRISPR gRNA sequence
gtacccaatgactattgttt

SEQ ID NO: 589106 - DNA, 20 bp, Artificial
  CRISPR gRNA sequence
acccaatgactattgtttga

SEQ ID NO: 589107 - DNA, 20 bp, Artificial
  CRISPR gRNA sequence
tgactattgtttgagagcta

SEQ ID NO: 589108 - DNA, 20 bp, Artificial
  CRISPR gRNA sequence
tgtttgagagctaaagatac

SEQ ID NO: 589109 - DNA, 20 bp, Artificial
  CRISPR gRNA sequence
gtttgagagctaaagataca

SEQ ID NO: 589110 - DNA, 20 bp, Artificial
  CRISPR gRNA sequence
ttgagagctaaagatacaag

SEQ ID NO: 589111 - DNA, 20 bp, Artificial
  CRISPR gRNA sequence
gagagctaaagatacaagga

SEQ ID NO: 589112 - DNA, 20 bp, Artificial
  CRISPR gRNA sequence
gatacaaggagagttaaaat

SEQ ID NO: 589113 - DNA, 20 bp, Artificial
  CRISPR gRNA sequence
tagaatataaaatactcgaa

SEQ ID NO: 589114 - DNA, 20 bp, Artificial
  CRISPR gRNA sequence
actcgaaaagccaattttct

SEQ ID NO: 589115 - DNA, 20 bp, Artificial
  CRISPR gRNA sequence
aattttctgagtatattttc

SEQ ID NO: 589116 - DNA, 20 bp, Artificial
  CRISPR gRNA sequence
gagtatattttcaagtttaa

SEQ ID NO: 589117 - DNA, 20 bp, Artificial
  CRISPR gRNA sequence
agaaacaattttattttcca

SEQ ID NO: 589118 - DNA, 20 bp, Artificial
  CRISPR gRNA sequence
aaacaattttattttccaca

SEQ ID NO: 589119 - DNA, 20 bp, Artificial
  CRISPR gRNA sequence
tttattttccacagagatcc

SEQ ID NO: 589120 - DNA, 20 bp, Artificial
  CRISPR gRNA sequence
ttccacagagatcccagcct

SEQ ID NO: 589121 - DNA, 20 bp, Artificial
  CRISPR gRNA sequence
tcccagcctgagcactgtat

SEQ ID NO: 589122 - DNA, 20 bp, Artificial
  CRISPR gRNA sequence
ctgtatcagtcaaaaaaaat

SEQ ID NO: 589123 - DNA, 20 bp, Artificial
  CRISPR gRNA sequence
atcagttttcatttcctcta

SEQ ID NO: 589124 - DNA, 20 bp, Artificial
  CRISPR gRNA sequence
aaacataactgatattatac

SEQ ID NO: 589125 - DNA, 20 bp, Artificial
  CRISPR gRNA sequence
tactggatcttcacttatct

SEQ ID NO: 589126 - DNA, 20 bp, Artificial
  CRISPR gRNA sequence
attgtaaaattttaaaatta

SEQ ID NO: 589127 - DNA, 20 bp, Artificial
  CRISPR gRNA sequence
aaattatagaaaatatataa

SEQ ID NO: 589128 - DNA, 20 bp, Artificial
  CRISPR gRNA sequence
tttcttattctaatatattg

SEQ ID NO: 589129 - DNA, 20 bp, Artificial
  CRISPR gRNA sequence
ttattctaatatattgaagt

SEQ ID NO: 589130 - DNA, 20 bp, Artificial
  CRISPR gRNA sequence
tattgaagtaagatactctt

SEQ ID NO: 589131 - DNA, 20 bp, Artificial
  CRISPR gRNA sequence
gtaagatactcttcagttga

SEQ ID NO: 589132 - DNA, 20 bp, Artificial
  CRISPR gRNA sequence
tgacagtgctcctttctgcc

SEQ ID NO: 589133 - DNA, 20 bp, Artificial
  CRISPR gRNA sequence
ctcctttctgccaagccgta

SEQ ID NO: 589134 - DNA, 20 bp, Artificial
  CRISPR gRNA sequence
gccgtaaagtctaaaaatga

SEQ ID NO: 589135 - DNA, 20 bp, Artificial
  CRISPR gRNA sequence
gaaagatacatgcatcctgc

SEQ ID NO: 589136 - DNA, 20 bp, Artificial
  CRISPR gRNA sequence
atttaatgtacaccaataac

SEQ ID NO: 589137 - DNA, 20 bp, Artificial
  CRISPR gRNA sequence
caccaataacaagattgtct

SEQ ID NO: 589138 - DNA, 20 bp, Artificial
  CRISPR gRNA sequence
tcattaccgactacataaca

SEQ ID NO: 589139 - DNA, 20 bp, Artificial
  CRISPR gRNA sequence
gccatgttactatcattcaa

SEQ ID NO: 589140 - DNA, 20 bp, Artificial
  CRISPR gRNA sequence
tcattcaatagtactcttct

SEQ ID NO: 589141 - DNA, 20 bp, Artificial
  CRISPR gRNA sequence
cctgttttacttttcttctc

SEQ ID NO: 589142 - DNA, 20 bp, Artificial
  CRISPR gRNA sequence
ctgttttacttttcttctca

SEQ ID NO: 589143 - DNA, 20 bp, Artificial
  CRISPR gRNA sequence
gttttacttttcttctcaag

SEQ ID NO: 589144 - DNA, 20 bp, Artificial
  CRISPR gRNA sequence
tacttttcttctcaaggagt

SEQ ID NO: 589145 - DNA, 20 bp, Artificial
  CRISPR gRNA sequence
aaggagttggtgacacttac

SEQ ID NO: 589146 - DNA, 20 bp, Artificial
  CRISPR gRNA sequence
gttggtgacacttaccagaa

SEQ ID NO: 589147 - DNA, 20 bp, Artificial
  CRISPR gRNA sequence
ttggtgacacttaccagaat

SEQ ID NO: 589148 - DNA, 20 bp, Artificial
  CRISPR gRNA sequence
cacttaccagaatgggtcct

SEQ ID NO: 589149 - DNA, 20 bp, Artificial
  CRISPR gRNA sequence
acttaccagaatgggtcctg

SEQ ID NO: 589150 - DNA, 20 bp, Artificial
  CRISPR gRNA sequence
tgggtcctgaggtgtcctgt

SEQ ID NO: 589151 - DNA, 20 bp, Artificial
  CRISPR gRNA sequence
gggtcctgaggtgtcctgtg

SEQ ID NO: 589152 - DNA, 20 bp, Artificial
  CRISPR gRNA sequence
ggtcctgaggtgtcctgtga

SEQ ID NO: 589153 - DNA, 20 bp, Artificial
  CRISPR gRNA sequence
tgagggcgtcccttcttcta

SEQ ID NO: 589154 - DNA, 20 bp, Artificial
  CRISPR gRNA sequence
gagggcgtcccttcttctac

SEQ ID NO: 589155 - DNA, 20 bp, Artificial
  CRISPR gRNA sequence
cgtcccttcttctacaggcg

SEQ ID NO: 589156 - DNA, 20 bp, Artificial
  CRISPR gRNA sequence
ttcttctacaggcgtagcta

SEQ ID NO: 589157 - DNA, 20 bp, Artificial
  CRISPR gRNA sequence
tctacaggcgtagctacaga

SEQ ID NO: 589158 - DNA, 20 bp, Artificial
  CRISPR gRNA sequence
ctacaggcgtagctacagaa

SEQ ID NO: 589159 - DNA, 20 bp, Artificial
  CRISPR gRNA sequence
ctacagaaaggacatttgaa

SEQ ID NO: 589160 - DNA, 20 bp, Artificial
  CRISPR gRNA sequence
acatttgaacggcttctctc

SEQ ID NO: 589161 - DNA, 20 bp, Artificial
  CRISPR gRNA sequence
atttgaacggcttctctcca

SEQ ID NO: 589162 - DNA, 20 bp, Artificial
  CRISPR gRNA sequence
gagtgtaactttatgtgtct

SEQ ID NO: 589163 - DNA, 20 bp, Artificial
  CRISPR gRNA sequence
tgtaactttatgtgtctcag

SEQ ID NO: 589164 - DNA, 20 bp, Artificial
  CRISPR gRNA sequence
gtaactttatgtgtctcaga

SEQ ID NO: 589165 - DNA, 20 bp, Artificial
  CRISPR gRNA sequence
tctcagaaggttgcccttct

SEQ ID NO: 589166 - DNA, 20 bp, Artificial
  CRISPR gRNA sequence
aaggttgcccttctgagtaa

SEQ ID NO: 589167 - DNA, 20 bp, Artificial
  CRISPR gRNA sequence
gttgcccttctgagtaaaag

SEQ ID NO: 589168 - DNA, 20 bp, Artificial
  CRISPR gRNA sequence
gagtaaaagaagctccacac

SEQ ID NO: 589169 - DNA, 20 bp, Artificial
  CRISPR gRNA sequence
aagaagctccacactggtta

SEQ ID NO: 589170 - DNA, 20 bp, Artificial
  CRISPR gRNA sequence
aagctccacactggttacag

SEQ ID NO: 589171 - DNA, 20 bp, Artificial
  CRISPR gRNA sequence
ctccacactggttacagtgg

SEQ ID NO: 589172 - DNA, 20 bp, Artificial
  CRISPR gRNA sequence
tccacactggttacagtgga

SEQ ID NO: 589173 - DNA, 20 bp, Artificial
  CRISPR gRNA sequence
ccacactggttacagtggaa

SEQ ID NO: 589174 - DNA, 20 bp, Artificial
  CRISPR gRNA sequence
cacactggttacagtggaag

SEQ ID NO: 589175 - DNA, 20 bp, Artificial
  CRISPR gRNA sequence
gtggaaggggcgttcacctg

SEQ ID NO: 589176 - DNA, 20 bp, Artificial
  CRISPR gRNA sequence
aaggggcgttcacctgcagt

SEQ ID NO: 589177 - DNA, 20 bp, Artificial
  CRISPR gRNA sequence
aggggcgttcacctgcagta

SEQ ID NO: 589178 - DNA, 20 bp, Artificial
  CRISPR gRNA sequence
gggcgttcacctgcagtaag

SEQ ID NO: 589179 - DNA, 20 bp, Artificial
  CRISPR gRNA sequence
cgttcacctgcagtaaggag

SEQ ID NO: 589180 - DNA, 20 bp, Artificial
  CRISPR gRNA sequence
cctgcagtaaggagaagaaa

SEQ ID NO: 589181 - DNA, 20 bp, Artificial
  CRISPR gRNA sequence
ctgcagtaaggagaagaaat

SEQ ID NO: 589182 - DNA, 20 bp, Artificial
  CRISPR gRNA sequence
cagtaaggagaagaaatggg

SEQ ID NO: 589183 - DNA, 20 bp, Artificial
  CRISPR gRNA sequence
aagaaatgggaagtatcaac

SEQ ID NO: 589184 - DNA, 20 bp, Artificial
  CRISPR gRNA sequence
agaaatgggaagtatcaact

SEQ ID NO: 589185 - DNA, 20 bp, Artificial
  CRISPR gRNA sequence
gaaatgggaagtatcaacta

SEQ ID NO: 589186 - DNA, 20 bp, Artificial
  CRISPR gRNA sequence
gtatcaactagggtatgtgc

SEQ ID NO: 589187 - DNA, 20 bp, Artificial
  CRISPR gRNA sequence
ttgccatccactgttaacca

SEQ ID NO: 589188 - DNA, 20 bp, Artificial
  CRISPR gRNA sequence
catccactgttaaccaaagc

SEQ ID NO: 589189 - DNA, 20 bp, Artificial
  CRISPR gRNA sequence
aaaatgttcatctccctcat

SEQ ID NO: 589190 - DNA, 20 bp, Artificial
  CRISPR gRNA sequence
cttttaaacatttatctgcc

SEQ ID NO: 589191 - DNA, 20 bp, Artificial
  CRISPR gRNA sequence
cagaatttgctttgtcaata

SEQ ID NO: 589192 - DNA, 20 bp, Artificial
  CRISPR gRNA sequence
ctttgtcaatacagttacca

SEQ ID NO: 589193 - DNA, 20 bp, Artificial
  CRISPR gRNA sequence
aatacagttaccaaagtctt

SEQ ID NO: 589194 - DNA, 20 bp, Artificial
  CRISPR gRNA sequence
tttatgtataaatgtgacaa

SEQ ID NO: 589195 - DNA, 20 bp, Artificial
  CRISPR gRNA sequence
caaaagtcctatcattgact

SEQ ID NO: 589196 - DNA, 20 bp, Artificial
  CRISPR gRNA sequence
aagtcctatcattgactcag

SEQ ID NO: 589197 - DNA, 20 bp, Artificial
  CRISPR gRNA sequence
actcagaagaataacaataa

SEQ ID NO: 589198 - DNA, 20 bp, Artificial
  CRISPR gRNA sequence
acaataatagcatttatcat

SEQ ID NO: 589199 - DNA, 20 bp, Artificial
  CRISPR gRNA sequence
tttatcattggttgaacaat

SEQ ID NO: 589200 - DNA, 20 bp, Artificial
  CRISPR gRNA sequence
ttatcattggttgaacaatg

SEQ ID NO: 589201 - DNA, 20 bp, Artificial
  CRISPR gRNA sequence
acaatgaggtgctgtcactt

SEQ ID NO: 589202 - DNA, 20 bp, Artificial
  CRISPR gRNA sequence
caatgaggtgctgtcacttt

SEQ ID NO: 589203 - DNA, 20 bp, Artificial
  CRISPR gRNA sequence
aatgaggtgctgtcacttta

SEQ ID NO: 589204 - DNA, 20 bp, Artificial
  CRISPR gRNA sequence
tttagggccttacacacaat

SEQ ID NO: 589205 - DNA, 20 bp, Artificial
  CRISPR gRNA sequence
acacaattggatgctttcca

SEQ ID NO: 589206 - DNA, 20 bp, Artificial
  CRISPR gRNA sequence
tttcttacaatgacaataat

SEQ ID NO: 589207 - DNA, 20 bp, Artificial
  CRISPR gRNA sequence
ttcttacaatgacaataatt

SEQ ID NO: 589208 - DNA, 20 bp, Artificial
  CRISPR gRNA sequence
ttaattttaattaacaaatg

SEQ ID NO: 589209 - DNA, 20 bp, Artificial
  CRISPR gRNA sequence
attaacaaatgaagaaatta

SEQ ID NO: 589210 - DNA, 20 bp, Artificial
  CRISPR gRNA sequence
aatgaagaaattaaagtcca

SEQ ID NO: 589211 - DNA, 20 bp, Artificial
  CRISPR gRNA sequence
gatcaaactattttgttaca

SEQ ID NO: 589212 - DNA, 20 bp, Artificial
  CRISPR gRNA sequence
tcaaactattttgttacaca

SEQ ID NO: 589213 - DNA, 20 bp, Artificial
  CRISPR gRNA sequence
actattttgttacacagagc

SEQ ID NO: 589214 - DNA, 20 bp, Artificial
  CRISPR gRNA sequence
ttttgttacacagagctaga

SEQ ID NO: 589215 - DNA, 20 bp, Artificial
  CRISPR gRNA sequence
tgttacacagagctagaaag

SEQ ID NO: 589216 - DNA, 20 bp, Artificial
  CRISPR gRNA sequence
cacagagctagaaagtagtc

SEQ ID NO: 589217 - DNA, 20 bp, Artificial
  CRISPR gRNA sequence
acagagctagaaagtagtca

SEQ ID NO: 589218 - DNA, 20 bp, Artificial
  CRISPR gRNA sequence
agctagaaagtagtcaaggt

SEQ ID NO: 589219 - DNA, 20 bp, Artificial
  CRISPR gRNA sequence
gtcaaggtgagaaatgaacc

SEQ ID NO: 589220 - DNA, 20 bp, Artificial
  CRISPR gRNA sequence
aggtgagaaatgaacctggt

SEQ ID NO: 589221 - DNA, 20 bp, Artificial
  CRISPR gRNA sequence
agaaatgaacctggtcagtt

SEQ ID NO: 589222 - DNA, 20 bp, Artificial
  CRISPR gRNA sequence
ccatgctatctctttaaaat

SEQ ID NO: 589223 - DNA, 20 bp, Artificial
  CRISPR gRNA sequence
tgctatctctttaaaattgg

SEQ ID NO: 589224 - DNA, 20 bp, Artificial
  CRISPR gRNA sequence
ttaaaattggcagaaaattt

SEQ ID NO: 589225 - DNA, 20 bp, Artificial
  CRISPR gRNA sequence
tggcagaaaatttgagctga

SEQ ID NO: 589226 - DNA, 20 bp, Artificial
  CRISPR gRNA sequence
gcagaaaatttgagctgaaa

SEQ ID NO: 589227 - DNA, 20 bp, Artificial
  CRISPR gRNA sequence
tttgagctgaaagagacctt

SEQ ID NO: 589228 - DNA, 20 bp, Artificial
  CRISPR gRNA sequence
ttcagtctaattccctcatt

SEQ ID NO: 589229 - DNA, 20 bp, Artificial
  CRISPR gRNA sequence
attccctcatttagctgata

SEQ ID NO: 589230 - DNA, 20 bp, Artificial
  CRISPR gRNA sequence
cctcatttagctgatatgga

SEQ ID NO: 589231 - DNA, 20 bp, Artificial
  CRISPR gRNA sequence
ctcatttagctgatatggaa

SEQ ID NO: 589232 - DNA, 20 bp, Artificial
  CRISPR gRNA sequence
tcatttagctgatatggaaa

SEQ ID NO: 589233 - DNA, 20 bp, Artificial
  CRISPR gRNA sequence
catttagctgatatggaaag

SEQ ID NO: 589234 - DNA, 20 bp, Artificial
  CRISPR gRNA sequence
atatggaaaggggcaactaa

SEQ ID NO: 589235 - DNA, 20 bp, Artificial
  CRISPR gRNA sequence
tatggaaaggggcaactaaa

SEQ ID NO: 589236 - DNA, 20 bp, Artificial
  CRISPR gRNA sequence
aaaggggcaactaaaaggta

SEQ ID NO: 589237 - DNA, 20 bp, Artificial
  CRISPR gRNA sequence
aaaaggtacagcaaatgaac

SEQ ID NO: 589238 - DNA, 20 bp, Artificial
  CRISPR gRNA sequence
agcaaatgaaccagcttaca

SEQ ID NO: 589239 - DNA, 20 bp, Artificial
  CRISPR gRNA sequence
aaccagcttacaaagctcat

SEQ ID NO: 589240 - DNA, 20 bp, Artificial
  CRISPR gRNA sequence
cttacaaagctcattagtac

SEQ ID NO: 589241 - DNA, 20 bp, Artificial
  CRISPR gRNA sequence
tagtacaagattttcaaata

SEQ ID NO: 589242 - DNA, 20 bp, Artificial
  CRISPR gRNA sequence
agtacaagattttcaaatac

SEQ ID NO: 589243 - DNA, 20 bp, Artificial
  CRISPR gRNA sequence
caagattttcaaatacgggc

SEQ ID NO: 589244 - DNA, 20 bp, Artificial
  CRISPR gRNA sequence
aagattttcaaatacgggcc

SEQ ID NO: 589245 - DNA, 20 bp, Artificial
  CRISPR gRNA sequence
gccaggtttcttgattctcc

SEQ ID NO: 589246 - DNA, 20 bp, Artificial
  CRISPR gRNA sequence
ttgattctcctggtcactaa

SEQ ID NO: 589247 - DNA, 20 bp, Artificial
  CRISPR gRNA sequence
gtcactaatagtaaaacctt

SEQ ID NO: 589248 - DNA, 20 bp, Artificial
  CRISPR gRNA sequence
tccaaataaaattattcatc

SEQ ID NO: 589249 - DNA, 20 bp, Artificial
  CRISPR gRNA sequence
ttgtgaaacttattatttga

SEQ ID NO: 589250 - DNA, 20 bp, Artificial
  CRISPR gRNA sequence
tgtgaaacttattatttgaa

SEQ ID NO: 589251 - DNA, 20 bp, Artificial
  CRISPR gRNA sequence
ctattactgatattgctatg

SEQ ID NO: 589252 - DNA, 20 bp, Artificial
  CRISPR gRNA sequence
gatattgctatgaagttttt

SEQ ID NO: 589253 - DNA, 20 bp, Artificial
  CRISPR gRNA sequence
agtttttaagcctcaattat

SEQ ID NO: 589254 - DNA, 20 bp, Artificial
  CRISPR gRNA sequence
ttaagcctcaattataagtt

SEQ ID NO: 589255 - DNA, 20 bp, Artificial
  CRISPR gRNA sequence
ataaaaacatgtacgcaatg

SEQ ID NO: 589256 - DNA, 20 bp, Artificial
  CRISPR gRNA sequence
aaaacatgtacgcaatgaag

SEQ ID NO: 589257 - DNA, 20 bp, Artificial
  CRISPR gRNA sequence
acgcaatgaagcagtacaac

SEQ ID NO: 589258 - DNA, 20 bp, Artificial
  CRISPR gRNA sequence
aatgaagcagtacaactggc

SEQ ID NO: 589259 - DNA, 20 bp, Artificial
  CRISPR gRNA sequence
gaagcagtacaactggcaag

SEQ ID NO: 589260 - DNA, 20 bp, Artificial
  CRISPR gRNA sequence
aagcagtacaactggcaagt

SEQ ID NO: 589261 - DNA, 20 bp, Artificial
  CRISPR gRNA sequence
ggcaagtaggatcaaattga

SEQ ID NO: 589262 - DNA, 20 bp, Artificial
  CRISPR gRNA sequence
gatagccttatcaaaccata

SEQ ID NO: 589263 - DNA, 20 bp, Artificial
  CRISPR gRNA sequence
tttaaattcacctatcacta

SEQ ID NO: 589264 - DNA, 20 bp, Artificial
  CRISPR gRNA sequence
taaaataaaaattcaaatat

SEQ ID NO: 589265 - DNA, 20 bp, Artificial
  CRISPR gRNA sequence
aaaattcaaatataagtaaa

SEQ ID NO: 589266 - DNA, 20 bp, Artificial
  CRISPR gRNA sequence
agtaaaaatgtatcatacta

SEQ ID NO: 589267 - DNA, 20 bp, Artificial
  CRISPR gRNA sequence
atgtatcatactaaagctct

SEQ ID NO: 589268 - DNA, 20 bp, Artificial
  CRISPR gRNA sequence
tcatactaaagctctaagtt

SEQ ID NO: 589269 - DNA, 20 bp, Artificial
  CRISPR gRNA sequence
agctctaagtttagaataaa

SEQ ID NO: 589270 - DNA, 20 bp, Artificial
  CRISPR gRNA sequence
attacaaaacaattcccttt

SEQ ID NO: 589271 - DNA, 20 bp, Artificial
  CRISPR gRNA sequence
caattcccttttggttgaac

SEQ ID NO: 589272 - DNA, 20 bp, Artificial
  CRISPR gRNA sequence
ctggaccatttctttacctg

SEQ ID NO: 589273 - DNA, 20 bp, Artificial
  CRISPR gRNA sequence
accatttctttacctgcagt

SEQ ID NO: 589274 - DNA, 20 bp, Artificial
  CRISPR gRNA sequence
gatgatgattctaattttaa

SEQ ID NO: 589275 - DNA, 20 bp, Artificial
  CRISPR gRNA sequence
aattttaatagtttttcaaa

SEQ ID NO: 589276 - DNA, 20 bp, Artificial
  CRISPR gRNA sequence
ataatgaataataaaaactc

SEQ ID NO: 589277 - DNA, 20 bp, Artificial
  CRISPR gRNA sequence
taatgaataataaaaactca

SEQ ID NO: 589278 - DNA, 20 bp, Artificial
  CRISPR gRNA sequence
aataaaaactcaaggttttt

SEQ ID NO: 589279 - DNA, 20 bp, Artificial
  CRISPR gRNA sequence
actcaatgattcttttatta

SEQ ID NO: 589280 - DNA, 20 bp, Artificial
  CRISPR gRNA sequence
aatgattcttttattaaaga

SEQ ID NO: 589281 - DNA, 20 bp, Artificial
  CRISPR gRNA sequence
ttcttttattaaagaaagct

SEQ ID NO: 589282 - DNA, 20 bp, Artificial
  CRISPR gRNA sequence
cttttattaaagaaagctaa

SEQ ID NO: 589283 - DNA, 20 bp, Artificial
  CRISPR gRNA sequence
ttttattaaagaaagctaag

SEQ ID NO: 589284 - DNA, 20 bp, Artificial
  CRISPR gRNA sequence
gaaagctaagaggtataaat

SEQ ID NO: 589285 - DNA, 20 bp, Artificial
  CRISPR gRNA sequence
ggtataaataagataaacta

SEQ ID NO: 589286 - DNA, 20 bp, Artificial
  CRISPR gRNA sequence
gataaactatggtcactttc

SEQ ID NO: 589287 - DNA, 20 bp, Artificial
  CRISPR gRNA sequence
aaactatggtcactttctgg

SEQ ID NO: 589288 - DNA, 20 bp, Artificial
  CRISPR gRNA sequence
ctatggtcactttctggcag

SEQ ID NO: 589289 - DNA, 20 bp, Artificial
  CRISPR gRNA sequence
ctattgaaaattctatcata

SEQ ID NO: 589290 - DNA, 20 bp, Artificial
  CRISPR gRNA sequence
tatagatttgttataaaacc

SEQ ID NO: 589291 - DNA, 20 bp, Artificial
  CRISPR gRNA sequence
acctagataaatttaaaaat

SEQ ID NO: 589292 - DNA, 20 bp, Artificial
  CRISPR gRNA sequence
tagataaatttaaaaattgg

SEQ ID NO: 589293 - DNA, 20 bp, Artificial
  CRISPR gRNA sequence
aatttaaaaattggtagatc

SEQ ID NO: 589294 - DNA, 20 bp, Artificial
  CRISPR gRNA sequence
caagtatatctcaaattctg

SEQ ID NO: 589295 - DNA, 20 bp, Artificial
  CRISPR gRNA sequence
atctcaaattctgtagtatt

SEQ ID NO: 589296 - DNA, 20 bp, Artificial
  CRISPR gRNA sequence
ttctgtagtatttagtgttt

SEQ ID NO: 589297 - DNA, 20 bp, Artificial
  CRISPR gRNA sequence
tctgtagtatttagtgtttt

SEQ ID NO: 589298 - DNA, 20 bp, Artificial
  CRISPR gRNA sequence
tgtagtatttagtgttttgg

SEQ ID NO: 589299 - DNA, 20 bp, Artificial
  CRISPR gRNA sequence
ttagtgttttgggagttaat

SEQ ID NO: 589300 - DNA, 20 bp, Artificial
  CRISPR gRNA sequence
tagtgttttgggagttaatg

SEQ ID NO: 589301 - DNA, 20 bp, Artificial
  CRISPR gRNA sequence
ttaatgaggtacataccaaa

SEQ ID NO: 589302 - DNA, 20 bp, Artificial
  CRISPR gRNA sequence
taatgaggtacataccaaaa

SEQ ID NO: 589303 - DNA, 20 bp, Artificial
  CRISPR gRNA sequence
taccaaaaaggtgtaatctg

SEQ ID NO: 589304 - DNA, 20 bp, Artificial
  CRISPR gRNA sequence
accaaaaaggtgtaatctgt

SEQ ID NO: 589305 - DNA, 20 bp, Artificial
  CRISPR gRNA sequence
aaaggtgtaatctgtgggtg

SEQ ID NO: 589306 - DNA, 20 bp, Artificial
  CRISPR gRNA sequence
ggtgtaatctgtgggtgtgg

SEQ ID NO: 589307 - DNA, 20 bp, Artificial
  CRISPR gRNA sequence
gtgtaatctgtgggtgtggt

SEQ ID NO: 589308 - DNA, 20 bp, Artificial
  CRISPR gRNA sequence
tgtaatctgtgggtgtggtg

SEQ ID NO: 589309 - DNA, 20 bp, Artificial
  CRISPR gRNA sequence
gtaatctgtgggtgtggtgg

SEQ ID NO: 589310 - DNA, 20 bp, Artificial
  CRISPR gRNA sequence
ctgtgggtgtggtgggggtt

SEQ ID NO: 589311 - DNA, 20 bp, Artificial
  CRISPR gRNA sequence
tgtgggtgtggtgggggtta

SEQ ID NO: 589312 - DNA, 20 bp, Artificial
  CRISPR gRNA sequence
gggggttaaggttttttctt

SEQ ID NO: 589313 - DNA, 20 bp, Artificial
  CRISPR gRNA sequence
aggttttttcttaagaaatc

SEQ ID NO: 589314 - DNA, 20 bp, Artificial
  CRISPR gRNA sequence
gttttttcttaagaaatctg

SEQ ID NO: 589315 - DNA, 20 bp, Artificial
  CRISPR gRNA sequence
aagaaatctggagctcttat

SEQ ID NO: 589316 - DNA, 20 bp, Artificial
  CRISPR gRNA sequence
ctcttatgagctacatgtac

SEQ ID NO: 589317 - DNA, 20 bp, Artificial
  CRISPR gRNA sequence
cttatgagctacatgtacaa

SEQ ID NO: 589318 - DNA, 20 bp, Artificial
  CRISPR gRNA sequence
ttatgagctacatgtacaag

SEQ ID NO: 589319 - DNA, 20 bp, Artificial
  CRISPR gRNA sequence
aggtcctatattgataatat

SEQ ID NO: 589320 - DNA, 20 bp, Artificial
  CRISPR gRNA sequence
gaaaaaaatctgtaatgtta

SEQ ID NO: 589321 - DNA, 20 bp, Artificial
  CRISPR gRNA sequence
tgtaatgttaaagttccctt

SEQ ID NO: 589322 - DNA, 20 bp, Artificial
  CRISPR gRNA sequence
aatgttaaagttcccttaag

SEQ ID NO: 589323 - DNA, 20 bp, Artificial
  CRISPR gRNA sequence
tcccttaagtggtatcttct

SEQ ID NO: 589324 - DNA, 20 bp, Artificial
  CRISPR gRNA sequence
tcttcttagtttgattaacc

SEQ ID NO: 589325 - DNA, 20 bp, Artificial
  CRISPR gRNA sequence
cttagtttgattaacctggt

SEQ ID NO: 589326 - DNA, 20 bp, Artificial
  CRISPR gRNA sequence
gatctatatctcctcatata

SEQ ID NO: 589327 - DNA, 20 bp, Artificial
  CRISPR gRNA sequence
catataaagtcttccaacat

SEQ ID NO: 589328 - DNA, 20 bp, Artificial
  CRISPR gRNA sequence
atataaagtcttccaacata

SEQ ID NO: 589329 - DNA, 20 bp, Artificial
  CRISPR gRNA sequence
ttttaaaataaattgaattt

SEQ ID NO: 589330 - DNA, 20 bp, Artificial
  CRISPR gRNA sequence
taaaataaattgaattttgg

SEQ ID NO: 589331 - DNA, 20 bp, Artificial
  CRISPR gRNA sequence
tatttgattctctttcctaa

SEQ ID NO: 589332 - DNA, 20 bp, Artificial
  CRISPR gRNA sequence
tctctttcctaatggaatca

SEQ ID NO: 589333 - DNA, 20 bp, Artificial
  CRISPR gRNA sequence
ctctttcctaatggaatcac

SEQ ID NO: 589334 - DNA, 20 bp, Artificial
  CRISPR gRNA sequence
aggctgcaactttttaaatc

SEQ ID NO: 589335 - DNA, 20 bp, Artificial
  CRISPR gRNA sequence
tccactcccaacccctgcca

SEQ ID NO: 589336 - DNA, 20 bp, Artificial
  CRISPR gRNA sequence
aacccctgccatagtaataa

SEQ ID NO: 589337 - DNA, 20 bp, Artificial
  CRISPR gRNA sequence
acccctgccatagtaataaa

SEQ ID NO: 589338 - DNA, 20 bp, Artificial
  CRISPR gRNA sequence
ctgccatagtaataaaagga

SEQ ID NO: 589339 - DNA, 20 bp, Artificial
  CRISPR gRNA sequence
catagtaataaaaggaaaga

SEQ ID NO: 589340 - DNA, 20 bp, Artificial
  CRISPR gRNA sequence
tagtaataaaaggaaagatg

SEQ ID NO: 589341 - DNA, 20 bp, Artificial
  CRISPR gRNA sequence
agtaataaaaggaaagatgg

SEQ ID NO: 589342 - DNA, 20 bp, Artificial
  CRISPR gRNA sequence
tttcacaaattaaattttta

SEQ ID NO: 589343 - DNA, 20 bp, Artificial
  CRISPR gRNA sequence
aaattaaatttttaaagaaa

SEQ ID NO: 589344 - DNA, 20 bp, Artificial
  CRISPR gRNA sequence
aattaaatttttaaagaaaa

SEQ ID NO: 589345 - DNA, 20 bp, Artificial
  CRISPR gRNA sequence
tttttaaagaaaaaggaaaa

SEQ ID NO: 589346 - DNA, 20 bp, Artificial
  CRISPR gRNA sequence
cttttaaaatatgtctacgt

SEQ ID NO: 589347 - DNA, 20 bp, Artificial
  CRISPR gRNA sequence
ttttaaaatatgtctacgta

SEQ ID NO: 589348 - DNA, 20 bp, Artificial
  CRISPR gRNA sequence
atgtctacgtaaggtttccc

SEQ ID NO: 589349 - DNA, 20 bp, Artificial
  CRISPR gRNA sequence
ctacgtaaggtttcccaagc

SEQ ID NO: 589350 - DNA, 20 bp, Artificial
  CRISPR gRNA sequence
ttcgttaacaataactttac

SEQ ID NO: 589351 - DNA, 20 bp, Artificial
  CRISPR gRNA sequence
cgttaacaataactttacaa

SEQ ID NO: 589352 - DNA, 20 bp, Artificial
  CRISPR gRNA sequence
tttacaagagttaaattact

SEQ ID NO: 589353 - DNA, 20 bp, Artificial
  CRISPR gRNA sequence
aagagttaaattactaagtg

SEQ ID NO: 589354 - DNA, 20 bp, Artificial
  CRISPR gRNA sequence
taagtgtggtgaacaatttg

SEQ ID NO: 589355 - DNA, 20 bp, Artificial
  CRISPR gRNA sequence
tttgaagtcatgtctgcctt

SEQ ID NO: 589356 - DNA, 20 bp, Artificial
  CRISPR gRNA sequence
gcctttagataatactccta

SEQ ID NO: 589357 - DNA, 20 bp, Artificial
  CRISPR gRNA sequence
ttaaacctcctacaatgttt

SEQ ID NO: 589358 - DNA, 20 bp, Artificial
  CRISPR gRNA sequence
atatttcaaaatccttaatt

SEQ ID NO: 589359 - DNA, 20 bp, Artificial
  CRISPR gRNA sequence
atttcaaaatccttaattta

SEQ ID NO: 589360 - DNA, 20 bp, Artificial
  CRISPR gRNA sequence
tcaaaatccttaatttagag

SEQ ID NO: 589361 - DNA, 20 bp, Artificial
  CRISPR gRNA sequence
tcattcttcaaaaataatgc

SEQ ID NO: 589362 - DNA, 20 bp, Artificial
  CRISPR gRNA sequence
gaaacaatatcttttttaaa

SEQ ID NO: 589363 - DNA, 20 bp, Artificial
  CRISPR gRNA sequence
attttaaaattcacctaatt

SEQ ID NO: 589364 - DNA, 20 bp, Artificial
  CRISPR gRNA sequence
gagttttatgcgattaatga

SEQ ID NO: 589365 - DNA, 20 bp, Artificial
  CRISPR gRNA sequence
agttttatgcgattaatgaa

SEQ ID NO: 589366 - DNA, 20 bp, Artificial
  CRISPR gRNA sequence
gttttatgcgattaatgaaa

SEQ ID NO: 589367 - DNA, 20 bp, Artificial
  CRISPR gRNA sequence
cgattaatgaaagggtaatt

SEQ ID NO: 589368 - DNA, 20 bp, Artificial
  CRISPR gRNA sequence
tttacatttacaaaatactc

SEQ ID NO: 589369 - DNA, 20 bp, Artificial
  CRISPR gRNA sequence
tatcttcaaatctttttaat

SEQ ID NO: 589370 - DNA, 20 bp, Artificial
  CRISPR gRNA sequence
tttatatgatcatccccaaa

SEQ ID NO: 589371 - DNA, 20 bp, Artificial
  CRISPR gRNA sequence
atgatcatccccaaatggcg

SEQ ID NO: 589372 - DNA, 20 bp, Artificial
  CRISPR gRNA sequence
aaatggcgtagaataaacaa

SEQ ID NO: 589373 - DNA, 20 bp, Artificial
  CRISPR gRNA sequence
aatggcgtagaataaacaaa

SEQ ID NO: 589374 - DNA, 20 bp, Artificial
  CRISPR gRNA sequence
ggcgtagaataaacaaaagg

SEQ ID NO: 589375 - DNA, 20 bp, Artificial
  CRISPR gRNA sequence
agaataaacaaaaggtagtc

SEQ ID NO: 589376 - DNA, 20 bp, Artificial
  CRISPR gRNA sequence
gaataaacaaaaggtagtct

SEQ ID NO: 589377 - DNA, 20 bp, Artificial
  CRISPR gRNA sequence
aaaggtagtctaggtatatc

SEQ ID NO: 589378 - DNA, 20 bp, Artificial
  CRISPR gRNA sequence
ggaaatattgtcctgttgct

SEQ ID NO: 589379 - DNA, 20 bp, Artificial
  CRISPR gRNA sequence
tattgtcctgttgctgagtg

SEQ ID NO: 589380 - DNA, 20 bp, Artificial
  CRISPR gRNA sequence
tgtcctgttgctgagtgtgg

SEQ ID NO: 589381 - DNA, 20 bp, Artificial
  CRISPR gRNA sequence
tgagtgtggaagtcatacta

SEQ ID NO: 589382 - DNA, 20 bp, Artificial
  CRISPR gRNA sequence
gtgtggaagtcatactatgg

SEQ ID NO: 589383 - DNA, 20 bp, Artificial
  CRISPR gRNA sequence
agtcatactatggaagtctt

SEQ ID NO: 589384 - DNA, 20 bp, Artificial
  CRISPR gRNA sequence
atactatggaagtctttggt

SEQ ID NO: 589385 - DNA, 20 bp, Artificial
  CRISPR gRNA sequence
gaagtctttggtaagttccc

SEQ ID NO: 589386 - DNA, 20 bp, Artificial
  CRISPR gRNA sequence
aagtctttggtaagttccca

SEQ ID NO: 589387 - DNA, 20 bp, Artificial
  CRISPR gRNA sequence
ttggtaagttcccaaggaca

SEQ ID NO: 589388 - DNA, 20 bp, Artificial
  CRISPR gRNA sequence
tggtaagttcccaaggacat

SEQ ID NO: 589389 - DNA, 20 bp, Artificial
  CRISPR gRNA sequence
taagttcccaaggacatggg

SEQ ID NO: 589390 - DNA, 20 bp, Artificial
  CRISPR gRNA sequence
tcccaaggacatgggaagta

SEQ ID NO: 589391 - DNA, 20 bp, Artificial
  CRISPR gRNA sequence
caaggacatgggaagtaaag

SEQ ID NO: 589392 - DNA, 20 bp, Artificial
  CRISPR gRNA sequence
catgggaagtaaagaagaac

SEQ ID NO: 589393 - DNA, 20 bp, Artificial
  CRISPR gRNA sequence
atgggaagtaaagaagaaca

SEQ ID NO: 589394 - DNA, 20 bp, Artificial
  CRISPR gRNA sequence
aagaagaacaaggcatgatg

SEQ ID NO: 589395 - DNA, 20 bp, Artificial
  CRISPR gRNA sequence
agaagaacaaggcatgatga

SEQ ID NO: 589396 - DNA, 20 bp, Artificial
  CRISPR gRNA sequence
caaggcatgatgaaggtaaa

SEQ ID NO: 589397 - DNA, 20 bp, Artificial
  CRISPR gRNA sequence
aatagttttcttcctttttt

SEQ ID NO: 589398 - DNA, 20 bp, Artificial
  CRISPR gRNA sequence
gttttcttcctttttttggt

SEQ ID NO: 589399 - DNA, 20 bp, Artificial
  CRISPR gRNA sequence
tttcttcctttttttggtaa

SEQ ID NO: 589400 - DNA, 20 bp, Artificial
  CRISPR gRNA sequence
tcctttttttggtaagagaa

SEQ ID NO: 589401 - DNA, 20 bp, Artificial
  CRISPR gRNA sequence
cctttttttggtaagagaaa

SEQ ID NO: 589402 - DNA, 20 bp, Artificial
  CRISPR gRNA sequence
ctttttttggtaagagaaaa

SEQ ID NO: 589403 - DNA, 20 bp, Artificial
  CRISPR gRNA sequence
tttttttggtaagagaaaag

SEQ ID NO: 589404 - DNA, 20 bp, Artificial
  CRISPR gRNA sequence
taatacattttaatttcaat

SEQ ID NO: 589405 - DNA, 20 bp, Artificial
  CRISPR gRNA sequence
cattttaatttcaataagat

SEQ ID NO: 589406 - DNA, 20 bp, Artificial
  CRISPR gRNA sequence
attttaatttcaataagata

SEQ ID NO: 589407 - DNA, 20 bp, Artificial
  CRISPR gRNA sequence
atttcaataagataaggctt

SEQ ID NO: 589408 - DNA, 20 bp, Artificial
  CRISPR gRNA sequence
tttcaataagataaggcttt

SEQ ID NO: 589409 - DNA, 20 bp, Artificial
  CRISPR gRNA sequence
tcaataagataaggctttgg

SEQ ID NO: 589410 - DNA, 20 bp, Artificial
  CRISPR gRNA sequence
tattgatttgaattatgaat

SEQ ID NO: 589411 - DNA, 20 bp, Artificial
  CRISPR gRNA sequence
gaattatgaataagtcttga

SEQ ID NO: 589412 - DNA, 20 bp, Artificial
  CRISPR gRNA sequence
tgatagatgctttttacatt

SEQ ID NO: 589413 - DNA, 20 bp, Artificial
  CRISPR gRNA sequence
acatttggatactaatttta

SEQ ID NO: 589414 - DNA, 20 bp, Artificial
  CRISPR gRNA sequence
tgatgtcttgattatatgaa

SEQ ID NO: 589415 - DNA, 20 bp, Artificial
  CRISPR gRNA sequence
gaaaagataattatcatttc

SEQ ID NO: 589416 - DNA, 20 bp, Artificial
  CRISPR gRNA sequence
aaagataattatcatttcaa

SEQ ID NO: 589417 - DNA, 20 bp, Artificial
  CRISPR gRNA sequence
ttttattgtgttccaaacta

SEQ ID NO: 589418 - DNA, 20 bp, Artificial
  CRISPR gRNA sequence
attgtgttccaaactaaagt

SEQ ID NO: 589419 - DNA, 20 bp, Artificial
  CRISPR gRNA sequence
tgttccaaactaaagttagt

SEQ ID NO: 589420 - DNA, 20 bp, Artificial
  CRISPR gRNA sequence
gaatcataatgaaaccctca

SEQ ID NO: 589421 - DNA, 20 bp, Artificial
  CRISPR gRNA sequence
accctcaaagacaatactgt

SEQ ID NO: 589422 - DNA, 20 bp, Artificial
  CRISPR gRNA sequence
aagacaatactgttagaaac

SEQ ID NO: 589423 - DNA, 20 bp, Artificial
  CRISPR gRNA sequence
agacaatactgttagaaaca

SEQ ID NO: 589424 - DNA, 20 bp, Artificial
  CRISPR gRNA sequence
gttagaaacaaggattaaaa

SEQ ID NO: 589425 - DNA, 20 bp, Artificial
  CRISPR gRNA sequence
tagaaacaaggattaaaaca

SEQ ID NO: 589426 - DNA, 20 bp, Artificial
  CRISPR gRNA sequence
agaaacaaggattaaaacag

SEQ ID NO: 589427 - DNA, 20 bp, Artificial
  CRISPR gRNA sequence
gaaacaaggattaaaacaga

SEQ ID NO: 589428 - DNA, 20 bp, Artificial
  CRISPR gRNA sequence
taaaacagagggtaatttat

SEQ ID NO: 589429 - DNA, 20 bp, Artificial
  CRISPR gRNA sequence
gtaatttatgagatttctaa

SEQ ID NO: 589430 - DNA, 20 bp, Artificial
  CRISPR gRNA sequence
gagatttctaaaagtataca

SEQ ID NO: 589431 - DNA, 20 bp, Artificial
  CRISPR gRNA sequence
aagtatacatagttatattc

SEQ ID NO: 589432 - DNA, 20 bp, Artificial
  CRISPR gRNA sequence
agtatacatagttatattcc

SEQ ID NO: 589433 - DNA, 20 bp, Artificial
  CRISPR gRNA sequence
ttccaggaataatccaaata

SEQ ID NO: 589434 - DNA, 20 bp, Artificial
  CRISPR gRNA sequence
caggaataatccaaatatag

SEQ ID NO: 589435 - DNA, 20 bp, Artificial
  CRISPR gRNA sequence
tctgtctaataacaaataaa

SEQ ID NO: 589436 - DNA, 20 bp, Artificial
  CRISPR gRNA sequence
aattgactcaatttttgata

SEQ ID NO: 589437 - DNA, 20 bp, Artificial
  CRISPR gRNA sequence
aagttatttctataaaacat

SEQ ID NO: 589438 - DNA, 20 bp, Artificial
  CRISPR gRNA sequence
aacccttttattgaatgtcg

SEQ ID NO: 589439 - DNA, 20 bp, Artificial
  CRISPR gRNA sequence
acccttttattgaatgtcgt

SEQ ID NO: 589440 - DNA, 20 bp, Artificial
  CRISPR gRNA sequence
cccttttattgaatgtcgtg

SEQ ID NO: 589441 - DNA, 20 bp, Artificial
  CRISPR gRNA sequence
gaatgtcgtggggtatttcc

SEQ ID NO: 589442 - DNA, 20 bp, Artificial
  CRISPR gRNA sequence
tcgtggggtatttcctggcc

SEQ ID NO: 589443 - DNA, 20 bp, Artificial
  CRISPR gRNA sequence
cgtggggtatttcctggcct

SEQ ID NO: 589444 - DNA, 20 bp, Artificial
  CRISPR gRNA sequence
atttcctggcctaggcatta

SEQ ID NO: 589445 - DNA, 20 bp, Artificial
  CRISPR gRNA sequence
tggcctaggcattacagaat

SEQ ID NO: 589446 - DNA, 20 bp, Artificial
  CRISPR gRNA sequence
tgtaaaattatctgataatt

SEQ ID NO: 589447 - DNA, 20 bp, Artificial
  CRISPR gRNA sequence
attatctgataattaagtaa

SEQ ID NO: 589448 - DNA, 20 bp, Artificial
  CRISPR gRNA sequence
tgataattaagtaaaagatt

SEQ ID NO: 589449 - DNA, 20 bp, Artificial
  CRISPR gRNA sequence
ctatcttttctctatgcaaa

SEQ ID NO: 589450 - DNA, 20 bp, Artificial
  CRISPR gRNA sequence
taaataatttgttctttaaa

SEQ ID NO: 589451 - DNA, 20 bp, Artificial
  CRISPR gRNA sequence
tgcatcaatgtgcccttttt

SEQ ID NO: 589452 - DNA, 20 bp, Artificial
  CRISPR gRNA sequence
tcaatgtgccctttttgagt

SEQ ID NO: 589453 - DNA, 20 bp, Artificial
  CRISPR gRNA sequence
gtgccctttttgagtcagtt

SEQ ID NO: 589454 - DNA, 20 bp, Artificial
  CRISPR gRNA sequence
tgttcttcatatgtatatca

SEQ ID NO: 589455 - DNA, 20 bp, Artificial
  CRISPR gRNA sequence
tgtatatcaaagcaaatttt

SEQ ID NO: 589456 - DNA, 20 bp, Artificial
  CRISPR gRNA sequence
aaatttactaactacattaa

SEQ ID NO: 589457 - DNA, 20 bp, Artificial
  CRISPR gRNA sequence
atttactaactacattaatg

SEQ ID NO: 589458 - DNA, 20 bp, Artificial
  CRISPR gRNA sequence
ctacattaatggagcaatcc

SEQ ID NO: 589459 - DNA, 20 bp, Artificial
  CRISPR gRNA sequence
caatccaagctgaaaacatt

SEQ ID NO: 589460 - DNA, 20 bp, Artificial
  CRISPR gRNA sequence
tccaagctgaaaacattaag

SEQ ID NO: 589461 - DNA, 20 bp, Artificial
  CRISPR gRNA sequence
ataatgactaatctttcccc

SEQ ID NO: 589462 - DNA, 20 bp, Artificial
  CRISPR gRNA sequence
atgactaatctttcccctgg

SEQ ID NO: 589463 - DNA, 20 bp, Artificial
  CRISPR gRNA sequence
tgactaatctttcccctggt

SEQ ID NO: 589464 - DNA, 20 bp, Artificial
  CRISPR gRNA sequence
ccctggtaggcacaaaaatc

SEQ ID NO: 589465 - DNA, 20 bp, Artificial
  CRISPR gRNA sequence
aaaatctagactaacaaaac

SEQ ID NO: 589466 - DNA, 20 bp, Artificial
  CRISPR gRNA sequence
tagactaacaaaactggatc

SEQ ID NO: 589467 - DNA, 20 bp, Artificial
  CRISPR gRNA sequence
agactaacaaaactggatcg

SEQ ID NO: 589468 - DNA, 20 bp, Artificial
  CRISPR gRNA sequence
ctggatcgaggaaaataatt

SEQ ID NO: 589469 - DNA, 20 bp, Artificial
  CRISPR gRNA sequence
cgaggaaaataattaagata

SEQ ID NO: 589470 - DNA, 20 bp, Artificial
  CRISPR gRNA sequence
gtttttatttttaaatacaa

SEQ ID NO: 589471 - DNA, 20 bp, Artificial
  CRISPR gRNA sequence
aatacaatagaacaatctac

SEQ ID NO: 589472 - DNA, 20 bp, Artificial
  CRISPR gRNA sequence
gtccatttttatttattgac

SEQ ID NO: 589473 - DNA, 20 bp, Artificial
  CRISPR gRNA sequence
tccatttttatttattgact

SEQ ID NO: 589474 - DNA, 20 bp, Artificial
  CRISPR gRNA sequence
tttttatttattgactgggt

SEQ ID NO: 589475 - DNA, 20 bp, Artificial
  CRISPR gRNA sequence
attatatattatttttatta

SEQ ID NO: 589476 - DNA, 20 bp, Artificial
  CRISPR gRNA sequence
ccttcataaacacctatttc

SEQ ID NO: 589477 - DNA, 20 bp, Artificial
  CRISPR gRNA sequence
atatatgcatcaacttgctt

SEQ ID NO: 589478 - DNA, 20 bp, Artificial
  CRISPR gRNA sequence
caacttgctttggtgaatca

SEQ ID NO: 589479 - DNA, 20 bp, Artificial
  CRISPR gRNA sequence
ttgctttggtgaatcaaaga

SEQ ID NO: 589480 - DNA, 20 bp, Artificial
  CRISPR gRNA sequence
gctttggtgaatcaaagaca

SEQ ID NO: 589481 - DNA, 20 bp, Artificial
  CRISPR gRNA sequence
ctttggtgaatcaaagacag

SEQ ID NO: 589482 - DNA, 20 bp, Artificial
  CRISPR gRNA sequence
tttggtgaatcaaagacaga

SEQ ID NO: 589483 - DNA, 20 bp, Artificial
  CRISPR gRNA sequence
gacagagggtgctcctatgt

SEQ ID NO: 589484 - DNA, 20 bp, Artificial
  CRISPR gRNA sequence
acagagggtgctcctatgtt

SEQ ID NO: 589485 - DNA, 20 bp, Artificial
  CRISPR gRNA sequence
gagggtgctcctatgttggg

SEQ ID NO: 589486 - DNA, 20 bp, Artificial
  CRISPR gRNA sequence
tggaacaacctacaaatatg

SEQ ID NO: 589487 - DNA, 20 bp, Artificial
  CRISPR gRNA sequence
ctacaaatatgcagaatctc

SEQ ID NO: 589488 - DNA, 20 bp, Artificial
  CRISPR gRNA sequence
cagaatctcaagcatctgct

SEQ ID NO: 589489 - DNA, 20 bp, Artificial
  CRISPR gRNA sequence
agcatctgctgagtgccttt

SEQ ID NO: 589490 - DNA, 20 bp, Artificial
  CRISPR gRNA sequence
tctgctgagtgcctttgagc

SEQ ID NO: 589491 - DNA, 20 bp, Artificial
  CRISPR gRNA sequence
tgctgagtgcctttgagcaa

SEQ ID NO: 589492 - DNA, 20 bp, Artificial
  CRISPR gRNA sequence
gctgagtgcctttgagcaag

SEQ ID NO: 589493 - DNA, 20 bp, Artificial
  CRISPR gRNA sequence
agtgcctttgagcaagagga

SEQ ID NO: 589494 - DNA, 20 bp, Artificial
  CRISPR gRNA sequence
agcaagaggatggctgcaca

SEQ ID NO: 589495 - DNA, 20 bp, Artificial
  CRISPR gRNA sequence
aagctgcaatgtacaaaata

SEQ ID NO: 589496 - DNA, 20 bp, Artificial
  CRISPR gRNA sequence
aaaatacggtgctgaaaact

SEQ ID NO: 589497 - DNA, 20 bp, Artificial
  CRISPR gRNA sequence
ggtgctgaaaactgagttac

SEQ ID NO: 589498 - DNA, 20 bp, Artificial
  CRISPR gRNA sequence
ctgaaaactgagttacaaga

SEQ ID NO: 589499 - DNA, 20 bp, Artificial
  CRISPR gRNA sequence
tgaaaactgagttacaagat

SEQ ID NO: 589500 - DNA, 20 bp, Artificial
  CRISPR gRNA sequence
aaaactgagttacaagatgg

SEQ ID NO: 589501 - DNA, 20 bp, Artificial
  CRISPR gRNA sequence
actgagttacaagatgggag

SEQ ID NO: 589502 - DNA, 20 bp, Artificial
  CRISPR gRNA sequence
ttacaagatgggagtagatt

SEQ ID NO: 589503 - DNA, 20 bp, Artificial
  CRISPR gRNA sequence
tacaagatgggagtagatta

SEQ ID NO: 589504 - DNA, 20 bp, Artificial
  CRISPR gRNA sequence
caagatgggagtagattaag

SEQ ID NO: 589505 - DNA, 20 bp, Artificial
  CRISPR gRNA sequence
agatgggagtagattaagga

SEQ ID NO: 589506 - DNA, 20 bp, Artificial
  CRISPR gRNA sequence
gatgggagtagattaaggag

SEQ ID NO: 589507 - DNA, 20 bp, Artificial
  CRISPR gRNA sequence
agattaaggagaggcaaaat

SEQ ID NO: 589508 - DNA, 20 bp, Artificial
  CRISPR gRNA sequence
gattaaggagaggcaaaatt

SEQ ID NO: 589509 - DNA, 20 bp, Artificial
  CRISPR gRNA sequence
attaaggagaggcaaaatta

SEQ ID NO: 589510 - DNA, 20 bp, Artificial
  CRISPR gRNA sequence
tactcttctctctatattcc

SEQ ID NO: 589511 - DNA, 20 bp, Artificial
  CRISPR gRNA sequence
ttctctctatattcccagtg

SEQ ID NO: 589512 - DNA, 20 bp, Artificial
  CRISPR gRNA sequence
ctctctatattcccagtgaa

SEQ ID NO: 589513 - DNA, 20 bp, Artificial
  CRISPR gRNA sequence
tattcccagtgaagagtgcc

SEQ ID NO: 589514 - DNA, 20 bp, Artificial
  CRISPR gRNA sequence
ttcccagtgaagagtgcctg

SEQ ID NO: 589515 - DNA, 20 bp, Artificial
  CRISPR gRNA sequence
tattacctgattacttacta

SEQ ID NO: 589516 - DNA, 20 bp, Artificial
  CRISPR gRNA sequence
tacctgattacttactaaag

SEQ ID NO: 589517 - DNA, 20 bp, Artificial
  CRISPR gRNA sequence
aataaaatgaaaccattaat

SEQ ID NO: 589518 - DNA, 20 bp, Artificial
  CRISPR gRNA sequence
cattaataagacactgcaat

SEQ ID NO: 589519 - DNA, 20 bp, Artificial
  CRISPR gRNA sequence
agacactgcaattggtactt

SEQ ID NO: 589520 - DNA, 20 bp, Artificial
  CRISPR gRNA sequence
cactgcaattggtactttag

SEQ ID NO: 589521 - DNA, 20 bp, Artificial
  CRISPR gRNA sequence
ctgcaattggtactttagta

SEQ ID NO: 589522 - DNA, 20 bp, Artificial
  CRISPR gRNA sequence
ggtactttagtagagtatga

SEQ ID NO: 589523 - DNA, 20 bp, Artificial
  CRISPR gRNA sequence
tactttagtagagtatgaca

SEQ ID NO: 589524 - DNA, 20 bp, Artificial
  CRISPR gRNA sequence
ttagtagagtatgacagaga

SEQ ID NO: 589525 - DNA, 20 bp, Artificial
  CRISPR gRNA sequence
gtagagtatgacagagaaag

SEQ ID NO: 589526 - DNA, 20 bp, Artificial
  CRISPR gRNA sequence
gagtatgacagagaaagaag

SEQ ID NO: 589527 - DNA, 20 bp, Artificial
  CRISPR gRNA sequence
gtatgacagagaaagaagaa

SEQ ID NO: 589528 - DNA, 20 bp, Artificial
  CRISPR gRNA sequence
tgacagagaaagaagaagag

SEQ ID NO: 589529 - DNA, 20 bp, Artificial
  CRISPR gRNA sequence
tccatgatattgtaatgaat

SEQ ID NO: 589530 - DNA, 20 bp, Artificial
  CRISPR gRNA sequence
tgatattgtaatgaattgga

SEQ ID NO: 589531 - DNA, 20 bp, Artificial
  CRISPR gRNA sequence
tttcactatcaattttatat

SEQ ID NO: 589532 - DNA, 20 bp, Artificial
  CRISPR gRNA sequence
tcactatcaattttatatta

SEQ ID NO: 589533 - DNA, 20 bp, Artificial
  CRISPR gRNA sequence
cactatcaattttatattag

SEQ ID NO: 589534 - DNA, 20 bp, Artificial
  CRISPR gRNA sequence
atcaattttatattagaggc

SEQ ID NO: 589535 - DNA, 20 bp, Artificial
  CRISPR gRNA sequence
tcaattttatattagaggct

SEQ ID NO: 589536 - DNA, 20 bp, Artificial
  CRISPR gRNA sequence
tttatattagaggctgggca

SEQ ID NO: 589537 - DNA, 20 bp, Artificial
  CRISPR gRNA sequence
atattagaggctgggcacgg

SEQ ID NO: 589538 - DNA, 20 bp, Artificial
  CRISPR gRNA sequence
gtggctcacgcctgtaatcc

SEQ ID NO: 589539 - DNA, 20 bp, Artificial
  CRISPR gRNA sequence
gcctgtaatcccagcacttt

SEQ ID NO: 589540 - DNA, 20 bp, Artificial
  CRISPR gRNA sequence
ctgtaatcccagcactttga

SEQ ID NO: 589541 - DNA, 20 bp, Artificial
  CRISPR gRNA sequence
tgtaatcccagcactttgag

SEQ ID NO: 589542 - DNA, 20 bp, Artificial
  CRISPR gRNA sequence
atcccagcactttgagaggc

SEQ ID NO: 589543 - DNA, 20 bp, Artificial
  CRISPR gRNA sequence
tcccagcactttgagaggct

SEQ ID NO: 589544 - DNA, 20 bp, Artificial
  CRISPR gRNA sequence
cccagcactttgagaggcta

SEQ ID NO: 589545 - DNA, 20 bp, Artificial
  CRISPR gRNA sequence
agcactttgagaggctaggg

SEQ ID NO: 589546 - DNA, 20 bp, Artificial
  CRISPR gRNA sequence
gcactttgagaggctagggt

SEQ ID NO: 589547 - DNA, 20 bp, Artificial
  CRISPR gRNA sequence
ctttgagaggctagggtggg

SEQ ID NO: 589548 - DNA, 20 bp, Artificial
  CRISPR gRNA sequence
ctagggtgggtggaacaact

SEQ ID NO: 589549 - DNA, 20 bp, Artificial
  CRISPR gRNA sequence
tagggtgggtggaacaactg

SEQ ID NO: 589550 - DNA, 20 bp, Artificial
  CRISPR gRNA sequence
gtgggtggaacaactgaggt

SEQ ID NO: 589551 - DNA, 20 bp, Artificial
  CRISPR gRNA sequence
tgggtggaacaactgaggtc

SEQ ID NO: 589552 - DNA, 20 bp, Artificial
  CRISPR gRNA sequence
ggtggaacaactgaggtcag

SEQ ID NO: 589553 - DNA, 20 bp, Artificial
  CRISPR gRNA sequence
acaactgaggtcaggagttt

SEQ ID NO: 589554 - DNA, 20 bp, Artificial
  CRISPR gRNA sequence
tcaggagtttgagaccaaca

SEQ ID NO: 589555 - DNA, 20 bp, Artificial
  CRISPR gRNA sequence
ccctgtctctactaaaaata

SEQ ID NO: 589556 - DNA, 20 bp, Artificial
  CRISPR gRNA sequence
tctactaaaaatacagaaat

SEQ ID NO: 589557 - DNA, 20 bp, Artificial
  CRISPR gRNA sequence
ctaaaaatacagaaattagc

SEQ ID NO: 589558 - DNA, 20 bp, Artificial
  CRISPR gRNA sequence
taaaaatacagaaattagct

SEQ ID NO: 589559 - DNA, 20 bp, Artificial
  CRISPR gRNA sequence
atacagaaattagctgggcc

SEQ ID NO: 589560 - DNA, 20 bp, Artificial
  CRISPR gRNA sequence
cagaaattagctgggcctgg

SEQ ID NO: 589561 - DNA, 20 bp, Artificial
  CRISPR gRNA sequence
aaattagctgggcctggtgg

SEQ ID NO: 589562 - DNA, 20 bp, Artificial
  CRISPR gRNA sequence
aattagctgggcctggtggt

SEQ ID NO: 589563 - DNA, 20 bp, Artificial
  CRISPR gRNA sequence
gtggtgggcacatgtaattc

SEQ ID NO: 589564 - DNA, 20 bp, Artificial
  CRISPR gRNA sequence
acatgtaattccagctactt

SEQ ID NO: 589565 - DNA, 20 bp, Artificial
  CRISPR gRNA sequence
atgtaattccagctactttg

SEQ ID NO: 589566 - DNA, 20 bp, Artificial
  CRISPR gRNA sequence
tgtaattccagctactttgg

SEQ ID NO: 589567 - DNA, 20 bp, Artificial
  CRISPR gRNA sequence
ttccagctactttggaggct

SEQ ID NO: 589568 - DNA, 20 bp, Artificial
  CRISPR gRNA sequence
tccagctactttggaggctg

SEQ ID NO: 589569 - DNA, 20 bp, Artificial
  CRISPR gRNA sequence
agctactttggaggctgagg

SEQ ID NO: 589570 - DNA, 20 bp, Artificial
  CRISPR gRNA sequence
gctactttggaggctgaggc

SEQ ID NO: 589571 - DNA, 20 bp, Artificial
  CRISPR gRNA sequence
tactttggaggctgaggcag

SEQ ID NO: 589572 - DNA, 20 bp, Artificial
  CRISPR gRNA sequence
actttggaggctgaggcagg

SEQ ID NO: 589573 - DNA, 20 bp, Artificial
  CRISPR gRNA sequence
gcaggaggatcgcttgaacc

SEQ ID NO: 589574 - DNA, 20 bp, Artificial
  CRISPR gRNA sequence
caggaggatcgcttgaaccc

SEQ ID NO: 589575 - DNA, 20 bp, Artificial
  CRISPR gRNA sequence
ggaggatcgcttgaacccag

SEQ ID NO: 589576 - DNA, 20 bp, Artificial
  CRISPR gRNA sequence
gaggatcgcttgaacccagg

SEQ ID NO: 589577 - DNA, 20 bp, Artificial
  CRISPR gRNA sequence
gatcgcttgaacccaggagg

SEQ ID NO: 589578 - DNA, 20 bp, Artificial
  CRISPR gRNA sequence
tcgcttgaacccaggaggtg

SEQ ID NO: 589579 - DNA, 20 bp, Artificial
  CRISPR gRNA sequence
cgcttgaacccaggaggtgg

SEQ ID NO: 589580 - DNA, 20 bp, Artificial
  CRISPR gRNA sequence
gcttgaacccaggaggtgga

SEQ ID NO: 589581 - DNA, 20 bp, Artificial
  CRISPR gRNA sequence
aacccaggaggtggagggtg

SEQ ID NO: 589582 - DNA, 20 bp, Artificial
  CRISPR gRNA sequence
ggtggagggtgcagtgatcc

SEQ ID NO: 589583 - DNA, 20 bp, Artificial
  CRISPR gRNA sequence
aagattgcaccactacactc

SEQ ID NO: 589584 - DNA, 20 bp, Artificial
  CRISPR gRNA sequence
tgcaccactacactccagcc

SEQ ID NO: 589585 - DNA, 20 bp, Artificial
  CRISPR gRNA sequence
gcaccactacactccagcct

SEQ ID NO: 589586 - DNA, 20 bp, Artificial
  CRISPR gRNA sequence
ctacactccagcctgggcga

SEQ ID NO: 589587 - DNA, 20 bp, Artificial
  CRISPR gRNA sequence
acactccagcctgggcgaca

SEQ ID NO: 589588 - DNA, 20 bp, Artificial
  CRISPR gRNA sequence
tccagcctgggcgacagagc

SEQ ID NO: 589589 - DNA, 20 bp, Artificial
  CRISPR gRNA sequence
actcaaaaaaaaaattatat

SEQ ID NO: 589590 - DNA, 20 bp, Artificial
  CRISPR gRNA sequence
actaaaatatatgtttctca

SEQ ID NO: 589591 - DNA, 20 bp, Artificial
  CRISPR gRNA sequence
ctaaaatatatgtttctcaa

SEQ ID NO: 589592 - DNA, 20 bp, Artificial
  CRISPR gRNA sequence
atgtttctcaaaggcattat

SEQ ID NO: 589593 - DNA, 20 bp, Artificial
  CRISPR gRNA sequence
tgtttctcaaaggcattata

SEQ ID NO: 589594 - DNA, 20 bp, Artificial
  CRISPR gRNA sequence
caaaggcattataaggtttt

SEQ ID NO: 589595 - DNA, 20 bp, Artificial
  CRISPR gRNA sequence
ggcattataaggttttaaga

SEQ ID NO: 589596 - DNA, 20 bp, Artificial
  CRISPR gRNA sequence
taagacagtatctttaatat

SEQ ID NO: 589597 - DNA, 20 bp, Artificial
  CRISPR gRNA sequence
agacagtatctttaatatga

SEQ ID NO: 589598 - DNA, 20 bp, Artificial
  CRISPR gRNA sequence
atgagagataaacaattgat

SEQ ID NO: 589599 - DNA, 20 bp, Artificial
  CRISPR gRNA sequence
gagagataaacaattgataa

SEQ ID NO: 589600 - DNA, 20 bp, Artificial
  CRISPR gRNA sequence
agataaacaattgataagag

SEQ ID NO: 589601 - DNA, 20 bp, Artificial
  CRISPR gRNA sequence
gataaacaattgataagagt

SEQ ID NO: 589602 - DNA, 20 bp, Artificial
  CRISPR gRNA sequence
aaacaattgataagagtggg

SEQ ID NO: 589603 - DNA, 20 bp, Artificial
  CRISPR gRNA sequence
gagtgggaagttctaaaatg

SEQ ID NO: 589604 - DNA, 20 bp, Artificial
  CRISPR gRNA sequence
ggaagttctaaaatgcagac

SEQ ID NO: 589605 - DNA, 20 bp, Artificial
  CRISPR gRNA sequence
ctaaaatgcagactagttca

SEQ ID NO: 589606 - DNA, 20 bp, Artificial
  CRISPR gRNA sequence
gcagactagttcatggtatt

SEQ ID NO: 589607 - DNA, 20 bp, Artificial
  CRISPR gRNA sequence
cagactagttcatggtatta

SEQ ID NO: 589608 - DNA, 20 bp, Artificial
  CRISPR gRNA sequence
gactagttcatggtattaag

SEQ ID NO: 589609 - DNA, 20 bp, Artificial
  CRISPR gRNA sequence
ggtattaaggagaaaacatt

SEQ ID NO: 589610 - DNA, 20 bp, Artificial
  CRISPR gRNA sequence
gaaaacatttggctaatgac

SEQ ID NO: 589611 - DNA, 20 bp, Artificial
  CRISPR gRNA sequence
tgactacatttttctcaatc

SEQ ID NO: 589612 - DNA, 20 bp, Artificial
  CRISPR gRNA sequence
tctcaatctagtttaaatta

SEQ ID NO: 589613 - DNA, 20 bp, Artificial
  CRISPR gRNA sequence
ttaaattaaagaaatgcaaa

SEQ ID NO: 589614 - DNA, 20 bp, Artificial
  CRISPR gRNA sequence
agaaatgcaaatagactttc

SEQ ID NO: 589615 - DNA, 20 bp, Artificial
  CRISPR gRNA sequence
tagactttctagtctcaaaa

SEQ ID NO: 589616 - DNA, 20 bp, Artificial
  CRISPR gRNA sequence
ctagtctcaaaatggtatta

SEQ ID NO: 589617 - DNA, 20 bp, Artificial
  CRISPR gRNA sequence
gtctcaaaatggtattaaag

SEQ ID NO: 589618 - DNA, 20 bp, Artificial
  CRISPR gRNA sequence
tattaaagtggtgttgaaaa

SEQ ID NO: 589619 - DNA, 20 bp, Artificial
  CRISPR gRNA sequence
taaagtggtgttgaaaatgg

SEQ ID NO: 589620 - DNA, 20 bp, Artificial
  CRISPR gRNA sequence
aaagtggtgttgaaaatggc

SEQ ID NO: 589621 - DNA, 20 bp, Artificial
  CRISPR gRNA sequence
tgaaaatggcaggacacact

SEQ ID NO: 589622 - DNA, 20 bp, Artificial
  CRISPR gRNA sequence
acacactcagatgtataaac

SEQ ID NO: 589623 - DNA, 20 bp, Artificial
  CRISPR gRNA sequence
agatgtataaactggatcat

SEQ ID NO: 589624 - DNA, 20 bp, Artificial
  CRISPR gRNA sequence
ggatcatcagaaatatgttg

SEQ ID NO: 589625 - DNA, 20 bp, Artificial
  CRISPR gRNA sequence
cagaaatatgttgaagtgtc

SEQ ID NO: 589626 - DNA, 20 bp, Artificial
  CRISPR gRNA sequence
atatcatgtccacaatttca

SEQ ID NO: 589627 - DNA, 20 bp, Artificial
  CRISPR gRNA sequence
ccacaatttcaaagttgaca

SEQ ID NO: 589628 - DNA, 20 bp, Artificial
  CRISPR gRNA sequence
tcaaagttgacaaagcatga

SEQ ID NO: 589629 - DNA, 20 bp, Artificial
  CRISPR gRNA sequence
caaagttgacaaagcatgac

SEQ ID NO: 589630 - DNA, 20 bp, Artificial
  CRISPR gRNA sequence
acaaagcatgacaggtatca

SEQ ID NO: 589631 - DNA, 20 bp, Artificial
  CRISPR gRNA sequence
tatcacagcttctccgtaaa

SEQ ID NO: 589632 - DNA, 20 bp, Artificial
  CRISPR gRNA sequence
cgtaaatggctattaacttt

SEQ ID NO: 589633 - DNA, 20 bp, Artificial
  CRISPR gRNA sequence
tattaactttaagaaaaatc

SEQ ID NO: 589634 - DNA, 20 bp, Artificial
  CRISPR gRNA sequence
ttaagaaaaatctagatctg

SEQ ID NO: 589635 - DNA, 20 bp, Artificial
  CRISPR gRNA sequence
gaaaaatctagatctgaaga

SEQ ID NO: 589636 - DNA, 20 bp, Artificial
  CRISPR gRNA sequence
taaacactgattgacaaaaa

SEQ ID NO: 589637 - DNA, 20 bp, Artificial
  CRISPR gRNA sequence
cactgattgacaaaaaaaga

SEQ ID NO: 589638 - DNA, 20 bp, Artificial
  CRISPR gRNA sequence
acaaaaaaagatagtgttgc

SEQ ID NO: 589639 - DNA, 20 bp, Artificial
  CRISPR gRNA sequence
aacatactccttgctgttat

SEQ ID NO: 589640 - DNA, 20 bp, Artificial
  CRISPR gRNA sequence
actccttgctgttatgagtt

SEQ ID NO: 589641 - DNA, 20 bp, Artificial
  CRISPR gRNA sequence
cttgctgttatgagttgagt

SEQ ID NO: 589642 - DNA, 20 bp, Artificial
  CRISPR gRNA sequence
ttgagtgagtctcgtattcc

SEQ ID NO: 589643 - DNA, 20 bp, Artificial
  CRISPR gRNA sequence
tgagtgagtctcgtattcct

SEQ ID NO: 589644 - DNA, 20 bp, Artificial
  CRISPR gRNA sequence
tctcgtattcctaggatttg

SEQ ID NO: 589645 - DNA, 20 bp, Artificial
  CRISPR gRNA sequence
ataaactttattatgccaat

SEQ ID NO: 589646 - DNA, 20 bp, Artificial
  CRISPR gRNA sequence
ataattcaactctaccacac

SEQ ID NO: 589647 - DNA, 20 bp, Artificial
  CRISPR gRNA sequence
accacactagtaaataacaa

SEQ ID NO: 589648 - DNA, 20 bp, Artificial
  CRISPR gRNA sequence
ccacactagtaaataacaaa

SEQ ID NO: 589649 - DNA, 20 bp, Artificial
  CRISPR gRNA sequence
actagtaaataacaaaagga

SEQ ID NO: 589650 - DNA, 20 bp, Artificial
  CRISPR gRNA sequence
agtaaataacaaaaggacag

SEQ ID NO: 589651 - DNA, 20 bp, Artificial
  CRISPR gRNA sequence
taaataacaaaaggacagta

SEQ ID NO: 589652 - DNA, 20 bp, Artificial
  CRISPR gRNA sequence
ataacaaaaggacagtagag

SEQ ID NO: 589653 - DNA, 20 bp, Artificial
  CRISPR gRNA sequence
taacaaaaggacagtagagt

SEQ ID NO: 589654 - DNA, 20 bp, Artificial
  CRISPR gRNA sequence
aatcctcatgaatattattg

SEQ ID NO: 589655 - DNA, 20 bp, Artificial
  CRISPR gRNA sequence
catgaatattattgtagcta

SEQ ID NO: 589656 - DNA, 20 bp, Artificial
  CRISPR gRNA sequence
attttctaaaaactgtactc

SEQ ID NO: 589657 - DNA, 20 bp, Artificial
  CRISPR gRNA sequence
ttctttgaattttcttaatt

SEQ ID NO: 589658 - DNA, 20 bp, Artificial
  CRISPR gRNA sequence
tttcttaattcagaacataa

SEQ ID NO: 589659 - DNA, 20 bp, Artificial
  CRISPR gRNA sequence
aatcttctaaatactgtttt

SEQ ID NO: 589660 - DNA, 20 bp, Artificial
  CRISPR gRNA sequence
actgtttttagtttattttt

SEQ ID NO: 589661 - DNA, 20 bp, Artificial
  CRISPR gRNA sequence
ttgcatgcaattcaactgaa

SEQ ID NO: 589662 - DNA, 20 bp, Artificial
  CRISPR gRNA sequence
caattcaactgaaaagccat

SEQ ID NO: 589663 - DNA, 20 bp, Artificial
  CRISPR gRNA sequence
gtgttttgtttgtattttac

SEQ ID NO: 589664 - DNA, 20 bp, Artificial
  CRISPR gRNA sequence
tttgtttgtattttactaga

SEQ ID NO: 589665 - DNA, 20 bp, Artificial
  CRISPR gRNA sequence
ttgtttgtattttactagat

SEQ ID NO: 589666 - DNA, 20 bp, Artificial
  CRISPR gRNA sequence
gtttgtattttactagatag

SEQ ID NO: 589667 - DNA, 20 bp, Artificial
  CRISPR gRNA sequence
tgtattttactagataggag

SEQ ID NO: 589668 - DNA, 20 bp, Artificial
  CRISPR gRNA sequence
gagaagttacacatttgaat

SEQ ID NO: 589669 - DNA, 20 bp, Artificial
  CRISPR gRNA sequence
atgaatatattataactttg

SEQ ID NO: 589670 - DNA, 20 bp, Artificial
  CRISPR gRNA sequence
aactttgtggaacttgtttt

SEQ ID NO: 589671 - DNA, 20 bp, Artificial
  CRISPR gRNA sequence
cttgtttttagaactgtcgt

SEQ ID NO: 589672 - DNA, 20 bp, Artificial
  CRISPR gRNA sequence
tttagaactgtcgttagaat

SEQ ID NO: 589673 - DNA, 20 bp, Artificial
  CRISPR gRNA sequence
tgtcgttagaattagttcat

SEQ ID NO: 589674 - DNA, 20 bp, Artificial
  CRISPR gRNA sequence
ttagaattagttcatgagcg

SEQ ID NO: 589675 - DNA, 20 bp, Artificial
  CRISPR gRNA sequence
agttcatgagcgtagatgaa

SEQ ID NO: 589676 - DNA, 20 bp, Artificial
  CRISPR gRNA sequence
tcatgagcgtagatgaaaag

SEQ ID NO: 589677 - DNA, 20 bp, Artificial
  CRISPR gRNA sequence
atgaaaagtagattatttta

SEQ ID NO: 589678 - DNA, 20 bp, Artificial
  CRISPR gRNA sequence
tccctttactttttatcaaa

SEQ ID NO: 589679 - DNA, 20 bp, Artificial
  CRISPR gRNA sequence
ctttttatcaaatagatacc

SEQ ID NO: 589680 - DNA, 20 bp, Artificial
  CRISPR gRNA sequence
ttgatctttcaaccttttct

SEQ ID NO: 589681 - DNA, 20 bp, Artificial
  CRISPR gRNA sequence
tctaagacacttaaaaatta

SEQ ID NO: 589682 - DNA, 20 bp, Artificial
  CRISPR gRNA sequence
cacttaaaaattaaagaaaa

SEQ ID NO: 589683 - DNA, 20 bp, Artificial
  CRISPR gRNA sequence
attaaagaaaaaagttacac

SEQ ID NO: 589684 - DNA, 20 bp, Artificial
  CRISPR gRNA sequence
aaaacatcgtgctgtttaaa

SEQ ID NO: 589685 - DNA, 20 bp, Artificial
  CRISPR gRNA sequence
aaacatcgtgctgtttaaaa

SEQ ID NO: 589686 - DNA, 20 bp, Artificial
  CRISPR gRNA sequence
acatcgtgctgtttaaaaag

SEQ ID NO: 589687 - DNA, 20 bp, Artificial
  CRISPR gRNA sequence
aaaggagataaaaaacgaaa

SEQ ID NO: 589688 - DNA, 20 bp, Artificial
  CRISPR gRNA sequence
aatgtaattgactgtatgat

SEQ ID NO: 589689 - DNA, 20 bp, Artificial
  CRISPR gRNA sequence
attgactgtatgattggaat

SEQ ID NO: 589690 - DNA, 20 bp, Artificial
  CRISPR gRNA sequence
gaataagtatatatgttcta

SEQ ID NO: 589691 - DNA, 20 bp, Artificial
  CRISPR gRNA sequence
aacttctcactgtaattttt

SEQ ID NO: 589692 - DNA, 20 bp, Artificial
  CRISPR gRNA sequence
cactgtaatttttaagatat

SEQ ID NO: 589693 - DNA, 20 bp, Artificial
  CRISPR gRNA sequence
aatttttaagatatcagcct

SEQ ID NO: 589694 - DNA, 20 bp, Artificial
  CRISPR gRNA sequence
aagatatcagccttagttta

SEQ ID NO: 589695 - DNA, 20 bp, Artificial
  CRISPR gRNA sequence
cataccttataataaattct

SEQ ID NO: 589696 - DNA, 20 bp, Artificial
  CRISPR gRNA sequence
tcttggtatactgacatacc

SEQ ID NO: 589697 - DNA, 20 bp, Artificial
  CRISPR gRNA sequence
tatactgacataccaagcaa

SEQ ID NO: 589698 - DNA, 20 bp, Artificial
  CRISPR gRNA sequence
atagtgtgtctgaacaaaac

SEQ ID NO: 589699 - DNA, 20 bp, Artificial
  CRISPR gRNA sequence
gtgtctgaacaaaaccagta

SEQ ID NO: 589700 - DNA, 20 bp, Artificial
  CRISPR gRNA sequence
tgtctgaacaaaaccagtat

SEQ ID NO: 589701 - DNA, 20 bp, Artificial
  CRISPR gRNA sequence
aacaaaaccagtatgggcat

SEQ ID NO: 589702 - DNA, 20 bp, Artificial
  CRISPR gRNA sequence
gtatgggcatcagaaaaccc

SEQ ID NO: 589703 - DNA, 20 bp, Artificial
  CRISPR gRNA sequence
gcatcagaaaaccctggttc

SEQ ID NO: 589704 - DNA, 20 bp, Artificial
  CRISPR gRNA sequence
gaaaaccctggttctagctt

SEQ ID NO: 589705 - DNA, 20 bp, Artificial
  CRISPR gRNA sequence
agcaatgcctttacctacat

SEQ ID NO: 589706 - DNA, 20 bp, Artificial
  CRISPR gRNA sequence
gcaatgcctttacctacata

SEQ ID NO: 589707 - DNA, 20 bp, Artificial
  CRISPR gRNA sequence
caatgcctttacctacataa

SEQ ID NO: 589708 - DNA, 20 bp, Artificial
  CRISPR gRNA sequence
tttacctacataagggataa

SEQ ID NO: 589709 - DNA, 20 bp, Artificial
  CRISPR gRNA sequence
tttcttcatgtgtattatga

SEQ ID NO: 589710 - DNA, 20 bp, Artificial
  CRISPR gRNA sequence
ttcttcatgtgtattatgaa

SEQ ID NO: 589711 - DNA, 20 bp, Artificial
  CRISPR gRNA sequence
atgaaaggttcgtattaaaa

SEQ ID NO: 589712 - DNA, 20 bp, Artificial
  CRISPR gRNA sequence
ccttgtatctttaatgtttt

SEQ ID NO: 589713 - DNA, 20 bp, Artificial
  CRISPR gRNA sequence
cacgtaattgttaaactatt

SEQ ID NO: 589714 - DNA, 20 bp, Artificial
  CRISPR gRNA sequence
gatttatatttcttccaaaa

SEQ ID NO: 589715 - DNA, 20 bp, Artificial
  CRISPR gRNA sequence
aaagtatattttaaaactct

SEQ ID NO: 589716 - DNA, 20 bp, Artificial
  CRISPR gRNA sequence
ttttaaaactctgagaatat

SEQ ID NO: 589717 - DNA, 20 bp, Artificial
  CRISPR gRNA sequence
cactacactactttgcatta

SEQ ID NO: 589718 - DNA, 20 bp, Artificial
  CRISPR gRNA sequence
actactttgcattatagtga

SEQ ID NO: 589719 - DNA, 20 bp, Artificial
  CRISPR gRNA sequence
gaacttgaatcttttttgtt

SEQ ID NO: 589720 - DNA, 20 bp, Artificial
  CRISPR gRNA sequence
acttgaatcttttttgttaa

SEQ ID NO: 589721 - DNA, 20 bp, Artificial
  CRISPR gRNA sequence
ttaagagtcaacgatcctcc

SEQ ID NO: 589722 - DNA, 20 bp, Artificial
  CRISPR gRNA sequence
tctcatttctgttgcttttt

SEQ ID NO: 589723 - DNA, 20 bp, Artificial
  CRISPR gRNA sequence
gctttttaagaaaaaaaaat

SEQ ID NO: 589724 - DNA, 20 bp, Artificial
  CRISPR gRNA sequence
ttaagaaaaaaaaattggca

SEQ ID NO: 589725 - DNA, 20 bp, Artificial
  CRISPR gRNA sequence
taagaaaaaaaaattggcaa

SEQ ID NO: 589726 - DNA, 20 bp, Artificial
  CRISPR gRNA sequence
aagaaaaaaaaattggcaaa

SEQ ID NO: 589727 - DNA, 20 bp, Artificial
  CRISPR gRNA sequence
aaattggcaaagggtttaaa

SEQ ID NO: 589728 - DNA, 20 bp, Artificial
  CRISPR gRNA sequence
gggtttaaaaagatttaaat

SEQ ID NO: 589729 - DNA, 20 bp, Artificial
  CRISPR gRNA sequence
ttaaataagaccttctcatt

SEQ ID NO: 589730 - DNA, 20 bp, Artificial
  CRISPR gRNA sequence
ataagaccttctcatttggt

SEQ ID NO: 589731 - DNA, 20 bp, Artificial
  CRISPR gRNA sequence
ctctcaaatgtttaaaaata

SEQ ID NO: 589732 - DNA, 20 bp, Artificial
  CRISPR gRNA sequence
atatagtatgaattaatctg

SEQ ID NO: 589733 - DNA, 20 bp, Artificial
  CRISPR gRNA sequence
tatagtatgaattaatctgt

SEQ ID NO: 589734 - DNA, 20 bp, Artificial
  CRISPR gRNA sequence
gctttttcctcactctatcc

SEQ ID NO: 589735 - DNA, 20 bp, Artificial
  CRISPR gRNA sequence
acatattccaacctacacac

SEQ ID NO: 589736 - DNA, 20 bp, Artificial
  CRISPR gRNA sequence
caatcctacatatatccttg

SEQ ID NO: 589737 - DNA, 20 bp, Artificial
  CRISPR gRNA sequence
aatcctacatatatccttgc

SEQ ID NO: 589738 - DNA, 20 bp, Artificial
  CRISPR gRNA sequence
tcctacatatatccttgcag

SEQ ID NO: 589739 - DNA, 20 bp, Artificial
  CRISPR gRNA sequence
ggagttataaccaacaatta

SEQ ID NO: 589740 - DNA, 20 bp, Artificial
  CRISPR gRNA sequence
ttataaccaacaattacaga

SEQ ID NO: 589741 - DNA, 20 bp, Artificial
  CRISPR gRNA sequence
aaccaacaattacagaaaga

SEQ ID NO: 589742 - DNA, 20 bp, Artificial
  CRISPR gRNA sequence
caacaattacagaaagatgg

SEQ ID NO: 589743 - DNA, 20 bp, Artificial
  CRISPR gRNA sequence
gcagcatccctgaactacaa

SEQ ID NO: 589744 - DNA, 20 bp, Artificial
  CRISPR gRNA sequence
aaaagcacctgcctgctact

SEQ ID NO: 589745 - DNA, 20 bp, Artificial
  CRISPR gRNA sequence
ctgcctgctactgagacctg

SEQ ID NO: 589746 - DNA, 20 bp, Artificial
  CRISPR gRNA sequence
cctgctactgagacctgtgg

SEQ ID NO: 589747 - DNA, 20 bp, Artificial
  CRISPR gRNA sequence
ctgctactgagacctgtggt

SEQ ID NO: 589748 - DNA, 20 bp, Artificial
  CRISPR gRNA sequence
tactgagacctgtggtagga

SEQ ID NO: 589749 - DNA, 20 bp, Artificial
  CRISPR gRNA sequence
actgagacctgtggtaggat

SEQ ID NO: 589750 - DNA, 20 bp, Artificial
  CRISPR gRNA sequence
gagacctgtggtaggatagg

SEQ ID NO: 589751 - DNA, 20 bp, Artificial
  CRISPR gRNA sequence
gacctgtggtaggataggca

SEQ ID NO: 589752 - DNA, 20 bp, Artificial
  CRISPR gRNA sequence
taggataggcagagatcaat

SEQ ID NO: 589753 - DNA, 20 bp, Artificial
  CRISPR gRNA sequence
tcaatcagaaattgtatttc

SEQ ID NO: 589754 - DNA, 20 bp, Artificial
  CRISPR gRNA sequence
caatcagaaattgtatttca

SEQ ID NO: 589755 - DNA, 20 bp, Artificial
  CRISPR gRNA sequence
atcagaaattgtatttcaag

SEQ ID NO: 589756 - DNA, 20 bp, Artificial
  CRISPR gRNA sequence
ttgtatttcaaggagttaac

SEQ ID NO: 589757 - DNA, 20 bp, Artificial
  CRISPR gRNA sequence
ttcaaggagttaactggata

SEQ ID NO: 589758 - DNA, 20 bp, Artificial
  CRISPR gRNA sequence
attcacttacataaatgcat

SEQ ID NO: 589759 - DNA, 20 bp, Artificial
  CRISPR gRNA sequence
aatgcatgagtgccattttg

SEQ ID NO: 589760 - DNA, 20 bp, Artificial
  CRISPR gRNA sequence
ttgtagtataaactcttatc

SEQ ID NO: 589761 - DNA, 20 bp, Artificial
  CRISPR gRNA sequence
caaactatattacctgccca

SEQ ID NO: 589762 - DNA, 20 bp, Artificial
  CRISPR gRNA sequence
aaactatattacctgcccat

SEQ ID NO: 589763 - DNA, 20 bp, Artificial
  CRISPR gRNA sequence
atattacctgcccatgggta

SEQ ID NO: 589764 - DNA, 20 bp, Artificial
  CRISPR gRNA sequence
tgggtatggtaaaatatgta

SEQ ID NO: 589765 - DNA, 20 bp, Artificial
  CRISPR gRNA sequence
aatatgtatagaaatacaaa

SEQ ID NO: 589766 - DNA, 20 bp, Artificial
  CRISPR gRNA sequence
tatagaaatacaaaaagatt

SEQ ID NO: 589767 - DNA, 20 bp, Artificial
  CRISPR gRNA sequence
tatcatattattgctatatt

SEQ ID NO: 589768 - DNA, 20 bp, Artificial
  CRISPR gRNA sequence
tattgctatattaagaactg

SEQ ID NO: 589769 - DNA, 20 bp, Artificial
  CRISPR gRNA sequence
ttcttttctgatatgctatt

SEQ ID NO: 589770 - DNA, 20 bp, Artificial
  CRISPR gRNA sequence
tgatatgctattcagatttg

SEQ ID NO: 589771 - DNA, 20 bp, Artificial
  CRISPR gRNA sequence
gatatgctattcagatttga

SEQ ID NO: 589772 - DNA, 20 bp, Artificial
  CRISPR gRNA sequence
tgctattcagatttgaaggc

SEQ ID NO: 589773 - DNA, 20 bp, Artificial
  CRISPR gRNA sequence
tattcagatttgaaggctgg

SEQ ID NO: 589774 - DNA, 20 bp, Artificial
  CRISPR gRNA sequence
agatttgaaggctggaagtc

SEQ ID NO: 589775 - DNA, 20 bp, Artificial
  CRISPR gRNA sequence
gaaggctggaagtcaagacc

SEQ ID NO: 589776 - DNA, 20 bp, Artificial
  CRISPR gRNA sequence
aaggctggaagtcaagaccc

SEQ ID NO: 589777 - DNA, 20 bp, Artificial
  CRISPR gRNA sequence
gtttttctgcaatccaatac

SEQ ID NO: 589778 - DNA, 20 bp, Artificial
  CRISPR gRNA sequence
tttctgcaatccaatactag

SEQ ID NO: 589779 - DNA, 20 bp, Artificial
  CRISPR gRNA sequence
aatactagcagaattctgaa

SEQ ID NO: 589780 - DNA, 20 bp, Artificial
  CRISPR gRNA sequence
atactagcagaattctgaaa

SEQ ID NO: 589781 - DNA, 20 bp, Artificial
  CRISPR gRNA sequence
ctagcagaattctgaaaagg

SEQ ID NO: 589782 - DNA, 20 bp, Artificial
  CRISPR gRNA sequence
cactgccacccctgaataaa

SEQ ID NO: 589783 - DNA, 20 bp, Artificial
  CRISPR gRNA sequence
actgccacccctgaataaaa

SEQ ID NO: 589784 - DNA, 20 bp, Artificial
  CRISPR gRNA sequence
ccacccctgaataaaaagga

SEQ ID NO: 589785 - DNA, 20 bp, Artificial
  CRISPR gRNA sequence
acccctgaataaaaaggaaa

SEQ ID NO: 589786 - DNA, 20 bp, Artificial
  CRISPR gRNA sequence
tgaataaaaaggaaagagaa

SEQ ID NO: 589787 - DNA, 20 bp, Artificial
  CRISPR gRNA sequence
aaaggaaagagaatagatgt

SEQ ID NO: 589788 - DNA, 20 bp, Artificial
  CRISPR gRNA sequence
aaggaaagagaatagatgtc

SEQ ID NO: 589789 - DNA, 20 bp, Artificial
  CRISPR gRNA sequence
atgtcaggtaatatcaacat

SEQ ID NO: 589790 - DNA, 20 bp, Artificial
  CRISPR gRNA sequence
aatatcaacatcagatgtca

SEQ ID NO: 589791 - DNA, 20 bp, Artificial
  CRISPR gRNA sequence
atatcaacatcagatgtcac

SEQ ID NO: 589792 - DNA, 20 bp, Artificial
  CRISPR gRNA sequence
tcaacatcagatgtcacagg

SEQ ID NO: 589793 - DNA, 20 bp, Artificial
  CRISPR gRNA sequence
cagatgtcacaggcagtcat

SEQ ID NO: 589794 - DNA, 20 bp, Artificial
  CRISPR gRNA sequence
agatgtcacaggcagtcatc

SEQ ID NO: 589795 - DNA, 20 bp, Artificial
  CRISPR gRNA sequence
cagtcatcaggttattcttt

SEQ ID NO: 589796 - DNA, 20 bp, Artificial
  CRISPR gRNA sequence
ttattctttcagctgcttac

SEQ ID NO: 589797 - DNA, 20 bp, Artificial
  CRISPR gRNA sequence
tgactccttttatgtaccat

SEQ ID NO: 589798 - DNA, 20 bp, Artificial
  CRISPR gRNA sequence
tttatgtaccataagcacat

SEQ ID NO: 589799 - DNA, 20 bp, Artificial
  CRISPR gRNA sequence
ttatgtaccataagcacatt

SEQ ID NO: 589800 - DNA, 20 bp, Artificial
  CRISPR gRNA sequence
gcccaatgcaaaccatgcca

SEQ ID NO: 589801 - DNA, 20 bp, Artificial
  CRISPR gRNA sequence
atgccacagacgtcacattt

SEQ ID NO: 589802 - DNA, 20 bp, Artificial
  CRISPR gRNA sequence
tcacatttcagtttaccatt

SEQ ID NO: 589803 - DNA, 20 bp, Artificial
  CRISPR gRNA sequence
catttcagtttaccattcgg

SEQ ID NO: 589804 - DNA, 20 bp, Artificial
  CRISPR gRNA sequence
tcagtttaccattcggaagc

SEQ ID NO: 589805 - DNA, 20 bp, Artificial
  CRISPR gRNA sequence
cggattcctccctcgccttg

SEQ ID NO: 589806 - DNA, 20 bp, Artificial
  CRISPR gRNA sequence
ctccctcgccttgaagctcc

SEQ ID NO: 589807 - DNA, 20 bp, Artificial
  CRISPR gRNA sequence
ctcctggactttcctgttgt

SEQ ID NO: 589808 - DNA, 20 bp, Artificial
  CRISPR gRNA sequence
gccacctcgctgctctcaat

SEQ ID NO: 589809 - DNA, 20 bp, Artificial
  CRISPR gRNA sequence
ccacctcgctgctctcaatt

SEQ ID NO: 589810 - DNA, 20 bp, Artificial
  CRISPR gRNA sequence
cacctcgctgctctcaatta

SEQ ID NO: 589811 - DNA, 20 bp, Artificial
  CRISPR gRNA sequence
acctcgctgctctcaattag

SEQ ID NO: 589812 - DNA, 20 bp, Artificial
  CRISPR gRNA sequence
ctctcaattaggggttcttc

SEQ ID NO: 589813 - DNA, 20 bp, Artificial
  CRISPR gRNA sequence
tctcaattaggggttcttct

SEQ ID NO: 589814 - DNA, 20 bp, Artificial
  CRISPR gRNA sequence
ctaggctgctaccctcatca

SEQ ID NO: 589815 - DNA, 20 bp, Artificial
  CRISPR gRNA sequence
ggcccctgatctcatcttca

SEQ ID NO: 589816 - DNA, 20 bp, Artificial
  CRISPR gRNA sequence
ctgatctcatcttcacggct

SEQ ID NO: 589817 - DNA, 20 bp, Artificial
  CRISPR gRNA sequence
tgatctcatcttcacggctc

SEQ ID NO: 589818 - DNA, 20 bp, Artificial
  CRISPR gRNA sequence
gatctcatcttcacggctca

SEQ ID NO: 589819 - DNA, 20 bp, Artificial
  CRISPR gRNA sequence
atctcatcttcacggctcag

SEQ ID NO: 589820 - DNA, 20 bp, Artificial
  CRISPR gRNA sequence
tcttcatcactctgcatttc

SEQ ID NO: 589821 - DNA, 20 bp, Artificial
  CRISPR gRNA sequence
tgaatttgctgtaatttgaa

SEQ ID NO: 589822 - DNA, 20 bp, Artificial
  CRISPR gRNA sequence
atttgctgtaatttgaaaag

SEQ ID NO: 589823 - DNA, 20 bp, Artificial
  CRISPR gRNA sequence
ctcattgtcatcctactaaa

SEQ ID NO: 589824 - DNA, 20 bp, Artificial
  CRISPR gRNA sequence
atggatgaaaatgatatata

SEQ ID NO: 589825 - DNA, 20 bp, Artificial
  CRISPR gRNA sequence
gatgaaaatgatatataaag

SEQ ID NO: 589826 - DNA, 20 bp, Artificial
  CRISPR gRNA sequence
aaatgatatataaagtagaa

SEQ ID NO: 589827 - DNA, 20 bp, Artificial
  CRISPR gRNA sequence
atgatatataaagtagaata

SEQ ID NO: 589828 - DNA, 20 bp, Artificial
  CRISPR gRNA sequence
tactgtgttctatgatattt

SEQ ID NO: 589829 - DNA, 20 bp, Artificial
  CRISPR gRNA sequence
gatattttagtgaaatgtca

SEQ ID NO: 589830 - DNA, 20 bp, Artificial
  CRISPR gRNA sequence
attttagtgaaatgtcatgg

SEQ ID NO: 589831 - DNA, 20 bp, Artificial
  CRISPR gRNA sequence
agtgaaatgtcatggaagtg

SEQ ID NO: 589832 - DNA, 20 bp, Artificial
  CRISPR gRNA sequence
aaatgtcatggaagtgaaga

SEQ ID NO: 589833 - DNA, 20 bp, Artificial
  CRISPR gRNA sequence
tcatggaagtgaagatagct

SEQ ID NO: 589834 - DNA, 20 bp, Artificial
  CRISPR gRNA sequence
catggaagtgaagatagctc

SEQ ID NO: 589835 - DNA, 20 bp, Artificial
  CRISPR gRNA sequence
aagatagctcaggaaaactc

SEQ ID NO: 589836 - DNA, 20 bp, Artificial
  CRISPR gRNA sequence
agatagctcaggaaaactct

SEQ ID NO: 589837 - DNA, 20 bp, Artificial
  CRISPR gRNA sequence
tcaggaaaactctaggtaaa

SEQ ID NO: 589838 - DNA, 20 bp, Artificial
  CRISPR gRNA sequence
acatatttgtttctttcact

SEQ ID NO: 589839 - DNA, 20 bp, Artificial
  CRISPR gRNA sequence
tagacatttgctttttaaac

SEQ ID NO: 589840 - DNA, 20 bp, Artificial
  CRISPR gRNA sequence
acaagtttttttaataatcc

SEQ ID NO: 589841 - DNA, 20 bp, Artificial
  CRISPR gRNA sequence
ttttttaataatcctggtat

SEQ ID NO: 589842 - DNA, 20 bp, Artificial
  CRISPR gRNA sequence
taatcctggtattggctttt

SEQ ID NO: 589843 - DNA, 20 bp, Artificial
  CRISPR gRNA sequence
tggcttttgagtctgtcact

SEQ ID NO: 589844 - DNA, 20 bp, Artificial
  CRISPR gRNA sequence
gagtctgtcactaagactcc

SEQ ID NO: 589845 - DNA, 20 bp, Artificial
  CRISPR gRNA sequence
agtctgtcactaagactcct

SEQ ID NO: 589846 - DNA, 20 bp, Artificial
  CRISPR gRNA sequence
tcactaagactcctaggact

SEQ ID NO: 589847 - DNA, 20 bp, Artificial
  CRISPR gRNA sequence
taagactcctaggactgaga

SEQ ID NO: 589848 - DNA, 20 bp, Artificial
  CRISPR gRNA sequence
aagactcctaggactgagat

SEQ ID NO: 589849 - DNA, 20 bp, Artificial
  CRISPR gRNA sequence
ctaggactgagataggatta

SEQ ID NO: 589850 - DNA, 20 bp, Artificial
  CRISPR gRNA sequence
ggactgagataggattatgg

SEQ ID NO: 589851 - DNA, 20 bp, Artificial
  CRISPR gRNA sequence
gataggattatggaagaaac

SEQ ID NO: 589852 - DNA, 20 bp, Artificial
  CRISPR gRNA sequence
tcatattctctgtttcacat

SEQ ID NO: 589853 - DNA, 20 bp, Artificial
  CRISPR gRNA sequence
atattctctgtttcacatca

SEQ ID NO: 589854 - DNA, 20 bp, Artificial
  CRISPR gRNA sequence
tgtataaacctgcttctgaa

SEQ ID NO: 589855 - DNA, 20 bp, Artificial
  CRISPR gRNA sequence
gtataaacctgcttctgaac

SEQ ID NO: 589856 - DNA, 20 bp, Artificial
  CRISPR gRNA sequence
tataaacctgcttctgaaca

SEQ ID NO: 589857 - DNA, 20 bp, Artificial
  CRISPR gRNA sequence
aacctgcttctgaacagggc

SEQ ID NO: 589858 - DNA, 20 bp, Artificial
  CRISPR gRNA sequence
cctgcttctgaacagggcaa

SEQ ID NO: 589859 - DNA, 20 bp, Artificial
  CRISPR gRNA sequence
acagggcaagagaaacaatt

SEQ ID NO: 589860 - DNA, 20 bp, Artificial
  CRISPR gRNA sequence
cagggcaagagaaacaattc

SEQ ID NO: 589861 - DNA, 20 bp, Artificial
  CRISPR gRNA sequence
aacaattcaggatcttaatc

SEQ ID NO: 589862 - DNA, 20 bp, Artificial
  CRISPR gRNA sequence
gcaaatgtctttgacatatg

SEQ ID NO: 589863 - DNA, 20 bp, Artificial
  CRISPR gRNA sequence
acatatgaagatacactgtc

SEQ ID NO: 589864 - DNA, 20 bp, Artificial
  CRISPR gRNA sequence
catatgaagatacactgtca

SEQ ID NO: 589865 - DNA, 20 bp, Artificial
  CRISPR gRNA sequence
tcaaactaaacacatatatt

SEQ ID NO: 589866 - DNA, 20 bp, Artificial
  CRISPR gRNA sequence
aaacacatatattcagtttc

SEQ ID NO: 589867 - DNA, 20 bp, Artificial
  CRISPR gRNA sequence
agtttcgagctatataaatg

SEQ ID NO: 589868 - DNA, 20 bp, Artificial
  CRISPR gRNA sequence
agctatataaatgtagtaca

SEQ ID NO: 589869 - DNA, 20 bp, Artificial
  CRISPR gRNA sequence
cacagacctcacatgctctt

SEQ ID NO: 589870 - DNA, 20 bp, Artificial
  CRISPR gRNA sequence
tctatctaaaaaattaccta

SEQ ID NO: 589871 - DNA, 20 bp, Artificial
  CRISPR gRNA sequence
aacatgttgtttgaaaatca

SEQ ID NO: 589872 - DNA, 20 bp, Artificial
  CRISPR gRNA sequence
tctaatctatgcacaccaaa

SEQ ID NO: 589873 - DNA, 20 bp, Artificial
  CRISPR gRNA sequence
aatctatgcacaccaaaaag

SEQ ID NO: 589874 - DNA, 20 bp, Artificial
  CRISPR gRNA sequence
caccaaaaagcagctaatca

SEQ ID NO: 589875 - DNA, 20 bp, Artificial
  CRISPR gRNA sequence
aaagcagctaatcacagtaa

SEQ ID NO: 589876 - DNA, 20 bp, Artificial
  CRISPR gRNA sequence
agctaatcacagtaatggca

SEQ ID NO: 589877 - DNA, 20 bp, Artificial
  CRISPR gRNA sequence
tgtacacacttgccactgtt

SEQ ID NO: 589878 - DNA, 20 bp, Artificial
  CRISPR gRNA sequence
tgccttctgtttgctgtttt

SEQ ID NO: 589879 - DNA, 20 bp, Artificial
  CRISPR gRNA sequence
gctgtttttggatcatccca

SEQ ID NO: 589880 - DNA, 20 bp, Artificial
  CRISPR gRNA sequence
ttttggatcatcccacagaa

SEQ ID NO: 589881 - DNA, 20 bp, Artificial
  CRISPR gRNA sequence
ggatcatcccacagaaaagt

SEQ ID NO: 589882 - DNA, 20 bp, Artificial
  CRISPR gRNA sequence
cagaaaagttggaattttgt

SEQ ID NO: 589883 - DNA, 20 bp, Artificial
  CRISPR gRNA sequence
aagttggaattttgttagca

SEQ ID NO: 589884 - DNA, 20 bp, Artificial
  CRISPR gRNA sequence
tgttagcacagccttcattc

SEQ ID NO: 589885 - DNA, 20 bp, Artificial
  CRISPR gRNA sequence
ccttcattctggattgctga

SEQ ID NO: 589886 - DNA, 20 bp, Artificial
  CRISPR gRNA sequence
ttcattctggattgctgaca

SEQ ID NO: 589887 - DNA, 20 bp, Artificial
  CRISPR gRNA sequence
gctgacagagtcttttcata

SEQ ID NO: 589888 - DNA, 20 bp, Artificial
  CRISPR gRNA sequence
gacagagtcttttcataaag

SEQ ID NO: 589889 - DNA, 20 bp, Artificial
  CRISPR gRNA sequence
tcttttcataaagcagaaac

SEQ ID NO: 589890 - DNA, 20 bp, Artificial
  CRISPR gRNA sequence
ataaagcagaaacaagcttt

SEQ ID NO: 589891 - DNA, 20 bp, Artificial
  CRISPR gRNA sequence
agcagaaacaagctttaagt

SEQ ID NO: 589892 - DNA, 20 bp, Artificial
  CRISPR gRNA sequence
aacaagctttaagtgagtat

SEQ ID NO: 589893 - DNA, 20 bp, Artificial
  CRISPR gRNA sequence
gtgagtatcagttttttatc

SEQ ID NO: 589894 - DNA, 20 bp, Artificial
  CRISPR gRNA sequence
cagttttttatccagtaata

SEQ ID NO: 589895 - DNA, 20 bp, Artificial
  CRISPR gRNA sequence
agtaatatagaaaatttctt

SEQ ID NO: 589896 - DNA, 20 bp, Artificial
  CRISPR gRNA sequence
aatatagaaaatttcttaag

SEQ ID NO: 589897 - DNA, 20 bp, Artificial
  CRISPR gRNA sequence
tttcttaagaagtcatatca

SEQ ID NO: 589898 - DNA, 20 bp, Artificial
  CRISPR gRNA sequence
gaagtcatatcaaagttact

SEQ ID NO: 589899 - DNA, 20 bp, Artificial
  CRISPR gRNA sequence
actaagcaaaacaacttatt

SEQ ID NO: 589900 - DNA, 20 bp, Artificial
  CRISPR gRNA sequence
cttatttggtactacttgat

SEQ ID NO: 589901 - DNA, 20 bp, Artificial
  CRISPR gRNA sequence
tatttggtactacttgatta

SEQ ID NO: 589902 - DNA, 20 bp, Artificial
  CRISPR gRNA sequence
atttggtactacttgattag

SEQ ID NO: 589903 - DNA, 20 bp, Artificial
  CRISPR gRNA sequence
agaggaaatattttcataaa

SEQ ID NO: 589904 - DNA, 20 bp, Artificial
  CRISPR gRNA sequence
gaggaaatattttcataaaa

SEQ ID NO: 589905 - DNA, 20 bp, Artificial
  CRISPR gRNA sequence
gaaatattttcataaaaagg

SEQ ID NO: 589906 - DNA, 20 bp, Artificial
  CRISPR gRNA sequence
tattttcataaaaaggaagt

SEQ ID NO: 589907 - DNA, 20 bp, Artificial
  CRISPR gRNA sequence
tttcattgccgttgttttct

SEQ ID NO: 589908 - DNA, 20 bp, Artificial
  CRISPR gRNA sequence
tcattgccgttgttttctta

SEQ ID NO: 589909 - DNA, 20 bp, Artificial
  CRISPR gRNA sequence
gttttcttagagaaaccaca

SEQ ID NO: 589910 - DNA, 20 bp, Artificial
  CRISPR gRNA sequence
cacagtctgtgatttgtcat

SEQ ID NO: 589911 - DNA, 20 bp, Artificial
  CRISPR gRNA sequence
ttgtcattagtacttatcac

SEQ ID NO: 589912 - DNA, 20 bp, Artificial
  CRISPR gRNA sequence
gtcattagtacttatcacaa

SEQ ID NO: 589913 - DNA, 20 bp, Artificial
  CRISPR gRNA sequence
tcattagtacttatcacaag

SEQ ID NO: 589914 - DNA, 20 bp, Artificial
  CRISPR gRNA sequence
cattagtacttatcacaaga

SEQ ID NO: 589915 - DNA, 20 bp, Artificial
  CRISPR gRNA sequence
aagagggtgcactatcaaaa

SEQ ID NO: 589916 - DNA, 20 bp, Artificial
  CRISPR gRNA sequence
gcactatcaaaatggctctg

SEQ ID NO: 589917 - DNA, 20 bp, Artificial
  CRISPR gRNA sequence
ctatcaaaatggctctgtgg

SEQ ID NO: 589918 - DNA, 20 bp, Artificial
  CRISPR gRNA sequence
aaaatggctctgtggtagaa

SEQ ID NO: 589919 - DNA, 20 bp, Artificial
  CRISPR gRNA sequence
gctctgtggtagaaaagtac

SEQ ID NO: 589920 - DNA, 20 bp, Artificial
  CRISPR gRNA sequence
ttgaactaattatttaaact

SEQ ID NO: 589921 - DNA, 20 bp, Artificial
  CRISPR gRNA sequence
aactgagtctcatgtttgca

SEQ ID NO: 589922 - DNA, 20 bp, Artificial
  CRISPR gRNA sequence
agtctcatgtttgcaaagta

SEQ ID NO: 589923 - DNA, 20 bp, Artificial
  CRISPR gRNA sequence
ttgcaaagtacagatgaact

SEQ ID NO: 589924 - DNA, 20 bp, Artificial
  CRISPR gRNA sequence
tgaactcagattactgaata

SEQ ID NO: 589925 - DNA, 20 bp, Artificial
  CRISPR gRNA sequence
cagattactgaataaagttc

SEQ ID NO: 589926 - DNA, 20 bp, Artificial
  CRISPR gRNA sequence
attactgaataaagttcgag

SEQ ID NO: 589927 - DNA, 20 bp, Artificial
  CRISPR gRNA sequence
tgaataaagttcgagcagaa

SEQ ID NO: 589928 - DNA, 20 bp, Artificial
  CRISPR gRNA sequence
aaagttcgagcagaacagtt

SEQ ID NO: 589929 - DNA, 20 bp, Artificial
  CRISPR gRNA sequence
aagttcgagcagaacagttt

SEQ ID NO: 589930 - DNA, 20 bp, Artificial
  CRISPR gRNA sequence
agcagaacagtttaggtatt

SEQ ID NO: 589931 - DNA, 20 bp, Artificial
  CRISPR gRNA sequence
acagtttaggtattaagaac

SEQ ID NO: 589932 - DNA, 20 bp, Artificial
  CRISPR gRNA sequence
cagtttaggtattaagaacg

SEQ ID NO: 589933 - DNA, 20 bp, Artificial
  CRISPR gRNA sequence
ttaggtattaagaacgagga

SEQ ID NO: 589934 - DNA, 20 bp, Artificial
  CRISPR gRNA sequence
gtattaagaacgaggatagt

SEQ ID NO: 589935 - DNA, 20 bp, Artificial
  CRISPR gRNA sequence
tattaagaacgaggatagtg

SEQ ID NO: 589936 - DNA, 20 bp, Artificial
  CRISPR gRNA sequence
aacgaggatagtgaggaact

SEQ ID NO: 589937 - DNA, 20 bp, Artificial
  CRISPR gRNA sequence
acgaggatagtgaggaactt

SEQ ID NO: 589938 - DNA, 20 bp, Artificial
  CRISPR gRNA sequence
tcaccatgtcctttataaaa

SEQ ID NO: 589939 - DNA, 20 bp, Artificial
  CRISPR gRNA sequence
caccatgtcctttataaaac

SEQ ID NO: 589940 - DNA, 20 bp, Artificial
  CRISPR gRNA sequence
accatgtcctttataaaacg

SEQ ID NO: 589941 - DNA, 20 bp, Artificial
  CRISPR gRNA sequence
ttataaaacggggatgataa

SEQ ID NO: 589942 - DNA, 20 bp, Artificial
  CRISPR gRNA sequence
ataatggtaccgacttccta

SEQ ID NO: 589943 - DNA, 20 bp, Artificial
  CRISPR gRNA sequence
cgacttcctatggttgctgt

SEQ ID NO: 589944 - DNA, 20 bp, Artificial
  CRISPR gRNA sequence
ggttgctgtgagcattaaat

SEQ ID NO: 589945 - DNA, 20 bp, Artificial
  CRISPR gRNA sequence
gagcattaaatgagtaaata

SEQ ID NO: 589946 - DNA, 20 bp, Artificial
  CRISPR gRNA sequence
agcattaaatgagtaaatac

SEQ ID NO: 589947 - DNA, 20 bp, Artificial
  CRISPR gRNA sequence
tgtgcttatcttttttttcc

SEQ ID NO: 589948 - DNA, 20 bp, Artificial
  CRISPR gRNA sequence
tcttttttttcctggatata

SEQ ID NO: 589949 - DNA, 20 bp, Artificial
  CRISPR gRNA sequence
atatatagtgctctatttca

SEQ ID NO: 589950 - DNA, 20 bp, Artificial
  CRISPR gRNA sequence
tatatagtgctctatttcat

SEQ ID NO: 589951 - DNA, 20 bp, Artificial
  CRISPR gRNA sequence
atatagtgctctatttcata

SEQ ID NO: 589952 - DNA, 20 bp, Artificial
  CRISPR gRNA sequence
tatttcatagggtttttatg

SEQ ID NO: 589953 - DNA, 20 bp, Artificial
  CRISPR gRNA sequence
tatgaagatcaatcaactta

SEQ ID NO: 589954 - DNA, 20 bp, Artificial
  CRISPR gRNA sequence
tatggtacataaactactct

SEQ ID NO: 589955 - DNA, 20 bp, Artificial
  CRISPR gRNA sequence
aaactactctgagatctaca

SEQ ID NO: 589956 - DNA, 20 bp, Artificial
  CRISPR gRNA sequence
aaagtgatatgcatccttcc

SEQ ID NO: 589957 - DNA, 20 bp, Artificial
  CRISPR gRNA sequence
cttcctggacccatttctaa

SEQ ID NO: 589958 - DNA, 20 bp, Artificial
  CRISPR gRNA sequence
tcctggacccatttctaaca

SEQ ID NO: 589959 - DNA, 20 bp, Artificial
  CRISPR gRNA sequence
aacagagtaccaactatatt

SEQ ID NO: 589960 - DNA, 20 bp, Artificial
  CRISPR gRNA sequence
acaaattgttactcccttac

SEQ ID NO: 589961 - DNA, 20 bp, Artificial
  CRISPR gRNA sequence
ctcccttactagtttttaaa

SEQ ID NO: 589962 - DNA, 20 bp, Artificial
  CRISPR gRNA sequence
cccttactagtttttaaaaa

SEQ ID NO: 589963 - DNA, 20 bp, Artificial
  CRISPR gRNA sequence
tactagtttttaaaaagagt

SEQ ID NO: 589964 - DNA, 20 bp, Artificial
  CRISPR gRNA sequence
actagtttttaaaaagagtt

SEQ ID NO: 589965 - DNA, 20 bp, Artificial
  CRISPR gRNA sequence
gtttttaaaaagagttggga

SEQ ID NO: 589966 - DNA, 20 bp, Artificial
  CRISPR gRNA sequence
tttatccatctttatattgc

SEQ ID NO: 589967 - DNA, 20 bp, Artificial
  CRISPR gRNA sequence
tttatattgccagcatgctc

SEQ ID NO: 589968 - DNA, 20 bp, Artificial
  CRISPR gRNA sequence
cagcatgctcaagaatgttg

SEQ ID NO: 589969 - DNA, 20 bp, Artificial
  CRISPR gRNA sequence
ctcaagaatgttgtggtata

SEQ ID NO: 589970 - DNA, 20 bp, Artificial
  CRISPR gRNA sequence
tcaagaatgttgtggtatat

SEQ ID NO: 589971 - DNA, 20 bp, Artificial
  CRISPR gRNA sequence
aagaatgttgtggtatatag

SEQ ID NO: 589972 - DNA, 20 bp, Artificial
  CRISPR gRNA sequence
gtggtatataggagatgttc

SEQ ID NO: 589973 - DNA, 20 bp, Artificial
  CRISPR gRNA sequence
gtatataggagatgttcaag

SEQ ID NO: 589974 - DNA, 20 bp, Artificial
  CRISPR gRNA sequence
atgttcaagtagtattcact

SEQ ID NO: 589975 - DNA, 20 bp, Artificial
  CRISPR gRNA sequence
ctgagatgttttactaactt

SEQ ID NO: 589976 - DNA, 20 bp, Artificial
  CRISPR gRNA sequence
gagatgttttactaacttaa

SEQ ID NO: 589977 - DNA, 20 bp, Artificial
  CRISPR gRNA sequence
aaacttgctttgtatgttta

SEQ ID NO: 589978 - DNA, 20 bp, Artificial
  CRISPR gRNA sequence
gtttaaagaacccataaaca

SEQ ID NO: 589979 - DNA, 20 bp, Artificial
  CRISPR gRNA sequence
aagaacccataaacatggca

SEQ ID NO: 589980 - DNA, 20 bp, Artificial
  CRISPR gRNA sequence
aagaaaaaacaaaaaacata

SEQ ID NO: 589981 - DNA, 20 bp, Artificial
  CRISPR gRNA sequence
aagaataaaaattacatatg

SEQ ID NO: 589982 - DNA, 20 bp, Artificial
  CRISPR gRNA sequence
tatgaagttcttttgtaacc

SEQ ID NO: 589983 - DNA, 20 bp, Artificial
  CRISPR gRNA sequence
taaccaagctcactatcttt

SEQ ID NO: 589984 - DNA, 20 bp, Artificial
  CRISPR gRNA sequence
aaccaagctcactatctttc

SEQ ID NO: 589985 - DNA, 20 bp, Artificial
  CRISPR gRNA sequence
tctttcaggccctatctcaa

SEQ ID NO: 589986 - DNA, 20 bp, Artificial
  CRISPR gRNA sequence
ggccctatctcaaaagcaac

SEQ ID NO: 589987 - DNA, 20 bp, Artificial
  CRISPR gRNA sequence
cataattttcaaattccaaa

SEQ ID NO: 589988 - DNA, 20 bp, Artificial
  CRISPR gRNA sequence
ctgaatccattttataaatc

SEQ ID NO: 589989 - DNA, 20 bp, Artificial
  CRISPR gRNA sequence
tctagcatcatttgttcatc

SEQ ID NO: 589990 - DNA, 20 bp, Artificial
  CRISPR gRNA sequence
ttgttcatccagttaatcat

SEQ ID NO: 589991 - DNA, 20 bp, Artificial
  CRISPR gRNA sequence
tttcttgtttcttgctatta

SEQ ID NO: 589992 - DNA, 20 bp, Artificial
  CRISPR gRNA sequence
cattattttacaataccaca

SEQ ID NO: 589993 - DNA, 20 bp, Artificial
  CRISPR gRNA sequence
acatagttctgtcaatctga

SEQ ID NO: 589994 - DNA, 20 bp, Artificial
  CRISPR gRNA sequence
tcaatctgacagattaaaac

SEQ ID NO: 589995 - DNA, 20 bp, Artificial
  CRISPR gRNA sequence
ttaaaactggtattttatta

SEQ ID NO: 589996 - DNA, 20 bp, Artificial
  CRISPR gRNA sequence
attttattatggtttttaaa

SEQ ID NO: 589997 - DNA, 20 bp, Artificial
  CRISPR gRNA sequence
aaaaagcattttaaaattat

SEQ ID NO: 589998 - DNA, 20 bp, Artificial
  CRISPR gRNA sequence
gcattttaaaattatgagtg

SEQ ID NO: 589999 - DNA, 20 bp, Artificial
  CRISPR gRNA sequence
tttaaaattatgagtgaagt

SEQ ID NO: 590000 - DNA, 20 bp, Artificial
  CRISPR gRNA sequence
aaacgttctttattttttct

SEQ ID NO: 590001 - DNA, 20 bp, Artificial
  CRISPR gRNA sequence
tttctcagaattatttatca

SEQ ID NO: 590002 - DNA, 20 bp, Artificial
  CRISPR gRNA sequence
ttgtctgcccatttttctat

SEQ ID NO: 590003 - DNA, 20 bp, Artificial
  CRISPR gRNA sequence
tgtctgcccatttttctatc

SEQ ID NO: 590004 - DNA, 20 bp, Artificial
  CRISPR gRNA sequence
ccatttttctatcaggttgt

SEQ ID NO: 590005 - DNA, 20 bp, Artificial
  CRISPR gRNA sequence
ttaaatgctctttatatatt

SEQ ID NO: 590006 - DNA, 20 bp, Artificial
  CRISPR gRNA sequence
taaatgctctttatatatta

SEQ ID NO: 590007 - DNA, 20 bp, Artificial
  CRISPR gRNA sequence
tctttatatattaaggaact

SEQ ID NO: 590008 - DNA, 20 bp, Artificial
  CRISPR gRNA sequence
atatattaaggaacttagcc

SEQ ID NO: 590009 - DNA, 20 bp, Artificial
  CRISPR gRNA sequence
gatatcttttgcaaacattt

SEQ ID NO: 590010 - DNA, 20 bp, Artificial
  CRISPR gRNA sequence
tttggtttatctctttactc

SEQ ID NO: 590011 - DNA, 20 bp, Artificial
  CRISPR gRNA sequence
ttggtttatctctttactca

SEQ ID NO: 590012 - DNA, 20 bp, Artificial
  CRISPR gRNA sequence
tggtttatctctttactcaa

SEQ ID NO: 590013 - DNA, 20 bp, Artificial
  CRISPR gRNA sequence
ctttactcaagggcattttt

SEQ ID NO: 590014 - DNA, 20 bp, Artificial
  CRISPR gRNA sequence
tttcacatgttgaattttta

SEQ ID NO: 590015 - DNA, 20 bp, Artificial
  CRISPR gRNA sequence
tgttgaatttttaaagtctt

SEQ ID NO: 590016 - DNA, 20 bp, Artificial
  CRISPR gRNA sequence
atttttaaagtcttcagtta

SEQ ID NO: 590017 - DNA, 20 bp, Artificial
  CRISPR gRNA sequence
aagtcttcagttatggctcc

SEQ ID NO: 590018 - DNA, 20 bp, Artificial
  CRISPR gRNA sequence
gattctatatcttgcatcaa

SEQ ID NO: 590019 - DNA, 20 bp, Artificial
  CRISPR gRNA sequence
attctatatcttgcatcaac

SEQ ID NO: 590020 - DNA, 20 bp, Artificial
  CRISPR gRNA sequence
aacaggtttttccataatct

SEQ ID NO: 590021 - DNA, 20 bp, Artificial
  CRISPR gRNA sequence
taatctaagtaattcttcca

SEQ ID NO: 590022 - DNA, 20 bp, Artificial
  CRISPR gRNA sequence
ttcttccatggtattttttc

SEQ ID NO: 590023 - DNA, 20 bp, Artificial
  CRISPR gRNA sequence
tccatggtattttttctggt

SEQ ID NO: 590024 - DNA, 20 bp, Artificial
  CRISPR gRNA sequence
ccatggtattttttctggta

SEQ ID NO: 590025 - DNA, 20 bp, Artificial
  CRISPR gRNA sequence
catggtattttttctggtaa

SEQ ID NO: 590026 - DNA, 20 bp, Artificial
  CRISPR gRNA sequence
tggtattttttctggtaagg

SEQ ID NO: 590027 - DNA, 20 bp, Artificial
  CRISPR gRNA sequence
aaatcaatgcgaaatgctat

SEQ ID NO: 590028 - DNA, 20 bp, Artificial
  CRISPR gRNA sequence
atgctattggttatcccata

SEQ ID NO: 590029 - DNA, 20 bp, Artificial
  CRISPR gRNA sequence
tgccatttaaaattaaaatt

SEQ ID NO: 590030 - DNA, 20 bp, Artificial
  CRISPR gRNA sequence
atttaaaattaaaattaaga

SEQ ID NO: 590031 - DNA, 20 bp, Artificial
  CRISPR gRNA sequence
taagaaagaaaatcactgaa

SEQ ID NO: 590032 - DNA, 20 bp, Artificial
  CRISPR gRNA sequence
ctgaaaagtgtaactttata

SEQ ID NO: 590033 - DNA, 20 bp, Artificial
  CRISPR gRNA sequence
cagcatgactttataccact

SEQ ID NO: 590034 - DNA, 20 bp, Artificial
  CRISPR gRNA sequence
tataccacttagtgtgcata

SEQ ID NO: 590035 - DNA, 20 bp, Artificial
  CRISPR gRNA sequence
ttagtgtgcataaagtgtat

SEQ ID NO: 590036 - DNA, 20 bp, Artificial
  CRISPR gRNA sequence
agtgtatcagaattccattt

SEQ ID NO: 590037 - DNA, 20 bp, Artificial
  CRISPR gRNA sequence
gtgtatcagaattccatttc

SEQ ID NO: 590038 - DNA, 20 bp, Artificial
  CRISPR gRNA sequence
agaattccatttcaggaatg

SEQ ID NO: 590039 - DNA, 20 bp, Artificial
  CRISPR gRNA sequence
atgaagaaatacataactga

SEQ ID NO: 590040 - DNA, 20 bp, Artificial
  CRISPR gRNA sequence
gaaatacataactgaaagtg

SEQ ID NO: 590041 - DNA, 20 bp, Artificial
  CRISPR gRNA sequence
cataactgaaagtgtagttt

SEQ ID NO: 590042 - DNA, 20 bp, Artificial
  CRISPR gRNA sequence
gttttagaacctgaaactat

SEQ ID NO: 590043 - DNA, 20 bp, Artificial
  CRISPR gRNA sequence
gagtcttttaaatttcaaaa

SEQ ID NO: 590044 - DNA, 20 bp, Artificial
  CRISPR gRNA sequence
ttttaaatttcaaaatagct

SEQ ID NO: 590045 - DNA, 20 bp, Artificial
  CRISPR gRNA sequence
caaaatagctcagaattatg

SEQ ID NO: 590046 - DNA, 20 bp, Artificial
  CRISPR gRNA sequence
atgactgacattacactact

SEQ ID NO: 590047 - DNA, 20 bp, Artificial
  CRISPR gRNA sequence
attacactactaagtttaat

SEQ ID NO: 590048 - DNA, 20 bp, Artificial
  CRISPR gRNA sequence
ttacactactaagtttaatt

SEQ ID NO: 590049 - DNA, 20 bp, Artificial
  CRISPR gRNA sequence
aattaaaacataacatgaaa

SEQ ID NO: 590050 - DNA, 20 bp, Artificial
  CRISPR gRNA sequence
gataaaaatgtgatttttaa

SEQ ID NO: 590051 - DNA, 20 bp, Artificial
  CRISPR gRNA sequence
aatgtgatttttaaaagtgt

SEQ ID NO: 590052 - DNA, 20 bp, Artificial
  CRISPR gRNA sequence
agtgtgagatattacaaata

SEQ ID NO: 590053 - DNA, 20 bp, Artificial
  CRISPR gRNA sequence
tgagatattacaaatatagt

SEQ ID NO: 590054 - DNA, 20 bp, Artificial
  CRISPR gRNA sequence
tagttagaactttttatcta

SEQ ID NO: 590055 - DNA, 20 bp, Artificial
  CRISPR gRNA sequence
ttagaactttttatctatag

SEQ ID NO: 590056 - DNA, 20 bp, Artificial
  CRISPR gRNA sequence
gaatatactacaaataaata

SEQ ID NO: 590057 - DNA, 20 bp, Artificial
  CRISPR gRNA sequence
atattttgctaaaaccgaaa

SEQ ID NO: 590058 - DNA, 20 bp, Artificial
  CRISPR gRNA sequence
ttgctaaaaccgaaatagac

SEQ ID NO: 590059 - DNA, 20 bp, Artificial
  CRISPR gRNA sequence
aaaccgaaatagacaagaaa

SEQ ID NO: 590060 - DNA, 20 bp, Artificial
  CRISPR gRNA sequence
gaaatagacaagaaatagta

SEQ ID NO: 590061 - DNA, 20 bp, Artificial
  CRISPR gRNA sequence
gacaagaaatagtaaagccg

SEQ ID NO: 590062 - DNA, 20 bp, Artificial
  CRISPR gRNA sequence
tattctctaacaatactata

SEQ ID NO: 590063 - DNA, 20 bp, Artificial
  CRISPR gRNA sequence
tctctaacaatactataaag

SEQ ID NO: 590064 - DNA, 20 bp, Artificial
  CRISPR gRNA sequence
atactataaagaagtatgtt

SEQ ID NO: 590065 - DNA, 20 bp, Artificial
  CRISPR gRNA sequence
ataattttgctgtatttata

SEQ ID NO: 590066 - DNA, 20 bp, Artificial
  CRISPR gRNA sequence
atttatacagtaaatcaata

SEQ ID NO: 590067 - DNA, 20 bp, Artificial
  CRISPR gRNA sequence
catatatacaaacaaaatcc

SEQ ID NO: 590068 - DNA, 20 bp, Artificial
  CRISPR gRNA sequence
ttcacccatctcactacaat

SEQ ID NO: 590069 - DNA, 20 bp, Artificial
  CRISPR gRNA sequence
tcacccatctcactacaatt

SEQ ID NO: 590070 - DNA, 20 bp, Artificial
  CRISPR gRNA sequence
ctacaattaggttgaaattc

SEQ ID NO: 590071 - DNA, 20 bp, Artificial
  CRISPR gRNA sequence
aggttgaaattctagaataa

SEQ ID NO: 590072 - DNA, 20 bp, Artificial
  CRISPR gRNA sequence
tttgaatcttaactattaca

SEQ ID NO: 590073 - DNA, 20 bp, Artificial
  CRISPR gRNA sequence
atcttaactattacatagaa

SEQ ID NO: 590074 - DNA, 20 bp, Artificial
  CRISPR gRNA sequence
agaaaagttttctccactca

SEQ ID NO: 590075 - DNA, 20 bp, Artificial
  CRISPR gRNA sequence
cactcatagaaactctccca

SEQ ID NO: 590076 - DNA, 20 bp, Artificial
  CRISPR gRNA sequence
atggtttattttcactattt

SEQ ID NO: 590077 - DNA, 20 bp, Artificial
  CRISPR gRNA sequence
taagatgtttgcaattaatg

SEQ ID NO: 590078 - DNA, 20 bp, Artificial
  CRISPR gRNA sequence
acttattaatgattaaatgt

SEQ ID NO: 590079 - DNA, 20 bp, Artificial
  CRISPR gRNA sequence
tattaatgattaaatgtaag

SEQ ID NO: 590080 - DNA, 20 bp, Artificial
  CRISPR gRNA sequence
taaatgtaagtagtaaactt

SEQ ID NO: 590081 - DNA, 20 bp, Artificial
  CRISPR gRNA sequence
attataacttatatatatat

SEQ ID NO: 590082 - DNA, 20 bp, Artificial
  CRISPR gRNA sequence
gacttttgttataatattcg

SEQ ID NO: 590083 - DNA, 20 bp, Artificial
  CRISPR gRNA sequence
aaccactgtacaataatatt

SEQ ID NO: 590084 - DNA, 20 bp, Artificial
  CRISPR gRNA sequence
ccactgtacaataatattca

SEQ ID NO: 590085 - DNA, 20 bp, Artificial
  CRISPR gRNA sequence
acttttcaaatatttgaaat

SEQ ID NO: 590086 - DNA, 20 bp, Artificial
  CRISPR gRNA sequence
atgaaatttattttacaatt

SEQ ID NO: 590087 - DNA, 20 bp, Artificial
  CRISPR gRNA sequence
ttttacaatttggtaacaca

SEQ ID NO: 590088 - DNA, 20 bp, Artificial
  CRISPR gRNA sequence
cacaaagacatcctcataaa

SEQ ID NO: 590089 - DNA, 20 bp, Artificial
  CRISPR gRNA sequence
acaaagacatcctcataaat

SEQ ID NO: 590090 - DNA, 20 bp, Artificial
  CRISPR gRNA sequence
atcctcataaatgggctata

SEQ ID NO: 590091 - DNA, 20 bp, Artificial
  CRISPR gRNA sequence
agatgaaaacttgttcattt

SEQ ID NO: 590092 - DNA, 20 bp, Artificial
  CRISPR gRNA sequence
ctgttacaattctcaatacc

SEQ ID NO: 590093 - DNA, 20 bp, Artificial
  CRISPR gRNA sequence
gttacaattctcaataccaa

SEQ ID NO: 590094 - DNA, 20 bp, Artificial
  CRISPR gRNA sequence
aataccaagagttatttttc

SEQ ID NO: 590095 - DNA, 20 bp, Artificial
  CRISPR gRNA sequence
tgtttctctgatatgaaata

SEQ ID NO: 590096 - DNA, 20 bp, Artificial
  CRISPR gRNA sequence
gaaataaagaatgtaaaact

SEQ ID NO: 590097 - DNA, 20 bp, Artificial
  CRISPR gRNA sequence
aaataaagaatgtaaaactt

SEQ ID NO: 590098 - DNA, 20 bp, Artificial
  CRISPR gRNA sequence
gtaaaacttgggcatatctg

SEQ ID NO: 590099 - DNA, 20 bp, Artificial
  CRISPR gRNA sequence
acacgttatcatatgctaat

SEQ ID NO: 590100 - DNA, 20 bp, Artificial
  CRISPR gRNA sequence
catatgctaataagcaataa

SEQ ID NO: 590101 - DNA, 20 bp, Artificial
  CRISPR gRNA sequence
caataatggtttaatttaaa

SEQ ID NO: 590102 - DNA, 20 bp, Artificial
  CRISPR gRNA sequence
taatttaaaaagaattttgc

SEQ ID NO: 590103 - DNA, 20 bp, Artificial
  CRISPR gRNA sequence
attttgccagaacaaactgt

SEQ ID NO: 590104 - DNA, 20 bp, Artificial
  CRISPR gRNA sequence
aacaaactgttagcaatgaa

SEQ ID NO: 590105 - DNA, 20 bp, Artificial
  CRISPR gRNA sequence
acaaactgttagcaatgaaa

SEQ ID NO: 590106 - DNA, 20 bp, Artificial
  CRISPR gRNA sequence
caaactgttagcaatgaaaa

SEQ ID NO: 590107 - DNA, 20 bp, Artificial
  CRISPR gRNA sequence
aaactgttagcaatgaaaag

SEQ ID NO: 590108 - DNA, 20 bp, Artificial
  CRISPR gRNA sequence
tagcaatgaaaaggggatat

SEQ ID NO: 590109 - DNA, 20 bp, Artificial
  CRISPR gRNA sequence
atgaaaaggggatatgagac

SEQ ID NO: 590110 - DNA, 20 bp, Artificial
  CRISPR gRNA sequence
ggggatatgagacaagattt

SEQ ID NO: 590111 - DNA, 20 bp, Artificial
  CRISPR gRNA sequence
agattttagttttgatgata

SEQ ID NO: 590112 - DNA, 20 bp, Artificial
  CRISPR gRNA sequence
taaagatgtttcttatactt

SEQ ID NO: 590113 - DNA, 20 bp, Artificial
  CRISPR gRNA sequence
ttcttatacttcagttgtaa

SEQ ID NO: 590114 - DNA, 20 bp, Artificial
  CRISPR gRNA sequence
gttgtaatggcacttctatt

SEQ ID NO: 590115 - DNA, 20 bp, Artificial
  CRISPR gRNA sequence
taactgttacatccatattt

SEQ ID NO: 590116 - DNA, 20 bp, Artificial
  CRISPR gRNA sequence
ctgttacatccatattttag

SEQ ID NO: 590117 - DNA, 20 bp, Artificial
  CRISPR gRNA sequence
catccatattttagtagact

SEQ ID NO: 590118 - DNA, 20 bp, Artificial
  CRISPR gRNA sequence
atccatattttagtagactc

SEQ ID NO: 590119 - DNA, 20 bp, Artificial
  CRISPR gRNA sequence
agactcaggtttgtgaacac

SEQ ID NO: 590120 - DNA, 20 bp, Artificial
  CRISPR gRNA sequence
gactcaggtttgtgaacaca

SEQ ID NO: 590121 - DNA, 20 bp, Artificial
  CRISPR gRNA sequence
caggtttgtgaacacaagga

SEQ ID NO: 590122 - DNA, 20 bp, Artificial
  CRISPR gRNA sequence
tgtgaacacaaggaaagaat

SEQ ID NO: 590123 - DNA, 20 bp, Artificial
  CRISPR gRNA sequence
acaaggaaagaataagttaa

SEQ ID NO: 590124 - DNA, 20 bp, Artificial
  CRISPR gRNA sequence
ttaatagaaaaaaactgtta

SEQ ID NO: 590125 - DNA, 20 bp, Artificial
  CRISPR gRNA sequence
agaaaaaaactgttatggtc

SEQ ID NO: 590126 - DNA, 20 bp, Artificial
  CRISPR gRNA sequence
ctgttatggtcaagtttatg

SEQ ID NO: 590127 - DNA, 20 bp, Artificial
  CRISPR gRNA sequence
tggtcaagtttatgtagaaa

SEQ ID NO: 590128 - DNA, 20 bp, Artificial
  CRISPR gRNA sequence
tttatgtagaaaaagctttg

SEQ ID NO: 590129 - DNA, 20 bp, Artificial
  CRISPR gRNA sequence
tgaagatatttcatgataaa

SEQ ID NO: 590130 - DNA, 20 bp, Artificial
  CRISPR gRNA sequence
atatttttccaaacaaaaaa

SEQ ID NO: 590131 - DNA, 20 bp, Artificial
  CRISPR gRNA sequence
ttccaaacaaaaaaaagctt

SEQ ID NO: 590132 - DNA, 20 bp, Artificial
  CRISPR gRNA sequence
tccaaacaaaaaaaagcttc

SEQ ID NO: 590133 - DNA, 20 bp, Artificial
  CRISPR gRNA sequence
ataaacattttcatgaattc

SEQ ID NO: 590134 - DNA, 20 bp, Artificial
  CRISPR gRNA sequence
aaaatactatttataaacac

SEQ ID NO: 590135 - DNA, 20 bp, Artificial
  CRISPR gRNA sequence
cttgatgccataaaaacacc

SEQ ID NO: 590136 - DNA, 20 bp, Artificial
  CRISPR gRNA sequence
gccataaaaacacctagttt

SEQ ID NO: 590137 - DNA, 20 bp, Artificial
  CRISPR gRNA sequence
caattccacttacaaattac

SEQ ID NO: 590138 - DNA, 20 bp, Artificial
  CRISPR gRNA sequence
ttccacttacaaattacaag

SEQ ID NO: 590139 - DNA, 20 bp, Artificial
  CRISPR gRNA sequence
cttacaaattacaagaagta

SEQ ID NO: 590140 - DNA, 20 bp, Artificial
  CRISPR gRNA sequence
aagaagtaaagacacttgca

SEQ ID NO: 590141 - DNA, 20 bp, Artificial
  CRISPR gRNA sequence
tgcacagatactctttttta

SEQ ID NO: 590142 - DNA, 20 bp, Artificial
  CRISPR gRNA sequence
tcttttttaaagtgaatttc

SEQ ID NO: 590143 - DNA, 20 bp, Artificial
  CRISPR gRNA sequence
caaacaattttcaattataa

SEQ ID NO: 590144 - DNA, 20 bp, Artificial
  CRISPR gRNA sequence
ttcaattataaaagttcctt

SEQ ID NO: 590145 - DNA, 20 bp, Artificial
  CRISPR gRNA sequence
agttccttcagtaaccattc

SEQ ID NO: 590146 - DNA, 20 bp, Artificial
  CRISPR gRNA sequence
gttccttcagtaaccattct

SEQ ID NO: 590147 - DNA, 20 bp, Artificial
  CRISPR gRNA sequence
ttctaggctctctacaatca

SEQ ID NO: 590148 - DNA, 20 bp, Artificial
  CRISPR gRNA sequence
tctaggctctctacaatcaa

SEQ ID NO: 590149 - DNA, 20 bp, Artificial
  CRISPR gRNA sequence
tacaatcaaaggcttcacaa

SEQ ID NO: 590150 - DNA, 20 bp, Artificial
  CRISPR gRNA sequence
ttcacaatagtcattgcttc

SEQ ID NO: 590151 - DNA, 20 bp, Artificial
  CRISPR gRNA sequence
cattgcttccagatacataa

SEQ ID NO: 590152 - DNA, 20 bp, Artificial
  CRISPR gRNA sequence
tccagatacataatagtgaa

SEQ ID NO: 590153 - DNA, 20 bp, Artificial
  CRISPR gRNA sequence
gatacataatagtgaatgga

SEQ ID NO: 590154 - DNA, 20 bp, Artificial
  CRISPR gRNA sequence
tagtgaatggacagttacac

SEQ ID NO: 590155 - DNA, 20 bp, Artificial
  CRISPR gRNA sequence
attcactaatatgataataa

SEQ ID NO: 590156 - DNA, 20 bp, Artificial
  CRISPR gRNA sequence
ttcactaatatgataataaa

SEQ ID NO: 590157 - DNA, 20 bp, Artificial
  CRISPR gRNA sequence
aataaaaggataactgaata

SEQ ID NO: 590158 - DNA, 20 bp, Artificial
  CRISPR gRNA sequence
ataaaaggataactgaataa

SEQ ID NO: 590159 - DNA, 20 bp, Artificial
  CRISPR gRNA sequence
actgaataaaggcctttaca

SEQ ID NO: 590160 - DNA, 20 bp, Artificial
  CRISPR gRNA sequence
ctgaataaaggcctttacac

SEQ ID NO: 590161 - DNA, 20 bp, Artificial
  CRISPR gRNA sequence
aaggcctttacacaggtaaa

SEQ ID NO: 590162 - DNA, 20 bp, Artificial
  CRISPR gRNA sequence
aggcctttacacaggtaaac

SEQ ID NO: 590163 - DNA, 20 bp, Artificial
  CRISPR gRNA sequence
tttacacaggtaaacaggta

SEQ ID NO: 590164 - DNA, 20 bp, Artificial
  CRISPR gRNA sequence
tatagatcattgtgaaaaaa

SEQ ID NO: 590165 - DNA, 20 bp, Artificial
  CRISPR gRNA sequence
agatcattgtgaaaaaaaag

SEQ ID NO: 590166 - DNA, 20 bp, Artificial
  CRISPR gRNA sequence
aagtagaatctaaaaccaaa

SEQ ID NO: 590167 - DNA, 20 bp, Artificial
  CRISPR gRNA sequence
gtagaatctaaaaccaaatg

SEQ ID NO: 590168 - DNA, 20 bp, Artificial
  CRISPR gRNA sequence
taatccaatcaatgtcataa

SEQ ID NO: 590169 - DNA, 20 bp, Artificial
  CRISPR gRNA sequence
tgccaccattgtacttgaaa

SEQ ID NO: 590170 - DNA, 20 bp, Artificial
  CRISPR gRNA sequence
aactcaaattttactcacat

SEQ ID NO: 590171 - DNA, 20 bp, Artificial
  CRISPR gRNA sequence
tttactcacataagaatgaa

SEQ ID NO: 590172 - DNA, 20 bp, Artificial
  CRISPR gRNA sequence
ttactcacataagaatgaaa

SEQ ID NO: 590173 - DNA, 20 bp, Artificial
  CRISPR gRNA sequence
aaggataataaaatgcacaa

SEQ ID NO: 590174 - DNA, 20 bp, Artificial
  CRISPR gRNA sequence
acagtcattacatacatttg

SEQ ID NO: 590175 - DNA, 20 bp, Artificial
  CRISPR gRNA sequence
gtagaccttacattcattta

SEQ ID NO: 590176 - DNA, 20 bp, Artificial
  CRISPR gRNA sequence
tttatagaactcatctacct

SEQ ID NO: 590177 - DNA, 20 bp, Artificial
  CRISPR gRNA sequence
ctcatctaccttagccaata

SEQ ID NO: 590178 - DNA, 20 bp, Artificial
  CRISPR gRNA sequence
accttagccaataaagaaca

SEQ ID NO: 590179 - DNA, 20 bp, Artificial
  CRISPR gRNA sequence
tagccaataaagaacaaaga

SEQ ID NO: 590180 - DNA, 20 bp, Artificial
  CRISPR gRNA sequence
ctcttaaaaaatcattaaac

SEQ ID NO: 590181 - DNA, 20 bp, Artificial
  CRISPR gRNA sequence
taaaccagtaaatatttatt

SEQ ID NO: 590182 - DNA, 20 bp, Artificial
  CRISPR gRNA sequence
taatactttgtcaataataa

SEQ ID NO: 590183 - DNA, 20 bp, Artificial
  CRISPR gRNA sequence
ctttgtcaataataatagta

SEQ ID NO: 590184 - DNA, 20 bp, Artificial
  CRISPR gRNA sequence
tttgtcaataataatagtaa

SEQ ID NO: 590185 - DNA, 20 bp, Artificial
  CRISPR gRNA sequence
ataataatagtaaaggttta

SEQ ID NO: 590186 - DNA, 20 bp, Artificial
  CRISPR gRNA sequence
atagtaaaggtttaaagcta

SEQ ID NO: 590187 - DNA, 20 bp, Artificial
  CRISPR gRNA sequence
aaaatactattaacttaaat

SEQ ID NO: 590188 - DNA, 20 bp, Artificial
  CRISPR gRNA sequence
taagtaacccatattaacac

SEQ ID NO: 590189 - DNA, 20 bp, Artificial
  CRISPR gRNA sequence
agtaacccatattaacacaa

SEQ ID NO: 590190 - DNA, 20 bp, Artificial
  CRISPR gRNA sequence
aagagtatgtactccaaaaa

SEQ ID NO: 590191 - DNA, 20 bp, Artificial
  CRISPR gRNA sequence
tactccaaaaatggccataa

SEQ ID NO: 590192 - DNA, 20 bp, Artificial
  CRISPR gRNA sequence
ctccaaaaatggccataaaa

SEQ ID NO: 590193 - DNA, 20 bp, Artificial
  CRISPR gRNA sequence
atggccataaaagagttcat

SEQ ID NO: 590194 - DNA, 20 bp, Artificial
  CRISPR gRNA sequence
ccataaaagagttcatgagt

SEQ ID NO: 590195 - DNA, 20 bp, Artificial
  CRISPR gRNA sequence
agagttcatgagttagaata

SEQ ID NO: 590196 - DNA, 20 bp, Artificial
  CRISPR gRNA sequence
gagttcatgagttagaatac

SEQ ID NO: 590197 - DNA, 20 bp, Artificial
  CRISPR gRNA sequence
ttttacaaacatatgtaatt

SEQ ID NO: 590198 - DNA, 20 bp, Artificial
  CRISPR gRNA sequence
gaacaatatataaatgtaaa

SEQ ID NO: 590199 - DNA, 20 bp, Artificial
  CRISPR gRNA sequence
aacaatatataaatgtaaaa

SEQ ID NO: 590200 - DNA, 20 bp, Artificial
  CRISPR gRNA sequence
aaaggcacttctttaaaacc

SEQ ID NO: 590201 - DNA, 20 bp, Artificial
  CRISPR gRNA sequence
ttttatgctataacttcaca

SEQ ID NO: 590202 - DNA, 20 bp, Artificial
  CRISPR gRNA sequence
acaaagtcacccatttgtgc

SEQ ID NO: 590203 - DNA, 20 bp, Artificial
  CRISPR gRNA sequence
agtcacccatttgtgcaaga

SEQ ID NO: 590204 - DNA, 20 bp, Artificial
  CRISPR gRNA sequence
caagacagcatatgattttg

SEQ ID NO: 590205 - DNA, 20 bp, Artificial
  CRISPR gRNA sequence
cagcatatgattttgcagtc

SEQ ID NO: 590206 - DNA, 20 bp, Artificial
  CRISPR gRNA sequence
tctcaatttttaaaattttt

SEQ ID NO: 590207 - DNA, 20 bp, Artificial
  CRISPR gRNA sequence
tttttaaaatttttaagaaa

SEQ ID NO: 590208 - DNA, 20 bp, Artificial
  CRISPR gRNA sequence
taattttaaattttcaaatt

SEQ ID NO: 590209 - DNA, 20 bp, Artificial
  CRISPR gRNA sequence
ataaattctaccctcatcat

SEQ ID NO: 590210 - DNA, 20 bp, Artificial
  CRISPR gRNA sequence
tgctataatttttaaatgtc

SEQ ID NO: 590211 - DNA, 20 bp, Artificial
  CRISPR gRNA sequence
aatttttaaatgtcaagttc

SEQ ID NO: 590212 - DNA, 20 bp, Artificial
  CRISPR gRNA sequence
agttctggaaacaccataca

SEQ ID NO: 590213 - DNA, 20 bp, Artificial
  CRISPR gRNA sequence
gaaacaccatacatagtaat

SEQ ID NO: 590214 - DNA, 20 bp, Artificial
  CRISPR gRNA sequence
agaactgaaaatatcaattt

SEQ ID NO: 590215 - DNA, 20 bp, Artificial
  CRISPR gRNA sequence
atacatattaaactttctac

SEQ ID NO: 590216 - DNA, 20 bp, Artificial
  CRISPR gRNA sequence
gattctactaatctacaaac

SEQ ID NO: 590217 - DNA, 20 bp, Artificial
  CRISPR gRNA sequence
ctactaatctacaaacaagt

SEQ ID NO: 590218 - DNA, 20 bp, Artificial
  CRISPR gRNA sequence
aatctacaaacaagttagtc

SEQ ID NO: 590219 - DNA, 20 bp, Artificial
  CRISPR gRNA sequence
agttagtcaagtttcctaac

SEQ ID NO: 590220 - DNA, 20 bp, Artificial
  CRISPR gRNA sequence
gttagtcaagtttcctaacc

SEQ ID NO: 590221 - DNA, 20 bp, Artificial
  CRISPR gRNA sequence
tcctaaccaggaaaataatg

SEQ ID NO: 590222 - DNA, 20 bp, Artificial
  CRISPR gRNA sequence
ctaaccaggaaaataatgca

SEQ ID NO: 590223 - DNA, 20 bp, Artificial
  CRISPR gRNA sequence
taaccaggaaaataatgcag

SEQ ID NO: 590224 - DNA, 20 bp, Artificial
  CRISPR gRNA sequence
aaccaggaaaataatgcaga

SEQ ID NO: 590225 - DNA, 20 bp, Artificial
  CRISPR gRNA sequence
tgatttattttctctattta

SEQ ID NO: 590226 - DNA, 20 bp, Artificial
  CRISPR gRNA sequence
tgatgtatttattgatctta

SEQ ID NO: 590227 - DNA, 20 bp, Artificial
  CRISPR gRNA sequence
atgtatttattgatcttata

SEQ ID NO: 590228 - DNA, 20 bp, Artificial
  CRISPR gRNA sequence
gatcttatagagtataaaat

SEQ ID NO: 590229 - DNA, 20 bp, Artificial
  CRISPR gRNA sequence
agagtataaaataagctttc

SEQ ID NO: 590230 - DNA, 20 bp, Artificial
  CRISPR gRNA sequence
tagtttaatttctatgaaat

SEQ ID NO: 590231 - DNA, 20 bp, Artificial
  CRISPR gRNA sequence
attggtgacttatttttgtt

SEQ ID NO: 590232 - DNA, 20 bp, Artificial
  CRISPR gRNA sequence
ttatttttgtttagttgcca

SEQ ID NO: 590233 - DNA, 20 bp, Artificial
  CRISPR gRNA sequence
attttaatttttaatttttc

SEQ ID NO: 590234 - DNA, 20 bp, Artificial
  CRISPR gRNA sequence
ttttaatttttaatttttca

SEQ ID NO: 590235 - DNA, 20 bp, Artificial
  CRISPR gRNA sequence
taatttttaatttttcaagg

SEQ ID NO: 590236 - DNA, 20 bp, Artificial
  CRISPR gRNA sequence
tttcaaggaagtaaatatta

SEQ ID NO: 590237 - DNA, 20 bp, Artificial
  CRISPR gRNA sequence
ttcaaggaagtaaatattat

SEQ ID NO: 590238 - DNA, 20 bp, Artificial
  CRISPR gRNA sequence
ggaattaaatatttttttca

SEQ ID NO: 590239 - DNA, 20 bp, Artificial
  CRISPR gRNA sequence
taaatatttttttcacagtg

SEQ ID NO: 590240 - DNA, 20 bp, Artificial
  CRISPR gRNA sequence
atttttttcacagtgtggaa

SEQ ID NO: 590241 - DNA, 20 bp, Artificial
  CRISPR gRNA sequence
tttttcacagtgtggaacag

SEQ ID NO: 590242 - DNA, 20 bp, Artificial
  CRISPR gRNA sequence
tcacagtgtggaacagaaga

SEQ ID NO: 590243 - DNA, 20 bp, Artificial
  CRISPR gRNA sequence
cttacttaccaaatgaaaaa

SEQ ID NO: 590244 - DNA, 20 bp, Artificial
  CRISPR gRNA sequence
aaatgaaaaaaagtgtattt

SEQ ID NO: 590245 - DNA, 20 bp, Artificial
  CRISPR gRNA sequence
aatgaaaaaaagtgtatttc

SEQ ID NO: 590246 - DNA, 20 bp, Artificial
  CRISPR gRNA sequence
gtatttcaggtgtgatgtgt

SEQ ID NO: 590247 - DNA, 20 bp, Artificial
  CRISPR gRNA sequence
tttcaggtgtgatgtgtaag

SEQ ID NO: 590248 - DNA, 20 bp, Artificial
  CRISPR gRNA sequence
gtgtaagtggactttttata

SEQ ID NO: 590249 - DNA, 20 bp, Artificial
  CRISPR gRNA sequence
aagtggactttttatatggt

SEQ ID NO: 590250 - DNA, 20 bp, Artificial
  CRISPR gRNA sequence
tatggttggtttctgttccc

SEQ ID NO: 590251 - DNA, 20 bp, Artificial
  CRISPR gRNA sequence
tttctgttccctggcaattc

SEQ ID NO: 590252 - DNA, 20 bp, Artificial
  CRISPR gRNA sequence
ctgttccctggcaattcaag

SEQ ID NO: 590253 - DNA, 20 bp, Artificial
  CRISPR gRNA sequence
tgttccctggcaattcaagt

SEQ ID NO: 590254 - DNA, 20 bp, Artificial
  CRISPR gRNA sequence
ggcaattcaagtgggcactt

SEQ ID NO: 590255 - DNA, 20 bp, Artificial
  CRISPR gRNA sequence
gcaattcaagtgggcactta

SEQ ID NO: 590256 - DNA, 20 bp, Artificial
  CRISPR gRNA sequence
caattcaagtgggcacttaa

SEQ ID NO: 590257 - DNA, 20 bp, Artificial
  CRISPR gRNA sequence
taagggattttataacttat

SEQ ID NO: 590258 - DNA, 20 bp, Artificial
  CRISPR gRNA sequence
ttataagcatgaacatttcc

SEQ ID NO: 590259 - DNA, 20 bp, Artificial
  CRISPR gRNA sequence
gaacatttcccagtctatgc

SEQ ID NO: 590260 - DNA, 20 bp, Artificial
  CRISPR gRNA sequence
tctatgccagacacttgaaa

SEQ ID NO: 590261 - DNA, 20 bp, Artificial
  CRISPR gRNA sequence
atacactaattgaaccaata

SEQ ID NO: 590262 - DNA, 20 bp, Artificial
  CRISPR gRNA sequence
ggctatctaataatttattg

SEQ ID NO: 590263 - DNA, 20 bp, Artificial
  CRISPR gRNA sequence
tctcacgtaaactttctaaa

SEQ ID NO: 590264 - DNA, 20 bp, Artificial
  CRISPR gRNA sequence
aatccatgttaatatcccaa

SEQ ID NO: 590265 - DNA, 20 bp, Artificial
  CRISPR gRNA sequence
cagctgtttaaataatgtgt

SEQ ID NO: 590266 - DNA, 20 bp, Artificial
  CRISPR gRNA sequence
agctgtttaaataatgtgtt

SEQ ID NO: 590267 - DNA, 20 bp, Artificial
  CRISPR gRNA sequence
aataatgtgttaggaaaaca

SEQ ID NO: 590268 - DNA, 20 bp, Artificial
  CRISPR gRNA sequence
gccttcaaaactgtgatgta

SEQ ID NO: 590269 - DNA, 20 bp, Artificial
  CRISPR gRNA sequence
gtaaagcccaattatttact

SEQ ID NO: 590270 - DNA, 20 bp, Artificial
  CRISPR gRNA sequence
atttactaagaatttaccaa

SEQ ID NO: 590271 - DNA, 20 bp, Artificial
  CRISPR gRNA sequence
accaacagtctaaacaatta

SEQ ID NO: 590272 - DNA, 20 bp, Artificial
  CRISPR gRNA sequence
attaaagtaaaaccacaaca

SEQ ID NO: 590273 - DNA, 20 bp, Artificial
  CRISPR gRNA sequence
ttaaagtaaaaccacaacaa

SEQ ID NO: 590274 - DNA, 20 bp, Artificial
  CRISPR gRNA sequence
caatcattttttaatatcct

SEQ ID NO: 590275 - DNA, 20 bp, Artificial
  CRISPR gRNA sequence
gtatttgttccttttgactg

SEQ ID NO: 590276 - DNA, 20 bp, Artificial
  CRISPR gRNA sequence
tttgactgtggataaataaa

SEQ ID NO: 590277 - DNA, 20 bp, Artificial
  CRISPR gRNA sequence
ctgtggataaataaatggat

SEQ ID NO: 590278 - DNA, 20 bp, Artificial
  CRISPR gRNA sequence
aatggatgagtcttgaaaaa

SEQ ID NO: 590279 - DNA, 20 bp, Artificial
  CRISPR gRNA sequence
gtttcttcacaacatcctta

SEQ ID NO: 590280 - DNA, 20 bp, Artificial
  CRISPR gRNA sequence
taaagaatttgttttataaa

SEQ ID NO: 590281 - DNA, 20 bp, Artificial
  CRISPR gRNA sequence
agaatttgttttataaacgg

SEQ ID NO: 590282 - DNA, 20 bp, Artificial
  CRISPR gRNA sequence
gaatttgttttataaacggt

SEQ ID NO: 590283 - DNA, 20 bp, Artificial
  CRISPR gRNA sequence
tataaacggtgggacatgtc

SEQ ID NO: 590284 - DNA, 20 bp, Artificial
  CRISPR gRNA sequence
ggtgggacatgtccagacac

SEQ ID NO: 590285 - DNA, 20 bp, Artificial
  CRISPR gRNA sequence
gtccagacactggtgtcact

SEQ ID NO: 590286 - DNA, 20 bp, Artificial
  CRISPR gRNA sequence
acactggtgtcactgagctg

SEQ ID NO: 590287 - DNA, 20 bp, Artificial
  CRISPR gRNA sequence
ggtgtcactgagctgcagct

SEQ ID NO: 590288 - DNA, 20 bp, Artificial
  CRISPR gRNA sequence
agctgcagctgagccacttc

SEQ ID NO: 590289 - DNA, 20 bp, Artificial
  CRISPR gRNA sequence
gctgcagctgagccacttct

SEQ ID NO: 590290 - DNA, 20 bp, Artificial
  CRISPR gRNA sequence
gcagctgagccacttctggg

SEQ ID NO: 590291 - DNA, 20 bp, Artificial
  CRISPR gRNA sequence
tctttcttctctgttcaata

SEQ ID NO: 590292 - DNA, 20 bp, Artificial
  CRISPR gRNA sequence
tatgtatttcttaaacccac

SEQ ID NO: 590293 - DNA, 20 bp, Artificial
  CRISPR gRNA sequence
tgtatttcttaaacccactg

SEQ ID NO: 590294 - DNA, 20 bp, Artificial
  CRISPR gRNA sequence
taaacccactggagttactc

SEQ ID NO: 590295 - DNA, 20 bp, Artificial
  CRISPR gRNA sequence
cactggagttactccagatc

SEQ ID NO: 590296 - DNA, 20 bp, Artificial
  CRISPR gRNA sequence
ggagttactccagatcaaga

SEQ ID NO: 590297 - DNA, 20 bp, Artificial
  CRISPR gRNA sequence
tactgttattattccaacaa

SEQ ID NO: 590298 - DNA, 20 bp, Artificial
  CRISPR gRNA sequence
ttattattccaacaatagtg

SEQ ID NO: 590299 - DNA, 20 bp, Artificial
  CRISPR gRNA sequence
attccaacaatagtgtagta

SEQ ID NO: 590300 - DNA, 20 bp, Artificial
  CRISPR gRNA sequence
gtaaagttaccctgcacctg

SEQ ID NO: 590301 - DNA, 20 bp, Artificial
  CRISPR gRNA sequence
taaagttaccctgcacctga

SEQ ID NO: 590302 - DNA, 20 bp, Artificial
  CRISPR gRNA sequence
agttaccctgcacctgaagg

SEQ ID NO: 590303 - DNA, 20 bp, Artificial
  CRISPR gRNA sequence
tgcacctgaaggcagaaaac

SEQ ID NO: 590304 - DNA, 20 bp, Artificial
  CRISPR gRNA sequence
gcacctgaaggcagaaaacc

SEQ ID NO: 590305 - DNA, 20 bp, Artificial
  CRISPR gRNA sequence
cacctgaaggcagaaaacca

SEQ ID NO: 590306 - DNA, 20 bp, Artificial
  CRISPR gRNA sequence
ttctgccatttaacttgtta

SEQ ID NO: 590307 - DNA, 20 bp, Artificial
  CRISPR gRNA sequence
tctgccatttaacttgttat

SEQ ID NO: 590308 - DNA, 20 bp, Artificial
  CRISPR gRNA sequence
tttaacttgttatgggacct

SEQ ID NO: 590309 - DNA, 20 bp, Artificial
  CRISPR gRNA sequence
ttaacttgttatgggacctt

SEQ ID NO: 590310 - DNA, 20 bp, Artificial
  CRISPR gRNA sequence
gaaatttgtttatcctgact

SEQ ID NO: 590311 - DNA, 20 bp, Artificial
  CRISPR gRNA sequence
gtttatcctgactcagccac

SEQ ID NO: 590312 - DNA, 20 bp, Artificial
  CRISPR gRNA sequence
cactagtaccatctaaaata

SEQ ID NO: 590313 - DNA, 20 bp, Artificial
  CRISPR gRNA sequence
actagtaccatctaaaatat

SEQ ID NO: 590314 - DNA, 20 bp, Artificial
  CRISPR gRNA sequence
ctagtaccatctaaaatatg

SEQ ID NO: 590315 - DNA, 20 bp, Artificial
  CRISPR gRNA sequence
tagtaccatctaaaatatgg

SEQ ID NO: 590316 - DNA, 20 bp, Artificial
  CRISPR gRNA sequence
agtaccatctaaaatatggg

SEQ ID NO: 590317 - DNA, 20 bp, Artificial
  CRISPR gRNA sequence
acacttgatgtttctgaaaa

SEQ ID NO: 590318 - DNA, 20 bp, Artificial
  CRISPR gRNA sequence
cttgatgtttctgaaaacag

SEQ ID NO: 590319 - DNA, 20 bp, Artificial
  CRISPR gRNA sequence
ttgatgtttctgaaaacagc

SEQ ID NO: 590320 - DNA, 20 bp, Artificial
  CRISPR gRNA sequence
tgtttctgaaaacagcaggc

SEQ ID NO: 590321 - DNA, 20 bp, Artificial
  CRISPR gRNA sequence
aggctagataaaataatctc

SEQ ID NO: 590322 - DNA, 20 bp, Artificial
  CRISPR gRNA sequence
ctagataaaataatctctgg

SEQ ID NO: 590323 - DNA, 20 bp, Artificial
  CRISPR gRNA sequence
aaataatctctggtagacta

SEQ ID NO: 590324 - DNA, 20 bp, Artificial
  CRISPR gRNA sequence
tctctggtagactacagatt

SEQ ID NO: 590325 - DNA, 20 bp, Artificial
  CRISPR gRNA sequence
tagaatccttttaatgataa

SEQ ID NO: 590326 - DNA, 20 bp, Artificial
  CRISPR gRNA sequence
aatagtaatgataataataa

SEQ ID NO: 590327 - DNA, 20 bp, Artificial
  CRISPR gRNA sequence
ataataatagaaaaataaaa

SEQ ID NO: 590328 - DNA, 20 bp, Artificial
  CRISPR gRNA sequence
acatattcttttttgatact

SEQ ID NO: 590329 - DNA, 20 bp, Artificial
  CRISPR gRNA sequence
tactcagaatgactgcattg

SEQ ID NO: 590330 - DNA, 20 bp, Artificial
  CRISPR gRNA sequence
actcagaatgactgcattgt

SEQ ID NO: 590331 - DNA, 20 bp, Artificial
  CRISPR gRNA sequence
cagaatgactgcattgtagg

SEQ ID NO: 590332 - DNA, 20 bp, Artificial
  CRISPR gRNA sequence
agaatgactgcattgtagga

SEQ ID NO: 590333 - DNA, 20 bp, Artificial
  CRISPR gRNA sequence
gaatgactgcattgtaggaa

SEQ ID NO: 590334 - DNA, 20 bp, Artificial
  CRISPR gRNA sequence
tgactgcattgtaggaaggg

SEQ ID NO: 590335 - DNA, 20 bp, Artificial
  CRISPR gRNA sequence
cattgtaggaagggtagcca

SEQ ID NO: 590336 - DNA, 20 bp, Artificial
  CRISPR gRNA sequence
gtagccacagataaacactg

SEQ ID NO: 590337 - DNA, 20 bp, Artificial
  CRISPR gRNA sequence
cacagataaacactgaagca

SEQ ID NO: 590338 - DNA, 20 bp, Artificial
  CRISPR gRNA sequence
aacactgaagcatggttgtt

SEQ ID NO: 590339 - DNA, 20 bp, Artificial
  CRISPR gRNA sequence
actgaagcatggttgttaag

SEQ ID NO: 590340 - DNA, 20 bp, Artificial
  CRISPR gRNA sequence
ggttgttaagtggctattga

SEQ ID NO: 590341 - DNA, 20 bp, Artificial
  CRISPR gRNA sequence
gttgttaagtggctattgaa

SEQ ID NO: 590342 - DNA, 20 bp, Artificial
  CRISPR gRNA sequence
agtggctattgaaaggatac

SEQ ID NO: 590343 - DNA, 20 bp, Artificial
  CRISPR gRNA sequence
gctattgaaaggatacaagt

SEQ ID NO: 590344 - DNA, 20 bp, Artificial
  CRISPR gRNA sequence
tgtgaacttgatatcaattc

SEQ ID NO: 590345 - DNA, 20 bp, Artificial
  CRISPR gRNA sequence
attcaagatcttttgactcg

SEQ ID NO: 590346 - DNA, 20 bp, Artificial
  CRISPR gRNA sequence
atccttctatgacatgatac

SEQ ID NO: 590347 - DNA, 20 bp, Artificial
  CRISPR gRNA sequence
tactggctctccaatgaaac

SEQ ID NO: 590348 - DNA, 20 bp, Artificial
  CRISPR gRNA sequence
atgaaacaagtaacttacat

SEQ ID NO: 590349 - DNA, 20 bp, Artificial
  CRISPR gRNA sequence
acttacattagtattatatt

SEQ ID NO: 590350 - DNA, 20 bp, Artificial
  CRISPR gRNA sequence
cttacattagtattatattt

SEQ ID NO: 590351 - DNA, 20 bp, Artificial
  CRISPR gRNA sequence
attatatttaggacaaaaat

SEQ ID NO: 590352 - DNA, 20 bp, Artificial
  CRISPR gRNA sequence
tttaggacaaaaatcagtca

SEQ ID NO: 590353 - DNA, 20 bp, Artificial
  CRISPR gRNA sequence
ttaggacaaaaatcagtcat

SEQ ID NO: 590354 - DNA, 20 bp, Artificial
  CRISPR gRNA sequence
aaaaatcagtcataggcaaa

SEQ ID NO: 590355 - DNA, 20 bp, Artificial
  CRISPR gRNA sequence
tcataggcaaacagttctta

SEQ ID NO: 590356 - DNA, 20 bp, Artificial
  CRISPR gRNA sequence
taggcaaacagttcttacgg

SEQ ID NO: 590357 - DNA, 20 bp, Artificial
  CRISPR gRNA sequence
agctgtaaaactatgtccac

SEQ ID NO: 590358 - DNA, 20 bp, Artificial
  CRISPR gRNA sequence
aaaactatgtccaccagttg

SEQ ID NO: 590359 - DNA, 20 bp, Artificial
  CRISPR gRNA sequence
aactatgtccaccagttgaa

SEQ ID NO: 590360 - DNA, 20 bp, Artificial
  CRISPR gRNA sequence
actatgtccaccagttgaag

SEQ ID NO: 590361 - DNA, 20 bp, Artificial
  CRISPR gRNA sequence
ccaccagttgaagaggatac

SEQ ID NO: 590362 - DNA, 20 bp, Artificial
  CRISPR gRNA sequence
gaagaggataccagaaactt

SEQ ID NO: 590363 - DNA, 20 bp, Artificial
  CRISPR gRNA sequence
ccagaaacttaagtcccgaa

SEQ ID NO: 590364 - DNA, 20 bp, Artificial
  CRISPR gRNA sequence
aaacttaagtcccgaatggt

SEQ ID NO: 590365 - DNA, 20 bp, Artificial
  CRISPR gRNA sequence
aagtcccgaatggtcagata

SEQ ID NO: 590366 - DNA, 20 bp, Artificial
  CRISPR gRNA sequence
tggtcagataaagaaatgtt

SEQ ID NO: 590367 - DNA, 20 bp, Artificial
  CRISPR gRNA sequence
ttatgactttctatcaaaac

SEQ ID NO: 590368 - DNA, 20 bp, Artificial
  CRISPR gRNA sequence
tatgactttctatcaaaact

SEQ ID NO: 590369 - DNA, 20 bp, Artificial
  CRISPR gRNA sequence
aaatttgctttgctgttgtc

SEQ ID NO: 590370 - DNA, 20 bp, Artificial
  CRISPR gRNA sequence
aatttgctttgctgttgtca

SEQ ID NO: 590371 - DNA, 20 bp, Artificial
  CRISPR gRNA sequence
atttgctttgctgttgtcaa

SEQ ID NO: 590372 - DNA, 20 bp, Artificial
  CRISPR gRNA sequence
ttgtcaagggtatgtccatg

SEQ ID NO: 590373 - DNA, 20 bp, Artificial
  CRISPR gRNA sequence
gtatgtccatgcagtacacc

SEQ ID NO: 590374 - DNA, 20 bp, Artificial
  CRISPR gRNA sequence
tgcagtacacctagttgctg

SEQ ID NO: 590375 - DNA, 20 bp, Artificial
  CRISPR gRNA sequence
cttgtcctgctatgaattat

SEQ ID NO: 590376 - DNA, 20 bp, Artificial
  CRISPR gRNA sequence
gtcctgctatgaattatcgg

SEQ ID NO: 590377 - DNA, 20 bp, Artificial
  CRISPR gRNA sequence
ctgctatgaattatcggtgg

SEQ ID NO: 590378 - DNA, 20 bp, Artificial
  CRISPR gRNA sequence
tgctatgaattatcggtggt

SEQ ID NO: 590379 - DNA, 20 bp, Artificial
  CRISPR gRNA sequence
tgaattatcggtggtaggtt

SEQ ID NO: 590380 - DNA, 20 bp, Artificial
  CRISPR gRNA sequence
gaattatcggtggtaggtta

SEQ ID NO: 590381 - DNA, 20 bp, Artificial
  CRISPR gRNA sequence
ttatcggtggtaggttaagg

SEQ ID NO: 590382 - DNA, 20 bp, Artificial
  CRISPR gRNA sequence
gtaggttaaggcagcaattt

SEQ ID NO: 590383 - DNA, 20 bp, Artificial
  CRISPR gRNA sequence
ggttaaggcagcaatttgag

SEQ ID NO: 590384 - DNA, 20 bp, Artificial
  CRISPR gRNA sequence
aaggcagcaatttgagcagt

SEQ ID NO: 590385 - DNA, 20 bp, Artificial
  CRISPR gRNA sequence
aattttaatctctaaaccaa

SEQ ID NO: 590386 - DNA, 20 bp, Artificial
  CRISPR gRNA sequence
ctctaaaccaatagtttatg

SEQ ID NO: 590387 - DNA, 20 bp, Artificial
  CRISPR gRNA sequence
tctaaaccaatagtttatga

SEQ ID NO: 590388 - DNA, 20 bp, Artificial
  CRISPR gRNA sequence
aaccaatagtttatgaagga

SEQ ID NO: 590389 - DNA, 20 bp, Artificial
  CRISPR gRNA sequence
gtttatgaaggatagcattt

SEQ ID NO: 590390 - DNA, 20 bp, Artificial
  CRISPR gRNA sequence
tttatgaaggatagcatttc

SEQ ID NO: 590391 - DNA, 20 bp, Artificial
  CRISPR gRNA sequence
gcatttcaggatttcctttg

SEQ ID NO: 590392 - DNA, 20 bp, Artificial
  CRISPR gRNA sequence
tcaggatttcctttgtggtc

SEQ ID NO: 590393 - DNA, 20 bp, Artificial
  CRISPR gRNA sequence
cctttgtggtcaagttttga

SEQ ID NO: 590394 - DNA, 20 bp, Artificial
  CRISPR gRNA sequence
ttgtgtcaattattgatata

SEQ ID NO: 590395 - DNA, 20 bp, Artificial
  CRISPR gRNA sequence
taaagataaatcacacctgt

SEQ ID NO: 590396 - DNA, 20 bp, Artificial
  CRISPR gRNA sequence
gataaatcacacctgtgagt

SEQ ID NO: 590397 - DNA, 20 bp, Artificial
  CRISPR gRNA sequence
acacctgtgagttggtaatg

SEQ ID NO: 590398 - DNA, 20 bp, Artificial
  CRISPR gRNA sequence
gaattttatctacatttaaa

SEQ ID NO: 590399 - DNA, 20 bp, Artificial
  CRISPR gRNA sequence
atctacatttaaacagatct

SEQ ID NO: 590400 - DNA, 20 bp, Artificial
  CRISPR gRNA sequence
cagatcttggcaacaaaata

SEQ ID NO: 590401 - DNA, 20 bp, Artificial
  CRISPR gRNA sequence
gcaacaaaataaagaccaaa

SEQ ID NO: 590402 - DNA, 20 bp, Artificial
  CRISPR gRNA sequence
aagtttcctccctactttca

SEQ ID NO: 590403 - DNA, 20 bp, Artificial
  CRISPR gRNA sequence
ggaaaaaaaatgtaaacgaa

SEQ ID NO: 590404 - DNA, 20 bp, Artificial
  CRISPR gRNA sequence
aaaaaaaatgtaaacgaatg

SEQ ID NO: 590405 - DNA, 20 bp, Artificial
  CRISPR gRNA sequence
aaaaaaatgtaaacgaatgg

SEQ ID NO: 590406 - DNA, 20 bp, Artificial
  CRISPR gRNA sequence
aaaaaatgtaaacgaatgga

SEQ ID NO: 590407 - DNA, 20 bp, Artificial
  CRISPR gRNA sequence
acactccatgaaaccttgta

SEQ ID NO: 590408 - DNA, 20 bp, Artificial
  CRISPR gRNA sequence
atcaaaatacacacctttat

SEQ ID NO: 590409 - DNA, 20 bp, Artificial
  CRISPR gRNA sequence
cacacctttattagctaaca

SEQ ID NO: 590410 - DNA, 20 bp, Artificial
  CRISPR gRNA sequence
acctttattagctaacacag

SEQ ID NO: 590411 - DNA, 20 bp, Artificial
  CRISPR gRNA sequence
ctaacacagtagcaccattg

SEQ ID NO: 590412 - DNA, 20 bp, Artificial
  CRISPR gRNA sequence
agtagcaccattgtggccca

SEQ ID NO: 590413 - DNA, 20 bp, Artificial
  CRISPR gRNA sequence
gcaccattgtggcccacaga

SEQ ID NO: 590414 - DNA, 20 bp, Artificial
  CRISPR gRNA sequence
accattgtggcccacagacg

SEQ ID NO: 590415 - DNA, 20 bp, Artificial
  CRISPR gRNA sequence
cagacggagtttctattttt

SEQ ID NO: 590416 - DNA, 20 bp, Artificial
  CRISPR gRNA sequence
acggagtttctattttttgg

SEQ ID NO: 590417 - DNA, 20 bp, Artificial
  CRISPR gRNA sequence
tctattttttggcggacaac

SEQ ID NO: 590418 - DNA, 20 bp, Artificial
  CRISPR gRNA sequence
ttggcggacaactagttcat

SEQ ID NO: 590419 - DNA, 20 bp, Artificial
  CRISPR gRNA sequence
ttcatgagaattatacaatg

SEQ ID NO: 590420 - DNA, 20 bp, Artificial
  CRISPR gRNA sequence
catgagaattatacaatgca

SEQ ID NO: 590421 - DNA, 20 bp, Artificial
  CRISPR gRNA sequence
gaaaataaacctactttaaa

SEQ ID NO: 590422 - DNA, 20 bp, Artificial
  CRISPR gRNA sequence
tactttaaatagaaatgcct

SEQ ID NO: 590423 - DNA, 20 bp, Artificial
  CRISPR gRNA sequence
atagaaatgcctcagccaaa

SEQ ID NO: 590424 - DNA, 20 bp, Artificial
  CRISPR gRNA sequence
gaaatgcctcagccaaacag

SEQ ID NO: 590425 - DNA, 20 bp, Artificial
  CRISPR gRNA sequence
gatgaatgatttcatttgcc

SEQ ID NO: 590426 - DNA, 20 bp, Artificial
  CRISPR gRNA sequence
atttcatttgccaagtccta

SEQ ID NO: 590427 - DNA, 20 bp, Artificial
  CRISPR gRNA sequence
tttcatttgccaagtcctaa

SEQ ID NO: 590428 - DNA, 20 bp, Artificial
  CRISPR gRNA sequence
catctgtttttgcatcttct

SEQ ID NO: 590429 - DNA, 20 bp, Artificial
  CRISPR gRNA sequence
atctgtttttgcatcttctt

SEQ ID NO: 590430 - DNA, 20 bp, Artificial
  CRISPR gRNA sequence
ttgggcaatacaactacttt

SEQ ID NO: 590431 - DNA, 20 bp, Artificial
  CRISPR gRNA sequence
gatccccatgacctctcacc

SEQ ID NO: 590432 - DNA, 20 bp, Artificial
  CRISPR gRNA sequence
cctctcacctggaacaatat

SEQ ID NO: 590433 - DNA, 20 bp, Artificial
  CRISPR gRNA sequence
aatatcagaaactttctaac

SEQ ID NO: 590434 - DNA, 20 bp, Artificial
  CRISPR gRNA sequence
tcccccaattcatctatatt

SEQ ID NO: 590435 - DNA, 20 bp, Artificial
  CRISPR gRNA sequence
attcatctatattcagttgt

SEQ ID NO: 590436 - DNA, 20 bp, Artificial
  CRISPR gRNA sequence
ttagattaatcttcctattg

SEQ ID NO: 590437 - DNA, 20 bp, Artificial
  CRISPR gRNA sequence
agattaatcttcctattgca

SEQ ID NO: 590438 - DNA, 20 bp, Artificial
  CRISPR gRNA sequence
ttactcttctaaatgtcttc

SEQ ID NO: 590439 - DNA, 20 bp, Artificial
  CRISPR gRNA sequence
ctgcctacacattaaataca

SEQ ID NO: 590440 - DNA, 20 bp, Artificial
  CRISPR gRNA sequence
tgcctacacattaaatacaa

SEQ ID NO: 590441 - DNA, 20 bp, Artificial
  CRISPR gRNA sequence
cacattaaatacaaaggtat

SEQ ID NO: 590442 - DNA, 20 bp, Artificial
  CRISPR gRNA sequence
taaatacaaaggtattggta

SEQ ID NO: 590443 - DNA, 20 bp, Artificial
  CRISPR gRNA sequence
aaggtattggtatggaattt

SEQ ID NO: 590444 - DNA, 20 bp, Artificial
  CRISPR gRNA sequence
atggaatttaagaatatcca

SEQ ID NO: 590445 - DNA, 20 bp, Artificial
  CRISPR gRNA sequence
atttaagaatatccaaagtg

SEQ ID NO: 590446 - DNA, 20 bp, Artificial
  CRISPR gRNA sequence
tgtagtcccatcatatcctt

SEQ ID NO: 590447 - DNA, 20 bp, Artificial
  CRISPR gRNA sequence
ccttcagccatatgtcctat

SEQ ID NO: 590448 - DNA, 20 bp, Artificial
  CRISPR gRNA sequence
catatgtcctatgagtcttt

SEQ ID NO: 590449 - DNA, 20 bp, Artificial
  CRISPR gRNA sequence
ttagttactcatgccttttc

SEQ ID NO: 590450 - DNA, 20 bp, Artificial
  CRISPR gRNA sequence
tccagtgaaaccactgtcct

SEQ ID NO: 590451 - DNA, 20 bp, Artificial
  CRISPR gRNA sequence
aaccactgtcctcagttttc

SEQ ID NO: 590452 - DNA, 20 bp, Artificial
  CRISPR gRNA sequence
atttatacatctctacttac

SEQ ID NO: 590453 - DNA, 20 bp, Artificial
  CRISPR gRNA sequence
tttatacatctctacttact

SEQ ID NO: 590454 - DNA, 20 bp, Artificial
  CRISPR gRNA sequence
aggtttttttgttttttctc

SEQ ID NO: 590455 - DNA, 20 bp, Artificial
  CRISPR gRNA sequence
aagcacctgcttttattttc

SEQ ID NO: 590456 - DNA, 20 bp, Artificial
  CRISPR gRNA sequence
agcacctgcttttattttct

SEQ ID NO: 590457 - DNA, 20 bp, Artificial
  CRISPR gRNA sequence
tcccctatttctataaaaat

SEQ ID NO: 590458 - DNA, 20 bp, Artificial
  CRISPR gRNA sequence
taaaaattagcacatcatta

SEQ ID NO: 590459 - DNA, 20 bp, Artificial
  CRISPR gRNA sequence
aaaaattagcacatcattaa

SEQ ID NO: 590460 - DNA, 20 bp, Artificial
  CRISPR gRNA sequence
tatctgctaccttttttcat

SEQ ID NO: 590461 - DNA, 20 bp, Artificial
  CRISPR gRNA sequence
ttttttcatgagtgttttct

SEQ ID NO: 590462 - DNA, 20 bp, Artificial
  CRISPR gRNA sequence
atgagtgttttctgagcaaa

SEQ ID NO: 590463 - DNA, 20 bp, Artificial
  CRISPR gRNA sequence
atttacttcactttacatta

SEQ ID NO: 590464 - DNA, 20 bp, Artificial
  CRISPR gRNA sequence
ttacattacagtgatttcat

SEQ ID NO: 590465 - DNA, 20 bp, Artificial
  CRISPR gRNA sequence
ccttacctctacactgccta

SEQ ID NO: 590466 - DNA, 20 bp, Artificial
  CRISPR gRNA sequence
ctctacactgcctatagtgt

SEQ ID NO: 590467 - DNA, 20 bp, Artificial
  CRISPR gRNA sequence
tctacactgcctatagtgta

SEQ ID NO: 590468 - DNA, 20 bp, Artificial
  CRISPR gRNA sequence
gcctatagtgtaaggtcctt

SEQ ID NO: 590469 - DNA, 20 bp, Artificial
  CRISPR gRNA sequence
ctatagtgtaaggtccttga

SEQ ID NO: 590470 - DNA, 20 bp, Artificial
  CRISPR gRNA sequence
tatagtgtaaggtccttgag

SEQ ID NO: 590471 - DNA, 20 bp, Artificial
  CRISPR gRNA sequence
ggaaatactgcctttattca

SEQ ID NO: 590472 - DNA, 20 bp, Artificial
  CRISPR gRNA sequence
attctatccttacacataca

SEQ ID NO: 590473 - DNA, 20 bp, Artificial
  CRISPR gRNA sequence
ccaatatgtatttgttgaac

SEQ ID NO: 590474 - DNA, 20 bp, Artificial
  CRISPR gRNA sequence
atttctgtttttaaattacg

SEQ ID NO: 590475 - DNA, 20 bp, Artificial
  CRISPR gRNA sequence
gatgaataaatataacaata

SEQ ID NO: 590476 - DNA, 20 bp, Artificial
  CRISPR gRNA sequence
taaatataacaatacagatt

SEQ ID NO: 590477 - DNA, 20 bp, Artificial
  CRISPR gRNA sequence
aaatataacaatacagattt

SEQ ID NO: 590478 - DNA, 20 bp, Artificial
  CRISPR gRNA sequence
tatcaaaataacattaatta

SEQ ID NO: 590479 - DNA, 20 bp, Artificial
  CRISPR gRNA sequence
aattaaagaaccattaatga

SEQ ID NO: 590480 - DNA, 20 bp, Artificial
  CRISPR gRNA sequence
attaaagaaccattaatgac

SEQ ID NO: 590481 - DNA, 20 bp, Artificial
  CRISPR gRNA sequence
aagaaccattaatgacagga

SEQ ID NO: 590482 - DNA, 20 bp, Artificial
  CRISPR gRNA sequence
attaatgacaggaaagaatt

SEQ ID NO: 590483 - DNA, 20 bp, Artificial
  CRISPR gRNA sequence
ttaatgacaggaaagaattt

SEQ ID NO: 590484 - DNA, 20 bp, Artificial
  CRISPR gRNA sequence
atcaactgaattaatcaaaa

SEQ ID NO: 590485 - DNA, 20 bp, Artificial
  CRISPR gRNA sequence
atcaaaatagccactccatg

SEQ ID NO: 590486 - DNA, 20 bp, Artificial
  CRISPR gRNA sequence
tttatcctcattttacaaat

SEQ ID NO: 590487 - DNA, 20 bp, Artificial
  CRISPR gRNA sequence
ttatcctcattttacaaatg

SEQ ID NO: 590488 - DNA, 20 bp, Artificial
  CRISPR gRNA sequence
ttttacaaatgaggaaactg

SEQ ID NO: 590489 - DNA, 20 bp, Artificial
  CRISPR gRNA sequence
aggaaactgaagcttaaaat

SEQ ID NO: 590490 - DNA, 20 bp, Artificial
  CRISPR gRNA sequence
actgaagcttaaaatcagtg

SEQ ID NO: 590491 - DNA, 20 bp, Artificial
  CRISPR gRNA sequence
attcaattcatacaaatatt

SEQ ID NO: 590492 - DNA, 20 bp, Artificial
  CRISPR gRNA sequence
tcaattcatacaaatattga

SEQ ID NO: 590493 - DNA, 20 bp, Artificial
  CRISPR gRNA sequence
ttcatacaaatattgagagt

SEQ ID NO: 590494 - DNA, 20 bp, Artificial
  CRISPR gRNA sequence
catacaaatattgagagtca

SEQ ID NO: 590495 - DNA, 20 bp, Artificial
  CRISPR gRNA sequence
ttgagagtcagagctgtgac

SEQ ID NO: 590496 - DNA, 20 bp, Artificial
  CRISPR gRNA sequence
tcagagctgtgactggaact

SEQ ID NO: 590497 - DNA, 20 bp, Artificial
  CRISPR gRNA sequence
ctatttccctatgatgccaa

SEQ ID NO: 590498 - DNA, 20 bp, Artificial
  CRISPR gRNA sequence
tccctatgatgccaaaagca

SEQ ID NO: 590499 - DNA, 20 bp, Artificial
  CRISPR gRNA sequence
ctatgatgccaaaagcaaag

SEQ ID NO: 590500 - DNA, 20 bp, Artificial
  CRISPR gRNA sequence
gatgccaaaagcaaagtagc

SEQ ID NO: 590501 - DNA, 20 bp, Artificial
  CRISPR gRNA sequence
aaaagcaaagtagctagtaa

SEQ ID NO: 590502 - DNA, 20 bp, Artificial
  CRISPR gRNA sequence
caaagtagctagtaatagta

SEQ ID NO: 590503 - DNA, 20 bp, Artificial
  CRISPR gRNA sequence
gtaatagtaaagaaaaaaaa

SEQ ID NO: 590504 - DNA, 20 bp, Artificial
  CRISPR gRNA sequence
aaacagatgtcaatatgtta

SEQ ID NO: 590505 - DNA, 20 bp, Artificial
  CRISPR gRNA sequence
aaagaatgatacctttgaat

SEQ ID NO: 590506 - DNA, 20 bp, Artificial
  CRISPR gRNA sequence
ctgatatgttttttactcca

SEQ ID NO: 590507 - DNA, 20 bp, Artificial
  CRISPR gRNA sequence
atatgttttttactccacag

SEQ ID NO: 590508 - DNA, 20 bp, Artificial
  CRISPR gRNA sequence
ttttactccacagtggaata

SEQ ID NO: 590509 - DNA, 20 bp, Artificial
  CRISPR gRNA sequence
tttactccacagtggaatac

SEQ ID NO: 590510 - DNA, 20 bp, Artificial
  CRISPR gRNA sequence
tccacagtggaatacaggtg

SEQ ID NO: 590511 - DNA, 20 bp, Artificial
  CRISPR gRNA sequence
acagtggaatacaggtgtag

SEQ ID NO: 590512 - DNA, 20 bp, Artificial
  CRISPR gRNA sequence
atacaggtgtagcagattgc

SEQ ID NO: 590513 - DNA, 20 bp, Artificial
  CRISPR gRNA sequence
gtgtagcagattgccagtct

SEQ ID NO: 590514 - DNA, 20 bp, Artificial
  CRISPR gRNA sequence
tgtagcagattgccagtctg

SEQ ID NO: 590515 - DNA, 20 bp, Artificial
  CRISPR gRNA sequence
cagattgccagtctgaggta

SEQ ID NO: 590516 - DNA, 20 bp, Artificial
  CRISPR gRNA sequence
gattgccagtctgaggtaaa

SEQ ID NO: 590517 - DNA, 20 bp, Artificial
  CRISPR gRNA sequence
gccagtctgaggtaaagaga

SEQ ID NO: 590518 - DNA, 20 bp, Artificial
  CRISPR gRNA sequence
aggtaaagagaaagttgtct

SEQ ID NO: 590519 - DNA, 20 bp, Artificial
  CRISPR gRNA sequence
aaagagaaagttgtctgagt

SEQ ID NO: 590520 - DNA, 20 bp, Artificial
  CRISPR gRNA sequence
ttgtctgagtaagcctgttt

SEQ ID NO: 590521 - DNA, 20 bp, Artificial
  CRISPR gRNA sequence
tctgagtaagcctgttttgg

SEQ ID NO: 590522 - DNA, 20 bp, Artificial
  CRISPR gRNA sequence
gagtaagcctgttttggaag

SEQ ID NO: 590523 - DNA, 20 bp, Artificial
  CRISPR gRNA sequence
agcctgttttggaagaagac

SEQ ID NO: 590524 - DNA, 20 bp, Artificial
  CRISPR gRNA sequence
cttacactgccaaatttcct

SEQ ID NO: 590525 - DNA, 20 bp, Artificial
  CRISPR gRNA sequence
actgccaaatttcctgagcg

SEQ ID NO: 590526 - DNA, 20 bp, Artificial
  CRISPR gRNA sequence
gcgtggattttatttcatat

SEQ ID NO: 590527 - DNA, 20 bp, Artificial
  CRISPR gRNA sequence
gtggattttatttcatataa

SEQ ID NO: 590528 - DNA, 20 bp, Artificial
  CRISPR gRNA sequence
aagagcaatctactttgaac

SEQ ID NO: 590529 - DNA, 20 bp, Artificial
  CRISPR gRNA sequence
atctactttgaactggtgtt

SEQ ID NO: 590530 - DNA, 20 bp, Artificial
  CRISPR gRNA sequence
catctgcttaacgtaactgt

SEQ ID NO: 590531 - DNA, 20 bp, Artificial
  CRISPR gRNA sequence
tctgcttaacgtaactgtaa

SEQ ID NO: 590532 - DNA, 20 bp, Artificial
  CRISPR gRNA sequence
ctgcttaacgtaactgtaag

SEQ ID NO: 590533 - DNA, 20 bp, Artificial
  CRISPR gRNA sequence
gtaactgtaagaggcttgtg

SEQ ID NO: 590534 - DNA, 20 bp, Artificial
  CRISPR gRNA sequence
tgtgaaattatctttttaat

SEQ ID NO: 590535 - DNA, 20 bp, Artificial
  CRISPR gRNA sequence
tgaaattatctttttaataa

SEQ ID NO: 590536 - DNA, 20 bp, Artificial
  CRISPR gRNA sequence
aattatctttttaataagag

SEQ ID NO: 590537 - DNA, 20 bp, Artificial
  CRISPR gRNA sequence
attcttaacctaacttctgt

SEQ ID NO: 590538 - DNA, 20 bp, Artificial
  CRISPR gRNA sequence
cttaacctaacttctgtaag

SEQ ID NO: 590539 - DNA, 20 bp, Artificial
  CRISPR gRNA sequence
cttctgtaagaagtaaaatc

SEQ ID NO: 590540 - DNA, 20 bp, Artificial
  CRISPR gRNA sequence
gtaagaagtaaaatccagct

SEQ ID NO: 590541 - DNA, 20 bp, Artificial
  CRISPR gRNA sequence
agaagtaaaatccagctgag

SEQ ID NO: 590542 - DNA, 20 bp, Artificial
  CRISPR gRNA sequence
gaagtaaaatccagctgagt

SEQ ID NO: 590543 - DNA, 20 bp, Artificial
  CRISPR gRNA sequence
gctgagtgggtatgttccca

SEQ ID NO: 590544 - DNA, 20 bp, Artificial
  CRISPR gRNA sequence
ctgagtgggtatgttcccaa

SEQ ID NO: 590545 - DNA, 20 bp, Artificial
  CRISPR gRNA sequence
tgagtgggtatgttcccaaa

SEQ ID NO: 590546 - DNA, 20 bp, Artificial
  CRISPR gRNA sequence
atgttcccaaagggacccac

SEQ ID NO: 590547 - DNA, 20 bp, Artificial
  CRISPR gRNA sequence
tgttcccaaagggacccaca

SEQ ID NO: 590548 - DNA, 20 bp, Artificial
  CRISPR gRNA sequence
aagggacccacaaggattcc

SEQ ID NO: 590549 - DNA, 20 bp, Artificial
  CRISPR gRNA sequence
gggacccacaaggattccca

SEQ ID NO: 590550 - DNA, 20 bp, Artificial
  CRISPR gRNA sequence
ggacccacaaggattcccag

SEQ ID NO: 590551 - DNA, 20 bp, Artificial
  CRISPR gRNA sequence
aaggattcccagaggtcact

SEQ ID NO: 590552 - DNA, 20 bp, Artificial
  CRISPR gRNA sequence
aggattcccagaggtcacta

SEQ ID NO: 590553 - DNA, 20 bp, Artificial
  CRISPR gRNA sequence
gtcactaaggacgcttaaac

SEQ ID NO: 590554 - DNA, 20 bp, Artificial
  CRISPR gRNA sequence
tcactaaggacgcttaaaca

SEQ ID NO: 590555 - DNA, 20 bp, Artificial
  CRISPR gRNA sequence
taaggacgcttaaacaaggt

SEQ ID NO: 590556 - DNA, 20 bp, Artificial
  CRISPR gRNA sequence
ggacgcttaaacaaggtcag

SEQ ID NO: 590557 - DNA, 20 bp, Artificial
  CRISPR gRNA sequence
gacgcttaaacaaggtcaga

SEQ ID NO: 590558 - DNA, 20 bp, Artificial
  CRISPR gRNA sequence
cttaaacaaggtcagaaggc

SEQ ID NO: 590559 - DNA, 20 bp, Artificial
  CRISPR gRNA sequence
ttaaacaaggtcagaaggca

SEQ ID NO: 590560 - DNA, 20 bp, Artificial
  CRISPR gRNA sequence
aggtcagaaggcaaggctgc

SEQ ID NO: 590561 - DNA, 20 bp, Artificial
  CRISPR gRNA sequence
tcagaaggcaaggctgctgg

SEQ ID NO: 590562 - DNA, 20 bp, Artificial
  CRISPR gRNA sequence
caaggctgctggcggctcaa

SEQ ID NO: 590563 - DNA, 20 bp, Artificial
  CRISPR gRNA sequence
gctgctggcggctcaacaga

SEQ ID NO: 590564 - DNA, 20 bp, Artificial
  CRISPR gRNA sequence
tgctggcggctcaacagaaa

SEQ ID NO: 590565 - DNA, 20 bp, Artificial
  CRISPR gRNA sequence
gcggctcaacagaaagagat

SEQ ID NO: 590566 - DNA, 20 bp, Artificial
  CRISPR gRNA sequence
cggctcaacagaaagagata

SEQ ID NO: 590567 - DNA, 20 bp, Artificial
  CRISPR gRNA sequence
ctcaacagaaagagataagg

SEQ ID NO: 590568 - DNA, 20 bp, Artificial
  CRISPR gRNA sequence
caacagaaagagataaggaa

SEQ ID NO: 590569 - DNA, 20 bp, Artificial
  CRISPR gRNA sequence
acagaaagagataaggaaga

SEQ ID NO: 590570 - DNA, 20 bp, Artificial
  CRISPR gRNA sequence
gaaagagataaggaagagag

SEQ ID NO: 590571 - DNA, 20 bp, Artificial
  CRISPR gRNA sequence
aaagagataaggaagagagc

SEQ ID NO: 590572 - DNA, 20 bp, Artificial
  CRISPR gRNA sequence
gagagcaggatttctatcac

SEQ ID NO: 590573 - DNA, 20 bp, Artificial
  CRISPR gRNA sequence
agagcaggatttctatcact

SEQ ID NO: 590574 - DNA, 20 bp, Artificial
  CRISPR gRNA sequence
ggatttctatcactgggcaa

SEQ ID NO: 590575 - DNA, 20 bp, Artificial
  CRISPR gRNA sequence
ctatcactgggcaacggcaa

SEQ ID NO: 590576 - DNA, 20 bp, Artificial
  CRISPR gRNA sequence
atcactgggcaacggcaaca

SEQ ID NO: 590577 - DNA, 20 bp, Artificial
  CRISPR gRNA sequence
tcactgggcaacggcaacag

SEQ ID NO: 590578 - DNA, 20 bp, Artificial
  CRISPR gRNA sequence
cactgggcaacggcaacaga

SEQ ID NO: 590579 - DNA, 20 bp, Artificial
  CRISPR gRNA sequence
ctgggcaacggcaacagagg

SEQ ID NO: 590580 - DNA, 20 bp, Artificial
  CRISPR gRNA sequence
tgggcaacggcaacagaggg

SEQ ID NO: 590581 - DNA, 20 bp, Artificial
  CRISPR gRNA sequence
gggcaacggcaacagaggga

SEQ ID NO: 590582 - DNA, 20 bp, Artificial
  CRISPR gRNA sequence
gcaacggcaacagagggagg

SEQ ID NO: 590583 - DNA, 20 bp, Artificial
  CRISPR gRNA sequence
caacggcaacagagggaggg

SEQ ID NO: 590584 - DNA, 20 bp, Artificial
  CRISPR gRNA sequence
acggcaacagagggagggag

SEQ ID NO: 590585 - DNA, 20 bp, Artificial
  CRISPR gRNA sequence
acagagggagggaggagcca

SEQ ID NO: 590586 - DNA, 20 bp, Artificial
  CRISPR gRNA sequence
gagggagggaggagccaaag

SEQ ID NO: 590587 - DNA, 20 bp, Artificial
  CRISPR gRNA sequence
caaagcagtgcaacacactt

SEQ ID NO: 590588 - DNA, 20 bp, Artificial
  CRISPR gRNA sequence
agcagtgcaacacacttcag

SEQ ID NO: 590589 - DNA, 20 bp, Artificial
  CRISPR gRNA sequence
acacacttcagcagctttac

SEQ ID NO: 590590 - DNA, 20 bp, Artificial
  CRISPR gRNA sequence
cacacttcagcagctttacc

SEQ ID NO: 590591 - DNA, 20 bp, Artificial
  CRISPR gRNA sequence
gcagctttaccgggtctctg

SEQ ID NO: 590592 - DNA, 20 bp, Artificial
  CRISPR gRNA sequence
tttaccgggtctctgaagtg

SEQ ID NO: 590593 - DNA, 20 bp, Artificial
  CRISPR gRNA sequence
gggtctctgaagtgaagcaa

SEQ ID NO: 590594 - DNA, 20 bp, Artificial
  CRISPR gRNA sequence
ggtctctgaagtgaagcaac

SEQ ID NO: 590595 - DNA, 20 bp, Artificial
  CRISPR gRNA sequence
gtctctgaagtgaagcaaca

SEQ ID NO: 590596 - DNA, 20 bp, Artificial
  CRISPR gRNA sequence
tctctgaagtgaagcaacag

SEQ ID NO: 590597 - DNA, 20 bp, Artificial
  CRISPR gRNA sequence
gaagcaacaggggaacccaa

SEQ ID NO: 590598 - DNA, 20 bp, Artificial
  CRISPR gRNA sequence
aagcaacaggggaacccaac

SEQ ID NO: 590599 - DNA, 20 bp, Artificial
  CRISPR gRNA sequence
cccaacaggtttccataccc

SEQ ID NO: 590600 - DNA, 20 bp, Artificial
  CRISPR gRNA sequence
ccaacaggtttccatacccc

SEQ ID NO: 590601 - DNA, 20 bp, Artificial
  CRISPR gRNA sequence
accccaggttcaaacatccc

SEQ ID NO: 590602 - DNA, 20 bp, Artificial
  CRISPR gRNA sequence
ccccaggttcaaacatccct

SEQ ID NO: 590603 - DNA, 20 bp, Artificial
  CRISPR gRNA sequence
gggtcatacacattgacatc

SEQ ID NO: 590604 - DNA, 20 bp, Artificial
  CRISPR gRNA sequence
ggtcatacacattgacatcg

SEQ ID NO: 590605 - DNA, 20 bp, Artificial
  CRISPR gRNA sequence
cattgacatcgaggctacaa

SEQ ID NO: 590606 - DNA, 20 bp, Artificial
  CRISPR gRNA sequence
ttccataaacactgtactac

SEQ ID NO: 590607 - DNA, 20 bp, Artificial
  CRISPR gRNA sequence
aaacactgtactactggtct

SEQ ID NO: 590608 - DNA, 20 bp, Artificial
  CRISPR gRNA sequence
actggtctgagtcaaataaa

SEQ ID NO: 590609 - DNA, 20 bp, Artificial
  CRISPR gRNA sequence
tggtctgagtcaaataaaca

SEQ ID NO: 590610 - DNA, 20 bp, Artificial
  CRISPR gRNA sequence
aaataaacagagtctgcatt

SEQ ID NO: 590611 - DNA, 20 bp, Artificial
  CRISPR gRNA sequence
cagagtctgcatttggccct

SEQ ID NO: 590612 - DNA, 20 bp, Artificial
  CRISPR gRNA sequence
ctgcatttggccctcagatg

SEQ ID NO: 590613 - DNA, 20 bp, Artificial
  CRISPR gRNA sequence
tgcatttggccctcagatgc

SEQ ID NO: 590614 - DNA, 20 bp, Artificial
  CRISPR gRNA sequence
ttggccctcagatgcaggat

SEQ ID NO: 590615 - DNA, 20 bp, Artificial
  CRISPR gRNA sequence
ccctcagatgcaggattggt

SEQ ID NO: 590616 - DNA, 20 bp, Artificial
  CRISPR gRNA sequence
cagatgcaggattggtcagt

SEQ ID NO: 590617 - DNA, 20 bp, Artificial
  CRISPR gRNA sequence
gtcagttagaaattaataac

SEQ ID NO: 590618 - DNA, 20 bp, Artificial
  CRISPR gRNA sequence
gttagaaattaataaccagt

SEQ ID NO: 590619 - DNA, 20 bp, Artificial
  CRISPR gRNA sequence
aataaccagtaagatctatc

SEQ ID NO: 590620 - DNA, 20 bp, Artificial
  CRISPR gRNA sequence
aaccagtaagatctatcaag

SEQ ID NO: 590621 - DNA, 20 bp, Artificial
  CRISPR gRNA sequence
agtaagatctatcaagtagt

SEQ ID NO: 590622 - DNA, 20 bp, Artificial
  CRISPR gRNA sequence
agatctatcaagtagtgaga

SEQ ID NO: 590623 - DNA, 20 bp, Artificial
  CRISPR gRNA sequence
atctatcaagtagtgagaaa

SEQ ID NO: 590624 - DNA, 20 bp, Artificial
  CRISPR gRNA sequence
agtgagaaagagaaaacttg

SEQ ID NO: 590625 - DNA, 20 bp, Artificial
  CRISPR gRNA sequence
agagaaaacttgtggtgatt

SEQ ID NO: 590626 - DNA, 20 bp, Artificial
  CRISPR gRNA sequence
gagaaaacttgtggtgatta

SEQ ID NO: 590627 - DNA, 20 bp, Artificial
  CRISPR gRNA sequence
agaaaacttgtggtgattaa

SEQ ID NO: 590628 - DNA, 20 bp, Artificial
  CRISPR gRNA sequence
gaaaacttgtggtgattaag

SEQ ID NO: 590629 - DNA, 20 bp, Artificial
  CRISPR gRNA sequence
gtggtgattaaggggaatta

SEQ ID NO: 590630 - DNA, 20 bp, Artificial
  CRISPR gRNA sequence
ggaattaaagcaatttttga

SEQ ID NO: 590631 - DNA, 20 bp, Artificial
  CRISPR gRNA sequence
taaagcaatttttgacagat

SEQ ID NO: 590632 - DNA, 20 bp, Artificial
  CRISPR gRNA sequence
aatttttgacagatcagtgc

SEQ ID NO: 590633 - DNA, 20 bp, Artificial
  CRISPR gRNA sequence
gatacttattttccacaatg

SEQ ID NO: 590634 - DNA, 20 bp, Artificial
  CRISPR gRNA sequence
acttattttccacaatgtag

SEQ ID NO: 590635 - DNA, 20 bp, Artificial
  CRISPR gRNA sequence
tattttccacaatgtagcag

SEQ ID NO: 590636 - DNA, 20 bp, Artificial
  CRISPR gRNA sequence
tttccacaatgtagcagcag

SEQ ID NO: 590637 - DNA, 20 bp, Artificial
  CRISPR gRNA sequence
ttctttacaatgctcatacc

SEQ ID NO: 590638 - DNA, 20 bp, Artificial
  CRISPR gRNA sequence
tctactcctaatgaatgaat

SEQ ID NO: 590639 - DNA, 20 bp, Artificial
  CRISPR gRNA sequence
aatgaatgaatgagcatttt

SEQ ID NO: 590640 - DNA, 20 bp, Artificial
  CRISPR gRNA sequence
gaatgaatgagcattttaag

SEQ ID NO: 590641 - DNA, 20 bp, Artificial
  CRISPR gRNA sequence
aatgaatgagcattttaagt

SEQ ID NO: 590642 - DNA, 20 bp, Artificial
  CRISPR gRNA sequence
gagcattttaagtaggatta

SEQ ID NO: 590643 - DNA, 20 bp, Artificial
  CRISPR gRNA sequence
ttacagaatgcatataatta

SEQ ID NO: 590644 - DNA, 20 bp, Artificial
  CRISPR gRNA sequence
tacagaatgcatataattaa

SEQ ID NO: 590645 - DNA, 20 bp, Artificial
  CRISPR gRNA sequence
taaaggcaaaaacatttaca

SEQ ID NO: 590646 - DNA, 20 bp, Artificial
  CRISPR gRNA sequence
catttacaaagcatcctatg

SEQ ID NO: 590647 - DNA, 20 bp, Artificial
  CRISPR gRNA sequence
cctatgaagtatttaaatca

SEQ ID NO: 590648 - DNA, 20 bp, Artificial
  CRISPR gRNA sequence
tatttaaatcatggaaatac

SEQ ID NO: 590649 - DNA, 20 bp, Artificial
  CRISPR gRNA sequence
atgcttacttatataaatgt

SEQ ID NO: 590650 - DNA, 20 bp, Artificial
  CRISPR gRNA sequence
cttacttatataaatgttgg

SEQ ID NO: 590651 - DNA, 20 bp, Artificial
  CRISPR gRNA sequence
aaatgttggaagccacttgc

SEQ ID NO: 590652 - DNA, 20 bp, Artificial
  CRISPR gRNA sequence
tccctgcttcctactgtatg

SEQ ID NO: 590653 - DNA, 20 bp, Artificial
  CRISPR gRNA sequence
gcttcctactgtatgaagtg

SEQ ID NO: 590654 - DNA, 20 bp, Artificial
  CRISPR gRNA sequence
tcctctacattaaaactgtg

SEQ ID NO: 590655 - DNA, 20 bp, Artificial
  CRISPR gRNA sequence
tacattaaaactgtgaagac

SEQ ID NO: 590656 - DNA, 20 bp, Artificial
  CRISPR gRNA sequence
taaaactgtgaagactggaa

SEQ ID NO: 590657 - DNA, 20 bp, Artificial
  CRISPR gRNA sequence
gaaaagcatgcaatcactta

SEQ ID NO: 590658 - DNA, 20 bp, Artificial
  CRISPR gRNA sequence
agcatgcaatcacttaaagc

SEQ ID NO: 590659 - DNA, 20 bp, Artificial
  CRISPR gRNA sequence
atcacttaaagcaagcaaca

SEQ ID NO: 590660 - DNA, 20 bp, Artificial
  CRISPR gRNA sequence
aagcaagcaacatagccctg

SEQ ID NO: 590661 - DNA, 20 bp, Artificial
  CRISPR gRNA sequence
gcaacatagccctgtggtta

SEQ ID NO: 590662 - DNA, 20 bp, Artificial
  CRISPR gRNA sequence
aacatagccctgtggttaaa

SEQ ID NO: 590663 - DNA, 20 bp, Artificial
  CRISPR gRNA sequence
tagccctgtggttaaagagc

SEQ ID NO: 590664 - DNA, 20 bp, Artificial
  CRISPR gRNA sequence
agccctgtggttaaagagca

SEQ ID NO: 590665 - DNA, 20 bp, Artificial
  CRISPR gRNA sequence
gccctgtggttaaagagcaa

SEQ ID NO: 590666 - DNA, 20 bp, Artificial
  CRISPR gRNA sequence
tggttaaagagcaagggctc

SEQ ID NO: 590667 - DNA, 20 bp, Artificial
  CRISPR gRNA sequence
ggttaaagagcaagggctct

SEQ ID NO: 590668 - DNA, 20 bp, Artificial
  CRISPR gRNA sequence
aagagcaagggctctaggtc

SEQ ID NO: 590669 - DNA, 20 bp, Artificial
  CRISPR gRNA sequence
gggctctaggtccagcaccc

SEQ ID NO: 590670 - DNA, 20 bp, Artificial
  CRISPR gRNA sequence
gctctaggtccagcaccctg

SEQ ID NO: 590671 - DNA, 20 bp, Artificial
  CRISPR gRNA sequence
ggtccagcaccctggagttt

SEQ ID NO: 590672 - DNA, 20 bp, Artificial
  CRISPR gRNA sequence
gtccagcaccctggagttta

SEQ ID NO: 590673 - DNA, 20 bp, Artificial
  CRISPR gRNA sequence
agcaccctggagtttaaggc

SEQ ID NO: 590674 - DNA, 20 bp, Artificial
  CRISPR gRNA sequence
gcaccctggagtttaaggcc

SEQ ID NO: 590675 - DNA, 20 bp, Artificial
  CRISPR gRNA sequence
ggccaggttcgttcatttat

SEQ ID NO: 590676 - DNA, 20 bp, Artificial
  CRISPR gRNA sequence
atttataagtcacatgacct

SEQ ID NO: 590677 - DNA, 20 bp, Artificial
  CRISPR gRNA sequence
tttataagtcacatgacctt

SEQ ID NO: 590678 - DNA, 20 bp, Artificial
  CRISPR gRNA sequence
cacatgaccttaggaaacct

SEQ ID NO: 590679 - DNA, 20 bp, Artificial
  CRISPR gRNA sequence
taaaatcaaaataatgacaa

SEQ ID NO: 590680 - DNA, 20 bp, Artificial
  CRISPR gRNA sequence
taatgacaacagctgcctcc

SEQ ID NO: 590681 - DNA, 20 bp, Artificial
  CRISPR gRNA sequence
aatgacaacagctgcctcct

SEQ ID NO: 590682 - DNA, 20 bp, Artificial
  CRISPR gRNA sequence
atgacaacagctgcctccta

SEQ ID NO: 590683 - DNA, 20 bp, Artificial
  CRISPR gRNA sequence
ctgcctcctagggttgtcct

SEQ ID NO: 590684 - DNA, 20 bp, Artificial
  CRISPR gRNA sequence
aattgtataaacaatacact

SEQ ID NO: 590685 - DNA, 20 bp, Artificial
  CRISPR gRNA sequence
ttattaatatatctatgtga

SEQ ID NO: 590686 - DNA, 20 bp, Artificial
  CRISPR gRNA sequence
tctatgtgaaagcatttcat

SEQ ID NO: 590687 - DNA, 20 bp, Artificial
  CRISPR gRNA sequence
acatcaaacaaacataaatc

SEQ ID NO: 590688 - DNA, 20 bp, Artificial
  CRISPR gRNA sequence
catcaaacaaacataaatct

SEQ ID NO: 590689 - DNA, 20 bp, Artificial
  CRISPR gRNA sequence
atcaaacaaacataaatctg

SEQ ID NO: 590690 - DNA, 20 bp, Artificial
  CRISPR gRNA sequence
ctggggttatgtttactaca

SEQ ID NO: 590691 - DNA, 20 bp, Artificial
  CRISPR gRNA sequence
gggttatgtttactacatgg

SEQ ID NO: 590692 - DNA, 20 bp, Artificial
  CRISPR gRNA sequence
atgtttactacatggaagta

SEQ ID NO: 590693 - DNA, 20 bp, Artificial
  CRISPR gRNA sequence
tgtttactacatggaagtac

SEQ ID NO: 590694 - DNA, 20 bp, Artificial
  CRISPR gRNA sequence
gtttactacatggaagtaca

SEQ ID NO: 590695 - DNA, 20 bp, Artificial
  CRISPR gRNA sequence
tactacatggaagtacaggg

SEQ ID NO: 590696 - DNA, 20 bp, Artificial
  CRISPR gRNA sequence
atggaagtacagggaagatg

SEQ ID NO: 590697 - DNA, 20 bp, Artificial
  CRISPR gRNA sequence
gaagtacagggaagatgcag

SEQ ID NO: 590698 - DNA, 20 bp, Artificial
  CRISPR gRNA sequence
aagtacagggaagatgcaga

SEQ ID NO: 590699 - DNA, 20 bp, Artificial
  CRISPR gRNA sequence
aagatgcagaaggctttatg

SEQ ID NO: 590700 - DNA, 20 bp, Artificial
  CRISPR gRNA sequence
agatgcagaaggctttatga

SEQ ID NO: 590701 - DNA, 20 bp, Artificial
  CRISPR gRNA sequence
agaaggctttatgaaggaaa

SEQ ID NO: 590702 - DNA, 20 bp, Artificial
  CRISPR gRNA sequence
gaaggaaatggcatgtaaaa

SEQ ID NO: 590703 - DNA, 20 bp, Artificial
  CRISPR gRNA sequence
ggcatgtaaaatagtactaa

SEQ ID NO: 590704 - DNA, 20 bp, Artificial
  CRISPR gRNA sequence
tgtaaaatagtactaaaagt

SEQ ID NO: 590705 - DNA, 20 bp, Artificial
  CRISPR gRNA sequence
gttggatatgacttatataa

SEQ ID NO: 590706 - DNA, 20 bp, Artificial
  CRISPR gRNA sequence
ggatatgacttatataaaag

SEQ ID NO: 590707 - DNA, 20 bp, Artificial
  CRISPR gRNA sequence
gacttatataaaagaagaac

SEQ ID NO: 590708 - DNA, 20 bp, Artificial
  CRISPR gRNA sequence
tatataaaagaagaactaga

SEQ ID NO: 590709 - DNA, 20 bp, Artificial
  CRISPR gRNA sequence
agaagaactagatggcactc

SEQ ID NO: 590710 - DNA, 20 bp, Artificial
  CRISPR gRNA sequence
gaactagatggcactcaaga

SEQ ID NO: 590711 - DNA, 20 bp, Artificial
  CRISPR gRNA sequence
aactagatggcactcaagat

SEQ ID NO: 590712 - DNA, 20 bp, Artificial
  CRISPR gRNA sequence
actagatggcactcaagata

SEQ ID NO: 590713 - DNA, 20 bp, Artificial
  CRISPR gRNA sequence
ctagatggcactcaagatag

SEQ ID NO: 590714 - DNA, 20 bp, Artificial
  CRISPR gRNA sequence
atggcactcaagataggggc

SEQ ID NO: 590715 - DNA, 20 bp, Artificial
  CRISPR gRNA sequence
tcaagataggggcaagcatg

SEQ ID NO: 590716 - DNA, 20 bp, Artificial
  CRISPR gRNA sequence
aagataggggcaagcatgaa

SEQ ID NO: 590717 - DNA, 20 bp, Artificial
  CRISPR gRNA sequence
gataggggcaagcatgaaga

SEQ ID NO: 590718 - DNA, 20 bp, Artificial
  CRISPR gRNA sequence
ataggggcaagcatgaagag

SEQ ID NO: 590719 - DNA, 20 bp, Artificial
  CRISPR gRNA sequence
gcaagcatgaagagaggaaa

SEQ ID NO: 590720 - DNA, 20 bp, Artificial
  CRISPR gRNA sequence
caagcatgaagagaggaaaa

SEQ ID NO: 590721 - DNA, 20 bp, Artificial
  CRISPR gRNA sequence
tgaagagaggaaaaaggcat

SEQ ID NO: 590722 - DNA, 20 bp, Artificial
  CRISPR gRNA sequence
aaaaaggcatgagtacatgt

SEQ ID NO: 590723 - DNA, 20 bp, Artificial
  CRISPR gRNA sequence
gtgaatgacaccattttttc

SEQ ID NO: 590724 - DNA, 20 bp, Artificial
  CRISPR gRNA sequence
tgacaccattttttccagaa

SEQ ID NO: 590725 - DNA, 20 bp, Artificial
  CRISPR gRNA sequence
tccagaatggatacactcaa

SEQ ID NO: 590726 - DNA, 20 bp, Artificial
  CRISPR gRNA sequence
actcaatggataatatacaa

SEQ ID NO: 590727 - DNA, 20 bp, Artificial
  CRISPR gRNA sequence
tagaacatatcctaaaacca

SEQ ID NO: 590728 - DNA, 20 bp, Artificial
  CRISPR gRNA sequence
gaacatatcctaaaaccaca

SEQ ID NO: 590729 - DNA, 20 bp, Artificial
  CRISPR gRNA sequence
accacagagcatttaaaatt

SEQ ID NO: 590730 - DNA, 20 bp, Artificial
  CRISPR gRNA sequence
agagcatttaaaattgagca

SEQ ID NO: 590731 - DNA, 20 bp, Artificial
  CRISPR gRNA sequence
tttaaaattgagcaaagtac

SEQ ID NO: 590732 - DNA, 20 bp, Artificial
  CRISPR gRNA sequence
taaaattgagcaaagtacaa

SEQ ID NO: 590733 - DNA, 20 bp, Artificial
  CRISPR gRNA sequence
caagagaattaatgcttgaa

SEQ ID NO: 590734 - DNA, 20 bp, Artificial
  CRISPR gRNA sequence
gagaattaatgcttgaatgg

SEQ ID NO: 590735 - DNA, 20 bp, Artificial
  CRISPR gRNA sequence
ttgaatggcagtaatttcaa

SEQ ID NO: 590736 - DNA, 20 bp, Artificial
  CRISPR gRNA sequence
aaatgctgttaacttattaa

SEQ ID NO: 590737 - DNA, 20 bp, Artificial
  CRISPR gRNA sequence
aatgctgttaacttattaat

SEQ ID NO: 590738 - DNA, 20 bp, Artificial
  CRISPR gRNA sequence
aacttattaataggacaacc

SEQ ID NO: 590739 - DNA, 20 bp, Artificial
  CRISPR gRNA sequence
taataggacaaccaagtatg

SEQ ID NO: 590740 - DNA, 20 bp, Artificial
  CRISPR gRNA sequence
accaagtatgaagaactctt

SEQ ID NO: 590741 - DNA, 20 bp, Artificial
  CRISPR gRNA sequence
atcattcaaaattactcact

SEQ ID NO: 590742 - DNA, 20 bp, Artificial
  CRISPR gRNA sequence
actgagcacctgctctgtac

SEQ ID NO: 590743 - DNA, 20 bp, Artificial
  CRISPR gRNA sequence
ctgagcacctgctctgtacc

SEQ ID NO: 590744 - DNA, 20 bp, Artificial
  CRISPR gRNA sequence
gctctgtaccaggcaccacg

SEQ ID NO: 590745 - DNA, 20 bp, Artificial
  CRISPR gRNA sequence
ctgtaccaggcaccacgaag

SEQ ID NO: 590746 - DNA, 20 bp, Artificial
  CRISPR gRNA sequence
taccaggcaccacgaagcag

SEQ ID NO: 590747 - DNA, 20 bp, Artificial
  CRISPR gRNA sequence
accacgaagcagtagtgaac

SEQ ID NO: 590748 - DNA, 20 bp, Artificial
  CRISPR gRNA sequence
cgaagcagtagtgaacaaga

SEQ ID NO: 590749 - DNA, 20 bp, Artificial
  CRISPR gRNA sequence
agatacattccctgctttta

SEQ ID NO: 590750 - DNA, 20 bp, Artificial
  CRISPR gRNA sequence
attccctgcttttatggcac

SEQ ID NO: 590751 - DNA, 20 bp, Artificial
  CRISPR gRNA sequence
tgcttttatggcactagtga

SEQ ID NO: 590752 - DNA, 20 bp, Artificial
  CRISPR gRNA sequence
gcttttatggcactagtgaa

SEQ ID NO: 590753 - DNA, 20 bp, Artificial
  CRISPR gRNA sequence
actagtgaaaggtatgcata

SEQ ID NO: 590754 - DNA, 20 bp, Artificial
  CRISPR gRNA sequence
gtctgtctttttatatatat

SEQ ID NO: 590755 - DNA, 20 bp, Artificial
  CRISPR gRNA sequence
tgcactgtaaaatatttaat

SEQ ID NO: 590756 - DNA, 20 bp, Artificial
  CRISPR gRNA sequence
aaatatttaatgagcaatac

SEQ ID NO: 590757 - DNA, 20 bp, Artificial
  CRISPR gRNA sequence
aatatttaatgagcaataca

SEQ ID NO: 590758 - DNA, 20 bp, Artificial
  CRISPR gRNA sequence
tgagcaatacaaggattcat

SEQ ID NO: 590759 - DNA, 20 bp, Artificial
  CRISPR gRNA sequence
taagccccacaccaccatgc

SEQ ID NO: 590760 - DNA, 20 bp, Artificial
  CRISPR gRNA sequence
caccaccatgccagaatatt

SEQ ID NO: 590761 - DNA, 20 bp, Artificial
  CRISPR gRNA sequence
attcagctactataaaacct

SEQ ID NO: 590762 - DNA, 20 bp, Artificial
  CRISPR gRNA sequence
taaaacctcagtgcaaaata

SEQ ID NO: 590763 - DNA, 20 bp, Artificial
  CRISPR gRNA sequence
aaacctcagtgcaaaatata

SEQ ID NO: 590764 - DNA, 20 bp, Artificial
  CRISPR gRNA sequence
taatcaacaaatattctcat

SEQ ID NO: 590765 - DNA, 20 bp, Artificial
  CRISPR gRNA sequence
cataagatcactaattcaaa

SEQ ID NO: 590766 - DNA, 20 bp, Artificial
  CRISPR gRNA sequence
aaaagataacttctcattgt

SEQ ID NO: 590767 - DNA, 20 bp, Artificial
  CRISPR gRNA sequence
agataacttctcattgtaag

SEQ ID NO: 590768 - DNA, 20 bp, Artificial
  CRISPR gRNA sequence
tcattgtaagtagttacttt

SEQ ID NO: 590769 - DNA, 20 bp, Artificial
  CRISPR gRNA sequence
atccttgtatttgtgaactg

SEQ ID NO: 590770 - DNA, 20 bp, Artificial
  CRISPR gRNA sequence
gtatttgtgaactgaagtct

SEQ ID NO: 590771 - DNA, 20 bp, Artificial
  CRISPR gRNA sequence
tgaagtcttggttattcaat

SEQ ID NO: 590772 - DNA, 20 bp, Artificial
  CRISPR gRNA sequence
tttctaaatcaccatttaaa

SEQ ID NO: 590773 - DNA, 20 bp, Artificial
  CRISPR gRNA sequence
accatttaaacagctttcta

SEQ ID NO: 590774 - DNA, 20 bp, Artificial
  CRISPR gRNA sequence
ctttctaaagctcataacta

SEQ ID NO: 590775 - DNA, 20 bp, Artificial
  CRISPR gRNA sequence
aaagtatgtgaaacatatta

SEQ ID NO: 590776 - DNA, 20 bp, Artificial
  CRISPR gRNA sequence
aaagtgatgactatgcacca

SEQ ID NO: 590777 - DNA, 20 bp, Artificial
  CRISPR gRNA sequence
tgatgactatgcaccataga

SEQ ID NO: 590778 - DNA, 20 bp, Artificial
  CRISPR gRNA sequence
actatgcaccatagaaagca

SEQ ID NO: 590779 - DNA, 20 bp, Artificial
  CRISPR gRNA sequence
atgcaccatagaaagcaaag

SEQ ID NO: 590780 - DNA, 20 bp, Artificial
  CRISPR gRNA sequence
accatagaaagcaaagtaga

SEQ ID NO: 590781 - DNA, 20 bp, Artificial
  CRISPR gRNA sequence
agcaaagtagacagacatat

SEQ ID NO: 590782 - DNA, 20 bp, Artificial
  CRISPR gRNA sequence
gcaaagtagacagacatata

SEQ ID NO: 590783 - DNA, 20 bp, Artificial
  CRISPR gRNA sequence
gtagacagacatataaggta

SEQ ID NO: 590784 - DNA, 20 bp, Artificial
  CRISPR gRNA sequence
agacatataaggtatagtta

SEQ ID NO: 590785 - DNA, 20 bp, Artificial
  CRISPR gRNA sequence
gacatataaggtatagttaa

SEQ ID NO: 590786 - DNA, 20 bp, Artificial
  CRISPR gRNA sequence
acatataaggtatagttaaa

SEQ ID NO: 590787 - DNA, 20 bp, Artificial
  CRISPR gRNA sequence
atagttaaagggcatataaa

SEQ ID NO: 590788 - DNA, 20 bp, Artificial
  CRISPR gRNA sequence
atgtatgatattacattaat

SEQ ID NO: 590789 - DNA, 20 bp, Artificial
  CRISPR gRNA sequence
atattacattaatcagatgt

SEQ ID NO: 590790 - DNA, 20 bp, Artificial
  CRISPR gRNA sequence
attacattaatcagatgtaa

SEQ ID NO: 590791 - DNA, 20 bp, Artificial
  CRISPR gRNA sequence
tacattaatcagatgtaaga

SEQ ID NO: 590792 - DNA, 20 bp, Artificial
  CRISPR gRNA sequence
ccatttaaaaatacttcttt

SEQ ID NO: 590793 - DNA, 20 bp, Artificial
  CRISPR gRNA sequence
ttagaatacttgatgctttc

SEQ ID NO: 590794 - DNA, 20 bp, Artificial
  CRISPR gRNA sequence
aatacttgatgctttctggt

SEQ ID NO: 590795 - DNA, 20 bp, Artificial
  CRISPR gRNA sequence
atacttgatgctttctggtc

SEQ ID NO: 590796 - DNA, 20 bp, Artificial
  CRISPR gRNA sequence
ttgatgctttctggtcaggt

SEQ ID NO: 590797 - DNA, 20 bp, Artificial
  CRISPR gRNA sequence
atgctttctggtcaggtaag

SEQ ID NO: 590798 - DNA, 20 bp, Artificial
  CRISPR gRNA sequence
agatcaaaatttatacaaac

SEQ ID NO: 590799 - DNA, 20 bp, Artificial
  CRISPR gRNA sequence
gatcaaaatttatacaaact

SEQ ID NO: 590800 - DNA, 20 bp, Artificial
  CRISPR gRNA sequence
gttttatttcttctattaac

SEQ ID NO: 590801 - DNA, 20 bp, Artificial
  CRISPR gRNA sequence
tcttctattaactggtgatt

SEQ ID NO: 590802 - DNA, 20 bp, Artificial
  CRISPR gRNA sequence
taactggtgatttagcactg

SEQ ID NO: 590803 - DNA, 20 bp, Artificial
  CRISPR gRNA sequence
aagatcacatctatgtcacc

SEQ ID NO: 590804 - DNA, 20 bp, Artificial
  CRISPR gRNA sequence
tatgtcacctggaattgtac

SEQ ID NO: 590805 - DNA, 20 bp, Artificial
  CRISPR gRNA sequence
aattgtacaagttaccttct

SEQ ID NO: 590806 - DNA, 20 bp, Artificial
  CRISPR gRNA sequence
attgtacaagttaccttcta

SEQ ID NO: 590807 - DNA, 20 bp, Artificial
  CRISPR gRNA sequence
ttgtacaagttaccttctaa

SEQ ID NO: 590808 - DNA, 20 bp, Artificial
  CRISPR gRNA sequence
tgtacaagttaccttctaag

SEQ ID NO: 590809 - DNA, 20 bp, Artificial
  CRISPR gRNA sequence
aagttaccttctaaggggct

SEQ ID NO: 590810 - DNA, 20 bp, Artificial
  CRISPR gRNA sequence
gcttccttttctgtgaaata

SEQ ID NO: 590811 - DNA, 20 bp, Artificial
  CRISPR gRNA sequence
cttccttttctgtgaaataa

SEQ ID NO: 590812 - DNA, 20 bp, Artificial
  CRISPR gRNA sequence
ggtaatgctaccgatttgtg

SEQ ID NO: 590813 - DNA, 20 bp, Artificial
  CRISPR gRNA sequence
gtaatgctaccgatttgtgc

SEQ ID NO: 590814 - DNA, 20 bp, Artificial
  CRISPR gRNA sequence
tgtgcaggtaaaatgcttaa

SEQ ID NO: 590815 - DNA, 20 bp, Artificial
  CRISPR gRNA sequence
gcttaaaagcctacctgcct

SEQ ID NO: 590816 - DNA, 20 bp, Artificial
  CRISPR gRNA sequence
cttaaaagcctacctgcctg

SEQ ID NO: 590817 - DNA, 20 bp, Artificial
  CRISPR gRNA sequence
aagcctacctgcctgaggtt

SEQ ID NO: 590818 - DNA, 20 bp, Artificial
  CRISPR gRNA sequence
agcctacctgcctgaggtta

SEQ ID NO: 590819 - DNA, 20 bp, Artificial
  CRISPR gRNA sequence
tgcctgaggttaaggatctt

SEQ ID NO: 590820 - DNA, 20 bp, Artificial
  CRISPR gRNA sequence
gcctgaggttaaggatctta

SEQ ID NO: 590821 - DNA, 20 bp, Artificial
  CRISPR gRNA sequence
cttaaggtcccttcaatcta

SEQ ID NO: 590822 - DNA, 20 bp, Artificial
  CRISPR gRNA sequence
atggtatctatctatgatta

SEQ ID NO: 590823 - DNA, 20 bp, Artificial
  CRISPR gRNA sequence
ctatgattacagaatacaac

SEQ ID NO: 590824 - DNA, 20 bp, Artificial
  CRISPR gRNA sequence
atacaaccagactattcttt

SEQ ID NO: 590825 - DNA, 20 bp, Artificial
  CRISPR gRNA sequence
taaataacaatttgtgtaat

SEQ ID NO: 590826 - DNA, 20 bp, Artificial
  CRISPR gRNA sequence
acaatttgtgtaattggtaa

SEQ ID NO: 590827 - DNA, 20 bp, Artificial
  CRISPR gRNA sequence
gtgtaattggtaatagttat

SEQ ID NO: 590828 - DNA, 20 bp, Artificial
  CRISPR gRNA sequence
tagttattggtcactattat

SEQ ID NO: 590829 - DNA, 20 bp, Artificial
  CRISPR gRNA sequence
ttggtcactattataagtaa

SEQ ID NO: 590830 - DNA, 20 bp, Artificial
  CRISPR gRNA sequence
aaatttatttatacaaaatc

SEQ ID NO: 590831 - DNA, 20 bp, Artificial
  CRISPR gRNA sequence
aatttatttatacaaaatct

SEQ ID NO: 590832 - DNA, 20 bp, Artificial
  CRISPR gRNA sequence
atttatttatacaaaatctg

SEQ ID NO: 590833 - DNA, 20 bp, Artificial
  CRISPR gRNA sequence
tttatacaaaatctggggta

SEQ ID NO: 590834 - DNA, 20 bp, Artificial
  CRISPR gRNA sequence
tggggtaaagatctaccttt

SEQ ID NO: 590835 - DNA, 20 bp, Artificial
  CRISPR gRNA sequence
gatcacatatttgaaacgtc

SEQ ID NO: 590836 - DNA, 20 bp, Artificial
  CRISPR gRNA sequence
atcacatatttgaaacgtct

SEQ ID NO: 590837 - DNA, 20 bp, Artificial
  CRISPR gRNA sequence
catgcctaattctatgtgtt

SEQ ID NO: 590838 - DNA, 20 bp, Artificial
  CRISPR gRNA sequence
atgcctaattctatgtgttc

SEQ ID NO: 590839 - DNA, 20 bp, Artificial
  CRISPR gRNA sequence
ctatgtgttcaggtgtttct

SEQ ID NO: 590840 - DNA, 20 bp, Artificial
  CRISPR gRNA sequence
tatgtgttcaggtgtttctg

SEQ ID NO: 590841 - DNA, 20 bp, Artificial
  CRISPR gRNA sequence
atgtgttcaggtgtttctga

SEQ ID NO: 590842 - DNA, 20 bp, Artificial
  CRISPR gRNA sequence
tcaggtgtttctgagggtca

SEQ ID NO: 590843 - DNA, 20 bp, Artificial
  CRISPR gRNA sequence
caggtgtttctgagggtcat

SEQ ID NO: 590844 - DNA, 20 bp, Artificial
  CRISPR gRNA sequence
tttctgagggtcataggtaa

SEQ ID NO: 590845 - DNA, 20 bp, Artificial
  CRISPR gRNA sequence
tgtacatttatacatatgca

SEQ ID NO: 590846 - DNA, 20 bp, Artificial
  CRISPR gRNA sequence
acatatgcatagtaatatac

SEQ ID NO: 590847 - DNA, 20 bp, Artificial
  CRISPR gRNA sequence
atagtaatatactggaaacc

SEQ ID NO: 590848 - DNA, 20 bp, Artificial
  CRISPR gRNA sequence
taatatactggaaacctagt

SEQ ID NO: 590849 - DNA, 20 bp, Artificial
  CRISPR gRNA sequence
aaacctagttggtatgtgtg

SEQ ID NO: 590850 - DNA, 20 bp, Artificial
  CRISPR gRNA sequence
aacctagttggtatgtgtgc

SEQ ID NO: 590851 - DNA, 20 bp, Artificial
  CRISPR gRNA sequence
tgtgcaggatgttctttatt

SEQ ID NO: 590852 - DNA, 20 bp, Artificial
  CRISPR gRNA sequence
ctttattaagcaataaatgt

SEQ ID NO: 590853 - DNA, 20 bp, Artificial
  CRISPR gRNA sequence
gcaataaatgttagctactt

SEQ ID NO: 590854 - DNA, 20 bp, Artificial
  CRISPR gRNA sequence
aatgttagctacttaagcaa

SEQ ID NO: 590855 - DNA, 20 bp, Artificial
  CRISPR gRNA sequence
ttagctacttaagcaaaaga

SEQ ID NO: 590856 - DNA, 20 bp, Artificial
  CRISPR gRNA sequence
ccatccccatgtgtttcctt

SEQ ID NO: 590857 - DNA, 20 bp, Artificial
  CRISPR gRNA sequence
tgtttccttcagttgaatgt

SEQ ID NO: 590858 - DNA, 20 bp, Artificial
  CRISPR gRNA sequence
tccttcagttgaatgttggc

SEQ ID NO: 590859 - DNA, 20 bp, Artificial
  CRISPR gRNA sequence
gttgaatgttggctagtatc

SEQ ID NO: 590860 - DNA, 20 bp, Artificial
  CRISPR gRNA sequence
ttgaatgttggctagtatcc

SEQ ID NO: 590861 - DNA, 20 bp, Artificial
  CRISPR gRNA sequence
gaatgttggctagtatccag

SEQ ID NO: 590862 - DNA, 20 bp, Artificial
  CRISPR gRNA sequence
aatgttggctagtatccagg

SEQ ID NO: 590863 - DNA, 20 bp, Artificial
  CRISPR gRNA sequence
atgttggctagtatccagga

SEQ ID NO: 590864 - DNA, 20 bp, Artificial
  CRISPR gRNA sequence
gttggctagtatccaggagg

SEQ ID NO: 590865 - DNA, 20 bp, Artificial
  CRISPR gRNA sequence
aacatactcaaaactttaaa

SEQ ID NO: 590866 - DNA, 20 bp, Artificial
  CRISPR gRNA sequence
tcaaaactttaaaaagaaaa

SEQ ID NO: 590867 - DNA, 20 bp, Artificial
  CRISPR gRNA sequence
aaactttaaaaagaaaaaag

SEQ ID NO: 590868 - DNA, 20 bp, Artificial
  CRISPR gRNA sequence
agtgctacaaccttcacaaa

SEQ ID NO: 590869 - DNA, 20 bp, Artificial
  CRISPR gRNA sequence
caaccttcacaaaaagcata

SEQ ID NO: 590870 - DNA, 20 bp, Artificial
  CRISPR gRNA sequence
ttgactcaaataatgttatg

SEQ ID NO: 590871 - DNA, 20 bp, Artificial
  CRISPR gRNA sequence
tttctctactttgtccccgt

SEQ ID NO: 590872 - DNA, 20 bp, Artificial
  CRISPR gRNA sequence
ttctctactttgtccccgtc

SEQ ID NO: 590873 - DNA, 20 bp, Artificial
  CRISPR gRNA sequence
gtgaaccctgccattatgta

SEQ ID NO: 590874 - DNA, 20 bp, Artificial
  CRISPR gRNA sequence
ctgccattatgtatggcttg

SEQ ID NO: 590875 - DNA, 20 bp, Artificial
  CRISPR gRNA sequence
atgtatggcttgcggctgtt

SEQ ID NO: 590876 - DNA, 20 bp, Artificial
  CRISPR gRNA sequence
tgtatggcttgcggctgttt

SEQ ID NO: 590877 - DNA, 20 bp, Artificial
  CRISPR gRNA sequence
tatggcttgcggctgtttgg

SEQ ID NO: 590878 - DNA, 20 bp, Artificial
  CRISPR gRNA sequence
ttgggagtttcctccccatc

SEQ ID NO: 590879 - DNA, 20 bp, Artificial
  CRISPR gRNA sequence
tgggagtttcctccccatct

SEQ ID NO: 590880 - DNA, 20 bp, Artificial
  CRISPR gRNA sequence
tttcctccccatctgggact

SEQ ID NO: 590881 - DNA, 20 bp, Artificial
  CRISPR gRNA sequence
tcctccccatctgggactaa

SEQ ID NO: 590882 - DNA, 20 bp, Artificial
  CRISPR gRNA sequence
cctccccatctgggactaag

SEQ ID NO: 590883 - DNA, 20 bp, Artificial
  CRISPR gRNA sequence
tgggactaagaggcaaattg

SEQ ID NO: 590884 - DNA, 20 bp, Artificial
  CRISPR gRNA sequence
gggactaagaggcaaattgc

SEQ ID NO: 590885 - DNA, 20 bp, Artificial
  CRISPR gRNA sequence
agaggcaaattgcaggtttc

SEQ ID NO: 590886 - DNA, 20 bp, Artificial
  CRISPR gRNA sequence
gaggcaaattgcaggtttcc

SEQ ID NO: 590887 - DNA, 20 bp, Artificial
  CRISPR gRNA sequence
aggcaaattgcaggtttcca

SEQ ID NO: 590888 - DNA, 20 bp, Artificial
  CRISPR gRNA sequence
gcaaattgcaggtttccagg

SEQ ID NO: 590889 - DNA, 20 bp, Artificial
  CRISPR gRNA sequence
caaattgcaggtttccaggg

SEQ ID NO: 590890 - DNA, 20 bp, Artificial
  CRISPR gRNA sequence
aaattgcaggtttccaggga

SEQ ID NO: 590891 - DNA, 20 bp, Artificial
  CRISPR gRNA sequence
aattgcaggtttccagggag

SEQ ID NO: 590892 - DNA, 20 bp, Artificial
  CRISPR gRNA sequence
cagggaggggaatgctgtta

SEQ ID NO: 590893 - DNA, 20 bp, Artificial
  CRISPR gRNA sequence
ggaggggaatgctgttacag

SEQ ID NO: 590894 - DNA, 20 bp, Artificial
  CRISPR gRNA sequence
gaggggaatgctgttacagt

SEQ ID NO: 590895 - DNA, 20 bp, Artificial
  CRISPR gRNA sequence
aggggaatgctgttacagta

SEQ ID NO: 590896 - DNA, 20 bp, Artificial
  CRISPR gRNA sequence
tgttacagtagggatcacct

SEQ ID NO: 590897 - DNA, 20 bp, Artificial
  CRISPR gRNA sequence
gatcacctcagcacttcaca

SEQ ID NO: 590898 - DNA, 20 bp, Artificial
  CRISPR gRNA sequence
cacttcacatggattgtgcc

SEQ ID NO: 590899 - DNA, 20 bp, Artificial
  CRISPR gRNA sequence
cacatggattgtgcctagcc

SEQ ID NO: 590900 - DNA, 20 bp, Artificial
  CRISPR gRNA sequence
tgtgcctagcctagtgatac

SEQ ID NO: 590901 - DNA, 20 bp, Artificial
  CRISPR gRNA sequence
gctaccttgatccctgtgac

SEQ ID NO: 590902 - DNA, 20 bp, Artificial
  CRISPR gRNA sequence
ccttgatccctgtgacaagc

SEQ ID NO: 590903 - DNA, 20 bp, Artificial
  CRISPR gRNA sequence
ccctgtgacaagctagccac

SEQ ID NO: 590904 - DNA, 20 bp, Artificial
  CRISPR gRNA sequence
cctgtgacaagctagccacc

SEQ ID NO: 590905 - DNA, 20 bp, Artificial
  CRISPR gRNA sequence
ctttgttactgaaattatgt

SEQ ID NO: 590906 - DNA, 20 bp, Artificial
  CRISPR gRNA sequence
tttgttactgaaattatgta

SEQ ID NO: 590907 - DNA, 20 bp, Artificial
  CRISPR gRNA sequence
actgaaattatgtaaggtat

SEQ ID NO: 590908 - DNA, 20 bp, Artificial
  CRISPR gRNA sequence
attatgtaaggtattagttt

SEQ ID NO: 590909 - DNA, 20 bp, Artificial
  CRISPR gRNA sequence
atgtaaggtattagttttag

SEQ ID NO: 590910 - DNA, 20 bp, Artificial
  CRISPR gRNA sequence
gtattagttttagaagccta

SEQ ID NO: 590911 - DNA, 20 bp, Artificial
  CRISPR gRNA sequence
ctaaagtctttgttttctca

SEQ ID NO: 590912 - DNA, 20 bp, Artificial
  CRISPR gRNA sequence
taaagtctttgttttctcaa

SEQ ID NO: 590913 - DNA, 20 bp, Artificial
  CRISPR gRNA sequence
aacatatgaataaccattaa

SEQ ID NO: 590914 - DNA, 20 bp, Artificial
  CRISPR gRNA sequence
taaaatgaatgcaattattt

SEQ ID NO: 590915 - DNA, 20 bp, Artificial
  CRISPR gRNA sequence
aaaatgaatgcaattatttc

SEQ ID NO: 590916 - DNA, 20 bp, Artificial
  CRISPR gRNA sequence
aatgaatgcaattatttcag

SEQ ID NO: 590917 - DNA, 20 bp, Artificial
  CRISPR gRNA sequence
tgcaattatttcaggagcac

SEQ ID NO: 590918 - DNA, 20 bp, Artificial
  CRISPR gRNA sequence
tttgtcactctcatcttcca

SEQ ID NO: 590919 - DNA, 20 bp, Artificial
  CRISPR gRNA sequence
actgtcttctttcacactcc

SEQ ID NO: 590920 - DNA, 20 bp, Artificial
  CRISPR gRNA sequence
gtcttctttcacactcctag

SEQ ID NO: 590921 - DNA, 20 bp, Artificial
  CRISPR gRNA sequence
tcttctttcacactcctagc

SEQ ID NO: 590922 - DNA, 20 bp, Artificial
  CRISPR gRNA sequence
ctagcaggttgcctttgttc

SEQ ID NO: 590923 - DNA, 20 bp, Artificial
  CRISPR gRNA sequence
tagcaggttgcctttgttca

SEQ ID NO: 590924 - DNA, 20 bp, Artificial
  CRISPR gRNA sequence
caggttgcctttgttcaagg

SEQ ID NO: 590925 - DNA, 20 bp, Artificial
  CRISPR gRNA sequence
aggcagcacatgcttactaa

SEQ ID NO: 590926 - DNA, 20 bp, Artificial
  CRISPR gRNA sequence
tgcttactaaaagcacctga

SEQ ID NO: 590927 - DNA, 20 bp, Artificial
  CRISPR gRNA sequence
tctttttcctctaactactg

SEQ ID NO: 590928 - DNA, 20 bp, Artificial
  CRISPR gRNA sequence
ctctaactactgtagtattc

SEQ ID NO: 590929 - DNA, 20 bp, Artificial
  CRISPR gRNA sequence
tctcactgctttaaaatgtc

SEQ ID NO: 590930 - DNA, 20 bp, Artificial
  CRISPR gRNA sequence
aaaatgtcaagctgaccact

SEQ ID NO: 590931 - DNA, 20 bp, Artificial
  CRISPR gRNA sequence
agctgaccactcagaaattc

SEQ ID NO: 590932 - DNA, 20 bp, Artificial
  CRISPR gRNA sequence
aaattcaagctatgtttctc

SEQ ID NO: 590933 - DNA, 20 bp, Artificial
  CRISPR gRNA sequence
aattcaagctatgtttctcc

SEQ ID NO: 590934 - DNA, 20 bp, Artificial
  CRISPR gRNA sequence
tcaagctatgtttctccagg

SEQ ID NO: 590935 - DNA, 20 bp, Artificial
  CRISPR gRNA sequence
caagctatgtttctccagga

SEQ ID NO: 590936 - DNA, 20 bp, Artificial
  CRISPR gRNA sequence
tccaggaaggtccaaatgat

SEQ ID NO: 590937 - DNA, 20 bp, Artificial
  CRISPR gRNA sequence
tacactgcctaacaccttca

SEQ ID NO: 590938 - DNA, 20 bp, Artificial
  CRISPR gRNA sequence
tgcctaacaccttcacagta

SEQ ID NO: 590939 - DNA, 20 bp, Artificial
  CRISPR gRNA sequence
cacagtatagcaacacctcc

SEQ ID NO: 590940 - DNA, 20 bp, Artificial
  CRISPR gRNA sequence
acagtatagcaacacctcct

SEQ ID NO: 590941 - DNA, 20 bp, Artificial
  CRISPR gRNA sequence
atagcaacacctcctgggac

SEQ ID NO: 590942 - DNA, 20 bp, Artificial
  CRISPR gRNA sequence
gaaacctaaatgaaacacaa

SEQ ID NO: 590943 - DNA, 20 bp, Artificial
  CRISPR gRNA sequence
caaaagctgcaacctgaaca

SEQ ID NO: 590944 - DNA, 20 bp, Artificial
  CRISPR gRNA sequence
agctgcaacctgaacaaagt

SEQ ID NO: 590945 - DNA, 20 bp, Artificial
  CRISPR gRNA sequence
caaagttagcaatatgtttt

SEQ ID NO: 590946 - DNA, 20 bp, Artificial
  CRISPR gRNA sequence
gttagcaatatgtttttggc

SEQ ID NO: 590947 - DNA, 20 bp, Artificial
  CRISPR gRNA sequence
tagcaatatgtttttggcaa

SEQ ID NO: 590948 - DNA, 20 bp, Artificial
  CRISPR gRNA sequence
aatatgtttttggcaagagt

SEQ ID NO: 590949 - DNA, 20 bp, Artificial
  CRISPR gRNA sequence
tttccatgatctgacactat

SEQ ID NO: 590950 - DNA, 20 bp, Artificial
  CRISPR gRNA sequence
taattttattttcttcctca

SEQ ID NO: 590951 - DNA, 20 bp, Artificial
  CRISPR gRNA sequence
ttcctcacagtgctatttct

SEQ ID NO: 590952 - DNA, 20 bp, Artificial
  CRISPR gRNA sequence
ctcacagtgctatttctaag

SEQ ID NO: 590953 - DNA, 20 bp, Artificial
  CRISPR gRNA sequence
tattgcatgactaatttacc

SEQ ID NO: 590954 - DNA, 20 bp, Artificial
  CRISPR gRNA sequence
tgcatgactaatttacctag

SEQ ID NO: 590955 - DNA, 20 bp, Artificial
  CRISPR gRNA sequence
tgactaatttacctagtggc

SEQ ID NO: 590956 - DNA, 20 bp, Artificial
  CRISPR gRNA sequence
gactaatttacctagtggca

SEQ ID NO: 590957 - DNA, 20 bp, Artificial
  CRISPR gRNA sequence
taatttacctagtggcaagg

SEQ ID NO: 590958 - DNA, 20 bp, Artificial
  CRISPR gRNA sequence
ccattattttcatgcatttt

SEQ ID NO: 590959 - DNA, 20 bp, Artificial
  CRISPR gRNA sequence
ttttcatgcattttgagatt

SEQ ID NO: 590960 - DNA, 20 bp, Artificial
  CRISPR gRNA sequence
taagtttatattcaaatgtc

SEQ ID NO: 590961 - DNA, 20 bp, Artificial
  CRISPR gRNA sequence
tctggtttgactttcacact

SEQ ID NO: 590962 - DNA, 20 bp, Artificial
  CRISPR gRNA sequence
tggtttgactttcacactca

SEQ ID NO: 590963 - DNA, 20 bp, Artificial
  CRISPR gRNA sequence
ggtttgactttcacactcag

SEQ ID NO: 590964 - DNA, 20 bp, Artificial
  CRISPR gRNA sequence
gaggaaaaaaaaattccttt

SEQ ID NO: 590965 - DNA, 20 bp, Artificial
  CRISPR gRNA sequence
tgaactaacttccttaaact

SEQ ID NO: 590966 - DNA, 20 bp, Artificial
  CRISPR gRNA sequence
gaactaacttccttaaactc

SEQ ID NO: 590967 - DNA, 20 bp, Artificial
  CRISPR gRNA sequence
ctaacttccttaaactcagg

SEQ ID NO: 590968 - DNA, 20 bp, Artificial
  CRISPR gRNA sequence
ctcaggaagctttaaacttc

SEQ ID NO: 590969 - DNA, 20 bp, Artificial
  CRISPR gRNA sequence
tttaaacttccagctgacac

SEQ ID NO: 590970 - DNA, 20 bp, Artificial
  CRISPR gRNA sequence
ccagctgacacaagaattat

SEQ ID NO: 590971 - DNA, 20 bp, Artificial
  CRISPR gRNA sequence
cacaagaattatcagtttac

SEQ ID NO: 590972 - DNA, 20 bp, Artificial
  CRISPR gRNA sequence
acaagaattatcagtttaca

SEQ ID NO: 590973 - DNA, 20 bp, Artificial
  CRISPR gRNA sequence
ttacaaggttcatatgaata

SEQ ID NO: 590974 - DNA, 20 bp, Artificial
  CRISPR gRNA sequence
tgaatacagtaaaatcctga

SEQ ID NO: 590975 - DNA, 20 bp, Artificial
  CRISPR gRNA sequence
tgatagtttttcaaataata

SEQ ID NO: 590976 - DNA, 20 bp, Artificial
  CRISPR gRNA sequence
ttcaaataatatggaaaaca

SEQ ID NO: 590977 - DNA, 20 bp, Artificial
  CRISPR gRNA sequence
tcaaataatatggaaaacac

SEQ ID NO: 590978 - DNA, 20 bp, Artificial
  CRISPR gRNA sequence
ggacatattttaactatgct

SEQ ID NO: 590979 - DNA, 20 bp, Artificial
  CRISPR gRNA sequence
attttaactatgcttagtta

SEQ ID NO: 590980 - DNA, 20 bp, Artificial
  CRISPR gRNA sequence
ttttaactatgcttagttat

SEQ ID NO: 590981 - DNA, 20 bp, Artificial
  CRISPR gRNA sequence
aactatgcttagttatggga

SEQ ID NO: 590982 - DNA, 20 bp, Artificial
  CRISPR gRNA sequence
ctatgcttagttatgggaaa

SEQ ID NO: 590983 - DNA, 20 bp, Artificial
  CRISPR gRNA sequence
ggaaagagatgcccattatt

SEQ ID NO: 590984 - DNA, 20 bp, Artificial
  CRISPR gRNA sequence
aaagagatgcccattattaa

SEQ ID NO: 590985 - DNA, 20 bp, Artificial
  CRISPR gRNA sequence
atgcccattattaagagatc

SEQ ID NO: 590986 - DNA, 20 bp, Artificial
  CRISPR gRNA sequence
cattattaagagatcaagtt

SEQ ID NO: 590987 - DNA, 20 bp, Artificial
  CRISPR gRNA sequence
tgccattatctttaactaca

SEQ ID NO: 590988 - DNA, 20 bp, Artificial
  CRISPR gRNA sequence
ctacatagcaaaattaaatt

SEQ ID NO: 590989 - DNA, 20 bp, Artificial
  CRISPR gRNA sequence
tacatagcaaaattaaatta

SEQ ID NO: 590990 - DNA, 20 bp, Artificial
  CRISPR gRNA sequence
agcaaaattaaattaaggaa

SEQ ID NO: 590991 - DNA, 20 bp, Artificial
  CRISPR gRNA sequence
aattaaggaatagaatcctg

SEQ ID NO: 590992 - DNA, 20 bp, Artificial
  CRISPR gRNA sequence
aggaatagaatcctgaagaa

SEQ ID NO: 590993 - DNA, 20 bp, Artificial
  CRISPR gRNA sequence
atcctgaagaatagctttta

SEQ ID NO: 590994 - DNA, 20 bp, Artificial
  CRISPR gRNA sequence
tgaagaatagcttttacaga

SEQ ID NO: 590995 - DNA, 20 bp, Artificial
  CRISPR gRNA sequence
gcttttacagatagaaaact

SEQ ID NO: 590996 - DNA, 20 bp, Artificial
  CRISPR gRNA sequence
ctacttacatctaatatata

SEQ ID NO: 590997 - DNA, 20 bp, Artificial
  CRISPR gRNA sequence
acttacatctaatatataaa

SEQ ID NO: 590998 - DNA, 20 bp, Artificial
  CRISPR gRNA sequence
catctaatatataaagagtg

SEQ ID NO: 590999 - DNA, 20 bp, Artificial
  CRISPR gRNA sequence
atatataaagagtgtggact

SEQ ID NO: 591000 - DNA, 20 bp, Artificial
  CRISPR gRNA sequence
tatataaagagtgtggactt

SEQ ID NO: 591001 - DNA, 20 bp, Artificial
  CRISPR gRNA sequence
ataaagagtgtggacttggg

SEQ ID NO: 591002 - DNA, 20 bp, Artificial
  CRISPR gRNA sequence
gtgtggacttgggaagtcac

SEQ ID NO: 591003 - DNA, 20 bp, Artificial
  CRISPR gRNA sequence
gaagtcactggattgtattc

SEQ ID NO: 591004 - DNA, 20 bp, Artificial
  CRISPR gRNA sequence
aagtcactggattgtattcc

SEQ ID NO: 591005 - DNA, 20 bp, Artificial
  CRISPR gRNA sequence
actggattgtattccaggat

SEQ ID NO: 591006 - DNA, 20 bp, Artificial
  CRISPR gRNA sequence
ctggattgtattccaggatc

SEQ ID NO: 591007 - DNA, 20 bp, Artificial
  CRISPR gRNA sequence
tggattgtattccaggatca

SEQ ID NO: 591008 - DNA, 20 bp, Artificial
  CRISPR gRNA sequence
tcagggaattcactgatttt

SEQ ID NO: 591009 - DNA, 20 bp, Artificial
  CRISPR gRNA sequence
cagggaattcactgattttc

SEQ ID NO: 591010 - DNA, 20 bp, Artificial
  CRISPR gRNA sequence
tcatcactttcccataataa

SEQ ID NO: 591011 - DNA, 20 bp, Artificial
  CRISPR gRNA sequence
ataataacagaaaaacaaat

SEQ ID NO: 591012 - DNA, 20 bp, Artificial
  CRISPR gRNA sequence
atttatcaaataccaattta

SEQ ID NO: 591013 - DNA, 20 bp, Artificial
  CRISPR gRNA sequence
ttatcaaataccaatttata

SEQ ID NO: 591014 - DNA, 20 bp, Artificial
  CRISPR gRNA sequence
aaataccaatttatagagta

SEQ ID NO: 591015 - DNA, 20 bp, Artificial
  CRISPR gRNA sequence
atagagtacagtatacacac

SEQ ID NO: 591016 - DNA, 20 bp, Artificial
  CRISPR gRNA sequence
tatacacactagacactgtt

SEQ ID NO: 591017 - DNA, 20 bp, Artificial
  CRISPR gRNA sequence
cactagacactgttaagtat

SEQ ID NO: 591018 - DNA, 20 bp, Artificial
  CRISPR gRNA sequence
actgttaagtattggatcta

SEQ ID NO: 591019 - DNA, 20 bp, Artificial
  CRISPR gRNA sequence
ctgttaagtattggatctat

SEQ ID NO: 591020 - DNA, 20 bp, Artificial
  CRISPR gRNA sequence
aagtattggatctataggac

SEQ ID NO: 591021 - DNA, 20 bp, Artificial
  CRISPR gRNA sequence
ttggatctataggactagac

SEQ ID NO: 591022 - DNA, 20 bp, Artificial
  CRISPR gRNA sequence
atctataggactagacaaga

SEQ ID NO: 591023 - DNA, 20 bp, Artificial
  CRISPR gRNA sequence
tctataggactagacaagac

SEQ ID NO: 591024 - DNA, 20 bp, Artificial
  CRISPR gRNA sequence
gactagacaagacaggctta

SEQ ID NO: 591025 - DNA, 20 bp, Artificial
  CRISPR gRNA sequence
gacaagacaggcttatagtc

SEQ ID NO: 591026 - DNA, 20 bp, Artificial
  CRISPR gRNA sequence
agacaggcttatagtctggt

SEQ ID NO: 591027 - DNA, 20 bp, Artificial
  CRISPR gRNA sequence
gacaggcttatagtctggtt

SEQ ID NO: 591028 - DNA, 20 bp, Artificial
  CRISPR gRNA sequence
acaggcttatagtctggttg

SEQ ID NO: 591029 - DNA, 20 bp, Artificial
  CRISPR gRNA sequence
ttatagtctggttggggata

SEQ ID NO: 591030 - DNA, 20 bp, Artificial
  CRISPR gRNA sequence
gggatacagacaaacctaac

SEQ ID NO: 591031 - DNA, 20 bp, Artificial
  CRISPR gRNA sequence
ggatacagacaaacctaaca

SEQ ID NO: 591032 - DNA, 20 bp, Artificial
  CRISPR gRNA sequence
acagacaaacctaacaaggt

SEQ ID NO: 591033 - DNA, 20 bp, Artificial
  CRISPR gRNA sequence
gacaaacctaacaaggtaag

SEQ ID NO: 591034 - DNA, 20 bp, Artificial
  CRISPR gRNA sequence
ctaacaaggtaagcagttct

SEQ ID NO: 591035 - DNA, 20 bp, Artificial
  CRISPR gRNA sequence
aaggtaagcagttctcagac

SEQ ID NO: 591036 - DNA, 20 bp, Artificial
  CRISPR gRNA sequence
aggtaagcagttctcagaca

SEQ ID NO: 591037 - DNA, 20 bp, Artificial
  CRISPR gRNA sequence
aagcagttctcagacaagga

SEQ ID NO: 591038 - DNA, 20 bp, Artificial
  CRISPR gRNA sequence
gttctcagacaaggacagta

SEQ ID NO: 591039 - DNA, 20 bp, Artificial
  CRISPR gRNA sequence
ggacagtacagaacgccaca

SEQ ID NO: 591040 - DNA, 20 bp, Artificial
  CRISPR gRNA sequence
gacagtacagaacgccacat

SEQ ID NO: 591041 - DNA, 20 bp, Artificial
  CRISPR gRNA sequence
cagtacagaacgccacatgg

SEQ ID NO: 591042 - DNA, 20 bp, Artificial
  CRISPR gRNA sequence
cagaacgccacatgggagca

SEQ ID NO: 591043 - DNA, 20 bp, Artificial
  CRISPR gRNA sequence
gccacatgggagcacggtct

SEQ ID NO: 591044 - DNA, 20 bp, Artificial
  CRISPR gRNA sequence
cacggtctcagtgcaaaata

SEQ ID NO: 591045 - DNA, 20 bp, Artificial
  CRISPR gRNA sequence
cagtgcaaaatacagtgttt

SEQ ID NO: 591046 - DNA, 20 bp, Artificial
  CRISPR gRNA sequence
gtgcaaaatacagtgtttga

SEQ ID NO: 591047 - DNA, 20 bp, Artificial
  CRISPR gRNA sequence
tgcaaaatacagtgtttgag

SEQ ID NO: 591048 - DNA, 20 bp, Artificial
  CRISPR gRNA sequence
cagtgtttgagaggaactaa

SEQ ID NO: 591049 - DNA, 20 bp, Artificial
  CRISPR gRNA sequence
agtgtttgagaggaactaaa

SEQ ID NO: 591050 - DNA, 20 bp, Artificial
  CRISPR gRNA sequence
ttgagaggaactaaaaggaa

SEQ ID NO: 591051 - DNA, 20 bp, Artificial
  CRISPR gRNA sequence
gaggaactaaaaggaaaaga

SEQ ID NO: 591052 - DNA, 20 bp, Artificial
  CRISPR gRNA sequence
aggaactaaaaggaaaagac

SEQ ID NO: 591053 - DNA, 20 bp, Artificial
  CRISPR gRNA sequence
gaactaaaaggaaaagacag

SEQ ID NO: 591054 - DNA, 20 bp, Artificial
  CRISPR gRNA sequence
actaaaaggaaaagacagga

SEQ ID NO: 591055 - DNA, 20 bp, Artificial
  CRISPR gRNA sequence
aaagacaggagagtcaacga

SEQ ID NO: 591056 - DNA, 20 bp, Artificial
  CRISPR gRNA sequence
ggagagtcaacgacggtgtc

SEQ ID NO: 591057 - DNA, 20 bp, Artificial
  CRISPR gRNA sequence
gagagtcaacgacggtgtcc

SEQ ID NO: 591058 - DNA, 20 bp, Artificial
  CRISPR gRNA sequence
gtctctcaaaataatactgc

SEQ ID NO: 591059 - DNA, 20 bp, Artificial
  CRISPR gRNA sequence
tcaaaataatactgctggaa

SEQ ID NO: 591060 - DNA, 20 bp, Artificial
  CRISPR gRNA sequence
aataatactgctggaaaaga

SEQ ID NO: 591061 - DNA, 20 bp, Artificial
  CRISPR gRNA sequence
ataatactgctggaaaagaa

SEQ ID NO: 591062 - DNA, 20 bp, Artificial
  CRISPR gRNA sequence
ctgctggaaaagaaaggttt

SEQ ID NO: 591063 - DNA, 20 bp, Artificial
  CRISPR gRNA sequence
tgctggaaaagaaaggttta

SEQ ID NO: 591064 - DNA, 20 bp, Artificial
  CRISPR gRNA sequence
agaaaggtttaaggccctta

SEQ ID NO: 591065 - DNA, 20 bp, Artificial
  CRISPR gRNA sequence
gaaaggtttaaggcccttaa

SEQ ID NO: 591066 - DNA, 20 bp, Artificial
  CRISPR gRNA sequence
ggcccttaaaggttaaaatc

SEQ ID NO: 591067 - DNA, 20 bp, Artificial
  CRISPR gRNA sequence
gcccttaaaggttaaaatcc

SEQ ID NO: 591068 - DNA, 20 bp, Artificial
  CRISPR gRNA sequence
cccttaaaggttaaaatcca

SEQ ID NO: 591069 - DNA, 20 bp, Artificial
  CRISPR gRNA sequence
aggttaaaatccagggccaa

SEQ ID NO: 591070 - DNA, 20 bp, Artificial
  CRISPR gRNA sequence
ggttaaaatccagggccaat

SEQ ID NO: 591071 - DNA, 20 bp, Artificial
  CRISPR gRNA sequence
gttaaaatccagggccaata

SEQ ID NO: 591072 - DNA, 20 bp, Artificial
  CRISPR gRNA sequence
atccagggccaatagggcca

SEQ ID NO: 591073 - DNA, 20 bp, Artificial
  CRISPR gRNA sequence
tccagggccaatagggccac

SEQ ID NO: 591074 - DNA, 20 bp, Artificial
  CRISPR gRNA sequence
cacaggaatttattattctg

SEQ ID NO: 591075 - DNA, 20 bp, Artificial
  CRISPR gRNA sequence
acaggaatttattattctgt

SEQ ID NO: 591076 - DNA, 20 bp, Artificial
  CRISPR gRNA sequence
gaatttattattctgtgggc

SEQ ID NO: 591077 - DNA, 20 bp, Artificial
  CRISPR gRNA sequence
gtgggctagttttgtgaaat

SEQ ID NO: 591078 - DNA, 20 bp, Artificial
  CRISPR gRNA sequence
ggctagttttgtgaaattgg

SEQ ID NO: 591079 - DNA, 20 bp, Artificial
  CRISPR gRNA sequence
ttttgtgaaattggtagcaa

SEQ ID NO: 591080 - DNA, 20 bp, Artificial
  CRISPR gRNA sequence
tgtgaaattggtagcaatgg

SEQ ID NO: 591081 - DNA, 20 bp, Artificial
  CRISPR gRNA sequence
gtgaaattggtagcaatgga

SEQ ID NO: 591082 - DNA, 20 bp, Artificial
  CRISPR gRNA sequence
caatggaaggaacaaatgaa

SEQ ID NO: 591083 - DNA, 20 bp, Artificial
  CRISPR gRNA sequence
atggaaggaacaaatgaaca

SEQ ID NO: 591084 - DNA, 20 bp, Artificial
  CRISPR gRNA sequence
ggaaggaacaaatgaacaga

SEQ ID NO: 591085 - DNA, 20 bp, Artificial
  CRISPR gRNA sequence
gaaggaacaaatgaacagag

SEQ ID NO: 591086 - DNA, 20 bp, Artificial
  CRISPR gRNA sequence
aaggaacaaatgaacagaga

SEQ ID NO: 591087 - DNA, 20 bp, Artificial
  CRISPR gRNA sequence
acaaatgaacagagagggaa

SEQ ID NO: 591088 - DNA, 20 bp, Artificial
  CRISPR gRNA sequence
gagggaaaagtactaacatc

SEQ ID NO: 591089 - DNA, 20 bp, Artificial
  CRISPR gRNA sequence
aaaagtactaacatctagtg

SEQ ID NO: 591090 - DNA, 20 bp, Artificial
  CRISPR gRNA sequence
aaagtactaacatctagtga

SEQ ID NO: 591091 - DNA, 20 bp, Artificial
  CRISPR gRNA sequence
acatctagtgaaggtgcatt

SEQ ID NO: 591092 - DNA, 20 bp, Artificial
  CRISPR gRNA sequence
ctagtgaaggtgcatttagt

SEQ ID NO: 591093 - DNA, 20 bp, Artificial
  CRISPR gRNA sequence
tagtgaaggtgcatttagtt

SEQ ID NO: 591094 - DNA, 20 bp, Artificial
  CRISPR gRNA sequence
agttgggcgtccttcaacat

SEQ ID NO: 591095 - DNA, 20 bp, Artificial
  CRISPR gRNA sequence
accaaacaaatctttccaat

SEQ ID NO: 591096 - DNA, 20 bp, Artificial
  CRISPR gRNA sequence
caaatctttccaataagtat

SEQ ID NO: 591097 - DNA, 20 bp, Artificial
  CRISPR gRNA sequence
attagtttcattttatacaa

SEQ ID NO: 591098 - DNA, 20 bp, Artificial
  CRISPR gRNA sequence
ttagtttcattttatacaaa

SEQ ID NO: 591099 - DNA, 20 bp, Artificial
  CRISPR gRNA sequence
gtttcattttatacaaaagg

SEQ ID NO: 591100 - DNA, 20 bp, Artificial
  CRISPR gRNA sequence
attttatacaaaaggaagct

SEQ ID NO: 591101 - DNA, 20 bp, Artificial
  CRISPR gRNA sequence
ttttatacaaaaggaagctg

SEQ ID NO: 591102 - DNA, 20 bp, Artificial
  CRISPR gRNA sequence
tacaaaaggaagctgaggat

SEQ ID NO: 591103 - DNA, 20 bp, Artificial
  CRISPR gRNA sequence
acaaaaggaagctgaggatc

SEQ ID NO: 591104 - DNA, 20 bp, Artificial
  CRISPR gRNA sequence
ataatactgtgtgtctgaac

SEQ ID NO: 591105 - DNA, 20 bp, Artificial
  CRISPR gRNA sequence
accctcattatgtatatcac

SEQ ID NO: 591106 - DNA, 20 bp, Artificial
  CRISPR gRNA sequence
atgtatatcactggctataa

SEQ ID NO: 591107 - DNA, 20 bp, Artificial
  CRISPR gRNA sequence
cactggctataaaagaaacc

SEQ ID NO: 591108 - DNA, 20 bp, Artificial
  CRISPR gRNA sequence
ggctataaaagaaaccaagt

SEQ ID NO: 591109 - DNA, 20 bp, Artificial
  CRISPR gRNA sequence
gctataaaagaaaccaagtt

SEQ ID NO: 591110 - DNA, 20 bp, Artificial
  CRISPR gRNA sequence
ctataaaagaaaccaagttg

SEQ ID NO: 591111 - DNA, 20 bp, Artificial
  CRISPR gRNA sequence
tataaaagaaaccaagttgg

SEQ ID NO: 591112 - DNA, 20 bp, Artificial
  CRISPR gRNA sequence
ggaaaatgtttctacaaata

SEQ ID NO: 591113 - DNA, 20 bp, Artificial
  CRISPR gRNA sequence
gaaaatgtttctacaaatat

SEQ ID NO: 591114 - DNA, 20 bp, Artificial
  CRISPR gRNA sequence
tctacaaatatgggaattca

SEQ ID NO: 591115 - DNA, 20 bp, Artificial
  CRISPR gRNA sequence
tcaaagtctttttccattaa

SEQ ID NO: 591116 - DNA, 20 bp, Artificial
  CRISPR gRNA sequence
caaagtctttttccattaat

SEQ ID NO: 591117 - DNA, 20 bp, Artificial
  CRISPR gRNA sequence
aaagtctttttccattaatg

SEQ ID NO: 591118 - DNA, 20 bp, Artificial
  CRISPR gRNA sequence
tggggccatttatattttac

SEQ ID NO: 591119 - DNA, 20 bp, Artificial
  CRISPR gRNA sequence
ctatacaaacaaatatttat

SEQ ID NO: 591120 - DNA, 20 bp, Artificial
  CRISPR gRNA sequence
taactgatatctgaatatta

SEQ ID NO: 591121 - DNA, 20 bp, Artificial
  CRISPR gRNA sequence
tatacaacatttaaaaacac

SEQ ID NO: 591122 - DNA, 20 bp, Artificial
  CRISPR gRNA sequence
aaaacacaagctcatttact

SEQ ID NO: 591123 - DNA, 20 bp, Artificial
  CRISPR gRNA sequence
caagctcatttactaagtaa

SEQ ID NO: 591124 - DNA, 20 bp, Artificial
  CRISPR gRNA sequence
aagctcatttactaagtaat

SEQ ID NO: 591125 - DNA, 20 bp, Artificial
  CRISPR gRNA sequence
ttactaagtaataggcaaac

SEQ ID NO: 591126 - DNA, 20 bp, Artificial
  CRISPR gRNA sequence
gtgaaatgcaacaaaataaa

SEQ ID NO: 591127 - DNA, 20 bp, Artificial
  CRISPR gRNA sequence
aaaataaacagaaaaatgca

SEQ ID NO: 591128 - DNA, 20 bp, Artificial
  CRISPR gRNA sequence
agaaaaatgcaaagaatctg

SEQ ID NO: 591129 - DNA, 20 bp, Artificial
  CRISPR gRNA sequence
aaaaatgcaaagaatctgca

SEQ ID NO: 591130 - DNA, 20 bp, Artificial
  CRISPR gRNA sequence
tgcaaagaatctgcagagaa

SEQ ID NO: 591131 - DNA, 20 bp, Artificial
  CRISPR gRNA sequence
gcaaagaatctgcagagaaa

SEQ ID NO: 591132 - DNA, 20 bp, Artificial
  CRISPR gRNA sequence
gaaaaggaattgaatgtaac

SEQ ID NO: 591133 - DNA, 20 bp, Artificial
  CRISPR gRNA sequence
aggaattgaatgtaacgagt

SEQ ID NO: 591134 - DNA, 20 bp, Artificial
  CRISPR gRNA sequence
tgaatgtaacgagtgagttt

SEQ ID NO: 591135 - DNA, 20 bp, Artificial
  CRISPR gRNA sequence
taacgagtgagtttaagaac

SEQ ID NO: 591136 - DNA, 20 bp, Artificial
  CRISPR gRNA sequence
aacgagtgagtttaagaact

SEQ ID NO: 591137 - DNA, 20 bp, Artificial
  CRISPR gRNA sequence
aagaactgggcttttacgcc

SEQ ID NO: 591138 - DNA, 20 bp, Artificial
  CRISPR gRNA sequence
gggcttttacgcccggtttc

SEQ ID NO: 591139 - DNA, 20 bp, Artificial
  CRISPR gRNA sequence
ggcttttacgcccggtttca

SEQ ID NO: 591140 - DNA, 20 bp, Artificial
  CRISPR gRNA sequence
gtttcaaggtgataaaatgt

SEQ ID NO: 591141 - DNA, 20 bp, Artificial
  CRISPR gRNA sequence
cttcactcaacaaatattta

SEQ ID NO: 591142 - DNA, 20 bp, Artificial
  CRISPR gRNA sequence
ttcactcaacaaatatttat

SEQ ID NO: 591143 - DNA, 20 bp, Artificial
  CRISPR gRNA sequence
tcactcaacaaatatttatg

SEQ ID NO: 591144 - DNA, 20 bp, Artificial
  CRISPR gRNA sequence
tcaacaaatatttatggggt

SEQ ID NO: 591145 - DNA, 20 bp, Artificial
  CRISPR gRNA sequence
atggggtaagacttttgtac

SEQ ID NO: 591146 - DNA, 20 bp, Artificial
  CRISPR gRNA sequence
tttgtaccggacacactgct

SEQ ID NO: 591147 - DNA, 20 bp, Artificial
  CRISPR gRNA sequence
ggacacactgctaagcacta

SEQ ID NO: 591148 - DNA, 20 bp, Artificial
  CRISPR gRNA sequence
actgctaagcactaaagata

SEQ ID NO: 591149 - DNA, 20 bp, Artificial
  CRISPR gRNA sequence
ctaaagatacagtaacaatc

SEQ ID NO: 591150 - DNA, 20 bp, Artificial
  CRISPR gRNA sequence
atacagtaacaatcaagcca

SEQ ID NO: 591151 - DNA, 20 bp, Artificial
  CRISPR gRNA sequence
acttcatattctgtttatat

SEQ ID NO: 591152 - DNA, 20 bp, Artificial
  CRISPR gRNA sequence
cttcatattctgtttatatt

SEQ ID NO: 591153 - DNA, 20 bp, Artificial
  CRISPR gRNA sequence
catattctgtttatattagg

SEQ ID NO: 591154 - DNA, 20 bp, Artificial
  CRISPR gRNA sequence
tattctgtttatattaggtg

SEQ ID NO: 591155 - DNA, 20 bp, Artificial
  CRISPR gRNA sequence
tgtttatattaggtggagac

SEQ ID NO: 591156 - DNA, 20 bp, Artificial
  CRISPR gRNA sequence
ttatattaggtggagacaag

SEQ ID NO: 591157 - DNA, 20 bp, Artificial
  CRISPR gRNA sequence
atattaggtggagacaagaa

SEQ ID NO: 591158 - DNA, 20 bp, Artificial
  CRISPR gRNA sequence
agagatcacaatcccactac

SEQ ID NO: 591159 - DNA, 20 bp, Artificial
  CRISPR gRNA sequence
actacaagtgtctgtctgtg

SEQ ID NO: 591160 - DNA, 20 bp, Artificial
  CRISPR gRNA sequence
acaagtgtctgtctgtgtgg

SEQ ID NO: 591161 - DNA, 20 bp, Artificial
  CRISPR gRNA sequence
caagtgtctgtctgtgtgga

SEQ ID NO: 591162 - DNA, 20 bp, Artificial
  CRISPR gRNA sequence
agtgtctgtctgtgtggaag

SEQ ID NO: 591163 - DNA, 20 bp, Artificial
  CRISPR gRNA sequence
gtctgtctgtgtggaaggag

SEQ ID NO: 591164 - DNA, 20 bp, Artificial
  CRISPR gRNA sequence
tgtgtggaaggagaagtata

SEQ ID NO: 591165 - DNA, 20 bp, Artificial
  CRISPR gRNA sequence
gtgtggaaggagaagtataa

SEQ ID NO: 591166 - DNA, 20 bp, Artificial
  CRISPR gRNA sequence
gaaggagaagtataaaggca

SEQ ID NO: 591167 - DNA, 20 bp, Artificial
  CRISPR gRNA sequence
gaagtataaaggcacagaat

SEQ ID NO: 591168 - DNA, 20 bp, Artificial
  CRISPR gRNA sequence
aagtataaaggcacagaatt

SEQ ID NO: 591169 - DNA, 20 bp, Artificial
  CRISPR gRNA sequence
tataaaggcacagaattggg

SEQ ID NO: 591170 - DNA, 20 bp, Artificial
  CRISPR gRNA sequence
aaaggcacagaattgggaag

SEQ ID NO: 591171 - DNA, 20 bp, Artificial
  CRISPR gRNA sequence
gcacagaattgggaagaaga

SEQ ID NO: 591172 - DNA, 20 bp, Artificial
  CRISPR gRNA sequence
cacagaattgggaagaagaa

SEQ ID NO: 591173 - DNA, 20 bp, Artificial
  CRISPR gRNA sequence
ttgggaagaagaaaggctca

SEQ ID NO: 591174 - DNA, 20 bp, Artificial
  CRISPR gRNA sequence
ttcacttaaattcctgaact

SEQ ID NO: 591175 - DNA, 20 bp, Artificial
  CRISPR gRNA sequence
tcacttaaattcctgaacta

SEQ ID NO: 591176 - DNA, 20 bp, Artificial
  CRISPR gRNA sequence
attcctgaactaaggacttg

SEQ ID NO: 591177 - DNA, 20 bp, Artificial
  CRISPR gRNA sequence
cctaccatatatccctttat

SEQ ID NO: 591178 - DNA, 20 bp, Artificial
  CRISPR gRNA sequence
ccatatatccctttatcaga

SEQ ID NO: 591179 - DNA, 20 bp, Artificial
  CRISPR gRNA sequence
tatatccctttatcagaaag

SEQ ID NO: 591180 - DNA, 20 bp, Artificial
  CRISPR gRNA sequence
aagcagaatatttactgttg

SEQ ID NO: 591181 - DNA, 20 bp, Artificial
  CRISPR gRNA sequence
ttactgttgaagatacatgt

SEQ ID NO: 591182 - DNA, 20 bp, Artificial
  CRISPR gRNA sequence
aagatacatgtcagtatcaa

SEQ ID NO: 591183 - DNA, 20 bp, Artificial
  CRISPR gRNA sequence
agatacatgtcagtatcaac

SEQ ID NO: 591184 - DNA, 20 bp, Artificial
  CRISPR gRNA sequence
tacatgtcagtatcaacagg

SEQ ID NO: 591185 - DNA, 20 bp, Artificial
  CRISPR gRNA sequence
tagttctcactaatacttcc

SEQ ID NO: 591186 - DNA, 20 bp, Artificial
  CRISPR gRNA sequence
gtcttttttcactatgaact

SEQ ID NO: 591187 - DNA, 20 bp, Artificial
  CRISPR gRNA sequence
tgaacttagccctacaatgc

SEQ ID NO: 591188 - DNA, 20 bp, Artificial
  CRISPR gRNA sequence
cccattatattcaccatcat

SEQ ID NO: 591189 - DNA, 20 bp, Artificial
  CRISPR gRNA sequence
tattcaccatcattagatac

SEQ ID NO: 591190 - DNA, 20 bp, Artificial
  CRISPR gRNA sequence
agatacaagatcgctatgac

SEQ ID NO: 591191 - DNA, 20 bp, Artificial
  CRISPR gRNA sequence
aagatcgctatgacaagtaa

SEQ ID NO: 591192 - DNA, 20 bp, Artificial
  CRISPR gRNA sequence
tatgacaagtaatagaacat

SEQ ID NO: 591193 - DNA, 20 bp, Artificial
  CRISPR gRNA sequence
agaacattggtcaaaaataa

SEQ ID NO: 591194 - DNA, 20 bp, Artificial
  CRISPR gRNA sequence
attggtcaaaaataatagct

SEQ ID NO: 591195 - DNA, 20 bp, Artificial
  CRISPR gRNA sequence
aaatttcttcatgctgataa

SEQ ID NO: 591196 - DNA, 20 bp, Artificial
  CRISPR gRNA sequence
ttcatgctgataatagttgc

SEQ ID NO: 591197 - DNA, 20 bp, Artificial
  CRISPR gRNA sequence
tcactatgttgccatattat

SEQ ID NO: 591198 - DNA, 20 bp, Artificial
  CRISPR gRNA sequence
tcttaatgaaattcacttgt

SEQ ID NO: 591199 - DNA, 20 bp, Artificial
  CRISPR gRNA sequence
ttgtcagttctgttttgaaa

SEQ ID NO: 591200 - DNA, 20 bp, Artificial
  CRISPR gRNA sequence
tgaaacagtgaattctcgcc

SEQ ID NO: 591201 - DNA, 20 bp, Artificial
  CRISPR gRNA sequence
tgaattctcgcccagcatga

SEQ ID NO: 591202 - DNA, 20 bp, Artificial
  CRISPR gRNA sequence
gaattctcgcccagcatgac

SEQ ID NO: 591203 - DNA, 20 bp, Artificial
  CRISPR gRNA sequence
aattctcgcccagcatgaca

SEQ ID NO: 591204 - DNA, 20 bp, Artificial
  CRISPR gRNA sequence
attctcgcccagcatgacag

SEQ ID NO: 591205 - DNA, 20 bp, Artificial
  CRISPR gRNA sequence
ttttctcttcccaatcaaat

SEQ ID NO: 591206 - DNA, 20 bp, Artificial
  CRISPR gRNA sequence
atcagctaacgatgaaatat

SEQ ID NO: 591207 - DNA, 20 bp, Artificial
  CRISPR gRNA sequence
gctaacgatgaaatataaga

SEQ ID NO: 591208 - DNA, 20 bp, Artificial
  CRISPR gRNA sequence
ctaacgatgaaatataagaa

SEQ ID NO: 591209 - DNA, 20 bp, Artificial
  CRISPR gRNA sequence
aacgatgaaatataagaaag

SEQ ID NO: 591210 - DNA, 20 bp, Artificial
  CRISPR gRNA sequence
aatataagaaaggagtaact

SEQ ID NO: 591211 - DNA, 20 bp, Artificial
  CRISPR gRNA sequence
cggaaatttctgtcactaat

SEQ ID NO: 591212 - DNA, 20 bp, Artificial
  CRISPR gRNA sequence
gtcactaattggtcaaaaaa

SEQ ID NO: 591213 - DNA, 20 bp, Artificial
  CRISPR gRNA sequence
taattggtcaaaaaaaagat

SEQ ID NO: 591214 - DNA, 20 bp, Artificial
  CRISPR gRNA sequence
tcaaaaaaaagattagtttt

SEQ ID NO: 591215 - DNA, 20 bp, Artificial
  CRISPR gRNA sequence
atgatctccctaaatgttac

SEQ ID NO: 591216 - DNA, 20 bp, Artificial
  CRISPR gRNA sequence
tctccctaaatgttactagt

SEQ ID NO: 591217 - DNA, 20 bp, Artificial
  CRISPR gRNA sequence
ttaaaaactcattttgtcgc

SEQ ID NO: 591218 - DNA, 20 bp, Artificial
  CRISPR gRNA sequence
ttgtcgccagcaaatatatt

SEQ ID NO: 591219 - DNA, 20 bp, Artificial
  CRISPR gRNA sequence
taaaacttgctgaaaataca

SEQ ID NO: 591220 - DNA, 20 bp, Artificial
  CRISPR gRNA sequence
aaatacacagtgttatacaa

SEQ ID NO: 591221 - DNA, 20 bp, Artificial
  CRISPR gRNA sequence
acacagtgttatacaatagt

SEQ ID NO: 591222 - DNA, 20 bp, Artificial
  CRISPR gRNA sequence
cacagtgttatacaatagta

SEQ ID NO: 591223 - DNA, 20 bp, Artificial
  CRISPR gRNA sequence
tacaatagtaaggaataatg

SEQ ID NO: 591224 - DNA, 20 bp, Artificial
  CRISPR gRNA sequence
aatagtaaggaataatgcag

SEQ ID NO: 591225 - DNA, 20 bp, Artificial
  CRISPR gRNA sequence
gtaaggaataatgcagtaga

SEQ ID NO: 591226 - DNA, 20 bp, Artificial
  CRISPR gRNA sequence
agtagacagtctacaatctg

SEQ ID NO: 591227 - DNA, 20 bp, Artificial
  CRISPR gRNA sequence
ttattatcattatcgctcac

SEQ ID NO: 591228 - DNA, 20 bp, Artificial
  CRISPR gRNA sequence
tattatcattatcgctcact

SEQ ID NO: 591229 - DNA, 20 bp, Artificial
  CRISPR gRNA sequence
gggtattgaacttatccctg

SEQ ID NO: 591230 - DNA, 20 bp, Artificial
  CRISPR gRNA sequence
tattgaacttatccctgtag

SEQ ID NO: 591231 - DNA, 20 bp, Artificial
  CRISPR gRNA sequence
tgtagtggaataatgtcacc

SEQ ID NO: 591232 - DNA, 20 bp, Artificial
  CRISPR gRNA sequence
agtggaataatgtcaccaag

SEQ ID NO: 591233 - DNA, 20 bp, Artificial
  CRISPR gRNA sequence
gtcaccaagcagctcattca

SEQ ID NO: 591234 - DNA, 20 bp, Artificial
  CRISPR gRNA sequence
ccaagcagctcattcaaaga

SEQ ID NO: 591235 - DNA, 20 bp, Artificial
  CRISPR gRNA sequence
cagctcattcaaagatagac

SEQ ID NO: 591236 - DNA, 20 bp, Artificial
  CRISPR gRNA sequence
agctcattcaaagatagaca

SEQ ID NO: 591237 - DNA, 20 bp, Artificial
  CRISPR gRNA sequence
attcaaagatagacaaggca

SEQ ID NO: 591238 - DNA, 20 bp, Artificial
  CRISPR gRNA sequence
acctttctacatactgactt

SEQ ID NO: 591239 - DNA, 20 bp, Artificial
  CRISPR gRNA sequence
ctttagttacaaacttttat

SEQ ID NO: 591240 - DNA, 20 bp, Artificial
  CRISPR gRNA sequence
ttacaaacttttataagcct

SEQ ID NO: 591241 - DNA, 20 bp, Artificial
  CRISPR gRNA sequence
ttataagccttagtgaattt

SEQ ID NO: 591242 - DNA, 20 bp, Artificial
  CRISPR gRNA sequence
gtgaatttcagcactcttga

SEQ ID NO: 591243 - DNA, 20 bp, Artificial
  CRISPR gRNA sequence
tttcagcactcttgaaagtt

SEQ ID NO: 591244 - DNA, 20 bp, Artificial
  CRISPR gRNA sequence
tcttgaaagttaagtctgtt

SEQ ID NO: 591245 - DNA, 20 bp, Artificial
  CRISPR gRNA sequence
ttgaaagttaagtctgttaa

SEQ ID NO: 591246 - DNA, 20 bp, Artificial
  CRISPR gRNA sequence
aagttaagtctgttaagaga

SEQ ID NO: 591247 - DNA, 20 bp, Artificial
  CRISPR gRNA sequence
agttaagtctgttaagagaa

SEQ ID NO: 591248 - DNA, 20 bp, Artificial
  CRISPR gRNA sequence
tttatttgtttccccattta

SEQ ID NO: 591249 - DNA, 20 bp, Artificial
  CRISPR gRNA sequence
ttatttgtttccccatttat

SEQ ID NO: 591250 - DNA, 20 bp, Artificial
  CRISPR gRNA sequence
tatttgtttccccatttata

SEQ ID NO: 591251 - DNA, 20 bp, Artificial
  CRISPR gRNA sequence
catttatagggcaccttatc

SEQ ID NO: 591252 - DNA, 20 bp, Artificial
  CRISPR gRNA sequence
ccttatcaagccttgcatat

SEQ ID NO: 591253 - DNA, 20 bp, Artificial
  CRISPR gRNA sequence
cttatcaagccttgcatatt

SEQ ID NO: 591254 - DNA, 20 bp, Artificial
  CRISPR gRNA sequence
cattaaactttatatttttc

SEQ ID NO: 591255 - DNA, 20 bp, Artificial
  CRISPR gRNA sequence
ttttctagtgtttttatttt

SEQ ID NO: 591256 - DNA, 20 bp, Artificial
  CRISPR gRNA sequence
ttgctgaaaactgttaaaca

SEQ ID NO: 591257 - DNA, 20 bp, Artificial
  CRISPR gRNA sequence
acagcaactcaataaaaatt

SEQ ID NO: 591258 - DNA, 20 bp, Artificial
  CRISPR gRNA sequence
aactcaataaaaattaagta

SEQ ID NO: 591259 - DNA, 20 bp, Artificial
  CRISPR gRNA sequence
aataaaaattaagtatggcc

SEQ ID NO: 591260 - DNA, 20 bp, Artificial
  CRISPR gRNA sequence
aaaaattaagtatggcctag

SEQ ID NO: 591261 - DNA, 20 bp, Artificial
  CRISPR gRNA sequence
aattaagtatggcctagaag

SEQ ID NO: 591262 - DNA, 20 bp, Artificial
  CRISPR gRNA sequence
gacacatgaacacgaaatct

SEQ ID NO: 591263 - DNA, 20 bp, Artificial
  CRISPR gRNA sequence
acacatgaacacgaaatcta

SEQ ID NO: 591264 - DNA, 20 bp, Artificial
  CRISPR gRNA sequence
gaacacgaaatctaaggcac

SEQ ID NO: 591265 - DNA, 20 bp, Artificial
  CRISPR gRNA sequence
ctaaggcactggaacccatt

SEQ ID NO: 591266 - DNA, 20 bp, Artificial
  CRISPR gRNA sequence
ggcactggaacccattcagt

SEQ ID NO: 591267 - DNA, 20 bp, Artificial
  CRISPR gRNA sequence
cactggaacccattcagtta

SEQ ID NO: 591268 - DNA, 20 bp, Artificial
  CRISPR gRNA sequence
ttataaattttattctgctt

SEQ ID NO: 591269 - DNA, 20 bp, Artificial
  CRISPR gRNA sequence
tcttcaatactctcaaatga

SEQ ID NO: 591270 - DNA, 20 bp, Artificial
  CRISPR gRNA sequence
catttaataatgcataaatt

SEQ ID NO: 591271 - DNA, 20 bp, Artificial
  CRISPR gRNA sequence
gcataaattcagtaaatatt

SEQ ID NO: 591272 - DNA, 20 bp, Artificial
  CRISPR gRNA sequence
aaattcagtaaatattcaga

SEQ ID NO: 591273 - DNA, 20 bp, Artificial
  CRISPR gRNA sequence
attcagacagaatacttatc

SEQ ID NO: 591274 - DNA, 20 bp, Artificial
  CRISPR gRNA sequence
acagaatacttatccagtat

SEQ ID NO: 591275 - DNA, 20 bp, Artificial
  CRISPR gRNA sequence
atacttatccagtataagta

SEQ ID NO: 591276 - DNA, 20 bp, Artificial
  CRISPR gRNA sequence
gtataagtacagtattgtct

SEQ ID NO: 591277 - DNA, 20 bp, Artificial
  CRISPR gRNA sequence
tacagtattgtctcggatgc

SEQ ID NO: 591278 - DNA, 20 bp, Artificial
  CRISPR gRNA sequence
gtattgtctcggatgcaaga

SEQ ID NO: 591279 - DNA, 20 bp, Artificial
  CRISPR gRNA sequence
ttgtctcggatgcaagaaag

SEQ ID NO: 591280 - DNA, 20 bp, Artificial
  CRISPR gRNA sequence
tctcggatgcaagaaagcag

SEQ ID NO: 591281 - DNA, 20 bp, Artificial
  CRISPR gRNA sequence
ctcggatgcaagaaagcaga

SEQ ID NO: 591282 - DNA, 20 bp, Artificial
  CRISPR gRNA sequence
gcaagaaagcagaaggttta

SEQ ID NO: 591283 - DNA, 20 bp, Artificial
  CRISPR gRNA sequence
caagaaagcagaaggtttac

SEQ ID NO: 591284 - DNA, 20 bp, Artificial
  CRISPR gRNA sequence
aagcagaaggtttacaggaa

SEQ ID NO: 591285 - DNA, 20 bp, Artificial
  CRISPR gRNA sequence
atattttacttaaaaacctt

SEQ ID NO: 591286 - DNA, 20 bp, Artificial
  CRISPR gRNA sequence
tattttacttaaaaacctta

SEQ ID NO: 591287 - DNA, 20 bp, Artificial
  CRISPR gRNA sequence
aggtctacttaatacgtcat

SEQ ID NO: 591288 - DNA, 20 bp, Artificial
  CRISPR gRNA sequence
agtccatattctttgtgatt

SEQ ID NO: 591289 - DNA, 20 bp, Artificial
  CRISPR gRNA sequence
gtccatattctttgtgattt

SEQ ID NO: 591290 - DNA, 20 bp, Artificial
  CRISPR gRNA sequence
tccatattctttgtgatttg

SEQ ID NO: 591291 - DNA, 20 bp, Artificial
  CRISPR gRNA sequence
ccatattctttgtgatttgg

SEQ ID NO: 591292 - DNA, 20 bp, Artificial
  CRISPR gRNA sequence
tattctttgtgatttggggg

SEQ ID NO: 591293 - DNA, 20 bp, Artificial
  CRISPR gRNA sequence
tctttgtgatttgggggaag

SEQ ID NO: 591294 - DNA, 20 bp, Artificial
  CRISPR gRNA sequence
tttgggggaagtggaaaatg

SEQ ID NO: 591295 - DNA, 20 bp, Artificial
  CRISPR gRNA sequence
ttgaaaaacatcacaaataa

SEQ ID NO: 591296 - DNA, 20 bp, Artificial
  CRISPR gRNA sequence
tcacaaataaaagttaatac

SEQ ID NO: 591297 - DNA, 20 bp, Artificial
  CRISPR gRNA sequence
cacaaataaaagttaatacg

SEQ ID NO: 591298 - DNA, 20 bp, Artificial
  CRISPR gRNA sequence
caaataaaagttaatacgag

SEQ ID NO: 591299 - DNA, 20 bp, Artificial
  CRISPR gRNA sequence
gttaatacgaggagctaata

SEQ ID NO: 591300 - DNA, 20 bp, Artificial
  CRISPR gRNA sequence
aggagctaatatagttaatc

SEQ ID NO: 591301 - DNA, 20 bp, Artificial
  CRISPR gRNA sequence
taatatagttaatctggtac

SEQ ID NO: 591302 - DNA, 20 bp, Artificial
  CRISPR gRNA sequence
ttaatctggtactagaaact

SEQ ID NO: 591303 - DNA, 20 bp, Artificial
  CRISPR gRNA sequence
caataaaccaatcactgaac

SEQ ID NO: 591304 - DNA, 20 bp, Artificial
  CRISPR gRNA sequence
taaaccaatcactgaactag

SEQ ID NO: 591305 - DNA, 20 bp, Artificial
  CRISPR gRNA sequence
ccaatcactgaactagaagt

SEQ ID NO: 591306 - DNA, 20 bp, Artificial
  CRISPR gRNA sequence
tgaactagaagtaagattcc

SEQ ID NO: 591307 - DNA, 20 bp, Artificial
  CRISPR gRNA sequence
gaactagaagtaagattcct

SEQ ID NO: 591308 - DNA, 20 bp, Artificial
  CRISPR gRNA sequence
agattcctaggttctactgc

SEQ ID NO: 591309 - DNA, 20 bp, Artificial
  CRISPR gRNA sequence
tcctaggttctactgctggt

SEQ ID NO: 591310 - DNA, 20 bp, Artificial
  CRISPR gRNA sequence
gttctactgctggttagtga

SEQ ID NO: 591311 - DNA, 20 bp, Artificial
  CRISPR gRNA sequence
tctactgctggttagtgatg

SEQ ID NO: 591312 - DNA, 20 bp, Artificial
  CRISPR gRNA sequence
tgctggttagtgatggagtt

SEQ ID NO: 591313 - DNA, 20 bp, Artificial
  CRISPR gRNA sequence
ggttagtgatggagttcagt

SEQ ID NO: 591314 - DNA, 20 bp, Artificial
  CRISPR gRNA sequence
agtgatggagttcagtgagt

SEQ ID NO: 591315 - DNA, 20 bp, Artificial
  CRISPR gRNA sequence
tgatggagttcagtgagtaa

SEQ ID NO: 591316 - DNA, 20 bp, Artificial
  CRISPR gRNA sequence
tggagttcagtgagtaagag

SEQ ID NO: 591317 - DNA, 20 bp, Artificial
  CRISPR gRNA sequence
gagttcagtgagtaagagtg

SEQ ID NO: 591318 - DNA, 20 bp, Artificial
  CRISPR gRNA sequence
agttcagtgagtaagagtgg

SEQ ID NO: 591319 - DNA, 20 bp, Artificial
  CRISPR gRNA sequence
gtaagagtggaggtaaatgt

SEQ ID NO: 591320 - DNA, 20 bp, Artificial
  CRISPR gRNA sequence
ggaggtaaatgttagtgtct

SEQ ID NO: 591321 - DNA, 20 bp, Artificial
  CRISPR gRNA sequence
tagtgtctcagtttcccaat

SEQ ID NO: 591322 - DNA, 20 bp, Artificial
  CRISPR gRNA sequence
tcagtttcccaataagtaac

SEQ ID NO: 591323 - DNA, 20 bp, Artificial
  CRISPR gRNA sequence
aactaactccatatttacca

SEQ ID NO: 591324 - DNA, 20 bp, Artificial
  CRISPR gRNA sequence
taactccatatttaccacag

SEQ ID NO: 591325 - DNA, 20 bp, Artificial
  CRISPR gRNA sequence
ctccatatttaccacagaag

SEQ ID NO: 591326 - DNA, 20 bp, Artificial
  CRISPR gRNA sequence
agaagtatacaaaaattaaa

SEQ ID NO: 591327 - DNA, 20 bp, Artificial
  CRISPR gRNA sequence
aattaaacagaaaacactgc

SEQ ID NO: 591328 - DNA, 20 bp, Artificial
  CRISPR gRNA sequence
attaaacagaaaacactgcc

SEQ ID NO: 591329 - DNA, 20 bp, Artificial
  CRISPR gRNA sequence
ggaaaatattaaacaaatga

SEQ ID NO: 591330 - DNA, 20 bp, Artificial
  CRISPR gRNA sequence
ctatgtttcataaatataaa

SEQ ID NO: 591331 - DNA, 20 bp, Artificial
  CRISPR gRNA sequence
tatgtttcataaatataaaa

SEQ ID NO: 591332 - DNA, 20 bp, Artificial
  CRISPR gRNA sequence
tcataaatataaaaaggttt

SEQ ID NO: 591333 - DNA, 20 bp, Artificial
  CRISPR gRNA sequence
ataaatataaaaaggtttta

SEQ ID NO: 591334 - DNA, 20 bp, Artificial
  CRISPR gRNA sequence
aaaaaggttttagagtatga

SEQ ID NO: 591335 - DNA, 20 bp, Artificial
  CRISPR gRNA sequence
acagttattcaaatgtttaa

SEQ ID NO: 591336 - DNA, 20 bp, Artificial
  CRISPR gRNA sequence
atagcatgttacacctttga

SEQ ID NO: 591337 - DNA, 20 bp, Artificial
  CRISPR gRNA sequence
agcatgttacacctttgaaa

SEQ ID NO: 591338 - DNA, 20 bp, Artificial
  CRISPR gRNA sequence
gcatgttacacctttgaaag

SEQ ID NO: 591339 - DNA, 20 bp, Artificial
  CRISPR gRNA sequence
tttgaaagaggtaacactac

SEQ ID NO: 591340 - DNA, 20 bp, Artificial
  CRISPR gRNA sequence
taacactacaagaaaaacaa

SEQ ID NO: 591341 - DNA, 20 bp, Artificial
  CRISPR gRNA sequence
cttcacctttccaaaatgta

SEQ ID NO: 591342 - DNA, 20 bp, Artificial
  CRISPR gRNA sequence
taaacaaattaaatgaaaat

SEQ ID NO: 591343 - DNA, 20 bp, Artificial
  CRISPR gRNA sequence
aaacaaattaaatgaaaatc

SEQ ID NO: 591344 - DNA, 20 bp, Artificial
  CRISPR gRNA sequence
aacaaattaaatgaaaatca

SEQ ID NO: 591345 - DNA, 20 bp, Artificial
  CRISPR gRNA sequence
aaattaaatgaaaatcaggg

SEQ ID NO: 591346 - DNA, 20 bp, Artificial
  CRISPR gRNA sequence
aatgaaaatcagggaagtga

SEQ ID NO: 591347 - DNA, 20 bp, Artificial
  CRISPR gRNA sequence
catgttaacttccaacgaat

SEQ ID NO: 591348 - DNA, 20 bp, Artificial
  CRISPR gRNA sequence
gttaacttccaacgaatcag

SEQ ID NO: 591349 - DNA, 20 bp, Artificial
  CRISPR gRNA sequence
acataatttttgttttcttt

SEQ ID NO: 591350 - DNA, 20 bp, Artificial
  CRISPR gRNA sequence
aatttttgttttctttgaga

SEQ ID NO: 591351 - DNA, 20 bp, Artificial
  CRISPR gRNA sequence
tttttgttttctttgagatg

SEQ ID NO: 591352 - DNA, 20 bp, Artificial
  CRISPR gRNA sequence
atggagtcttgctctgtcgc

SEQ ID NO: 591353 - DNA, 20 bp, Artificial
  CRISPR gRNA sequence
tggagtcttgctctgtcgcc

SEQ ID NO: 591354 - DNA, 20 bp, Artificial
  CRISPR gRNA sequence
tcttgctctgtcgccaggtc

SEQ ID NO: 591355 - DNA, 20 bp, Artificial
  CRISPR gRNA sequence
ttgctctgtcgccaggtctg

SEQ ID NO: 591356 - DNA, 20 bp, Artificial
  CRISPR gRNA sequence
ctgtcgccaggtctggagtg

SEQ ID NO: 591357 - DNA, 20 bp, Artificial
  CRISPR gRNA sequence
tcgccaggtctggagtgcag

SEQ ID NO: 591358 - DNA, 20 bp, Artificial
  CRISPR gRNA sequence
ggagtgcagtggcacgatct

SEQ ID NO: 591359 - DNA, 20 bp, Artificial
  CRISPR gRNA sequence
taacctaaattttaaaaatt

SEQ ID NO: 591360 - DNA, 20 bp, Artificial
  CRISPR gRNA sequence
taaaaattcagaatgatgtg

SEQ ID NO: 591361 - DNA, 20 bp, Artificial
  CRISPR gRNA sequence
gatgtgaagaattatctcta

SEQ ID NO: 591362 - DNA, 20 bp, Artificial
  CRISPR gRNA sequence
attatctctaaagtaacatc

SEQ ID NO: 591363 - DNA, 20 bp, Artificial
  CRISPR gRNA sequence
atctctaaagtaacatccag

SEQ ID NO: 591364 - DNA, 20 bp, Artificial
  CRISPR gRNA sequence
tctaaagtaacatccagaag

SEQ ID NO: 591365 - DNA, 20 bp, Artificial
  CRISPR gRNA sequence
gtaacatccagaagtagaaa

SEQ ID NO: 591366 - DNA, 20 bp, Artificial
  CRISPR gRNA sequence
aatttccatttcacaatccc

SEQ ID NO: 591367 - DNA, 20 bp, Artificial
  CRISPR gRNA sequence
atttccatttcacaatccct

SEQ ID NO: 591368 - DNA, 20 bp, Artificial
  CRISPR gRNA sequence
atttcacaatccctgggatc

SEQ ID NO: 591369 - DNA, 20 bp, Artificial
  CRISPR gRNA sequence
aaacttgtacctatttgacc

SEQ ID NO: 591370 - DNA, 20 bp, Artificial
  CRISPR gRNA sequence
ctcctataatcatatttccc

SEQ ID NO: 591371 - DNA, 20 bp, Artificial
  CRISPR gRNA sequence
ttttactatcctctcaaact

SEQ ID NO: 591372 - DNA, 20 bp, Artificial
  CRISPR gRNA sequence
actatcctctcaaactgaga

SEQ ID NO: 591373 - DNA, 20 bp, Artificial
  CRISPR gRNA sequence
attattttgttgcaaatatc

SEQ ID NO: 591374 - DNA, 20 bp, Artificial
  CRISPR gRNA sequence
tattttgttgcaaatatcca

SEQ ID NO: 591375 - DNA, 20 bp, Artificial
  CRISPR gRNA sequence
taaatatcatacaaatgaaa

SEQ ID NO: 591376 - DNA, 20 bp, Artificial
  CRISPR gRNA sequence
tacaaatgaaaaagattgaa

SEQ ID NO: 591377 - DNA, 20 bp, Artificial
  CRISPR gRNA sequence
attgaaaagaaaaaactttg

SEQ ID NO: 591378 - DNA, 20 bp, Artificial
  CRISPR gRNA sequence
tgaaaagaaaaaactttgaa

SEQ ID NO: 591379 - DNA, 20 bp, Artificial
  CRISPR gRNA sequence
tctctaactaaaaacatgaa

SEQ ID NO: 591380 - DNA, 20 bp, Artificial
  CRISPR gRNA sequence
tctaactaaaaacatgaaca

SEQ ID NO: 591381 - DNA, 20 bp, Artificial
  CRISPR gRNA sequence
aactaaaaacatgaacagag

SEQ ID NO: 591382 - DNA, 20 bp, Artificial
  CRISPR gRNA sequence
taaaaacatgaacagagtag

SEQ ID NO: 591383 - DNA, 20 bp, Artificial
  CRISPR gRNA sequence
ttttaaccccatataaaact

SEQ ID NO: 591384 - DNA, 20 bp, Artificial
  CRISPR gRNA sequence
accccatataaaactaagtc

SEQ ID NO: 591385 - DNA, 20 bp, Artificial
  CRISPR gRNA sequence
ccccatataaaactaagtca

SEQ ID NO: 591386 - DNA, 20 bp, Artificial
  CRISPR gRNA sequence
aatcaactatcacctaacta

SEQ ID NO: 591387 - DNA, 20 bp, Artificial
  CRISPR gRNA sequence
atcaactatcacctaactac

SEQ ID NO: 591388 - DNA, 20 bp, Artificial
  CRISPR gRNA sequence
taactacaggaatgtgctct

SEQ ID NO: 591389 - DNA, 20 bp, Artificial
  CRISPR gRNA sequence
tgctctgagaaatgtgtcct

SEQ ID NO: 591390 - DNA, 20 bp, Artificial
  CRISPR gRNA sequence
ccttagctgtgaacactatc

SEQ ID NO: 591391 - DNA, 20 bp, Artificial
  CRISPR gRNA sequence
tcaagtgtacatcacaaatc

SEQ ID NO: 591392 - DNA, 20 bp, Artificial
  CRISPR gRNA sequence
gtgtacatcacaaatctaga

SEQ ID NO: 591393 - DNA, 20 bp, Artificial
  CRISPR gRNA sequence
tgtacatcacaaatctagat

SEQ ID NO: 591394 - DNA, 20 bp, Artificial
  CRISPR gRNA sequence
catcacaaatctagatagga

SEQ ID NO: 591395 - DNA, 20 bp, Artificial
  CRISPR gRNA sequence
aggatagcctacttcatacc

SEQ ID NO: 591396 - DNA, 20 bp, Artificial
  CRISPR gRNA sequence
ggatagcctacttcatacct

SEQ ID NO: 591397 - DNA, 20 bp, Artificial
  CRISPR gRNA sequence
tacttcatacctaggccgta

SEQ ID NO: 591398 - DNA, 20 bp, Artificial
  CRISPR gRNA sequence
atatattgcctgttgttcct

SEQ ID NO: 591399 - DNA, 20 bp, Artificial
  CRISPR gRNA sequence
tcctaagctacaaacctgca

SEQ ID NO: 591400 - DNA, 20 bp, Artificial
  CRISPR gRNA sequence
atgttactgtactgaatacg

SEQ ID NO: 591401 - DNA, 20 bp, Artificial
  CRISPR gRNA sequence
tgttactgtactgaatacgt

SEQ ID NO: 591402 - DNA, 20 bp, Artificial
  CRISPR gRNA sequence
cgtaggcaattgtaacccaa

SEQ ID NO: 591403 - DNA, 20 bp, Artificial
  CRISPR gRNA sequence
caatggtatctacatataca

SEQ ID NO: 591404 - DNA, 20 bp, Artificial
  CRISPR gRNA sequence
ataccctatttataatatta

SEQ ID NO: 591405 - DNA, 20 bp, Artificial
  CRISPR gRNA sequence
cgctgtatatgttgtatatg

SEQ ID NO: 591406 - DNA, 20 bp, Artificial
  CRISPR gRNA sequence
atatgtggtctatcattgaa

SEQ ID NO: 591407 - DNA, 20 bp, Artificial
  CRISPR gRNA sequence
gtctatcattgaaaagttat

SEQ ID NO: 591408 - DNA, 20 bp, Artificial
  CRISPR gRNA sequence
tctatcattgaaaagttatc

SEQ ID NO: 591409 - DNA, 20 bp, Artificial
  CRISPR gRNA sequence
ttatgtcaaatattaaaatc

SEQ ID NO: 591410 - DNA, 20 bp, Artificial
  CRISPR gRNA sequence
gtcaaatattaaaatccaga

SEQ ID NO: 591411 - DNA, 20 bp, Artificial
  CRISPR gRNA sequence
ttaaaatccagatggaacat

SEQ ID NO: 591412 - DNA, 20 bp, Artificial
  CRISPR gRNA sequence
aatccagatggaacattagt

SEQ ID NO: 591413 - DNA, 20 bp, Artificial
  CRISPR gRNA sequence
aacattagttagaataacaa

SEQ ID NO: 591414 - DNA, 20 bp, Artificial
  CRISPR gRNA sequence
aaactcttaaatccaatcaa

SEQ ID NO: 591415 - DNA, 20 bp, Artificial
  CRISPR gRNA sequence
ttgcttacatacatattttt

SEQ ID NO: 591416 - DNA, 20 bp, Artificial
  CRISPR gRNA sequence
cttacatacatattttttag

SEQ ID NO: 591417 - DNA, 20 bp, Artificial
  CRISPR gRNA sequence
actgacattgcattaccaca

SEQ ID NO: 591418 - DNA, 20 bp, Artificial
  CRISPR gRNA sequence
gacattgcattaccacatag

SEQ ID NO: 591419 - DNA, 20 bp, Artificial
  CRISPR gRNA sequence
gctgtgattcaaatttcact

SEQ ID NO: 591420 - DNA, 20 bp, Artificial
  CRISPR gRNA sequence
ttcaaatttcactaagaatc

SEQ ID NO: 591421 - DNA, 20 bp, Artificial
  CRISPR gRNA sequence
ctagattctgttctgtactt

SEQ ID NO: 591422 - DNA, 20 bp, Artificial
  CRISPR gRNA sequence
tctgtactttggtctttgcc

SEQ ID NO: 591423 - DNA, 20 bp, Artificial
  CRISPR gRNA sequence
gtctttgccaagttttgcta

SEQ ID NO: 591424 - DNA, 20 bp, Artificial
  CRISPR gRNA sequence
gccaagttttgctacagtaa

SEQ ID NO: 591425 - DNA, 20 bp, Artificial
  CRISPR gRNA sequence
ttttctgcaattatttcatt

SEQ ID NO: 591426 - DNA, 20 bp, Artificial
  CRISPR gRNA sequence
tttctgcaattatttcattt

SEQ ID NO: 591427 - DNA, 20 bp, Artificial
  CRISPR gRNA sequence
ttattacaattgtatttaaa

SEQ ID NO: 591428 - DNA, 20 bp, Artificial
  CRISPR gRNA sequence
tttaaatggttattaaacgt

SEQ ID NO: 591429 - DNA, 20 bp, Artificial
  CRISPR gRNA sequence
aaacgtaagcctaaattatt

SEQ ID NO: 591430 - DNA, 20 bp, Artificial
  CRISPR gRNA sequence
aacgtaagcctaaattattc

SEQ ID NO: 591431 - DNA, 20 bp, Artificial
  CRISPR gRNA sequence
taagcctaaattattcaggc

SEQ ID NO: 591432 - DNA, 20 bp, Artificial
  CRISPR gRNA sequence
cctaaattattcaggctaga

SEQ ID NO: 591433 - DNA, 20 bp, Artificial
  CRISPR gRNA sequence
attattcaggctagacagac

SEQ ID NO: 591434 - DNA, 20 bp, Artificial
  CRISPR gRNA sequence
tcaggctagacagacaagca

SEQ ID NO: 591435 - DNA, 20 bp, Artificial
  CRISPR gRNA sequence
agacaagcatggatcctgaa

SEQ ID NO: 591436 - DNA, 20 bp, Artificial
  CRISPR gRNA sequence
gacaagcatggatcctgaaa

SEQ ID NO: 591437 - DNA, 20 bp, Artificial
  CRISPR gRNA sequence
aagcatggatcctgaaaagg

SEQ ID NO: 591438 - DNA, 20 bp, Artificial
  CRISPR gRNA sequence
gttttcttaaaactaacttc

SEQ ID NO: 591439 - DNA, 20 bp, Artificial
  CRISPR gRNA sequence
aaactaacttccagttattt

SEQ ID NO: 591440 - DNA, 20 bp, Artificial
  CRISPR gRNA sequence
caactatgtgtgtacttttc

SEQ ID NO: 591441 - DNA, 20 bp, Artificial
  CRISPR gRNA sequence
ctatgtgtgtacttttctag

SEQ ID NO: 591442 - DNA, 20 bp, Artificial
  CRISPR gRNA sequence
ttttctagaagacaattcta

SEQ ID NO: 591443 - DNA, 20 bp, Artificial
  CRISPR gRNA sequence
tctagaagacaattctaaag

SEQ ID NO: 591444 - DNA, 20 bp, Artificial
  CRISPR gRNA sequence
gtggctttcaaactgttcct

SEQ ID NO: 591445 - DNA, 20 bp, Artificial
  CRISPR gRNA sequence
ttccttggctatacactata

SEQ ID NO: 591446 - DNA, 20 bp, Artificial
  CRISPR gRNA sequence
ctatacactatacagatact

SEQ ID NO: 591447 - DNA, 20 bp, Artificial
  CRISPR gRNA sequence
acactatacagatactgaga

SEQ ID NO: 591448 - DNA, 20 bp, Artificial
  CRISPR gRNA sequence
tactgagacagtctcaataa

SEQ ID NO: 591449 - DNA, 20 bp, Artificial
  CRISPR gRNA sequence
ctgagacagtctcaataaaa

SEQ ID NO: 591450 - DNA, 20 bp, Artificial
  CRISPR gRNA sequence
tcaataaaagagaaatgctg

SEQ ID NO: 591451 - DNA, 20 bp, Artificial
  CRISPR gRNA sequence
ctatactaccttatttcatt

SEQ ID NO: 591452 - DNA, 20 bp, Artificial
  CRISPR gRNA sequence
taccttatttcattcagtta

SEQ ID NO: 591453 - DNA, 20 bp, Artificial
  CRISPR gRNA sequence
aaagttttgttctgttctgc

SEQ ID NO: 591454 - DNA, 20 bp, Artificial
  CRISPR gRNA sequence
tctgttctgctggcttaata

SEQ ID NO: 591455 - DNA, 20 bp, Artificial
  CRISPR gRNA sequence
tattaacattaaatatgaaa

SEQ ID NO: 591456 - DNA, 20 bp, Artificial
  CRISPR gRNA sequence
tatgaaatagtaaatctcac

SEQ ID NO: 591457 - DNA, 20 bp, Artificial
  CRISPR gRNA sequence
atgaaatagtaaatctcact

SEQ ID NO: 591458 - DNA, 20 bp, Artificial
  CRISPR gRNA sequence
atagtaaatctcactgggaa

SEQ ID NO: 591459 - DNA, 20 bp, Artificial
  CRISPR gRNA sequence
cactgggaaaagttttctaa

SEQ ID NO: 591460 - DNA, 20 bp, Artificial
  CRISPR gRNA sequence
ctaaaagctaatcgctgctt

SEQ ID NO: 591461 - DNA, 20 bp, Artificial
  CRISPR gRNA sequence
aaaagctaatcgctgcttta

SEQ ID NO: 591462 - DNA, 20 bp, Artificial
  CRISPR gRNA sequence
gctttagagaaacaatctat

SEQ ID NO: 591463 - DNA, 20 bp, Artificial
  CRISPR gRNA sequence
ctgtatgtgtttatgttcat

SEQ ID NO: 591464 - DNA, 20 bp, Artificial
  CRISPR gRNA sequence
gtttatgttcattagcaaac

SEQ ID NO: 591465 - DNA, 20 bp, Artificial
  CRISPR gRNA sequence
gccattgcaatacttcaaat

SEQ ID NO: 591466 - DNA, 20 bp, Artificial
  CRISPR gRNA sequence
ccattgcaatacttcaaatt

SEQ ID NO: 591467 - DNA, 20 bp, Artificial
  CRISPR gRNA sequence
cattgcaatacttcaaatta

SEQ ID NO: 591468 - DNA, 20 bp, Artificial
  CRISPR gRNA sequence
aatacttcaaattagggtat

SEQ ID NO: 591469 - DNA, 20 bp, Artificial
  CRISPR gRNA sequence
tagggtatcagctgaaatat

SEQ ID NO: 591470 - DNA, 20 bp, Artificial
  CRISPR gRNA sequence
agggtatcagctgaaatatt

SEQ ID NO: 591471 - DNA, 20 bp, Artificial
  CRISPR gRNA sequence
gaaatattaggttgatgcca

SEQ ID NO: 591472 - DNA, 20 bp, Artificial
  CRISPR gRNA sequence
ggttgatgccaaagtaactg

SEQ ID NO: 591473 - DNA, 20 bp, Artificial
  CRISPR gRNA sequence
cataatatttaaaatgaacc

SEQ ID NO: 591474 - DNA, 20 bp, Artificial
  CRISPR gRNA sequence
aagaaataaatacaaattcc

SEQ ID NO: 591475 - DNA, 20 bp, Artificial
  CRISPR gRNA sequence
tacaaattccaagtactttc

SEQ ID NO: 591476 - DNA, 20 bp, Artificial
  CRISPR gRNA sequence
aagtactttcaagttatact

SEQ ID NO: 591477 - DNA, 20 bp, Artificial
  CRISPR gRNA sequence
tactttcaagttatactcag

SEQ ID NO: 591478 - DNA, 20 bp, Artificial
  CRISPR gRNA sequence
atatatcttatcctatattt

SEQ ID NO: 591479 - DNA, 20 bp, Artificial
  CRISPR gRNA sequence
atatttgagttcccccaatg

SEQ ID NO: 591480 - DNA, 20 bp, Artificial
  CRISPR gRNA sequence
ggatgttgtcataatgtcat

SEQ ID NO: 591481 - DNA, 20 bp, Artificial
  CRISPR gRNA sequence
tgttgtcataatgtcattag

SEQ ID NO: 591482 - DNA, 20 bp, Artificial
  CRISPR gRNA sequence
tgtcataatgtcattagtag

SEQ ID NO: 591483 - DNA, 20 bp, Artificial
  CRISPR gRNA sequence
tagtagaagtttatttttta

SEQ ID NO: 591484 - DNA, 20 bp, Artificial
  CRISPR gRNA sequence
aagtttattttttaaagtga

SEQ ID NO: 591485 - DNA, 20 bp, Artificial
  CRISPR gRNA sequence
ttatttatcaactctcattt

SEQ ID NO: 591486 - DNA, 20 bp, Artificial
  CRISPR gRNA sequence
tcatttgagaatctgaatac

SEQ ID NO: 591487 - DNA, 20 bp, Artificial
  CRISPR gRNA sequence
aatacaagtattaattttct

SEQ ID NO: 591488 - DNA, 20 bp, Artificial
  CRISPR gRNA sequence
atacaagtattaattttctg

SEQ ID NO: 591489 - DNA, 20 bp, Artificial
  CRISPR gRNA sequence
attaattttctgaggtcaca

SEQ ID NO: 591490 - DNA, 20 bp, Artificial
  CRISPR gRNA sequence
aattttctgaggtcacacag

SEQ ID NO: 591491 - DNA, 20 bp, Artificial
  CRISPR gRNA sequence
aagttttcttttaacaaaac

SEQ ID NO: 591492 - DNA, 20 bp, Artificial
  CRISPR gRNA sequence
taacaaaactagaatcctca

SEQ ID NO: 591493 - DNA, 20 bp, Artificial
  CRISPR gRNA sequence
aacaaaactagaatcctcaa

SEQ ID NO: 591494 - DNA, 20 bp, Artificial
  CRISPR gRNA sequence
atactgacacaataaccatt

SEQ ID NO: 591495 - DNA, 20 bp, Artificial
  CRISPR gRNA sequence
ctgacacaataaccattaag

SEQ ID NO: 591496 - DNA, 20 bp, Artificial
  CRISPR gRNA sequence
tagtttatgttaaacacacc

SEQ ID NO: 591497 - DNA, 20 bp, Artificial
  CRISPR gRNA sequence
gtattttaaccatcctcgtt

SEQ ID NO: 591498 - DNA, 20 bp, Artificial
  CRISPR gRNA sequence
tattttaaccatcctcgttt

SEQ ID NO: 591499 - DNA, 20 bp, Artificial
  CRISPR gRNA sequence
ttaaccatcctcgtttgggt

SEQ ID NO: 591500 - DNA, 20 bp, Artificial
  CRISPR gRNA sequence
cctcgtttgggtgagaaatg

SEQ ID NO: 591501 - DNA, 20 bp, Artificial
  CRISPR gRNA sequence
cctctatcttgatattatac

SEQ ID NO: 591502 - DNA, 20 bp, Artificial
  CRISPR gRNA sequence
aagcactgacattcaaacta

SEQ ID NO: 591503 - DNA, 20 bp, Artificial
  CRISPR gRNA sequence
gacattcaaactaaagaata

SEQ ID NO: 591504 - DNA, 20 bp, Artificial
  CRISPR gRNA sequence
ttcaaactaaagaatatgga

SEQ ID NO: 591505 - DNA, 20 bp, Artificial
  CRISPR gRNA sequence
aaactaaagaatatggaaag

SEQ ID NO: 591506 - DNA, 20 bp, Artificial
  CRISPR gRNA sequence
atttttgatttttctctgcc

SEQ ID NO: 591507 - DNA, 20 bp, Artificial
  CRISPR gRNA sequence
tttttgatttttctctgcct

SEQ ID NO: 591508 - DNA, 20 bp, Artificial
  CRISPR gRNA sequence
gcctgggaataatattatca

SEQ ID NO: 591509 - DNA, 20 bp, Artificial
  CRISPR gRNA sequence
agaactcataaaataatcat

SEQ ID NO: 591510 - DNA, 20 bp, Artificial
  CRISPR gRNA sequence
aataatcataagcaaatact

SEQ ID NO: 591511 - DNA, 20 bp, Artificial
  CRISPR gRNA sequence
ccaccacactctaccaaatt

SEQ ID NO: 591512 - DNA, 20 bp, Artificial
  CRISPR gRNA sequence
caccacactctaccaaattt

SEQ ID NO: 591513 - DNA, 20 bp, Artificial
  CRISPR gRNA sequence
ctctaccaaatttaggttaa

SEQ ID NO: 591514 - DNA, 20 bp, Artificial
  CRISPR gRNA sequence
aaatttaggttaatggcaca

SEQ ID NO: 591515 - DNA, 20 bp, Artificial
  CRISPR gRNA sequence
taggttaatggcacatagca

SEQ ID NO: 591516 - DNA, 20 bp, Artificial
  CRISPR gRNA sequence
ggttaatggcacatagcaaa

SEQ ID NO: 591517 - DNA, 20 bp, Artificial
  CRISPR gRNA sequence
taatggcacatagcaaagag

SEQ ID NO: 591518 - DNA, 20 bp, Artificial
  CRISPR gRNA sequence
atggcacatagcaaagagca

SEQ ID NO: 591519 - DNA, 20 bp, Artificial
  CRISPR gRNA sequence
gcacatagcaaagagcagag

SEQ ID NO: 591520 - DNA, 20 bp, Artificial
  CRISPR gRNA sequence
tagcaaagagcagagcagat

SEQ ID NO: 591521 - DNA, 20 bp, Artificial
  CRISPR gRNA sequence
agcaaagagcagagcagata

SEQ ID NO: 591522 - DNA, 20 bp, Artificial
  CRISPR gRNA sequence
gcagagcagataaggcatca

SEQ ID NO: 591523 - DNA, 20 bp, Artificial
  CRISPR gRNA sequence
atatacaaatttaaaacaca

SEQ ID NO: 591524 - DNA, 20 bp, Artificial
  CRISPR gRNA sequence
tacacatcatgtaaactaaa

SEQ ID NO: 591525 - DNA, 20 bp, Artificial
  CRISPR gRNA sequence
acacatcatgtaaactaaac

SEQ ID NO: 591526 - DNA, 20 bp, Artificial
  CRISPR gRNA sequence
taaacaggattttttttaaa

SEQ ID NO: 591527 - DNA, 20 bp, Artificial
  CRISPR gRNA sequence
aaacaggattttttttaaac

SEQ ID NO: 591528 - DNA, 20 bp, Artificial
  CRISPR gRNA sequence
caggattttttttaaacagg

SEQ ID NO: 591529 - DNA, 20 bp, Artificial
  CRISPR gRNA sequence
aggattttttttaaacaggc

SEQ ID NO: 591530 - DNA, 20 bp, Artificial
  CRISPR gRNA sequence
ggattttttttaaacaggca

SEQ ID NO: 591531 - DNA, 20 bp, Artificial
  CRISPR gRNA sequence
ttttaaacaggcagggaaaa

SEQ ID NO: 591532 - DNA, 20 bp, Artificial
  CRISPR gRNA sequence
caggcagggaaaaaagtgaa

SEQ ID NO: 591533 - DNA, 20 bp, Artificial
  CRISPR gRNA sequence
gcagggaaaaaagtgaacgg

SEQ ID NO: 591534 - DNA, 20 bp, Artificial
  CRISPR gRNA sequence
tacaaaactaatgcttttcc

SEQ ID NO: 591535 - DNA, 20 bp, Artificial
  CRISPR gRNA sequence
acaaaactaatgcttttcct

SEQ ID NO: 591536 - DNA, 20 bp, Artificial
  CRISPR gRNA sequence
caaaactaatgcttttccta

SEQ ID NO: 591537 - DNA, 20 bp, Artificial
  CRISPR gRNA sequence
taatgcttttcctagggata

SEQ ID NO: 591538 - DNA, 20 bp, Artificial
  CRISPR gRNA sequence
aagtcatatgcaccatcacc

SEQ ID NO: 591539 - DNA, 20 bp, Artificial
  CRISPR gRNA sequence
accatcacctagttttccac

SEQ ID NO: 591540 - DNA, 20 bp, Artificial
  CRISPR gRNA sequence
ttttccactagaaaaaaaaa

SEQ ID NO: 591541 - DNA, 20 bp, Artificial
  CRISPR gRNA sequence
aaaatagaaaactcttttta

SEQ ID NO: 591542 - DNA, 20 bp, Artificial
  CRISPR gRNA sequence
cctaaacatgtaatataaac

SEQ ID NO: 591543 - DNA, 20 bp, Artificial
  CRISPR gRNA sequence
taaacatgtaatataaacaa

SEQ ID NO: 591544 - DNA, 20 bp, Artificial
  CRISPR gRNA sequence
acatgtaatataaacaagag

SEQ ID NO: 591545 - DNA, 20 bp, Artificial
  CRISPR gRNA sequence
aatataaacaagagaagaat

SEQ ID NO: 591546 - DNA, 20 bp, Artificial
  CRISPR gRNA sequence
taaacaagagaagaataaga

SEQ ID NO: 591547 - DNA, 20 bp, Artificial
  CRISPR gRNA sequence
aacaagagaagaataagaca

SEQ ID NO: 591548 - DNA, 20 bp, Artificial
  CRISPR gRNA sequence
atttaaacacaaataatgtg

SEQ ID NO: 591549 - DNA, 20 bp, Artificial
  CRISPR gRNA sequence
taaacacaaataatgtgtag

SEQ ID NO: 591550 - DNA, 20 bp, Artificial
  CRISPR gRNA sequence
aaacacaaataatgtgtagt

SEQ ID NO: 591551 - DNA, 20 bp, Artificial
  CRISPR gRNA sequence
caaataatgtgtagtaggca

SEQ ID NO: 591552 - DNA, 20 bp, Artificial
  CRISPR gRNA sequence
cccaacacaaaaattaaaca

SEQ ID NO: 591553 - DNA, 20 bp, Artificial
  CRISPR gRNA sequence
aacacaaaaattaaacatgg

SEQ ID NO: 591554 - DNA, 20 bp, Artificial
  CRISPR gRNA sequence
aaacatggtggtttgcgata

SEQ ID NO: 591555 - DNA, 20 bp, Artificial
  CRISPR gRNA sequence
aacatctatcgatctatctt

SEQ ID NO: 591556 - DNA, 20 bp, Artificial
  CRISPR gRNA sequence
atctatcgatctatcttcag

SEQ ID NO: 591557 - DNA, 20 bp, Artificial
  CRISPR gRNA sequence
ttaaatgaaatatgtatgtg

SEQ ID NO: 591558 - DNA, 20 bp, Artificial
  CRISPR gRNA sequence
taaattcatatattcactgc

SEQ ID NO: 591559 - DNA, 20 bp, Artificial
  CRISPR gRNA sequence
gctagttattataatatttt

SEQ ID NO: 591560 - DNA, 20 bp, Artificial
  CRISPR gRNA sequence
ttggaattaaatgtttaata

SEQ ID NO: 591561 - DNA, 20 bp, Artificial
  CRISPR gRNA sequence
attaaatgtttaatatagaa

SEQ ID NO: 591562 - DNA, 20 bp, Artificial
  CRISPR gRNA sequence
taaatgtttaatatagaaaa

SEQ ID NO: 591563 - DNA, 20 bp, Artificial
  CRISPR gRNA sequence
atatagaaaagagaataaat

SEQ ID NO: 591564 - DNA, 20 bp, Artificial
  CRISPR gRNA sequence
tttccctatacttaatacca

SEQ ID NO: 591565 - DNA, 20 bp, Artificial
  CRISPR gRNA sequence
aatatttatcttcaattgtt

SEQ ID NO: 591566 - DNA, 20 bp, Artificial
  CRISPR gRNA sequence
atatttatcttcaattgttt

SEQ ID NO: 591567 - DNA, 20 bp, Artificial
  CRISPR gRNA sequence
attatgatattttaatttaa

SEQ ID NO: 591568 - DNA, 20 bp, Artificial
  CRISPR gRNA sequence
atgatattttaatttaaaag

SEQ ID NO: 591569 - DNA, 20 bp, Artificial
  CRISPR gRNA sequence
ttttaatttaaaagaagctt

SEQ ID NO: 591570 - DNA, 20 bp, Artificial
  CRISPR gRNA sequence
ttaatttaaaagaagcttga

SEQ ID NO: 591571 - DNA, 20 bp, Artificial
  CRISPR gRNA sequence
aaattctacaattcactatt

SEQ ID NO: 591572 - DNA, 20 bp, Artificial
  CRISPR gRNA sequence
aattcactattaagaaatga

SEQ ID NO: 591573 - DNA, 20 bp, Artificial
  CRISPR gRNA sequence
actattaagaaatgaaagtc

SEQ ID NO: 591574 - DNA, 20 bp, Artificial
  CRISPR gRNA sequence
aaatgaaagtccagctactc

SEQ ID NO: 591575 - DNA, 20 bp, Artificial
  CRISPR gRNA sequence
atgaaagtccagctactccg

SEQ ID NO: 591576 - DNA, 20 bp, Artificial
  CRISPR gRNA sequence
tgaaagtccagctactccgg

SEQ ID NO: 591577 - DNA, 20 bp, Artificial
  CRISPR gRNA sequence
gtccagctactccggaggct

SEQ ID NO: 591578 - DNA, 20 bp, Artificial
  CRISPR gRNA sequence
tccagctactccggaggctg

SEQ ID NO: 591579 - DNA, 20 bp, Artificial
  CRISPR gRNA sequence
agctactccggaggctgagg

SEQ ID NO: 591580 - DNA, 20 bp, Artificial
  CRISPR gRNA sequence
gctactccggaggctgaggc

SEQ ID NO: 591581 - DNA, 20 bp, Artificial
  CRISPR gRNA sequence
tactccggaggctgaggcag

SEQ ID NO: 591582 - DNA, 20 bp, Artificial
  CRISPR gRNA sequence
tccggaggctgaggcaggag

SEQ ID NO: 591583 - DNA, 20 bp, Artificial
  CRISPR gRNA sequence
ccggaggctgaggcaggaga

SEQ ID NO: 591584 - DNA, 20 bp, Artificial
  CRISPR gRNA sequence
cggaggctgaggcaggagaa

SEQ ID NO: 591585 - DNA, 20 bp, Artificial
  CRISPR gRNA sequence
gcaggagaagggcgtgaacc

SEQ ID NO: 591586 - DNA, 20 bp, Artificial
  CRISPR gRNA sequence
caggagaagggcgtgaaccc

SEQ ID NO: 591587 - DNA, 20 bp, Artificial
  CRISPR gRNA sequence
ggagaagggcgtgaacccag

SEQ ID NO: 591588 - DNA, 20 bp, Artificial
  CRISPR gRNA sequence
gagaagggcgtgaacccagg

SEQ ID NO: 591589 - DNA, 20 bp, Artificial
  CRISPR gRNA sequence
aagggcgtgaacccaggagg

SEQ ID NO: 591590 - DNA, 20 bp, Artificial
  CRISPR gRNA sequence
gggcgtgaacccaggaggcg

SEQ ID NO: 591591 - DNA, 20 bp, Artificial
  CRISPR gRNA sequence
ccaggaggcggagcttgcgt

SEQ ID NO: 591592 - DNA, 20 bp, Artificial
  CRISPR gRNA sequence
ggaggcggagcttgcgtgag

SEQ ID NO: 591593 - DNA, 20 bp, Artificial
  CRISPR gRNA sequence
aggcggagcttgcgtgagcg

SEQ ID NO: 591594 - DNA, 20 bp, Artificial
  CRISPR gRNA sequence
gagatcgcgccactgcactc

SEQ ID NO: 591595 - DNA, 20 bp, Artificial
  CRISPR gRNA sequence
cgcgccactgcactccagcc

SEQ ID NO: 591596 - DNA, 20 bp, Artificial
  CRISPR gRNA sequence
gcgccactgcactccagcct

SEQ ID NO: 591597 - DNA, 20 bp, Artificial
  CRISPR gRNA sequence
gcactccagcctgggcgaca

SEQ ID NO: 591598 - DNA, 20 bp, Artificial
  CRISPR gRNA sequence
tccagcctgggcgacaaagc

SEQ ID NO: 591599 - DNA, 20 bp, Artificial
  CRISPR gRNA sequence
caaaaaaaataaataaataa

SEQ ID NO: 591600 - DNA, 20 bp, Artificial
  CRISPR gRNA sequence
taaataaataaaagaaataa

SEQ ID NO: 591601 - DNA, 20 bp, Artificial
  CRISPR gRNA sequence
gaaataaaagtatatgaact

SEQ ID NO: 591602 - DNA, 20 bp, Artificial
  CRISPR gRNA sequence
taaaagtatatgaacttagt

SEQ ID NO: 591603 - DNA, 20 bp, Artificial
  CRISPR gRNA sequence
atatgaacttagtgagtctg

SEQ ID NO: 591604 - DNA, 20 bp, Artificial
  CRISPR gRNA sequence
actaatatataaatcatttc

SEQ ID NO: 591605 - DNA, 20 bp, Artificial
  CRISPR gRNA sequence
ctaatatataaatcatttca

SEQ ID NO: 591606 - DNA, 20 bp, Artificial
  CRISPR gRNA sequence
aatcatttcaaggaaaattt

SEQ ID NO: 591607 - DNA, 20 bp, Artificial
  CRISPR gRNA sequence
aaggaaaattttggtttcct

SEQ ID NO: 591608 - DNA, 20 bp, Artificial
  CRISPR gRNA sequence
ttttggtttcctcagaataa

SEQ ID NO: 591609 - DNA, 20 bp, Artificial
  CRISPR gRNA sequence
gaataaaagattgttacaca

SEQ ID NO: 591610 - DNA, 20 bp, Artificial
  CRISPR gRNA sequence
aataaaagattgttacacac

SEQ ID NO: 591611 - DNA, 20 bp, Artificial
  CRISPR gRNA sequence
agattgttacacacaggtac

SEQ ID NO: 591612 - DNA, 20 bp, Artificial
  CRISPR gRNA sequence
cacaggtacaagtttaccaa

SEQ ID NO: 591613 - DNA, 20 bp, Artificial
  CRISPR gRNA sequence
acaggtacaagtttaccaaa

SEQ ID NO: 591614 - DNA, 20 bp, Artificial
  CRISPR gRNA sequence
caagtttaccaaaaggactg

SEQ ID NO: 591615 - DNA, 20 bp, Artificial
  CRISPR gRNA sequence
actgtggaatatctttatgc

SEQ ID NO: 591616 - DNA, 20 bp, Artificial
  CRISPR gRNA sequence
tacatgaaattcactgaatc

SEQ ID NO: 591617 - DNA, 20 bp, Artificial
  CRISPR gRNA sequence
gaaattcactgaatctggta

SEQ ID NO: 591618 - DNA, 20 bp, Artificial
  CRISPR gRNA sequence
aattcactgaatctggtata

SEQ ID NO: 591619 - DNA, 20 bp, Artificial
  CRISPR gRNA sequence
tcactgaatctggtatagag

SEQ ID NO: 591620 - DNA, 20 bp, Artificial
  CRISPR gRNA sequence
cactgaatctggtatagaga

SEQ ID NO: 591621 - DNA, 20 bp, Artificial
  CRISPR gRNA sequence
gtatagagaaggcttatttt

SEQ ID NO: 591622 - DNA, 20 bp, Artificial
  CRISPR gRNA sequence
tatagagaaggcttatttta

SEQ ID NO: 591623 - DNA, 20 bp, Artificial
  CRISPR gRNA sequence
ggcttattttaaggattttc

SEQ ID NO: 591624 - DNA, 20 bp, Artificial
  CRISPR gRNA sequence
gtgacttaattctacattta

SEQ ID NO: 591625 - DNA, 20 bp, Artificial
  CRISPR gRNA sequence
acaccaaatgaatatgataa

SEQ ID NO: 591626 - DNA, 20 bp, Artificial
  CRISPR gRNA sequence
tatgataatagtgaacaaat

SEQ ID NO: 591627 - DNA, 20 bp, Artificial
  CRISPR gRNA sequence
aatgtgtcacttgtttaaat

SEQ ID NO: 591628 - DNA, 20 bp, Artificial
  CRISPR gRNA sequence
gtgtcacttgtttaaatcag

SEQ ID NO: 591629 - DNA, 20 bp, Artificial
  CRISPR gRNA sequence
tcttaaaatgtatccatgaa

SEQ ID NO: 591630 - DNA, 20 bp, Artificial
  CRISPR gRNA sequence
aatgtatccatgaaaagcac

SEQ ID NO: 591631 - DNA, 20 bp, Artificial
  CRISPR gRNA sequence
catgaaaagcacaagtgtta

SEQ ID NO: 591632 - DNA, 20 bp, Artificial
  CRISPR gRNA sequence
gtgttatagatattaaattg

SEQ ID NO: 591633 - DNA, 20 bp, Artificial
  CRISPR gRNA sequence
tattaaattgtagtattcca

SEQ ID NO: 591634 - DNA, 20 bp, Artificial
  CRISPR gRNA sequence
attgtagtattccatagctc

SEQ ID NO: 591635 - DNA, 20 bp, Artificial
  CRISPR gRNA sequence
tagctcaagtaaaataatac

SEQ ID NO: 591636 - DNA, 20 bp, Artificial
  CRISPR gRNA sequence
tactagtcttttttccatca

SEQ ID NO: 591637 - DNA, 20 bp, Artificial
  CRISPR gRNA sequence
catgaactacctcttatcta

SEQ ID NO: 591638 - DNA, 20 bp, Artificial
  CRISPR gRNA sequence
atcaacaaaatgaatgaaaa

SEQ ID NO: 591639 - DNA, 20 bp, Artificial
  CRISPR gRNA sequence
acaaaatgaatgaaaatagt

SEQ ID NO: 591640 - DNA, 20 bp, Artificial
  CRISPR gRNA sequence
aatgaatgaaaatagtaagt

SEQ ID NO: 591641 - DNA, 20 bp, Artificial
  CRISPR gRNA sequence
gtaagtatgaactataaaaa

SEQ ID NO: 591642 - DNA, 20 bp, Artificial
  CRISPR gRNA sequence
taagtatgaactataaaaat

SEQ ID NO: 591643 - DNA, 20 bp, Artificial
  CRISPR gRNA sequence
aaatttttttaattgacctt

SEQ ID NO: 591644 - DNA, 20 bp, Artificial
  CRISPR gRNA sequence
aatttttttaattgaccttt

SEQ ID NO: 591645 - DNA, 20 bp, Artificial
  CRISPR gRNA sequence
ttaattgacctttgggcttc

SEQ ID NO: 591646 - DNA, 20 bp, Artificial
  CRISPR gRNA sequence
tttttttttttttttttttt

SEQ ID NO: 591647 - DNA, 20 bp, Artificial
  CRISPR gRNA sequence
ttttttttttttttttgaga

SEQ ID NO: 591648 - DNA, 20 bp, Artificial
  CRISPR gRNA sequence
ttttttttttttttgagaca

SEQ ID NO: 591649 - DNA, 20 bp, Artificial
  CRISPR gRNA sequence
cagagtcttgctctctcgcc

SEQ ID NO: 591650 - DNA, 20 bp, Artificial
  CRISPR gRNA sequence
agagtcttgctctctcgccc

SEQ ID NO: 591651 - DNA, 20 bp, Artificial
  CRISPR gRNA sequence
tcttgctctctcgcccaggc

SEQ ID NO: 591652 - DNA, 20 bp, Artificial
  CRISPR gRNA sequence
ttgctctctcgcccaggctg

SEQ ID NO: 591653 - DNA, 20 bp, Artificial
  CRISPR gRNA sequence
ctctcgcccaggctggagtg

SEQ ID NO: 591654 - DNA, 20 bp, Artificial
  CRISPR gRNA sequence
tcgcccaggctggagtgcag

SEQ ID NO: 591655 - DNA, 20 bp, Artificial
  CRISPR gRNA sequence
ggagtgcagtggtgcaattt

SEQ ID NO: 591656 - DNA, 20 bp, Artificial
  CRISPR gRNA sequence
gtgcaatttcggctcactgc

SEQ ID NO: 591657 - DNA, 20 bp, Artificial
  CRISPR gRNA sequence
tcactgcaagctccacctcc

SEQ ID NO: 591658 - DNA, 20 bp, Artificial
  CRISPR gRNA sequence
cactgcaagctccacctccc

SEQ ID NO: 591659 - DNA, 20 bp, Artificial
  CRISPR gRNA sequence
ttcacgccattctcctgccc

SEQ ID NO: 591660 - DNA, 20 bp, Artificial
  CRISPR gRNA sequence
ttctcctgccccagcctccc

SEQ ID NO: 591661 - DNA, 20 bp, Artificial
  CRISPR gRNA sequence
tcctgccccagcctcccaag

SEQ ID NO: 591662 - DNA, 20 bp, Artificial
  CRISPR gRNA sequence
gccccagcctcccaagtagc

SEQ ID NO: 591663 - DNA, 20 bp, Artificial
  CRISPR gRNA sequence
ccccagcctcccaagtagct

SEQ ID NO: 591664 - DNA, 20 bp, Artificial
  CRISPR gRNA sequence
ctcccaagtagctgggacta

SEQ ID NO: 591665 - DNA, 20 bp, Artificial
  CRISPR gRNA sequence
tcccaagtagctgggactac

SEQ ID NO: 591666 - DNA, 20 bp, Artificial
  CRISPR gRNA sequence
caggcgcccgccaccatgtc

SEQ ID NO: 591667 - DNA, 20 bp, Artificial
  CRISPR gRNA sequence
ggctaatttttgtgtatttt

SEQ ID NO: 591668 - DNA, 20 bp, Artificial
  CRISPR gRNA sequence
taatttttgtgtatttttag

SEQ ID NO: 591669 - DNA, 20 bp, Artificial
  CRISPR gRNA sequence
atttttgtgtatttttagta

SEQ ID NO: 591670 - DNA, 20 bp, Artificial
  CRISPR gRNA sequence
ttgtgtatttttagtagaga

SEQ ID NO: 591671 - DNA, 20 bp, Artificial
  CRISPR gRNA sequence
tgtgtatttttagtagagac

SEQ ID NO: 591672 - DNA, 20 bp, Artificial
  CRISPR gRNA sequence
gtgtatttttagtagagacg

SEQ ID NO: 591673 - DNA, 20 bp, Artificial
  CRISPR gRNA sequence
gagacggggtttcaccgtgt

SEQ ID NO: 591674 - DNA, 20 bp, Artificial
  CRISPR gRNA sequence
cggggtttcaccgtgttagc

SEQ ID NO: 591675 - DNA, 20 bp, Artificial
  CRISPR gRNA sequence
ggggtttcaccgtgttagcc

SEQ ID NO: 591676 - DNA, 20 bp, Artificial
  CRISPR gRNA sequence
tttcaccgtgttagccagga

SEQ ID NO: 591677 - DNA, 20 bp, Artificial
  CRISPR gRNA sequence
acctcgtgatccaccctcct

SEQ ID NO: 591678 - DNA, 20 bp, Artificial
  CRISPR gRNA sequence
ccaccctcctcggcctccca

SEQ ID NO: 591679 - DNA, 20 bp, Artificial
  CRISPR gRNA sequence
tcctcggcctcccaaagtac

SEQ ID NO: 591680 - DNA, 20 bp, Artificial
  CRISPR gRNA sequence
cctcggcctcccaaagtact

SEQ ID NO: 591681 - DNA, 20 bp, Artificial
  CRISPR gRNA sequence
ctcccaaagtactgggatta

SEQ ID NO: 591682 - DNA, 20 bp, Artificial
  CRISPR gRNA sequence
tcccaaagtactgggattac

SEQ ID NO: 591683 - DNA, 20 bp, Artificial
  CRISPR gRNA sequence
agtactgggattacaggtgt

SEQ ID NO: 591684 - DNA, 20 bp, Artificial
  CRISPR gRNA sequence
caggtgtgagccaccgcacc

SEQ ID NO: 591685 - DNA, 20 bp, Artificial
  CRISPR gRNA sequence
ttttttaatcatgtttacat

SEQ ID NO: 591686 - DNA, 20 bp, Artificial
  CRISPR gRNA sequence
taatcatgtttacattagtt

SEQ ID NO: 591687 - DNA, 20 bp, Artificial
  CRISPR gRNA sequence
tcatgtttacattagtttgg

SEQ ID NO: 591688 - DNA, 20 bp, Artificial
  CRISPR gRNA sequence
ctatatttctctctaaaatc

SEQ ID NO: 591689 - DNA, 20 bp, Artificial
  CRISPR gRNA sequence
ctttgtttaatctataacac

SEQ ID NO: 591690 - DNA, 20 bp, Artificial
  CRISPR gRNA sequence
tgtttaatctataacacaag

SEQ ID NO: 591691 - DNA, 20 bp, Artificial
  CRISPR gRNA sequence
gtttaatctataacacaagt

SEQ ID NO: 591692 - DNA, 20 bp, Artificial
  CRISPR gRNA sequence
aatctataacacaagtgggt

SEQ ID NO: 591693 - DNA, 20 bp, Artificial
  CRISPR gRNA sequence
tctataacacaagtgggtta

SEQ ID NO: 591694 - DNA, 20 bp, Artificial
  CRISPR gRNA sequence
ataacacaagtgggttagag

SEQ ID NO: 591695 - DNA, 20 bp, Artificial
  CRISPR gRNA sequence
acacaagtgggttagagtag

SEQ ID NO: 591696 - DNA, 20 bp, Artificial
  CRISPR gRNA sequence
tgcatattcctttccgtctt

SEQ ID NO: 591697 - DNA, 20 bp, Artificial
  CRISPR gRNA sequence
catattcctttccgtcttaa

SEQ ID NO: 591698 - DNA, 20 bp, Artificial
  CRISPR gRNA sequence
aagagctttatgatcctact

SEQ ID NO: 591699 - DNA, 20 bp, Artificial
  CRISPR gRNA sequence
agagctttatgatcctacta

SEQ ID NO: 591700 - DNA, 20 bp, Artificial
  CRISPR gRNA sequence
tcctgtatcctcaactcttc

SEQ ID NO: 591701 - DNA, 20 bp, Artificial
  CRISPR gRNA sequence
ctcaactcttcaagtgtaaa

SEQ ID NO: 591702 - DNA, 20 bp, Artificial
  CRISPR gRNA sequence
aaaaacaattcatgaataca

SEQ ID NO: 591703 - DNA, 20 bp, Artificial
  CRISPR gRNA sequence
tatgttttgctatattattt

SEQ ID NO: 591704 - DNA, 20 bp, Artificial
  CRISPR gRNA sequence
gttttgctatattattttag

SEQ ID NO: 591705 - DNA, 20 bp, Artificial
  CRISPR gRNA sequence
ttttgctatattattttaga

SEQ ID NO: 591706 - DNA, 20 bp, Artificial
  CRISPR gRNA sequence
tttgctatattattttagaa

SEQ ID NO: 591707 - DNA, 20 bp, Artificial
  CRISPR gRNA sequence
gctatattattttagaaggg

SEQ ID NO: 591708 - DNA, 20 bp, Artificial
  CRISPR gRNA sequence
tatattattttagaagggta

SEQ ID NO: 591709 - DNA, 20 bp, Artificial
  CRISPR gRNA sequence
ttttagaagggtagagaaat

SEQ ID NO: 591710 - DNA, 20 bp, Artificial
  CRISPR gRNA sequence
agaaattggctgaaattgct

SEQ ID NO: 591711 - DNA, 20 bp, Artificial
  CRISPR gRNA sequence
gctaagaaaacttaaaaatg

SEQ ID NO: 591712 - DNA, 20 bp, Artificial
  CRISPR gRNA sequence
agaaaacttaaaaatgtaga

SEQ ID NO: 591713 - DNA, 20 bp, Artificial
  CRISPR gRNA sequence
tgtactttctatttttaaca

SEQ ID NO: 591714 - DNA, 20 bp, Artificial
  CRISPR gRNA sequence
gtactttctatttttaacaa

SEQ ID NO: 591715 - DNA, 20 bp, Artificial
  CRISPR gRNA sequence
cccttttcttaacattaaat

SEQ ID NO: 591716 - DNA, 20 bp, Artificial
  CRISPR gRNA sequence
ttaaattagttctcaattca

SEQ ID NO: 591717 - DNA, 20 bp, Artificial
  CRISPR gRNA sequence
aacaattactatattctttc

SEQ ID NO: 591718 - DNA, 20 bp, Artificial
  CRISPR gRNA sequence
attctttccagaaacaaaat

SEQ ID NO: 591719 - DNA, 20 bp, Artificial
  CRISPR gRNA sequence
gaaacaaaatcagtatccta

SEQ ID NO: 591720 - DNA, 20 bp, Artificial
  CRISPR gRNA sequence
aacaaaatcagtatcctaca

SEQ ID NO: 591721 - DNA, 20 bp, Artificial
  CRISPR gRNA sequence
acaaaatcagtatcctacag

SEQ ID NO: 591722 - DNA, 20 bp, Artificial
  CRISPR gRNA sequence
cagtatcctacagaggttat

SEQ ID NO: 591723 - DNA, 20 bp, Artificial
  CRISPR gRNA sequence
tgagaaactcttttctttat

SEQ ID NO: 591724 - DNA, 20 bp, Artificial
  CRISPR gRNA sequence
taatgtaactcatacttaaa

SEQ ID NO: 591725 - DNA, 20 bp, Artificial
  CRISPR gRNA sequence
tcatacttaaacagtttatt

SEQ ID NO: 591726 - DNA, 20 bp, Artificial
  CRISPR gRNA sequence
cttaaacagtttatttagtt

SEQ ID NO: 591727 - DNA, 20 bp, Artificial
  CRISPR gRNA sequence
taaacagtttatttagttca

SEQ ID NO: 591728 - DNA, 20 bp, Artificial
  CRISPR gRNA sequence
tttcaaatcttccatctcaa

SEQ ID NO: 591729 - DNA, 20 bp, Artificial
  CRISPR gRNA sequence
atctcaatagatcttcacac

SEQ ID NO: 591730 - DNA, 20 bp, Artificial
  CRISPR gRNA sequence
gatcttcacactagaatatg

SEQ ID NO: 591731 - DNA, 20 bp, Artificial
  CRISPR gRNA sequence
cttcacactagaatatgaag

SEQ ID NO: 591732 - DNA, 20 bp, Artificial
  CRISPR gRNA sequence
ttcacactagaatatgaagt

SEQ ID NO: 591733 - DNA, 20 bp, Artificial
  CRISPR gRNA sequence
gtaggtgctattattatccc

SEQ ID NO: 591734 - DNA, 20 bp, Artificial
  CRISPR gRNA sequence
attatccccagtaaacgtac

SEQ ID NO: 591735 - DNA, 20 bp, Artificial
  CRISPR gRNA sequence
cgtacaagaaaactgaatcg

SEQ ID NO: 591736 - DNA, 20 bp, Artificial
  CRISPR gRNA sequence
gaaaactgaatcgcagaaaa

SEQ ID NO: 591737 - DNA, 20 bp, Artificial
  CRISPR gRNA sequence
cgcagaaaacagaattattt

SEQ ID NO: 591738 - DNA, 20 bp, Artificial
  CRISPR gRNA sequence
attatttgagcaaaatcaca

SEQ ID NO: 591739 - DNA, 20 bp, Artificial
  CRISPR gRNA sequence
agcaaaatcacacagctaat

SEQ ID NO: 591740 - DNA, 20 bp, Artificial
  CRISPR gRNA sequence
aaatcacacagctaataagt

SEQ ID NO: 591741 - DNA, 20 bp, Artificial
  CRISPR gRNA sequence
cacagctaataagtaagttg

SEQ ID NO: 591742 - DNA, 20 bp, Artificial
  CRISPR gRNA sequence
cagctaataagtaagttgaa

SEQ ID NO: 591743 - DNA, 20 bp, Artificial
  CRISPR gRNA sequence
ctaataagtaagttgaagag

SEQ ID NO: 591744 - DNA, 20 bp, Artificial
  CRISPR gRNA sequence
taataagtaagttgaagagc

SEQ ID NO: 591745 - DNA, 20 bp, Artificial
  CRISPR gRNA sequence
aataagtaagttgaagagca

SEQ ID NO: 591746 - DNA, 20 bp, Artificial
  CRISPR gRNA sequence
gtaagttgaagagcagggct

SEQ ID NO: 591747 - DNA, 20 bp, Artificial
  CRISPR gRNA sequence
taagttgaagagcagggctt

SEQ ID NO: 591748 - DNA, 20 bp, Artificial
  CRISPR gRNA sequence
tgtttcttcatccctttgaa

SEQ ID NO: 591749 - DNA, 20 bp, Artificial
  CRISPR gRNA sequence
tcttcatccctttgaaaagt

SEQ ID NO: 591750 - DNA, 20 bp, Artificial
  CRISPR gRNA sequence
atccctttgaaaagtgagtc

SEQ ID NO: 591751 - DNA, 20 bp, Artificial
  CRISPR gRNA sequence
cctttgaaaagtgagtccag

SEQ ID NO: 591752 - DNA, 20 bp, Artificial
  CRISPR gRNA sequence
ctttgaaaagtgagtccaga

SEQ ID NO: 591753 - DNA, 20 bp, Artificial
  CRISPR gRNA sequence
tttgaaaagtgagtccagaa

SEQ ID NO: 591754 - DNA, 20 bp, Artificial
  CRISPR gRNA sequence
agaagggtaattttacattt

SEQ ID NO: 591755 - DNA, 20 bp, Artificial
  CRISPR gRNA sequence
aattttacattttagtgaaa

SEQ ID NO: 591756 - DNA, 20 bp, Artificial
  CRISPR gRNA sequence
ttttacattttagtgaaata

SEQ ID NO: 591757 - DNA, 20 bp, Artificial
  CRISPR gRNA sequence
acattttagtgaaatagagt

SEQ ID NO: 591758 - DNA, 20 bp, Artificial
  CRISPR gRNA sequence
ttttagtgaaatagagtgag

SEQ ID NO: 591759 - DNA, 20 bp, Artificial
  CRISPR gRNA sequence
gagtggctacctaattttga

SEQ ID NO: 591760 - DNA, 20 bp, Artificial
  CRISPR gRNA sequence
ttctcatttatctgtctcat

SEQ ID NO: 591761 - DNA, 20 bp, Artificial
  CRISPR gRNA sequence
atttatctgtctcattagca

SEQ ID NO: 591762 - DNA, 20 bp, Artificial
  CRISPR gRNA sequence
atctgtctcattagcatgga

SEQ ID NO: 591763 - DNA, 20 bp, Artificial
  CRISPR gRNA sequence
tctcattagcatggacagac

SEQ ID NO: 591764 - DNA, 20 bp, Artificial
  CRISPR gRNA sequence
attagcatggacagaccaga

SEQ ID NO: 591765 - DNA, 20 bp, Artificial
  CRISPR gRNA sequence
cagatggacaacccaccata

SEQ ID NO: 591766 - DNA, 20 bp, Artificial
  CRISPR gRNA sequence
tggacaacccaccatataga

SEQ ID NO: 591767 - DNA, 20 bp, Artificial
  CRISPR gRNA sequence
tgtcatttcctgccaaacca

SEQ ID NO: 591768 - DNA, 20 bp, Artificial
  CRISPR gRNA sequence
tcacaaccaaactgctctct

SEQ ID NO: 591769 - DNA, 20 bp, Artificial
  CRISPR gRNA sequence
ttttctgtttccaaacctat

SEQ ID NO: 591770 - DNA, 20 bp, Artificial
  CRISPR gRNA sequence
tccaaacctatgagaaacaa

SEQ ID NO: 591771 - DNA, 20 bp, Artificial
  CRISPR gRNA sequence
aaacctatgagaaacaatag

SEQ ID NO: 591772 - DNA, 20 bp, Artificial
  CRISPR gRNA sequence
tatgagaaacaatagtggca

SEQ ID NO: 591773 - DNA, 20 bp, Artificial
  CRISPR gRNA sequence
agaaacaatagtggcatggt

SEQ ID NO: 591774 - DNA, 20 bp, Artificial
  CRISPR gRNA sequence
agtactaacttctgatatgt

SEQ ID NO: 591775 - DNA, 20 bp, Artificial
  CRISPR gRNA sequence
gtactaacttctgatatgtc

SEQ ID NO: 591776 - DNA, 20 bp, Artificial
  CRISPR gRNA sequence
gatatgtcaggttgatatga

SEQ ID NO: 591777 - DNA, 20 bp, Artificial
  CRISPR gRNA sequence
atgtcaggttgatatgacag

SEQ ID NO: 591778 - DNA, 20 bp, Artificial
  CRISPR gRNA sequence
ggttgatatgacagtagtac

SEQ ID NO: 591779 - DNA, 20 bp, Artificial
  CRISPR gRNA sequence
tgaaaaataaaccttaaata

SEQ ID NO: 591780 - DNA, 20 bp, Artificial
  CRISPR gRNA sequence
ctaattttctcttttttgtt

SEQ ID NO: 591781 - DNA, 20 bp, Artificial
  CRISPR gRNA sequence
taattttctcttttttgttg

SEQ ID NO: 591782 - DNA, 20 bp, Artificial
  CRISPR gRNA sequence
aattttctcttttttgttga

SEQ ID NO: 591783 - DNA, 20 bp, Artificial
  CRISPR gRNA sequence
ttttctcttttttgttgagg

SEQ ID NO: 591784 - DNA, 20 bp, Artificial
  CRISPR gRNA sequence
tctcttttttgttgagggag

SEQ ID NO: 591785 - DNA, 20 bp, Artificial
  CRISPR gRNA sequence
ctcttttttgttgagggaga

SEQ ID NO: 591786 - DNA, 20 bp, Artificial
  CRISPR gRNA sequence
tcttttttgttgagggagaa

SEQ ID NO: 591787 - DNA, 20 bp, Artificial
  CRISPR gRNA sequence
cttttttgttgagggagaag

SEQ ID NO: 591788 - DNA, 20 bp, Artificial
  CRISPR gRNA sequence
ttttttgttgagggagaagg

SEQ ID NO: 591789 - DNA, 20 bp, Artificial
  CRISPR gRNA sequence
ttttgttgagggagaagggg

SEQ ID NO: 591790 - DNA, 20 bp, Artificial
  CRISPR gRNA sequence
tgttgagggagaagggggag

SEQ ID NO: 591791 - DNA, 20 bp, Artificial
  CRISPR gRNA sequence
gttgagggagaagggggaga

SEQ ID NO: 591792 - DNA, 20 bp, Artificial
  CRISPR gRNA sequence
gaagggggagaaggtctata

SEQ ID NO: 591793 - DNA, 20 bp, Artificial
  CRISPR gRNA sequence
gggggagaaggtctataaag

SEQ ID NO: 591794 - DNA, 20 bp, Artificial
  CRISPR gRNA sequence
gggagaaggtctataaagaa

SEQ ID NO: 591795 - DNA, 20 bp, Artificial
  CRISPR gRNA sequence
aggtctataaagaagagtct

SEQ ID NO: 591796 - DNA, 20 bp, Artificial
  CRISPR gRNA sequence
ctataaagaagagtcttggt

SEQ ID NO: 591797 - DNA, 20 bp, Artificial
  CRISPR gRNA sequence
tataaagaagagtcttggtt

SEQ ID NO: 591798 - DNA, 20 bp, Artificial
  CRISPR gRNA sequence
agagtcttggttgggtgtca

SEQ ID NO: 591799 - DNA, 20 bp, Artificial
  CRISPR gRNA sequence
ggtgtcatggctcatgcctg

SEQ ID NO: 591800 - DNA, 20 bp, Artificial
  CRISPR gRNA sequence
gctcatgcctgtagtcccaa

SEQ ID NO: 591801 - DNA, 20 bp, Artificial
  CRISPR gRNA sequence
tgcctgtagtcccaacagtt

SEQ ID NO: 591802 - DNA, 20 bp, Artificial
  CRISPR gRNA sequence
gcctgtagtcccaacagttt

SEQ ID NO: 591803 - DNA, 20 bp, Artificial
  CRISPR gRNA sequence
ctgtagtcccaacagtttgg

SEQ ID NO: 591804 - DNA, 20 bp, Artificial
  CRISPR gRNA sequence
gtcccaacagtttgggagcc

SEQ ID NO: 591805 - DNA, 20 bp, Artificial
  CRISPR gRNA sequence
tcccaacagtttgggagcct

SEQ ID NO: 591806 - DNA, 20 bp, Artificial
  CRISPR gRNA sequence
caacagtttgggagcctggg

SEQ ID NO: 591807 - DNA, 20 bp, Artificial
  CRISPR gRNA sequence
ggagcctgggtagatcactt

SEQ ID NO: 591808 - DNA, 20 bp, Artificial
  CRISPR gRNA sequence
ggtagatcacttgagcccac

SEQ ID NO: 591809 - DNA, 20 bp, Artificial
  CRISPR gRNA sequence
tcacttgagcccactggttc

SEQ ID NO: 591810 - DNA, 20 bp, Artificial
  CRISPR gRNA sequence
tgagcccactggttcaagac

SEQ ID NO: 591811 - DNA, 20 bp, Artificial
  CRISPR gRNA sequence
ccactggttcaagacgagcc

SEQ ID NO: 591812 - DNA, 20 bp, Artificial
  CRISPR gRNA sequence
cactggttcaagacgagcct

SEQ ID NO: 591813 - DNA, 20 bp, Artificial
  CRISPR gRNA sequence
caagacgagcctgggcaaca

SEQ ID NO: 591814 - DNA, 20 bp, Artificial
  CRISPR gRNA sequence
gacgagcctgggcaacatag

SEQ ID NO: 591815 - DNA, 20 bp, Artificial
  CRISPR gRNA sequence
acgagcctgggcaacatagt

SEQ ID NO: 591816 - DNA, 20 bp, Artificial
  CRISPR gRNA sequence
tatacaaaaaatttaaaatg

SEQ ID NO: 591817 - DNA, 20 bp, Artificial
  CRISPR gRNA sequence
caaaaaatttaaaatgtagc

SEQ ID NO: 591818 - DNA, 20 bp, Artificial
  CRISPR gRNA sequence
aaaaaatttaaaatgtagcc

SEQ ID NO: 591819 - DNA, 20 bp, Artificial
  CRISPR gRNA sequence
atttaaaatgtagccaggtg

SEQ ID NO: 591820 - DNA, 20 bp, Artificial
  CRISPR gRNA sequence
taaaatgtagccaggtgtgg

SEQ ID NO: 591821 - DNA, 20 bp, Artificial
  CRISPR gRNA sequence
ggtgtggtagtgcgtgtttg

SEQ ID NO: 591822 - DNA, 20 bp, Artificial
  CRISPR gRNA sequence
tgtttgtagtcccaactact

SEQ ID NO: 591823 - DNA, 20 bp, Artificial
  CRISPR gRNA sequence
gtttgtagtcccaactactt

SEQ ID NO: 591824 - DNA, 20 bp, Artificial
  CRISPR gRNA sequence
tttgtagtcccaactacttg

SEQ ID NO: 591825 - DNA, 20 bp, Artificial
  CRISPR gRNA sequence
ttgtagtcccaactacttgg

SEQ ID NO: 591826 - DNA, 20 bp, Artificial
  CRISPR gRNA sequence
gtcccaactacttgggggac

SEQ ID NO: 591827 - DNA, 20 bp, Artificial
  CRISPR gRNA sequence
tcccaactacttgggggact

SEQ ID NO: 591828 - DNA, 20 bp, Artificial
  CRISPR gRNA sequence
aactacttgggggactggga

SEQ ID NO: 591829 - DNA, 20 bp, Artificial
  CRISPR gRNA sequence
actacttgggggactgggac

SEQ ID NO: 591830 - DNA, 20 bp, Artificial
  CRISPR gRNA sequence
tacttgggggactgggacag

SEQ ID NO: 591831 - DNA, 20 bp, Artificial
  CRISPR gRNA sequence
ctgggacaggagtattgctt

SEQ ID NO: 591832 - DNA, 20 bp, Artificial
  CRISPR gRNA sequence
acaggagtattgcttcagcc

SEQ ID NO: 591833 - DNA, 20 bp, Artificial
  CRISPR gRNA sequence
caggagtattgcttcagccc

SEQ ID NO: 591834 - DNA, 20 bp, Artificial
  CRISPR gRNA sequence
ggagtattgcttcagcccag

SEQ ID NO: 591835 - DNA, 20 bp, Artificial
  CRISPR gRNA sequence
ttgcttcagcccaggagttc

SEQ ID NO: 591836 - DNA, 20 bp, Artificial
  CRISPR gRNA sequence
tgcttcagcccaggagttca

SEQ ID NO: 591837 - DNA, 20 bp, Artificial
  CRISPR gRNA sequence
tcagcccaggagttcaaggc

SEQ ID NO: 591838 - DNA, 20 bp, Artificial
  CRISPR gRNA sequence
agcccaggagttcaaggctg

SEQ ID NO: 591839 - DNA, 20 bp, Artificial
  CRISPR gRNA sequence
caggagttcaaggctggagt

SEQ ID NO: 591840 - DNA, 20 bp, Artificial
  CRISPR gRNA sequence
atgattgtgccactgtactg

SEQ ID NO: 591841 - DNA, 20 bp, Artificial
  CRISPR gRNA sequence
tgtgccactgtactgaagcc

SEQ ID NO: 591842 - DNA, 20 bp, Artificial
  CRISPR gRNA sequence
gtgccactgtactgaagcct

SEQ ID NO: 591843 - DNA, 20 bp, Artificial
  CRISPR gRNA sequence
ctgaagcctaggtgacacaa

SEQ ID NO: 591844 - DNA, 20 bp, Artificial
  CRISPR gRNA sequence
gcctaggtgacacaatagaa

SEQ ID NO: 591845 - DNA, 20 bp, Artificial
  CRISPR gRNA sequence
tgacacaatagaaaagaaaa

SEQ ID NO: 591846 - DNA, 20 bp, Artificial
  CRISPR gRNA sequence
cacaatagaaaagaaaaaag

SEQ ID NO: 591847 - DNA, 20 bp, Artificial
  CRISPR gRNA sequence
acaatagaaaagaaaaaaga

SEQ ID NO: 591848 - DNA, 20 bp, Artificial
  CRISPR gRNA sequence
tagaaaagaaaaaagaagga

SEQ ID NO: 591849 - DNA, 20 bp, Artificial
  CRISPR gRNA sequence
agaaaagaaaaaagaaggaa

SEQ ID NO: 591850 - DNA, 20 bp, Artificial
  CRISPR gRNA sequence
aagaaaaaagaaggaaagga

SEQ ID NO: 591851 - DNA, 20 bp, Artificial
  CRISPR gRNA sequence
agaaaaaagaaggaaaggaa

SEQ ID NO: 591852 - DNA, 20 bp, Artificial
  CRISPR gRNA sequence
aaaaagaaggaaaggaaagg

SEQ ID NO: 591853 - DNA, 20 bp, Artificial
  CRISPR gRNA sequence
agaaggaaaggaaaggaaga

SEQ ID NO: 591854 - DNA, 20 bp, Artificial
  CRISPR gRNA sequence
aggaaaggaaaggaagaaag

SEQ ID NO: 591855 - DNA, 20 bp, Artificial
  CRISPR gRNA sequence
ggaaaggaaaggaagaaaga

SEQ ID NO: 591856 - DNA, 20 bp, Artificial
  CRISPR gRNA sequence
aaggaaaggaagaaagaagg

SEQ ID NO: 591857 - DNA, 20 bp, Artificial
  CRISPR gRNA sequence
aggaaaggaagaaagaagga

SEQ ID NO: 591858 - DNA, 20 bp, Artificial
  CRISPR gRNA sequence
aaaggaagaaagaaggaagg

SEQ ID NO: 591859 - DNA, 20 bp, Artificial
  CRISPR gRNA sequence
aaggaagaaagaaggaagga

SEQ ID NO: 591860 - DNA, 20 bp, Artificial
  CRISPR gRNA sequence
gaagaaagaaggaaggaagg

SEQ ID NO: 591861 - DNA, 20 bp, Artificial
  CRISPR gRNA sequence
aagaaggaaggaaggaagca

SEQ ID NO: 591862 - DNA, 20 bp, Artificial
  CRISPR gRNA sequence
aaggaaggaaggaagcatgg

SEQ ID NO: 591863 - DNA, 20 bp, Artificial
  CRISPR gRNA sequence
aggaaggaaggaagcatgga

SEQ ID NO: 591864 - DNA, 20 bp, Artificial
  CRISPR gRNA sequence
aaggaaggaagcatggaagg

SEQ ID NO: 591865 - DNA, 20 bp, Artificial
  CRISPR gRNA sequence
aggaaggaagcatggaagga

SEQ ID NO: 591866 - DNA, 20 bp, Artificial
  CRISPR gRNA sequence
aaggaagcatggaaggaagg

SEQ ID NO: 591867 - DNA, 20 bp, Artificial
  CRISPR gRNA sequence
aggaagcatggaaggaagga

SEQ ID NO: 591868 - DNA, 20 bp, Artificial
  CRISPR gRNA sequence
aagcatggaaggaaggaagg

SEQ ID NO: 591869 - DNA, 20 bp, Artificial
  CRISPR gRNA sequence
agcatggaaggaaggaagga

SEQ ID NO: 591870 - DNA, 20 bp, Artificial
  CRISPR gRNA sequence
tggaaggaaggaaggaagga

SEQ ID NO: 591871 - DNA, 20 bp, Artificial
  CRISPR gRNA sequence
ggaaggaaggaaggaaggaa

SEQ ID NO: 591872 - DNA, 20 bp, Artificial
  CRISPR gRNA sequence
aaggaaggaaggaaggaaag

SEQ ID NO: 591873 - DNA, 20 bp, Artificial
  CRISPR gRNA sequence
aggaaggaaggaaggaaagg

SEQ ID NO: 591874 - DNA, 20 bp, Artificial
  CRISPR gRNA sequence
ggaaggaaggaaggaaagga

SEQ ID NO: 591875 - DNA, 20 bp, Artificial
  CRISPR gRNA sequence
aaggaaggaaggaaaggagg

SEQ ID NO: 591876 - DNA, 20 bp, Artificial
  CRISPR gRNA sequence
aggaaggaaggaaaggaggg

SEQ ID NO: 591877 - DNA, 20 bp, Artificial
  CRISPR gRNA sequence
ggaaggaaggaaaggaggga

SEQ ID NO: 591878 - DNA, 20 bp, Artificial
  CRISPR gRNA sequence
aaggaaggaaaggagggagg

SEQ ID NO: 591879 - DNA, 20 bp, Artificial
  CRISPR gRNA sequence
aggaaggaaaggagggaggg

SEQ ID NO: 591880 - DNA, 20 bp, Artificial
  CRISPR gRNA sequence
ggaaggaaaggagggaggga

SEQ ID NO: 591881 - DNA, 20 bp, Artificial
  CRISPR gRNA sequence
aggaaaggagggagggaggg

SEQ ID NO: 591882 - DNA, 20 bp, Artificial
  CRISPR gRNA sequence
aaaggagggagggagggtgg

SEQ ID NO: 591883 - DNA, 20 bp, Artificial
  CRISPR gRNA sequence
aaggagggagggagggtgga

SEQ ID NO: 591884 - DNA, 20 bp, Artificial
  CRISPR gRNA sequence
gagggagggagggtggaagg

SEQ ID NO: 591885 - DNA, 20 bp, Artificial
  CRISPR gRNA sequence
agggagggagggtggaagga

SEQ ID NO: 591886 - DNA, 20 bp, Artificial
  CRISPR gRNA sequence
agggagggtggaaggaagga

SEQ ID NO: 591887 - DNA, 20 bp, Artificial
  CRISPR gRNA sequence
gggagggtggaaggaaggaa

SEQ ID NO: 591888 - DNA, 20 bp, Artificial
  CRISPR gRNA sequence
gagggtggaaggaaggaaag

SEQ ID NO: 591889 - DNA, 20 bp, Artificial
  CRISPR gRNA sequence
agggtggaaggaaggaaagg

SEQ ID NO: 591890 - DNA, 20 bp, Artificial
  CRISPR gRNA sequence
gggtggaaggaaggaaagga

SEQ ID NO: 591891 - DNA, 20 bp, Artificial
  CRISPR gRNA sequence
gtggaaggaaggaaaggagg

SEQ ID NO: 591892 - DNA, 20 bp, Artificial
  CRISPR gRNA sequence
tggaaggaaggaaaggaggg

SEQ ID NO: 591893 - DNA, 20 bp, Artificial
  CRISPR gRNA sequence
ggaaggaaggaaaggaggga

SEQ ID NO: 591894 - DNA, 20 bp, Artificial
  CRISPR gRNA sequence
gaaggaaggaaaggagggag

SEQ ID NO: 591895 - DNA, 20 bp, Artificial
  CRISPR gRNA sequence
aaggaaggaaaggagggagg

SEQ ID NO: 591896 - DNA, 20 bp, Artificial
  CRISPR gRNA sequence
ggaaggaaaggagggagggg

SEQ ID NO: 591897 - DNA, 20 bp, Artificial
  CRISPR gRNA sequence
aaggaaaggagggaggggga

SEQ ID NO: 591898 - DNA, 20 bp, Artificial
  CRISPR gRNA sequence
ggaaaggagggagggggaga

SEQ ID NO: 591899 - DNA, 20 bp, Artificial
  CRISPR gRNA sequence
gggagggggagagagaaaaa

SEQ ID NO: 591900 - DNA, 20 bp, Artificial
  CRISPR gRNA sequence
gggggagagagaaaaaaaga

SEQ ID NO: 591901 - DNA, 20 bp, Artificial
  CRISPR gRNA sequence
gggagagagaaaaaaagaaa

SEQ ID NO: 591902 - DNA, 20 bp, Artificial
  CRISPR gRNA sequence
gagagagaaaaaaagaaaga

SEQ ID NO: 591903 - DNA, 20 bp, Artificial
  CRISPR gRNA sequence
gagagaaaaaaagaaagaga

SEQ ID NO: 591904 - DNA, 20 bp, Artificial
  CRISPR gRNA sequence
gagaaaaaaagaaagagaga

SEQ ID NO: 591905 - DNA, 20 bp, Artificial
  CRISPR gRNA sequence
gaaaaaaagaaagagagaga

SEQ ID NO: 591906 - DNA, 20 bp, Artificial
  CRISPR gRNA sequence
aaaaagaaagagagagagag

SEQ ID NO: 591907 - DNA, 20 bp, Artificial
  CRISPR gRNA sequence
agaaagagagagagagaaga

SEQ ID NO: 591908 - DNA, 20 bp, Artificial
  CRISPR gRNA sequence
gaaagagagagagagaagaa

SEQ ID NO: 591909 - DNA, 20 bp, Artificial
  CRISPR gRNA sequence
agagagagagagaagaaagg

SEQ ID NO: 591910 - DNA, 20 bp, Artificial
  CRISPR gRNA sequence
gagagagagagaagaaagga

SEQ ID NO: 591911 - DNA, 20 bp, Artificial
  CRISPR gRNA sequence
agagagagaagaaaggaagg

SEQ ID NO: 591912 - DNA, 20 bp, Artificial
  CRISPR gRNA sequence
gagagagaagaaaggaagga

SEQ ID NO: 591913 - DNA, 20 bp, Artificial
  CRISPR gRNA sequence
agagaagaaaggaaggaagg

SEQ ID NO: 591914 - DNA, 20 bp, Artificial
  CRISPR gRNA sequence
gagaagaaaggaaggaaggc

SEQ ID NO: 591915 - DNA, 20 bp, Artificial
  CRISPR gRNA sequence
aagaaaggaaggaaggcagg

SEQ ID NO: 591916 - DNA, 20 bp, Artificial
  CRISPR gRNA sequence
agaaaggaaggaaggcagga

SEQ ID NO: 591917 - DNA, 20 bp, Artificial
  CRISPR gRNA sequence
gaaaggaaggaaggcaggaa

SEQ ID NO: 591918 - DNA, 20 bp, Artificial
  CRISPR gRNA sequence
aaggaaggaaggcaggaagg

SEQ ID NO: 591919 - DNA, 20 bp, Artificial
  CRISPR gRNA sequence
aggaaggaaggcaggaaggg

SEQ ID NO: 591920 - DNA, 20 bp, Artificial
  CRISPR gRNA sequence
ggaaggaaggcaggaaggga

SEQ ID NO: 591921 - DNA, 20 bp, Artificial
  CRISPR gRNA sequence
aaggaaggcaggaagggagg

SEQ ID NO: 591922 - DNA, 20 bp, Artificial
  CRISPR gRNA sequence
aggaaggcaggaagggaggg

SEQ ID NO: 591923 - DNA, 20 bp, Artificial
  CRISPR gRNA sequence
ggaaggcaggaagggaggga

SEQ ID NO: 591924 - DNA, 20 bp, Artificial
  CRISPR gRNA sequence
aggcaggaagggagggaggg

SEQ ID NO: 591925 - DNA, 20 bp, Artificial
  CRISPR gRNA sequence
ggcaggaagggagggaggga

SEQ ID NO: 591926 - DNA, 20 bp, Artificial
  CRISPR gRNA sequence
aggaagggagggagggaagg

SEQ ID NO: 591927 - DNA, 20 bp, Artificial
  CRISPR gRNA sequence
ggaagggagggagggaagga

SEQ ID NO: 591928 - DNA, 20 bp, Artificial
  CRISPR gRNA sequence
aagggagggagggaaggaag

SEQ ID NO: 591929 - DNA, 20 bp, Artificial
  CRISPR gRNA sequence
gagggagggaaggaaggaga

SEQ ID NO: 591930 - DNA, 20 bp, Artificial
  CRISPR gRNA sequence
agggagggaaggaaggagaa

SEQ ID NO: 591931 - DNA, 20 bp, Artificial
  CRISPR gRNA sequence
gggagggaaggaaggagaaa

SEQ ID NO: 591932 - DNA, 20 bp, Artificial
  CRISPR gRNA sequence
ggagggaaggaaggagaaag

SEQ ID NO: 591933 - DNA, 20 bp, Artificial
  CRISPR gRNA sequence
agggaaggaaggagaaaggg

SEQ ID NO: 591934 - DNA, 20 bp, Artificial
  CRISPR gRNA sequence
ggaaggaaggagaaagggga

SEQ ID NO: 591935 - DNA, 20 bp, Artificial
  CRISPR gRNA sequence
aaggaaggagaaaggggaga

SEQ ID NO: 591936 - DNA, 20 bp, Artificial
  CRISPR gRNA sequence
ggaaggagaaaggggagaga

SEQ ID NO: 591937 - DNA, 20 bp, Artificial
  CRISPR gRNA sequence
aaggagaaaggggagagaga

SEQ ID NO: 591938 - DNA, 20 bp, Artificial
  CRISPR gRNA sequence
agaaaggggagagagagaga

SEQ ID NO: 591939 - DNA, 20 bp, Artificial
  CRISPR gRNA sequence
aaaggggagagagagagaca

SEQ ID NO: 591940 - DNA, 20 bp, Artificial
  CRISPR gRNA sequence
gggagagagagagacagaga

SEQ ID NO: 591941 - DNA, 20 bp, Artificial
  CRISPR gRNA sequence
gagagagagagacagagaaa

SEQ ID NO: 591942 - DNA, 20 bp, Artificial
  CRISPR gRNA sequence
agagagacagagaaagagaa

SEQ ID NO: 591943 - DNA, 20 bp, Artificial
  CRISPR gRNA sequence
gacagagaaagagaaaagaa

SEQ ID NO: 591944 - DNA, 20 bp, Artificial
  CRISPR gRNA sequence
taaatttcttgtatactacc

SEQ ID NO: 591945 - DNA, 20 bp, Artificial
  CRISPR gRNA sequence
aatttcttgtatactaccaa

SEQ ID NO: 591946 - DNA, 20 bp, Artificial
  CRISPR gRNA sequence
tttcttgtatactaccaaga

SEQ ID NO: 591947 - DNA, 20 bp, Artificial
  CRISPR gRNA sequence
ttgtatactaccaagagaga

SEQ ID NO: 591948 - DNA, 20 bp, Artificial
  CRISPR gRNA sequence
aagcttgtgttgtcccacca

SEQ ID NO: 591949 - DNA, 20 bp, Artificial
  CRISPR gRNA sequence
ttgtgttgtcccaccacagt

SEQ ID NO: 591950 - DNA, 20 bp, Artificial
  CRISPR gRNA sequence
tgtgttgtcccaccacagtt

SEQ ID NO: 591951 - DNA, 20 bp, Artificial
  CRISPR gRNA sequence
gttgtcccaccacagttggg

SEQ ID NO: 591952 - DNA, 20 bp, Artificial
  CRISPR gRNA sequence
ttgtcccaccacagttgggc

SEQ ID NO: 591953 - DNA, 20 bp, Artificial
  CRISPR gRNA sequence
gttgggcaggatacatttgc

SEQ ID NO: 591954 - DNA, 20 bp, Artificial
  CRISPR gRNA sequence
caggatacatttgccagccc

SEQ ID NO: 591955 - DNA, 20 bp, Artificial
  CRISPR gRNA sequence
aagtaaaaatatgattaaaa

SEQ ID NO: 591956 - DNA, 20 bp, Artificial
  CRISPR gRNA sequence
agtaaaaatatgattaaaat

SEQ ID NO: 591957 - DNA, 20 bp, Artificial
  CRISPR gRNA sequence
aaatatgattaaaataggca

SEQ ID NO: 591958 - DNA, 20 bp, Artificial
  CRISPR gRNA sequence
ttactttctctatgttttcc

SEQ ID NO: 591959 - DNA, 20 bp, Artificial
  CRISPR gRNA sequence
ctttctctatgttttcctag

SEQ ID NO: 591960 - DNA, 20 bp, Artificial
  CRISPR gRNA sequence
agcaacttccatttttccca

SEQ ID NO: 591961 - DNA, 20 bp, Artificial
  CRISPR gRNA sequence
cccaaagtgctacccacctt

SEQ ID NO: 591962 - DNA, 20 bp, Artificial
  CRISPR gRNA sequence
ccaaagtgctacccacctta

SEQ ID NO: 591963 - DNA, 20 bp, Artificial
  CRISPR gRNA sequence
cccaccttaaggcatctaat

SEQ ID NO: 591964 - DNA, 20 bp, Artificial
  CRISPR gRNA sequence
cccactgtttttccaccctc

SEQ ID NO: 591965 - DNA, 20 bp, Artificial
  CRISPR gRNA sequence
ccaccctccagtttgatgcc

SEQ ID NO: 591966 - DNA, 20 bp, Artificial
  CRISPR gRNA sequence
ttttcatttctcctatcacc

SEQ ID NO: 591967 - DNA, 20 bp, Artificial
  CRISPR gRNA sequence
atcacctggaaccctgccaa

SEQ ID NO: 591968 - DNA, 20 bp, Artificial
  CRISPR gRNA sequence
gaaccctgccaaaagctttt

SEQ ID NO: 591969 - DNA, 20 bp, Artificial
  CRISPR gRNA sequence
aaccctgccaaaagcttttt

SEQ ID NO: 591970 - DNA, 20 bp, Artificial
  CRISPR gRNA sequence
acctaatctgataaactgct

SEQ ID NO: 591971 - DNA, 20 bp, Artificial
  CRISPR gRNA sequence
ataaactgctgagcaatatt

SEQ ID NO: 591972 - DNA, 20 bp, Artificial
  CRISPR gRNA sequence
actgctgagcaatatttagc

SEQ ID NO: 591973 - DNA, 20 bp, Artificial
  CRISPR gRNA sequence
aaaacacatgtacccaattc

SEQ ID NO: 591974 - DNA, 20 bp, Artificial
  CRISPR gRNA sequence
tcccacaacttacaactaca

SEQ ID NO: 591975 - DNA, 20 bp, Artificial
  CRISPR gRNA sequence
acttacaactacaaagttca

SEQ ID NO: 591976 - DNA, 20 bp, Artificial
  CRISPR gRNA sequence
cttacaactacaaagttcaa

SEQ ID NO: 591977 - DNA, 20 bp, Artificial
  CRISPR gRNA sequence
tacaaagttcaaaggaacaa

SEQ ID NO: 591978 - DNA, 20 bp, Artificial
  CRISPR gRNA sequence
agaaataaaaacactctcct

SEQ ID NO: 591979 - DNA, 20 bp, Artificial
  CRISPR gRNA sequence
aaataaaaacactctcctaa

SEQ ID NO: 591980 - DNA, 20 bp, Artificial
  CRISPR gRNA sequence
aaacactctcctaagagaaa

SEQ ID NO: 591981 - DNA, 20 bp, Artificial
  CRISPR gRNA sequence
acactctcctaagagaaaaa

SEQ ID NO: 591982 - DNA, 20 bp, Artificial
  CRISPR gRNA sequence
ctcctaagagaaaaagagat

SEQ ID NO: 591983 - DNA, 20 bp, Artificial
  CRISPR gRNA sequence
agagaaaaagagataagcct

SEQ ID NO: 591984 - DNA, 20 bp, Artificial
  CRISPR gRNA sequence
ctgagcttctatttaccctg

SEQ ID NO: 591985 - DNA, 20 bp, Artificial
  CRISPR gRNA sequence
atatatttaaaaaatctata

SEQ ID NO: 591986 - DNA, 20 bp, Artificial
  CRISPR gRNA sequence
atatttaaaaaatctatata

SEQ ID NO: 591987 - DNA, 20 bp, Artificial
  CRISPR gRNA sequence
ttaaaaaatctatatagaga

SEQ ID NO: 591988 - DNA, 20 bp, Artificial
  CRISPR gRNA sequence
aaaatctatatagagataga

SEQ ID NO: 591989 - DNA, 20 bp, Artificial
  CRISPR gRNA sequence
tctatatagagatagataga

SEQ ID NO: 591990 - DNA, 20 bp, Artificial
  CRISPR gRNA sequence
tatagagatagatagataga

SEQ ID NO: 591991 - DNA, 20 bp, Artificial
  CRISPR gRNA sequence
gagatagatagatagataga

SEQ ID NO: 591992 - DNA, 20 bp, Artificial
  CRISPR gRNA sequence
tagatagatagatagataga

SEQ ID NO: 591993 - DNA, 20 bp, Artificial
  CRISPR gRNA sequence
gatagatagatagatagata

SEQ ID NO: 591994 - DNA, 20 bp, Artificial
  CRISPR gRNA sequence
tctgttatgatgtgataata

SEQ ID NO: 591995 - DNA, 20 bp, Artificial
  CRISPR gRNA sequence
ttatgatgtgataatatgga

SEQ ID NO: 591996 - DNA, 20 bp, Artificial
  CRISPR gRNA sequence
tatgatgtgataatatggaa

SEQ ID NO: 591997 - DNA, 20 bp, Artificial
  CRISPR gRNA sequence
atgatgtgataatatggaaa

SEQ ID NO: 591998 - DNA, 20 bp, Artificial
  CRISPR gRNA sequence
gatgtgataatatggaaagg

SEQ ID NO: 591999 - DNA, 20 bp, Artificial
  CRISPR gRNA sequence
ataatttacaaatactgtgt

SEQ ID NO: 592000 - DNA, 20 bp, Artificial
  CRISPR gRNA sequence
actgtgtcagtgaacttcta

SEQ ID NO: 592001 - DNA, 20 bp, Artificial
  CRISPR gRNA sequence
tgtcagtgaacttctaaagt

SEQ ID NO: 592002 - DNA, 20 bp, Artificial
  CRISPR gRNA sequence
gaaattactttaaaataatt

SEQ ID NO: 592003 - DNA, 20 bp, Artificial
  CRISPR gRNA sequence
aaattactttaaaataattt

SEQ ID NO: 592004 - DNA, 20 bp, Artificial
  CRISPR gRNA sequence
attactttaaaataatttgg

SEQ ID NO: 592005 - DNA, 20 bp, Artificial
  CRISPR gRNA sequence
ttactttaaaataatttggg

SEQ ID NO: 592006 - DNA, 20 bp, Artificial
  CRISPR gRNA sequence
tactttaaaataatttggga

SEQ ID NO: 592007 - DNA, 20 bp, Artificial
  CRISPR gRNA sequence
ttaaaataatttgggaggga

SEQ ID NO: 592008 - DNA, 20 bp, Artificial
  CRISPR gRNA sequence
atttgggagggaaagtattt

SEQ ID NO: 592009 - DNA, 20 bp, Artificial
  CRISPR gRNA sequence
tttgggagggaaagtatttt

SEQ ID NO: 592010 - DNA, 20 bp, Artificial
  CRISPR gRNA sequence
agggaaagtattttgggata

SEQ ID NO: 592011 - DNA, 20 bp, Artificial
  CRISPR gRNA sequence
ggaaagtattttgggatatg

SEQ ID NO: 592012 - DNA, 20 bp, Artificial
  CRISPR gRNA sequence
gaaagtattttgggatatgg

SEQ ID NO: 592013 - DNA, 20 bp, Artificial
  CRISPR gRNA sequence
ttttgggatatggaggcaca

SEQ ID NO: 592014 - DNA, 20 bp, Artificial
  CRISPR gRNA sequence
tttgggatatggaggcacaa

SEQ ID NO: 592015 - DNA, 20 bp, Artificial
  CRISPR gRNA sequence
tatccaaattttcaacatta

SEQ ID NO: 592016 - DNA, 20 bp, Artificial
  CRISPR gRNA sequence
atccaaattttcaacattaa

SEQ ID NO: 592017 - DNA, 20 bp, Artificial
  CRISPR gRNA sequence
aaattttcaacattaaagga

SEQ ID NO: 592018 - DNA, 20 bp, Artificial
  CRISPR gRNA sequence
attttcaacattaaaggaaa

SEQ ID NO: 592019 - DNA, 20 bp, Artificial
  CRISPR gRNA sequence
cattaaaggaaagagaaaac

SEQ ID NO: 592020 - DNA, 20 bp, Artificial
  CRISPR gRNA sequence
attaaaggaaagagaaaacg

SEQ ID NO: 592021 - DNA, 20 bp, Artificial
  CRISPR gRNA sequence
taaaggaaagagaaaacgag

SEQ ID NO: 592022 - DNA, 20 bp, Artificial
  CRISPR gRNA sequence
agaacaaatcaatcaatgaa

SEQ ID NO: 592023 - DNA, 20 bp, Artificial
  CRISPR gRNA sequence
gaacaaatcaatcaatgaat

SEQ ID NO: 592024 - DNA, 20 bp, Artificial
  CRISPR gRNA sequence
aacaaatcaatcaatgaatg

SEQ ID NO: 592025 - DNA, 20 bp, Artificial
  CRISPR gRNA sequence
acaaatcaatcaatgaatgg

SEQ ID NO: 592026 - DNA, 20 bp, Artificial
  CRISPR gRNA sequence
aaatcaatcaatgaatgggg

SEQ ID NO: 592027 - DNA, 20 bp, Artificial
  CRISPR gRNA sequence
atcaatgaatgggggagcaa

SEQ ID NO: 592028 - DNA, 20 bp, Artificial
  CRISPR gRNA sequence
aaactgcaactattataatt

SEQ ID NO: 592029 - DNA, 20 bp, Artificial
  CRISPR gRNA sequence
aattcagaaaactttgaaaa

SEQ ID NO: 592030 - DNA, 20 bp, Artificial
  CRISPR gRNA sequence
aactttgaaaatggttgaaa

SEQ ID NO: 592031 - DNA, 20 bp, Artificial
  CRISPR gRNA sequence
aaatggttgaaatagaaaat

SEQ ID NO: 592032 - DNA, 20 bp, Artificial
  CRISPR gRNA sequence
ctctaataatgtatgactgt

SEQ ID NO: 592033 - DNA, 20 bp, Artificial
  CRISPR gRNA sequence
ctaataatgtatgactgtaa

SEQ ID NO: 592034 - DNA, 20 bp, Artificial
  CRISPR gRNA sequence
atgtatgactgtaagagaca

SEQ ID NO: 592035 - DNA, 20 bp, Artificial
  CRISPR gRNA sequence
tgtatgactgtaagagacat

SEQ ID NO: 592036 - DNA, 20 bp, Artificial
  CRISPR gRNA sequence
aagagacatgggtaaaatgc

SEQ ID NO: 592037 - DNA, 20 bp, Artificial
  CRISPR gRNA sequence
tgggtaaaatgcaagtgatt

SEQ ID NO: 592038 - DNA, 20 bp, Artificial
  CRISPR gRNA sequence
aaaatgcaagtgattaagac

SEQ ID NO: 592039 - DNA, 20 bp, Artificial
  CRISPR gRNA sequence
aagactagttcaaaataaat

SEQ ID NO: 592040 - DNA, 20 bp, Artificial
  CRISPR gRNA sequence
ataaatgagaactaaatgtt

SEQ ID NO: 592041 - DNA, 20 bp, Artificial
  CRISPR gRNA sequence
tgagaactaaatgttcagaa

SEQ ID NO: 592042 - DNA, 20 bp, Artificial
  CRISPR gRNA sequence
tttaaatattttcttacaac

SEQ ID NO: 592043 - DNA, 20 bp, Artificial
  CRISPR gRNA sequence
ctagtaaattttcatgtatc

SEQ ID NO: 592044 - DNA, 20 bp, Artificial
  CRISPR gRNA sequence
gtatctagtgaatattttta

SEQ ID NO: 592045 - DNA, 20 bp, Artificial
  CRISPR gRNA sequence
tatctagtgaatatttttaa

SEQ ID NO: 592046 - DNA, 20 bp, Artificial
  CRISPR gRNA sequence
tttaaatcactgacaaattt

SEQ ID NO: 592047 - DNA, 20 bp, Artificial
  CRISPR gRNA sequence
tcactgacaaatttaagata

SEQ ID NO: 592048 - DNA, 20 bp, Artificial
  CRISPR gRNA sequence
cactgacaaatttaagataa

SEQ ID NO: 592049 - DNA, 20 bp, Artificial
  CRISPR gRNA sequence
caaatttaagataaaggaca

SEQ ID NO: 592050 - DNA, 20 bp, Artificial
  CRISPR gRNA sequence
aaatttaagataaaggacat

SEQ ID NO: 592051 - DNA, 20 bp, Artificial
  CRISPR gRNA sequence
ttaagataaaggacatgggc

SEQ ID NO: 592052 - DNA, 20 bp, Artificial
  CRISPR gRNA sequence
taaaggacatgggctagcca

SEQ ID NO: 592053 - DNA, 20 bp, Artificial
  CRISPR gRNA sequence
ggacatgggctagccatggc

SEQ ID NO: 592054 - DNA, 20 bp, Artificial
  CRISPR gRNA sequence
gggctagccatggcaagaaa

SEQ ID NO: 592055 - DNA, 20 bp, Artificial
  CRISPR gRNA sequence
aaaatcctaactaattctaa

SEQ ID NO: 592056 - DNA, 20 bp, Artificial
  CRISPR gRNA sequence
aaatcctaactaattctaat

SEQ ID NO: 592057 - DNA, 20 bp, Artificial
  CRISPR gRNA sequence
tttgacaattgcaacacata

SEQ ID NO: 592058 - DNA, 20 bp, Artificial
  CRISPR gRNA sequence
gacaattgcaacacatatgg

SEQ ID NO: 592059 - DNA, 20 bp, Artificial
  CRISPR gRNA sequence
acaattgcaacacatatgga

SEQ ID NO: 592060 - DNA, 20 bp, Artificial
  CRISPR gRNA sequence
cacatatggaaggaaaaaaa

SEQ ID NO: 592061 - DNA, 20 bp, Artificial
  CRISPR gRNA sequence
gaaaaaaaaagctatttact

SEQ ID NO: 592062 - DNA, 20 bp, Artificial
  CRISPR gRNA sequence
ccttctctaatccatttaat

SEQ ID NO: 592063 - DNA, 20 bp, Artificial
  CRISPR gRNA sequence
cttctctaatccatttaata

SEQ ID NO: 592064 - DNA, 20 bp, Artificial
  CRISPR gRNA sequence
ttctctaatccatttaataa

SEQ ID NO: 592065 - DNA, 20 bp, Artificial
  CRISPR gRNA sequence
ttaataagggatgaaatgtt

SEQ ID NO: 592066 - DNA, 20 bp, Artificial
  CRISPR gRNA sequence
atcttgacctattgttaaat

SEQ ID NO: 592067 - DNA, 20 bp, Artificial
  CRISPR gRNA sequence
cattaaatatccctttcata

SEQ ID NO: 592068 - DNA, 20 bp, Artificial
  CRISPR gRNA sequence
ttcataaagaaaaaaaaatt

SEQ ID NO: 592069 - DNA, 20 bp, Artificial
  CRISPR gRNA sequence
aagaaaaaaaaatttggtgt

SEQ ID NO: 592070 - DNA, 20 bp, Artificial
  CRISPR gRNA sequence
agaaaaaaaaatttggtgtt

SEQ ID NO: 592071 - DNA, 20 bp, Artificial
  CRISPR gRNA sequence
aaaaaatttggtgttaggtt

SEQ ID NO: 592072 - DNA, 20 bp, Artificial
  CRISPR gRNA sequence
ggtgttaggttgagtttttt

SEQ ID NO: 592073 - DNA, 20 bp, Artificial
  CRISPR gRNA sequence
atctattacaactaataaaa

SEQ ID NO: 592074 - DNA, 20 bp, Artificial
  CRISPR gRNA sequence
acaactaataaaaaagcaat

SEQ ID NO: 592075 - DNA, 20 bp, Artificial
  CRISPR gRNA sequence
aactaataaaaaagcaatta

SEQ ID NO: 592076 - DNA, 20 bp, Artificial
  CRISPR gRNA sequence
ttatatgtccaacatgtatt

SEQ ID NO: 592077 - DNA, 20 bp, Artificial
  CRISPR gRNA sequence
atgtccaacatgtattaagt

SEQ ID NO: 592078 - DNA, 20 bp, Artificial
  CRISPR gRNA sequence
tgtccaacatgtattaagtt

SEQ ID NO: 592079 - DNA, 20 bp, Artificial
  CRISPR gRNA sequence
tgtattaagttaggtctgtg

SEQ ID NO: 592080 - DNA, 20 bp, Artificial
  CRISPR gRNA sequence
gtattaagttaggtctgtga

SEQ ID NO: 592081 - DNA, 20 bp, Artificial
  CRISPR gRNA sequence
aagttaggtctgtgaaggcc

SEQ ID NO: 592082 - DNA, 20 bp, Artificial
  CRISPR gRNA sequence
gttaggtctgtgaaggccta

SEQ ID NO: 592083 - DNA, 20 bp, Artificial
  CRISPR gRNA sequence
gtctgtgaaggcctagagtc

SEQ ID NO: 592084 - DNA, 20 bp, Artificial
  CRISPR gRNA sequence
tctgtgaaggcctagagtct

SEQ ID NO: 592085 - DNA, 20 bp, Artificial
  CRISPR gRNA sequence
gtgaaggcctagagtctagg

SEQ ID NO: 592086 - DNA, 20 bp, Artificial
  CRISPR gRNA sequence
ggcctagagtctaggaagat

SEQ ID NO: 592087 - DNA, 20 bp, Artificial
  CRISPR gRNA sequence
tagagtctaggaagatgagt

SEQ ID NO: 592088 - DNA, 20 bp, Artificial
  CRISPR gRNA sequence
agagtctaggaagatgagta

SEQ ID NO: 592089 - DNA, 20 bp, Artificial
  CRISPR gRNA sequence
ggaagatgagtaaggcccat

SEQ ID NO: 592090 - DNA, 20 bp, Artificial
  CRISPR gRNA sequence
gaagatgagtaaggcccatg

SEQ ID NO: 592091 - DNA, 20 bp, Artificial
  CRISPR gRNA sequence
aagatgagtaaggcccatga

SEQ ID NO: 592092 - DNA, 20 bp, Artificial
  CRISPR gRNA sequence
gagtaaggcccatgagggtc

SEQ ID NO: 592093 - DNA, 20 bp, Artificial
  CRISPR gRNA sequence
taaggcccatgagggtcaag

SEQ ID NO: 592094 - DNA, 20 bp, Artificial
  CRISPR gRNA sequence
agggtcaagtggaaacatac

SEQ ID NO: 592095 - DNA, 20 bp, Artificial
  CRISPR gRNA sequence
gggtcaagtggaaacatacc

SEQ ID NO: 592096 - DNA, 20 bp, Artificial
  CRISPR gRNA sequence
aagtggaaacataccaggcc

SEQ ID NO: 592097 - DNA, 20 bp, Artificial
  CRISPR gRNA sequence
agtggaaacataccaggcct

SEQ ID NO: 592098 - DNA, 20 bp, Artificial
  CRISPR gRNA sequence
ggaaacataccaggcctggg

SEQ ID NO: 592099 - DNA, 20 bp, Artificial
  CRISPR gRNA sequence
aaacataccaggcctgggaa

SEQ ID NO: 592100 - DNA, 20 bp, Artificial
  CRISPR gRNA sequence
taccaggcctgggaagagta

SEQ ID NO: 592101 - DNA, 20 bp, Artificial
  CRISPR gRNA sequence
accaggcctgggaagagtat

SEQ ID NO: 592102 - DNA, 20 bp, Artificial
  CRISPR gRNA sequence
caggcctgggaagagtatag

SEQ ID NO: 592103 - DNA, 20 bp, Artificial
  CRISPR gRNA sequence
aggcctgggaagagtatagg

SEQ ID NO: 592104 - DNA, 20 bp, Artificial
  CRISPR gRNA sequence
cctgggaagagtataggagg

SEQ ID NO: 592105 - DNA, 20 bp, Artificial
  CRISPR gRNA sequence
gaagagtataggaggtagtt

SEQ ID NO: 592106 - DNA, 20 bp, Artificial
  CRISPR gRNA sequence
agtataggaggtagttcaga

SEQ ID NO: 592107 - DNA, 20 bp, Artificial
  CRISPR gRNA sequence
aggtagttcagaaagactta

SEQ ID NO: 592108 - DNA, 20 bp, Artificial
  CRISPR gRNA sequence
tcagaaagacttacagcata

SEQ ID NO: 592109 - DNA, 20 bp, Artificial
  CRISPR gRNA sequence
agaaagacttacagcatata

SEQ ID NO: 592110 - DNA, 20 bp, Artificial
  CRISPR gRNA sequence
agacttacagcatatagagc

SEQ ID NO: 592111 - DNA, 20 bp, Artificial
  CRISPR gRNA sequence
ttacagcatatagagctagc

SEQ ID NO: 592112 - DNA, 20 bp, Artificial
  CRISPR gRNA sequence
cagcatatagagctagccag

SEQ ID NO: 592113 - DNA, 20 bp, Artificial
  CRISPR gRNA sequence
gagctagccagtggttatcc

SEQ ID NO: 592114 - DNA, 20 bp, Artificial
  CRISPR gRNA sequence
tatcccagcaatcaacaaac

SEQ ID NO: 592115 - DNA, 20 bp, Artificial
  CRISPR gRNA sequence
tcccagcaatcaacaaactg

SEQ ID NO: 592116 - DNA, 20 bp, Artificial
  CRISPR gRNA sequence
gcaatcaacaaactggagca

SEQ ID NO: 592117 - DNA, 20 bp, Artificial
  CRISPR gRNA sequence
acaaactggagcatggccca

SEQ ID NO: 592118 - DNA, 20 bp, Artificial
  CRISPR gRNA sequence
caaactggagcatggcccaa

SEQ ID NO: 592119 - DNA, 20 bp, Artificial
  CRISPR gRNA sequence
actggagcatggcccaaagg

SEQ ID NO: 592120 - DNA, 20 bp, Artificial
  CRISPR gRNA sequence
ctggagcatggcccaaaggt

SEQ ID NO: 592121 - DNA, 20 bp, Artificial
  CRISPR gRNA sequence
aaaggtaggtacactgaaat

SEQ ID NO: 592122 - DNA, 20 bp, Artificial
  CRISPR gRNA sequence
aaggtaggtacactgaaatc

SEQ ID NO: 592123 - DNA, 20 bp, Artificial
  CRISPR gRNA sequence
gtacactgaaatcaggatat

SEQ ID NO: 592124 - DNA, 20 bp, Artificial
  CRISPR gRNA sequence
actgaaatcaggatattagc

SEQ ID NO: 592125 - DNA, 20 bp, Artificial
  CRISPR gRNA sequence
aatcaggatattagccagaa

SEQ ID NO: 592126 - DNA, 20 bp, Artificial
  CRISPR gRNA sequence
caggatattagccagaacag

SEQ ID NO: 592127 - DNA, 20 bp, Artificial
  CRISPR gRNA sequence
agaacagaagaaaaaaaaaa

SEQ ID NO: 592128 - DNA, 20 bp, Artificial
  CRISPR gRNA sequence
agaagaaaaaaaaaaaagaa

SEQ ID NO: 592129 - DNA, 20 bp, Artificial
  CRISPR gRNA sequence
gaagaaaaaaaaaaaagaat

SEQ ID NO: 592130 - DNA, 20 bp, Artificial
  CRISPR gRNA sequence
aaaaaaaagaataggtatgt

SEQ ID NO: 592131 - DNA, 20 bp, Artificial
  CRISPR gRNA sequence
taggtatgtaagtatgtcat

SEQ ID NO: 592132 - DNA, 20 bp, Artificial
  CRISPR gRNA sequence
gtatgtaagtatgtcattag

SEQ ID NO: 592133 - DNA, 20 bp, Artificial
  CRISPR gRNA sequence
ttagtagattcaattaaatc

SEQ ID NO: 592134 - DNA, 20 bp, Artificial
  CRISPR gRNA sequence
cagtatctataatatcctcc

SEQ ID NO: 592135 - DNA, 20 bp, Artificial
  CRISPR gRNA sequence
tatctataatatcctccaag

SEQ ID NO: 592136 - DNA, 20 bp, Artificial
  CRISPR gRNA sequence
taatatcctccaagtagatg

SEQ ID NO: 592137 - DNA, 20 bp, Artificial
  CRISPR gRNA sequence
aatatcctccaagtagatgc

SEQ ID NO: 592138 - DNA, 20 bp, Artificial
  CRISPR gRNA sequence
tcctccaagtagatgcagga

SEQ ID NO: 592139 - DNA, 20 bp, Artificial
  CRISPR gRNA sequence
cctccaagtagatgcaggac

SEQ ID NO: 592140 - DNA, 20 bp, Artificial
  CRISPR gRNA sequence
gtagatgcaggacaggtgat

SEQ ID NO: 592141 - DNA, 20 bp, Artificial
  CRISPR gRNA sequence
attggcaatgatccaaaaca

SEQ ID NO: 592142 - DNA, 20 bp, Artificial
  CRISPR gRNA sequence
aatgatccaaaacaaagtca

SEQ ID NO: 592143 - DNA, 20 bp, Artificial
  CRISPR gRNA sequence
gatccaaaacaaagtcacag

SEQ ID NO: 592144 - DNA, 20 bp, Artificial
  CRISPR gRNA sequence
aacatttattgaactacaat

SEQ ID NO: 592145 - DNA, 20 bp, Artificial
  CRISPR gRNA sequence
attgaactacaatgagctca

SEQ ID NO: 592146 - DNA, 20 bp, Artificial
  CRISPR gRNA sequence
aatgagctcaaagtccaata

SEQ ID NO: 592147 - DNA, 20 bp, Artificial
  CRISPR gRNA sequence
agctcaaagtccaatataga

SEQ ID NO: 592148 - DNA, 20 bp, Artificial
  CRISPR gRNA sequence
caaagtccaatatagacaga

SEQ ID NO: 592149 - DNA, 20 bp, Artificial
  CRISPR gRNA sequence
acagaaagtcaacaaataat

SEQ ID NO: 592150 - DNA, 20 bp, Artificial
  CRISPR gRNA sequence
gtcaacaaataatgagaata

SEQ ID NO: 592151 - DNA, 20 bp, Artificial
  CRISPR gRNA sequence
taatgagaatatggcatgat

SEQ ID NO: 592152 - DNA, 20 bp, Artificial
  CRISPR gRNA sequence
tggcatgatgagtacactaa

SEQ ID NO: 592153 - DNA, 20 bp, Artificial
  CRISPR gRNA sequence
tgagtacactaatagatgtg

SEQ ID NO: 592154 - DNA, 20 bp, Artificial
  CRISPR gRNA sequence
cactaatagatgtgtggact

SEQ ID NO: 592155 - DNA, 20 bp, Artificial
  CRISPR gRNA sequence
actaatagatgtgtggactc

SEQ ID NO: 592156 - DNA, 20 bp, Artificial
  CRISPR gRNA sequence
agatgtgtggactcaggtat

SEQ ID NO: 592157 - DNA, 20 bp, Artificial
  CRISPR gRNA sequence
gatgtgtggactcaggtata

SEQ ID NO: 592158 - DNA, 20 bp, Artificial
  CRISPR gRNA sequence
tgtgtggactcaggtataag

SEQ ID NO: 592159 - DNA, 20 bp, Artificial
  CRISPR gRNA sequence
gtggactcaggtataaggag

SEQ ID NO: 592160 - DNA, 20 bp, Artificial
  CRISPR gRNA sequence
ggtataaggagaagatataa

SEQ ID NO: 592161 - DNA, 20 bp, Artificial
  CRISPR gRNA sequence
tataaggagaagatataaaa

SEQ ID NO: 592162 - DNA, 20 bp, Artificial
  CRISPR gRNA sequence
ataaggagaagatataaaag

SEQ ID NO: 592163 - DNA, 20 bp, Artificial
  CRISPR gRNA sequence
taaggagaagatataaaaga

SEQ ID NO: 592164 - DNA, 20 bp, Artificial
  CRISPR gRNA sequence
aaggagaagatataaaagag

SEQ ID NO: 592165 - DNA, 20 bp, Artificial
  CRISPR gRNA sequence
tataaaagaggggatgatca

SEQ ID NO: 592166 - DNA, 20 bp, Artificial
  CRISPR gRNA sequence
aaaagaggggatgatcaaag

SEQ ID NO: 592167 - DNA, 20 bp, Artificial
  CRISPR gRNA sequence
aggggatgatcaaagaagtt

SEQ ID NO: 592168 - DNA, 20 bp, Artificial
  CRISPR gRNA sequence
ggggatgatcaaagaagttt

SEQ ID NO: 592169 - DNA, 20 bp, Artificial
  CRISPR gRNA sequence
gatgatcaaagaagtttggg

SEQ ID NO: 592170 - DNA, 20 bp, Artificial
  CRISPR gRNA sequence
atgatcaaagaagtttgggt

SEQ ID NO: 592171 - DNA, 20 bp, Artificial
  CRISPR gRNA sequence
tcaaagaagtttgggtaggc

SEQ ID NO: 592172 - DNA, 20 bp, Artificial
  CRISPR gRNA sequence
caaagaagtttgggtaggct

SEQ ID NO: 592173 - DNA, 20 bp, Artificial
  CRISPR gRNA sequence
aaagaagtttgggtaggctg

SEQ ID NO: 592174 - DNA, 20 bp, Artificial
  CRISPR gRNA sequence
gaagtttgggtaggctgggg

SEQ ID NO: 592175 - DNA, 20 bp, Artificial
  CRISPR gRNA sequence
aagtttgggtaggctgggga

SEQ ID NO: 592176 - DNA, 20 bp, Artificial
  CRISPR gRNA sequence
aggctggggaaggtttctca

SEQ ID NO: 592177 - DNA, 20 bp, Artificial
  CRISPR gRNA sequence
ctggggaaggtttctcaaag

SEQ ID NO: 592178 - DNA, 20 bp, Artificial
  CRISPR gRNA sequence
gaattccaccttgaaacatg

SEQ ID NO: 592179 - DNA, 20 bp, Artificial
  CRISPR gRNA sequence
cttgaaacatgaagtttcac

SEQ ID NO: 592180 - DNA, 20 bp, Artificial
  CRISPR gRNA sequence
gaagtttcaccagtcacact

SEQ ID NO: 592181 - DNA, 20 bp, Artificial
  CRISPR gRNA sequence
gtttcaccagtcacacttgg

SEQ ID NO: 592182 - DNA, 20 bp, Artificial
  CRISPR gRNA sequence
tttcaccagtcacacttggt

SEQ ID NO: 592183 - DNA, 20 bp, Artificial
  CRISPR gRNA sequence
caccagtcacacttggtggg

SEQ ID NO: 592184 - DNA, 20 bp, Artificial
  CRISPR gRNA sequence
cacttggtgggaagatatcc

SEQ ID NO: 592185 - DNA, 20 bp, Artificial
  CRISPR gRNA sequence
ttggtgggaagatatcccag

SEQ ID NO: 592186 - DNA, 20 bp, Artificial
  CRISPR gRNA sequence
tggtgggaagatatcccaga

SEQ ID NO: 592187 - DNA, 20 bp, Artificial
  CRISPR gRNA sequence
ggtgggaagatatcccagaa

SEQ ID NO: 592188 - DNA, 20 bp, Artificial
  CRISPR gRNA sequence
gtgggaagatatcccagaag

SEQ ID NO: 592189 - DNA, 20 bp, Artificial
  CRISPR gRNA sequence
tgggaagatatcccagaagg

SEQ ID NO: 592190 - DNA, 20 bp, Artificial
  CRISPR gRNA sequence
aataacatgtgcgaatgcaa

SEQ ID NO: 592191 - DNA, 20 bp, Artificial
  CRISPR gRNA sequence
taacatgtgcgaatgcaatg

SEQ ID NO: 592192 - DNA, 20 bp, Artificial
  CRISPR gRNA sequence
atgcaatggagtatgaaaaa

SEQ ID NO: 592193 - DNA, 20 bp, Artificial
  CRISPR gRNA sequence
gcaatggagtatgaaaaatg

SEQ ID NO: 592194 - DNA, 20 bp, Artificial
  CRISPR gRNA sequence
atgaaaaatggagtgatcat

SEQ ID NO: 592195 - DNA, 20 bp, Artificial
  CRISPR gRNA sequence
tgaaaaatggagtgatcatc

SEQ ID NO: 592196 - DNA, 20 bp, Artificial
  CRISPR gRNA sequence
atggagtgatcatcaggtac

SEQ ID NO: 592197 - DNA, 20 bp, Artificial
  CRISPR gRNA sequence
tgatcatcaggtaccagtca

SEQ ID NO: 592198 - DNA, 20 bp, Artificial
  CRISPR gRNA sequence
gatcatcaggtaccagtcat

SEQ ID NO: 592199 - DNA, 20 bp, Artificial
  CRISPR gRNA sequence
atcatcaggtaccagtcatg

SEQ ID NO: 592200 - DNA, 20 bp, Artificial
  CRISPR gRNA sequence
tcaggtaccagtcatgggga

SEQ ID NO: 592201 - DNA, 20 bp, Artificial
  CRISPR gRNA sequence
ggtaccagtcatggggaaag

SEQ ID NO: 592202 - DNA, 20 bp, Artificial
  CRISPR gRNA sequence
gtaccagtcatggggaaagt

SEQ ID NO: 592203 - DNA, 20 bp, Artificial
  CRISPR gRNA sequence
tcatggggaaagtgggtttt

SEQ ID NO: 592204 - DNA, 20 bp, Artificial
  CRISPR gRNA sequence
catggggaaagtgggttttc

SEQ ID NO: 592205 - DNA, 20 bp, Artificial
  CRISPR gRNA sequence
atggggaaagtgggttttca

SEQ ID NO: 592206 - DNA, 20 bp, Artificial
  CRISPR gRNA sequence
ggaaagtgggttttcagggc

SEQ ID NO: 592207 - DNA, 20 bp, Artificial
  CRISPR gRNA sequence
gttttcagggcaagaaactc

SEQ ID NO: 592208 - DNA, 20 bp, Artificial
  CRISPR gRNA sequence
ggcaagaaactcaagaccct

SEQ ID NO: 592209 - DNA, 20 bp, Artificial
  CRISPR gRNA sequence
caagaaactcaagaccctga

SEQ ID NO: 592210 - DNA, 20 bp, Artificial
  CRISPR gRNA sequence
aaaccataaaatcatgccct

SEQ ID NO: 592211 - DNA, 20 bp, Artificial
  CRISPR gRNA sequence
aaccataaaatcatgccctg

SEQ ID NO: 592212 - DNA, 20 bp, Artificial
  CRISPR gRNA sequence
aaatcatgccctgaggaacc

SEQ ID NO: 592213 - DNA, 20 bp, Artificial
  CRISPR gRNA sequence
aatcatgccctgaggaaccg

SEQ ID NO: 592214 - DNA, 20 bp, Artificial
  CRISPR gRNA sequence
ccctgaggaaccgaggtacc

SEQ ID NO: 592215 - DNA, 20 bp, Artificial
  CRISPR gRNA sequence
cctgaggaaccgaggtacca

SEQ ID NO: 592216 - DNA, 20 bp, Artificial
  CRISPR gRNA sequence
aggaaccgaggtaccaaggt

SEQ ID NO: 592217 - DNA, 20 bp, Artificial
  CRISPR gRNA sequence
ccgaggtaccaaggtcagac

SEQ ID NO: 592218 - DNA, 20 bp, Artificial
  CRISPR gRNA sequence
aatgtgactgtgtactaaac

SEQ ID NO: 592219 - DNA, 20 bp, Artificial
  CRISPR gRNA sequence
tgactgtgtactaaactagt

SEQ ID NO: 592220 - DNA, 20 bp, Artificial
  CRISPR gRNA sequence
acacccctcctaatatcctc

SEQ ID NO: 592221 - DNA, 20 bp, Artificial
  CRISPR gRNA sequence
cacccctcctaatatcctct

SEQ ID NO: 592222 - DNA, 20 bp, Artificial
  CRISPR gRNA sequence
acccctcctaatatcctctg

SEQ ID NO: 592223 - DNA, 20 bp, Artificial
  CRISPR gRNA sequence
cccctcctaatatcctctgg

SEQ ID NO: 592224 - DNA, 20 bp, Artificial
  CRISPR gRNA sequence
ctcctaatatcctctggggg

SEQ ID NO: 592225 - DNA, 20 bp, Artificial
  CRISPR gRNA sequence
tcctaatatcctctgggggt

SEQ ID NO: 592226 - DNA, 20 bp, Artificial
  CRISPR gRNA sequence
cctaatatcctctgggggta

SEQ ID NO: 592227 - DNA, 20 bp, Artificial
  CRISPR gRNA sequence
tatcctctgggggtagggtc

SEQ ID NO: 592228 - DNA, 20 bp, Artificial
  CRISPR gRNA sequence
gggggtagggtccagaatct

SEQ ID NO: 592229 - DNA, 20 bp, Artificial
  CRISPR gRNA sequence
gtccagaatctgagtccatt

SEQ ID NO: 592230 - DNA, 20 bp, Artificial
  CRISPR gRNA sequence
tccagaatctgagtccatta

SEQ ID NO: 592231 - DNA, 20 bp, Artificial
  CRISPR gRNA sequence
attaaggatattcaattgta

SEQ ID NO: 592232 - DNA, 20 bp, Artificial
  CRISPR gRNA sequence
ttaaggatattcaattgtaa

SEQ ID NO: 592233 - DNA, 20 bp, Artificial
  CRISPR gRNA sequence
ggatattcaattgtaaaggt

SEQ ID NO: 592234 - DNA, 20 bp, Artificial
  CRISPR gRNA sequence
atattcaattgtaaaggtca

SEQ ID NO: 592235 - DNA, 20 bp, Artificial
  CRISPR gRNA sequence
tattcaattgtaaaggtcag

SEQ ID NO: 592236 - DNA, 20 bp, Artificial
  CRISPR gRNA sequence
aattgtaaaggtcagaggtc

SEQ ID NO: 592237 - DNA, 20 bp, Artificial
  CRISPR gRNA sequence
aggtcagaggtctggctgca

SEQ ID NO: 592238 - DNA, 20 bp, Artificial
  CRISPR gRNA sequence
cagaggtctggctgcaaagt

SEQ ID NO: 592239 - DNA, 20 bp, Artificial
  CRISPR gRNA sequence
agaggtctggctgcaaagtc

SEQ ID NO: 592240 - DNA, 20 bp, Artificial
  CRISPR gRNA sequence
gaggtctggctgcaaagtca

SEQ ID NO: 592241 - DNA, 20 bp, Artificial
  CRISPR gRNA sequence
ggtctggctgcaaagtcagg

SEQ ID NO: 592242 - DNA, 20 bp, Artificial
  CRISPR gRNA sequence
gtctggctgcaaagtcaggg

SEQ ID NO: 592243 - DNA, 20 bp, Artificial
  CRISPR gRNA sequence
agtcagggaggtccttaaat

SEQ ID NO: 592244 - DNA, 20 bp, Artificial
  CRISPR gRNA sequence
gtccttaaataagtttaaat

SEQ ID NO: 592245 - DNA, 20 bp, Artificial
  CRISPR gRNA sequence
agtttaaataagaactaaac

SEQ ID NO: 592246 - DNA, 20 bp, Artificial
  CRISPR gRNA sequence
taaactagttatattttaat

SEQ ID NO: 592247 - DNA, 20 bp, Artificial
  CRISPR gRNA sequence
atattttaataagaacttta

SEQ ID NO: 592248 - DNA, 20 bp, Artificial
  CRISPR gRNA sequence
ataagaactttatagaccta

SEQ ID NO: 592249 - DNA, 20 bp, Artificial
  CRISPR gRNA sequence
gaactttatagacctaaaga

SEQ ID NO: 592250 - DNA, 20 bp, Artificial
  CRISPR gRNA sequence
aactttatagacctaaagaa

SEQ ID NO: 592251 - DNA, 20 bp, Artificial
  CRISPR gRNA sequence
gacctaaagaaaggtctctg

SEQ ID NO: 592252 - DNA, 20 bp, Artificial
  CRISPR gRNA sequence
cctaaagaaaggtctctgaa

SEQ ID NO: 592253 - DNA, 20 bp, Artificial
  CRISPR gRNA sequence
aagaaaggtctctgaagagc

SEQ ID NO: 592254 - DNA, 20 bp, Artificial
  CRISPR gRNA sequence
aaaggtctctgaagagcaag

SEQ ID NO: 592255 - DNA, 20 bp, Artificial
  CRISPR gRNA sequence
aaggtctctgaagagcaagt

SEQ ID NO: 592256 - DNA, 20 bp, Artificial
  CRISPR gRNA sequence
agcaagtgggactcatgatc

SEQ ID NO: 592257 - DNA, 20 bp, Artificial
  CRISPR gRNA sequence
tgggactcatgatcaagtta

SEQ ID NO: 592258 - DNA, 20 bp, Artificial
  CRISPR gRNA sequence
gggactcatgatcaagttaa

SEQ ID NO: 592259 - DNA, 20 bp, Artificial
  CRISPR gRNA sequence
ctcatgatcaagttaaaggc

SEQ ID NO: 592260 - DNA, 20 bp, Artificial
  CRISPR gRNA sequence
tgatcaagttaaaggcaagt

SEQ ID NO: 592261 - DNA, 20 bp, Artificial
  CRISPR gRNA sequence
gatcaagttaaaggcaagtg

SEQ ID NO: 592262 - DNA, 20 bp, Artificial
  CRISPR gRNA sequence
aggcaagtgaggctgactac

SEQ ID NO: 592263 - DNA, 20 bp, Artificial
  CRISPR gRNA sequence
gctgactacaagttacccaa

SEQ ID NO: 592264 - DNA, 20 bp, Artificial
  CRISPR gRNA sequence
cccaatagtgatgaaatatc

SEQ ID NO: 592265 - DNA, 20 bp, Artificial
  CRISPR gRNA sequence
ccaatagtgatgaaatatct

SEQ ID NO: 592266 - DNA, 20 bp, Artificial
  CRISPR gRNA sequence
gattttgataacatgtcaaa

SEQ ID NO: 592267 - DNA, 20 bp, Artificial
  CRISPR gRNA sequence
atgtcaaacagaaatttttc

SEQ ID NO: 592268 - DNA, 20 bp, Artificial
  CRISPR gRNA sequence
ttatgtgctatatgttaaaa

SEQ ID NO: 592269 - DNA, 20 bp, Artificial
  CRISPR gRNA sequence
aaacagtttttcatgaaatc

SEQ ID NO: 592270 - DNA, 20 bp, Artificial
  CRISPR gRNA sequence
cagtttttcatgaaatcaag

SEQ ID NO: 592271 - DNA, 20 bp, Artificial
  CRISPR gRNA sequence
gcagcaataaatgtatactt

SEQ ID NO: 592272 - DNA, 20 bp, Artificial
  CRISPR gRNA sequence
cagcaataaatgtatactta

SEQ ID NO: 592273 - DNA, 20 bp, Artificial
  CRISPR gRNA sequence
tgtatacttaaggcttgcaa

SEQ ID NO: 592274 - DNA, 20 bp, Artificial
  CRISPR gRNA sequence
aatagaaaaactattgtgct

SEQ ID NO: 592275 - DNA, 20 bp, Artificial
  CRISPR gRNA sequence
aaaactattgtgctaagttt

SEQ ID NO: 592276 - DNA, 20 bp, Artificial
  CRISPR gRNA sequence
aaactattgtgctaagtttg

SEQ ID NO: 592277 - DNA, 20 bp, Artificial
  CRISPR gRNA sequence
gaggaataaatacaacgata

SEQ ID NO: 592278 - DNA, 20 bp, Artificial
  CRISPR gRNA sequence
aaagaatgatccttactctc

SEQ ID NO: 592279 - DNA, 20 bp, Artificial
  CRISPR gRNA sequence
gaatgatccttactctcaag

SEQ ID NO: 592280 - DNA, 20 bp, Artificial
  CRISPR gRNA sequence
ccttactctcaagaagttta

SEQ ID NO: 592281 - DNA, 20 bp, Artificial
  CRISPR gRNA sequence
aagaagtttacagccaaatt

SEQ ID NO: 592282 - DNA, 20 bp, Artificial
  CRISPR gRNA sequence
agaagtttacagccaaatta

SEQ ID NO: 592283 - DNA, 20 bp, Artificial
  CRISPR gRNA sequence
gccaaattaaggaaataaaa

SEQ ID NO: 592284 - DNA, 20 bp, Artificial
  CRISPR gRNA sequence
aaggaaataaaacagctatc

SEQ ID NO: 592285 - DNA, 20 bp, Artificial
  CRISPR gRNA sequence
aaacagctatctagaaatat

SEQ ID NO: 592286 - DNA, 20 bp, Artificial
  CRISPR gRNA sequence
agaaatatgagcaaatatac

SEQ ID NO: 592287 - DNA, 20 bp, Artificial
  CRISPR gRNA sequence
gaaatatgagcaaatataca

SEQ ID NO: 592288 - DNA, 20 bp, Artificial
  CRISPR gRNA sequence
atgagcaaatatacaaggta

SEQ ID NO: 592289 - DNA, 20 bp, Artificial
  CRISPR gRNA sequence
caaggtacagcaaatgtcaa

SEQ ID NO: 592290 - DNA, 20 bp, Artificial
  CRISPR gRNA sequence
aaggtacagcaaatgtcaat

SEQ ID NO: 592291 - DNA, 20 bp, Artificial
  CRISPR gRNA sequence
taaaccaatgtactttttac

SEQ ID NO: 592292 - DNA, 20 bp, Artificial
  CRISPR gRNA sequence
ctgtgatgttatattaatgc

SEQ ID NO: 592293 - DNA, 20 bp, Artificial
  CRISPR gRNA sequence
gttatattaatgcaagaaat

SEQ ID NO: 592294 - DNA, 20 bp, Artificial
  CRISPR gRNA sequence
gatttataatgataaaaaca

SEQ ID NO: 592295 - DNA, 20 bp, Artificial
  CRISPR gRNA sequence
aatgataaaaacatagataa

SEQ ID NO: 592296 - DNA, 20 bp, Artificial
  CRISPR gRNA sequence
atgataaaaacatagataaa

SEQ ID NO: 592297 - DNA, 20 bp, Artificial
  CRISPR gRNA sequence
ataaaaacatagataaaagg

SEQ ID NO: 592298 - DNA, 20 bp, Artificial
  CRISPR gRNA sequence
aacatagataaaaggaagaa

SEQ ID NO: 592299 - DNA, 20 bp, Artificial
  CRISPR gRNA sequence
acatagataaaaggaagaaa

SEQ ID NO: 592300 - DNA, 20 bp, Artificial
  CRISPR gRNA sequence
gaaaaggtacatttgcacaa

SEQ ID NO: 592301 - DNA, 20 bp, Artificial
  CRISPR gRNA sequence
aaaagaatctgtgctaatgt

SEQ ID NO: 592302 - DNA, 20 bp, Artificial
  CRISPR gRNA sequence
ctgtgctaatgttagcaatg

SEQ ID NO: 592303 - DNA, 20 bp, Artificial
  CRISPR gRNA sequence
atgaagcaaaccctctgact

SEQ ID NO: 592304 - DNA, 20 bp, Artificial
  CRISPR gRNA sequence
taagtcaactttaaaactct

SEQ ID NO: 592305 - DNA, 20 bp, Artificial
  CRISPR gRNA sequence
ctttaaaactctaagtttat

SEQ ID NO: 592306 - DNA, 20 bp, Artificial
  CRISPR gRNA sequence
aactctaagtttattggatt

SEQ ID NO: 592307 - DNA, 20 bp, Artificial
  CRISPR gRNA sequence
tttagaacttaacacatata

SEQ ID NO: 592308 - DNA, 20 bp, Artificial
  CRISPR gRNA sequence
ccatatcattcaaattactc

SEQ ID NO: 592309 - DNA, 20 bp, Artificial
  CRISPR gRNA sequence
catatcattcaaattactca

SEQ ID NO: 592310 - DNA, 20 bp, Artificial
  CRISPR gRNA sequence
ttcaaattactcaaggcact

SEQ ID NO: 592311 - DNA, 20 bp, Artificial
  CRISPR gRNA sequence
tactcaaggcactcagtata

SEQ ID NO: 592312 - DNA, 20 bp, Artificial
  CRISPR gRNA sequence
cactcagtatacagaatatg

SEQ ID NO: 592313 - DNA, 20 bp, Artificial
  CRISPR gRNA sequence
acagaatatgaagaaatatt

SEQ ID NO: 592314 - DNA, 20 bp, Artificial
  CRISPR gRNA sequence
tgaagaaatatttagatcat

SEQ ID NO: 592315 - DNA, 20 bp, Artificial
  CRISPR gRNA sequence
atcggaacttgcctattata

SEQ ID NO: 592316 - DNA, 20 bp, Artificial
  CRISPR gRNA sequence
gaacttgcctattataaagc

SEQ ID NO: 592317 - DNA, 20 bp, Artificial
  CRISPR gRNA sequence
aacttgcctattataaagca

SEQ ID NO: 592318 - DNA, 20 bp, Artificial
  CRISPR gRNA sequence
acttgcctattataaagcaa

SEQ ID NO: 592319 - DNA, 20 bp, Artificial
  CRISPR gRNA sequence
gttaaaaatactcttcttca

SEQ ID NO: 592320 - DNA, 20 bp, Artificial
  CRISPR gRNA sequence
aaatactcttcttcaaagtt

SEQ ID NO: 592321 - DNA, 20 bp, Artificial
  CRISPR gRNA sequence
actcttcttcaaagtttggt

SEQ ID NO: 592322 - DNA, 20 bp, Artificial
  CRISPR gRNA sequence
tcaaagtttggtgagtgtgt

SEQ ID NO: 592323 - DNA, 20 bp, Artificial
  CRISPR gRNA sequence
agtttggtgagtgtgtgagt

SEQ ID NO: 592324 - DNA, 20 bp, Artificial
  CRISPR gRNA sequence
cacctgctgccaactccata

SEQ ID NO: 592325 - DNA, 20 bp, Artificial
  CRISPR gRNA sequence
tgctgccaactccatacaga

SEQ ID NO: 592326 - DNA, 20 bp, Artificial
  CRISPR gRNA sequence
aactccatacagatagcaaa

SEQ ID NO: 592327 - DNA, 20 bp, Artificial
  CRISPR gRNA sequence
aatttcactgacaatttttt

SEQ ID NO: 592328 - DNA, 20 bp, Artificial
  CRISPR gRNA sequence
tcactgacaatttttttgga

SEQ ID NO: 592329 - DNA, 20 bp, Artificial
  CRISPR gRNA sequence
cactgacaatttttttggat

SEQ ID NO: 592330 - DNA, 20 bp, Artificial
  CRISPR gRNA sequence
actgacaatttttttggatg

SEQ ID NO: 592331 - DNA, 20 bp, Artificial
  CRISPR gRNA sequence
aatttttttggatggggttt

SEQ ID NO: 592332 - DNA, 20 bp, Artificial
  CRISPR gRNA sequence
cttattacatccataaacac

SEQ ID NO: 592333 - DNA, 20 bp, Artificial
  CRISPR gRNA sequence
tattacatccataaacactg

SEQ ID NO: 592334 - DNA, 20 bp, Artificial
  CRISPR gRNA sequence
agacatttcactacttttga

SEQ ID NO: 592335 - DNA, 20 bp, Artificial
  CRISPR gRNA sequence
ttcactacttttgacagttc

SEQ ID NO: 592336 - DNA, 20 bp, Artificial
  CRISPR gRNA sequence
atgtttgcaaaatataattt

SEQ ID NO: 592337 - DNA, 20 bp, Artificial
  CRISPR gRNA sequence
gtttgcaaaatataatttca

SEQ ID NO: 592338 - DNA, 20 bp, Artificial
  CRISPR gRNA sequence
tttgcaaaatataatttcag

SEQ ID NO: 592339 - DNA, 20 bp, Artificial
  CRISPR gRNA sequence
tgcaaaatataatttcagag

SEQ ID NO: 592340 - DNA, 20 bp, Artificial
  CRISPR gRNA sequence
tcagaggagaaatgttgctt

SEQ ID NO: 592341 - DNA, 20 bp, Artificial
  CRISPR gRNA sequence
agaaatgttgctttggtttg

SEQ ID NO: 592342 - DNA, 20 bp, Artificial
  CRISPR gRNA sequence
gaaatgttgctttggtttgc

SEQ ID NO: 592343 - DNA, 20 bp, Artificial
  CRISPR gRNA sequence
aaatgttgctttggtttgca

SEQ ID NO: 592344 - DNA, 20 bp, Artificial
  CRISPR gRNA sequence
agggtttttaacaattcatt

SEQ ID NO: 592345 - DNA, 20 bp, Artificial
  CRISPR gRNA sequence
ggtttttaacaattcattta

SEQ ID NO: 592346 - DNA, 20 bp, Artificial
  CRISPR gRNA sequence
gtttttaacaattcatttag

SEQ ID NO: 592347 - DNA, 20 bp, Artificial
  CRISPR gRNA sequence
taacaattcatttagaggtc

SEQ ID NO: 592348 - DNA, 20 bp, Artificial
  CRISPR gRNA sequence
attcatttagaggtccagaa

SEQ ID NO: 592349 - DNA, 20 bp, Artificial
  CRISPR gRNA sequence
tcatatgtctgcttatttga

SEQ ID NO: 592350 - DNA, 20 bp, Artificial
  CRISPR gRNA sequence
gatggtaattttatacctct

SEQ ID NO: 592351 - DNA, 20 bp, Artificial
  CRISPR gRNA sequence
aaaatgactttttaaacctt

SEQ ID NO: 592352 - DNA, 20 bp, Artificial
  CRISPR gRNA sequence
tttaaaccttcagttaaaat

SEQ ID NO: 592353 - DNA, 20 bp, Artificial
  CRISPR gRNA sequence
ttcagttaaaatgagccata

SEQ ID NO: 592354 - DNA, 20 bp, Artificial
  CRISPR gRNA sequence
aaatgagccatatagttgaa

SEQ ID NO: 592355 - DNA, 20 bp, Artificial
  CRISPR gRNA sequence
gaaaagtctattaaaaacta

SEQ ID NO: 592356 - DNA, 20 bp, Artificial
  CRISPR gRNA sequence
agtctattaaaaactatagc

SEQ ID NO: 592357 - DNA, 20 bp, Artificial
  CRISPR gRNA sequence
tattaaaaactatagccaga

SEQ ID NO: 592358 - DNA, 20 bp, Artificial
  CRISPR gRNA sequence
aaaaactatagccagaaagt

SEQ ID NO: 592359 - DNA, 20 bp, Artificial
  CRISPR gRNA sequence
ctaaaattaaacactacttt

SEQ ID NO: 592360 - DNA, 20 bp, Artificial
  CRISPR gRNA sequence
ctctgcttttgcaatgtttg

SEQ ID NO: 592361 - DNA, 20 bp, Artificial
  CRISPR gRNA sequence
gaagttcaaataacttctat

SEQ ID NO: 592362 - DNA, 20 bp, Artificial
  CRISPR gRNA sequence
caaataacttctataagttc

SEQ ID NO: 592363 - DNA, 20 bp, Artificial
  CRISPR gRNA sequence
acttctataagttctagtgc

SEQ ID NO: 592364 - DNA, 20 bp, Artificial
  CRISPR gRNA sequence
cttctataagttctagtgcc

SEQ ID NO: 592365 - DNA, 20 bp, Artificial
  CRISPR gRNA sequence
tgccaggcatccccaaaccc

SEQ ID NO: 592366 - DNA, 20 bp, Artificial
  CRISPR gRNA sequence
gccaggcatccccaaacccc

SEQ ID NO: 592367 - DNA, 20 bp, Artificial
  CRISPR gRNA sequence
ggcatccccaaaccccaggc

SEQ ID NO: 592368 - DNA, 20 bp, Artificial
  CRISPR gRNA sequence
gcatccccaaaccccaggcc

SEQ ID NO: 592369 - DNA, 20 bp, Artificial
  CRISPR gRNA sequence
catccccaaaccccaggcca

SEQ ID NO: 592370 - DNA, 20 bp, Artificial
  CRISPR gRNA sequence
ccaaaccccaggccagggac

SEQ ID NO: 592371 - DNA, 20 bp, Artificial
  CRISPR gRNA sequence
aaccccaggccagggaccag

SEQ ID NO: 592372 - DNA, 20 bp, Artificial
  CRISPR gRNA sequence
accccaggccagggaccagt

SEQ ID NO: 592373 - DNA, 20 bp, Artificial
  CRISPR gRNA sequence
ggccagggaccagtaggaac

SEQ ID NO: 592374 - DNA, 20 bp, Artificial
  CRISPR gRNA sequence
cagggaccagtaggaaccag

SEQ ID NO: 592375 - DNA, 20 bp, Artificial
  CRISPR gRNA sequence
agggaccagtaggaaccagt

SEQ ID NO: 592376 - DNA, 20 bp, Artificial
  CRISPR gRNA sequence
agtaggaaccagtaggaaac

SEQ ID NO: 592377 - DNA, 20 bp, Artificial
  CRISPR gRNA sequence
ccagtaggaaactggtcaca

SEQ ID NO: 592378 - DNA, 20 bp, Artificial
  CRISPR gRNA sequence
gtaggaaactggtcacatag

SEQ ID NO: 592379 - DNA, 20 bp, Artificial
  CRISPR gRNA sequence
taggaaactggtcacatagc

SEQ ID NO: 592380 - DNA, 20 bp, Artificial
  CRISPR gRNA sequence
ggaaactggtcacatagcag

SEQ ID NO: 592381 - DNA, 20 bp, Artificial
  CRISPR gRNA sequence
gaaactggtcacatagcagg

SEQ ID NO: 592382 - DNA, 20 bp, Artificial
  CRISPR gRNA sequence
ctggtcacatagcaggaggt

SEQ ID NO: 592383 - DNA, 20 bp, Artificial
  CRISPR gRNA sequence
gtgagctccatctgtattta

SEQ ID NO: 592384 - DNA, 20 bp, Artificial
  CRISPR gRNA sequence
catctctcatactactgctt

SEQ ID NO: 592385 - DNA, 20 bp, Artificial
  CRISPR gRNA sequence
gcttgagctccacctcctgt

SEQ ID NO: 592386 - DNA, 20 bp, Artificial
  CRISPR gRNA sequence
agctccacctcctgtcagat

SEQ ID NO: 592387 - DNA, 20 bp, Artificial
  CRISPR gRNA sequence
acctcctgtcagatcagcta

SEQ ID NO: 592388 - DNA, 20 bp, Artificial
  CRISPR gRNA sequence
tgtcagatcagctatggcac

SEQ ID NO: 592389 - DNA, 20 bp, Artificial
  CRISPR gRNA sequence
gctatggcactagattctca

SEQ ID NO: 592390 - DNA, 20 bp, Artificial
  CRISPR gRNA sequence
ctatggcactagattctcat

SEQ ID NO: 592391 - DNA, 20 bp, Artificial
  CRISPR gRNA sequence
ggcactagattctcatagga

SEQ ID NO: 592392 - DNA, 20 bp, Artificial
  CRISPR gRNA sequence
tttttttttttttttttttt

SEQ ID NO: 592393 - DNA, 20 bp, Artificial
  CRISPR gRNA sequence
ttttttttttttttttgaga

SEQ ID NO: 592394 - DNA, 20 bp, Artificial
  CRISPR gRNA sequence
ttttttttttttttgagacg

SEQ ID NO: 592395 - DNA, 20 bp, Artificial
  CRISPR gRNA sequence
ggagtttcgctcttgttgcc

SEQ ID NO: 592396 - DNA, 20 bp, Artificial
  CRISPR gRNA sequence
gagtttcgctcttgttgccc

SEQ ID NO: 592397 - DNA, 20 bp, Artificial
  CRISPR gRNA sequence
ttcgctcttgttgcccaggc

SEQ ID NO: 592398 - DNA, 20 bp, Artificial
  CRISPR gRNA sequence
cgctcttgttgcccaggctg

SEQ ID NO: 592399 - DNA, 20 bp, Artificial
  CRISPR gRNA sequence
ttgcccaggctggagtgcaa

SEQ ID NO: 592400 - DNA, 20 bp, Artificial
  CRISPR gRNA sequence
ggagtgcaatggcgcaatct

SEQ ID NO: 592401 - DNA, 20 bp, Artificial
  CRISPR gRNA sequence
tcaccacaacctctgcctcc

SEQ ID NO: 592402 - DNA, 20 bp, Artificial
  CRISPR gRNA sequence
aacctctgcctcccagtttc

SEQ ID NO: 592403 - DNA, 20 bp, Artificial
  CRISPR gRNA sequence
ttcaagcgattctcctgcct

SEQ ID NO: 592404 - DNA, 20 bp, Artificial
  CRISPR gRNA sequence
gcgattctcctgcctcagcc

SEQ ID NO: 592405 - DNA, 20 bp, Artificial
  CRISPR gRNA sequence
ttctcctgcctcagcctagc

SEQ ID NO: 592406 - DNA, 20 bp, Artificial
  CRISPR gRNA sequence
tctcctgcctcagcctagct

SEQ ID NO: 592407 - DNA, 20 bp, Artificial
  CRISPR gRNA sequence
cctcagcctagctgggatta

SEQ ID NO: 592408 - DNA, 20 bp, Artificial
  CRISPR gRNA sequence
acagacatgcgccaccacac

SEQ ID NO: 592409 - DNA, 20 bp, Artificial
  CRISPR gRNA sequence
cagacatgcgccaccacacc

SEQ ID NO: 592410 - DNA, 20 bp, Artificial
  CRISPR gRNA sequence
tttttttttttttgtatttt

SEQ ID NO: 592411 - DNA, 20 bp, Artificial
  CRISPR gRNA sequence
ttttttttttgtatttttag

SEQ ID NO: 592412 - DNA, 20 bp, Artificial
  CRISPR gRNA sequence
ttttttttgtatttttagta

SEQ ID NO: 592413 - DNA, 20 bp, Artificial
  CRISPR gRNA sequence
ttttgtatttttagtagaga

SEQ ID NO: 592414 - DNA, 20 bp, Artificial
  CRISPR gRNA sequence
ttgtatttttagtagagatg

SEQ ID NO: 592415 - DNA, 20 bp, Artificial
  CRISPR gRNA sequence
gagatggagtttctctatgt

SEQ ID NO: 592416 - DNA, 20 bp, Artificial
  CRISPR gRNA sequence
tggagtttctctatgttggt

SEQ ID NO: 592417 - DNA, 20 bp, Artificial
  CRISPR gRNA sequence
ggagtttctctatgttggtc

SEQ ID NO: 592418 - DNA, 20 bp, Artificial
  CRISPR gRNA sequence
tttctctatgttggtcaggc

SEQ ID NO: 592419 - DNA, 20 bp, Artificial
  CRISPR gRNA sequence
tggtctcaaactctcaacct

SEQ ID NO: 592420 - DNA, 20 bp, Artificial
  CRISPR gRNA sequence
ggtctcaaactctcaacctc

SEQ ID NO: 592421 - DNA, 20 bp, Artificial
  CRISPR gRNA sequence
ctcaggtgatccgcccacct

SEQ ID NO: 592422 - DNA, 20 bp, Artificial
  CRISPR gRNA sequence
ccgcccacctcggcctccca

SEQ ID NO: 592423 - DNA, 20 bp, Artificial
  CRISPR gRNA sequence
acctcggcctcccaaagtac

SEQ ID NO: 592424 - DNA, 20 bp, Artificial
  CRISPR gRNA sequence
cctcggcctcccaaagtact

SEQ ID NO: 592425 - DNA, 20 bp, Artificial
  CRISPR gRNA sequence
tcccaaagtactaggattac

SEQ ID NO: 592426 - DNA, 20 bp, Artificial
  CRISPR gRNA sequence
gtactaggattacaagtgtg

SEQ ID NO: 592427 - DNA, 20 bp, Artificial
  CRISPR gRNA sequence
caagtgtgaagcactgcgcc

SEQ ID NO: 592428 - DNA, 20 bp, Artificial
  CRISPR gRNA sequence
tgaagcactgcgcccagcct

SEQ ID NO: 592429 - DNA, 20 bp, Artificial
  CRISPR gRNA sequence
gcactgcgcccagcctcaga

SEQ ID NO: 592430 - DNA, 20 bp, Artificial
  CRISPR gRNA sequence
ttattgtgaactgcacatgc

SEQ ID NO: 592431 - DNA, 20 bp, Artificial
  CRISPR gRNA sequence
attgtgaactgcacatgcca

SEQ ID NO: 592432 - DNA, 20 bp, Artificial
  CRISPR gRNA sequence
aactgcacatgccagagatc

SEQ ID NO: 592433 - DNA, 20 bp, Artificial
  CRISPR gRNA sequence
ctagcttgtgtgctccttat

SEQ ID NO: 592434 - DNA, 20 bp, Artificial
  CRISPR gRNA sequence
tcactgtctcccatcacccc

SEQ ID NO: 592435 - DNA, 20 bp, Artificial
  CRISPR gRNA sequence
cccatcacccccagactatc

SEQ ID NO: 592436 - DNA, 20 bp, Artificial
  CRISPR gRNA sequence
ccatcacccccagactatct

SEQ ID NO: 592437 - DNA, 20 bp, Artificial
  CRISPR gRNA sequence
ccagactatctgggactatc

SEQ ID NO: 592438 - DNA, 20 bp, Artificial
  CRISPR gRNA sequence
tatctgggactatctagttg

SEQ ID NO: 592439 - DNA, 20 bp, Artificial
  CRISPR gRNA sequence
atctgggactatctagttgc

SEQ ID NO: 592440 - DNA, 20 bp, Artificial
  CRISPR gRNA sequence
ctatctagttgcaggaaaac

SEQ ID NO: 592441 - DNA, 20 bp, Artificial
  CRISPR gRNA sequence
tagttgcaggaaaacaagct

SEQ ID NO: 592442 - DNA, 20 bp, Artificial
  CRISPR gRNA sequence
agttgcaggaaaacaagctt

SEQ ID NO: 592443 - DNA, 20 bp, Artificial
  CRISPR gRNA sequence
aaaacaagcttaggactcca

SEQ ID NO: 592444 - DNA, 20 bp, Artificial
  CRISPR gRNA sequence
cacagattctacattatgat

SEQ ID NO: 592445 - DNA, 20 bp, Artificial
  CRISPR gRNA sequence
ttctacattatgatgagtta

SEQ ID NO: 592446 - DNA, 20 bp, Artificial
  CRISPR gRNA sequence
tatatataacaatgtaataa

SEQ ID NO: 592447 - DNA, 20 bp, Artificial
  CRISPR gRNA sequence
acaatgtaataatagaaaca

SEQ ID NO: 592448 - DNA, 20 bp, Artificial
  CRISPR gRNA sequence
aaccatcccccactaaccct

SEQ ID NO: 592449 - DNA, 20 bp, Artificial
  CRISPR gRNA sequence
accatcccccactaaccctc

SEQ ID NO: 592450 - DNA, 20 bp, Artificial
  CRISPR gRNA sequence
ccccactaaccctcaggctg

SEQ ID NO: 592451 - DNA, 20 bp, Artificial
  CRISPR gRNA sequence
aaaattgtcttccacaaaac

SEQ ID NO: 592452 - DNA, 20 bp, Artificial
  CRISPR gRNA sequence
tcttccacaaaaccagtact

SEQ ID NO: 592453 - DNA, 20 bp, Artificial
  CRISPR gRNA sequence
aaccagtacttggtgccaaa

SEQ ID NO: 592454 - DNA, 20 bp, Artificial
  CRISPR gRNA sequence
accagtacttggtgccaaaa

SEQ ID NO: 592455 - DNA, 20 bp, Artificial
  CRISPR gRNA sequence
gtacttggtgccaaaaaggt

SEQ ID NO: 592456 - DNA, 20 bp, Artificial
  CRISPR gRNA sequence
tacttggtgccaaaaaggtt

SEQ ID NO: 592457 - DNA, 20 bp, Artificial
  CRISPR gRNA sequence
acttggtgccaaaaaggttg

SEQ ID NO: 592458 - DNA, 20 bp, Artificial
  CRISPR gRNA sequence
ggtgccaaaaaggttgggga

SEQ ID NO: 592459 - DNA, 20 bp, Artificial
  CRISPR gRNA sequence
aaaaggttggggatagaata

SEQ ID NO: 592460 - DNA, 20 bp, Artificial
  CRISPR gRNA sequence
gggatagaatacagattatt

SEQ ID NO: 592461 - DNA, 20 bp, Artificial
  CRISPR gRNA sequence
gatagaatacagattatttg

SEQ ID NO: 592462 - DNA, 20 bp, Artificial
  CRISPR gRNA sequence
gaatacagattatttggagt

SEQ ID NO: 592463 - DNA, 20 bp, Artificial
  CRISPR gRNA sequence
acagattatttggagtaagt

SEQ ID NO: 592464 - DNA, 20 bp, Artificial
  CRISPR gRNA sequence
cagattatttggagtaagtc

SEQ ID NO: 592465 - DNA, 20 bp, Artificial
  CRISPR gRNA sequence
atttggagtaagtcaggcct

SEQ ID NO: 592466 - DNA, 20 bp, Artificial
  CRISPR gRNA sequence
ttgtcacctgccaattattc

SEQ ID NO: 592467 - DNA, 20 bp, Artificial
  CRISPR gRNA sequence
aagtacacctgtctaaacta

SEQ ID NO: 592468 - DNA, 20 bp, Artificial
  CRISPR gRNA sequence
cacctgtctaaactacagta

SEQ ID NO: 592469 - DNA, 20 bp, Artificial
  CRISPR gRNA sequence
tgtctaaactacagtaaagt

SEQ ID NO: 592470 - DNA, 20 bp, Artificial
  CRISPR gRNA sequence
agtaaagtgagcatatgatg

SEQ ID NO: 592471 - DNA, 20 bp, Artificial
  CRISPR gRNA sequence
atcccaaacctgtcacttac

SEQ ID NO: 592472 - DNA, 20 bp, Artificial
  CRISPR gRNA sequence
cacttaccagctgtatatca

SEQ ID NO: 592473 - DNA, 20 bp, Artificial
  CRISPR gRNA sequence
cttaccagctgtatatcaca

SEQ ID NO: 592474 - DNA, 20 bp, Artificial
  CRISPR gRNA sequence
ctgtatatcacagagcatat

SEQ ID NO: 592475 - DNA, 20 bp, Artificial
  CRISPR gRNA sequence
atatcacagagcatattagt

SEQ ID NO: 592476 - DNA, 20 bp, Artificial
  CRISPR gRNA sequence
cagagcatattagtcagcct

SEQ ID NO: 592477 - DNA, 20 bp, Artificial
  CRISPR gRNA sequence
ttagtcagcctcagtttccc

SEQ ID NO: 592478 - DNA, 20 bp, Artificial
  CRISPR gRNA sequence
gtttccctggaatgcttccc

SEQ ID NO: 592479 - DNA, 20 bp, Artificial
  CRISPR gRNA sequence
cctggaatgcttccctggct

SEQ ID NO: 592480 - DNA, 20 bp, Artificial
  CRISPR gRNA sequence
cttccctggcttagaaattt

SEQ ID NO: 592481 - DNA, 20 bp, Artificial
  CRISPR gRNA sequence
aatttgagataataactttc

SEQ ID NO: 592482 - DNA, 20 bp, Artificial
  CRISPR gRNA sequence
atttgagataataactttcc

SEQ ID NO: 592483 - DNA, 20 bp, Artificial
  CRISPR gRNA sequence
tttgagataataactttcca

SEQ ID NO: 592484 - DNA, 20 bp, Artificial
  CRISPR gRNA sequence
gagataataactttccaggg

SEQ ID NO: 592485 - DNA, 20 bp, Artificial
  CRISPR gRNA sequence
taactttccagggaagtttt

SEQ ID NO: 592486 - DNA, 20 bp, Artificial
  CRISPR gRNA sequence
aactttccagggaagtttta

SEQ ID NO: 592487 - DNA, 20 bp, Artificial
  CRISPR gRNA sequence
ctttccagggaagttttaag

SEQ ID NO: 592488 - DNA, 20 bp, Artificial
  CRISPR gRNA sequence
gttttaaggagtaaattgta

SEQ ID NO: 592489 - DNA, 20 bp, Artificial
  CRISPR gRNA sequence
aaattgtatagactgtatga

SEQ ID NO: 592490 - DNA, 20 bp, Artificial
  CRISPR gRNA sequence
ctgtatgaaagtacctcaca

SEQ ID NO: 592491 - DNA, 20 bp, Artificial
  CRISPR gRNA sequence
ctcacacagtacctaacata

SEQ ID NO: 592492 - DNA, 20 bp, Artificial
  CRISPR gRNA sequence
tcacacagtacctaacatat

SEQ ID NO: 592493 - DNA, 20 bp, Artificial
  CRISPR gRNA sequence
cacacagtacctaacatata

SEQ ID NO: 592494 - DNA, 20 bp, Artificial
  CRISPR gRNA sequence
tagggatactcaataaataa

SEQ ID NO: 592495 - DNA, 20 bp, Artificial
  CRISPR gRNA sequence
agttctgttcctcactacaa

SEQ ID NO: 592496 - DNA, 20 bp, Artificial
  CRISPR gRNA sequence
caaaagattctcctaaacta

SEQ ID NO: 592497 - DNA, 20 bp, Artificial
  CRISPR gRNA sequence
cctaaactacagtttactca

SEQ ID NO: 592498 - DNA, 20 bp, Artificial
  CRISPR gRNA sequence
caatgttaatttcattctta

SEQ ID NO: 592499 - DNA, 20 bp, Artificial
  CRISPR gRNA sequence
gttaatttcattcttatggt

SEQ ID NO: 592500 - DNA, 20 bp, Artificial
  CRISPR gRNA sequence
ttcattcttatggtcagtgt

SEQ ID NO: 592501 - DNA, 20 bp, Artificial
  CRISPR gRNA sequence
tcttatggtcagtgttagaa

SEQ ID NO: 592502 - DNA, 20 bp, Artificial
  CRISPR gRNA sequence
gtcagtgttagaaaagtgct

SEQ ID NO: 592503 - DNA, 20 bp, Artificial
  CRISPR gRNA sequence
cttagtaatcatttttatta

SEQ ID NO: 592504 - DNA, 20 bp, Artificial
  CRISPR gRNA sequence
aatcatttttattatggctt

SEQ ID NO: 592505 - DNA, 20 bp, Artificial
  CRISPR gRNA sequence
atcatttttattatggcttt

SEQ ID NO: 592506 - DNA, 20 bp, Artificial
  CRISPR gRNA sequence
tcatttttattatggctttg

SEQ ID NO: 592507 - DNA, 20 bp, Artificial
  CRISPR gRNA sequence
ttttattatggctttggggt

SEQ ID NO: 592508 - DNA, 20 bp, Artificial
  CRISPR gRNA sequence
tttattatggctttggggta

SEQ ID NO: 592509 - DNA, 20 bp, Artificial
  CRISPR gRNA sequence
tgaacatatatgaaatctta

SEQ ID NO: 592510 - DNA, 20 bp, Artificial
  CRISPR gRNA sequence
acatatatgaaatcttacag

SEQ ID NO: 592511 - DNA, 20 bp, Artificial
  CRISPR gRNA sequence
tgaaatcttacagaagtaac

SEQ ID NO: 592512 - DNA, 20 bp, Artificial
  CRISPR gRNA sequence
gaaatcttacagaagtaaca

SEQ ID NO: 592513 - DNA, 20 bp, Artificial
  CRISPR gRNA sequence
gaagtaacaaggtctacaaa

SEQ ID NO: 592514 - DNA, 20 bp, Artificial
  CRISPR gRNA sequence
aagtaacaaggtctacaaaa

SEQ ID NO: 592515 - DNA, 20 bp, Artificial
  CRISPR gRNA sequence
aggtttctgaaaaaaatcat

SEQ ID NO: 592516 - DNA, 20 bp, Artificial
  CRISPR gRNA sequence
gtatctatgtcactctaaaa

SEQ ID NO: 592517 - DNA, 20 bp, Artificial
  CRISPR gRNA sequence
aaagaaattgaaaaaaaaaa

SEQ ID NO: 592518 - DNA, 20 bp, Artificial
  CRISPR gRNA sequence
aagaaattgaaaaaaaaaac

SEQ ID NO: 592519 - DNA, 20 bp, Artificial
  CRISPR gRNA sequence
ccttcaactctccctttctt

SEQ ID NO: 592520 - DNA, 20 bp, Artificial
  CRISPR gRNA sequence
aagtattttctgttactatt

SEQ ID NO: 592521 - DNA, 20 bp, Artificial
  CRISPR gRNA sequence
ttactattaagtcccaatat

SEQ ID NO: 592522 - DNA, 20 bp, Artificial
  CRISPR gRNA sequence
tactattaagtcccaatatc

SEQ ID NO: 592523 - DNA, 20 bp, Artificial
  CRISPR gRNA sequence
aagtcccaatatcaggtgat

SEQ ID NO: 592524 - DNA, 20 bp, Artificial
  CRISPR gRNA sequence
caggtgatgagcattatctg

SEQ ID NO: 592525 - DNA, 20 bp, Artificial
  CRISPR gRNA sequence
aggtgatgagcattatctga

SEQ ID NO: 592526 - DNA, 20 bp, Artificial
  CRISPR gRNA sequence
tcatgccttctctaatctga

SEQ ID NO: 592527 - DNA, 20 bp, Artificial
  CRISPR gRNA sequence
tgaaagaataaaataacatt

SEQ ID NO: 592528 - DNA, 20 bp, Artificial
  CRISPR gRNA sequence
aataacattaagccttgttg

SEQ ID NO: 592529 - DNA, 20 bp, Artificial
  CRISPR gRNA sequence
aagttgtactttgtaacctt

SEQ ID NO: 592530 - DNA, 20 bp, Artificial
  CRISPR gRNA sequence
gttgtactttgtaaccttta

SEQ ID NO: 592531 - DNA, 20 bp, Artificial
  CRISPR gRNA sequence
tacaactctctttgctcatg

SEQ ID NO: 592532 - DNA, 20 bp, Artificial
  CRISPR gRNA sequence
catgtagtatccctttgcat

SEQ ID NO: 592533 - DNA, 20 bp, Artificial
  CRISPR gRNA sequence
cctcatttgtcctcattttc

SEQ ID NO: 592534 - DNA, 20 bp, Artificial
  CRISPR gRNA sequence
ttttctagctttcatgattc

SEQ ID NO: 592535 - DNA, 20 bp, Artificial
  CRISPR gRNA sequence
tttctagctttcatgattca

SEQ ID NO: 592536 - DNA, 20 bp, Artificial
  CRISPR gRNA sequence
agctttcatgattcaaggtc

SEQ ID NO: 592537 - DNA, 20 bp, Artificial
  CRISPR gRNA sequence
gtttcaatgtgatttcctaa

SEQ ID NO: 592538 - DNA, 20 bp, Artificial
  CRISPR gRNA sequence
tatccctttctgtccaattt

SEQ ID NO: 592539 - DNA, 20 bp, Artificial
  CRISPR gRNA sequence
tccaattttggtgaaattaa

SEQ ID NO: 592540 - DNA, 20 bp, Artificial
  CRISPR gRNA sequence
gtgaaattaatggctcctaa

SEQ ID NO: 592541 - DNA, 20 bp, Artificial
  CRISPR gRNA sequence
attaatggctcctaacagaa

SEQ ID NO: 592542 - DNA, 20 bp, Artificial
  CRISPR gRNA sequence
tacgctgtacgctatgaccc

SEQ ID NO: 592543 - DNA, 20 bp, Artificial
  CRISPR gRNA sequence
tcttattcatctctgcattc

SEQ ID NO: 592544 - DNA, 20 bp, Artificial
  CRISPR gRNA sequence
cttattcatctctgcattcc

SEQ ID NO: 592545 - DNA, 20 bp, Artificial
  CRISPR gRNA sequence
tgcattccaggcacttaaca

SEQ ID NO: 592546 - DNA, 20 bp, Artificial
  CRISPR gRNA sequence
attccaggcacttaacacag

SEQ ID NO: 592547 - DNA, 20 bp, Artificial
  CRISPR gRNA sequence
caggcacttaacacagtggc

SEQ ID NO: 592548 - DNA, 20 bp, Artificial
  CRISPR gRNA sequence
taatgttcaaaaaatattta

SEQ ID NO: 592549 - DNA, 20 bp, Artificial
  CRISPR gRNA sequence
caaaaaatatttacagaatc

SEQ ID NO: 592550 - DNA, 20 bp, Artificial
  CRISPR gRNA sequence
atcaagttgaattcttcccc

SEQ ID NO: 592551 - DNA, 20 bp, Artificial
  CRISPR gRNA sequence
tctttctcttttaaaacact

SEQ ID NO: 592552 - DNA, 20 bp, Artificial
  CRISPR gRNA sequence
ttaaaacacttagaaacact

SEQ ID NO: 592553 - DNA, 20 bp, Artificial
  CRISPR gRNA sequence
cacttagaaacacttagaaa

SEQ ID NO: 592554 - DNA, 20 bp, Artificial
  CRISPR gRNA sequence
ttagaaacagatgatgttaa

SEQ ID NO: 592555 - DNA, 20 bp, Artificial
  CRISPR gRNA sequence
atgatgttaaaagcaatttt

SEQ ID NO: 592556 - DNA, 20 bp, Artificial
  CRISPR gRNA sequence
tgttaaaagcaatttttagt

SEQ ID NO: 592557 - DNA, 20 bp, Artificial
  CRISPR gRNA sequence
gtaagcatttttaaaatcga

SEQ ID NO: 592558 - DNA, 20 bp, Artificial
  CRISPR gRNA sequence
taagcatttttaaaatcgaa

SEQ ID NO: 592559 - DNA, 20 bp, Artificial
  CRISPR gRNA sequence
catttttaaaatcgaaaggt

SEQ ID NO: 592560 - DNA, 20 bp, Artificial
  CRISPR gRNA sequence
tgagctccttcttttattaa

SEQ ID NO: 592561 - DNA, 20 bp, Artificial
  CRISPR gRNA sequence
gagctccttcttttattaaa

SEQ ID NO: 592562 - DNA, 20 bp, Artificial
  CRISPR gRNA sequence
tcttttattaaaaggcacta

SEQ ID NO: 592563 - DNA, 20 bp, Artificial
  CRISPR gRNA sequence
ttttattaaaaggcactaaa

SEQ ID NO: 592564 - DNA, 20 bp, Artificial
  CRISPR gRNA sequence
tatgtatgtttttaaacaaa

SEQ ID NO: 592565 - DNA, 20 bp, Artificial
  CRISPR gRNA sequence
tttttaaacaaaaagccttt

SEQ ID NO: 592566 - DNA, 20 bp, Artificial
  CRISPR gRNA sequence
tggacacatgttcttattat

SEQ ID NO: 592567 - DNA, 20 bp, Artificial
  CRISPR gRNA sequence
ttattatgagccaaatttgc

SEQ ID NO: 592568 - DNA, 20 bp, Artificial
  CRISPR gRNA sequence
tatgagccaaatttgccagc

SEQ ID NO: 592569 - DNA, 20 bp, Artificial
  CRISPR gRNA sequence
atgagccaaatttgccagca

SEQ ID NO: 592570 - DNA, 20 bp, Artificial
  CRISPR gRNA sequence
gccaaatttgccagcaaggc

SEQ ID NO: 592571 - DNA, 20 bp, Artificial
  CRISPR gRNA sequence
aagtgacactattgacatct

SEQ ID NO: 592572 - DNA, 20 bp, Artificial
  CRISPR gRNA sequence
agtgacactattgacatctt

SEQ ID NO: 592573 - DNA, 20 bp, Artificial
  CRISPR gRNA sequence
gtgacactattgacatctta

SEQ ID NO: 592574 - DNA, 20 bp, Artificial
  CRISPR gRNA sequence
ttgacatcttagggtataaa

SEQ ID NO: 592575 - DNA, 20 bp, Artificial
  CRISPR gRNA sequence
caatatgattcatttaaaca

SEQ ID NO: 592576 - DNA, 20 bp, Artificial
  CRISPR gRNA sequence
atggctttgtttaaaaaatc

SEQ ID NO: 592577 - DNA, 20 bp, Artificial
  CRISPR gRNA sequence
ctttgtttaaaaaatctagt

SEQ ID NO: 592578 - DNA, 20 bp, Artificial
  CRISPR gRNA sequence
tttgtttaaaaaatctagtt

SEQ ID NO: 592579 - DNA, 20 bp, Artificial
  CRISPR gRNA sequence
tattcaccatgatcttattc

SEQ ID NO: 592580 - DNA, 20 bp, Artificial
  CRISPR gRNA sequence
tattccagaaactattttta

SEQ ID NO: 592581 - DNA, 20 bp, Artificial
  CRISPR gRNA sequence
taaagtttcatttataaatg

SEQ ID NO: 592582 - DNA, 20 bp, Artificial
  CRISPR gRNA sequence
atttataaatgcagtaaaat

SEQ ID NO: 592583 - DNA, 20 bp, Artificial
  CRISPR gRNA sequence
ttataaatgcagtaaaatta

SEQ ID NO: 592584 - DNA, 20 bp, Artificial
  CRISPR gRNA sequence
gagtttattcatcaactcat

SEQ ID NO: 592585 - DNA, 20 bp, Artificial
  CRISPR gRNA sequence
gtttattcatcaactcatga

SEQ ID NO: 592586 - DNA, 20 bp, Artificial
  CRISPR gRNA sequence
attcatcaactcatgagagt

SEQ ID NO: 592587 - DNA, 20 bp, Artificial
  CRISPR gRNA sequence
catcaactcatgagagttgg

SEQ ID NO: 592588 - DNA, 20 bp, Artificial
  CRISPR gRNA sequence
ctcatgagagttggcagtgc

SEQ ID NO: 592589 - DNA, 20 bp, Artificial
  CRISPR gRNA sequence
tggcagtgctggtttcacca

SEQ ID NO: 592590 - DNA, 20 bp, Artificial
  CRISPR gRNA sequence
gtttcaccatggtgtaataa

SEQ ID NO: 592591 - DNA, 20 bp, Artificial
  CRISPR gRNA sequence
ccatggtgtaataaaagaat

SEQ ID NO: 592592 - DNA, 20 bp, Artificial
  CRISPR gRNA sequence
atggtgtaataaaagaatga

SEQ ID NO: 592593 - DNA, 20 bp, Artificial
  CRISPR gRNA sequence
ggtgtaataaaagaatgaga

SEQ ID NO: 592594 - DNA, 20 bp, Artificial
  CRISPR gRNA sequence
gtaataaaagaatgagagag

SEQ ID NO: 592595 - DNA, 20 bp, Artificial
  CRISPR gRNA sequence
tgagagagtggatatctact

SEQ ID NO: 592596 - DNA, 20 bp, Artificial
  CRISPR gRNA sequence
gagtggatatctactcagtg

SEQ ID NO: 592597 - DNA, 20 bp, Artificial
  CRISPR gRNA sequence
agtggatatctactcagtga

SEQ ID NO: 592598 - DNA, 20 bp, Artificial
  CRISPR gRNA sequence
tctactcagtgaaggtgttg

SEQ ID NO: 592599 - DNA, 20 bp, Artificial
  CRISPR gRNA sequence
aggtgttgcagcattaatga

SEQ ID NO: 592600 - DNA, 20 bp, Artificial
  CRISPR gRNA sequence
ggtgttgcagcattaatgat

SEQ ID NO: 592601 - DNA, 20 bp, Artificial
  CRISPR gRNA sequence
gtgttgcagcattaatgata

SEQ ID NO: 592602 - DNA, 20 bp, Artificial
  CRISPR gRNA sequence
aatgatagggaaactgacct

SEQ ID NO: 592603 - DNA, 20 bp, Artificial
  CRISPR gRNA sequence
gaaacccataacataatctg

SEQ ID NO: 592604 - DNA, 20 bp, Artificial
  CRISPR gRNA sequence
ataacataatctgtagaatg

SEQ ID NO: 592605 - DNA, 20 bp, Artificial
  CRISPR gRNA sequence
taacataatctgtagaatga

SEQ ID NO: 592606 - DNA, 20 bp, Artificial
  CRISPR gRNA sequence
acataatctgtagaatgaag

SEQ ID NO: 592607 - DNA, 20 bp, Artificial
  CRISPR gRNA sequence
cataatctgtagaatgaagg

SEQ ID NO: 592608 - DNA, 20 bp, Artificial
  CRISPR gRNA sequence
tgaaggaggcaacacgatgt

SEQ ID NO: 592609 - DNA, 20 bp, Artificial
  CRISPR gRNA sequence
gaaggaggcaacacgatgtt

SEQ ID NO: 592610 - DNA, 20 bp, Artificial
  CRISPR gRNA sequence
gaggcaacacgatgttgggt

SEQ ID NO: 592611 - DNA, 20 bp, Artificial
  CRISPR gRNA sequence
acgatgttgggtcagcctgc

SEQ ID NO: 592612 - DNA, 20 bp, Artificial
  CRISPR gRNA sequence
acaatgcatgcactctattt

SEQ ID NO: 592613 - DNA, 20 bp, Artificial
  CRISPR gRNA sequence
tttatgttttgctatacata

SEQ ID NO: 592614 - DNA, 20 bp, Artificial
  CRISPR gRNA sequence
atgttttgctatacatacag

SEQ ID NO: 592615 - DNA, 20 bp, Artificial
  CRISPR gRNA sequence
gttttgctatacatacagaa

SEQ ID NO: 592616 - DNA, 20 bp, Artificial
  CRISPR gRNA sequence
ttgctatacatacagaagag

SEQ ID NO: 592617 - DNA, 20 bp, Artificial
  CRISPR gRNA sequence
tgctatacatacagaagagc

SEQ ID NO: 592618 - DNA, 20 bp, Artificial
  CRISPR gRNA sequence
ctcctttctcgattatcctt

SEQ ID NO: 592619 - DNA, 20 bp, Artificial
  CRISPR gRNA sequence
tcctttctcgattatcctta

SEQ ID NO: 592620 - DNA, 20 bp, Artificial
  CRISPR gRNA sequence
ctttctcgattatccttaag

SEQ ID NO: 592621 - DNA, 20 bp, Artificial
  CRISPR gRNA sequence
tttctcgattatccttaagg

SEQ ID NO: 592622 - DNA, 20 bp, Artificial
  CRISPR gRNA sequence
gattatccttaaggaggttg

SEQ ID NO: 592623 - DNA, 20 bp, Artificial
  CRISPR gRNA sequence
ggttgcagccttgttaatga

SEQ ID NO: 592624 - DNA, 20 bp, Artificial
  CRISPR gRNA sequence
gttgcagccttgttaatgat

SEQ ID NO: 592625 - DNA, 20 bp, Artificial
  CRISPR gRNA sequence
ccttgttaatgataggtgtc

SEQ ID NO: 592626 - DNA, 20 bp, Artificial
  CRISPR gRNA sequence
ataggtgtcaagatctccaa

SEQ ID NO: 592627 - DNA, 20 bp, Artificial
  CRISPR gRNA sequence
aggtgtcaagatctccaaaa

SEQ ID NO: 592628 - DNA, 20 bp, Artificial
  CRISPR gRNA sequence
gtcaagatctccaaaagaga

SEQ ID NO: 592629 - DNA, 20 bp, Artificial
  CRISPR gRNA sequence
aagagatggactttactcac

SEQ ID NO: 592630 - DNA, 20 bp, Artificial
  CRISPR gRNA sequence
tttactcactggaaaatgtt

SEQ ID NO: 592631 - DNA, 20 bp, Artificial
  CRISPR gRNA sequence
tggaaaatgttgagactttc

SEQ ID NO: 592632 - DNA, 20 bp, Artificial
  CRISPR gRNA sequence
ggaaaatgttgagactttcc

SEQ ID NO: 592633 - DNA, 20 bp, Artificial
  CRISPR gRNA sequence
gagactttccgggatcactc

SEQ ID NO: 592634 - DNA, 20 bp, Artificial
  CRISPR gRNA sequence
tttccgggatcactctggcc

SEQ ID NO: 592635 - DNA, 20 bp, Artificial
  CRISPR gRNA sequence
ctggccaagttcttaaactt

SEQ ID NO: 592636 - DNA, 20 bp, Artificial
  CRISPR gRNA sequence
gccaagttcttaaacttgag

SEQ ID NO: 592637 - DNA, 20 bp, Artificial
  CRISPR gRNA sequence
ccaagttcttaaacttgaga

SEQ ID NO: 592638 - DNA, 20 bp, Artificial
  CRISPR gRNA sequence
agttcttaaacttgagaagg

SEQ ID NO: 592639 - DNA, 20 bp, Artificial
  CRISPR gRNA sequence
cttgagaaggtggtgattaa

SEQ ID NO: 592640 - DNA, 20 bp, Artificial
  CRISPR gRNA sequence
agaaggtggtgattaaaagt

SEQ ID NO: 592641 - DNA, 20 bp, Artificial
  CRISPR gRNA sequence
ggtggtgattaaaagttagc

SEQ ID NO: 592642 - DNA, 20 bp, Artificial
  CRISPR gRNA sequence
ggtgattaaaagttagcaag

SEQ ID NO: 592643 - DNA, 20 bp, Artificial
  CRISPR gRNA sequence
aaagttagcaagtggttctg

SEQ ID NO: 592644 - DNA, 20 bp, Artificial
  CRISPR gRNA sequence
gttagcaagtggttctgcag

SEQ ID NO: 592645 - DNA, 20 bp, Artificial
  CRISPR gRNA sequence
gcaagtggttctgcagtggt

SEQ ID NO: 592646 - DNA, 20 bp, Artificial
  CRISPR gRNA sequence
ggttctgcagtggtgagacg

SEQ ID NO: 592647 - DNA, 20 bp, Artificial
  CRISPR gRNA sequence
gttctgcagtggtgagacgt

SEQ ID NO: 592648 - DNA, 20 bp, Artificial
  CRISPR gRNA sequence
ttctgcagtggtgagacgtg

SEQ ID NO: 592649 - DNA, 20 bp, Artificial
  CRISPR gRNA sequence
cagtggtgagacgtggggta

SEQ ID NO: 592650 - DNA, 20 bp, Artificial
  CRISPR gRNA sequence
aataattgctaacccaaact

SEQ ID NO: 592651 - DNA, 20 bp, Artificial
  CRISPR gRNA sequence
ataattgctaacccaaactg

SEQ ID NO: 592652 - DNA, 20 bp, Artificial
  CRISPR gRNA sequence
taattgctaacccaaactga

SEQ ID NO: 592653 - DNA, 20 bp, Artificial
  CRISPR gRNA sequence
atgctaacttcaccaaatta

SEQ ID NO: 592654 - DNA, 20 bp, Artificial
  CRISPR gRNA sequence
ttaaagaaaacaaaactgct

SEQ ID NO: 592655 - DNA, 20 bp, Artificial
  CRISPR gRNA sequence
gaaaacaaaactgcttagta

SEQ ID NO: 592656 - DNA, 20 bp, Artificial
  CRISPR gRNA sequence
aaaacaaaactgcttagtat

SEQ ID NO: 592657 - DNA, 20 bp, Artificial
  CRISPR gRNA sequence
cactaaaaacataaattact

SEQ ID NO: 592658 - DNA, 20 bp, Artificial
  CRISPR gRNA sequence
aaacataaattacttggact

SEQ ID NO: 592659 - DNA, 20 bp, Artificial
  CRISPR gRNA sequence
tttcacctaaaacactgtac

SEQ ID NO: 592660 - DNA, 20 bp, Artificial
  CRISPR gRNA sequence
gtactagtgaaccttatgtt

SEQ ID NO: 592661 - DNA, 20 bp, Artificial
  CRISPR gRNA sequence
caatattcaacaatacttct

SEQ ID NO: 592662 - DNA, 20 bp, Artificial
  CRISPR gRNA sequence
attcaaatataactccatgt

SEQ ID NO: 592663 - DNA, 20 bp, Artificial
  CRISPR gRNA sequence
tataactccatgtgagcatg

SEQ ID NO: 592664 - DNA, 20 bp, Artificial
  CRISPR gRNA sequence
ccatgtgagcatgtagaatc

SEQ ID NO: 592665 - DNA, 20 bp, Artificial
  CRISPR gRNA sequence
catgtgagcatgtagaatcc

SEQ ID NO: 592666 - DNA, 20 bp, Artificial
  CRISPR gRNA sequence
atgtgagcatgtagaatcca

SEQ ID NO: 592667 - DNA, 20 bp, Artificial
  CRISPR gRNA sequence
gagcatgtagaatccaggga

SEQ ID NO: 592668 - DNA, 20 bp, Artificial
  CRISPR gRNA sequence
gaatccagggaaagaatccc

SEQ ID NO: 592669 - DNA, 20 bp, Artificial
  CRISPR gRNA sequence
gaatgctgtaactgtttgaa

SEQ ID NO: 592670 - DNA, 20 bp, Artificial
  CRISPR gRNA sequence
tgcaaatacctacatccaaa

SEQ ID NO: 592671 - DNA, 20 bp, Artificial
  CRISPR gRNA sequence
acctacatccaaaaagaaaa

SEQ ID NO: 592672 - DNA, 20 bp, Artificial
  CRISPR gRNA sequence
ctacatccaaaaagaaaaaa

SEQ ID NO: 592673 - DNA, 20 bp, Artificial
  CRISPR gRNA sequence
atccaaaaagaaaaaagagt

SEQ ID NO: 592674 - DNA, 20 bp, Artificial
  CRISPR gRNA sequence
caaaaagaaaaaagagttgg

SEQ ID NO: 592675 - DNA, 20 bp, Artificial
  CRISPR gRNA sequence
aagaaaaaagagttggaaga

SEQ ID NO: 592676 - DNA, 20 bp, Artificial
  CRISPR gRNA sequence
tgcaaatgttactaatttac

SEQ ID NO: 592677 - DNA, 20 bp, Artificial
  CRISPR gRNA sequence
tactaaataccaacaaaata

SEQ ID NO: 592678 - DNA, 20 bp, Artificial
  CRISPR gRNA sequence
gatgtatgatttacaaaaaa

SEQ ID NO: 592679 - DNA, 20 bp, Artificial
  CRISPR gRNA sequence
tacaaaaaacagactaaaat

SEQ ID NO: 592680 - DNA, 20 bp, Artificial
  CRISPR gRNA sequence
aaataagctctaaatttctg

SEQ ID NO: 592681 - DNA, 20 bp, Artificial
  CRISPR gRNA sequence
agctctaaatttctgtggac

SEQ ID NO: 592682 - DNA, 20 bp, Artificial
  CRISPR gRNA sequence
gtggacaagatgaatgtgtg

SEQ ID NO: 592683 - DNA, 20 bp, Artificial
  CRISPR gRNA sequence
aagatgaatgtgtgtggctg

SEQ ID NO: 592684 - DNA, 20 bp, Artificial
  CRISPR gRNA sequence
agatgaatgtgtgtggctga

SEQ ID NO: 592685 - DNA, 20 bp, Artificial
  CRISPR gRNA sequence
gatgaatgtgtgtggctgaa

SEQ ID NO: 592686 - DNA, 20 bp, Artificial
  CRISPR gRNA sequence
gaatgtgtgtggctgaaggg

SEQ ID NO: 592687 - DNA, 20 bp, Artificial
  CRISPR gRNA sequence
gtgtggctgaagggaagcaa

SEQ ID NO: 592688 - DNA, 20 bp, Artificial
  CRISPR gRNA sequence
caaaagtgatcctgatccca

SEQ ID NO: 592689 - DNA, 20 bp, Artificial
  CRISPR gRNA sequence
gatcctgatcccatggtatt

SEQ ID NO: 592690 - DNA, 20 bp, Artificial
  CRISPR gRNA sequence
atcctgatcccatggtatta

SEQ ID NO: 592691 - DNA, 20 bp, Artificial
  CRISPR gRNA sequence
ctgatcccatggtattaagg

SEQ ID NO: 592692 - DNA, 20 bp, Artificial
  CRISPR gRNA sequence
cccatggtattaaggtagtt

SEQ ID NO: 592693 - DNA, 20 bp, Artificial
  CRISPR gRNA sequence
ccatggtattaaggtagttc

SEQ ID NO: 592694 - DNA, 20 bp, Artificial
  CRISPR gRNA sequence
ggtattaaggtagttcaggt

SEQ ID NO: 592695 - DNA, 20 bp, Artificial
  CRISPR gRNA sequence
tatttttcacacataaacac

SEQ ID NO: 592696 - DNA, 20 bp, Artificial
  CRISPR gRNA sequence
ttcacacataaacactagcc

SEQ ID NO: 592697 - DNA, 20 bp, Artificial
  CRISPR gRNA sequence
acacataaacactagcccgg

SEQ ID NO: 592698 - DNA, 20 bp, Artificial
  CRISPR gRNA sequence
acctttactgcatatcccta

SEQ ID NO: 592699 - DNA, 20 bp, Artificial
  CRISPR gRNA sequence
tgcatatccctaaagatgtc

SEQ ID NO: 592700 - DNA, 20 bp, Artificial
  CRISPR gRNA sequence
catatccctaaagatgtcca

SEQ ID NO: 592701 - DNA, 20 bp, Artificial
  CRISPR gRNA sequence
taaagatgtccagagattgc

SEQ ID NO: 592702 - DNA, 20 bp, Artificial
  CRISPR gRNA sequence
aaagatgtccagagattgct

SEQ ID NO: 592703 - DNA, 20 bp, Artificial
  CRISPR gRNA sequence
cagagattgctaggcttcct

SEQ ID NO: 592704 - DNA, 20 bp, Artificial
  CRISPR gRNA sequence
ggcttcctcagcaacgacta

SEQ ID NO: 592705 - DNA, 20 bp, Artificial
  CRISPR gRNA sequence
gcttcctcagcaacgactac

SEQ ID NO: 592706 - DNA, 20 bp, Artificial
  CRISPR gRNA sequence
cttcctcagcaacgactaca

SEQ ID NO: 592707 - DNA, 20 bp, Artificial
  CRISPR gRNA sequence
tcagcaacgactacagggac

SEQ ID NO: 592708 - DNA, 20 bp, Artificial
  CRISPR gRNA sequence
cagcaacgactacagggact

SEQ ID NO: 592709 - DNA, 20 bp, Artificial
  CRISPR gRNA sequence
acagggactaggaactcttt

SEQ ID NO: 592710 - DNA, 20 bp, Artificial
  CRISPR gRNA sequence
agggactaggaactctttca

SEQ ID NO: 592711 - DNA, 20 bp, Artificial
  CRISPR gRNA sequence
ggactaggaactctttcaga

SEQ ID NO: 592712 - DNA, 20 bp, Artificial
  CRISPR gRNA sequence
cagagagaccccctactctc

SEQ ID NO: 592713 - DNA, 20 bp, Artificial
  CRISPR gRNA sequence
cctactctccagcctccaaa

SEQ ID NO: 592714 - DNA, 20 bp, Artificial
  CRISPR gRNA sequence
ctctccagcctccaaacagt

SEQ ID NO: 592715 - DNA, 20 bp, Artificial
  CRISPR gRNA sequence
tctccagcctccaaacagtc

SEQ ID NO: 592716 - DNA, 20 bp, Artificial
  CRISPR gRNA sequence
gcctccaaacagtcaggcac

SEQ ID NO: 592717 - DNA, 20 bp, Artificial
  CRISPR gRNA sequence
caaacagtcaggcactagtc

SEQ ID NO: 592718 - DNA, 20 bp, Artificial
  CRISPR gRNA sequence
acagtcaggcactagtccag

SEQ ID NO: 592719 - DNA, 20 bp, Artificial
  CRISPR gRNA sequence
ggcactagtccagcagccct

SEQ ID NO: 592720 - DNA, 20 bp, Artificial
  CRISPR gRNA sequence
agcagcccttggctgtgctc

SEQ ID NO: 592721 - DNA, 20 bp, Artificial
  CRISPR gRNA sequence
cccttggctgtgctcaagca

SEQ ID NO: 592722 - DNA, 20 bp, Artificial
  CRISPR gRNA sequence
tgtgctcaagcaaagaattt

SEQ ID NO: 592723 - DNA, 20 bp, Artificial
  CRISPR gRNA sequence
gtgctcaagcaaagaatttt

SEQ ID NO: 592724 - DNA, 20 bp, Artificial
  CRISPR gRNA sequence
caagcaaagaattttaggaa

SEQ ID NO: 592725 - DNA, 20 bp, Artificial
  CRISPR gRNA sequence
aagcaaagaattttaggaat

SEQ ID NO: 592726 - DNA, 20 bp, Artificial
  CRISPR gRNA sequence
aagaattttaggaatgggta

SEQ ID NO: 592727 - DNA, 20 bp, Artificial
  CRISPR gRNA sequence
agaattttaggaatgggtaa

SEQ ID NO: 592728 - DNA, 20 bp, Artificial
  CRISPR gRNA sequence
tttaggaatgggtaaaggaa

SEQ ID NO: 592729 - DNA, 20 bp, Artificial
  CRISPR gRNA sequence
taaaggaatggcacattccc

SEQ ID NO: 592730 - DNA, 20 bp, Artificial
  CRISPR gRNA sequence
aaggaatggcacattcccta

SEQ ID NO: 592731 - DNA, 20 bp, Artificial
  CRISPR gRNA sequence
ggaatggcacattccctaga

SEQ ID NO: 592732 - DNA, 20 bp, Artificial
  CRISPR gRNA sequence
ggcacattccctagagagtt

SEQ ID NO: 592733 - DNA, 20 bp, Artificial
  CRISPR gRNA sequence
attccctagagagtttagtg

SEQ ID NO: 592734 - DNA, 20 bp, Artificial
  CRISPR gRNA sequence
ctagagagtttagtgtggaa

SEQ ID NO: 592735 - DNA, 20 bp, Artificial
  CRISPR gRNA sequence
tagagagtttagtgtggaat

SEQ ID NO: 592736 - DNA, 20 bp, Artificial
  CRISPR gRNA sequence
gagagtttagtgtggaatgg

SEQ ID NO: 592737 - DNA, 20 bp, Artificial
  CRISPR gRNA sequence
agtttagtgtggaatgggag

SEQ ID NO: 592738 - DNA, 20 bp, Artificial
  CRISPR gRNA sequence
tttagtgtggaatgggagtg

SEQ ID NO: 592739 - DNA, 20 bp, Artificial
  CRISPR gRNA sequence
ttagtgtggaatgggagtgg

SEQ ID NO: 592740 - DNA, 20 bp, Artificial
  CRISPR gRNA sequence
tagtgtggaatgggagtgga

SEQ ID NO: 592741 - DNA, 20 bp, Artificial
  CRISPR gRNA sequence
agtgtggaatgggagtggag

SEQ ID NO: 592742 - DNA, 20 bp, Artificial
  CRISPR gRNA sequence
gtgtggaatgggagtggagg

SEQ ID NO: 592743 - DNA, 20 bp, Artificial
  CRISPR gRNA sequence
tgtggaatgggagtggaggg

SEQ ID NO: 592744 - DNA, 20 bp, Artificial
  CRISPR gRNA sequence
tggaatgggagtggaggggg

SEQ ID NO: 592745 - DNA, 20 bp, Artificial
  CRISPR gRNA sequence
ggaatgggagtggagggggg

SEQ ID NO: 592746 - DNA, 20 bp, Artificial
  CRISPR gRNA sequence
gggagtggaggggggaggaa

SEQ ID NO: 592747 - DNA, 20 bp, Artificial
  CRISPR gRNA sequence
gagtggaggggggaggaaaa

SEQ ID NO: 592748 - DNA, 20 bp, Artificial
  CRISPR gRNA sequence
agtggaggggggaggaaaag

SEQ ID NO: 592749 - DNA, 20 bp, Artificial
  CRISPR gRNA sequence
gtggaggggggaggaaaaga

SEQ ID NO: 592750 - DNA, 20 bp, Artificial
  CRISPR gRNA sequence
attattaactattatgctga

SEQ ID NO: 592751 - DNA, 20 bp, Artificial
  CRISPR gRNA sequence
taactattatgctgatggaa

SEQ ID NO: 592752 - DNA, 20 bp, Artificial
  CRISPR gRNA sequence
aatggaatctaacgttatac

SEQ ID NO: 592753 - DNA, 20 bp, Artificial
  CRISPR gRNA sequence
aatctaacgttatactggct

SEQ ID NO: 592754 - DNA, 20 bp, Artificial
  CRISPR gRNA sequence
aacgttatactggctaagac

SEQ ID NO: 592755 - DNA, 20 bp, Artificial
  CRISPR gRNA sequence
ggctaagactggctttcctc

SEQ ID NO: 592756 - DNA, 20 bp, Artificial
  CRISPR gRNA sequence
gctaagactggctttcctcc

SEQ ID NO: 592757 - DNA, 20 bp, Artificial
  CRISPR gRNA sequence
tcaacactattgccaaaaaa

SEQ ID NO: 592758 - DNA, 20 bp, Artificial
  CRISPR gRNA sequence
tattgccaaaaaacagactg

SEQ ID NO: 592759 - DNA, 20 bp, Artificial
  CRISPR gRNA sequence
aaacagactgtggttttatt

SEQ ID NO: 592760 - DNA, 20 bp, Artificial
  CRISPR gRNA sequence
tgtggttttattaagtgatc

SEQ ID NO: 592761 - DNA, 20 bp, Artificial
  CRISPR gRNA sequence
gatctggcctttgctccata

SEQ ID NO: 592762 - DNA, 20 bp, Artificial
  CRISPR gRNA sequence
agatctccctgttaatgcaa

SEQ ID NO: 592763 - DNA, 20 bp, Artificial
  CRISPR gRNA sequence
gatctccctgttaatgcaat

SEQ ID NO: 592764 - DNA, 20 bp, Artificial
  CRISPR gRNA sequence
atctccctgttaatgcaata

SEQ ID NO: 592765 - DNA, 20 bp, Artificial
  CRISPR gRNA sequence
ctccctgttaatgcaatagg

SEQ ID NO: 592766 - DNA, 20 bp, Artificial
  CRISPR gRNA sequence
taaaacaccttccacaatac

SEQ ID NO: 592767 - DNA, 20 bp, Artificial
  CRISPR gRNA sequence
ccacaataccagtacactta

SEQ ID NO: 592768 - DNA, 20 bp, Artificial
  CRISPR gRNA sequence
caataccagtacacttaaag

SEQ ID NO: 592769 - DNA, 20 bp, Artificial
  CRISPR gRNA sequence
tacacttaaagtggtaatct

SEQ ID NO: 592770 - DNA, 20 bp, Artificial
  CRISPR gRNA sequence
acacttaaagtggtaatctt

SEQ ID NO: 592771 - DNA, 20 bp, Artificial
  CRISPR gRNA sequence
aatcttaggttttgaaacaa

SEQ ID NO: 592772 - DNA, 20 bp, Artificial
  CRISPR gRNA sequence
atcttaggttttgaaacaaa

SEQ ID NO: 592773 - DNA, 20 bp, Artificial
  CRISPR gRNA sequence
ttaggttttgaaacaaaagg

SEQ ID NO: 592774 - DNA, 20 bp, Artificial
  CRISPR gRNA sequence
taggttttgaaacaaaaggt

SEQ ID NO: 592775 - DNA, 20 bp, Artificial
  CRISPR gRNA sequence
aggttttgaaacaaaaggta

SEQ ID NO: 592776 - DNA, 20 bp, Artificial
  CRISPR gRNA sequence
ggttttgaaacaaaaggtag

SEQ ID NO: 592777 - DNA, 20 bp, Artificial
  CRISPR gRNA sequence
tttgaaacaaaaggtagggg

SEQ ID NO: 592778 - DNA, 20 bp, Artificial
  CRISPR gRNA sequence
aaaggtaggggaagtcaaat

SEQ ID NO: 592779 - DNA, 20 bp, Artificial
  CRISPR gRNA sequence
ggtaggggaagtcaaatcag

SEQ ID NO: 592780 - DNA, 20 bp, Artificial
  CRISPR gRNA sequence
gtcaaatcagtggaaaaccc

SEQ ID NO: 592781 - DNA, 20 bp, Artificial
  CRISPR gRNA sequence
tggaaaacccgagcaaatca

SEQ ID NO: 592782 - DNA, 20 bp, Artificial
  CRISPR gRNA sequence
ggaaaacccgagcaaatcaa

SEQ ID NO: 592783 - DNA, 20 bp, Artificial
  CRISPR gRNA sequence
aggtcttgatatgcaatgta

SEQ ID NO: 592784 - DNA, 20 bp, Artificial
  CRISPR gRNA sequence
atgtatagtaaaattgaccc

SEQ ID NO: 592785 - DNA, 20 bp, Artificial
  CRISPR gRNA sequence
tatagtaaaattgacccaag

SEQ ID NO: 592786 - DNA, 20 bp, Artificial
  CRISPR gRNA sequence
tagtaaaattgacccaagca

SEQ ID NO: 592787 - DNA, 20 bp, Artificial
  CRISPR gRNA sequence
taaaattgacccaagcagag

SEQ ID NO: 592788 - DNA, 20 bp, Artificial
  CRISPR gRNA sequence
aaattgacccaagcagagca

SEQ ID NO: 592789 - DNA, 20 bp, Artificial
  CRISPR gRNA sequence
aattgacccaagcagagcag

SEQ ID NO: 592790 - DNA, 20 bp, Artificial
  CRISPR gRNA sequence
tatttgactcattatttctg

SEQ ID NO: 592791 - DNA, 20 bp, Artificial
  CRISPR gRNA sequence
atttgactcattatttctgt

SEQ ID NO: 592792 - DNA, 20 bp, Artificial
  CRISPR gRNA sequence
tgggaactttgatttgcata

SEQ ID NO: 592793 - DNA, 20 bp, Artificial
  CRISPR gRNA sequence
gggaactttgatttgcataa

SEQ ID NO: 592794 - DNA, 20 bp, Artificial
  CRISPR gRNA sequence
ctttgatttgcataaaggca

SEQ ID NO: 592795 - DNA, 20 bp, Artificial
  CRISPR gRNA sequence
tgatttgcataaaggcatgg

SEQ ID NO: 592796 - DNA, 20 bp, Artificial
  CRISPR gRNA sequence
ataaaggcatggcagatctt

SEQ ID NO: 592797 - DNA, 20 bp, Artificial
  CRISPR gRNA sequence
aaaggcatggcagatcttaa

SEQ ID NO: 592798 - DNA, 20 bp, Artificial
  CRISPR gRNA sequence
aaggcatggcagatcttaag

SEQ ID NO: 592799 - DNA, 20 bp, Artificial
  CRISPR gRNA sequence
gcatggcagatcttaagagg

SEQ ID NO: 592800 - DNA, 20 bp, Artificial
  CRISPR gRNA sequence
cactaatcacatttataatt

SEQ ID NO: 592801 - DNA, 20 bp, Artificial
  CRISPR gRNA sequence
aatcacatttataattcaga

SEQ ID NO: 592802 - DNA, 20 bp, Artificial
  CRISPR gRNA sequence
atcctgattttaatactttg

SEQ ID NO: 592803 - DNA, 20 bp, Artificial
  CRISPR gRNA sequence
ttttaatactttgtagttct

SEQ ID NO: 592804 - DNA, 20 bp, Artificial
  CRISPR gRNA sequence
tttaatactttgtagttctg

SEQ ID NO: 592805 - DNA, 20 bp, Artificial
  CRISPR gRNA sequence
aaaaatgcaactcatttaaa

SEQ ID NO: 592806 - DNA, 20 bp, Artificial
  CRISPR gRNA sequence
gcaactcatttaaaaagaaa

SEQ ID NO: 592807 - DNA, 20 bp, Artificial
  CRISPR gRNA sequence
aaaagttgttttatttacat

SEQ ID NO: 592808 - DNA, 20 bp, Artificial
  CRISPR gRNA sequence
ttattttttaattatacttt

SEQ ID NO: 592809 - DNA, 20 bp, Artificial
  CRISPR gRNA sequence
tttaattatactttaagttc

SEQ ID NO: 592810 - DNA, 20 bp, Artificial
  CRISPR gRNA sequence
ttaattatactttaagttct

SEQ ID NO: 592811 - DNA, 20 bp, Artificial
  CRISPR gRNA sequence
taattatactttaagttcta

SEQ ID NO: 592812 - DNA, 20 bp, Artificial
  CRISPR gRNA sequence
gggtacatgtgcacaacatg

SEQ ID NO: 592813 - DNA, 20 bp, Artificial
  CRISPR gRNA sequence
ggtacatgtgcacaacatgc

SEQ ID NO: 592814 - DNA, 20 bp, Artificial
  CRISPR gRNA sequence
catgtatacatgtgccatgt

SEQ ID NO: 592815 - DNA, 20 bp, Artificial
  CRISPR gRNA sequence
cgttaactcatcatttacat

SEQ ID NO: 592816 - DNA, 20 bp, Artificial
  CRISPR gRNA sequence
gttaactcatcatttacatt

SEQ ID NO: 592817 - DNA, 20 bp, Artificial
  CRISPR gRNA sequence
ccactccctgcaccccatga

SEQ ID NO: 592818 - DNA, 20 bp, Artificial
  CRISPR gRNA sequence
cactccctgcaccccatgac

SEQ ID NO: 592819 - DNA, 20 bp, Artificial
  CRISPR gRNA sequence
ctgcaccccatgacaggccc

SEQ ID NO: 592820 - DNA, 20 bp, Artificial
  CRISPR gRNA sequence
atgttccccaccctgtgtcc

SEQ ID NO: 592821 - DNA, 20 bp, Artificial
  CRISPR gRNA sequence
gtccaagtgttctcattgtt

SEQ ID NO: 592822 - DNA, 20 bp, Artificial
  CRISPR gRNA sequence
attgttcagttcccacctat

SEQ ID NO: 592823 - DNA, 20 bp, Artificial
  CRISPR gRNA sequence
ttcagttcccacctatgagt

SEQ ID NO: 592824 - DNA, 20 bp, Artificial
  CRISPR gRNA sequence
cacctatgagtgagaacatg

SEQ ID NO: 592825 - DNA, 20 bp, Artificial
  CRISPR gRNA sequence
gagtgagaacatgcggtgtt

SEQ ID NO: 592826 - DNA, 20 bp, Artificial
  CRISPR gRNA sequence
ttggttttctgtccttgcga

SEQ ID NO: 592827 - DNA, 20 bp, Artificial
  CRISPR gRNA sequence
cgatagtttgctcataatga

SEQ ID NO: 592828 - DNA, 20 bp, Artificial
  CRISPR gRNA sequence
ttgctcataatgatggtttc

SEQ ID NO: 592829 - DNA, 20 bp, Artificial
  CRISPR gRNA sequence
gcttcatccatgtccctaca

SEQ ID NO: 592830 - DNA, 20 bp, Artificial
  CRISPR gRNA sequence
cttcatccatgtccctacaa

SEQ ID NO: 592831 - DNA, 20 bp, Artificial
  CRISPR gRNA sequence
catgaactcatcctttttcg

SEQ ID NO: 592832 - DNA, 20 bp, Artificial
  CRISPR gRNA sequence
catcctttttcgtggctgca

SEQ ID NO: 592833 - DNA, 20 bp, Artificial
  CRISPR gRNA sequence
gctgcatagtatttattcca

SEQ ID NO: 592834 - DNA, 20 bp, Artificial
  CRISPR gRNA sequence
tgtgccacattttcttaatc

SEQ ID NO: 592835 - DNA, 20 bp, Artificial
  CRISPR gRNA sequence
ttaatccagtctatcactga

SEQ ID NO: 592836 - DNA, 20 bp, Artificial
  CRISPR gRNA sequence
gtctatcactgatggacatt

SEQ ID NO: 592837 - DNA, 20 bp, Artificial
  CRISPR gRNA sequence
tctatcactgatggacattt

SEQ ID NO: 592838 - DNA, 20 bp, Artificial
  CRISPR gRNA sequence
tcactgatggacatttgggt

SEQ ID NO: 592839 - DNA, 20 bp, Artificial
  CRISPR gRNA sequence
tggacatttgggttggttcc

SEQ ID NO: 592840 - DNA, 20 bp, Artificial
  CRISPR gRNA sequence
caagtctttgctattgtgaa

SEQ ID NO: 592841 - DNA, 20 bp, Artificial
  CRISPR gRNA sequence
cacgtgtgcatgtgtcttta

SEQ ID NO: 592842 - DNA, 20 bp, Artificial
  CRISPR gRNA sequence
gtgtgcatgtgtctttatag

SEQ ID NO: 592843 - DNA, 20 bp, Artificial
  CRISPR gRNA sequence
cagcatgatttataatcctt

SEQ ID NO: 592844 - DNA, 20 bp, Artificial
  CRISPR gRNA sequence
agcatgatttataatccttt

SEQ ID NO: 592845 - DNA, 20 bp, Artificial
  CRISPR gRNA sequence
taatcctttgggtatatacc

SEQ ID NO: 592846 - DNA, 20 bp, Artificial
  CRISPR gRNA sequence
tttgggtatatacccagtaa

SEQ ID NO: 592847 - DNA, 20 bp, Artificial
  CRISPR gRNA sequence
ttgggtatatacccagtaat

SEQ ID NO: 592848 - DNA, 20 bp, Artificial
  CRISPR gRNA sequence
gtatatacccagtaatggga

SEQ ID NO: 592849 - DNA, 20 bp, Artificial
  CRISPR gRNA sequence
atacccagtaatgggatggc

SEQ ID NO: 592850 - DNA, 20 bp, Artificial
  CRISPR gRNA sequence
tacccagtaatgggatggct

SEQ ID NO: 592851 - DNA, 20 bp, Artificial
  CRISPR gRNA sequence
gctgggtcaaatgatatttc

SEQ ID NO: 592852 - DNA, 20 bp, Artificial
  CRISPR gRNA sequence
tcaaatgatatttctagttc

SEQ ID NO: 592853 - DNA, 20 bp, Artificial
  CRISPR gRNA sequence
atttctagttctagatccct

SEQ ID NO: 592854 - DNA, 20 bp, Artificial
  CRISPR gRNA sequence
tttctagttctagatccctg

SEQ ID NO: 592855 - DNA, 20 bp, Artificial
  CRISPR gRNA sequence
tgccacactgtcttccacaa

SEQ ID NO: 592856 - DNA, 20 bp, Artificial
  CRISPR gRNA sequence
gtcttccacaatggttgaac

SEQ ID NO: 592857 - DNA, 20 bp, Artificial
  CRISPR gRNA sequence
acaatggttgaactagttta

SEQ ID NO: 592858 - DNA, 20 bp, Artificial
  CRISPR gRNA sequence
gttgaactagtttacagtcc

SEQ ID NO: 592859 - DNA, 20 bp, Artificial
  CRISPR gRNA sequence
ctagtttacagtcccagcaa

SEQ ID NO: 592860 - DNA, 20 bp, Artificial
  CRISPR gRNA sequence
cagtcccagcaacagtgtaa

SEQ ID NO: 592861 - DNA, 20 bp, Artificial
  CRISPR gRNA sequence
ccatttctccacatcctctc

SEQ ID NO: 592862 - DNA, 20 bp, Artificial
  CRISPR gRNA sequence
ttaatgatcgccattctaac

SEQ ID NO: 592863 - DNA, 20 bp, Artificial
  CRISPR gRNA sequence
atcgccattctaactggtgt

SEQ ID NO: 592864 - DNA, 20 bp, Artificial
  CRISPR gRNA sequence
ccattctaactggtgtgaga

SEQ ID NO: 592865 - DNA, 20 bp, Artificial
  CRISPR gRNA sequence
tgtgagatggtatctcattg

SEQ ID NO: 592866 - DNA, 20 bp, Artificial
  CRISPR gRNA sequence
tttgatttgcatttctctga

SEQ ID NO: 592867 - DNA, 20 bp, Artificial
  CRISPR gRNA sequence
atttgcatttctctgatggc

SEQ ID NO: 592868 - DNA, 20 bp, Artificial
  CRISPR gRNA sequence
ctctgatggccagtgatgat

SEQ ID NO: 592869 - DNA, 20 bp, Artificial
  CRISPR gRNA sequence
gcatttttccatgtgtctgt

SEQ ID NO: 592870 - DNA, 20 bp, Artificial
  CRISPR gRNA sequence
ctacataaatgtcttctttc

SEQ ID NO: 592871 - DNA, 20 bp, Artificial
  CRISPR gRNA sequence
cataaatgtcttctttcgag

SEQ ID NO: 592872 - DNA, 20 bp, Artificial
  CRISPR gRNA sequence
atcctttgcccactttttga

SEQ ID NO: 592873 - DNA, 20 bp, Artificial
  CRISPR gRNA sequence
tcctttgcccactttttgat

SEQ ID NO: 592874 - DNA, 20 bp, Artificial
  CRISPR gRNA sequence
cctttgcccactttttgatg

SEQ ID NO: 592875 - DNA, 20 bp, Artificial
  CRISPR gRNA sequence
tttttcttgtaaatttgttt

SEQ ID NO: 592876 - DNA, 20 bp, Artificial
  CRISPR gRNA sequence
aaatttgtttaagttctttg

SEQ ID NO: 592877 - DNA, 20 bp, Artificial
  CRISPR gRNA sequence
tttaagttctttgtagattc

SEQ ID NO: 592878 - DNA, 20 bp, Artificial
  CRISPR gRNA sequence
ttgtagattctggatatact

SEQ ID NO: 592879 - DNA, 20 bp, Artificial
  CRISPR gRNA sequence
ttatatccaatttcattcca

SEQ ID NO: 592880 - DNA, 20 bp, Artificial
  CRISPR gRNA sequence
ccaaagctgatatttaaaaa

SEQ ID NO: 592881 - DNA, 20 bp, Artificial
  CRISPR gRNA sequence
agctttaaaaataattttcc

SEQ ID NO: 592882 - DNA, 20 bp, Artificial
  CRISPR gRNA sequence
taaaaataattttcctggcc

SEQ ID NO: 592883 - DNA, 20 bp, Artificial
  CRISPR gRNA sequence
ataattttcctggcctggca

SEQ ID NO: 592884 - DNA, 20 bp, Artificial
  CRISPR gRNA sequence
attttcctggcctggcacag

SEQ ID NO: 592885 - DNA, 20 bp, Artificial
  CRISPR gRNA sequence
gtggctcacacctgtaatct

SEQ ID NO: 592886 - DNA, 20 bp, Artificial
  CRISPR gRNA sequence
acctgtaatcttagcaattt

SEQ ID NO: 592887 - DNA, 20 bp, Artificial
  CRISPR gRNA sequence
ctgtaatcttagcaatttga

SEQ ID NO: 592888 - DNA, 20 bp, Artificial
  CRISPR gRNA sequence
tgtaatcttagcaatttgag

SEQ ID NO: 592889 - DNA, 20 bp, Artificial
  CRISPR gRNA sequence
tcttagcaatttgagaggct

SEQ ID NO: 592890 - DNA, 20 bp, Artificial
  CRISPR gRNA sequence
cttagcaatttgagaggctg

SEQ ID NO: 592891 - DNA, 20 bp, Artificial
  CRISPR gRNA sequence
agcaatttgagaggctgagg

SEQ ID NO: 592892 - DNA, 20 bp, Artificial
  CRISPR gRNA sequence
gcaatttgagaggctgaggc

SEQ ID NO: 592893 - DNA, 20 bp, Artificial
  CRISPR gRNA sequence
caatttgagaggctgaggca

SEQ ID NO: 592894 - DNA, 20 bp, Artificial
  CRISPR gRNA sequence
aatttgagaggctgaggcag

SEQ ID NO: 592895 - DNA, 20 bp, Artificial
  CRISPR gRNA sequence
atttgagaggctgaggcagg

SEQ ID NO: 592896 - DNA, 20 bp, Artificial
  CRISPR gRNA sequence
tgaggcagggggatcatttg

SEQ ID NO: 592897 - DNA, 20 bp, Artificial
  CRISPR gRNA sequence
cagggggatcatttgaagtc

SEQ ID NO: 592898 - DNA, 20 bp, Artificial
  CRISPR gRNA sequence
gggggatcatttgaagtcaa

SEQ ID NO: 592899 - DNA, 20 bp, Artificial
  CRISPR gRNA sequence
tgaagtcaagagtttgaaac

SEQ ID NO: 592900 - DNA, 20 bp, Artificial
  CRISPR gRNA sequence
tcaagagtttgaaaccagcc

SEQ ID NO: 592901 - DNA, 20 bp, Artificial
  CRISPR gRNA sequence
tgaaaccagcctggccaaca

SEQ ID NO: 592902 - DNA, 20 bp, Artificial
  CRISPR gRNA sequence
acatggtgaaacctcctctc

SEQ ID NO: 592903 - DNA, 20 bp, Artificial
  CRISPR gRNA sequence
tctagtaaaaacataaaaat

SEQ ID NO: 592904 - DNA, 20 bp, Artificial
  CRISPR gRNA sequence
gtaaaaacataaaaattagc

SEQ ID NO: 592905 - DNA, 20 bp, Artificial
  CRISPR gRNA sequence
acataaaaattagccagtca

SEQ ID NO: 592906 - DNA, 20 bp, Artificial
  CRISPR gRNA sequence
taaaaattagccagtcatag

SEQ ID NO: 592907 - DNA, 20 bp, Artificial
  CRISPR gRNA sequence
aaattagccagtcatagtgg

SEQ ID NO: 592908 - DNA, 20 bp, Artificial
  CRISPR gRNA sequence
aattagccagtcatagtggt

SEQ ID NO: 592909 - DNA, 20 bp, Artificial
  CRISPR gRNA sequence
tagccagtcatagtggtggg

SEQ ID NO: 592910 - DNA, 20 bp, Artificial
  CRISPR gRNA sequence
gcggctgtaatcacaccact

SEQ ID NO: 592911 - DNA, 20 bp, Artificial
  CRISPR gRNA sequence
cggctgtaatcacaccactt

SEQ ID NO: 592912 - DNA, 20 bp, Artificial
  CRISPR gRNA sequence
atcacaccacttgggaatct

SEQ ID NO: 592913 - DNA, 20 bp, Artificial
  CRISPR gRNA sequence
tcacaccacttgggaatctg

SEQ ID NO: 592914 - DNA, 20 bp, Artificial
  CRISPR gRNA sequence
caccacttgggaatctgagg

SEQ ID NO: 592915 - DNA, 20 bp, Artificial
  CRISPR gRNA sequence
accacttgggaatctgaggc

SEQ ID NO: 592916 - DNA, 20 bp, Artificial
  CRISPR gRNA sequence
cacttgggaatctgaggcag

SEQ ID NO: 592917 - DNA, 20 bp, Artificial
  CRISPR gRNA sequence
gcaggagaatcgcttgaacc

SEQ ID NO: 592918 - DNA, 20 bp, Artificial
  CRISPR gRNA sequence
ggagaatcgcttgaacccag

SEQ ID NO: 592919 - DNA, 20 bp, Artificial
  CRISPR gRNA sequence
gagaatcgcttgaacccaga

SEQ ID NO: 592920 - DNA, 20 bp, Artificial
  CRISPR gRNA sequence
aatcgcttgaacccagaagg

SEQ ID NO: 592921 - DNA, 20 bp, Artificial
  CRISPR gRNA sequence
tcgcttgaacccagaaggcg

SEQ ID NO: 592922 - DNA, 20 bp, Artificial
  CRISPR gRNA sequence
cgcttgaacccagaaggcgg

SEQ ID NO: 592923 - DNA, 20 bp, Artificial
  CRISPR gRNA sequence
aacccagaaggcggaggttg

SEQ ID NO: 592924 - DNA, 20 bp, Artificial
  CRISPR gRNA sequence
cagaaggcggaggttgcagt

SEQ ID NO: 592925 - DNA, 20 bp, Artificial
  CRISPR gRNA sequence
ggcggaggttgcagtgagcc

SEQ ID NO: 592926 - DNA, 20 bp, Artificial
  CRISPR gRNA sequence
aagattgcgccactgcactc

SEQ ID NO: 592927 - DNA, 20 bp, Artificial
  CRISPR gRNA sequence
tgcgccactgcactccagtc

SEQ ID NO: 592928 - DNA, 20 bp, Artificial
  CRISPR gRNA sequence
gcgccactgcactccagtct

SEQ ID NO: 592929 - DNA, 20 bp, Artificial
  CRISPR gRNA sequence
ctgcactccagtctgggcaa

SEQ ID NO: 592930 - DNA, 20 bp, Artificial
  CRISPR gRNA sequence
gcactccagtctgggcaaca

SEQ ID NO: 592931 - DNA, 20 bp, Artificial
  CRISPR gRNA sequence
tccagtctgggcaacagagc

SEQ ID NO: 592932 - DNA, 20 bp, Artificial
  CRISPR gRNA sequence
tcaaaataaataaataaata

SEQ ID NO: 592933 - DNA, 20 bp, Artificial
  CRISPR gRNA sequence
aaaattaataacaacaataa

SEQ ID NO: 592934 - DNA, 20 bp, Artificial
  CRISPR gRNA sequence
attaataacaacaataatgg

SEQ ID NO: 592935 - DNA, 20 bp, Artificial
  CRISPR gRNA sequence
caataatggaagatatttat

SEQ ID NO: 592936 - DNA, 20 bp, Artificial
  CRISPR gRNA sequence
aataatggaagatatttatt

SEQ ID NO: 592937 - DNA, 20 bp, Artificial
  CRISPR gRNA sequence
ttaggtgctaattacttgtc

SEQ ID NO: 592938 - DNA, 20 bp, Artificial
  CRISPR gRNA sequence
tacttgtcaagaattacact

SEQ ID NO: 592939 - DNA, 20 bp, Artificial
  CRISPR gRNA sequence
attatctaatgttaccttca

SEQ ID NO: 592940 - DNA, 20 bp, Artificial
  CRISPR gRNA sequence
aatgttaccttcaaagaacc

SEQ ID NO: 592941 - DNA, 20 bp, Artificial
  CRISPR gRNA sequence
ttcaaagaacccagtgaaat

SEQ ID NO: 592942 - DNA, 20 bp, Artificial
  CRISPR gRNA sequence
agtaatatatccccacctat

SEQ ID NO: 592943 - DNA, 20 bp, Artificial
  CRISPR gRNA sequence
atatatccccacctataagt

SEQ ID NO: 592944 - DNA, 20 bp, Artificial
  CRISPR gRNA sequence
tatatccccacctataagtg

SEQ ID NO: 592945 - DNA, 20 bp, Artificial
  CRISPR gRNA sequence
cacctataagtgaggacact

SEQ ID NO: 592946 - DNA, 20 bp, Artificial
  CRISPR gRNA sequence
actaagtcttaaaaaactgt

SEQ ID NO: 592947 - DNA, 20 bp, Artificial
  CRISPR gRNA sequence
ctaagtcttaaaaaactgtt

SEQ ID NO: 592948 - DNA, 20 bp, Artificial
  CRISPR gRNA sequence
agtcttaaaaaactgttggg

SEQ ID NO: 592949 - DNA, 20 bp, Artificial
  CRISPR gRNA sequence
aaaaaactgttgggtagctt

SEQ ID NO: 592950 - DNA, 20 bp, Artificial
  CRISPR gRNA sequence
ttggttctctgctgcattgt

SEQ ID NO: 592951 - DNA, 20 bp, Artificial
  CRISPR gRNA sequence
tggttctctgctgcattgta

SEQ ID NO: 592952 - DNA, 20 bp, Artificial
  CRISPR gRNA sequence
ggttctctgctgcattgtaa

SEQ ID NO: 592953 - DNA, 20 bp, Artificial
  CRISPR gRNA sequence
accataattgcactactctg

SEQ ID NO: 592954 - DNA, 20 bp, Artificial
  CRISPR gRNA sequence
ccataattgcactactctgc

SEQ ID NO: 592955 - DNA, 20 bp, Artificial
  CRISPR gRNA sequence
ataattgcactactctgcag

SEQ ID NO: 592956 - DNA, 20 bp, Artificial
  CRISPR gRNA sequence
actactctgcaggagcatcc

SEQ ID NO: 592957 - DNA, 20 bp, Artificial
  CRISPR gRNA sequence
atcctggctctcgaatcctt

SEQ ID NO: 592958 - DNA, 20 bp, Artificial
  CRISPR gRNA sequence
ggctctcgaatcctttggct

SEQ ID NO: 592959 - DNA, 20 bp, Artificial
  CRISPR gRNA sequence
ttggctaagacattttgatt

SEQ ID NO: 592960 - DNA, 20 bp, Artificial
  CRISPR gRNA sequence
attaagactcatcttgattt

SEQ ID NO: 592961 - DNA, 20 bp, Artificial
  CRISPR gRNA sequence
ctcatcttgatttgagattc

SEQ ID NO: 592962 - DNA, 20 bp, Artificial
  CRISPR gRNA sequence
tcatcttgatttgagattct

SEQ ID NO: 592963 - DNA, 20 bp, Artificial
  CRISPR gRNA sequence
agattctaggaatgactctc

SEQ ID NO: 592964 - DNA, 20 bp, Artificial
  CRISPR gRNA sequence
caagcttcacctgttcaaaa

SEQ ID NO: 592965 - DNA, 20 bp, Artificial
  CRISPR gRNA sequence
agcttcacctgttcaaaaca

SEQ ID NO: 592966 - DNA, 20 bp, Artificial
  CRISPR gRNA sequence
acagagctcttcatttcccc

SEQ ID NO: 592967 - DNA, 20 bp, Artificial
  CRISPR gRNA sequence
agctcttcatttccccaagt

SEQ ID NO: 592968 - DNA, 20 bp, Artificial
  CRISPR gRNA sequence
cttcatttccccaagtcagt

SEQ ID NO: 592969 - DNA, 20 bp, Artificial
  CRISPR gRNA sequence
taagtgacatcactattcac

SEQ ID NO: 592970 - DNA, 20 bp, Artificial
  CRISPR gRNA sequence
aagtgacatcactattcacc

SEQ ID NO: 592971 - DNA, 20 bp, Artificial
  CRISPR gRNA sequence
cactattcaccaggctactt

SEQ ID NO: 592972 - DNA, 20 bp, Artificial
  CRISPR gRNA sequence
aggctacttaagccaaacac

SEQ ID NO: 592973 - DNA, 20 bp, Artificial
  CRISPR gRNA sequence
ctacttaagccaaacactag

SEQ ID NO: 592974 - DNA, 20 bp, Artificial
  CRISPR gRNA sequence
aaacactagcagtcactcct

SEQ ID NO: 592975 - DNA, 20 bp, Artificial
  CRISPR gRNA sequence
acatgccgcttccaatccat

SEQ ID NO: 592976 - DNA, 20 bp, Artificial
  CRISPR gRNA sequence
gccgcttccaatccatcagc

SEQ ID NO: 592977 - DNA, 20 bp, Artificial
  CRISPR gRNA sequence
caatccatcagcaagtccaa

SEQ ID NO: 592978 - DNA, 20 bp, Artificial
  CRISPR gRNA sequence
aatccatcagcaagtccaac

SEQ ID NO: 592979 - DNA, 20 bp, Artificial
  CRISPR gRNA sequence
ccaacaggctctacttacaa

SEQ ID NO: 592980 - DNA, 20 bp, Artificial
  CRISPR gRNA sequence
cacccccactgctcctgctc

SEQ ID NO: 592981 - DNA, 20 bp, Artificial
  CRISPR gRNA sequence
cccactgctcctgctctagt

SEQ ID NO: 592982 - DNA, 20 bp, Artificial
  CRISPR gRNA sequence
tcacacaaatcactttcacg

SEQ ID NO: 592983 - DNA, 20 bp, Artificial
  CRISPR gRNA sequence
tcacgcagaccttctcactt

SEQ ID NO: 592984 - DNA, 20 bp, Artificial
  CRISPR gRNA sequence
cagaccttctcacttcagct

SEQ ID NO: 592985 - DNA, 20 bp, Artificial
  CRISPR gRNA sequence
agaccttctcacttcagctc

SEQ ID NO: 592986 - DNA, 20 bp, Artificial
  CRISPR gRNA sequence
caggcctcttcacttttgtg

SEQ ID NO: 592987 - DNA, 20 bp, Artificial
  CRISPR gRNA sequence
aggcctcttcacttttgtgc

SEQ ID NO: 592988 - DNA, 20 bp, Artificial
  CRISPR gRNA sequence
cttttgtgcaggcctcctca

SEQ ID NO: 592989 - DNA, 20 bp, Artificial
  CRISPR gRNA sequence
ttttgtgcaggcctcctcac

SEQ ID NO: 592990 - DNA, 20 bp, Artificial
  CRISPR gRNA sequence
tttgtgcaggcctcctcaca

SEQ ID NO: 592991 - DNA, 20 bp, Artificial
  CRISPR gRNA sequence
ctcacagggcaccttgcttg

SEQ ID NO: 592992 - DNA, 20 bp, Artificial
  CRISPR gRNA sequence
ccctttgtccactctccaca

SEQ ID NO: 592993 - DNA, 20 bp, Artificial
  CRISPR gRNA sequence
cctttgtccactctccacat

SEQ ID NO: 592994 - DNA, 20 bp, Artificial
  CRISPR gRNA sequence
tccactctccacatgggacc

SEQ ID NO: 592995 - DNA, 20 bp, Artificial
  CRISPR gRNA sequence
aaatatatgatcaccccata

SEQ ID NO: 592996 - DNA, 20 bp, Artificial
  CRISPR gRNA sequence
tacagatctctcccctcttt

SEQ ID NO: 592997 - DNA, 20 bp, Artificial
  CRISPR gRNA sequence
ccactgtaaccaaaccaaac

SEQ ID NO: 592998 - DNA, 20 bp, Artificial
  CRISPR gRNA sequence
tggtacccttgctgttcctc

SEQ ID NO: 592999 - DNA, 20 bp, Artificial
  CRISPR gRNA sequence
tcaagtacaccaaatatgca

SEQ ID NO: 593000 - DNA, 20 bp, Artificial
  CRISPR gRNA sequence
tgcaaagtgtcacaattccc

SEQ ID NO: 593001 - DNA, 20 bp, Artificial
  CRISPR gRNA sequence
ttcccaagaatgattctaac

SEQ ID NO: 593002 - DNA, 20 bp, Artificial
  CRISPR gRNA sequence
aaaatccactgcttttgtaa

SEQ ID NO: 593003 - DNA, 20 bp, Artificial
  CRISPR gRNA sequence
cttttgtaatagaacatttt

SEQ ID NO: 593004 - DNA, 20 bp, Artificial
  CRISPR gRNA sequence
aatagaacatttttggctga

SEQ ID NO: 593005 - DNA, 20 bp, Artificial
  CRISPR gRNA sequence
catttttggctgacagatca

SEQ ID NO: 593006 - DNA, 20 bp, Artificial
  CRISPR gRNA sequence
atttttggctgacagatcat

SEQ ID NO: 593007 - DNA, 20 bp, Artificial
  CRISPR gRNA sequence
aaaatttaacctccactctc

SEQ ID NO: 593008 - DNA, 20 bp, Artificial
  CRISPR gRNA sequence
aaatttaacctccactctcc

SEQ ID NO: 593009 - DNA, 20 bp, Artificial
  CRISPR gRNA sequence
tccactctccaggcccaatc

SEQ ID NO: 593010 - DNA, 20 bp, Artificial
  CRISPR gRNA sequence
tttgtaaccatgtacatgca

SEQ ID NO: 593011 - DNA, 20 bp, Artificial
  CRISPR gRNA sequence
tggcaacccttattctgtta

SEQ ID NO: 593012 - DNA, 20 bp, Artificial
  CRISPR gRNA sequence
ggcaacccttattctgttac

SEQ ID NO: 593013 - DNA, 20 bp, Artificial
  CRISPR gRNA sequence
gcaacccttattctgttacg

SEQ ID NO: 593014 - DNA, 20 bp, Artificial
  CRISPR gRNA sequence
aacccttattctgttacggg

SEQ ID NO: 593015 - DNA, 20 bp, Artificial
  CRISPR gRNA sequence
ccttattctgttacggggag

SEQ ID NO: 593016 - DNA, 20 bp, Artificial
  CRISPR gRNA sequence
cttattctgttacggggaga

SEQ ID NO: 593017 - DNA, 20 bp, Artificial
  CRISPR gRNA sequence
tattctgttacggggagaag

SEQ ID NO: 593018 - DNA, 20 bp, Artificial
  CRISPR gRNA sequence
attctgttacggggagaagg

SEQ ID NO: 593019 - DNA, 20 bp, Artificial
  CRISPR gRNA sequence
tctgttacggggagaaggag

SEQ ID NO: 593020 - DNA, 20 bp, Artificial
  CRISPR gRNA sequence
ctgttacggggagaaggagg

SEQ ID NO: 593021 - DNA, 20 bp, Artificial
  CRISPR gRNA sequence
ggggagaaggaggaggaaat

SEQ ID NO: 593022 - DNA, 20 bp, Artificial
  CRISPR gRNA sequence
gggagaaggaggaggaaatt

SEQ ID NO: 593023 - DNA, 20 bp, Artificial
  CRISPR gRNA sequence
gagaaggaggaggaaattgg

SEQ ID NO: 593024 - DNA, 20 bp, Artificial
  CRISPR gRNA sequence
ggaaattgggagaattctgt

SEQ ID NO: 593025 - DNA, 20 bp, Artificial
  CRISPR gRNA sequence
gaaattgggagaattctgta

SEQ ID NO: 593026 - DNA, 20 bp, Artificial
  CRISPR gRNA sequence
aaattgggagaattctgtaa

SEQ ID NO: 593027 - DNA, 20 bp, Artificial
  CRISPR gRNA sequence
aattgggagaattctgtaag

SEQ ID NO: 593028 - DNA, 20 bp, Artificial
  CRISPR gRNA sequence
attgggagaattctgtaagg

SEQ ID NO: 593029 - DNA, 20 bp, Artificial
  CRISPR gRNA sequence
tgggagaattctgtaagggg

SEQ ID NO: 593030 - DNA, 20 bp, Artificial
  CRISPR gRNA sequence
gagaattctgtaagggggag

SEQ ID NO: 593031 - DNA, 20 bp, Artificial
  CRISPR gRNA sequence
agaattctgtaagggggaga

SEQ ID NO: 593032 - DNA, 20 bp, Artificial
  CRISPR gRNA sequence
gaattctgtaagggggagaa

SEQ ID NO: 593033 - DNA, 20 bp, Artificial
  CRISPR gRNA sequence
tctgtaagggggagaagggt

SEQ ID NO: 593034 - DNA, 20 bp, Artificial
  CRISPR gRNA sequence
agggggagaagggttagtaa

SEQ ID NO: 593035 - DNA, 20 bp, Artificial
  CRISPR gRNA sequence
gggggagaagggttagtaaa

SEQ ID NO: 593036 - DNA, 20 bp, Artificial
  CRISPR gRNA sequence
gagaagggttagtaaaaggt

SEQ ID NO: 593037 - DNA, 20 bp, Artificial
  CRISPR gRNA sequence
gggttagtaaaaggtaagta

SEQ ID NO: 593038 - DNA, 20 bp, Artificial
  CRISPR gRNA sequence
gttagtaaaaggtaagtata

SEQ ID NO: 593039 - DNA, 20 bp, Artificial
  CRISPR gRNA sequence
aaaggtaagtatagagaaaa

SEQ ID NO: 593040 - DNA, 20 bp, Artificial
  CRISPR gRNA sequence
ggtaagtatagagaaaaaag

SEQ ID NO: 593041 - DNA, 20 bp, Artificial
  CRISPR gRNA sequence
taagtatagagaaaaaagta

SEQ ID NO: 593042 - DNA, 20 bp, Artificial
  CRISPR gRNA sequence
atagagaaaaaagtagagcc

SEQ ID NO: 593043 - DNA, 20 bp, Artificial
  CRISPR gRNA sequence
gcctagcatctgttcttcat

SEQ ID NO: 593044 - DNA, 20 bp, Artificial
  CRISPR gRNA sequence
cttcattggactccttgcct

SEQ ID NO: 593045 - DNA, 20 bp, Artificial
  CRISPR gRNA sequence
tgcctgagattaaatgctta

SEQ ID NO: 593046 - DNA, 20 bp, Artificial
  CRISPR gRNA sequence
gagattaaatgcttacagta

SEQ ID NO: 593047 - DNA, 20 bp, Artificial
  CRISPR gRNA sequence
agattaaatgcttacagtaa

SEQ ID NO: 593048 - DNA, 20 bp, Artificial
  CRISPR gRNA sequence
tgcttacagtaaaggaatga

SEQ ID NO: 593049 - DNA, 20 bp, Artificial
  CRISPR gRNA sequence
gaatgacagccaaaaaatga

SEQ ID NO: 593050 - DNA, 20 bp, Artificial
  CRISPR gRNA sequence
atggaactgaaatgaaattc

SEQ ID NO: 593051 - DNA, 20 bp, Artificial
  CRISPR gRNA sequence
tgaaatgaaattctggaaaa

SEQ ID NO: 593052 - DNA, 20 bp, Artificial
  CRISPR gRNA sequence
tctggaaaaaagattatgac

SEQ ID NO: 593053 - DNA, 20 bp, Artificial
  CRISPR gRNA sequence
attatgaccagaaattgatc

SEQ ID NO: 593054 - DNA, 20 bp, Artificial
  CRISPR gRNA sequence
tatgaccagaaattgatcaa

SEQ ID NO: 593055 - DNA, 20 bp, Artificial
  CRISPR gRNA sequence
agagacacttcctgatactc

SEQ ID NO: 593056 - DNA, 20 bp, Artificial
  CRISPR gRNA sequence
gagacacttcctgatactct

SEQ ID NO: 593057 - DNA, 20 bp, Artificial
  CRISPR gRNA sequence
cttcctgatactctgggcac

SEQ ID NO: 593058 - DNA, 20 bp, Artificial
  CRISPR gRNA sequence
cctgatactctgggcactag

SEQ ID NO: 593059 - DNA, 20 bp, Artificial
  CRISPR gRNA sequence
tgatactctgggcactagca

SEQ ID NO: 593060 - DNA, 20 bp, Artificial
  CRISPR gRNA sequence
ggcactagcagagcttcttt

SEQ ID NO: 593061 - DNA, 20 bp, Artificial
  CRISPR gRNA sequence
gcactagcagagcttcttta

SEQ ID NO: 593062 - DNA, 20 bp, Artificial
  CRISPR gRNA sequence
agcagagcttctttaaggcc

SEQ ID NO: 593063 - DNA, 20 bp, Artificial
  CRISPR gRNA sequence
agacaatacaatatcactca

SEQ ID NO: 593064 - DNA, 20 bp, Artificial
  CRISPR gRNA sequence
aatacaatatcactcacagc

SEQ ID NO: 593065 - DNA, 20 bp, Artificial
  CRISPR gRNA sequence
atacaatatcactcacagct

SEQ ID NO: 593066 - DNA, 20 bp, Artificial
  CRISPR gRNA sequence
tacaatatcactcacagctg

SEQ ID NO: 593067 - DNA, 20 bp, Artificial
  CRISPR gRNA sequence
caatatcactcacagctggg

SEQ ID NO: 593068 - DNA, 20 bp, Artificial
  CRISPR gRNA sequence
atatcactcacagctgggga

SEQ ID NO: 593069 - DNA, 20 bp, Artificial
  CRISPR gRNA sequence
agacctcctgccaaaacacc

SEQ ID NO: 593070 - DNA, 20 bp, Artificial
  CRISPR gRNA sequence
cctcctgccaaaacacccag

SEQ ID NO: 593071 - DNA, 20 bp, Artificial
  CRISPR gRNA sequence
cccagaagcatccttgactc

SEQ ID NO: 593072 - DNA, 20 bp, Artificial
  CRISPR gRNA sequence
aagcactgattttctcctga

SEQ ID NO: 593073 - DNA, 20 bp, Artificial
  CRISPR gRNA sequence
agcactgattttctcctgat

SEQ ID NO: 593074 - DNA, 20 bp, Artificial
  CRISPR gRNA sequence
actgattttctcctgatagg

SEQ ID NO: 593075 - DNA, 20 bp, Artificial
  CRISPR gRNA sequence
cctgataggaagtaacaaca

SEQ ID NO: 593076 - DNA, 20 bp, Artificial
  CRISPR gRNA sequence
ctgataggaagtaacaacaa

SEQ ID NO: 593077 - DNA, 20 bp, Artificial
  CRISPR gRNA sequence
tgataggaagtaacaacaaa

SEQ ID NO: 593078 - DNA, 20 bp, Artificial
  CRISPR gRNA sequence
caacaaagggtctttgccaa

SEQ ID NO: 593079 - DNA, 20 bp, Artificial
  CRISPR gRNA sequence
tctttgccaatggacctcct

SEQ ID NO: 593080 - DNA, 20 bp, Artificial
  CRISPR gRNA sequence
ccaatggacctcctgagctg

SEQ ID NO: 593081 - DNA, 20 bp, Artificial
  CRISPR gRNA sequence
gagctgtggatgcaaacatt

SEQ ID NO: 593082 - DNA, 20 bp, Artificial
  CRISPR gRNA sequence
agctgtggatgcaaacattt

SEQ ID NO: 593083 - DNA, 20 bp, Artificial
  CRISPR gRNA sequence
ggatgcaaacatttgggaac

SEQ ID NO: 593084 - DNA, 20 bp, Artificial
  CRISPR gRNA sequence
gatgcaaacatttgggaact

SEQ ID NO: 593085 - DNA, 20 bp, Artificial
  CRISPR gRNA sequence
atgcaaacatttgggaacta

SEQ ID NO: 593086 - DNA, 20 bp, Artificial
  CRISPR gRNA sequence
tgcaaacatttgggaactag

SEQ ID NO: 593087 - DNA, 20 bp, Artificial
  CRISPR gRNA sequence
caaacatttgggaactaggg

SEQ ID NO: 593088 - DNA, 20 bp, Artificial
  CRISPR gRNA sequence
tgggaactaggggagaaatg

SEQ ID NO: 593089 - DNA, 20 bp, Artificial
  CRISPR gRNA sequence
gggaactaggggagaaatgt

SEQ ID NO: 593090 - DNA, 20 bp, Artificial
  CRISPR gRNA sequence
aactaggggagaaatgtggg

SEQ ID NO: 593091 - DNA, 20 bp, Artificial
  CRISPR gRNA sequence
gaaatgtgggcagtgtgtgt

SEQ ID NO: 593092 - DNA, 20 bp, Artificial
  CRISPR gRNA sequence
tgggcagtgtgtgttagtga

SEQ ID NO: 593093 - DNA, 20 bp, Artificial
  CRISPR gRNA sequence
agtgtgtgttagtgacagct

SEQ ID NO: 593094 - DNA, 20 bp, Artificial
  CRISPR gRNA sequence
tgtgtgttagtgacagctga

SEQ ID NO: 593095 - DNA, 20 bp, Artificial
  CRISPR gRNA sequence
gttagtgacagctgagagaa

SEQ ID NO: 593096 - DNA, 20 bp, Artificial
  CRISPR gRNA sequence
acagctgagagaatggtttc

SEQ ID NO: 593097 - DNA, 20 bp, Artificial
  CRISPR gRNA sequence
aatggtttctggacatatgt

SEQ ID NO: 593098 - DNA, 20 bp, Artificial
  CRISPR gRNA sequence
atggtttctggacatatgtg

SEQ ID NO: 593099 - DNA, 20 bp, Artificial
  CRISPR gRNA sequence
tctggacatatgtgaggtga

SEQ ID NO: 593100 - DNA, 20 bp, Artificial
  CRISPR gRNA sequence
ggacatatgtgaggtgacag

SEQ ID NO: 593101 - DNA, 20 bp, Artificial
  CRISPR gRNA sequence
gtgaggtgacagtggattcc

SEQ ID NO: 593102 - DNA, 20 bp, Artificial
  CRISPR gRNA sequence
gaggtgacagtggattccta

SEQ ID NO: 593103 - DNA, 20 bp, Artificial
  CRISPR gRNA sequence
aggtgacagtggattcctag

SEQ ID NO: 593104 - DNA, 20 bp, Artificial
  CRISPR gRNA sequence
ggtgacagtggattcctaga

SEQ ID NO: 593105 - DNA, 20 bp, Artificial
  CRISPR gRNA sequence
agtggattcctagagggtca

SEQ ID NO: 593106 - DNA, 20 bp, Artificial
  CRISPR gRNA sequence
gtggattcctagagggtcac

SEQ ID NO: 593107 - DNA, 20 bp, Artificial
  CRISPR gRNA sequence
cctagagggtcacaggtaca

SEQ ID NO: 593108 - DNA, 20 bp, Artificial
  CRISPR gRNA sequence
agggtcacaggtacatggtg

SEQ ID NO: 593109 - DNA, 20 bp, Artificial
  CRISPR gRNA sequence
gtcacaggtacatggtgaag

SEQ ID NO: 593110 - DNA, 20 bp, Artificial
  CRISPR gRNA sequence
tcacaggtacatggtgaaga

SEQ ID NO: 593111 - DNA, 20 bp, Artificial
  CRISPR gRNA sequence
gaaggtgaatttatatgaat

SEQ ID NO: 593112 - DNA, 20 bp, Artificial
  CRISPR gRNA sequence
aaggtgaatttatatgaatc

SEQ ID NO: 593113 - DNA, 20 bp, Artificial
  CRISPR gRNA sequence
tgaatttatatgaatcaggc

SEQ ID NO: 593114 - DNA, 20 bp, Artificial
  CRISPR gRNA sequence
ttatatgaatcaggccagtg

SEQ ID NO: 593115 - DNA, 20 bp, Artificial
  CRISPR gRNA sequence
atgaatcaggccagtgcggc

SEQ ID NO: 593116 - DNA, 20 bp, Artificial
  CRISPR gRNA sequence
aatcaggccagtgcggccag

SEQ ID NO: 593117 - DNA, 20 bp, Artificial
  CRISPR gRNA sequence
caggccagtgcggccagtag

SEQ ID NO: 593118 - DNA, 20 bp, Artificial
  CRISPR gRNA sequence
ggccagtgcggccagtagta

SEQ ID NO: 593119 - DNA, 20 bp, Artificial
  CRISPR gRNA sequence
ccagtgcggccagtagtaga

SEQ ID NO: 593120 - DNA, 20 bp, Artificial
  CRISPR gRNA sequence
tgcggccagtagtagagagt

SEQ ID NO: 593121 - DNA, 20 bp, Artificial
  CRISPR gRNA sequence
ctatctcaatctgctcacta

SEQ ID NO: 593122 - DNA, 20 bp, Artificial
  CRISPR gRNA sequence
aaagtatatgtgtctttatg

SEQ ID NO: 593123 - DNA, 20 bp, Artificial
  CRISPR gRNA sequence
gtatatgtgtctttatgcag

SEQ ID NO: 593124 - DNA, 20 bp, Artificial
  CRISPR gRNA sequence
tgtgtctttatgcagaagtc

SEQ ID NO: 593125 - DNA, 20 bp, Artificial
  CRISPR gRNA sequence
gtgtctttatgcagaagtca

SEQ ID NO: 593126 - DNA, 20 bp, Artificial
  CRISPR gRNA sequence
ctttatgcagaagtcaaggc

SEQ ID NO: 593127 - DNA, 20 bp, Artificial
  CRISPR gRNA sequence
atgcagaagtcaaggctggt

SEQ ID NO: 593128 - DNA, 20 bp, Artificial
  CRISPR gRNA sequence
tgcagaagtcaaggctggta

SEQ ID NO: 593129 - DNA, 20 bp, Artificial
  CRISPR gRNA sequence
ggtaaggtctgtaaacatct

SEQ ID NO: 593130 - DNA, 20 bp, Artificial
  CRISPR gRNA sequence
aaacatcttggttctgcctt

SEQ ID NO: 593131 - DNA, 20 bp, Artificial
  CRISPR gRNA sequence
aacatcttggttctgccttt

SEQ ID NO: 593132 - DNA, 20 bp, Artificial
  CRISPR gRNA sequence
cttggttctgcctttaggtt

SEQ ID NO: 593133 - DNA, 20 bp, Artificial
  CRISPR gRNA sequence
cttttcctctaacatttcta

SEQ ID NO: 593134 - DNA, 20 bp, Artificial
  CRISPR gRNA sequence
ttttcctctaacatttctaa

SEQ ID NO: 593135 - DNA, 20 bp, Artificial
  CRISPR gRNA sequence
ttcctctaacatttctaaag

SEQ ID NO: 593136 - DNA, 20 bp, Artificial
  CRISPR gRNA sequence
taaaggagactaaacaaaca

SEQ ID NO: 593137 - DNA, 20 bp, Artificial
  CRISPR gRNA sequence
gtcttttctgtcactaactc

SEQ ID NO: 593138 - DNA, 20 bp, Artificial
  CRISPR gRNA sequence
tcttttctgtcactaactcc

SEQ ID NO: 593139 - DNA, 20 bp, Artificial
  CRISPR gRNA sequence
aactccaggctcacttactt

SEQ ID NO: 593140 - DNA, 20 bp, Artificial
  CRISPR gRNA sequence
cacatttctatttgatgctt

SEQ ID NO: 593141 - DNA, 20 bp, Artificial
  CRISPR gRNA sequence
tttgatgctttggctataca

SEQ ID NO: 593142 - DNA, 20 bp, Artificial
  CRISPR gRNA sequence
atgctttggctatacacaga

SEQ ID NO: 593143 - DNA, 20 bp, Artificial
  CRISPR gRNA sequence
ctttggctatacacagacag

SEQ ID NO: 593144 - DNA, 20 bp, Artificial
  CRISPR gRNA sequence
aagacaattatacaataaaa

SEQ ID NO: 593145 - DNA, 20 bp, Artificial
  CRISPR gRNA sequence
tactcttttcaccaaaaaac

SEQ ID NO: 593146 - DNA, 20 bp, Artificial
  CRISPR gRNA sequence
aacaagccaatttaaaaact

SEQ ID NO: 593147 - DNA, 20 bp, Artificial
  CRISPR gRNA sequence
ctaagtttctttaaaaattg

SEQ ID NO: 593148 - DNA, 20 bp, Artificial
  CRISPR gRNA sequence
aattgcagatgtaatgaatt

SEQ ID NO: 593149 - DNA, 20 bp, Artificial
  CRISPR gRNA sequence
attgcagatgtaatgaatta

SEQ ID NO: 593150 - DNA, 20 bp, Artificial
  CRISPR gRNA sequence
cagatgtaatgaattaaggt

SEQ ID NO: 593151 - DNA, 20 bp, Artificial
  CRISPR gRNA sequence
taatgaattaaggtaagatg

SEQ ID NO: 593152 - DNA, 20 bp, Artificial
  CRISPR gRNA sequence
aaggtaagatgaagtcgtac

SEQ ID NO: 593153 - DNA, 20 bp, Artificial
  CRISPR gRNA sequence
ggtaagatgaagtcgtacta

SEQ ID NO: 593154 - DNA, 20 bp, Artificial
  CRISPR gRNA sequence
aagatgaagtcgtactagag

SEQ ID NO: 593155 - DNA, 20 bp, Artificial
  CRISPR gRNA sequence
agatgaagtcgtactagagt

SEQ ID NO: 593156 - DNA, 20 bp, Artificial
  CRISPR gRNA sequence
gatgaagtcgtactagagta

SEQ ID NO: 593157 - DNA, 20 bp, Artificial
  CRISPR gRNA sequence
aagtcgtactagagtagggt

SEQ ID NO: 593158 - DNA, 20 bp, Artificial
  CRISPR gRNA sequence
agcccttaatctattgtgac

SEQ ID NO: 593159 - DNA, 20 bp, Artificial
  CRISPR gRNA sequence
gtgactggtgtccttacaaa

SEQ ID NO: 593160 - DNA, 20 bp, Artificial
  CRISPR gRNA sequence
tgactggtgtccttacaaaa

SEQ ID NO: 593161 - DNA, 20 bp, Artificial
  CRISPR gRNA sequence
gactggtgtccttacaaaaa

SEQ ID NO: 593162 - DNA, 20 bp, Artificial
  CRISPR gRNA sequence
ggtgtccttacaaaaaggga

SEQ ID NO: 593163 - DNA, 20 bp, Artificial
  CRISPR gRNA sequence
ccttacaaaaagggaaagtt

SEQ ID NO: 593164 - DNA, 20 bp, Artificial
  CRISPR gRNA sequence
acaaaaagggaaagtttaga

SEQ ID NO: 593165 - DNA, 20 bp, Artificial
  CRISPR gRNA sequence
aaaaagggaaagtttagaca

SEQ ID NO: 593166 - DNA, 20 bp, Artificial
  CRISPR gRNA sequence
tttagacagagacatgcata

SEQ ID NO: 593167 - DNA, 20 bp, Artificial
  CRISPR gRNA sequence
ttagacagagacatgcatat

SEQ ID NO: 593168 - DNA, 20 bp, Artificial
  CRISPR gRNA sequence
tagacagagacatgcatatg

SEQ ID NO: 593169 - DNA, 20 bp, Artificial
  CRISPR gRNA sequence
gggtgaatgctgtgaacatg

SEQ ID NO: 593170 - DNA, 20 bp, Artificial
  CRISPR gRNA sequence
ggtgaatgctgtgaacatga

SEQ ID NO: 593171 - DNA, 20 bp, Artificial
  CRISPR gRNA sequence
atgctgtgaacatgaaggca

SEQ ID NO: 593172 - DNA, 20 bp, Artificial
  CRISPR gRNA sequence
gtgaacatgaaggcaaagat

SEQ ID NO: 593173 - DNA, 20 bp, Artificial
  CRISPR gRNA sequence
tgaacatgaaggcaaagatg

SEQ ID NO: 593174 - DNA, 20 bp, Artificial
  CRISPR gRNA sequence
gaacatgaaggcaaagatga

SEQ ID NO: 593175 - DNA, 20 bp, Artificial
  CRISPR gRNA sequence
aggcaaagatgagggtgatg

SEQ ID NO: 593176 - DNA, 20 bp, Artificial
  CRISPR gRNA sequence
gatgagggtgatgcagatat

SEQ ID NO: 593177 - DNA, 20 bp, Artificial
  CRISPR gRNA sequence
agggtgatgcagatataagc

SEQ ID NO: 593178 - DNA, 20 bp, Artificial
  CRISPR gRNA sequence
gggtgatgcagatataagcc

SEQ ID NO: 593179 - DNA, 20 bp, Artificial
  CRISPR gRNA sequence
agatataagccaggaacacc

SEQ ID NO: 593180 - DNA, 20 bp, Artificial
  CRISPR gRNA sequence
gatataagccaggaacacca

SEQ ID NO: 593181 - DNA, 20 bp, Artificial
  CRISPR gRNA sequence
ccaggaacaccaaggaatat

SEQ ID NO: 593182 - DNA, 20 bp, Artificial
  CRISPR gRNA sequence
ggaacaccaaggaatatcag

SEQ ID NO: 593183 - DNA, 20 bp, Artificial
  CRISPR gRNA sequence
caaggaatatcagcagccat

SEQ ID NO: 593184 - DNA, 20 bp, Artificial
  CRISPR gRNA sequence
ggaatatcagcagccatcag

SEQ ID NO: 593185 - DNA, 20 bp, Artificial
  CRISPR gRNA sequence
tatcagcagccatcagcagc

SEQ ID NO: 593186 - DNA, 20 bp, Artificial
  CRISPR gRNA sequence
atcagcagccatcagcagcc

SEQ ID NO: 593187 - DNA, 20 bp, Artificial
  CRISPR gRNA sequence
tcagcagccatcagcagcca

SEQ ID NO: 593188 - DNA, 20 bp, Artificial
  CRISPR gRNA sequence
cagcagccatcagcagccag

SEQ ID NO: 593189 - DNA, 20 bp, Artificial
  CRISPR gRNA sequence
gcagccatcagcagccaggg

SEQ ID NO: 593190 - DNA, 20 bp, Artificial
  CRISPR gRNA sequence
agccatcagcagccagggga

SEQ ID NO: 593191 - DNA, 20 bp, Artificial
  CRISPR gRNA sequence
gccatcagcagccaggggag

SEQ ID NO: 593192 - DNA, 20 bp, Artificial
  CRISPR gRNA sequence
ccatcagcagccaggggaga

SEQ ID NO: 593193 - DNA, 20 bp, Artificial
  CRISPR gRNA sequence
gcagccaggggagagggaca

SEQ ID NO: 593194 - DNA, 20 bp, Artificial
  CRISPR gRNA sequence
gccaggggagagggacatag

SEQ ID NO: 593195 - DNA, 20 bp, Artificial
  CRISPR gRNA sequence
acatagcagattctccctca

SEQ ID NO: 593196 - DNA, 20 bp, Artificial
  CRISPR gRNA sequence
tactgcttacaccttaatct

SEQ ID NO: 593197 - DNA, 20 bp, Artificial
  CRISPR gRNA sequence
acaccttaatctcagacttc

SEQ ID NO: 593198 - DNA, 20 bp, Artificial
  CRISPR gRNA sequence
aatctcagacttccagcctc

SEQ ID NO: 593199 - DNA, 20 bp, Artificial
  CRISPR gRNA sequence
cttccagcctccagaactgt

SEQ ID NO: 593200 - DNA, 20 bp, Artificial
  CRISPR gRNA sequence
ttccagcctccagaactgtg

SEQ ID NO: 593201 - DNA, 20 bp, Artificial
  CRISPR gRNA sequence
gcaataaacttctgttgttt

SEQ ID NO: 593202 - DNA, 20 bp, Artificial
  CRISPR gRNA sequence
cttctgttgtttaagccacc

SEQ ID NO: 593203 - DNA, 20 bp, Artificial
  CRISPR gRNA sequence
tgtttaagccacccagtctg

SEQ ID NO: 593204 - DNA, 20 bp, Artificial
  CRISPR gRNA sequence
ttaagccacccagtctgtgg

SEQ ID NO: 593205 - DNA, 20 bp, Artificial
  CRISPR gRNA sequence
cagtctgtggtagttcgtta

SEQ ID NO: 593206 - DNA, 20 bp, Artificial
  CRISPR gRNA sequence
gtagttcgttacagcaaacc

SEQ ID NO: 593207 - DNA, 20 bp, Artificial
  CRISPR gRNA sequence
tagttcgttacagcaaacca

SEQ ID NO: 593208 - DNA, 20 bp, Artificial
  CRISPR gRNA sequence
gcaaaccaaggaaattaata

SEQ ID NO: 593209 - DNA, 20 bp, Artificial
  CRISPR gRNA sequence
caaaccaaggaaattaatac

SEQ ID NO: 593210 - DNA, 20 bp, Artificial
  CRISPR gRNA sequence
caaggaaattaatacaggct

SEQ ID NO: 593211 - DNA, 20 bp, Artificial
  CRISPR gRNA sequence
aaattaatacaggctcagat

SEQ ID NO: 593212 - DNA, 20 bp, Artificial
  CRISPR gRNA sequence
ggctcagatgagatatattt

SEQ ID NO: 593213 - DNA, 20 bp, Artificial
  CRISPR gRNA sequence
gctcagatgagatatatttt

SEQ ID NO: 593214 - DNA, 20 bp, Artificial
  CRISPR gRNA sequence
atgagatatattttaggaac

SEQ ID NO: 593215 - DNA, 20 bp, Artificial
  CRISPR gRNA sequence
gatatattttaggaaccaga

SEQ ID NO: 593216 - DNA, 20 bp, Artificial
  CRISPR gRNA sequence
atatattttaggaaccagaa

SEQ ID NO: 593217 - DNA, 20 bp, Artificial
  CRISPR gRNA sequence
atattttaggaaccagaaag

SEQ ID NO: 593218 - DNA, 20 bp, Artificial
  CRISPR gRNA sequence
taggaaccagaaaggagatg

SEQ ID NO: 593219 - DNA, 20 bp, Artificial
  CRISPR gRNA sequence
gaaccagaaaggagatgcag

SEQ ID NO: 593220 - DNA, 20 bp, Artificial
  CRISPR gRNA sequence
aaaggagatgcagaagtgat

SEQ ID NO: 593221 - DNA, 20 bp, Artificial
  CRISPR gRNA sequence
aaggagatgcagaagtgatt

SEQ ID NO: 593222 - DNA, 20 bp, Artificial
  CRISPR gRNA sequence
cagaagtgattgggacacta

SEQ ID NO: 593223 - DNA, 20 bp, Artificial
  CRISPR gRNA sequence
agtgattgggacactacagc

SEQ ID NO: 593224 - DNA, 20 bp, Artificial
  CRISPR gRNA sequence
actacagcaagaacattttg

SEQ ID NO: 593225 - DNA, 20 bp, Artificial
  CRISPR gRNA sequence
aagaacattttgaagtcctt

SEQ ID NO: 593226 - DNA, 20 bp, Artificial
  CRISPR gRNA sequence
gaacattttgaagtccttca

SEQ ID NO: 593227 - DNA, 20 bp, Artificial
  CRISPR gRNA sequence
aacattttgaagtccttcag

SEQ ID NO: 593228 - DNA, 20 bp, Artificial
  CRISPR gRNA sequence
ttttgaagtccttcagagga

SEQ ID NO: 593229 - DNA, 20 bp, Artificial
  CRISPR gRNA sequence
tttgaagtccttcagaggaa

SEQ ID NO: 593230 - DNA, 20 bp, Artificial
  CRISPR gRNA sequence
aagtccttcagaggaaagga

SEQ ID NO: 593231 - DNA, 20 bp, Artificial
  CRISPR gRNA sequence
agtccttcagaggaaaggaa

SEQ ID NO: 593232 - DNA, 20 bp, Artificial
  CRISPR gRNA sequence
tcagaggaaaggaaaggtgc

SEQ ID NO: 593233 - DNA, 20 bp, Artificial
  CRISPR gRNA sequence
agaggaaaggaaaggtgcca

SEQ ID NO: 593234 - DNA, 20 bp, Artificial
  CRISPR gRNA sequence
gaggaaaggaaaggtgccag

SEQ ID NO: 593235 - DNA, 20 bp, Artificial
  CRISPR gRNA sequence
aaggaaaggtgccagaggac

SEQ ID NO: 593236 - DNA, 20 bp, Artificial
  CRISPR gRNA sequence
ggaaaggtgccagaggacca

SEQ ID NO: 593237 - DNA, 20 bp, Artificial
  CRISPR gRNA sequence
aggtgccagaggaccagaga

SEQ ID NO: 593238 - DNA, 20 bp, Artificial
  CRISPR gRNA sequence
ggtgccagaggaccagagac

SEQ ID NO: 593239 - DNA, 20 bp, Artificial
  CRISPR gRNA sequence
ggctaattttacgattttta

SEQ ID NO: 593240 - DNA, 20 bp, Artificial
  CRISPR gRNA sequence
gctaattttacgatttttaa

SEQ ID NO: 593241 - DNA, 20 bp, Artificial
  CRISPR gRNA sequence
ttttacgatttttaaaggca

SEQ ID NO: 593242 - DNA, 20 bp, Artificial
  CRISPR gRNA sequence
tttacgatttttaaaggcaa

SEQ ID NO: 593243 - DNA, 20 bp, Artificial
  CRISPR gRNA sequence
gatgtgaattttgtcaatct

SEQ ID NO: 593244 - DNA, 20 bp, Artificial
  CRISPR gRNA sequence
tacaatgaaccaattaaaat

SEQ ID NO: 593245 - DNA, 20 bp, Artificial
  CRISPR gRNA sequence
aatgaaccaattaaaattgg

SEQ ID NO: 593246 - DNA, 20 bp, Artificial
  CRISPR gRNA sequence
atgaaccaattaaaattgga

SEQ ID NO: 593247 - DNA, 20 bp, Artificial
  CRISPR gRNA sequence
accaattaaaattggaaggt

SEQ ID NO: 593248 - DNA, 20 bp, Artificial
  CRISPR gRNA sequence
ttgtgtaacaactttttaaa

SEQ ID NO: 593249 - DNA, 20 bp, Artificial
  CRISPR gRNA sequence
ttaaaaagtatgatccaata

SEQ ID NO: 593250 - DNA, 20 bp, Artificial
  CRISPR gRNA sequence
taaaaagtatgatccaatat

SEQ ID NO: 593251 - DNA, 20 bp, Artificial
  CRISPR gRNA sequence
aataatatttttattgttga

SEQ ID NO: 593252 - DNA, 20 bp, Artificial
  CRISPR gRNA sequence
tgttgatggaattattaaac

SEQ ID NO: 593253 - DNA, 20 bp, Artificial
  CRISPR gRNA sequence
tgatggaattattaaactgg

SEQ ID NO: 593254 - DNA, 20 bp, Artificial
  CRISPR gRNA sequence
aaactggtagtttaaaaatg

SEQ ID NO: 593255 - DNA, 20 bp, Artificial
  CRISPR gRNA sequence
tgaacttaattccatatctg

SEQ ID NO: 593256 - DNA, 20 bp, Artificial
  CRISPR gRNA sequence
cttaattccatatctgaaga

SEQ ID NO: 593257 - DNA, 20 bp, Artificial
  CRISPR gRNA sequence
aaagctctcataatgttctt

SEQ ID NO: 593258 - DNA, 20 bp, Artificial
  CRISPR gRNA sequence
aagctctcataatgttcttg

SEQ ID NO: 593259 - DNA, 20 bp, Artificial
  CRISPR gRNA sequence
taatgttcttgaggtcgaaa

SEQ ID NO: 593260 - DNA, 20 bp, Artificial
  CRISPR gRNA sequence
atgttcttgaggtcgaaatg

SEQ ID NO: 593261 - DNA, 20 bp, Artificial
  CRISPR gRNA sequence
ggtcgaaatggagaaatatg

SEQ ID NO: 593262 - DNA, 20 bp, Artificial
  CRISPR gRNA sequence
gtcgaaatggagaaatatgt

SEQ ID NO: 593263 - DNA, 20 bp, Artificial
  CRISPR gRNA sequence
aaatatgtaggaaataatat

SEQ ID NO: 593264 - DNA, 20 bp, Artificial
  CRISPR gRNA sequence
atatgtaggaaataatatga

SEQ ID NO: 593265 - DNA, 20 bp, Artificial
  CRISPR gRNA sequence
tatgtaggaaataatatgag

SEQ ID NO: 593266 - DNA, 20 bp, Artificial
  CRISPR gRNA sequence
tatgagaggtacattcataa

SEQ ID NO: 593267 - DNA, 20 bp, Artificial
  CRISPR gRNA sequence
atgagaggtacattcataac

SEQ ID NO: 593268 - DNA, 20 bp, Artificial
  CRISPR gRNA sequence
gttgaacaaccacacccaaa

SEQ ID NO: 593269 - DNA, 20 bp, Artificial
  CRISPR gRNA sequence
aaacagtattgattaatgac

SEQ ID NO: 593270 - DNA, 20 bp, Artificial
  CRISPR gRNA sequence
acaagatgttaacttgaaaa

SEQ ID NO: 593271 - DNA, 20 bp, Artificial
  CRISPR gRNA sequence
gttaacttgaaaacagatct

SEQ ID NO: 593272 - DNA, 20 bp, Artificial
  CRISPR gRNA sequence
ttaacttgaaaacagatctc

SEQ ID NO: 593273 - DNA, 20 bp, Artificial
  CRISPR gRNA sequence
agatctcaggttgtgtgcca

SEQ ID NO: 593274 - DNA, 20 bp, Artificial
  CRISPR gRNA sequence
gatctcaggttgtgtgccat

SEQ ID NO: 593275 - DNA, 20 bp, Artificial
  CRISPR gRNA sequence
atctcaggttgtgtgccata

SEQ ID NO: 593276 - DNA, 20 bp, Artificial
  CRISPR gRNA sequence
tgccatagggctattttcac

SEQ ID NO: 593277 - DNA, 20 bp, Artificial
  CRISPR gRNA sequence
gctattttcacaagattgaa

SEQ ID NO: 593278 - DNA, 20 bp, Artificial
  CRISPR gRNA sequence
aagattgaaaagaaacttgc

SEQ ID NO: 593279 - DNA, 20 bp, Artificial
  CRISPR gRNA sequence
agattgaaaagaaacttgca

SEQ ID NO: 593280 - DNA, 20 bp, Artificial
  CRISPR gRNA sequence
tcaaacctgtgcatgacaca

SEQ ID NO: 593281 - DNA, 20 bp, Artificial
  CRISPR gRNA sequence
gtgcatgacacacagctgac

SEQ ID NO: 593282 - DNA, 20 bp, Artificial
  CRISPR gRNA sequence
tgcatgacacacagctgaca

SEQ ID NO: 593283 - DNA, 20 bp, Artificial
  CRISPR gRNA sequence
aggatacctgatcccctcaa

SEQ ID NO: 593284 - DNA, 20 bp, Artificial
  CRISPR gRNA sequence
acctgatcccctcaatggct

SEQ ID NO: 593285 - DNA, 20 bp, Artificial
  CRISPR gRNA sequence
caatggctgagttttgattc

SEQ ID NO: 593286 - DNA, 20 bp, Artificial
  CRISPR gRNA sequence
ttccagaaatcatccgtctg

SEQ ID NO: 593287 - DNA, 20 bp, Artificial
  CRISPR gRNA sequence
cagaaatcatccgtctgaag

SEQ ID NO: 593288 - DNA, 20 bp, Artificial
  CRISPR gRNA sequence
aatcatccgtctgaagaaga

SEQ ID NO: 593289 - DNA, 20 bp, Artificial
  CRISPR gRNA sequence
atcatccgtctgaagaagaa

SEQ ID NO: 593290 - DNA, 20 bp, Artificial
  CRISPR gRNA sequence
cgtctgaagaagaaaggaat

SEQ ID NO: 593291 - DNA, 20 bp, Artificial
  CRISPR gRNA sequence
tctgaagaagaaaggaatta

SEQ ID NO: 593292 - DNA, 20 bp, Artificial
  CRISPR gRNA sequence
aggaattagagatgttaacc

SEQ ID NO: 593293 - DNA, 20 bp, Artificial
  CRISPR gRNA sequence
gaattagagatgttaaccaa

SEQ ID NO: 593294 - DNA, 20 bp, Artificial
  CRISPR gRNA sequence
gttaaccaagagaaaaacaa

SEQ ID NO: 593295 - DNA, 20 bp, Artificial
  CRISPR gRNA sequence
ttaaccaagagaaaaacaac

SEQ ID NO: 593296 - DNA, 20 bp, Artificial
  CRISPR gRNA sequence
taaccaagagaaaaacaaca

SEQ ID NO: 593297 - DNA, 20 bp, Artificial
  CRISPR gRNA sequence
caagagaaaaacaacaggga

SEQ ID NO: 593298 - DNA, 20 bp, Artificial
  CRISPR gRNA sequence
aagagaaaaacaacagggaa

SEQ ID NO: 593299 - DNA, 20 bp, Artificial
  CRISPR gRNA sequence
agaaaaacaacagggaaagg

SEQ ID NO: 593300 - DNA, 20 bp, Artificial
  CRISPR gRNA sequence
caacagggaaaggtagatat

SEQ ID NO: 593301 - DNA, 20 bp, Artificial
  CRISPR gRNA sequence
ggaaaggtagatatgagatc

SEQ ID NO: 593302 - DNA, 20 bp, Artificial
  CRISPR gRNA sequence
gaaaggtagatatgagatca

SEQ ID NO: 593303 - DNA, 20 bp, Artificial
  CRISPR gRNA sequence
ggtagatatgagatcaaggc

SEQ ID NO: 593304 - DNA, 20 bp, Artificial
  CRISPR gRNA sequence
gatcaaggctggatttatga

SEQ ID NO: 593305 - DNA, 20 bp, Artificial
  CRISPR gRNA sequence
ggctggatttatgaaagatg

SEQ ID NO: 593306 - DNA, 20 bp, Artificial
  CRISPR gRNA sequence
gctggatttatgaaagatgt

SEQ ID NO: 593307 - DNA, 20 bp, Artificial
  CRISPR gRNA sequence
ttatgaaagatgtgggatca

SEQ ID NO: 593308 - DNA, 20 bp, Artificial
  CRISPR gRNA sequence
tgaaagatgtgggatcaaag

SEQ ID NO: 593309 - DNA, 20 bp, Artificial
  CRISPR gRNA sequence
tgggatcaaagtagcttatg

SEQ ID NO: 593310 - DNA, 20 bp, Artificial
  CRISPR gRNA sequence
tcaaagtagcttatgcagaa

SEQ ID NO: 593311 - DNA, 20 bp, Artificial
  CRISPR gRNA sequence
aagatgtgaaaatttaataa

SEQ ID NO: 593312 - DNA, 20 bp, Artificial
  CRISPR gRNA sequence
tgtgaaaatttaataaaaga

SEQ ID NO: 593313 - DNA, 20 bp, Artificial
  CRISPR gRNA sequence
tctctgtgtaactgtcactc

SEQ ID NO: 593314 - DNA, 20 bp, Artificial
  CRISPR gRNA sequence
atattttacttaattattgc

SEQ ID NO: 593315 - DNA, 20 bp, Artificial
  CRISPR gRNA sequence
attattgctggtcctctcca

SEQ ID NO: 593316 - DNA, 20 bp, Artificial
  CRISPR gRNA sequence
ctggtcctctccatggccac

SEQ ID NO: 593317 - DNA, 20 bp, Artificial
  CRISPR gRNA sequence
ttttccaatccattctgtga

SEQ ID NO: 593318 - DNA, 20 bp, Artificial
  CRISPR gRNA sequence
ttccaatccattctgtgaaa

SEQ ID NO: 593319 - DNA, 20 bp, Artificial
  CRISPR gRNA sequence
ccaatccattctgtgaaaga

SEQ ID NO: 593320 - DNA, 20 bp, Artificial
  CRISPR gRNA sequence
cattctgtgaaagagagtat

SEQ ID NO: 593321 - DNA, 20 bp, Artificial
  CRISPR gRNA sequence
atctattttatttattatac

SEQ ID NO: 593322 - DNA, 20 bp, Artificial
  CRISPR gRNA sequence
tacatgcacatactattttt

SEQ ID NO: 593323 - DNA, 20 bp, Artificial
  CRISPR gRNA sequence
tgcacatactatttttgaga

SEQ ID NO: 593324 - DNA, 20 bp, Artificial
  CRISPR gRNA sequence
gcacatactatttttgagac

SEQ ID NO: 593325 - DNA, 20 bp, Artificial
  CRISPR gRNA sequence
cacatactatttttgagaca

SEQ ID NO: 593326 - DNA, 20 bp, Artificial
  CRISPR gRNA sequence
cagggtctcactctgttgcc

SEQ ID NO: 593327 - DNA, 20 bp, Artificial
  CRISPR gRNA sequence
agggtctcactctgttgccc

SEQ ID NO: 593328 - DNA, 20 bp, Artificial
  CRISPR gRNA sequence
tctcactctgttgcccaggc

SEQ ID NO: 593329 - DNA, 20 bp, Artificial
  CRISPR gRNA sequence
tcactctgttgcccaggctg

SEQ ID NO: 593330 - DNA, 20 bp, Artificial
  CRISPR gRNA sequence
ctgttgcccaggctggagtg

SEQ ID NO: 593331 - DNA, 20 bp, Artificial
  CRISPR gRNA sequence
ttgcccaggctggagtgcag

SEQ ID NO: 593332 - DNA, 20 bp, Artificial
  CRISPR gRNA sequence
tggagtgcagtagcacaatc

SEQ ID NO: 593333 - DNA, 20 bp, Artificial
  CRISPR gRNA sequence
ggagtgcagtagcacaatca

SEQ ID NO: 593334 - DNA, 20 bp, Artificial
  CRISPR gRNA sequence
agcacaatcaaggctcactg

SEQ ID NO: 593335 - DNA, 20 bp, Artificial
  CRISPR gRNA sequence
tcactgcagcatcgacttcc

SEQ ID NO: 593336 - DNA, 20 bp, Artificial
  CRISPR gRNA sequence
cactgcagcatcgacttcct

SEQ ID NO: 593337 - DNA, 20 bp, Artificial
  CRISPR gRNA sequence
agcatcgacttcctgggctt

SEQ ID NO: 593338 - DNA, 20 bp, Artificial
  CRISPR gRNA sequence
cttaagtgatcttccctcct

SEQ ID NO: 593339 - DNA, 20 bp, Artificial
  CRISPR gRNA sequence
tcttccctcctcagtctcct

SEQ ID NO: 593340 - DNA, 20 bp, Artificial
  CRISPR gRNA sequence
tcctcagtctcctgagtcgc

SEQ ID NO: 593341 - DNA, 20 bp, Artificial
  CRISPR gRNA sequence
catatgcacaccaccacacc

SEQ ID NO: 593342 - DNA, 20 bp, Artificial
  CRISPR gRNA sequence
aatttaaaataattattttg

SEQ ID NO: 593343 - DNA, 20 bp, Artificial
  CRISPR gRNA sequence
tttaaaataattattttgta

SEQ ID NO: 593344 - DNA, 20 bp, Artificial
  CRISPR gRNA sequence
aataattattttgtagagat

SEQ ID NO: 593345 - DNA, 20 bp, Artificial
  CRISPR gRNA sequence
tgagatctccctatgttgcc

SEQ ID NO: 593346 - DNA, 20 bp, Artificial
  CRISPR gRNA sequence
tctccctatgttgcccagac

SEQ ID NO: 593347 - DNA, 20 bp, Artificial
  CRISPR gRNA sequence
ccagactagttttgaacttt

SEQ ID NO: 593348 - DNA, 20 bp, Artificial
  CRISPR gRNA sequence
agttttgaactttgagacta

SEQ ID NO: 593349 - DNA, 20 bp, Artificial
  CRISPR gRNA sequence
tttgaactttgagactaaag

SEQ ID NO: 593350 - DNA, 20 bp, Artificial
  CRISPR gRNA sequence
ctaaagcagttctcctgcct

SEQ ID NO: 593351 - DNA, 20 bp, Artificial
  CRISPR gRNA sequence
ccttggcctcccaaaatgct

SEQ ID NO: 593352 - DNA, 20 bp, Artificial
  CRISPR gRNA sequence
ctcccaaaatgctgagatta

SEQ ID NO: 593353 - DNA, 20 bp, Artificial
  CRISPR gRNA sequence
aaatgctgagattacagtgt

SEQ ID NO: 593354 - DNA, 20 bp, Artificial
  CRISPR gRNA sequence
acagtgtgagccactgtgcc

SEQ ID NO: 593355 - DNA, 20 bp, Artificial
  CRISPR gRNA sequence
agccactgtgcctggcctat

SEQ ID NO: 593356 - DNA, 20 bp, Artificial
  CRISPR gRNA sequence
tcctctaccatttcaatgta

SEQ ID NO: 593357 - DNA, 20 bp, Artificial
  CRISPR gRNA sequence
accatttcaatgtacagtta

SEQ ID NO: 593358 - DNA, 20 bp, Artificial
  CRISPR gRNA sequence
ttaaatttttacttcaaata

SEQ ID NO: 593359 - DNA, 20 bp, Artificial
  CRISPR gRNA sequence
atttttacttcaaatatagc

SEQ ID NO: 593360 - DNA, 20 bp, Artificial
  CRISPR gRNA sequence
ttacttcaaatatagctggc

SEQ ID NO: 593361 - DNA, 20 bp, Artificial
  CRISPR gRNA sequence
acttcaaatatagctggcta

SEQ ID NO: 593362 - DNA, 20 bp, Artificial
  CRISPR gRNA sequence
gctagagttctcacttgccc

SEQ ID NO: 593363 - DNA, 20 bp, Artificial
  CRISPR gRNA sequence
tctcacttgccccagaactt

SEQ ID NO: 593364 - DNA, 20 bp, Artificial
  CRISPR gRNA sequence
agtctacataccatgccacg

SEQ ID NO: 593365 - DNA, 20 bp, Artificial
  CRISPR gRNA sequence
tctacataccatgccacgca

SEQ ID NO: 593366 - DNA, 20 bp, Artificial
  CRISPR gRNA sequence
tacataccatgccacgcaga

SEQ ID NO: 593367 - DNA, 20 bp, Artificial
  CRISPR gRNA sequence
taccatgccacgcagagagt

SEQ ID NO: 593368 - DNA, 20 bp, Artificial
  CRISPR gRNA sequence
ataattaatctgctattcac

SEQ ID NO: 593369 - DNA, 20 bp, Artificial
  CRISPR gRNA sequence
taattaatctgctattcaca

SEQ ID NO: 593370 - DNA, 20 bp, Artificial
  CRISPR gRNA sequence
tctgctattcacaaggctac

SEQ ID NO: 593371 - DNA, 20 bp, Artificial
  CRISPR gRNA sequence
cttttatcacccaacaatgt

SEQ ID NO: 593372 - DNA, 20 bp, Artificial
  CRISPR gRNA sequence
aatgttagtcccccctgtga

SEQ ID NO: 593373 - DNA, 20 bp, Artificial
  CRISPR gRNA sequence
accatcccaccgccctgttc

SEQ ID NO: 593374 - DNA, 20 bp, Artificial
  CRISPR gRNA sequence
ccaccgccctgttcgagcca

SEQ ID NO: 593375 - DNA, 20 bp, Artificial
  CRISPR gRNA sequence
agtgatgatcctgtttcctt

SEQ ID NO: 593376 - DNA, 20 bp, Artificial
  CRISPR gRNA sequence
atcctgtttcctttggtgcc

SEQ ID NO: 593377 - DNA, 20 bp, Artificial
  CRISPR gRNA sequence
gtttcctttggtgcccagct

SEQ ID NO: 593378 - DNA, 20 bp, Artificial
  CRISPR gRNA sequence
ctttggtgcccagctcagtc

SEQ ID NO: 593379 - DNA, 20 bp, Artificial
  CRISPR gRNA sequence
tttggtgcccagctcagtca

SEQ ID NO: 593380 - DNA, 20 bp, Artificial
  CRISPR gRNA sequence
ttggtgcccagctcagtcaa

SEQ ID NO: 593381 - DNA, 20 bp, Artificial
  CRISPR gRNA sequence
gtgtttgcaactaccattac

SEQ ID NO: 593382 - DNA, 20 bp, Artificial
  CRISPR gRNA sequence
attaccagctgttcttccct

SEQ ID NO: 593383 - DNA, 20 bp, Artificial
  CRISPR gRNA sequence
ttaccagctgttcttcccta

SEQ ID NO: 593384 - DNA, 20 bp, Artificial
  CRISPR gRNA sequence
ggtactaactacactgatga

SEQ ID NO: 593385 - DNA, 20 bp, Artificial
  CRISPR gRNA sequence
tatacaaaattttctatcat

SEQ ID NO: 593386 - DNA, 20 bp, Artificial
  CRISPR gRNA sequence
ttttctatcatcagccccat

SEQ ID NO: 593387 - DNA, 20 bp, Artificial
  CRISPR gRNA sequence
catcagccccatgagttcaa

SEQ ID NO: 593388 - DNA, 20 bp, Artificial
  CRISPR gRNA sequence
atcagccccatgagttcaaa

SEQ ID NO: 593389 - DNA, 20 bp, Artificial
  CRISPR gRNA sequence
tcagccccatgagttcaaaa

SEQ ID NO: 593390 - DNA, 20 bp, Artificial
  CRISPR gRNA sequence
aaagggtttctcttgaatgt

SEQ ID NO: 593391 - DNA, 20 bp, Artificial
  CRISPR gRNA sequence
ttctcttgaatgttggttgc

SEQ ID NO: 593392 - DNA, 20 bp, Artificial
  CRISPR gRNA sequence
tctcttgaatgttggttgcc

SEQ ID NO: 593393 - DNA, 20 bp, Artificial
  CRISPR gRNA sequence
cttgaatgttggttgccagg

SEQ ID NO: 593394 - DNA, 20 bp, Artificial
  CRISPR gRNA sequence
ttgaatgttggttgccaggt

SEQ ID NO: 593395 - DNA, 20 bp, Artificial
  CRISPR gRNA sequence
tgaatgttggttgccaggtg

SEQ ID NO: 593396 - DNA, 20 bp, Artificial
  CRISPR gRNA sequence
tcctcaatgtaacttcattt

SEQ ID NO: 593397 - DNA, 20 bp, Artificial
  CRISPR gRNA sequence
cctcaatgtaacttcatttc

SEQ ID NO: 593398 - DNA, 20 bp, Artificial
  CRISPR gRNA sequence
aggaatctcattgccctttc

SEQ ID NO: 593399 - DNA, 20 bp, Artificial
  CRISPR gRNA sequence
gaatctcattgccctttcca

SEQ ID NO: 593400 - DNA, 20 bp, Artificial
  CRISPR gRNA sequence
tcattgccctttccagagac

SEQ ID NO: 593401 - DNA, 20 bp, Artificial
  CRISPR gRNA sequence
cattgccctttccagagact

SEQ ID NO: 593402 - DNA, 20 bp, Artificial
  CRISPR gRNA sequence
cctttccagagactgggatt

SEQ ID NO: 593403 - DNA, 20 bp, Artificial
  CRISPR gRNA sequence
tccagagactgggattgagt

SEQ ID NO: 593404 - DNA, 20 bp, Artificial
  CRISPR gRNA sequence
gggattgagtcagtgccaca

SEQ ID NO: 593405 - DNA, 20 bp, Artificial
  CRISPR gRNA sequence
agtgccacacagctctatgt

SEQ ID NO: 593406 - DNA, 20 bp, Artificial
  CRISPR gRNA sequence
gccacacagctctatgtcag

SEQ ID NO: 593407 - DNA, 20 bp, Artificial
  CRISPR gRNA sequence
cacacagctctatgtcagca

SEQ ID NO: 593408 - DNA, 20 bp, Artificial
  CRISPR gRNA sequence
agctctatgtcagcagagac

SEQ ID NO: 593409 - DNA, 20 bp, Artificial
  CRISPR gRNA sequence
gctctatgtcagcagagact

SEQ ID NO: 593410 - DNA, 20 bp, Artificial
  CRISPR gRNA sequence
tgtcagcagagactaggtat

SEQ ID NO: 593411 - DNA, 20 bp, Artificial
  CRISPR gRNA sequence
ggtattagttctttctctcc

SEQ ID NO: 593412 - DNA, 20 bp, Artificial
  CRISPR gRNA sequence
attagttctttctctcccag

SEQ ID NO: 593413 - DNA, 20 bp, Artificial
  CRISPR gRNA sequence
ttagttctttctctcccaga

SEQ ID NO: 593414 - DNA, 20 bp, Artificial
  CRISPR gRNA sequence
ctttctctcccagaaggcgc

SEQ ID NO: 593415 - DNA, 20 bp, Artificial
  CRISPR gRNA sequence
gtgtaaactgatctcctccc

SEQ ID NO: 593416 - DNA, 20 bp, Artificial
  CRISPR gRNA sequence
tgtaaactgatctcctcccc

SEQ ID NO: 593417 - DNA, 20 bp, Artificial
  CRISPR gRNA sequence
ctgatctcctccccaggaac

SEQ ID NO: 593418 - DNA, 20 bp, Artificial
  CRISPR gRNA sequence
ctccccaggaaccagcttta

SEQ ID NO: 593419 - DNA, 20 bp, Artificial
  CRISPR gRNA sequence
ccccaggaaccagctttaca

SEQ ID NO: 593420 - DNA, 20 bp, Artificial
  CRISPR gRNA sequence
caggaaccagctttacagag

SEQ ID NO: 593421 - DNA, 20 bp, Artificial
  CRISPR gRNA sequence
agctttacagagcagaatac

SEQ ID NO: 593422 - DNA, 20 bp, Artificial
  CRISPR gRNA sequence
gcagaatacaagtgcattct

SEQ ID NO: 593423 - DNA, 20 bp, Artificial
  CRISPR gRNA sequence
cagaatacaagtgcattctc

SEQ ID NO: 593424 - DNA, 20 bp, Artificial
  CRISPR gRNA sequence
agaatacaagtgcattctca

SEQ ID NO: 593425 - DNA, 20 bp, Artificial
  CRISPR gRNA sequence
aatacaagtgcattctcagg

SEQ ID NO: 593426 - DNA, 20 bp, Artificial
  CRISPR gRNA sequence
acaagtgcattctcagggag

SEQ ID NO: 593427 - DNA, 20 bp, Artificial
  CRISPR gRNA sequence
agtgcattctcagggagtgg

SEQ ID NO: 593428 - DNA, 20 bp, Artificial
  CRISPR gRNA sequence
gtggcagacttctattaatg

SEQ ID NO: 593429 - DNA, 20 bp, Artificial
  CRISPR gRNA sequence
cagacttctattaatgaagt

SEQ ID NO: 593430 - DNA, 20 bp, Artificial
  CRISPR gRNA sequence
cttctattaatgaagtcaga

SEQ ID NO: 593431 - DNA, 20 bp, Artificial
  CRISPR gRNA sequence
tgctctatatttgctaaact

SEQ ID NO: 593432 - DNA, 20 bp, Artificial
  CRISPR gRNA sequence
ctatatttgctaaactaaga

SEQ ID NO: 593433 - DNA, 20 bp, Artificial
  CRISPR gRNA sequence
ctaaactaagaaagttattc

SEQ ID NO: 593434 - DNA, 20 bp, Artificial
  CRISPR gRNA sequence
agaaagttattcaagtaata

SEQ ID NO: 593435 - DNA, 20 bp, Artificial
  CRISPR gRNA sequence
aagttattcaagtaatacag

SEQ ID NO: 593436 - DNA, 20 bp, Artificial
  CRISPR gRNA sequence
attcaagtaatacagaagat

SEQ ID NO: 593437 - DNA, 20 bp, Artificial
  CRISPR gRNA sequence
atacagaagataagcacttc

SEQ ID NO: 593438 - DNA, 20 bp, Artificial
  CRISPR gRNA sequence
atcataaatcaaattctacc

SEQ ID NO: 593439 - DNA, 20 bp, Artificial
  CRISPR gRNA sequence
taaatcaaattctaccaagt

SEQ ID NO: 593440 - DNA, 20 bp, Artificial
  CRISPR gRNA sequence
agtgttcaacactatttcaa

SEQ ID NO: 593441 - DNA, 20 bp, Artificial
  CRISPR gRNA sequence
caatagttgtttgttgcttt

SEQ ID NO: 593442 - DNA, 20 bp, Artificial
  CRISPR gRNA sequence
aatagttgtttgttgctttt

SEQ ID NO: 593443 - DNA, 20 bp, Artificial
  CRISPR gRNA sequence
cccaaatcctcaaaaaaata

SEQ ID NO: 593444 - DNA, 20 bp, Artificial
  CRISPR gRNA sequence
aaaaaataaagtatattaca

SEQ ID NO: 593445 - DNA, 20 bp, Artificial
  CRISPR gRNA sequence
atggctccttctcacctctc

SEQ ID NO: 593446 - DNA, 20 bp, Artificial
  CRISPR gRNA sequence
cacctctccagatacatcat

SEQ ID NO: 593447 - DNA, 20 bp, Artificial
  CRISPR gRNA sequence
agccactccatctccctcca

SEQ ID NO: 593448 - DNA, 20 bp, Artificial
  CRISPR gRNA sequence
cactccatctccctccatag

SEQ ID NO: 593449 - DNA, 20 bp, Artificial
  CRISPR gRNA sequence
actccatctccctccatagc

SEQ ID NO: 593450 - DNA, 20 bp, Artificial
  CRISPR gRNA sequence
ctccctccatagcaggctca

SEQ ID NO: 593451 - DNA, 20 bp, Artificial
  CRISPR gRNA sequence
tccctccatagcaggctcac

SEQ ID NO: 593452 - DNA, 20 bp, Artificial
  CRISPR gRNA sequence
caggctcacaggccttcttt

SEQ ID NO: 593453 - DNA, 20 bp, Artificial
  CRISPR gRNA sequence
caggccttctttcagttctt

SEQ ID NO: 593454 - DNA, 20 bp, Artificial
  CRISPR gRNA sequence
ctttggtgaacatattataa

SEQ ID NO: 593455 - DNA, 20 bp, Artificial
  CRISPR gRNA sequence
aagccaactttttcctgctg

SEQ ID NO: 593456 - DNA, 20 bp, Artificial
  CRISPR gRNA sequence
agccaactttttcctgctgc

SEQ ID NO: 593457 - DNA, 20 bp, Artificial
  CRISPR gRNA sequence
gccaactttttcctgctgcg

SEQ ID NO: 593458 - DNA, 20 bp, Artificial
  CRISPR gRNA sequence
gggcctttgcacatatacaa

SEQ ID NO: 593459 - DNA, 20 bp, Artificial
  CRISPR gRNA sequence
ctcatactctactgctatct

SEQ ID NO: 593460 - DNA, 20 bp, Artificial
  CRISPR gRNA sequence
atactctactgctatctgag

SEQ ID NO: 593461 - DNA, 20 bp, Artificial
  CRISPR gRNA sequence
cccactccttacctcctcta

SEQ ID NO: 593462 - DNA, 20 bp, Artificial
  CRISPR gRNA sequence
ctaaatcgtcaatataaact

SEQ ID NO: 593463 - DNA, 20 bp, Artificial
  CRISPR gRNA sequence
taaatcgtcaatataaacta

SEQ ID NO: 593464 - DNA, 20 bp, Artificial
  CRISPR gRNA sequence
gtcctattatttttatttta

SEQ ID NO: 593465 - DNA, 20 bp, Artificial
  CRISPR gRNA sequence
taatgtcttctttcaactgt

SEQ ID NO: 593466 - DNA, 20 bp, Artificial
  CRISPR gRNA sequence
ctttcaactgtaagctctat

SEQ ID NO: 593467 - DNA, 20 bp, Artificial
  CRISPR gRNA sequence
tttcaactgtaagctctata

SEQ ID NO: 593468 - DNA, 20 bp, Artificial
  CRISPR gRNA sequence
aactgtaagctctataagga

SEQ ID NO: 593469 - DNA, 20 bp, Artificial
  CRISPR gRNA sequence
ctgtaagctctataaggata

SEQ ID NO: 593470 - DNA, 20 bp, Artificial
  CRISPR gRNA sequence
gtctgttttgttcactgctg

SEQ ID NO: 593471 - DNA, 20 bp, Artificial
  CRISPR gRNA sequence
ctgttttgttcactgctgta

SEQ ID NO: 593472 - DNA, 20 bp, Artificial
  CRISPR gRNA sequence
tttgttcactgctgtagagc

SEQ ID NO: 593473 - DNA, 20 bp, Artificial
  CRISPR gRNA sequence
tcactgctgtagagcaagct

SEQ ID NO: 593474 - DNA, 20 bp, Artificial
  CRISPR gRNA sequence
caagcttagtgcctgaccca

SEQ ID NO: 593475 - DNA, 20 bp, Artificial
  CRISPR gRNA sequence
cttagtgcctgacccaaagt

SEQ ID NO: 593476 - DNA, 20 bp, Artificial
  CRISPR gRNA sequence
cctgacccaaagtaagcctc

SEQ ID NO: 593477 - DNA, 20 bp, Artificial
  CRISPR gRNA sequence
agcctcaagaaatattttat

SEQ ID NO: 593478 - DNA, 20 bp, Artificial
  CRISPR gRNA sequence
aatattttattagataattg

SEQ ID NO: 593479 - DNA, 20 bp, Artificial
  CRISPR gRNA sequence
atattttattagataattga

SEQ ID NO: 593480 - DNA, 20 bp, Artificial
  CRISPR gRNA sequence
tagataattgaaggaataac

SEQ ID NO: 593481 - DNA, 20 bp, Artificial
  CRISPR gRNA sequence
taactagaaatacccaataa

SEQ ID NO: 593482 - DNA, 20 bp, Artificial
  CRISPR gRNA sequence
atacccaataacagaaccac

SEQ ID NO: 593483 - DNA, 20 bp, Artificial
  CRISPR gRNA sequence
aaccactagctttattgtct

SEQ ID NO: 593484 - DNA, 20 bp, Artificial
  CRISPR gRNA sequence
cactagctttattgtcttgg

SEQ ID NO: 593485 - DNA, 20 bp, Artificial
  CRISPR gRNA sequence
tacatcgcatgctttgcaca

SEQ ID NO: 593486 - DNA, 20 bp, Artificial
  CRISPR gRNA sequence
acatcgcatgctttgcacaa

SEQ ID NO: 593487 - DNA, 20 bp, Artificial
  CRISPR gRNA sequence
gctttgcacaaaggtttcct

SEQ ID NO: 593488 - DNA, 20 bp, Artificial
  CRISPR gRNA sequence
tgcacaaaggtttcctaagt

SEQ ID NO: 593489 - DNA, 20 bp, Artificial
  CRISPR gRNA sequence
gcacaaaggtttcctaagtt

SEQ ID NO: 593490 - DNA, 20 bp, Artificial
  CRISPR gRNA sequence
caaaggtttcctaagttggg

SEQ ID NO: 593491 - DNA, 20 bp, Artificial
  CRISPR gRNA sequence
ggtttcctaagttgggaaga

SEQ ID NO: 593492 - DNA, 20 bp, Artificial
  CRISPR gRNA sequence
ctacatgaccttgaactttc

SEQ ID NO: 593493 - DNA, 20 bp, Artificial
  CRISPR gRNA sequence
tgaccttgaactttctagtt

SEQ ID NO: 593494 - DNA, 20 bp, Artificial
  CRISPR gRNA sequence
gaccttgaactttctagttc

SEQ ID NO: 593495 - DNA, 20 bp, Artificial
  CRISPR gRNA sequence
ttcgggaactaatacattat

SEQ ID NO: 593496 - DNA, 20 bp, Artificial
  CRISPR gRNA sequence
actaatacattataagacat

SEQ ID NO: 593497 - DNA, 20 bp, Artificial
  CRISPR gRNA sequence
ataagacataagctgctatg

SEQ ID NO: 593498 - DNA, 20 bp, Artificial
  CRISPR gRNA sequence
taagctgctatgtggattct

SEQ ID NO: 593499 - DNA, 20 bp, Artificial
  CRISPR gRNA sequence
tgctatgtggattctaagaa

SEQ ID NO: 593500 - DNA, 20 bp, Artificial
  CRISPR gRNA sequence
tatgtggattctaagaacag

SEQ ID NO: 593501 - DNA, 20 bp, Artificial
  CRISPR gRNA sequence
atgtggattctaagaacaga

SEQ ID NO: 593502 - DNA, 20 bp, Artificial
  CRISPR gRNA sequence
aacagaaggtcattcttatt

SEQ ID NO: 593503 - DNA, 20 bp, Artificial
  CRISPR gRNA sequence
acagaaggtcattcttattt

SEQ ID NO: 593504 - DNA, 20 bp, Artificial
  CRISPR gRNA sequence
gaaggtcattcttatttggg

SEQ ID NO: 593505 - DNA, 20 bp, Artificial
  CRISPR gRNA sequence
gtcattcttatttgggaagt

SEQ ID NO: 593506 - DNA, 20 bp, Artificial
  CRISPR gRNA sequence
cttatttgggaagttagtaa

SEQ ID NO: 593507 - DNA, 20 bp, Artificial
  CRISPR gRNA sequence
gggaagttagtaaaagtttc

SEQ ID NO: 593508 - DNA, 20 bp, Artificial
  CRISPR gRNA sequence
ggaagttagtaaaagtttca

SEQ ID NO: 593509 - DNA, 20 bp, Artificial
  CRISPR gRNA sequence
aagttagtaaaagtttcaag

SEQ ID NO: 593510 - DNA, 20 bp, Artificial
  CRISPR gRNA sequence
agttagtaaaagtttcaagg

SEQ ID NO: 593511 - DNA, 20 bp, Artificial
  CRISPR gRNA sequence
gaattacttgaaatataatc

SEQ ID NO: 593512 - DNA, 20 bp, Artificial
  CRISPR gRNA sequence
aatataatcgagatataact

SEQ ID NO: 593513 - DNA, 20 bp, Artificial
  CRISPR gRNA sequence
tataatcgagatataactta

SEQ ID NO: 593514 - DNA, 20 bp, Artificial
  CRISPR gRNA sequence
ataatcgagatataacttag

SEQ ID NO: 593515 - DNA, 20 bp, Artificial
  CRISPR gRNA sequence
tgtttgatttgaaactgcac

SEQ ID NO: 593516 - DNA, 20 bp, Artificial
  CRISPR gRNA sequence
tttgatttgaaactgcacaa

SEQ ID NO: 593517 - DNA, 20 bp, Artificial
  CRISPR gRNA sequence
tgatttgaaactgcacaaga

SEQ ID NO: 593518 - DNA, 20 bp, Artificial
  CRISPR gRNA sequence
aactgcacaagagagaactc

SEQ ID NO: 593519 - DNA, 20 bp, Artificial
  CRISPR gRNA sequence
ctgcacaagagagaactcca

SEQ ID NO: 593520 - DNA, 20 bp, Artificial
  CRISPR gRNA sequence
cagagatgtgaacatgtgaa

SEQ ID NO: 593521 - DNA, 20 bp, Artificial
  CRISPR gRNA sequence
agagatgtgaacatgtgaaa

SEQ ID NO: 593522 - DNA, 20 bp, Artificial
  CRISPR gRNA sequence
gagatgtgaacatgtgaaaa

SEQ ID NO: 593523 - DNA, 20 bp, Artificial
  CRISPR gRNA sequence
tgtgaaaagggaaacataaa

SEQ ID NO: 593524 - DNA, 20 bp, Artificial
  CRISPR gRNA sequence
gtgaaaagggaaacataaaa

SEQ ID NO: 593525 - DNA, 20 bp, Artificial
  CRISPR gRNA sequence
ggaaacataaaaaggtaaat

SEQ ID NO: 593526 - DNA, 20 bp, Artificial
  CRISPR gRNA sequence
aggtaaataagaacatcttg

SEQ ID NO: 593527 - DNA, 20 bp, Artificial
  CRISPR gRNA sequence
ggtaaataagaacatcttgt

SEQ ID NO: 593528 - DNA, 20 bp, Artificial
  CRISPR gRNA sequence
ataagaacatcttgtgggaa

SEQ ID NO: 593529 - DNA, 20 bp, Artificial
  CRISPR gRNA sequence
taagaacatcttgtgggaaa

SEQ ID NO: 593530 - DNA, 20 bp, Artificial
  CRISPR gRNA sequence
ttgtgggaaaaggtaaacct

SEQ ID NO: 593531 - DNA, 20 bp, Artificial
  CRISPR gRNA sequence
aggtaaacctgagttcatct

SEQ ID NO: 593532 - DNA, 20 bp, Artificial
  CRISPR gRNA sequence
aaacctgagttcatctgaga

SEQ ID NO: 593533 - DNA, 20 bp, Artificial
  CRISPR gRNA sequence
aacctgagttcatctgagaa

SEQ ID NO: 593534 - DNA, 20 bp, Artificial
  CRISPR gRNA sequence
gagttcatctgagaaaggta

SEQ ID NO: 593535 - DNA, 20 bp, Artificial
  CRISPR gRNA sequence
ctgagaaaggtatggattaa

SEQ ID NO: 593536 - DNA, 20 bp, Artificial
  CRISPR gRNA sequence
tgagaaaggtatggattaac

SEQ ID NO: 593537 - DNA, 20 bp, Artificial
  CRISPR gRNA sequence
aaggtatggattaacaggtt

SEQ ID NO: 593538 - DNA, 20 bp, Artificial
  CRISPR gRNA sequence
gtatggattaacaggttaag

SEQ ID NO: 593539 - DNA, 20 bp, Artificial
  CRISPR gRNA sequence
attaacaggttaagcagaca

SEQ ID NO: 593540 - DNA, 20 bp, Artificial
  CRISPR gRNA sequence
caggttaagcagacatggta

SEQ ID NO: 593541 - DNA, 20 bp, Artificial
  CRISPR gRNA sequence
ttaagcagacatggtaaagt

SEQ ID NO: 593542 - DNA, 20 bp, Artificial
  CRISPR gRNA sequence
tggtaaagtgagttgataaa

SEQ ID NO: 593543 - DNA, 20 bp, Artificial
  CRISPR gRNA sequence
agttgataaaaagtttgaac

SEQ ID NO: 593544 - DNA, 20 bp, Artificial
  CRISPR gRNA sequence
gttgataaaaagtttgaact

SEQ ID NO: 593545 - DNA, 20 bp, Artificial
  CRISPR gRNA sequence
gggttcaaatttccatctct

SEQ ID NO: 593546 - DNA, 20 bp, Artificial
  CRISPR gRNA sequence
ggttcaaatttccatctctt

SEQ ID NO: 593547 - DNA, 20 bp, Artificial
  CRISPR gRNA sequence
gttcaaatttccatctctta

SEQ ID NO: 593548 - DNA, 20 bp, Artificial
  CRISPR gRNA sequence
ttcaaatttccatctcttag

SEQ ID NO: 593549 - DNA, 20 bp, Artificial
  CRISPR gRNA sequence
caaatttccatctcttaggg

SEQ ID NO: 593550 - DNA, 20 bp, Artificial
  CRISPR gRNA sequence
tcttaggggagtgataaaat

SEQ ID NO: 593551 - DNA, 20 bp, Artificial
  CRISPR gRNA sequence
cttaggggagtgataaaatt

SEQ ID NO: 593552 - DNA, 20 bp, Artificial
  CRISPR gRNA sequence
ttaggggagtgataaaatta

SEQ ID NO: 593553 - DNA, 20 bp, Artificial
  CRISPR gRNA sequence
aggggagtgataaaattagg

SEQ ID NO: 593554 - DNA, 20 bp, Artificial
  CRISPR gRNA sequence
gagattcatctgactatgct

SEQ ID NO: 593555 - DNA, 20 bp, Artificial
  CRISPR gRNA sequence
tctgactatgctgagtatgt

SEQ ID NO: 593556 - DNA, 20 bp, Artificial
  CRISPR gRNA sequence
gactatgctgagtatgtcag

SEQ ID NO: 593557 - DNA, 20 bp, Artificial
  CRISPR gRNA sequence
actatgctgagtatgtcaga

SEQ ID NO: 593558 - DNA, 20 bp, Artificial
  CRISPR gRNA sequence
gctgagtatgtcagaaggat

SEQ ID NO: 593559 - DNA, 20 bp, Artificial
  CRISPR gRNA sequence
gagtatgtcagaaggataag

SEQ ID NO: 593560 - DNA, 20 bp, Artificial
  CRISPR gRNA sequence
atgtcagaaggataagtagc

SEQ ID NO: 593561 - DNA, 20 bp, Artificial
  CRISPR gRNA sequence
gtcagaaggataagtagcta

SEQ ID NO: 593562 - DNA, 20 bp, Artificial
  CRISPR gRNA sequence
tcagaaggataagtagctag

SEQ ID NO: 593563 - DNA, 20 bp, Artificial
  CRISPR gRNA sequence
aggataagtagctagaggta

SEQ ID NO: 593564 - DNA, 20 bp, Artificial
  CRISPR gRNA sequence
gataagtagctagaggtaaa

SEQ ID NO: 593565 - DNA, 20 bp, Artificial
  CRISPR gRNA sequence
gctagaggtaaagagtaact

SEQ ID NO: 593566 - DNA, 20 bp, Artificial
  CRISPR gRNA sequence
ctagaggtaaagagtaacta

SEQ ID NO: 593567 - DNA, 20 bp, Artificial
  CRISPR gRNA sequence
tagaggtaaagagtaactaa

SEQ ID NO: 593568 - DNA, 20 bp, Artificial
  CRISPR gRNA sequence
agaggtaaagagtaactaag

SEQ ID NO: 593569 - DNA, 20 bp, Artificial
  CRISPR gRNA sequence
gggctactaatctaccataa

SEQ ID NO: 593570 - DNA, 20 bp, Artificial
  CRISPR gRNA sequence
aatctaccataacagctatg

SEQ ID NO: 593571 - DNA, 20 bp, Artificial
  CRISPR gRNA sequence
accataacagctatgaagct

SEQ ID NO: 593572 - DNA, 20 bp, Artificial
  CRISPR gRNA sequence
cataacagctatgaagcttg

SEQ ID NO: 593573 - DNA, 20 bp, Artificial
  CRISPR gRNA sequence
cagctatgaagcttggagta

SEQ ID NO: 593574 - DNA, 20 bp, Artificial
  CRISPR gRNA sequence
tatgaagcttggagtaaaga

SEQ ID NO: 593575 - DNA, 20 bp, Artificial
  CRISPR gRNA sequence
atgaagcttggagtaaagat

SEQ ID NO: 593576 - DNA, 20 bp, Artificial
  CRISPR gRNA sequence
tgaagcttggagtaaagata

SEQ ID NO: 593577 - DNA, 20 bp, Artificial
  CRISPR gRNA sequence
ttggagtaaagatagggtga

SEQ ID NO: 593578 - DNA, 20 bp, Artificial
  CRISPR gRNA sequence
tatttaacaattctataaac

SEQ ID NO: 593579 - DNA, 20 bp, Artificial
  CRISPR gRNA sequence
acaattctataaactggcaa

SEQ ID NO: 593580 - DNA, 20 bp, Artificial
  CRISPR gRNA sequence
attctataaactggcaacag

SEQ ID NO: 593581 - DNA, 20 bp, Artificial
  CRISPR gRNA sequence
tctataaactggcaacagca

SEQ ID NO: 593582 - DNA, 20 bp, Artificial
  CRISPR gRNA sequence
tataaactggcaacagcaga

SEQ ID NO: 593583 - DNA, 20 bp, Artificial
  CRISPR gRNA sequence
ataaactggcaacagcagag

SEQ ID NO: 593584 - DNA, 20 bp, Artificial
  CRISPR gRNA sequence
tggcaacagcagagaggctg

SEQ ID NO: 593585 - DNA, 20 bp, Artificial
  CRISPR gRNA sequence
agagaggctgcagttcccac

SEQ ID NO: 593586 - DNA, 20 bp, Artificial
  CRISPR gRNA sequence
gctgcagttcccacaagcaa

SEQ ID NO: 593587 - DNA, 20 bp, Artificial
  CRISPR gRNA sequence
cagttcccacaagcaatagc

SEQ ID NO: 593588 - DNA, 20 bp, Artificial
  CRISPR gRNA sequence
gttcccacaagcaatagcaa

SEQ ID NO: 593589 - DNA, 20 bp, Artificial
  CRISPR gRNA sequence
tcccacaagcaatagcaaga

SEQ ID NO: 593590 - DNA, 20 bp, Artificial
  CRISPR gRNA sequence
ccacaagcaatagcaagaga

SEQ ID NO: 593591 - DNA, 20 bp, Artificial
  CRISPR gRNA sequence
aagcaatagcaagagagagc

SEQ ID NO: 593592 - DNA, 20 bp, Artificial
  CRISPR gRNA sequence
aatagcaagagagagctggc

SEQ ID NO: 593593 - DNA, 20 bp, Artificial
  CRISPR gRNA sequence
tagcaagagagagctggcaa

SEQ ID NO: 593594 - DNA, 20 bp, Artificial
  CRISPR gRNA sequence
gagctggcaagagactacca

SEQ ID NO: 593595 - DNA, 20 bp, Artificial
  CRISPR gRNA sequence
gcaagagactaccatagctt

SEQ ID NO: 593596 - DNA, 20 bp, Artificial
  CRISPR gRNA sequence
caagagactaccatagcttc

SEQ ID NO: 593597 - DNA, 20 bp, Artificial
  CRISPR gRNA sequence
aagagactaccatagcttca

SEQ ID NO: 593598 - DNA, 20 bp, Artificial
  CRISPR gRNA sequence
agagactaccatagcttcag

SEQ ID NO: 593599 - DNA, 20 bp, Artificial
  CRISPR gRNA sequence
atagcttcaggggcccatgt

SEQ ID NO: 593600 - DNA, 20 bp, Artificial
  CRISPR gRNA sequence
cccatgtaagtactatttgc

SEQ ID NO: 593601 - DNA, 20 bp, Artificial
  CRISPR gRNA sequence
agtactatttgctggtgtac

SEQ ID NO: 593602 - DNA, 20 bp, Artificial
  CRISPR gRNA sequence
tggtgtaccagcactgacac

SEQ ID NO: 593603 - DNA, 20 bp, Artificial
  CRISPR gRNA sequence
ggtgtaccagcactgacacc

SEQ ID NO: 593604 - DNA, 20 bp, Artificial
  CRISPR gRNA sequence
gtgtaccagcactgacacca

SEQ ID NO: 593605 - DNA, 20 bp, Artificial
  CRISPR gRNA sequence
caccagggtaccatctttcc

SEQ ID NO: 593606 - DNA, 20 bp, Artificial
  CRISPR gRNA sequence
cagggtaccatctttcctgg

SEQ ID NO: 593607 - DNA, 20 bp, Artificial
  CRISPR gRNA sequence
catctttcctggaagaatct

SEQ ID NO: 593608 - DNA, 20 bp, Artificial
  CRISPR gRNA sequence
ggaagaatctgagacccccc

SEQ ID NO: 593609 - DNA, 20 bp, Artificial
  CRISPR gRNA sequence
aatctgagacccccctagcc

SEQ ID NO: 593610 - DNA, 20 bp, Artificial
  CRISPR gRNA sequence
atctgagacccccctagcct

SEQ ID NO: 593611 - DNA, 20 bp, Artificial
  CRISPR gRNA sequence
ctgagacccccctagcctgg

SEQ ID NO: 593612 - DNA, 20 bp, Artificial
  CRISPR gRNA sequence
gagacccccctagcctggga

SEQ ID NO: 593613 - DNA, 20 bp, Artificial
  CRISPR gRNA sequence
agcctgggagagaacatcca

SEQ ID NO: 593614 - DNA, 20 bp, Artificial
  CRISPR gRNA sequence
gcctgggagagaacatccat

SEQ ID NO: 593615 - DNA, 20 bp, Artificial
  CRISPR gRNA sequence
agaacatccatgggcacact

SEQ ID NO: 593616 - DNA, 20 bp, Artificial
  CRISPR gRNA sequence
gaacatccatgggcacactg

SEQ ID NO: 593617 - DNA, 20 bp, Artificial
  CRISPR gRNA sequence
tccatgggcacactgaggct

SEQ ID NO: 593618 - DNA, 20 bp, Artificial
  CRISPR gRNA sequence
cacactgaggctgagatgcg

SEQ ID NO: 593619 - DNA, 20 bp, Artificial
  CRISPR gRNA sequence
acactgaggctgagatgcgc

SEQ ID NO: 593620 - DNA, 20 bp, Artificial
  CRISPR gRNA sequence
tgaggctgagatgcgcaggc

SEQ ID NO: 593621 - DNA, 20 bp, Artificial
  CRISPR gRNA sequence
gaggctgagatgcgcaggct

SEQ ID NO: 593622 - DNA, 20 bp, Artificial
  CRISPR gRNA sequence
gagatgcgcaggctgggaca

SEQ ID NO: 593623 - DNA, 20 bp, Artificial
  CRISPR gRNA sequence
agatgcgcaggctgggacac

SEQ ID NO: 593624 - DNA, 20 bp, Artificial
  CRISPR gRNA sequence
gcgcaggctgggacacaggc

SEQ ID NO: 593625 - DNA, 20 bp, Artificial
  CRISPR gRNA sequence
aggctgggacacaggctggt

SEQ ID NO: 593626 - DNA, 20 bp, Artificial
  CRISPR gRNA sequence
tgggacacaggctggttagc

SEQ ID NO: 593627 - DNA, 20 bp, Artificial
  CRISPR gRNA sequence
caggctggttagccagttga

SEQ ID NO: 593628 - DNA, 20 bp, Artificial
  CRISPR gRNA sequence
tagccagttgacagcatatt

SEQ ID NO: 593629 - DNA, 20 bp, Artificial
  CRISPR gRNA sequence
ccagttgacagcatattaag

SEQ ID NO: 593630 - DNA, 20 bp, Artificial
  CRISPR gRNA sequence
cagttgacagcatattaagc

SEQ ID NO: 593631 - DNA, 20 bp, Artificial
  CRISPR gRNA sequence
agttgacagcatattaagca

SEQ ID NO: 593632 - DNA, 20 bp, Artificial
  CRISPR gRNA sequence
tattaagcagggtacccaca

SEQ ID NO: 593633 - DNA, 20 bp, Artificial
  CRISPR gRNA sequence
cagggtacccacaaagctct

SEQ ID NO: 593634 - DNA, 20 bp, Artificial
  CRISPR gRNA sequence
agggtacccacaaagctctt

SEQ ID NO: 593635 - DNA, 20 bp, Artificial
  CRISPR gRNA sequence
cccacaaagctcttgggatg

SEQ ID NO: 593636 - DNA, 20 bp, Artificial
  CRISPR gRNA sequence
ccacaaagctcttgggatga

SEQ ID NO: 593637 - DNA, 20 bp, Artificial
  CRISPR gRNA sequence
cacaaagctcttgggatgaa

SEQ ID NO: 593638 - DNA, 20 bp, Artificial
  CRISPR gRNA sequence
caaagctcttgggatgaagg

SEQ ID NO: 593639 - DNA, 20 bp, Artificial
  CRISPR gRNA sequence
ctcttgggatgaagggagta

SEQ ID NO: 593640 - DNA, 20 bp, Artificial
  CRISPR gRNA sequence
tcttgggatgaagggagtac

SEQ ID NO: 593641 - DNA, 20 bp, Artificial
  CRISPR gRNA sequence
aagggagtacaggtactcaa

SEQ ID NO: 593642 - DNA, 20 bp, Artificial
  CRISPR gRNA sequence
tacaggtactcaatggactt

SEQ ID NO: 593643 - DNA, 20 bp, Artificial
  CRISPR gRNA sequence
acaggtactcaatggacttg

SEQ ID NO: 593644 - DNA, 20 bp, Artificial
  CRISPR gRNA sequence
tactcaatggacttgaggaa

SEQ ID NO: 593645 - DNA, 20 bp, Artificial
  CRISPR gRNA sequence
tctttctcaaacctgtacaa

SEQ ID NO: 593646 - DNA, 20 bp, Artificial
  CRISPR gRNA sequence
acaaaagcattttaatattt

SEQ ID NO: 593647 - DNA, 20 bp, Artificial
  CRISPR gRNA sequence
cattttaatattttagcaac

SEQ ID NO: 593648 - DNA, 20 bp, Artificial
  CRISPR gRNA sequence
accagtataatcatatctgt

SEQ ID NO: 593649 - DNA, 20 bp, Artificial
  CRISPR gRNA sequence
ataatcatatctgtaagtgc

SEQ ID NO: 593650 - DNA, 20 bp, Artificial
  CRISPR gRNA sequence
taatcatatctgtaagtgct

SEQ ID NO: 593651 - DNA, 20 bp, Artificial
  CRISPR gRNA sequence
tgtaagtgctgggtgcatat

SEQ ID NO: 593652 - DNA, 20 bp, Artificial
  CRISPR gRNA sequence
tgctgggtgcatatcagcca

SEQ ID NO: 593653 - DNA, 20 bp, Artificial
  CRISPR gRNA sequence
gctgggtgcatatcagccac

SEQ ID NO: 593654 - DNA, 20 bp, Artificial
  CRISPR gRNA sequence
gtgcatatcagccacaggta

SEQ ID NO: 593655 - DNA, 20 bp, Artificial
  CRISPR gRNA sequence
atatcagccacaggtaaaga

SEQ ID NO: 593656 - DNA, 20 bp, Artificial
  CRISPR gRNA sequence
tatcagccacaggtaaagaa

SEQ ID NO: 593657 - DNA, 20 bp, Artificial
  CRISPR gRNA sequence
agccacaggtaaagaaaggc

SEQ ID NO: 593658 - DNA, 20 bp, Artificial
  CRISPR gRNA sequence
caggtaaagaaaggctagat

SEQ ID NO: 593659 - DNA, 20 bp, Artificial
  CRISPR gRNA sequence
aagaaaggctagataagatg

SEQ ID NO: 593660 - DNA, 20 bp, Artificial
  CRISPR gRNA sequence
aggctagataagatgtggac

SEQ ID NO: 593661 - DNA, 20 bp, Artificial
  CRISPR gRNA sequence
tagataagatgtggactggc

SEQ ID NO: 593662 - DNA, 20 bp, Artificial
  CRISPR gRNA sequence
gataagatgtggactggcaa

SEQ ID NO: 593663 - DNA, 20 bp, Artificial
  CRISPR gRNA sequence
ataagatgtggactggcaag

SEQ ID NO: 593664 - DNA, 20 bp, Artificial
  CRISPR gRNA sequence
aagatgtggactggcaagag

SEQ ID NO: 593665 - DNA, 20 bp, Artificial
  CRISPR gRNA sequence
gatgtggactggcaagagga

SEQ ID NO: 593666 - DNA, 20 bp, Artificial
  CRISPR gRNA sequence
tgtggactggcaagaggaga

SEQ ID NO: 593667 - DNA, 20 bp, Artificial
  CRISPR gRNA sequence
gtggactggcaagaggagag

SEQ ID NO: 593668 - DNA, 20 bp, Artificial
  CRISPR gRNA sequence
actggcaagaggagagagga

SEQ ID NO: 593669 - DNA, 20 bp, Artificial
  CRISPR gRNA sequence
aggagagaggacagaatcaa

SEQ ID NO: 593670 - DNA, 20 bp, Artificial
  CRISPR gRNA sequence
agaatcaaaagaaatcttaa

SEQ ID NO: 593671 - DNA, 20 bp, Artificial
  CRISPR gRNA sequence
aaaagaaatcttaacggaaa

SEQ ID NO: 593672 - DNA, 20 bp, Artificial
  CRISPR gRNA sequence
aatcttaacggaaaaagaac

SEQ ID NO: 593673 - DNA, 20 bp, Artificial
  CRISPR gRNA sequence
acggaaaaagaacaagatac

SEQ ID NO: 593674 - DNA, 20 bp, Artificial
  CRISPR gRNA sequence
aagaacaagataccagatga

SEQ ID NO: 593675 - DNA, 20 bp, Artificial
  CRISPR gRNA sequence
caagataccagatgacagac

SEQ ID NO: 593676 - DNA, 20 bp, Artificial
  CRISPR gRNA sequence
aagataccagatgacagact

SEQ ID NO: 593677 - DNA, 20 bp, Artificial
  CRISPR gRNA sequence
gataccagatgacagactag

SEQ ID NO: 593678 - DNA, 20 bp, Artificial
  CRISPR gRNA sequence
accagatgacagactaggag

SEQ ID NO: 593679 - DNA, 20 bp, Artificial
  CRISPR gRNA sequence
atgacagactaggagaagcc

SEQ ID NO: 593680 - DNA, 20 bp, Artificial
  CRISPR gRNA sequence
taggagaagccaagaatatt

SEQ ID NO: 593681 - DNA, 20 bp, Artificial
  CRISPR gRNA sequence
atattaagtaatctgattcc

SEQ ID NO: 593682 - DNA, 20 bp, Artificial
  CRISPR gRNA sequence
taatctgattccaagatttc

SEQ ID NO: 593683 - DNA, 20 bp, Artificial
  CRISPR gRNA sequence
attccaagatttcaagtctg

SEQ ID NO: 593684 - DNA, 20 bp, Artificial
  CRISPR gRNA sequence
ttcaagtctgaagaaccata

SEQ ID NO: 593685 - DNA, 20 bp, Artificial
  CRISPR gRNA sequence
tcaagtctgaagaaccatat

SEQ ID NO: 593686 - DNA, 20 bp, Artificial
  CRISPR gRNA sequence
caagtctgaagaaccatata

SEQ ID NO: 593687 - DNA, 20 bp, Artificial
  CRISPR gRNA sequence
aagtctgaagaaccatatag

SEQ ID NO: 593688 - DNA, 20 bp, Artificial
  CRISPR gRNA sequence
gtctgaagaaccatataggg

SEQ ID NO: 593689 - DNA, 20 bp, Artificial
  CRISPR gRNA sequence
ctgaagaaccatatagggga

SEQ ID NO: 593690 - DNA, 20 bp, Artificial
  CRISPR gRNA sequence
ggagagtgttatattaatga

SEQ ID NO: 593691 - DNA, 20 bp, Artificial
  CRISPR gRNA sequence
gttatattaatgacagacat

SEQ ID NO: 593692 - DNA, 20 bp, Artificial
  CRISPR gRNA sequence
ttatattaatgacagacata

SEQ ID NO: 593693 - DNA, 20 bp, Artificial
  CRISPR gRNA sequence
atgacagacataaggtattt

SEQ ID NO: 593694 - DNA, 20 bp, Artificial
  CRISPR gRNA sequence
gacataaggtattttggaaa

SEQ ID NO: 593695 - DNA, 20 bp, Artificial
  CRISPR gRNA sequence
tttggaaacagaataaattt

SEQ ID NO: 593696 - DNA, 20 bp, Artificial
  CRISPR gRNA sequence
aaacagaataaatttgagtg

SEQ ID NO: 593697 - DNA, 20 bp, Artificial
  CRISPR gRNA sequence
cagaataaatttgagtgaag

SEQ ID NO: 593698 - DNA, 20 bp, Artificial
  CRISPR gRNA sequence
atttgagtgaagtggtatat

SEQ ID NO: 593699 - DNA, 20 bp, Artificial
  CRISPR gRNA sequence
aagtggtatatgagaattat

SEQ ID NO: 593700 - DNA, 20 bp, Artificial
  CRISPR gRNA sequence
tgacttgaaaatgttattca

SEQ ID NO: 593701 - DNA, 20 bp, Artificial
  CRISPR gRNA sequence
gttgttcataaacatccata

SEQ ID NO: 593702 - DNA, 20 bp, Artificial
  CRISPR gRNA sequence
ttgttcataaacatccataa

SEQ ID NO: 593703 - DNA, 20 bp, Artificial
  CRISPR gRNA sequence
acatccataaaggcaactaa

SEQ ID NO: 593704 - DNA, 20 bp, Artificial
  CRISPR gRNA sequence
caactaaaagtacaaacctt

SEQ ID NO: 593705 - DNA, 20 bp, Artificial
  CRISPR gRNA sequence
aaaagtacaaaccttaagtt

SEQ ID NO: 593706 - DNA, 20 bp, Artificial
  CRISPR gRNA sequence
taagttcagatctgaactca

SEQ ID NO: 593707 - DNA, 20 bp, Artificial
  CRISPR gRNA sequence
cagatctgaactcaaagtta

SEQ ID NO: 593708 - DNA, 20 bp, Artificial
  CRISPR gRNA sequence
gaactcaaagttacagactt

SEQ ID NO: 593709 - DNA, 20 bp, Artificial
  CRISPR gRNA sequence
aactcaaagttacagacttt

SEQ ID NO: 593710 - DNA, 20 bp, Artificial
  CRISPR gRNA sequence
actcaaagttacagactttg

SEQ ID NO: 593711 - DNA, 20 bp, Artificial
  CRISPR gRNA sequence
ggggaaaactatgcaaatat

SEQ ID NO: 593712 - DNA, 20 bp, Artificial
  CRISPR gRNA sequence
tatcagtataaatgtgataa

SEQ ID NO: 593713 - DNA, 20 bp, Artificial
  CRISPR gRNA sequence
taatggtaaataaactcttt

SEQ ID NO: 593714 - DNA, 20 bp, Artificial
  CRISPR gRNA sequence
ggtaaataaactctttaagt

SEQ ID NO: 593715 - DNA, 20 bp, Artificial
  CRISPR gRNA sequence
atcctgaataaatgtgcata

SEQ ID NO: 593716 - DNA, 20 bp, Artificial
  CRISPR gRNA sequence
tgaataaatgtgcatataga

SEQ ID NO: 593717 - DNA, 20 bp, Artificial
  CRISPR gRNA sequence
gcatatagatagctttcttt

SEQ ID NO: 593718 - DNA, 20 bp, Artificial
  CRISPR gRNA sequence
catatagatagctttctttt

SEQ ID NO: 593719 - DNA, 20 bp, Artificial
  CRISPR gRNA sequence
gatagctttcttttaggata

SEQ ID NO: 593720 - DNA, 20 bp, Artificial
  CRISPR gRNA sequence
aggataaagtaaattaaaat

SEQ ID NO: 593721 - DNA, 20 bp, Artificial
  CRISPR gRNA sequence
catatcattaaattaaaaat

SEQ ID NO: 593722 - DNA, 20 bp, Artificial
  CRISPR gRNA sequence
taaatcatttttaaatatcc

SEQ ID NO: 593723 - DNA, 20 bp, Artificial
  CRISPR gRNA sequence
ttaaaacgtgatccccaaac

SEQ ID NO: 593724 - DNA, 20 bp, Artificial
  CRISPR gRNA sequence
taaaacgtgatccccaaact

SEQ ID NO: 593725 - DNA, 20 bp, Artificial
  CRISPR gRNA sequence
aaaacgtgatccccaaactg

SEQ ID NO: 593726 - DNA, 20 bp, Artificial
  CRISPR gRNA sequence
ccccaaactggggtgcatat

SEQ ID NO: 593727 - DNA, 20 bp, Artificial
  CRISPR gRNA sequence
ggggtgcatattagactctt

SEQ ID NO: 593728 - DNA, 20 bp, Artificial
  CRISPR gRNA sequence
gggtgcatattagactcttt

SEQ ID NO: 593729 - DNA, 20 bp, Artificial
  CRISPR gRNA sequence
ggtaacttttaccatcatac

SEQ ID NO: 593730 - DNA, 20 bp, Artificial
  CRISPR gRNA sequence
aacttttaccatcatactgg

SEQ ID NO: 593731 - DNA, 20 bp, Artificial
  CRISPR gRNA sequence
catactggtggttgaccaat

SEQ ID NO: 593732 - DNA, 20 bp, Artificial
  CRISPR gRNA sequence
ctggtggttgaccaattaga

SEQ ID NO: 593733 - DNA, 20 bp, Artificial
  CRISPR gRNA sequence
tggtggttgaccaattagat

SEQ ID NO: 593734 - DNA, 20 bp, Artificial
  CRISPR gRNA sequence
tgggaatcactgaattaaaa

SEQ ID NO: 593735 - DNA, 20 bp, Artificial
  CRISPR gRNA sequence
ctgtaaaatgaacatatgta

SEQ ID NO: 593736 - DNA, 20 bp, Artificial
  CRISPR gRNA sequence
atatgtaaagtcaaatgtct

SEQ ID NO: 593737 - DNA, 20 bp, Artificial
  CRISPR gRNA sequence
aaagtcaaatgtcttagaaa

SEQ ID NO: 593738 - DNA, 20 bp, Artificial
  CRISPR gRNA sequence
gatttgaataatcttcaatg

SEQ ID NO: 593739 - DNA, 20 bp, Artificial
  CRISPR gRNA sequence
tttgaataatcttcaatgaa

SEQ ID NO: 593740 - DNA, 20 bp, Artificial
  CRISPR gRNA sequence
atgaagagctttaaaaaata

SEQ ID NO: 593741 - DNA, 20 bp, Artificial
  CRISPR gRNA sequence
ttaaaaaataaagatttatc

SEQ ID NO: 593742 - DNA, 20 bp, Artificial
  CRISPR gRNA sequence
agatttatctagacactgaa

SEQ ID NO: 593743 - DNA, 20 bp, Artificial
  CRISPR gRNA sequence
atttatctagacactgaaaa

SEQ ID NO: 593744 - DNA, 20 bp, Artificial
  CRISPR gRNA sequence
cactgaaaagagtttaaaca

SEQ ID NO: 593745 - DNA, 20 bp, Artificial
  CRISPR gRNA sequence
tgaaaagagtttaaacatag

SEQ ID NO: 593746 - DNA, 20 bp, Artificial
  CRISPR gRNA sequence
atgcatatgttatttaacca

SEQ ID NO: 593747 - DNA, 20 bp, Artificial
  CRISPR gRNA sequence
tgcatatgttatttaaccac

SEQ ID NO: 593748 - DNA, 20 bp, Artificial
  CRISPR gRNA sequence
ggtataccataaacatttta

SEQ ID NO: 593749 - DNA, 20 bp, Artificial
  CRISPR gRNA sequence
tctttcaaattttttaaatc

SEQ ID NO: 593750 - DNA, 20 bp, Artificial
  CRISPR gRNA sequence
ttttaaatctagttttactg

SEQ ID NO: 593751 - DNA, 20 bp, Artificial
  CRISPR gRNA sequence
agttttactgaagtttctta

SEQ ID NO: 593752 - DNA, 20 bp, Artificial
  CRISPR gRNA sequence
tttactgaagtttcttatgg

SEQ ID NO: 593753 - DNA, 20 bp, Artificial
  CRISPR gRNA sequence
tagaaatgtgtgttaatgaa

SEQ ID NO: 593754 - DNA, 20 bp, Artificial
  CRISPR gRNA sequence
agttgaacaaattaacattt

SEQ ID NO: 593755 - DNA, 20 bp, Artificial
  CRISPR gRNA sequence
ttaacatttcagttcatgct

SEQ ID NO: 593756 - DNA, 20 bp, Artificial
  CRISPR gRNA sequence
acatttcagttcatgctaag

SEQ ID NO: 593757 - DNA, 20 bp, Artificial
  CRISPR gRNA sequence
agcacacttcactatttcac

SEQ ID NO: 593758 - DNA, 20 bp, Artificial
  CRISPR gRNA sequence
tcactatttcactagaacta

SEQ ID NO: 593759 - DNA, 20 bp, Artificial
  CRISPR gRNA sequence
cactagaactaaagaaaaat

SEQ ID NO: 593760 - DNA, 20 bp, Artificial
  CRISPR gRNA sequence
aagaaaaataagttattgtt

SEQ ID NO: 593761 - DNA, 20 bp, Artificial
  CRISPR gRNA sequence
gttattgttaagtatttctg

SEQ ID NO: 593762 - DNA, 20 bp, Artificial
  CRISPR gRNA sequence
attgttaagtatttctgcag

SEQ ID NO: 593763 - DNA, 20 bp, Artificial
  CRISPR gRNA sequence
atttctgcagaagcaaaatt

SEQ ID NO: 593764 - DNA, 20 bp, Artificial
  CRISPR gRNA sequence
tttctgcagaagcaaaattc

SEQ ID NO: 593765 - DNA, 20 bp, Artificial
  CRISPR gRNA sequence
ttctgcagaagcaaaattca

SEQ ID NO: 593766 - DNA, 20 bp, Artificial
  CRISPR gRNA sequence
tctgcagaagcaaaattcag

SEQ ID NO: 593767 - DNA, 20 bp, Artificial
  CRISPR gRNA sequence
ttcaggggaaattcctaatt

SEQ ID NO: 593768 - DNA, 20 bp, Artificial
  CRISPR gRNA sequence
aattcctaatttggtatttg

SEQ ID NO: 593769 - DNA, 20 bp, Artificial
  CRISPR gRNA sequence
ttggtatttgtagctcatct

SEQ ID NO: 593770 - DNA, 20 bp, Artificial
  CRISPR gRNA sequence
tggtatttgtagctcatcta

SEQ ID NO: 593771 - DNA, 20 bp, Artificial
  CRISPR gRNA sequence
tattgtttctatctactaac

SEQ ID NO: 593772 - DNA, 20 bp, Artificial
  CRISPR gRNA sequence
attgtttctatctactaacg

SEQ ID NO: 593773 - DNA, 20 bp, Artificial
  CRISPR gRNA sequence
atctactaacgaggtaatta

SEQ ID NO: 593774 - DNA, 20 bp, Artificial
  CRISPR gRNA sequence
agatatttgaaatcaaattt

SEQ ID NO: 593775 - DNA, 20 bp, Artificial
  CRISPR gRNA sequence
tatttgaaatcaaatttaag

SEQ ID NO: 593776 - DNA, 20 bp, Artificial
  CRISPR gRNA sequence
caaatttaagtagtatgact

SEQ ID NO: 593777 - DNA, 20 bp, Artificial
  CRISPR gRNA sequence
aatttaagtagtatgacttg

SEQ ID NO: 593778 - DNA, 20 bp, Artificial
  CRISPR gRNA sequence
gaaaaaaaaattcccatttg

SEQ ID NO: 593779 - DNA, 20 bp, Artificial
  CRISPR gRNA sequence
gtatctttaacaataattga

SEQ ID NO: 593780 - DNA, 20 bp, Artificial
  CRISPR gRNA sequence
taacaataattgatagtcat

SEQ ID NO: 593781 - DNA, 20 bp, Artificial
  CRISPR gRNA sequence
agtcataagtaacccatctc

SEQ ID NO: 593782 - DNA, 20 bp, Artificial
  CRISPR gRNA sequence
gtcataagtaacccatctct

SEQ ID NO: 593783 - DNA, 20 bp, Artificial
  CRISPR gRNA sequence
agtaacccatctctgggtta

SEQ ID NO: 593784 - DNA, 20 bp, Artificial
  CRISPR gRNA sequence
agtaaccactaaatattata

SEQ ID NO: 593785 - DNA, 20 bp, Artificial
  CRISPR gRNA sequence
actaaatattatacagctta

SEQ ID NO: 593786 - DNA, 20 bp, Artificial
  CRISPR gRNA sequence
aaatattatacagcttatag

SEQ ID NO: 593787 - DNA, 20 bp, Artificial
  CRISPR gRNA sequence
aatattatacagcttataga

SEQ ID NO: 593788 - DNA, 20 bp, Artificial
  CRISPR gRNA sequence
acagcttatagaaggtaacc

SEQ ID NO: 593789 - DNA, 20 bp, Artificial
  CRISPR gRNA sequence
gcttatagaaggtaacccag

SEQ ID NO: 593790 - DNA, 20 bp, Artificial
  CRISPR gRNA sequence
aacccagaagatatgtccaa

SEQ ID NO: 593791 - DNA, 20 bp, Artificial
  CRISPR gRNA sequence
cccagaagatatgtccaaaa

SEQ ID NO: 593792 - DNA, 20 bp, Artificial
  CRISPR gRNA sequence
aagatatgtccaaaagagcc

SEQ ID NO: 593793 - DNA, 20 bp, Artificial
  CRISPR gRNA sequence
atatgtccaaaagagcctag

SEQ ID NO: 593794 - DNA, 20 bp, Artificial
  CRISPR gRNA sequence
atgtccaaaagagcctagaa

SEQ ID NO: 593795 - DNA, 20 bp, Artificial
  CRISPR gRNA sequence
tgtccaaaagagcctagaag

SEQ ID NO: 593796 - DNA, 20 bp, Artificial
  CRISPR gRNA sequence
aaagagcctagaagaggtac

SEQ ID NO: 593797 - DNA, 20 bp, Artificial
  CRISPR gRNA sequence
agagcctagaagaggtactg

SEQ ID NO: 593798 - DNA, 20 bp, Artificial
  CRISPR gRNA sequence
gcctagaagaggtactggag

SEQ ID NO: 593799 - DNA, 20 bp, Artificial
  CRISPR gRNA sequence
ctagaagaggtactggagaa

SEQ ID NO: 593800 - DNA, 20 bp, Artificial
  CRISPR gRNA sequence
tagaagaggtactggagaag

SEQ ID NO: 593801 - DNA, 20 bp, Artificial
  CRISPR gRNA sequence
agaagaggtactggagaaga

SEQ ID NO: 593802 - DNA, 20 bp, Artificial
  CRISPR gRNA sequence
aggtactggagaagagggta

SEQ ID NO: 593803 - DNA, 20 bp, Artificial
  CRISPR gRNA sequence
tggagaagagggtatagctg

SEQ ID NO: 593804 - DNA, 20 bp, Artificial
  CRISPR gRNA sequence
tagctgaagtctcaaaaaaa

SEQ ID NO: 593805 - DNA, 20 bp, Artificial
  CRISPR gRNA sequence
aaaaatagcacccattcact

SEQ ID NO: 593806 - DNA, 20 bp, Artificial
  CRISPR gRNA sequence
aaaatagcacccattcacta

SEQ ID NO: 593807 - DNA, 20 bp, Artificial
  CRISPR gRNA sequence
taaggatatgttacttgatc

SEQ ID NO: 593808 - DNA, 20 bp, Artificial
  CRISPR gRNA sequence
aggatatgttacttgatcaa

SEQ ID NO: 593809 - DNA, 20 bp, Artificial
  CRISPR gRNA sequence
gatatgttacttgatcaaga

SEQ ID NO: 593810 - DNA, 20 bp, Artificial
  CRISPR gRNA sequence
ttgatgcgaatttcacatga

SEQ ID NO: 593811 - DNA, 20 bp, Artificial
  CRISPR gRNA sequence
ttcacatgaaagaaacttaa

SEQ ID NO: 593812 - DNA, 20 bp, Artificial
  CRISPR gRNA sequence
catgaaagaaacttaatagc

SEQ ID NO: 593813 - DNA, 20 bp, Artificial
  CRISPR gRNA sequence
tgaaagaaacttaatagcca

SEQ ID NO: 593814 - DNA, 20 bp, Artificial
  CRISPR gRNA sequence
gaaacttaatagccagagaa

SEQ ID NO: 593815 - DNA, 20 bp, Artificial
  CRISPR gRNA sequence
aaacttaatagccagagaat

SEQ ID NO: 593816 - DNA, 20 bp, Artificial
  CRISPR gRNA sequence
aataggaaatattgactcta

SEQ ID NO: 593817 - DNA, 20 bp, Artificial
  CRISPR gRNA sequence
tattgactctaaagatgtct

SEQ ID NO: 593818 - DNA, 20 bp, Artificial
  CRISPR gRNA sequence
aaagatgtcttagaatgtct

SEQ ID NO: 593819 - DNA, 20 bp, Artificial
  CRISPR gRNA sequence
tgtcttagaatgtctaagaa

SEQ ID NO: 593820 - DNA, 20 bp, Artificial
  CRISPR gRNA sequence
atgtctaagaatagcaaatc

SEQ ID NO: 593821 - DNA, 20 bp, Artificial
  CRISPR gRNA sequence
taagaatagcaaatcaagca

SEQ ID NO: 593822 - DNA, 20 bp, Artificial
  CRISPR gRNA sequence
agcatggccccaccaaaata

SEQ ID NO: 593823 - DNA, 20 bp, Artificial
  CRISPR gRNA sequence
caaaataaagctgctaacta

SEQ ID NO: 593824 - DNA, 20 bp, Artificial
  CRISPR gRNA sequence
aaaataaagctgctaactat

SEQ ID NO: 593825 - DNA, 20 bp, Artificial
  CRISPR gRNA sequence
tattctttttctgattatga

SEQ ID NO: 593826 - DNA, 20 bp, Artificial
  CRISPR gRNA sequence
aatgcctcattatataaaaa

SEQ ID NO: 593827 - DNA, 20 bp, Artificial
  CRISPR gRNA sequence
atgcctcattatataaaaac

SEQ ID NO: 593828 - DNA, 20 bp, Artificial
  CRISPR gRNA sequence
tatataaaaacaggtattta

SEQ ID NO: 593829 - DNA, 20 bp, Artificial
  CRISPR gRNA sequence
tataaaaacaggtatttaca

SEQ ID NO: 593830 - DNA, 20 bp, Artificial
  CRISPR gRNA sequence
atttacagagatatttaaac

SEQ ID NO: 593831 - DNA, 20 bp, Artificial
  CRISPR gRNA sequence
tacccctatttttaacattt

SEQ ID NO: 593832 - DNA, 20 bp, Artificial
  CRISPR gRNA sequence
gtttcttttcaaaaaaattt

SEQ ID NO: 593833 - DNA, 20 bp, Artificial
  CRISPR gRNA sequence
agattttatctatcgataaa

SEQ ID NO: 593834 - DNA, 20 bp, Artificial
  CRISPR gRNA sequence
atcgataaacagataatgta

SEQ ID NO: 593835 - DNA, 20 bp, Artificial
  CRISPR gRNA sequence
tgtatatataatatactata

SEQ ID NO: 593836 - DNA, 20 bp, Artificial
  CRISPR gRNA sequence
ttacctctctataataacct

SEQ ID NO: 593837 - DNA, 20 bp, Artificial
  CRISPR gRNA sequence
ctaagcatttccatgtcatt

SEQ ID NO: 593838 - DNA, 20 bp, Artificial
  CRISPR gRNA sequence
gtcattaagaaattcttcaa

SEQ ID NO: 593839 - DNA, 20 bp, Artificial
  CRISPR gRNA sequence
tcttcaacagcataattttt

SEQ ID NO: 593840 - DNA, 20 bp, Artificial
  CRISPR gRNA sequence
ttttaagactatatatactt

SEQ ID NO: 593841 - DNA, 20 bp, Artificial
  CRISPR gRNA sequence
actatatatacttcagctta

SEQ ID NO: 593842 - DNA, 20 bp, Artificial
  CRISPR gRNA sequence
ggaataaccatgatttacct

SEQ ID NO: 593843 - DNA, 20 bp, Artificial
  CRISPR gRNA sequence
ttacctaagcactgtaccga

SEQ ID NO: 593844 - DNA, 20 bp, Artificial
  CRISPR gRNA sequence
aatttccaataataatactc

SEQ ID NO: 593845 - DNA, 20 bp, Artificial
  CRISPR gRNA sequence
tactccagtgtctacttttg

SEQ ID NO: 593846 - DNA, 20 bp, Artificial
  CRISPR gRNA sequence
aaatctgtctgcatttctaa

SEQ ID NO: 593847 - DNA, 20 bp, Artificial
  CRISPR gRNA sequence
aatctgtctgcatttctaac

SEQ ID NO: 593848 - DNA, 20 bp, Artificial
  CRISPR gRNA sequence
taacaggtttcttaaaattg

SEQ ID NO: 593849 - DNA, 20 bp, Artificial
  CRISPR gRNA sequence
ttcttaaaattgaagtctca

SEQ ID NO: 593850 - DNA, 20 bp, Artificial
  CRISPR gRNA sequence
ttaaaattgaagtctcaaag

SEQ ID NO: 593851 - DNA, 20 bp, Artificial
  CRISPR gRNA sequence
taaaattgaagtctcaaaga

SEQ ID NO: 593852 - DNA, 20 bp, Artificial
  CRISPR gRNA sequence
agtctcaaagaaggcattat

SEQ ID NO: 593853 - DNA, 20 bp, Artificial
  CRISPR gRNA sequence
gtctcaaagaaggcattatt

SEQ ID NO: 593854 - DNA, 20 bp, Artificial
  CRISPR gRNA sequence
agaaggcattattaggtgaa

SEQ ID NO: 593855 - DNA, 20 bp, Artificial
  CRISPR gRNA sequence
aaggcattattaggtgaaaa

SEQ ID NO: 593856 - DNA, 20 bp, Artificial
  CRISPR gRNA sequence
ggcattattaggtgaaaaga

SEQ ID NO: 593857 - DNA, 20 bp, Artificial
  CRISPR gRNA sequence
gcattattaggtgaaaagag

SEQ ID NO: 593858 - DNA, 20 bp, Artificial
  CRISPR gRNA sequence
tattaggtgaaaagagaggc

SEQ ID NO: 593859 - DNA, 20 bp, Artificial
  CRISPR gRNA sequence
agagaggcaagcgcattata

SEQ ID NO: 593860 - DNA, 20 bp, Artificial
  CRISPR gRNA sequence
ataaaactgccgtccaaaat

SEQ ID NO: 593861 - DNA, 20 bp, Artificial
  CRISPR gRNA sequence
taaaactgccgtccaaaatg

SEQ ID NO: 593862 - DNA, 20 bp, Artificial
  CRISPR gRNA sequence
gtgtcaatttaaacttgcat

SEQ ID NO: 593863 - DNA, 20 bp, Artificial
  CRISPR gRNA sequence
ttattgatgttaaacaatct

SEQ ID NO: 593864 - DNA, 20 bp, Artificial
  CRISPR gRNA sequence
ttgatgttaaacaatctcag

SEQ ID NO: 593865 - DNA, 20 bp, Artificial
  CRISPR gRNA sequence
agctttcatcatttataata

SEQ ID NO: 593866 - DNA, 20 bp, Artificial
  CRISPR gRNA sequence
ttcatcatttataatatggt

SEQ ID NO: 593867 - DNA, 20 bp, Artificial
  CRISPR gRNA sequence
ataatatggtgagtaaaaca

SEQ ID NO: 593868 - DNA, 20 bp, Artificial
  CRISPR gRNA sequence
catggtattttattatttta

SEQ ID NO: 593869 - DNA, 20 bp, Artificial
  CRISPR gRNA sequence
agtgtatttatttcattgat

SEQ ID NO: 593870 - DNA, 20 bp, Artificial
  CRISPR gRNA sequence
cgcgttaattattaattcct

SEQ ID NO: 593871 - DNA, 20 bp, Artificial
  CRISPR gRNA sequence
attaattcctgagattacaa

SEQ ID NO: 593872 - DNA, 20 bp, Artificial
  CRISPR gRNA sequence
aatttaaaatcaattattga

SEQ ID NO: 593873 - DNA, 20 bp, Artificial
  CRISPR gRNA sequence
tattattttctatattttta

SEQ ID NO: 593874 - DNA, 20 bp, Artificial
  CRISPR gRNA sequence
tttctatatttttaaagacc

SEQ ID NO: 593875 - DNA, 20 bp, Artificial
  CRISPR gRNA sequence
tctatatttttaaagaccaa

SEQ ID NO: 593876 - DNA, 20 bp, Artificial
  CRISPR gRNA sequence
gagataatacatcaaatgtg

SEQ ID NO: 593877 - DNA, 20 bp, Artificial
  CRISPR gRNA sequence
atcaaatgtgcagtaaaatc

SEQ ID NO: 593878 - DNA, 20 bp, Artificial
  CRISPR gRNA sequence
tcaaatgtgcagtaaaatca

SEQ ID NO: 593879 - DNA, 20 bp, Artificial
  CRISPR gRNA sequence
tgcagtaaaatcaaggctaa

SEQ ID NO: 593880 - DNA, 20 bp, Artificial
  CRISPR gRNA sequence
aaatcaaggctaatggcatg

SEQ ID NO: 593881 - DNA, 20 bp, Artificial
  CRISPR gRNA sequence
ctaatggcatgcagtttaat

SEQ ID NO: 593882 - DNA, 20 bp, Artificial
  CRISPR gRNA sequence
agtttaatgagataattaat

SEQ ID NO: 593883 - DNA, 20 bp, Artificial
  CRISPR gRNA sequence
aattagctttttatgctaat

SEQ ID NO: 593884 - DNA, 20 bp, Artificial
  CRISPR gRNA sequence
tttatgctaattagtacaac

SEQ ID NO: 593885 - DNA, 20 bp, Artificial
  CRISPR gRNA sequence
ttatgctaattagtacaact

SEQ ID NO: 593886 - DNA, 20 bp, Artificial
  CRISPR gRNA sequence
agtacaactgggaatcattc

SEQ ID NO: 593887 - DNA, 20 bp, Artificial
  CRISPR gRNA sequence
ggaatcattctagttaacta

SEQ ID NO: 593888 - DNA, 20 bp, Artificial
  CRISPR gRNA sequence
tgattctaaaaaatatgcaa

SEQ ID NO: 593889 - DNA, 20 bp, Artificial
  CRISPR gRNA sequence
tctaaaaaatatgcaatagt

SEQ ID NO: 593890 - DNA, 20 bp, Artificial
  CRISPR gRNA sequence
atgcaatagttggaaataat

SEQ ID NO: 593891 - DNA, 20 bp, Artificial
  CRISPR gRNA sequence
aatatttcaaaatgttttat

SEQ ID NO: 593892 - DNA, 20 bp, Artificial
  CRISPR gRNA sequence
ttagttaataatcatatcta

SEQ ID NO: 593893 - DNA, 20 bp, Artificial
  CRISPR gRNA sequence
aaataaaactcaacaccatg

SEQ ID NO: 593894 - DNA, 20 bp, Artificial
  CRISPR gRNA sequence
actcaacaccatgaagcaaa

SEQ ID NO: 593895 - DNA, 20 bp, Artificial
  CRISPR gRNA sequence
tattaccaaatatctctctc

SEQ ID NO: 593896 - DNA, 20 bp, Artificial
  CRISPR gRNA sequence
attaccaaatatctctctct

SEQ ID NO: 593897 - DNA, 20 bp, Artificial
  CRISPR gRNA sequence
actcttgatttcatatgtta

SEQ ID NO: 593898 - DNA, 20 bp, Artificial
  CRISPR gRNA sequence
atttcatatgttaaagtatt

SEQ ID NO: 593899 - DNA, 20 bp, Artificial
  CRISPR gRNA sequence
tattcagaaaccttcacatt

SEQ ID NO: 593900 - DNA, 20 bp, Artificial
  CRISPR gRNA sequence
tcacatttagcctttatgtc

SEQ ID NO: 593901 - DNA, 20 bp, Artificial
  CRISPR gRNA sequence
catttagcctttatgtccag

SEQ ID NO: 593902 - DNA, 20 bp, Artificial
  CRISPR gRNA sequence
agcctttatgtccagtagat

SEQ ID NO: 593903 - DNA, 20 bp, Artificial
  CRISPR gRNA sequence
gagttattcaaatgactttt

SEQ ID NO: 593904 - DNA, 20 bp, Artificial
  CRISPR gRNA sequence
attcaaatgacttttaagat

SEQ ID NO: 593905 - DNA, 20 bp, Artificial
  CRISPR gRNA sequence
ttaagatcagtcataccctt

SEQ ID NO: 593906 - DNA, 20 bp, Artificial
  CRISPR gRNA sequence
aacttaattaataactcttt

SEQ ID NO: 593907 - DNA, 20 bp, Artificial
  CRISPR gRNA sequence
gaactgatttcatcatatat

SEQ ID NO: 593908 - DNA, 20 bp, Artificial
  CRISPR gRNA sequence
ctgatttcatcatatataag

SEQ ID NO: 593909 - DNA, 20 bp, Artificial
  CRISPR gRNA sequence
aaattgtgactcctatatta

SEQ ID NO: 593910 - DNA, 20 bp, Artificial
  CRISPR gRNA sequence
aattgtgactcctatattac

SEQ ID NO: 593911 - DNA, 20 bp, Artificial
  CRISPR gRNA sequence
tattacgggtgattgtatca

SEQ ID NO: 593912 - DNA, 20 bp, Artificial
  CRISPR gRNA sequence
gtatcatagaacctgacaca

SEQ ID NO: 593913 - DNA, 20 bp, Artificial
  CRISPR gRNA sequence
agaacctgacacacagcaca

SEQ ID NO: 593914 - DNA, 20 bp, Artificial
  CRISPR gRNA sequence
acctgacacacagcacacgg

SEQ ID NO: 593915 - DNA, 20 bp, Artificial
  CRISPR gRNA sequence
attccctttcccctaacttc

SEQ ID NO: 593916 - DNA, 20 bp, Artificial
  CRISPR gRNA sequence
caaattttatttgtaattaa

SEQ ID NO: 593917 - DNA, 20 bp, Artificial
  CRISPR gRNA sequence
aaattttatttgtaattaaa

SEQ ID NO: 593918 - DNA, 20 bp, Artificial
  CRISPR gRNA sequence
acatccttaccttaaattaa

SEQ ID NO: 593919 - DNA, 20 bp, Artificial
  CRISPR gRNA sequence
attaatggttgaatgtaatc

SEQ ID NO: 593920 - DNA, 20 bp, Artificial
  CRISPR gRNA sequence
atggttgaatgtaatctggc

SEQ ID NO: 593921 - DNA, 20 bp, Artificial
  CRISPR gRNA sequence
tggttgaatgtaatctggca

SEQ ID NO: 593922 - DNA, 20 bp, Artificial
  CRISPR gRNA sequence
gaatgtaatctggcaaggaa

SEQ ID NO: 593923 - DNA, 20 bp, Artificial
  CRISPR gRNA sequence
tgtaatctggcaaggaacag

SEQ ID NO: 593924 - DNA, 20 bp, Artificial
  CRISPR gRNA sequence
caaggaacagaagtatatca

SEQ ID NO: 593925 - DNA, 20 bp, Artificial
  CRISPR gRNA sequence
aaggaacagaagtatatcaa

SEQ ID NO: 593926 - DNA, 20 bp, Artificial
  CRISPR gRNA sequence
ctaattctatatttttgaaa

SEQ ID NO: 593927 - DNA, 20 bp, Artificial
  CRISPR gRNA sequence
ttgaaaaagaccctataaat

SEQ ID NO: 593928 - DNA, 20 bp, Artificial
  CRISPR gRNA sequence
gaaaaagaccctataaatta

SEQ ID NO: 593929 - DNA, 20 bp, Artificial
  CRISPR gRNA sequence
aagaccctataaattagaga

SEQ ID NO: 593930 - DNA, 20 bp, Artificial
  CRISPR gRNA sequence
ttagagaaagctttttttac

SEQ ID NO: 593931 - DNA, 20 bp, Artificial
  CRISPR gRNA sequence
agagaaagctttttttacaa

SEQ ID NO: 593932 - DNA, 20 bp, Artificial
  CRISPR gRNA sequence
ttttacaagagtgattaaaa

SEQ ID NO: 593933 - DNA, 20 bp, Artificial
  CRISPR gRNA sequence
tgaattaatcaatctcaaaa

SEQ ID NO: 593934 - DNA, 20 bp, Artificial
  CRISPR gRNA sequence
aatcaatctcaaaaaagtca

SEQ ID NO: 593935 - DNA, 20 bp, Artificial
  CRISPR gRNA sequence
caatctcaaaaaagtcacag

SEQ ID NO: 593936 - DNA, 20 bp, Artificial
  CRISPR gRNA sequence
ctcaaaaaagtcacagaagt

SEQ ID NO: 593937 - DNA, 20 bp, Artificial
  CRISPR gRNA sequence
tcaaaaaagtcacagaagtt

SEQ ID NO: 593938 - DNA, 20 bp, Artificial
  CRISPR gRNA sequence
aaaagtcacagaagttaggt

SEQ ID NO: 593939 - DNA, 20 bp, Artificial
  CRISPR gRNA sequence
gtgatatcattctatatcca

SEQ ID NO: 593940 - DNA, 20 bp, Artificial
  CRISPR gRNA sequence
tcattctatatccatggctc

SEQ ID NO: 593941 - DNA, 20 bp, Artificial
  CRISPR gRNA sequence
tctagaccttcactgtgcat

SEQ ID NO: 593942 - DNA, 20 bp, Artificial
  CRISPR gRNA sequence
cactgtgcatcagaattatc

SEQ ID NO: 593943 - DNA, 20 bp, Artificial
  CRISPR gRNA sequence
actgtgcatcagaattatct

SEQ ID NO: 593944 - DNA, 20 bp, Artificial
  CRISPR gRNA sequence
ctgtgcatcagaattatctg

SEQ ID NO: 593945 - DNA, 20 bp, Artificial
  CRISPR gRNA sequence
ataaatcattatcaatgcct

SEQ ID NO: 593946 - DNA, 20 bp, Artificial
  CRISPR gRNA sequence
tacccctatttttattaaat

SEQ ID NO: 593947 - DNA, 20 bp, Artificial
  CRISPR gRNA sequence
ctatttttattaaattggta

SEQ ID NO: 593948 - DNA, 20 bp, Artificial
  CRISPR gRNA sequence
tatttttattaaattggtat

SEQ ID NO: 593949 - DNA, 20 bp, Artificial
  CRISPR gRNA sequence
tttattaaattggtatggga

SEQ ID NO: 593950 - DNA, 20 bp, Artificial
  CRISPR gRNA sequence
ttattaaattggtatgggat

SEQ ID NO: 593951 - DNA, 20 bp, Artificial
  CRISPR gRNA sequence
tattaaattggtatgggatg

SEQ ID NO: 593952 - DNA, 20 bp, Artificial
  CRISPR gRNA sequence
atgggatggggtaaaaatac

SEQ ID NO: 593953 - DNA, 20 bp, Artificial
  CRISPR gRNA sequence
cagtattttttaaacatatc

SEQ ID NO: 593954 - DNA, 20 bp, Artificial
  CRISPR gRNA sequence
atccagatgattctaatgtg

SEQ ID NO: 593955 - DNA, 20 bp, Artificial
  CRISPR gRNA sequence
atgattctaatgtgcagcca

SEQ ID NO: 593956 - DNA, 20 bp, Artificial
  CRISPR gRNA sequence
tctaatgtgcagccaaagtt

SEQ ID NO: 593957 - DNA, 20 bp, Artificial
  CRISPR gRNA sequence
gaaccaccattctacatatt

SEQ ID NO: 593958 - DNA, 20 bp, Artificial
  CRISPR gRNA sequence
ccaccattctacatattgag

SEQ ID NO: 593959 - DNA, 20 bp, Artificial
  CRISPR gRNA sequence
tattgagaagaaataaatta

SEQ ID NO: 593960 - DNA, 20 bp, Artificial
  CRISPR gRNA sequence
ttgagaagaaataaattaca

SEQ ID NO: 593961 - DNA, 20 bp, Artificial
  CRISPR gRNA sequence
agaagaaataaattacagag

SEQ ID NO: 593962 - DNA, 20 bp, Artificial
  CRISPR gRNA sequence
aagaaataaattacagagta

SEQ ID NO: 593963 - DNA, 20 bp, Artificial
  CRISPR gRNA sequence
agtagagcaactcgcaaaat

SEQ ID NO: 593964 - DNA, 20 bp, Artificial
  CRISPR gRNA sequence
agcaactcgcaaaatgagac

SEQ ID NO: 593965 - DNA, 20 bp, Artificial
  CRISPR gRNA sequence
gcaaaatgagactagaatcc

SEQ ID NO: 593966 - DNA, 20 bp, Artificial
  CRISPR gRNA sequence
agaatccaagtttccaattt

SEQ ID NO: 593967 - DNA, 20 bp, Artificial
  CRISPR gRNA sequence
gaatccaagtttccaatttt

SEQ ID NO: 593968 - DNA, 20 bp, Artificial
  CRISPR gRNA sequence
tttccaattttaggacttac

SEQ ID NO: 593969 - DNA, 20 bp, Artificial
  CRISPR gRNA sequence
cttacaagaaaatctcctcc

SEQ ID NO: 593970 - DNA, 20 bp, Artificial
  CRISPR gRNA sequence
aaatctcctcctggaatcaa

SEQ ID NO: 593971 - DNA, 20 bp, Artificial
  CRISPR gRNA sequence
atctcctcctggaatcaaaa

SEQ ID NO: 593972 - DNA, 20 bp, Artificial
  CRISPR gRNA sequence
tctcctcctggaatcaaaag

SEQ ID NO: 593973 - DNA, 20 bp, Artificial
  CRISPR gRNA sequence
aatgtacattatataatatg

SEQ ID NO: 593974 - DNA, 20 bp, Artificial
  CRISPR gRNA sequence
tgaagatatttaaacatatt

SEQ ID NO: 593975 - DNA, 20 bp, Artificial
  CRISPR gRNA sequence
gaagatatttaaacatattg

SEQ ID NO: 593976 - DNA, 20 bp, Artificial
  CRISPR gRNA sequence
aggcacccatgacatttaat

SEQ ID NO: 593977 - DNA, 20 bp, Artificial
  CRISPR gRNA sequence
ttcaaccttacacaaaatga

SEQ ID NO: 593978 - DNA, 20 bp, Artificial
  CRISPR gRNA sequence
acccttactaatgccataaa

SEQ ID NO: 593979 - DNA, 20 bp, Artificial
  CRISPR gRNA sequence
tcacaccatcttaatttcaa

SEQ ID NO: 593980 - DNA, 20 bp, Artificial
  CRISPR gRNA sequence
tttctttgcttctgaatctg

SEQ ID NO: 593981 - DNA, 20 bp, Artificial
  CRISPR gRNA sequence
aagaaaacaaaaaaatctca

SEQ ID NO: 593982 - DNA, 20 bp, Artificial
  CRISPR gRNA sequence
attactttttgccatatata

SEQ ID NO: 593983 - DNA, 20 bp, Artificial
  CRISPR gRNA sequence
tactttttgccatatataaa

SEQ ID NO: 593984 - DNA, 20 bp, Artificial
  CRISPR gRNA sequence
ttttgccatatataaagaga

SEQ ID NO: 593985 - DNA, 20 bp, Artificial
  CRISPR gRNA sequence
tgccatatataaagagaaag

SEQ ID NO: 593986 - DNA, 20 bp, Artificial
  CRISPR gRNA sequence
cttttctatacaaaaatgaa

SEQ ID NO: 593987 - DNA, 20 bp, Artificial
  CRISPR gRNA sequence
tctatacaaaaatgaacaga

SEQ ID NO: 593988 - DNA, 20 bp, Artificial
  CRISPR gRNA sequence
atacaaaaatgaacagacag

SEQ ID NO: 593989 - DNA, 20 bp, Artificial
  CRISPR gRNA sequence
tacaaaaatgaacagacagc

SEQ ID NO: 593990 - DNA, 20 bp, Artificial
  CRISPR gRNA sequence
acagcaggaaaaaaaatata

SEQ ID NO: 593991 - DNA, 20 bp, Artificial
  CRISPR gRNA sequence
cagcaggaaaaaaaatatat

SEQ ID NO: 593992 - DNA, 20 bp, Artificial
  CRISPR gRNA sequence
ggaaaaaaaatatataggaa

SEQ ID NO: 593993 - DNA, 20 bp, Artificial
  CRISPR gRNA sequence
taggaatagaatcaccgcct

SEQ ID NO: 593994 - DNA, 20 bp, Artificial
  CRISPR gRNA sequence
aggaatagaatcaccgcctt

SEQ ID NO: 593995 - DNA, 20 bp, Artificial
  CRISPR gRNA sequence
agaatcaccgccttaggtga

SEQ ID NO: 593996 - DNA, 20 bp, Artificial
  CRISPR gRNA sequence
gaatcaccgccttaggtgat

SEQ ID NO: 593997 - DNA, 20 bp, Artificial
  CRISPR gRNA sequence
tcaccgccttaggtgatggg

SEQ ID NO: 593998 - DNA, 20 bp, Artificial
  CRISPR gRNA sequence
cgccttaggtgatgggcaga

SEQ ID NO: 593999 - DNA, 20 bp, Artificial
  CRISPR gRNA sequence
tgatgggcagacagtttcca

SEQ ID NO: 594000 - DNA, 20 bp, Artificial
  CRISPR gRNA sequence
ggcagacagtttccaaagca

SEQ ID NO: 594001 - DNA, 20 bp, Artificial
  CRISPR gRNA sequence
agcattctctcactctgtcc

SEQ ID NO: 594002 - DNA, 20 bp, Artificial
  CRISPR gRNA sequence
ccggttaaaacctgtttgtc

SEQ ID NO: 594003 - DNA, 20 bp, Artificial
  CRISPR gRNA sequence
cggttaaaacctgtttgtct

SEQ ID NO: 594004 - DNA, 20 bp, Artificial
  CRISPR gRNA sequence
ggttaaaacctgtttgtctg

SEQ ID NO: 594005 - DNA, 20 bp, Artificial
  CRISPR gRNA sequence
aaacctgtttgtctggggat

SEQ ID NO: 594006 - DNA, 20 bp, Artificial
  CRISPR gRNA sequence
tgtttgtctggggattggct

SEQ ID NO: 594007 - DNA, 20 bp, Artificial
  CRISPR gRNA sequence
ggggattggctcagctgctc

SEQ ID NO: 594008 - DNA, 20 bp, Artificial
  CRISPR gRNA sequence
tggctcagctgctccagttc

SEQ ID NO: 594009 - DNA, 20 bp, Artificial
  CRISPR gRNA sequence
ctgctccagttccagcttcc

SEQ ID NO: 594010 - DNA, 20 bp, Artificial
  CRISPR gRNA sequence
ttccagcttcccggccttcc

SEQ ID NO: 594011 - DNA, 20 bp, Artificial
  CRISPR gRNA sequence
tccagcttcccggccttcca

SEQ ID NO: 594012 - DNA, 20 bp, Artificial
  CRISPR gRNA sequence
ccaaggtgctgacgtgacct

SEQ ID NO: 594013 - DNA, 20 bp, Artificial
  CRISPR gRNA sequence
gacctcagttgtcattctgc

SEQ ID NO: 594014 - DNA, 20 bp, Artificial
  CRISPR gRNA sequence
cctcagttgtcattctgctg

SEQ ID NO: 594015 - DNA, 20 bp, Artificial
  CRISPR gRNA sequence
agttgtcattctgctggagc

SEQ ID NO: 594016 - DNA, 20 bp, Artificial
  CRISPR gRNA sequence
ctaacaaaatccaacacatg

SEQ ID NO: 594017 - DNA, 20 bp, Artificial
  CRISPR gRNA sequence
taacaaaatccaacacatgc

SEQ ID NO: 594018 - DNA, 20 bp, Artificial
  CRISPR gRNA sequence
gcacttgtttctccattatc

SEQ ID NO: 594019 - DNA, 20 bp, Artificial
  CRISPR gRNA sequence
ctccattatccagtgccttc

SEQ ID NO: 594020 - DNA, 20 bp, Artificial
  CRISPR gRNA sequence
tccattatccagtgccttca

SEQ ID NO: 594021 - DNA, 20 bp, Artificial
  CRISPR gRNA sequence
ccattatccagtgccttcaa

SEQ ID NO: 594022 - DNA, 20 bp, Artificial
  CRISPR gRNA sequence
ttatccagtgccttcaaggg

SEQ ID NO: 594023 - DNA, 20 bp, Artificial
  CRISPR gRNA sequence
tccagtgccttcaagggcag

SEQ ID NO: 594024 - DNA, 20 bp, Artificial
  CRISPR gRNA sequence
cagtgccttcaagggcagca

SEQ ID NO: 594025 - DNA, 20 bp, Artificial
  CRISPR gRNA sequence
cttcaagggcagcagagaat

SEQ ID NO: 594026 - DNA, 20 bp, Artificial
  CRISPR gRNA sequence
ttcaagggcagcagagaatc

SEQ ID NO: 594027 - DNA, 20 bp, Artificial
  CRISPR gRNA sequence
tcaagggcagcagagaatca

SEQ ID NO: 594028 - DNA, 20 bp, Artificial
  CRISPR gRNA sequence
aagggcagcagagaatcagg

SEQ ID NO: 594029 - DNA, 20 bp, Artificial
  CRISPR gRNA sequence
gcagcagagaatcagggagt

SEQ ID NO: 594030 - DNA, 20 bp, Artificial
  CRISPR gRNA sequence
tcttctaatcttgcccttga

SEQ ID NO: 594031 - DNA, 20 bp, Artificial
  CRISPR gRNA sequence
caatccttaaacactgtgca

SEQ ID NO: 594032 - DNA, 20 bp, Artificial
  CRISPR gRNA sequence
aatccttaaacactgtgcaa

SEQ ID NO: 594033 - DNA, 20 bp, Artificial
  CRISPR gRNA sequence
aaacactgtgcaaaggttat

SEQ ID NO: 594034 - DNA, 20 bp, Artificial
  CRISPR gRNA sequence
aacactgtgcaaaggttatt

SEQ ID NO: 594035 - DNA, 20 bp, Artificial
  CRISPR gRNA sequence
actgtgcaaaggttattagg

SEQ ID NO: 594036 - DNA, 20 bp, Artificial
  CRISPR gRNA sequence
ggcagatgaacatcaatgat

SEQ ID NO: 594037 - DNA, 20 bp, Artificial
  CRISPR gRNA sequence
atcaatgatcagcaatcaaa

SEQ ID NO: 594038 - DNA, 20 bp, Artificial
  CRISPR gRNA sequence
gcaatcaaatggaccaaatg

SEQ ID NO: 594039 - DNA, 20 bp, Artificial
  CRISPR gRNA sequence
atggaccaaatgaagaaaac

SEQ ID NO: 594040 - DNA, 20 bp, Artificial
  CRISPR gRNA sequence
ataaaaattcaattaaatat

SEQ ID NO: 594041 - DNA, 20 bp, Artificial
  CRISPR gRNA sequence
aaattcaattaaatattagc

SEQ ID NO: 594042 - DNA, 20 bp, Artificial
  CRISPR gRNA sequence
aatattagctagttgattta

SEQ ID NO: 594043 - DNA, 20 bp, Artificial
  CRISPR gRNA sequence
agttgatttacagaatttta

SEQ ID NO: 594044 - DNA, 20 bp, Artificial
  CRISPR gRNA sequence
tgatttacagaattttacag

SEQ ID NO: 594045 - DNA, 20 bp, Artificial
  CRISPR gRNA sequence
gatttacagaattttacaga

SEQ ID NO: 594046 - DNA, 20 bp, Artificial
  CRISPR gRNA sequence
atttacagaattttacagaa

SEQ ID NO: 594047 - DNA, 20 bp, Artificial
  CRISPR gRNA sequence
tacagaattttacagaaggg

SEQ ID NO: 594048 - DNA, 20 bp, Artificial
  CRISPR gRNA sequence
ttttacagaagggaagcatc

SEQ ID NO: 594049 - DNA, 20 bp, Artificial
  CRISPR gRNA sequence
agggaagcatctagtaaact

SEQ ID NO: 594050 - DNA, 20 bp, Artificial
  CRISPR gRNA sequence
agtttattcatatactgatg

SEQ ID NO: 594051 - DNA, 20 bp, Artificial
  CRISPR gRNA sequence
catatactgatgaagatctg

SEQ ID NO: 594052 - DNA, 20 bp, Artificial
  CRISPR gRNA sequence
atatactgatgaagatctga

SEQ ID NO: 594053 - DNA, 20 bp, Artificial
  CRISPR gRNA sequence
tgatgaagatctgaaggctt

SEQ ID NO: 594054 - DNA, 20 bp, Artificial
  CRISPR gRNA sequence
aagatctgaaggctttagtt

SEQ ID NO: 594055 - DNA, 20 bp, Artificial
  CRISPR gRNA sequence
agatctgaaggctttagttg

SEQ ID NO: 594056 - DNA, 20 bp, Artificial
  CRISPR gRNA sequence
tctgaaggctttagttgagg

SEQ ID NO: 594057 - DNA, 20 bp, Artificial
  CRISPR gRNA sequence
ttgaggaagctacatgacaa

SEQ ID NO: 594058 - DNA, 20 bp, Artificial
  CRISPR gRNA sequence
ggaagctacatgacaaaagt

SEQ ID NO: 594059 - DNA, 20 bp, Artificial
  CRISPR gRNA sequence
ccatcctcctttcttttata

SEQ ID NO: 594060 - DNA, 20 bp, Artificial
  CRISPR gRNA sequence
ttcttttataaagataactg

SEQ ID NO: 594061 - DNA, 20 bp, Artificial
  CRISPR gRNA sequence
cttttataaagataactgaa

SEQ ID NO: 594062 - DNA, 20 bp, Artificial
  CRISPR gRNA sequence
aaagataactgaagagattg

SEQ ID NO: 594063 - DNA, 20 bp, Artificial
  CRISPR gRNA sequence
aagataactgaagagattga

SEQ ID NO: 594064 - DNA, 20 bp, Artificial
  CRISPR gRNA sequence
aatattgtaaatattactgt

SEQ ID NO: 594065 - DNA, 20 bp, Artificial
  CRISPR gRNA sequence
attatatacatgattcctga

SEQ ID NO: 594066 - DNA, 20 bp, Artificial
  CRISPR gRNA sequence
atacatgattcctgaaagtt

SEQ ID NO: 594067 - DNA, 20 bp, Artificial
  CRISPR gRNA sequence
tgagtatctatgtacatatg

SEQ ID NO: 594068 - DNA, 20 bp, Artificial
  CRISPR gRNA sequence
agtatctatgtacatatgaa

SEQ ID NO: 594069 - DNA, 20 bp, Artificial
  CRISPR gRNA sequence
atctatgtacatatgaagag

SEQ ID NO: 594070 - DNA, 20 bp, Artificial
  CRISPR gRNA sequence
ctatgtacatatgaagagta

SEQ ID NO: 594071 - DNA, 20 bp, Artificial
  CRISPR gRNA sequence
atgtacatatgaagagtaga

SEQ ID NO: 594072 - DNA, 20 bp, Artificial
  CRISPR gRNA sequence
tctcatctgctttttttgaa

SEQ ID NO: 594073 - DNA, 20 bp, Artificial
  CRISPR gRNA sequence
ctcatctgctttttttgaaa

SEQ ID NO: 594074 - DNA, 20 bp, Artificial
  CRISPR gRNA sequence
tcatctgctttttttgaaaa

SEQ ID NO: 594075 - DNA, 20 bp, Artificial
  CRISPR gRNA sequence
gaaaagggattctttcttat

SEQ ID NO: 594076 - DNA, 20 bp, Artificial
  CRISPR gRNA sequence
tctttcttataagctgtatc

SEQ ID NO: 594077 - DNA, 20 bp, Artificial
  CRISPR gRNA sequence
ttgtgatcatcaacaatttg

SEQ ID NO: 594078 - DNA, 20 bp, Artificial
  CRISPR gRNA sequence
tcatcaacaatttgtagtaa

SEQ ID NO: 594079 - DNA, 20 bp, Artificial
  CRISPR gRNA sequence
aatttgtagtaacagactct

SEQ ID NO: 594080 - DNA, 20 bp, Artificial
  CRISPR gRNA sequence
tagtaacagactctgagatc

SEQ ID NO: 594081 - DNA, 20 bp, Artificial
  CRISPR gRNA sequence
gtaacagactctgagatcaa

SEQ ID NO: 594082 - DNA, 20 bp, Artificial
  CRISPR gRNA sequence
caagagcaacgtacgtgatg

SEQ ID NO: 594083 - DNA, 20 bp, Artificial
  CRISPR gRNA sequence
tcttactccctataccaact

SEQ ID NO: 594084 - DNA, 20 bp, Artificial
  CRISPR gRNA sequence
cctataccaactcagcactg

SEQ ID NO: 594085 - DNA, 20 bp, Artificial
  CRISPR gRNA sequence
cactgaagatttgcatgctt

SEQ ID NO: 594086 - DNA, 20 bp, Artificial
  CRISPR gRNA sequence
atgcttgagctttcctcttc

SEQ ID NO: 594087 - DNA, 20 bp, Artificial
  CRISPR gRNA sequence
tctaaataattcctcatata

SEQ ID NO: 594088 - DNA, 20 bp, Artificial
  CRISPR gRNA sequence
ataattcctcatatacagca

SEQ ID NO: 594089 - DNA, 20 bp, Artificial
  CRISPR gRNA sequence
ctcatatacagcatggtaca

SEQ ID NO: 594090 - DNA, 20 bp, Artificial
  CRISPR gRNA sequence
tggtacacagctttacctac

SEQ ID NO: 594091 - DNA, 20 bp, Artificial
  CRISPR gRNA sequence
acaaaacaacattctttacc

SEQ ID NO: 594092 - DNA, 20 bp, Artificial
  CRISPR gRNA sequence
gttattacctcctcatttaa

SEQ ID NO: 594093 - DNA, 20 bp, Artificial
  CRISPR gRNA sequence
catttaaaagaaaaaacgtg

SEQ ID NO: 594094 - DNA, 20 bp, Artificial
  CRISPR gRNA sequence
aaagaaaaaacgtgaagcac

SEQ ID NO: 594095 - DNA, 20 bp, Artificial
  CRISPR gRNA sequence
tgtaatcatattatgaacaa

SEQ ID NO: 594096 - DNA, 20 bp, Artificial
  CRISPR gRNA sequence
acaaaagcatgttttaatgt

SEQ ID NO: 594097 - DNA, 20 bp, Artificial
  CRISPR gRNA sequence
tgttttaatgttagcttttt

SEQ ID NO: 594098 - DNA, 20 bp, Artificial
  CRISPR gRNA sequence
ttaatgttagcttttttagt

SEQ ID NO: 594099 - DNA, 20 bp, Artificial
  CRISPR gRNA sequence
gttagcttttttagttagct

SEQ ID NO: 594100 - DNA, 20 bp, Artificial
  CRISPR gRNA sequence
ttagttagctcagtgaccat

SEQ ID NO: 594101 - DNA, 20 bp, Artificial
  CRISPR gRNA sequence
tttttaacctctctgaccct

SEQ ID NO: 594102 - DNA, 20 bp, Artificial
  CRISPR gRNA sequence
aacctctctgacccttagct

SEQ ID NO: 594103 - DNA, 20 bp, Artificial
  CRISPR gRNA sequence
tagctcggcatctctaaaat

SEQ ID NO: 594104 - DNA, 20 bp, Artificial
  CRISPR gRNA sequence
agctcggcatctctaaaatg

SEQ ID NO: 594105 - DNA, 20 bp, Artificial
  CRISPR gRNA sequence
gctcggcatctctaaaatga

SEQ ID NO: 594106 - DNA, 20 bp, Artificial
  CRISPR gRNA sequence
atctctaaaatgagggtaat

SEQ ID NO: 594107 - DNA, 20 bp, Artificial
  CRISPR gRNA sequence
tctctaaaatgagggtaata

SEQ ID NO: 594108 - DNA, 20 bp, Artificial
  CRISPR gRNA sequence
aacctatcccgttgtgcttt

SEQ ID NO: 594109 - DNA, 20 bp, Artificial
  CRISPR gRNA sequence
cctatcccgttgtgctttta

SEQ ID NO: 594110 - DNA, 20 bp, Artificial
  CRISPR gRNA sequence
ctatcccgttgtgcttttag

SEQ ID NO: 594111 - DNA, 20 bp, Artificial
  CRISPR gRNA sequence
gtgcttttagaggattaaat

SEQ ID NO: 594112 - DNA, 20 bp, Artificial
  CRISPR gRNA sequence
tagaggattaaataagataa

SEQ ID NO: 594113 - DNA, 20 bp, Artificial
  CRISPR gRNA sequence
gacaccctattgcacattgt

SEQ ID NO: 594114 - DNA, 20 bp, Artificial
  CRISPR gRNA sequence
acattgtaagcacttaatga

SEQ ID NO: 594115 - DNA, 20 bp, Artificial
  CRISPR gRNA sequence
cacttaatgatagttattac

SEQ ID NO: 594116 - DNA, 20 bp, Artificial
  CRISPR gRNA sequence
acttaatgatagttattact

SEQ ID NO: 594117 - DNA, 20 bp, Artificial
  CRISPR gRNA sequence
atagttattactaggtatat

SEQ ID NO: 594118 - DNA, 20 bp, Artificial
  CRISPR gRNA sequence
tattactaggtatatgagta

SEQ ID NO: 594119 - DNA, 20 bp, Artificial
  CRISPR gRNA sequence
attactaggtatatgagtaa

SEQ ID NO: 594120 - DNA, 20 bp, Artificial
  CRISPR gRNA sequence
gagtaaaggctctactgctt

SEQ ID NO: 594121 - DNA, 20 bp, Artificial
  CRISPR gRNA sequence
ctactgctttagattcatta

SEQ ID NO: 594122 - DNA, 20 bp, Artificial
  CRISPR gRNA sequence
ctttagattcattaaagaat

SEQ ID NO: 594123 - DNA, 20 bp, Artificial
  CRISPR gRNA sequence
attggctttcattttcattt

SEQ ID NO: 594124 - DNA, 20 bp, Artificial
  CRISPR gRNA sequence
attactttataaaaatcata

SEQ ID NO: 594125 - DNA, 20 bp, Artificial
  CRISPR gRNA sequence
aatcatatggttatccacat

SEQ ID NO: 594126 - DNA, 20 bp, Artificial
  CRISPR gRNA sequence
tccacataagttactaatat

SEQ ID NO: 594127 - DNA, 20 bp, Artificial
  CRISPR gRNA sequence
acataagttactaatataag

SEQ ID NO: 594128 - DNA, 20 bp, Artificial
  CRISPR gRNA sequence
cataagttactaatataagt

SEQ ID NO: 594129 - DNA, 20 bp, Artificial
  CRISPR gRNA sequence
tatgtttatattttaatgta

SEQ ID NO: 594130 - DNA, 20 bp, Artificial
  CRISPR gRNA sequence
tattttaatgtatggcattt

SEQ ID NO: 594131 - DNA, 20 bp, Artificial
  CRISPR gRNA sequence
catttaagctaactgacact

SEQ ID NO: 594132 - DNA, 20 bp, Artificial
  CRISPR gRNA sequence
gctaactgacactaagcaca

SEQ ID NO: 594133 - DNA, 20 bp, Artificial
  CRISPR gRNA sequence
aactcttctaatgtcatcta

SEQ ID NO: 594134 - DNA, 20 bp, Artificial
  CRISPR gRNA sequence
tcaaatgaaatatccttctg

SEQ ID NO: 594135 - DNA, 20 bp, Artificial
  CRISPR gRNA sequence
caaatgaaatatccttctgt

SEQ ID NO: 594136 - DNA, 20 bp, Artificial
  CRISPR gRNA sequence
atgaaatatccttctgtggg

SEQ ID NO: 594137 - DNA, 20 bp, Artificial
  CRISPR gRNA sequence
tgaaatatccttctgtggga

SEQ ID NO: 594138 - DNA, 20 bp, Artificial
  CRISPR gRNA sequence
cttctgtgggaaggaccaat

SEQ ID NO: 594139 - DNA, 20 bp, Artificial
  CRISPR gRNA sequence
ttcatcacatttgtataatc

SEQ ID NO: 594140 - DNA, 20 bp, Artificial
  CRISPR gRNA sequence
atttgacaaaaacaaaatac

SEQ ID NO: 594141 - DNA, 20 bp, Artificial
  CRISPR gRNA sequence
tttattactctatcaaactt

SEQ ID NO: 594142 - DNA, 20 bp, Artificial
  CRISPR gRNA sequence
actctatcaaactttggtga

SEQ ID NO: 594143 - DNA, 20 bp, Artificial
  CRISPR gRNA sequence
caaactttggtgacagtttt

SEQ ID NO: 594144 - DNA, 20 bp, Artificial
  CRISPR gRNA sequence
caacttctatatttaatttc

SEQ ID NO: 594145 - DNA, 20 bp, Artificial
  CRISPR gRNA sequence
aacttctatatttaatttca

SEQ ID NO: 594146 - DNA, 20 bp, Artificial
  CRISPR gRNA sequence
ttctatatttaatttcaagg

SEQ ID NO: 594147 - DNA, 20 bp, Artificial
  CRISPR gRNA sequence
tatttaatttcaaggcagac

SEQ ID NO: 594148 - DNA, 20 bp, Artificial
  CRISPR gRNA sequence
gactggtaacaaatgctttc

SEQ ID NO: 594149 - DNA, 20 bp, Artificial
  CRISPR gRNA sequence
aacaaatgctttccagccta

SEQ ID NO: 594150 - DNA, 20 bp, Artificial
  CRISPR gRNA sequence
cagcctacagactgcatatt

SEQ ID NO: 594151 - DNA, 20 bp, Artificial
  CRISPR gRNA sequence
cctacagactgcatattaag

SEQ ID NO: 594152 - DNA, 20 bp, Artificial
  CRISPR gRNA sequence
ctacagactgcatattaagt

SEQ ID NO: 594153 - DNA, 20 bp, Artificial
  CRISPR gRNA sequence
tattaagtaggactactata

SEQ ID NO: 594154 - DNA, 20 bp, Artificial
  CRISPR gRNA sequence
tataaagaatacttgatttt

SEQ ID NO: 594155 - DNA, 20 bp, Artificial
  CRISPR gRNA sequence
atacttgattttaagaatga

SEQ ID NO: 594156 - DNA, 20 bp, Artificial
  CRISPR gRNA sequence
aaactaaaaatccttattaa

SEQ ID NO: 594157 - DNA, 20 bp, Artificial
  CRISPR gRNA sequence
acatgaatctcaattcaaac

SEQ ID NO: 594158 - DNA, 20 bp, Artificial
  CRISPR gRNA sequence
catgaatctcaattcaaact

SEQ ID NO: 594159 - DNA, 20 bp, Artificial
  CRISPR gRNA sequence
taggtatgaattttaaaaaa

SEQ ID NO: 594160 - DNA, 20 bp, Artificial
  CRISPR gRNA sequence
gtaaaattgccaaaatacca

SEQ ID NO: 594161 - DNA, 20 bp, Artificial
  CRISPR gRNA sequence
taaaattgccaaaataccat

SEQ ID NO: 594162 - DNA, 20 bp, Artificial
  CRISPR gRNA sequence
aaaattgccaaaataccata

SEQ ID NO: 594163 - DNA, 20 bp, Artificial
  CRISPR gRNA sequence
aaattgccaaaataccatag

SEQ ID NO: 594164 - DNA, 20 bp, Artificial
  CRISPR gRNA sequence
aaaataccataggggcccct

SEQ ID NO: 594165 - DNA, 20 bp, Artificial
  CRISPR gRNA sequence
ccataggggccccttggtga

SEQ ID NO: 594166 - DNA, 20 bp, Artificial
  CRISPR gRNA sequence
tatttaacatactgtcttaa

SEQ ID NO: 594167 - DNA, 20 bp, Artificial
  CRISPR gRNA sequence
atttaacatactgtcttaaa

SEQ ID NO: 594168 - DNA, 20 bp, Artificial
  CRISPR gRNA sequence
tcttaaaaggctatttaata

SEQ ID NO: 594169 - DNA, 20 bp, Artificial
  CRISPR gRNA sequence
cttaatgttgatctaataca

SEQ ID NO: 594170 - DNA, 20 bp, Artificial
  CRISPR gRNA sequence
tacaaagcattaccgtgcaa

SEQ ID NO: 594171 - DNA, 20 bp, Artificial
  CRISPR gRNA sequence
aactatgaaaaacaaccaat

SEQ ID NO: 594172 - DNA, 20 bp, Artificial
  CRISPR gRNA sequence
ctatgaaaaacaaccaataa

SEQ ID NO: 594173 - DNA, 20 bp, Artificial
  CRISPR gRNA sequence
aaccaataagagtaacctta

SEQ ID NO: 594174 - DNA, 20 bp, Artificial
  CRISPR gRNA sequence
accaataagagtaaccttac

SEQ ID NO: 594175 - DNA, 20 bp, Artificial
  CRISPR gRNA sequence
ggtttacacttaaatttttt

SEQ ID NO: 594176 - DNA, 20 bp, Artificial
  CRISPR gRNA sequence
gtttacacttaaatttttta

SEQ ID NO: 594177 - DNA, 20 bp, Artificial
  CRISPR gRNA sequence
tacacttaaattttttaagg

SEQ ID NO: 594178 - DNA, 20 bp, Artificial
  CRISPR gRNA sequence
taatctaactacaatatact

SEQ ID NO: 594179 - DNA, 20 bp, Artificial
  CRISPR gRNA sequence
aatctaactacaatatactt

SEQ ID NO: 594180 - DNA, 20 bp, Artificial
  CRISPR gRNA sequence
acaatatacttaggaatact

SEQ ID NO: 594181 - DNA, 20 bp, Artificial
  CRISPR gRNA sequence
ggaatacttggcaacattaa

SEQ ID NO: 594182 - DNA, 20 bp, Artificial
  CRISPR gRNA sequence
ggcaacattaacagtacctg

SEQ ID NO: 594183 - DNA, 20 bp, Artificial
  CRISPR gRNA sequence
aacagtacctgtggctactc

SEQ ID NO: 594184 - DNA, 20 bp, Artificial
  CRISPR gRNA sequence
acagtacctgtggctactct

SEQ ID NO: 594185 - DNA, 20 bp, Artificial
  CRISPR gRNA sequence
gtacctgtggctactctagg

SEQ ID NO: 594186 - DNA, 20 bp, Artificial
  CRISPR gRNA sequence
ctaggtagtatttcttttta

SEQ ID NO: 594187 - DNA, 20 bp, Artificial
  CRISPR gRNA sequence
taggtagtatttctttttaa

SEQ ID NO: 594188 - DNA, 20 bp, Artificial
  CRISPR gRNA sequence
tagtatttctttttaaaggc

SEQ ID NO: 594189 - DNA, 20 bp, Artificial
  CRISPR gRNA sequence
agtatttctttttaaaggcc

SEQ ID NO: 594190 - DNA, 20 bp, Artificial
  CRISPR gRNA sequence
aaaggccaggtacttgtata

SEQ ID NO: 594191 - DNA, 20 bp, Artificial
  CRISPR gRNA sequence
aggccaggtacttgtataaa

SEQ ID NO: 594192 - DNA, 20 bp, Artificial
  CRISPR gRNA sequence
ccaggtacttgtataaagag

SEQ ID NO: 594193 - DNA, 20 bp, Artificial
  CRISPR gRNA sequence
caataatatattaaaatgtt

SEQ ID NO: 594194 - DNA, 20 bp, Artificial
  CRISPR gRNA sequence
ttagcttgttgtttttctta

SEQ ID NO: 594195 - DNA, 20 bp, Artificial
  CRISPR gRNA sequence
ttgttgtttttcttacagaa

SEQ ID NO: 594196 - DNA, 20 bp, Artificial
  CRISPR gRNA sequence
acagaacagataatactttc

SEQ ID NO: 594197 - DNA, 20 bp, Artificial
  CRISPR gRNA sequence
cagaacagataatactttct

SEQ ID NO: 594198 - DNA, 20 bp, Artificial
  CRISPR gRNA sequence
tttctaggtatttgcttttc

SEQ ID NO: 594199 - DNA, 20 bp, Artificial
  CRISPR gRNA sequence
atttcaacgtaatgttttgt

SEQ ID NO: 594200 - DNA, 20 bp, Artificial
  CRISPR gRNA sequence
acgtaatgttttgtcagttt

SEQ ID NO: 594201 - DNA, 20 bp, Artificial
  CRISPR gRNA sequence
cataatgaaaattaataata

SEQ ID NO: 594202 - DNA, 20 bp, Artificial
  CRISPR gRNA sequence
taatacagatcctacctaca

SEQ ID NO: 594203 - DNA, 20 bp, Artificial
  CRISPR gRNA sequence
ctacacggttgaaccctact

SEQ ID NO: 594204 - DNA, 20 bp, Artificial
  CRISPR gRNA sequence
tacacggttgaaccctactt

SEQ ID NO: 594205 - DNA, 20 bp, Artificial
  CRISPR gRNA sequence
gaaccctacttgggctgcca

SEQ ID NO: 594206 - DNA, 20 bp, Artificial
  CRISPR gRNA sequence
ccctacttgggctgccatgg

SEQ ID NO: 594207 - DNA, 20 bp, Artificial
  CRISPR gRNA sequence
acttgggctgccatggtaga

SEQ ID NO: 594208 - DNA, 20 bp, Artificial
  CRISPR gRNA sequence
ttgggctgccatggtagaaa

SEQ ID NO: 594209 - DNA, 20 bp, Artificial
  CRISPR gRNA sequence
gggctgccatggtagaaaga

SEQ ID NO: 594210 - DNA, 20 bp, Artificial
  CRISPR gRNA sequence
gctgccatggtagaaagaga

SEQ ID NO: 594211 - DNA, 20 bp, Artificial
  CRISPR gRNA sequence
tgccatggtagaaagagaga

SEQ ID NO: 594212 - DNA, 20 bp, Artificial
  CRISPR gRNA sequence
atggtagaaagagagagaga

SEQ ID NO: 594213 - DNA, 20 bp, Artificial
  CRISPR gRNA sequence
tagaaagagagagagaaaga

SEQ ID NO: 594214 - DNA, 20 bp, Artificial
  CRISPR gRNA sequence
gaaagagagagagaaagaaa

SEQ ID NO: 594215 - DNA, 20 bp, Artificial
  CRISPR gRNA sequence
aagagagagagaaagaaaga

SEQ ID NO: 594216 - DNA, 20 bp, Artificial
  CRISPR gRNA sequence
gagagagagaaagaaagaga

SEQ ID NO: 594217 - DNA, 20 bp, Artificial
  CRISPR gRNA sequence
gagagagaaagaaagagaga

SEQ ID NO: 594218 - DNA, 20 bp, Artificial
  CRISPR gRNA sequence
gagagaaagaaagagagaga

SEQ ID NO: 594219 - DNA, 20 bp, Artificial
  CRISPR gRNA sequence
gagaaagaaagagagagaga

SEQ ID NO: 594220 - DNA, 20 bp, Artificial
  CRISPR gRNA sequence
aaagaaagagagagagagag

SEQ ID NO: 594221 - DNA, 20 bp, Artificial
  CRISPR gRNA sequence
agaaagagagagagagagaa

SEQ ID NO: 594222 - DNA, 20 bp, Artificial
  CRISPR gRNA sequence
cctattttccctatacctat

SEQ ID NO: 594223 - DNA, 20 bp, Artificial
  CRISPR gRNA sequence
ctattttccctatacctatg

SEQ ID NO: 594224 - DNA, 20 bp, Artificial
  CRISPR gRNA sequence
atattacaatgaaacaaaat

SEQ ID NO: 594225 - DNA, 20 bp, Artificial
  CRISPR gRNA sequence
tacaatgaaacaaaatgaga

SEQ ID NO: 594226 - DNA, 20 bp, Artificial
  CRISPR gRNA sequence
atgaaacaaaatgagatgga

SEQ ID NO: 594227 - DNA, 20 bp, Artificial
  CRISPR gRNA sequence
atgtctataatgttaaaatt

SEQ ID NO: 594228 - DNA, 20 bp, Artificial
  CRISPR gRNA sequence
aatgttaaaatttggtttat

SEQ ID NO: 594229 - DNA, 20 bp, Artificial
  CRISPR gRNA sequence
taaattacttcatatctttc

SEQ ID NO: 594230 - DNA, 20 bp, Artificial
  CRISPR gRNA sequence
gcctgctttaaaaaaaatct

SEQ ID NO: 594231 - DNA, 20 bp, Artificial
  CRISPR gRNA sequence
aaccataaaaatgttttcat

SEQ ID NO: 594232 - DNA, 20 bp, Artificial
  CRISPR gRNA sequence
ttcattagttatttaaacac

SEQ ID NO: 594233 - DNA, 20 bp, Artificial
  CRISPR gRNA sequence
tagttatttaaacactagaa

SEQ ID NO: 594234 - DNA, 20 bp, Artificial
  CRISPR gRNA sequence
agttatttaaacactagaat

SEQ ID NO: 594235 - DNA, 20 bp, Artificial
  CRISPR gRNA sequence
tatttaaacactagaatagg

SEQ ID NO: 594236 - DNA, 20 bp, Artificial
  CRISPR gRNA sequence
cactagaataggtagtgact

SEQ ID NO: 594237 - DNA, 20 bp, Artificial
  CRISPR gRNA sequence
ataggtagtgactaagattt

SEQ ID NO: 594238 - DNA, 20 bp, Artificial
  CRISPR gRNA sequence
ggtagtgactaagatttgag

SEQ ID NO: 594239 - DNA, 20 bp, Artificial
  CRISPR gRNA sequence
agtgactaagatttgagaag

SEQ ID NO: 594240 - DNA, 20 bp, Artificial
  CRISPR gRNA sequence
ctaagatttgagaagaagat

SEQ ID NO: 594241 - DNA, 20 bp, Artificial
  CRISPR gRNA sequence
aagatttgagaagaagatga

SEQ ID NO: 594242 - DNA, 20 bp, Artificial
  CRISPR gRNA sequence
agatttgagaagaagatgag

SEQ ID NO: 594243 - DNA, 20 bp, Artificial
  CRISPR gRNA sequence
tttgagaagaagatgagagg

SEQ ID NO: 594244 - DNA, 20 bp, Artificial
  CRISPR gRNA sequence
gatgagaggcagtctctaac

SEQ ID NO: 594245 - DNA, 20 bp, Artificial
  CRISPR gRNA sequence
tactcattatttctccaacc

SEQ ID NO: 594246 - DNA, 20 bp, Artificial
  CRISPR gRNA sequence
ggaaaaactttttcttcttt

SEQ ID NO: 594247 - DNA, 20 bp, Artificial
  CRISPR gRNA sequence
aaaaactttttcttctttca

SEQ ID NO: 594248 - DNA, 20 bp, Artificial
  CRISPR gRNA sequence
aaaactttttcttctttcag

SEQ ID NO: 594249 - DNA, 20 bp, Artificial
  CRISPR gRNA sequence
tctttcagaggtcaaattaa

SEQ ID NO: 594250 - DNA, 20 bp, Artificial
  CRISPR gRNA sequence
attaaaagtacctttaccta

SEQ ID NO: 594251 - DNA, 20 bp, Artificial
  CRISPR gRNA sequence
tacctttacctatggttatc

SEQ ID NO: 594252 - DNA, 20 bp, Artificial
  CRISPR gRNA sequence
ttacctatggttatccagaa

SEQ ID NO: 594253 - DNA, 20 bp, Artificial
  CRISPR gRNA sequence
tacctatggttatccagaaa

SEQ ID NO: 594254 - DNA, 20 bp, Artificial
  CRISPR gRNA sequence
tggttatccagaaaaggaat

SEQ ID NO: 594255 - DNA, 20 bp, Artificial
  CRISPR gRNA sequence
tccagaaaaggaatgagaat

SEQ ID NO: 594256 - DNA, 20 bp, Artificial
  CRISPR gRNA sequence
aaaaggaatgagaattagaa

SEQ ID NO: 594257 - DNA, 20 bp, Artificial
  CRISPR gRNA sequence
tagaatagatacgttcactg

SEQ ID NO: 594258 - DNA, 20 bp, Artificial
  CRISPR gRNA sequence
cgttcactgtagtctgccta

SEQ ID NO: 594259 - DNA, 20 bp, Artificial
  CRISPR gRNA sequence
agtctgcctaaagaaaacac

SEQ ID NO: 594260 - DNA, 20 bp, Artificial
  CRISPR gRNA sequence
gtctgcctaaagaaaacact

SEQ ID NO: 594261 - DNA, 20 bp, Artificial
  CRISPR gRNA sequence
gcctaaagaaaacactagga

SEQ ID NO: 594262 - DNA, 20 bp, Artificial
  CRISPR gRNA sequence
ccttcacattgatgtttttc

SEQ ID NO: 594263 - DNA, 20 bp, Artificial
  CRISPR gRNA sequence
aactgacactacctactatt

SEQ ID NO: 594264 - DNA, 20 bp, Artificial
  CRISPR gRNA sequence
cctactattaagataattct

SEQ ID NO: 594265 - DNA, 20 bp, Artificial
  CRISPR gRNA sequence
tgagattacaaaaaaaaaat

SEQ ID NO: 594266 - DNA, 20 bp, Artificial
  CRISPR gRNA sequence
aaaaaaaattagttcaaatg

SEQ ID NO: 594267 - DNA, 20 bp, Artificial
  CRISPR gRNA sequence
aaaaaaattagttcaaatga

SEQ ID NO: 594268 - DNA, 20 bp, Artificial
  CRISPR gRNA sequence
aaatgaaggaaatccttacc

SEQ ID NO: 594269 - DNA, 20 bp, Artificial
  CRISPR gRNA sequence
aatgaaggaaatccttacct

SEQ ID NO: 594270 - DNA, 20 bp, Artificial
  CRISPR gRNA sequence
aaattaaatttaattttaaa

SEQ ID NO: 594271 - DNA, 20 bp, Artificial
  CRISPR gRNA sequence
taaaaatgtttatgtccaca

SEQ ID NO: 594272 - DNA, 20 bp, Artificial
  CRISPR gRNA sequence
aaaaatgtttatgtccacaa

SEQ ID NO: 594273 - DNA, 20 bp, Artificial
  CRISPR gRNA sequence
atgtttatgtccacaaagga

SEQ ID NO: 594274 - DNA, 20 bp, Artificial
  CRISPR gRNA sequence
ccctaacgtcttataacaat

SEQ ID NO: 594275 - DNA, 20 bp, Artificial
  CRISPR gRNA sequence
cagctatcaaatgaataatc

SEQ ID NO: 594276 - DNA, 20 bp, Artificial
  CRISPR gRNA sequence
aatgaataatccagcacctt

SEQ ID NO: 594277 - DNA, 20 bp, Artificial
  CRISPR gRNA sequence
tgaataatccagcaccttaa

SEQ ID NO: 594278 - DNA, 20 bp, Artificial
  CRISPR gRNA sequence
accttaagagtatttttaat

SEQ ID NO: 594279 - DNA, 20 bp, Artificial
  CRISPR gRNA sequence
attccatcatacatgaaata

SEQ ID NO: 594280 - DNA, 20 bp, Artificial
  CRISPR gRNA sequence
atcatacatgaaatatagta

SEQ ID NO: 594281 - DNA, 20 bp, Artificial
  CRISPR gRNA sequence
agtacagcttgttccatgtt

SEQ ID NO: 594282 - DNA, 20 bp, Artificial
  CRISPR gRNA sequence
gcttgttccatgtttggtcc

SEQ ID NO: 594283 - DNA, 20 bp, Artificial
  CRISPR gRNA sequence
ttggtccaagatgctaatga

SEQ ID NO: 594284 - DNA, 20 bp, Artificial
  CRISPR gRNA sequence
gtccaagatgctaatgatag

SEQ ID NO: 594285 - DNA, 20 bp, Artificial
  CRISPR gRNA sequence
gatgctaatgatagtagctg

SEQ ID NO: 594286 - DNA, 20 bp, Artificial
  CRISPR gRNA sequence
agtagctgtggcaatcaaat

SEQ ID NO: 594287 - DNA, 20 bp, Artificial
  CRISPR gRNA sequence
agctgtggcaatcaaatcag

SEQ ID NO: 594288 - DNA, 20 bp, Artificial
  CRISPR gRNA sequence
caaatcagtagcacgaacga

SEQ ID NO: 594289 - DNA, 20 bp, Artificial
  CRISPR gRNA sequence
aacgatagtacactcacacc

SEQ ID NO: 594290 - DNA, 20 bp, Artificial
  CRISPR gRNA sequence
cgatagtacactcacaccta

SEQ ID NO: 594291 - DNA, 20 bp, Artificial
  CRISPR gRNA sequence
acactcacacctagagtgca

SEQ ID NO: 594292 - DNA, 20 bp, Artificial
  CRISPR gRNA sequence
ttactactttattctcactt

SEQ ID NO: 594293 - DNA, 20 bp, Artificial
  CRISPR gRNA sequence
tctcactttagctctgtcta

SEQ ID NO: 594294 - DNA, 20 bp, Artificial
  CRISPR gRNA sequence
ctcactttagctctgtctaa

SEQ ID NO: 594295 - DNA, 20 bp, Artificial
  CRISPR gRNA sequence
ctttagctctgtctaaagga

SEQ ID NO: 594296 - DNA, 20 bp, Artificial
  CRISPR gRNA sequence
tttagctctgtctaaaggac

SEQ ID NO: 594297 - DNA, 20 bp, Artificial
  CRISPR gRNA sequence
aacaaataaacctgccattt

SEQ ID NO: 594298 - DNA, 20 bp, Artificial
  CRISPR gRNA sequence
ttcagataactgatccatga

SEQ ID NO: 594299 - DNA, 20 bp, Artificial
  CRISPR gRNA sequence
tcagataactgatccatgac

SEQ ID NO: 594300 - DNA, 20 bp, Artificial
  CRISPR gRNA sequence
actgatccatgacaggttac

SEQ ID NO: 594301 - DNA, 20 bp, Artificial
  CRISPR gRNA sequence
aggttactagtattcaaaac

SEQ ID NO: 594302 - DNA, 20 bp, Artificial
  CRISPR gRNA sequence
tagtattcaaaactggcact

SEQ ID NO: 594303 - DNA, 20 bp, Artificial
  CRISPR gRNA sequence
ttagaacattgtcaccatgc

SEQ ID NO: 594304 - DNA, 20 bp, Artificial
  CRISPR gRNA sequence
attgtcaccatgcaagcaaa

SEQ ID NO: 594305 - DNA, 20 bp, Artificial
  CRISPR gRNA sequence
ttgtcaccatgcaagcaaac

SEQ ID NO: 594306 - DNA, 20 bp, Artificial
  CRISPR gRNA sequence
tcaccatgcaagcaaacagg

SEQ ID NO: 594307 - DNA, 20 bp, Artificial
  CRISPR gRNA sequence
agcaaacaggaagcaatttg

SEQ ID NO: 594308 - DNA, 20 bp, Artificial
  CRISPR gRNA sequence
gcaaacaggaagcaatttgc

SEQ ID NO: 594309 - DNA, 20 bp, Artificial
  CRISPR gRNA sequence
aggaagcaatttgcaggctg

SEQ ID NO: 594310 - DNA, 20 bp, Artificial
  CRISPR gRNA sequence
gtagacctaaatctgctaca

SEQ ID NO: 594311 - DNA, 20 bp, Artificial
  CRISPR gRNA sequence
tggatcttttttacttgttt

SEQ ID NO: 594312 - DNA, 20 bp, Artificial
  CRISPR gRNA sequence
tttacttgttttggtaaaac

SEQ ID NO: 594313 - DNA, 20 bp, Artificial
  CRISPR gRNA sequence
ttacttgttttggtaaaacc

SEQ ID NO: 594314 - DNA, 20 bp, Artificial
  CRISPR gRNA sequence
ttgttttggtaaaaccagga

SEQ ID NO: 594315 - DNA, 20 bp, Artificial
  CRISPR gRNA sequence
ttttggtaaaaccaggaaag

SEQ ID NO: 594316 - DNA, 20 bp, Artificial
  CRISPR gRNA sequence
acatacaatacatattttta

SEQ ID NO: 594317 - DNA, 20 bp, Artificial
  CRISPR gRNA sequence
tacaatacatatttttaaag

SEQ ID NO: 594318 - DNA, 20 bp, Artificial
  CRISPR gRNA sequence
aatacatatttttaaagaag

SEQ ID NO: 594319 - DNA, 20 bp, Artificial
  CRISPR gRNA sequence
caataattctgtatttaaac

SEQ ID NO: 594320 - DNA, 20 bp, Artificial
  CRISPR gRNA sequence
gtatttaaactagaatttgt

SEQ ID NO: 594321 - DNA, 20 bp, Artificial
  CRISPR gRNA sequence
tttaaactagaatttgtgag

SEQ ID NO: 594322 - DNA, 20 bp, Artificial
  CRISPR gRNA sequence
aatttgtgagcggcatcttt

SEQ ID NO: 594323 - DNA, 20 bp, Artificial
  CRISPR gRNA sequence
tgtgagcggcatctttgaga

SEQ ID NO: 594324 - DNA, 20 bp, Artificial
  CRISPR gRNA sequence
gtgagcggcatctttgagat

SEQ ID NO: 594325 - DNA, 20 bp, Artificial
  CRISPR gRNA sequence
gcggcatctttgagatggga

SEQ ID NO: 594326 - DNA, 20 bp, Artificial
  CRISPR gRNA sequence
tttgagatgggacagatgca

SEQ ID NO: 594327 - DNA, 20 bp, Artificial
  CRISPR gRNA sequence
atgggacagatgcatagtcc

SEQ ID NO: 594328 - DNA, 20 bp, Artificial
  CRISPR gRNA sequence
tattgactactttctgtacc

SEQ ID NO: 594329 - DNA, 20 bp, Artificial
  CRISPR gRNA sequence
attgactactttctgtaccc

SEQ ID NO: 594330 - DNA, 20 bp, Artificial
  CRISPR gRNA sequence
tttctgtacccgggaaaacc

SEQ ID NO: 594331 - DNA, 20 bp, Artificial
  CRISPR gRNA sequence
ttctgtacccgggaaaacca

SEQ ID NO: 594332 - DNA, 20 bp, Artificial
  CRISPR gRNA sequence
tacccgggaaaaccaaggcg

SEQ ID NO: 594333 - DNA, 20 bp, Artificial
  CRISPR gRNA sequence
aaaccaaggcgtggtgctgt

SEQ ID NO: 594334 - DNA, 20 bp, Artificial
  CRISPR gRNA sequence
ccaaggcgtggtgctgttgg

SEQ ID NO: 594335 - DNA, 20 bp, Artificial
  CRISPR gRNA sequence
gtggtgctgttggcagttgt

SEQ ID NO: 594336 - DNA, 20 bp, Artificial
  CRISPR gRNA sequence
tggtgctgttggcagttgtc

SEQ ID NO: 594337 - DNA, 20 bp, Artificial
  CRISPR gRNA sequence
ggtgctgttggcagttgtca

SEQ ID NO: 594338 - DNA, 20 bp, Artificial
  CRISPR gRNA sequence
ctgtttgcccaacttttatc

SEQ ID NO: 594339 - DNA, 20 bp, Artificial
  CRISPR gRNA sequence
ttgcccaacttttatccagc

SEQ ID NO: 594340 - DNA, 20 bp, Artificial
  CRISPR gRNA sequence
gcccaacttttatccagctg

SEQ ID NO: 594341 - DNA, 20 bp, Artificial
  CRISPR gRNA sequence
acttttatccagctggagca

SEQ ID NO: 594342 - DNA, 20 bp, Artificial
  CRISPR gRNA sequence
cttttatccagctggagcaa

SEQ ID NO: 594343 - DNA, 20 bp, Artificial
  CRISPR gRNA sequence
ccagctggagcaaaggtaat

SEQ ID NO: 594344 - DNA, 20 bp, Artificial
  CRISPR gRNA sequence
aaggtaataagctcttgaaa

SEQ ID NO: 594345 - DNA, 20 bp, Artificial
  CRISPR gRNA sequence
ataagctcttgaaatagaaa

SEQ ID NO: 594346 - DNA, 20 bp, Artificial
  CRISPR gRNA sequence
gctcttgaaatagaaaaaga

SEQ ID NO: 594347 - DNA, 20 bp, Artificial
  CRISPR gRNA sequence
cttgaaatagaaaaagaaag

SEQ ID NO: 594348 - DNA, 20 bp, Artificial
  CRISPR gRNA sequence
atagaaaaagaaagtggaaa

SEQ ID NO: 594349 - DNA, 20 bp, Artificial
  CRISPR gRNA sequence
caaaactgaattaaaatgta

SEQ ID NO: 594350 - DNA, 20 bp, Artificial
  CRISPR gRNA sequence
ttaaaatgtatagtaccata

SEQ ID NO: 594351 - DNA, 20 bp, Artificial
  CRISPR gRNA sequence
taaaatgtatagtaccatac

SEQ ID NO: 594352 - DNA, 20 bp, Artificial
  CRISPR gRNA sequence
ccattaaatgtaatacaaac

SEQ ID NO: 594353 - DNA, 20 bp, Artificial
  CRISPR gRNA sequence
taatacaaacaagaataaac

SEQ ID NO: 594354 - DNA, 20 bp, Artificial
  CRISPR gRNA sequence
atacaaacaagaataaacca

SEQ ID NO: 594355 - DNA, 20 bp, Artificial
  CRISPR gRNA sequence
agagcaattcacaattcacc

SEQ ID NO: 594356 - DNA, 20 bp, Artificial
  CRISPR gRNA sequence
aattcacaattcaccaagac

SEQ ID NO: 594357 - DNA, 20 bp, Artificial
  CRISPR gRNA sequence
cacaattcaccaagacaagt

SEQ ID NO: 594358 - DNA, 20 bp, Artificial
  CRISPR gRNA sequence
acaattcaccaagacaagtt

SEQ ID NO: 594359 - DNA, 20 bp, Artificial
  CRISPR gRNA sequence
aattcaccaagacaagttgg

SEQ ID NO: 594360 - DNA, 20 bp, Artificial
  CRISPR gRNA sequence
attcaccaagacaagttggg

SEQ ID NO: 594361 - DNA, 20 bp, Artificial
  CRISPR gRNA sequence
gttgtttttacacctgttct

SEQ ID NO: 594362 - DNA, 20 bp, Artificial
  CRISPR gRNA sequence
ttggtttgctcccaatgtac

SEQ ID NO: 594363 - DNA, 20 bp, Artificial
  CRISPR gRNA sequence
tgctcccaatgtacaagcaa

SEQ ID NO: 594364 - DNA, 20 bp, Artificial
  CRISPR gRNA sequence
gctcccaatgtacaagcaat

SEQ ID NO: 594365 - DNA, 20 bp, Artificial
  CRISPR gRNA sequence
caagcaataggaaatttttt

SEQ ID NO: 594366 - DNA, 20 bp, Artificial
  CRISPR gRNA sequence
aggaaattttttaagtaaat

SEQ ID NO: 594367 - DNA, 20 bp, Artificial
  CRISPR gRNA sequence
aaatctcaataactcttcat

SEQ ID NO: 594368 - DNA, 20 bp, Artificial
  CRISPR gRNA sequence
aaataatgcataaaaatcca

SEQ ID NO: 594369 - DNA, 20 bp, Artificial
  CRISPR gRNA sequence
gcataaaaatccacagcata

SEQ ID NO: 594370 - DNA, 20 bp, Artificial
  CRISPR gRNA sequence
atagcaaaatgaattttaat

SEQ ID NO: 594371 - DNA, 20 bp, Artificial
  CRISPR gRNA sequence
aagaccaaatataacattta

SEQ ID NO: 594372 - DNA, 20 bp, Artificial
  CRISPR gRNA sequence
agaccaaatataacatttaa

SEQ ID NO: 594373 - DNA, 20 bp, Artificial
  CRISPR gRNA sequence
ccaaatataacatttaaagg

SEQ ID NO: 594374 - DNA, 20 bp, Artificial
  CRISPR gRNA sequence
caaatataacatttaaagga

SEQ ID NO: 594375 - DNA, 20 bp, Artificial
  CRISPR gRNA sequence
aaatataacatttaaaggaa

SEQ ID NO: 594376 - DNA, 20 bp, Artificial
  CRISPR gRNA sequence
aatataacatttaaaggaag

SEQ ID NO: 594377 - DNA, 20 bp, Artificial
  CRISPR gRNA sequence
atataacatttaaaggaagg

SEQ ID NO: 594378 - DNA, 20 bp, Artificial
  CRISPR gRNA sequence
tataacatttaaaggaaggg

SEQ ID NO: 594379 - DNA, 20 bp, Artificial
  CRISPR gRNA sequence
ataacatttaaaggaagggg

SEQ ID NO: 594380 - DNA, 20 bp, Artificial
  CRISPR gRNA sequence
taacatttaaaggaaggggg

SEQ ID NO: 594381 - DNA, 20 bp, Artificial
  CRISPR gRNA sequence
aacatttaaaggaagggggg

SEQ ID NO: 594382 - DNA, 20 bp, Artificial
  CRISPR gRNA sequence
tctcaattctattgaattta

SEQ ID NO: 594383 - DNA, 20 bp, Artificial
  CRISPR gRNA sequence
tattcttcttgtcatatttc

SEQ ID NO: 594384 - DNA, 20 bp, Artificial
  CRISPR gRNA sequence
tgtcatatttccagctgtac

SEQ ID NO: 594385 - DNA, 20 bp, Artificial
  CRISPR gRNA sequence
taccagaaaatttttttaaa

SEQ ID NO: 594386 - DNA, 20 bp, Artificial
  CRISPR gRNA sequence
cagaaaatttttttaaaaag

SEQ ID NO: 594387 - DNA, 20 bp, Artificial
  CRISPR gRNA sequence
tttaaaaagaagtgcttcct

SEQ ID NO: 594388 - DNA, 20 bp, Artificial
  CRISPR gRNA sequence
aatattctgctgctctacaa

SEQ ID NO: 594389 - DNA, 20 bp, Artificial
  CRISPR gRNA sequence
ttctgctgctctacaacagt

SEQ ID NO: 594390 - DNA, 20 bp, Artificial
  CRISPR gRNA sequence
ctctacaacagtaagcaaaa

SEQ ID NO: 594391 - DNA, 20 bp, Artificial
  CRISPR gRNA sequence
acaacagtaagcaaaacagc

SEQ ID NO: 594392 - DNA, 20 bp, Artificial
  CRISPR gRNA sequence
taagcaaaacagcaagcatg

SEQ ID NO: 594393 - DNA, 20 bp, Artificial
  CRISPR gRNA sequence
aagcaaaacagcaagcatga

SEQ ID NO: 594394 - DNA, 20 bp, Artificial
  CRISPR gRNA sequence
acagcaagcatgaaggcatc

SEQ ID NO: 594395 - DNA, 20 bp, Artificial
  CRISPR gRNA sequence
agcaagcatgaaggcatcaa

SEQ ID NO: 594396 - DNA, 20 bp, Artificial
  CRISPR gRNA sequence
gcaagcatgaaggcatcaag

SEQ ID NO: 594397 - DNA, 20 bp, Artificial
  CRISPR gRNA sequence
gcatgaaggcatcaagagga

SEQ ID NO: 594398 - DNA, 20 bp, Artificial
  CRISPR gRNA sequence
atcaagaggaaagcacatgt

SEQ ID NO: 594399 - DNA, 20 bp, Artificial
  CRISPR gRNA sequence
aggaaagcacatgtgagaaa

SEQ ID NO: 594400 - DNA, 20 bp, Artificial
  CRISPR gRNA sequence
ggaaagcacatgtgagaaat

SEQ ID NO: 594401 - DNA, 20 bp, Artificial
  CRISPR gRNA sequence
aagcacatgtgagaaatggg

SEQ ID NO: 594402 - DNA, 20 bp, Artificial
  CRISPR gRNA sequence
gggcagcctttcattgtaaa

SEQ ID NO: 594403 - DNA, 20 bp, Artificial
  CRISPR gRNA sequence
ggcagcctttcattgtaaaa

SEQ ID NO: 594404 - DNA, 20 bp, Artificial
  CRISPR gRNA sequence
tttttactctcgaatattgt

SEQ ID NO: 594405 - DNA, 20 bp, Artificial
  CRISPR gRNA sequence
actctcgaatattgtgagat

SEQ ID NO: 594406 - DNA, 20 bp, Artificial
  CRISPR gRNA sequence
ctcgaatattgtgagataag

SEQ ID NO: 594407 - DNA, 20 bp, Artificial
  CRISPR gRNA sequence
tattgtgagataagcagtaa

SEQ ID NO: 594408 - DNA, 20 bp, Artificial
  CRISPR gRNA sequence
ataagcagtaatggaaaaat

SEQ ID NO: 594409 - DNA, 20 bp, Artificial
  CRISPR gRNA sequence
aagcagtaatggaaaaataa

SEQ ID NO: 594410 - DNA, 20 bp, Artificial
  CRISPR gRNA sequence
gcagtaatggaaaaataaga

SEQ ID NO: 594411 - DNA, 20 bp, Artificial
  CRISPR gRNA sequence
cagtaatggaaaaataagag

SEQ ID NO: 594412 - DNA, 20 bp, Artificial
  CRISPR gRNA sequence
aatggaaaaataagagaggt

SEQ ID NO: 594413 - DNA, 20 bp, Artificial
  CRISPR gRNA sequence
gaaaaataagagaggtaaga

SEQ ID NO: 594414 - DNA, 20 bp, Artificial
  CRISPR gRNA sequence
ataagagaggtaagatggca

SEQ ID NO: 594415 - DNA, 20 bp, Artificial
  CRISPR gRNA sequence
aggtaagatggcatggaccc

SEQ ID NO: 594416 - DNA, 20 bp, Artificial
  CRISPR gRNA sequence
ggtaagatggcatggaccca

SEQ ID NO: 594417 - DNA, 20 bp, Artificial
  CRISPR gRNA sequence
catggacccaaggaaataac

SEQ ID NO: 594418 - DNA, 20 bp, Artificial
  CRISPR gRNA sequence
tggacccaaggaaataactg

SEQ ID NO: 594419 - DNA, 20 bp, Artificial
  CRISPR gRNA sequence
ggacccaaggaaataactgg

SEQ ID NO: 594420 - DNA, 20 bp, Artificial
  CRISPR gRNA sequence
aaggaaataactggaggatc

SEQ ID NO: 594421 - DNA, 20 bp, Artificial
  CRISPR gRNA sequence
actggaggatcaagtccata

SEQ ID NO: 594422 - DNA, 20 bp, Artificial
  CRISPR gRNA sequence
ggaggatcaagtccatatag

SEQ ID NO: 594423 - DNA, 20 bp, Artificial
  CRISPR gRNA sequence
gatcaagtccatatagtggt

SEQ ID NO: 594424 - DNA, 20 bp, Artificial
  CRISPR gRNA sequence
atcaagtccatatagtggtc

SEQ ID NO: 594425 - DNA, 20 bp, Artificial
  CRISPR gRNA sequence
ccatatagtggtcaggataa

SEQ ID NO: 594426 - DNA, 20 bp, Artificial
  CRISPR gRNA sequence
atggcaatataaacaataat

SEQ ID NO: 594427 - DNA, 20 bp, Artificial
  CRISPR gRNA sequence
ctcacatgttctaaataccg

SEQ ID NO: 594428 - DNA, 20 bp, Artificial
  CRISPR gRNA sequence
cacatgttctaaataccgta

SEQ ID NO: 594429 - DNA, 20 bp, Artificial
  CRISPR gRNA sequence
acatgttctaaataccgtag

SEQ ID NO: 594430 - DNA, 20 bp, Artificial
  CRISPR gRNA sequence
catgttctaaataccgtaga

SEQ ID NO: 594431 - DNA, 20 bp, Artificial
  CRISPR gRNA sequence
atgttctaaataccgtagag

SEQ ID NO: 594432 - DNA, 20 bp, Artificial
  CRISPR gRNA sequence
tgttctaaataccgtagagg

SEQ ID NO: 594433 - DNA, 20 bp, Artificial
  CRISPR gRNA sequence
ctaacaatcttaaaaaatat

SEQ ID NO: 594434 - DNA, 20 bp, Artificial
  CRISPR gRNA sequence
ataagtattctcactttgta

SEQ ID NO: 594435 - DNA, 20 bp, Artificial
  CRISPR gRNA sequence
taagtattctcactttgtac

SEQ ID NO: 594436 - DNA, 20 bp, Artificial
  CRISPR gRNA sequence
tattctcactttgtacaggt

SEQ ID NO: 594437 - DNA, 20 bp, Artificial
  CRISPR gRNA sequence
tttgtacaggtaagtcaact

SEQ ID NO: 594438 - DNA, 20 bp, Artificial
  CRISPR gRNA sequence
ttgtacaggtaagtcaactg

SEQ ID NO: 594439 - DNA, 20 bp, Artificial
  CRISPR gRNA sequence
caggtaagtcaactgaggct

SEQ ID NO: 594440 - DNA, 20 bp, Artificial
  CRISPR gRNA sequence
ggtaagtcaactgaggctca

SEQ ID NO: 594441 - DNA, 20 bp, Artificial
  CRISPR gRNA sequence
agatattaatttattcatac

SEQ ID NO: 594442 - DNA, 20 bp, Artificial
  CRISPR gRNA sequence
gatattaatttattcataca

SEQ ID NO: 594443 - DNA, 20 bp, Artificial
  CRISPR gRNA sequence
tttattcatacaaggtcact

SEQ ID NO: 594444 - DNA, 20 bp, Artificial
  CRISPR gRNA sequence
ttcatacaaggtcactcagt

SEQ ID NO: 594445 - DNA, 20 bp, Artificial
  CRISPR gRNA sequence
atacaaggtcactcagtcag

SEQ ID NO: 594446 - DNA, 20 bp, Artificial
  CRISPR gRNA sequence
aaggtcactcagtcagtagc

SEQ ID NO: 594447 - DNA, 20 bp, Artificial
  CRISPR gRNA sequence
tcagtagctagttattcctt

SEQ ID NO: 594448 - DNA, 20 bp, Artificial
  CRISPR gRNA sequence
cagtagctagttattccttt

SEQ ID NO: 594449 - DNA, 20 bp, Artificial
  CRISPR gRNA sequence
taaattgtgataaatgatga

SEQ ID NO: 594450 - DNA, 20 bp, Artificial
  CRISPR gRNA sequence
aattgtgataaatgatgata

SEQ ID NO: 594451 - DNA, 20 bp, Artificial
  CRISPR gRNA sequence
ttgtgataaatgatgataga

SEQ ID NO: 594452 - DNA, 20 bp, Artificial
  CRISPR gRNA sequence
aatgatgatagagagaccaa

SEQ ID NO: 594453 - DNA, 20 bp, Artificial
  CRISPR gRNA sequence
tacacacatatcacaactaa

SEQ ID NO: 594454 - DNA, 20 bp, Artificial
  CRISPR gRNA sequence
tcacaactaatggcaatgct

SEQ ID NO: 594455 - DNA, 20 bp, Artificial
  CRISPR gRNA sequence
tgcttagatttgaaccattg

SEQ ID NO: 594456 - DNA, 20 bp, Artificial
  CRISPR gRNA sequence
accattgcagactgtcttca

SEQ ID NO: 594457 - DNA, 20 bp, Artificial
  CRISPR gRNA sequence
tgcagactgtcttcaaagct

SEQ ID NO: 594458 - DNA, 20 bp, Artificial
  CRISPR gRNA sequence
gactgtcttcaaagcttgga

SEQ ID NO: 594459 - DNA, 20 bp, Artificial
  CRISPR gRNA sequence
gtcttcaaagcttggacaga

SEQ ID NO: 594460 - DNA, 20 bp, Artificial
  CRISPR gRNA sequence
agcttaataaacaatcacaa

SEQ ID NO: 594461 - DNA, 20 bp, Artificial
  CRISPR gRNA sequence
gcttaataaacaatcacaaa

SEQ ID NO: 594462 - DNA, 20 bp, Artificial
  CRISPR gRNA sequence
aatcacaaaaggataataaa

SEQ ID NO: 594463 - DNA, 20 bp, Artificial
  CRISPR gRNA sequence
tattatatgaatacttatca

SEQ ID NO: 594464 - DNA, 20 bp, Artificial
  CRISPR gRNA sequence
cttctgatttatcaaatcaa

SEQ ID NO: 594465 - DNA, 20 bp, Artificial
  CRISPR gRNA sequence
aaatcaacagactgaacgaa

SEQ ID NO: 594466 - DNA, 20 bp, Artificial
  CRISPR gRNA sequence
caacagactgaacgaaaaga

SEQ ID NO: 594467 - DNA, 20 bp, Artificial
  CRISPR gRNA sequence
aacagactgaacgaaaagaa

SEQ ID NO: 594468 - DNA, 20 bp, Artificial
  CRISPR gRNA sequence
cgaaaagaaaggcttaataa

SEQ ID NO: 594469 - DNA, 20 bp, Artificial
  CRISPR gRNA sequence
agaaaggcttaataaaagtt

SEQ ID NO: 594470 - DNA, 20 bp, Artificial
  CRISPR gRNA sequence
aaggcttaataaaagtttag

SEQ ID NO: 594471 - DNA, 20 bp, Artificial
  CRISPR gRNA sequence
aggcttaataaaagtttagt

SEQ ID NO: 594472 - DNA, 20 bp, Artificial
  CRISPR gRNA sequence
gtgggcacttactgaatgta

SEQ ID NO: 594473 - DNA, 20 bp, Artificial
  CRISPR gRNA sequence
ttactgaatgtatagtgaat

SEQ ID NO: 594474 - DNA, 20 bp, Artificial
  CRISPR gRNA sequence
actgaatgtatagtgaatga

SEQ ID NO: 594475 - DNA, 20 bp, Artificial
  CRISPR gRNA sequence
gaatgagagaatgaatgaat

SEQ ID NO: 594476 - DNA, 20 bp, Artificial
  CRISPR gRNA sequence
gagaatgaatgaatgagtat

SEQ ID NO: 594477 - DNA, 20 bp, Artificial
  CRISPR gRNA sequence
atgaatgaatgagtataaga

SEQ ID NO: 594478 - DNA, 20 bp, Artificial
  CRISPR gRNA sequence
atgaatgagtataagatggc

SEQ ID NO: 594479 - DNA, 20 bp, Artificial
  CRISPR gRNA sequence
ataagatggcaagtgataaa

SEQ ID NO: 594480 - DNA, 20 bp, Artificial
  CRISPR gRNA sequence
taaatagcctttttttcttt

SEQ ID NO: 594481 - DNA, 20 bp, Artificial
  CRISPR gRNA sequence
aaatagcctttttttcttta

SEQ ID NO: 594482 - DNA, 20 bp, Artificial
  CRISPR gRNA sequence
agcctttttttctttaagga

SEQ ID NO: 594483 - DNA, 20 bp, Artificial
  CRISPR gRNA sequence
gcctttttttctttaaggaa

SEQ ID NO: 594484 - DNA, 20 bp, Artificial
  CRISPR gRNA sequence
ttttttctttaaggaaagga

SEQ ID NO: 594485 - DNA, 20 bp, Artificial
  CRISPR gRNA sequence
tttttctttaaggaaaggat

SEQ ID NO: 594486 - DNA, 20 bp, Artificial
  CRISPR gRNA sequence
tttctacgttaattctctga

SEQ ID NO: 594487 - DNA, 20 bp, Artificial
  CRISPR gRNA sequence
ttctacgttaattctctgaa

SEQ ID NO: 594488 - DNA, 20 bp, Artificial
  CRISPR gRNA sequence
ttttgtaaactttgaataat

SEQ ID NO: 594489 - DNA, 20 bp, Artificial
  CRISPR gRNA sequence
tttgtaaactttgaataatt

SEQ ID NO: 594490 - DNA, 20 bp, Artificial
  CRISPR gRNA sequence
ttgtaaactttgaataatta

SEQ ID NO: 594491 - DNA, 20 bp, Artificial
  CRISPR gRNA sequence
tgtaaactttgaataattag

SEQ ID NO: 594492 - DNA, 20 bp, Artificial
  CRISPR gRNA sequence
ctttgaataattaggggaaa

SEQ ID NO: 594493 - DNA, 20 bp, Artificial
  CRISPR gRNA sequence
tttgaataattaggggaaac

SEQ ID NO: 594494 - DNA, 20 bp, Artificial
  CRISPR gRNA sequence
aattaggggaaacaggaata

SEQ ID NO: 594495 - DNA, 20 bp, Artificial
  CRISPR gRNA sequence
ggaatatagcaaaatatttg

SEQ ID NO: 594496 - DNA, 20 bp, Artificial
  CRISPR gRNA sequence
tatagcaaaatatttgaaga

SEQ ID NO: 594497 - DNA, 20 bp, Artificial
  CRISPR gRNA sequence
agatagtttaaattacaaat

SEQ ID NO: 594498 - DNA, 20 bp, Artificial
  CRISPR gRNA sequence
attacaaataagctatttta

SEQ ID NO: 594499 - DNA, 20 bp, Artificial
  CRISPR gRNA sequence
aagctattttaaagtctata

SEQ ID NO: 594500 - DNA, 20 bp, Artificial
  CRISPR gRNA sequence
aagtctatatagatgtgtta

SEQ ID NO: 594501 - DNA, 20 bp, Artificial
  CRISPR gRNA sequence
agatgttcatttttataact

SEQ ID NO: 594502 - DNA, 20 bp, Artificial
  CRISPR gRNA sequence
ataacttagaacaactgtta

SEQ ID NO: 594503 - DNA, 20 bp, Artificial
  CRISPR gRNA sequence
gaacaactgttacagaaata

SEQ ID NO: 594504 - DNA, 20 bp, Artificial
  CRISPR gRNA sequence
aatctcaccataaaattcct

SEQ ID NO: 594505 - DNA, 20 bp, Artificial
  CRISPR gRNA sequence
aaattccttagttacaaata

SEQ ID NO: 594506 - DNA, 20 bp, Artificial
  CRISPR gRNA sequence
agttacaaatatagtgatat

SEQ ID NO: 594507 - DNA, 20 bp, Artificial
  CRISPR gRNA sequence
tatagtgatatcagatttat

SEQ ID NO: 594508 - DNA, 20 bp, Artificial
  CRISPR gRNA sequence
gatttataagaaaatgttaa

SEQ ID NO: 594509 - DNA, 20 bp, Artificial
  CRISPR gRNA sequence
atttataagaaaatgttaaa

SEQ ID NO: 594510 - DNA, 20 bp, Artificial
  CRISPR gRNA sequence
aggactttgaatttgctaaa

SEQ ID NO: 594511 - DNA, 20 bp, Artificial
  CRISPR gRNA sequence
gactttgaatttgctaaaaa

SEQ ID NO: 594512 - DNA, 20 bp, Artificial
  CRISPR gRNA sequence
tttgaatttgctaaaaagag

SEQ ID NO: 594513 - DNA, 20 bp, Artificial
  CRISPR gRNA sequence
ttttgaaatgtattgaataa

SEQ ID NO: 594514 - DNA, 20 bp, Artificial
  CRISPR gRNA sequence
tacataaatgatcaattaaa

SEQ ID NO: 594515 - DNA, 20 bp, Artificial
  CRISPR gRNA sequence
tgatcaattaaaaagatttt

SEQ ID NO: 594516 - DNA, 20 bp, Artificial
  CRISPR gRNA sequence
ttaaaaagatttttagtatt

SEQ ID NO: 594517 - DNA, 20 bp, Artificial
  CRISPR gRNA sequence
attcagaattatatatttcc

SEQ ID NO: 594518 - DNA, 20 bp, Artificial
  CRISPR gRNA sequence
ttcattattttaatgctcac

SEQ ID NO: 594519 - DNA, 20 bp, Artificial
  CRISPR gRNA sequence
aatgctcacaagacacacct

SEQ ID NO: 594520 - DNA, 20 bp, Artificial
  CRISPR gRNA sequence
cacacctcggattcgatttg

SEQ ID NO: 594521 - DNA, 20 bp, Artificial
  CRISPR gRNA sequence
ttgcagtatacataaaatgt

SEQ ID NO: 594522 - DNA, 20 bp, Artificial
  CRISPR gRNA sequence
tgcagtatacataaaatgta

SEQ ID NO: 594523 - DNA, 20 bp, Artificial
  CRISPR gRNA sequence
gcagtatacataaaatgtaa

SEQ ID NO: 594524 - DNA, 20 bp, Artificial
  CRISPR gRNA sequence
cagtatacataaaatgtaag

SEQ ID NO: 594525 - DNA, 20 bp, Artificial
  CRISPR gRNA sequence
agtatacataaaatgtaagg

SEQ ID NO: 594526 - DNA, 20 bp, Artificial
  CRISPR gRNA sequence
cataaaatgtaagggggaaa

SEQ ID NO: 594527 - DNA, 20 bp, Artificial
  CRISPR gRNA sequence
gggaaaaagacctccatgtc

SEQ ID NO: 594528 - DNA, 20 bp, Artificial
  CRISPR gRNA sequence
gaaaaagacctccatgtcta

SEQ ID NO: 594529 - DNA, 20 bp, Artificial
  CRISPR gRNA sequence
aaaaagacctccatgtctag

SEQ ID NO: 594530 - DNA, 20 bp, Artificial
  CRISPR gRNA sequence
aaacttgcaaaacacattaa

SEQ ID NO: 594531 - DNA, 20 bp, Artificial
  CRISPR gRNA sequence
tgcaaaacacattaatagta

SEQ ID NO: 594532 - DNA, 20 bp, Artificial
  CRISPR gRNA sequence
cattaatagtacagttaaaa

SEQ ID NO: 594533 - DNA, 20 bp, Artificial
  CRISPR gRNA sequence
aatgtgttaacctgtcttct

SEQ ID NO: 594534 - DNA, 20 bp, Artificial
  CRISPR gRNA sequence
atgtgttaacctgtcttctg

SEQ ID NO: 594535 - DNA, 20 bp, Artificial
  CRISPR gRNA sequence
gtcttctgaggttaccgcac

SEQ ID NO: 594536 - DNA, 20 bp, Artificial
  CRISPR gRNA sequence
ttaccgcacaagtgttttaa

SEQ ID NO: 594537 - DNA, 20 bp, Artificial
  CRISPR gRNA sequence
ttaaaagttttgttttgctg

SEQ ID NO: 594538 - DNA, 20 bp, Artificial
  CRISPR gRNA sequence
tttgttttgctgtggtttta

SEQ ID NO: 594539 - DNA, 20 bp, Artificial
  CRISPR gRNA sequence
tttgctgtggttttaaagct

SEQ ID NO: 594540 - DNA, 20 bp, Artificial
  CRISPR gRNA sequence
ctctctaccactgcttctaa

SEQ ID NO: 594541 - DNA, 20 bp, Artificial
  CRISPR gRNA sequence
aacggacaaaaaaaaaaaaa

SEQ ID NO: 594542 - DNA, 20 bp, Artificial
  CRISPR gRNA sequence
caaaaaaaaaaaaaaagaaa

SEQ ID NO: 594543 - DNA, 20 bp, Artificial
  CRISPR gRNA sequence
aaaaaaaaaagaaaaagaaa

SEQ ID NO: 594544 - DNA, 20 bp, Artificial
  CRISPR gRNA sequence
aagttacaactcaaattctg

SEQ ID NO: 594545 - DNA, 20 bp, Artificial
  CRISPR gRNA sequence
tcaaattctgtagtaaacca

SEQ ID NO: 594546 - DNA, 20 bp, Artificial
  CRISPR gRNA sequence
caaattctgtagtaaaccac

SEQ ID NO: 594547 - DNA, 20 bp, Artificial
  CRISPR gRNA sequence
aaattctgtagtaaaccaca

SEQ ID NO: 594548 - DNA, 20 bp, Artificial
  CRISPR gRNA sequence
ttctgtagtaaaccacaggg

SEQ ID NO: 594549 - DNA, 20 bp, Artificial
  CRISPR gRNA sequence
ctgtagtaaaccacagggca

SEQ ID NO: 594550 - DNA, 20 bp, Artificial
  CRISPR gRNA sequence
tgtagtaaaccacagggcag

SEQ ID NO: 594551 - DNA, 20 bp, Artificial
  CRISPR gRNA sequence
gtaaaccacagggcagaggc

SEQ ID NO: 594552 - DNA, 20 bp, Artificial
  CRISPR gRNA sequence
taaaccacagggcagaggca

SEQ ID NO: 594553 - DNA, 20 bp, Artificial
  CRISPR gRNA sequence
aaaccacagggcagaggcaa

SEQ ID NO: 594554 - DNA, 20 bp, Artificial
  CRISPR gRNA sequence
aaccacagggcagaggcaag

SEQ ID NO: 594555 - DNA, 20 bp, Artificial
  CRISPR gRNA sequence
gggcagaggcaaggggttct

SEQ ID NO: 594556 - DNA, 20 bp, Artificial
  CRISPR gRNA sequence
ttccttaacaaacttgttgc

SEQ ID NO: 594557 - DNA, 20 bp, Artificial
  CRISPR gRNA sequence
cctaactcgcctatgttccc

SEQ ID NO: 594558 - DNA, 20 bp, Artificial
  CRISPR gRNA sequence
ctaactcgcctatgttcccc

SEQ ID NO: 594559 - DNA, 20 bp, Artificial
  CRISPR gRNA sequence
gcctatgttccccaggcact

SEQ ID NO: 594560 - DNA, 20 bp, Artificial
  CRISPR gRNA sequence
ttccccaggcactgagccaa

SEQ ID NO: 594561 - DNA, 20 bp, Artificial
  CRISPR gRNA sequence
gccaaaagtatcattttact

SEQ ID NO: 594562 - DNA, 20 bp, Artificial
  CRISPR gRNA sequence
aagtatcattttactgagtg

SEQ ID NO: 594563 - DNA, 20 bp, Artificial
  CRISPR gRNA sequence
attttactgagtgaagaaaa

SEQ ID NO: 594564 - DNA, 20 bp, Artificial
  CRISPR gRNA sequence
tttactgagtgaagaaaaaa

SEQ ID NO: 594565 - DNA, 20 bp, Artificial
  CRISPR gRNA sequence
ttttctaactattgaaatga

SEQ ID NO: 594566 - DNA, 20 bp, Artificial
  CRISPR gRNA sequence
ttccccccaaaatattaata

SEQ ID NO: 594567 - DNA, 20 bp, Artificial
  CRISPR gRNA sequence
cccaaaatattaataaagaa

SEQ ID NO: 594568 - DNA, 20 bp, Artificial
  CRISPR gRNA sequence
ccaaaatattaataaagaat

SEQ ID NO: 594569 - DNA, 20 bp, Artificial
  CRISPR gRNA sequence
caaaatattaataaagaata

SEQ ID NO: 594570 - DNA, 20 bp, Artificial
  CRISPR gRNA sequence
atattaataaagaataggga

SEQ ID NO: 594571 - DNA, 20 bp, Artificial
  CRISPR gRNA sequence
tattaataaagaatagggaa

SEQ ID NO: 594572 - DNA, 20 bp, Artificial
  CRISPR gRNA sequence
taataaagaatagggaaagg

SEQ ID NO: 594573 - DNA, 20 bp, Artificial
  CRISPR gRNA sequence
ataaagaatagggaaaggaa

SEQ ID NO: 594574 - DNA, 20 bp, Artificial
  CRISPR gRNA sequence
gaatagggaaaggaagagaa

SEQ ID NO: 594575 - DNA, 20 bp, Artificial
  CRISPR gRNA sequence
aatagggaaaggaagagaat

SEQ ID NO: 594576 - DNA, 20 bp, Artificial
  CRISPR gRNA sequence
agggaaaggaagagaatggg

SEQ ID NO: 594577 - DNA, 20 bp, Artificial
  CRISPR gRNA sequence
gggaaaggaagagaatggga

SEQ ID NO: 594578 - DNA, 20 bp, Artificial
  CRISPR gRNA sequence
gaaaggaagagaatgggaag

SEQ ID NO: 594579 - DNA, 20 bp, Artificial
  CRISPR gRNA sequence
aaaggaagagaatgggaagg

SEQ ID NO: 594580 - DNA, 20 bp, Artificial
  CRISPR gRNA sequence
gggaaggaggtgttctcttc

SEQ ID NO: 594581 - DNA, 20 bp, Artificial
  CRISPR gRNA sequence
aggaggtgttctcttctaga

SEQ ID NO: 594582 - DNA, 20 bp, Artificial
  CRISPR gRNA sequence
gttctcttctagatagtacg

SEQ ID NO: 594583 - DNA, 20 bp, Artificial
  CRISPR gRNA sequence
tctcttctagatagtacgca

SEQ ID NO: 594584 - DNA, 20 bp, Artificial
  CRISPR gRNA sequence
ctagatagtacgcagagtac

SEQ ID NO: 594585 - DNA, 20 bp, Artificial
  CRISPR gRNA sequence
tagatagtacgcagagtacg

SEQ ID NO: 594586 - DNA, 20 bp, Artificial
  CRISPR gRNA sequence
gcactattttaaacactgat

SEQ ID NO: 594587 - DNA, 20 bp, Artificial
  CRISPR gRNA sequence
cactattttaaacactgata

SEQ ID NO: 594588 - DNA, 20 bp, Artificial
  CRISPR gRNA sequence
actattttaaacactgataa

SEQ ID NO: 594589 - DNA, 20 bp, Artificial
  CRISPR gRNA sequence
aacactgataagggcacgca

SEQ ID NO: 594590 - DNA, 20 bp, Artificial
  CRISPR gRNA sequence
actgataagggcacgcatag

SEQ ID NO: 594591 - DNA, 20 bp, Artificial
  CRISPR gRNA sequence
gataagggcacgcatagaag

SEQ ID NO: 594592 - DNA, 20 bp, Artificial
  CRISPR gRNA sequence
ataagggcacgcatagaagc

SEQ ID NO: 594593 - DNA, 20 bp, Artificial
  CRISPR gRNA sequence
taagggcacgcatagaagca

SEQ ID NO: 594594 - DNA, 20 bp, Artificial
  CRISPR gRNA sequence
gcagggactctgcttgctgc

SEQ ID NO: 594595 - DNA, 20 bp, Artificial
  CRISPR gRNA sequence
ctgcttgctgccagtgaatt

SEQ ID NO: 594596 - DNA, 20 bp, Artificial
  CRISPR gRNA sequence
tgcttgctgccagtgaattc

SEQ ID NO: 594597 - DNA, 20 bp, Artificial
  CRISPR gRNA sequence
tccattgttccaaattgcta

SEQ ID NO: 594598 - DNA, 20 bp, Artificial
  CRISPR gRNA sequence
tgttccaaattgctatggtc

SEQ ID NO: 594599 - DNA, 20 bp, Artificial
  CRISPR gRNA sequence
aaattgctatggtctggtga

SEQ ID NO: 594600 - DNA, 20 bp, Artificial
  CRISPR gRNA sequence
aattgctatggtctggtgac

SEQ ID NO: 594601 - DNA, 20 bp, Artificial
  CRISPR gRNA sequence
ctggtgacaggaaccccaac

SEQ ID NO: 594602 - DNA, 20 bp, Artificial
  CRISPR gRNA sequence
acaggaaccccaactagaac

SEQ ID NO: 594603 - DNA, 20 bp, Artificial
  CRISPR gRNA sequence
cctgcattttcttttgcatt

SEQ ID NO: 594604 - DNA, 20 bp, Artificial
  CRISPR gRNA sequence
atttagatgccaactttgat

SEQ ID NO: 594605 - DNA, 20 bp, Artificial
  CRISPR gRNA sequence
tttagatgccaactttgata

SEQ ID NO: 594606 - DNA, 20 bp, Artificial
  CRISPR gRNA sequence
ttgataaggtcacgccttaa

SEQ ID NO: 594607 - DNA, 20 bp, Artificial
  CRISPR gRNA sequence
cacgccttaaaagatccaca

SEQ ID NO: 594608 - DNA, 20 bp, Artificial
  CRISPR gRNA sequence
tccacatagcatgcaacaca

SEQ ID NO: 594609 - DNA, 20 bp, Artificial
  CRISPR gRNA sequence
catagcatgcaacacacaga

SEQ ID NO: 594610 - DNA, 20 bp, Artificial
  CRISPR gRNA sequence
gcaacacacagatagcaata

SEQ ID NO: 594611 - DNA, 20 bp, Artificial
  CRISPR gRNA sequence
acagatagcaataaagcctt

SEQ ID NO: 594612 - DNA, 20 bp, Artificial
  CRISPR gRNA sequence
ccttcagccattcccatact

SEQ ID NO: 594613 - DNA, 20 bp, Artificial
  CRISPR gRNA sequence
agccattcccatactcagat

SEQ ID NO: 594614 - DNA, 20 bp, Artificial
  CRISPR gRNA sequence
tactcagataagaatgtaaa

SEQ ID NO: 594615 - DNA, 20 bp, Artificial
  CRISPR gRNA sequence
tcagataagaatgtaaaaag

SEQ ID NO: 594616 - DNA, 20 bp, Artificial
  CRISPR gRNA sequence
agataagaatgtaaaaagaa

SEQ ID NO: 594617 - DNA, 20 bp, Artificial
  CRISPR gRNA sequence
gataagaatgtaaaaagaag

SEQ ID NO: 594618 - DNA, 20 bp, Artificial
  CRISPR gRNA sequence
atgtaaaaagaagaggaaat

SEQ ID NO: 594619 - DNA, 20 bp, Artificial
  CRISPR gRNA sequence
aaaaagaagaggaaatcaga

SEQ ID NO: 594620 - DNA, 20 bp, Artificial
  CRISPR gRNA sequence
aagacattcacatatatgaa

SEQ ID NO: 594621 - DNA, 20 bp, Artificial
  CRISPR gRNA sequence
cacatatatgaacagattta

SEQ ID NO: 594622 - DNA, 20 bp, Artificial
  CRISPR gRNA sequence
acatatatgaacagatttac

SEQ ID NO: 594623 - DNA, 20 bp, Artificial
  CRISPR gRNA sequence
catatatgaacagatttaca

SEQ ID NO: 594624 - DNA, 20 bp, Artificial
  CRISPR gRNA sequence
catttataactacacctatc

SEQ ID NO: 594625 - DNA, 20 bp, Artificial
  CRISPR gRNA sequence
atctagatcctttcacacac

SEQ ID NO: 594626 - DNA, 20 bp, Artificial
  CRISPR gRNA sequence
tctagatcctttcacacacc

SEQ ID NO: 594627 - DNA, 20 bp, Artificial
  CRISPR gRNA sequence
ctagatcctttcacacacca

SEQ ID NO: 594628 - DNA, 20 bp, Artificial
  CRISPR gRNA sequence
tcacacaccagggacctatg

SEQ ID NO: 594629 - DNA, 20 bp, Artificial
  CRISPR gRNA sequence
acacaccagggacctatgtg

SEQ ID NO: 594630 - DNA, 20 bp, Artificial
  CRISPR gRNA sequence
cctatgtggagccaacaaca

SEQ ID NO: 594631 - DNA, 20 bp, Artificial
  CRISPR gRNA sequence
ctatgtggagccaacaacaa

SEQ ID NO: 594632 - DNA, 20 bp, Artificial
  CRISPR gRNA sequence
agccaacaacaaaggtactc

SEQ ID NO: 594633 - DNA, 20 bp, Artificial
  CRISPR gRNA sequence
ccaacaacaaaggtactcca

SEQ ID NO: 594634 - DNA, 20 bp, Artificial
  CRISPR gRNA sequence
ccagagattccctcccctcc

SEQ ID NO: 594635 - DNA, 20 bp, Artificial
  CRISPR gRNA sequence
cagagattccctcccctccc

SEQ ID NO: 594636 - DNA, 20 bp, Artificial
  CRISPR gRNA sequence
aggcccccatgctcctatcc

SEQ ID NO: 594637 - DNA, 20 bp, Artificial
  CRISPR gRNA sequence
cctatcccagaattttctca

SEQ ID NO: 594638 - DNA, 20 bp, Artificial
  CRISPR gRNA sequence
ctatcccagaattttctcaa

SEQ ID NO: 594639 - DNA, 20 bp, Artificial
  CRISPR gRNA sequence
atcccagaattttctcaaag

SEQ ID NO: 594640 - DNA, 20 bp, Artificial
  CRISPR gRNA sequence
agctcattgctttccctcac

SEQ ID NO: 594641 - DNA, 20 bp, Artificial
  CRISPR gRNA sequence
ttccctcactggcttccttt

SEQ ID NO: 594642 - DNA, 20 bp, Artificial
  CRISPR gRNA sequence
cctcactggcttcctttgag

SEQ ID NO: 594643 - DNA, 20 bp, Artificial
  CRISPR gRNA sequence
ttcctttgagtagtgtcaaa

SEQ ID NO: 594644 - DNA, 20 bp, Artificial
  CRISPR gRNA sequence
ttgactgcttctttcaattc

SEQ ID NO: 594645 - DNA, 20 bp, Artificial
  CRISPR gRNA sequence
tgactgcttctttcaattcc

SEQ ID NO: 594646 - DNA, 20 bp, Artificial
  CRISPR gRNA sequence
gactgcttctttcaattcca

SEQ ID NO: 594647 - DNA, 20 bp, Artificial
  CRISPR gRNA sequence
tattcccctgaccctcccaa

SEQ ID NO: 594648 - DNA, 20 bp, Artificial
  CRISPR gRNA sequence
attcccctgaccctcccaaa

SEQ ID NO: 594649 - DNA, 20 bp, Artificial
  CRISPR gRNA sequence
ttgactcctcttctactgca

SEQ ID NO: 594650 - DNA, 20 bp, Artificial
  CRISPR gRNA sequence
actgcaaagctctccctcat

SEQ ID NO: 594651 - DNA, 20 bp, Artificial
  CRISPR gRNA sequence
tctccctcatgagctaccca

SEQ ID NO: 594652 - DNA, 20 bp, Artificial
  CRISPR gRNA sequence
catgagctacccacagaaac

SEQ ID NO: 594653 - DNA, 20 bp, Artificial
  CRISPR gRNA sequence
acccacagaaaccagttccc

SEQ ID NO: 594654 - DNA, 20 bp, Artificial
  CRISPR gRNA sequence
actgccttccctcccaatca

SEQ ID NO: 594655 - DNA, 20 bp, Artificial
  CRISPR gRNA sequence
tccctcccaatcatagcccg

SEQ ID NO: 594656 - DNA, 20 bp, Artificial
  CRISPR gRNA sequence
tcctttccaactgttcccaa

SEQ ID NO: 594657 - DNA, 20 bp, Artificial
  CRISPR gRNA sequence
acctaacctgacatcattat

SEQ ID NO: 594658 - DNA, 20 bp, Artificial
  CRISPR gRNA sequence
cattattagtgaaaatacac

SEQ ID NO: 594659 - DNA, 20 bp, Artificial
  CRISPR gRNA sequence
ttattagtgaaaatacacca

SEQ ID NO: 594660 - DNA, 20 bp, Artificial
  CRISPR gRNA sequence
tattagtgaaaatacaccag

SEQ ID NO: 594661 - DNA, 20 bp, Artificial
  CRISPR gRNA sequence
tgaaaatacaccagaggttt

SEQ ID NO: 594662 - DNA, 20 bp, Artificial
  CRISPR gRNA sequence
gaaaatacaccagaggtttt

SEQ ID NO: 594663 - DNA, 20 bp, Artificial
  CRISPR gRNA sequence
aaaatacaccagaggttttg

SEQ ID NO: 594664 - DNA, 20 bp, Artificial
  CRISPR gRNA sequence
aaatacaccagaggttttgg

SEQ ID NO: 594665 - DNA, 20 bp, Artificial
  CRISPR gRNA sequence
tacaccagaggttttggggg

SEQ ID NO: 594666 - DNA, 20 bp, Artificial
  CRISPR gRNA sequence
acaccagaggttttggggga

SEQ ID NO: 594667 - DNA, 20 bp, Artificial
  CRISPR gRNA sequence
caccagaggttttgggggaa

SEQ ID NO: 594668 - DNA, 20 bp, Artificial
  CRISPR gRNA sequence
ccagaggttttgggggaagg

SEQ ID NO: 594669 - DNA, 20 bp, Artificial
  CRISPR gRNA sequence
cagaggttttgggggaaggg

SEQ ID NO: 594670 - DNA, 20 bp, Artificial
  CRISPR gRNA sequence
ggggaagggaggaataccat

SEQ ID NO: 594671 - DNA, 20 bp, Artificial
  CRISPR gRNA sequence
ggaagggaggaataccatta

SEQ ID NO: 594672 - DNA, 20 bp, Artificial
  CRISPR gRNA sequence
ggaggaataccattagagca

SEQ ID NO: 594673 - DNA, 20 bp, Artificial
  CRISPR gRNA sequence
gaggaataccattagagcaa

SEQ ID NO: 594674 - DNA, 20 bp, Artificial
  CRISPR gRNA sequence
gaaaaacacacatgcacata

SEQ ID NO: 594675 - DNA, 20 bp, Artificial
  CRISPR gRNA sequence
acacacatgcacatacagtg

SEQ ID NO: 594676 - DNA, 20 bp, Artificial
  CRISPR gRNA sequence
cacacatgcacatacagtgc

SEQ ID NO: 594677 - DNA, 20 bp, Artificial
  CRISPR gRNA sequence
aggaatgatgttctcattcc

SEQ ID NO: 594678 - DNA, 20 bp, Artificial
  CRISPR gRNA sequence
tgatgttctcattcctggac

SEQ ID NO: 594679 - DNA, 20 bp, Artificial
  CRISPR gRNA sequence
cacactcaaacattcccaaa

SEQ ID NO: 594680 - DNA, 20 bp, Artificial
  CRISPR gRNA sequence
cttgattaaatgattttatc

SEQ ID NO: 594681 - DNA, 20 bp, Artificial
  CRISPR gRNA sequence
gattttatctggcgtattta

SEQ ID NO: 594682 - DNA, 20 bp, Artificial
  CRISPR gRNA sequence
tttatctggcgtatttaaag

SEQ ID NO: 594683 - DNA, 20 bp, Artificial
  CRISPR gRNA sequence
ctggcgtatttaaagaagtg

SEQ ID NO: 594684 - DNA, 20 bp, Artificial
  CRISPR gRNA sequence
atttaaagaagtgtagtgtg

SEQ ID NO: 594685 - DNA, 20 bp, Artificial
  CRISPR gRNA sequence
tttaaagaagtgtagtgtgt

SEQ ID NO: 594686 - DNA, 20 bp, Artificial
  CRISPR gRNA sequence
ttaaagaagtgtagtgtgtg

SEQ ID NO: 594687 - DNA, 20 bp, Artificial
  CRISPR gRNA sequence
taaagaagtgtagtgtgtgg

SEQ ID NO: 594688 - DNA, 20 bp, Artificial
  CRISPR gRNA sequence
aaagaagtgtagtgtgtggg

SEQ ID NO: 594689 - DNA, 20 bp, Artificial
  CRISPR gRNA sequence
aagaagtgtagtgtgtgggg

SEQ ID NO: 594690 - DNA, 20 bp, Artificial
  CRISPR gRNA sequence
agaagtgtagtgtgtggggg

SEQ ID NO: 594691 - DNA, 20 bp, Artificial
  CRISPR gRNA sequence
agtgtagtgtgtgggggggg

SEQ ID NO: 594692 - DNA, 20 bp, Artificial
  CRISPR gRNA sequence
gtgtagtgtgtgggggggga

SEQ ID NO: 594693 - DNA, 20 bp, Artificial
  CRISPR gRNA sequence
tgtagtgtgtggggggggaa

SEQ ID NO: 594694 - DNA, 20 bp, Artificial
  CRISPR gRNA sequence
gtagtgtgtggggggggaag

SEQ ID NO: 594695 - DNA, 20 bp, Artificial
  CRISPR gRNA sequence
tagtgtgtggggggggaagg

SEQ ID NO: 594696 - DNA, 20 bp, Artificial
  CRISPR gRNA sequence
agtgtgtggggggggaaggg

SEQ ID NO: 594697 - DNA, 20 bp, Artificial
  CRISPR gRNA sequence
gtgtgtggggggggaagggg

SEQ ID NO: 594698 - DNA, 20 bp, Artificial
  CRISPR gRNA sequence
tgtgtggggggggaaggggg

SEQ ID NO: 594699 - DNA, 20 bp, Artificial
  CRISPR gRNA sequence
gtggggggggaagggggggg

SEQ ID NO: 594700 - DNA, 20 bp, Artificial
  CRISPR gRNA sequence
ggaaggggggggtggtatgt

SEQ ID NO: 594701 - DNA, 20 bp, Artificial
  CRISPR gRNA sequence
tgtgaccaaaatcaaaacac

SEQ ID NO: 594702 - DNA, 20 bp, Artificial
  CRISPR gRNA sequence
aaaatcaaaacacaagtgca

SEQ ID NO: 594703 - DNA, 20 bp, Artificial
  CRISPR gRNA sequence
gattatcaaatgctacaaat

SEQ ID NO: 594704 - DNA, 20 bp, Artificial
  CRISPR gRNA sequence
ctgcaaacaaacaaaaatca

SEQ ID NO: 594705 - DNA, 20 bp, Artificial
  CRISPR gRNA sequence
caaaaatcaaagaacttctt

SEQ ID NO: 594706 - DNA, 20 bp, Artificial
  CRISPR gRNA sequence
tcttcagccacgactattga

SEQ ID NO: 594707 - DNA, 20 bp, Artificial
  CRISPR gRNA sequence
cttcagccacgactattgat

SEQ ID NO: 594708 - DNA, 20 bp, Artificial
  CRISPR gRNA sequence
ttcagccacgactattgata

SEQ ID NO: 594709 - DNA, 20 bp, Artificial
  CRISPR gRNA sequence
cttgtgaaaatgctgtgctc

SEQ ID NO: 594710 - DNA, 20 bp, Artificial
  CRISPR gRNA sequence
gctctagctcaatgcttaac

SEQ ID NO: 594711 - DNA, 20 bp, Artificial
  CRISPR gRNA sequence
aatgcttaaccagactcttc

SEQ ID NO: 594712 - DNA, 20 bp, Artificial
  CRISPR gRNA sequence
ttcgctgtaatgttttcaaa

SEQ ID NO: 594713 - DNA, 20 bp, Artificial
  CRISPR gRNA sequence
taatgttttcaaaaagattt

SEQ ID NO: 594714 - DNA, 20 bp, Artificial
  CRISPR gRNA sequence
atgttttcaaaaagatttaa

SEQ ID NO: 594715 - DNA, 20 bp, Artificial
  CRISPR gRNA sequence
aacttgttttacactgactt

SEQ ID NO: 594716 - DNA, 20 bp, Artificial
  CRISPR gRNA sequence
acactgacttaagttttacc

SEQ ID NO: 594717 - DNA, 20 bp, Artificial
  CRISPR gRNA sequence
gacttaagttttacctagct

SEQ ID NO: 594718 - DNA, 20 bp, Artificial
  CRISPR gRNA sequence
ttacctagctcagataaaaa

SEQ ID NO: 594719 - DNA, 20 bp, Artificial
  CRISPR gRNA sequence
tcagataaaaatagatttct

SEQ ID NO: 594720 - DNA, 20 bp, Artificial
  CRISPR gRNA sequence
cagataaaaatagatttctt

SEQ ID NO: 594721 - DNA, 20 bp, Artificial
  CRISPR gRNA sequence
aaaatagatttcttgggcaa

SEQ ID NO: 594722 - DNA, 20 bp, Artificial
  CRISPR gRNA sequence
ttgaaaacgttttcttcaat

SEQ ID NO: 594723 - DNA, 20 bp, Artificial
  CRISPR gRNA sequence
tatttttatgacctaaaata

SEQ ID NO: 594724 - DNA, 20 bp, Artificial
  CRISPR gRNA sequence
taaaatatagtaacaaaatt

SEQ ID NO: 594725 - DNA, 20 bp, Artificial
  CRISPR gRNA sequence
gtgattccatttttcacttt

SEQ ID NO: 594726 - DNA, 20 bp, Artificial
  CRISPR gRNA sequence
actgtctttatttaaattgt

SEQ ID NO: 594727 - DNA, 20 bp, Artificial
  CRISPR gRNA sequence
aaattgtcagacttcatgat

SEQ ID NO: 594728 - DNA, 20 bp, Artificial
  CRISPR gRNA sequence
agctatttctctttttaaaa

SEQ ID NO: 594729 - DNA, 20 bp, Artificial
  CRISPR gRNA sequence
gctatttctctttttaaaaa

SEQ ID NO: 594730 - DNA, 20 bp, Artificial
  CRISPR gRNA sequence
ataattataatccaaataat

SEQ ID NO: 594731 - DNA, 20 bp, Artificial
  CRISPR gRNA sequence
ttttaaaaaaatctcttttg

SEQ ID NO: 594732 - DNA, 20 bp, Artificial
  CRISPR gRNA sequence
aaatctcttttgtggttgaa

SEQ ID NO: 594733 - DNA, 20 bp, Artificial
  CRISPR gRNA sequence
tgtggttgaaaagaaaatta

SEQ ID NO: 594734 - DNA, 20 bp, Artificial
  CRISPR gRNA sequence
gttgaaaagaaaattatgga

SEQ ID NO: 594735 - DNA, 20 bp, Artificial
  CRISPR gRNA sequence
aaaagaaaattatggaaaga

SEQ ID NO: 594736 - DNA, 20 bp, Artificial
  CRISPR gRNA sequence
accaatctatttttctgttt

SEQ ID NO: 594737 - DNA, 20 bp, Artificial
  CRISPR gRNA sequence
caatctatttttctgtttaa

SEQ ID NO: 594738 - DNA, 20 bp, Artificial
  CRISPR gRNA sequence
atccttgcgcctgtttttta

SEQ ID NO: 594739 - DNA, 20 bp, Artificial
  CRISPR gRNA sequence
tccttgcgcctgttttttaa

SEQ ID NO: 594740 - DNA, 20 bp, Artificial
  CRISPR gRNA sequence
ttgcgcctgttttttaaagg

SEQ ID NO: 594741 - DNA, 20 bp, Artificial
  CRISPR gRNA sequence
gcgcctgttttttaaaggaa

SEQ ID NO: 594742 - DNA, 20 bp, Artificial
  CRISPR gRNA sequence
ctgttttttaaaggaagagt

SEQ ID NO: 594743 - DNA, 20 bp, Artificial
  CRISPR gRNA sequence
actcttacgaaaaaaaaaaa

SEQ ID NO: 594744 - DNA, 20 bp, Artificial
  CRISPR gRNA sequence
ttacgaaaaaaaaaaatggc

SEQ ID NO: 594745 - DNA, 20 bp, Artificial
  CRISPR gRNA sequence
tacgaaaaaaaaaaatggct

SEQ ID NO: 594746 - DNA, 20 bp, Artificial
  CRISPR gRNA sequence
aaaaaaatggctaggcacaa

SEQ ID NO: 594747 - DNA, 20 bp, Artificial
  CRISPR gRNA sequence
cgtctataatcccaacactt

SEQ ID NO: 594748 - DNA, 20 bp, Artificial
  CRISPR gRNA sequence
gtctataatcccaacacttt

SEQ ID NO: 594749 - DNA, 20 bp, Artificial
  CRISPR gRNA sequence
ctataatcccaacactttgg

SEQ ID NO: 594750 - DNA, 20 bp, Artificial
  CRISPR gRNA sequence
tataatcccaacactttggg

SEQ ID NO: 594751 - DNA, 20 bp, Artificial
  CRISPR gRNA sequence
cccaacactttgggaggccg

SEQ ID NO: 594752 - DNA, 20 bp, Artificial
  CRISPR gRNA sequence
acactttgggaggccgcggc

SEQ ID NO: 594753 - DNA, 20 bp, Artificial
  CRISPR gRNA sequence
actttgggaggccgcggctg

SEQ ID NO: 594754 - DNA, 20 bp, Artificial
  CRISPR gRNA sequence
ccgcggctggagaatcgctt

SEQ ID NO: 594755 - DNA, 20 bp, Artificial
  CRISPR gRNA sequence
ctggagaatcgcttgagccc

SEQ ID NO: 594756 - DNA, 20 bp, Artificial
  CRISPR gRNA sequence
tcgcttgagcccaagtgttt

SEQ ID NO: 594757 - DNA, 20 bp, Artificial
  CRISPR gRNA sequence
tgagcccaagtgtttgagac

SEQ ID NO: 594758 - DNA, 20 bp, Artificial
  CRISPR gRNA sequence
agtgtttgagaccagcctgt

SEQ ID NO: 594759 - DNA, 20 bp, Artificial
  CRISPR gRNA sequence
tgagaccagcctgtgagaca

SEQ ID NO: 594760 - DNA, 20 bp, Artificial
  CRISPR gRNA sequence
accagcctgtgagacatagt

SEQ ID NO: 594761 - DNA, 20 bp, Artificial
  CRISPR gRNA sequence
tgtgagacatagtgagacct

SEQ ID NO: 594762 - DNA, 20 bp, Artificial
  CRISPR gRNA sequence
acatagtgagacctcggatc

SEQ ID NO: 594763 - DNA, 20 bp, Artificial
  CRISPR gRNA sequence
atagtgagacctcggatcta

SEQ ID NO: 594764 - DNA, 20 bp, Artificial
  CRISPR gRNA sequence
agtgagacctcggatctaga

SEQ ID NO: 594765 - DNA, 20 bp, Artificial
  CRISPR gRNA sequence
cctcggatctagagagatat

SEQ ID NO: 594766 - DNA, 20 bp, Artificial
  CRISPR gRNA sequence
ggatctagagagatattagc

SEQ ID NO: 594767 - DNA, 20 bp, Artificial
  CRISPR gRNA sequence
gatctagagagatattagcc

SEQ ID NO: 594768 - DNA, 20 bp, Artificial
  CRISPR gRNA sequence
agagagatattagccaggca

SEQ ID NO: 594769 - DNA, 20 bp, Artificial
  CRISPR gRNA sequence
gagatattagccaggcatgg

SEQ ID NO: 594770 - DNA, 20 bp, Artificial
  CRISPR gRNA sequence
atattagccaggcatggtgg

SEQ ID NO: 594771 - DNA, 20 bp, Artificial
  CRISPR gRNA sequence
atggtggtggcgcatgtccc

SEQ ID NO: 594772 - DNA, 20 bp, Artificial
  CRISPR gRNA sequence
gtggcgcatgtccctagccc

SEQ ID NO: 594773 - DNA, 20 bp, Artificial
  CRISPR gRNA sequence
cgcatgtccctagccccagc

SEQ ID NO: 594774 - DNA, 20 bp, Artificial
  CRISPR gRNA sequence
gtccctagccccagctagtc

SEQ ID NO: 594775 - DNA, 20 bp, Artificial
  CRISPR gRNA sequence
ccctagccccagctagtcca

SEQ ID NO: 594776 - DNA, 20 bp, Artificial
  CRISPR gRNA sequence
cctagccccagctagtccag

SEQ ID NO: 594777 - DNA, 20 bp, Artificial
  CRISPR gRNA sequence
ccccagctagtccagaggct

SEQ ID NO: 594778 - DNA, 20 bp, Artificial
  CRISPR gRNA sequence
cccagctagtccagaggctg

SEQ ID NO: 594779 - DNA, 20 bp, Artificial
  CRISPR gRNA sequence
gctagtccagaggctgaggt

SEQ ID NO: 594780 - DNA, 20 bp, Artificial
  CRISPR gRNA sequence
tagtccagaggctgaggtga

SEQ ID NO: 594781 - DNA, 20 bp, Artificial
  CRISPR gRNA sequence
agtccagaggctgaggtgag

SEQ ID NO: 594782 - DNA, 20 bp, Artificial
  CRISPR gRNA sequence
ctgaggtgagaggatctctt

SEQ ID NO: 594783 - DNA, 20 bp, Artificial
  CRISPR gRNA sequence
gtgagaggatctcttgagcc

SEQ ID NO: 594784 - DNA, 20 bp, Artificial
  CRISPR gRNA sequence
tgagaggatctcttgagccc

SEQ ID NO: 594785 - DNA, 20 bp, Artificial
  CRISPR gRNA sequence
agaggatctcttgagcccag

SEQ ID NO: 594786 - DNA, 20 bp, Artificial
  CRISPR gRNA sequence
tctcttgagcccaggagttc

SEQ ID NO: 594787 - DNA, 20 bp, Artificial
  CRISPR gRNA sequence
ctcttgagcccaggagttcg

SEQ ID NO: 594788 - DNA, 20 bp, Artificial
  CRISPR gRNA sequence
ggagttcgaggctgccacat

SEQ ID NO: 594789 - DNA, 20 bp, Artificial
  CRISPR gRNA sequence
tgccacataagccatgatca

SEQ ID NO: 594790 - DNA, 20 bp, Artificial
  CRISPR gRNA sequence
ggtgccactgcactccaacc

SEQ ID NO: 594791 - DNA, 20 bp, Artificial
  CRISPR gRNA sequence
gtgccactgcactccaacct

SEQ ID NO: 594792 - DNA, 20 bp, Artificial
  CRISPR gRNA sequence
ctgcactccaacctgggcga

SEQ ID NO: 594793 - DNA, 20 bp, Artificial
  CRISPR gRNA sequence
gcactccaacctgggcgaca

SEQ ID NO: 594794 - DNA, 20 bp, Artificial
  CRISPR gRNA sequence
tccaacctgggcgacagagt

SEQ ID NO: 594795 - DNA, 20 bp, Artificial
  CRISPR gRNA sequence
ccaacctgggcgacagagtg

SEQ ID NO: 594796 - DNA, 20 bp, Artificial
  CRISPR gRNA sequence
caacctgggcgacagagtga

SEQ ID NO: 594797 - DNA, 20 bp, Artificial
  CRISPR gRNA sequence
ccctgtctaaaaaaaaaaaa

SEQ ID NO: 594798 - DNA, 20 bp, Artificial
  CRISPR gRNA sequence
taaaaaaaaaaaaaagaaaa

SEQ ID NO: 594799 - DNA, 20 bp, Artificial
  CRISPR gRNA sequence
aaaaaaaaaagaaaaaagaa

SEQ ID NO: 594800 - DNA, 20 bp, Artificial
  CRISPR gRNA sequence
aaaaagaaaaaagaaaagaa

SEQ ID NO: 594801 - DNA, 20 bp, Artificial
  CRISPR gRNA sequence
aagaaaaaagaaaagaaaag

SEQ ID NO: 594802 - DNA, 20 bp, Artificial
  CRISPR gRNA sequence
gaagaaaaaaaatgtttttt

SEQ ID NO: 594803 - DNA, 20 bp, Artificial
  CRISPR gRNA sequence
gaaaaaaaatgttttttaag

SEQ ID NO: 594804 - DNA, 20 bp, Artificial
  CRISPR gRNA sequence
aaaaaaaatgttttttaagt

SEQ ID NO: 594805 - DNA, 20 bp, Artificial
  CRISPR gRNA sequence
taagtaggttttccatttct

SEQ ID NO: 594806 - DNA, 20 bp, Artificial
  CRISPR gRNA sequence
ttctgagactaaatatctaa

SEQ ID NO: 594807 - DNA, 20 bp, Artificial
  CRISPR gRNA sequence
ttgccacttgaaaaatctaa

SEQ ID NO: 594808 - DNA, 20 bp, Artificial
  CRISPR gRNA sequence
atctaaaagtgaaacatctc

SEQ ID NO: 594809 - DNA, 20 bp, Artificial
  CRISPR gRNA sequence
tgtactatgatgaacacatt

SEQ ID NO: 594810 - DNA, 20 bp, Artificial
  CRISPR gRNA sequence
tgtgattaatatgtaatctt

SEQ ID NO: 594811 - DNA, 20 bp, Artificial
  CRISPR gRNA sequence
ttaatatgtaatcttgagca

SEQ ID NO: 594812 - DNA, 20 bp, Artificial
  CRISPR gRNA sequence
taatatgtaatcttgagcaa

SEQ ID NO: 594813 - DNA, 20 bp, Artificial
  CRISPR gRNA sequence
tcttgagcaaaggtaccaaa

SEQ ID NO: 594814 - DNA, 20 bp, Artificial
  CRISPR gRNA sequence
caaaaagtatctctccaatt

SEQ ID NO: 594815 - DNA, 20 bp, Artificial
  CRISPR gRNA sequence
aaaagtatctctccaattca

SEQ ID NO: 594816 - DNA, 20 bp, Artificial
  CRISPR gRNA sequence
atctctccaattcagagcaa

SEQ ID NO: 594817 - DNA, 20 bp, Artificial
  CRISPR gRNA sequence
tattccttatgccacccatc

SEQ ID NO: 594818 - DNA, 20 bp, Artificial
  CRISPR gRNA sequence
ccttatgccacccatcaaga

SEQ ID NO: 594819 - DNA, 20 bp, Artificial
  CRISPR gRNA sequence
gaaagccattatatgataaa

SEQ ID NO: 594820 - DNA, 20 bp, Artificial
  CRISPR gRNA sequence
agccattatatgataaacag

SEQ ID NO: 594821 - DNA, 20 bp, Artificial
  CRISPR gRNA sequence
atgctgctgattaattataa

SEQ ID NO: 594822 - DNA, 20 bp, Artificial
  CRISPR gRNA sequence
tgctgctgattaattataat

SEQ ID NO: 594823 - DNA, 20 bp, Artificial
  CRISPR gRNA sequence
gctgctgattaattataatg

SEQ ID NO: 594824 - DNA, 20 bp, Artificial
  CRISPR gRNA sequence
aatggggaaaatcataaacc

SEQ ID NO: 594825 - DNA, 20 bp, Artificial
  CRISPR gRNA sequence
gaaatcaactatatcacata

SEQ ID NO: 594826 - DNA, 20 bp, Artificial
  CRISPR gRNA sequence
atcaactatatcacatatag

SEQ ID NO: 594827 - DNA, 20 bp, Artificial
  CRISPR gRNA sequence
tcaactatatcacatataga

SEQ ID NO: 594828 - DNA, 20 bp, Artificial
  CRISPR gRNA sequence
atatcacatatagaaggaca

SEQ ID NO: 594829 - DNA, 20 bp, Artificial
  CRISPR gRNA sequence
cacatatagaaggacacggt

SEQ ID NO: 594830 - DNA, 20 bp, Artificial
  CRISPR gRNA sequence
acatatagaaggacacggta

SEQ ID NO: 594831 - DNA, 20 bp, Artificial
  CRISPR gRNA sequence
atatagaaggacacggtaag

SEQ ID NO: 594832 - DNA, 20 bp, Artificial
  CRISPR gRNA sequence
agaatgtacctgtttgtcaa

SEQ ID NO: 594833 - DNA, 20 bp, Artificial
  CRISPR gRNA sequence
gaatgtacctgtttgtcaac

SEQ ID NO: 594834 - DNA, 20 bp, Artificial
  CRISPR gRNA sequence
acaggtccattgtctatgat

SEQ ID NO: 594835 - DNA, 20 bp, Artificial
  CRISPR gRNA sequence
attgtctatgatgagcaaat

SEQ ID NO: 594836 - DNA, 20 bp, Artificial
  CRISPR gRNA sequence
gatgagcaaattagcctgct

SEQ ID NO: 594837 - DNA, 20 bp, Artificial
  CRISPR gRNA sequence
tgagcaaattagcctgctca

SEQ ID NO: 594838 - DNA, 20 bp, Artificial
  CRISPR gRNA sequence
caaattagcctgctcagagt

SEQ ID NO: 594839 - DNA, 20 bp, Artificial
  CRISPR gRNA sequence
tcagagtcagaaacaacact

SEQ ID NO: 594840 - DNA, 20 bp, Artificial
  CRISPR gRNA sequence
cagagtcagaaacaacactt

SEQ ID NO: 594841 - DNA, 20 bp, Artificial
  CRISPR gRNA sequence
agagtcagaaacaacactta

SEQ ID NO: 594842 - DNA, 20 bp, Artificial
  CRISPR gRNA sequence
aacaacacttagggttccct

SEQ ID NO: 594843 - DNA, 20 bp, Artificial
  CRISPR gRNA sequence
ttagggttccctcagacaca

SEQ ID NO: 594844 - DNA, 20 bp, Artificial
  CRISPR gRNA sequence
ttccctcagacacacagtga

SEQ ID NO: 594845 - DNA, 20 bp, Artificial
  CRISPR gRNA sequence
cacagtgaaagaccatcaca

SEQ ID NO: 594846 - DNA, 20 bp, Artificial
  CRISPR gRNA sequence
aaagaccatcacaaagcact

SEQ ID NO: 594847 - DNA, 20 bp, Artificial
  CRISPR gRNA sequence
aagaccatcacaaagcactc

SEQ ID NO: 594848 - DNA, 20 bp, Artificial
  CRISPR gRNA sequence
agcactcaggctgttaacac

SEQ ID NO: 594849 - DNA, 20 bp, Artificial
  CRISPR gRNA sequence
acacaagacaaaaaaaataa

SEQ ID NO: 594850 - DNA, 20 bp, Artificial
  CRISPR gRNA sequence
acaaaaaaaataatagtcct

SEQ ID NO: 594851 - DNA, 20 bp, Artificial
  CRISPR gRNA sequence
aaaaaaataatagtcctcag

SEQ ID NO: 594852 - DNA, 20 bp, Artificial
  CRISPR gRNA sequence
ctttctcatcccttgcccat

SEQ ID NO: 594853 - DNA, 20 bp, Artificial
  CRISPR gRNA sequence
cccttgcccatgagaacttt

SEQ ID NO: 594854 - DNA, 20 bp, Artificial
  CRISPR gRNA sequence
ccttgcccatgagaacttta

SEQ ID NO: 594855 - DNA, 20 bp, Artificial
  CRISPR gRNA sequence
cccatgagaactttaaggct

SEQ ID NO: 594856 - DNA, 20 bp, Artificial
  CRISPR gRNA sequence
tgagaactttaaggcttagc

SEQ ID NO: 594857 - DNA, 20 bp, Artificial
  CRISPR gRNA sequence
aaggcttagcaagacaaaca

SEQ ID NO: 594858 - DNA, 20 bp, Artificial
  CRISPR gRNA sequence
acaaagaattatatatttct

SEQ ID NO: 594859 - DNA, 20 bp, Artificial
  CRISPR gRNA sequence
caaagaattatatatttctt

SEQ ID NO: 594860 - DNA, 20 bp, Artificial
  CRISPR gRNA sequence
gaattatatatttcttgggc

SEQ ID NO: 594861 - DNA, 20 bp, Artificial
  CRISPR gRNA sequence
aattatatatttcttgggca

SEQ ID NO: 594862 - DNA, 20 bp, Artificial
  CRISPR gRNA sequence
ttatcacatttatgtcaaca

SEQ ID NO: 594863 - DNA, 20 bp, Artificial
  CRISPR gRNA sequence
atcacatttatgtcaacaaa

SEQ ID NO: 594864 - DNA, 20 bp, Artificial
  CRISPR gRNA sequence
aacaaagagatgatcactgt

SEQ ID NO: 594865 - DNA, 20 bp, Artificial
  CRISPR gRNA sequence
acaaagagatgatcactgtg

SEQ ID NO: 594866 - DNA, 20 bp, Artificial
  CRISPR gRNA sequence
atgatcactgtgaggtctta

SEQ ID NO: 594867 - DNA, 20 bp, Artificial
  CRISPR gRNA sequence
tgtgaggtcttatagcttca

SEQ ID NO: 594868 - DNA, 20 bp, Artificial
  CRISPR gRNA sequence
gtcttatagcttcacagttg

SEQ ID NO: 594869 - DNA, 20 bp, Artificial
  CRISPR gRNA sequence
cttcacagttgtagttttta

SEQ ID NO: 594870 - DNA, 20 bp, Artificial
  CRISPR gRNA sequence
ttcacagttgtagtttttaa

SEQ ID NO: 594871 - DNA, 20 bp, Artificial
  CRISPR gRNA sequence
cacagttgtagtttttaaag

SEQ ID NO: 594872 - DNA, 20 bp, Artificial
  CRISPR gRNA sequence
acagttgtagtttttaaagg

SEQ ID NO: 594873 - DNA, 20 bp, Artificial
  CRISPR gRNA sequence
cagttgtagtttttaaagga

SEQ ID NO: 594874 - DNA, 20 bp, Artificial
  CRISPR gRNA sequence
tgaactcccaacaaattgta

SEQ ID NO: 594875 - DNA, 20 bp, Artificial
  CRISPR gRNA sequence
caaattgtatagctcatttt

SEQ ID NO: 594876 - DNA, 20 bp, Artificial
  CRISPR gRNA sequence
tacatacacgcactttccat

SEQ ID NO: 594877 - DNA, 20 bp, Artificial
  CRISPR gRNA sequence
gtatcacaaaattctaattg

SEQ ID NO: 594878 - DNA, 20 bp, Artificial
  CRISPR gRNA sequence
tctaaatgtttttctcactg

SEQ ID NO: 594879 - DNA, 20 bp, Artificial
  CRISPR gRNA sequence
tgtttttctcactgtggaaa

SEQ ID NO: 594880 - DNA, 20 bp, Artificial
  CRISPR gRNA sequence
ttttctcactgtggaaaaag

SEQ ID NO: 594881 - DNA, 20 bp, Artificial
  CRISPR gRNA sequence
aaagcagatttgctcatctg

SEQ ID NO: 594882 - DNA, 20 bp, Artificial
  CRISPR gRNA sequence
cagatttgctcatctgtagc

SEQ ID NO: 594883 - DNA, 20 bp, Artificial
  CRISPR gRNA sequence
atctgtagcgagaacctgac

SEQ ID NO: 594884 - DNA, 20 bp, Artificial
  CRISPR gRNA sequence
agaacctgactggcacttaa

SEQ ID NO: 594885 - DNA, 20 bp, Artificial
  CRISPR gRNA sequence
gaacctgactggcacttaat

SEQ ID NO: 594886 - DNA, 20 bp, Artificial
  CRISPR gRNA sequence
aacctgactggcacttaata

SEQ ID NO: 594887 - DNA, 20 bp, Artificial
  CRISPR gRNA sequence
ctgactggcacttaataggg

SEQ ID NO: 594888 - DNA, 20 bp, Artificial
  CRISPR gRNA sequence
tgactggcacttaataggga

SEQ ID NO: 594889 - DNA, 20 bp, Artificial
  CRISPR gRNA sequence
tagggaaggtatgtaaatca

SEQ ID NO: 594890 - DNA, 20 bp, Artificial
  CRISPR gRNA sequence
aggtatgtaaatcatggttc

SEQ ID NO: 594891 - DNA, 20 bp, Artificial
  CRISPR gRNA sequence
tgtaaatcatggttcaagtt

SEQ ID NO: 594892 - DNA, 20 bp, Artificial
  CRISPR gRNA sequence
ggttcaagttcagtcattgc

SEQ ID NO: 594893 - DNA, 20 bp, Artificial
  CRISPR gRNA sequence
gtgtaactaccttcatgtat

SEQ ID NO: 594894 - DNA, 20 bp, Artificial
  CRISPR gRNA sequence
gtaactaccttcatgtatta

SEQ ID NO: 594895 - DNA, 20 bp, Artificial
  CRISPR gRNA sequence
ccttcatgtattagagtttt

SEQ ID NO: 594896 - DNA, 20 bp, Artificial
  CRISPR gRNA sequence
tagagttttcagtgaaaatt

SEQ ID NO: 594897 - DNA, 20 bp, Artificial
  CRISPR gRNA sequence
aaaatttagataatttatct

SEQ ID NO: 594898 - DNA, 20 bp, Artificial
  CRISPR gRNA sequence
aaatttagataatttatctc

SEQ ID NO: 594899 - DNA, 20 bp, Artificial
  CRISPR gRNA sequence
atctcaggaattcttgtttt

SEQ ID NO: 594900 - DNA, 20 bp, Artificial
  CRISPR gRNA sequence
tcttgttttcagtgaaaatt

SEQ ID NO: 594901 - DNA, 20 bp, Artificial
  CRISPR gRNA sequence
aaaatttagataatttatct

SEQ ID NO: 594902 - DNA, 20 bp, Artificial
  CRISPR gRNA sequence
aaatttagataatttatctc

SEQ ID NO: 594903 - DNA, 20 bp, Artificial
  CRISPR gRNA sequence
atttatctcaggaattcttg

SEQ ID NO: 594904 - DNA, 20 bp, Artificial
  CRISPR gRNA sequence
tttatctcaggaattcttgc

SEQ ID NO: 594905 - DNA, 20 bp, Artificial
  CRISPR gRNA sequence
tatctcaggaattcttgcag

SEQ ID NO: 594906 - DNA, 20 bp, Artificial
  CRISPR gRNA sequence
atctcaggaattcttgcagg

SEQ ID NO: 594907 - DNA, 20 bp, Artificial
  CRISPR gRNA sequence
atacatacttctaaactctt

SEQ ID NO: 594908 - DNA, 20 bp, Artificial
  CRISPR gRNA sequence
atacttctaaactctttggc

SEQ ID NO: 594909 - DNA, 20 bp, Artificial
  CRISPR gRNA sequence
aactctttggcgagatcaca

SEQ ID NO: 594910 - DNA, 20 bp, Artificial
  CRISPR gRNA sequence
tggcgagatcacaaagatct

SEQ ID NO: 594911 - DNA, 20 bp, Artificial
  CRISPR gRNA sequence
ggcgagatcacaaagatctt

SEQ ID NO: 594912 - DNA, 20 bp, Artificial
  CRISPR gRNA sequence
ggcccttcttgacaacattt

SEQ ID NO: 594913 - DNA, 20 bp, Artificial
  CRISPR gRNA sequence
cccttcttgacaacatttta

SEQ ID NO: 594914 - DNA, 20 bp, Artificial
  CRISPR gRNA sequence
caacattttagagaactatc

SEQ ID NO: 594915 - DNA, 20 bp, Artificial
  CRISPR gRNA sequence
tagagaactatcaagaatac

SEQ ID NO: 594916 - DNA, 20 bp, Artificial
  CRISPR gRNA sequence
tcaagaatactggaacacga

SEQ ID NO: 594917 - DNA, 20 bp, Artificial
  CRISPR gRNA sequence
catgctgaattcgaaatcaa

SEQ ID NO: 594918 - DNA, 20 bp, Artificial
  CRISPR gRNA sequence
attcgaaatcaaaagacctg

SEQ ID NO: 594919 - DNA, 20 bp, Artificial
  CRISPR gRNA sequence
ttacctgtgttctaactgtg

SEQ ID NO: 594920 - DNA, 20 bp, Artificial
  CRISPR gRNA sequence
tacctgtgttctaactgtgt

SEQ ID NO: 594921 - DNA, 20 bp, Artificial
  CRISPR gRNA sequence
tgtgttctaactgtgtaggt

SEQ ID NO: 594922 - DNA, 20 bp, Artificial
  CRISPR gRNA sequence
taggttagttttcatatctc

SEQ ID NO: 594923 - DNA, 20 bp, Artificial
  CRISPR gRNA sequence
gttttcatatctctagaaca

SEQ ID NO: 594924 - DNA, 20 bp, Artificial
  CRISPR gRNA sequence
tttcatatctctagaacaaa

SEQ ID NO: 594925 - DNA, 20 bp, Artificial
  CRISPR gRNA sequence
tcatatctctagaacaaaga

SEQ ID NO: 594926 - DNA, 20 bp, Artificial
  CRISPR gRNA sequence
catatctctagaacaaagag

SEQ ID NO: 594927 - DNA, 20 bp, Artificial
  CRISPR gRNA sequence
agaggtatgctacatctcga

SEQ ID NO: 594928 - DNA, 20 bp, Artificial
  CRISPR gRNA sequence
acatctcgaaagctatgatt

SEQ ID NO: 594929 - DNA, 20 bp, Artificial
  CRISPR gRNA sequence
ttaagtgaaatgtaaaccat

SEQ ID NO: 594930 - DNA, 20 bp, Artificial
  CRISPR gRNA sequence
taagtgaaatgtaaaccatc

SEQ ID NO: 594931 - DNA, 20 bp, Artificial
  CRISPR gRNA sequence
catcaggcatgatgctaaat

SEQ ID NO: 594932 - DNA, 20 bp, Artificial
  CRISPR gRNA sequence
atcaggcatgatgctaaatt

SEQ ID NO: 594933 - DNA, 20 bp, Artificial
  CRISPR gRNA sequence
catgatgctaaattaggcaa

SEQ ID NO: 594934 - DNA, 20 bp, Artificial
  CRISPR gRNA sequence
atgatgctaaattaggcaaa

SEQ ID NO: 594935 - DNA, 20 bp, Artificial
  CRISPR gRNA sequence
atgctaaattaggcaaaagg

SEQ ID NO: 594936 - DNA, 20 bp, Artificial
  CRISPR gRNA sequence
taggcaaaaggaagcaacaa

SEQ ID NO: 594937 - DNA, 20 bp, Artificial
  CRISPR gRNA sequence
aacggccgtgaaaccctact

SEQ ID NO: 594938 - DNA, 20 bp, Artificial
  CRISPR gRNA sequence
gtgaaaccctactgagttga

SEQ ID NO: 594939 - DNA, 20 bp, Artificial
  CRISPR gRNA sequence
tgaaaccctactgagttgat

SEQ ID NO: 594940 - DNA, 20 bp, Artificial
  CRISPR gRNA sequence
aaaccctactgagttgatag

SEQ ID NO: 594941 - DNA, 20 bp, Artificial
  CRISPR gRNA sequence
ctactgagttgataggagaa

SEQ ID NO: 594942 - DNA, 20 bp, Artificial
  CRISPR gRNA sequence
tactgagttgataggagaat

SEQ ID NO: 594943 - DNA, 20 bp, Artificial
  CRISPR gRNA sequence
actgagttgataggagaatg

SEQ ID NO: 594944 - DNA, 20 bp, Artificial
  CRISPR gRNA sequence
gaatggggtcaatgtaaact

SEQ ID NO: 594945 - DNA, 20 bp, Artificial
  CRISPR gRNA sequence
aatggggtcaatgtaaactt

SEQ ID NO: 594946 - DNA, 20 bp, Artificial
  CRISPR gRNA sequence
aaaaacgattgaaattacta

SEQ ID NO: 594947 - DNA, 20 bp, Artificial
  CRISPR gRNA sequence
aaacgattgaaattactatg

SEQ ID NO: 594948 - DNA, 20 bp, Artificial
  CRISPR gRNA sequence
attactatggagcaacccac

SEQ ID NO: 594949 - DNA, 20 bp, Artificial
  CRISPR gRNA sequence
ttactatggagcaacccaca

SEQ ID NO: 594950 - DNA, 20 bp, Artificial
  CRISPR gRNA sequence
ccacaaggcattatcctttt

SEQ ID NO: 594951 - DNA, 20 bp, Artificial
  CRISPR gRNA sequence
tatccttttcagtgtttaat

SEQ ID NO: 594952 - DNA, 20 bp, Artificial
  CRISPR gRNA sequence
atttcccgaaatattcaaaa

SEQ ID NO: 594953 - DNA, 20 bp, Artificial
  CRISPR gRNA sequence
tttcccgaaatattcaaaat

SEQ ID NO: 594954 - DNA, 20 bp, Artificial
  CRISPR gRNA sequence
gtgcatgctttgatgtcaac

SEQ ID NO: 594955 - DNA, 20 bp, Artificial
  CRISPR gRNA sequence
tgcatgctttgatgtcaact

SEQ ID NO: 594956 - DNA, 20 bp, Artificial
  CRISPR gRNA sequence
aacctgtgaaaaaatgaaat

SEQ ID NO: 594957 - DNA, 20 bp, Artificial
  CRISPR gRNA sequence
acctgtgaaaaaatgaaata

SEQ ID NO: 594958 - DNA, 20 bp, Artificial
  CRISPR gRNA sequence
aaatgaaataaggactatat

SEQ ID NO: 594959 - DNA, 20 bp, Artificial
  CRISPR gRNA sequence
aataaggactatataagatg

SEQ ID NO: 594960 - DNA, 20 bp, Artificial
  CRISPR gRNA sequence
taagatgtagaattatccat

SEQ ID NO: 594961 - DNA, 20 bp, Artificial
  CRISPR gRNA sequence
atgtagaattatccattgga

SEQ ID NO: 594962 - DNA, 20 bp, Artificial
  CRISPR gRNA sequence
tagaattatccattggaaag

SEQ ID NO: 594963 - DNA, 20 bp, Artificial
  CRISPR gRNA sequence
agaattatccattggaaagt

SEQ ID NO: 594964 - DNA, 20 bp, Artificial
  CRISPR gRNA sequence
gaaagtaggtgatttttatt

SEQ ID NO: 594965 - DNA, 20 bp, Artificial
  CRISPR gRNA sequence
aaagtaggtgatttttattg

SEQ ID NO: 594966 - DNA, 20 bp, Artificial
  CRISPR gRNA sequence
tgatttttattgaggaaaaa

SEQ ID NO: 594967 - DNA, 20 bp, Artificial
  CRISPR gRNA sequence
ataaaatattatgcttacat

SEQ ID NO: 594968 - DNA, 20 bp, Artificial
  CRISPR gRNA sequence
ctgccatccccaatgaactg

SEQ ID NO: 594969 - DNA, 20 bp, Artificial
  CRISPR gRNA sequence
caatgaactgtggtcataat

SEQ ID NO: 594970 - DNA, 20 bp, Artificial
  CRISPR gRNA sequence
tgaactgtggtcataataag

SEQ ID NO: 594971 - DNA, 20 bp, Artificial
  CRISPR gRNA sequence
agcagatttgtgtgcatgaa

SEQ ID NO: 594972 - DNA, 20 bp, Artificial
  CRISPR gRNA sequence
gatttgtgtgcatgaaaaga

SEQ ID NO: 594973 - DNA, 20 bp, Artificial
  CRISPR gRNA sequence
tttgtgtgcatgaaaagaca

SEQ ID NO: 594974 - DNA, 20 bp, Artificial
  CRISPR gRNA sequence
ttgtgtgcatgaaaagacag

SEQ ID NO: 594975 - DNA, 20 bp, Artificial
  CRISPR gRNA sequence
tgtgtgcatgaaaagacaga

SEQ ID NO: 594976 - DNA, 20 bp, Artificial
  CRISPR gRNA sequence
gtgtgcatgaaaagacagag

SEQ ID NO: 594977 - DNA, 20 bp, Artificial
  CRISPR gRNA sequence
gcatgaaaagacagaggggc

SEQ ID NO: 594978 - DNA, 20 bp, Artificial
  CRISPR gRNA sequence
acccttctcactgtgcccca

SEQ ID NO: 594979 - DNA, 20 bp, Artificial
  CRISPR gRNA sequence
ctcactgtgccccacagttt

SEQ ID NO: 594980 - DNA, 20 bp, Artificial
  CRISPR gRNA sequence
cactgtgccccacagtttga

SEQ ID NO: 594981 - DNA, 20 bp, Artificial
  CRISPR gRNA sequence
tgccccacagtttgagagat

SEQ ID NO: 594982 - DNA, 20 bp, Artificial
  CRISPR gRNA sequence
ccccacagtttgagagatca

SEQ ID NO: 594983 - DNA, 20 bp, Artificial
  CRISPR gRNA sequence
gtttgagagatcagagctac

SEQ ID NO: 594984 - DNA, 20 bp, Artificial
  CRISPR gRNA sequence
agagatcagagctacaagct

SEQ ID NO: 594985 - DNA, 20 bp, Artificial
  CRISPR gRNA sequence
ctactgaactgatatgacct

SEQ ID NO: 594986 - DNA, 20 bp, Artificial
  CRISPR gRNA sequence
cctgagatctgatcccactg

SEQ ID NO: 594987 - DNA, 20 bp, Artificial
  CRISPR gRNA sequence
gagatctgatcccactgcag

SEQ ID NO: 594988 - DNA, 20 bp, Artificial
  CRISPR gRNA sequence
gatcccactgcagtagccat

SEQ ID NO: 594989 - DNA, 20 bp, Artificial
  CRISPR gRNA sequence
atcccactgcagtagccatc

SEQ ID NO: 594990 - DNA, 20 bp, Artificial
  CRISPR gRNA sequence
ctgcagtagccatcgggcta

SEQ ID NO: 594991 - DNA, 20 bp, Artificial
  CRISPR gRNA sequence
cagtagccatcgggctacag

SEQ ID NO: 594992 - DNA, 20 bp, Artificial
  CRISPR gRNA sequence
tagccatcgggctacagtgg

SEQ ID NO: 594993 - DNA, 20 bp, Artificial
  CRISPR gRNA sequence
caaaataaacccctcctcaa

SEQ ID NO: 594994 - DNA, 20 bp, Artificial
  CRISPR gRNA sequence
aaaataaacccctcctcaat

SEQ ID NO: 594995 - DNA, 20 bp, Artificial
  CRISPR gRNA sequence
acccctcctcaataggaaaa

SEQ ID NO: 594996 - DNA, 20 bp, Artificial
  CRISPR gRNA sequence
cctcaataggaaaacggtcc

SEQ ID NO: 594997 - DNA, 20 bp, Artificial
  CRISPR gRNA sequence
tcaataggaaaacggtccaa

SEQ ID NO: 594998 - DNA, 20 bp, Artificial
  CRISPR gRNA sequence
aaacggtccaagagtgcttc

SEQ ID NO: 594999 - DNA, 20 bp, Artificial
  CRISPR gRNA sequence
aacggtccaagagtgcttcc

SEQ ID NO: 595000 - DNA, 20 bp, Artificial
  CRISPR gRNA sequence
ggtgccaacttctactcttc

SEQ ID NO: 595001 - DNA, 20 bp, Artificial
  CRISPR gRNA sequence
ggaataaaattccactaaca

SEQ ID NO: 595002 - DNA, 20 bp, Artificial
  CRISPR gRNA sequence
ttccactaacaaagttgata

SEQ ID NO: 595003 - DNA, 20 bp, Artificial
  CRISPR gRNA sequence
acaaagttgatatagcttta

SEQ ID NO: 595004 - DNA, 20 bp, Artificial
  CRISPR gRNA sequence
tttaaagtgcttttctttaa

SEQ ID NO: 595005 - DNA, 20 bp, Artificial
  CRISPR gRNA sequence
aaagtgcttttctttaaaag

SEQ ID NO: 595006 - DNA, 20 bp, Artificial
  CRISPR gRNA sequence
aagtgcttttctttaaaaga

SEQ ID NO: 595007 - DNA, 20 bp, Artificial
  CRISPR gRNA sequence
taaaagaaggtacatatatt

SEQ ID NO: 595008 - DNA, 20 bp, Artificial
  CRISPR gRNA sequence
aaaagaaggtacatatattt

SEQ ID NO: 595009 - DNA, 20 bp, Artificial
  CRISPR gRNA sequence
catcctacaattcaatctcg

SEQ ID NO: 595010 - DNA, 20 bp, Artificial
  CRISPR gRNA sequence
aagaatacataaacataaaa

SEQ ID NO: 595011 - DNA, 20 bp, Artificial
  CRISPR gRNA sequence
tgctttttttgctaatataa

SEQ ID NO: 595012 - DNA, 20 bp, Artificial
  CRISPR gRNA sequence
aaaaaatgtaaaatctataa

SEQ ID NO: 595013 - DNA, 20 bp, Artificial
  CRISPR gRNA sequence
taaatcaaacaaaaatcaca

SEQ ID NO: 595014 - DNA, 20 bp, Artificial
  CRISPR gRNA sequence
aaatgaccactattcacatt

SEQ ID NO: 595015 - DNA, 20 bp, Artificial
  CRISPR gRNA sequence
aatatacatctatttatata

SEQ ID NO: 595016 - DNA, 20 bp, Artificial
  CRISPR gRNA sequence
acgcttttctttacatattt

SEQ ID NO: 595017 - DNA, 20 bp, Artificial
  CRISPR gRNA sequence
ctatgccataatcattctta

SEQ ID NO: 595018 - DNA, 20 bp, Artificial
  CRISPR gRNA sequence
ataatcattcttaaagcaca

SEQ ID NO: 595019 - DNA, 20 bp, Artificial
  CRISPR gRNA sequence
ttaaagcacatggtttttaa

SEQ ID NO: 595020 - DNA, 20 bp, Artificial
  CRISPR gRNA sequence
ctatttaaaatatttcaaat

SEQ ID NO: 595021 - DNA, 20 bp, Artificial
  CRISPR gRNA sequence
ccgtattaaataatcacttt

SEQ ID NO: 595022 - DNA, 20 bp, Artificial
  CRISPR gRNA sequence
cgtattaaataatcactttg

SEQ ID NO: 595023 - DNA, 20 bp, Artificial
  CRISPR gRNA sequence
tattaaataatcactttgag

SEQ ID NO: 595024 - DNA, 20 bp, Artificial
  CRISPR gRNA sequence
cactttgaggagacttattt

SEQ ID NO: 595025 - DNA, 20 bp, Artificial
  CRISPR gRNA sequence
tttgaggagacttattttag

SEQ ID NO: 595026 - DNA, 20 bp, Artificial
  CRISPR gRNA sequence
acttgaccctaccaaattct

SEQ ID NO: 595027 - DNA, 20 bp, Artificial
  CRISPR gRNA sequence
gaccctaccaaattctcagc

SEQ ID NO: 595028 - DNA, 20 bp, Artificial
  CRISPR gRNA sequence
tctcagcaagtaaaacatgc

SEQ ID NO: 595029 - DNA, 20 bp, Artificial
  CRISPR gRNA sequence
cagcaagtaaaacatgcaag

SEQ ID NO: 595030 - DNA, 20 bp, Artificial
  CRISPR gRNA sequence
tgcaagcagacacaaaatta

SEQ ID NO: 595031 - DNA, 20 bp, Artificial
  CRISPR gRNA sequence
aagcagacacaaaattatag

SEQ ID NO: 595032 - DNA, 20 bp, Artificial
  CRISPR gRNA sequence
ctcaaataaatcaaatctta

SEQ ID NO: 595033 - DNA, 20 bp, Artificial
  CRISPR gRNA sequence
tcaaataaatcaaatcttac

SEQ ID NO: 595034 - DNA, 20 bp, Artificial
  CRISPR gRNA sequence
aataaatcaaatcttacagg

SEQ ID NO: 595035 - DNA, 20 bp, Artificial
  CRISPR gRNA sequence
aaatcaaatcttacaggtag

SEQ ID NO: 595036 - DNA, 20 bp, Artificial
  CRISPR gRNA sequence
taatattcatcttgcaattt

SEQ ID NO: 595037 - DNA, 20 bp, Artificial
  CRISPR gRNA sequence
aatattcatcttgcaatttt

SEQ ID NO: 595038 - DNA, 20 bp, Artificial
  CRISPR gRNA sequence
atattcatcttgcaatttta

SEQ ID NO: 595039 - DNA, 20 bp, Artificial
  CRISPR gRNA sequence
attttagggctacatatcat

SEQ ID NO: 595040 - DNA, 20 bp, Artificial
  CRISPR gRNA sequence
tatcataagtaacacaacca

SEQ ID NO: 595041 - DNA, 20 bp, Artificial
  CRISPR gRNA sequence
atcataagtaacacaaccac

SEQ ID NO: 595042 - DNA, 20 bp, Artificial
  CRISPR gRNA sequence
taacacaaccacaggaataa

SEQ ID NO: 595043 - DNA, 20 bp, Artificial
  CRISPR gRNA sequence
aataatagatgcttgcattg

SEQ ID NO: 595044 - DNA, 20 bp, Artificial
  CRISPR gRNA sequence
ttgcattgaagatactatac

SEQ ID NO: 595045 - DNA, 20 bp, Artificial
  CRISPR gRNA sequence
tgcattgaagatactatact

SEQ ID NO: 595046 - DNA, 20 bp, Artificial
  CRISPR gRNA sequence
atactatactaggtattata

SEQ ID NO: 595047 - DNA, 20 bp, Artificial
  CRISPR gRNA sequence
aaccttgaccacaaccctgt

SEQ ID NO: 595048 - DNA, 20 bp, Artificial
  CRISPR gRNA sequence
accttgaccacaaccctgta

SEQ ID NO: 595049 - DNA, 20 bp, Artificial
  CRISPR gRNA sequence
caaccctgtaaggcatgtat

SEQ ID NO: 595050 - DNA, 20 bp, Artificial
  CRISPR gRNA sequence
ttagtatcacttttttttaa

SEQ ID NO: 595051 - DNA, 20 bp, Artificial
  CRISPR gRNA sequence
tcacttttttttaacagatt

SEQ ID NO: 595052 - DNA, 20 bp, Artificial
  CRISPR gRNA sequence
ttaagaaattaactttctga

SEQ ID NO: 595053 - DNA, 20 bp, Artificial
  CRISPR gRNA sequence
taagaaattaactttctgaa

SEQ ID NO: 595054 - DNA, 20 bp, Artificial
  CRISPR gRNA sequence
aattaactttctgaaaggtt

SEQ ID NO: 595055 - DNA, 20 bp, Artificial
  CRISPR gRNA sequence
gaaaggttaagtaattcaca

SEQ ID NO: 595056 - DNA, 20 bp, Artificial
  CRISPR gRNA sequence
aatgaatcctaccaaaactt

SEQ ID NO: 595057 - DNA, 20 bp, Artificial
  CRISPR gRNA sequence
tcctaccaaaacttaagaca

SEQ ID NO: 595058 - DNA, 20 bp, Artificial
  CRISPR gRNA sequence
tcttgaatcccatttccaaa

SEQ ID NO: 595059 - DNA, 20 bp, Artificial
  CRISPR gRNA sequence
cccatttccaaacagatatt

SEQ ID NO: 595060 - DNA, 20 bp, Artificial
  CRISPR gRNA sequence
ccattattatcatgatgtta

SEQ ID NO: 595061 - DNA, 20 bp, Artificial
  CRISPR gRNA sequence
attatcatgatgttacagta

SEQ ID NO: 595062 - DNA, 20 bp, Artificial
  CRISPR gRNA sequence
gatgttacagtacagcaatt

SEQ ID NO: 595063 - DNA, 20 bp, Artificial
  CRISPR gRNA sequence
atttggcaatactatatttc

SEQ ID NO: 595064 - DNA, 20 bp, Artificial
  CRISPR gRNA sequence
tggcaatactatatttcaag

SEQ ID NO: 595065 - DNA, 20 bp, Artificial
  CRISPR gRNA sequence
tatttcaagaagaaaaacat

SEQ ID NO: 595066 - DNA, 20 bp, Artificial
  CRISPR gRNA sequence
tcaagaagaaaaacataagc

SEQ ID NO: 595067 - DNA, 20 bp, Artificial
  CRISPR gRNA sequence
caagaagaaaaacataagca

SEQ ID NO: 595068 - DNA, 20 bp, Artificial
  CRISPR gRNA sequence
taagcaaggtaaaatatcta

SEQ ID NO: 595069 - DNA, 20 bp, Artificial
  CRISPR gRNA sequence
aaataatattatcatttcta

SEQ ID NO: 595070 - DNA, 20 bp, Artificial
  CRISPR gRNA sequence
agttgcatattgtataaaaa

SEQ ID NO: 595071 - DNA, 20 bp, Artificial
  CRISPR gRNA sequence
gtaaattctaaaatgaacac

SEQ ID NO: 595072 - DNA, 20 bp, Artificial
  CRISPR gRNA sequence
ggtcttgatttttgtacaac

SEQ ID NO: 595073 - DNA, 20 bp, Artificial
  CRISPR gRNA sequence
gttcaatattaattgcttga

SEQ ID NO: 595074 - DNA, 20 bp, Artificial
  CRISPR gRNA sequence
tcaatattaattgcttgatg

SEQ ID NO: 595075 - DNA, 20 bp, Artificial
  CRISPR gRNA sequence
tgcttgatggagttaatgtg

SEQ ID NO: 595076 - DNA, 20 bp, Artificial
  CRISPR gRNA sequence
gcttgatggagttaatgtgt

SEQ ID NO: 595077 - DNA, 20 bp, Artificial
  CRISPR gRNA sequence
gagttaatgtgtaggaaaca

SEQ ID NO: 595078 - DNA, 20 bp, Artificial
  CRISPR gRNA sequence
aaaccatcaacaaatgatct

SEQ ID NO: 595079 - DNA, 20 bp, Artificial
  CRISPR gRNA sequence
tcaacaaatgatctgagtgt

SEQ ID NO: 595080 - DNA, 20 bp, Artificial
  CRISPR gRNA sequence
caacaaatgatctgagtgta

SEQ ID NO: 595081 - DNA, 20 bp, Artificial
  CRISPR gRNA sequence
taaggaatctacatctaaat

SEQ ID NO: 595082 - DNA, 20 bp, Artificial
  CRISPR gRNA sequence
aaggaatctacatctaaatt

SEQ ID NO: 595083 - DNA, 20 bp, Artificial
  CRISPR gRNA sequence
tctacatctaaattgggtgt

SEQ ID NO: 595084 - DNA, 20 bp, Artificial
  CRISPR gRNA sequence
ctacatctaaattgggtgtt

SEQ ID NO: 595085 - DNA, 20 bp, Artificial
  CRISPR gRNA sequence
tacatctaaattgggtgttg

SEQ ID NO: 595086 - DNA, 20 bp, Artificial
  CRISPR gRNA sequence
atctaaattgggtgttgggg

SEQ ID NO: 595087 - DNA, 20 bp, Artificial
  CRISPR gRNA sequence
gtgttggggaagcaaattaa

SEQ ID NO: 595088 - DNA, 20 bp, Artificial
  CRISPR gRNA sequence
agcaaattaatggattacac

SEQ ID NO: 595089 - DNA, 20 bp, Artificial
  CRISPR gRNA sequence
tggattacaccagtttctta

SEQ ID NO: 595090 - DNA, 20 bp, Artificial
  CRISPR gRNA sequence
ccagtttcttacagttccac

SEQ ID NO: 595091 - DNA, 20 bp, Artificial
  CRISPR gRNA sequence
cttacagttccactggcaaa

SEQ ID NO: 595092 - DNA, 20 bp, Artificial
  CRISPR gRNA sequence
gttccactggcaaacagttg

SEQ ID NO: 595093 - DNA, 20 bp, Artificial
  CRISPR gRNA sequence
ttccactggcaaacagttga

SEQ ID NO: 595094 - DNA, 20 bp, Artificial
  CRISPR gRNA sequence
tccactggcaaacagttgaa

SEQ ID NO: 595095 - DNA, 20 bp, Artificial
  CRISPR gRNA sequence
agttgaagggctgacacttt

SEQ ID NO: 595096 - DNA, 20 bp, Artificial
  CRISPR gRNA sequence
acactttcagtctcacccta

SEQ ID NO: 595097 - DNA, 20 bp, Artificial
  CRISPR gRNA sequence
aaaaaaactaatatttactg

SEQ ID NO: 595098 - DNA, 20 bp, Artificial
  CRISPR gRNA sequence
aactaatatttactgtggtt

SEQ ID NO: 595099 - DNA, 20 bp, Artificial
  CRISPR gRNA sequence
tgtggtttagttgttattat

SEQ ID NO: 595100 - DNA, 20 bp, Artificial
  CRISPR gRNA sequence
tttgttttgatgttgtcaaa

SEQ ID NO: 595101 - DNA, 20 bp, Artificial
  CRISPR gRNA sequence
ttgttttgatgttgtcaaat

SEQ ID NO: 595102 - DNA, 20 bp, Artificial
  CRISPR gRNA sequence
ttttgatgttgtcaaatagg

SEQ ID NO: 595103 - DNA, 20 bp, Artificial
  CRISPR gRNA sequence
caaataggtagatatttgaa

SEQ ID NO: 595104 - DNA, 20 bp, Artificial
  CRISPR gRNA sequence
tgaatggttcaaaaatcaaa

SEQ ID NO: 595105 - DNA, 20 bp, Artificial
  CRISPR gRNA sequence
tcaaaaatcaaaaagtataa

SEQ ID NO: 595106 - DNA, 20 bp, Artificial
  CRISPR gRNA sequence
aaaaagtataaaagtatatc

SEQ ID NO: 595107 - DNA, 20 bp, Artificial
  CRISPR gRNA sequence
gtataaaagtatatctagtg

SEQ ID NO: 595108 - DNA, 20 bp, Artificial
  CRISPR gRNA sequence
ataaaagtatatctagtgaa

SEQ ID NO: 595109 - DNA, 20 bp, Artificial
  CRISPR gRNA sequence
tgaagagtcttgttccatcc

SEQ ID NO: 595110 - DNA, 20 bp, Artificial
  CRISPR gRNA sequence
atcccagcccctcatctgct

SEQ ID NO: 595111 - DNA, 20 bp, Artificial
  CRISPR gRNA sequence
taccttcttgtttatcctat

SEQ ID NO: 595112 - DNA, 20 bp, Artificial
  CRISPR gRNA sequence
gagtttttaaatataattat

SEQ ID NO: 595113 - DNA, 20 bp, Artificial
  CRISPR gRNA sequence
taattattagtaaacatttc

SEQ ID NO: 595114 - DNA, 20 bp, Artificial
  CRISPR gRNA sequence
aattattagtaaacatttct

SEQ ID NO: 595115 - DNA, 20 bp, Artificial
  CRISPR gRNA sequence
attattagtaaacatttctg

SEQ ID NO: 595116 - DNA, 20 bp, Artificial
  CRISPR gRNA sequence
cccttccttttttttaatct

SEQ ID NO: 595117 - DNA, 20 bp, Artificial
  CRISPR gRNA sequence
cttgcataatattcaattat

SEQ ID NO: 595118 - DNA, 20 bp, Artificial
  CRISPR gRNA sequence
tttaatcaatccactactga

SEQ ID NO: 595119 - DNA, 20 bp, Artificial
  CRISPR gRNA sequence
ttaatcaatccactactgat

SEQ ID NO: 595120 - DNA, 20 bp, Artificial
  CRISPR gRNA sequence
aacatttgacaaattattat

SEQ ID NO: 595121 - DNA, 20 bp, Artificial
  CRISPR gRNA sequence
attattataagataaatttg

SEQ ID NO: 595122 - DNA, 20 bp, Artificial
  CRISPR gRNA sequence
ataagataaatttgtagaaa

SEQ ID NO: 595123 - DNA, 20 bp, Artificial
  CRISPR gRNA sequence
taagataaatttgtagaaac

SEQ ID NO: 595124 - DNA, 20 bp, Artificial
  CRISPR gRNA sequence
agataaatttgtagaaacag

SEQ ID NO: 595125 - DNA, 20 bp, Artificial
  CRISPR gRNA sequence
tttgtagaaacaggagtact

SEQ ID NO: 595126 - DNA, 20 bp, Artificial
  CRISPR gRNA sequence
gaaacaggagtactgagtca

SEQ ID NO: 595127 - DNA, 20 bp, Artificial
  CRISPR gRNA sequence
agtactgagtcaaagtttat

SEQ ID NO: 595128 - DNA, 20 bp, Artificial
  CRISPR gRNA sequence
ctcccatcaacaatacataa

SEQ ID NO: 595129 - DNA, 20 bp, Artificial
  CRISPR gRNA sequence
tcccatcaacaatacataaa

SEQ ID NO: 595130 - DNA, 20 bp, Artificial
  CRISPR gRNA sequence
taaaaggccctgtttccttg

SEQ ID NO: 595131 - DNA, 20 bp, Artificial
  CRISPR gRNA sequence
tccttgcagccttgccaaca

SEQ ID NO: 595132 - DNA, 20 bp, Artificial
  CRISPR gRNA sequence
acagcatgacacaaaatttt

SEQ ID NO: 595133 - DNA, 20 bp, Artificial
  CRISPR gRNA sequence
tttttgctaatataatgaat

SEQ ID NO: 595134 - DNA, 20 bp, Artificial
  CRISPR gRNA sequence
atgaattagacatgctatgt

SEQ ID NO: 595135 - DNA, 20 bp, Artificial
  CRISPR gRNA sequence
ttagacatgctatgtcagta

SEQ ID NO: 595136 - DNA, 20 bp, Artificial
  CRISPR gRNA sequence
gttttatatacctcctattt

SEQ ID NO: 595137 - DNA, 20 bp, Artificial
  CRISPR gRNA sequence
ttttatatacctcctatttt

SEQ ID NO: 595138 - DNA, 20 bp, Artificial
  CRISPR gRNA sequence
tatacctcctattttgggtg

SEQ ID NO: 595139 - DNA, 20 bp, Artificial
  CRISPR gRNA sequence
ctcctattttgggtgaagtt

SEQ ID NO: 595140 - DNA, 20 bp, Artificial
  CRISPR gRNA sequence
taagaaaaactttatatgtg

SEQ ID NO: 595141 - DNA, 20 bp, Artificial
  CRISPR gRNA sequence
aagaaaaactttatatgtgt

SEQ ID NO: 595142 - DNA, 20 bp, Artificial
  CRISPR gRNA sequence
gaaaaactttatatgtgtag

SEQ ID NO: 595143 - DNA, 20 bp, Artificial
  CRISPR gRNA sequence
tttatatgtgtaggagccaa

SEQ ID NO: 595144 - DNA, 20 bp, Artificial
  CRISPR gRNA sequence
tttttctgtgaactgtgtgt

SEQ ID NO: 595145 - DNA, 20 bp, Artificial
  CRISPR gRNA sequence
taatttaaccaaatttctat

SEQ ID NO: 595146 - DNA, 20 bp, Artificial
  CRISPR gRNA sequence
attagatacttactgtactt

SEQ ID NO: 595147 - DNA, 20 bp, Artificial
  CRISPR gRNA sequence
ttagatacttactgtacttc

SEQ ID NO: 595148 - DNA, 20 bp, Artificial
  CRISPR gRNA sequence
tactgtacttcaggaattac

SEQ ID NO: 595149 - DNA, 20 bp, Artificial
  CRISPR gRNA sequence
actgtacttcaggaattact

SEQ ID NO: 595150 - DNA, 20 bp, Artificial
  CRISPR gRNA sequence
tgtacttcaggaattactag

SEQ ID NO: 595151 - DNA, 20 bp, Artificial
  CRISPR gRNA sequence
tactaggagctgttatgtat

SEQ ID NO: 595152 - DNA, 20 bp, Artificial
  CRISPR gRNA sequence
ctaggagctgttatgtatta

SEQ ID NO: 595153 - DNA, 20 bp, Artificial
  CRISPR gRNA sequence
gtattagagattaaccgttt

SEQ ID NO: 595154 - DNA, 20 bp, Artificial
  CRISPR gRNA sequence
aaccgtttaagtcatcatat

SEQ ID NO: 595155 - DNA, 20 bp, Artificial
  CRISPR gRNA sequence
tgagttgcaaattttacctc

SEQ ID NO: 595156 - DNA, 20 bp, Artificial
  CRISPR gRNA sequence
ccagcttgttgtttaccttt

SEQ ID NO: 595157 - DNA, 20 bp, Artificial
  CRISPR gRNA sequence
ttatgctattttttgccatg

SEQ ID NO: 595158 - DNA, 20 bp, Artificial
  CRISPR gRNA sequence
aatcctttgaaattgacttt

SEQ ID NO: 595159 - DNA, 20 bp, Artificial
  CRISPR gRNA sequence
agatattgaattttattaaa

SEQ ID NO: 595160 - DNA, 20 bp, Artificial
  CRISPR gRNA sequence
atattgaattttattaaaaa

SEQ ID NO: 595161 - DNA, 20 bp, Artificial
  CRISPR gRNA sequence
ttattaaaaagagcttccca

SEQ ID NO: 595162 - DNA, 20 bp, Artificial
  CRISPR gRNA sequence
taaaaagagcttcccatagt

SEQ ID NO: 595163 - DNA, 20 bp, Artificial
  CRISPR gRNA sequence
tcccatagtaagaccataat

SEQ ID NO: 595164 - DNA, 20 bp, Artificial
  CRISPR gRNA sequence
attttcttctattacttata

SEQ ID NO: 595165 - DNA, 20 bp, Artificial
  CRISPR gRNA sequence
tatatatctttgttccaatt

SEQ ID NO: 595166 - DNA, 20 bp, Artificial
  CRISPR gRNA sequence
tatatctttgttccaattca

SEQ ID NO: 595167 - DNA, 20 bp, Artificial
  CRISPR gRNA sequence
ccaattcagagtttatcctg

SEQ ID NO: 595168 - DNA, 20 bp, Artificial
  CRISPR gRNA sequence
tcagagtttatcctgaagtt

SEQ ID NO: 595169 - DNA, 20 bp, Artificial
  CRISPR gRNA sequence
tttatcctgaagttcagtat

SEQ ID NO: 595170 - DNA, 20 bp, Artificial
  CRISPR gRNA sequence
tgaagttcagtataagatat

SEQ ID NO: 595171 - DNA, 20 bp, Artificial
  CRISPR gRNA sequence
aatattgcatctacctgtga

SEQ ID NO: 595172 - DNA, 20 bp, Artificial
  CRISPR gRNA sequence
acctgtgaaagaatacttca

SEQ ID NO: 595173 - DNA, 20 bp, Artificial
  CRISPR gRNA sequence
cagtatatcttccccatttt

SEQ ID NO: 595174 - DNA, 20 bp, Artificial
  CRISPR gRNA sequence
aatattacacatttaaatat

SEQ ID NO: 595175 - DNA, 20 bp, Artificial
  CRISPR gRNA sequence
tttatgaattatttgtcttt

SEQ ID NO: 595176 - DNA, 20 bp, Artificial
  CRISPR gRNA sequence
gtctttcagctgattctctg

SEQ ID NO: 595177 - DNA, 20 bp, Artificial
  CRISPR gRNA sequence
agctgattctctgcagttta

SEQ ID NO: 595178 - DNA, 20 bp, Artificial
  CRISPR gRNA sequence
caaaacataccatctgcaaa

SEQ ID NO: 595179 - DNA, 20 bp, Artificial
  CRISPR gRNA sequence
tttttattatctaaatccat

SEQ ID NO: 595180 - DNA, 20 bp, Artificial
  CRISPR gRNA sequence
ttattatctaaatccattgg

SEQ ID NO: 595181 - DNA, 20 bp, Artificial
  CRISPR gRNA sequence
aatccattggcagtttcgtc

SEQ ID NO: 595182 - DNA, 20 bp, Artificial
  CRISPR gRNA sequence
cgtccagcacaatattaaaa

SEQ ID NO: 595183 - DNA, 20 bp, Artificial
  CRISPR gRNA sequence
tccagcacaatattaaaaaa

SEQ ID NO: 595184 - DNA, 20 bp, Artificial
  CRISPR gRNA sequence
cacaatattaaaaaagagta

SEQ ID NO: 595185 - DNA, 20 bp, Artificial
  CRISPR gRNA sequence
caatattaaaaaagagtaaa

SEQ ID NO: 595186 - DNA, 20 bp, Artificial
  CRISPR gRNA sequence
gagaacaaacaaaatctacc

SEQ ID NO: 595187 - DNA, 20 bp, Artificial
  CRISPR gRNA sequence
acctagtttctgaaattact

SEQ ID NO: 595188 - DNA, 20 bp, Artificial
  CRISPR gRNA sequence
tgttttcctatgaatcataa

SEQ ID NO: 595189 - DNA, 20 bp, Artificial
  CRISPR gRNA sequence
ctatgaatcataatggcttt

SEQ ID NO: 595190 - DNA, 20 bp, Artificial
  CRISPR gRNA sequence
acatacatttgatcactatg

SEQ ID NO: 595191 - DNA, 20 bp, Artificial
  CRISPR gRNA sequence
tacatttgatcactatgaag

SEQ ID NO: 595192 - DNA, 20 bp, Artificial
  CRISPR gRNA sequence
ttccctttatttctgtttac

SEQ ID NO: 595193 - DNA, 20 bp, Artificial
  CRISPR gRNA sequence
tccctttatttctgtttact

SEQ ID NO: 595194 - DNA, 20 bp, Artificial
  CRISPR gRNA sequence
ttatttctgtttactgggtg

SEQ ID NO: 595195 - DNA, 20 bp, Artificial
  CRISPR gRNA sequence
atttctgtttactgggtgta

SEQ ID NO: 595196 - DNA, 20 bp, Artificial
  CRISPR gRNA sequence
tgtttactgggtgtagagaa

SEQ ID NO: 595197 - DNA, 20 bp, Artificial
  CRISPR gRNA sequence
ctatgttttttcactgtcta

SEQ ID NO: 595198 - DNA, 20 bp, Artificial
  CRISPR gRNA sequence
atgttttttcactgtctata

SEQ ID NO: 595199 - DNA, 20 bp, Artificial
  CRISPR gRNA sequence
aatcatatgattgttctctt

SEQ ID NO: 595200 - DNA, 20 bp, Artificial
  CRISPR gRNA sequence
tagtttaatatgataaatat

SEQ ID NO: 595201 - DNA, 20 bp, Artificial
  CRISPR gRNA sequence
taataacaaattattacttt

SEQ ID NO: 595202 - DNA, 20 bp, Artificial
  CRISPR gRNA sequence
aataacaaattattactttc

SEQ ID NO: 595203 - DNA, 20 bp, Artificial
  CRISPR gRNA sequence
ataacaaattattactttca

SEQ ID NO: 595204 - DNA, 20 bp, Artificial
  CRISPR gRNA sequence
caaattgtaatttatttttt

SEQ ID NO: 595205 - DNA, 20 bp, Artificial
  CRISPR gRNA sequence
tagaaactgcctcttctttt

SEQ ID NO: 595206 - DNA, 20 bp, Artificial
  CRISPR gRNA sequence
attattacttgatattgtta

SEQ ID NO: 595207 - DNA, 20 bp, Artificial
  CRISPR gRNA sequence
ttattacttgatattgttaa

SEQ ID NO: 595208 - DNA, 20 bp, Artificial
  CRISPR gRNA sequence
acttgatattgttaaaggac

SEQ ID NO: 595209 - DNA, 20 bp, Artificial
  CRISPR gRNA sequence
ttgatattgttaaaggacaa

SEQ ID NO: 595210 - DNA, 20 bp, Artificial
  CRISPR gRNA sequence
tgatattgttaaaggacaag

SEQ ID NO: 595211 - DNA, 20 bp, Artificial
  CRISPR gRNA sequence
ttgttaaaggacaagaggcc

SEQ ID NO: 595212 - DNA, 20 bp, Artificial
  CRISPR gRNA sequence
ggacaagaggccaagcctta

SEQ ID NO: 595213 - DNA, 20 bp, Artificial
  CRISPR gRNA sequence
agcaataaaaaattaccaac

SEQ ID NO: 595214 - DNA, 20 bp, Artificial
  CRISPR gRNA sequence
ataaaaaattaccaaccaga

SEQ ID NO: 595215 - DNA, 20 bp, Artificial
  CRISPR gRNA sequence
ttaccaaccagaaagatttg

SEQ ID NO: 595216 - DNA, 20 bp, Artificial
  CRISPR gRNA sequence
accaaccagaaagatttgca

SEQ ID NO: 595217 - DNA, 20 bp, Artificial
  CRISPR gRNA sequence
ccaaccagaaagatttgcag

SEQ ID NO: 595218 - DNA, 20 bp, Artificial
  CRISPR gRNA sequence
aaccagaaagatttgcagag

SEQ ID NO: 595219 - DNA, 20 bp, Artificial
  CRISPR gRNA sequence
agatttgcagaggagaactt

SEQ ID NO: 595220 - DNA, 20 bp, Artificial
  CRISPR gRNA sequence
gatttgcagaggagaacttt

SEQ ID NO: 595221 - DNA, 20 bp, Artificial
  CRISPR gRNA sequence
gcagaggagaactttaggtt

SEQ ID NO: 595222 - DNA, 20 bp, Artificial
  CRISPR gRNA sequence
cagaggagaactttaggttg

SEQ ID NO: 595223 - DNA, 20 bp, Artificial
  CRISPR gRNA sequence
gaggagaactttaggttgag

SEQ ID NO: 595224 - DNA, 20 bp, Artificial
  CRISPR gRNA sequence
gagaactttaggttgaggag

SEQ ID NO: 595225 - DNA, 20 bp, Artificial
  CRISPR gRNA sequence
agaactttaggttgaggagc

SEQ ID NO: 595226 - DNA, 20 bp, Artificial
  CRISPR gRNA sequence
gaggagcaggtataaactaa

SEQ ID NO: 595227 - DNA, 20 bp, Artificial
  CRISPR gRNA sequence
tagattatgtttgataatta

SEQ ID NO: 595228 - DNA, 20 bp, Artificial
  CRISPR gRNA sequence
tttgataattacagtttcat

SEQ ID NO: 595229 - DNA, 20 bp, Artificial
  CRISPR gRNA sequence
taattacagtttcattggtt

SEQ ID NO: 595230 - DNA, 20 bp, Artificial
  CRISPR gRNA sequence
tttcattggttaagaactgt

SEQ ID NO: 595231 - DNA, 20 bp, Artificial
  CRISPR gRNA sequence
aactgtgagactaacatttt

SEQ ID NO: 595232 - DNA, 20 bp, Artificial
  CRISPR gRNA sequence
acattttcagtcctactcca

SEQ ID NO: 595233 - DNA, 20 bp, Artificial
  CRISPR gRNA sequence
cattttcagtcctactccat

SEQ ID NO: 595234 - DNA, 20 bp, Artificial
  CRISPR gRNA sequence
attttcagtcctactccata

SEQ ID NO: 595235 - DNA, 20 bp, Artificial
  CRISPR gRNA sequence
ccatagggaaattatatgct

SEQ ID NO: 595236 - DNA, 20 bp, Artificial
  CRISPR gRNA sequence
tagggaaattatatgctcag

SEQ ID NO: 595237 - DNA, 20 bp, Artificial
  CRISPR gRNA sequence
ggaaattatatgctcagcag

SEQ ID NO: 595238 - DNA, 20 bp, Artificial
  CRISPR gRNA sequence
ttttatcctaacactgttta

SEQ ID NO: 595239 - DNA, 20 bp, Artificial
  CRISPR gRNA sequence
tttatcctaacactgtttat

SEQ ID NO: 595240 - DNA, 20 bp, Artificial
  CRISPR gRNA sequence
aacaatacattaattcaact

SEQ ID NO: 595241 - DNA, 20 bp, Artificial
  CRISPR gRNA sequence
tacattaattcaacttagta

SEQ ID NO: 595242 - DNA, 20 bp, Artificial
  CRISPR gRNA sequence
actgaacatcaactattttc

SEQ ID NO: 595243 - DNA, 20 bp, Artificial
  CRISPR gRNA sequence
ctgaacatcaactattttca

SEQ ID NO: 595244 - DNA, 20 bp, Artificial
  CRISPR gRNA sequence
tcaactattttcaaggtatt

SEQ ID NO: 595245 - DNA, 20 bp, Artificial
  CRISPR gRNA sequence
ttcaaggtattgagattgtg

SEQ ID NO: 595246 - DNA, 20 bp, Artificial
  CRISPR gRNA sequence
ggtattgagattgtgtagtt

SEQ ID NO: 595247 - DNA, 20 bp, Artificial
  CRISPR gRNA sequence
attgagattgtgtagttcag

SEQ ID NO: 595248 - DNA, 20 bp, Artificial
  CRISPR gRNA sequence
ttgcaaacttttttttgacc

SEQ ID NO: 595249 - DNA, 20 bp, Artificial
  CRISPR gRNA sequence
aaacttttttttgacccaga

SEQ ID NO: 595250 - DNA, 20 bp, Artificial
  CRISPR gRNA sequence
catattaatgtttatgaaaa

SEQ ID NO: 595251 - DNA, 20 bp, Artificial
  CRISPR gRNA sequence
aacaatactacacataatca

SEQ ID NO: 595252 - DNA, 20 bp, Artificial
  CRISPR gRNA sequence
tccttctttctttttttttt

SEQ ID NO: 595253 - DNA, 20 bp, Artificial
  CRISPR gRNA sequence
tctttcttttttttttaaga

SEQ ID NO: 595254 - DNA, 20 bp, Artificial
  CRISPR gRNA sequence
ctttcttttttttttaagac

SEQ ID NO: 595255 - DNA, 20 bp, Artificial
  CRISPR gRNA sequence
tttcttttttttttaagaca

SEQ ID NO: 595256 - DNA, 20 bp, Artificial
  CRISPR gRNA sequence
cagggtctcaccctgtctcc

SEQ ID NO: 595257 - DNA, 20 bp, Artificial
  CRISPR gRNA sequence
ctcaccctgtctcccagtga

SEQ ID NO: 595258 - DNA, 20 bp, Artificial
  CRISPR gRNA sequence
tctcccagtgacagattgtg

SEQ ID NO: 595259 - DNA, 20 bp, Artificial
  CRISPR gRNA sequence
cccagtgacagattgtgcag

SEQ ID NO: 595260 - DNA, 20 bp, Artificial
  CRISPR gRNA sequence
attgtgcagtggcacgatca

SEQ ID NO: 595261 - DNA, 20 bp, Artificial
  CRISPR gRNA sequence
gtggcacgatcacagctcac

SEQ ID NO: 595262 - DNA, 20 bp, Artificial
  CRISPR gRNA sequence
agctcactagccatgaactc

SEQ ID NO: 595263 - DNA, 20 bp, Artificial
  CRISPR gRNA sequence
gctcactagccatgaactcc

SEQ ID NO: 595264 - DNA, 20 bp, Artificial
  CRISPR gRNA sequence
ctcactagccatgaactcca

SEQ ID NO: 595265 - DNA, 20 bp, Artificial
  CRISPR gRNA sequence
agccatgaactccagggctc

SEQ ID NO: 595266 - DNA, 20 bp, Artificial
  CRISPR gRNA sequence
ctcaagtgatcctcttgcct

SEQ ID NO: 595267 - DNA, 20 bp, Artificial
  CRISPR gRNA sequence
tcttgcctcagccttctgca

SEQ ID NO: 595268 - DNA, 20 bp, Artificial
  CRISPR gRNA sequence
cttctgcatagctaaaatta

SEQ ID NO: 595269 - DNA, 20 bp, Artificial
  CRISPR gRNA sequence
ttctgcatagctaaaattac

SEQ ID NO: 595270 - DNA, 20 bp, Artificial
  CRISPR gRNA sequence
atagctaaaattacaggtgc

SEQ ID NO: 595271 - DNA, 20 bp, Artificial
  CRISPR gRNA sequence
aaattacaggtgcaagccac

SEQ ID NO: 595272 - DNA, 20 bp, Artificial
  CRISPR gRNA sequence
aattacaggtgcaagccact

SEQ ID NO: 595273 - DNA, 20 bp, Artificial
  CRISPR gRNA sequence
caggtgcaagccactgggcc

SEQ ID NO: 595274 - DNA, 20 bp, Artificial
  CRISPR gRNA sequence
attccatatcatttttacta

SEQ ID NO: 595275 - DNA, 20 bp, Artificial
  CRISPR gRNA sequence
tatcatttttactaaagtgt

SEQ ID NO: 595276 - DNA, 20 bp, Artificial
  CRISPR gRNA sequence
ccataataaattaaaattta

SEQ ID NO: 595277 - DNA, 20 bp, Artificial
  CRISPR gRNA sequence
taaattaaaatttacagtgt

SEQ ID NO: 595278 - DNA, 20 bp, Artificial
  CRISPR gRNA sequence
cagtgttagaaatatcatat

SEQ ID NO: 595279 - DNA, 20 bp, Artificial
  CRISPR gRNA sequence
ttagaaatatcatattagct

SEQ ID NO: 595280 - DNA, 20 bp, Artificial
  CRISPR gRNA sequence
atatcatattagctaagacg

SEQ ID NO: 595281 - DNA, 20 bp, Artificial
  CRISPR gRNA sequence
tatcatattagctaagacga

SEQ ID NO: 595282 - DNA, 20 bp, Artificial
  CRISPR gRNA sequence
ttagctaagacgaaggattc

SEQ ID NO: 595283 - DNA, 20 bp, Artificial
  CRISPR gRNA sequence
aagacgaaggattctggaac

SEQ ID NO: 595284 - DNA, 20 bp, Artificial
  CRISPR gRNA sequence
agacgaaggattctggaact

SEQ ID NO: 595285 - DNA, 20 bp, Artificial
  CRISPR gRNA sequence
gattctggaactaggcaacc

SEQ ID NO: 595286 - DNA, 20 bp, Artificial
  CRISPR gRNA sequence
attctggaactaggcaacca

SEQ ID NO: 595287 - DNA, 20 bp, Artificial
  CRISPR gRNA sequence
ggcaaccaaggtttgaatca

SEQ ID NO: 595288 - DNA, 20 bp, Artificial
  CRISPR gRNA sequence
atcacagctttacctcttaa

SEQ ID NO: 595289 - DNA, 20 bp, Artificial
  CRISPR gRNA sequence
aatggcttttaattgcacct

SEQ ID NO: 595290 - DNA, 20 bp, Artificial
  CRISPR gRNA sequence
cctcagtttttcatctataa

SEQ ID NO: 595291 - DNA, 20 bp, Artificial
  CRISPR gRNA sequence
cagtttttcatctataacag

SEQ ID NO: 595292 - DNA, 20 bp, Artificial
  CRISPR gRNA sequence
agtttttcatctataacagc

SEQ ID NO: 595293 - DNA, 20 bp, Artificial
  CRISPR gRNA sequence
gtttttcatctataacagcg

SEQ ID NO: 595294 - DNA, 20 bp, Artificial
  CRISPR gRNA sequence
ctataacagcggggcaatac

SEQ ID NO: 595295 - DNA, 20 bp, Artificial
  CRISPR gRNA sequence
caatactagcatctacctca

SEQ ID NO: 595296 - DNA, 20 bp, Artificial
  CRISPR gRNA sequence
aatactagcatctacctcat

SEQ ID NO: 595297 - DNA, 20 bp, Artificial
  CRISPR gRNA sequence
atactagcatctacctcata

SEQ ID NO: 595298 - DNA, 20 bp, Artificial
  CRISPR gRNA sequence
ctacctcatagggttttatt

SEQ ID NO: 595299 - DNA, 20 bp, Artificial
  CRISPR gRNA sequence
aaacatttcccttgatccta

SEQ ID NO: 595300 - DNA, 20 bp, Artificial
  CRISPR gRNA sequence
gatcctacagttgctaaaaa

SEQ ID NO: 595301 - DNA, 20 bp, Artificial
  CRISPR gRNA sequence
tccccaaaatacaaaaactg

SEQ ID NO: 595302 - DNA, 20 bp, Artificial
  CRISPR gRNA sequence
cccaaaatacaaaaactgtg

SEQ ID NO: 595303 - DNA, 20 bp, Artificial
  CRISPR gRNA sequence
aaaaactgtggagaaatcat

SEQ ID NO: 595304 - DNA, 20 bp, Artificial
  CRISPR gRNA sequence
tggagaaatcattagatata

SEQ ID NO: 595305 - DNA, 20 bp, Artificial
  CRISPR gRNA sequence
catctaaaaaaaataattat

SEQ ID NO: 595306 - DNA, 20 bp, Artificial
  CRISPR gRNA sequence
aaatatctgattgtttttta

SEQ ID NO: 595307 - DNA, 20 bp, Artificial
  CRISPR gRNA sequence
tttttaaagtgaatctgaac

SEQ ID NO: 595308 - DNA, 20 bp, Artificial
  CRISPR gRNA sequence
tgaactggatcttctctttc

SEQ ID NO: 595309 - DNA, 20 bp, Artificial
  CRISPR gRNA sequence
gaactggatcttctctttca

SEQ ID NO: 595310 - DNA, 20 bp, Artificial
  CRISPR gRNA sequence
atcttctctttcaaggcctt

SEQ ID NO: 595311 - DNA, 20 bp, Artificial
  CRISPR gRNA sequence
tttcaaggccttgagataac

SEQ ID NO: 595312 - DNA, 20 bp, Artificial
  CRISPR gRNA sequence
ttgagataaccagtaaatat

SEQ ID NO: 595313 - DNA, 20 bp, Artificial
  CRISPR gRNA sequence
ataaccagtaaatattagct

SEQ ID NO: 595314 - DNA, 20 bp, Artificial
  CRISPR gRNA sequence
agctaagttaaataatcatt

SEQ ID NO: 595315 - DNA, 20 bp, Artificial
  CRISPR gRNA sequence
tcttttattcctactttata

SEQ ID NO: 595316 - DNA, 20 bp, Artificial
  CRISPR gRNA sequence
ccttgctccaatgactatca

SEQ ID NO: 595317 - DNA, 20 bp, Artificial
  CRISPR gRNA sequence
tgctccaatgactatcaaag

SEQ ID NO: 595318 - DNA, 20 bp, Artificial
  CRISPR gRNA sequence
tcaaagaagttgataacact

SEQ ID NO: 595319 - DNA, 20 bp, Artificial
  CRISPR gRNA sequence
aaagaagttgataacactaa

SEQ ID NO: 595320 - DNA, 20 bp, Artificial
  CRISPR gRNA sequence
gttgataacactaagagact

SEQ ID NO: 595321 - DNA, 20 bp, Artificial
  CRISPR gRNA sequence
gataacactaagagacttag

SEQ ID NO: 595322 - DNA, 20 bp, Artificial
  CRISPR gRNA sequence
taacactaagagacttagtg

SEQ ID NO: 595323 - DNA, 20 bp, Artificial
  CRISPR gRNA sequence
gacttagtggagatctataa

SEQ ID NO: 595324 - DNA, 20 bp, Artificial
  CRISPR gRNA sequence
aactccaactcattctgaaa

SEQ ID NO: 595325 - DNA, 20 bp, Artificial
  CRISPR gRNA sequence
actcattctgaaatggtatg

SEQ ID NO: 595326 - DNA, 20 bp, Artificial
  CRISPR gRNA sequence
tcattctgaaatggtatgca

SEQ ID NO: 595327 - DNA, 20 bp, Artificial
  CRISPR gRNA sequence
attctgaaatggtatgcaga

SEQ ID NO: 595328 - DNA, 20 bp, Artificial
  CRISPR gRNA sequence
ctgaaatggtatgcagagag

SEQ ID NO: 595329 - DNA, 20 bp, Artificial
  CRISPR gRNA sequence
agagagtagcctaatcttta

SEQ ID NO: 595330 - DNA, 20 bp, Artificial
  CRISPR gRNA sequence
agcctaatctttacagtatt

SEQ ID NO: 595331 - DNA, 20 bp, Artificial
  CRISPR gRNA sequence
gcctaatctttacagtattt

SEQ ID NO: 595332 - DNA, 20 bp, Artificial
  CRISPR gRNA sequence
ctaatctttacagtatttag

SEQ ID NO: 595333 - DNA, 20 bp, Artificial
  CRISPR gRNA sequence
gagtttaaacatcttaaaat

SEQ ID NO: 595334 - DNA, 20 bp, Artificial
  CRISPR gRNA sequence
taaacatcttaaaatcagcc

SEQ ID NO: 595335 - DNA, 20 bp, Artificial
  CRISPR gRNA sequence
aacatcttaaaatcagcctg

SEQ ID NO: 595336 - DNA, 20 bp, Artificial
  CRISPR gRNA sequence
acatcttaaaatcagcctgg

SEQ ID NO: 595337 - DNA, 20 bp, Artificial
  CRISPR gRNA sequence
cttaaaatcagcctggagga

SEQ ID NO: 595338 - DNA, 20 bp, Artificial
  CRISPR gRNA sequence
atcttatctcttccttaact

SEQ ID NO: 595339 - DNA, 20 bp, Artificial
  CRISPR gRNA sequence
cttccttaactcagtttttt

SEQ ID NO: 595340 - DNA, 20 bp, Artificial
  CRISPR gRNA sequence
ttccttaactcagttttttt

SEQ ID NO: 595341 - DNA, 20 bp, Artificial
  CRISPR gRNA sequence
tccttaactcagtttttttg

SEQ ID NO: 595342 - DNA, 20 bp, Artificial
  CRISPR gRNA sequence
gtttttttggggcctcttca

SEQ ID NO: 595343 - DNA, 20 bp, Artificial
  CRISPR gRNA sequence
ggcctcttcaaagttaactt

SEQ ID NO: 595344 - DNA, 20 bp, Artificial
  CRISPR gRNA sequence
cctcttcaaagttaacttta

SEQ ID NO: 595345 - DNA, 20 bp, Artificial
  CRISPR gRNA sequence
aaagttaactttagagccca

SEQ ID NO: 595346 - DNA, 20 bp, Artificial
  CRISPR gRNA sequence
agttaactttagagcccatg

SEQ ID NO: 595347 - DNA, 20 bp, Artificial
  CRISPR gRNA sequence
actttagagcccatggagaa

SEQ ID NO: 595348 - DNA, 20 bp, Artificial
  CRISPR gRNA sequence
acataattttactattacat

SEQ ID NO: 595349 - DNA, 20 bp, Artificial
  CRISPR gRNA sequence
ttactattacataagcttgc

SEQ ID NO: 595350 - DNA, 20 bp, Artificial
  CRISPR gRNA sequence
tactattacataagcttgct

SEQ ID NO: 595351 - DNA, 20 bp, Artificial
  CRISPR gRNA sequence
tatccattgtacaaaacaaa

SEQ ID NO: 595352 - DNA, 20 bp, Artificial
  CRISPR gRNA sequence
acaaatggtattaaaacctc

SEQ ID NO: 595353 - DNA, 20 bp, Artificial
  CRISPR gRNA sequence
gtaaatatactacctacttt

SEQ ID NO: 595354 - DNA, 20 bp, Artificial
  CRISPR gRNA sequence
taaatatactacctactttc

SEQ ID NO: 595355 - DNA, 20 bp, Artificial
  CRISPR gRNA sequence
ctactttcaggtacaatctc

SEQ ID NO: 595356 - DNA, 20 bp, Artificial
  CRISPR gRNA sequence
gtctgtttctctaaaaaaca

SEQ ID NO: 595357 - DNA, 20 bp, Artificial
  CRISPR gRNA sequence
aaacaaagaaccatgtttca

SEQ ID NO: 595358 - DNA, 20 bp, Artificial
  CRISPR gRNA sequence
gtttcaaagttaatttactt

SEQ ID NO: 595359 - DNA, 20 bp, Artificial
  CRISPR gRNA sequence
ttcaaagttaatttactttg

SEQ ID NO: 595360 - DNA, 20 bp, Artificial
  CRISPR gRNA sequence
tcaaagttaatttactttgg

SEQ ID NO: 595361 - DNA, 20 bp, Artificial
  CRISPR gRNA sequence
agttaatttactttggaggt

SEQ ID NO: 595362 - DNA, 20 bp, Artificial
  CRISPR gRNA sequence
taatttactttggaggtaag

SEQ ID NO: 595363 - DNA, 20 bp, Artificial
  CRISPR gRNA sequence
tactttggaggtaagaagtt

SEQ ID NO: 595364 - DNA, 20 bp, Artificial
  CRISPR gRNA sequence
taagaagtttggttgttgct

SEQ ID NO: 595365 - DNA, 20 bp, Artificial
  CRISPR gRNA sequence
tccccttatctctctttctt

SEQ ID NO: 595366 - DNA, 20 bp, Artificial
  CRISPR gRNA sequence
cagctgtacctattgatact

SEQ ID NO: 595367 - DNA, 20 bp, Artificial
  CRISPR gRNA sequence
tacgttttttctaattgttt

SEQ ID NO: 595368 - DNA, 20 bp, Artificial
  CRISPR gRNA sequence
acgttttttctaattgtttt

SEQ ID NO: 595369 - DNA, 20 bp, Artificial
  CRISPR gRNA sequence
cgttttttctaattgtttta

SEQ ID NO: 595370 - DNA, 20 bp, Artificial
  CRISPR gRNA sequence
tttttctaattgttttaggg

SEQ ID NO: 595371 - DNA, 20 bp, Artificial
  CRISPR gRNA sequence
ttttctaattgttttaggga

SEQ ID NO: 595372 - DNA, 20 bp, Artificial
  CRISPR gRNA sequence
ttctaattgttttagggaag

SEQ ID NO: 595373 - DNA, 20 bp, Artificial
  CRISPR gRNA sequence
taattgttttagggaaggag

SEQ ID NO: 595374 - DNA, 20 bp, Artificial
  CRISPR gRNA sequence
attgttttagggaaggagtg

SEQ ID NO: 595375 - DNA, 20 bp, Artificial
  CRISPR gRNA sequence
tgttttagggaaggagtgga

SEQ ID NO: 595376 - DNA, 20 bp, Artificial
  CRISPR gRNA sequence
ttttagggaaggagtggaga

SEQ ID NO: 595377 - DNA, 20 bp, Artificial
  CRISPR gRNA sequence
tttagggaaggagtggagag

SEQ ID NO: 595378 - DNA, 20 bp, Artificial
  CRISPR gRNA sequence
ggtgtttgtttgttttgttt

SEQ ID NO: 595379 - DNA, 20 bp, Artificial
  CRISPR gRNA sequence
agcatgtttctaaatgtgcc

SEQ ID NO: 595380 - DNA, 20 bp, Artificial
  CRISPR gRNA sequence
gcatgtttctaaatgtgcct

SEQ ID NO: 595381 - DNA, 20 bp, Artificial
  CRISPR gRNA sequence
tgcctgggattatattctta

SEQ ID NO: 595382 - DNA, 20 bp, Artificial
  CRISPR gRNA sequence
tgggattatattcttaaagt

SEQ ID NO: 595383 - DNA, 20 bp, Artificial
  CRISPR gRNA sequence
tcttaaagttggcatctatt

SEQ ID NO: 595384 - DNA, 20 bp, Artificial
  CRISPR gRNA sequence
aaagttggcatctattgagc

SEQ ID NO: 595385 - DNA, 20 bp, Artificial
  CRISPR gRNA sequence
aagttggcatctattgagca

SEQ ID NO: 595386 - DNA, 20 bp, Artificial
  CRISPR gRNA sequence
gttggcatctattgagcaag

SEQ ID NO: 595387 - DNA, 20 bp, Artificial
  CRISPR gRNA sequence
ttggcatctattgagcaagg

SEQ ID NO: 595388 - DNA, 20 bp, Artificial
  CRISPR gRNA sequence
tggcatctattgagcaagga

SEQ ID NO: 595389 - DNA, 20 bp, Artificial
  CRISPR gRNA sequence
ggcatctattgagcaaggag

SEQ ID NO: 595390 - DNA, 20 bp, Artificial
  CRISPR gRNA sequence
tctattgagcaaggaggggc

SEQ ID NO: 595391 - DNA, 20 bp, Artificial
  CRISPR gRNA sequence
ctattgagcaaggaggggca

SEQ ID NO: 595392 - DNA, 20 bp, Artificial
  CRISPR gRNA sequence
aaggaggggcaaggatacac

SEQ ID NO: 595393 - DNA, 20 bp, Artificial
  CRISPR gRNA sequence
gcaaggatacacaagtttga

SEQ ID NO: 595394 - DNA, 20 bp, Artificial
  CRISPR gRNA sequence
acacaagtttgacagaaata

SEQ ID NO: 595395 - DNA, 20 bp, Artificial
  CRISPR gRNA sequence
cacaagtttgacagaaataa

SEQ ID NO: 595396 - DNA, 20 bp, Artificial
  CRISPR gRNA sequence
ttgacagaaataaaggtaaa

SEQ ID NO: 595397 - DNA, 20 bp, Artificial
  CRISPR gRNA sequence
gctatttttatactcatcac

SEQ ID NO: 595398 - DNA, 20 bp, Artificial
  CRISPR gRNA sequence
ctatttttatactcatcaca

SEQ ID NO: 595399 - DNA, 20 bp, Artificial
  CRISPR gRNA sequence
atactcatcacaaggatgac

SEQ ID NO: 595400 - DNA, 20 bp, Artificial
  CRISPR gRNA sequence
atcacaaggatgacaagtgc

SEQ ID NO: 595401 - DNA, 20 bp, Artificial
  CRISPR gRNA sequence
aggatgacaagtgctagcaa

SEQ ID NO: 595402 - DNA, 20 bp, Artificial
  CRISPR gRNA sequence
tgacaagtgctagcaatggc

SEQ ID NO: 595403 - DNA, 20 bp, Artificial
  CRISPR gRNA sequence
cctaatatacctgtaataat

SEQ ID NO: 595404 - DNA, 20 bp, Artificial
  CRISPR gRNA sequence
ttacgtctaatacatctctt

SEQ ID NO: 595405 - DNA, 20 bp, Artificial
  CRISPR gRNA sequence
tctaatacatctcttgagcc

SEQ ID NO: 595406 - DNA, 20 bp, Artificial
  CRISPR gRNA sequence
gacacccaactccaaatttt

SEQ ID NO: 595407 - DNA, 20 bp, Artificial
  CRISPR gRNA sequence
caaattttgagttcaaataa

SEQ ID NO: 595408 - DNA, 20 bp, Artificial
  CRISPR gRNA sequence
ttcaaataatagctgactga

SEQ ID NO: 595409 - DNA, 20 bp, Artificial
  CRISPR gRNA sequence
gaaagttttcaatatatttt

SEQ ID NO: 595410 - DNA, 20 bp, Artificial
  CRISPR gRNA sequence
tttcagtgtttatatttgct

SEQ ID NO: 595411 - DNA, 20 bp, Artificial
  CRISPR gRNA sequence
ttcagtgtttatatttgcta

SEQ ID NO: 595412 - DNA, 20 bp, Artificial
  CRISPR gRNA sequence
tttatatttgctaaggataa

SEQ ID NO: 595413 - DNA, 20 bp, Artificial
  CRISPR gRNA sequence
ttatatttgctaaggataat

SEQ ID NO: 595414 - DNA, 20 bp, Artificial
  CRISPR gRNA sequence
tgaaaaaaaattttcttcct

SEQ ID NO: 595415 - DNA, 20 bp, Artificial
  CRISPR gRNA sequence
aaaaaaaattttcttcctca

SEQ ID NO: 595416 - DNA, 20 bp, Artificial
  CRISPR gRNA sequence
aaatcttcctctataataaa

SEQ ID NO: 595417 - DNA, 20 bp, Artificial
  CRISPR gRNA sequence
aatcttcctctataataaaa

SEQ ID NO: 595418 - DNA, 20 bp, Artificial
  CRISPR gRNA sequence
tcctctataataaaaaggtg

SEQ ID NO: 595419 - DNA, 20 bp, Artificial
  CRISPR gRNA sequence
gtgtggatgtgtgtgtgtta

SEQ ID NO: 595420 - DNA, 20 bp, Artificial
  CRISPR gRNA sequence
tgtggatgtgtgtgtgttat

SEQ ID NO: 595421 - DNA, 20 bp, Artificial
  CRISPR gRNA sequence
gtggatgtgtgtgtgttata

SEQ ID NO: 595422 - DNA, 20 bp, Artificial
  CRISPR gRNA sequence
tggatgtgtgtgtgttatag

SEQ ID NO: 595423 - DNA, 20 bp, Artificial
  CRISPR gRNA sequence
gtgtgtgtgttataggggca

SEQ ID NO: 595424 - DNA, 20 bp, Artificial
  CRISPR gRNA sequence
tgtgtgtgttataggggcaa

SEQ ID NO: 595425 - DNA, 20 bp, Artificial
  CRISPR gRNA sequence
ttataggggcaaaggtgcaa

SEQ ID NO: 595426 - DNA, 20 bp, Artificial
  CRISPR gRNA sequence
tataggggcaaaggtgcaac

SEQ ID NO: 595427 - DNA, 20 bp, Artificial
  CRISPR gRNA sequence
gggtttttttttactctgac

SEQ ID NO: 595428 - DNA, 20 bp, Artificial
  CRISPR gRNA sequence
tactctgacaagtattctga

SEQ ID NO: 595429 - DNA, 20 bp, Artificial
  CRISPR gRNA sequence
tattctgatagtttgacttt

SEQ ID NO: 595430 - DNA, 20 bp, Artificial
  CRISPR gRNA sequence
ttctgatagtttgactttga

SEQ ID NO: 595431 - DNA, 20 bp, Artificial
  CRISPR gRNA sequence
atcctaaatgtaaattgtta

SEQ ID NO: 595432 - DNA, 20 bp, Artificial
  CRISPR gRNA sequence
aattaaatcaaatatttaaa

SEQ ID NO: 595433 - DNA, 20 bp, Artificial
  CRISPR gRNA sequence
atcaaatatttaaaaagacc

SEQ ID NO: 595434 - DNA, 20 bp, Artificial
  CRISPR gRNA sequence
ttcttccatttatttactgt

SEQ ID NO: 595435 - DNA, 20 bp, Artificial
  CRISPR gRNA sequence
tccatttatttactgttgga

SEQ ID NO: 595436 - DNA, 20 bp, Artificial
  CRISPR gRNA sequence
atttactgttggatggactt

SEQ ID NO: 595437 - DNA, 20 bp, Artificial
  CRISPR gRNA sequence
tgttggatggacttgagaaa

SEQ ID NO: 595438 - DNA, 20 bp, Artificial
  CRISPR gRNA sequence
gacttgagaaatggaattaa

SEQ ID NO: 595439 - DNA, 20 bp, Artificial
  CRISPR gRNA sequence
attaatagtgattatttaat

SEQ ID NO: 595440 - DNA, 20 bp, Artificial
  CRISPR gRNA sequence
ccaaatgccttcccaaaata

SEQ ID NO: 595441 - DNA, 20 bp, Artificial
  CRISPR gRNA sequence
atgaaaatgaatgtgaaact

SEQ ID NO: 595442 - DNA, 20 bp, Artificial
  CRISPR gRNA sequence
tgaaaatgaatgtgaaactc

SEQ ID NO: 595443 - DNA, 20 bp, Artificial
  CRISPR gRNA sequence
gaaaatgaatgtgaaactca

SEQ ID NO: 595444 - DNA, 20 bp, Artificial
  CRISPR gRNA sequence
atgaatgtgaaactcagggt

SEQ ID NO: 595445 - DNA, 20 bp, Artificial
  CRISPR gRNA sequence
gaatgtgaaactcagggtaa

SEQ ID NO: 595446 - DNA, 20 bp, Artificial
  CRISPR gRNA sequence
agggtaagagatttttccaa

SEQ ID NO: 595447 - DNA, 20 bp, Artificial
  CRISPR gRNA sequence
ttttccaaaagtcttccaaa

SEQ ID NO: 595448 - DNA, 20 bp, Artificial
  CRISPR gRNA sequence
tgtgaaaatgtgaacctgaa

SEQ ID NO: 595449 - DNA, 20 bp, Artificial
  CRISPR gRNA sequence
gatcaatgcaaaaacctctt

SEQ ID NO: 595450 - DNA, 20 bp, Artificial
  CRISPR gRNA sequence
aaaaacctcttaagaaacaa

SEQ ID NO: 595451 - DNA, 20 bp, Artificial
  CRISPR gRNA sequence
cctcttaagaaacaaaagca

SEQ ID NO: 595452 - DNA, 20 bp, Artificial
  CRISPR gRNA sequence
ctcttaagaaacaaaagcac

SEQ ID NO: 595453 - DNA, 20 bp, Artificial
  CRISPR gRNA sequence
taagaaacaaaagcacaggc

SEQ ID NO: 595454 - DNA, 20 bp, Artificial
  CRISPR gRNA sequence
aagaaacaaaagcacaggct

SEQ ID NO: 595455 - DNA, 20 bp, Artificial
  CRISPR gRNA sequence
acaaaagcacaggctaggtg

SEQ ID NO: 595456 - DNA, 20 bp, Artificial
  CRISPR gRNA sequence
aaagcacaggctaggtgcgg

SEQ ID NO: 595457 - DNA, 20 bp, Artificial
  CRISPR gRNA sequence
gtggctcactcctataatcc

SEQ ID NO: 595458 - DNA, 20 bp, Artificial
  CRISPR gRNA sequence
ctcctataatcccagcactt

SEQ ID NO: 595459 - DNA, 20 bp, Artificial
  CRISPR gRNA sequence
tcctataatcccagcacttt

SEQ ID NO: 595460 - DNA, 20 bp, Artificial
  CRISPR gRNA sequence
ctataatcccagcactttgg

SEQ ID NO: 595461 - DNA, 20 bp, Artificial
  CRISPR gRNA sequence
tataatcccagcactttggg

SEQ ID NO: 595462 - DNA, 20 bp, Artificial
  CRISPR gRNA sequence
ataatcccagcactttggga

SEQ ID NO: 595463 - DNA, 20 bp, Artificial
  CRISPR gRNA sequence
agcactttgggagggcaacc

SEQ ID NO: 595464 - DNA, 20 bp, Artificial
  CRISPR gRNA sequence
gcactttgggagggcaacct

SEQ ID NO: 595465 - DNA, 20 bp, Artificial
  CRISPR gRNA sequence
ctttgggagggcaacctggg

SEQ ID NO: 595466 - DNA, 20 bp, Artificial
  CRISPR gRNA sequence
gggcaacctgggcggatcac

SEQ ID NO: 595467 - DNA, 20 bp, Artificial
  CRISPR gRNA sequence
ggcaacctgggcggatcacg

SEQ ID NO: 595468 - DNA, 20 bp, Artificial
  CRISPR gRNA sequence
cctgggcggatcacgaggtc

SEQ ID NO: 595469 - DNA, 20 bp, Artificial
  CRISPR gRNA sequence
tgggcggatcacgaggtcaa

SEQ ID NO: 595470 - DNA, 20 bp, Artificial
  CRISPR gRNA sequence
gatcacgaggtcaagagatc

SEQ ID NO: 595471 - DNA, 20 bp, Artificial
  CRISPR gRNA sequence
tcaagagatcgagaccatcc

SEQ ID NO: 595472 - DNA, 20 bp, Artificial
  CRISPR gRNA sequence
cgagaccatcctggccaaca

SEQ ID NO: 595473 - DNA, 20 bp, Artificial
  CRISPR gRNA sequence
tctactaaaaatacaaaaat

SEQ ID NO: 595474 - DNA, 20 bp, Artificial
  CRISPR gRNA sequence
ctaaaaatacaaaaattagc

SEQ ID NO: 595475 - DNA, 20 bp, Artificial
  CRISPR gRNA sequence
taaaaatacaaaaattagct

SEQ ID NO: 595476 - DNA, 20 bp, Artificial
  CRISPR gRNA sequence
atacaaaaattagctgggca

SEQ ID NO: 595477 - DNA, 20 bp, Artificial
  CRISPR gRNA sequence
caaaaattagctgggcatgg

SEQ ID NO: 595478 - DNA, 20 bp, Artificial
  CRISPR gRNA sequence
ggcatggtagcgcgcgcctg

SEQ ID NO: 595479 - DNA, 20 bp, Artificial
  CRISPR gRNA sequence
gtagcgcgcgcctgtagtcc

SEQ ID NO: 595480 - DNA, 20 bp, Artificial
  CRISPR gRNA sequence
cgcctgtagtcccagctact

SEQ ID NO: 595481 - DNA, 20 bp, Artificial
  CRISPR gRNA sequence
gcctgtagtcccagctactc

SEQ ID NO: 595482 - DNA, 20 bp, Artificial
  CRISPR gRNA sequence
ctgtagtcccagctactcag

SEQ ID NO: 595483 - DNA, 20 bp, Artificial
  CRISPR gRNA sequence
tgtagtcccagctactcagg

SEQ ID NO: 595484 - DNA, 20 bp, Artificial
  CRISPR gRNA sequence
tcccagctactcaggaggct

SEQ ID NO: 595485 - DNA, 20 bp, Artificial
  CRISPR gRNA sequence
cccagctactcaggaggctg

SEQ ID NO: 595486 - DNA, 20 bp, Artificial
  CRISPR gRNA sequence
agctactcaggaggctgagg

SEQ ID NO: 595487 - DNA, 20 bp, Artificial
  CRISPR gRNA sequence
gctactcaggaggctgaggc

SEQ ID NO: 595488 - DNA, 20 bp, Artificial
  CRISPR gRNA sequence
gcaggaaaatcacttgaacc

SEQ ID NO: 595489 - DNA, 20 bp, Artificial
  CRISPR gRNA sequence
caggaaaatcacttgaaccc

SEQ ID NO: 595490 - DNA, 20 bp, Artificial
  CRISPR gRNA sequence
ggaaaatcacttgaacccgg

SEQ ID NO: 595491 - DNA, 20 bp, Artificial
  CRISPR gRNA sequence
gaaaatcacttgaacccggg

SEQ ID NO: 595492 - DNA, 20 bp, Artificial
  CRISPR gRNA sequence
ttgaacccgggaggcaactg

SEQ ID NO: 595493 - DNA, 20 bp, Artificial
  CRISPR gRNA sequence
acccgggaggcaactgtagt

SEQ ID NO: 595494 - DNA, 20 bp, Artificial
  CRISPR gRNA sequence
ggaggcaactgtagtgagcc

SEQ ID NO: 595495 - DNA, 20 bp, Artificial
  CRISPR gRNA sequence
gcaactgtagtgagcccaga

SEQ ID NO: 595496 - DNA, 20 bp, Artificial
  CRISPR gRNA sequence
cagatggtgccactgcactc

SEQ ID NO: 595497 - DNA, 20 bp, Artificial
  CRISPR gRNA sequence
ggtgccactgcactccagcc

SEQ ID NO: 595498 - DNA, 20 bp, Artificial
  CRISPR gRNA sequence
actgcactccagcctggtga

SEQ ID NO: 595499 - DNA, 20 bp, Artificial
  CRISPR gRNA sequence
tgcactccagcctggtgaca

SEQ ID NO: 595500 - DNA, 20 bp, Artificial
  CRISPR gRNA sequence
ctccagcctggtgacagagt

SEQ ID NO: 595501 - DNA, 20 bp, Artificial
  CRISPR gRNA sequence
ctcaaaaaaaaaaaaaatca

SEQ ID NO: 595502 - DNA, 20 bp, Artificial
  CRISPR gRNA sequence
aaaaaaaatcaaagaaacaa

SEQ ID NO: 595503 - DNA, 20 bp, Artificial
  CRISPR gRNA sequence
caaaagcataaacctatttc

SEQ ID NO: 595504 - DNA, 20 bp, Artificial
  CRISPR gRNA sequence
ataaacctatttctagaatg

SEQ ID NO: 595505 - DNA, 20 bp, Artificial
  CRISPR gRNA sequence
taaacctatttctagaatga

SEQ ID NO: 595506 - DNA, 20 bp, Artificial
  CRISPR gRNA sequence
aaatgcacgttaacccttaa

SEQ ID NO: 595507 - DNA, 20 bp, Artificial
  CRISPR gRNA sequence
ttaacccttaaaagttacaa

SEQ ID NO: 595508 - DNA, 20 bp, Artificial
  CRISPR gRNA sequence
ccttaaaagttacaacagtg

SEQ ID NO: 595509 - DNA, 20 bp, Artificial
  CRISPR gRNA sequence
caacagtgtagttttacatc

SEQ ID NO: 595510 - DNA, 20 bp, Artificial
  CRISPR gRNA sequence
gtagttttacatctggctca

SEQ ID NO: 595511 - DNA, 20 bp, Artificial
  CRISPR gRNA sequence
gttttacatctggctcaaag

SEQ ID NO: 595512 - DNA, 20 bp, Artificial
  CRISPR gRNA sequence
ttttacatctggctcaaaga

SEQ ID NO: 595513 - DNA, 20 bp, Artificial
  CRISPR gRNA sequence
tacatctggctcaaagaagg

SEQ ID NO: 595514 - DNA, 20 bp, Artificial
  CRISPR gRNA sequence
gctcaaagaaggcggaatca

SEQ ID NO: 595515 - DNA, 20 bp, Artificial
  CRISPR gRNA sequence
agaaggcggaatcacagtta

SEQ ID NO: 595516 - DNA, 20 bp, Artificial
  CRISPR gRNA sequence
aggcggaatcacagttatag

SEQ ID NO: 595517 - DNA, 20 bp, Artificial
  CRISPR gRNA sequence
ggcggaatcacagttatagt

SEQ ID NO: 595518 - DNA, 20 bp, Artificial
  CRISPR gRNA sequence
acagttatagtaggtaatgc

SEQ ID NO: 595519 - DNA, 20 bp, Artificial
  CRISPR gRNA sequence
tagtaggtaatgctggatga

SEQ ID NO: 595520 - DNA, 20 bp, Artificial
  CRISPR gRNA sequence
taggtaatgctggatgatgg

SEQ ID NO: 595521 - DNA, 20 bp, Artificial
  CRISPR gRNA sequence
ggatgatggcagctgtgaaa

SEQ ID NO: 595522 - DNA, 20 bp, Artificial
  CRISPR gRNA sequence
gatggcagctgtgaaaaagc

SEQ ID NO: 595523 - DNA, 20 bp, Artificial
  CRISPR gRNA sequence
caatcgcatacattataata

SEQ ID NO: 595524 - DNA, 20 bp, Artificial
  CRISPR gRNA sequence
gcatactgcatgttcctaca

SEQ ID NO: 595525 - DNA, 20 bp, Artificial
  CRISPR gRNA sequence
catactgcatgttcctacac

SEQ ID NO: 595526 - DNA, 20 bp, Artificial
  CRISPR gRNA sequence
taaacctaattccattcatt

SEQ ID NO: 595527 - DNA, 20 bp, Artificial
  CRISPR gRNA sequence
agtattcgatacgtttactg

SEQ ID NO: 595528 - DNA, 20 bp, Artificial
  CRISPR gRNA sequence
actgaagttttaatcaatgt

SEQ ID NO: 595529 - DNA, 20 bp, Artificial
  CRISPR gRNA sequence
ctgaagttttaatcaatgtc

SEQ ID NO: 595530 - DNA, 20 bp, Artificial
  CRISPR gRNA sequence
ttttaatcaatgtcaggcac

SEQ ID NO: 595531 - DNA, 20 bp, Artificial
  CRISPR gRNA sequence
tcaatgtcaggcactggtct

SEQ ID NO: 595532 - DNA, 20 bp, Artificial
  CRISPR gRNA sequence
caggcactggtctaagaaaa

SEQ ID NO: 595533 - DNA, 20 bp, Artificial
  CRISPR gRNA sequence
atatgaaacgatcctaattt

SEQ ID NO: 595534 - DNA, 20 bp, Artificial
  CRISPR gRNA sequence
tatgaaacgatcctaatttg

SEQ ID NO: 595535 - DNA, 20 bp, Artificial
  CRISPR gRNA sequence
acgatcctaatttgaggtat

SEQ ID NO: 595536 - DNA, 20 bp, Artificial
  CRISPR gRNA sequence
cgatcctaatttgaggtatg

SEQ ID NO: 595537 - DNA, 20 bp, Artificial
  CRISPR gRNA sequence
tcctaatttgaggtatgagg

SEQ ID NO: 595538 - DNA, 20 bp, Artificial
  CRISPR gRNA sequence
cctaatttgaggtatgagga

SEQ ID NO: 595539 - DNA, 20 bp, Artificial
  CRISPR gRNA sequence
tgaggtatgaggaaggaaaa

SEQ ID NO: 595540 - DNA, 20 bp, Artificial
  CRISPR gRNA sequence
tgaggaaggaaaacagtgac

SEQ ID NO: 595541 - DNA, 20 bp, Artificial
  CRISPR gRNA sequence
aggaaggaaaacagtgacta

SEQ ID NO: 595542 - DNA, 20 bp, Artificial
  CRISPR gRNA sequence
gaaggaaaacagtgactaga

SEQ ID NO: 595543 - DNA, 20 bp, Artificial
  CRISPR gRNA sequence
gactagagagtaaacaacac

SEQ ID NO: 595544 - DNA, 20 bp, Artificial
  CRISPR gRNA sequence
tactattaaataaaattcca

SEQ ID NO: 595545 - DNA, 20 bp, Artificial
  CRISPR gRNA sequence
actattaaataaaattccat

SEQ ID NO: 595546 - DNA, 20 bp, Artificial
  CRISPR gRNA sequence
attccataggcataaaacaa

SEQ ID NO: 595547 - DNA, 20 bp, Artificial
  CRISPR gRNA sequence
ccataggcataaaacaatgg

SEQ ID NO: 595548 - DNA, 20 bp, Artificial
  CRISPR gRNA sequence
aatggaagaatttaaccaca

SEQ ID NO: 595549 - DNA, 20 bp, Artificial
  CRISPR gRNA sequence
cctttatctctctgccaccc

SEQ ID NO: 595550 - DNA, 20 bp, Artificial
  CRISPR gRNA sequence
ctttatctctctgccaccct

SEQ ID NO: 595551 - DNA, 20 bp, Artificial
  CRISPR gRNA sequence
tgggaaaatgtctgttttca

SEQ ID NO: 595552 - DNA, 20 bp, Artificial
  CRISPR gRNA sequence
aaaatgtctgttttcatagt

SEQ ID NO: 595553 - DNA, 20 bp, Artificial
  CRISPR gRNA sequence
aaatgtctgttttcatagtg

SEQ ID NO: 595554 - DNA, 20 bp, Artificial
  CRISPR gRNA sequence
agtgaggtctctcaaaatga

SEQ ID NO: 595555 - DNA, 20 bp, Artificial
  CRISPR gRNA sequence
caaaatgatagcaaactaat

SEQ ID NO: 595556 - DNA, 20 bp, Artificial
  CRISPR gRNA sequence
aatgatagcaaactaatcag

SEQ ID NO: 595557 - DNA, 20 bp, Artificial
  CRISPR gRNA sequence
tgatagcaaactaatcagca

SEQ ID NO: 595558 - DNA, 20 bp, Artificial
  CRISPR gRNA sequence
gatagcaaactaatcagcag

SEQ ID NO: 595559 - DNA, 20 bp, Artificial
  CRISPR gRNA sequence
actaatcagcagaggttctt

SEQ ID NO: 595560 - DNA, 20 bp, Artificial
  CRISPR gRNA sequence
agcagaggttcttgagataa

SEQ ID NO: 595561 - DNA, 20 bp, Artificial
  CRISPR gRNA sequence
gcagaggttcttgagataat

SEQ ID NO: 595562 - DNA, 20 bp, Artificial
  CRISPR gRNA sequence
agaggttcttgagataatgg

SEQ ID NO: 595563 - DNA, 20 bp, Artificial
  CRISPR gRNA sequence
tgagataatgggagcttgcc

SEQ ID NO: 595564 - DNA, 20 bp, Artificial
  CRISPR gRNA sequence
tgggagcttgcctggctaac

SEQ ID NO: 595565 - DNA, 20 bp, Artificial
  CRISPR gRNA sequence
gggagcttgcctggctaacc

SEQ ID NO: 595566 - DNA, 20 bp, Artificial
  CRISPR gRNA sequence
agcttgcctggctaaccagg

SEQ ID NO: 595567 - DNA, 20 bp, Artificial
  CRISPR gRNA sequence
ggcagcctgtccatcaactt

SEQ ID NO: 595568 - DNA, 20 bp, Artificial
  CRISPR gRNA sequence
catatctcctgaattataat

SEQ ID NO: 595569 - DNA, 20 bp, Artificial
  CRISPR gRNA sequence
tatctcctgaattataatca

SEQ ID NO: 595570 - DNA, 20 bp, Artificial
  CRISPR gRNA sequence
tgatgttcacaccctgaaac

SEQ ID NO: 595571 - DNA, 20 bp, Artificial
  CRISPR gRNA sequence
ctgccttaacaataaattaa

SEQ ID NO: 595572 - DNA, 20 bp, Artificial
  CRISPR gRNA sequence
tgccttaacaataaattaaa

SEQ ID NO: 595573 - DNA, 20 bp, Artificial
  CRISPR gRNA sequence
ttaacaataaattaaaagga

SEQ ID NO: 595574 - DNA, 20 bp, Artificial
  CRISPR gRNA sequence
taacaataaattaaaaggat

SEQ ID NO: 595575 - DNA, 20 bp, Artificial
  CRISPR gRNA sequence
ataaattaaaaggataggta

SEQ ID NO: 595576 - DNA, 20 bp, Artificial
  CRISPR gRNA sequence
taaattaaaaggataggtaa

SEQ ID NO: 595577 - DNA, 20 bp, Artificial
  CRISPR gRNA sequence
caaaccatgtgaatctcaac

SEQ ID NO: 595578 - DNA, 20 bp, Artificial
  CRISPR gRNA sequence
gtatgttccatttactatct

SEQ ID NO: 595579 - DNA, 20 bp, Artificial
  CRISPR gRNA sequence
ttccatttactatcttggaa

SEQ ID NO: 595580 - DNA, 20 bp, Artificial
  CRISPR gRNA sequence
tatcttggaacagtcataat

SEQ ID NO: 595581 - DNA, 20 bp, Artificial
  CRISPR gRNA sequence
ggaacagtcataattggtat

SEQ ID NO: 595582 - DNA, 20 bp, Artificial
  CRISPR gRNA sequence
gtcataattggtattagacc

SEQ ID NO: 595583 - DNA, 20 bp, Artificial
  CRISPR gRNA sequence
gtttttcccgtcaaaaccaa

SEQ ID NO: 595584 - DNA, 20 bp, Artificial
  CRISPR gRNA sequence
ccgtcaaaaccaaaagacaa

SEQ ID NO: 595585 - DNA, 20 bp, Artificial
  CRISPR gRNA sequence
aaatgctaaacaccaaatgt

SEQ ID NO: 595586 - DNA, 20 bp, Artificial
  CRISPR gRNA sequence
caaatgtcagtaaaccaaaa

SEQ ID NO: 595587 - DNA, 20 bp, Artificial
  CRISPR gRNA sequence
aaaaagtcaaaatattcaca

SEQ ID NO: 595588 - DNA, 20 bp, Artificial
  CRISPR gRNA sequence
cacatggtgtaataaatact

SEQ ID NO: 595589 - DNA, 20 bp, Artificial
  CRISPR gRNA sequence
ttggattttattttacttta

SEQ ID NO: 595590 - DNA, 20 bp, Artificial
  CRISPR gRNA sequence
ttattttactttaaagcatt

SEQ ID NO: 595591 - DNA, 20 bp, Artificial
  CRISPR gRNA sequence
taaagcatttagcaaataat

SEQ ID NO: 595592 - DNA, 20 bp, Artificial
  CRISPR gRNA sequence
caccccattattacaatgta

SEQ ID NO: 595593 - DNA, 20 bp, Artificial
  CRISPR gRNA sequence
accccattattacaatgtat

SEQ ID NO: 595594 - DNA, 20 bp, Artificial
  CRISPR gRNA sequence
tacaatgtatgggtgtatga

SEQ ID NO: 595595 - DNA, 20 bp, Artificial
  CRISPR gRNA sequence
gtgtatgacagaaaaaaaaa

SEQ ID NO: 595596 - DNA, 20 bp, Artificial
  CRISPR gRNA sequence
aaaaaaaagctgtgtaacat

SEQ ID NO: 595597 - DNA, 20 bp, Artificial
  CRISPR gRNA sequence
aaaaaagctgtgtaacatca

SEQ ID NO: 595598 - DNA, 20 bp, Artificial
  CRISPR gRNA sequence
gagctttcttattttgtgta

SEQ ID NO: 595599 - DNA, 20 bp, Artificial
  CRISPR gRNA sequence
agctttcttattttgtgtat

SEQ ID NO: 595600 - DNA, 20 bp, Artificial
  CRISPR gRNA sequence
attttgtgtatgggtaaaac

SEQ ID NO: 595601 - DNA, 20 bp, Artificial
  CRISPR gRNA sequence
ttttgtgtatgggtaaaaca

SEQ ID NO: 595602 - DNA, 20 bp, Artificial
  CRISPR gRNA sequence
atgggtaaaacaaggaaaac

SEQ ID NO: 595603 - DNA, 20 bp, Artificial
  CRISPR gRNA sequence
tgggtaaaacaaggaaaaca

SEQ ID NO: 595604 - DNA, 20 bp, Artificial
  CRISPR gRNA sequence
aaggaaaacaaggcaaaaac

SEQ ID NO: 595605 - DNA, 20 bp, Artificial
  CRISPR gRNA sequence
aggaaaacaaggcaaaaaca

SEQ ID NO: 595606 - DNA, 20 bp, Artificial
  CRISPR gRNA sequence
caaggttaaactcttaaata

SEQ ID NO: 595607 - DNA, 20 bp, Artificial
  CRISPR gRNA sequence
ttaaactcttaaatatagca

SEQ ID NO: 595608 - DNA, 20 bp, Artificial
  CRISPR gRNA sequence
tttgaacctcttttaatgta

SEQ ID NO: 595609 - DNA, 20 bp, Artificial
  CRISPR gRNA sequence
ttgaacctcttttaatgtaa

SEQ ID NO: 595610 - DNA, 20 bp, Artificial
  CRISPR gRNA sequence
tgaacctcttttaatgtaaa

SEQ ID NO: 595611 - DNA, 20 bp, Artificial
  CRISPR gRNA sequence
cttttaatgtaaagggataa

SEQ ID NO: 595612 - DNA, 20 bp, Artificial
  CRISPR gRNA sequence
attatactttattgaccttc

SEQ ID NO: 595613 - DNA, 20 bp, Artificial
  CRISPR gRNA sequence
ctagttaataacactatttt

SEQ ID NO: 595614 - DNA, 20 bp, Artificial
  CRISPR gRNA sequence
gttaaactctttcttcgtta

SEQ ID NO: 595615 - DNA, 20 bp, Artificial
  CRISPR gRNA sequence
ttaaactctttcttcgttac

SEQ ID NO: 595616 - DNA, 20 bp, Artificial
  CRISPR gRNA sequence
ttcgttacaggaacacaaaa

SEQ ID NO: 595617 - DNA, 20 bp, Artificial
  CRISPR gRNA sequence
cgttacaggaacacaaaaaa

SEQ ID NO: 595618 - DNA, 20 bp, Artificial
  CRISPR gRNA sequence
ggaacacaaaaaagagatac

SEQ ID NO: 595619 - DNA, 20 bp, Artificial
  CRISPR gRNA sequence
cacaaaaaagagataccagt

SEQ ID NO: 595620 - DNA, 20 bp, Artificial
  CRISPR gRNA sequence
taccagttagtccattacca

SEQ ID NO: 595621 - DNA, 20 bp, Artificial
  CRISPR gRNA sequence
agttagtccattaccacaga

SEQ ID NO: 595622 - DNA, 20 bp, Artificial
  CRISPR gRNA sequence
ccacagaaagaattactctg

SEQ ID NO: 595623 - DNA, 20 bp, Artificial
  CRISPR gRNA sequence
ttataatgtatgtatgtgct

SEQ ID NO: 595624 - DNA, 20 bp, Artificial
  CRISPR gRNA sequence
atgtgcttagaaacatgaaa

SEQ ID NO: 595625 - DNA, 20 bp, Artificial
  CRISPR gRNA sequence
tagaaacatgaaacagtgtt

SEQ ID NO: 595626 - DNA, 20 bp, Artificial
  CRISPR gRNA sequence
agaaacatgaaacagtgttg

SEQ ID NO: 595627 - DNA, 20 bp, Artificial
  CRISPR gRNA sequence
gttgaggacgtacaatgtta

SEQ ID NO: 595628 - DNA, 20 bp, Artificial
  CRISPR gRNA sequence
ttgaggacgtacaatgttaa

SEQ ID NO: 595629 - DNA, 20 bp, Artificial
  CRISPR gRNA sequence
catccatttccatgtttaca

SEQ ID NO: 595630 - DNA, 20 bp, Artificial
  CRISPR gRNA sequence
tttccatgtttacatggtca

SEQ ID NO: 595631 - DNA, 20 bp, Artificial
  CRISPR gRNA sequence
gtcatagaaaataatctaaa

SEQ ID NO: 595632 - DNA, 20 bp, Artificial
  CRISPR gRNA sequence
aatctaaacagatatacttt

SEQ ID NO: 595633 - DNA, 20 bp, Artificial
  CRISPR gRNA sequence
cagatatactttgagttgct

SEQ ID NO: 595634 - DNA, 20 bp, Artificial
  CRISPR gRNA sequence
tgctaagtgaattatatgca

SEQ ID NO: 595635 - DNA, 20 bp, Artificial
  CRISPR gRNA sequence
tgaattatatgcaaagcact

SEQ ID NO: 595636 - DNA, 20 bp, Artificial
  CRISPR gRNA sequence
ttagaacaatgcctaataca

SEQ ID NO: 595637 - DNA, 20 bp, Artificial
  CRISPR gRNA sequence
atacacagtaaatgctcttt

SEQ ID NO: 595638 - DNA, 20 bp, Artificial
  CRISPR gRNA sequence
atgctctttaagaatttctg

SEQ ID NO: 595639 - DNA, 20 bp, Artificial
  CRISPR gRNA sequence
tgctctttaagaatttctgc

SEQ ID NO: 595640 - DNA, 20 bp, Artificial
  CRISPR gRNA sequence
ctttaagaatttctgcaggc

SEQ ID NO: 595641 - DNA, 20 bp, Artificial
  CRISPR gRNA sequence
tttaagaatttctgcaggct

SEQ ID NO: 595642 - DNA, 20 bp, Artificial
  CRISPR gRNA sequence
ttaagaatttctgcaggctg

SEQ ID NO: 595643 - DNA, 20 bp, Artificial
  CRISPR gRNA sequence
taagaatttctgcaggctgg

SEQ ID NO: 595644 - DNA, 20 bp, Artificial
  CRISPR gRNA sequence
atttctgcaggctgggggca

SEQ ID NO: 595645 - DNA, 20 bp, Artificial
  CRISPR gRNA sequence
tctgcaggctgggggcacag

SEQ ID NO: 595646 - DNA, 20 bp, Artificial
  CRISPR gRNA sequence
gtggctcacatctgtaatcc

SEQ ID NO: 595647 - DNA, 20 bp, Artificial
  CRISPR gRNA sequence
catctgtaatcccagcattt

SEQ ID NO: 595648 - DNA, 20 bp, Artificial
  CRISPR gRNA sequence
atctgtaatcccagcatttt

SEQ ID NO: 595649 - DNA, 20 bp, Artificial
  CRISPR gRNA sequence
ctgtaatcccagcattttgg

SEQ ID NO: 595650 - DNA, 20 bp, Artificial
  CRISPR gRNA sequence
tgtaatcccagcattttggg

SEQ ID NO: 595651 - DNA, 20 bp, Artificial
  CRISPR gRNA sequence
tcccagcattttgggaggcc

SEQ ID NO: 595652 - DNA, 20 bp, Artificial
  CRISPR gRNA sequence
cccagcattttgggaggcca

SEQ ID NO: 595653 - DNA, 20 bp, Artificial
  CRISPR gRNA sequence
agcattttgggaggccaagg

SEQ ID NO: 595654 - DNA, 20 bp, Artificial
  CRISPR gRNA sequence
gcattttgggaggccaaggc

SEQ ID NO: 595655 - DNA, 20 bp, Artificial
  CRISPR gRNA sequence
ttttgggaggccaaggcggg

SEQ ID NO: 595656 - DNA, 20 bp, Artificial
  CRISPR gRNA sequence
ccaaggcgggtggattgctt

SEQ ID NO: 595657 - DNA, 20 bp, Artificial
  CRISPR gRNA sequence
gcgggtggattgcttgagtc

SEQ ID NO: 595658 - DNA, 20 bp, Artificial
  CRISPR gRNA sequence
cgggtggattgcttgagtcc

SEQ ID NO: 595659 - DNA, 20 bp, Artificial
  CRISPR gRNA sequence
ggtggattgcttgagtccag

SEQ ID NO: 595660 - DNA, 20 bp, Artificial
  CRISPR gRNA sequence
ttgcttgagtccaggagttc

SEQ ID NO: 595661 - DNA, 20 bp, Artificial
  CRISPR gRNA sequence
tgagtccaggagttcaagac

SEQ ID NO: 595662 - DNA, 20 bp, Artificial
  CRISPR gRNA sequence
ccaggagttcaagaccagcc

SEQ ID NO: 595663 - DNA, 20 bp, Artificial
  CRISPR gRNA sequence
caggagttcaagaccagcct

SEQ ID NO: 595664 - DNA, 20 bp, Artificial
  CRISPR gRNA sequence
caagaccagcctgggaaaca

SEQ ID NO: 595665 - DNA, 20 bp, Artificial
  CRISPR gRNA sequence
gaccagcctgggaaacacag

SEQ ID NO: 595666 - DNA, 20 bp, Artificial
  CRISPR gRNA sequence
accagcctgggaaacacagt

SEQ ID NO: 595667 - DNA, 20 bp, Artificial
  CRISPR gRNA sequence
aaaacatttaaaaaattata

SEQ ID NO: 595668 - DNA, 20 bp, Artificial
  CRISPR gRNA sequence
aaacatttaaaaaattatac

SEQ ID NO: 595669 - DNA, 20 bp, Artificial
  CRISPR gRNA sequence
catttaaaaaattatacagg

SEQ ID NO: 595670 - DNA, 20 bp, Artificial
  CRISPR gRNA sequence
atttaaaaaattatacaggc

SEQ ID NO: 595671 - DNA, 20 bp, Artificial
  CRISPR gRNA sequence
tttaaaaaattatacaggca

SEQ ID NO: 595672 - DNA, 20 bp, Artificial
  CRISPR gRNA sequence
aaaaaattatacaggcaggg

SEQ ID NO: 595673 - DNA, 20 bp, Artificial
  CRISPR gRNA sequence
ggcagggtggcctgtgcctg

SEQ ID NO: 595674 - DNA, 20 bp, Artificial
  CRISPR gRNA sequence
gtggcctgtgcctgtagtcc

SEQ ID NO: 595675 - DNA, 20 bp, Artificial
  CRISPR gRNA sequence
tgcctgtagtcccagctact

SEQ ID NO: 595676 - DNA, 20 bp, Artificial
  CRISPR gRNA sequence
ctgtagtcccagctacttgg

SEQ ID NO: 595677 - DNA, 20 bp, Artificial
  CRISPR gRNA sequence
tgtagtcccagctacttgga

SEQ ID NO: 595678 - DNA, 20 bp, Artificial
  CRISPR gRNA sequence
tcccagctacttggaaggct

SEQ ID NO: 595679 - DNA, 20 bp, Artificial
  CRISPR gRNA sequence
cccagctacttggaaggctg

SEQ ID NO: 595680 - DNA, 20 bp, Artificial
  CRISPR gRNA sequence
agctacttggaaggctgagg

SEQ ID NO: 595681 - DNA, 20 bp, Artificial
  CRISPR gRNA sequence
gctacttggaaggctgaggt

SEQ ID NO: 595682 - DNA, 20 bp, Artificial
  CRISPR gRNA sequence
ctgaggtgggatgatcacct

SEQ ID NO: 595683 - DNA, 20 bp, Artificial
  CRISPR gRNA sequence
tgaggtgggatgatcacctg

SEQ ID NO: 595684 - DNA, 20 bp, Artificial
  CRISPR gRNA sequence
ggatgatcacctgaggctgt

SEQ ID NO: 595685 - DNA, 20 bp, Artificial
  CRISPR gRNA sequence
gatgatcacctgaggctgtg

SEQ ID NO: 595686 - DNA, 20 bp, Artificial
  CRISPR gRNA sequence
cacctgaggctgtgaggtcg

SEQ ID NO: 595687 - DNA, 20 bp, Artificial
  CRISPR gRNA sequence
gtgaggtcgaagttgacact

SEQ ID NO: 595688 - DNA, 20 bp, Artificial
  CRISPR gRNA sequence
atgatcgcatcactgcactc

SEQ ID NO: 595689 - DNA, 20 bp, Artificial
  CRISPR gRNA sequence
cgcatcactgcactcaagcc

SEQ ID NO: 595690 - DNA, 20 bp, Artificial
  CRISPR gRNA sequence
gcatcactgcactcaagcct

SEQ ID NO: 595691 - DNA, 20 bp, Artificial
  CRISPR gRNA sequence
ctgcactcaagcctgggtga

SEQ ID NO: 595692 - DNA, 20 bp, Artificial
  CRISPR gRNA sequence
gcactcaagcctgggtgaca

SEQ ID NO: 595693 - DNA, 20 bp, Artificial
  CRISPR gRNA sequence
tcaagcctgggtgacagagt

SEQ ID NO: 595694 - DNA, 20 bp, Artificial
  CRISPR gRNA sequence
tctgctattatcattttgta

SEQ ID NO: 595695 - DNA, 20 bp, Artificial
  CRISPR gRNA sequence
ttatcattttgtatggtaat

SEQ ID NO: 595696 - DNA, 20 bp, Artificial
  CRISPR gRNA sequence
atgtacaattatgactgctt

SEQ ID NO: 595697 - DNA, 20 bp, Artificial
  CRISPR gRNA sequence
cacatccaataatcacaatt

SEQ ID NO: 595698 - DNA, 20 bp, Artificial
  CRISPR gRNA sequence
caataatcacaatttggaaa

SEQ ID NO: 595699 - DNA, 20 bp, Artificial
  CRISPR gRNA sequence
acctcgtaatttgtactcaa

SEQ ID NO: 595700 - DNA, 20 bp, Artificial
  CRISPR gRNA sequence
aatttgtactcaacagcact

SEQ ID NO: 595701 - DNA, 20 bp, Artificial
  CRISPR gRNA sequence
atttgtactcaacagcactt

SEQ ID NO: 595702 - DNA, 20 bp, Artificial
  CRISPR gRNA sequence
tttgtactcaacagcactta

SEQ ID NO: 595703 - DNA, 20 bp, Artificial
  CRISPR gRNA sequence
gcacttagggtaaaattccg

SEQ ID NO: 595704 - DNA, 20 bp, Artificial
  CRISPR gRNA sequence
cacttagggtaaaattccgt

SEQ ID NO: 595705 - DNA, 20 bp, Artificial
  CRISPR gRNA sequence
ggtaaaattccgtaggtaaa

SEQ ID NO: 595706 - DNA, 20 bp, Artificial
  CRISPR gRNA sequence
aattccgtaggtaaaaagcc

SEQ ID NO: 595707 - DNA, 20 bp, Artificial
  CRISPR gRNA sequence
aggtaaaaagcccagaattt

SEQ ID NO: 595708 - DNA, 20 bp, Artificial
  CRISPR gRNA sequence
ggtaaaaagcccagaatttg

SEQ ID NO: 595709 - DNA, 20 bp, Artificial
  CRISPR gRNA sequence
gcccagaatttgaggtacat

SEQ ID NO: 595710 - DNA, 20 bp, Artificial
  CRISPR gRNA sequence
cccagaatttgaggtacata

SEQ ID NO: 595711 - DNA, 20 bp, Artificial
  CRISPR gRNA sequence
agaatttgaggtacataagg

SEQ ID NO: 595712 - DNA, 20 bp, Artificial
  CRISPR gRNA sequence
aatttgaggtacataaggaa

SEQ ID NO: 595713 - DNA, 20 bp, Artificial
  CRISPR gRNA sequence
ttgaggtacataaggaagag

SEQ ID NO: 595714 - DNA, 20 bp, Artificial
  CRISPR gRNA sequence
agaaacaaatattaaaatat

SEQ ID NO: 595715 - DNA, 20 bp, Artificial
  CRISPR gRNA sequence
gaaacaaatattaaaatatt

SEQ ID NO: 595716 - DNA, 20 bp, Artificial
  CRISPR gRNA sequence
tattaaaatattaggcatct

SEQ ID NO: 595717 - DNA, 20 bp, Artificial
  CRISPR gRNA sequence
tctgagtattctgtgctgaa

SEQ ID NO: 595718 - DNA, 20 bp, Artificial
  CRISPR gRNA sequence
tattctgtgctgaacagcga

SEQ ID NO: 595719 - DNA, 20 bp, Artificial
  CRISPR gRNA sequence
aaactcctgaccccaataaa

SEQ ID NO: 595720 - DNA, 20 bp, Artificial
  CRISPR gRNA sequence
cctgaccccaataaacagac

SEQ ID NO: 595721 - DNA, 20 bp, Artificial
  CRISPR gRNA sequence
aataaacagaccagcactga

SEQ ID NO: 595722 - DNA, 20 bp, Artificial
  CRISPR gRNA sequence
ataaacagaccagcactgaa

SEQ ID NO: 595723 - DNA, 20 bp, Artificial
  CRISPR gRNA sequence
aaacagaccagcactgaaag

SEQ ID NO: 595724 - DNA, 20 bp, Artificial
  CRISPR gRNA sequence
caacactgcctctccaacac

SEQ ID NO: 595725 - DNA, 20 bp, Artificial
  CRISPR gRNA sequence
ctctccaacacaagccttac

SEQ ID NO: 595726 - DNA, 20 bp, Artificial
  CRISPR gRNA sequence
agatactgccattcaaccca

SEQ ID NO: 595727 - DNA, 20 bp, Artificial
  CRISPR gRNA sequence
taatcatatctcacatttat

SEQ ID NO: 595728 - DNA, 20 bp, Artificial
  CRISPR gRNA sequence
tatatgctccatactttgct

SEQ ID NO: 595729 - DNA, 20 bp, Artificial
  CRISPR gRNA sequence
tatgctccatactttgctaa

SEQ ID NO: 595730 - DNA, 20 bp, Artificial
  CRISPR gRNA sequence
tactttgctaagagatttaa

SEQ ID NO: 595731 - DNA, 20 bp, Artificial
  CRISPR gRNA sequence
atatcatttaattctcccaa

SEQ ID NO: 595732 - DNA, 20 bp, Artificial
  CRISPR gRNA sequence
aattctcccaacagccttat

SEQ ID NO: 595733 - DNA, 20 bp, Artificial
  CRISPR gRNA sequence
ttctcccaacagccttatga

SEQ ID NO: 595734 - DNA, 20 bp, Artificial
  CRISPR gRNA sequence
ctcccaacagccttatgaga

SEQ ID NO: 595735 - DNA, 20 bp, Artificial
  CRISPR gRNA sequence
agagatgttcttcaaccctt

SEQ ID NO: 595736 - DNA, 20 bp, Artificial
  CRISPR gRNA sequence
gagatgttcttcaacccttt

SEQ ID NO: 595737 - DNA, 20 bp, Artificial
  CRISPR gRNA sequence
agatgttcttcaacccttta

SEQ ID NO: 595738 - DNA, 20 bp, Artificial
  CRISPR gRNA sequence
ttcttcaaccctttagggct

SEQ ID NO: 595739 - DNA, 20 bp, Artificial
  CRISPR gRNA sequence
cttcaaccctttagggctga

SEQ ID NO: 595740 - DNA, 20 bp, Artificial
  CRISPR gRNA sequence
ttcaaccctttagggctgag

SEQ ID NO: 595741 - DNA, 20 bp, Artificial
  CRISPR gRNA sequence
cctttagggctgagaggaat

SEQ ID NO: 595742 - DNA, 20 bp, Artificial
  CRISPR gRNA sequence
ctttagggctgagaggaatg

SEQ ID NO: 595743 - DNA, 20 bp, Artificial
  CRISPR gRNA sequence
gggctgagaggaatgaggca

SEQ ID NO: 595744 - DNA, 20 bp, Artificial
  CRISPR gRNA sequence
gctgagaggaatgaggcatg

SEQ ID NO: 595745 - DNA, 20 bp, Artificial
  CRISPR gRNA sequence
tgagaggaatgaggcatgga

SEQ ID NO: 595746 - DNA, 20 bp, Artificial
  CRISPR gRNA sequence
gagaggaatgaggcatggag

SEQ ID NO: 595747 - DNA, 20 bp, Artificial
  CRISPR gRNA sequence
gaatgaggcatggagaggtt

SEQ ID NO: 595748 - DNA, 20 bp, Artificial
  CRISPR gRNA sequence
agaggttaagtaacatatcc

SEQ ID NO: 595749 - DNA, 20 bp, Artificial
  CRISPR gRNA sequence
gtaacatatccaagatcaca

SEQ ID NO: 595750 - DNA, 20 bp, Artificial
  CRISPR gRNA sequence
catatccaagatcacatagc

SEQ ID NO: 595751 - DNA, 20 bp, Artificial
  CRISPR gRNA sequence
tccaagatcacatagctggt

SEQ ID NO: 595752 - DNA, 20 bp, Artificial
  CRISPR gRNA sequence
aagatcacatagctggtaag

SEQ ID NO: 595753 - DNA, 20 bp, Artificial
  CRISPR gRNA sequence
gatcacatagctggtaagta

SEQ ID NO: 595754 - DNA, 20 bp, Artificial
  CRISPR gRNA sequence
catagctggtaagtagagcc

SEQ ID NO: 595755 - DNA, 20 bp, Artificial
  CRISPR gRNA sequence
gtagagccaagatttgaacc

SEQ ID NO: 595756 - DNA, 20 bp, Artificial
  CRISPR gRNA sequence
tagagccaagatttgaacct

SEQ ID NO: 595757 - DNA, 20 bp, Artificial
  CRISPR gRNA sequence
caagatttgaacctaggccc

SEQ ID NO: 595758 - DNA, 20 bp, Artificial
  CRISPR gRNA sequence
cctaggccccagaatttaat

SEQ ID NO: 595759 - DNA, 20 bp, Artificial
  CRISPR gRNA sequence
aggccccagaatttaatcag

SEQ ID NO: 595760 - DNA, 20 bp, Artificial
  CRISPR gRNA sequence
tagttattgaacacctactc

SEQ ID NO: 595761 - DNA, 20 bp, Artificial
  CRISPR gRNA sequence
acctactccagaaaaaatgc

SEQ ID NO: 595762 - DNA, 20 bp, Artificial
  CRISPR gRNA sequence
cctactccagaaaaaatgct

SEQ ID NO: 595763 - DNA, 20 bp, Artificial
  CRISPR gRNA sequence
ccagaaaaaatgctaggcac

SEQ ID NO: 595764 - DNA, 20 bp, Artificial
  CRISPR gRNA sequence
cagaaaaaatgctaggcaca

SEQ ID NO: 595765 - DNA, 20 bp, Artificial
  CRISPR gRNA sequence
gaaaaaatgctaggcacaag

SEQ ID NO: 595766 - DNA, 20 bp, Artificial
  CRISPR gRNA sequence
aggagctgctaactgcacaa

SEQ ID NO: 595767 - DNA, 20 bp, Artificial
  CRISPR gRNA sequence
ctgctaactgcacaacagtc

SEQ ID NO: 595768 - DNA, 20 bp, Artificial
  CRISPR gRNA sequence
cagtcaagacatgctctgct

SEQ ID NO: 595769 - DNA, 20 bp, Artificial
  CRISPR gRNA sequence
agtcaagacatgctctgcta

SEQ ID NO: 595770 - DNA, 20 bp, Artificial
  CRISPR gRNA sequence
gtcaagacatgctctgctaa

SEQ ID NO: 595771 - DNA, 20 bp, Artificial
  CRISPR gRNA sequence
aagacatgctctgctaaggg

SEQ ID NO: 595772 - DNA, 20 bp, Artificial
  CRISPR gRNA sequence
agacatgctctgctaagggc

SEQ ID NO: 595773 - DNA, 20 bp, Artificial
  CRISPR gRNA sequence
gacatgctctgctaagggca

SEQ ID NO: 595774 - DNA, 20 bp, Artificial
  CRISPR gRNA sequence
acatgctctgctaagggcag

SEQ ID NO: 595775 - DNA, 20 bp, Artificial
  CRISPR gRNA sequence
aggggctctaacaattactc

SEQ ID NO: 595776 - DNA, 20 bp, Artificial
  CRISPR gRNA sequence
ggggctctaacaattactct

SEQ ID NO: 595777 - DNA, 20 bp, Artificial
  CRISPR gRNA sequence
cctcttcaaattctgatcct

SEQ ID NO: 595778 - DNA, 20 bp, Artificial
  CRISPR gRNA sequence
agtccctacatccatcactg

SEQ ID NO: 595779 - DNA, 20 bp, Artificial
  CRISPR gRNA sequence
gcatttattgccacttgcac

SEQ ID NO: 595780 - DNA, 20 bp, Artificial
  CRISPR gRNA sequence
tttattgccacttgcaccag

SEQ ID NO: 595781 - DNA, 20 bp, Artificial
  CRISPR gRNA sequence
ttattgccacttgcaccaga

SEQ ID NO: 595782 - DNA, 20 bp, Artificial
  CRISPR gRNA sequence
ttcccactcttgacaatgaa

SEQ ID NO: 595783 - DNA, 20 bp, Artificial
  CRISPR gRNA sequence
tcccactcttgacaatgaac

SEQ ID NO: 595784 - DNA, 20 bp, Artificial
  CRISPR gRNA sequence
cccactcttgacaatgaaca

SEQ ID NO: 595785 - DNA, 20 bp, Artificial
  CRISPR gRNA sequence
ccactcttgacaatgaacag

SEQ ID NO: 595786 - DNA, 20 bp, Artificial
  CRISPR gRNA sequence
tcttgacaatgaacagggga

SEQ ID NO: 595787 - DNA, 20 bp, Artificial
  CRISPR gRNA sequence
caggggaaagtgtatttccc

SEQ ID NO: 595788 - DNA, 20 bp, Artificial
  CRISPR gRNA sequence
atttaaaatgtatttcctca

SEQ ID NO: 595789 - DNA, 20 bp, Artificial
  CRISPR gRNA sequence
aatgtatttcctcatagtgt

SEQ ID NO: 595790 - DNA, 20 bp, Artificial
  CRISPR gRNA sequence
ctacaattgccacattaact

SEQ ID NO: 595791 - DNA, 20 bp, Artificial
  CRISPR gRNA sequence
tttattgttgtttctttcaa

SEQ ID NO: 595792 - DNA, 20 bp, Artificial
  CRISPR gRNA sequence
tggaatttaaccaccatttt

SEQ ID NO: 595793 - DNA, 20 bp, Artificial
  CRISPR gRNA sequence
aatttaaccaccatttttag

SEQ ID NO: 595794 - DNA, 20 bp, Artificial
  CRISPR gRNA sequence
accatttttagcagtgtttc

SEQ ID NO: 595795 - DNA, 20 bp, Artificial
  CRISPR gRNA sequence
ttagcagtgtttcaagtgaa

SEQ ID NO: 595796 - DNA, 20 bp, Artificial
  CRISPR gRNA sequence
tagcagtgtttcaagtgaaa

SEQ ID NO: 595797 - DNA, 20 bp, Artificial
  CRISPR gRNA sequence
accccttcattttattttta

SEQ ID NO: 595798 - DNA, 20 bp, Artificial
  CRISPR gRNA sequence
agttgtcatacaaaaaacat

SEQ ID NO: 595799 - DNA, 20 bp, Artificial
  CRISPR gRNA sequence
catgagcatttttttccttt

SEQ ID NO: 595800 - DNA, 20 bp, Artificial
  CRISPR gRNA sequence
atttttttccttttagcatt

SEQ ID NO: 595801 - DNA, 20 bp, Artificial
  CRISPR gRNA sequence
attcagttctacaacatgca

SEQ ID NO: 595802 - DNA, 20 bp, Artificial
  CRISPR gRNA sequence
cttataaccactaccataat

SEQ ID NO: 595803 - DNA, 20 bp, Artificial
  CRISPR gRNA sequence
ttataaccactaccataatc

SEQ ID NO: 595804 - DNA, 20 bp, Artificial
  CRISPR gRNA sequence
ccactaccataatcaggata

SEQ ID NO: 595805 - DNA, 20 bp, Artificial
  CRISPR gRNA sequence
taatcaggatacagaacaaa

SEQ ID NO: 595806 - DNA, 20 bp, Artificial
  CRISPR gRNA sequence
aatcaggatacagaacaaaa

SEQ ID NO: 595807 - DNA, 20 bp, Artificial
  CRISPR gRNA sequence
aaaggcattctcattaaaaa

SEQ ID NO: 595808 - DNA, 20 bp, Artificial
  CRISPR gRNA sequence
aggcattctcattaaaaaaa

SEQ ID NO: 595809 - DNA, 20 bp, Artificial
  CRISPR gRNA sequence
gcattctcattaaaaaaaga

SEQ ID NO: 595810 - DNA, 20 bp, Artificial
  CRISPR gRNA sequence
tctcattaaaaaaagagaga

SEQ ID NO: 595811 - DNA, 20 bp, Artificial
  CRISPR gRNA sequence
aaagagagacggcttataaa

SEQ ID NO: 595812 - DNA, 20 bp, Artificial
  CRISPR gRNA sequence
cggcttataaatggacttaa

SEQ ID NO: 595813 - DNA, 20 bp, Artificial
  CRISPR gRNA sequence
tactctgtcttccaacacac

SEQ ID NO: 595814 - DNA, 20 bp, Artificial
  CRISPR gRNA sequence
actctgtcttccaacacacc

SEQ ID NO: 595815 - DNA, 20 bp, Artificial
  CRISPR gRNA sequence
accaggctttccttctattc

SEQ ID NO: 595816 - DNA, 20 bp, Artificial
  CRISPR gRNA sequence
ctttccttctattctagaat

SEQ ID NO: 595817 - DNA, 20 bp, Artificial
  CRISPR gRNA sequence
ctattctagaataagtgaat

SEQ ID NO: 595818 - DNA, 20 bp, Artificial
  CRISPR gRNA sequence
aagtgaattggacaccacaa

SEQ ID NO: 595819 - DNA, 20 bp, Artificial
  CRISPR gRNA sequence
gacaccacaatagaaacact

SEQ ID NO: 595820 - DNA, 20 bp, Artificial
  CRISPR gRNA sequence
aaatatattttgtatacctg

SEQ ID NO: 595821 - DNA, 20 bp, Artificial
  CRISPR gRNA sequence
acctgtggctttccattttt

SEQ ID NO: 595822 - DNA, 20 bp, Artificial
  CRISPR gRNA sequence
cctgtggctttccattttta

SEQ ID NO: 595823 - DNA, 20 bp, Artificial
  CRISPR gRNA sequence
tttccatttttaaggatatt

SEQ ID NO: 595824 - DNA, 20 bp, Artificial
  CRISPR gRNA sequence
ccatttttaaggatatttag

SEQ ID NO: 595825 - DNA, 20 bp, Artificial
  CRISPR gRNA sequence
ttaaggatatttagaagctg

SEQ ID NO: 595826 - DNA, 20 bp, Artificial
  CRISPR gRNA sequence
atttagaagctgtggtttta

SEQ ID NO: 595827 - DNA, 20 bp, Artificial
  CRISPR gRNA sequence
tttagaagctgtggttttat

SEQ ID NO: 595828 - DNA, 20 bp, Artificial
  CRISPR gRNA sequence
ttagaagctgtggttttata

SEQ ID NO: 595829 - DNA, 20 bp, Artificial
  CRISPR gRNA sequence
tagaagctgtggttttatag

SEQ ID NO: 595830 - DNA, 20 bp, Artificial
  CRISPR gRNA sequence
ttataggggctttatcaaaa

SEQ ID NO: 595831 - DNA, 20 bp, Artificial
  CRISPR gRNA sequence
atggttgaaattcttttcca

SEQ ID NO: 595832 - DNA, 20 bp, Artificial
  CRISPR gRNA sequence
gttgaaattcttttccatgg

SEQ ID NO: 595833 - DNA, 20 bp, Artificial
  CRISPR gRNA sequence
tgaaattcttttccatggca

SEQ ID NO: 595834 - DNA, 20 bp, Artificial
  CRISPR gRNA sequence
gaaattcttttccatggcag

SEQ ID NO: 595835 - DNA, 20 bp, Artificial
  CRISPR gRNA sequence
tggcagaggtttgacaactg

SEQ ID NO: 595836 - DNA, 20 bp, Artificial
  CRISPR gRNA sequence
aactgtggaaataattaaat

SEQ ID NO: 595837 - DNA, 20 bp, Artificial
  CRISPR gRNA sequence
tttcaacactacacatgact

SEQ ID NO: 595838 - DNA, 20 bp, Artificial
  CRISPR gRNA sequence
atgactgagaactgcttatc

SEQ ID NO: 595839 - DNA, 20 bp, Artificial
  CRISPR gRNA sequence
actgagaactgcttatccag

SEQ ID NO: 595840 - DNA, 20 bp, Artificial
  CRISPR gRNA sequence
tgagaactgcttatccagaa

SEQ ID NO: 595841 - DNA, 20 bp, Artificial
  CRISPR gRNA sequence
actgcttatccagaagagac

SEQ ID NO: 595842 - DNA, 20 bp, Artificial
  CRISPR gRNA sequence
cttatccagaagagactagc

SEQ ID NO: 595843 - DNA, 20 bp, Artificial
  CRISPR gRNA sequence
ttatccagaagagactagct

SEQ ID NO: 595844 - DNA, 20 bp, Artificial
  CRISPR gRNA sequence
tccagaagagactagctagg

SEQ ID NO: 595845 - DNA, 20 bp, Artificial
  CRISPR gRNA sequence
cagaagagactagctaggtg

SEQ ID NO: 595846 - DNA, 20 bp, Artificial
  CRISPR gRNA sequence
agaagagactagctaggtgg

SEQ ID NO: 595847 - DNA, 20 bp, Artificial
  CRISPR gRNA sequence
gaagagactagctaggtgga

SEQ ID NO: 595848 - DNA, 20 bp, Artificial
  CRISPR gRNA sequence
taggtggagggctctgttct

SEQ ID NO: 595849 - DNA, 20 bp, Artificial
  CRISPR gRNA sequence
ggctctgttctaagactatc

SEQ ID NO: 595850 - DNA, 20 bp, Artificial
  CRISPR gRNA sequence
actatcgagtatatgttatg

SEQ ID NO: 595851 - DNA, 20 bp, Artificial
  CRISPR gRNA sequence
tatatgttatgtggtattta

SEQ ID NO: 595852 - DNA, 20 bp, Artificial
  CRISPR gRNA sequence
tatatttgtaaaactataac

SEQ ID NO: 595853 - DNA, 20 bp, Artificial
  CRISPR gRNA sequence
atttgtaaaactataactag

SEQ ID NO: 595854 - DNA, 20 bp, Artificial
  CRISPR gRNA sequence
cttatattaaaacaaaacaa

SEQ ID NO: 595855 - DNA, 20 bp, Artificial
  CRISPR gRNA sequence
actaactctaacaaactgaa

SEQ ID NO: 595856 - DNA, 20 bp, Artificial
  CRISPR gRNA sequence
ctaactctaacaaactgaaa

SEQ ID NO: 595857 - DNA, 20 bp, Artificial
  CRISPR gRNA sequence
actctaacaaactgaaaagg

SEQ ID NO: 595858 - DNA, 20 bp, Artificial
  CRISPR gRNA sequence
caaactgaaaaggcagttga

SEQ ID NO: 595859 - DNA, 20 bp, Artificial
  CRISPR gRNA sequence
agttgaaagaatattaatca

SEQ ID NO: 595860 - DNA, 20 bp, Artificial
  CRISPR gRNA sequence
tattaatcaaagttcttgtt

SEQ ID NO: 595861 - DNA, 20 bp, Artificial
  CRISPR gRNA sequence
aaagttcttgtttagcttta

SEQ ID NO: 595862 - DNA, 20 bp, Artificial
  CRISPR gRNA sequence
ccacctaaaactttttttcc

SEQ ID NO: 595863 - DNA, 20 bp, Artificial
  CRISPR gRNA sequence
ttttttcccagaaaaatttt

SEQ ID NO: 595864 - DNA, 20 bp, Artificial
  CRISPR gRNA sequence
tcccagaaaaatttttggaa

SEQ ID NO: 595865 - DNA, 20 bp, Artificial
  CRISPR gRNA sequence
cccagaaaaatttttggaac

SEQ ID NO: 595866 - DNA, 20 bp, Artificial
  CRISPR gRNA sequence
ccagaaaaatttttggaaca

SEQ ID NO: 595867 - DNA, 20 bp, Artificial
  CRISPR gRNA sequence
tttggaacagggtcaacgaa

SEQ ID NO: 595868 - DNA, 20 bp, Artificial
  CRISPR gRNA sequence
acagggtcaacgaatggcca

SEQ ID NO: 595869 - DNA, 20 bp, Artificial
  CRISPR gRNA sequence
agggtcaacgaatggccaaa

SEQ ID NO: 595870 - DNA, 20 bp, Artificial
  CRISPR gRNA sequence
aatggccaaagagtcacttt

SEQ ID NO: 595871 - DNA, 20 bp, Artificial
  CRISPR gRNA sequence
ctaacacttttgtaactaca

SEQ ID NO: 595872 - DNA, 20 bp, Artificial
  CRISPR gRNA sequence
cacttttgtaactacaaagt

SEQ ID NO: 595873 - DNA, 20 bp, Artificial
  CRISPR gRNA sequence
gtaactacaaagtcagtcat

SEQ ID NO: 595874 - DNA, 20 bp, Artificial
  CRISPR gRNA sequence
atattttgtgcttgtgaaaa

SEQ ID NO: 595875 - DNA, 20 bp, Artificial
  CRISPR gRNA sequence
attttgtgcttgtgaaaaaa

SEQ ID NO: 595876 - DNA, 20 bp, Artificial
  CRISPR gRNA sequence
gtgaaaaaagagtctctact

SEQ ID NO: 595877 - DNA, 20 bp, Artificial
  CRISPR gRNA sequence
tgaaaaaagagtctctactc

SEQ ID NO: 595878 - DNA, 20 bp, Artificial
  CRISPR gRNA sequence
aaagagtctctactcaggtc

SEQ ID NO: 595879 - DNA, 20 bp, Artificial
  CRISPR gRNA sequence
ctcaggtctggtactacctt

SEQ ID NO: 595880 - DNA, 20 bp, Artificial
  CRISPR gRNA sequence
tcaggtctggtactaccttt

SEQ ID NO: 595881 - DNA, 20 bp, Artificial
  CRISPR gRNA sequence
ggtactacctttgggctgca

SEQ ID NO: 595882 - DNA, 20 bp, Artificial
  CRISPR gRNA sequence
ctacctttgggctgcaaaga

SEQ ID NO: 595883 - DNA, 20 bp, Artificial
  CRISPR gRNA sequence
tgcaaagacagttactttaa

SEQ ID NO: 595884 - DNA, 20 bp, Artificial
  CRISPR gRNA sequence
ctttaatggtattaatttga

SEQ ID NO: 595885 - DNA, 20 bp, Artificial
  CRISPR gRNA sequence
attaatttgacagaaaacaa

SEQ ID NO: 595886 - DNA, 20 bp, Artificial
  CRISPR gRNA sequence
aacttcttctccataccctc

SEQ ID NO: 595887 - DNA, 20 bp, Artificial
  CRISPR gRNA sequence
ccataccctccagcataatc

SEQ ID NO: 595888 - DNA, 20 bp, Artificial
  CRISPR gRNA sequence
gtacctgaaatctccattat

SEQ ID NO: 595889 - DNA, 20 bp, Artificial
  CRISPR gRNA sequence
ttatcagaaatttactacta

SEQ ID NO: 595890 - DNA, 20 bp, Artificial
  CRISPR gRNA sequence
agaaatttactactatggct

SEQ ID NO: 595891 - DNA, 20 bp, Artificial
  CRISPR gRNA sequence
gaaatttactactatggctt

SEQ ID NO: 595892 - DNA, 20 bp, Artificial
  CRISPR gRNA sequence
atggcttgggaaccaatttc

SEQ ID NO: 595893 - DNA, 20 bp, Artificial
  CRISPR gRNA sequence
ggcttgggaaccaatttcta

SEQ ID NO: 595894 - DNA, 20 bp, Artificial
  CRISPR gRNA sequence
ttctagagacatctctatta

SEQ ID NO: 595895 - DNA, 20 bp, Artificial
  CRISPR gRNA sequence
tttatgccactataaaacaa

SEQ ID NO: 595896 - DNA, 20 bp, Artificial
  CRISPR gRNA sequence
agtaatctattaaactatgt

SEQ ID NO: 595897 - DNA, 20 bp, Artificial
  CRISPR gRNA sequence
tatgtcagtctcaaaaacct

SEQ ID NO: 595898 - DNA, 20 bp, Artificial
  CRISPR gRNA sequence
ttacttgaattgttctatga

SEQ ID NO: 595899 - DNA, 20 bp, Artificial
  CRISPR gRNA sequence
tacttgaattgttctatgac

SEQ ID NO: 595900 - DNA, 20 bp, Artificial
  CRISPR gRNA sequence
tgaattgttctatgacagga

SEQ ID NO: 595901 - DNA, 20 bp, Artificial
  CRISPR gRNA sequence
ttgttctatgacaggatgga

SEQ ID NO: 595902 - DNA, 20 bp, Artificial
  CRISPR gRNA sequence
tctatgacaggatggaaagc

SEQ ID NO: 595903 - DNA, 20 bp, Artificial
  CRISPR gRNA sequence
ctatgacaggatggaaagct

SEQ ID NO: 595904 - DNA, 20 bp, Artificial
  CRISPR gRNA sequence
tatgacaggatggaaagctg

SEQ ID NO: 595905 - DNA, 20 bp, Artificial
  CRISPR gRNA sequence
acaggatggaaagctgggga

SEQ ID NO: 595906 - DNA, 20 bp, Artificial
  CRISPR gRNA sequence
caggatggaaagctggggaa

SEQ ID NO: 595907 - DNA, 20 bp, Artificial
  CRISPR gRNA sequence
aggatggaaagctggggaaa

SEQ ID NO: 595908 - DNA, 20 bp, Artificial
  CRISPR gRNA sequence
aaagctggggaaagggttcc

SEQ ID NO: 595909 - DNA, 20 bp, Artificial
  CRISPR gRNA sequence
gaaagggttcctagtgtcca

SEQ ID NO: 595910 - DNA, 20 bp, Artificial
  CRISPR gRNA sequence
gggttcctagtgtccacaga

SEQ ID NO: 595911 - DNA, 20 bp, Artificial
  CRISPR gRNA sequence
ggttcctagtgtccacagac

SEQ ID NO: 595912 - DNA, 20 bp, Artificial
  CRISPR gRNA sequence
tagtgtccacagacaggttt

SEQ ID NO: 595913 - DNA, 20 bp, Artificial
  CRISPR gRNA sequence
gacaggttttggtttgaata

SEQ ID NO: 595914 - DNA, 20 bp, Artificial
  CRISPR gRNA sequence
ggttttggtttgaataaaga

SEQ ID NO: 595915 - DNA, 20 bp, Artificial
  CRISPR gRNA sequence
ttgaataaagaaagattgtg

SEQ ID NO: 595916 - DNA, 20 bp, Artificial
  CRISPR gRNA sequence
aagattgtgaagacacgtat

SEQ ID NO: 595917 - DNA, 20 bp, Artificial
  CRISPR gRNA sequence
tcagaatcacgcaaccctga

SEQ ID NO: 595918 - DNA, 20 bp, Artificial
  CRISPR gRNA sequence
cagaatcacgcaaccctgaa

SEQ ID NO: 595919 - DNA, 20 bp, Artificial
  CRISPR gRNA sequence
aatcacgcaaccctgaaagg

SEQ ID NO: 595920 - DNA, 20 bp, Artificial
  CRISPR gRNA sequence
atcacgcaaccctgaaaggc

SEQ ID NO: 595921 - DNA, 20 bp, Artificial
  CRISPR gRNA sequence
acgcaaccctgaaaggcagg

SEQ ID NO: 595922 - DNA, 20 bp, Artificial
  CRISPR gRNA sequence
cgcaaccctgaaaggcaggc

SEQ ID NO: 595923 - DNA, 20 bp, Artificial
  CRISPR gRNA sequence
cctgaaaggcaggcaggact

SEQ ID NO: 595924 - DNA, 20 bp, Artificial
  CRISPR gRNA sequence
gaaaggcaggcaggactgag

SEQ ID NO: 595925 - DNA, 20 bp, Artificial
  CRISPR gRNA sequence
aaaggcaggcaggactgagc

SEQ ID NO: 595926 - DNA, 20 bp, Artificial
  CRISPR gRNA sequence
gcaggcaggactgagcagga

SEQ ID NO: 595927 - DNA, 20 bp, Artificial
  CRISPR gRNA sequence
caggactgagcaggacagtg

SEQ ID NO: 595928 - DNA, 20 bp, Artificial
  CRISPR gRNA sequence
gagcaggacagtgaagcaac

SEQ ID NO: 595929 - DNA, 20 bp, Artificial
  CRISPR gRNA sequence
aggacagtgaagcaacaagc

SEQ ID NO: 595930 - DNA, 20 bp, Artificial
  CRISPR gRNA sequence
aagcaacaagcaagtaccac

SEQ ID NO: 595931 - DNA, 20 bp, Artificial
  CRISPR gRNA sequence
agcaacaagcaagtaccaca

SEQ ID NO: 595932 - DNA, 20 bp, Artificial
  CRISPR gRNA sequence
gcaacaagcaagtaccacaa

SEQ ID NO: 595933 - DNA, 20 bp, Artificial
  CRISPR gRNA sequence
acaagcaagtaccacaaggg

SEQ ID NO: 595934 - DNA, 20 bp, Artificial
  CRISPR gRNA sequence
agcaagtaccacaagggaag

SEQ ID NO: 595935 - DNA, 20 bp, Artificial
  CRISPR gRNA sequence
gcaagtaccacaagggaagt

SEQ ID NO: 595936 - DNA, 20 bp, Artificial
  CRISPR gRNA sequence
aagggaagtgggtttgcaaa

SEQ ID NO: 595937 - DNA, 20 bp, Artificial
  CRISPR gRNA sequence
ggaagtgggtttgcaaatgg

SEQ ID NO: 595938 - DNA, 20 bp, Artificial
  CRISPR gRNA sequence
ggtttgcaaatggaagtgct

SEQ ID NO: 595939 - DNA, 20 bp, Artificial
  CRISPR gRNA sequence
tgcaaatggaagtgctaaga

SEQ ID NO: 595940 - DNA, 20 bp, Artificial
  CRISPR gRNA sequence
gaagtgctaagaaagaaaaa

SEQ ID NO: 595941 - DNA, 20 bp, Artificial
  CRISPR gRNA sequence
gctaagaaagaaaaaaagaa

SEQ ID NO: 595942 - DNA, 20 bp, Artificial
  CRISPR gRNA sequence
aaagaaaaaaagaatagtaa

SEQ ID NO: 595943 - DNA, 20 bp, Artificial
  CRISPR gRNA sequence
aagaaaaaaagaatagtaaa

SEQ ID NO: 595944 - DNA, 20 bp, Artificial
  CRISPR gRNA sequence
agaaaaaaagaatagtaaaa

SEQ ID NO: 595945 - DNA, 20 bp, Artificial
  CRISPR gRNA sequence
gaaaaaaagaatagtaaaag

SEQ ID NO: 595946 - DNA, 20 bp, Artificial
  CRISPR gRNA sequence
aggggccccaaaacaattca

SEQ ID NO: 595947 - DNA, 20 bp, Artificial
  CRISPR gRNA sequence
ggggccccaaaacaattcat

SEQ ID NO: 595948 - DNA, 20 bp, Artificial
  CRISPR gRNA sequence
aattcataggtaattctcta

SEQ ID NO: 595949 - DNA, 20 bp, Artificial
  CRISPR gRNA sequence
cataggtaattctctaaagc

SEQ ID NO: 595950 - DNA, 20 bp, Artificial
  CRISPR gRNA sequence
cctatctgtataacctttgc

SEQ ID NO: 595951 - DNA, 20 bp, Artificial
  CRISPR gRNA sequence
ctatctgtataacctttgct

SEQ ID NO: 595952 - DNA, 20 bp, Artificial
  CRISPR gRNA sequence
tatctgtataacctttgcta

SEQ ID NO: 595953 - DNA, 20 bp, Artificial
  CRISPR gRNA sequence
tataacctttgctagggcac

SEQ ID NO: 595954 - DNA, 20 bp, Artificial
  CRISPR gRNA sequence
aacctttgctagggcactgg

SEQ ID NO: 595955 - DNA, 20 bp, Artificial
  CRISPR gRNA sequence
atgcccccttcctgcattct

SEQ ID NO: 595956 - DNA, 20 bp, Artificial
  CRISPR gRNA sequence
cctcattttttttaatgaaa

SEQ ID NO: 595957 - DNA, 20 bp, Artificial
  CRISPR gRNA sequence
ctcattttttttaatgaaat

SEQ ID NO: 595958 - DNA, 20 bp, Artificial
  CRISPR gRNA sequence
ttttttttaatgaaataggt

SEQ ID NO: 595959 - DNA, 20 bp, Artificial
  CRISPR gRNA sequence
tgaaataggtcagctcgaca

SEQ ID NO: 595960 - DNA, 20 bp, Artificial
  CRISPR gRNA sequence
aaataggtcagctcgacaaa

SEQ ID NO: 595961 - DNA, 20 bp, Artificial
  CRISPR gRNA sequence
tcgacaaagagcaaatgact

SEQ ID NO: 595962 - DNA, 20 bp, Artificial
  CRISPR gRNA sequence
gaaacaaatttccctaactt

SEQ ID NO: 595963 - DNA, 20 bp, Artificial
  CRISPR gRNA sequence
caaatttccctaactttagt

SEQ ID NO: 595964 - DNA, 20 bp, Artificial
  CRISPR gRNA sequence
aatttccctaactttagtca

SEQ ID NO: 595965 - DNA, 20 bp, Artificial
  CRISPR gRNA sequence
atttccctaactttagtcag

SEQ ID NO: 595966 - DNA, 20 bp, Artificial
  CRISPR gRNA sequence
tccctaactttagtcagagg

SEQ ID NO: 595967 - DNA, 20 bp, Artificial
  CRISPR gRNA sequence
cataaaaaatctaatgctgc

SEQ ID NO: 595968 - DNA, 20 bp, Artificial
  CRISPR gRNA sequence
aaaaatctaatgctgcgagc

SEQ ID NO: 595969 - DNA, 20 bp, Artificial
  CRISPR gRNA sequence
tgctgcgagccagcataaac

SEQ ID NO: 595970 - DNA, 20 bp, Artificial
  CRISPR gRNA sequence
ctgcgagccagcataaacaa

SEQ ID NO: 595971 - DNA, 20 bp, Artificial
  CRISPR gRNA sequence
ccagcataaacaagagatga

SEQ ID NO: 595972 - DNA, 20 bp, Artificial
  CRISPR gRNA sequence
ataaacaagagatgaaagtg

SEQ ID NO: 595973 - DNA, 20 bp, Artificial
  CRISPR gRNA sequence
taaacaagagatgaaagtgt

SEQ ID NO: 595974 - DNA, 20 bp, Artificial
  CRISPR gRNA sequence
aacaagagatgaaagtgtgg

SEQ ID NO: 595975 - DNA, 20 bp, Artificial
  CRISPR gRNA sequence
gagatgaaagtgtgggagac

SEQ ID NO: 595976 - DNA, 20 bp, Artificial
  CRISPR gRNA sequence
gtgtgggagacaagaaacat

SEQ ID NO: 595977 - DNA, 20 bp, Artificial
  CRISPR gRNA sequence
tgggagacaagaaacatgag

SEQ ID NO: 595978 - DNA, 20 bp, Artificial
  CRISPR gRNA sequence
gggagacaagaaacatgaga

SEQ ID NO: 595979 - DNA, 20 bp, Artificial
  CRISPR gRNA sequence
gagacaagaaacatgagaag

SEQ ID NO: 595980 - DNA, 20 bp, Artificial
  CRISPR gRNA sequence
agacaagaaacatgagaagg

SEQ ID NO: 595981 - DNA, 20 bp, Artificial
  CRISPR gRNA sequence
acatgagaaggaggaaaaaa

SEQ ID NO: 595982 - DNA, 20 bp, Artificial
  CRISPR gRNA sequence
gagaaggaggaaaaaaaaga

SEQ ID NO: 595983 - DNA, 20 bp, Artificial
  CRISPR gRNA sequence
agaaggaggaaaaaaaagaa

SEQ ID NO: 595984 - DNA, 20 bp, Artificial
  CRISPR gRNA sequence
gttctgttgttattctgtta

SEQ ID NO: 595985 - DNA, 20 bp, Artificial
  CRISPR gRNA sequence
ctgttacagatgacacacat

SEQ ID NO: 595986 - DNA, 20 bp, Artificial
  CRISPR gRNA sequence
tgttacagatgacacacata

SEQ ID NO: 595987 - DNA, 20 bp, Artificial
  CRISPR gRNA sequence
tacagatgacacacataagg

SEQ ID NO: 595988 - DNA, 20 bp, Artificial
  CRISPR gRNA sequence
gacacacataaggaagtccc

SEQ ID NO: 595989 - DNA, 20 bp, Artificial
  CRISPR gRNA sequence
ttaatactctaccctatgat

SEQ ID NO: 595990 - DNA, 20 bp, Artificial
  CRISPR gRNA sequence
taatactctaccctatgatg

SEQ ID NO: 595991 - DNA, 20 bp, Artificial
  CRISPR gRNA sequence
ctctaccctatgatgaggca

SEQ ID NO: 595992 - DNA, 20 bp, Artificial
  CRISPR gRNA sequence
cctatgatgaggcacagcta

SEQ ID NO: 595993 - DNA, 20 bp, Artificial
  CRISPR gRNA sequence
agctacagacatatccatct

SEQ ID NO: 595994 - DNA, 20 bp, Artificial
  CRISPR gRNA sequence
acagacatatccatcttagt

SEQ ID NO: 595995 - DNA, 20 bp, Artificial
  CRISPR gRNA sequence
tatccatcttagtcagctct

SEQ ID NO: 595996 - DNA, 20 bp, Artificial
  CRISPR gRNA sequence
cttagtcagctctgagttat

SEQ ID NO: 595997 - DNA, 20 bp, Artificial
  CRISPR gRNA sequence
gagttataagaatatgcctg

SEQ ID NO: 595998 - DNA, 20 bp, Artificial
  CRISPR gRNA sequence
ataagaatatgcctgaagcc

SEQ ID NO: 595999 - DNA, 20 bp, Artificial
  CRISPR gRNA sequence
atgcctgaagccaagatgaa

SEQ ID NO: 596000 - DNA, 20 bp, Artificial
  CRISPR gRNA sequence
gaagccaagatgaatggact

SEQ ID NO: 596001 - DNA, 20 bp, Artificial
  CRISPR gRNA sequence
aagccaagatgaatggactt

SEQ ID NO: 596002 - DNA, 20 bp, Artificial
  CRISPR gRNA sequence
tggacttgggtactgaatgc

SEQ ID NO: 596003 - DNA, 20 bp, Artificial
  CRISPR gRNA sequence
ggacttgggtactgaatgca

SEQ ID NO: 596004 - DNA, 20 bp, Artificial
  CRISPR gRNA sequence
tgaatgcaaggctttctcta

SEQ ID NO: 596005 - DNA, 20 bp, Artificial
  CRISPR gRNA sequence
caaggctttctctacagact

SEQ ID NO: 596006 - DNA, 20 bp, Artificial
  CRISPR gRNA sequence
aaggctttctctacagactc

SEQ ID NO: 596007 - DNA, 20 bp, Artificial
  CRISPR gRNA sequence
tttctctacagactcgggtt

SEQ ID NO: 596008 - DNA, 20 bp, Artificial
  CRISPR gRNA sequence
tctctacagactcgggttca

SEQ ID NO: 596009 - DNA, 20 bp, Artificial
  CRISPR gRNA sequence
ctctacagactcgggttcag

SEQ ID NO: 596010 - DNA, 20 bp, Artificial
  CRISPR gRNA sequence
tcagaggtcaccatcatata

SEQ ID NO: 596011 - DNA, 20 bp, Artificial
  CRISPR gRNA sequence
ctaccacatcctgtgtgcat

SEQ ID NO: 596012 - DNA, 20 bp, Artificial
  CRISPR gRNA sequence
taccacatcctgtgtgcata

SEQ ID NO: 596013 - DNA, 20 bp, Artificial
  CRISPR gRNA sequence
accacatcctgtgtgcataa

SEQ ID NO: 596014 - DNA, 20 bp, Artificial
  CRISPR gRNA sequence
tgcataagggcatgtgatat

SEQ ID NO: 596015 - DNA, 20 bp, Artificial
  CRISPR gRNA sequence
atgtgatatcagattaaaat

SEQ ID NO: 596016 - DNA, 20 bp, Artificial
  CRISPR gRNA sequence
agattaaaattggcctttac

SEQ ID NO: 596017 - DNA, 20 bp, Artificial
  CRISPR gRNA sequence
ggcctttactagcaatcttg

SEQ ID NO: 596018 - DNA, 20 bp, Artificial
  CRISPR gRNA sequence
gcctttactagcaatcttga

SEQ ID NO: 596019 - DNA, 20 bp, Artificial
  CRISPR gRNA sequence
ctttactagcaatcttgaag

SEQ ID NO: 596020 - DNA, 20 bp, Artificial
  CRISPR gRNA sequence
tactagcaatcttgaaggag

SEQ ID NO: 596021 - DNA, 20 bp, Artificial
  CRISPR gRNA sequence
tgaaggagaagaaaaataat

SEQ ID NO: 596022 - DNA, 20 bp, Artificial
  CRISPR gRNA sequence
ggagaagaaaaataattagt

SEQ ID NO: 596023 - DNA, 20 bp, Artificial
  CRISPR gRNA sequence
gaagaaaaataattagttag

SEQ ID NO: 596024 - DNA, 20 bp, Artificial
  CRISPR gRNA sequence
aaaaataattagttagtagt

SEQ ID NO: 596025 - DNA, 20 bp, Artificial
  CRISPR gRNA sequence
ataattagttagtagtcagt

SEQ ID NO: 596026 - DNA, 20 bp, Artificial
  CRISPR gRNA sequence
gttagtagtcagtaagtacc

SEQ ID NO: 596027 - DNA, 20 bp, Artificial
  CRISPR gRNA sequence
tagtcagtaagtacctggca

SEQ ID NO: 596028 - DNA, 20 bp, Artificial
  CRISPR gRNA sequence
cagtaagtacctggcaaaga

SEQ ID NO: 596029 - DNA, 20 bp, Artificial
  CRISPR gRNA sequence
taagtacctggcaaagaaag

SEQ ID NO: 596030 - DNA, 20 bp, Artificial
  CRISPR gRNA sequence
gtacctggcaaagaaagaag

SEQ ID NO: 596031 - DNA, 20 bp, Artificial
  CRISPR gRNA sequence
cagtctcacttattcgactt

SEQ ID NO: 596032 - DNA, 20 bp, Artificial
  CRISPR gRNA sequence
ctcacttattcgactttagt

SEQ ID NO: 596033 - DNA, 20 bp, Artificial
  CRISPR gRNA sequence
cttattcgactttagtgaga

SEQ ID NO: 596034 - DNA, 20 bp, Artificial
  CRISPR gRNA sequence
tgagatagtatctgtttgtt

SEQ ID NO: 596035 - DNA, 20 bp, Artificial
  CRISPR gRNA sequence
agatagtatctgtttgtttg

SEQ ID NO: 596036 - DNA, 20 bp, Artificial
  CRISPR gRNA sequence
gtatctgtttgtttggagaa

SEQ ID NO: 596037 - DNA, 20 bp, Artificial
  CRISPR gRNA sequence
gagaaaagaatttgctgttg

SEQ ID NO: 596038 - DNA, 20 bp, Artificial
  CRISPR gRNA sequence
agaaaagaatttgctgttga

SEQ ID NO: 596039 - DNA, 20 bp, Artificial
  CRISPR gRNA sequence
aaagaatttgctgttgaagg

SEQ ID NO: 596040 - DNA, 20 bp, Artificial
  CRISPR gRNA sequence
aggcagactacatgttatgt

SEQ ID NO: 596041 - DNA, 20 bp, Artificial
  CRISPR gRNA sequence
gactacatgttatgtgagcc

SEQ ID NO: 596042 - DNA, 20 bp, Artificial
  CRISPR gRNA sequence
actacatgttatgtgagccc

SEQ ID NO: 596043 - DNA, 20 bp, Artificial
  CRISPR gRNA sequence
ctctccctcttttcattccc

SEQ ID NO: 596044 - DNA, 20 bp, Artificial
  CRISPR gRNA sequence
tctccctcttttcattcccc

SEQ ID NO: 596045 - DNA, 20 bp, Artificial
  CRISPR gRNA sequence
ctcttttcattccccaggta

SEQ ID NO: 596046 - DNA, 20 bp, Artificial
  CRISPR gRNA sequence
ttttcattccccaggtaaag

SEQ ID NO: 596047 - DNA, 20 bp, Artificial
  CRISPR gRNA sequence
aactccatctctctttcttc

SEQ ID NO: 596048 - DNA, 20 bp, Artificial
  CRISPR gRNA sequence
actccatctctctttcttca

SEQ ID NO: 596049 - DNA, 20 bp, Artificial
  CRISPR gRNA sequence
catctctctttcttcaaggc

SEQ ID NO: 596050 - DNA, 20 bp, Artificial
  CRISPR gRNA sequence
tactcccatccacttcatga

SEQ ID NO: 596051 - DNA, 20 bp, Artificial
  CRISPR gRNA sequence
aagttcattcactctccttt

SEQ ID NO: 596052 - DNA, 20 bp, Artificial
  CRISPR gRNA sequence
gtcatttgttcataaaacaa

SEQ ID NO: 596053 - DNA, 20 bp, Artificial
  CRISPR gRNA sequence
tcatttgttcataaaacaat

SEQ ID NO: 596054 - DNA, 20 bp, Artificial
  CRISPR gRNA sequence
tttgttcataaaacaatggg

SEQ ID NO: 596055 - DNA, 20 bp, Artificial
  CRISPR gRNA sequence
gttcataaaacaatgggaag

SEQ ID NO: 596056 - DNA, 20 bp, Artificial
  CRISPR gRNA sequence
gtggtacacctattctctgc

SEQ ID NO: 596057 - DNA, 20 bp, Artificial
  CRISPR gRNA sequence
tggtacacctattctctgcc

SEQ ID NO: 596058 - DNA, 20 bp, Artificial
  CRISPR gRNA sequence
cacctattctctgccaggta

SEQ ID NO: 596059 - DNA, 20 bp, Artificial
  CRISPR gRNA sequence
ctattctctgccaggtacag

SEQ ID NO: 596060 - DNA, 20 bp, Artificial
  CRISPR gRNA sequence
aggtacagtggcaaaattat

SEQ ID NO: 596061 - DNA, 20 bp, Artificial
  CRISPR gRNA sequence
gtggcaaaattataagtaca

SEQ ID NO: 596062 - DNA, 20 bp, Artificial
  CRISPR gRNA sequence
ttataagtacacagatgaac

SEQ ID NO: 596063 - DNA, 20 bp, Artificial
  CRISPR gRNA sequence
gtacacagatgaacaagaca

SEQ ID NO: 596064 - DNA, 20 bp, Artificial
  CRISPR gRNA sequence
gaacaagacatagtctgccc

SEQ ID NO: 596065 - DNA, 20 bp, Artificial
  CRISPR gRNA sequence
acaagacatagtctgcccca

SEQ ID NO: 596066 - DNA, 20 bp, Artificial
  CRISPR gRNA sequence
caagacatagtctgccccag

SEQ ID NO: 596067 - DNA, 20 bp, Artificial
  CRISPR gRNA sequence
agacatagtctgccccagag

SEQ ID NO: 596068 - DNA, 20 bp, Artificial
  CRISPR gRNA sequence
gaggagctcaaaatctaata

SEQ ID NO: 596069 - DNA, 20 bp, Artificial
  CRISPR gRNA sequence
aggagctcaaaatctaatat

SEQ ID NO: 596070 - DNA, 20 bp, Artificial
  CRISPR gRNA sequence
gagctcaaaatctaatatgg

SEQ ID NO: 596071 - DNA, 20 bp, Artificial
  CRISPR gRNA sequence
aaaatctaatatgggagaca

SEQ ID NO: 596072 - DNA, 20 bp, Artificial
  CRISPR gRNA sequence
gagacaaagacataaaacaa

SEQ ID NO: 596073 - DNA, 20 bp, Artificial
  CRISPR gRNA sequence
aaaacaatagcaatacaatg

SEQ ID NO: 596074 - DNA, 20 bp, Artificial
  CRISPR gRNA sequence
caatgtggtgaatactataa

SEQ ID NO: 596075 - DNA, 20 bp, Artificial
  CRISPR gRNA sequence
aatagatacatgtacatact

SEQ ID NO: 596076 - DNA, 20 bp, Artificial
  CRISPR gRNA sequence
catgtacatactcagtgcta

SEQ ID NO: 596077 - DNA, 20 bp, Artificial
  CRISPR gRNA sequence
tactcagtgctatagaaata

SEQ ID NO: 596078 - DNA, 20 bp, Artificial
  CRISPR gRNA sequence
actcagtgctatagaaatat

SEQ ID NO: 596079 - DNA, 20 bp, Artificial
  CRISPR gRNA sequence
ctcagtgctatagaaatatg

SEQ ID NO: 596080 - DNA, 20 bp, Artificial
  CRISPR gRNA sequence
gaataactaaaaattcaaat

SEQ ID NO: 596081 - DNA, 20 bp, Artificial
  CRISPR gRNA sequence
taactaaaaattcaaataag

SEQ ID NO: 596082 - DNA, 20 bp, Artificial
  CRISPR gRNA sequence
attcaaataagcagttacac

SEQ ID NO: 596083 - DNA, 20 bp, Artificial
  CRISPR gRNA sequence
agttacactggacctttgaa

SEQ ID NO: 596084 - DNA, 20 bp, Artificial
  CRISPR gRNA sequence
gttacactggacctttgaaa

SEQ ID NO: 596085 - DNA, 20 bp, Artificial
  CRISPR gRNA sequence
ctggacctttgaaaaggatt

SEQ ID NO: 596086 - DNA, 20 bp, Artificial
  CRISPR gRNA sequence
ggacctttgaaaaggattga

SEQ ID NO: 596087 - DNA, 20 bp, Artificial
  CRISPR gRNA sequence
aaaaggattgagagttttcc

SEQ ID NO: 596088 - DNA, 20 bp, Artificial
  CRISPR gRNA sequence
gattgagagttttcctggtt

SEQ ID NO: 596089 - DNA, 20 bp, Artificial
  CRISPR gRNA sequence
gagttttcctggttgagaaa

SEQ ID NO: 596090 - DNA, 20 bp, Artificial
  CRISPR gRNA sequence
ttcctggttgagaaaaagta

SEQ ID NO: 596091 - DNA, 20 bp, Artificial
  CRISPR gRNA sequence
gagaaaaagtacagaaatcc

SEQ ID NO: 596092 - DNA, 20 bp, Artificial
  CRISPR gRNA sequence
agaaaaagtacagaaatcca

SEQ ID NO: 596093 - DNA, 20 bp, Artificial
  CRISPR gRNA sequence
aaagtacagaaatccaagga

SEQ ID NO: 596094 - DNA, 20 bp, Artificial
  CRISPR gRNA sequence
aagtacagaaatccaaggaa

SEQ ID NO: 596095 - DNA, 20 bp, Artificial
  CRISPR gRNA sequence
gtacagaaatccaaggaaag

SEQ ID NO: 596096 - DNA, 20 bp, Artificial
  CRISPR gRNA sequence
cagaaatccaaggaaaggag

SEQ ID NO: 596097 - DNA, 20 bp, Artificial
  CRISPR gRNA sequence
agaaatccaaggaaaggaga

SEQ ID NO: 596098 - DNA, 20 bp, Artificial
  CRISPR gRNA sequence
aaaggagaaggattcatgca

SEQ ID NO: 596099 - DNA, 20 bp, Artificial
  CRISPR gRNA sequence
agaaggattcatgcaaagaa

SEQ ID NO: 596100 - DNA, 20 bp, Artificial
  CRISPR gRNA sequence
gaaggattcatgcaaagaaa

SEQ ID NO: 596101 - DNA, 20 bp, Artificial
  CRISPR gRNA sequence
gcaaagaaaaggcaatttga

SEQ ID NO: 596102 - DNA, 20 bp, Artificial
  CRISPR gRNA sequence
tgaaagaatatgttatattc

SEQ ID NO: 596103 - DNA, 20 bp, Artificial
  CRISPR gRNA sequence
aatatgttatattcaagaca

SEQ ID NO: 596104 - DNA, 20 bp, Artificial
  CRISPR gRNA sequence
tgttatattcaagacatggc

SEQ ID NO: 596105 - DNA, 20 bp, Artificial
  CRISPR gRNA sequence
caagacatggcaagtatctg

SEQ ID NO: 596106 - DNA, 20 bp, Artificial
  CRISPR gRNA sequence
atggcaagtatctgtggctg

SEQ ID NO: 596107 - DNA, 20 bp, Artificial
  CRISPR gRNA sequence
aagtatctgtggctgaagca

SEQ ID NO: 596108 - DNA, 20 bp, Artificial
  CRISPR gRNA sequence
tgaagcacagtatatgtgaa

SEQ ID NO: 596109 - DNA, 20 bp, Artificial
  CRISPR gRNA sequence
gaagcacagtatatgtgaaa

SEQ ID NO: 596110 - DNA, 20 bp, Artificial
  CRISPR gRNA sequence
gtatatgtgaaaaggaattt

SEQ ID NO: 596111 - DNA, 20 bp, Artificial
  CRISPR gRNA sequence
tatatgtgaaaaggaatttc

SEQ ID NO: 596112 - DNA, 20 bp, Artificial
  CRISPR gRNA sequence
tatgtgaaaaggaatttcag

SEQ ID NO: 596113 - DNA, 20 bp, Artificial
  CRISPR gRNA sequence
aaaaggaatttcaggagatg

SEQ ID NO: 596114 - DNA, 20 bp, Artificial
  CRISPR gRNA sequence
tttcaggagatgaagacaaa

SEQ ID NO: 596115 - DNA, 20 bp, Artificial
  CRISPR gRNA sequence
aggagatgaagacaaaaaga

SEQ ID NO: 596116 - DNA, 20 bp, Artificial
  CRISPR gRNA sequence
atgaagacaaaaagatagat

SEQ ID NO: 596117 - DNA, 20 bp, Artificial
  CRISPR gRNA sequence
tgaagacaaaaagatagatt

SEQ ID NO: 596118 - DNA, 20 bp, Artificial
  CRISPR gRNA sequence
aaaagatagattgggctgtt

SEQ ID NO: 596119 - DNA, 20 bp, Artificial
  CRISPR gRNA sequence
atagattgggctgtttagta

SEQ ID NO: 596120 - DNA, 20 bp, Artificial
  CRISPR gRNA sequence
tagattgggctgtttagtaa

SEQ ID NO: 596121 - DNA, 20 bp, Artificial
  CRISPR gRNA sequence
gggctgtttagtaaaggctg

SEQ ID NO: 596122 - DNA, 20 bp, Artificial
  CRISPR gRNA sequence
ggctgtagtataaaatgcta

SEQ ID NO: 596123 - DNA, 20 bp, Artificial
  CRISPR gRNA sequence
ctgtagtataaaatgctaaa

SEQ ID NO: 596124 - DNA, 20 bp, Artificial
  CRISPR gRNA sequence
taaaatgctaaagagcttat

SEQ ID NO: 596125 - DNA, 20 bp, Artificial
  CRISPR gRNA sequence
gcttattagactgcattcct

SEQ ID NO: 596126 - DNA, 20 bp, Artificial
  CRISPR gRNA sequence
cttattagactgcattcctc

SEQ ID NO: 596127 - DNA, 20 bp, Artificial
  CRISPR gRNA sequence
ttagactgcattcctcaggt

SEQ ID NO: 596128 - DNA, 20 bp, Artificial
  CRISPR gRNA sequence
tagactgcattcctcaggta

SEQ ID NO: 596129 - DNA, 20 bp, Artificial
  CRISPR gRNA sequence
agactgcattcctcaggtaa

SEQ ID NO: 596130 - DNA, 20 bp, Artificial
  CRISPR gRNA sequence
gactgcattcctcaggtaag

SEQ ID NO: 596131 - DNA, 20 bp, Artificial
  CRISPR gRNA sequence
ctgcattcctcaggtaaggg

SEQ ID NO: 596132 - DNA, 20 bp, Artificial
  CRISPR gRNA sequence
ctcaggtaaggggagtcatt

SEQ ID NO: 596133 - DNA, 20 bp, Artificial
  CRISPR gRNA sequence
aaggggagtcattcagaaaa

SEQ ID NO: 596134 - DNA, 20 bp, Artificial
  CRISPR gRNA sequence
gagtcattcagaaaaaagaa

SEQ ID NO: 596135 - DNA, 20 bp, Artificial
  CRISPR gRNA sequence
tggcaaacaaatttttgtaa

SEQ ID NO: 596136 - DNA, 20 bp, Artificial
  CRISPR gRNA sequence
caaacaaatttttgtaatag

SEQ ID NO: 596137 - DNA, 20 bp, Artificial
  CRISPR gRNA sequence
acaaatttttgtaatagaag

SEQ ID NO: 596138 - DNA, 20 bp, Artificial
  CRISPR gRNA sequence
caaatttttgtaatagaagt

SEQ ID NO: 596139 - DNA, 20 bp, Artificial
  CRISPR gRNA sequence
agaagtaggtgacaaaacta

SEQ ID NO: 596140 - DNA, 20 bp, Artificial
  CRISPR gRNA sequence
gtaggtgacaaaactacaga

SEQ ID NO: 596141 - DNA, 20 bp, Artificial
  CRISPR gRNA sequence
taggtgacaaaactacagaa

SEQ ID NO: 596142 - DNA, 20 bp, Artificial
  CRISPR gRNA sequence
attaattctataactctaac

SEQ ID NO: 596143 - DNA, 20 bp, Artificial
  CRISPR gRNA sequence
aattctataactctaactgg

SEQ ID NO: 596144 - DNA, 20 bp, Artificial
  CRISPR gRNA sequence
attctataactctaactgga

SEQ ID NO: 596145 - DNA, 20 bp, Artificial
  CRISPR gRNA sequence
ctataactctaactggaagg

SEQ ID NO: 596146 - DNA, 20 bp, Artificial
  CRISPR gRNA sequence
gaaggcagatgacctacaat

SEQ ID NO: 596147 - DNA, 20 bp, Artificial
  CRISPR gRNA sequence
gatgacctacaattagtcct

SEQ ID NO: 596148 - DNA, 20 bp, Artificial
  CRISPR gRNA sequence
ttatatatttatttattttt

SEQ ID NO: 596149 - DNA, 20 bp, Artificial
  CRISPR gRNA sequence
atatttatttatttttgaga

SEQ ID NO: 596150 - DNA, 20 bp, Artificial
  CRISPR gRNA sequence
ttatttttgagacagtctcg

SEQ ID NO: 596151 - DNA, 20 bp, Artificial
  CRISPR gRNA sequence
gagacagtctcgtagtaacc

SEQ ID NO: 596152 - DNA, 20 bp, Artificial
  CRISPR gRNA sequence
agacagtctcgtagtaaccc

SEQ ID NO: 596153 - DNA, 20 bp, Artificial
  CRISPR gRNA sequence
agtctcgtagtaacccaggc

SEQ ID NO: 596154 - DNA, 20 bp, Artificial
  CRISPR gRNA sequence
tctcgtagtaacccaggctg

SEQ ID NO: 596155 - DNA, 20 bp, Artificial
  CRISPR gRNA sequence
tagtaacccaggctggagtg

SEQ ID NO: 596156 - DNA, 20 bp, Artificial
  CRISPR gRNA sequence
ccaggctggagtgcagttgc

SEQ ID NO: 596157 - DNA, 20 bp, Artificial
  CRISPR gRNA sequence
ggagtgcagttgcaagatct

SEQ ID NO: 596158 - DNA, 20 bp, Artificial
  CRISPR gRNA sequence
tgcaagatcttggctcactg

SEQ ID NO: 596159 - DNA, 20 bp, Artificial
  CRISPR gRNA sequence
tcactgcagcctcaacctcc

SEQ ID NO: 596160 - DNA, 20 bp, Artificial
  CRISPR gRNA sequence
cactgcagcctcaacctcct

SEQ ID NO: 596161 - DNA, 20 bp, Artificial
  CRISPR gRNA sequence
agcctcaacctcctgggttc

SEQ ID NO: 596162 - DNA, 20 bp, Artificial
  CRISPR gRNA sequence
gcctcaacctcctgggttca

SEQ ID NO: 596163 - DNA, 20 bp, Artificial
  CRISPR gRNA sequence
cctcaacctcctgggttcaa

SEQ ID NO: 596164 - DNA, 20 bp, Artificial
  CRISPR gRNA sequence
ttcaagggatcctctcacct

SEQ ID NO: 596165 - DNA, 20 bp, Artificial
  CRISPR gRNA sequence
tcctctcacctcagcccctc

SEQ ID NO: 596166 - DNA, 20 bp, Artificial
  CRISPR gRNA sequence
tctcacctcagcccctcaag

SEQ ID NO: 596167 - DNA, 20 bp, Artificial
  CRISPR gRNA sequence
acctcagcccctcaagtagc

SEQ ID NO: 596168 - DNA, 20 bp, Artificial
  CRISPR gRNA sequence
cctcagcccctcaagtagct

SEQ ID NO: 596169 - DNA, 20 bp, Artificial
  CRISPR gRNA sequence
ccctcaagtagctgggacta

SEQ ID NO: 596170 - DNA, 20 bp, Artificial
  CRISPR gRNA sequence
cctcaagtagctgggactac

SEQ ID NO: 596171 - DNA, 20 bp, Artificial
  CRISPR gRNA sequence
cgggtacgtgccacaacgcc

SEQ ID NO: 596172 - DNA, 20 bp, Artificial
  CRISPR gRNA sequence
ctaattttttgtattttttg

SEQ ID NO: 596173 - DNA, 20 bp, Artificial
  CRISPR gRNA sequence
aattttttgtattttttgta

SEQ ID NO: 596174 - DNA, 20 bp, Artificial
  CRISPR gRNA sequence
ttttgtattttttgtagaga

SEQ ID NO: 596175 - DNA, 20 bp, Artificial
  CRISPR gRNA sequence
tttgtattttttgtagagac

SEQ ID NO: 596176 - DNA, 20 bp, Artificial
  CRISPR gRNA sequence
ttgtattttttgtagagaca

SEQ ID NO: 596177 - DNA, 20 bp, Artificial
  CRISPR gRNA sequence
agggttttgccatgttgccc

SEQ ID NO: 596178 - DNA, 20 bp, Artificial
  CRISPR gRNA sequence
gtgaaatctgattctcttta

SEQ ID NO: 596179 - DNA, 20 bp, Artificial
  CRISPR gRNA sequence
tgaaatctgattctctttaa

SEQ ID NO: 596180 - DNA, 20 bp, Artificial
  CRISPR gRNA sequence
tatacacaatatttttcata

SEQ ID NO: 596181 - DNA, 20 bp, Artificial
  CRISPR gRNA sequence
atttttcataaagtactaaa

SEQ ID NO: 596182 - DNA, 20 bp, Artificial
  CRISPR gRNA sequence
tagatacttgctgactgatc

SEQ ID NO: 596183 - DNA, 20 bp, Artificial
  CRISPR gRNA sequence
tgactgatcaagatgcataa

SEQ ID NO: 596184 - DNA, 20 bp, Artificial
  CRISPR gRNA sequence
gatgcataatagttatccta

SEQ ID NO: 596185 - DNA, 20 bp, Artificial
  CRISPR gRNA sequence
atgcataatagttatcctat

SEQ ID NO: 596186 - DNA, 20 bp, Artificial
  CRISPR gRNA sequence
ttatcctataggatcttttc

SEQ ID NO: 596187 - DNA, 20 bp, Artificial
  CRISPR gRNA sequence
ataggatcttttctagaaac

SEQ ID NO: 596188 - DNA, 20 bp, Artificial
  CRISPR gRNA sequence
ctatttctgatctatttctt

SEQ ID NO: 596189 - DNA, 20 bp, Artificial
  CRISPR gRNA sequence
gatctatttcttcagactgt

SEQ ID NO: 596190 - DNA, 20 bp, Artificial
  CRISPR gRNA sequence
tctatttcttcagactgttg

SEQ ID NO: 596191 - DNA, 20 bp, Artificial
  CRISPR gRNA sequence
tcagactgttggagaaatat

SEQ ID NO: 596192 - DNA, 20 bp, Artificial
  CRISPR gRNA sequence
cagactgttggagaaatata

SEQ ID NO: 596193 - DNA, 20 bp, Artificial
  CRISPR gRNA sequence
tggagaaatataaggtcaac

SEQ ID NO: 596194 - DNA, 20 bp, Artificial
  CRISPR gRNA sequence
ggagaaatataaggtcaacc

SEQ ID NO: 596195 - DNA, 20 bp, Artificial
  CRISPR gRNA sequence
aaatataaggtcaaccaggt

SEQ ID NO: 596196 - DNA, 20 bp, Artificial
  CRISPR gRNA sequence
aaccaggtaagtatttgtac

SEQ ID NO: 596197 - DNA, 20 bp, Artificial
  CRISPR gRNA sequence
acaagcgcatttaaaatgtt

SEQ ID NO: 596198 - DNA, 20 bp, Artificial
  CRISPR gRNA sequence
gttgagctcttctttccttt

SEQ ID NO: 596199 - DNA, 20 bp, Artificial
  CRISPR gRNA sequence
ctcttctttccttttggctc

SEQ ID NO: 596200 - DNA, 20 bp, Artificial
  CRISPR gRNA sequence
ttccttttggctccagctca

SEQ ID NO: 596201 - DNA, 20 bp, Artificial
  CRISPR gRNA sequence
ccttttggctccagctcatg

SEQ ID NO: 596202 - DNA, 20 bp, Artificial
  CRISPR gRNA sequence
ggctccagctcatggagata

SEQ ID NO: 596203 - DNA, 20 bp, Artificial
  CRISPR gRNA sequence
ggagatatggcttcctatct

SEQ ID NO: 596204 - DNA, 20 bp, Artificial
  CRISPR gRNA sequence
gagatatggcttcctatctt

SEQ ID NO: 596205 - DNA, 20 bp, Artificial
  CRISPR gRNA sequence
gcttcctatcttaggcaaat

SEQ ID NO: 596206 - DNA, 20 bp, Artificial
  CRISPR gRNA sequence
atcttaggcaaatcagtact

SEQ ID NO: 596207 - DNA, 20 bp, Artificial
  CRISPR gRNA sequence
tcttaggcaaatcagtactt

SEQ ID NO: 596208 - DNA, 20 bp, Artificial
  CRISPR gRNA sequence
gggtgctacactgataccat

SEQ ID NO: 596209 - DNA, 20 bp, Artificial
  CRISPR gRNA sequence
ttagctatatttcttacatt

SEQ ID NO: 596210 - DNA, 20 bp, Artificial
  CRISPR gRNA sequence
gctatatttcttacattcag

SEQ ID NO: 596211 - DNA, 20 bp, Artificial
  CRISPR gRNA sequence
cattcagtagtaattcaatg

SEQ ID NO: 596212 - DNA, 20 bp, Artificial
  CRISPR gRNA sequence
tcagtagtaattcaatgtgg

SEQ ID NO: 596213 - DNA, 20 bp, Artificial
  CRISPR gRNA sequence
tagtaattcaatgtggaagc

SEQ ID NO: 596214 - DNA, 20 bp, Artificial
  CRISPR gRNA sequence
gtaattcaatgtggaagctg

SEQ ID NO: 596215 - DNA, 20 bp, Artificial
  CRISPR gRNA sequence
agctggagttctgaaactgt

SEQ ID NO: 596216 - DNA, 20 bp, Artificial
  CRISPR gRNA sequence
tggagttctgaaactgttag

SEQ ID NO: 596217 - DNA, 20 bp, Artificial
  CRISPR gRNA sequence
cagatcatgtatgatattcc

SEQ ID NO: 596218 - DNA, 20 bp, Artificial
  CRISPR gRNA sequence
tattctttctaacattcatt

SEQ ID NO: 596219 - DNA, 20 bp, Artificial
  CRISPR gRNA sequence
cattgagttgctataaatac

SEQ ID NO: 596220 - DNA, 20 bp, Artificial
  CRISPR gRNA sequence
attgagttgctataaataca

SEQ ID NO: 596221 - DNA, 20 bp, Artificial
  CRISPR gRNA sequence
gaaatgtttgtgattacccc

SEQ ID NO: 596222 - DNA, 20 bp, Artificial
  CRISPR gRNA sequence
ccctggcatattacaacttg

SEQ ID NO: 596223 - DNA, 20 bp, Artificial
  CRISPR gRNA sequence
tattacaacttgtggaatac

SEQ ID NO: 596224 - DNA, 20 bp, Artificial
  CRISPR gRNA sequence
ctggtcactaaacattttga

SEQ ID NO: 596225 - DNA, 20 bp, Artificial
  CRISPR gRNA sequence
aacattttgatagcctcttt

SEQ ID NO: 596226 - DNA, 20 bp, Artificial
  CRISPR gRNA sequence
acattttgatagcctctttg

SEQ ID NO: 596227 - DNA, 20 bp, Artificial
  CRISPR gRNA sequence
agcctctttgaggtacaata

SEQ ID NO: 596228 - DNA, 20 bp, Artificial
  CRISPR gRNA sequence
aataaagaaaaacaaaactt

SEQ ID NO: 596229 - DNA, 20 bp, Artificial
  CRISPR gRNA sequence
agaaaaacaaaacttcagca

SEQ ID NO: 596230 - DNA, 20 bp, Artificial
  CRISPR gRNA sequence
gaaaaacaaaacttcagcaa

SEQ ID NO: 596231 - DNA, 20 bp, Artificial
  CRISPR gRNA sequence
gcaaaggccttttataacca

SEQ ID NO: 596232 - DNA, 20 bp, Artificial
  CRISPR gRNA sequence
gccttttataaccacagcat

SEQ ID NO: 596233 - DNA, 20 bp, Artificial
  CRISPR gRNA sequence
accacagcattggtttaaaa

SEQ ID NO: 596234 - DNA, 20 bp, Artificial
  CRISPR gRNA sequence
tatttgtacaaaaaactaaa

SEQ ID NO: 596235 - DNA, 20 bp, Artificial
  CRISPR gRNA sequence
taatatctgtttccattctg

SEQ ID NO: 596236 - DNA, 20 bp, Artificial
  CRISPR gRNA sequence
atatctgtttccattctgaa

SEQ ID NO: 596237 - DNA, 20 bp, Artificial
  CRISPR gRNA sequence
cattctgaagagttccttct

SEQ ID NO: 596238 - DNA, 20 bp, Artificial
  CRISPR gRNA sequence
tgaagagttccttctcagtt

SEQ ID NO: 596239 - DNA, 20 bp, Artificial
  CRISPR gRNA sequence
gagttccttctcagtttggt

SEQ ID NO: 596240 - DNA, 20 bp, Artificial
  CRISPR gRNA sequence
ccttctcagtttggttagaa

SEQ ID NO: 596241 - DNA, 20 bp, Artificial
  CRISPR gRNA sequence
ggttagaacagcacactaat

SEQ ID NO: 596242 - DNA, 20 bp, Artificial
  CRISPR gRNA sequence
atctaaactgattatttctg

SEQ ID NO: 596243 - DNA, 20 bp, Artificial
  CRISPR gRNA sequence
gattatttctgaagtgtcaa

SEQ ID NO: 596244 - DNA, 20 bp, Artificial
  CRISPR gRNA sequence
caacagatgcacaaactccc

SEQ ID NO: 596245 - DNA, 20 bp, Artificial
  CRISPR gRNA sequence
cacaaactccctggctgaaa

SEQ ID NO: 596246 - DNA, 20 bp, Artificial
  CRISPR gRNA sequence
acaaactccctggctgaaac

SEQ ID NO: 596247 - DNA, 20 bp, Artificial
  CRISPR gRNA sequence
atgtgtctattttgtgtcaa

SEQ ID NO: 596248 - DNA, 20 bp, Artificial
  CRISPR gRNA sequence
tgtgtctattttgtgtcaac

SEQ ID NO: 596249 - DNA, 20 bp, Artificial
  CRISPR gRNA sequence
tattttgtgtcaacaggctg

SEQ ID NO: 596250 - DNA, 20 bp, Artificial
  CRISPR gRNA sequence
attttgtgtcaacaggctga

SEQ ID NO: 596251 - DNA, 20 bp, Artificial
  CRISPR gRNA sequence
caggctgaaggaatacaact

SEQ ID NO: 596252 - DNA, 20 bp, Artificial
  CRISPR gRNA sequence
ggctgaaggaatacaactga

SEQ ID NO: 596253 - DNA, 20 bp, Artificial
  CRISPR gRNA sequence
ctgaaggaatacaactgaga

SEQ ID NO: 596254 - DNA, 20 bp, Artificial
  CRISPR gRNA sequence
aaggaatacaactgagagag

SEQ ID NO: 596255 - DNA, 20 bp, Artificial
  CRISPR gRNA sequence
atacaactgagagagaagtg

SEQ ID NO: 596256 - DNA, 20 bp, Artificial
  CRISPR gRNA sequence
agaagtgcagaaataaataa

SEQ ID NO: 596257 - DNA, 20 bp, Artificial
  CRISPR gRNA sequence
aagtgcagaaataaataata

SEQ ID NO: 596258 - DNA, 20 bp, Artificial
  CRISPR gRNA sequence
gtgcagaaataaataataga

SEQ ID NO: 596259 - DNA, 20 bp, Artificial
  CRISPR gRNA sequence
atagagagtgtaataaaata

SEQ ID NO: 596260 - DNA, 20 bp, Artificial
  CRISPR gRNA sequence
tataaaacatctcaatcaaa

SEQ ID NO: 596261 - DNA, 20 bp, Artificial
  CRISPR gRNA sequence
acatctcaatcaaaaagacc

SEQ ID NO: 596262 - DNA, 20 bp, Artificial
  CRISPR gRNA sequence
ctcaatcaaaaagacctaga

SEQ ID NO: 596263 - DNA, 20 bp, Artificial
  CRISPR gRNA sequence
tcaaaaagacctagaaagcc

SEQ ID NO: 596264 - DNA, 20 bp, Artificial
  CRISPR gRNA sequence
aagacctagaaagccaagca

SEQ ID NO: 596265 - DNA, 20 bp, Artificial
  CRISPR gRNA sequence
agacctagaaagccaagcaa

SEQ ID NO: 596266 - DNA, 20 bp, Artificial
  CRISPR gRNA sequence
aagcaaaggaaaaattatca

SEQ ID NO: 596267 - DNA, 20 bp, Artificial
  CRISPR gRNA sequence
agcaaaggaaaaattatcaa

SEQ ID NO: 596268 - DNA, 20 bp, Artificial
  CRISPR gRNA sequence
aaaggaaaaattatcaaagg

SEQ ID NO: 596269 - DNA, 20 bp, Artificial
  CRISPR gRNA sequence
aaggaaaaattatcaaaggc

SEQ ID NO: 596270 - DNA, 20 bp, Artificial
  CRISPR gRNA sequence
gaaaaattatcaaaggcagg

SEQ ID NO: 596271 - DNA, 20 bp, Artificial
  CRISPR gRNA sequence
aaaattatcaaaggcaggta

SEQ ID NO: 596272 - DNA, 20 bp, Artificial
  CRISPR gRNA sequence
aaattatcaaaggcaggtag

SEQ ID NO: 596273 - DNA, 20 bp, Artificial
  CRISPR gRNA sequence
atcaaaggcaggtagaggaa

SEQ ID NO: 596274 - DNA, 20 bp, Artificial
  CRISPR gRNA sequence
aggcaggtagaggaaaagaa

SEQ ID NO: 596275 - DNA, 20 bp, Artificial
  CRISPR gRNA sequence
aggtagaggaaaagaaaaga

SEQ ID NO: 596276 - DNA, 20 bp, Artificial
  CRISPR gRNA sequence
agaggaaaagaaaagacaga

SEQ ID NO: 596277 - DNA, 20 bp, Artificial
  CRISPR gRNA sequence
aggaaaagaaaagacagaca

SEQ ID NO: 596278 - DNA, 20 bp, Artificial
  CRISPR gRNA sequence
gaaaagaaaagacagacaga

SEQ ID NO: 596279 - DNA, 20 bp, Artificial
  CRISPR gRNA sequence
agaaaagacagacagagaga

SEQ ID NO: 596280 - DNA, 20 bp, Artificial
  CRISPR gRNA sequence
aaaagacagacagagagaca

SEQ ID NO: 596281 - DNA, 20 bp, Artificial
  CRISPR gRNA sequence
aagacagacagagagacaga

SEQ ID NO: 596282 - DNA, 20 bp, Artificial
  CRISPR gRNA sequence
gacagacagagagacagaga

SEQ ID NO: 596283 - DNA, 20 bp, Artificial
  CRISPR gRNA sequence
cagacagagagacagagaga

SEQ ID NO: 596284 - DNA, 20 bp, Artificial
  CRISPR gRNA sequence
agacagagagacagagagag

SEQ ID NO: 596285 - DNA, 20 bp, Artificial
  CRISPR gRNA sequence
gacagagagacagagagaga

SEQ ID NO: 596286 - DNA, 20 bp, Artificial
  CRISPR gRNA sequence
tgcatatatgcttacatttt

SEQ ID NO: 596287 - DNA, 20 bp, Artificial
  CRISPR gRNA sequence
tacatttttagttttttctt

SEQ ID NO: 596288 - DNA, 20 bp, Artificial
  CRISPR gRNA sequence
atttttagttttttcttgag

SEQ ID NO: 596289 - DNA, 20 bp, Artificial
  CRISPR gRNA sequence
ttttagttttttcttgagaa

SEQ ID NO: 596290 - DNA, 20 bp, Artificial
  CRISPR gRNA sequence
ctgcctaccacccaacccta

SEQ ID NO: 596291 - DNA, 20 bp, Artificial
  CRISPR gRNA sequence
accacccaaccctaaagatg

SEQ ID NO: 596292 - DNA, 20 bp, Artificial
  CRISPR gRNA sequence
ccaaccctaaagatgcagtt

SEQ ID NO: 596293 - DNA, 20 bp, Artificial
  CRISPR gRNA sequence
ttcttctaccatcttctgaa

SEQ ID NO: 596294 - DNA, 20 bp, Artificial
  CRISPR gRNA sequence
ttctaccatcttctgaaaag

SEQ ID NO: 596295 - DNA, 20 bp, Artificial
  CRISPR gRNA sequence
ctaccatcttctgaaaagca

SEQ ID NO: 596296 - DNA, 20 bp, Artificial
  CRISPR gRNA sequence
ctgaaaagcagagactattt

SEQ ID NO: 596297 - DNA, 20 bp, Artificial
  CRISPR gRNA sequence
gagactattttagtgattga

SEQ ID NO: 596298 - DNA, 20 bp, Artificial
  CRISPR gRNA sequence
ggtaaaatgctgtaatatct

SEQ ID NO: 596299 - DNA, 20 bp, Artificial
  CRISPR gRNA sequence
gctgtaatatcttagctcct

SEQ ID NO: 596300 - DNA, 20 bp, Artificial
  CRISPR gRNA sequence
tgtaatatcttagctccttg

SEQ ID NO: 596301 - DNA, 20 bp, Artificial
  CRISPR gRNA sequence
caaccactattttctttccc

SEQ ID NO: 596302 - DNA, 20 bp, Artificial
  CRISPR gRNA sequence
cctgcacatatactatctga

SEQ ID NO: 596303 - DNA, 20 bp, Artificial
  CRISPR gRNA sequence
tcctaaacttgcctgattat

SEQ ID NO: 596304 - DNA, 20 bp, Artificial
  CRISPR gRNA sequence
acttgcctgattatcagaat

SEQ ID NO: 596305 - DNA, 20 bp, Artificial
  CRISPR gRNA sequence
ttgcctgattatcagaatta

SEQ ID NO: 596306 - DNA, 20 bp, Artificial
  CRISPR gRNA sequence
gattatcagaattagagtcg

SEQ ID NO: 596307 - DNA, 20 bp, Artificial
  CRISPR gRNA sequence
attatcagaattagagtcgc

SEQ ID NO: 596308 - DNA, 20 bp, Artificial
  CRISPR gRNA sequence
cttgaacactttgtttgatt

SEQ ID NO: 596309 - DNA, 20 bp, Artificial
  CRISPR gRNA sequence
ttgtttgattcagtatactt

SEQ ID NO: 596310 - DNA, 20 bp, Artificial
  CRISPR gRNA sequence
tgattcagtatacttgagtt

SEQ ID NO: 596311 - DNA, 20 bp, Artificial
  CRISPR gRNA sequence
gattcagtatacttgagttg

SEQ ID NO: 596312 - DNA, 20 bp, Artificial
  CRISPR gRNA sequence
agtatacttgagttgaggtc

SEQ ID NO: 596313 - DNA, 20 bp, Artificial
  CRISPR gRNA sequence
gtatacttgagttgaggtct

SEQ ID NO: 596314 - DNA, 20 bp, Artificial
  CRISPR gRNA sequence
tgggactgtttatttttttc

SEQ ID NO: 596315 - DNA, 20 bp, Artificial
  CRISPR gRNA sequence
tttatttttttcaagtatct

SEQ ID NO: 596316 - DNA, 20 bp, Artificial
  CRISPR gRNA sequence
cttagatgattcttacgatc

SEQ ID NO: 596317 - DNA, 20 bp, Artificial
  CRISPR gRNA sequence
gatgattcttacgatcaagc

SEQ ID NO: 596318 - DNA, 20 bp, Artificial
  CRISPR gRNA sequence
tcttacgatcaagcaagttt

SEQ ID NO: 596319 - DNA, 20 bp, Artificial
  CRISPR gRNA sequence
gatcaagcaagtttgagaaa

SEQ ID NO: 596320 - DNA, 20 bp, Artificial
  CRISPR gRNA sequence
taactattttaaaaataaat

SEQ ID NO: 596321 - DNA, 20 bp, Artificial
  CRISPR gRNA sequence
tttaaaaataaattggtttt

SEQ ID NO: 596322 - DNA, 20 bp, Artificial
  CRISPR gRNA sequence
ttaaaaataaattggtttta

SEQ ID NO: 596323 - DNA, 20 bp, Artificial
  CRISPR gRNA sequence
tttaaggattattctttcct

SEQ ID NO: 596324 - DNA, 20 bp, Artificial
  CRISPR gRNA sequence
cataatgtctcttgccatga

SEQ ID NO: 596325 - DNA, 20 bp, Artificial
  CRISPR gRNA sequence
aatgtctcttgccatgatgg

SEQ ID NO: 596326 - DNA, 20 bp, Artificial
  CRISPR gRNA sequence
ctcttgccatgatggcagac

SEQ ID NO: 596327 - DNA, 20 bp, Artificial
  CRISPR gRNA sequence
gccatgatggcagaccagaa

SEQ ID NO: 596328 - DNA, 20 bp, Artificial
  CRISPR gRNA sequence
aaacactcttaccaaatctg

SEQ ID NO: 596329 - DNA, 20 bp, Artificial
  CRISPR gRNA sequence
tctgcagtgacataattaaa

SEQ ID NO: 596330 - DNA, 20 bp, Artificial
  CRISPR gRNA sequence
ctgcagtgacataattaaat

SEQ ID NO: 596331 - DNA, 20 bp, Artificial
  CRISPR gRNA sequence
cataattaaatgggctaaca

SEQ ID NO: 596332 - DNA, 20 bp, Artificial
  CRISPR gRNA sequence
atttatatccaatcatttct

SEQ ID NO: 596333 - DNA, 20 bp, Artificial
  CRISPR gRNA sequence
atatccaatcatttctcagc

SEQ ID NO: 596334 - DNA, 20 bp, Artificial
  CRISPR gRNA sequence
ttaaataattctccaaacta

SEQ ID NO: 596335 - DNA, 20 bp, Artificial
  CRISPR gRNA sequence
taattctccaaactaaagta

SEQ ID NO: 596336 - DNA, 20 bp, Artificial
  CRISPR gRNA sequence
attctccaaactaaagtaaa

SEQ ID NO: 596337 - DNA, 20 bp, Artificial
  CRISPR gRNA sequence
ttctccaaactaaagtaaag

SEQ ID NO: 596338 - DNA, 20 bp, Artificial
  CRISPR gRNA sequence
tccaaactaaagtaaagagg

SEQ ID NO: 596339 - DNA, 20 bp, Artificial
  CRISPR gRNA sequence
aagaggtggatgacaaaatc

SEQ ID NO: 596340 - DNA, 20 bp, Artificial
  CRISPR gRNA sequence
gtggatgacaaaatctagcc

SEQ ID NO: 596341 - DNA, 20 bp, Artificial
  CRISPR gRNA sequence
aatctagcctagataatcaa

SEQ ID NO: 596342 - DNA, 20 bp, Artificial
  CRISPR gRNA sequence
agaaactccaatccttcaca

SEQ ID NO: 596343 - DNA, 20 bp, Artificial
  CRISPR gRNA sequence
actccaatccttcacatggc

SEQ ID NO: 596344 - DNA, 20 bp, Artificial
  CRISPR gRNA sequence
cacatggctagattttgcca

SEQ ID NO: 596345 - DNA, 20 bp, Artificial
  CRISPR gRNA sequence
acatggctagattttgccac

SEQ ID NO: 596346 - DNA, 20 bp, Artificial
  CRISPR gRNA sequence
agattttgccacaggtgacc

SEQ ID NO: 596347 - DNA, 20 bp, Artificial
  CRISPR gRNA sequence
tggaacacgtgatatttctg

SEQ ID NO: 596348 - DNA, 20 bp, Artificial
  CRISPR gRNA sequence
acacgtgatatttctgcagc

SEQ ID NO: 596349 - DNA, 20 bp, Artificial
  CRISPR gRNA sequence
cacgtgatatttctgcagct

SEQ ID NO: 596350 - DNA, 20 bp, Artificial
  CRISPR gRNA sequence
acgtgatatttctgcagcta

SEQ ID NO: 596351 - DNA, 20 bp, Artificial
  CRISPR gRNA sequence
gatatttctgcagctagggt

SEQ ID NO: 596352 - DNA, 20 bp, Artificial
  CRISPR gRNA sequence
cctcctcaaatgttcacaca

SEQ ID NO: 596353 - DNA, 20 bp, Artificial
  CRISPR gRNA sequence
caaatgttcacacaaagacg

SEQ ID NO: 596354 - DNA, 20 bp, Artificial
  CRISPR gRNA sequence
tgttcacacaaagacgaagc

SEQ ID NO: 596355 - DNA, 20 bp, Artificial
  CRISPR gRNA sequence
ctaatttccctgttaaatgt

SEQ ID NO: 596356 - DNA, 20 bp, Artificial
  CRISPR gRNA sequence
tttccctgttaaatgtgagt

SEQ ID NO: 596357 - DNA, 20 bp, Artificial
  CRISPR gRNA sequence
gagtcaccatcctaacgatt

SEQ ID NO: 596358 - DNA, 20 bp, Artificial
  CRISPR gRNA sequence
tcctaacgatttagattgct

SEQ ID NO: 596359 - DNA, 20 bp, Artificial
  CRISPR gRNA sequence
cctaacgatttagattgcta

SEQ ID NO: 596360 - DNA, 20 bp, Artificial
  CRISPR gRNA sequence
atattgaaatatatgcttcc

SEQ ID NO: 596361 - DNA, 20 bp, Artificial
  CRISPR gRNA sequence
aattccatatccaattacaa

SEQ ID NO: 596362 - DNA, 20 bp, Artificial
  CRISPR gRNA sequence
ttacaacagtaaatccaata

SEQ ID NO: 596363 - DNA, 20 bp, Artificial
  CRISPR gRNA sequence
tacaacagtaaatccaataa

SEQ ID NO: 596364 - DNA, 20 bp, Artificial
  CRISPR gRNA sequence
cagtaaatccaataaaggca

SEQ ID NO: 596365 - DNA, 20 bp, Artificial
  CRISPR gRNA sequence
ggcacagtaaaactgccact

SEQ ID NO: 596366 - DNA, 20 bp, Artificial
  CRISPR gRNA sequence
gcacagtaaaactgccactc

SEQ ID NO: 596367 - DNA, 20 bp, Artificial
  CRISPR gRNA sequence
agtaaaactgccactcaggc

SEQ ID NO: 596368 - DNA, 20 bp, Artificial
  CRISPR gRNA sequence
gtaaaactgccactcaggca

SEQ ID NO: 596369 - DNA, 20 bp, Artificial
  CRISPR gRNA sequence
taaaactgccactcaggcaa

SEQ ID NO: 596370 - DNA, 20 bp, Artificial
  CRISPR gRNA sequence
aaactgccactcaggcaagg

SEQ ID NO: 596371 - DNA, 20 bp, Artificial
  CRISPR gRNA sequence
cactcaggcaagggagaaat

SEQ ID NO: 596372 - DNA, 20 bp, Artificial
  CRISPR gRNA sequence
tcaggcaagggagaaataag

SEQ ID NO: 596373 - DNA, 20 bp, Artificial
  CRISPR gRNA sequence
agggagaaataagaagtcat

SEQ ID NO: 596374 - DNA, 20 bp, Artificial
  CRISPR gRNA sequence
aagaagtcataagctaattc

SEQ ID NO: 596375 - DNA, 20 bp, Artificial
  CRISPR gRNA sequence
tcaagtgttgctaatatcct

SEQ ID NO: 596376 - DNA, 20 bp, Artificial
  CRISPR gRNA sequence
aagtgttgctaatatcctca

SEQ ID NO: 596377 - DNA, 20 bp, Artificial
  CRISPR gRNA sequence
agtgttgctaatatcctcag

SEQ ID NO: 596378 - DNA, 20 bp, Artificial
  CRISPR gRNA sequence
gttgctaatatcctcagagg

SEQ ID NO: 596379 - DNA, 20 bp, Artificial
  CRISPR gRNA sequence
tatcctcagaggaagaaatg

SEQ ID NO: 596380 - DNA, 20 bp, Artificial
  CRISPR gRNA sequence
tggatgcctacaaccacttt

SEQ ID NO: 596381 - DNA, 20 bp, Artificial
  CRISPR gRNA sequence
atgcctacaaccactttcag

SEQ ID NO: 596382 - DNA, 20 bp, Artificial
  CRISPR gRNA sequence
tccatattatctttttcacc

SEQ ID NO: 596383 - DNA, 20 bp, Artificial
  CRISPR gRNA sequence
ccatattatctttttcacct

SEQ ID NO: 596384 - DNA, 20 bp, Artificial
  CRISPR gRNA sequence
ttcacctaggaatctttctt

SEQ ID NO: 596385 - DNA, 20 bp, Artificial
  CRISPR gRNA sequence
gaatctttcttaagaaatgt

SEQ ID NO: 596386 - DNA, 20 bp, Artificial
  CRISPR gRNA sequence
ctttcttaagaaatgtcagc

SEQ ID NO: 596387 - DNA, 20 bp, Artificial
  CRISPR gRNA sequence
gtgatgaatttccacaacct

SEQ ID NO: 596388 - DNA, 20 bp, Artificial
  CRISPR gRNA sequence
gaatttccacaacctaagca

SEQ ID NO: 596389 - DNA, 20 bp, Artificial
  CRISPR gRNA sequence
taagcaaagtaaaatcctga

SEQ ID NO: 596390 - DNA, 20 bp, Artificial
  CRISPR gRNA sequence
tgatcatacttccttcatgt

SEQ ID NO: 596391 - DNA, 20 bp, Artificial
  CRISPR gRNA sequence
agttttgtaacatctcccta

SEQ ID NO: 596392 - DNA, 20 bp, Artificial
  CRISPR gRNA sequence
tcactttatgtcctactttt

SEQ ID NO: 596393 - DNA, 20 bp, Artificial
  CRISPR gRNA sequence
tgtcctacttttaagcctca

SEQ ID NO: 596394 - DNA, 20 bp, Artificial
  CRISPR gRNA sequence
acttttaagcctcaaagcat

SEQ ID NO: 596395 - DNA, 20 bp, Artificial
  CRISPR gRNA sequence
cttttaagcctcaaagcatc

SEQ ID NO: 596396 - DNA, 20 bp, Artificial
  CRISPR gRNA sequence
cctcaaagcatcaggtttta

SEQ ID NO: 596397 - DNA, 20 bp, Artificial
  CRISPR gRNA sequence
tgctcaaaattctatgcaca

SEQ ID NO: 596398 - DNA, 20 bp, Artificial
  CRISPR gRNA sequence
gtcaaaattgtatatgtaaa

SEQ ID NO: 596399 - DNA, 20 bp, Artificial
  CRISPR gRNA sequence
gtatatgtaaatggaaacat

SEQ ID NO: 596400 - DNA, 20 bp, Artificial
  CRISPR gRNA sequence
gtaaatggaaacataagcaa

SEQ ID NO: 596401 - DNA, 20 bp, Artificial
  CRISPR gRNA sequence
atggatttctgtttccaaaa

SEQ ID NO: 596402 - DNA, 20 bp, Artificial
  CRISPR gRNA sequence
tggatttctgtttccaaaat

SEQ ID NO: 596403 - DNA, 20 bp, Artificial
  CRISPR gRNA sequence
ttctgtttccaaaataggca

SEQ ID NO: 596404 - DNA, 20 bp, Artificial
  CRISPR gRNA sequence
caaaattttattttaaccat

SEQ ID NO: 596405 - DNA, 20 bp, Artificial
  CRISPR gRNA sequence
ttatttgaattgtcgaataa

SEQ ID NO: 596406 - DNA, 20 bp, Artificial
  CRISPR gRNA sequence
ttgtcgaataaaagacttaa

SEQ ID NO: 596407 - DNA, 20 bp, Artificial
  CRISPR gRNA sequence
tgtcgaataaaagacttaaa

SEQ ID NO: 596408 - DNA, 20 bp, Artificial
  CRISPR gRNA sequence
atatacctaatgtaaatgac

SEQ ID NO: 596409 - DNA, 20 bp, Artificial
  CRISPR gRNA sequence
taatgtaaatgacaagttaa

SEQ ID NO: 596410 - DNA, 20 bp, Artificial
  CRISPR gRNA sequence
aatgtaaatgacaagttaat

SEQ ID NO: 596411 - DNA, 20 bp, Artificial
  CRISPR gRNA sequence
aaatgacaagttaataggtg

SEQ ID NO: 596412 - DNA, 20 bp, Artificial
  CRISPR gRNA sequence
ataggtgcagcacaccaaca

SEQ ID NO: 596413 - DNA, 20 bp, Artificial
  CRISPR gRNA sequence
cttgttgtgcacatgtaccc

SEQ ID NO: 596414 - DNA, 20 bp, Artificial
  CRISPR gRNA sequence
cacatgtaccctagaactta

SEQ ID NO: 596415 - DNA, 20 bp, Artificial
  CRISPR gRNA sequence
aaaataaataaataaattaa

SEQ ID NO: 596416 - DNA, 20 bp, Artificial
  CRISPR gRNA sequence
aataaataaataaattaaaa

SEQ ID NO: 596417 - DNA, 20 bp, Artificial
  CRISPR gRNA sequence
ataaataaattaaaagagta

SEQ ID NO: 596418 - DNA, 20 bp, Artificial
  CRISPR gRNA sequence
taaaagagtaaagtgcttaa

SEQ ID NO: 596419 - DNA, 20 bp, Artificial
  CRISPR gRNA sequence
aagtgcttaaaagtaacaat

SEQ ID NO: 596420 - DNA, 20 bp, Artificial
  CRISPR gRNA sequence
taaaagtaacaataagatac

SEQ ID NO: 596421 - DNA, 20 bp, Artificial
  CRISPR gRNA sequence
caagttattgaaaataaatt

SEQ ID NO: 596422 - DNA, 20 bp, Artificial
  CRISPR gRNA sequence
aagttattgaaaataaattc

SEQ ID NO: 596423 - DNA, 20 bp, Artificial
  CRISPR gRNA sequence
agttattgaaaataaattca

SEQ ID NO: 596424 - DNA, 20 bp, Artificial
  CRISPR gRNA sequence
ttgaaaataaattcagggtt

SEQ ID NO: 596425 - DNA, 20 bp, Artificial
  CRISPR gRNA sequence
aataaattcagggtttggtt

SEQ ID NO: 596426 - DNA, 20 bp, Artificial
  CRISPR gRNA sequence
attcagggtttggtttggtt

SEQ ID NO: 596427 - DNA, 20 bp, Artificial
  CRISPR gRNA sequence
tacttaacatgctttacttg

SEQ ID NO: 596428 - DNA, 20 bp, Artificial
  CRISPR gRNA sequence
catgctttacttgcagctgt

SEQ ID NO: 596429 - DNA, 20 bp, Artificial
  CRISPR gRNA sequence
tacttgcagctgttggtaca

SEQ ID NO: 596430 - DNA, 20 bp, Artificial
  CRISPR gRNA sequence
acttgcagctgttggtacaa

SEQ ID NO: 596431 - DNA, 20 bp, Artificial
  CRISPR gRNA sequence
tgcagctgttggtacaaagg

SEQ ID NO: 596432 - DNA, 20 bp, Artificial
  CRISPR gRNA sequence
tgttggtacaaaggtggaaa

SEQ ID NO: 596433 - DNA, 20 bp, Artificial
  CRISPR gRNA sequence
aaagacataatatatatgtt

SEQ ID NO: 596434 - DNA, 20 bp, Artificial
  CRISPR gRNA sequence
tatatgttaagcactacacc

SEQ ID NO: 596435 - DNA, 20 bp, Artificial
  CRISPR gRNA sequence
tatgttaagcactacaccta

SEQ ID NO: 596436 - DNA, 20 bp, Artificial
  CRISPR gRNA sequence
acacctagagcatcattcct

SEQ ID NO: 596437 - DNA, 20 bp, Artificial
  CRISPR gRNA sequence
cctagagcatcattcctcag

SEQ ID NO: 596438 - DNA, 20 bp, Artificial
  CRISPR gRNA sequence
ttcctcagaagaaatgatga

SEQ ID NO: 596439 - DNA, 20 bp, Artificial
  CRISPR gRNA sequence
gatgatagtattctaaatac

SEQ ID NO: 596440 - DNA, 20 bp, Artificial
  CRISPR gRNA sequence
atgatagtattctaaataca

SEQ ID NO: 596441 - DNA, 20 bp, Artificial
  CRISPR gRNA sequence
tgatagtattctaaatacaa

SEQ ID NO: 596442 - DNA, 20 bp, Artificial
  CRISPR gRNA sequence
cactctaaaaacctacatga

SEQ ID NO: 596443 - DNA, 20 bp, Artificial
  CRISPR gRNA sequence
tacatgaaagcctgctctac

SEQ ID NO: 596444 - DNA, 20 bp, Artificial
  CRISPR gRNA sequence
acaagcactaatacataaca

SEQ ID NO: 596445 - DNA, 20 bp, Artificial
  CRISPR gRNA sequence
acaaagcatctaaaacttgt

SEQ ID NO: 596446 - DNA, 20 bp, Artificial
  CRISPR gRNA sequence
tctaaaacttgtgagatatt

SEQ ID NO: 596447 - DNA, 20 bp, Artificial
  CRISPR gRNA sequence
acttgtgagatatttagctt

SEQ ID NO: 596448 - DNA, 20 bp, Artificial
  CRISPR gRNA sequence
gagatatttagcttgagtct

SEQ ID NO: 596449 - DNA, 20 bp, Artificial
  CRISPR gRNA sequence
tgagtcttagtgaaaaaaaa

SEQ ID NO: 596450 - DNA, 20 bp, Artificial
  CRISPR gRNA sequence
gtcttagtgaaaaaaaaaag

SEQ ID NO: 596451 - DNA, 20 bp, Artificial
  CRISPR gRNA sequence
aaaaaaaagcagtgacattt

SEQ ID NO: 596452 - DNA, 20 bp, Artificial
  CRISPR gRNA sequence
aaaagcagtgacatttcaga

SEQ ID NO: 596453 - DNA, 20 bp, Artificial
  CRISPR gRNA sequence
aaagcagtgacatttcagac

SEQ ID NO: 596454 - DNA, 20 bp, Artificial
  CRISPR gRNA sequence
gcagtgacatttcagacagg

SEQ ID NO: 596455 - DNA, 20 bp, Artificial
  CRISPR gRNA sequence
gacatttcagacaggcagat

SEQ ID NO: 596456 - DNA, 20 bp, Artificial
  CRISPR gRNA sequence
acatttcagacaggcagatg

SEQ ID NO: 596457 - DNA, 20 bp, Artificial
  CRISPR gRNA sequence
catttcagacaggcagatga

SEQ ID NO: 596458 - DNA, 20 bp, Artificial
  CRISPR gRNA sequence
ggcagatgagggctcaatat

SEQ ID NO: 596459 - DNA, 20 bp, Artificial
  CRISPR gRNA sequence
gcagatgagggctcaatata

SEQ ID NO: 596460 - DNA, 20 bp, Artificial
  CRISPR gRNA sequence
gatgagggctcaatataagg

SEQ ID NO: 596461 - DNA, 20 bp, Artificial
  CRISPR gRNA sequence
aatataaggaagaactttct

SEQ ID NO: 596462 - DNA, 20 bp, Artificial
  CRISPR gRNA sequence
aggaagaactttctaagaat

SEQ ID NO: 596463 - DNA, 20 bp, Artificial
  CRISPR gRNA sequence
gaagaactttctaagaatta

SEQ ID NO: 596464 - DNA, 20 bp, Artificial
  CRISPR gRNA sequence
ttctaagaattagagctgat

SEQ ID NO: 596465 - DNA, 20 bp, Artificial
  CRISPR gRNA sequence
gaattagagctgatcagcaa

SEQ ID NO: 596466 - DNA, 20 bp, Artificial
  CRISPR gRNA sequence
agagctgatcagcaatggaa

SEQ ID NO: 596467 - DNA, 20 bp, Artificial
  CRISPR gRNA sequence
acagtaaacttcctttcctc

SEQ ID NO: 596468 - DNA, 20 bp, Artificial
  CRISPR gRNA sequence
ttcctttcctctagcacttg

SEQ ID NO: 596469 - DNA, 20 bp, Artificial
  CRISPR gRNA sequence
ctttcctctagcacttgaag

SEQ ID NO: 596470 - DNA, 20 bp, Artificial
  CRISPR gRNA sequence
ctctagcacttgaagcagtc

SEQ ID NO: 596471 - DNA, 20 bp, Artificial
  CRISPR gRNA sequence
gaagcagtcaagcaaaatcc

SEQ ID NO: 596472 - DNA, 20 bp, Artificial
  CRISPR gRNA sequence
agcagtcaagcaaaatccca

SEQ ID NO: 596473 - DNA, 20 bp, Artificial
  CRISPR gRNA sequence
cacctgtcatgcatgctgtc

SEQ ID NO: 596474 - DNA, 20 bp, Artificial
  CRISPR gRNA sequence
acctgtcatgcatgctgtca

SEQ ID NO: 596475 - DNA, 20 bp, Artificial
  CRISPR gRNA sequence
aaggatattcttgctttgtt

SEQ ID NO: 596476 - DNA, 20 bp, Artificial
  CRISPR gRNA sequence
aggatattcttgctttgtta

SEQ ID NO: 596477 - DNA, 20 bp, Artificial
  CRISPR gRNA sequence
atattcttgctttgttaagg

SEQ ID NO: 596478 - DNA, 20 bp, Artificial
  CRISPR gRNA sequence
aagttgttctaaatgacctt

SEQ ID NO: 596479 - DNA, 20 bp, Artificial
  CRISPR gRNA sequence
agttgttctaaatgaccttt

SEQ ID NO: 596480 - DNA, 20 bp, Artificial
  CRISPR gRNA sequence
gttgttctaaatgacctttg

SEQ ID NO: 596481 - DNA, 20 bp, Artificial
  CRISPR gRNA sequence
tgacctttggggtcactttt

SEQ ID NO: 596482 - DNA, 20 bp, Artificial
  CRISPR gRNA sequence
cacttttaagtaactgattc

SEQ ID NO: 596483 - DNA, 20 bp, Artificial
  CRISPR gRNA sequence
acttttaagtaactgattca

SEQ ID NO: 596484 - DNA, 20 bp, Artificial
  CRISPR gRNA sequence
actgattcaaggattatttt

SEQ ID NO: 596485 - DNA, 20 bp, Artificial
  CRISPR gRNA sequence
attcaaggattattttcagt

SEQ ID NO: 596486 - DNA, 20 bp, Artificial
  CRISPR gRNA sequence
attattttcagtgagatgaa

SEQ ID NO: 596487 - DNA, 20 bp, Artificial
  CRISPR gRNA sequence
tttcagtgagatgaatggca

SEQ ID NO: 596488 - DNA, 20 bp, Artificial
  CRISPR gRNA sequence
ttcagtgagatgaatggcat

SEQ ID NO: 596489 - DNA, 20 bp, Artificial
  CRISPR gRNA sequence
cacacacacacacacacaca

SEQ ID NO: 596490 - DNA, 20 bp, Artificial
  CRISPR gRNA sequence
acacacacacagccacacaa

SEQ ID NO: 596491 - DNA, 20 bp, Artificial
  CRISPR gRNA sequence
cacagccacacaaaagaact

SEQ ID NO: 596492 - DNA, 20 bp, Artificial
  CRISPR gRNA sequence
agccacacaaaagaacttgg

SEQ ID NO: 596493 - DNA, 20 bp, Artificial
  CRISPR gRNA sequence
tatttttaaatgtgatttta

SEQ ID NO: 596494 - DNA, 20 bp, Artificial
  CRISPR gRNA sequence
atttttaaatgtgattttac

SEQ ID NO: 596495 - DNA, 20 bp, Artificial
  CRISPR gRNA sequence
aatgtgattttacaggcaaa

SEQ ID NO: 596496 - DNA, 20 bp, Artificial
  CRISPR gRNA sequence
gattttacaggcaaaaagca

SEQ ID NO: 596497 - DNA, 20 bp, Artificial
  CRISPR gRNA sequence
tttacaggcaaaaagcaaag

SEQ ID NO: 596498 - DNA, 20 bp, Artificial
  CRISPR gRNA sequence
aaaaagcaaagaagatcaat

SEQ ID NO: 596499 - DNA, 20 bp, Artificial
  CRISPR gRNA sequence
gtcatgaaactgccattgtg

SEQ ID NO: 596500 - DNA, 20 bp, Artificial
  CRISPR gRNA sequence
atgaaactgccattgtgcag

SEQ ID NO: 596501 - DNA, 20 bp, Artificial
  CRISPR gRNA sequence
tgaaactgccattgtgcaga

SEQ ID NO: 596502 - DNA, 20 bp, Artificial
  CRISPR gRNA sequence
gaaactgccattgtgcagaa

SEQ ID NO: 596503 - DNA, 20 bp, Artificial
  CRISPR gRNA sequence
aaactgccattgtgcagaag

SEQ ID NO: 596504 - DNA, 20 bp, Artificial
  CRISPR gRNA sequence
aactgccattgtgcagaagg

SEQ ID NO: 596505 - DNA, 20 bp, Artificial
  CRISPR gRNA sequence
gccattgtgcagaaggggga

SEQ ID NO: 596506 - DNA, 20 bp, Artificial
  CRISPR gRNA sequence
ccattgtgcagaagggggaa

SEQ ID NO: 596507 - DNA, 20 bp, Artificial
  CRISPR gRNA sequence
cattgtgcagaagggggaaa

SEQ ID NO: 596508 - DNA, 20 bp, Artificial
  CRISPR gRNA sequence
gcagaagggggaaagggata

SEQ ID NO: 596509 - DNA, 20 bp, Artificial
  CRISPR gRNA sequence
cagaagggggaaagggatac

SEQ ID NO: 596510 - DNA, 20 bp, Artificial
  CRISPR gRNA sequence
ggggaaagggatacaggtac

SEQ ID NO: 596511 - DNA, 20 bp, Artificial
  CRISPR gRNA sequence
acaggtacaagccttctgcc

SEQ ID NO: 596512 - DNA, 20 bp, Artificial
  CRISPR gRNA sequence
caggtacaagccttctgcct

SEQ ID NO: 596513 - DNA, 20 bp, Artificial
  CRISPR gRNA sequence
aggtacaagccttctgccta

SEQ ID NO: 596514 - DNA, 20 bp, Artificial
  CRISPR gRNA sequence
ttctgcctagggattatctt

SEQ ID NO: 596515 - DNA, 20 bp, Artificial
  CRISPR gRNA sequence
tctgcctagggattatcttt

SEQ ID NO: 596516 - DNA, 20 bp, Artificial
  CRISPR gRNA sequence
tagggattatctttaggtca

SEQ ID NO: 596517 - DNA, 20 bp, Artificial
  CRISPR gRNA sequence
tttaggtcaaagaacaaacc

SEQ ID NO: 596518 - DNA, 20 bp, Artificial
  CRISPR gRNA sequence
ttaggtcaaagaacaaaccc

SEQ ID NO: 596519 - DNA, 20 bp, Artificial
  CRISPR gRNA sequence
caaagaacaaacccaggtcc

SEQ ID NO: 596520 - DNA, 20 bp, Artificial
  CRISPR gRNA sequence
aaagaacaaacccaggtcct

SEQ ID NO: 596521 - DNA, 20 bp, Artificial
  CRISPR gRNA sequence
cccaggtcctaggtaacctt

SEQ ID NO: 596522 - DNA, 20 bp, Artificial
  CRISPR gRNA sequence
accttcagcatactctctaa

SEQ ID NO: 596523 - DNA, 20 bp, Artificial
  CRISPR gRNA sequence
tctgcaaaccatcccgttcc

SEQ ID NO: 596524 - DNA, 20 bp, Artificial
  CRISPR gRNA sequence
ctgcaaaccatcccgttccc

SEQ ID NO: 596525 - DNA, 20 bp, Artificial
  CRISPR gRNA sequence
aaaccatcccgttcccggga

SEQ ID NO: 596526 - DNA, 20 bp, Artificial
  CRISPR gRNA sequence
atcccgttcccgggacagac

SEQ ID NO: 596527 - DNA, 20 bp, Artificial
  CRISPR gRNA sequence
tcccgttcccgggacagacc

SEQ ID NO: 596528 - DNA, 20 bp, Artificial
  CRISPR gRNA sequence
ccgttcccgggacagaccag

SEQ ID NO: 596529 - DNA, 20 bp, Artificial
  CRISPR gRNA sequence
acaaaactacacgacacact

SEQ ID NO: 596530 - DNA, 20 bp, Artificial
  CRISPR gRNA sequence
atgcataatttttcacgtac

SEQ ID NO: 596531 - DNA, 20 bp, Artificial
  CRISPR gRNA sequence
cataatttttcacgtacaag

SEQ ID NO: 596532 - DNA, 20 bp, Artificial
  CRISPR gRNA sequence
aatgaactttctctgctctc

SEQ ID NO: 596533 - DNA, 20 bp, Artificial
  CRISPR gRNA sequence
tgaactttctctgctctcaa

SEQ ID NO: 596534 - DNA, 20 bp, Artificial
  CRISPR gRNA sequence
ctctgctctcaagagtattt

SEQ ID NO: 596535 - DNA, 20 bp, Artificial
  CRISPR gRNA sequence
gtatttcagtttcccatgtg

SEQ ID NO: 596536 - DNA, 20 bp, Artificial
  CRISPR gRNA sequence
ttcagtttcccatgtgtaga

SEQ ID NO: 596537 - DNA, 20 bp, Artificial
  CRISPR gRNA sequence
tttcccatgtgtagaaagta

SEQ ID NO: 596538 - DNA, 20 bp, Artificial
  CRISPR gRNA sequence
ttcccatgtgtagaaagtac

SEQ ID NO: 596539 - DNA, 20 bp, Artificial
  CRISPR gRNA sequence
tcccatgtgtagaaagtaca

SEQ ID NO: 596540 - DNA, 20 bp, Artificial
  CRISPR gRNA sequence
atgtgtagaaagtacagggt

SEQ ID NO: 596541 - DNA, 20 bp, Artificial
  CRISPR gRNA sequence
gggtgagtctaaacctgaat

SEQ ID NO: 596542 - DNA, 20 bp, Artificial
  CRISPR gRNA sequence
atacaacttatttcctgaat

SEQ ID NO: 596543 - DNA, 20 bp, Artificial
  CRISPR gRNA sequence
ataagtatacaacaacaaca

SEQ ID NO: 596544 - DNA, 20 bp, Artificial
  CRISPR gRNA sequence
atacaacaacaacaaagtac

SEQ ID NO: 596545 - DNA, 20 bp, Artificial
  CRISPR gRNA sequence
tacaacaacaacaaagtacc

SEQ ID NO: 596546 - DNA, 20 bp, Artificial
  CRISPR gRNA sequence
accaggtttcatcttttctc

SEQ ID NO: 596547 - DNA, 20 bp, Artificial
  CRISPR gRNA sequence
ccaggtttcatcttttctca

SEQ ID NO: 596548 - DNA, 20 bp, Artificial
  CRISPR gRNA sequence
caggtttcatcttttctcaa

SEQ ID NO: 596549 - DNA, 20 bp, Artificial
  CRISPR gRNA sequence
gtttcatcttttctcaaggg

SEQ ID NO: 596550 - DNA, 20 bp, Artificial
  CRISPR gRNA sequence
tttcatcttttctcaagggt

SEQ ID NO: 596551 - DNA, 20 bp, Artificial
  CRISPR gRNA sequence
ggctttgcctatgtgtttcc

SEQ ID NO: 596552 - DNA, 20 bp, Artificial
  CRISPR gRNA sequence
gctttgcctatgtgtttcca

SEQ ID NO: 596553 - DNA, 20 bp, Artificial
  CRISPR gRNA sequence
tgctaatcaattgacaaact

SEQ ID NO: 596554 - DNA, 20 bp, Artificial
  CRISPR gRNA sequence
ctaatcaattgacaaactca

SEQ ID NO: 596555 - DNA, 20 bp, Artificial
  CRISPR gRNA sequence
acaaactcagagttctctac

SEQ ID NO: 596556 - DNA, 20 bp, Artificial
  CRISPR gRNA sequence
gttctctaccagtcttgaaa

SEQ ID NO: 596557 - DNA, 20 bp, Artificial
  CRISPR gRNA sequence
ttctctaccagtcttgaaat

SEQ ID NO: 596558 - DNA, 20 bp, Artificial
  CRISPR gRNA sequence
ctaccagtcttgaaatagga

SEQ ID NO: 596559 - DNA, 20 bp, Artificial
  CRISPR gRNA sequence
gtcttgaaataggaaagaaa

SEQ ID NO: 596560 - DNA, 20 bp, Artificial
  CRISPR gRNA sequence
aataggaaagaaaaagaaat

SEQ ID NO: 596561 - DNA, 20 bp, Artificial
  CRISPR gRNA sequence
ataggaaagaaaaagaaatc

SEQ ID NO: 596562 - DNA, 20 bp, Artificial
  CRISPR gRNA sequence
ttattccttacatcctgcac

SEQ ID NO: 596563 - DNA, 20 bp, Artificial
  CRISPR gRNA sequence
tattccttacatcctgcaca

SEQ ID NO: 596564 - DNA, 20 bp, Artificial
  CRISPR gRNA sequence
ctattcccttatacctcacc

SEQ ID NO: 596565 - DNA, 20 bp, Artificial
  CRISPR gRNA sequence
taattaattgtataattttt

SEQ ID NO: 596566 - DNA, 20 bp, Artificial
  CRISPR gRNA sequence
aattgtataatttttaagta

SEQ ID NO: 596567 - DNA, 20 bp, Artificial
  CRISPR gRNA sequence
attgtataatttttaagtaa

SEQ ID NO: 596568 - DNA, 20 bp, Artificial
  CRISPR gRNA sequence
ctttgtttgctacttcttat

SEQ ID NO: 596569 - DNA, 20 bp, Artificial
  CRISPR gRNA sequence
tacacaatcttttcccctaa

SEQ ID NO: 596570 - DNA, 20 bp, Artificial
  CRISPR gRNA sequence
aatcttttcccctaatagaa

SEQ ID NO: 596571 - DNA, 20 bp, Artificial
  CRISPR gRNA sequence
cccctaatagaatggctata

SEQ ID NO: 596572 - DNA, 20 bp, Artificial
  CRISPR gRNA sequence
agaatggctatatggatgac

SEQ ID NO: 596573 - DNA, 20 bp, Artificial
  CRISPR gRNA sequence
gaatggctatatggatgaca

SEQ ID NO: 596574 - DNA, 20 bp, Artificial
  CRISPR gRNA sequence
atgacaaggtttcttgatat

SEQ ID NO: 596575 - DNA, 20 bp, Artificial
  CRISPR gRNA sequence
ggtttcttgatataagaatt

SEQ ID NO: 596576 - DNA, 20 bp, Artificial
  CRISPR gRNA sequence
aactgctatgctaaatactt

SEQ ID NO: 596577 - DNA, 20 bp, Artificial
  CRISPR gRNA sequence
tgctatgctaaatactttgg

SEQ ID NO: 596578 - DNA, 20 bp, Artificial
  CRISPR gRNA sequence
gctatgctaaatactttgga

SEQ ID NO: 596579 - DNA, 20 bp, Artificial
  CRISPR gRNA sequence
ctatgctaaatactttggaa

SEQ ID NO: 596580 - DNA, 20 bp, Artificial
  CRISPR gRNA sequence
ggtttcttatgtgatttacc

SEQ ID NO: 596581 - DNA, 20 bp, Artificial
  CRISPR gRNA sequence
atgtgatttaccaagataac

SEQ ID NO: 596582 - DNA, 20 bp, Artificial
  CRISPR gRNA sequence
accaagataactagtgaaat

SEQ ID NO: 596583 - DNA, 20 bp, Artificial
  CRISPR gRNA sequence
caagataactagtgaaatta

SEQ ID NO: 596584 - DNA, 20 bp, Artificial
  CRISPR gRNA sequence
gataactagtgaaattagag

SEQ ID NO: 596585 - DNA, 20 bp, Artificial
  CRISPR gRNA sequence
tagtgaaattagagcagata

SEQ ID NO: 596586 - DNA, 20 bp, Artificial
  CRISPR gRNA sequence
tagagcagatacagaaataa

SEQ ID NO: 596587 - DNA, 20 bp, Artificial
  CRISPR gRNA sequence
aaaagtcacatcttctgttc

SEQ ID NO: 596588 - DNA, 20 bp, Artificial
  CRISPR gRNA sequence
aagtcacatcttctgttcta

SEQ ID NO: 596589 - DNA, 20 bp, Artificial
  CRISPR gRNA sequence
tcttttttctctctttctcc

SEQ ID NO: 596590 - DNA, 20 bp, Artificial
  CRISPR gRNA sequence
ctctttctcctagttcctaa

SEQ ID NO: 596591 - DNA, 20 bp, Artificial
  CRISPR gRNA sequence
ctttctcctagttcctaata

SEQ ID NO: 596592 - DNA, 20 bp, Artificial
  CRISPR gRNA sequence
tttttaattataatttctcc

SEQ ID NO: 596593 - DNA, 20 bp, Artificial
  CRISPR gRNA sequence
ataatttctcccagacactg

SEQ ID NO: 596594 - DNA, 20 bp, Artificial
  CRISPR gRNA sequence
atttctcccagacactgaag

SEQ ID NO: 596595 - DNA, 20 bp, Artificial
  CRISPR gRNA sequence
actgaagcagaaatattctt

SEQ ID NO: 596596 - DNA, 20 bp, Artificial
  CRISPR gRNA sequence
ctgaagcagaaatattcttc

SEQ ID NO: 596597 - DNA, 20 bp, Artificial
  CRISPR gRNA sequence
tcaggaacaaaaattaaata

SEQ ID NO: 596598 - DNA, 20 bp, Artificial
  CRISPR gRNA sequence
atgtttaaaaaaccgtaatt

SEQ ID NO: 596599 - DNA, 20 bp, Artificial
  CRISPR gRNA sequence
taagaaatgtcaaacatacg

SEQ ID NO: 596600 - DNA, 20 bp, Artificial
  CRISPR gRNA sequence
agataccatcttcccccatt

SEQ ID NO: 596601 - DNA, 20 bp, Artificial
  CRISPR gRNA sequence
cccattcagatgaaccaaaa

SEQ ID NO: 596602 - DNA, 20 bp, Artificial
  CRISPR gRNA sequence
ggataaaatgcatttttgtc

SEQ ID NO: 596603 - DNA, 20 bp, Artificial
  CRISPR gRNA sequence
gataaaatgcatttttgtca

SEQ ID NO: 596604 - DNA, 20 bp, Artificial
  CRISPR gRNA sequence
ataaaatgcatttttgtcaa

SEQ ID NO: 596605 - DNA, 20 bp, Artificial
  CRISPR gRNA sequence
taaaatgcatttttgtcaag

SEQ ID NO: 596606 - DNA, 20 bp, Artificial
  CRISPR gRNA sequence
aaatgcatttttgtcaaggg

SEQ ID NO: 596607 - DNA, 20 bp, Artificial
  CRISPR gRNA sequence
tttttgtcaaggggagaaaa

SEQ ID NO: 596608 - DNA, 20 bp, Artificial
  CRISPR gRNA sequence
aacagacactcacatattac

SEQ ID NO: 596609 - DNA, 20 bp, Artificial
  CRISPR gRNA sequence
cactcacatattactagttg

SEQ ID NO: 596610 - DNA, 20 bp, Artificial
  CRISPR gRNA sequence
gtaaattgttatactttcca

SEQ ID NO: 596611 - DNA, 20 bp, Artificial
  CRISPR gRNA sequence
aaattgttatactttccaaa

SEQ ID NO: 596612 - DNA, 20 bp, Artificial
  CRISPR gRNA sequence
atactttccaaagagcaatt

SEQ ID NO: 596613 - DNA, 20 bp, Artificial
  CRISPR gRNA sequence
ctactaaaatattcattgca

SEQ ID NO: 596614 - DNA, 20 bp, Artificial
  CRISPR gRNA sequence
attgcacagacttcttgaca

SEQ ID NO: 596615 - DNA, 20 bp, Artificial
  CRISPR gRNA sequence
ttcttgacatagcaaataca

SEQ ID NO: 596616 - DNA, 20 bp, Artificial
  CRISPR gRNA sequence
gacatagcaaatacacagct

SEQ ID NO: 596617 - DNA, 20 bp, Artificial
  CRISPR gRNA sequence
atacacagctaagttatcct

SEQ ID NO: 596618 - DNA, 20 bp, Artificial
  CRISPR gRNA sequence
tacacagctaagttatccta

SEQ ID NO: 596619 - DNA, 20 bp, Artificial
  CRISPR gRNA sequence
taagttatcctaaggatgta

SEQ ID NO: 596620 - DNA, 20 bp, Artificial
  CRISPR gRNA sequence
gttatcctaaggatgtaaag

SEQ ID NO: 596621 - DNA, 20 bp, Artificial
  CRISPR gRNA sequence
ttatcctaaggatgtaaaga

SEQ ID NO: 596622 - DNA, 20 bp, Artificial
  CRISPR gRNA sequence
aagaaggtaaatgaatgaac

SEQ ID NO: 596623 - DNA, 20 bp, Artificial
  CRISPR gRNA sequence
tctacataataacaaaaaca

SEQ ID NO: 596624 - DNA, 20 bp, Artificial
  CRISPR gRNA sequence
gaaacaacctaaatgtccaa

SEQ ID NO: 596625 - DNA, 20 bp, Artificial
  CRISPR gRNA sequence
ctaaatgtccaacagtgaat

SEQ ID NO: 596626 - DNA, 20 bp, Artificial
  CRISPR gRNA sequence
taaatgtccaacagtgaatg

SEQ ID NO: 596627 - DNA, 20 bp, Artificial
  CRISPR gRNA sequence
aatgtccaacagtgaatgag

SEQ ID NO: 596628 - DNA, 20 bp, Artificial
  CRISPR gRNA sequence
attaaatcaccatgtatcat

SEQ ID NO: 596629 - DNA, 20 bp, Artificial
  CRISPR gRNA sequence
ccatgtatcatcagtgtata

SEQ ID NO: 596630 - DNA, 20 bp, Artificial
  CRISPR gRNA sequence
catgtatcatcagtgtataa

SEQ ID NO: 596631 - DNA, 20 bp, Artificial
  CRISPR gRNA sequence
taaaggtattatatgcaccc

SEQ ID NO: 596632 - DNA, 20 bp, Artificial
  CRISPR gRNA sequence
tatgcacccaagaacaacgt

SEQ ID NO: 596633 - DNA, 20 bp, Artificial
  CRISPR gRNA sequence
aaaatcctaaatgaaaaatt

SEQ ID NO: 596634 - DNA, 20 bp, Artificial
  CRISPR gRNA sequence
ctaaatgaaaaattgagtca

SEQ ID NO: 596635 - DNA, 20 bp, Artificial
  CRISPR gRNA sequence
taaatgaaaaattgagtcat

SEQ ID NO: 596636 - DNA, 20 bp, Artificial
  CRISPR gRNA sequence
aaatgaaaaattgagtcata

SEQ ID NO: 596637 - DNA, 20 bp, Artificial
  CRISPR gRNA sequence
gaaaaattgagtcatagggc

SEQ ID NO: 596638 - DNA, 20 bp, Artificial
  CRISPR gRNA sequence
aaccctatttgtactattaa

SEQ ID NO: 596639 - DNA, 20 bp, Artificial
  CRISPR gRNA sequence
accctatttgtactattaat

SEQ ID NO: 596640 - DNA, 20 bp, Artificial
  CRISPR gRNA sequence
tatttgtactattaatagga

SEQ ID NO: 596641 - DNA, 20 bp, Artificial
  CRISPR gRNA sequence
atttgtactattaataggaa

SEQ ID NO: 596642 - DNA, 20 bp, Artificial
  CRISPR gRNA sequence
aggaaaggaaacaaaatatg

SEQ ID NO: 596643 - DNA, 20 bp, Artificial
  CRISPR gRNA sequence
tgtagacacatgatttgtac

SEQ ID NO: 596644 - DNA, 20 bp, Artificial
  CRISPR gRNA sequence
tagtatataccaaaaaatta

SEQ ID NO: 596645 - DNA, 20 bp, Artificial
  CRISPR gRNA sequence
atataccaaaaaattatgga

SEQ ID NO: 596646 - DNA, 20 bp, Artificial
  CRISPR gRNA sequence
aaaattatggaaagataatt

SEQ ID NO: 596647 - DNA, 20 bp, Artificial
  CRISPR gRNA sequence
aaattatggaaagataatta

SEQ ID NO: 596648 - DNA, 20 bp, Artificial
  CRISPR gRNA sequence
tggaaagataattaaggaat

SEQ ID NO: 596649 - DNA, 20 bp, Artificial
  CRISPR gRNA sequence
aaagataattaaggaattgg

SEQ ID NO: 596650 - DNA, 20 bp, Artificial
  CRISPR gRNA sequence
taattaaggaattggtagca

SEQ ID NO: 596651 - DNA, 20 bp, Artificial
  CRISPR gRNA sequence
aattaaggaattggtagcac

SEQ ID NO: 596652 - DNA, 20 bp, Artificial
  CRISPR gRNA sequence
aattggtagcacaggaaact

SEQ ID NO: 596653 - DNA, 20 bp, Artificial
  CRISPR gRNA sequence
attggtagcacaggaaactg

SEQ ID NO: 596654 - DNA, 20 bp, Artificial
  CRISPR gRNA sequence
tagcacaggaaactgaggac

SEQ ID NO: 596655 - DNA, 20 bp, Artificial
  CRISPR gRNA sequence
agcacaggaaactgaggact

SEQ ID NO: 596656 - DNA, 20 bp, Artificial
  CRISPR gRNA sequence
gcacaggaaactgaggacta

SEQ ID NO: 596657 - DNA, 20 bp, Artificial
  CRISPR gRNA sequence
aactgaggactagggtactt

SEQ ID NO: 596658 - DNA, 20 bp, Artificial
  CRISPR gRNA sequence
tgaggactagggtacttgag

SEQ ID NO: 596659 - DNA, 20 bp, Artificial
  CRISPR gRNA sequence
ggactagggtacttgagtgg

SEQ ID NO: 596660 - DNA, 20 bp, Artificial
  CRISPR gRNA sequence
actagggtacttgagtggtg

SEQ ID NO: 596661 - DNA, 20 bp, Artificial
  CRISPR gRNA sequence
gttcctatatcatttttacc

SEQ ID NO: 596662 - DNA, 20 bp, Artificial
  CRISPR gRNA sequence
ttttacctagaatctctatt

SEQ ID NO: 596663 - DNA, 20 bp, Artificial
  CRISPR gRNA sequence
tctctatttagactgctctt

SEQ ID NO: 596664 - DNA, 20 bp, Artificial
  CRISPR gRNA sequence
tctttagccccacactatgt

SEQ ID NO: 596665 - DNA, 20 bp, Artificial
  CRISPR gRNA sequence
atgtcagaattttgtaatgc

SEQ ID NO: 596666 - DNA, 20 bp, Artificial
  CRISPR gRNA sequence
aatgctggccacatcccctg

SEQ ID NO: 596667 - DNA, 20 bp, Artificial
  CRISPR gRNA sequence
atgctggccacatcccctgt

SEQ ID NO: 596668 - DNA, 20 bp, Artificial
  CRISPR gRNA sequence
gccacatcccctgtgggatg

SEQ ID NO: 596669 - DNA, 20 bp, Artificial
  CRISPR gRNA sequence
cacccacaccccatcatccc

SEQ ID NO: 596670 - DNA, 20 bp, Artificial
  CRISPR gRNA sequence
actatcatgccataacacca

SEQ ID NO: 596671 - DNA, 20 bp, Artificial
  CRISPR gRNA sequence
atgccataacaccaaagttc

SEQ ID NO: 596672 - DNA, 20 bp, Artificial
  CRISPR gRNA sequence
ataacaccaaagttccagtt

SEQ ID NO: 596673 - DNA, 20 bp, Artificial
  CRISPR gRNA sequence
ccagttcagaacttacgtaa

SEQ ID NO: 596674 - DNA, 20 bp, Artificial
  CRISPR gRNA sequence
ttcagaacttacgtaatgga

SEQ ID NO: 596675 - DNA, 20 bp, Artificial
  CRISPR gRNA sequence
acttacgtaatggatggttt

SEQ ID NO: 596676 - DNA, 20 bp, Artificial
  CRISPR gRNA sequence
cttacgtaatggatggtttc

SEQ ID NO: 596677 - DNA, 20 bp, Artificial
  CRISPR gRNA sequence
ttacgtaatggatggtttca

SEQ ID NO: 596678 - DNA, 20 bp, Artificial
  CRISPR gRNA sequence
cctttctttctctaaaatct

SEQ ID NO: 596679 - DNA, 20 bp, Artificial
  CRISPR gRNA sequence
tctaaaatctaagctccttt

SEQ ID NO: 596680 - DNA, 20 bp, Artificial
  CRISPR gRNA sequence
taaaatctaagctcctttga

SEQ ID NO: 596681 - DNA, 20 bp, Artificial
  CRISPR gRNA sequence
aatctaagctcctttgagag

SEQ ID NO: 596682 - DNA, 20 bp, Artificial
  CRISPR gRNA sequence
atctaagctcctttgagagt

SEQ ID NO: 596683 - DNA, 20 bp, Artificial
  CRISPR gRNA sequence
tctaagctcctttgagagta

SEQ ID NO: 596684 - DNA, 20 bp, Artificial
  CRISPR gRNA sequence
ggtcaatgctgccttaatcc

SEQ ID NO: 596685 - DNA, 20 bp, Artificial
  CRISPR gRNA sequence
ttaatcctagcttcccacaa

SEQ ID NO: 596686 - DNA, 20 bp, Artificial
  CRISPR gRNA sequence
agcttcccacaatggcatcc

SEQ ID NO: 596687 - DNA, 20 bp, Artificial
  CRISPR gRNA sequence
gcttcccacaatggcatcct

SEQ ID NO: 596688 - DNA, 20 bp, Artificial
  CRISPR gRNA sequence
ttcccacaatggcatcctag

SEQ ID NO: 596689 - DNA, 20 bp, Artificial
  CRISPR gRNA sequence
tcccacaatggcatcctagg

SEQ ID NO: 596690 - DNA, 20 bp, Artificial
  CRISPR gRNA sequence
aatggcatcctaggaggtac

SEQ ID NO: 596691 - DNA, 20 bp, Artificial
  CRISPR gRNA sequence
taccggtaataaataaacat

SEQ ID NO: 596692 - DNA, 20 bp, Artificial
  CRISPR gRNA sequence
ccggtaataaataaacatta

SEQ ID NO: 596693 - DNA, 20 bp, Artificial
  CRISPR gRNA sequence
acattagagttgttttttat

SEQ ID NO: 596694 - DNA, 20 bp, Artificial
  CRISPR gRNA sequence
ttttatgagattatcgtttt

SEQ ID NO: 596695 - DNA, 20 bp, Artificial
  CRISPR gRNA sequence
tttatgagattatcgtttta

SEQ ID NO: 596696 - DNA, 20 bp, Artificial
  CRISPR gRNA sequence
aggttaaaattgtattttac

SEQ ID NO: 596697 - DNA, 20 bp, Artificial
  CRISPR gRNA sequence
gttaaaattgtattttacaa

SEQ ID NO: 596698 - DNA, 20 bp, Artificial
  CRISPR gRNA sequence
aaaattgtattttacaagag

SEQ ID NO: 596699 - DNA, 20 bp, Artificial
  CRISPR gRNA sequence
ttcctactttcctgaccata

SEQ ID NO: 596700 - DNA, 20 bp, Artificial
  CRISPR gRNA sequence
cctactttcctgaccatata

SEQ ID NO: 596701 - DNA, 20 bp, Artificial
  CRISPR gRNA sequence
ctttcctgaccatatagagt

SEQ ID NO: 596702 - DNA, 20 bp, Artificial
  CRISPR gRNA sequence
agttggtaataaatcacctc

SEQ ID NO: 596703 - DNA, 20 bp, Artificial
  CRISPR gRNA sequence
aataaatcacctccagatta

SEQ ID NO: 596704 - DNA, 20 bp, Artificial
  CRISPR gRNA sequence
aatcacctccagattacaga

SEQ ID NO: 596705 - DNA, 20 bp, Artificial
  CRISPR gRNA sequence
agattacagaaagaaacact

SEQ ID NO: 596706 - DNA, 20 bp, Artificial
  CRISPR gRNA sequence
aagaaacactgagatgcttt

SEQ ID NO: 596707 - DNA, 20 bp, Artificial
  CRISPR gRNA sequence
tttgtaattattaaacaaca

SEQ ID NO: 596708 - DNA, 20 bp, Artificial
  CRISPR gRNA sequence
ttaaacaacaaagtaaatga

SEQ ID NO: 596709 - DNA, 20 bp, Artificial
  CRISPR gRNA sequence
acaaagtaaatgatggtaaa

SEQ ID NO: 596710 - DNA, 20 bp, Artificial
  CRISPR gRNA sequence
caaagtaaatgatggtaaaa

SEQ ID NO: 596711 - DNA, 20 bp, Artificial
  CRISPR gRNA sequence
aagtaaatgatggtaaaaag

SEQ ID NO: 596712 - DNA, 20 bp, Artificial
  CRISPR gRNA sequence
aaatgatggtaaaaaggaga

SEQ ID NO: 596713 - DNA, 20 bp, Artificial
  CRISPR gRNA sequence
ggagacagaaacatttgaaa

SEQ ID NO: 596714 - DNA, 20 bp, Artificial
  CRISPR gRNA sequence
gttttaaataaaatttttca

SEQ ID NO: 596715 - DNA, 20 bp, Artificial
  CRISPR gRNA sequence
aaatttttcaaagaaaaatg

SEQ ID NO: 596716 - DNA, 20 bp, Artificial
  CRISPR gRNA sequence
agaaaaatgcagacttgcaa

SEQ ID NO: 596717 - DNA, 20 bp, Artificial
  CRISPR gRNA sequence
gaaaaatgcagacttgcaat

SEQ ID NO: 596718 - DNA, 20 bp, Artificial
  CRISPR gRNA sequence
cttgcaataggtacgtcata

SEQ ID NO: 596719 - DNA, 20 bp, Artificial
  CRISPR gRNA sequence
ataggtacgtcatatggtac

SEQ ID NO: 596720 - DNA, 20 bp, Artificial
  CRISPR gRNA sequence
taggtacgtcatatggtaca

SEQ ID NO: 596721 - DNA, 20 bp, Artificial
  CRISPR gRNA sequence
aggtacgtcatatggtacaa

SEQ ID NO: 596722 - DNA, 20 bp, Artificial
  CRISPR gRNA sequence
atatggtacaagggaacaca

SEQ ID NO: 596723 - DNA, 20 bp, Artificial
  CRISPR gRNA sequence
tacaagggaacacaaagaaa

SEQ ID NO: 596724 - DNA, 20 bp, Artificial
  CRISPR gRNA sequence
aagaaaaagaaatttgattg

SEQ ID NO: 596725 - DNA, 20 bp, Artificial
  CRISPR gRNA sequence
aaatacaatttcaaaaaaca

SEQ ID NO: 596726 - DNA, 20 bp, Artificial
  CRISPR gRNA sequence
aaaaacaaagcaaaacacat

SEQ ID NO: 596727 - DNA, 20 bp, Artificial
  CRISPR gRNA sequence
aaagcaaaacacattggttt

SEQ ID NO: 596728 - DNA, 20 bp, Artificial
  CRISPR gRNA sequence
aacacattggtttcagctca

SEQ ID NO: 596729 - DNA, 20 bp, Artificial
  CRISPR gRNA sequence
ctcacggtacacatttataa

SEQ ID NO: 596730 - DNA, 20 bp, Artificial
  CRISPR gRNA sequence
tacacatttataacagtgaa

SEQ ID NO: 596731 - DNA, 20 bp, Artificial
  CRISPR gRNA sequence
acacatttataacagtgaat

SEQ ID NO: 596732 - DNA, 20 bp, Artificial
  CRISPR gRNA sequence
agtgaataggaactacacat

SEQ ID NO: 596733 - DNA, 20 bp, Artificial
  CRISPR gRNA sequence
ataggaactacacatcagaa

SEQ ID NO: 596734 - DNA, 20 bp, Artificial
  CRISPR gRNA sequence
aatgattattgatttcttaa

SEQ ID NO: 596735 - DNA, 20 bp, Artificial
  CRISPR gRNA sequence
accaaaaaaccatcaatctt

SEQ ID NO: 596736 - DNA, 20 bp, Artificial
  CRISPR gRNA sequence
ccaaaaaaccatcaatcttt

SEQ ID NO: 596737 - DNA, 20 bp, Artificial
  CRISPR gRNA sequence
taataattataaacctatca

SEQ ID NO: 596738 - DNA, 20 bp, Artificial
  CRISPR gRNA sequence
taaacctatcacagcccata

SEQ ID NO: 596739 - DNA, 20 bp, Artificial
  CRISPR gRNA sequence
cagcattctgactgaattga

SEQ ID NO: 596740 - DNA, 20 bp, Artificial
  CRISPR gRNA sequence
tgaaagttactgctatctgc

SEQ ID NO: 596741 - DNA, 20 bp, Artificial
  CRISPR gRNA sequence
gaaagttactgctatctgcc

SEQ ID NO: 596742 - DNA, 20 bp, Artificial
  CRISPR gRNA sequence
tgaccaattttctatttctc

SEQ ID NO: 596743 - DNA, 20 bp, Artificial
  CRISPR gRNA sequence
ctccagctccaaccacaata

SEQ ID NO: 596744 - DNA, 20 bp, Artificial
  CRISPR gRNA sequence
gctccaaccacaatatggaa

SEQ ID NO: 596745 - DNA, 20 bp, Artificial
  CRISPR gRNA sequence
caaccacaatatggaatggt

SEQ ID NO: 596746 - DNA, 20 bp, Artificial
  CRISPR gRNA sequence
ccacaatatggaatggtgag

SEQ ID NO: 596747 - DNA, 20 bp, Artificial
  CRISPR gRNA sequence
acttacatcaaatgctatta

SEQ ID NO: 596748 - DNA, 20 bp, Artificial
  CRISPR gRNA sequence
cttacatcaaatgctattac

SEQ ID NO: 596749 - DNA, 20 bp, Artificial
  CRISPR gRNA sequence
tcaaatgctattacaggaca

SEQ ID NO: 596750 - DNA, 20 bp, Artificial
  CRISPR gRNA sequence
ttacaggacacggtttgtaa

SEQ ID NO: 596751 - DNA, 20 bp, Artificial
  CRISPR gRNA sequence
gacacggtttgtaacagcca

SEQ ID NO: 596752 - DNA, 20 bp, Artificial
  CRISPR gRNA sequence
caccatttgtaaattgctat

SEQ ID NO: 596753 - DNA, 20 bp, Artificial
  CRISPR gRNA sequence
ccatttgtaaattgctatta

SEQ ID NO: 596754 - DNA, 20 bp, Artificial
  CRISPR gRNA sequence
atttgtaaattgctattaga

SEQ ID NO: 596755 - DNA, 20 bp, Artificial
  CRISPR gRNA sequence
tttgtaaattgctattagag

SEQ ID NO: 596756 - DNA, 20 bp, Artificial
  CRISPR gRNA sequence
ctattagagaggtaaacaat

SEQ ID NO: 596757 - DNA, 20 bp, Artificial
  CRISPR gRNA sequence
tattagagaggtaaacaatc

SEQ ID NO: 596758 - DNA, 20 bp, Artificial
  CRISPR gRNA sequence
agaggtaaacaatcaggtcc

SEQ ID NO: 596759 - DNA, 20 bp, Artificial
  CRISPR gRNA sequence
ggtaaacaatcaggtcctgg

SEQ ID NO: 596760 - DNA, 20 bp, Artificial
  CRISPR gRNA sequence
ggaattttcttattattcat

SEQ ID NO: 596761 - DNA, 20 bp, Artificial
  CRISPR gRNA sequence
tatgaaaactgtaaataaaa

SEQ ID NO: 596762 - DNA, 20 bp, Artificial
  CRISPR gRNA sequence
atgaaaactgtaaataaaat

SEQ ID NO: 596763 - DNA, 20 bp, Artificial
  CRISPR gRNA sequence
actgtaaataaaatgggtat

SEQ ID NO: 596764 - DNA, 20 bp, Artificial
  CRISPR gRNA sequence
ctgtaaataaaatgggtata

SEQ ID NO: 596765 - DNA, 20 bp, Artificial
  CRISPR gRNA sequence
taaataaaatgggtataagg

SEQ ID NO: 596766 - DNA, 20 bp, Artificial
  CRISPR gRNA sequence
taaggcagttacacttatca

SEQ ID NO: 596767 - DNA, 20 bp, Artificial
  CRISPR gRNA sequence
acttatcaaagacctttcat

SEQ ID NO: 596768 - DNA, 20 bp, Artificial
  CRISPR gRNA sequence
tatcaaagacctttcattag

SEQ ID NO: 596769 - DNA, 20 bp, Artificial
  CRISPR gRNA sequence
caaagacctttcattagtgg

SEQ ID NO: 596770 - DNA, 20 bp, Artificial
  CRISPR gRNA sequence
aaagacctttcattagtggc

SEQ ID NO: 596771 - DNA, 20 bp, Artificial
  CRISPR gRNA sequence
ctttcattagtggcaggttg

SEQ ID NO: 596772 - DNA, 20 bp, Artificial
  CRISPR gRNA sequence
ttcattagtggcaggttgtg

SEQ ID NO: 596773 - DNA, 20 bp, Artificial
  CRISPR gRNA sequence
attagtggcaggttgtggag

SEQ ID NO: 596774 - DNA, 20 bp, Artificial
  CRISPR gRNA sequence
ttagtggcaggttgtggaga

SEQ ID NO: 596775 - DNA, 20 bp, Artificial
  CRISPR gRNA sequence
tagtggcaggttgtggagaa

SEQ ID NO: 596776 - DNA, 20 bp, Artificial
  CRISPR gRNA sequence
agtggcaggttgtggagaag

SEQ ID NO: 596777 - DNA, 20 bp, Artificial
  CRISPR gRNA sequence
caggttgtggagaaggggtc

SEQ ID NO: 596778 - DNA, 20 bp, Artificial
  CRISPR gRNA sequence
aggttgtggagaaggggtca

SEQ ID NO: 596779 - DNA, 20 bp, Artificial
  CRISPR gRNA sequence
ggttgtggagaaggggtcaa

SEQ ID NO: 596780 - DNA, 20 bp, Artificial
  CRISPR gRNA sequence
gagaaggggtcaagggcaaa

SEQ ID NO: 596781 - DNA, 20 bp, Artificial
  CRISPR gRNA sequence
gtcaagggcaaacagtacat

SEQ ID NO: 596782 - DNA, 20 bp, Artificial
  CRISPR gRNA sequence
gggcaaacagtacattagtt

SEQ ID NO: 596783 - DNA, 20 bp, Artificial
  CRISPR gRNA sequence
ggcaaacagtacattagttg

SEQ ID NO: 596784 - DNA, 20 bp, Artificial
  CRISPR gRNA sequence
acctcttcccaaatctgcac

SEQ ID NO: 596785 - DNA, 20 bp, Artificial
  CRISPR gRNA sequence
tctgtaactataaaactaca

SEQ ID NO: 596786 - DNA, 20 bp, Artificial
  CRISPR gRNA sequence
tagttctctttctaaatcct

SEQ ID NO: 596787 - DNA, 20 bp, Artificial
  CRISPR gRNA sequence
agttctctttctaaatccta

SEQ ID NO: 596788 - DNA, 20 bp, Artificial
  CRISPR gRNA sequence
ctaaatcctaaggatgttct

SEQ ID NO: 596789 - DNA, 20 bp, Artificial
  CRISPR gRNA sequence
ctaaggatgttctcagtaaa

SEQ ID NO: 596790 - DNA, 20 bp, Artificial
  CRISPR gRNA sequence
tagcacttttactaaatatc

SEQ ID NO: 596791 - DNA, 20 bp, Artificial
  CRISPR gRNA sequence
cacttttactaaatatccag

SEQ ID NO: 596792 - DNA, 20 bp, Artificial
  CRISPR gRNA sequence
agtggaataccaatacaact

SEQ ID NO: 596793 - DNA, 20 bp, Artificial
  CRISPR gRNA sequence
ctaagatactattttccaaa

SEQ ID NO: 596794 - DNA, 20 bp, Artificial
  CRISPR gRNA sequence
aaaagaaaaccccattatgt

SEQ ID NO: 596795 - DNA, 20 bp, Artificial
  CRISPR gRNA sequence
cccattatgtcagtttcacc

SEQ ID NO: 596796 - DNA, 20 bp, Artificial
  CRISPR gRNA sequence
attatgtcagtttcacctag

SEQ ID NO: 596797 - DNA, 20 bp, Artificial
  CRISPR gRNA sequence
cattgaataatgatgtgata

SEQ ID NO: 596798 - DNA, 20 bp, Artificial
  CRISPR gRNA sequence
tgatacggtattgatcaatt

SEQ ID NO: 596799 - DNA, 20 bp, Artificial
  CRISPR gRNA sequence
tttgtaattgtcatattttc

SEQ ID NO: 596800 - DNA, 20 bp, Artificial
  CRISPR gRNA sequence
attgtcatattttccagctg

SEQ ID NO: 596801 - DNA, 20 bp, Artificial
  CRISPR gRNA sequence
gtcatattttccagctgtag

SEQ ID NO: 596802 - DNA, 20 bp, Artificial
  CRISPR gRNA sequence
attttccagctgtagtagta

SEQ ID NO: 596803 - DNA, 20 bp, Artificial
  CRISPR gRNA sequence
tagataacaccacttccttc

SEQ ID NO: 596804 - DNA, 20 bp, Artificial
  CRISPR gRNA sequence
taacaccacttccttccaga

SEQ ID NO: 596805 - DNA, 20 bp, Artificial
  CRISPR gRNA sequence
tgatctatattacacacaaa

SEQ ID NO: 596806 - DNA, 20 bp, Artificial
  CRISPR gRNA sequence
atattacacacaaatagtcc

SEQ ID NO: 596807 - DNA, 20 bp, Artificial
  CRISPR gRNA sequence
acacaaatagtcctagcata

SEQ ID NO: 596808 - DNA, 20 bp, Artificial
  CRISPR gRNA sequence
aaatagtcctagcataaaga

SEQ ID NO: 596809 - DNA, 20 bp, Artificial
  CRISPR gRNA sequence
agctaatccaacccaaataa

SEQ ID NO: 596810 - DNA, 20 bp, Artificial
  CRISPR gRNA sequence
cttgtttacattttctcttt

SEQ ID NO: 596811 - DNA, 20 bp, Artificial
  CRISPR gRNA sequence
ctttaagtcctatctatcat

SEQ ID NO: 596812 - DNA, 20 bp, Artificial
  CRISPR gRNA sequence
ctatctatcatcagaatttt

SEQ ID NO: 596813 - DNA, 20 bp, Artificial
  CRISPR gRNA sequence
ctatcatcagaatttttggt

SEQ ID NO: 596814 - DNA, 20 bp, Artificial
  CRISPR gRNA sequence
tatgtcaacattcttttcta

SEQ ID NO: 596815 - DNA, 20 bp, Artificial
  CRISPR gRNA sequence
tccacccaattaactaactt

SEQ ID NO: 596816 - DNA, 20 bp, Artificial
  CRISPR gRNA sequence
catgtatttccaaaatatcc

SEQ ID NO: 596817 - DNA, 20 bp, Artificial
  CRISPR gRNA sequence
atgtatttccaaaatatcct

SEQ ID NO: 596818 - DNA, 20 bp, Artificial
  CRISPR gRNA sequence
ccaaaatatcctaggaacta

SEQ ID NO: 596819 - DNA, 20 bp, Artificial
  CRISPR gRNA sequence
atcctaggaactaaagaaat

SEQ ID NO: 596820 - DNA, 20 bp, Artificial
  CRISPR gRNA sequence
tagatttgattgtttttata

SEQ ID NO: 596821 - DNA, 20 bp, Artificial
  CRISPR gRNA sequence
tataaagcatttcccttcct

SEQ ID NO: 596822 - DNA, 20 bp, Artificial
  CRISPR gRNA sequence
taaagcatttcccttcctaa

SEQ ID NO: 596823 - DNA, 20 bp, Artificial
  CRISPR gRNA sequence
aaagcatttcccttcctaag

SEQ ID NO: 596824 - DNA, 20 bp, Artificial
  CRISPR gRNA sequence
ataataattaaaatactatt

SEQ ID NO: 596825 - DNA, 20 bp, Artificial
  CRISPR gRNA sequence
tactattaagtataatataa

SEQ ID NO: 596826 - DNA, 20 bp, Artificial
  CRISPR gRNA sequence
aagtataatataaaagcaaa

SEQ ID NO: 596827 - DNA, 20 bp, Artificial
  CRISPR gRNA sequence
aatataaaagcaaatagaaa

SEQ ID NO: 596828 - DNA, 20 bp, Artificial
  CRISPR gRNA sequence
caaatagaaaaagctaaata

SEQ ID NO: 596829 - DNA, 20 bp, Artificial
  CRISPR gRNA sequence
gttaccattataaaataaaa

SEQ ID NO: 596830 - DNA, 20 bp, Artificial
  CRISPR gRNA sequence
agatttgtgaaataccacaa

SEQ ID NO: 596831 - DNA, 20 bp, Artificial
  CRISPR gRNA sequence
accacaatagatttgtgaaa

SEQ ID NO: 596832 - DNA, 20 bp, Artificial
  CRISPR gRNA sequence
tttgtgaaatggtgaaatgt

SEQ ID NO: 596833 - DNA, 20 bp, Artificial
  CRISPR gRNA sequence
ttgtgaaatggtgaaatgtg

SEQ ID NO: 596834 - DNA, 20 bp, Artificial
  CRISPR gRNA sequence
tgtttgtctgtttaataaaa

SEQ ID NO: 596835 - DNA, 20 bp, Artificial
  CRISPR gRNA sequence
gtttgtctgtttaataaaaa

SEQ ID NO: 596836 - DNA, 20 bp, Artificial
  CRISPR gRNA sequence
ggtattctaaatcttaaaac

SEQ ID NO: 596837 - DNA, 20 bp, Artificial
  CRISPR gRNA sequence
gtattctaaatcttaaaaca

SEQ ID NO: 596838 - DNA, 20 bp, Artificial
  CRISPR gRNA sequence
ggcaaaacaaatgtatttcc

SEQ ID NO: 596839 - DNA, 20 bp, Artificial
  CRISPR gRNA sequence
aaatgtatttcctagaatgc

SEQ ID NO: 596840 - DNA, 20 bp, Artificial
  CRISPR gRNA sequence
tgtatttcctagaatgcaag

SEQ ID NO: 596841 - DNA, 20 bp, Artificial
  CRISPR gRNA sequence
tagaatgcaagtggtaactt

SEQ ID NO: 596842 - DNA, 20 bp, Artificial
  CRISPR gRNA sequence
tgcaagtggtaactttagaa

SEQ ID NO: 596843 - DNA, 20 bp, Artificial
  CRISPR gRNA sequence
gcaagtggtaactttagaat

SEQ ID NO: 596844 - DNA, 20 bp, Artificial
  CRISPR gRNA sequence
caagtggtaactttagaatg

SEQ ID NO: 596845 - DNA, 20 bp, Artificial
  CRISPR gRNA sequence
tggtaactttagaatggggt

SEQ ID NO: 596846 - DNA, 20 bp, Artificial
  CRISPR gRNA sequence
attcattaattttcaaaccc

SEQ ID NO: 596847 - DNA, 20 bp, Artificial
  CRISPR gRNA sequence
cattaattttcaaaccctag

SEQ ID NO: 596848 - DNA, 20 bp, Artificial
  CRISPR gRNA sequence
cttatctaataaatattaaa

SEQ ID NO: 596849 - DNA, 20 bp, Artificial
  CRISPR gRNA sequence
aagctatatgcaaatatttg

SEQ ID NO: 596850 - DNA, 20 bp, Artificial
  CRISPR gRNA sequence
ttgcagtctataaatcacaa

SEQ ID NO: 596851 - DNA, 20 bp, Artificial
  CRISPR gRNA sequence
cagcaaacgtgccaaaaaat

SEQ ID NO: 596852 - DNA, 20 bp, Artificial
  CRISPR gRNA sequence
aacgtgccaaaaaatgagct

SEQ ID NO: 596853 - DNA, 20 bp, Artificial
  CRISPR gRNA sequence
catttatttcttcaaaactt

SEQ ID NO: 596854 - DNA, 20 bp, Artificial
  CRISPR gRNA sequence
atttatttcttcaaaactta

SEQ ID NO: 596855 - DNA, 20 bp, Artificial
  CRISPR gRNA sequence
atttcttcaaaacttaaggc

SEQ ID NO: 596856 - DNA, 20 bp, Artificial
  CRISPR gRNA sequence
attattattataccatttta

SEQ ID NO: 596857 - DNA, 20 bp, Artificial
  CRISPR gRNA sequence
attataccattttacagctg

SEQ ID NO: 596858 - DNA, 20 bp, Artificial
  CRISPR gRNA sequence
ttataccattttacagctga

SEQ ID NO: 596859 - DNA, 20 bp, Artificial
  CRISPR gRNA sequence
acagctgaaggaactaaatt

SEQ ID NO: 596860 - DNA, 20 bp, Artificial
  CRISPR gRNA sequence
cagctgaaggaactaaattt

SEQ ID NO: 596861 - DNA, 20 bp, Artificial
  CRISPR gRNA sequence
gaactaaatttaggaaatct

SEQ ID NO: 596862 - DNA, 20 bp, Artificial
  CRISPR gRNA sequence
aactaaatttaggaaatcta

SEQ ID NO: 596863 - DNA, 20 bp, Artificial
  CRISPR gRNA sequence
gaaatctaaggaacattcct

SEQ ID NO: 596864 - DNA, 20 bp, Artificial
  CRISPR gRNA sequence
aaatctaaggaacattccta

SEQ ID NO: 596865 - DNA, 20 bp, Artificial
  CRISPR gRNA sequence
ggaacattcctaaggtcaca

SEQ ID NO: 596866 - DNA, 20 bp, Artificial
  CRISPR gRNA sequence
tcctaaggtcacacagctat

SEQ ID NO: 596867 - DNA, 20 bp, Artificial
  CRISPR gRNA sequence
cctaaggtcacacagctatt

SEQ ID NO: 596868 - DNA, 20 bp, Artificial
  CRISPR gRNA sequence
gctattaggttgaaaaacaa

SEQ ID NO: 596869 - DNA, 20 bp, Artificial
  CRISPR gRNA sequence
tattaggttgaaaaacaatg

SEQ ID NO: 596870 - DNA, 20 bp, Artificial
  CRISPR gRNA sequence
gttgaaaaacaatggagtgt

SEQ ID NO: 596871 - DNA, 20 bp, Artificial
  CRISPR gRNA sequence
ggagtgtcagtaatccctta

SEQ ID NO: 596872 - DNA, 20 bp, Artificial
  CRISPR gRNA sequence
tcccttacggcttaacccaa

SEQ ID NO: 596873 - DNA, 20 bp, Artificial
  CRISPR gRNA sequence
cttacggcttaacccaaaag

SEQ ID NO: 596874 - DNA, 20 bp, Artificial
  CRISPR gRNA sequence
ttacggcttaacccaaaagt

SEQ ID NO: 596875 - DNA, 20 bp, Artificial
  CRISPR gRNA sequence
tacggcttaacccaaaagta

SEQ ID NO: 596876 - DNA, 20 bp, Artificial
  CRISPR gRNA sequence
taacccaaaagtagggtgca

SEQ ID NO: 596877 - DNA, 20 bp, Artificial
  CRISPR gRNA sequence
ccaaaagtagggtgcacagc

SEQ ID NO: 596878 - DNA, 20 bp, Artificial
  CRISPR gRNA sequence
caaaagtagggtgcacagcc

SEQ ID NO: 596879 - DNA, 20 bp, Artificial
  CRISPR gRNA sequence
gcacagccaggactccaaac

SEQ ID NO: 596880 - DNA, 20 bp, Artificial
  CRISPR gRNA sequence
cacagccaggactccaaacc

SEQ ID NO: 596881 - DNA, 20 bp, Artificial
  CRISPR gRNA sequence
ggtctatgtaatatgaaaat

SEQ ID NO: 596882 - DNA, 20 bp, Artificial
  CRISPR gRNA sequence
agtactcttaactacttcta

SEQ ID NO: 596883 - DNA, 20 bp, Artificial
  CRISPR gRNA sequence
gtactcttaactacttctac

SEQ ID NO: 596884 - DNA, 20 bp, Artificial
  CRISPR gRNA sequence
tactcttaactacttctaca

SEQ ID NO: 596885 - DNA, 20 bp, Artificial
  CRISPR gRNA sequence
agggcctcaccccaaaacat

SEQ ID NO: 596886 - DNA, 20 bp, Artificial
  CRISPR gRNA sequence
ggcctcaccccaaaacataa

SEQ ID NO: 596887 - DNA, 20 bp, Artificial
  CRISPR gRNA sequence
acataagagtgtatcatgta

SEQ ID NO: 596888 - DNA, 20 bp, Artificial
  CRISPR gRNA sequence
aagagtgtatcatgtaaagc

SEQ ID NO: 596889 - DNA, 20 bp, Artificial
  CRISPR gRNA sequence
agagtgtatcatgtaaagca

SEQ ID NO: 596890 - DNA, 20 bp, Artificial
  CRISPR gRNA sequence
catgtaaagcaaggaacacc

SEQ ID NO: 596891 - DNA, 20 bp, Artificial
  CRISPR gRNA sequence
aaagcaaggaacaccaagcc

SEQ ID NO: 596892 - DNA, 20 bp, Artificial
  CRISPR gRNA sequence
agcaaggaacaccaagccaa

SEQ ID NO: 596893 - DNA, 20 bp, Artificial
  CRISPR gRNA sequence
aggaacaccaagccaagagt

SEQ ID NO: 596894 - DNA, 20 bp, Artificial
  CRISPR gRNA sequence
aacaccaagccaagagtcag

SEQ ID NO: 596895 - DNA, 20 bp, Artificial
  CRISPR gRNA sequence
caagccaagagtcagaagat

SEQ ID NO: 596896 - DNA, 20 bp, Artificial
  CRISPR gRNA sequence
aagccaagagtcagaagata

SEQ ID NO: 596897 - DNA, 20 bp, Artificial
  CRISPR gRNA sequence
ttgttgttgttgttgttttt

SEQ ID NO: 596898 - DNA, 20 bp, Artificial
  CRISPR gRNA sequence
tgttgttgttgtttttcaga

SEQ ID NO: 596899 - DNA, 20 bp, Artificial
  CRISPR gRNA sequence
ttgttgttgtttttcagaca

SEQ ID NO: 596900 - DNA, 20 bp, Artificial
  CRISPR gRNA sequence
gagtctcactttctgtcgcc

SEQ ID NO: 596901 - DNA, 20 bp, Artificial
  CRISPR gRNA sequence
agtctcactttctgtcgccc

SEQ ID NO: 596902 - DNA, 20 bp, Artificial
  CRISPR gRNA sequence
tcactttctgtcgcccagga

SEQ ID NO: 596903 - DNA, 20 bp, Artificial
  CRISPR gRNA sequence
actttctgtcgcccaggatg

SEQ ID NO: 596904 - DNA, 20 bp, Artificial
  CRISPR gRNA sequence
ctgtcgcccaggatggagta

SEQ ID NO: 596905 - DNA, 20 bp, Artificial
  CRISPR gRNA sequence
tcgcccaggatggagtacag

SEQ ID NO: 596906 - DNA, 20 bp, Artificial
  CRISPR gRNA sequence
ggagtacagtggcatgatct

SEQ ID NO: 596907 - DNA, 20 bp, Artificial
  CRISPR gRNA sequence
cactgcaacctccacccgcc

SEQ ID NO: 596908 - DNA, 20 bp, Artificial
  CRISPR gRNA sequence
ttcaaactattctcctgcct

SEQ ID NO: 596909 - DNA, 20 bp, Artificial
  CRISPR gRNA sequence
tattctcctgcctcagcctc

SEQ ID NO: 596910 - DNA, 20 bp, Artificial
  CRISPR gRNA sequence
ttctcctgcctcagcctcca

SEQ ID NO: 596911 - DNA, 20 bp, Artificial
  CRISPR gRNA sequence
tcctgcctcagcctccagag

SEQ ID NO: 596912 - DNA, 20 bp, Artificial
  CRISPR gRNA sequence
gcctcagcctccagagtagc

SEQ ID NO: 596913 - DNA, 20 bp, Artificial
  CRISPR gRNA sequence
cctcagcctccagagtagct

SEQ ID NO: 596914 - DNA, 20 bp, Artificial
  CRISPR gRNA sequence
ctccagagtagctgggatta

SEQ ID NO: 596915 - DNA, 20 bp, Artificial
  CRISPR gRNA sequence
tccagagtagctgggattac

SEQ ID NO: 596916 - DNA, 20 bp, Artificial
  CRISPR gRNA sequence
agtagctgggattacaggtg

SEQ ID NO: 596917 - DNA, 20 bp, Artificial
  CRISPR gRNA sequence
gtagctgggattacaggtgc

SEQ ID NO: 596918 - DNA, 20 bp, Artificial
  CRISPR gRNA sequence
tttttttttttttgtatttt

SEQ ID NO: 596919 - DNA, 20 bp, Artificial
  CRISPR gRNA sequence
ttttttttttgtatttttag

SEQ ID NO: 596920 - DNA, 20 bp, Artificial
  CRISPR gRNA sequence
ttttttttgtatttttagta

SEQ ID NO: 596921 - DNA, 20 bp, Artificial
  CRISPR gRNA sequence
ttttgtatttttagtagaga

SEQ ID NO: 596922 - DNA, 20 bp, Artificial
  CRISPR gRNA sequence
ttgtatttttagtagagacg

SEQ ID NO: 596923 - DNA, 20 bp, Artificial
  CRISPR gRNA sequence
gagacggagtttcaccattt

SEQ ID NO: 596924 - DNA, 20 bp, Artificial
  CRISPR gRNA sequence
cggagtttcaccattttggc

SEQ ID NO: 596925 - DNA, 20 bp, Artificial
  CRISPR gRNA sequence
ggagtttcaccattttggcc

SEQ ID NO: 596926 - DNA, 20 bp, Artificial
  CRISPR gRNA sequence
tttcaccattttggccaggc

SEQ ID NO: 596927 - DNA, 20 bp, Artificial
  CRISPR gRNA sequence
tggtctcgaacttctgacct

SEQ ID NO: 596928 - DNA, 20 bp, Artificial
  CRISPR gRNA sequence
ggtctcgaacttctgacctc

SEQ ID NO: 596929 - DNA, 20 bp, Artificial
  CRISPR gRNA sequence
ctcaggtgatccacccgtct

SEQ ID NO: 596930 - DNA, 20 bp, Artificial
  CRISPR gRNA sequence
ccacccgtctcggcctccca

SEQ ID NO: 596931 - DNA, 20 bp, Artificial
  CRISPR gRNA sequence
gtctcggcctcccaaagtgc

SEQ ID NO: 596932 - DNA, 20 bp, Artificial
  CRISPR gRNA sequence
tctcggcctcccaaagtgct

SEQ ID NO: 596933 - DNA, 20 bp, Artificial
  CRISPR gRNA sequence
ctcccaaagtgctgggatta

SEQ ID NO: 596934 - DNA, 20 bp, Artificial
  CRISPR gRNA sequence
tcccaaagtgctgggattac

SEQ ID NO: 596935 - DNA, 20 bp, Artificial
  CRISPR gRNA sequence
agtgctgggattacaggcgt

SEQ ID NO: 596936 - DNA, 20 bp, Artificial
  CRISPR gRNA sequence
caggcgtgagccaccacatc

SEQ ID NO: 596937 - DNA, 20 bp, Artificial
  CRISPR gRNA sequence
gtgagccaccacatctggcc

SEQ ID NO: 596938 - DNA, 20 bp, Artificial
  CRISPR gRNA sequence
ccaccacatctggccaagat

SEQ ID NO: 596939 - DNA, 20 bp, Artificial
  CRISPR gRNA sequence
caccacatctggccaagata

SEQ ID NO: 596940 - DNA, 20 bp, Artificial
  CRISPR gRNA sequence
gtgactttcgcctcaatgta

SEQ ID NO: 596941 - DNA, 20 bp, Artificial
  CRISPR gRNA sequence
tgactttcgcctcaatgtac

SEQ ID NO: 596942 - DNA, 20 bp, Artificial
  CRISPR gRNA sequence
caatgtacaggtttctaaaa

SEQ ID NO: 596943 - DNA, 20 bp, Artificial
  CRISPR gRNA sequence
atgtacaggtttctaaaata

SEQ ID NO: 596944 - DNA, 20 bp, Artificial
  CRISPR gRNA sequence
tgtacaggtttctaaaatag

SEQ ID NO: 596945 - DNA, 20 bp, Artificial
  CRISPR gRNA sequence
gtacaggtttctaaaataga

SEQ ID NO: 596946 - DNA, 20 bp, Artificial
  CRISPR gRNA sequence
ggtttctaaaatagagggtt

SEQ ID NO: 596947 - DNA, 20 bp, Artificial
  CRISPR gRNA sequence
agggtttagaatgaacacta

SEQ ID NO: 596948 - DNA, 20 bp, Artificial
  CRISPR gRNA sequence
aaaacactttgtttgcttta

SEQ ID NO: 596949 - DNA, 20 bp, Artificial
  CRISPR gRNA sequence
gtttgctttatagacacaca

SEQ ID NO: 596950 - DNA, 20 bp, Artificial
  CRISPR gRNA sequence
ttgctttatagacacacaca

SEQ ID NO: 596951 - DNA, 20 bp, Artificial
  CRISPR gRNA sequence
cacacagagaattctattta

SEQ ID NO: 596952 - DNA, 20 bp, Artificial
  CRISPR gRNA sequence
acagagaattctatttatgg

SEQ ID NO: 596953 - DNA, 20 bp, Artificial
  CRISPR gRNA sequence
cagagaattctatttatgga

SEQ ID NO: 596954 - DNA, 20 bp, Artificial
  CRISPR gRNA sequence
agagaattctatttatggaa

SEQ ID NO: 596955 - DNA, 20 bp, Artificial
  CRISPR gRNA sequence
aattctatttatggaaggga

SEQ ID NO: 596956 - DNA, 20 bp, Artificial
  CRISPR gRNA sequence
atttatggaagggaaagaac

SEQ ID NO: 596957 - DNA, 20 bp, Artificial
  CRISPR gRNA sequence
tttatggaagggaaagaaca

SEQ ID NO: 596958 - DNA, 20 bp, Artificial
  CRISPR gRNA sequence
tatggaagggaaagaacaag

SEQ ID NO: 596959 - DNA, 20 bp, Artificial
  CRISPR gRNA sequence
gaagggaaagaacaaggagt

SEQ ID NO: 596960 - DNA, 20 bp, Artificial
  CRISPR gRNA sequence
caaggagtcagttcatctgt

SEQ ID NO: 596961 - DNA, 20 bp, Artificial
  CRISPR gRNA sequence
tttattgtctattacattcc

SEQ ID NO: 596962 - DNA, 20 bp, Artificial
  CRISPR gRNA sequence
gccctactacatgaatgaac

SEQ ID NO: 596963 - DNA, 20 bp, Artificial
  CRISPR gRNA sequence
aatgttcctcaactgtgtgt

SEQ ID NO: 596964 - DNA, 20 bp, Artificial
  CRISPR gRNA sequence
atgttcctcaactgtgtgtt

SEQ ID NO: 596965 - DNA, 20 bp, Artificial
  CRISPR gRNA sequence
gttcctcaactgtgtgttgg

SEQ ID NO: 596966 - DNA, 20 bp, Artificial
  CRISPR gRNA sequence
cctcaactgtgtgttgggag

SEQ ID NO: 596967 - DNA, 20 bp, Artificial
  CRISPR gRNA sequence
tcaactgtgtgttgggagaa

SEQ ID NO: 596968 - DNA, 20 bp, Artificial
  CRISPR gRNA sequence
aagagataaatacacaaatt

SEQ ID NO: 596969 - DNA, 20 bp, Artificial
  CRISPR gRNA sequence
atacacaaattaagtaaatt

SEQ ID NO: 596970 - DNA, 20 bp, Artificial
  CRISPR gRNA sequence
aagtaaattcagatactatt

SEQ ID NO: 596971 - DNA, 20 bp, Artificial
  CRISPR gRNA sequence
agatactattaagtataata

SEQ ID NO: 596972 - DNA, 20 bp, Artificial
  CRISPR gRNA sequence
gtataataaagaaaataaaa

SEQ ID NO: 596973 - DNA, 20 bp, Artificial
  CRISPR gRNA sequence
tataataaagaaaataaaac

SEQ ID NO: 596974 - DNA, 20 bp, Artificial
  CRISPR gRNA sequence
aataaaacaggataatgtca

SEQ ID NO: 596975 - DNA, 20 bp, Artificial
  CRISPR gRNA sequence
ggataatgtcatagaatgcc

SEQ ID NO: 596976 - DNA, 20 bp, Artificial
  CRISPR gRNA sequence
ataatgtcatagaatgcctg

SEQ ID NO: 596977 - DNA, 20 bp, Artificial
  CRISPR gRNA sequence
aatgtcatagaatgcctgga

SEQ ID NO: 596978 - DNA, 20 bp, Artificial
  CRISPR gRNA sequence
atgtcatagaatgcctggag

SEQ ID NO: 596979 - DNA, 20 bp, Artificial
  CRISPR gRNA sequence
tgtcatagaatgcctggaga

SEQ ID NO: 596980 - DNA, 20 bp, Artificial
  CRISPR gRNA sequence
gtcatagaatgcctggagag

SEQ ID NO: 596981 - DNA, 20 bp, Artificial
  CRISPR gRNA sequence
tggagaggggcttatttatc

SEQ ID NO: 596982 - DNA, 20 bp, Artificial
  CRISPR gRNA sequence
ggagaggggcttatttatct

SEQ ID NO: 596983 - DNA, 20 bp, Artificial
  CRISPR gRNA sequence
gcttatttatctaggatgct

SEQ ID NO: 596984 - DNA, 20 bp, Artificial
  CRISPR gRNA sequence
cttatttatctaggatgctc

SEQ ID NO: 596985 - DNA, 20 bp, Artificial
  CRISPR gRNA sequence
ttatctaggatgctcaggca

SEQ ID NO: 596986 - DNA, 20 bp, Artificial
  CRISPR gRNA sequence
tgctcaggcaaagcctcgcc

SEQ ID NO: 596987 - DNA, 20 bp, Artificial
  CRISPR gRNA sequence
gctcaggcaaagcctcgcca

SEQ ID NO: 596988 - DNA, 20 bp, Artificial
  CRISPR gRNA sequence
tcaggcaaagcctcgccaag

SEQ ID NO: 596989 - DNA, 20 bp, Artificial
  CRISPR gRNA sequence
caggcaaagcctcgccaagg

SEQ ID NO: 596990 - DNA, 20 bp, Artificial
  CRISPR gRNA sequence
aagcctcgccaaggaggcga

SEQ ID NO: 596991 - DNA, 20 bp, Artificial
  CRISPR gRNA sequence
ccaaggaggcgacagttaaa

SEQ ID NO: 596992 - DNA, 20 bp, Artificial
  CRISPR gRNA sequence
ggcgacagttaaatggaaat

SEQ ID NO: 596993 - DNA, 20 bp, Artificial
  CRISPR gRNA sequence
cagttaaatggaaataagaa

SEQ ID NO: 596994 - DNA, 20 bp, Artificial
  CRISPR gRNA sequence
ttaaatggaaataagaaaag

SEQ ID NO: 596995 - DNA, 20 bp, Artificial
  CRISPR gRNA sequence
taaatggaaataagaaaaga

SEQ ID NO: 596996 - DNA, 20 bp, Artificial
  CRISPR gRNA sequence
aatggaaataagaaaagaag

SEQ ID NO: 596997 - DNA, 20 bp, Artificial
  CRISPR gRNA sequence
atggaaataagaaaagaagg

SEQ ID NO: 596998 - DNA, 20 bp, Artificial
  CRISPR gRNA sequence
aggaggctttcatgcaaaac

SEQ ID NO: 596999 - DNA, 20 bp, Artificial
  CRISPR gRNA sequence
ggaggctttcatgcaaaaca

SEQ ID NO: 597000 - DNA, 20 bp, Artificial
  CRISPR gRNA sequence
ggctttcatgcaaaacaagg

SEQ ID NO: 597001 - DNA, 20 bp, Artificial
  CRISPR gRNA sequence
agaaaacgtgtcccaaacca

SEQ ID NO: 597002 - DNA, 20 bp, Artificial
  CRISPR gRNA sequence
cgtgtcccaaaccaaagaaa

SEQ ID NO: 597003 - DNA, 20 bp, Artificial
  CRISPR gRNA sequence
tcccaaaccaaagaaacagc

SEQ ID NO: 597004 - DNA, 20 bp, Artificial
  CRISPR gRNA sequence
aaccaaagaaacagcaagta

SEQ ID NO: 597005 - DNA, 20 bp, Artificial
  CRISPR gRNA sequence
ccaaagaaacagcaagtaca

SEQ ID NO: 597006 - DNA, 20 bp, Artificial
  CRISPR gRNA sequence
caaagaaacagcaagtacag

SEQ ID NO: 597007 - DNA, 20 bp, Artificial
  CRISPR gRNA sequence
acagcaagtacagaggtcct

SEQ ID NO: 597008 - DNA, 20 bp, Artificial
  CRISPR gRNA sequence
caagtacagaggtccttaga

SEQ ID NO: 597009 - DNA, 20 bp, Artificial
  CRISPR gRNA sequence
aagtacagaggtccttagac

SEQ ID NO: 597010 - DNA, 20 bp, Artificial
  CRISPR gRNA sequence
ggaacgaacttgccatgtcc

SEQ ID NO: 597011 - DNA, 20 bp, Artificial
  CRISPR gRNA sequence
gaacttgccatgtcccggaa

SEQ ID NO: 597012 - DNA, 20 bp, Artificial
  CRISPR gRNA sequence
gccatgtcccggaaaagaaa

SEQ ID NO: 597013 - DNA, 20 bp, Artificial
  CRISPR gRNA sequence
ccatgtcccggaaaagaaaa

SEQ ID NO: 597014 - DNA, 20 bp, Artificial
  CRISPR gRNA sequence
catgtcccggaaaagaaaaa

SEQ ID NO: 597015 - DNA, 20 bp, Artificial
  CRISPR gRNA sequence
gtcccggaaaagaaaaaggg

SEQ ID NO: 597016 - DNA, 20 bp, Artificial
  CRISPR gRNA sequence
cccggaaaagaaaaagggaa

SEQ ID NO: 597017 - DNA, 20 bp, Artificial
  CRISPR gRNA sequence
ccggaaaagaaaaagggaag

SEQ ID NO: 597018 - DNA, 20 bp, Artificial
  CRISPR gRNA sequence
aaaaagggaagaggtattaa

SEQ ID NO: 597019 - DNA, 20 bp, Artificial
  CRISPR gRNA sequence
gggaagaggtattaaaagtt

SEQ ID NO: 597020 - DNA, 20 bp, Artificial
  CRISPR gRNA sequence
ggtattaaaagttcagtgaa

SEQ ID NO: 597021 - DNA, 20 bp, Artificial
  CRISPR gRNA sequence
gtattaaaagttcagtgaac

SEQ ID NO: 597022 - DNA, 20 bp, Artificial
  CRISPR gRNA sequence
tattaaaagttcagtgaaca

SEQ ID NO: 597023 - DNA, 20 bp, Artificial
  CRISPR gRNA sequence
aaaagttcagtgaacaggga

SEQ ID NO: 597024 - DNA, 20 bp, Artificial
  CRISPR gRNA sequence
ttcagtgaacagggaaagaa

SEQ ID NO: 597025 - DNA, 20 bp, Artificial
  CRISPR gRNA sequence
cagtgaacagggaaagaata

SEQ ID NO: 597026 - DNA, 20 bp, Artificial
  CRISPR gRNA sequence
tgaacagggaaagaatagag

SEQ ID NO: 597027 - DNA, 20 bp, Artificial
  CRISPR gRNA sequence
aacagggaaagaatagagaa

SEQ ID NO: 597028 - DNA, 20 bp, Artificial
  CRISPR gRNA sequence
acagggaaagaatagagaag

SEQ ID NO: 597029 - DNA, 20 bp, Artificial
  CRISPR gRNA sequence
gggaaagaatagagaagagg

SEQ ID NO: 597030 - DNA, 20 bp, Artificial
  CRISPR gRNA sequence
aagaatagagaagaggaagt

SEQ ID NO: 597031 - DNA, 20 bp, Artificial
  CRISPR gRNA sequence
gaatagagaagaggaagtca

SEQ ID NO: 597032 - DNA, 20 bp, Artificial
  CRISPR gRNA sequence
agagaagaggaagtcagaga

SEQ ID NO: 597033 - DNA, 20 bp, Artificial
  CRISPR gRNA sequence
agaagaggaagtcagagatg

SEQ ID NO: 597034 - DNA, 20 bp, Artificial
  CRISPR gRNA sequence
gaagaggaagtcagagatgg

SEQ ID NO: 597035 - DNA, 20 bp, Artificial
  CRISPR gRNA sequence
gaggaagtcagagatggagg

SEQ ID NO: 597036 - DNA, 20 bp, Artificial
  CRISPR gRNA sequence
aggaagtcagagatggaggc

SEQ ID NO: 597037 - DNA, 20 bp, Artificial
  CRISPR gRNA sequence
ggaagtcagagatggaggca

SEQ ID NO: 597038 - DNA, 20 bp, Artificial
  CRISPR gRNA sequence
cagagatggaggcagggcca

SEQ ID NO: 597039 - DNA, 20 bp, Artificial
  CRISPR gRNA sequence
ggaggcagggccacagcctt

SEQ ID NO: 597040 - DNA, 20 bp, Artificial
  CRISPR gRNA sequence
gaggcagggccacagccttt

SEQ ID NO: 597041 - DNA, 20 bp, Artificial
  CRISPR gRNA sequence
ccacagcctttaggacctta

SEQ ID NO: 597042 - DNA, 20 bp, Artificial
  CRISPR gRNA sequence
ctttaggaccttacagactt

SEQ ID NO: 597043 - DNA, 20 bp, Artificial
  CRISPR gRNA sequence
aggaccttacagactttgga

SEQ ID NO: 597044 - DNA, 20 bp, Artificial
  CRISPR gRNA sequence
ggaccttacagactttggaa

SEQ ID NO: 597045 - DNA, 20 bp, Artificial
  CRISPR gRNA sequence
cagactttggaaaggaattt

SEQ ID NO: 597046 - DNA, 20 bp, Artificial
  CRISPR gRNA sequence
aaggaattttagttgtattc

SEQ ID NO: 597047 - DNA, 20 bp, Artificial
  CRISPR gRNA sequence
ttttagttgtattctagttt

SEQ ID NO: 597048 - DNA, 20 bp, Artificial
  CRISPR gRNA sequence
tagttgtattctagtttcag

SEQ ID NO: 597049 - DNA, 20 bp, Artificial
  CRISPR gRNA sequence
tgtattctagtttcagtgga

SEQ ID NO: 597050 - DNA, 20 bp, Artificial
  CRISPR gRNA sequence
gtggaaagcttttgtgttta

SEQ ID NO: 597051 - DNA, 20 bp, Artificial
  CRISPR gRNA sequence
tgaattgttatgatctgatt

SEQ ID NO: 597052 - DNA, 20 bp, Artificial
  CRISPR gRNA sequence
gaattgttatgatctgattt

SEQ ID NO: 597053 - DNA, 20 bp, Artificial
  CRISPR gRNA sequence
ttatgatctgatttgggttt

SEQ ID NO: 597054 - DNA, 20 bp, Artificial
  CRISPR gRNA sequence
gatctgatttgggttttaga

SEQ ID NO: 597055 - DNA, 20 bp, Artificial
  CRISPR gRNA sequence
tgatttgggttttagaaagt

SEQ ID NO: 597056 - DNA, 20 bp, Artificial
  CRISPR gRNA sequence
gatttgggttttagaaagtc

SEQ ID NO: 597057 - DNA, 20 bp, Artificial
  CRISPR gRNA sequence
gtcaggctctgtctattgtg

SEQ ID NO: 597058 - DNA, 20 bp, Artificial
  CRISPR gRNA sequence
attgtgtggaaaacaaacta

SEQ ID NO: 597059 - DNA, 20 bp, Artificial
  CRISPR gRNA sequence
tgtgtggaaaacaaactaca

SEQ ID NO: 597060 - DNA, 20 bp, Artificial
  CRISPR gRNA sequence
gtggaaaacaaactacagag

SEQ ID NO: 597061 - DNA, 20 bp, Artificial
  CRISPR gRNA sequence
aaaacaaactacagagaagc

SEQ ID NO: 597062 - DNA, 20 bp, Artificial
  CRISPR gRNA sequence
aaactacagagaagcaagaa

SEQ ID NO: 597063 - DNA, 20 bp, Artificial
  CRISPR gRNA sequence
ctacagagaagcaagaatgg

SEQ ID NO: 597064 - DNA, 20 bp, Artificial
  CRISPR gRNA sequence
cagagaagcaagaatggaag

SEQ ID NO: 597065 - DNA, 20 bp, Artificial
  CRISPR gRNA sequence
agagaagcaagaatggaagc

SEQ ID NO: 597066 - DNA, 20 bp, Artificial
  CRISPR gRNA sequence
gaagcaagaatggaagcagg

SEQ ID NO: 597067 - DNA, 20 bp, Artificial
  CRISPR gRNA sequence
aagaatggaagcaggaagac

SEQ ID NO: 597068 - DNA, 20 bp, Artificial
  CRISPR gRNA sequence
gttaaactgttgcaatattt

SEQ ID NO: 597069 - DNA, 20 bp, Artificial
  CRISPR gRNA sequence
ttaaactgttgcaatatttt

SEQ ID NO: 597070 - DNA, 20 bp, Artificial
  CRISPR gRNA sequence
tgttgcaatattttaggctt

SEQ ID NO: 597071 - DNA, 20 bp, Artificial
  CRISPR gRNA sequence
gttgcaatattttaggctta

SEQ ID NO: 597072 - DNA, 20 bp, Artificial
  CRISPR gRNA sequence
atattttaggcttaaggtac

SEQ ID NO: 597073 - DNA, 20 bp, Artificial
  CRISPR gRNA sequence
tattttaggcttaaggtact

SEQ ID NO: 597074 - DNA, 20 bp, Artificial
  CRISPR gRNA sequence
aaggtactaggaaatgatga

SEQ ID NO: 597075 - DNA, 20 bp, Artificial
  CRISPR gRNA sequence
taggaaatgatgatagacta

SEQ ID NO: 597076 - DNA, 20 bp, Artificial
  CRISPR gRNA sequence
atgatgatagactaaagtta

SEQ ID NO: 597077 - DNA, 20 bp, Artificial
  CRISPR gRNA sequence
atgatagactaaagttacag

SEQ ID NO: 597078 - DNA, 20 bp, Artificial
  CRISPR gRNA sequence
atagactaaagttacagtag

SEQ ID NO: 597079 - DNA, 20 bp, Artificial
  CRISPR gRNA sequence
tagactaaagttacagtagc

SEQ ID NO: 597080 - DNA, 20 bp, Artificial
  CRISPR gRNA sequence
taaagttacagtagcgggcc

SEQ ID NO: 597081 - DNA, 20 bp, Artificial
  CRISPR gRNA sequence
gttacagtagcgggcctggt

SEQ ID NO: 597082 - DNA, 20 bp, Artificial
  CRISPR gRNA sequence
tggtgagaattgtttaaatt

SEQ ID NO: 597083 - DNA, 20 bp, Artificial
  CRISPR gRNA sequence
ggtgagaattgtttaaattc

SEQ ID NO: 597084 - DNA, 20 bp, Artificial
  CRISPR gRNA sequence
tttaaattcaggatgtattt

SEQ ID NO: 597085 - DNA, 20 bp, Artificial
  CRISPR gRNA sequence
aaattcaggatgtattttag

SEQ ID NO: 597086 - DNA, 20 bp, Artificial
  CRISPR gRNA sequence
ttcaggatgtattttagaag

SEQ ID NO: 597087 - DNA, 20 bp, Artificial
  CRISPR gRNA sequence
caggatgtattttagaagca

SEQ ID NO: 597088 - DNA, 20 bp, Artificial
  CRISPR gRNA sequence
tgtattttagaagcagagcc

SEQ ID NO: 597089 - DNA, 20 bp, Artificial
  CRISPR gRNA sequence
gtattttagaagcagagcca

SEQ ID NO: 597090 - DNA, 20 bp, Artificial
  CRISPR gRNA sequence
gcagagccaaggatttctga

SEQ ID NO: 597091 - DNA, 20 bp, Artificial
  CRISPR gRNA sequence
gccaaggatttctgatagac

SEQ ID NO: 597092 - DNA, 20 bp, Artificial
  CRISPR gRNA sequence
gatttctgatagactggatg

SEQ ID NO: 597093 - DNA, 20 bp, Artificial
  CRISPR gRNA sequence
atttctgatagactggatgt

SEQ ID NO: 597094 - DNA, 20 bp, Artificial
  CRISPR gRNA sequence
ctggatgtgggatttccttt

SEQ ID NO: 597095 - DNA, 20 bp, Artificial
  CRISPR gRNA sequence
tggatgtgggatttcctttg

SEQ ID NO: 597096 - DNA, 20 bp, Artificial
  CRISPR gRNA sequence
tgtgggatttcctttgagga

SEQ ID NO: 597097 - DNA, 20 bp, Artificial
  CRISPR gRNA sequence
atttcctttgaggaaagaaa

SEQ ID NO: 597098 - DNA, 20 bp, Artificial
  CRISPR gRNA sequence
tttgaggaaagaaacagtgc

SEQ ID NO: 597099 - DNA, 20 bp, Artificial
  CRISPR gRNA sequence
gaaagaaacagtgctagatg

SEQ ID NO: 597100 - DNA, 20 bp, Artificial
  CRISPR gRNA sequence
aagaaacagtgctagatgca

SEQ ID NO: 597101 - DNA, 20 bp, Artificial
  CRISPR gRNA sequence
agtgctagatgcagagttga

SEQ ID NO: 597102 - DNA, 20 bp, Artificial
  CRISPR gRNA sequence
tgcagagttgaaagtcatga

SEQ ID NO: 597103 - DNA, 20 bp, Artificial
  CRISPR gRNA sequence
gaaagtcatgaaagcatcta

SEQ ID NO: 597104 - DNA, 20 bp, Artificial
  CRISPR gRNA sequence
gaaagcatctacagtatcta

SEQ ID NO: 597105 - DNA, 20 bp, Artificial
  CRISPR gRNA sequence
agtatctaaagaaataaact

SEQ ID NO: 597106 - DNA, 20 bp, Artificial
  CRISPR gRNA sequence
tctaaagaaataaactgaga

SEQ ID NO: 597107 - DNA, 20 bp, Artificial
  CRISPR gRNA sequence
taaagaaataaactgagaaa

SEQ ID NO: 597108 - DNA, 20 bp, Artificial
  CRISPR gRNA sequence
aagaaataaactgagaaaga

SEQ ID NO: 597109 - DNA, 20 bp, Artificial
  CRISPR gRNA sequence
aaataaactgagaaagagag

SEQ ID NO: 597110 - DNA, 20 bp, Artificial
  CRISPR gRNA sequence
ataaactgagaaagagagaa

SEQ ID NO: 597111 - DNA, 20 bp, Artificial
  CRISPR gRNA sequence
taaactgagaaagagagaag

SEQ ID NO: 597112 - DNA, 20 bp, Artificial
  CRISPR gRNA sequence
gagaagaggacctgtacata

SEQ ID NO: 597113 - DNA, 20 bp, Artificial
  CRISPR gRNA sequence
gacctgtacataaagatata

SEQ ID NO: 597114 - DNA, 20 bp, Artificial
  CRISPR gRNA sequence
acctgtacataaagatatac

SEQ ID NO: 597115 - DNA, 20 bp, Artificial
  CRISPR gRNA sequence
aaagatatacaggctgcaaa

SEQ ID NO: 597116 - DNA, 20 bp, Artificial
  CRISPR gRNA sequence
atacaggctgcaaatagatg

SEQ ID NO: 597117 - DNA, 20 bp, Artificial
  CRISPR gRNA sequence
tacaggctgcaaatagatga

SEQ ID NO: 597118 - DNA, 20 bp, Artificial
  CRISPR gRNA sequence
ggctgcaaatagatgaaggt

SEQ ID NO: 597119 - DNA, 20 bp, Artificial
  CRISPR gRNA sequence
aaatagatgaaggtgagtac

SEQ ID NO: 597120 - DNA, 20 bp, Artificial
  CRISPR gRNA sequence
ccagatgttttctgctcact

SEQ ID NO: 597121 - DNA, 20 bp, Artificial
  CRISPR gRNA sequence
ttttctgctcactaagtaat

SEQ ID NO: 597122 - DNA, 20 bp, Artificial
  CRISPR gRNA sequence
tctgctcactaagtaattgg

SEQ ID NO: 597123 - DNA, 20 bp, Artificial
  CRISPR gRNA sequence
tgattgtaacacttctaatg

SEQ ID NO: 597124 - DNA, 20 bp, Artificial
  CRISPR gRNA sequence
gattgtaacacttctaatga

SEQ ID NO: 597125 - DNA, 20 bp, Artificial
  CRISPR gRNA sequence
ccttctctatttcttctctt

SEQ ID NO: 597126 - DNA, 20 bp, Artificial
  CRISPR gRNA sequence
ctctatttcttctctttaga

SEQ ID NO: 597127 - DNA, 20 bp, Artificial
  CRISPR gRNA sequence
tctatttcttctctttagat

SEQ ID NO: 597128 - DNA, 20 bp, Artificial
  CRISPR gRNA sequence
ctatttcttctctttagata

SEQ ID NO: 597129 - DNA, 20 bp, Artificial
  CRISPR gRNA sequence
ttctctttagatagggacac

SEQ ID NO: 597130 - DNA, 20 bp, Artificial
  CRISPR gRNA sequence
agatcttgttgttctatcaa

SEQ ID NO: 597131 - DNA, 20 bp, Artificial
  CRISPR gRNA sequence
gttgttctatcaaaagcttc

SEQ ID NO: 597132 - DNA, 20 bp, Artificial
  CRISPR gRNA sequence
gttttctgatgtcctctaac

SEQ ID NO: 597133 - DNA, 20 bp, Artificial
  CRISPR gRNA sequence
gatcatttcctttatcccaa

SEQ ID NO: 597134 - DNA, 20 bp, Artificial
  CRISPR gRNA sequence
atttcctttatcccaatagc

SEQ ID NO: 597135 - DNA, 20 bp, Artificial
  CRISPR gRNA sequence
tatcccaatagccagtaatc

SEQ ID NO: 597136 - DNA, 20 bp, Artificial
  CRISPR gRNA sequence
atctagaaaataaaaacact

SEQ ID NO: 597137 - DNA, 20 bp, Artificial
  CRISPR gRNA sequence
ataaaaacacttggtaaaaa

SEQ ID NO: 597138 - DNA, 20 bp, Artificial
  CRISPR gRNA sequence
acttggtaaaaacagaaact

SEQ ID NO: 597139 - DNA, 20 bp, Artificial
  CRISPR gRNA sequence
agaaacaaaaactaatcact

SEQ ID NO: 597140 - DNA, 20 bp, Artificial
  CRISPR gRNA sequence
acaaaaactaatcactaagc

SEQ ID NO: 597141 - DNA, 20 bp, Artificial
  CRISPR gRNA sequence
caaaaactaatcactaagct

SEQ ID NO: 597142 - DNA, 20 bp, Artificial
  CRISPR gRNA sequence
aaaaactaatcactaagcta

SEQ ID NO: 597143 - DNA, 20 bp, Artificial
  CRISPR gRNA sequence
cactaagctagggtctctca

SEQ ID NO: 597144 - DNA, 20 bp, Artificial
  CRISPR gRNA sequence
actaagctagggtctctcac

SEQ ID NO: 597145 - DNA, 20 bp, Artificial
  CRISPR gRNA sequence
aagctagggtctctcacagg

SEQ ID NO: 597146 - DNA, 20 bp, Artificial
  CRISPR gRNA sequence
agctagggtctctcacaggc

SEQ ID NO: 597147 - DNA, 20 bp, Artificial
  CRISPR gRNA sequence
agggtctctcacaggcagga

SEQ ID NO: 597148 - DNA, 20 bp, Artificial
  CRISPR gRNA sequence
gtctctcacaggcaggaaag

SEQ ID NO: 597149 - DNA, 20 bp, Artificial
  CRISPR gRNA sequence
ggaaagaagtcaaaatacca

SEQ ID NO: 597150 - DNA, 20 bp, Artificial
  CRISPR gRNA sequence
aagtcaaaataccaaagcat

SEQ ID NO: 597151 - DNA, 20 bp, Artificial
  CRISPR gRNA sequence
gtcaaaataccaaagcatga

SEQ ID NO: 597152 - DNA, 20 bp, Artificial
  CRISPR gRNA sequence
accaaagcatgagagcattt

SEQ ID NO: 597153 - DNA, 20 bp, Artificial
  CRISPR gRNA sequence
caaagcatgagagcatttta

SEQ ID NO: 597154 - DNA, 20 bp, Artificial
  CRISPR gRNA sequence
aaactgacaaacacaattaa

SEQ ID NO: 597155 - DNA, 20 bp, Artificial
  CRISPR gRNA sequence
caaacacaattaatagacat

SEQ ID NO: 597156 - DNA, 20 bp, Artificial
  CRISPR gRNA sequence
ttaatagacatcagtcatca

SEQ ID NO: 597157 - DNA, 20 bp, Artificial
  CRISPR gRNA sequence
tcatcaaagctgtgcctacc

SEQ ID NO: 597158 - DNA, 20 bp, Artificial
  CRISPR gRNA sequence
atcaaagctgtgcctaccta

SEQ ID NO: 597159 - DNA, 20 bp, Artificial
  CRISPR gRNA sequence
ctacctagagacatgatcct

SEQ ID NO: 597160 - DNA, 20 bp, Artificial
  CRISPR gRNA sequence
gagacatgatcctgagaaca

SEQ ID NO: 597161 - DNA, 20 bp, Artificial
  CRISPR gRNA sequence
catgatcctgagaacacagt

SEQ ID NO: 597162 - DNA, 20 bp, Artificial
  CRISPR gRNA sequence
ccgtaaacttcacacttgaa

SEQ ID NO: 597163 - DNA, 20 bp, Artificial
  CRISPR gRNA sequence
cgtaaacttcacacttgaaa

SEQ ID NO: 597164 - DNA, 20 bp, Artificial
  CRISPR gRNA sequence
aaacttcacacttgaaaagg

SEQ ID NO: 597165 - DNA, 20 bp, Artificial
  CRISPR gRNA sequence
acacttgaaaaggaagcatt

SEQ ID NO: 597166 - DNA, 20 bp, Artificial
  CRISPR gRNA sequence
cacttgaaaaggaagcattt

SEQ ID NO: 597167 - DNA, 20 bp, Artificial
  CRISPR gRNA sequence
acttgaaaaggaagcatttg

SEQ ID NO: 597168 - DNA, 20 bp, Artificial
  CRISPR gRNA sequence
cttgaaaaggaagcatttgg

SEQ ID NO: 597169 - DNA, 20 bp, Artificial
  CRISPR gRNA sequence
tgaaaaggaagcatttgggg

SEQ ID NO: 597170 - DNA, 20 bp, Artificial
  CRISPR gRNA sequence
aagcatttgggggagcactg

SEQ ID NO: 597171 - DNA, 20 bp, Artificial
  CRISPR gRNA sequence
tgaagttccccaccaacctt

SEQ ID NO: 597172 - DNA, 20 bp, Artificial
  CRISPR gRNA sequence
accaaccttaagacccaccc

SEQ ID NO: 597173 - DNA, 20 bp, Artificial
  CRISPR gRNA sequence
aaccttaagacccacccaag

SEQ ID NO: 597174 - DNA, 20 bp, Artificial
  CRISPR gRNA sequence
accttaagacccacccaagc

SEQ ID NO: 597175 - DNA, 20 bp, Artificial
  CRISPR gRNA sequence
ccttaagacccacccaagca

SEQ ID NO: 597176 - DNA, 20 bp, Artificial
  CRISPR gRNA sequence
gtgatttaaaataatcttac

SEQ ID NO: 597177 - DNA, 20 bp, Artificial
  CRISPR gRNA sequence
atttaaaataatcttactag

SEQ ID NO: 597178 - DNA, 20 bp, Artificial
  CRISPR gRNA sequence
ataatcttactagtagctga

SEQ ID NO: 597179 - DNA, 20 bp, Artificial
  CRISPR gRNA sequence
tagtagctgaaagtatttta

SEQ ID NO: 597180 - DNA, 20 bp, Artificial
  CRISPR gRNA sequence
aagtattttacagtaattca

SEQ ID NO: 597181 - DNA, 20 bp, Artificial
  CRISPR gRNA sequence
agtattttacagtaattcaa

SEQ ID NO: 597182 - DNA, 20 bp, Artificial
  CRISPR gRNA sequence
caaaggaaaaaaatgtcaaa

SEQ ID NO: 597183 - DNA, 20 bp, Artificial
  CRISPR gRNA sequence
aaatgtcaaacagaaaatta

SEQ ID NO: 597184 - DNA, 20 bp, Artificial
  CRISPR gRNA sequence
tacagattgattaccacaaa

SEQ ID NO: 597185 - DNA, 20 bp, Artificial
  CRISPR gRNA sequence
ttaccacaaacagttctttt

SEQ ID NO: 597186 - DNA, 20 bp, Artificial
  CRISPR gRNA sequence
aaattgctactaaaaatata

SEQ ID NO: 597187 - DNA, 20 bp, Artificial
  CRISPR gRNA sequence
tactaaaaatatatggatac

SEQ ID NO: 597188 - DNA, 20 bp, Artificial
  CRISPR gRNA sequence
tggatacaagcttgaatttt

SEQ ID NO: 597189 - DNA, 20 bp, Artificial
  CRISPR gRNA sequence
acaagcttgaattttcagtt

SEQ ID NO: 597190 - DNA, 20 bp, Artificial
  CRISPR gRNA sequence
gcttgaattttcagttcagt

SEQ ID NO: 597191 - DNA, 20 bp, Artificial
  CRISPR gRNA sequence
cttgaattttcagttcagtt

SEQ ID NO: 597192 - DNA, 20 bp, Artificial
  CRISPR gRNA sequence
ttttcagttcagttaggatt

SEQ ID NO: 597193 - DNA, 20 bp, Artificial
  CRISPR gRNA sequence
cattgctttcctatatatgc

SEQ ID NO: 597194 - DNA, 20 bp, Artificial
  CRISPR gRNA sequence
gctttcctatatatgccagt

SEQ ID NO: 597195 - DNA, 20 bp, Artificial
  CRISPR gRNA sequence
tatatgccagttagatatta

SEQ ID NO: 597196 - DNA, 20 bp, Artificial
  CRISPR gRNA sequence
atatgccagttagatattat

SEQ ID NO: 597197 - DNA, 20 bp, Artificial
  CRISPR gRNA sequence
gatattatgggcttaattca

SEQ ID NO: 597198 - DNA, 20 bp, Artificial
  CRISPR gRNA sequence
aattcacagaaccatacgcc

SEQ ID NO: 597199 - DNA, 20 bp, Artificial
  CRISPR gRNA sequence
ccaagcaaattatatttcat

SEQ ID NO: 597200 - DNA, 20 bp, Artificial
  CRISPR gRNA sequence
aaaatttttttgtaacgtta

SEQ ID NO: 597201 - DNA, 20 bp, Artificial
  CRISPR gRNA sequence
ttttgtaacgttaaagaaaa

SEQ ID NO: 597202 - DNA, 20 bp, Artificial
  CRISPR gRNA sequence
aacgttaaagaaaacagtga

SEQ ID NO: 597203 - DNA, 20 bp, Artificial
  CRISPR gRNA sequence
cgttaaagaaaacagtgaaa

SEQ ID NO: 597204 - DNA, 20 bp, Artificial
  CRISPR gRNA sequence
cagtgaaagagatacaataa

SEQ ID NO: 597205 - DNA, 20 bp, Artificial
  CRISPR gRNA sequence
acaataaaagattacttctt

SEQ ID NO: 597206 - DNA, 20 bp, Artificial
  CRISPR gRNA sequence
ataaaagattacttcttaag

SEQ ID NO: 597207 - DNA, 20 bp, Artificial
  CRISPR gRNA sequence
gatctgttacaatgtaaaca

SEQ ID NO: 597208 - DNA, 20 bp, Artificial
  CRISPR gRNA sequence
tctgttacaatgtaaacaaa

SEQ ID NO: 597209 - DNA, 20 bp, Artificial
  CRISPR gRNA sequence
atgtaaacaaagagaataca

SEQ ID NO: 597210 - DNA, 20 bp, Artificial
  CRISPR gRNA sequence
gagaatacatggtattcttc

SEQ ID NO: 597211 - DNA, 20 bp, Artificial
  CRISPR gRNA sequence
atatactgccttatttcttg

SEQ ID NO: 597212 - DNA, 20 bp, Artificial
  CRISPR gRNA sequence
tgccttatttcttgcagcta

SEQ ID NO: 597213 - DNA, 20 bp, Artificial
  CRISPR gRNA sequence
gccttatttcttgcagctat

SEQ ID NO: 597214 - DNA, 20 bp, Artificial
  CRISPR gRNA sequence
caaacaaatgcttgtaaaac

SEQ ID NO: 597215 - DNA, 20 bp, Artificial
  CRISPR gRNA sequence
tgctcatgtaacaaattgct

SEQ ID NO: 597216 - DNA, 20 bp, Artificial
  CRISPR gRNA sequence
caaattgcttggacatattt

SEQ ID NO: 597217 - DNA, 20 bp, Artificial
  CRISPR gRNA sequence
catatttaagcaaatatttc

SEQ ID NO: 597218 - DNA, 20 bp, Artificial
  CRISPR gRNA sequence
tttaagcaaatatttctagt

SEQ ID NO: 597219 - DNA, 20 bp, Artificial
  CRISPR gRNA sequence
tttctagtaagaattcaact

SEQ ID NO: 597220 - DNA, 20 bp, Artificial
  CRISPR gRNA sequence
ttctagtaagaattcaactg

SEQ ID NO: 597221 - DNA, 20 bp, Artificial
  CRISPR gRNA sequence
tctagtaagaattcaactga

SEQ ID NO: 597222 - DNA, 20 bp, Artificial
  CRISPR gRNA sequence
ctagtaagaattcaactgag

SEQ ID NO: 597223 - DNA, 20 bp, Artificial
  CRISPR gRNA sequence
tagtaagaattcaactgagg

SEQ ID NO: 597224 - DNA, 20 bp, Artificial
  CRISPR gRNA sequence
ctgagggggaatgtaaatgt

SEQ ID NO: 597225 - DNA, 20 bp, Artificial
  CRISPR gRNA sequence
tgagggggaatgtaaatgtt

SEQ ID NO: 597226 - DNA, 20 bp, Artificial
  CRISPR gRNA sequence
tgtaaatgttgggataaaac

SEQ ID NO: 597227 - DNA, 20 bp, Artificial
  CRISPR gRNA sequence
gtaaatgttgggataaaact

SEQ ID NO: 597228 - DNA, 20 bp, Artificial
  CRISPR gRNA sequence
taaatgttgggataaaactg

SEQ ID NO: 597229 - DNA, 20 bp, Artificial
  CRISPR gRNA sequence
aaatgttgggataaaactgg

SEQ ID NO: 597230 - DNA, 20 bp, Artificial
  CRISPR gRNA sequence
tgggggaaatatcttttgta

SEQ ID NO: 597231 - DNA, 20 bp, Artificial
  CRISPR gRNA sequence
aagattgtgtatatgaaccc

SEQ ID NO: 597232 - DNA, 20 bp, Artificial
  CRISPR gRNA sequence
aagtactgttacaataattg

SEQ ID NO: 597233 - DNA, 20 bp, Artificial
  CRISPR gRNA sequence
ataattatcacaactcctct

SEQ ID NO: 597234 - DNA, 20 bp, Artificial
  CRISPR gRNA sequence
tcacaactcctctaagaaaa

SEQ ID NO: 597235 - DNA, 20 bp, Artificial
  CRISPR gRNA sequence
acaactcctctaagaaaatg

SEQ ID NO: 597236 - DNA, 20 bp, Artificial
  CRISPR gRNA sequence
caactcctctaagaaaatgg

SEQ ID NO: 597237 - DNA, 20 bp, Artificial
  CRISPR gRNA sequence
cctctaagaaaatggaggtc

SEQ ID NO: 597238 - DNA, 20 bp, Artificial
  CRISPR gRNA sequence
tggaggtctggctcacaatc

SEQ ID NO: 597239 - DNA, 20 bp, Artificial
  CRISPR gRNA sequence
ggctcacaatctggaatcaa

SEQ ID NO: 597240 - DNA, 20 bp, Artificial
  CRISPR gRNA sequence
aatcaacagaactgtcttaa

SEQ ID NO: 597241 - DNA, 20 bp, Artificial
  CRISPR gRNA sequence
agaactgtcttaacagtttt

SEQ ID NO: 597242 - DNA, 20 bp, Artificial
  CRISPR gRNA sequence
gaactgtcttaacagtttta

SEQ ID NO: 597243 - DNA, 20 bp, Artificial
  CRISPR gRNA sequence
aactgtcttaacagttttaa

SEQ ID NO: 597244 - DNA, 20 bp, Artificial
  CRISPR gRNA sequence
ctgtcttaacagttttaagg

SEQ ID NO: 597245 - DNA, 20 bp, Artificial
  CRISPR gRNA sequence
gtcttaacagttttaaggga

SEQ ID NO: 597246 - DNA, 20 bp, Artificial
  CRISPR gRNA sequence
agggagagccatttgattca

SEQ ID NO: 597247 - DNA, 20 bp, Artificial
  CRISPR gRNA sequence
gggagagccatttgattcat

SEQ ID NO: 597248 - DNA, 20 bp, Artificial
  CRISPR gRNA sequence
taggattctaaatgatcttt

SEQ ID NO: 597249 - DNA, 20 bp, Artificial
  CRISPR gRNA sequence
tctaaatgatctttgagatt

SEQ ID NO: 597250 - DNA, 20 bp, Artificial
  CRISPR gRNA sequence
gatctttgagatttagctac

SEQ ID NO: 597251 - DNA, 20 bp, Artificial
  CRISPR gRNA sequence
gagatttagctactggatta

SEQ ID NO: 597252 - DNA, 20 bp, Artificial
  CRISPR gRNA sequence
aagtttattaaaaacaacat

SEQ ID NO: 597253 - DNA, 20 bp, Artificial
  CRISPR gRNA sequence
atgactgatttatgacttga

SEQ ID NO: 597254 - DNA, 20 bp, Artificial
  CRISPR gRNA sequence
gatttatgacttgaaagatt

SEQ ID NO: 597255 - DNA, 20 bp, Artificial
  CRISPR gRNA sequence
cttgaaagatttggatcata

SEQ ID NO: 597256 - DNA, 20 bp, Artificial
  CRISPR gRNA sequence
aagatttggatcataaagat

SEQ ID NO: 597257 - DNA, 20 bp, Artificial
  CRISPR gRNA sequence
ttcattactcaaaataataa

SEQ ID NO: 597258 - DNA, 20 bp, Artificial
  CRISPR gRNA sequence
aacttttaaattgtatcttt

SEQ ID NO: 597259 - DNA, 20 bp, Artificial
  CRISPR gRNA sequence
cctgtttgtatatacatttc

SEQ ID NO: 597260 - DNA, 20 bp, Artificial
  CRISPR gRNA sequence
atatacatttcaagattctc

SEQ ID NO: 597261 - DNA, 20 bp, Artificial
  CRISPR gRNA sequence
tatacatttcaagattctct

SEQ ID NO: 597262 - DNA, 20 bp, Artificial
  CRISPR gRNA sequence
gattctctaggtatccctta

SEQ ID NO: 597263 - DNA, 20 bp, Artificial
  CRISPR gRNA sequence
taaaatccatctctaaattc

SEQ ID NO: 597264 - DNA, 20 bp, Artificial
  CRISPR gRNA sequence
aaatccatctctaaattcta

SEQ ID NO: 597265 - DNA, 20 bp, Artificial
  CRISPR gRNA sequence
tctaaattctagagtgacac

SEQ ID NO: 597266 - DNA, 20 bp, Artificial
  CRISPR gRNA sequence
ctagagtgacactggctgaa

SEQ ID NO: 597267 - DNA, 20 bp, Artificial
  CRISPR gRNA sequence
ctgaaaagatgtatattttg

SEQ ID NO: 597268 - DNA, 20 bp, Artificial
  CRISPR gRNA sequence
gtatattttgaagccatgtg

SEQ ID NO: 597269 - DNA, 20 bp, Artificial
  CRISPR gRNA sequence
gaagccatgtgaagcttttg

SEQ ID NO: 597270 - DNA, 20 bp, Artificial
  CRISPR gRNA sequence
gcttttgaagtcatgtactt

SEQ ID NO: 597271 - DNA, 20 bp, Artificial
  CRISPR gRNA sequence
tttgaagtcatgtacttgag

SEQ ID NO: 597272 - DNA, 20 bp, Artificial
  CRISPR gRNA sequence
tcatgtacttgagaagcttt

SEQ ID NO: 597273 - DNA, 20 bp, Artificial
  CRISPR gRNA sequence
gagaagcttttagtccaatg

SEQ ID NO: 597274 - DNA, 20 bp, Artificial
  CRISPR gRNA sequence
caatgtagtattgtttgaat

SEQ ID NO: 597275 - DNA, 20 bp, Artificial
  CRISPR gRNA sequence
gtattgtttgaatgagtgtt

SEQ ID NO: 597276 - DNA, 20 bp, Artificial
  CRISPR gRNA sequence
gtttgaatgagtgttgagaa

SEQ ID NO: 597277 - DNA, 20 bp, Artificial
  CRISPR gRNA sequence
ttgaatgagtgttgagaaaa

SEQ ID NO: 597278 - DNA, 20 bp, Artificial
  CRISPR gRNA sequence
agtgttgagaaaagagttaa

SEQ ID NO: 597279 - DNA, 20 bp, Artificial
  CRISPR gRNA sequence
aaaagagttaaaagttgtct

SEQ ID NO: 597280 - DNA, 20 bp, Artificial
  CRISPR gRNA sequence
gagttaaaagttgtctaagc

SEQ ID NO: 597281 - DNA, 20 bp, Artificial
  CRISPR gRNA sequence
gttaaaagttgtctaagcta

SEQ ID NO: 597282 - DNA, 20 bp, Artificial
  CRISPR gRNA sequence
gtctaagctagagccatcgt

SEQ ID NO: 597283 - DNA, 20 bp, Artificial
  CRISPR gRNA sequence
ctaagctagagccatcgtta

SEQ ID NO: 597284 - DNA, 20 bp, Artificial
  CRISPR gRNA sequence
tttattttaaaactgccttc

SEQ ID NO: 597285 - DNA, 20 bp, Artificial
  CRISPR gRNA sequence
ttattttaaaactgccttct

SEQ ID NO: 597286 - DNA, 20 bp, Artificial
  CRISPR gRNA sequence
tttaaaactgccttctgggt

SEQ ID NO: 597287 - DNA, 20 bp, Artificial
  CRISPR gRNA sequence
aactgccttctgggtaagac

SEQ ID NO: 597288 - DNA, 20 bp, Artificial
  CRISPR gRNA sequence
gccttctgggtaagactagc

SEQ ID NO: 597289 - DNA, 20 bp, Artificial
  CRISPR gRNA sequence
ccttctgggtaagactagct

SEQ ID NO: 597290 - DNA, 20 bp, Artificial
  CRISPR gRNA sequence
gtaagactagctgggtgatt

SEQ ID NO: 597291 - DNA, 20 bp, Artificial
  CRISPR gRNA sequence
tagctgggtgatttggtctc

SEQ ID NO: 597292 - DNA, 20 bp, Artificial
  CRISPR gRNA sequence
ggtctctggtatcctcaaca

SEQ ID NO: 597293 - DNA, 20 bp, Artificial
  CRISPR gRNA sequence
tctggtatcctcaacacaga

SEQ ID NO: 597294 - DNA, 20 bp, Artificial
  CRISPR gRNA sequence
caacacagatagcataactg

SEQ ID NO: 597295 - DNA, 20 bp, Artificial
  CRISPR gRNA sequence
agcataactgaagtaacctg

SEQ ID NO: 597296 - DNA, 20 bp, Artificial
  CRISPR gRNA sequence
gcataactgaagtaacctgt

SEQ ID NO: 597297 - DNA, 20 bp, Artificial
  CRISPR gRNA sequence
cataactgaagtaacctgtg

SEQ ID NO: 597298 - DNA, 20 bp, Artificial
  CRISPR gRNA sequence
ttaatctgaataataatgtc

SEQ ID NO: 597299 - DNA, 20 bp, Artificial
  CRISPR gRNA sequence
taataatgtctggaataact

SEQ ID NO: 597300 - DNA, 20 bp, Artificial
  CRISPR gRNA sequence
ataatgtctggaataactga

SEQ ID NO: 597301 - DNA, 20 bp, Artificial
  CRISPR gRNA sequence
agagacgtctctaatgcatt

SEQ ID NO: 597302 - DNA, 20 bp, Artificial
  CRISPR gRNA sequence
ctctaatgcattcagtcaat

SEQ ID NO: 597303 - DNA, 20 bp, Artificial
  CRISPR gRNA sequence
tcaatcagataaccaacaca

SEQ ID NO: 597304 - DNA, 20 bp, Artificial
  CRISPR gRNA sequence
caatcagataaccaacacat

SEQ ID NO: 597305 - DNA, 20 bp, Artificial
  CRISPR gRNA sequence
aatcagataaccaacacata

SEQ ID NO: 597306 - DNA, 20 bp, Artificial
  CRISPR gRNA sequence
acaatatattttaaaataaa

SEQ ID NO: 597307 - DNA, 20 bp, Artificial
  CRISPR gRNA sequence
aacagcaaatcttcttaatt

SEQ ID NO: 597308 - DNA, 20 bp, Artificial
  CRISPR gRNA sequence
cagcaaatcttcttaattga

SEQ ID NO: 597309 - DNA, 20 bp, Artificial
  CRISPR gRNA sequence
attgagagactactatgtat

SEQ ID NO: 597310 - DNA, 20 bp, Artificial
  CRISPR gRNA sequence
ttgagagactactatgtata

SEQ ID NO: 597311 - DNA, 20 bp, Artificial
  CRISPR gRNA sequence
ctatgtataaggcactgtgt

SEQ ID NO: 597312 - DNA, 20 bp, Artificial
  CRISPR gRNA sequence
aggcactgtgttagcttctg

SEQ ID NO: 597313 - DNA, 20 bp, Artificial
  CRISPR gRNA sequence
ctgtgttagcttctgtggaa

SEQ ID NO: 597314 - DNA, 20 bp, Artificial
  CRISPR gRNA sequence
aattatttcttaaaatgtat

SEQ ID NO: 597315 - DNA, 20 bp, Artificial
  CRISPR gRNA sequence
attatttcttaaaatgtatt

SEQ ID NO: 597316 - DNA, 20 bp, Artificial
  CRISPR gRNA sequence
tgtattaggccctgtgataa

SEQ ID NO: 597317 - DNA, 20 bp, Artificial
  CRISPR gRNA sequence
cctgtgataaaagctttact

SEQ ID NO: 597318 - DNA, 20 bp, Artificial
  CRISPR gRNA sequence
ttaaccctcacaacaactcc

SEQ ID NO: 597319 - DNA, 20 bp, Artificial
  CRISPR gRNA sequence
aaccctcacaacaactccaa

SEQ ID NO: 597320 - DNA, 20 bp, Artificial
  CRISPR gRNA sequence
tcacaacaactccaagagac

SEQ ID NO: 597321 - DNA, 20 bp, Artificial
  CRISPR gRNA sequence
actttccctattttacaaat

SEQ ID NO: 597322 - DNA, 20 bp, Artificial
  CRISPR gRNA sequence
ctttccctattttacaaatg

SEQ ID NO: 597323 - DNA, 20 bp, Artificial
  CRISPR gRNA sequence
caaatgaggtaactaaaaca

SEQ ID NO: 597324 - DNA, 20 bp, Artificial
  CRISPR gRNA sequence
gaggtaactaaaacacagca

SEQ ID NO: 597325 - DNA, 20 bp, Artificial
  CRISPR gRNA sequence
aggtaactaaaacacagcat

SEQ ID NO: 597326 - DNA, 20 bp, Artificial
  CRISPR gRNA sequence
aactaaaacacagcatagga

SEQ ID NO: 597327 - DNA, 20 bp, Artificial
  CRISPR gRNA sequence
gcataggaaagatactatcc

SEQ ID NO: 597328 - DNA, 20 bp, Artificial
  CRISPR gRNA sequence
aggaaagatactatcccagt

SEQ ID NO: 597329 - DNA, 20 bp, Artificial
  CRISPR gRNA sequence
aagatactatcccagtcggt

SEQ ID NO: 597330 - DNA, 20 bp, Artificial
  CRISPR gRNA sequence
agatactatcccagtcggtt

SEQ ID NO: 597331 - DNA, 20 bp, Artificial
  CRISPR gRNA sequence
cccagtcggttaggtgctaa

SEQ ID NO: 597332 - DNA, 20 bp, Artificial
  CRISPR gRNA sequence
catattctgtctgctaccct

SEQ ID NO: 597333 - DNA, 20 bp, Artificial
  CRISPR gRNA sequence
atattctgtctgctaccctc

SEQ ID NO: 597334 - DNA, 20 bp, Artificial
  CRISPR gRNA sequence
tgtctgctaccctcaggctg

SEQ ID NO: 597335 - DNA, 20 bp, Artificial
  CRISPR gRNA sequence
tctgctaccctcaggctgca

SEQ ID NO: 597336 - DNA, 20 bp, Artificial
  CRISPR gRNA sequence
ctcaggctgcagagattaca

SEQ ID NO: 597337 - DNA, 20 bp, Artificial
  CRISPR gRNA sequence
aagtcattttccctgccctc

SEQ ID NO: 597338 - DNA, 20 bp, Artificial
  CRISPR gRNA sequence
agtcattttccctgccctca

SEQ ID NO: 597339 - DNA, 20 bp, Artificial
  CRISPR gRNA sequence
tcattttccctgccctcaag

SEQ ID NO: 597340 - DNA, 20 bp, Artificial
  CRISPR gRNA sequence
ccctgccctcaaggagtttc

SEQ ID NO: 597341 - DNA, 20 bp, Artificial
  CRISPR gRNA sequence
aaggagtttccagtcacaca

SEQ ID NO: 597342 - DNA, 20 bp, Artificial
  CRISPR gRNA sequence
aggagtttccagtcacacaa

SEQ ID NO: 597343 - DNA, 20 bp, Artificial
  CRISPR gRNA sequence
gagtttccagtcacacaaag

SEQ ID NO: 597344 - DNA, 20 bp, Artificial
  CRISPR gRNA sequence
tccagtcacacaaaggagat

SEQ ID NO: 597345 - DNA, 20 bp, Artificial
  CRISPR gRNA sequence
aaaggagataagatgtactc

SEQ ID NO: 597346 - DNA, 20 bp, Artificial
  CRISPR gRNA sequence
taagatgtactcaagaaatt

SEQ ID NO: 597347 - DNA, 20 bp, Artificial
  CRISPR gRNA sequence
gaaattaagcaatgataaaa

SEQ ID NO: 597348 - DNA, 20 bp, Artificial
  CRISPR gRNA sequence
aaattaagcaatgataaaac

SEQ ID NO: 597349 - DNA, 20 bp, Artificial
  CRISPR gRNA sequence
taagcaatgataaaacagga

SEQ ID NO: 597350 - DNA, 20 bp, Artificial
  CRISPR gRNA sequence
aagcaatgataaaacaggat

SEQ ID NO: 597351 - DNA, 20 bp, Artificial
  CRISPR gRNA sequence
gcaatgataaaacaggatag

SEQ ID NO: 597352 - DNA, 20 bp, Artificial
  CRISPR gRNA sequence
caatgataaaacaggatagg

SEQ ID NO: 597353 - DNA, 20 bp, Artificial
  CRISPR gRNA sequence
aaacaggataggaggtgata

SEQ ID NO: 597354 - DNA, 20 bp, Artificial
  CRISPR gRNA sequence
aacaggataggaggtgataa

SEQ ID NO: 597355 - DNA, 20 bp, Artificial
  CRISPR gRNA sequence
aggcatccaaaaaaaaaaaa

SEQ ID NO: 597356 - DNA, 20 bp, Artificial
  CRISPR gRNA sequence
aaaaaaaaaaaaagatcatt

SEQ ID NO: 597357 - DNA, 20 bp, Artificial
  CRISPR gRNA sequence
aaaaaaagatcatttggaat

SEQ ID NO: 597358 - DNA, 20 bp, Artificial
  CRISPR gRNA sequence
aaaaaagatcatttggaatt

SEQ ID NO: 597359 - DNA, 20 bp, Artificial
  CRISPR gRNA sequence
aaaaagatcatttggaatta

SEQ ID NO: 597360 - DNA, 20 bp, Artificial
  CRISPR gRNA sequence
ctgtcctgtgcctatgacaa

SEQ ID NO: 597361 - DNA, 20 bp, Artificial
  CRISPR gRNA sequence
atagtaactctgacccaaaa

SEQ ID NO: 597362 - DNA, 20 bp, Artificial
  CRISPR gRNA sequence
tagtaactctgacccaaaaa

SEQ ID NO: 597363 - DNA, 20 bp, Artificial
  CRISPR gRNA sequence
aaaaaaggtgaaacttcact

SEQ ID NO: 597364 - DNA, 20 bp, Artificial
  CRISPR gRNA sequence
aaaaaggtgaaacttcactc

SEQ ID NO: 597365 - DNA, 20 bp, Artificial
  CRISPR gRNA sequence
ttttctccttgattctacac

SEQ ID NO: 597366 - DNA, 20 bp, Artificial
  CRISPR gRNA sequence
ttctccttgattctacacaa

SEQ ID NO: 597367 - DNA, 20 bp, Artificial
  CRISPR gRNA sequence
ctccttgattctacacaaga

SEQ ID NO: 597368 - DNA, 20 bp, Artificial
  CRISPR gRNA sequence
ttctacacaagagagaaaaa

SEQ ID NO: 597369 - DNA, 20 bp, Artificial
  CRISPR gRNA sequence
agagaaaaaaagaacactgc

SEQ ID NO: 597370 - DNA, 20 bp, Artificial
  CRISPR gRNA sequence
gagaaaaaaagaacactgct

SEQ ID NO: 597371 - DNA, 20 bp, Artificial
  CRISPR gRNA sequence
agaaaaaaagaacactgctg

SEQ ID NO: 597372 - DNA, 20 bp, Artificial
  CRISPR gRNA sequence
actgctggggtatgtatatg

SEQ ID NO: 597373 - DNA, 20 bp, Artificial
  CRISPR gRNA sequence
gggtatgtatatgtggttct

SEQ ID NO: 597374 - DNA, 20 bp, Artificial
  CRISPR gRNA sequence
atatgtggttctgagaattc

SEQ ID NO: 597375 - DNA, 20 bp, Artificial
  CRISPR gRNA sequence
tgagaattccagatatgcaa

SEQ ID NO: 597376 - DNA, 20 bp, Artificial
  CRISPR gRNA sequence
agaattccagatatgcaaca

SEQ ID NO: 597377 - DNA, 20 bp, Artificial
  CRISPR gRNA sequence
catgaatttaatataacaca

SEQ ID NO: 597378 - DNA, 20 bp, Artificial
  CRISPR gRNA sequence
tgaatttaatataacacata

SEQ ID NO: 597379 - DNA, 20 bp, Artificial
  CRISPR gRNA sequence
tataacacatagagcaccat

SEQ ID NO: 597380 - DNA, 20 bp, Artificial
  CRISPR gRNA sequence
cacatagagcaccataagta

SEQ ID NO: 597381 - DNA, 20 bp, Artificial
  CRISPR gRNA sequence
tatggaaattaataaaattt

SEQ ID NO: 597382 - DNA, 20 bp, Artificial
  CRISPR gRNA sequence
tggaaattaataaaatttca

SEQ ID NO: 597383 - DNA, 20 bp, Artificial
  CRISPR gRNA sequence
ataaaatttcagagctatac

SEQ ID NO: 597384 - DNA, 20 bp, Artificial
  CRISPR gRNA sequence
taaaatttcagagctatact

SEQ ID NO: 597385 - DNA, 20 bp, Artificial
  CRISPR gRNA sequence
aattcattcaccaacacatc

SEQ ID NO: 597386 - DNA, 20 bp, Artificial
  CRISPR gRNA sequence
accaacacatctagttatac

SEQ ID NO: 597387 - DNA, 20 bp, Artificial
  CRISPR gRNA sequence
atctagttatacaagtaaat

SEQ ID NO: 597388 - DNA, 20 bp, Artificial
  CRISPR gRNA sequence
tccatcctaaaaactcactc

SEQ ID NO: 597389 - DNA, 20 bp, Artificial
  CRISPR gRNA sequence
cctaaaaactcactctggac

SEQ ID NO: 597390 - DNA, 20 bp, Artificial
  CRISPR gRNA sequence
ctaaaaactcactctggaca

SEQ ID NO: 597391 - DNA, 20 bp, Artificial
  CRISPR gRNA sequence
tcactctggacaaggtcacc

SEQ ID NO: 597392 - DNA, 20 bp, Artificial
  CRISPR gRNA sequence
cactctggacaaggtcacct

SEQ ID NO: 597393 - DNA, 20 bp, Artificial
  CRISPR gRNA sequence
actctggacaaggtcaccta

SEQ ID NO: 597394 - DNA, 20 bp, Artificial
  CRISPR gRNA sequence
tctggacaaggtcacctagg

SEQ ID NO: 597395 - DNA, 20 bp, Artificial
  CRISPR gRNA sequence
ctggacaaggtcacctaggg

SEQ ID NO: 597396 - DNA, 20 bp, Artificial
  CRISPR gRNA sequence
gtcacctagggaggtacacc

SEQ ID NO: 597397 - DNA, 20 bp, Artificial
  CRISPR gRNA sequence
acctagggaggtacaccaag

SEQ ID NO: 597398 - DNA, 20 bp, Artificial
  CRISPR gRNA sequence
gggaggtacaccaagcagcc

SEQ ID NO: 597399 - DNA, 20 bp, Artificial
  CRISPR gRNA sequence
accaagcagccaagacctgc

SEQ ID NO: 597400 - DNA, 20 bp, Artificial
  CRISPR gRNA sequence
tcaattatacccgtcacaaa

SEQ ID NO: 597401 - DNA, 20 bp, Artificial
  CRISPR gRNA sequence
aattatacccgtcacaaaca

SEQ ID NO: 597402 - DNA, 20 bp, Artificial
  CRISPR gRNA sequence
tatacccgtcacaaacagag

SEQ ID NO: 597403 - DNA, 20 bp, Artificial
  CRISPR gRNA sequence
atacccgtcacaaacagagt

SEQ ID NO: 597404 - DNA, 20 bp, Artificial
  CRISPR gRNA sequence
tatgtgtgattcaatttaat

SEQ ID NO: 597405 - DNA, 20 bp, Artificial
  CRISPR gRNA sequence
atgtgtgattcaatttaatt

SEQ ID NO: 597406 - DNA, 20 bp, Artificial
  CRISPR gRNA sequence
taattttactttcatttctt

SEQ ID NO: 597407 - DNA, 20 bp, Artificial
  CRISPR gRNA sequence
agtaattgatttgaatacaa

SEQ ID NO: 597408 - DNA, 20 bp, Artificial
  CRISPR gRNA sequence
tcttttcaaacaaaaattct

SEQ ID NO: 597409 - DNA, 20 bp, Artificial
  CRISPR gRNA sequence
ttctgagtctgtctacctga

SEQ ID NO: 597410 - DNA, 20 bp, Artificial
  CRISPR gRNA sequence
tctacctgacagcactcaaa

SEQ ID NO: 597411 - DNA, 20 bp, Artificial
  CRISPR gRNA sequence
acagcactcaaacagatgaa

SEQ ID NO: 597412 - DNA, 20 bp, Artificial
  CRISPR gRNA sequence
gcactcaaacagatgaaaag

SEQ ID NO: 597413 - DNA, 20 bp, Artificial
  CRISPR gRNA sequence
agatgaaaagcagaaatatt

SEQ ID NO: 597414 - DNA, 20 bp, Artificial
  CRISPR gRNA sequence
gaaaagcagaaatattcagt

SEQ ID NO: 597415 - DNA, 20 bp, Artificial
  CRISPR gRNA sequence
gaaatattcagtaagtgatc

SEQ ID NO: 597416 - DNA, 20 bp, Artificial
  CRISPR gRNA sequence
ttatgttccatgcaatgctt

SEQ ID NO: 597417 - DNA, 20 bp, Artificial
  CRISPR gRNA sequence
ttaaaattattgttgattaa

SEQ ID NO: 597418 - DNA, 20 bp, Artificial
  CRISPR gRNA sequence
aaattattgttgattaaaag

SEQ ID NO: 597419 - DNA, 20 bp, Artificial
  CRISPR gRNA sequence
gttgattaaaagcggactaa

SEQ ID NO: 597420 - DNA, 20 bp, Artificial
  CRISPR gRNA sequence
gactaaaagcatgtccttcc

SEQ ID NO: 597421 - DNA, 20 bp, Artificial
  CRISPR gRNA sequence
taaaagcatgtccttcctag

SEQ ID NO: 597422 - DNA, 20 bp, Artificial
  CRISPR gRNA sequence
gactatttgatatatgtttg

SEQ ID NO: 597423 - DNA, 20 bp, Artificial
  CRISPR gRNA sequence
actatttgatatatgtttgt

SEQ ID NO: 597424 - DNA, 20 bp, Artificial
  CRISPR gRNA sequence
tgtttgtgggacctgtttct

SEQ ID NO: 597425 - DNA, 20 bp, Artificial
  CRISPR gRNA sequence
ctttttatctaacaataaaa

SEQ ID NO: 597426 - DNA, 20 bp, Artificial
  CRISPR gRNA sequence
tttttatctaacaataaaat

SEQ ID NO: 597427 - DNA, 20 bp, Artificial
  CRISPR gRNA sequence
tttatctaacaataaaatag

SEQ ID NO: 597428 - DNA, 20 bp, Artificial
  CRISPR gRNA sequence
taaaataggagctatcattc

SEQ ID NO: 597429 - DNA, 20 bp, Artificial
  CRISPR gRNA sequence
cattctggctaacttaccat

SEQ ID NO: 597430 - DNA, 20 bp, Artificial
  CRISPR gRNA sequence
ctggctaacttaccatgagc

SEQ ID NO: 597431 - DNA, 20 bp, Artificial
  CRISPR gRNA sequence
ccatgagccagtcactgttc

SEQ ID NO: 597432 - DNA, 20 bp, Artificial
  CRISPR gRNA sequence
tgagccagtcactgttctgg

SEQ ID NO: 597433 - DNA, 20 bp, Artificial
  CRISPR gRNA sequence
aatgcttaccactcctctga

SEQ ID NO: 597434 - DNA, 20 bp, Artificial
  CRISPR gRNA sequence
tgcttaccactcctctgaca

SEQ ID NO: 597435 - DNA, 20 bp, Artificial
  CRISPR gRNA sequence
cttaccactcctctgacaga

SEQ ID NO: 597436 - DNA, 20 bp, Artificial
  CRISPR gRNA sequence
atatcccctttttacaaata

SEQ ID NO: 597437 - DNA, 20 bp, Artificial
  CRISPR gRNA sequence
ccctttttacaaataaagct

SEQ ID NO: 597438 - DNA, 20 bp, Artificial
  CRISPR gRNA sequence
acaaataaagctgagcttcc

SEQ ID NO: 597439 - DNA, 20 bp, Artificial
  CRISPR gRNA sequence
aaataaagctgagcttccaa

SEQ ID NO: 597440 - DNA, 20 bp, Artificial
  CRISPR gRNA sequence
caagagataaaatatctgtc

SEQ ID NO: 597441 - DNA, 20 bp, Artificial
  CRISPR gRNA sequence
aagagataaaatatctgtct

SEQ ID NO: 597442 - DNA, 20 bp, Artificial
  CRISPR gRNA sequence
agagataaaatatctgtcta

SEQ ID NO: 597443 - DNA, 20 bp, Artificial
  CRISPR gRNA sequence
gagataaaatatctgtctag

SEQ ID NO: 597444 - DNA, 20 bp, Artificial
  CRISPR gRNA sequence
gcctcacatttgacatatat

SEQ ID NO: 597445 - DNA, 20 bp, Artificial
  CRISPR gRNA sequence
cctcacatttgacatatatt

SEQ ID NO: 597446 - DNA, 20 bp, Artificial
  CRISPR gRNA sequence
tcccacttctttatatacca

SEQ ID NO: 597447 - DNA, 20 bp, Artificial
  CRISPR gRNA sequence
ccacttctttatataccaca

SEQ ID NO: 597448 - DNA, 20 bp, Artificial
  CRISPR gRNA sequence
cacttctttatataccacag

SEQ ID NO: 597449 - DNA, 20 bp, Artificial
  CRISPR gRNA sequence
acttctttatataccacaga

SEQ ID NO: 597450 - DNA, 20 bp, Artificial
  CRISPR gRNA sequence
ttctttatataccacagagg

SEQ ID NO: 597451 - DNA, 20 bp, Artificial
  CRISPR gRNA sequence
ctttatataccacagaggga

SEQ ID NO: 597452 - DNA, 20 bp, Artificial
  CRISPR gRNA sequence
ataccacagagggagagaaa

SEQ ID NO: 597453 - DNA, 20 bp, Artificial
  CRISPR gRNA sequence
taccacagagggagagaaac

SEQ ID NO: 597454 - DNA, 20 bp, Artificial
  CRISPR gRNA sequence
atttttaaaaacatgtttac

SEQ ID NO: 597455 - DNA, 20 bp, Artificial
  CRISPR gRNA sequence
ttaaaaacatgtttactggc

SEQ ID NO: 597456 - DNA, 20 bp, Artificial
  CRISPR gRNA sequence
taaaaacatgtttactggcc

SEQ ID NO: 597457 - DNA, 20 bp, Artificial
  CRISPR gRNA sequence
acatgtttactggccaggca

SEQ ID NO: 597458 - DNA, 20 bp, Artificial
  CRISPR gRNA sequence
tgtttactggccaggcacgg

SEQ ID NO: 597459 - DNA, 20 bp, Artificial
  CRISPR gRNA sequence
gtggctcacgcctgtgatcc

SEQ ID NO: 597460 - DNA, 20 bp, Artificial
  CRISPR gRNA sequence
cgcctgtgatcccagcactt

SEQ ID NO: 597461 - DNA, 20 bp, Artificial
  CRISPR gRNA sequence
gcctgtgatcccagcacttt

SEQ ID NO: 597462 - DNA, 20 bp, Artificial
  CRISPR gRNA sequence
ctgtgatcccagcactttgg

SEQ ID NO: 597463 - DNA, 20 bp, Artificial
  CRISPR gRNA sequence
tgtgatcccagcactttggg

SEQ ID NO: 597464 - DNA, 20 bp, Artificial
  CRISPR gRNA sequence
tcccagcactttgggaggct

SEQ ID NO: 597465 - DNA, 20 bp, Artificial
  CRISPR gRNA sequence
cccagcactttgggaggctg

SEQ ID NO: 597466 - DNA, 20 bp, Artificial
  CRISPR gRNA sequence
agcactttgggaggctgagg

SEQ ID NO: 597467 - DNA, 20 bp, Artificial
  CRISPR gRNA sequence
gcactttgggaggctgaggt

SEQ ID NO: 597468 - DNA, 20 bp, Artificial
  CRISPR gRNA sequence
ctttgggaggctgaggtagg

SEQ ID NO: 597469 - DNA, 20 bp, Artificial
  CRISPR gRNA sequence
ctgaggtaggcagattactt

SEQ ID NO: 597470 - DNA, 20 bp, Artificial
  CRISPR gRNA sequence
tgaggtaggcagattacttg

SEQ ID NO: 597471 - DNA, 20 bp, Artificial
  CRISPR gRNA sequence
gtaggcagattacttgaggt

SEQ ID NO: 597472 - DNA, 20 bp, Artificial
  CRISPR gRNA sequence
ggcagattacttgaggtcag

SEQ ID NO: 597473 - DNA, 20 bp, Artificial
  CRISPR gRNA sequence
ttacttgaggtcagaagttc

SEQ ID NO: 597474 - DNA, 20 bp, Artificial
  CRISPR gRNA sequence
tgaggtcagaagttcaagac

SEQ ID NO: 597475 - DNA, 20 bp, Artificial
  CRISPR gRNA sequence
caagactagcctgaccaaca

SEQ ID NO: 597476 - DNA, 20 bp, Artificial
  CRISPR gRNA sequence
ctgaccaacatggtaaaacc

SEQ ID NO: 597477 - DNA, 20 bp, Artificial
  CRISPR gRNA sequence
ctaaaaatacaaaaatttgc

SEQ ID NO: 597478 - DNA, 20 bp, Artificial
  CRISPR gRNA sequence
taaaaatacaaaaatttgct

SEQ ID NO: 597479 - DNA, 20 bp, Artificial
  CRISPR gRNA sequence
atacaaaaatttgctaggca

SEQ ID NO: 597480 - DNA, 20 bp, Artificial
  CRISPR gRNA sequence
caaaaatttgctaggcatgg

SEQ ID NO: 597481 - DNA, 20 bp, Artificial
  CRISPR gRNA sequence
aaatttgctaggcatggtgg

SEQ ID NO: 597482 - DNA, 20 bp, Artificial
  CRISPR gRNA sequence
aatttgctaggcatggtggc

SEQ ID NO: 597483 - DNA, 20 bp, Artificial
  CRISPR gRNA sequence
gtggcaggtacctgtaatct

SEQ ID NO: 597484 - DNA, 20 bp, Artificial
  CRISPR gRNA sequence
tacctgtaatctcagcttct

SEQ ID NO: 597485 - DNA, 20 bp, Artificial
  CRISPR gRNA sequence
acctgtaatctcagcttctc

SEQ ID NO: 597486 - DNA, 20 bp, Artificial
  CRISPR gRNA sequence
ctgtaatctcagcttctcgg

SEQ ID NO: 597487 - DNA, 20 bp, Artificial
  CRISPR gRNA sequence
tgtaatctcagcttctcggg

SEQ ID NO: 597488 - DNA, 20 bp, Artificial
  CRISPR gRNA sequence
tctcagcttctcgggaggcg

SEQ ID NO: 597489 - DNA, 20 bp, Artificial
  CRISPR gRNA sequence
ctcagcttctcgggaggcga

SEQ ID NO: 597490 - DNA, 20 bp, Artificial
  CRISPR gRNA sequence
ttctcgggaggcgaaggttg

SEQ ID NO: 597491 - DNA, 20 bp, Artificial
  CRISPR gRNA sequence
tcgggaggcgaaggttgcag

SEQ ID NO: 597492 - DNA, 20 bp, Artificial
  CRISPR gRNA sequence
gggaggcgaaggttgcagtg

SEQ ID NO: 597493 - DNA, 20 bp, Artificial
  CRISPR gRNA sequence
gcgaaggttgcagtggagcc

SEQ ID NO: 597494 - DNA, 20 bp, Artificial
  CRISPR gRNA sequence
gagatcgcaccaccgcactc

SEQ ID NO: 597495 - DNA, 20 bp, Artificial
  CRISPR gRNA sequence
cgcaccaccgcactctagcc

SEQ ID NO: 597496 - DNA, 20 bp, Artificial
  CRISPR gRNA sequence
gcaccaccgcactctagcct

SEQ ID NO: 597497 - DNA, 20 bp, Artificial
  CRISPR gRNA sequence
gcactctagcctgggcgaca

SEQ ID NO: 597498 - DNA, 20 bp, Artificial
  CRISPR gRNA sequence
tctagcctgggcgacaaaga

SEQ ID NO: 597499 - DNA, 20 bp, Artificial
  CRISPR gRNA sequence
aataaatattcactattttc

SEQ ID NO: 597500 - DNA, 20 bp, Artificial
  CRISPR gRNA sequence
cactattttccagtaatgct

SEQ ID NO: 597501 - DNA, 20 bp, Artificial
  CRISPR gRNA sequence
taatgctaagtactatcaaa

SEQ ID NO: 597502 - DNA, 20 bp, Artificial
  CRISPR gRNA sequence
atgctaagtactatcaaaaa

SEQ ID NO: 597503 - DNA, 20 bp, Artificial
  CRISPR gRNA sequence
ctaagtactatcaaaaagag

SEQ ID NO: 597504 - DNA, 20 bp, Artificial
  CRISPR gRNA sequence
agagtagattactctgacac

SEQ ID NO: 597505 - DNA, 20 bp, Artificial
  CRISPR gRNA sequence
acactggttgcataaatatt

SEQ ID NO: 597506 - DNA, 20 bp, Artificial
  CRISPR gRNA sequence
gttgcataaatattaagctc

SEQ ID NO: 597507 - DNA, 20 bp, Artificial
  CRISPR gRNA sequence
tattaagctcaagttttgat

SEQ ID NO: 597508 - DNA, 20 bp, Artificial
  CRISPR gRNA sequence
ttgatcagcacattctatgc

SEQ ID NO: 597509 - DNA, 20 bp, Artificial
  CRISPR gRNA sequence
acattctatgctagatgtaa

SEQ ID NO: 597510 - DNA, 20 bp, Artificial
  CRISPR gRNA sequence
atgtaaaagcattttgaaaa

SEQ ID NO: 597511 - DNA, 20 bp, Artificial
  CRISPR gRNA sequence
aaagtaccttacaaataaaa

SEQ ID NO: 597512 - DNA, 20 bp, Artificial
  CRISPR gRNA sequence
tacaaataaaatggtattct

SEQ ID NO: 597513 - DNA, 20 bp, Artificial
  CRISPR gRNA sequence
aaataaaatggtattcttag

SEQ ID NO: 597514 - DNA, 20 bp, Artificial
  CRISPR gRNA sequence
gacttaaaatttgttttttt

SEQ ID NO: 597515 - DNA, 20 bp, Artificial
  CRISPR gRNA sequence
taaaatttgtttttttaagc

SEQ ID NO: 597516 - DNA, 20 bp, Artificial
  CRISPR gRNA sequence
ctttttattattgttattta

SEQ ID NO: 597517 - DNA, 20 bp, Artificial
  CRISPR gRNA sequence
tttttattattgttatttat

SEQ ID NO: 597518 - DNA, 20 bp, Artificial
  CRISPR gRNA sequence
attattgttatttatgggct

SEQ ID NO: 597519 - DNA, 20 bp, Artificial
  CRISPR gRNA sequence
tcaacaatgatacacatgta

SEQ ID NO: 597520 - DNA, 20 bp, Artificial
  CRISPR gRNA sequence
caactgataaatttttacta

SEQ ID NO: 597521 - DNA, 20 bp, Artificial
  CRISPR gRNA sequence
aaatttttactacagtatta

SEQ ID NO: 597522 - DNA, 20 bp, Artificial
  CRISPR gRNA sequence
tttttactacagtattaaag

SEQ ID NO: 597523 - DNA, 20 bp, Artificial
  CRISPR gRNA sequence
attttttaaaaatgtctcaa

SEQ ID NO: 597524 - DNA, 20 bp, Artificial
  CRISPR gRNA sequence
ttttttaaaaatgtctcaat

SEQ ID NO: 597525 - DNA, 20 bp, Artificial
  CRISPR gRNA sequence
aaaaatgtctcaatgggtaa

SEQ ID NO: 597526 - DNA, 20 bp, Artificial
  CRISPR gRNA sequence
caatgggtaaaagccaacct

SEQ ID NO: 597527 - DNA, 20 bp, Artificial
  CRISPR gRNA sequence
aacctgagccttctaaataa

SEQ ID NO: 597528 - DNA, 20 bp, Artificial
  CRISPR gRNA sequence
cctgagccttctaaataaca

SEQ ID NO: 597529 - DNA, 20 bp, Artificial
  CRISPR gRNA sequence
aaataacagagtatgatctc

SEQ ID NO: 597530 - DNA, 20 bp, Artificial
  CRISPR gRNA sequence
aacagagtatgatctcaaga

SEQ ID NO: 597531 - DNA, 20 bp, Artificial
  CRISPR gRNA sequence
atgatctcaagaaagtcttc

SEQ ID NO: 597532 - DNA, 20 bp, Artificial
  CRISPR gRNA sequence
agaaagtcttctggaaccct

SEQ ID NO: 597533 - DNA, 20 bp, Artificial
  CRISPR gRNA sequence
aaccctcagtgcctgtgtct

SEQ ID NO: 597534 - DNA, 20 bp, Artificial
  CRISPR gRNA sequence
gcctgtgtcttagacacttc

SEQ ID NO: 597535 - DNA, 20 bp, Artificial
  CRISPR gRNA sequence
ctgtgtcttagacacttcga

SEQ ID NO: 597536 - DNA, 20 bp, Artificial
  CRISPR gRNA sequence
tgtgtcttagacacttcgag

SEQ ID NO: 597537 - DNA, 20 bp, Artificial
  CRISPR gRNA sequence
tagacacttcgagaggaaaa

SEQ ID NO: 597538 - DNA, 20 bp, Artificial
  CRISPR gRNA sequence
cgagaggaaaatggaaaaac

SEQ ID NO: 597539 - DNA, 20 bp, Artificial
  CRISPR gRNA sequence
aaaatggaaaaaccagcgat

SEQ ID NO: 597540 - DNA, 20 bp, Artificial
  CRISPR gRNA sequence
aatggaaaaaccagcgatca

SEQ ID NO: 597541 - DNA, 20 bp, Artificial
  CRISPR gRNA sequence
atggaaaaaccagcgatcag

SEQ ID NO: 597542 - DNA, 20 bp, Artificial
  CRISPR gRNA sequence
agcgatcagaggacaaaaac

SEQ ID NO: 597543 - DNA, 20 bp, Artificial
  CRISPR gRNA sequence
catctcatctgctcaatatc

SEQ ID NO: 597544 - DNA, 20 bp, Artificial
  CRISPR gRNA sequence
cttcttcattgccatctccc

SEQ ID NO: 597545 - DNA, 20 bp, Artificial
  CRISPR gRNA sequence
tcttcattgccatctcccaa

SEQ ID NO: 597546 - DNA, 20 bp, Artificial
  CRISPR gRNA sequence
cttcattgccatctcccaag

SEQ ID NO: 597547 - DNA, 20 bp, Artificial
  CRISPR gRNA sequence
ttcattgccatctcccaaga

SEQ ID NO: 597548 - DNA, 20 bp, Artificial
  CRISPR gRNA sequence
tcattgccatctcccaagag

SEQ ID NO: 597549 - DNA, 20 bp, Artificial
  CRISPR gRNA sequence
cattgccatctcccaagagg

SEQ ID NO: 597550 - DNA, 20 bp, Artificial
  CRISPR gRNA sequence
tctcccaagagggggaaaaa

SEQ ID NO: 597551 - DNA, 20 bp, Artificial
  CRISPR gRNA sequence
cccaagagggggaaaaaaag

SEQ ID NO: 597552 - DNA, 20 bp, Artificial
  CRISPR gRNA sequence
caagagggggaaaaaaagca

SEQ ID NO: 597553 - DNA, 20 bp, Artificial
  CRISPR gRNA sequence
agggggaaaaaaagcagaga

SEQ ID NO: 597554 - DNA, 20 bp, Artificial
  CRISPR gRNA sequence
aaagcagagaaagttctttc

SEQ ID NO: 597555 - DNA, 20 bp, Artificial
  CRISPR gRNA sequence
gcagagaaagttctttctgg

SEQ ID NO: 597556 - DNA, 20 bp, Artificial
  CRISPR gRNA sequence
agttctttctggcagcctta

SEQ ID NO: 597557 - DNA, 20 bp, Artificial
  CRISPR gRNA sequence
tctcctttcccactaaacta

SEQ ID NO: 597558 - DNA, 20 bp, Artificial
  CRISPR gRNA sequence
tcccactaaactaaagtaaa

SEQ ID NO: 597559 - DNA, 20 bp, Artificial
  CRISPR gRNA sequence
actaaagtaaaaagacaact

SEQ ID NO: 597560 - DNA, 20 bp, Artificial
  CRISPR gRNA sequence
ctaaagtaaaaagacaactg

SEQ ID NO: 597561 - DNA, 20 bp, Artificial
  CRISPR gRNA sequence
taaagtaaaaagacaactga

SEQ ID NO: 597562 - DNA, 20 bp, Artificial
  CRISPR gRNA sequence
aaagtaaaaagacaactgag

SEQ ID NO: 597563 - DNA, 20 bp, Artificial
  CRISPR gRNA sequence
taaaaagacaactgaggggc

SEQ ID NO: 597564 - DNA, 20 bp, Artificial
  CRISPR gRNA sequence
acaactgaggggcaagatca

SEQ ID NO: 597565 - DNA, 20 bp, Artificial
  CRISPR gRNA sequence
ttaccgcatccacgataatt

SEQ ID NO: 597566 - DNA, 20 bp, Artificial
  CRISPR gRNA sequence
taccgcatccacgataattt

SEQ ID NO: 597567 - DNA, 20 bp, Artificial
  CRISPR gRNA sequence
cgataatttaggaatacgac

SEQ ID NO: 597568 - DNA, 20 bp, Artificial
  CRISPR gRNA sequence
aatttaggaatacgaccagt

SEQ ID NO: 597569 - DNA, 20 bp, Artificial
  CRISPR gRNA sequence
atttaggaatacgaccagtt

SEQ ID NO: 597570 - DNA, 20 bp, Artificial
  CRISPR gRNA sequence
taggatatctcttacacaca

SEQ ID NO: 597571 - DNA, 20 bp, Artificial
  CRISPR gRNA sequence
tatctcttacacacacagta

SEQ ID NO: 597572 - DNA, 20 bp, Artificial
  CRISPR gRNA sequence
gtacacaatcatttttgcaa

SEQ ID NO: 597573 - DNA, 20 bp, Artificial
  CRISPR gRNA sequence
atcatttttgcaaaagataa

SEQ ID NO: 597574 - DNA, 20 bp, Artificial
  CRISPR gRNA sequence
tttgcaaaagataaaagcaa

SEQ ID NO: 597575 - DNA, 20 bp, Artificial
  CRISPR gRNA sequence
aaaagataaaagcaatagat

SEQ ID NO: 597576 - DNA, 20 bp, Artificial
  CRISPR gRNA sequence
taaaagcaatagattagtcc

SEQ ID NO: 597577 - DNA, 20 bp, Artificial
  CRISPR gRNA sequence
agcaatagattagtccaaga

SEQ ID NO: 597578 - DNA, 20 bp, Artificial
  CRISPR gRNA sequence
tccaagatggccactgataa

SEQ ID NO: 597579 - DNA, 20 bp, Artificial
  CRISPR gRNA sequence
atggccactgataatagcac

SEQ ID NO: 597580 - DNA, 20 bp, Artificial
  CRISPR gRNA sequence
aactaatataacttaataac

SEQ ID NO: 597581 - DNA, 20 bp, Artificial
  CRISPR gRNA sequence
actaatataacttaataact

SEQ ID NO: 597582 - DNA, 20 bp, Artificial
  CRISPR gRNA sequence
aacttttatcctgctttaat

SEQ ID NO: 597583 - DNA, 20 bp, Artificial
  CRISPR gRNA sequence
ctttaattggctaattgttc

SEQ ID NO: 597584 - DNA, 20 bp, Artificial
  CRISPR gRNA sequence
ttgttctagaatcaatccct

SEQ ID NO: 597585 - DNA, 20 bp, Artificial
  CRISPR gRNA sequence
tgttctagaatcaatccctt

SEQ ID NO: 597586 - DNA, 20 bp, Artificial
  CRISPR gRNA sequence
agaatcaatcccttaggacc

SEQ ID NO: 597587 - DNA, 20 bp, Artificial
  CRISPR gRNA sequence
tacccccatctcctactccc

SEQ ID NO: 597588 - DNA, 20 bp, Artificial
  CRISPR gRNA sequence
ccctggctttcaaatatctg

SEQ ID NO: 597589 - DNA, 20 bp, Artificial
  CRISPR gRNA sequence
tggctttcaaatatctgaag

SEQ ID NO: 597590 - DNA, 20 bp, Artificial
  CRISPR gRNA sequence
aatctaaatgcttattcatt

SEQ ID NO: 597591 - DNA, 20 bp, Artificial
  CRISPR gRNA sequence
cttattcatttagcttctac

SEQ ID NO: 597592 - DNA, 20 bp, Artificial
  CRISPR gRNA sequence
tgccacattcctcatcactt

SEQ ID NO: 597593 - DNA, 20 bp, Artificial
  CRISPR gRNA sequence
cacattcctcatcacttaag

SEQ ID NO: 597594 - DNA, 20 bp, Artificial
  CRISPR gRNA sequence
acattcctcatcacttaagc

SEQ ID NO: 597595 - DNA, 20 bp, Artificial
  CRISPR gRNA sequence
ttcctcatcacttaagcagg

SEQ ID NO: 597596 - DNA, 20 bp, Artificial
  CRISPR gRNA sequence
tctttatttatttttttgtg

SEQ ID NO: 597597 - DNA, 20 bp, Artificial
  CRISPR gRNA sequence
tatttatttttttgtgaaga

SEQ ID NO: 597598 - DNA, 20 bp, Artificial
  CRISPR gRNA sequence
tttttttgtgaagaaagaaa

SEQ ID NO: 597599 - DNA, 20 bp, Artificial
  CRISPR gRNA sequence
ttttttgtgaagaaagaaaa

SEQ ID NO: 597600 - DNA, 20 bp, Artificial
  CRISPR gRNA sequence
tttttgtgaagaaagaaaaa

SEQ ID NO: 597601 - DNA, 20 bp, Artificial
  CRISPR gRNA sequence
ttttgtgaagaaagaaaaag

SEQ ID NO: 597602 - DNA, 20 bp, Artificial
  CRISPR gRNA sequence
ttgtgaagaaagaaaaaggg

SEQ ID NO: 597603 - DNA, 20 bp, Artificial
  CRISPR gRNA sequence
tgtgaagaaagaaaaagggg

SEQ ID NO: 597604 - DNA, 20 bp, Artificial
  CRISPR gRNA sequence
agaaagaaaaaggggaggaa

SEQ ID NO: 597605 - DNA, 20 bp, Artificial
  CRISPR gRNA sequence
atttgctctattgctctctc

SEQ ID NO: 597606 - DNA, 20 bp, Artificial
  CRISPR gRNA sequence
tgctctattgctctctccag

SEQ ID NO: 597607 - DNA, 20 bp, Artificial
  CRISPR gRNA sequence
tccagtggatctactaactc

SEQ ID NO: 597608 - DNA, 20 bp, Artificial
  CRISPR gRNA sequence
agtggatctactaactcaag

SEQ ID NO: 597609 - DNA, 20 bp, Artificial
  CRISPR gRNA sequence
tggatctactaactcaagtg

SEQ ID NO: 597610 - DNA, 20 bp, Artificial
  CRISPR gRNA sequence
actaactcaagtggagtctg

SEQ ID NO: 597611 - DNA, 20 bp, Artificial
  CRISPR gRNA sequence
tattctttctttcttcttgc

SEQ ID NO: 597612 - DNA, 20 bp, Artificial
  CRISPR gRNA sequence
tctatgctctctatacttca

SEQ ID NO: 597613 - DNA, 20 bp, Artificial
  CRISPR gRNA sequence
cagctctgctctttctttta

SEQ ID NO: 597614 - DNA, 20 bp, Artificial
  CRISPR gRNA sequence
agctctgctctttcttttat

SEQ ID NO: 597615 - DNA, 20 bp, Artificial
  CRISPR gRNA sequence
ctctttcttttataggcctt

SEQ ID NO: 597616 - DNA, 20 bp, Artificial
  CRISPR gRNA sequence
taggccttaagttattttcg

SEQ ID NO: 597617 - DNA, 20 bp, Artificial
  CRISPR gRNA sequence
aggccttaagttattttcgc

SEQ ID NO: 597618 - DNA, 20 bp, Artificial
  CRISPR gRNA sequence
ttcgcaggtcctacctccat

SEQ ID NO: 597619 - DNA, 20 bp, Artificial
  CRISPR gRNA sequence
tacctccattagcaacatac

SEQ ID NO: 597620 - DNA, 20 bp, Artificial
  CRISPR gRNA sequence
cagaattgtcttgctaaaaa

SEQ ID NO: 597621 - DNA, 20 bp, Artificial
  CRISPR gRNA sequence
taaaaatagtttctctttaa

SEQ ID NO: 597622 - DNA, 20 bp, Artificial
  CRISPR gRNA sequence
atagttttaatgtaaaaaat

SEQ ID NO: 597623 - DNA, 20 bp, Artificial
  CRISPR gRNA sequence
gtaaaaaattagcaacattc

SEQ ID NO: 597624 - DNA, 20 bp, Artificial
  CRISPR gRNA sequence
taaaaaattagcaacattcg

SEQ ID NO: 597625 - DNA, 20 bp, Artificial
  CRISPR gRNA sequence
aaaaaattagcaacattcga

SEQ ID NO: 597626 - DNA, 20 bp, Artificial
  CRISPR gRNA sequence
ttaaattgatgaatatgaaa

SEQ ID NO: 597627 - DNA, 20 bp, Artificial
  CRISPR gRNA sequence
aaattgatgaatatgaaaaa

SEQ ID NO: 597628 - DNA, 20 bp, Artificial
  CRISPR gRNA sequence
atgaatatgaaaaagagact

SEQ ID NO: 597629 - DNA, 20 bp, Artificial
  CRISPR gRNA sequence
tgaatatgaaaaagagacta

SEQ ID NO: 597630 - DNA, 20 bp, Artificial
  CRISPR gRNA sequence
agactaaggctcttttttaa

SEQ ID NO: 597631 - DNA, 20 bp, Artificial
  CRISPR gRNA sequence
taaacttgtttgttacatgc

SEQ ID NO: 597632 - DNA, 20 bp, Artificial
  CRISPR gRNA sequence
cttgtttgttacatgcaaga

SEQ ID NO: 597633 - DNA, 20 bp, Artificial
  CRISPR gRNA sequence
atgttttaactcattctact

SEQ ID NO: 597634 - DNA, 20 bp, Artificial
  CRISPR gRNA sequence
actcagatttcttttgccat

SEQ ID NO: 597635 - DNA, 20 bp, Artificial
  CRISPR gRNA sequence
atatttatatgtacattatt

SEQ ID NO: 597636 - DNA, 20 bp, Artificial
  CRISPR gRNA sequence
atattactcataaaacaatt

SEQ ID NO: 597637 - DNA, 20 bp, Artificial
  CRISPR gRNA sequence
attactcataaaacaattca

SEQ ID NO: 597638 - DNA, 20 bp, Artificial
  CRISPR gRNA sequence
tcagagtatataacattatt

SEQ ID NO: 597639 - DNA, 20 bp, Artificial
  CRISPR gRNA sequence
aaatgccactgtaaacaacc

SEQ ID NO: 597640 - DNA, 20 bp, Artificial
  CRISPR gRNA sequence
ccactgtaaacaacctagcc

SEQ ID NO: 597641 - DNA, 20 bp, Artificial
  CRISPR gRNA sequence
gtaaacaacctagccaagtg

SEQ ID NO: 597642 - DNA, 20 bp, Artificial
  CRISPR gRNA sequence
aacaacctagccaagtgtgg

SEQ ID NO: 597643 - DNA, 20 bp, Artificial
  CRISPR gRNA sequence
gtggctcacacctgtaaact

SEQ ID NO: 597644 - DNA, 20 bp, Artificial
  CRISPR gRNA sequence
cacctgtaaactcagctact

SEQ ID NO: 597645 - DNA, 20 bp, Artificial
  CRISPR gRNA sequence
acctgtaaactcagctactc

SEQ ID NO: 597646 - DNA, 20 bp, Artificial
  CRISPR gRNA sequence
ctgtaaactcagctactcag

SEQ ID NO: 597647 - DNA, 20 bp, Artificial
  CRISPR gRNA sequence
tgtaaactcagctactcagg

SEQ ID NO: 597648 - DNA, 20 bp, Artificial
  CRISPR gRNA sequence
actcagctactcaggaggct

SEQ ID NO: 597649 - DNA, 20 bp, Artificial
  CRISPR gRNA sequence
ctcagctactcaggaggctg

SEQ ID NO: 597650 - DNA, 20 bp, Artificial
  CRISPR gRNA sequence
agctactcaggaggctgagg

SEQ ID NO: 597651 - DNA, 20 bp, Artificial
  CRISPR gRNA sequence
gctactcaggaggctgaggc

SEQ ID NO: 597652 - DNA, 20 bp, Artificial
  CRISPR gRNA sequence
tactcaggaggctgaggcgg

SEQ ID NO: 597653 - DNA, 20 bp, Artificial
  CRISPR gRNA sequence
ctgaggcgggagaatcactt

SEQ ID NO: 597654 - DNA, 20 bp, Artificial
  CRISPR gRNA sequence
tgaggcgggagaatcacttg

SEQ ID NO: 597655 - DNA, 20 bp, Artificial
  CRISPR gRNA sequence
gcgggagaatcacttgaggc

SEQ ID NO: 597656 - DNA, 20 bp, Artificial
  CRISPR gRNA sequence
cgggagaatcacttgaggcc

SEQ ID NO: 597657 - DNA, 20 bp, Artificial
  CRISPR gRNA sequence
ggagaatcacttgaggccag

SEQ ID NO: 597658 - DNA, 20 bp, Artificial
  CRISPR gRNA sequence
tcacttgaggccaggagttc

SEQ ID NO: 597659 - DNA, 20 bp, Artificial
  CRISPR gRNA sequence
tgaggccaggagttcaagac

SEQ ID NO: 597660 - DNA, 20 bp, Artificial
  CRISPR gRNA sequence
ccaggagttcaagaccagcc

SEQ ID NO: 597661 - DNA, 20 bp, Artificial
  CRISPR gRNA sequence
caagaccagcctggacaaca

SEQ ID NO: 597662 - DNA, 20 bp, Artificial
  CRISPR gRNA sequence
accagcctggacaacacagt

SEQ ID NO: 597663 - DNA, 20 bp, Artificial
  CRISPR gRNA sequence
gcctggacaacacagtaaga

SEQ ID NO: 597664 - DNA, 20 bp, Artificial
  CRISPR gRNA sequence
ggacaacacagtaagatagt

SEQ ID NO: 597665 - DNA, 20 bp, Artificial
  CRISPR gRNA sequence
aaaaaaaaattgttaaaaat

SEQ ID NO: 597666 - DNA, 20 bp, Artificial
  CRISPR gRNA sequence
aaaaattgttaaaaattagc

SEQ ID NO: 597667 - DNA, 20 bp, Artificial
  CRISPR gRNA sequence
aaaattgttaaaaattagct

SEQ ID NO: 597668 - DNA, 20 bp, Artificial
  CRISPR gRNA sequence
tgttaaaaattagctgggca

SEQ ID NO: 597669 - DNA, 20 bp, Artificial
  CRISPR gRNA sequence
taaaaattagctgggcatgg

SEQ ID NO: 597670 - DNA, 20 bp, Artificial
  CRISPR gRNA sequence
ggcatggtggcatgcacctg

SEQ ID NO: 597671 - DNA, 20 bp, Artificial
  CRISPR gRNA sequence
gtggcatgcacctgtagccc

SEQ ID NO: 597672 - DNA, 20 bp, Artificial
  CRISPR gRNA sequence
acctgtagccccagatactt

SEQ ID NO: 597673 - DNA, 20 bp, Artificial
  CRISPR gRNA sequence
tgtagccccagatacttgag

SEQ ID NO: 597674 - DNA, 20 bp, Artificial
  CRISPR gRNA sequence
gatacttgagaagattgctt

SEQ ID NO: 597675 - DNA, 20 bp, Artificial
  CRISPR gRNA sequence
ttgagaagattgcttgagcc

SEQ ID NO: 597676 - DNA, 20 bp, Artificial
  CRISPR gRNA sequence
tgagaagattgcttgagccc

SEQ ID NO: 597677 - DNA, 20 bp, Artificial
  CRISPR gRNA sequence
agaagattgcttgagcccag

SEQ ID NO: 597678 - DNA, 20 bp, Artificial
  CRISPR gRNA sequence
ttgcttgagcccaggagttc

SEQ ID NO: 597679 - DNA, 20 bp, Artificial
  CRISPR gRNA sequence
tgcttgagcccaggagttcc

SEQ ID NO: 597680 - DNA, 20 bp, Artificial
  CRISPR gRNA sequence
caggagttccaggctgcact

SEQ ID NO: 597681 - DNA, 20 bp, Artificial
  CRISPR gRNA sequence
ataatcgtgacaccgtactc

SEQ ID NO: 597682 - DNA, 20 bp, Artificial
  CRISPR gRNA sequence
ccgtactccagcctgaacaa

SEQ ID NO: 597683 - DNA, 20 bp, Artificial
  CRISPR gRNA sequence
tccagcctgaacaacagaac

SEQ ID NO: 597684 - DNA, 20 bp, Artificial
  CRISPR gRNA sequence
aacagaacaagaccccatct

SEQ ID NO: 597685 - DNA, 20 bp, Artificial
  CRISPR gRNA sequence
acagaacaagaccccatctc

SEQ ID NO: 597686 - DNA, 20 bp, Artificial
  CRISPR gRNA sequence
aacaagaccccatctcagga

SEQ ID NO: 597687 - DNA, 20 bp, Artificial
  CRISPR gRNA sequence
acaagaccccatctcaggaa

SEQ ID NO: 597688 - DNA, 20 bp, Artificial
  CRISPR gRNA sequence
accccatctcaggaaaggaa

SEQ ID NO: 597689 - DNA, 20 bp, Artificial
  CRISPR gRNA sequence
ccccatctcaggaaaggaaa

SEQ ID NO: 597690 - DNA, 20 bp, Artificial
  CRISPR gRNA sequence
atctcaggaaaggaaaagga

SEQ ID NO: 597691 - DNA, 20 bp, Artificial
  CRISPR gRNA sequence
ggaaaggaaaaggaaagaaa

SEQ ID NO: 597692 - DNA, 20 bp, Artificial
  CRISPR gRNA sequence
gaaaggaaaaggaaagaaaa

SEQ ID NO: 597693 - DNA, 20 bp, Artificial
  CRISPR gRNA sequence
aaaggaaagaaaaaggaaaa

SEQ ID NO: 597694 - DNA, 20 bp, Artificial
  CRISPR gRNA sequence
aaggaaagaaaaaggaaaaa

SEQ ID NO: 597695 - DNA, 20 bp, Artificial
  CRISPR gRNA sequence
aaagaaaaaggaaaaaagga

SEQ ID NO: 597696 - DNA, 20 bp, Artificial
  CRISPR gRNA sequence
aagaaaaaggaaaaaaggaa

SEQ ID NO: 597697 - DNA, 20 bp, Artificial
  CRISPR gRNA sequence
aaaaaggaaaaaaggaaagg

SEQ ID NO: 597698 - DNA, 20 bp, Artificial
  CRISPR gRNA sequence
ggaaaaaaggaaaggaagaa

SEQ ID NO: 597699 - DNA, 20 bp, Artificial
  CRISPR gRNA sequence
aaaaggaaaggaagaaaaga

SEQ ID NO: 597700 - DNA, 20 bp, Artificial
  CRISPR gRNA sequence
aaggaaaggaagaaaagaaa

SEQ ID NO: 597701 - DNA, 20 bp, Artificial
  CRISPR gRNA sequence
ggaaaggaagaaaagaaaga

SEQ ID NO: 597702 - DNA, 20 bp, Artificial
  CRISPR gRNA sequence
aggaagaaaagaaagagaga

SEQ ID NO: 597703 - DNA, 20 bp, Artificial
  CRISPR gRNA sequence
aagaaaagaaagagagaaag

SEQ ID NO: 597704 - DNA, 20 bp, Artificial
  CRISPR gRNA sequence
aaagaaagagagaaagaaga

SEQ ID NO: 597705 - DNA, 20 bp, Artificial
  CRISPR gRNA sequence
aagaaagagagaaagaagaa

SEQ ID NO: 597706 - DNA, 20 bp, Artificial
  CRISPR gRNA sequence
agagagaaagaagaaaggaa

SEQ ID NO: 597707 - DNA, 20 bp, Artificial
  CRISPR gRNA sequence
gagagaaagaagaaaggaaa

SEQ ID NO: 597708 - DNA, 20 bp, Artificial
  CRISPR gRNA sequence
gaaagaagaaaggaaaagga

SEQ ID NO: 597709 - DNA, 20 bp, Artificial
  CRISPR gRNA sequence
aagaaaggaaaaggaaagaa

SEQ ID NO: 597710 - DNA, 20 bp, Artificial
  CRISPR gRNA sequence
gaaaggaaaaggaaagaaaa

SEQ ID NO: 597711 - DNA, 20 bp, Artificial
  CRISPR gRNA sequence
aggaaaaggaaagaaaagag

SEQ ID NO: 597712 - DNA, 20 bp, Artificial
  CRISPR gRNA sequence
gaaaaggaaagaaaagagaa

SEQ ID NO: 597713 - DNA, 20 bp, Artificial
  CRISPR gRNA sequence
aaggaaagaaaagagaagag

SEQ ID NO: 597714 - DNA, 20 bp, Artificial
  CRISPR gRNA sequence
aagaaaagagaagagaagac

SEQ ID NO: 597715 - DNA, 20 bp, Artificial
  CRISPR gRNA sequence
aagagaagagaagacaagac

SEQ ID NO: 597716 - DNA, 20 bp, Artificial
  CRISPR gRNA sequence
gagaagagaagacaagacaa

SEQ ID NO: 597717 - DNA, 20 bp, Artificial
  CRISPR gRNA sequence
aagacaagacaagagatgaa

SEQ ID NO: 597718 - DNA, 20 bp, Artificial
  CRISPR gRNA sequence
aagacaagagatgaaaagaa

SEQ ID NO: 597719 - DNA, 20 bp, Artificial
  CRISPR gRNA sequence
aagagatgaaaagaaaagaa

SEQ ID NO: 597720 - DNA, 20 bp, Artificial
  CRISPR gRNA sequence
aaaagaaaagaatacaatgc

SEQ ID NO: 597721 - DNA, 20 bp, Artificial
  CRISPR gRNA sequence
aaagaaaagaatacaatgcc

SEQ ID NO: 597722 - DNA, 20 bp, Artificial
  CRISPR gRNA sequence
aaagaatacaatgccgggca

SEQ ID NO: 597723 - DNA, 20 bp, Artificial
  CRISPR gRNA sequence
gaatacaatgccgggcacgg

SEQ ID NO: 597724 - DNA, 20 bp, Artificial
  CRISPR gRNA sequence
tgccgggcacggtggctcac

SEQ ID NO: 597725 - DNA, 20 bp, Artificial
  CRISPR gRNA sequence
ggcacggtggctcacaagct

SEQ ID NO: 597726 - DNA, 20 bp, Artificial
  CRISPR gRNA sequence
gcacggtggctcacaagctc

SEQ ID NO: 597727 - DNA, 20 bp, Artificial
  CRISPR gRNA sequence
acggtggctcacaagctcag

SEQ ID NO: 597728 - DNA, 20 bp, Artificial
  CRISPR gRNA sequence
gctcacaagctcaggagtac

SEQ ID NO: 597729 - DNA, 20 bp, Artificial
  CRISPR gRNA sequence
tcacaagctcaggagtacga

SEQ ID NO: 597730 - DNA, 20 bp, Artificial
  CRISPR gRNA sequence
acgagagcgcctgaccaaca

SEQ ID NO: 597731 - DNA, 20 bp, Artificial
  CRISPR gRNA sequence
ctaaaaatgcaaaaaaaaat

SEQ ID NO: 597732 - DNA, 20 bp, Artificial
  CRISPR gRNA sequence
aaatgcaaaaaaaaattagc

SEQ ID NO: 597733 - DNA, 20 bp, Artificial
  CRISPR gRNA sequence
aatgcaaaaaaaaattagcc

SEQ ID NO: 597734 - DNA, 20 bp, Artificial
  CRISPR gRNA sequence
aaaaaaaaattagccgggca

SEQ ID NO: 597735 - DNA, 20 bp, Artificial
  CRISPR gRNA sequence
aaaaaattagccgggcatgg

SEQ ID NO: 597736 - DNA, 20 bp, Artificial
  CRISPR gRNA sequence
tggtggcatgcctgtaatcc

SEQ ID NO: 597737 - DNA, 20 bp, Artificial
  CRISPR gRNA sequence
tgcctgtaatcccagctact

SEQ ID NO: 597738 - DNA, 20 bp, Artificial
  CRISPR gRNA sequence
gcctgtaatcccagctactc

SEQ ID NO: 597739 - DNA, 20 bp, Artificial
  CRISPR gRNA sequence
ctgtaatcccagctactcag

SEQ ID NO: 597740 - DNA, 20 bp, Artificial
  CRISPR gRNA sequence
tgtaatcccagctactcagg

SEQ ID NO: 597741 - DNA, 20 bp, Artificial
  CRISPR gRNA sequence
tcccagctactcaggaggct

SEQ ID NO: 597742 - DNA, 20 bp, Artificial
  CRISPR gRNA sequence
cccagctactcaggaggctg

SEQ ID NO: 597743 - DNA, 20 bp, Artificial
  CRISPR gRNA sequence
agctactcaggaggctgagg

SEQ ID NO: 597744 - DNA, 20 bp, Artificial
  CRISPR gRNA sequence
gctactcaggaggctgaggc

SEQ ID NO: 597745 - DNA, 20 bp, Artificial
  CRISPR gRNA sequence
tactcaggaggctgaggcag

SEQ ID NO: 597746 - DNA, 20 bp, Artificial
  CRISPR gRNA sequence
gcaggagaattgcttgaacc

SEQ ID NO: 597747 - DNA, 20 bp, Artificial
  CRISPR gRNA sequence
caggagaattgcttgaaccc

SEQ ID NO: 597748 - DNA, 20 bp, Artificial
  CRISPR gRNA sequence
ggagaattgcttgaacccag

SEQ ID NO: 597749 - DNA, 20 bp, Artificial
  CRISPR gRNA sequence
gagaattgcttgaacccagg

SEQ ID NO: 597750 - DNA, 20 bp, Artificial
  CRISPR gRNA sequence
aattgcttgaacccaggagg

SEQ ID NO: 597751 - DNA, 20 bp, Artificial
  CRISPR gRNA sequence
ttgcttgaacccaggaggcg

SEQ ID NO: 597752 - DNA, 20 bp, Artificial
  CRISPR gRNA sequence
tgcttgaacccaggaggcgg

SEQ ID NO: 597753 - DNA, 20 bp, Artificial
  CRISPR gRNA sequence
aacccaggaggcggaggttg

SEQ ID NO: 597754 - DNA, 20 bp, Artificial
  CRISPR gRNA sequence
caggaggcggaggttgcagt

SEQ ID NO: 597755 - DNA, 20 bp, Artificial
  CRISPR gRNA sequence
aggcggaggttgcagtgagc

SEQ ID NO: 597756 - DNA, 20 bp, Artificial
  CRISPR gRNA sequence
cagtgagccagatcgcgcca

SEQ ID NO: 597757 - DNA, 20 bp, Artificial
  CRISPR gRNA sequence
cagatcgcgccacggcactc

SEQ ID NO: 597758 - DNA, 20 bp, Artificial
  CRISPR gRNA sequence
cgcgccacggcactccagcc

SEQ ID NO: 597759 - DNA, 20 bp, Artificial
  CRISPR gRNA sequence
gcgccacggcactccagcct

SEQ ID NO: 597760 - DNA, 20 bp, Artificial
  CRISPR gRNA sequence
cggcactccagcctgggcta

SEQ ID NO: 597761 - DNA, 20 bp, Artificial
  CRISPR gRNA sequence
gcactccagcctgggctaca

SEQ ID NO: 597762 - DNA, 20 bp, Artificial
  CRISPR gRNA sequence
tccagcctgggctacagagc

SEQ ID NO: 597763 - DNA, 20 bp, Artificial
  CRISPR gRNA sequence
tccgtttcaaaaaaaaaaaa

SEQ ID NO: 597764 - DNA, 20 bp, Artificial
  CRISPR gRNA sequence
tttcaaaaaaaaaaaaaaga

SEQ ID NO: 597765 - DNA, 20 bp, Artificial
  CRISPR gRNA sequence
aaaaaaaaaaaaaagaaaga

SEQ ID NO: 597766 - DNA, 20 bp, Artificial
  CRISPR gRNA sequence
aaaaaaagaaagaaagaaaa

SEQ ID NO: 597767 - DNA, 20 bp, Artificial
  CRISPR gRNA sequence
aagaaagaaagaaaaaagaa

SEQ ID NO: 597768 - DNA, 20 bp, Artificial
  CRISPR gRNA sequence
aagaaagaaaaaagaaaaga

SEQ ID NO: 597769 - DNA, 20 bp, Artificial
  CRISPR gRNA sequence
gaaagaaaaaagaaaagaaa

SEQ ID NO: 597770 - DNA, 20 bp, Artificial
  CRISPR gRNA sequence
gaaaaaagaaaagaaagagc

SEQ ID NO: 597771 - DNA, 20 bp, Artificial
  CRISPR gRNA sequence
aaaaaagaaaagaaagagcc

SEQ ID NO: 597772 - DNA, 20 bp, Artificial
  CRISPR gRNA sequence
aaaaagaaaagaaagagccg

SEQ ID NO: 597773 - DNA, 20 bp, Artificial
  CRISPR gRNA sequence
aaaagaaaagaaagagccgg

SEQ ID NO: 597774 - DNA, 20 bp, Artificial
  CRISPR gRNA sequence
agaaaagaaagagccggggg

SEQ ID NO: 597775 - DNA, 20 bp, Artificial
  CRISPR gRNA sequence
aaagaaagagccgggggcag

SEQ ID NO: 597776 - DNA, 20 bp, Artificial
  CRISPR gRNA sequence
gtggctttatgcctgtaatc

SEQ ID NO: 597777 - DNA, 20 bp, Artificial
  CRISPR gRNA sequence
atgcctgtaatccagcactt

SEQ ID NO: 597778 - DNA, 20 bp, Artificial
  CRISPR gRNA sequence
tgcctgtaatccagcacttt

SEQ ID NO: 597779 - DNA, 20 bp, Artificial
  CRISPR gRNA sequence
cctgtaatccagcactttgg

SEQ ID NO: 597780 - DNA, 20 bp, Artificial
  CRISPR gRNA sequence
ctgtaatccagcactttggg

SEQ ID NO: 597781 - DNA, 20 bp, Artificial
  CRISPR gRNA sequence
atccagcactttgggaggct

SEQ ID NO: 597782 - DNA, 20 bp, Artificial
  CRISPR gRNA sequence
tccagcactttgggaggctg

SEQ ID NO: 597783 - DNA, 20 bp, Artificial
  CRISPR gRNA sequence
agcactttgggaggctgagg

SEQ ID NO: 597784 - DNA, 20 bp, Artificial
  CRISPR gRNA sequence
gcactttgggaggctgaggc

SEQ ID NO: 597785 - DNA, 20 bp, Artificial
  CRISPR gRNA sequence
ctttgggaggctgaggcagg

SEQ ID NO: 597786 - DNA, 20 bp, Artificial
  CRISPR gRNA sequence
gggaggctgaggcaggtgga

SEQ ID NO: 597787 - DNA, 20 bp, Artificial
  CRISPR gRNA sequence
ctgaggcaggtggatagccc

SEQ ID NO: 597788 - DNA, 20 bp, Artificial
  CRISPR gRNA sequence
tgaggcaggtggatagcccg

SEQ ID NO: 597789 - DNA, 20 bp, Artificial
  CRISPR gRNA sequence
caggtggatagcccgaggtc

SEQ ID NO: 597790 - DNA, 20 bp, Artificial
  CRISPR gRNA sequence
ggtggatagcccgaggtcaa

SEQ ID NO: 597791 - DNA, 20 bp, Artificial
  CRISPR gRNA sequence
tagcccgaggtcaagagttt

SEQ ID NO: 597792 - DNA, 20 bp, Artificial
  CRISPR gRNA sequence
cgaggtcaagagtttgagac

SEQ ID NO: 597793 - DNA, 20 bp, Artificial
  CRISPR gRNA sequence
tgagaccagcctgaccaact

SEQ ID NO: 597794 - DNA, 20 bp, Artificial
  CRISPR gRNA sequence
acactaaaaaataaaaaaat

SEQ ID NO: 597795 - DNA, 20 bp, Artificial
  CRISPR gRNA sequence
taaaaaataaaaaaattagc

SEQ ID NO: 597796 - DNA, 20 bp, Artificial
  CRISPR gRNA sequence
ataaaaaaattagctggacg

SEQ ID NO: 597797 - DNA, 20 bp, Artificial
  CRISPR gRNA sequence
aaattagctggacgtggtga

SEQ ID NO: 597798 - DNA, 20 bp, Artificial
  CRISPR gRNA sequence
aattagctggacgtggtgat

SEQ ID NO: 597799 - DNA, 20 bp, Artificial
  CRISPR gRNA sequence
gtgatgggcgcctgtaatcc

SEQ ID NO: 597800 - DNA, 20 bp, Artificial
  CRISPR gRNA sequence
cgcctgtaatcccagctact

SEQ ID NO: 597801 - DNA, 20 bp, Artificial
  CRISPR gRNA sequence
gcctgtaatcccagctactc

SEQ ID NO: 597802 - DNA, 20 bp, Artificial
  CRISPR gRNA sequence
ctgtaatcccagctactcgg

SEQ ID NO: 597803 - DNA, 20 bp, Artificial
  CRISPR gRNA sequence
tcccagctactcgggagact

SEQ ID NO: 597804 - DNA, 20 bp, Artificial
  CRISPR gRNA sequence
cccagctactcgggagactg

SEQ ID NO: 597805 - DNA, 20 bp, Artificial
  CRISPR gRNA sequence
agctactcgggagactgagg

SEQ ID NO: 597806 - DNA, 20 bp, Artificial
  CRISPR gRNA sequence
gctactcgggagactgaggc

SEQ ID NO: 597807 - DNA, 20 bp, Artificial
  CRISPR gRNA sequence
tactcgggagactgaggcag

SEQ ID NO: 597808 - DNA, 20 bp, Artificial
  CRISPR gRNA sequence
gcaggagaattgcttgaacc

SEQ ID NO: 597809 - DNA, 20 bp, Artificial
  CRISPR gRNA sequence
caggagaattgcttgaacct

SEQ ID NO: 597810 - DNA, 20 bp, Artificial
  CRISPR gRNA sequence
ggagaattgcttgaacctgg

SEQ ID NO: 597811 - DNA, 20 bp, Artificial
  CRISPR gRNA sequence
attgcttgaacctgggagtg

SEQ ID NO: 597812 - DNA, 20 bp, Artificial
  CRISPR gRNA sequence
ttgcttgaacctgggagtga

SEQ ID NO: 597813 - DNA, 20 bp, Artificial
  CRISPR gRNA sequence
tgcttgaacctgggagtgaa

SEQ ID NO: 597814 - DNA, 20 bp, Artificial
  CRISPR gRNA sequence
aacctgggagtgaagggttg

SEQ ID NO: 597815 - DNA, 20 bp, Artificial
  CRISPR gRNA sequence
tgggagtgaagggttgcagt

SEQ ID NO: 597816 - DNA, 20 bp, Artificial
  CRISPR gRNA sequence
gtgaagggttgcagtgagcc

SEQ ID NO: 597817 - DNA, 20 bp, Artificial
  CRISPR gRNA sequence
aagatcgcgccactgcactc

SEQ ID NO: 597818 - DNA, 20 bp, Artificial
  CRISPR gRNA sequence
cgcgccactgcactccagcc

SEQ ID NO: 597819 - DNA, 20 bp, Artificial
  CRISPR gRNA sequence
gcgccactgcactccagcct

SEQ ID NO: 597820 - DNA, 20 bp, Artificial
  CRISPR gRNA sequence
ctgcactccagcctgggtga

SEQ ID NO: 597821 - DNA, 20 bp, Artificial
  CRISPR gRNA sequence
gcactccagcctgggtgaca

SEQ ID NO: 597822 - DNA, 20 bp, Artificial
  CRISPR gRNA sequence
ctccagcctgggtgacagag

SEQ ID NO: 597823 - DNA, 20 bp, Artificial
  CRISPR gRNA sequence
tccagcctgggtgacagagc

SEQ ID NO: 597824 - DNA, 20 bp, Artificial
  CRISPR gRNA sequence
caaaaaaaaaaaaaaaaaaa

SEQ ID NO: 597825 - DNA, 20 bp, Artificial
  CRISPR gRNA sequence
aaaaaaaaaaaaaaaagaaa

SEQ ID NO: 597826 - DNA, 20 bp, Artificial
  CRISPR gRNA sequence
aaaaaaaaaagaaaaagaaa

SEQ ID NO: 597827 - DNA, 20 bp, Artificial
  CRISPR gRNA sequence
aaaaagaaaaagaaaaagaa

SEQ ID NO: 597828 - DNA, 20 bp, Artificial
  CRISPR gRNA sequence
aaaagaaaaagaaaagaaaa

SEQ ID NO: 597829 - DNA, 20 bp, Artificial
  CRISPR gRNA sequence
gaaaaagaaaagaaaaaaga

SEQ ID NO: 597830 - DNA, 20 bp, Artificial
  CRISPR gRNA sequence
aaagaaaaaagaaagaataa

SEQ ID NO: 597831 - DNA, 20 bp, Artificial
  CRISPR gRNA sequence
aaaagaaagaataaaagaaa

SEQ ID NO: 597832 - DNA, 20 bp, Artificial
  CRISPR gRNA sequence
ttatattttgactaaatcta

SEQ ID NO: 597833 - DNA, 20 bp, Artificial
  CRISPR gRNA sequence
tgactaaatctatagtaaaa

SEQ ID NO: 597834 - DNA, 20 bp, Artificial
  CRISPR gRNA sequence
aatagtattcaataaatctg

SEQ ID NO: 597835 - DNA, 20 bp, Artificial
  CRISPR gRNA sequence
tacatgaaaatgcctgattt

SEQ ID NO: 597836 - DNA, 20 bp, Artificial
  CRISPR gRNA sequence
tcagtatttatcattgatga

SEQ ID NO: 597837 - DNA, 20 bp, Artificial
  CRISPR gRNA sequence
tgacagctgatcatttttat

SEQ ID NO: 597838 - DNA, 20 bp, Artificial
  CRISPR gRNA sequence
ataattttattgaaatttca

SEQ ID NO: 597839 - DNA, 20 bp, Artificial
  CRISPR gRNA sequence
attgaaatttcaaagttaaa

SEQ ID NO: 597840 - DNA, 20 bp, Artificial
  CRISPR gRNA sequence
caaagttaaatggatgtaat

SEQ ID NO: 597841 - DNA, 20 bp, Artificial
  CRISPR gRNA sequence
aagttaaatggatgtaatca

SEQ ID NO: 597842 - DNA, 20 bp, Artificial
  CRISPR gRNA sequence
gatgtaatcagagctactat

SEQ ID NO: 597843 - DNA, 20 bp, Artificial
  CRISPR gRNA sequence
cagagctactatcagttttc

SEQ ID NO: 597844 - DNA, 20 bp, Artificial
  CRISPR gRNA sequence
tctggctccatactttcttt

SEQ ID NO: 597845 - DNA, 20 bp, Artificial
  CRISPR gRNA sequence
tggctccatactttctttta

SEQ ID NO: 597846 - DNA, 20 bp, Artificial
  CRISPR gRNA sequence
ggctccatactttcttttag

SEQ ID NO: 597847 - DNA, 20 bp, Artificial
  CRISPR gRNA sequence
ccatactttcttttagagga

SEQ ID NO: 597848 - DNA, 20 bp, Artificial
  CRISPR gRNA sequence
ggatggttgactgaattcat

SEQ ID NO: 597849 - DNA, 20 bp, Artificial
  CRISPR gRNA sequence
tatatgaatttattttttgt

SEQ ID NO: 597850 - DNA, 20 bp, Artificial
  CRISPR gRNA sequence
tatgaatttattttttgtaa

SEQ ID NO: 597851 - DNA, 20 bp, Artificial
  CRISPR gRNA sequence
tattttttgtaagagactta

SEQ ID NO: 597852 - DNA, 20 bp, Artificial
  CRISPR gRNA sequence
tgtaagagacttaaagaatg

SEQ ID NO: 597853 - DNA, 20 bp, Artificial
  CRISPR gRNA sequence
ttaaagaatgtagaactatt

SEQ ID NO: 597854 - DNA, 20 bp, Artificial
  CRISPR gRNA sequence
gtttaccctccgatatccca

SEQ ID NO: 597855 - DNA, 20 bp, Artificial
  CRISPR gRNA sequence
atcccaaagtcaactatatc

SEQ ID NO: 597856 - DNA, 20 bp, Artificial
  CRISPR gRNA sequence
tatgcttttaaaaacataaa

SEQ ID NO: 597857 - DNA, 20 bp, Artificial
  CRISPR gRNA sequence
aaatggtattatcatataca

SEQ ID NO: 597858 - DNA, 20 bp, Artificial
  CRISPR gRNA sequence
atggtattatcatatacata

SEQ ID NO: 597859 - DNA, 20 bp, Artificial
  CRISPR gRNA sequence
gttgtatgaaatcaattgtc

SEQ ID NO: 597860 - DNA, 20 bp, Artificial
  CRISPR gRNA sequence
atcaattgtctagttaacta

SEQ ID NO: 597861 - DNA, 20 bp, Artificial
  CRISPR gRNA sequence
ctagttaactatagcttctc

SEQ ID NO: 597862 - DNA, 20 bp, Artificial
  CRISPR gRNA sequence
atatctcttcaaatttgtta

SEQ ID NO: 597863 - DNA, 20 bp, Artificial
  CRISPR gRNA sequence
tatctcttcaaatttgttac

SEQ ID NO: 597864 - DNA, 20 bp, Artificial
  CRISPR gRNA sequence
tccccaaaactttatgcaaa

SEQ ID NO: 597865 - DNA, 20 bp, Artificial
  CRISPR gRNA sequence
attttaaattgtgttttgtt

SEQ ID NO: 597866 - DNA, 20 bp, Artificial
  CRISPR gRNA sequence
ttttaaattgtgttttgttg

SEQ ID NO: 597867 - DNA, 20 bp, Artificial
  CRISPR gRNA sequence
aattgtgttttgttgaggta

SEQ ID NO: 597868 - DNA, 20 bp, Artificial
  CRISPR gRNA sequence
attgtgttttgttgaggtac

SEQ ID NO: 597869 - DNA, 20 bp, Artificial
  CRISPR gRNA sequence
ttgtgttttgttgaggtacg

SEQ ID NO: 597870 - DNA, 20 bp, Artificial
  CRISPR gRNA sequence
tgtgttttgttgaggtacgg

SEQ ID NO: 597871 - DNA, 20 bp, Artificial
  CRISPR gRNA sequence
attaaatctaaaactatcat

SEQ ID NO: 597872 - DNA, 20 bp, Artificial
  CRISPR gRNA sequence
ttaaatctaaaactatcatt

SEQ ID NO: 597873 - DNA, 20 bp, Artificial
  CRISPR gRNA sequence
gtcattaatgtgtcataatt

SEQ ID NO: 597874 - DNA, 20 bp, Artificial
  CRISPR gRNA sequence
ttaatgtgtcataattcaga

SEQ ID NO: 597875 - DNA, 20 bp, Artificial
  CRISPR gRNA sequence
tgtgtcataattcagacaga

SEQ ID NO: 597876 - DNA, 20 bp, Artificial
  CRISPR gRNA sequence
gtcataattcagacagatgg

SEQ ID NO: 597877 - DNA, 20 bp, Artificial
  CRISPR gRNA sequence
agtgtgtaaattcatgcttc

SEQ ID NO: 597878 - DNA, 20 bp, Artificial
  CRISPR gRNA sequence
atgcttcgagaacttaaaaa

SEQ ID NO: 597879 - DNA, 20 bp, Artificial
  CRISPR gRNA sequence
cttcgagaacttaaaaacag

SEQ ID NO: 597880 - DNA, 20 bp, Artificial
  CRISPR gRNA sequence
acttaaaaacagcagactca

SEQ ID NO: 597881 - DNA, 20 bp, Artificial
  CRISPR gRNA sequence
atatttctttttataattct

SEQ ID NO: 597882 - DNA, 20 bp, Artificial
  CRISPR gRNA sequence
ttataattctcagttatgtc

SEQ ID NO: 597883 - DNA, 20 bp, Artificial
  CRISPR gRNA sequence
cacaatctattgctgctttc

SEQ ID NO: 597884 - DNA, 20 bp, Artificial
  CRISPR gRNA sequence
aatctattgctgctttcaag

SEQ ID NO: 597885 - DNA, 20 bp, Artificial
  CRISPR gRNA sequence
tcaaaaatgtaataatgtaa

SEQ ID NO: 597886 - DNA, 20 bp, Artificial
  CRISPR gRNA sequence
aaaatgtaataatgtaatag

SEQ ID NO: 597887 - DNA, 20 bp, Artificial
  CRISPR gRNA sequence
catttccaaatactacattc

SEQ ID NO: 597888 - DNA, 20 bp, Artificial
  CRISPR gRNA sequence
tccaaatactacattcgagt

SEQ ID NO: 597889 - DNA, 20 bp, Artificial
  CRISPR gRNA sequence
acattcgagtcagtgttttt

SEQ ID NO: 597890 - DNA, 20 bp, Artificial
  CRISPR gRNA sequence
cattcgagtcagtgttttta

SEQ ID NO: 597891 - DNA, 20 bp, Artificial
  CRISPR gRNA sequence
agtcagtgtttttaaggcgt

SEQ ID NO: 597892 - DNA, 20 bp, Artificial
  CRISPR gRNA sequence
ttaaggcgtaagtcatttta

SEQ ID NO: 597893 - DNA, 20 bp, Artificial
  CRISPR gRNA sequence
aggcgtaagtcattttaaag

SEQ ID NO: 597894 - DNA, 20 bp, Artificial
  CRISPR gRNA sequence
aagcagtacacaaaaatgat

SEQ ID NO: 597895 - DNA, 20 bp, Artificial
  CRISPR gRNA sequence
agcagtacacaaaaatgatt

SEQ ID NO: 597896 - DNA, 20 bp, Artificial
  CRISPR gRNA sequence
gattaggtaccacctatttt

SEQ ID NO: 597897 - DNA, 20 bp, Artificial
  CRISPR gRNA sequence
agtacctaaaaattattgaa

SEQ ID NO: 597898 - DNA, 20 bp, Artificial
  CRISPR gRNA sequence
tattgaatagctcaattttc

SEQ ID NO: 597899 - DNA, 20 bp, Artificial
  CRISPR gRNA sequence
atagctcaattttcaagctt

SEQ ID NO: 597900 - DNA, 20 bp, Artificial
  CRISPR gRNA sequence
ttcaagctttagatgatatt

SEQ ID NO: 597901 - DNA, 20 bp, Artificial
  CRISPR gRNA sequence
tcaagctttagatgatattt

SEQ ID NO: 597902 - DNA, 20 bp, Artificial
  CRISPR gRNA sequence
agatgatatttgggtgatct

SEQ ID NO: 597903 - DNA, 20 bp, Artificial
  CRISPR gRNA sequence
gatatttgggtgatctgagc

SEQ ID NO: 597904 - DNA, 20 bp, Artificial
  CRISPR gRNA sequence
atctgagcaagcatttctaa

SEQ ID NO: 597905 - DNA, 20 bp, Artificial
  CRISPR gRNA sequence
gcaagcatttctaatagaaa

SEQ ID NO: 597906 - DNA, 20 bp, Artificial
  CRISPR gRNA sequence
acgaattaaatatacatcct

SEQ ID NO: 597907 - DNA, 20 bp, Artificial
  CRISPR gRNA sequence
atcctcagccctaaaaacta

SEQ ID NO: 597908 - DNA, 20 bp, Artificial
  CRISPR gRNA sequence
actatagaaatgccactttt

SEQ ID NO: 597909 - DNA, 20 bp, Artificial
  CRISPR gRNA sequence
atgccacttttcagtctaaa

SEQ ID NO: 597910 - DNA, 20 bp, Artificial
  CRISPR gRNA sequence
cttttcagtctaaaaagtaa

SEQ ID NO: 597911 - DNA, 20 bp, Artificial
  CRISPR gRNA sequence
taacagatgtattgaaaata

SEQ ID NO: 597912 - DNA, 20 bp, Artificial
  CRISPR gRNA sequence
gaaaataaagtcatctactt

SEQ ID NO: 597913 - DNA, 20 bp, Artificial
  CRISPR gRNA sequence
cttcagaccatctgaataat

SEQ ID NO: 597914 - DNA, 20 bp, Artificial
  CRISPR gRNA sequence
catctgaataataagcatat

SEQ ID NO: 597915 - DNA, 20 bp, Artificial
  CRISPR gRNA sequence
aataataagcatattggcat

SEQ ID NO: 597916 - DNA, 20 bp, Artificial
  CRISPR gRNA sequence
catattggcataagtctgat

SEQ ID NO: 597917 - DNA, 20 bp, Artificial
  CRISPR gRNA sequence
attggcataagtctgattag

SEQ ID NO: 597918 - DNA, 20 bp, Artificial
  CRISPR gRNA sequence
agtctgattagaagacctat

SEQ ID NO: 597919 - DNA, 20 bp, Artificial
  CRISPR gRNA sequence
gtatttttaaacaacaaaac

SEQ ID NO: 597920 - DNA, 20 bp, Artificial
  CRISPR gRNA sequence
tatttttaaacaacaaaaca

SEQ ID NO: 597921 - DNA, 20 bp, Artificial
  CRISPR gRNA sequence
aacaaggatatttatgaaaa

SEQ ID NO: 597922 - DNA, 20 bp, Artificial
  CRISPR gRNA sequence
atttatgaaaatggccatga

SEQ ID NO: 597923 - DNA, 20 bp, Artificial
  CRISPR gRNA sequence
gaaaatgttttatatacttg

SEQ ID NO: 597924 - DNA, 20 bp, Artificial
  CRISPR gRNA sequence
aatgttttatatacttgtag

SEQ ID NO: 597925 - DNA, 20 bp, Artificial
  CRISPR gRNA sequence
tagaagaaattatgcctatt

SEQ ID NO: 597926 - DNA, 20 bp, Artificial
  CRISPR gRNA sequence
atgcctatttagaactcaac

SEQ ID NO: 597927 - DNA, 20 bp, Artificial
  CRISPR gRNA sequence
tgttaattcaactgaaaaca

SEQ ID NO: 597928 - DNA, 20 bp, Artificial
  CRISPR gRNA sequence
caactgaaaacacagcaacg

SEQ ID NO: 597929 - DNA, 20 bp, Artificial
  CRISPR gRNA sequence
aacacagcaacgtagtaccc

SEQ ID NO: 597930 - DNA, 20 bp, Artificial
  CRISPR gRNA sequence
gtaccctagcacttcaaaat

SEQ ID NO: 597931 - DNA, 20 bp, Artificial
  CRISPR gRNA sequence
tagcacttcaaaataagatc

SEQ ID NO: 597932 - DNA, 20 bp, Artificial
  CRISPR gRNA sequence
gtcctgcatgttgaatgtct

SEQ ID NO: 597933 - DNA, 20 bp, Artificial
  CRISPR gRNA sequence
tgcatgttgaatgtcttagt

SEQ ID NO: 597934 - DNA, 20 bp, Artificial
  CRISPR gRNA sequence
atgttgaatgtcttagtaag

SEQ ID NO: 597935 - DNA, 20 bp, Artificial
  CRISPR gRNA sequence
ttgaatgtcttagtaagaag

SEQ ID NO: 597936 - DNA, 20 bp, Artificial
  CRISPR gRNA sequence
tgaatgtcttagtaagaagt

SEQ ID NO: 597937 - DNA, 20 bp, Artificial
  CRISPR gRNA sequence
atgtcttagtaagaagtagg

SEQ ID NO: 597938 - DNA, 20 bp, Artificial
  CRISPR gRNA sequence
gtcttagtaagaagtaggta

SEQ ID NO: 597939 - DNA, 20 bp, Artificial
  CRISPR gRNA sequence
agaagtaggtagagctgaca

SEQ ID NO: 597940 - DNA, 20 bp, Artificial
  CRISPR gRNA sequence
taggtagagctgacatagac

SEQ ID NO: 597941 - DNA, 20 bp, Artificial
  CRISPR gRNA sequence
aggtagagctgacatagaca

SEQ ID NO: 597942 - DNA, 20 bp, Artificial
  CRISPR gRNA sequence
ggtagagctgacatagacaa

SEQ ID NO: 597943 - DNA, 20 bp, Artificial
  CRISPR gRNA sequence
gagctgacatagacaagggt

SEQ ID NO: 597944 - DNA, 20 bp, Artificial
  CRISPR gRNA sequence
agctgacatagacaagggta

SEQ ID NO: 597945 - DNA, 20 bp, Artificial
  CRISPR gRNA sequence
ctgacatagacaagggtaag

SEQ ID NO: 597946 - DNA, 20 bp, Artificial
  CRISPR gRNA sequence
gacaagggtaaggagaacta

SEQ ID NO: 597947 - DNA, 20 bp, Artificial
  CRISPR gRNA sequence
actacagcttcaatgataat

SEQ ID NO: 597948 - DNA, 20 bp, Artificial
  CRISPR gRNA sequence
tacagcttcaatgataatga

SEQ ID NO: 597949 - DNA, 20 bp, Artificial
  CRISPR gRNA sequence
agcaatgacaaaaacgtcaa

SEQ ID NO: 597950 - DNA, 20 bp, Artificial
  CRISPR gRNA sequence
tgacaaaaacgtcaaaagtg

SEQ ID NO: 597951 - DNA, 20 bp, Artificial
  CRISPR gRNA sequence
acgtcaaaagtgtagacacc

SEQ ID NO: 597952 - DNA, 20 bp, Artificial
  CRISPR gRNA sequence
cacccagaatgttaatttat

SEQ ID NO: 597953 - DNA, 20 bp, Artificial
  CRISPR gRNA sequence
tatacactcatcaaaatatc

SEQ ID NO: 597954 - DNA, 20 bp, Artificial
  CRISPR gRNA sequence
tacactcatcaaaatatctg

SEQ ID NO: 597955 - DNA, 20 bp, Artificial
  CRISPR gRNA sequence
tcaaaatatctggagtgcat

SEQ ID NO: 597956 - DNA, 20 bp, Artificial
  CRISPR gRNA sequence
atatctggagtgcataagaa

SEQ ID NO: 597957 - DNA, 20 bp, Artificial
  CRISPR gRNA sequence
tgcataagaaaagctaattg

SEQ ID NO: 597958 - DNA, 20 bp, Artificial
  CRISPR gRNA sequence
cttgtacatgctactaaaaa

SEQ ID NO: 597959 - DNA, 20 bp, Artificial
  CRISPR gRNA sequence
catgctactaaaaacagttt

SEQ ID NO: 597960 - DNA, 20 bp, Artificial
  CRISPR gRNA sequence
actaaaaacagtttaagtga

SEQ ID NO: 597961 - DNA, 20 bp, Artificial
  CRISPR gRNA sequence
taaaaacagtttaagtgatg

SEQ ID NO: 597962 - DNA, 20 bp, Artificial
  CRISPR gRNA sequence
cagtttaagtgatggagaac

SEQ ID NO: 597963 - DNA, 20 bp, Artificial
  CRISPR gRNA sequence
agaactggctttaaaattac

SEQ ID NO: 597964 - DNA, 20 bp, Artificial
  CRISPR gRNA sequence
gctttaaaattacaagtata

SEQ ID NO: 597965 - DNA, 20 bp, Artificial
  CRISPR gRNA sequence
aaccttaaatgtgctatatc

SEQ ID NO: 597966 - DNA, 20 bp, Artificial
  CRISPR gRNA sequence
gtgctatatcaagatattaa

SEQ ID NO: 597967 - DNA, 20 bp, Artificial
  CRISPR gRNA sequence
ctatatcaagatattaatag

SEQ ID NO: 597968 - DNA, 20 bp, Artificial
  CRISPR gRNA sequence
agatattaatagtagtaatg

SEQ ID NO: 597969 - DNA, 20 bp, Artificial
  CRISPR gRNA sequence
agtagtaatgaagatgatga

SEQ ID NO: 597970 - DNA, 20 bp, Artificial
  CRISPR gRNA sequence
agtaatgaagatgatgatgg

SEQ ID NO: 597971 - DNA, 20 bp, Artificial
  CRISPR gRNA sequence
agatgatgatggtggtgtca

SEQ ID NO: 597972 - DNA, 20 bp, Artificial
  CRISPR gRNA sequence
catctacattaacattcatg

SEQ ID NO: 597973 - DNA, 20 bp, Artificial
  CRISPR gRNA sequence
catgtggattccactgaaca

SEQ ID NO: 597974 - DNA, 20 bp, Artificial
  CRISPR gRNA sequence
ttccactgaacatggttgta

SEQ ID NO: 597975 - DNA, 20 bp, Artificial
  CRISPR gRNA sequence
tgaacatggttgtatagaat

SEQ ID NO: 597976 - DNA, 20 bp, Artificial
  CRISPR gRNA sequence
tgtatagaatcagaaaacat

SEQ ID NO: 597977 - DNA, 20 bp, Artificial
  CRISPR gRNA sequence
cagaaaacataagaactgtt

SEQ ID NO: 597978 - DNA, 20 bp, Artificial
  CRISPR gRNA sequence
ataagaactgtttagaaact

SEQ ID NO: 597979 - DNA, 20 bp, Artificial
  CRISPR gRNA sequence
aagaactgtttagaaactta

SEQ ID NO: 597980 - DNA, 20 bp, Artificial
  CRISPR gRNA sequence
ctgtttagaaacttagagat

SEQ ID NO: 597981 - DNA, 20 bp, Artificial
  CRISPR gRNA sequence
gaaacttagagatcagcttt

SEQ ID NO: 597982 - DNA, 20 bp, Artificial
  CRISPR gRNA sequence
aaacttagagatcagctttt

SEQ ID NO: 597983 - DNA, 20 bp, Artificial
  CRISPR gRNA sequence
cagcttttgggaccaatttg

SEQ ID NO: 597984 - DNA, 20 bp, Artificial
  CRISPR gRNA sequence
gaagattacaaaatcttttt

SEQ ID NO: 597985 - DNA, 20 bp, Artificial
  CRISPR gRNA sequence
agattacaaaatctttttca

SEQ ID NO: 597986 - DNA, 20 bp, Artificial
  CRISPR gRNA sequence
tacaaaatctttttcagagt

SEQ ID NO: 597987 - DNA, 20 bp, Artificial
  CRISPR gRNA sequence
aaaaataacacatccccaaa

SEQ ID NO: 597988 - DNA, 20 bp, Artificial
  CRISPR gRNA sequence
aaataacacatccccaaaca

SEQ ID NO: 597989 - DNA, 20 bp, Artificial
  CRISPR gRNA sequence
ccccaaacagagaaaatcac

SEQ ID NO: 597990 - DNA, 20 bp, Artificial
  CRISPR gRNA sequence
agagaaaatcacaagtaaat

SEQ ID NO: 597991 - DNA, 20 bp, Artificial
  CRISPR gRNA sequence
gagaaaatcacaagtaaatt

SEQ ID NO: 597992 - DNA, 20 bp, Artificial
  CRISPR gRNA sequence
cacaagtaaattaggatttt

SEQ ID NO: 597993 - DNA, 20 bp, Artificial
  CRISPR gRNA sequence
tttggattatttcaacaact

SEQ ID NO: 597994 - DNA, 20 bp, Artificial
  CRISPR gRNA sequence
atttcaacaactaagaaatc

SEQ ID NO: 597995 - DNA, 20 bp, Artificial
  CRISPR gRNA sequence
tcaagtttccaaattttttc

SEQ ID NO: 597996 - DNA, 20 bp, Artificial
  CRISPR gRNA sequence
agtttccaaattttttcaag

SEQ ID NO: 597997 - DNA, 20 bp, Artificial
  CRISPR gRNA sequence
ccaaattttttcaagtagat

SEQ ID NO: 597998 - DNA, 20 bp, Artificial
  CRISPR gRNA sequence
aattttttcaagtagatcag

SEQ ID NO: 597999 - DNA, 20 bp, Artificial
  CRISPR gRNA sequence
tcagaagcatactatttaaa

SEQ ID NO: 598000 - DNA, 20 bp, Artificial
  CRISPR gRNA sequence
atatgtaatatgctaatctt

SEQ ID NO: 598001 - DNA, 20 bp, Artificial
  CRISPR gRNA sequence
cttcattcaacaaatattta

SEQ ID NO: 598002 - DNA, 20 bp, Artificial
  CRISPR gRNA sequence
ttcattcaacaaatatttac

SEQ ID NO: 598003 - DNA, 20 bp, Artificial
  CRISPR gRNA sequence
tcattcaacaaatatttaca

SEQ ID NO: 598004 - DNA, 20 bp, Artificial
  CRISPR gRNA sequence
aatgcatacaatgcatatgc

SEQ ID NO: 598005 - DNA, 20 bp, Artificial
  CRISPR gRNA sequence
atgcatacaatgcatatgct

SEQ ID NO: 598006 - DNA, 20 bp, Artificial
  CRISPR gRNA sequence
tgcatacaatgcatatgcta

SEQ ID NO: 598007 - DNA, 20 bp, Artificial
  CRISPR gRNA sequence
caatgcatatgctagggatg

SEQ ID NO: 598008 - DNA, 20 bp, Artificial
  CRISPR gRNA sequence
atgcatatgctagggatgaa

SEQ ID NO: 598009 - DNA, 20 bp, Artificial
  CRISPR gRNA sequence
agatatgaccattttcccca

SEQ ID NO: 598010 - DNA, 20 bp, Artificial
  CRISPR gRNA sequence
tttccccaaagattcacatc

SEQ ID NO: 598011 - DNA, 20 bp, Artificial
  CRISPR gRNA sequence
tgattaatttctttataatc

SEQ ID NO: 598012 - DNA, 20 bp, Artificial
  CRISPR gRNA sequence
gattaatttctttataatca

SEQ ID NO: 598013 - DNA, 20 bp, Artificial
  CRISPR gRNA sequence
atttctttataatcaaggtg

SEQ ID NO: 598014 - DNA, 20 bp, Artificial
  CRISPR gRNA sequence
ataaatctatatgctttgaa

SEQ ID NO: 598015 - DNA, 20 bp, Artificial
  CRISPR gRNA sequence
aaagttacttaattcacact

SEQ ID NO: 598016 - DNA, 20 bp, Artificial
  CRISPR gRNA sequence
ttaattcacactcagtaatt

SEQ ID NO: 598017 - DNA, 20 bp, Artificial
  CRISPR gRNA sequence
ttcacactcagtaattaaga

SEQ ID NO: 598018 - DNA, 20 bp, Artificial
  CRISPR gRNA sequence
ctaactaacatgaaatacaa

SEQ ID NO: 598019 - DNA, 20 bp, Artificial
  CRISPR gRNA sequence
ctataaaatctcatttgatg

SEQ ID NO: 598020 - DNA, 20 bp, Artificial
  CRISPR gRNA sequence
aaaatctcatttgatgcggt

SEQ ID NO: 598021 - DNA, 20 bp, Artificial
  CRISPR gRNA sequence
gatcacttcaataatttcat

SEQ ID NO: 598022 - DNA, 20 bp, Artificial
  CRISPR gRNA sequence
cttcaataatttcatgagac

SEQ ID NO: 598023 - DNA, 20 bp, Artificial
  CRISPR gRNA sequence
ataatttcatgagactggtt

SEQ ID NO: 598024 - DNA, 20 bp, Artificial
  CRISPR gRNA sequence
tttccttctgacctataaac

SEQ ID NO: 598025 - DNA, 20 bp, Artificial
  CRISPR gRNA sequence
ccttctgacctataaactgg

SEQ ID NO: 598026 - DNA, 20 bp, Artificial
  CRISPR gRNA sequence
tggaagtgcctctatatcac

SEQ ID NO: 598027 - DNA, 20 bp, Artificial
  CRISPR gRNA sequence
tctatatcaccagctaactt

SEQ ID NO: 598028 - DNA, 20 bp, Artificial
  CRISPR gRNA sequence
ctatatcaccagctaactta

SEQ ID NO: 598029 - DNA, 20 bp, Artificial
  CRISPR gRNA sequence
gctaacttaaggatctttcc

SEQ ID NO: 598030 - DNA, 20 bp, Artificial
  CRISPR gRNA sequence
ctaacttaaggatctttcct

SEQ ID NO: 598031 - DNA, 20 bp, Artificial
  CRISPR gRNA sequence
acttaaggatctttcctagg

SEQ ID NO: 598032 - DNA, 20 bp, Artificial
  CRISPR gRNA sequence
taaggatctttcctaggtgg

SEQ ID NO: 598033 - DNA, 20 bp, Artificial
  CRISPR gRNA sequence
ttttccatcttcatctaaaa

SEQ ID NO: 598034 - DNA, 20 bp, Artificial
  CRISPR gRNA sequence
cttcatctaaaatagatatt

SEQ ID NO: 598035 - DNA, 20 bp, Artificial
  CRISPR gRNA sequence
tcttaaactgctgaccacat

SEQ ID NO: 598036 - DNA, 20 bp, Artificial
  CRISPR gRNA sequence
tgctgaccacatcagctgtc

SEQ ID NO: 598037 - DNA, 20 bp, Artificial
  CRISPR gRNA sequence
gctgtcgagatttctgtgaa

SEQ ID NO: 598038 - DNA, 20 bp, Artificial
  CRISPR gRNA sequence
gtcgagatttctgtgaatgg

SEQ ID NO: 598039 - DNA, 20 bp, Artificial
  CRISPR gRNA sequence
tgaatggaagttcgaattta

SEQ ID NO: 598040 - DNA, 20 bp, Artificial
  CRISPR gRNA sequence
gaagttcgaatttatggcaa

SEQ ID NO: 598041 - DNA, 20 bp, Artificial
  CRISPR gRNA sequence
gttcgaatttatggcaatag

SEQ ID NO: 598042 - DNA, 20 bp, Artificial
  CRISPR gRNA sequence
atttatggcaatagtagttg

SEQ ID NO: 598043 - DNA, 20 bp, Artificial
  CRISPR gRNA sequence
tttatggcaatagtagttga

SEQ ID NO: 598044 - DNA, 20 bp, Artificial
  CRISPR gRNA sequence
atggcaatagtagttgaagg

SEQ ID NO: 598045 - DNA, 20 bp, Artificial
  CRISPR gRNA sequence
gttgaaggaagtatccttta

SEQ ID NO: 598046 - DNA, 20 bp, Artificial
  CRISPR gRNA sequence
ttgaaggaagtatcctttat

SEQ ID NO: 598047 - DNA, 20 bp, Artificial
  CRISPR gRNA sequence
gtatcctttatgggcactat

SEQ ID NO: 598048 - DNA, 20 bp, Artificial
  CRISPR gRNA sequence
actataagattgtcttcata

SEQ ID NO: 598049 - DNA, 20 bp, Artificial
  CRISPR gRNA sequence
taagattgtcttcataaagt

SEQ ID NO: 598050 - DNA, 20 bp, Artificial
  CRISPR gRNA sequence
aagattgtcttcataaagtt

SEQ ID NO: 598051 - DNA, 20 bp, Artificial
  CRISPR gRNA sequence
aatcaacattttacaaatta

SEQ ID NO: 598052 - DNA, 20 bp, Artificial
  CRISPR gRNA sequence
caacattttacaaattaaag

SEQ ID NO: 598053 - DNA, 20 bp, Artificial
  CRISPR gRNA sequence
cagaaatataaatcacacta

SEQ ID NO: 598054 - DNA, 20 bp, Artificial
  CRISPR gRNA sequence
atcacactaaagaaaatgaa

SEQ ID NO: 598055 - DNA, 20 bp, Artificial
  CRISPR gRNA sequence
taaagaaaatgaatggatct

SEQ ID NO: 598056 - DNA, 20 bp, Artificial
  CRISPR gRNA sequence
aaagaaaatgaatggatctc

SEQ ID NO: 598057 - DNA, 20 bp, Artificial
  CRISPR gRNA sequence
aaaatgaatggatctcaggc

SEQ ID NO: 598058 - DNA, 20 bp, Artificial
  CRISPR gRNA sequence
tgaatggatctcaggccaga

SEQ ID NO: 598059 - DNA, 20 bp, Artificial
  CRISPR gRNA sequence
cctgattgtatgtattaata

SEQ ID NO: 598060 - DNA, 20 bp, Artificial
  CRISPR gRNA sequence
ctgattgtatgtattaatat

SEQ ID NO: 598061 - DNA, 20 bp, Artificial
  CRISPR gRNA sequence
gtatgtattaatataggtta

SEQ ID NO: 598062 - DNA, 20 bp, Artificial
  CRISPR gRNA sequence
tataggttacagactgaatc

SEQ ID NO: 598063 - DNA, 20 bp, Artificial
  CRISPR gRNA sequence
ataggttacagactgaatct

SEQ ID NO: 598064 - DNA, 20 bp, Artificial
  CRISPR gRNA sequence
taggttacagactgaatctg

SEQ ID NO: 598065 - DNA, 20 bp, Artificial
  CRISPR gRNA sequence
aggttacagactgaatctgg

SEQ ID NO: 598066 - DNA, 20 bp, Artificial
  CRISPR gRNA sequence
cagactgaatctgggggatt

SEQ ID NO: 598067 - DNA, 20 bp, Artificial
  CRISPR gRNA sequence
tgaatctgggggatttagcc

SEQ ID NO: 598068 - DNA, 20 bp, Artificial
  CRISPR gRNA sequence
gaatctgggggatttagcct

SEQ ID NO: 598069 - DNA, 20 bp, Artificial
  CRISPR gRNA sequence
tctgggggatttagcctagg

SEQ ID NO: 598070 - DNA, 20 bp, Artificial
  CRISPR gRNA sequence
gggatttagcctaggaagcc

SEQ ID NO: 598071 - DNA, 20 bp, Artificial
  CRISPR gRNA sequence
ggatttagcctaggaagcca

SEQ ID NO: 598072 - DNA, 20 bp, Artificial
  CRISPR gRNA sequence
gatttagcctaggaagccaa

SEQ ID NO: 598073 - DNA, 20 bp, Artificial
  CRISPR gRNA sequence
atttagcctaggaagccaag

SEQ ID NO: 598074 - DNA, 20 bp, Artificial
  CRISPR gRNA sequence
ggggaaaaaaaaatgaatct

SEQ ID NO: 598075 - DNA, 20 bp, Artificial
  CRISPR gRNA sequence
gaaaaaaaaatgaatctcag

SEQ ID NO: 598076 - DNA, 20 bp, Artificial
  CRISPR gRNA sequence
aatgaatctcagaagtattt

SEQ ID NO: 598077 - DNA, 20 bp, Artificial
  CRISPR gRNA sequence
cagaagtattttggttgaac

SEQ ID NO: 598078 - DNA, 20 bp, Artificial
  CRISPR gRNA sequence
agaagtattttggttgaact

SEQ ID NO: 598079 - DNA, 20 bp, Artificial
  CRISPR gRNA sequence
gaagtattttggttgaacta

SEQ ID NO: 598080 - DNA, 20 bp, Artificial
  CRISPR gRNA sequence
tctaaatccatgtccattaa

SEQ ID NO: 598081 - DNA, 20 bp, Artificial
  CRISPR gRNA sequence
ctaaatccatgtccattaaa

SEQ ID NO: 598082 - DNA, 20 bp, Artificial
  CRISPR gRNA sequence
aaatccatgtccattaaaag

SEQ ID NO: 598083 - DNA, 20 bp, Artificial
  CRISPR gRNA sequence
atccatgtccattaaaagga

SEQ ID NO: 598084 - DNA, 20 bp, Artificial
  CRISPR gRNA sequence
tccatgtccattaaaaggag

SEQ ID NO: 598085 - DNA, 20 bp, Artificial
  CRISPR gRNA sequence
ccatgtccattaaaaggaga

SEQ ID NO: 598086 - DNA, 20 bp, Artificial
  CRISPR gRNA sequence
ccattaaaaggagagggaac

SEQ ID NO: 598087 - DNA, 20 bp, Artificial
  CRISPR gRNA sequence
aaaggagagggaactggaca

SEQ ID NO: 598088 - DNA, 20 bp, Artificial
  CRISPR gRNA sequence
aaggagagggaactggacaa

SEQ ID NO: 598089 - DNA, 20 bp, Artificial
  CRISPR gRNA sequence
ttcaaccataattatccaaa

SEQ ID NO: 598090 - DNA, 20 bp, Artificial
  CRISPR gRNA sequence
tattgtgatgctgaatatat

SEQ ID NO: 598091 - DNA, 20 bp, Artificial
  CRISPR gRNA sequence
attgtgatgctgaatatatt

SEQ ID NO: 598092 - DNA, 20 bp, Artificial
  CRISPR gRNA sequence
ctgaatatattaggttctct

SEQ ID NO: 598093 - DNA, 20 bp, Artificial
  CRISPR gRNA sequence
tataactaactccctttatt

SEQ ID NO: 598094 - DNA, 20 bp, Artificial
  CRISPR gRNA sequence
ctttattcagattccttgct

SEQ ID NO: 598095 - DNA, 20 bp, Artificial
  CRISPR gRNA sequence
acctttactgattacccata

SEQ ID NO: 598096 - DNA, 20 bp, Artificial
  CRISPR gRNA sequence
cctttactgattacccatat

SEQ ID NO: 598097 - DNA, 20 bp, Artificial
  CRISPR gRNA sequence
tactgattacccatataggt

SEQ ID NO: 598098 - DNA, 20 bp, Artificial
  CRISPR gRNA sequence
acccatataggtcagttcac

SEQ ID NO: 598099 - DNA, 20 bp, Artificial
  CRISPR gRNA sequence
ttcacaagaacaaaatgatc

SEQ ID NO: 598100 - DNA, 20 bp, Artificial
  CRISPR gRNA sequence
aagaacaaaatgatctagtc

SEQ ID NO: 598101 - DNA, 20 bp, Artificial
  CRISPR gRNA sequence
aatgatctagtcaagccaac

SEQ ID NO: 598102 - DNA, 20 bp, Artificial
  CRISPR gRNA sequence
tgatctagtcaagccaactg

SEQ ID NO: 598103 - DNA, 20 bp, Artificial
  CRISPR gRNA sequence
tcaagccaactggagtgatc

SEQ ID NO: 598104 - DNA, 20 bp, Artificial
  CRISPR gRNA sequence
gatccagctcctatgtttgt

SEQ ID NO: 598105 - DNA, 20 bp, Artificial
  CRISPR gRNA sequence
atcaatatctaaacataaat

SEQ ID NO: 598106 - DNA, 20 bp, Artificial
  CRISPR gRNA sequence
ggcattctgattttaaatat

SEQ ID NO: 598107 - DNA, 20 bp, Artificial
  CRISPR gRNA sequence
tttgtaaacctgtttaatgt

SEQ ID NO: 598108 - DNA, 20 bp, Artificial
  CRISPR gRNA sequence
gtttaatgtcagtcaacctt

SEQ ID NO: 598109 - DNA, 20 bp, Artificial
  CRISPR gRNA sequence
tgtcagtcaaccttgagata

SEQ ID NO: 598110 - DNA, 20 bp, Artificial
  CRISPR gRNA sequence
ttgagatacagatccactct

SEQ ID NO: 598111 - DNA, 20 bp, Artificial
  CRISPR gRNA sequence
ctctaagtgtgccacaaatc

SEQ ID NO: 598112 - DNA, 20 bp, Artificial
  CRISPR gRNA sequence
gtgtgccacaaatctagttt

SEQ ID NO: 598113 - DNA, 20 bp, Artificial
  CRISPR gRNA sequence
aatctagtttcagaacttgc

SEQ ID NO: 598114 - DNA, 20 bp, Artificial
  CRISPR gRNA sequence
atctagtttcagaacttgca

SEQ ID NO: 598115 - DNA, 20 bp, Artificial
  CRISPR gRNA sequence
gtttcagaacttgcaaggat

SEQ ID NO: 598116 - DNA, 20 bp, Artificial
  CRISPR gRNA sequence
ctgcattataaataattttg

SEQ ID NO: 598117 - DNA, 20 bp, Artificial
  CRISPR gRNA sequence
tgcattataaataattttgt

SEQ ID NO: 598118 - DNA, 20 bp, Artificial
  CRISPR gRNA sequence
gcattataaataattttgtg

SEQ ID NO: 598119 - DNA, 20 bp, Artificial
  CRISPR gRNA sequence
gtggggaaatgttatcctct

SEQ ID NO: 598120 - DNA, 20 bp, Artificial
  CRISPR gRNA sequence
tatcctctgagaacctatct

SEQ ID NO: 598121 - DNA, 20 bp, Artificial
  CRISPR gRNA sequence
cctctgagaacctatctaag

SEQ ID NO: 598122 - DNA, 20 bp, Artificial
  CRISPR gRNA sequence
acacacatttgaaaaactct

SEQ ID NO: 598123 - DNA, 20 bp, Artificial
  CRISPR gRNA sequence
acacatttgaaaaactcttg

SEQ ID NO: 598124 - DNA, 20 bp, Artificial
  CRISPR gRNA sequence
cacatttgaaaaactcttgg

SEQ ID NO: 598125 - DNA, 20 bp, Artificial
  CRISPR gRNA sequence
tgaaaaactcttggaggtaa

SEQ ID NO: 598126 - DNA, 20 bp, Artificial
  CRISPR gRNA sequence
gaaaaactcttggaggtaaa

SEQ ID NO: 598127 - DNA, 20 bp, Artificial
  CRISPR gRNA sequence
aactcttggaggtaaaaggt

SEQ ID NO: 598128 - DNA, 20 bp, Artificial
  CRISPR gRNA sequence
tcttggaggtaaaaggtgag

SEQ ID NO: 598129 - DNA, 20 bp, Artificial
  CRISPR gRNA sequence
tggaggtaaaaggtgagaag

SEQ ID NO: 598130 - DNA, 20 bp, Artificial
  CRISPR gRNA sequence
agcagctcattaatctataa

SEQ ID NO: 598131 - DNA, 20 bp, Artificial
  CRISPR gRNA sequence
cattaatctataatggatgt

SEQ ID NO: 598132 - DNA, 20 bp, Artificial
  CRISPR gRNA sequence
tctataatggatgtaagtca

SEQ ID NO: 598133 - DNA, 20 bp, Artificial
  CRISPR gRNA sequence
taatggatgtaagtcacagt

SEQ ID NO: 598134 - DNA, 20 bp, Artificial
  CRISPR gRNA sequence
catttacttctaaatgcaat

SEQ ID NO: 598135 - DNA, 20 bp, Artificial
  CRISPR gRNA sequence
ttacttctaaatgcaataag

SEQ ID NO: 598136 - DNA, 20 bp, Artificial
  CRISPR gRNA sequence
acacaaaatatcaattcatt

SEQ ID NO: 598137 - DNA, 20 bp, Artificial
  CRISPR gRNA sequence
tcaattcatttggacccttg

SEQ ID NO: 598138 - DNA, 20 bp, Artificial
  CRISPR gRNA sequence
ttgaagataccatccttctc

SEQ ID NO: 598139 - DNA, 20 bp, Artificial
  CRISPR gRNA sequence
acaccccaaacctatttttt

SEQ ID NO: 598140 - DNA, 20 bp, Artificial
  CRISPR gRNA sequence
caaacctattttttgagccc

SEQ ID NO: 598141 - DNA, 20 bp, Artificial
  CRISPR gRNA sequence
tattttttgagccccagcac

SEQ ID NO: 598142 - DNA, 20 bp, Artificial
  CRISPR gRNA sequence
caccagcaatgcatcataca

SEQ ID NO: 598143 - DNA, 20 bp, Artificial
  CRISPR gRNA sequence
agcaatgcatcatacacagt

SEQ ID NO: 598144 - DNA, 20 bp, Artificial
  CRISPR gRNA sequence
agtgcttaataaatgtttgc

SEQ ID NO: 598145 - DNA, 20 bp, Artificial
  CRISPR gRNA sequence
tttgctggatcaatgatcga

SEQ ID NO: 598146 - DNA, 20 bp, Artificial
  CRISPR gRNA sequence
aagatgaaaaatatctctct

SEQ ID NO: 598147 - DNA, 20 bp, Artificial
  CRISPR gRNA sequence
agatgaaaaatatctctcta

SEQ ID NO: 598148 - DNA, 20 bp, Artificial
  CRISPR gRNA sequence
atgaaaaatatctctctaag

SEQ ID NO: 598149 - DNA, 20 bp, Artificial
  CRISPR gRNA sequence
gagttctgaatctccacata

SEQ ID NO: 598150 - DNA, 20 bp, Artificial
  CRISPR gRNA sequence
agttctgaatctccacatac

SEQ ID NO: 598151 - DNA, 20 bp, Artificial
  CRISPR gRNA sequence
tctccacatacaggaaatct

SEQ ID NO: 598152 - DNA, 20 bp, Artificial
  CRISPR gRNA sequence
ccacatacaggaaatctcag

SEQ ID NO: 598153 - DNA, 20 bp, Artificial
  CRISPR gRNA sequence
catacaggaaatctcagaag

SEQ ID NO: 598154 - DNA, 20 bp, Artificial
  CRISPR gRNA sequence
aatctcagaagaagtgtttc

SEQ ID NO: 598155 - DNA, 20 bp, Artificial
  CRISPR gRNA sequence
ttctagcattaacattcatt

SEQ ID NO: 598156 - DNA, 20 bp, Artificial
  CRISPR gRNA sequence
aacattcatttggaattcta

SEQ ID NO: 598157 - DNA, 20 bp, Artificial
  CRISPR gRNA sequence
tttggaattctatggtgtct

SEQ ID NO: 598158 - DNA, 20 bp, Artificial
  CRISPR gRNA sequence
ttggaattctatggtgtctt

SEQ ID NO: 598159 - DNA, 20 bp, Artificial
  CRISPR gRNA sequence
gaattctatggtgtcttggg

SEQ ID NO: 598160 - DNA, 20 bp, Artificial
  CRISPR gRNA sequence
tctatggtgtcttgggtagt

SEQ ID NO: 598161 - DNA, 20 bp, Artificial
  CRISPR gRNA sequence
tagtcagcgcttacattttt

SEQ ID NO: 598162 - DNA, 20 bp, Artificial
  CRISPR gRNA sequence
cagcgcttacatttttaaga

SEQ ID NO: 598163 - DNA, 20 bp, Artificial
  CRISPR gRNA sequence
gaattctgtaataaatattt

SEQ ID NO: 598164 - DNA, 20 bp, Artificial
  CRISPR gRNA sequence
tcagaataattatgctgatt

SEQ ID NO: 598165 - DNA, 20 bp, Artificial
  CRISPR gRNA sequence
ctatgctatactgtcccatc

SEQ ID NO: 598166 - DNA, 20 bp, Artificial
  CRISPR gRNA sequence
tatgctatactgtcccatct

SEQ ID NO: 598167 - DNA, 20 bp, Artificial
  CRISPR gRNA sequence
catctaggtaacctcatccc

SEQ ID NO: 598168 - DNA, 20 bp, Artificial
  CRISPR gRNA sequence
atctaggtaacctcatccca

SEQ ID NO: 598169 - DNA, 20 bp, Artificial
  CRISPR gRNA sequence
tctaggtaacctcatcccaa

SEQ ID NO: 598170 - DNA, 20 bp, Artificial
  CRISPR gRNA sequence
ctaggtaacctcatcccaag

SEQ ID NO: 598171 - DNA, 20 bp, Artificial
  CRISPR gRNA sequence
gtatctgcatatttatctca

SEQ ID NO: 598172 - DNA, 20 bp, Artificial
  CRISPR gRNA sequence
tttatctcaaagtcttcaaa

SEQ ID NO: 598173 - DNA, 20 bp, Artificial
  CRISPR gRNA sequence
ttatctcaaagtcttcaaaa

SEQ ID NO: 598174 - DNA, 20 bp, Artificial
  CRISPR gRNA sequence
caaagtcttcaaaaaggctc

SEQ ID NO: 598175 - DNA, 20 bp, Artificial
  CRISPR gRNA sequence
gtcttcaaaaaggctctggt

SEQ ID NO: 598176 - DNA, 20 bp, Artificial
  CRISPR gRNA sequence
tcttcaaaaaggctctggtg

SEQ ID NO: 598177 - DNA, 20 bp, Artificial
  CRISPR gRNA sequence
ttcaaaaaggctctggtgag

SEQ ID NO: 598178 - DNA, 20 bp, Artificial
  CRISPR gRNA sequence
gtgaggagtattaaattcct

SEQ ID NO: 598179 - DNA, 20 bp, Artificial
  CRISPR gRNA sequence
aaattccttagctattaatg

SEQ ID NO: 598180 - DNA, 20 bp, Artificial
  CRISPR gRNA sequence
ttccttagctattaatgtgg

SEQ ID NO: 598181 - DNA, 20 bp, Artificial
  CRISPR gRNA sequence
agctattaatgtggcagaac

SEQ ID NO: 598182 - DNA, 20 bp, Artificial
  CRISPR gRNA sequence
tggcagaactggccaatgtt

SEQ ID NO: 598183 - DNA, 20 bp, Artificial
  CRISPR gRNA sequence
tttagctaacaacctgtaat

SEQ ID NO: 598184 - DNA, 20 bp, Artificial
  CRISPR gRNA sequence
taagtatgtaatattttcaa

SEQ ID NO: 598185 - DNA, 20 bp, Artificial
  CRISPR gRNA sequence
tcaatagcatatttatttat

SEQ ID NO: 598186 - DNA, 20 bp, Artificial
  CRISPR gRNA sequence
caatagcatatttatttata

SEQ ID NO: 598187 - DNA, 20 bp, Artificial
  CRISPR gRNA sequence
catatttatttataaggaaa

SEQ ID NO: 598188 - DNA, 20 bp, Artificial
  CRISPR gRNA sequence
atatttatttataaggaaac

SEQ ID NO: 598189 - DNA, 20 bp, Artificial
  CRISPR gRNA sequence
atttataaggaaacaggtta

SEQ ID NO: 598190 - DNA, 20 bp, Artificial
  CRISPR gRNA sequence
aggaaacaggttacagaata

SEQ ID NO: 598191 - DNA, 20 bp, Artificial
  CRISPR gRNA sequence
aacaggttacagaataaaga

SEQ ID NO: 598192 - DNA, 20 bp, Artificial
  CRISPR gRNA sequence
acagaataaagacagatcat

SEQ ID NO: 598193 - DNA, 20 bp, Artificial
  CRISPR gRNA sequence
ataaagacagatcattagaa

SEQ ID NO: 598194 - DNA, 20 bp, Artificial
  CRISPR gRNA sequence
aaagacagatcattagaata

SEQ ID NO: 598195 - DNA, 20 bp, Artificial
  CRISPR gRNA sequence
aagacagatcattagaatag

SEQ ID NO: 598196 - DNA, 20 bp, Artificial
  CRISPR gRNA sequence
gatcattagaatagaggcac

SEQ ID NO: 598197 - DNA, 20 bp, Artificial
  CRISPR gRNA sequence
tcattagaatagaggcactg

SEQ ID NO: 598198 - DNA, 20 bp, Artificial
  CRISPR gRNA sequence
aatagaggcactggagtata

SEQ ID NO: 598199 - DNA, 20 bp, Artificial
  CRISPR gRNA sequence
ttatgattttttttaaaaaa

SEQ ID NO: 598200 - DNA, 20 bp, Artificial
  CRISPR gRNA sequence
tgattttttttaaaaaacag

SEQ ID NO: 598201 - DNA, 20 bp, Artificial
  CRISPR gRNA sequence
aaaaacagaagttatgatat

SEQ ID NO: 598202 - DNA, 20 bp, Artificial
  CRISPR gRNA sequence
agatataccacaaaatgttg

SEQ ID NO: 598203 - DNA, 20 bp, Artificial
  CRISPR gRNA sequence
atataccacaaaatgttgaa

SEQ ID NO: 598204 - DNA, 20 bp, Artificial
  CRISPR gRNA sequence
agagctttttgtttaaaaat

SEQ ID NO: 598205 - DNA, 20 bp, Artificial
  CRISPR gRNA sequence
gctttttgtttaaaaatcag

SEQ ID NO: 598206 - DNA, 20 bp, Artificial
  CRISPR gRNA sequence
ctttttgtttaaaaatcagt

SEQ ID NO: 598207 - DNA, 20 bp, Artificial
  CRISPR gRNA sequence
catcaattaattcaacttct

SEQ ID NO: 598208 - DNA, 20 bp, Artificial
  CRISPR gRNA sequence
attaattcaacttctgagac

SEQ ID NO: 598209 - DNA, 20 bp, Artificial
  CRISPR gRNA sequence
caacttctgagaccagtata

SEQ ID NO: 598210 - DNA, 20 bp, Artificial
  CRISPR gRNA sequence
aacttctgagaccagtataa

SEQ ID NO: 598211 - DNA, 20 bp, Artificial
  CRISPR gRNA sequence
ccagtataaaggattccatt

SEQ ID NO: 598212 - DNA, 20 bp, Artificial
  CRISPR gRNA sequence
ataaaggattccattaagca

SEQ ID NO: 598213 - DNA, 20 bp, Artificial
  CRISPR gRNA sequence
aaaggattccattaagcaaa

SEQ ID NO: 598214 - DNA, 20 bp, Artificial
  CRISPR gRNA sequence
attaagcaaagagtttatta

SEQ ID NO: 598215 - DNA, 20 bp, Artificial
  CRISPR gRNA sequence
tgtgcacataaaactcaata

SEQ ID NO: 598216 - DNA, 20 bp, Artificial
  CRISPR gRNA sequence
aatatagaattttgatttaa

SEQ ID NO: 598217 - DNA, 20 bp, Artificial
  CRISPR gRNA sequence
atatagaattttgatttaat

SEQ ID NO: 598218 - DNA, 20 bp, Artificial
  CRISPR gRNA sequence
tatagaattttgatttaatg

SEQ ID NO: 598219 - DNA, 20 bp, Artificial
  CRISPR gRNA sequence
tttgatttaatggggcaatt

SEQ ID NO: 598220 - DNA, 20 bp, Artificial
  CRISPR gRNA sequence
ttgatttaatggggcaattg

SEQ ID NO: 598221 - DNA, 20 bp, Artificial
  CRISPR gRNA sequence
aatggggcaattgaggaaat

SEQ ID NO: 598222 - DNA, 20 bp, Artificial
  CRISPR gRNA sequence
atggggcaattgaggaaata

SEQ ID NO: 598223 - DNA, 20 bp, Artificial
  CRISPR gRNA sequence
aaggccactgatcaaatact

SEQ ID NO: 598224 - DNA, 20 bp, Artificial
  CRISPR gRNA sequence
atcaaatactgagaattact

SEQ ID NO: 598225 - DNA, 20 bp, Artificial
  CRISPR gRNA sequence
acatgaatgttttcaaaata

SEQ ID NO: 598226 - DNA, 20 bp, Artificial
  CRISPR gRNA sequence
atggtattaaactactgtta

SEQ ID NO: 598227 - DNA, 20 bp, Artificial
  CRISPR gRNA sequence
aaactactgttaaagtaata

SEQ ID NO: 598228 - DNA, 20 bp, Artificial
  CRISPR gRNA sequence
aactactgttaaagtaatat

SEQ ID NO: 598229 - DNA, 20 bp, Artificial
  CRISPR gRNA sequence
tactgttaaagtaatatggg

SEQ ID NO: 598230 - DNA, 20 bp, Artificial
  CRISPR gRNA sequence
ttaaagtaatatgggcagaa

SEQ ID NO: 598231 - DNA, 20 bp, Artificial
  CRISPR gRNA sequence
gcagaaaagtaaccaaacca

SEQ ID NO: 598232 - DNA, 20 bp, Artificial
  CRISPR gRNA sequence
cagaaaagtaaccaaaccat

SEQ ID NO: 598233 - DNA, 20 bp, Artificial
  CRISPR gRNA sequence
accaaaccatgggctaatat

SEQ ID NO: 598234 - DNA, 20 bp, Artificial
  CRISPR gRNA sequence
taatattagttttcactaat

SEQ ID NO: 598235 - DNA, 20 bp, Artificial
  CRISPR gRNA sequence
aatattagttttcactaatt

SEQ ID NO: 598236 - DNA, 20 bp, Artificial
  CRISPR gRNA sequence
aattaggaaaattcatactt

SEQ ID NO: 598237 - DNA, 20 bp, Artificial
  CRISPR gRNA sequence
ctctcccaaattgtaccctg

SEQ ID NO: 598238 - DNA, 20 bp, Artificial
  CRISPR gRNA sequence
tctcccaaattgtaccctgt

SEQ ID NO: 598239 - DNA, 20 bp, Artificial
  CRISPR gRNA sequence
accctgtgggtgcttcaaac

SEQ ID NO: 598240 - DNA, 20 bp, Artificial
  CRISPR gRNA sequence
cttcaaaccagaattgaact

SEQ ID NO: 598241 - DNA, 20 bp, Artificial
  CRISPR gRNA sequence
aactaagctaaatcttttcc

SEQ ID NO: 598242 - DNA, 20 bp, Artificial
  CRISPR gRNA sequence
cttttcccggaaacctgctc

SEQ ID NO: 598243 - DNA, 20 bp, Artificial
  CRISPR gRNA sequence
gtatttgctatcttcactga

SEQ ID NO: 598244 - DNA, 20 bp, Artificial
  CRISPR gRNA sequence
accatctatcccgtaattta

SEQ ID NO: 598245 - DNA, 20 bp, Artificial
  CRISPR gRNA sequence
ccatctatcccgtaatttaa

SEQ ID NO: 598246 - DNA, 20 bp, Artificial
  CRISPR gRNA sequence
tctccttaattctactaccc

SEQ ID NO: 598247 - DNA, 20 bp, Artificial
  CRISPR gRNA sequence
acccaagtactgtctacttt

SEQ ID NO: 598248 - DNA, 20 bp, Artificial
  CRISPR gRNA sequence
ttaagatgctaaatattacc

SEQ ID NO: 598249 - DNA, 20 bp, Artificial
  CRISPR gRNA sequence
cctttttatcccactactgc

SEQ ID NO: 598250 - DNA, 20 bp, Artificial
  CRISPR gRNA sequence
ttctcactcaatcattgaaa

SEQ ID NO: 598251 - DNA, 20 bp, Artificial
  CRISPR gRNA sequence
ctgttaaatatgcacctgcc

SEQ ID NO: 598252 - DNA, 20 bp, Artificial
  CRISPR gRNA sequence
gttaaatatgcacctgccta

SEQ ID NO: 598253 - DNA, 20 bp, Artificial
  CRISPR gRNA sequence
atatgcacctgcctagagac

SEQ ID NO: 598254 - DNA, 20 bp, Artificial
  CRISPR gRNA sequence
gtaatcaaatcgatccatgt

SEQ ID NO: 598255 - DNA, 20 bp, Artificial
  CRISPR gRNA sequence
aatcgatccatgtcagtcaa

SEQ ID NO: 598256 - DNA, 20 bp, Artificial
  CRISPR gRNA sequence
ccatgtcagtcaaaagactg

SEQ ID NO: 598257 - DNA, 20 bp, Artificial
  CRISPR gRNA sequence
attgacttccatgaaaataa

SEQ ID NO: 598258 - DNA, 20 bp, Artificial
  CRISPR gRNA sequence
cttccatgaaaataaaagcc

SEQ ID NO: 598259 - DNA, 20 bp, Artificial
  CRISPR gRNA sequence
agccaagtttcctctcatac

SEQ ID NO: 598260 - DNA, 20 bp, Artificial
  CRISPR gRNA sequence
ctgccttgattaactctcca

SEQ ID NO: 598261 - DNA, 20 bp, Artificial
  CRISPR gRNA sequence
taactctccaaagtcattcc

SEQ ID NO: 598262 - DNA, 20 bp, Artificial
  CRISPR gRNA sequence
cattcctggcctcgaattcc

SEQ ID NO: 598263 - DNA, 20 bp, Artificial
  CRISPR gRNA sequence
attcctagactccaacttta

SEQ ID NO: 598264 - DNA, 20 bp, Artificial
  CRISPR gRNA sequence
tagactccaactttatagtc

SEQ ID NO: 598265 - DNA, 20 bp, Artificial
  CRISPR gRNA sequence
accaatctgcttgtatttcc

SEQ ID NO: 598266 - DNA, 20 bp, Artificial
  CRISPR gRNA sequence
ctatttctcacctcttattg

SEQ ID NO: 598267 - DNA, 20 bp, Artificial
  CRISPR gRNA sequence
tggatatattatttattgaa

SEQ ID NO: 598268 - DNA, 20 bp, Artificial
  CRISPR gRNA sequence
ggatatattatttattgaaa

SEQ ID NO: 598269 - DNA, 20 bp, Artificial
  CRISPR gRNA sequence
tatttattgaaaaggccttc

SEQ ID NO: 598270 - DNA, 20 bp, Artificial
  CRISPR gRNA sequence
ctaaatcctattcatttaat

SEQ ID NO: 598271 - DNA, 20 bp, Artificial
  CRISPR gRNA sequence
cctattcatttaataagtct

SEQ ID NO: 598272 - DNA, 20 bp, Artificial
  CRISPR gRNA sequence
catttaataagtctcggctc

SEQ ID NO: 598273 - DNA, 20 bp, Artificial
  CRISPR gRNA sequence
ttaataagtctcggctcaag

SEQ ID NO: 598274 - DNA, 20 bp, Artificial
  CRISPR gRNA sequence
tctaaaaaatatttccaaat

SEQ ID NO: 598275 - DNA, 20 bp, Artificial
  CRISPR gRNA sequence
tctcatcccccgtaataatc

SEQ ID NO: 598276 - DNA, 20 bp, Artificial
  CRISPR gRNA sequence
cccgtaataatcaagacact

SEQ ID NO: 598277 - DNA, 20 bp, Artificial
  CRISPR gRNA sequence
tcaagacactaagcttacta

SEQ ID NO: 598278 - DNA, 20 bp, Artificial
  CRISPR gRNA sequence
ttaatgtctgtctgtcccac

SEQ ID NO: 598279 - DNA, 20 bp, Artificial
  CRISPR gRNA sequence
aatgtctgtctgtcccacta

SEQ ID NO: 598280 - DNA, 20 bp, Artificial
  CRISPR gRNA sequence
tgtctgtcccactagagtat

SEQ ID NO: 598281 - DNA, 20 bp, Artificial
  CRISPR gRNA sequence
cccactagagtatgagttcc

SEQ ID NO: 598282 - DNA, 20 bp, Artificial
  CRISPR gRNA sequence
cactagagtatgagttcctg

SEQ ID NO: 598283 - DNA, 20 bp, Artificial
  CRISPR gRNA sequence
actagagtatgagttcctgg

SEQ ID NO: 598284 - DNA, 20 bp, Artificial
  CRISPR gRNA sequence
agtatgagttcctggaggaa

SEQ ID NO: 598285 - DNA, 20 bp, Artificial
  CRISPR gRNA sequence
gtatgagttcctggaggaaa

SEQ ID NO: 598286 - DNA, 20 bp, Artificial
  CRISPR gRNA sequence
ctatactctttattcacctt

SEQ ID NO: 598287 - DNA, 20 bp, Artificial
  CRISPR gRNA sequence
tggattcaccttacaatacc

SEQ ID NO: 598288 - DNA, 20 bp, Artificial
  CRISPR gRNA sequence
ttacaatacctggcacatat

SEQ ID NO: 598289 - DNA, 20 bp, Artificial
  CRISPR gRNA sequence
tacaatacctggcacatatg

SEQ ID NO: 598290 - DNA, 20 bp, Artificial
  CRISPR gRNA sequence
tatttattgaattgatcaac

SEQ ID NO: 598291 - DNA, 20 bp, Artificial
  CRISPR gRNA sequence
attgatcaactagaattgaa

SEQ ID NO: 598292 - DNA, 20 bp, Artificial
  CRISPR gRNA sequence
tataattaataattgcattt

SEQ ID NO: 598293 - DNA, 20 bp, Artificial
  CRISPR gRNA sequence
atttaagcctacttcaaatt

SEQ ID NO: 598294 - DNA, 20 bp, Artificial
  CRISPR gRNA sequence
catctaaactactacccccg

SEQ ID NO: 598295 - DNA, 20 bp, Artificial
  CRISPR gRNA sequence
aattaaaccaacaattttat

SEQ ID NO: 598296 - DNA, 20 bp, Artificial
  CRISPR gRNA sequence
attaaaccaacaattttatt

SEQ ID NO: 598297 - DNA, 20 bp, Artificial
  CRISPR gRNA sequence
caattttattaggtatcatc

SEQ ID NO: 598298 - DNA, 20 bp, Artificial
  CRISPR gRNA sequence
tttattaggtatcatcaagt

SEQ ID NO: 598299 - DNA, 20 bp, Artificial
  CRISPR gRNA sequence
tatcatcaagtgagaattta

SEQ ID NO: 598300 - DNA, 20 bp, Artificial
  CRISPR gRNA sequence
gtgagaatttatggtactac

SEQ ID NO: 598301 - DNA, 20 bp, Artificial
  CRISPR gRNA sequence
agaatttatggtactaccag

SEQ ID NO: 598302 - DNA, 20 bp, Artificial
  CRISPR gRNA sequence
tactaccagaagcatcaaat

SEQ ID NO: 598303 - DNA, 20 bp, Artificial
  CRISPR gRNA sequence
actaccagaagcatcaaatg

SEQ ID NO: 598304 - DNA, 20 bp, Artificial
  CRISPR gRNA sequence
ccagaagcatcaaatgaggt

SEQ ID NO: 598305 - DNA, 20 bp, Artificial
  CRISPR gRNA sequence
catcaaatgaggttagattt

SEQ ID NO: 598306 - DNA, 20 bp, Artificial
  CRISPR gRNA sequence
aatgaggttagattttagat

SEQ ID NO: 598307 - DNA, 20 bp, Artificial
  CRISPR gRNA sequence
atgaggttagattttagatg

SEQ ID NO: 598308 - DNA, 20 bp, Artificial
  CRISPR gRNA sequence
attttagatgaggactctct

SEQ ID NO: 598309 - DNA, 20 bp, Artificial
  CRISPR gRNA sequence
ctctaagaattgattctctg

SEQ ID NO: 598310 - DNA, 20 bp, Artificial
  CRISPR gRNA sequence
tctaagaattgattctctgt

SEQ ID NO: 598311 - DNA, 20 bp, Artificial
  CRISPR gRNA sequence
gaattgattctctgtaggaa

SEQ ID NO: 598312 - DNA, 20 bp, Artificial
  CRISPR gRNA sequence
aattgattctctgtaggaat

SEQ ID NO: 598313 - DNA, 20 bp, Artificial
  CRISPR gRNA sequence
taggaataggttactctatt

SEQ ID NO: 598314 - DNA, 20 bp, Artificial
  CRISPR gRNA sequence
aggaataggttactctatta

SEQ ID NO: 598315 - DNA, 20 bp, Artificial
  CRISPR gRNA sequence
ggaataggttactctattaa

SEQ ID NO: 598316 - DNA, 20 bp, Artificial
  CRISPR gRNA sequence
cttttgttatttgtaatgac

SEQ ID NO: 598317 - DNA, 20 bp, Artificial
  CRISPR gRNA sequence
tttgtaatgactggtatatc

SEQ ID NO: 598318 - DNA, 20 bp, Artificial
  CRISPR gRNA sequence
tctggaacaccaataatatg

SEQ ID NO: 598319 - DNA, 20 bp, Artificial
  CRISPR gRNA sequence
caaaaccacaaaactatact

SEQ ID NO: 598320 - DNA, 20 bp, Artificial
  CRISPR gRNA sequence
aaaaccacaaaactatactc

SEQ ID NO: 598321 - DNA, 20 bp, Artificial
  CRISPR gRNA sequence
aaactatactcaggaatgtt

SEQ ID NO: 598322 - DNA, 20 bp, Artificial
  CRISPR gRNA sequence
ccctccccaattctgacata

SEQ ID NO: 598323 - DNA, 20 bp, Artificial
  CRISPR gRNA sequence
tttcttaaccaaaatcttca

SEQ ID NO: 598324 - DNA, 20 bp, Artificial
  CRISPR gRNA sequence
ttcatagatgctttaaataa

SEQ ID NO: 598325 - DNA, 20 bp, Artificial
  CRISPR gRNA sequence
catagatgctttaaataacg

SEQ ID NO: 598326 - DNA, 20 bp, Artificial
  CRISPR gRNA sequence
atagatgctttaaataacgg

SEQ ID NO: 598327 - DNA, 20 bp, Artificial
  CRISPR gRNA sequence
tagatgctttaaataacgga

SEQ ID NO: 598328 - DNA, 20 bp, Artificial
  CRISPR gRNA sequence
caatttttaccctaaattat

SEQ ID NO: 598329 - DNA, 20 bp, Artificial
  CRISPR gRNA sequence
aaatccctatctttcttccc

SEQ ID NO: 598330 - DNA, 20 bp, Artificial
  CRISPR gRNA sequence
ccctggacctgtgcaatata

SEQ ID NO: 598331 - DNA, 20 bp, Artificial
  CRISPR gRNA sequence
gacctgtgcaatatacagaa

SEQ ID NO: 598332 - DNA, 20 bp, Artificial
  CRISPR gRNA sequence
cctgtgcaatatacagaaaa

SEQ ID NO: 598333 - DNA, 20 bp, Artificial
  CRISPR gRNA sequence
caatatacagaaaagagcaa

SEQ ID NO: 598334 - DNA, 20 bp, Artificial
  CRISPR gRNA sequence
acagaaaagagcaaaagacc

SEQ ID NO: 598335 - DNA, 20 bp, Artificial
  CRISPR gRNA sequence
caaaagacccagatttcaaa

SEQ ID NO: 598336 - DNA, 20 bp, Artificial
  CRISPR gRNA sequence
acccagatttcaaatagact

SEQ ID NO: 598337 - DNA, 20 bp, Artificial
  CRISPR gRNA sequence
aaacaaaccctttttcttac

SEQ ID NO: 598338 - DNA, 20 bp, Artificial
  CRISPR gRNA sequence
accctttttcttacaagtca

SEQ ID NO: 598339 - DNA, 20 bp, Artificial
  CRISPR gRNA sequence
ccctttttcttacaagtcat

SEQ ID NO: 598340 - DNA, 20 bp, Artificial
  CRISPR gRNA sequence
caagtcataggtccataaaa

SEQ ID NO: 598341 - DNA, 20 bp, Artificial
  CRISPR gRNA sequence
aaaagtaacttgactgctct

SEQ ID NO: 598342 - DNA, 20 bp, Artificial
  CRISPR gRNA sequence
aacttgactgctctgagtaa

SEQ ID NO: 598343 - DNA, 20 bp, Artificial
  CRISPR gRNA sequence
ttgactgctctgagtaatag

SEQ ID NO: 598344 - DNA, 20 bp, Artificial
  CRISPR gRNA sequence
actgctctgagtaatagcag

SEQ ID NO: 598345 - DNA, 20 bp, Artificial
  CRISPR gRNA sequence
agcagcagtgattatttatt

SEQ ID NO: 598346 - DNA, 20 bp, Artificial
  CRISPR gRNA sequence
agtgattatttattgagtct

SEQ ID NO: 598347 - DNA, 20 bp, Artificial
  CRISPR gRNA sequence
tattgagtcttagcatgtgc

SEQ ID NO: 598348 - DNA, 20 bp, Artificial
  CRISPR gRNA sequence
tgagtcttagcatgtgccag

SEQ ID NO: 598349 - DNA, 20 bp, Artificial
  CRISPR gRNA sequence
catgtgccagaagttgtgct

SEQ ID NO: 598350 - DNA, 20 bp, Artificial
  CRISPR gRNA sequence
gccttattgaaatctcacaa

SEQ ID NO: 598351 - DNA, 20 bp, Artificial
  CRISPR gRNA sequence
aaatctcacaacagcccatt

SEQ ID NO: 598352 - DNA, 20 bp, Artificial
  CRISPR gRNA sequence
aatctcacaacagcccattg

SEQ ID NO: 598353 - DNA, 20 bp, Artificial
  CRISPR gRNA sequence
ctcacaacagcccattgagg

SEQ ID NO: 598354 - DNA, 20 bp, Artificial
  CRISPR gRNA sequence
tcacaacagcccattgaggt

SEQ ID NO: 598355 - DNA, 20 bp, Artificial
  CRISPR gRNA sequence
tattgcttatccctattcta

SEQ ID NO: 598356 - DNA, 20 bp, Artificial
  CRISPR gRNA sequence
cttatccctattctacggat

SEQ ID NO: 598357 - DNA, 20 bp, Artificial
  CRISPR gRNA sequence
ttatccctattctacggata

SEQ ID NO: 598358 - DNA, 20 bp, Artificial
  CRISPR gRNA sequence
tattctacggataaggaaac

SEQ ID NO: 598359 - DNA, 20 bp, Artificial
  CRISPR gRNA sequence
ttctacggataaggaaactg

SEQ ID NO: 598360 - DNA, 20 bp, Artificial
  CRISPR gRNA sequence
cggataaggaaactggagct

SEQ ID NO: 598361 - DNA, 20 bp, Artificial
  CRISPR gRNA sequence
gataaggaaactggagctca

SEQ ID NO: 598362 - DNA, 20 bp, Artificial
  CRISPR gRNA sequence
aactggagctcagagatgtg

SEQ ID NO: 598363 - DNA, 20 bp, Artificial
  CRISPR gRNA sequence
ctcagagatgtgaagtgaca

SEQ ID NO: 598364 - DNA, 20 bp, Artificial
  CRISPR gRNA sequence
agatgtgaagtgacatggcc

SEQ ID NO: 598365 - DNA, 20 bp, Artificial
  CRISPR gRNA sequence
gatgtgaagtgacatggcca

SEQ ID NO: 598366 - DNA, 20 bp, Artificial
  CRISPR gRNA sequence
gtgacatggccaaggtcaca

SEQ ID NO: 598367 - DNA, 20 bp, Artificial
  CRISPR gRNA sequence
atggccaaggtcacacagca

SEQ ID NO: 598368 - DNA, 20 bp, Artificial
  CRISPR gRNA sequence
gccaaggtcacacagcaaag

SEQ ID NO: 598369 - DNA, 20 bp, Artificial
  CRISPR gRNA sequence
ccaaggtcacacagcaaagc

SEQ ID NO: 598370 - DNA, 20 bp, Artificial
  CRISPR gRNA sequence
gcaaagcaggaattctaacc

SEQ ID NO: 598371 - DNA, 20 bp, Artificial
  CRISPR gRNA sequence
caaagcaggaattctaaccc

SEQ ID NO: 598372 - DNA, 20 bp, Artificial
  CRISPR gRNA sequence
gcaggaattctaacccaggc

SEQ ID NO: 598373 - DNA, 20 bp, Artificial
  CRISPR gRNA sequence
cccaggccagcataattgca

SEQ ID NO: 598374 - DNA, 20 bp, Artificial
  CRISPR gRNA sequence
cccatatttttaaccactca

SEQ ID NO: 598375 - DNA, 20 bp, Artificial
  CRISPR gRNA sequence
actcacagtctactgcttct

SEQ ID NO: 598376 - DNA, 20 bp, Artificial
  CRISPR gRNA sequence
agtctactgcttctgagcct

SEQ ID NO: 598377 - DNA, 20 bp, Artificial
  CRISPR gRNA sequence
tgcttctgagcctcagtttt

SEQ ID NO: 598378 - DNA, 20 bp, Artificial
  CRISPR gRNA sequence
cagttttaagtgttataaaa

SEQ ID NO: 598379 - DNA, 20 bp, Artificial
  CRISPR gRNA sequence
gttttaagtgttataaaata

SEQ ID NO: 598380 - DNA, 20 bp, Artificial
  CRISPR gRNA sequence
gtaattacatgcctacctca

SEQ ID NO: 598381 - DNA, 20 bp, Artificial
  CRISPR gRNA sequence
cctacctcacagaattgatg

SEQ ID NO: 598382 - DNA, 20 bp, Artificial
  CRISPR gRNA sequence
tacctcacagaattgatgtg

SEQ ID NO: 598383 - DNA, 20 bp, Artificial
  CRISPR gRNA sequence
acagaattgatgtggagaca

SEQ ID NO: 598384 - DNA, 20 bp, Artificial
  CRISPR gRNA sequence
tggagacaaagtgaaataat

SEQ ID NO: 598385 - DNA, 20 bp, Artificial
  CRISPR gRNA sequence
acaaagtgaaataataagta

SEQ ID NO: 598386 - DNA, 20 bp, Artificial
  CRISPR gRNA sequence
gaaataataagtaaagcatc

SEQ ID NO: 598387 - DNA, 20 bp, Artificial
  CRISPR gRNA sequence
agtaaagcatctagcatact

SEQ ID NO: 598388 - DNA, 20 bp, Artificial
  CRISPR gRNA sequence
catactaagtgcactcaata

SEQ ID NO: 598389 - DNA, 20 bp, Artificial
  CRISPR gRNA sequence
atactaagtgcactcaataa

SEQ ID NO: 598390 - DNA, 20 bp, Artificial
  CRISPR gRNA sequence
ccctctaccttctctcgctc

SEQ ID NO: 598391 - DNA, 20 bp, Artificial
  CRISPR gRNA sequence
tctaccttctctcgctctag

SEQ ID NO: 598392 - DNA, 20 bp, Artificial
  CRISPR gRNA sequence
tgattataacatttataata

SEQ ID NO: 598393 - DNA, 20 bp, Artificial
  CRISPR gRNA sequence
gattataacatttataataa

SEQ ID NO: 598394 - DNA, 20 bp, Artificial
  CRISPR gRNA sequence
attccttacctatatcaaaa

SEQ ID NO: 598395 - DNA, 20 bp, Artificial
  CRISPR gRNA sequence
tccttacctatatcaaaaca

SEQ ID NO: 598396 - DNA, 20 bp, Artificial
  CRISPR gRNA sequence
ccttacctatatcaaaacag

SEQ ID NO: 598397 - DNA, 20 bp, Artificial
  CRISPR gRNA sequence
atatcaaaacagaggtatat

SEQ ID NO: 598398 - DNA, 20 bp, Artificial
  CRISPR gRNA sequence
tatcaaaacagaggtatatt

SEQ ID NO: 598399 - DNA, 20 bp, Artificial
  CRISPR gRNA sequence
gggtctcaattaattcgcaa

SEQ ID NO: 598400 - DNA, 20 bp, Artificial
  CRISPR gRNA sequence
ggtctcaattaattcgcaaa

SEQ ID NO: 598401 - DNA, 20 bp, Artificial
  CRISPR gRNA sequence
tcgcaaaaggaaaataccaa

SEQ ID NO: 598402 - DNA, 20 bp, Artificial
  CRISPR gRNA sequence
cgcaaaaggaaaataccaac

SEQ ID NO: 598403 - DNA, 20 bp, Artificial
  CRISPR gRNA sequence
acaaatacatttaacataaa

SEQ ID NO: 598404 - DNA, 20 bp, Artificial
  CRISPR gRNA sequence
tacatttaacataaacagat

SEQ ID NO: 598405 - DNA, 20 bp, Artificial
  CRISPR gRNA sequence
atttaacataaacagataag

SEQ ID NO: 598406 - DNA, 20 bp, Artificial
  CRISPR gRNA sequence
tttaacataaacagataaga

SEQ ID NO: 598407 - DNA, 20 bp, Artificial
  CRISPR gRNA sequence
ttaacataaacagataagaa

SEQ ID NO: 598408 - DNA, 20 bp, Artificial
  CRISPR gRNA sequence
aaacagataagaagggaaaa

SEQ ID NO: 598409 - DNA, 20 bp, Artificial
  CRISPR gRNA sequence
gataagaagggaaaaaagta

SEQ ID NO: 598410 - DNA, 20 bp, Artificial
  CRISPR gRNA sequence
caacatattctacctcattt

SEQ ID NO: 598411 - DNA, 20 bp, Artificial
  CRISPR gRNA sequence
aacatattctacctcatttt

SEQ ID NO: 598412 - DNA, 20 bp, Artificial
  CRISPR gRNA sequence
attctacctcattttaggac

SEQ ID NO: 598413 - DNA, 20 bp, Artificial
  CRISPR gRNA sequence
aaaatatatcaacatgtcaa

SEQ ID NO: 598414 - DNA, 20 bp, Artificial
  CRISPR gRNA sequence
tatatcaacatgtcaaaagt

SEQ ID NO: 598415 - DNA, 20 bp, Artificial
  CRISPR gRNA sequence
atatcaacatgtcaaaagtt

SEQ ID NO: 598416 - DNA, 20 bp, Artificial
  CRISPR gRNA sequence
atcaacatgtcaaaagttag

SEQ ID NO: 598417 - DNA, 20 bp, Artificial
  CRISPR gRNA sequence
caacatgtcaaaagttagga

SEQ ID NO: 598418 - DNA, 20 bp, Artificial
  CRISPR gRNA sequence
catgtcaaaagttaggagag

SEQ ID NO: 598419 - DNA, 20 bp, Artificial
  CRISPR gRNA sequence
tgtcaaaagttaggagagaa

SEQ ID NO: 598420 - DNA, 20 bp, Artificial
  CRISPR gRNA sequence
aaagttaggagagaagagca

SEQ ID NO: 598421 - DNA, 20 bp, Artificial
  CRISPR gRNA sequence
ggagagaagagcacggaacc

SEQ ID NO: 598422 - DNA, 20 bp, Artificial
  CRISPR gRNA sequence
agagaagagcacggaaccca

SEQ ID NO: 598423 - DNA, 20 bp, Artificial
  CRISPR gRNA sequence
ccagagatgaaaattcatta

SEQ ID NO: 598424 - DNA, 20 bp, Artificial
  CRISPR gRNA sequence
tgaaaattcattatggctta

SEQ ID NO: 598425 - DNA, 20 bp, Artificial
  CRISPR gRNA sequence
gaaaattcattatggcttac

SEQ ID NO: 598426 - DNA, 20 bp, Artificial
  CRISPR gRNA sequence
aattcattatggcttacagg

SEQ ID NO: 598427 - DNA, 20 bp, Artificial
  CRISPR gRNA sequence
gcttacaggaagactctcaa

SEQ ID NO: 598428 - DNA, 20 bp, Artificial
  CRISPR gRNA sequence
tctcaatagaacacaatcaa

SEQ ID NO: 598429 - DNA, 20 bp, Artificial
  CRISPR gRNA sequence
ggtgttacctttttttaaaa

SEQ ID NO: 598430 - DNA, 20 bp, Artificial
  CRISPR gRNA sequence
tttttttaaaaaagtacttc

SEQ ID NO: 598431 - DNA, 20 bp, Artificial
  CRISPR gRNA sequence
ttttaaaaaagtacttctag

SEQ ID NO: 598432 - DNA, 20 bp, Artificial
  CRISPR gRNA sequence
tttaaaaaagtacttctagt

SEQ ID NO: 598433 - DNA, 20 bp, Artificial
  CRISPR gRNA sequence
aaaaagtacttctagtggga

SEQ ID NO: 598434 - DNA, 20 bp, Artificial
  CRISPR gRNA sequence
agtacttctagtgggaaaga

SEQ ID NO: 598435 - DNA, 20 bp, Artificial
  CRISPR gRNA sequence
ggaaagacagattttgaaca

SEQ ID NO: 598436 - DNA, 20 bp, Artificial
  CRISPR gRNA sequence
agacagattttgaacaaaga

SEQ ID NO: 598437 - DNA, 20 bp, Artificial
  CRISPR gRNA sequence
acagattttgaacaaagata

SEQ ID NO: 598438 - DNA, 20 bp, Artificial
  CRISPR gRNA sequence
tgaacaaagatagagatgat

SEQ ID NO: 598439 - DNA, 20 bp, Artificial
  CRISPR gRNA sequence
gaacaaagatagagatgata

SEQ ID NO: 598440 - DNA, 20 bp, Artificial
  CRISPR gRNA sequence
gttgttttgttttttgaaaa

SEQ ID NO: 598441 - DNA, 20 bp, Artificial
  CRISPR gRNA sequence
tgaaaacggactttaattct

SEQ ID NO: 598442 - DNA, 20 bp, Artificial
  CRISPR gRNA sequence
ggactttaattctcagtact

SEQ ID NO: 598443 - DNA, 20 bp, Artificial
  CRISPR gRNA sequence
ctttaattctcagtactaag

SEQ ID NO: 598444 - DNA, 20 bp, Artificial
  CRISPR gRNA sequence
tcagtactaagcagactaaa

SEQ ID NO: 598445 - DNA, 20 bp, Artificial
  CRISPR gRNA sequence
tactaagcagactaaaaaga

SEQ ID NO: 598446 - DNA, 20 bp, Artificial
  CRISPR gRNA sequence
actaagcagactaaaaagat

SEQ ID NO: 598447 - DNA, 20 bp, Artificial
  CRISPR gRNA sequence
ctaagcagactaaaaagata

SEQ ID NO: 598448 - DNA, 20 bp, Artificial
  CRISPR gRNA sequence
aagcagactaaaaagatagg

SEQ ID NO: 598449 - DNA, 20 bp, Artificial
  CRISPR gRNA sequence
agactaaaaagatagggagt

SEQ ID NO: 598450 - DNA, 20 bp, Artificial
  CRISPR gRNA sequence
gactaaaaagatagggagtt

SEQ ID NO: 598451 - DNA, 20 bp, Artificial
  CRISPR gRNA sequence
ctaaaaagatagggagttgg

SEQ ID NO: 598452 - DNA, 20 bp, Artificial
  CRISPR gRNA sequence
aaaagatagggagttgggag

SEQ ID NO: 598453 - DNA, 20 bp, Artificial
  CRISPR gRNA sequence
tagggagttgggagcggaat

SEQ ID NO: 598454 - DNA, 20 bp, Artificial
  CRISPR gRNA sequence
agggagttgggagcggaatg

SEQ ID NO: 598455 - DNA, 20 bp, Artificial
  CRISPR gRNA sequence
tgggagcggaatgaggtgca

SEQ ID NO: 598456 - DNA, 20 bp, Artificial
  CRISPR gRNA sequence
cggaatgaggtgcaaagaaa

SEQ ID NO: 598457 - DNA, 20 bp, Artificial
  CRISPR gRNA sequence
gaggtgcaaagaaaaagtta

SEQ ID NO: 598458 - DNA, 20 bp, Artificial
  CRISPR gRNA sequence
ttttccctttttttctcttt

SEQ ID NO: 598459 - DNA, 20 bp, Artificial
  CRISPR gRNA sequence
tttttttctcttttggtaca

SEQ ID NO: 598460 - DNA, 20 bp, Artificial
  CRISPR gRNA sequence
atttatctctgatacctgta

SEQ ID NO: 598461 - DNA, 20 bp, Artificial
  CRISPR gRNA sequence
tacctgtaaagaaattaaat

SEQ ID NO: 598462 - DNA, 20 bp, Artificial
  CRISPR gRNA sequence
tatttaattccctaataaac

SEQ ID NO: 598463 - DNA, 20 bp, Artificial
  CRISPR gRNA sequence
ataaacaagaactaaatgta

SEQ ID NO: 598464 - DNA, 20 bp, Artificial
  CRISPR gRNA sequence
gaactaaatgtaaagtacat

SEQ ID NO: 598465 - DNA, 20 bp, Artificial
  CRISPR gRNA sequence
aactaaatgtaaagtacatt

SEQ ID NO: 598466 - DNA, 20 bp, Artificial
  CRISPR gRNA sequence
ttgggtatatacacaaacct

SEQ ID NO: 598467 - DNA, 20 bp, Artificial
  CRISPR gRNA sequence
tatatacacaaacctaagta

SEQ ID NO: 598468 - DNA, 20 bp, Artificial
  CRISPR gRNA sequence
ctaagtatggcgacttaaaa

SEQ ID NO: 598469 - DNA, 20 bp, Artificial
  CRISPR gRNA sequence
agtatggcgacttaaaacag

SEQ ID NO: 598470 - DNA, 20 bp, Artificial
  CRISPR gRNA sequence
aaaacagaagattttctatc

SEQ ID NO: 598471 - DNA, 20 bp, Artificial
  CRISPR gRNA sequence
gattttctatcaagcccatc

SEQ ID NO: 598472 - DNA, 20 bp, Artificial
  CRISPR gRNA sequence
aagcccatctggtgttatat

SEQ ID NO: 598473 - DNA, 20 bp, Artificial
  CRISPR gRNA sequence
agcccatctggtgttatatt

SEQ ID NO: 598474 - DNA, 20 bp, Artificial
  CRISPR gRNA sequence
gcccatctggtgttatatta

SEQ ID NO: 598475 - DNA, 20 bp, Artificial
  CRISPR gRNA sequence
ttatattagggtgtgtccta

SEQ ID NO: 598476 - DNA, 20 bp, Artificial
  CRISPR gRNA sequence
ggtgtgtcctacagaaatcc

SEQ ID NO: 598477 - DNA, 20 bp, Artificial
  CRISPR gRNA sequence
tgtcctacagaaatccaagc

SEQ ID NO: 598478 - DNA, 20 bp, Artificial
  CRISPR gRNA sequence
gtcctacagaaatccaagca

SEQ ID NO: 598479 - DNA, 20 bp, Artificial
  CRISPR gRNA sequence
tcctacagaaatccaagcaa

SEQ ID NO: 598480 - DNA, 20 bp, Artificial
  CRISPR gRNA sequence
gcaagggtgactgccaaact

SEQ ID NO: 598481 - DNA, 20 bp, Artificial
  CRISPR gRNA sequence
gtgactgccaaactaagcta

SEQ ID NO: 598482 - DNA, 20 bp, Artificial
  CRISPR gRNA sequence
actgccaaactaagctacag

SEQ ID NO: 598483 - DNA, 20 bp, Artificial
  CRISPR gRNA sequence
ctaagctacagaagaaaact

SEQ ID NO: 598484 - DNA, 20 bp, Artificial
  CRISPR gRNA sequence
gctacagaagaaaactcaga

SEQ ID NO: 598485 - DNA, 20 bp, Artificial
  CRISPR gRNA sequence
cagaagaaaactcagaaagc

SEQ ID NO: 598486 - DNA, 20 bp, Artificial
  CRISPR gRNA sequence
agaaaactcagaaagctggt

SEQ ID NO: 598487 - DNA, 20 bp, Artificial
  CRISPR gRNA sequence
agctggtaagtcccataata

SEQ ID NO: 598488 - DNA, 20 bp, Artificial
  CRISPR gRNA sequence
gctggtaagtcccataatat

SEQ ID NO: 598489 - DNA, 20 bp, Artificial
  CRISPR gRNA sequence
aatataggctctatttcaaa

SEQ ID NO: 598490 - DNA, 20 bp, Artificial
  CRISPR gRNA sequence
ctctatttcaaaaagtgcat

SEQ ID NO: 598491 - DNA, 20 bp, Artificial
  CRISPR gRNA sequence
cattagaacacccgcctgaa

SEQ ID NO: 598492 - DNA, 20 bp, Artificial
  CRISPR gRNA sequence
ataataactcttctatttct

SEQ ID NO: 598493 - DNA, 20 bp, Artificial
  CRISPR gRNA sequence
agatatttgtcacaaaaata

SEQ ID NO: 598494 - DNA, 20 bp, Artificial
  CRISPR gRNA sequence
gatatttgtcacaaaaatat

SEQ ID NO: 598495 - DNA, 20 bp, Artificial
  CRISPR gRNA sequence
tttgtcacaaaaatatgggc

SEQ ID NO: 598496 - DNA, 20 bp, Artificial
  CRISPR gRNA sequence
acaaaaatatgggccagtat

SEQ ID NO: 598497 - DNA, 20 bp, Artificial
  CRISPR gRNA sequence
atatgggccagtattggaca

SEQ ID NO: 598498 - DNA, 20 bp, Artificial
  CRISPR gRNA sequence
tgggccagtattggacacgg

SEQ ID NO: 598499 - DNA, 20 bp, Artificial
  CRISPR gRNA sequence
ttggacacggcagacaccct

SEQ ID NO: 598500 - DNA, 20 bp, Artificial
  CRISPR gRNA sequence
gacacggcagacaccctgag

SEQ ID NO: 598501 - DNA, 20 bp, Artificial
  CRISPR gRNA sequence
acacggcagacaccctgaga

SEQ ID NO: 598502 - DNA, 20 bp, Artificial
  CRISPR gRNA sequence
accctgagaaggtgacattg

SEQ ID NO: 598503 - DNA, 20 bp, Artificial
  CRISPR gRNA sequence
cctgagaaggtgacattgta

SEQ ID NO: 598504 - DNA, 20 bp, Artificial
  CRISPR gRNA sequence
agaaggtgacattgtagaga

SEQ ID NO: 598505 - DNA, 20 bp, Artificial
  CRISPR gRNA sequence
aggtgacattgtagagatag

SEQ ID NO: 598506 - DNA, 20 bp, Artificial
  CRISPR gRNA sequence
cagttatctaactaacccac

SEQ ID NO: 598507 - DNA, 20 bp, Artificial
  CRISPR gRNA sequence
agttatctaactaacccaca

SEQ ID NO: 598508 - DNA, 20 bp, Artificial
  CRISPR gRNA sequence
gataacttcatctttctgct

SEQ ID NO: 598509 - DNA, 20 bp, Artificial
  CRISPR gRNA sequence
atctttctgctaagttctct

SEQ ID NO: 598510 - DNA, 20 bp, Artificial
  CRISPR gRNA sequence
ctttctgctaagttctctaa

SEQ ID NO: 598511 - DNA, 20 bp, Artificial
  CRISPR gRNA sequence
tttctgctaagttctctaag

SEQ ID NO: 598512 - DNA, 20 bp, Artificial
  CRISPR gRNA sequence
agaggtaaattgatttcttc

SEQ ID NO: 598513 - DNA, 20 bp, Artificial
  CRISPR gRNA sequence
caatttccacatatgaaaaa

SEQ ID NO: 598514 - DNA, 20 bp, Artificial
  CRISPR gRNA sequence
ataatatacttctgcttcgc

SEQ ID NO: 598515 - DNA, 20 bp, Artificial
  CRISPR gRNA sequence
taatatacttctgcttcgct

SEQ ID NO: 598516 - DNA, 20 bp, Artificial
  CRISPR gRNA sequence
gcttcgctaggttctaaaaa

SEQ ID NO: 598517 - DNA, 20 bp, Artificial
  CRISPR gRNA sequence
taggttctaaaaatggaaac

SEQ ID NO: 598518 - DNA, 20 bp, Artificial
  CRISPR gRNA sequence
tctaaaaatggaaactagct

SEQ ID NO: 598519 - DNA, 20 bp, Artificial
  CRISPR gRNA sequence
ctaagaaaaaaattaatgtg

SEQ ID NO: 598520 - DNA, 20 bp, Artificial
  CRISPR gRNA sequence
ttaatgtgaagtactctgaa

SEQ ID NO: 598521 - DNA, 20 bp, Artificial
  CRISPR gRNA sequence
gtactctgaaaagaataaac

SEQ ID NO: 598522 - DNA, 20 bp, Artificial
  CRISPR gRNA sequence
agattccctgacctgattat

SEQ ID NO: 598523 - DNA, 20 bp, Artificial
  CRISPR gRNA sequence
tccctgacctgattattggt

SEQ ID NO: 598524 - DNA, 20 bp, Artificial
  CRISPR gRNA sequence
cctgacctgattattggtca

SEQ ID NO: 598525 - DNA, 20 bp, Artificial
  CRISPR gRNA sequence
tggtcagagccttgtaaaac

SEQ ID NO: 598526 - DNA, 20 bp, Artificial
  CRISPR gRNA sequence
ccgattccatacatgccacc

SEQ ID NO: 598527 - DNA, 20 bp, Artificial
  CRISPR gRNA sequence
catacatgccacctggccat

SEQ ID NO: 598528 - DNA, 20 bp, Artificial
  CRISPR gRNA sequence
ctggccatcagactgataaa

SEQ ID NO: 598529 - DNA, 20 bp, Artificial
  CRISPR gRNA sequence
gataaatagcattgactgta

SEQ ID NO: 598530 - DNA, 20 bp, Artificial
  CRISPR gRNA sequence
tgtacagttgatccacttaa

SEQ ID NO: 598531 - DNA, 20 bp, Artificial
  CRISPR gRNA sequence
tgatccacttaacagcttta

SEQ ID NO: 598532 - DNA, 20 bp, Artificial
  CRISPR gRNA sequence
acttaacagctttaaagtaa

SEQ ID NO: 598533 - DNA, 20 bp, Artificial
  CRISPR gRNA sequence
atgtattttcatacccattt

SEQ ID NO: 598534 - DNA, 20 bp, Artificial
  CRISPR gRNA sequence
catttaagtaactacctgca

SEQ ID NO: 598535 - DNA, 20 bp, Artificial
  CRISPR gRNA sequence
acataaacattataaaaaaa

SEQ ID NO: 598536 - DNA, 20 bp, Artificial
  CRISPR gRNA sequence
aacattataaaaaaatagat

SEQ ID NO: 598537 - DNA, 20 bp, Artificial
  CRISPR gRNA sequence
actttaaacaattttcaaaa

SEQ ID NO: 598538 - DNA, 20 bp, Artificial
  CRISPR gRNA sequence
ttttcaaaatagtcacctgc

SEQ ID NO: 598539 - DNA, 20 bp, Artificial
  CRISPR gRNA sequence
aaaatagtcacctgccagta

SEQ ID NO: 598540 - DNA, 20 bp, Artificial
  CRISPR gRNA sequence
agtcacctgccagtatagaa

SEQ ID NO: 598541 - DNA, 20 bp, Artificial
  CRISPR gRNA sequence
ccaatactgaacaactatgc

SEQ ID NO: 598542 - DNA, 20 bp, Artificial
  CRISPR gRNA sequence
ctgaacaactatgcaagaat

SEQ ID NO: 598543 - DNA, 20 bp, Artificial
  CRISPR gRNA sequence
actatgcaagaattggaaat

SEQ ID NO: 598544 - DNA, 20 bp, Artificial
  CRISPR gRNA sequence
gaattggaaatgagctaacc

SEQ ID NO: 598545 - DNA, 20 bp, Artificial
  CRISPR gRNA sequence
gaaatgagctaaccaagaaa

SEQ ID NO: 598546 - DNA, 20 bp, Artificial
  CRISPR gRNA sequence
atgagctaaccaagaaacag

SEQ ID NO: 598547 - DNA, 20 bp, Artificial
  CRISPR gRNA sequence
tgagctaaccaagaaacaga

SEQ ID NO: 598548 - DNA, 20 bp, Artificial
  CRISPR gRNA sequence
aagaaacagaaggaatcaca

SEQ ID NO: 598549 - DNA, 20 bp, Artificial
  CRISPR gRNA sequence
aacagaaggaatcacaaagt

SEQ ID NO: 598550 - DNA, 20 bp, Artificial
  CRISPR gRNA sequence
acaaagtaagtttcatctga

SEQ ID NO: 598551 - DNA, 20 bp, Artificial
  CRISPR gRNA sequence
caaagtaagtttcatctgat

SEQ ID NO: 598552 - DNA, 20 bp, Artificial
  CRISPR gRNA sequence
tgatgggccgaaatacaata

SEQ ID NO: 598553 - DNA, 20 bp, Artificial
  CRISPR gRNA sequence
atttttatattgttctgtct

SEQ ID NO: 598554 - DNA, 20 bp, Artificial
  CRISPR gRNA sequence
tctgtctgagatgtctgtct

SEQ ID NO: 598555 - DNA, 20 bp, Artificial
  CRISPR gRNA sequence
gatgtctgtctcagattctt

SEQ ID NO: 598556 - DNA, 20 bp, Artificial
  CRISPR gRNA sequence
tgtctcagattcttaagtcc

SEQ ID NO: 598557 - DNA, 20 bp, Artificial
  CRISPR gRNA sequence
ttaacactgtgtatttccaa

SEQ ID NO: 598558 - DNA, 20 bp, Artificial
  CRISPR gRNA sequence
gtgtatttccaatagccatc

SEQ ID NO: 598559 - DNA, 20 bp, Artificial
  CRISPR gRNA sequence
tgtatttccaatagccatca

SEQ ID NO: 598560 - DNA, 20 bp, Artificial
  CRISPR gRNA sequence
tactgtcatccctgacaccg

SEQ ID NO: 598561 - DNA, 20 bp, Artificial
  CRISPR gRNA sequence
tccctgacaccgaagattgt

SEQ ID NO: 598562 - DNA, 20 bp, Artificial
  CRISPR gRNA sequence
ctgacaccgaagattgtcag

SEQ ID NO: 598563 - DNA, 20 bp, Artificial
  CRISPR gRNA sequence
aatatgtacactaatgatct

SEQ ID NO: 598564 - DNA, 20 bp, Artificial
  CRISPR gRNA sequence
atatgtacactaatgatctc

SEQ ID NO: 598565 - DNA, 20 bp, Artificial
  CRISPR gRNA sequence
caatgtccatcttcttaaca

SEQ ID NO: 598566 - DNA, 20 bp, Artificial
  CRISPR gRNA sequence
taacaaagacatcctcattc

SEQ ID NO: 598567 - DNA, 20 bp, Artificial
  CRISPR gRNA sequence
caaagacatcctcattccag

SEQ ID NO: 598568 - DNA, 20 bp, Artificial
  CRISPR gRNA sequence
catcctcattccagaagaaa

SEQ ID NO: 598569 - DNA, 20 bp, Artificial
  CRISPR gRNA sequence
attccagaagaaaaagttta

SEQ ID NO: 598570 - DNA, 20 bp, Artificial
  CRISPR gRNA sequence
gaaaaagtttaaagttctct

SEQ ID NO: 598571 - DNA, 20 bp, Artificial
  CRISPR gRNA sequence
agaaaattcattcaaaacca

SEQ ID NO: 598572 - DNA, 20 bp, Artificial
  CRISPR gRNA sequence
gaaaattcattcaaaaccat

SEQ ID NO: 598573 - DNA, 20 bp, Artificial
  CRISPR gRNA sequence
aattcattcaaaaccatagg

SEQ ID NO: 598574 - DNA, 20 bp, Artificial
  CRISPR gRNA sequence
tcattcaaaaccataggaag

SEQ ID NO: 598575 - DNA, 20 bp, Artificial
  CRISPR gRNA sequence
aagtagtcattataaaatgt

SEQ ID NO: 598576 - DNA, 20 bp, Artificial
  CRISPR gRNA sequence
agtagtcattataaaatgtt

SEQ ID NO: 598577 - DNA, 20 bp, Artificial
  CRISPR gRNA sequence
aatacctcttacttcttctt

SEQ ID NO: 598578 - DNA, 20 bp, Artificial
  CRISPR gRNA sequence
acttcttcttaagtttatct

SEQ ID NO: 598579 - DNA, 20 bp, Artificial
  CRISPR gRNA sequence
attttaaaaccaaaaactgt

SEQ ID NO: 598580 - DNA, 20 bp, Artificial
  CRISPR gRNA sequence
ttttaaaaccaaaaactgtc

SEQ ID NO: 598581 - DNA, 20 bp, Artificial
  CRISPR gRNA sequence
gtcaggcattataacatttt

SEQ ID NO: 598582 - DNA, 20 bp, Artificial
  CRISPR gRNA sequence
tttttagttctctccctccc

SEQ ID NO: 598583 - DNA, 20 bp, Artificial
  CRISPR gRNA sequence
ttctctccctcccaagtcac

SEQ ID NO: 598584 - DNA, 20 bp, Artificial
  CRISPR gRNA sequence
aagtcaccagtgctctattc

SEQ ID NO: 598585 - DNA, 20 bp, Artificial
  CRISPR gRNA sequence
ctagcactgtcaaataatga

SEQ ID NO: 598586 - DNA, 20 bp, Artificial
  CRISPR gRNA sequence
ccgtcattatttttatacaa

SEQ ID NO: 598587 - DNA, 20 bp, Artificial
  CRISPR gRNA sequence
cattatttttatacaatagc

SEQ ID NO: 598588 - DNA, 20 bp, Artificial
  CRISPR gRNA sequence
tatttttatacaatagctgg

SEQ ID NO: 598589 - DNA, 20 bp, Artificial
  CRISPR gRNA sequence
tttatacaatagctggcagc

SEQ ID NO: 598590 - DNA, 20 bp, Artificial
  CRISPR gRNA sequence
atagctggcagcaagttgca

SEQ ID NO: 598591 - DNA, 20 bp, Artificial
  CRISPR gRNA sequence
tgcacagaaacccttcatct

SEQ ID NO: 598592 - DNA, 20 bp, Artificial
  CRISPR gRNA sequence
acagaaacccttcatcttag

SEQ ID NO: 598593 - DNA, 20 bp, Artificial
  CRISPR gRNA sequence
agaaacccttcatcttagaa

SEQ ID NO: 598594 - DNA, 20 bp, Artificial
  CRISPR gRNA sequence
atcttagaagagttaccaaa

SEQ ID NO: 598595 - DNA, 20 bp, Artificial
  CRISPR gRNA sequence
caaatagcttaaacaaatgc

SEQ ID NO: 598596 - DNA, 20 bp, Artificial
  CRISPR gRNA sequence
aaatagcttaaacaaatgct

SEQ ID NO: 598597 - DNA, 20 bp, Artificial
  CRISPR gRNA sequence
aaacaaatgctgggacctta

SEQ ID NO: 598598 - DNA, 20 bp, Artificial
  CRISPR gRNA sequence
caaatgctgggaccttacag

SEQ ID NO: 598599 - DNA, 20 bp, Artificial
  CRISPR gRNA sequence
tagtactgaccaccttccta

SEQ ID NO: 598600 - DNA, 20 bp, Artificial
  CRISPR gRNA sequence
caccttcctaaagccaaaat

SEQ ID NO: 598601 - DNA, 20 bp, Artificial
  CRISPR gRNA sequence
ttcctaaagccaaaataagt

SEQ ID NO: 598602 - DNA, 20 bp, Artificial
  CRISPR gRNA sequence
atgccttattgatacttttc

SEQ ID NO: 598603 - DNA, 20 bp, Artificial
  CRISPR gRNA sequence
cttattgatacttttctggc

SEQ ID NO: 598604 - DNA, 20 bp, Artificial
  CRISPR gRNA sequence
tacttttctggccagaatgt

SEQ ID NO: 598605 - DNA, 20 bp, Artificial
  CRISPR gRNA sequence
catcctctccttcctgctac

SEQ ID NO: 598606 - DNA, 20 bp, Artificial
  CRISPR gRNA sequence
tgctactagaaactgtctta

SEQ ID NO: 598607 - DNA, 20 bp, Artificial
  CRISPR gRNA sequence
gctactagaaactgtcttaa

SEQ ID NO: 598608 - DNA, 20 bp, Artificial
  CRISPR gRNA sequence
aaggttttcacatttacttt

SEQ ID NO: 598609 - DNA, 20 bp, Artificial
  CRISPR gRNA sequence
caaaattgcaattctgtttt

SEQ ID NO: 598610 - DNA, 20 bp, Artificial
  CRISPR gRNA sequence
aattgcaattctgtttttgg

SEQ ID NO: 598611 - DNA, 20 bp, Artificial
  CRISPR gRNA sequence
tgcaattctgtttttggaag

SEQ ID NO: 598612 - DNA, 20 bp, Artificial
  CRISPR gRNA sequence
gcaattctgtttttggaagc

SEQ ID NO: 598613 - DNA, 20 bp, Artificial
  CRISPR gRNA sequence
ttttggaagcaggcaccctc

SEQ ID NO: 598614 - DNA, 20 bp, Artificial
  CRISPR gRNA sequence
tttggaagcaggcaccctcc

SEQ ID NO: 598615 - DNA, 20 bp, Artificial
  CRISPR gRNA sequence
ggaagcaggcaccctccagg

SEQ ID NO: 598616 - DNA, 20 bp, Artificial
  CRISPR gRNA sequence
ccctccaggaagtatatttg

SEQ ID NO: 598617 - DNA, 20 bp, Artificial
  CRISPR gRNA sequence
tttgaagatattaaaaaatg

SEQ ID NO: 598618 - DNA, 20 bp, Artificial
  CRISPR gRNA sequence
aaaaaatgcagaaaataaat

SEQ ID NO: 598619 - DNA, 20 bp, Artificial
  CRISPR gRNA sequence
taagttcttttcattaaaca

SEQ ID NO: 598620 - DNA, 20 bp, Artificial
  CRISPR gRNA sequence
caaagtcaacaatgcatgta

SEQ ID NO: 598621 - DNA, 20 bp, Artificial
  CRISPR gRNA sequence
aaagtcaacaatgcatgtaa

SEQ ID NO: 598622 - DNA, 20 bp, Artificial
  CRISPR gRNA sequence
aagtcaacaatgcatgtaaa

SEQ ID NO: 598623 - DNA, 20 bp, Artificial
  CRISPR gRNA sequence
acaatgcatgtaaagggatt

SEQ ID NO: 598624 - DNA, 20 bp, Artificial
  CRISPR gRNA sequence
caatgcatgtaaagggattt

SEQ ID NO: 598625 - DNA, 20 bp, Artificial
  CRISPR gRNA sequence
gtaaagggatttaggaaaac

SEQ ID NO: 598626 - DNA, 20 bp, Artificial
  CRISPR gRNA sequence
tttaggaaaaccggtgatct

SEQ ID NO: 598627 - DNA, 20 bp, Artificial
  CRISPR gRNA sequence
aaaccggtgatctcagacac

SEQ ID NO: 598628 - DNA, 20 bp, Artificial
  CRISPR gRNA sequence
ctcagacacaagtgatttga

SEQ ID NO: 598629 - DNA, 20 bp, Artificial
  CRISPR gRNA sequence
tcagacacaagtgatttgac

SEQ ID NO: 598630 - DNA, 20 bp, Artificial
  CRISPR gRNA sequence
acacaagtgatttgacaggc

SEQ ID NO: 598631 - DNA, 20 bp, Artificial
  CRISPR gRNA sequence
tgcacacaaaaaattattcc

SEQ ID NO: 598632 - DNA, 20 bp, Artificial
  CRISPR gRNA sequence
caaaaaattattccaagtca

SEQ ID NO: 598633 - DNA, 20 bp, Artificial
  CRISPR gRNA sequence
tccaagtcacagaaaaacat

SEQ ID NO: 598634 - DNA, 20 bp, Artificial
  CRISPR gRNA sequence
caagtcacagaaaaacatca

SEQ ID NO: 598635 - DNA, 20 bp, Artificial
  CRISPR gRNA sequence
aacatcagagtgaccaattc

SEQ ID NO: 598636 - DNA, 20 bp, Artificial
  CRISPR gRNA sequence
acatcagagtgaccaattct

SEQ ID NO: 598637 - DNA, 20 bp, Artificial
  CRISPR gRNA sequence
aggtctcttgttctaattaa

SEQ ID NO: 598638 - DNA, 20 bp, Artificial
  CRISPR gRNA sequence
tcttgttctaattaatagac

SEQ ID NO: 598639 - DNA, 20 bp, Artificial
  CRISPR gRNA sequence
ttgttctaattaatagacga

SEQ ID NO: 598640 - DNA, 20 bp, Artificial
  CRISPR gRNA sequence
ctctctatcactatttgctt

SEQ ID NO: 598641 - DNA, 20 bp, Artificial
  CRISPR gRNA sequence
ctaaaatgctgatattctcc

SEQ ID NO: 598642 - DNA, 20 bp, Artificial
  CRISPR gRNA sequence
tgatattctcctagatctaa

SEQ ID NO: 598643 - DNA, 20 bp, Artificial
  CRISPR gRNA sequence
atattctcctagatctaaca

SEQ ID NO: 598644 - DNA, 20 bp, Artificial
  CRISPR gRNA sequence
attctcctagatctaacaga

SEQ ID NO: 598645 - DNA, 20 bp, Artificial
  CRISPR gRNA sequence
ttctcctagatctaacagag

SEQ ID NO: 598646 - DNA, 20 bp, Artificial
  CRISPR gRNA sequence
gatctaacagagaggaaaaa

SEQ ID NO: 598647 - DNA, 20 bp, Artificial
  CRISPR gRNA sequence
atctaacagagaggaaaaat

SEQ ID NO: 598648 - DNA, 20 bp, Artificial
  CRISPR gRNA sequence
atcttctccatctaacacct

SEQ ID NO: 598649 - DNA, 20 bp, Artificial
  CRISPR gRNA sequence
ttctccatctaacacctaag

SEQ ID NO: 598650 - DNA, 20 bp, Artificial
  CRISPR gRNA sequence
tctccatctaacacctaagt

SEQ ID NO: 598651 - DNA, 20 bp, Artificial
  CRISPR gRNA sequence
taacacctaagtgggtaacc

SEQ ID NO: 598652 - DNA, 20 bp, Artificial
  CRISPR gRNA sequence
ggtaacctagatactgtaaa

SEQ ID NO: 598653 - DNA, 20 bp, Artificial
  CRISPR gRNA sequence
taacctagatactgtaaata

SEQ ID NO: 598654 - DNA, 20 bp, Artificial
  CRISPR gRNA sequence
aacctagatactgtaaatag

SEQ ID NO: 598655 - DNA, 20 bp, Artificial
  CRISPR gRNA sequence
ctgtaaatagaggctacata

SEQ ID NO: 598656 - DNA, 20 bp, Artificial
  CRISPR gRNA sequence
tgtaaatagaggctacataa

SEQ ID NO: 598657 - DNA, 20 bp, Artificial
  CRISPR gRNA sequence
agaggctacataaaggatgc

SEQ ID NO: 598658 - DNA, 20 bp, Artificial
  CRISPR gRNA sequence
aggctacataaaggatgcaa

SEQ ID NO: 598659 - DNA, 20 bp, Artificial
  CRISPR gRNA sequence
tacataaaggatgcaagaga

SEQ ID NO: 598660 - DNA, 20 bp, Artificial
  CRISPR gRNA sequence
ggatgcaagagacagctctg

SEQ ID NO: 598661 - DNA, 20 bp, Artificial
  CRISPR gRNA sequence
gcaagagacagctctgaagt

SEQ ID NO: 598662 - DNA, 20 bp, Artificial
  CRISPR gRNA sequence
aagagacagctctgaagtga

SEQ ID NO: 598663 - DNA, 20 bp, Artificial
  CRISPR gRNA sequence
atatttaacctgcaactctt

SEQ ID NO: 598664 - DNA, 20 bp, Artificial
  CRISPR gRNA sequence
taacctgcaactctttggaa

SEQ ID NO: 598665 - DNA, 20 bp, Artificial
  CRISPR gRNA sequence
acctgaaaacacgtgcatct

SEQ ID NO: 598666 - DNA, 20 bp, Artificial
  CRISPR gRNA sequence
agccaaaacctgtactaaca

SEQ ID NO: 598667 - DNA, 20 bp, Artificial
  CRISPR gRNA sequence
gtactaacatggaattgcca

SEQ ID NO: 598668 - DNA, 20 bp, Artificial
  CRISPR gRNA sequence
tactaacatggaattgccac

SEQ ID NO: 598669 - DNA, 20 bp, Artificial
  CRISPR gRNA sequence
aacatggaattgccacaggc

SEQ ID NO: 598670 - DNA, 20 bp, Artificial
  CRISPR gRNA sequence
tggaattgccacaggctagt

SEQ ID NO: 598671 - DNA, 20 bp, Artificial
  CRISPR gRNA sequence
aaaaactctctaccaaacat

SEQ ID NO: 598672 - DNA, 20 bp, Artificial
  CRISPR gRNA sequence
aaacataagtttactgttgt

SEQ ID NO: 598673 - DNA, 20 bp, Artificial
  CRISPR gRNA sequence
aacataagtttactgttgtt

SEQ ID NO: 598674 - DNA, 20 bp, Artificial
  CRISPR gRNA sequence
taagtttactgttgttgggt

SEQ ID NO: 598675 - DNA, 20 bp, Artificial
  CRISPR gRNA sequence
ttactgttgttgggtgagaa

SEQ ID NO: 598676 - DNA, 20 bp, Artificial
  CRISPR gRNA sequence
gagaaaagctcaaatgtcaa

SEQ ID NO: 598677 - DNA, 20 bp, Artificial
  CRISPR gRNA sequence
aagctcaaatgtcaaaagca

SEQ ID NO: 598678 - DNA, 20 bp, Artificial
  CRISPR gRNA sequence
ctctgcactgtttatttaaa

SEQ ID NO: 598679 - DNA, 20 bp, Artificial
  CRISPR gRNA sequence
cactgtttatttaaaaagat

SEQ ID NO: 598680 - DNA, 20 bp, Artificial
  CRISPR gRNA sequence
atgagtgaactgcctttctg

SEQ ID NO: 598681 - DNA, 20 bp, Artificial
  CRISPR gRNA sequence
gtgaactgcctttctgaagc

SEQ ID NO: 598682 - DNA, 20 bp, Artificial
  CRISPR gRNA sequence
gaagcaagtacttgcaaaac

SEQ ID NO: 598683 - DNA, 20 bp, Artificial
  CRISPR gRNA sequence
tgcaaaaccagaatcaaatt

SEQ ID NO: 598684 - DNA, 20 bp, Artificial
  CRISPR gRNA sequence
cagaatcaaattcagaaata

SEQ ID NO: 598685 - DNA, 20 bp, Artificial
  CRISPR gRNA sequence
aatcaaattcagaaataaag

SEQ ID NO: 598686 - DNA, 20 bp, Artificial
  CRISPR gRNA sequence
cagccaattaaccacttgac

SEQ ID NO: 598687 - DNA, 20 bp, Artificial
  CRISPR gRNA sequence
acttgacaagcattttcctg

SEQ ID NO: 598688 - DNA, 20 bp, Artificial
  CRISPR gRNA sequence
cattttcctgtggttgtgtc

SEQ ID NO: 598689 - DNA, 20 bp, Artificial
  CRISPR gRNA sequence
attttcctgtggttgtgtct

SEQ ID NO: 598690 - DNA, 20 bp, Artificial
  CRISPR gRNA sequence
ttttcctgtggttgtgtcta

SEQ ID NO: 598691 - DNA, 20 bp, Artificial
  CRISPR gRNA sequence
tttcctgtggttgtgtctag

SEQ ID NO: 598692 - DNA, 20 bp, Artificial
  CRISPR gRNA sequence
tggttgtgtctaggggatga

SEQ ID NO: 598693 - DNA, 20 bp, Artificial
  CRISPR gRNA sequence
gtgtctaggggatgacagtc

SEQ ID NO: 598694 - DNA, 20 bp, Artificial
  CRISPR gRNA sequence
acagtcaagtctctgattaa

SEQ ID NO: 598695 - DNA, 20 bp, Artificial
  CRISPR gRNA sequence
ctatacatgcaatgtttcta

SEQ ID NO: 598696 - DNA, 20 bp, Artificial
  CRISPR gRNA sequence
tgcaatgtttctaaagccaa

SEQ ID NO: 598697 - DNA, 20 bp, Artificial
  CRISPR gRNA sequence
taaagccaatagctaactaa

SEQ ID NO: 598698 - DNA, 20 bp, Artificial
  CRISPR gRNA sequence
tattatctctttttactctt

SEQ ID NO: 598699 - DNA, 20 bp, Artificial
  CRISPR gRNA sequence
attatctctttttactcttt

SEQ ID NO: 598700 - DNA, 20 bp, Artificial
  CRISPR gRNA sequence
tactctttaggaaattgtgt

SEQ ID NO: 598701 - DNA, 20 bp, Artificial
  CRISPR gRNA sequence
ggaaattgtgtgagttatct

SEQ ID NO: 598702 - DNA, 20 bp, Artificial
  CRISPR gRNA sequence
aaaacattacaccaaataac

SEQ ID NO: 598703 - DNA, 20 bp, Artificial
  CRISPR gRNA sequence
aaattctattgcctaaattg

SEQ ID NO: 598704 - DNA, 20 bp, Artificial
  CRISPR gRNA sequence
tattgcctaaattgtagtca

SEQ ID NO: 598705 - DNA, 20 bp, Artificial
  CRISPR gRNA sequence
atattttttatcaaatcaac

SEQ ID NO: 598706 - DNA, 20 bp, Artificial
  CRISPR gRNA sequence
agcaaaaaacatgaatgcaa

SEQ ID NO: 598707 - DNA, 20 bp, Artificial
  CRISPR gRNA sequence
gaatgcaaaagattcattat

SEQ ID NO: 598708 - DNA, 20 bp, Artificial
  CRISPR gRNA sequence
caaaagattcattatgagat

SEQ ID NO: 598709 - DNA, 20 bp, Artificial
  CRISPR gRNA sequence
atgagattagtatgataatt

SEQ ID NO: 598710 - DNA, 20 bp, Artificial
  CRISPR gRNA sequence
cattcacctgctaactttac

SEQ ID NO: 598711 - DNA, 20 bp, Artificial
  CRISPR gRNA sequence
ttttttctttctaaatgata

SEQ ID NO: 598712 - DNA, 20 bp, Artificial
  CRISPR gRNA sequence
tttttctttctaaatgatac

SEQ ID NO: 598713 - DNA, 20 bp, Artificial
  CRISPR gRNA sequence
ctaaatgatacgggaattgt

SEQ ID NO: 598714 - DNA, 20 bp, Artificial
  CRISPR gRNA sequence
taaatgatacgggaattgta

SEQ ID NO: 598715 - DNA, 20 bp, Artificial
  CRISPR gRNA sequence
cttctataattaaattttct

SEQ ID NO: 598716 - DNA, 20 bp, Artificial
  CRISPR gRNA sequence
ttctataattaaattttctt

SEQ ID NO: 598717 - DNA, 20 bp, Artificial
  CRISPR gRNA sequence
tataattaaattttcttagg

SEQ ID NO: 598718 - DNA, 20 bp, Artificial
  CRISPR gRNA sequence
aggaagtgctcattacttaa

SEQ ID NO: 598719 - DNA, 20 bp, Artificial
  CRISPR gRNA sequence
ttacaacttttaaataaata

SEQ ID NO: 598720 - DNA, 20 bp, Artificial
  CRISPR gRNA sequence
tcaaactcaatcataatttc

SEQ ID NO: 598721 - DNA, 20 bp, Artificial
  CRISPR gRNA sequence
caatcataatttcaagtcaa

SEQ ID NO: 598722 - DNA, 20 bp, Artificial
  CRISPR gRNA sequence
tcaatagctaaaattactta

SEQ ID NO: 598723 - DNA, 20 bp, Artificial
  CRISPR gRNA sequence
aaattgcaaaatgtattcaa

SEQ ID NO: 598724 - DNA, 20 bp, Artificial
  CRISPR gRNA sequence
tatataaattgcttaaattt

SEQ ID NO: 598725 - DNA, 20 bp, Artificial
  CRISPR gRNA sequence
ataaattgcttaaatttcag

SEQ ID NO: 598726 - DNA, 20 bp, Artificial
  CRISPR gRNA sequence
agtagtatttactaattact

SEQ ID NO: 598727 - DNA, 20 bp, Artificial
  CRISPR gRNA sequence
tttactaattactaagcttg

SEQ ID NO: 598728 - DNA, 20 bp, Artificial
  CRISPR gRNA sequence
tgcagttttataataactta

SEQ ID NO: 598729 - DNA, 20 bp, Artificial
  CRISPR gRNA sequence
ttataataacttacagtttc

SEQ ID NO: 598730 - DNA, 20 bp, Artificial
  CRISPR gRNA sequence
ataataacttacagtttcga

SEQ ID NO: 598731 - DNA, 20 bp, Artificial
  CRISPR gRNA sequence
cttacagtttcgagagctgt

SEQ ID NO: 598732 - DNA, 20 bp, Artificial
  CRISPR gRNA sequence
acagtttcgagagctgttag

SEQ ID NO: 598733 - DNA, 20 bp, Artificial
  CRISPR gRNA sequence
cgagagctgttagaagtaaa

SEQ ID NO: 598734 - DNA, 20 bp, Artificial
  CRISPR gRNA sequence
ctgttagaagtaaaaagaaa

SEQ ID NO: 598735 - DNA, 20 bp, Artificial
  CRISPR gRNA sequence
aaagaaaaagttgctctctc

SEQ ID NO: 598736 - DNA, 20 bp, Artificial
  CRISPR gRNA sequence
aaaaagttgctctctctgga

SEQ ID NO: 598737 - DNA, 20 bp, Artificial
  CRISPR gRNA sequence
agttgctctctctggatagt

SEQ ID NO: 598738 - DNA, 20 bp, Artificial
  CRISPR gRNA sequence
ttacaaatatgctcataatt

SEQ ID NO: 598739 - DNA, 20 bp, Artificial
  CRISPR gRNA sequence
agtacatgattcacttttct

SEQ ID NO: 598740 - DNA, 20 bp, Artificial
  CRISPR gRNA sequence
tttcttagttattaaatctt

SEQ ID NO: 598741 - DNA, 20 bp, Artificial
  CRISPR gRNA sequence
ttcttagttattaaatcttc

SEQ ID NO: 598742 - DNA, 20 bp, Artificial
  CRISPR gRNA sequence
tcttagttattaaatcttcg

SEQ ID NO: 598743 - DNA, 20 bp, Artificial
  CRISPR gRNA sequence
cttagttattaaatcttcgg

SEQ ID NO: 598744 - DNA, 20 bp, Artificial
  CRISPR gRNA sequence
ttagttattaaatcttcggg

SEQ ID NO: 598745 - DNA, 20 bp, Artificial
  CRISPR gRNA sequence
tagttattaaatcttcgggg

SEQ ID NO: 598746 - DNA, 20 bp, Artificial
  CRISPR gRNA sequence
agttattaaatcttcggggg

SEQ ID NO: 598747 - DNA, 20 bp, Artificial
  CRISPR gRNA sequence
gttattaaatcttcgggggg

SEQ ID NO: 598748 - DNA, 20 bp, Artificial
  CRISPR gRNA sequence
ttattaaatcttcggggggg

SEQ ID NO: 598749 - DNA, 20 bp, Artificial
  CRISPR gRNA sequence
ttaaatcttcgggggggggg

SEQ ID NO: 598750 - DNA, 20 bp, Artificial
  CRISPR gRNA sequence
taaatcttcgggggggggga

SEQ ID NO: 598751 - DNA, 20 bp, Artificial
  CRISPR gRNA sequence
tcttcggggggggggaagga

SEQ ID NO: 598752 - DNA, 20 bp, Artificial
  CRISPR gRNA sequence
ttcggggggggggaaggaaa

SEQ ID NO: 598753 - DNA, 20 bp, Artificial
  CRISPR gRNA sequence
tccttcacatattgccaaaa

SEQ ID NO: 598754 - DNA, 20 bp, Artificial
  CRISPR gRNA sequence
atttaattatatttacatgt

SEQ ID NO: 598755 - DNA, 20 bp, Artificial
  CRISPR gRNA sequence
atgtcctttctataacatgt

SEQ ID NO: 598756 - DNA, 20 bp, Artificial
  CRISPR gRNA sequence
aagaataaaatataaatcta

SEQ ID NO: 598757 - DNA, 20 bp, Artificial
  CRISPR gRNA sequence
aaatataaatctaaagtata

SEQ ID NO: 598758 - DNA, 20 bp, Artificial
  CRISPR gRNA sequence
atctaaagtataaagaaaac

SEQ ID NO: 598759 - DNA, 20 bp, Artificial
  CRISPR gRNA sequence
caagatttcaaattactttt

SEQ ID NO: 598760 - DNA, 20 bp, Artificial
  CRISPR gRNA sequence
atttcaaattacttttgagt

SEQ ID NO: 598761 - DNA, 20 bp, Artificial
  CRISPR gRNA sequence
ttcaaattacttttgagtaa

SEQ ID NO: 598762 - DNA, 20 bp, Artificial
  CRISPR gRNA sequence
acttttgagtaagagtaata

SEQ ID NO: 598763 - DNA, 20 bp, Artificial
  CRISPR gRNA sequence
actgataaaatattataatt

SEQ ID NO: 598764 - DNA, 20 bp, Artificial
  CRISPR gRNA sequence
aaatattataattaagaaaa

SEQ ID NO: 598765 - DNA, 20 bp, Artificial
  CRISPR gRNA sequence
aagcaaccatattcttaata

SEQ ID NO: 598766 - DNA, 20 bp, Artificial
  CRISPR gRNA sequence
attttgtcttctgtcactga

SEQ ID NO: 598767 - DNA, 20 bp, Artificial
  CRISPR gRNA sequence
ttctgtcactgacagcatgt

SEQ ID NO: 598768 - DNA, 20 bp, Artificial
  CRISPR gRNA sequence
aaaaacaatgtatattacat

SEQ ID NO: 598769 - DNA, 20 bp, Artificial
  CRISPR gRNA sequence
aaatgaccctttatcaaaaa

SEQ ID NO: 598770 - DNA, 20 bp, Artificial
  CRISPR gRNA sequence
tgaccctttatcaaaaacag

SEQ ID NO: 598771 - DNA, 20 bp, Artificial
  CRISPR gRNA sequence
aacatctttccaaattttat

SEQ ID NO: 598772 - DNA, 20 bp, Artificial
  CRISPR gRNA sequence
aaattttatcagttcttctc

SEQ ID NO: 598773 - DNA, 20 bp, Artificial
  CRISPR gRNA sequence
atcagttcttctctggacaa

SEQ ID NO: 598774 - DNA, 20 bp, Artificial
  CRISPR gRNA sequence
aaagcctttcaactttgcta

SEQ ID NO: 598775 - DNA, 20 bp, Artificial
  CRISPR gRNA sequence
tttcaactttgctacagaaa

SEQ ID NO: 598776 - DNA, 20 bp, Artificial
  CRISPR gRNA sequence
ctacagaaatggatataaat

SEQ ID NO: 598777 - DNA, 20 bp, Artificial
  CRISPR gRNA sequence
acacttcacttccaatgctt

SEQ ID NO: 598778 - DNA, 20 bp, Artificial
  CRISPR gRNA sequence
acttcacttccaatgctttg

SEQ ID NO: 598779 - DNA, 20 bp, Artificial
  CRISPR gRNA sequence
tcacttccaatgctttggag

SEQ ID NO: 598780 - DNA, 20 bp, Artificial
  CRISPR gRNA sequence
gaaactttcacattttttaa

SEQ ID NO: 598781 - DNA, 20 bp, Artificial
  CRISPR gRNA sequence
ctttcacattttttaaaagc

SEQ ID NO: 598782 - DNA, 20 bp, Artificial
  CRISPR gRNA sequence
cactgtaattttatcactga

SEQ ID NO: 598783 - DNA, 20 bp, Artificial
  CRISPR gRNA sequence
taattttatcactgacggtt

SEQ ID NO: 598784 - DNA, 20 bp, Artificial
  CRISPR gRNA sequence
tgacggtttagctttctacc

SEQ ID NO: 598785 - DNA, 20 bp, Artificial
  CRISPR gRNA sequence
gacggtttagctttctacca

SEQ ID NO: 598786 - DNA, 20 bp, Artificial
  CRISPR gRNA sequence
tatttcattttttaactgtg

SEQ ID NO: 598787 - DNA, 20 bp, Artificial
  CRISPR gRNA sequence
tttcattttttaactgtgaa

SEQ ID NO: 598788 - DNA, 20 bp, Artificial
  CRISPR gRNA sequence
tttaactgtgaagagtcctt

SEQ ID NO: 598789 - DNA, 20 bp, Artificial
  CRISPR gRNA sequence
aactgtgaagagtcctttgg

SEQ ID NO: 598790 - DNA, 20 bp, Artificial
  CRISPR gRNA sequence
cccaacaacaacaaaaaatc

SEQ ID NO: 598791 - DNA, 20 bp, Artificial
  CRISPR gRNA sequence
aaaaaatccagtcataaacc

SEQ ID NO: 598792 - DNA, 20 bp, Artificial
  CRISPR gRNA sequence
aatccagtcataaacctggc

SEQ ID NO: 598793 - DNA, 20 bp, Artificial
  CRISPR gRNA sequence
tggcaagtcaaaacaacaac

SEQ ID NO: 598794 - DNA, 20 bp, Artificial
  CRISPR gRNA sequence
ctaacctttcttacctgata

SEQ ID NO: 598795 - DNA, 20 bp, Artificial
  CRISPR gRNA sequence
taacctttcttacctgatac

SEQ ID NO: 598796 - DNA, 20 bp, Artificial
  CRISPR gRNA sequence
ctttcttacctgatacaggt

SEQ ID NO: 598797 - DNA, 20 bp, Artificial
  CRISPR gRNA sequence
tacctgatacaggtaagcac

SEQ ID NO: 598798 - DNA, 20 bp, Artificial
  CRISPR gRNA sequence
ccagctcccaaatgccacct

SEQ ID NO: 598799 - DNA, 20 bp, Artificial
  CRISPR gRNA sequence
cagctcccaaatgccacctt

SEQ ID NO: 598800 - DNA, 20 bp, Artificial
  CRISPR gRNA sequence
tcccaaatgccaccttggga

SEQ ID NO: 598801 - DNA, 20 bp, Artificial
  CRISPR gRNA sequence
aatgccaccttgggatagtt

SEQ ID NO: 598802 - DNA, 20 bp, Artificial
  CRISPR gRNA sequence
caccttgggatagttcagac

SEQ ID NO: 598803 - DNA, 20 bp, Artificial
  CRISPR gRNA sequence
ttgggatagttcagactagt

SEQ ID NO: 598804 - DNA, 20 bp, Artificial
  CRISPR gRNA sequence
ggatagttcagactagtaag

SEQ ID NO: 598805 - DNA, 20 bp, Artificial
  CRISPR gRNA sequence
gatagttcagactagtaagc

SEQ ID NO: 598806 - DNA, 20 bp, Artificial
  CRISPR gRNA sequence
aggctcatgttttataatac

SEQ ID NO: 598807 - DNA, 20 bp, Artificial
  CRISPR gRNA sequence
ttttataatactagaatgaa

SEQ ID NO: 598808 - DNA, 20 bp, Artificial
  CRISPR gRNA sequence
tttataatactagaatgaac

SEQ ID NO: 598809 - DNA, 20 bp, Artificial
  CRISPR gRNA sequence
aatctgtgttgttctttctt

SEQ ID NO: 598810 - DNA, 20 bp, Artificial
  CRISPR gRNA sequence
ttctttagcaaaatctataa

SEQ ID NO: 598811 - DNA, 20 bp, Artificial
  CRISPR gRNA sequence
tttagcaaaatctataacag

SEQ ID NO: 598812 - DNA, 20 bp, Artificial
  CRISPR gRNA sequence
cagtagctataccacaatgt

SEQ ID NO: 598813 - DNA, 20 bp, Artificial
  CRISPR gRNA sequence
gtagctataccacaatgtga

SEQ ID NO: 598814 - DNA, 20 bp, Artificial
  CRISPR gRNA sequence
tagctataccacaatgtgag

SEQ ID NO: 598815 - DNA, 20 bp, Artificial
  CRISPR gRNA sequence
cacaatgtgagaggacccca

SEQ ID NO: 598816 - DNA, 20 bp, Artificial
  CRISPR gRNA sequence
cccacagacctaacaaatta

SEQ ID NO: 598817 - DNA, 20 bp, Artificial
  CRISPR gRNA sequence
aacaaattaaagtctgttgc

SEQ ID NO: 598818 - DNA, 20 bp, Artificial
  CRISPR gRNA sequence
caaattaaagtctgttgctg

SEQ ID NO: 598819 - DNA, 20 bp, Artificial
  CRISPR gRNA sequence
aattaaagtctgttgctgga

SEQ ID NO: 598820 - DNA, 20 bp, Artificial
  CRISPR gRNA sequence
caaaaaaaaatcataaaatg

SEQ ID NO: 598821 - DNA, 20 bp, Artificial
  CRISPR gRNA sequence
ttactgcttgtcatgtgact

SEQ ID NO: 598822 - DNA, 20 bp, Artificial
  CRISPR gRNA sequence
tgcttgtcatgtgacttggt

SEQ ID NO: 598823 - DNA, 20 bp, Artificial
  CRISPR gRNA sequence
gcttgtcatgtgacttggtg

SEQ ID NO: 598824 - DNA, 20 bp, Artificial
  CRISPR gRNA sequence
tggtgaggcatgctgtccat

SEQ ID NO: 598825 - DNA, 20 bp, Artificial
  CRISPR gRNA sequence
ggtgaggcatgctgtccatt

SEQ ID NO: 598826 - DNA, 20 bp, Artificial
  CRISPR gRNA sequence
gctgtccattgggtgtgctt

SEQ ID NO: 598827 - DNA, 20 bp, Artificial
  CRISPR gRNA sequence
ctgtccattgggtgtgcttg

SEQ ID NO: 598828 - DNA, 20 bp, Artificial
  CRISPR gRNA sequence
ccattgggtgtgcttgaggt

SEQ ID NO: 598829 - DNA, 20 bp, Artificial
  CRISPR gRNA sequence
cattgggtgtgcttgaggtg

SEQ ID NO: 598830 - DNA, 20 bp, Artificial
  CRISPR gRNA sequence
ggtgaggtcaattgccatat

SEQ ID NO: 598831 - DNA, 20 bp, Artificial
  CRISPR gRNA sequence
tgaggtcaattgccatattg

SEQ ID NO: 598832 - DNA, 20 bp, Artificial
  CRISPR gRNA sequence
catattggagtgctcccttt

SEQ ID NO: 598833 - DNA, 20 bp, Artificial
  CRISPR gRNA sequence
atattggagtgctccctttc

SEQ ID NO: 598834 - DNA, 20 bp, Artificial
  CRISPR gRNA sequence
gagtgctccctttcgggtga

SEQ ID NO: 598835 - DNA, 20 bp, Artificial
  CRISPR gRNA sequence
tttcacaaaatataatcttt

SEQ ID NO: 598836 - DNA, 20 bp, Artificial
  CRISPR gRNA sequence
gtttctattcattgtcacat

SEQ ID NO: 598837 - DNA, 20 bp, Artificial
  CRISPR gRNA sequence
actttgctttatacacgcaa

SEQ ID NO: 598838 - DNA, 20 bp, Artificial
  CRISPR gRNA sequence
tatacacgcaatggcatgca

SEQ ID NO: 598839 - DNA, 20 bp, Artificial
  CRISPR gRNA sequence
atgcatagccttcaaactgt

SEQ ID NO: 598840 - DNA, 20 bp, Artificial
  CRISPR gRNA sequence
tgcatagccttcaaactgta

SEQ ID NO: 598841 - DNA, 20 bp, Artificial
  CRISPR gRNA sequence
aaggtaatacatttttccct

SEQ ID NO: 598842 - DNA, 20 bp, Artificial
  CRISPR gRNA sequence
atttttcccttagaaactat

SEQ ID NO: 598843 - DNA, 20 bp, Artificial
  CRISPR gRNA sequence
tttttcccttagaaactata

SEQ ID NO: 598844 - DNA, 20 bp, Artificial
  CRISPR gRNA sequence
aactataaggaaatatcatt

SEQ ID NO: 598845 - DNA, 20 bp, Artificial
  CRISPR gRNA sequence
aaatatcatttagaaatata

SEQ ID NO: 598846 - DNA, 20 bp, Artificial
  CRISPR gRNA sequence
atacagttgaatgaaatgat

SEQ ID NO: 598847 - DNA, 20 bp, Artificial
  CRISPR gRNA sequence
cagttgaatgaaatgatgag

SEQ ID NO: 598848 - DNA, 20 bp, Artificial
  CRISPR gRNA sequence
actttattatctcaatacat

SEQ ID NO: 598849 - DNA, 20 bp, Artificial
  CRISPR gRNA sequence
acataagttgttgatttcta

SEQ ID NO: 598850 - DNA, 20 bp, Artificial
  CRISPR gRNA sequence
ttgatttctaaagtatcttt

SEQ ID NO: 598851 - DNA, 20 bp, Artificial
  CRISPR gRNA sequence
ctaaagtatctttcagttga

SEQ ID NO: 598852 - DNA, 20 bp, Artificial
  CRISPR gRNA sequence
taacatctaatttaattgtt

SEQ ID NO: 598853 - DNA, 20 bp, Artificial
  CRISPR gRNA sequence
taatttaattgttaagcaca

SEQ ID NO: 598854 - DNA, 20 bp, Artificial
  CRISPR gRNA sequence
aagcacacagaatttataat

SEQ ID NO: 598855 - DNA, 20 bp, Artificial
  CRISPR gRNA sequence
atgagcattttccaaaatgc

SEQ ID NO: 598856 - DNA, 20 bp, Artificial
  CRISPR gRNA sequence
ttttccaaaatgctggctat

SEQ ID NO: 598857 - DNA, 20 bp, Artificial
  CRISPR gRNA sequence
ttccaaaatgctggctatca

SEQ ID NO: 598858 - DNA, 20 bp, Artificial
  CRISPR gRNA sequence
ccaaaatgctggctatcaga

SEQ ID NO: 598859 - DNA, 20 bp, Artificial
  CRISPR gRNA sequence
aaaatgctggctatcagaga

SEQ ID NO: 598860 - DNA, 20 bp, Artificial
  CRISPR gRNA sequence
aaatgctggctatcagagag

SEQ ID NO: 598861 - DNA, 20 bp, Artificial
  CRISPR gRNA sequence
gctggctatcagagagagga

SEQ ID NO: 598862 - DNA, 20 bp, Artificial
  CRISPR gRNA sequence
ctatcagagagaggatggaa

SEQ ID NO: 598863 - DNA, 20 bp, Artificial
  CRISPR gRNA sequence
cagagagaggatggaaaaga

SEQ ID NO: 598864 - DNA, 20 bp, Artificial
  CRISPR gRNA sequence
agagagaggatggaaaagac

SEQ ID NO: 598865 - DNA, 20 bp, Artificial
  CRISPR gRNA sequence
gagaggatggaaaagacagg

SEQ ID NO: 598866 - DNA, 20 bp, Artificial
  CRISPR gRNA sequence
atggaaaagacaggtagcta

SEQ ID NO: 598867 - DNA, 20 bp, Artificial
  CRISPR gRNA sequence
caggtagctaaagaaatgtc

SEQ ID NO: 598868 - DNA, 20 bp, Artificial
  CRISPR gRNA sequence
tagctaaagaaatgtcaagt

SEQ ID NO: 598869 - DNA, 20 bp, Artificial
  CRISPR gRNA sequence
agctaaagaaatgtcaagtt

SEQ ID NO: 598870 - DNA, 20 bp, Artificial
  CRISPR gRNA sequence
aaagaaatgtcaagttagga

SEQ ID NO: 598871 - DNA, 20 bp, Artificial
  CRISPR gRNA sequence
acataatatgtctgaaaaat

SEQ ID NO: 598872 - DNA, 20 bp, Artificial
  CRISPR gRNA sequence
cataatatgtctgaaaaatt

SEQ ID NO: 598873 - DNA, 20 bp, Artificial
  CRISPR gRNA sequence
atgtctgaaaaattaggtta

SEQ ID NO: 598874 - DNA, 20 bp, Artificial
  CRISPR gRNA sequence
gtctgaaaaattaggttaca

SEQ ID NO: 598875 - DNA, 20 bp, Artificial
  CRISPR gRNA sequence
tgaaaaattaggttacagag

SEQ ID NO: 598876 - DNA, 20 bp, Artificial
  CRISPR gRNA sequence
gttacagagaagtaaatatt

SEQ ID NO: 598877 - DNA, 20 bp, Artificial
  CRISPR gRNA sequence
tttagtacacaccatattaa

SEQ ID NO: 598878 - DNA, 20 bp, Artificial
  CRISPR gRNA sequence
taatagacatatatgaaacc

SEQ ID NO: 598879 - DNA, 20 bp, Artificial
  CRISPR gRNA sequence
cctattctcaacttacaaca

SEQ ID NO: 598880 - DNA, 20 bp, Artificial
  CRISPR gRNA sequence
acaacaaagtaaattataaa

SEQ ID NO: 598881 - DNA, 20 bp, Artificial
  CRISPR gRNA sequence
acaaagtaaattataaaaag

SEQ ID NO: 598882 - DNA, 20 bp, Artificial
  CRISPR gRNA sequence
caaagtaaattataaaaagt

SEQ ID NO: 598883 - DNA, 20 bp, Artificial
  CRISPR gRNA sequence
gtaaattataaaaagtagga

SEQ ID NO: 598884 - DNA, 20 bp, Artificial
  CRISPR gRNA sequence
gtaggaaagtgttgaactgc

SEQ ID NO: 598885 - DNA, 20 bp, Artificial
  CRISPR gRNA sequence
ctgctagctactattgattt

SEQ ID NO: 598886 - DNA, 20 bp, Artificial
  CRISPR gRNA sequence
tttaagtacactacttaact

SEQ ID NO: 598887 - DNA, 20 bp, Artificial
  CRISPR gRNA sequence
atttccttcttatttcactt

SEQ ID NO: 598888 - DNA, 20 bp, Artificial
  CRISPR gRNA sequence
cattttctcaaactcattca

SEQ ID NO: 598889 - DNA, 20 bp, Artificial
  CRISPR gRNA sequence
attttctcaaactcattcaa

SEQ ID NO: 598890 - DNA, 20 bp, Artificial
  CRISPR gRNA sequence
ttcaaaggtgaaattgtgaa

SEQ ID NO: 598891 - DNA, 20 bp, Artificial
  CRISPR gRNA sequence
caaaggtgaaattgtgaaca

SEQ ID NO: 598892 - DNA, 20 bp, Artificial
  CRISPR gRNA sequence
aaggtgaaattgtgaacaga

SEQ ID NO: 598893 - DNA, 20 bp, Artificial
  CRISPR gRNA sequence
aattgtgaacagagagaaaa

SEQ ID NO: 598894 - DNA, 20 bp, Artificial
  CRISPR gRNA sequence
ttgtgaacagagagaaaaaa

SEQ ID NO: 598895 - DNA, 20 bp, Artificial
  CRISPR gRNA sequence
aacagagagaaaaaagagta

SEQ ID NO: 598896 - DNA, 20 bp, Artificial
  CRISPR gRNA sequence
agagtacagaattctcaata

SEQ ID NO: 598897 - DNA, 20 bp, Artificial
  CRISPR gRNA sequence
ctcaataaagtttcataatc

SEQ ID NO: 598898 - DNA, 20 bp, Artificial
  CRISPR gRNA sequence
tcaataaagtttcataatcc

SEQ ID NO: 598899 - DNA, 20 bp, Artificial
  CRISPR gRNA sequence
ataatccaggaattaaaaca

SEQ ID NO: 598900 - DNA, 20 bp, Artificial
  CRISPR gRNA sequence
taatccaggaattaaaacac

SEQ ID NO: 598901 - DNA, 20 bp, Artificial
  CRISPR gRNA sequence
attaaaacacaggtaataca

SEQ ID NO: 598902 - DNA, 20 bp, Artificial
  CRISPR gRNA sequence
ttaaaacacaggtaatacaa

SEQ ID NO: 598903 - DNA, 20 bp, Artificial
  CRISPR gRNA sequence
actaatacttacacgttata

SEQ ID NO: 598904 - DNA, 20 bp, Artificial
  CRISPR gRNA sequence
acacgttatatagccatcaa

SEQ ID NO: 598905 - DNA, 20 bp, Artificial
  CRISPR gRNA sequence
atcaatagcctctgtttcca

SEQ ID NO: 598906 - DNA, 20 bp, Artificial
  CRISPR gRNA sequence
agcctctgtttccatagtca

SEQ ID NO: 598907 - DNA, 20 bp, Artificial
  CRISPR gRNA sequence
agtgcaatgctgcaaaacaa

SEQ ID NO: 598908 - DNA, 20 bp, Artificial
  CRISPR gRNA sequence
cttaatacaatgattccttt

SEQ ID NO: 598909 - DNA, 20 bp, Artificial
  CRISPR gRNA sequence
ttaaattcttaacttatttg

SEQ ID NO: 598910 - DNA, 20 bp, Artificial
  CRISPR gRNA sequence
cttaacttatttgaagctcc

SEQ ID NO: 598911 - DNA, 20 bp, Artificial
  CRISPR gRNA sequence
aacttatttgaagctccaag

SEQ ID NO: 598912 - DNA, 20 bp, Artificial
  CRISPR gRNA sequence
tatttgaagctccaagcagt

SEQ ID NO: 598913 - DNA, 20 bp, Artificial
  CRISPR gRNA sequence
ttgctgctgccacctgtgcc

SEQ ID NO: 598914 - DNA, 20 bp, Artificial
  CRISPR gRNA sequence
cctgtgcccagaaacataca

SEQ ID NO: 598915 - DNA, 20 bp, Artificial
  CRISPR gRNA sequence
tactgtatgtgctcatttgc

SEQ ID NO: 598916 - DNA, 20 bp, Artificial
  CRISPR gRNA sequence
gcaaatgatctgattcctgc

SEQ ID NO: 598917 - DNA, 20 bp, Artificial
  CRISPR gRNA sequence
aaatgatctgattcctgctg

SEQ ID NO: 598918 - DNA, 20 bp, Artificial
  CRISPR gRNA sequence
gatctgattcctgctggaga

SEQ ID NO: 598919 - DNA, 20 bp, Artificial
  CRISPR gRNA sequence
atctgattcctgctggagat

SEQ ID NO: 598920 - DNA, 20 bp, Artificial
  CRISPR gRNA sequence
gattcctgctggagatagga

SEQ ID NO: 598921 - DNA, 20 bp, Artificial
  CRISPR gRNA sequence
attcctgctggagataggat

SEQ ID NO: 598922 - DNA, 20 bp, Artificial
  CRISPR gRNA sequence
ctgctggagataggatagga

SEQ ID NO: 598923 - DNA, 20 bp, Artificial
  CRISPR gRNA sequence
ggagataggataggaaagat

SEQ ID NO: 598924 - DNA, 20 bp, Artificial
  CRISPR gRNA sequence
aggaaagataagtgtgctgt

SEQ ID NO: 598925 - DNA, 20 bp, Artificial
  CRISPR gRNA sequence
aagataagtgtgctgtgaga

SEQ ID NO: 598926 - DNA, 20 bp, Artificial
  CRISPR gRNA sequence
agataagtgtgctgtgagat

SEQ ID NO: 598927 - DNA, 20 bp, Artificial
  CRISPR gRNA sequence
aagtgtgctgtgagatgggc

SEQ ID NO: 598928 - DNA, 20 bp, Artificial
  CRISPR gRNA sequence
gtgtgctgtgagatgggcta

SEQ ID NO: 598929 - DNA, 20 bp, Artificial
  CRISPR gRNA sequence
gtgagatgggctagagcaaa

SEQ ID NO: 598930 - DNA, 20 bp, Artificial
  CRISPR gRNA sequence
tgagatgggctagagcaaaa

SEQ ID NO: 598931 - DNA, 20 bp, Artificial
  CRISPR gRNA sequence
gagatgggctagagcaaaaa

SEQ ID NO: 598932 - DNA, 20 bp, Artificial
  CRISPR gRNA sequence
ctctcttaatcaaaatttat

SEQ ID NO: 598933 - DNA, 20 bp, Artificial
  CRISPR gRNA sequence
tctcttaatcaaaatttatt

SEQ ID NO: 598934 - DNA, 20 bp, Artificial
  CRISPR gRNA sequence
aatcaaaatttattgggttt

SEQ ID NO: 598935 - DNA, 20 bp, Artificial
  CRISPR gRNA sequence
ttattgggtttaagaaaaaa

SEQ ID NO: 598936 - DNA, 20 bp, Artificial
  CRISPR gRNA sequence
tattgggtttaagaaaaaat

SEQ ID NO: 598937 - DNA, 20 bp, Artificial
  CRISPR gRNA sequence
attgggtttaagaaaaaata

SEQ ID NO: 598938 - DNA, 20 bp, Artificial
  CRISPR gRNA sequence
ttgggtttaagaaaaaatag

SEQ ID NO: 598939 - DNA, 20 bp, Artificial
  CRISPR gRNA sequence
tgggtttaagaaaaaatagg

SEQ ID NO: 598940 - DNA, 20 bp, Artificial
  CRISPR gRNA sequence
ttaagaaaaaatagggggta

SEQ ID NO: 598941 - DNA, 20 bp, Artificial
  CRISPR gRNA sequence
ggggtatagctcaaatgtgt

SEQ ID NO: 598942 - DNA, 20 bp, Artificial
  CRISPR gRNA sequence
tcaaatgtgtcagctttaac

SEQ ID NO: 598943 - DNA, 20 bp, Artificial
  CRISPR gRNA sequence
caaatgtgtcagctttaact

SEQ ID NO: 598944 - DNA, 20 bp, Artificial
  CRISPR gRNA sequence
gtcagctttaactgggattt

SEQ ID NO: 598945 - DNA, 20 bp, Artificial
  CRISPR gRNA sequence
tacttcccacaatcacactg

SEQ ID NO: 598946 - DNA, 20 bp, Artificial
  CRISPR gRNA sequence
ccacaatcacactgcagttt

SEQ ID NO: 598947 - DNA, 20 bp, Artificial
  CRISPR gRNA sequence
cacaatcacactgcagtttg

SEQ ID NO: 598948 - DNA, 20 bp, Artificial
  CRISPR gRNA sequence
ctgcagtttgaggacttccc

SEQ ID NO: 598949 - DNA, 20 bp, Artificial
  CRISPR gRNA sequence
ttgaggacttccccagtata

SEQ ID NO: 598950 - DNA, 20 bp, Artificial
  CRISPR gRNA sequence
ggacttccccagtatacaga

SEQ ID NO: 598951 - DNA, 20 bp, Artificial
  CRISPR gRNA sequence
gctctattcacaattgttgc

SEQ ID NO: 598952 - DNA, 20 bp, Artificial
  CRISPR gRNA sequence
tattcacaattgttgcaagt

SEQ ID NO: 598953 - DNA, 20 bp, Artificial
  CRISPR gRNA sequence
gttggttcatcatgttctaa

SEQ ID NO: 598954 - DNA, 20 bp, Artificial
  CRISPR gRNA sequence
ttggttcatcatgttctaat

SEQ ID NO: 598955 - DNA, 20 bp, Artificial
  CRISPR gRNA sequence
tggttcatcatgttctaata

SEQ ID NO: 598956 - DNA, 20 bp, Artificial
  CRISPR gRNA sequence
gttcatcatgttctaatagg

SEQ ID NO: 598957 - DNA, 20 bp, Artificial
  CRISPR gRNA sequence
ttcatcatgttctaataggg

SEQ ID NO: 598958 - DNA, 20 bp, Artificial
  CRISPR gRNA sequence
tcatcatgttctaataggga

SEQ ID NO: 598959 - DNA, 20 bp, Artificial
  CRISPR gRNA sequence
catcatgttctaatagggag

SEQ ID NO: 598960 - DNA, 20 bp, Artificial
  CRISPR gRNA sequence
atcatgttctaatagggagg

SEQ ID NO: 598961 - DNA, 20 bp, Artificial
  CRISPR gRNA sequence
catgttctaatagggagggg

SEQ ID NO: 598962 - DNA, 20 bp, Artificial
  CRISPR gRNA sequence
atgttctaatagggaggggg

SEQ ID NO: 598963 - DNA, 20 bp, Artificial
  CRISPR gRNA sequence
gggggaggacaaacaaacat

SEQ ID NO: 598964 - DNA, 20 bp, Artificial
  CRISPR gRNA sequence
acaaaacaaaacaaaaaact

SEQ ID NO: 598965 - DNA, 20 bp, Artificial
  CRISPR gRNA sequence
acaaaaaacttagtgcccaa

SEQ ID NO: 598966 - DNA, 20 bp, Artificial
  CRISPR gRNA sequence
tagtgcccaacggtgtcttg

SEQ ID NO: 598967 - DNA, 20 bp, Artificial
  CRISPR gRNA sequence
cggtgtcttgaagatttcta

SEQ ID NO: 598968 - DNA, 20 bp, Artificial
  CRISPR gRNA sequence
tgtcttgaagatttctacag

SEQ ID NO: 598969 - DNA, 20 bp, Artificial
  CRISPR gRNA sequence
ttgaagatttctacagcagt

SEQ ID NO: 598970 - DNA, 20 bp, Artificial
  CRISPR gRNA sequence
ttgacattttaacctacccc

SEQ ID NO: 598971 - DNA, 20 bp, Artificial
  CRISPR gRNA sequence
acctaccccaagttctgtgt

SEQ ID NO: 598972 - DNA, 20 bp, Artificial
  CRISPR gRNA sequence
atgtaaccttaatttcctgc

SEQ ID NO: 598973 - DNA, 20 bp, Artificial
  CRISPR gRNA sequence
atttcctgccagaccatgct

SEQ ID NO: 598974 - DNA, 20 bp, Artificial
  CRISPR gRNA sequence
catgcttggacacaaatgcc

SEQ ID NO: 598975 - DNA, 20 bp, Artificial
  CRISPR gRNA sequence
aatgccaagcctacttaata

SEQ ID NO: 598976 - DNA, 20 bp, Artificial
  CRISPR gRNA sequence
tttgaaaatttcataaactt

SEQ ID NO: 598977 - DNA, 20 bp, Artificial
  CRISPR gRNA sequence
ttcataaactttggttgtgc

SEQ ID NO: 598978 - DNA, 20 bp, Artificial
  CRISPR gRNA sequence
cataaactttggttgtgcta

SEQ ID NO: 598979 - DNA, 20 bp, Artificial
  CRISPR gRNA sequence
taaactttggttgtgctaga

SEQ ID NO: 598980 - DNA, 20 bp, Artificial
  CRISPR gRNA sequence
tttaaaaaaaaaaaaaactt

SEQ ID NO: 598981 - DNA, 20 bp, Artificial
  CRISPR gRNA sequence
ttaaaaaaaaaaaaaacttt

SEQ ID NO: 598982 - DNA, 20 bp, Artificial
  CRISPR gRNA sequence
catgcacaaacgccacacaa

SEQ ID NO: 598983 - DNA, 20 bp, Artificial
  CRISPR gRNA sequence
acacaacagaacataattct

SEQ ID NO: 598984 - DNA, 20 bp, Artificial
  CRISPR gRNA sequence
aacataattctcagaaacaa

SEQ ID NO: 598985 - DNA, 20 bp, Artificial
  CRISPR gRNA sequence
gaaacaaaagtaaactgtat

SEQ ID NO: 598986 - DNA, 20 bp, Artificial
  CRISPR gRNA sequence
ctgtatgagatgacaccccc

SEQ ID NO: 598987 - DNA, 20 bp, Artificial
  CRISPR gRNA sequence
gctttgattcacataatgaa

SEQ ID NO: 598988 - DNA, 20 bp, Artificial
  CRISPR gRNA sequence
gataatctaactgtattctg

SEQ ID NO: 598989 - DNA, 20 bp, Artificial
  CRISPR gRNA sequence
ataatctaactgtattctgt

SEQ ID NO: 598990 - DNA, 20 bp, Artificial
  CRISPR gRNA sequence
taatctaactgtattctgtg

SEQ ID NO: 598991 - DNA, 20 bp, Artificial
  CRISPR gRNA sequence
actgtattctgtggggaaaa

SEQ ID NO: 598992 - DNA, 20 bp, Artificial
  CRISPR gRNA sequence
ttctgtggggaaaaaagttt

SEQ ID NO: 598993 - DNA, 20 bp, Artificial
  CRISPR gRNA sequence
aaaaaagtttaagaattgac

SEQ ID NO: 598994 - DNA, 20 bp, Artificial
  CRISPR gRNA sequence
tttaagaattgacaagtcct

SEQ ID NO: 598995 - DNA, 20 bp, Artificial
  CRISPR gRNA sequence
aagaattgacaagtcctgag

SEQ ID NO: 598996 - DNA, 20 bp, Artificial
  CRISPR gRNA sequence
tttacttttttttccccctt

SEQ ID NO: 598997 - DNA, 20 bp, Artificial
  CRISPR gRNA sequence
tttttttccccctttggcct

SEQ ID NO: 598998 - DNA, 20 bp, Artificial
  CRISPR gRNA sequence
gccttggtcctttttgcctt

SEQ ID NO: 598999 - DNA, 20 bp, Artificial
  CRISPR gRNA sequence
tttcaaaactctcactgcac

SEQ ID NO: 599000 - DNA, 20 bp, Artificial
  CRISPR gRNA sequence
caaaactctcactgcaccag

SEQ ID NO: 599001 - DNA, 20 bp, Artificial
  CRISPR gRNA sequence
gcagctaaattattcacaat

SEQ ID NO: 599002 - DNA, 20 bp, Artificial
  CRISPR gRNA sequence
ccatttctgtattgatcgcc

SEQ ID NO: 599003 - DNA, 20 bp, Artificial
  CRISPR gRNA sequence
tattgatcgccaagtatatt

SEQ ID NO: 599004 - DNA, 20 bp, Artificial
  CRISPR gRNA sequence
tcgccaagtatatttagccc

SEQ ID NO: 599005 - DNA, 20 bp, Artificial
  CRISPR gRNA sequence
gtatatttagccctggctcc

SEQ ID NO: 599006 - DNA, 20 bp, Artificial
  CRISPR gRNA sequence
ggaatttctccattacttac

SEQ ID NO: 599007 - DNA, 20 bp, Artificial
  CRISPR gRNA sequence
ctccattacttactggaaaa

SEQ ID NO: 599008 - DNA, 20 bp, Artificial
  CRISPR gRNA sequence
tccattacttactggaaaac

SEQ ID NO: 599009 - DNA, 20 bp, Artificial
  CRISPR gRNA sequence
attacttactggaaaacagg

SEQ ID NO: 599010 - DNA, 20 bp, Artificial
  CRISPR gRNA sequence
aacttttatttctttcttta

SEQ ID NO: 599011 - DNA, 20 bp, Artificial
  CRISPR gRNA sequence
ttctttctttatggaataat

SEQ ID NO: 599012 - DNA, 20 bp, Artificial
  CRISPR gRNA sequence
atcagatcaaattcccaact

SEQ ID NO: 599013 - DNA, 20 bp, Artificial
  CRISPR gRNA sequence
ttcccaactcagtcactaca

SEQ ID NO: 599014 - DNA, 20 bp, Artificial
  CRISPR gRNA sequence
cttttaaattatgattacat

SEQ ID NO: 599015 - DNA, 20 bp, Artificial
  CRISPR gRNA sequence
ttttaaattatgattacata

SEQ ID NO: 599016 - DNA, 20 bp, Artificial
  CRISPR gRNA sequence
tatgattacataaggcttta

SEQ ID NO: 599017 - DNA, 20 bp, Artificial
  CRISPR gRNA sequence
attacataaggctttaaaga

SEQ ID NO: 599018 - DNA, 20 bp, Artificial
  CRISPR gRNA sequence
tacataaggctttaaagaaa

SEQ ID NO: 599019 - DNA, 20 bp, Artificial
  CRISPR gRNA sequence
tttaaagaaagagatccgta

SEQ ID NO: 599020 - DNA, 20 bp, Artificial
  CRISPR gRNA sequence
aagagatccgtaaagtttaa

SEQ ID NO: 599021 - DNA, 20 bp, Artificial
  CRISPR gRNA sequence
gagatccgtaaagtttaaaa

SEQ ID NO: 599022 - DNA, 20 bp, Artificial
  CRISPR gRNA sequence
agatccgtaaagtttaaaag

SEQ ID NO: 599023 - DNA, 20 bp, Artificial
  CRISPR gRNA sequence
atccgtaaagtttaaaagag

SEQ ID NO: 599024 - DNA, 20 bp, Artificial
  CRISPR gRNA sequence
cgtaaagtttaaaagaggag

SEQ ID NO: 599025 - DNA, 20 bp, Artificial
  CRISPR gRNA sequence
taaaagaggagcagtttctt

SEQ ID NO: 599026 - DNA, 20 bp, Artificial
  CRISPR gRNA sequence
tcttcggatattttacaaat

SEQ ID NO: 599027 - DNA, 20 bp, Artificial
  CRISPR gRNA sequence
tttaacacacacatattaaa

SEQ ID NO: 599028 - DNA, 20 bp, Artificial
  CRISPR gRNA sequence
acacacacatattaaaaaga

SEQ ID NO: 599029 - DNA, 20 bp, Artificial
  CRISPR gRNA sequence
tattaaaaagaaagaaacgt

SEQ ID NO: 599030 - DNA, 20 bp, Artificial
  CRISPR gRNA sequence
attaaaaagaaagaaacgtc

SEQ ID NO: 599031 - DNA, 20 bp, Artificial
  CRISPR gRNA sequence
ttaaaaagaaagaaacgtca

SEQ ID NO: 599032 - DNA, 20 bp, Artificial
  CRISPR gRNA sequence
aaaaagaaagaaacgtcagg

SEQ ID NO: 599033 - DNA, 20 bp, Artificial
  CRISPR gRNA sequence
aagaaagaaacgtcagggag

SEQ ID NO: 599034 - DNA, 20 bp, Artificial
  CRISPR gRNA sequence
gaaacgtcagggagaagcga

SEQ ID NO: 599035 - DNA, 20 bp, Artificial
  CRISPR gRNA sequence
acgtcagggagaagcgaaag

SEQ ID NO: 599036 - DNA, 20 bp, Artificial
  CRISPR gRNA sequence
cgtcagggagaagcgaaaga

SEQ ID NO: 599037 - DNA, 20 bp, Artificial
  CRISPR gRNA sequence
aggctgccccatcaatgaaa

SEQ ID NO: 599038 - DNA, 20 bp, Artificial
  CRISPR gRNA sequence
atgaaatggttattaaccct

SEQ ID NO: 599039 - DNA, 20 bp, Artificial
  CRISPR gRNA sequence
gaaatggttattaaccctca

SEQ ID NO: 599040 - DNA, 20 bp, Artificial
  CRISPR gRNA sequence
atggttattaaccctcagag

SEQ ID NO: 599041 - DNA, 20 bp, Artificial
  CRISPR gRNA sequence
tggttattaaccctcagaga

SEQ ID NO: 599042 - DNA, 20 bp, Artificial
  CRISPR gRNA sequence
tattaaccctcagagaagga

SEQ ID NO: 599043 - DNA, 20 bp, Artificial
  CRISPR gRNA sequence
taaccctcagagaaggaaag

SEQ ID NO: 599044 - DNA, 20 bp, Artificial
  CRISPR gRNA sequence
aaccctcagagaaggaaaga

SEQ ID NO: 599045 - DNA, 20 bp, Artificial
  CRISPR gRNA sequence
cagagaaggaaagaaggaaa

SEQ ID NO: 599046 - DNA, 20 bp, Artificial
  CRISPR gRNA sequence
aggaaagaaggaaaaagaaa

SEQ ID NO: 599047 - DNA, 20 bp, Artificial
  CRISPR gRNA sequence
ggaaagaaggaaaaagaaaa

SEQ ID NO: 599048 - DNA, 20 bp, Artificial
  CRISPR gRNA sequence
aaagaaggaaaaagaaaaag

SEQ ID NO: 599049 - DNA, 20 bp, Artificial
  CRISPR gRNA sequence
aaggaaaaagaaaaaggaga

SEQ ID NO: 599050 - DNA, 20 bp, Artificial
  CRISPR gRNA sequence
ggaaaaagaaaaaggagaaa

SEQ ID NO: 599051 - DNA, 20 bp, Artificial
  CRISPR gRNA sequence
gaaacgaaatgtacatacaa

SEQ ID NO: 599052 - DNA, 20 bp, Artificial
  CRISPR gRNA sequence
aaattgtcctttgattaaaa

SEQ ID NO: 599053 - DNA, 20 bp, Artificial
  CRISPR gRNA sequence
aaaagattcatcaccatttc

SEQ ID NO: 599054 - DNA, 20 bp, Artificial
  CRISPR gRNA sequence
atcaccatttccagctctgt

SEQ ID NO: 599055 - DNA, 20 bp, Artificial
  CRISPR gRNA sequence
tcaccatttccagctctgtc

SEQ ID NO: 599056 - DNA, 20 bp, Artificial
  CRISPR gRNA sequence
accatttccagctctgtcgg

SEQ ID NO: 599057 - DNA, 20 bp, Artificial
  CRISPR gRNA sequence
ccagctctgtcgggagatct

SEQ ID NO: 599058 - DNA, 20 bp, Artificial
  CRISPR gRNA sequence
cagcttcttctaacccctca

SEQ ID NO: 599059 - DNA, 20 bp, Artificial
  CRISPR gRNA sequence
gcttcttctaacccctcaaa

SEQ ID NO: 599060 - DNA, 20 bp, Artificial
  CRISPR gRNA sequence
cttcttctaacccctcaaag

SEQ ID NO: 599061 - DNA, 20 bp, Artificial
  CRISPR gRNA sequence
tcttctaacccctcaaagag

SEQ ID NO: 599062 - DNA, 20 bp, Artificial
  CRISPR gRNA sequence
cttctaacccctcaaagagg

SEQ ID NO: 599063 - DNA, 20 bp, Artificial
  CRISPR gRNA sequence
caaagaggaggtgacaatgt

SEQ ID NO: 599064 - DNA, 20 bp, Artificial
  CRISPR gRNA sequence
aaagaggaggtgacaatgtc

SEQ ID NO: 599065 - DNA, 20 bp, Artificial
  CRISPR gRNA sequence
gaggtgacaatgtcgggctg

SEQ ID NO: 599066 - DNA, 20 bp, Artificial
  CRISPR gRNA sequence
aatgtcgggctgaagataaa

SEQ ID NO: 599067 - DNA, 20 bp, Artificial
  CRISPR gRNA sequence
tgtcgggctgaagataaacg

SEQ ID NO: 599068 - DNA, 20 bp, Artificial
  CRISPR gRNA sequence
gtcgggctgaagataaacgg

SEQ ID NO: 599069 - DNA, 20 bp, Artificial
  CRISPR gRNA sequence
tcgggctgaagataaacgga

SEQ ID NO: 599070 - DNA, 20 bp, Artificial
  CRISPR gRNA sequence
gggctgaagataaacggagg

SEQ ID NO: 599071 - DNA, 20 bp, Artificial
  CRISPR gRNA sequence
tgaagataaacggagggaga

SEQ ID NO: 599072 - DNA, 20 bp, Artificial
  CRISPR gRNA sequence
gataaacggagggagaaaga

SEQ ID NO: 599073 - DNA, 20 bp, Artificial
  CRISPR gRNA sequence
aaacggagggagaaagaaag

SEQ ID NO: 599074 - DNA, 20 bp, Artificial
  CRISPR gRNA sequence
ttccctcccttgccccctcc

SEQ ID NO: 599075 - DNA, 20 bp, Artificial
  CRISPR gRNA sequence
tcccttgccccctccaagcc

SEQ ID NO: 599076 - DNA, 20 bp, Artificial
  CRISPR gRNA sequence
cctccaagccaagccccctg

SEQ ID NO: 599077 - DNA, 20 bp, Artificial
  CRISPR gRNA sequence
tccaagccaagccccctgca

SEQ ID NO: 599078 - DNA, 20 bp, Artificial
  CRISPR gRNA sequence
ccaagccccctgcagagttc

SEQ ID NO: 599079 - DNA, 20 bp, Artificial
  CRISPR gRNA sequence
caagccccctgcagagttca

SEQ ID NO: 599080 - DNA, 20 bp, Artificial
  CRISPR gRNA sequence
aagccccctgcagagttcaa

SEQ ID NO: 599081 - DNA, 20 bp, Artificial
  CRISPR gRNA sequence
agccccctgcagagttcaag

SEQ ID NO: 599082 - DNA, 20 bp, Artificial
  CRISPR gRNA sequence
ccccctgcagagttcaaggg

SEQ ID NO: 599083 - DNA, 20 bp, Artificial
  CRISPR gRNA sequence
cccctgcagagttcaagggg

SEQ ID NO: 599084 - DNA, 20 bp, Artificial
  CRISPR gRNA sequence
cctgcagagttcaaggggag

SEQ ID NO: 599085 - DNA, 20 bp, Artificial
  CRISPR gRNA sequence
ctgcagagttcaaggggagg

SEQ ID NO: 599086 - DNA, 20 bp, Artificial
  CRISPR gRNA sequence
cagagttcaaggggaggagg

SEQ ID NO: 599087 - DNA, 20 bp, Artificial
  CRISPR gRNA sequence
agagttcaaggggaggagga

SEQ ID NO: 599088 - DNA, 20 bp, Artificial
  CRISPR gRNA sequence
tcaaggggaggaggaaggaa

SEQ ID NO: 599089 - DNA, 20 bp, Artificial
  CRISPR gRNA sequence
gaggaaggaaaagcacttta

SEQ ID NO: 599090 - DNA, 20 bp, Artificial
  CRISPR gRNA sequence
aggaaggaaaagcactttac

SEQ ID NO: 599091 - DNA, 20 bp, Artificial
  CRISPR gRNA sequence
aaggaaaagcactttacagg

SEQ ID NO: 599092 - DNA, 20 bp, Artificial
  CRISPR gRNA sequence
aggaaaagcactttacaggt

SEQ ID NO: 599093 - DNA, 20 bp, Artificial
  CRISPR gRNA sequence
ctttacaggtgggtcattcc

SEQ ID NO: 599094 - DNA, 20 bp, Artificial
  CRISPR gRNA sequence
ggtcattccaagcccaaatc

SEQ ID NO: 599095 - DNA, 20 bp, Artificial
  CRISPR gRNA sequence
ccaagcccaaatccagcaaa

SEQ ID NO: 599096 - DNA, 20 bp, Artificial
  CRISPR gRNA sequence
cccaaatccagcaaacagat

SEQ ID NO: 599097 - DNA, 20 bp, Artificial
  CRISPR gRNA sequence
atcggctgataaacaaaacc

SEQ ID NO: 599098 - DNA, 20 bp, Artificial
  CRISPR gRNA sequence
gataaacaaaaccaagaaat

SEQ ID NO: 599099 - DNA, 20 bp, Artificial
  CRISPR gRNA sequence
taaacaaaaccaagaaatga

SEQ ID NO: 599100 - DNA, 20 bp, Artificial
  CRISPR gRNA sequence
aacaaaaccaagaaatgaga

SEQ ID NO: 599101 - DNA, 20 bp, Artificial
  CRISPR gRNA sequence
aaaaccaagaaatgagagag

SEQ ID NO: 599102 - DNA, 20 bp, Artificial
  CRISPR gRNA sequence
cacccctccccctcgtccct

SEQ ID NO: 599103 - DNA, 20 bp, Artificial
  CRISPR gRNA sequence
acccctccccctcgtccctt

SEQ ID NO: 599104 - DNA, 20 bp, Artificial
  CRISPR gRNA sequence
cccctccccctcgtccctta

SEQ ID NO: 599105 - DNA, 20 bp, Artificial
  CRISPR gRNA sequence
tccccctcgtcccttaggga

SEQ ID NO: 599106 - DNA, 20 bp, Artificial
  CRISPR gRNA sequence
ctcgtcccttagggatggtc

SEQ ID NO: 599107 - DNA, 20 bp, Artificial
  CRISPR gRNA sequence
gtcccttagggatggtctag

SEQ ID NO: 599108 - DNA, 20 bp, Artificial
  CRISPR gRNA sequence
tcccttagggatggtctagt

SEQ ID NO: 599109 - DNA, 20 bp, Artificial
  CRISPR gRNA sequence
tagggatggtctagtaggaa

SEQ ID NO: 599110 - DNA, 20 bp, Artificial
  CRISPR gRNA sequence
gtctagtaggaaaagtcact

SEQ ID NO: 599111 - DNA, 20 bp, Artificial
  CRISPR gRNA sequence
tctagtaggaaaagtcactc

SEQ ID NO: 599112 - DNA, 20 bp, Artificial
  CRISPR gRNA sequence
taggaaaagtcactcaggaa

SEQ ID NO: 599113 - DNA, 20 bp, Artificial
  CRISPR gRNA sequence
ggaatggcaccacgtacttt

SEQ ID NO: 599114 - DNA, 20 bp, Artificial
  CRISPR gRNA sequence
gaatggcaccacgtactttc

SEQ ID NO: 599115 - DNA, 20 bp, Artificial
  CRISPR gRNA sequence
ggcaccacgtactttcagga

SEQ ID NO: 599116 - DNA, 20 bp, Artificial
  CRISPR gRNA sequence
caccacgtactttcaggaaa

SEQ ID NO: 599117 - DNA, 20 bp, Artificial
  CRISPR gRNA sequence
accacgtactttcaggaaag

SEQ ID NO: 599118 - DNA, 20 bp, Artificial
  CRISPR gRNA sequence
tttcaggaaagaggaaaaaa

SEQ ID NO: 599119 - DNA, 20 bp, Artificial
  CRISPR gRNA sequence
tcaggaaagaggaaaaaaaa

SEQ ID NO: 599120 - DNA, 20 bp, Artificial
  CRISPR gRNA sequence
aggaaagaggaaaaaaaaga

SEQ ID NO: 599121 - DNA, 20 bp, Artificial
  CRISPR gRNA sequence
gaaagaggaaaaaaaagaga

SEQ ID NO: 599122 - DNA, 20 bp, Artificial
  CRISPR gRNA sequence
aagaggaaaaaaaagagaga

SEQ ID NO: 599123 - DNA, 20 bp, Artificial
  CRISPR gRNA sequence
gaggaaaaaaaagagagaga

SEQ ID NO: 599124 - DNA, 20 bp, Artificial
  CRISPR gRNA sequence
ggaaaaaaaagagagagaga

SEQ ID NO: 599125 - DNA, 20 bp, Artificial
  CRISPR gRNA sequence
gaaaaaaaagagagagagag

SEQ ID NO: 599126 - DNA, 20 bp, Artificial
  CRISPR gRNA sequence
aaaaagagagagagagaggt

SEQ ID NO: 599127 - DNA, 20 bp, Artificial
  CRISPR gRNA sequence
agagagagagagaggtcagt

SEQ ID NO: 599128 - DNA, 20 bp, Artificial
  CRISPR gRNA sequence
agagaggtcagtcagtgcta

SEQ ID NO: 599129 - DNA, 20 bp, Artificial
  CRISPR gRNA sequence
gctatagcaatgcgattaac

SEQ ID NO: 599130 - DNA, 20 bp, Artificial
  CRISPR gRNA sequence
tatagcaatgcgattaacaa

SEQ ID NO: 599131 - DNA, 20 bp, Artificial
  CRISPR gRNA sequence
agagaaaaaacttgatccac

SEQ ID NO: 599132 - DNA, 20 bp, Artificial
  CRISPR gRNA sequence
acttgatccaccggttcctt

SEQ ID NO: 599133 - DNA, 20 bp, Artificial
  CRISPR gRNA sequence
gttccttaagaatcgaccaa

SEQ ID NO: 599134 - DNA, 20 bp, Artificial
  CRISPR gRNA sequence
ttaagaatcgaccaaaagct

SEQ ID NO: 599135 - DNA, 20 bp, Artificial
  CRISPR gRNA sequence
aatcgaccaaaagctaagac

SEQ ID NO: 599136 - DNA, 20 bp, Artificial
  CRISPR gRNA sequence
agctaagacaagaaaactga

SEQ ID NO: 599137 - DNA, 20 bp, Artificial
  CRISPR gRNA sequence
agacaagaaaactgaaagaa

SEQ ID NO: 599138 - DNA, 20 bp, Artificial
  CRISPR gRNA sequence
gacaagaaaactgaaagaaa

SEQ ID NO: 599139 - DNA, 20 bp, Artificial
  CRISPR gRNA sequence
acaagaaaactgaaagaaaa

SEQ ID NO: 599140 - DNA, 20 bp, Artificial
  CRISPR gRNA sequence
caagaaaactgaaagaaaag

SEQ ID NO: 599141 - DNA, 20 bp, Artificial
  CRISPR gRNA sequence
aagaaaactgaaagaaaagg

SEQ ID NO: 599142 - DNA, 20 bp, Artificial
  CRISPR gRNA sequence
agaaaactgaaagaaaaggg

SEQ ID NO: 599143 - DNA, 20 bp, Artificial
  CRISPR gRNA sequence
gaaaactgaaagaaaagggg

SEQ ID NO: 599144 - DNA, 20 bp, Artificial
  CRISPR gRNA sequence
aaaactgaaagaaaaggggg

SEQ ID NO: 599145 - DNA, 20 bp, Artificial
  CRISPR gRNA sequence
aaactgaaagaaaagggggg

SEQ ID NO: 599146 - DNA, 20 bp, Artificial
  CRISPR gRNA sequence
aactgaaagaaaaggggggg

SEQ ID NO: 599147 - DNA, 20 bp, Artificial
  CRISPR gRNA sequence
actgaaagaaaagggggggg

SEQ ID NO: 599148 - DNA, 20 bp, Artificial
  CRISPR gRNA sequence
gaaagaaaaggggggggggg

SEQ ID NO: 599149 - DNA, 20 bp, Artificial
  CRISPR gRNA sequence
aaagaaaagggggggggggc

SEQ ID NO: 599150 - DNA, 20 bp, Artificial
  CRISPR gRNA sequence
gaaaagggggggggggcggg

SEQ ID NO: 599151 - DNA, 20 bp, Artificial
  CRISPR gRNA sequence
aaagggggggggggcgggta

SEQ ID NO: 599152 - DNA, 20 bp, Artificial
  CRISPR gRNA sequence
aagggggggggggcgggtag

SEQ ID NO: 599153 - DNA, 20 bp, Artificial
  CRISPR gRNA sequence
agggggggggggcgggtaga

SEQ ID NO: 599154 - DNA, 20 bp, Artificial
  CRISPR gRNA sequence
gggggggggggcgggtagag

SEQ ID NO: 599155 - DNA, 20 bp, Artificial
  CRISPR gRNA sequence
gggggggggcgggtagaggg

SEQ ID NO: 599156 - DNA, 20 bp, Artificial
  CRISPR gRNA sequence
ggggggggcgggtagagggg

SEQ ID NO: 599157 - DNA, 20 bp, Artificial
  CRISPR gRNA sequence
gggggggcgggtagagggga

SEQ ID NO: 599158 - DNA, 20 bp, Artificial
  CRISPR gRNA sequence
gggcgggtagaggggaggga

SEQ ID NO: 599159 - DNA, 20 bp, Artificial
  CRISPR gRNA sequence
gggtagaggggagggacagt

SEQ ID NO: 599160 - DNA, 20 bp, Artificial
  CRISPR gRNA sequence
ggtagaggggagggacagtc

SEQ ID NO: 599161 - DNA, 20 bp, Artificial
  CRISPR gRNA sequence
agaggggagggacagtcagg

SEQ ID NO: 599162 - DNA, 20 bp, Artificial
  CRISPR gRNA sequence
agggacagtcaggcagaacc

SEQ ID NO: 599163 - DNA, 20 bp, Artificial
  CRISPR gRNA sequence
acagtcaggcagaacccagc

SEQ ID NO: 599164 - DNA, 20 bp, Artificial
  CRISPR gRNA sequence
cagtcaggcagaacccagct

SEQ ID NO: 599165 - DNA, 20 bp, Artificial
  CRISPR gRNA sequence
gcagaacccagctaggaacc

SEQ ID NO: 599166 - DNA, 20 bp, Artificial
  CRISPR gRNA sequence
cagaacccagctaggaaccc

SEQ ID NO: 599167 - DNA, 20 bp, Artificial
  CRISPR gRNA sequence
aggaacccaggccaacttca

SEQ ID NO: 599168 - DNA, 20 bp, Artificial
  CRISPR gRNA sequence
ggaacccaggccaacttcac

SEQ ID NO: 599169 - DNA, 20 bp, Artificial
  CRISPR gRNA sequence
caacttcacaggactgtttt

SEQ ID NO: 599170 - DNA, 20 bp, Artificial
  CRISPR gRNA sequence
acaggactgtttttggccct

SEQ ID NO: 599171 - DNA, 20 bp, Artificial
  CRISPR gRNA sequence
gtttttggcccttggcaaaa

SEQ ID NO: 599172 - DNA, 20 bp, Artificial
  CRISPR gRNA sequence
tccatctctttcgcccatac

SEQ ID NO: 599173 - DNA, 20 bp, Artificial
  CRISPR gRNA sequence
gcccatactagaacctgtca

SEQ ID NO: 599174 - DNA, 20 bp, Artificial
  CRISPR gRNA sequence
cctgtttacatgtgtcatac

SEQ ID NO: 599175 - DNA, 20 bp, Artificial
  CRISPR gRNA sequence
ctgtttacatgtgtcatacc

SEQ ID NO: 599176 - DNA, 20 bp, Artificial
  CRISPR gRNA sequence
tgtttacatgtgtcatacca

SEQ ID NO: 599177 - DNA, 20 bp, Artificial
  CRISPR gRNA sequence
atgtgtcataccagggtttt

SEQ ID NO: 599178 - DNA, 20 bp, Artificial
  CRISPR gRNA sequence
ttttttttttttaattccaa

SEQ ID NO: 599179 - DNA, 20 bp, Artificial
  CRISPR gRNA sequence
tttttttttttaattccaac

SEQ ID NO: 599180 - DNA, 20 bp, Artificial
  CRISPR gRNA sequence
tttttaattccaacaggatc

SEQ ID NO: 599181 - DNA, 20 bp, Artificial
  CRISPR gRNA sequence
tctggatattaccttctatc

SEQ ID NO: 599182 - DNA, 20 bp, Artificial
  CRISPR gRNA sequence
gatattaccttctatctgga

SEQ ID NO: 599183 - DNA, 20 bp, Artificial
  CRISPR gRNA sequence
tggacagcttcaatttattc

SEQ ID NO: 599184 - DNA, 20 bp, Artificial
  CRISPR gRNA sequence
gcctacccaatctttcttct

SEQ ID NO: 599185 - DNA, 20 bp, Artificial
  CRISPR gRNA sequence
aatctttcttcttggaattc

SEQ ID NO: 599186 - DNA, 20 bp, Artificial
  CRISPR gRNA sequence
ttggaattcaagttaaaaca

SEQ ID NO: 599187 - DNA, 20 bp, Artificial
  CRISPR gRNA sequence
aagttaaaacaaagcaaaac

SEQ ID NO: 599188 - DNA, 20 bp, Artificial
  CRISPR gRNA sequence
aaacaagtccaaattcatga

SEQ ID NO: 599189 - DNA, 20 bp, Artificial
  CRISPR gRNA sequence
gtccaaattcatgacagcta

SEQ ID NO: 599190 - DNA, 20 bp, Artificial
  CRISPR gRNA sequence
ccaaattcatgacagctata

SEQ ID NO: 599191 - DNA, 20 bp, Artificial
  CRISPR gRNA sequence
ttcatgacagctatagagat

SEQ ID NO: 599192 - DNA, 20 bp, Artificial
  CRISPR gRNA sequence
tgattaatcgattaacatcc

SEQ ID NO: 599193 - DNA, 20 bp, Artificial
  CRISPR gRNA sequence
atcgattaacatcccagaaa

SEQ ID NO: 599194 - DNA, 20 bp, Artificial
  CRISPR gRNA sequence
acatcccagaaacagattac

SEQ ID NO: 599195 - DNA, 20 bp, Artificial
  CRISPR gRNA sequence
catcccagaaacagattaca

SEQ ID NO: 599196 - DNA, 20 bp, Artificial
  CRISPR gRNA sequence
tcccagaaacagattacaag

SEQ ID NO: 599197 - DNA, 20 bp, Artificial
  CRISPR gRNA sequence
cccagaaacagattacaagg

SEQ ID NO: 599198 - DNA, 20 bp, Artificial
  CRISPR gRNA sequence
ccagaaacagattacaagga

SEQ ID NO: 599199 - DNA, 20 bp, Artificial
  CRISPR gRNA sequence
cagaaacagattacaaggag

SEQ ID NO: 599200 - DNA, 20 bp, Artificial
  CRISPR gRNA sequence
caaggaggggacgataaatt

SEQ ID NO: 599201 - DNA, 20 bp, Artificial
  CRISPR gRNA sequence
aaggaggggacgataaatta

SEQ ID NO: 599202 - DNA, 20 bp, Artificial
  CRISPR gRNA sequence
gaggggacgataaattaagg

SEQ ID NO: 599203 - DNA, 20 bp, Artificial
  CRISPR gRNA sequence
ggggacgataaattaaggca

SEQ ID NO: 599204 - DNA, 20 bp, Artificial
  CRISPR gRNA sequence
gggacgataaattaaggcag

SEQ ID NO: 599205 - DNA, 20 bp, Artificial
  CRISPR gRNA sequence
catcttcaacccgattccct

SEQ ID NO: 599206 - DNA, 20 bp, Artificial
  CRISPR gRNA sequence
acaaaaatcattaccctaat

SEQ ID NO: 599207 - DNA, 20 bp, Artificial
  CRISPR gRNA sequence
gaaccacaatccatccctcc

SEQ ID NO: 599208 - DNA, 20 bp, Artificial
  CRISPR gRNA sequence
accacaatccatccctccca

SEQ ID NO: 599209 - DNA, 20 bp, Artificial
  CRISPR gRNA sequence
tatattattattattattac

SEQ ID NO: 599210 - DNA, 20 bp, Artificial
  CRISPR gRNA sequence
ttattattattactggttaa

SEQ ID NO: 599211 - DNA, 20 bp, Artificial
  CRISPR gRNA sequence
tattactggttaacagcaac

SEQ ID NO: 599212 - DNA, 20 bp, Artificial
  CRISPR gRNA sequence
caagtcatttgatcacatca

SEQ ID NO: 599213 - DNA, 20 bp, Artificial
  CRISPR gRNA sequence
atcacatcacagtgcaaaac

SEQ ID NO: 599214 - DNA, 20 bp, Artificial
  CRISPR gRNA sequence
tttatatataatctatgaat

SEQ ID NO: 599215 - DNA, 20 bp, Artificial
  CRISPR gRNA sequence
atatataatctatgaatcag

SEQ ID NO: 599216 - DNA, 20 bp, Artificial
  CRISPR gRNA sequence
tatgaatcagaagacaaaac

SEQ ID NO: 599217 - DNA, 20 bp, Artificial
  CRISPR gRNA sequence
tgaatcagaagacaaaacaa

SEQ ID NO: 599218 - DNA, 20 bp, Artificial
  CRISPR gRNA sequence
agctgttcttcaccacgcaa

SEQ ID NO: 599219 - DNA, 20 bp, Artificial
  CRISPR gRNA sequence
ttcttcaccacgcaaaagcc

SEQ ID NO: 599220 - DNA, 20 bp, Artificial
  CRISPR gRNA sequence
ttcaccacgcaaaagccaag

SEQ ID NO: 599221 - DNA, 20 bp, Artificial
  CRISPR gRNA sequence
caccacgcaaaagccaagcg

SEQ ID NO: 599222 - DNA, 20 bp, Artificial
  CRISPR gRNA sequence
agccaagcggagatttacct

SEQ ID NO: 599223 - DNA, 20 bp, Artificial
  CRISPR gRNA sequence
caagcggagatttacctcag

SEQ ID NO: 599224 - DNA, 20 bp, Artificial
  CRISPR gRNA sequence
atttacctcagcagtgcatg

SEQ ID NO: 599225 - DNA, 20 bp, Artificial
  CRISPR gRNA sequence
taacgtgtgtttgtgcactg

SEQ ID NO: 599226 - DNA, 20 bp, Artificial
  CRISPR gRNA sequence
gtgtgtttgtgcactgcagt

SEQ ID NO: 599227 - DNA, 20 bp, Artificial
  CRISPR gRNA sequence
tgtttgtgcactgcagttgg

SEQ ID NO: 599228 - DNA, 20 bp, Artificial
  CRISPR gRNA sequence
ttgtgcactgcagttggtgg

SEQ ID NO: 599229 - DNA, 20 bp, Artificial
  CRISPR gRNA sequence
tgcagttggtggtggaaact

SEQ ID NO: 599230 - DNA, 20 bp, Artificial
  CRISPR gRNA sequence
gcagttggtggtggaaacta

SEQ ID NO: 599231 - DNA, 20 bp, Artificial
  CRISPR gRNA sequence
gttggtggtggaaactaagg

SEQ ID NO: 599232 - DNA, 20 bp, Artificial
  CRISPR gRNA sequence
ggtggtggaaactaaggcag

SEQ ID NO: 599233 - DNA, 20 bp, Artificial
  CRISPR gRNA sequence
aaactaaggcagtggatctg

SEQ ID NO: 599234 - DNA, 20 bp, Artificial
  CRISPR gRNA sequence
aaggcagtggatctgtagct

SEQ ID NO: 599235 - DNA, 20 bp, Artificial
  CRISPR gRNA sequence
aggcagtggatctgtagcta

SEQ ID NO: 599236 - DNA, 20 bp, Artificial
  CRISPR gRNA sequence
ggcagtggatctgtagctaa

SEQ ID NO: 599237 - DNA, 20 bp, Artificial
  CRISPR gRNA sequence
gtttttacttcctccatctt

SEQ ID NO: 599238 - DNA, 20 bp, Artificial
  CRISPR gRNA sequence
ttacttcctccatcttcagc

SEQ ID NO: 599239 - DNA, 20 bp, Artificial
  CRISPR gRNA sequence
tacttcctccatcttcagcg

SEQ ID NO: 599240 - DNA, 20 bp, Artificial
  CRISPR gRNA sequence
cttcctccatcttcagcgag

SEQ ID NO: 599241 - DNA, 20 bp, Artificial
  CRISPR gRNA sequence
cctccatcttcagcgaggag

SEQ ID NO: 599242 - DNA, 20 bp, Artificial
  CRISPR gRNA sequence
ctccatcttcagcgaggagc

SEQ ID NO: 599243 - DNA, 20 bp, Artificial
  CRISPR gRNA sequence
tccatcttcagcgaggagca

SEQ ID NO: 599244 - DNA, 20 bp, Artificial
  CRISPR gRNA sequence
tcttcagcgaggagcagggt

SEQ ID NO: 599245 - DNA, 20 bp, Artificial
  CRISPR gRNA sequence
agcgaggagcagggttagcc

SEQ ID NO: 599246 - DNA, 20 bp, Artificial
  CRISPR gRNA sequence
gcgaggagcagggttagccc

SEQ ID NO: 599247 - DNA, 20 bp, Artificial
  CRISPR gRNA sequence
ggagcagggttagcccggga

SEQ ID NO: 599248 - DNA, 20 bp, Artificial
  CRISPR gRNA sequence
cagggttagcccgggacagc

SEQ ID NO: 599249 - DNA, 20 bp, Artificial
  CRISPR gRNA sequence
gggacagctggtcaaacccc

SEQ ID NO: 599250 - DNA, 20 bp, Artificial
  CRISPR gRNA sequence
caaaccccgagaaaccgatc

SEQ ID NO: 599251 - DNA, 20 bp, Artificial
  CRISPR gRNA sequence
accccgagaaaccgatccgg

SEQ ID NO: 599252 - DNA, 20 bp, Artificial
  CRISPR gRNA sequence
cccgagaaaccgatccggtg

SEQ ID NO: 599253 - DNA, 20 bp, Artificial
  CRISPR gRNA sequence
aaaccgatccggtggagccc

SEQ ID NO: 599254 - DNA, 20 bp, Artificial
  CRISPR gRNA sequence
cccgagcacatctcccccgc

SEQ ID NO: 599255 - DNA, 20 bp, Artificial
  CRISPR gRNA sequence
agcacatctcccccgccggc

SEQ ID NO: 599256 - DNA, 20 bp, Artificial
  CRISPR gRNA sequence
gcacatctcccccgccggcc

SEQ ID NO: 599257 - DNA, 20 bp, Artificial
  CRISPR gRNA sequence
ccccgccggccgggctcgcg

SEQ ID NO: 599258 - DNA, 20 bp, Artificial
  CRISPR gRNA sequence
cgggctcgcgcagacgcccg

SEQ ID NO: 599259 - DNA, 20 bp, Artificial
  CRISPR gRNA sequence
gggctcgcgcagacgcccgc

SEQ ID NO: 599260 - DNA, 20 bp, Artificial
  CRISPR gRNA sequence
ctcgcgcagacgcccgcggg

SEQ ID NO: 599261 - DNA, 20 bp, Artificial
  CRISPR gRNA sequence
cgcgcagacgcccgcgggcg

SEQ ID NO: 599262 - DNA, 20 bp, Artificial
  CRISPR gRNA sequence
gcgcagacgcccgcgggcgg

SEQ ID NO: 599263 - DNA, 20 bp, Artificial
  CRISPR gRNA sequence
cgcagacgcccgcgggcgga

SEQ ID NO: 599264 - DNA, 20 bp, Artificial
  CRISPR gRNA sequence
agacgcccgcgggcggaggg

SEQ ID NO: 599265 - DNA, 20 bp, Artificial
  CRISPR gRNA sequence
gacgcccgcgggcggagggc

SEQ ID NO: 599266 - DNA, 20 bp, Artificial
  CRISPR gRNA sequence
cccgcgggcggagggcgggc

SEQ ID NO: 599267 - DNA, 20 bp, Artificial
  CRISPR gRNA sequence
gcgggcggagggcgggctgg

SEQ ID NO: 599268 - DNA, 20 bp, Artificial
  CRISPR gRNA sequence
ggcggagggcgggctggcgg

SEQ ID NO: 599269 - DNA, 20 bp, Artificial
  CRISPR gRNA sequence
gggcgggctggcggcggctg

SEQ ID NO: 599270 - DNA, 20 bp, Artificial
  CRISPR gRNA sequence
cgggctggcggcggctgcgg

SEQ ID NO: 599271 - DNA, 20 bp, Artificial
  CRISPR gRNA sequence
gctggcggcggctgcggcgg

SEQ ID NO: 599272 - DNA, 20 bp, Artificial
  CRISPR gRNA sequence
ggcggcggctgcggcggcgg

SEQ ID NO: 599273 - DNA, 20 bp, Artificial
  CRISPR gRNA sequence
ggcggctgcggcggcggcgg

SEQ ID NO: 599274 - DNA, 20 bp, Artificial
  CRISPR gRNA sequence
ggctgcggcggcggcggcgg

SEQ ID NO: 599275 - DNA, 20 bp, Artificial
  CRISPR gRNA sequence
gctgcggcggcggcggcggc

SEQ ID NO: 599276 - DNA, 20 bp, Artificial
  CRISPR gRNA sequence
gcggcggcggcggcggcggg

SEQ ID NO: 599277 - DNA, 20 bp, Artificial
  CRISPR gRNA sequence
cggcggcggcggcgggcggc

SEQ ID NO: 599278 - DNA, 20 bp, Artificial
  CRISPR gRNA sequence
cggcggcggcgggcggctgg

SEQ ID NO: 599279 - DNA, 20 bp, Artificial
  CRISPR gRNA sequence
cggcggcgggcggctggcgg

SEQ ID NO: 599280 - DNA, 20 bp, Artificial
  CRISPR gRNA sequence
ggcggcgggcggctggcggc

SEQ ID NO: 599281 - DNA, 20 bp, Artificial
  CRISPR gRNA sequence
ggcgggcggctggcggcggg

SEQ ID NO: 599282 - DNA, 20 bp, Artificial
  CRISPR gRNA sequence
gggcggctggcggcgggcag

SEQ ID NO: 599283 - DNA, 20 bp, Artificial
  CRISPR gRNA sequence
gcggctggcggcgggcagcg

SEQ ID NO: 599284 - DNA, 20 bp, Artificial
  CRISPR gRNA sequence
ggcggcgggcagcggagccc

SEQ ID NO: 599285 - DNA, 20 bp, Artificial
  CRISPR gRNA sequence
gcggcgggcagcggagcccc

SEQ ID NO: 599286 - DNA, 20 bp, Artificial
  CRISPR gRNA sequence
gggcagcggagccccgggcg

SEQ ID NO: 599287 - DNA, 20 bp, Artificial
  CRISPR gRNA sequence
ggcagcggagccccgggcgc

SEQ ID NO: 599288 - DNA, 20 bp, Artificial
  CRISPR gRNA sequence
gcggagccccgggcgcgggc

SEQ ID NO: 599289 - DNA, 20 bp, Artificial
  CRISPR gRNA sequence
gagccccgggcgcgggcgag

SEQ ID NO: 599290 - DNA, 20 bp, Artificial
  CRISPR gRNA sequence
tgcgcgcgcgtgcgtgtgtg

SEQ ID NO: 599291 - DNA, 20 bp, Artificial
  CRISPR gRNA sequence
gcgcgcgcgtgcgtgtgtgc

SEQ ID NO: 599292 - DNA, 20 bp, Artificial
  CRISPR gRNA sequence
cgcgcgcgtgcgtgtgtgcg

SEQ ID NO: 599293 - DNA, 20 bp, Artificial
  CRISPR gRNA sequence
cgtgcgtgtgtgcggggccc

SEQ ID NO: 599294 - DNA, 20 bp, Artificial
  CRISPR gRNA sequence
gcgcctgtgcgtgtgtgtat

SEQ ID NO: 599295 - DNA, 20 bp, Artificial
  CRISPR gRNA sequence
gcctgtgcgtgtgtgtatga

SEQ ID NO: 599296 - DNA, 20 bp, Artificial
  CRISPR gRNA sequence
agcgcgtgtgcgcgcgcgcg

SEQ ID NO: 599297 - DNA, 20 bp, Artificial
  CRISPR gRNA sequence
gcgcgtgtgcgcgcgcgcgc

SEQ ID NO: 599298 - DNA, 20 bp, Artificial
  CRISPR gRNA sequence
gtgtgcgcgcgcgcgcgggc

SEQ ID NO: 599299 - DNA, 20 bp, Artificial
  CRISPR gRNA sequence
tgcgcgcgcgcgcgggctgg

SEQ ID NO: 599300 - DNA, 20 bp, Artificial
  CRISPR gRNA sequence
gcgcgcgcgcgcgggctggc

SEQ ID NO: 599301 - DNA, 20 bp, Artificial
  CRISPR gRNA sequence
tgtgcgcgtgtctgcgcgct

SEQ ID NO: 599302 - DNA, 20 bp, Artificial
  CRISPR gRNA sequence
tgtctgcgcgctaagccgct

SEQ ID NO: 599303 - DNA, 20 bp, Artificial
  CRISPR gRNA sequence
gctaagccgctcggcgcgct

SEQ ID NO: 599304 - DNA, 20 bp, Artificial
  CRISPR gRNA sequence
gcgcgctcggcaatcgatta

SEQ ID NO: 599305 - DNA, 20 bp, Artificial
  CRISPR gRNA sequence
cgcgctcggcaatcgattac

SEQ ID NO: 599306 - DNA, 20 bp, Artificial
  CRISPR gRNA sequence
tcggcaatcgattacaggac

SEQ ID NO: 599307 - DNA, 20 bp, Artificial
  CRISPR gRNA sequence
ttacaggacaagtgctgccc

SEQ ID NO: 599308 - DNA, 20 bp, Artificial
  CRISPR gRNA sequence
acaggacaagtgctgccccg

SEQ ID NO: 599309 - DNA, 20 bp, Artificial
  CRISPR gRNA sequence
caggacaagtgctgccccgg

SEQ ID NO: 599310 - DNA, 20 bp, Artificial
  CRISPR gRNA sequence
ctcgcgcccacccgcgcgcc

SEQ ID NO: 599311 - DNA, 20 bp, Artificial
  CRISPR gRNA sequence
gcgcccggccgcgtcgcccc

SEQ ID NO: 599312 - DNA, 20 bp, Artificial
  CRISPR gRNA sequence
ccgcgtcgcccccagcccgt

SEQ ID NO: 599313 - DNA, 20 bp, Artificial
  CRISPR gRNA sequence
gcccccagcccgttggtccc

SEQ ID NO: 599314 - DNA, 20 bp, Artificial
  CRISPR gRNA sequence
gcccgttggtccccggactg

SEQ ID NO: 599315 - DNA, 20 bp, Artificial
  CRISPR gRNA sequence
actgcggaccccgcccccga

SEQ ID NO: 599316 - DNA, 20 bp, Artificial
  CRISPR gRNA sequence
ctgcggaccccgcccccgac

SEQ ID NO: 599317 - DNA, 20 bp, Artificial
  CRISPR gRNA sequence
tgcggaccccgcccccgacg

SEQ ID NO: 599318 - DNA, 20 bp, Artificial
  CRISPR gRNA sequence
gcggaccccgcccccgacgg

SEQ ID NO: 599319 - DNA, 20 bp, Artificial
  CRISPR gRNA sequence
accccgcccccgacgggggc

SEQ ID NO: 599320 - DNA, 20 bp, Artificial
  CRISPR gRNA sequence
ccccgcccccgacgggggcc

SEQ ID NO: 599321 - DNA, 20 bp, Artificial
  CRISPR gRNA sequence
gggccaggtaacccgcttcc

SEQ ID NO: 599322 - DNA, 20 bp, Artificial
  CRISPR gRNA sequence
acccgcttccgagtgtgcca

SEQ ID NO: 599323 - DNA, 20 bp, Artificial
  CRISPR gRNA sequence
ataaatctcacgttttctgc

SEQ ID NO: 599324 - DNA, 20 bp, Artificial
  CRISPR gRNA sequence
atctcacgttttctgccggc

SEQ ID NO: 599325 - DNA, 20 bp, Artificial
  CRISPR gRNA sequence
ctcacgttttctgccggctg

SEQ ID NO: 599326 - DNA, 20 bp, Artificial
  CRISPR gRNA sequence
tcacgttttctgccggctgg

SEQ ID NO: 599327 - DNA, 20 bp, Artificial
  CRISPR gRNA sequence
ttttctgccggctggaggct

SEQ ID NO: 599328 - DNA, 20 bp, Artificial
  CRISPR gRNA sequence
ttctgccggctggaggcttg

SEQ ID NO: 599329 - DNA, 20 bp, Artificial
  CRISPR gRNA sequence
tgccggctggaggcttggag

SEQ ID NO: 599330 - DNA, 20 bp, Artificial
  CRISPR gRNA sequence
ggctggaggcttggagcggt

SEQ ID NO: 599331 - DNA, 20 bp, Artificial
  CRISPR gRNA sequence
gctggaggcttggagcggtg

SEQ ID NO: 599332 - DNA, 20 bp, Artificial
  CRISPR gRNA sequence
cggtgaggtgacgttcattt

SEQ ID NO: 599333 - DNA, 20 bp, Artificial
  CRISPR gRNA sequence
acgttcatttcggccgcgtg

SEQ ID NO: 599334 - DNA, 20 bp, Artificial
  CRISPR gRNA sequence
cgtgaagttttctttcaaac

SEQ ID NO: 599335 - DNA, 20 bp, Artificial
  CRISPR gRNA sequence
gtgaagttttctttcaaact

SEQ ID NO: 599336 - DNA, 20 bp, Artificial
  CRISPR gRNA sequence
gttttctttcaaactgggat

SEQ ID NO: 599337 - DNA, 20 bp, Artificial
  CRISPR gRNA sequence
ttctttcaaactgggattgg

SEQ ID NO: 599338 - DNA, 20 bp, Artificial
  CRISPR gRNA sequence
tctttcaaactgggattggt

SEQ ID NO: 599339 - DNA, 20 bp, Artificial
  CRISPR gRNA sequence
ctttcaaactgggattggtg

SEQ ID NO: 599340 - DNA, 20 bp, Artificial
  CRISPR gRNA sequence
ttcaaactgggattggtggg

SEQ ID NO: 599341 - DNA, 20 bp, Artificial
  CRISPR gRNA sequence
tcaaactgggattggtgggg

SEQ ID NO: 599342 - DNA, 20 bp, Artificial
  CRISPR gRNA sequence
actgggattggtggggaggc

SEQ ID NO: 599343 - DNA, 20 bp, Artificial
  CRISPR gRNA sequence
ctgggattggtggggaggcc

SEQ ID NO: 599344 - DNA, 20 bp, Artificial
  CRISPR gRNA sequence
tgggattggtggggaggccg

SEQ ID NO: 599345 - DNA, 20 bp, Artificial
  CRISPR gRNA sequence
gggattggtggggaggccgg

SEQ ID NO: 599346 - DNA, 20 bp, Artificial
  CRISPR gRNA sequence
attggtggggaggccggggg

SEQ ID NO: 599347 - DNA, 20 bp, Artificial
  CRISPR gRNA sequence
ttggtggggaggccggggga

SEQ ID NO: 599348 - DNA, 20 bp, Artificial
  CRISPR gRNA sequence
tggtggggaggccgggggaa

SEQ ID NO: 599349 - DNA, 20 bp, Artificial
  CRISPR gRNA sequence
gtggggaggccgggggaagg

SEQ ID NO: 599350 - DNA, 20 bp, Artificial
  CRISPR gRNA sequence
gggaggccgggggaagggag

SEQ ID NO: 599351 - DNA, 20 bp, Artificial
  CRISPR gRNA sequence
ggaggccgggggaagggagc

SEQ ID NO: 599352 - DNA, 20 bp, Artificial
  CRISPR gRNA sequence
gaggccgggggaagggagcg

SEQ ID NO: 599353 - DNA, 20 bp, Artificial
  CRISPR gRNA sequence
gccgggggaagggagcgggg

SEQ ID NO: 599354 - DNA, 20 bp, Artificial
  CRISPR gRNA sequence
agggagcggggcggcgatct

SEQ ID NO: 599355 - DNA, 20 bp, Artificial
  CRISPR gRNA sequence
ggcgatcttggcgccctgcg

SEQ ID NO: 599356 - DNA, 20 bp, Artificial
  CRISPR gRNA sequence
cgatcttggcgccctgcgcg

SEQ ID NO: 599357 - DNA, 20 bp, Artificial
  CRISPR gRNA sequence
ttggcgccctgcgcggagtc

SEQ ID NO: 599358 - DNA, 20 bp, Artificial
  CRISPR gRNA sequence
tggcgccctgcgcggagtcc

SEQ ID NO: 599359 - DNA, 20 bp, Artificial
  CRISPR gRNA sequence
gcgccctgcgcggagtccgg

SEQ ID NO: 599360 - DNA, 20 bp, Artificial
  CRISPR gRNA sequence
ggagtccgggagccgcgtcc

SEQ ID NO: 599361 - DNA, 20 bp, Artificial
  CRISPR gRNA sequence
ccgggagccgcgtcccggcc

SEQ ID NO: 599362 - DNA, 20 bp, Artificial
  CRISPR gRNA sequence
gagccgcgtcccggccgagt

SEQ ID NO: 599363 - DNA, 20 bp, Artificial
  CRISPR gRNA sequence
agccgcgtcccggccgagtc

SEQ ID NO: 599364 - DNA, 20 bp, Artificial
  CRISPR gRNA sequence
gccgcgtcccggccgagtcg

SEQ ID NO: 599365 - DNA, 20 bp, Artificial
  CRISPR gRNA sequence
cgcgtcccggccgagtcggg

SEQ ID NO: 599366 - DNA, 20 bp, Artificial
  CRISPR gRNA sequence
gccgagtcggggagtgtgcg

SEQ ID NO: 599367 - DNA, 20 bp, Artificial
  CRISPR gRNA sequence
cgagtcggggagtgtgcgtg

SEQ ID NO: 599368 - DNA, 20 bp, Artificial
  CRISPR gRNA sequence
gcgtggagcctcccacctac

SEQ ID NO: 599369 - DNA, 20 bp, Artificial
  CRISPR gRNA sequence
tcccacctactggtctccgc

SEQ ID NO: 599370 - DNA, 20 bp, Artificial
  CRISPR gRNA sequence
ggtctccgccggcaactctg

SEQ ID NO: 599371 - DNA, 20 bp, Artificial
  CRISPR gRNA sequence
gcaactctgcggccccattt

SEQ ID NO: 599372 - DNA, 20 bp, Artificial
  CRISPR gRNA sequence
ctctgcggccccatttcgga

SEQ ID NO: 599373 - DNA, 20 bp, Artificial
  CRISPR gRNA sequence
ggaaagcgcaccgcattgac

SEQ ID NO: 599374 - DNA, 20 bp, Artificial
  CRISPR gRNA sequence
gaaagcgcaccgcattgacc

SEQ ID NO: 599375 - DNA, 20 bp, Artificial
  CRISPR gRNA sequence
accgcattgaccgggacctg

SEQ ID NO: 599376 - DNA, 20 bp, Artificial
  CRISPR gRNA sequence
gcattgaccgggacctgaag

SEQ ID NO: 599377 - DNA, 20 bp, Artificial
  CRISPR gRNA sequence
cattgaccgggacctgaagc

SEQ ID NO: 599378 - DNA, 20 bp, Artificial
  CRISPR gRNA sequence
accgggacctgaagcgggat

SEQ ID NO: 599379 - DNA, 20 bp, Artificial
  CRISPR gRNA sequence
cgggacctgaagcgggataa

SEQ ID NO: 599380 - DNA, 20 bp, Artificial
  CRISPR gRNA sequence
gggacctgaagcgggataag

SEQ ID NO: 599381 - DNA, 20 bp, Artificial
  CRISPR gRNA sequence
ggacctgaagcgggataaga

SEQ ID NO: 599382 - DNA, 20 bp, Artificial
  CRISPR gRNA sequence
gacctgaagcgggataagag

SEQ ID NO: 599383 - DNA, 20 bp, Artificial
  CRISPR gRNA sequence
aagcgggataagaggggtcc

SEQ ID NO: 599384 - DNA, 20 bp, Artificial
  CRISPR gRNA sequence
agcgggataagaggggtcct

SEQ ID NO: 599385 - DNA, 20 bp, Artificial
  CRISPR gRNA sequence
gcgggataagaggggtcctg

SEQ ID NO: 599386 - DNA, 20 bp, Artificial
  CRISPR gRNA sequence
ataagaggggtcctggggaa

SEQ ID NO: 599387 - DNA, 20 bp, Artificial
  CRISPR gRNA sequence
ggggtcctggggaatagact

SEQ ID NO: 599388 - DNA, 20 bp, Artificial
  CRISPR gRNA sequence
tcctggggaatagactgaga

SEQ ID NO: 599389 - DNA, 20 bp, Artificial
  CRISPR gRNA sequence
tgagaaagacattcatgtct

SEQ ID NO: 599390 - DNA, 20 bp, Artificial
  CRISPR gRNA sequence
agacattcatgtctgagatg

SEQ ID NO: 599391 - DNA, 20 bp, Artificial
  CRISPR gRNA sequence
ctcaactattactattttga

SEQ ID NO: 599392 - DNA, 20 bp, Artificial
  CRISPR gRNA sequence
ctattttgaaagtgctttaa

SEQ ID NO: 599393 - DNA, 20 bp, Artificial
  CRISPR gRNA sequence
tgaaagtgctttaacagtgc

SEQ ID NO: 599394 - DNA, 20 bp, Artificial
  CRISPR gRNA sequence
cagtgcaagtttaaaaacta

SEQ ID NO: 599395 - DNA, 20 bp, Artificial
  CRISPR gRNA sequence
ttgacttgctttttctcccc

SEQ ID NO: 599396 - DNA, 20 bp, Artificial
  CRISPR gRNA sequence
tgacttgctttttctccccc

SEQ ID NO: 599397 - DNA, 20 bp, Artificial
  CRISPR gRNA sequence
gacttgctttttctcccccg

SEQ ID NO: 599398 - DNA, 20 bp, Artificial
  CRISPR gRNA sequence
ggcatgtgccacgtcttcca

SEQ ID NO: 599399 - DNA, 20 bp, Artificial
  CRISPR gRNA sequence
tgccacgtcttccaaagtca

SEQ ID NO: 599400 - DNA, 20 bp, Artificial
  CRISPR gRNA sequence
gccacgtcttccaaagtcaa

SEQ ID NO: 599401 - DNA, 20 bp, Artificial
  CRISPR gRNA sequence
gtcttccaaagtcaaaggaa

SEQ ID NO: 599402 - DNA, 20 bp, Artificial
  CRISPR gRNA sequence
ccaaagtcaaaggaacggat

SEQ ID NO: 599403 - DNA, 20 bp, Artificial
  CRISPR gRNA sequence
aaggaacggatgagtacaaa

SEQ ID NO: 599404 - DNA, 20 bp, Artificial
  CRISPR gRNA sequence
acaaaaagttgctacccttg

SEQ ID NO: 599405 - DNA, 20 bp, Artificial
  CRISPR gRNA sequence
ttacctatcactatcaacca

SEQ ID NO: 599406 - DNA, 20 bp, Artificial
  CRISPR gRNA sequence
tcaaccacagcttgtttatt

SEQ ID NO: 599407 - DNA, 20 bp, Artificial
  CRISPR gRNA sequence
ccacagcttgtttatttgga

SEQ ID NO: 599408 - DNA, 20 bp, Artificial
  CRISPR gRNA sequence
tgtttatttggaaagaactt

SEQ ID NO: 599409 - DNA, 20 bp, Artificial
  CRISPR gRNA sequence
aagaacttaagtgaaccgtc

SEQ ID NO: 599410 - DNA, 20 bp, Artificial
  CRISPR gRNA sequence
gaacttaagtgaaccgtcaa

SEQ ID NO: 599411 - DNA, 20 bp, Artificial
  CRISPR gRNA sequence
atgcatattctttctacaaa

SEQ ID NO: 599412 - DNA, 20 bp, Artificial
  CRISPR gRNA sequence
catattctttctacaaatag

SEQ ID NO: 599413 - DNA, 20 bp, Artificial
  CRISPR gRNA sequence
tttctacaaatagtagcatt

SEQ ID NO: 599414 - DNA, 20 bp, Artificial
  CRISPR gRNA sequence
ttcctgaccacatttgcgaa

SEQ ID NO: 599415 - DNA, 20 bp, Artificial
  CRISPR gRNA sequence
cctgaccacatttgcgaaaa

SEQ ID NO: 599416 - DNA, 20 bp, Artificial
  CRISPR gRNA sequence
ctgaccacatttgcgaaaag

SEQ ID NO: 599417 - DNA, 20 bp, Artificial
  CRISPR gRNA sequence
tgaccacatttgcgaaaaga

SEQ ID NO: 599418 - DNA, 20 bp, Artificial
  CRISPR gRNA sequence
acatttgcgaaaagagggaa

SEQ ID NO: 599419 - DNA, 20 bp, Artificial
  CRISPR gRNA sequence
atttgcgaaaagagggaata

SEQ ID NO: 599420 - DNA, 20 bp, Artificial
  CRISPR gRNA sequence
aatagagacttctataatta

SEQ ID NO: 599421 - DNA, 20 bp, Artificial
  CRISPR gRNA sequence
atagagacttctataattaa

SEQ ID NO: 599422 - DNA, 20 bp, Artificial
  CRISPR gRNA sequence
tagagacttctataattaaa

SEQ ID NO: 599423 - DNA, 20 bp, Artificial
  CRISPR gRNA sequence
acttctataattaaagggaa

SEQ ID NO: 599424 - DNA, 20 bp, Artificial
  CRISPR gRNA sequence
cttctataattaaagggaaa

SEQ ID NO: 599425 - DNA, 20 bp, Artificial
  CRISPR gRNA sequence
taaagggaaaaggaaaatga

SEQ ID NO: 599426 - DNA, 20 bp, Artificial
  CRISPR gRNA sequence
aaagggaaaaggaaaatgaa

SEQ ID NO: 599427 - DNA, 20 bp, Artificial
  CRISPR gRNA sequence
agggaaaaggaaaatgaaag

SEQ ID NO: 599428 - DNA, 20 bp, Artificial
  CRISPR gRNA sequence
aaaatgaaaggagctgaaaa

SEQ ID NO: 599429 - DNA, 20 bp, Artificial
  CRISPR gRNA sequence
gctgaaaatagtgaactgtg

SEQ ID NO: 599430 - DNA, 20 bp, Artificial
  CRISPR gRNA sequence
aaatagtgaactgtgtagtc

SEQ ID NO: 599431 - DNA, 20 bp, Artificial
  CRISPR gRNA sequence
agtgaactgtgtagtctgga

SEQ ID NO: 599432 - DNA, 20 bp, Artificial
  CRISPR gRNA sequence
ttgaaaacacatgaaattat

SEQ ID NO: 599433 - DNA, 20 bp, Artificial
  CRISPR gRNA sequence
tgaaaacacatgaaattatc

SEQ ID NO: 599434 - DNA, 20 bp, Artificial
  CRISPR gRNA sequence
aaattatcaggactgccaaa

SEQ ID NO: 599435 - DNA, 20 bp, Artificial
  CRISPR gRNA sequence
gactgccaaacggtgttcct

SEQ ID NO: 599436 - DNA, 20 bp, Artificial
  CRISPR gRNA sequence
gttcctgagaaaccatatca

SEQ ID NO: 599437 - DNA, 20 bp, Artificial
  CRISPR gRNA sequence
aaaccatatcacagattgtg

SEQ ID NO: 599438 - DNA, 20 bp, Artificial
  CRISPR gRNA sequence
attgtgaagaaaatcaatgc

SEQ ID NO: 599439 - DNA, 20 bp, Artificial
  CRISPR gRNA sequence
gtgaagaaaatcaatgctag

SEQ ID NO: 599440 - DNA, 20 bp, Artificial
  CRISPR gRNA sequence
gaagaaaatcaatgctagaa

SEQ ID NO: 599441 - DNA, 20 bp, Artificial
  CRISPR gRNA sequence
aaaatcaatgctagaagagt

SEQ ID NO: 599442 - DNA, 20 bp, Artificial
  CRISPR gRNA sequence
caatgctagaagagtcggaa

SEQ ID NO: 599443 - DNA, 20 bp, Artificial
  CRISPR gRNA sequence
aatgctagaagagtcggaac

SEQ ID NO: 599444 - DNA, 20 bp, Artificial
  CRISPR gRNA sequence
accgtactcttactcctttg

SEQ ID NO: 599445 - DNA, 20 bp, Artificial
  CRISPR gRNA sequence
cttactcctttgaagaatcc

SEQ ID NO: 599446 - DNA, 20 bp, Artificial
  CRISPR gRNA sequence
cctttgaagaatcccagaaa

SEQ ID NO: 599447 - DNA, 20 bp, Artificial
  CRISPR gRNA sequence
gaatcccagaaatagttgtt

SEQ ID NO: 599448 - DNA, 20 bp, Artificial
  CRISPR gRNA sequence
aatcccagaaatagttgttg

SEQ ID NO: 599449 - DNA, 20 bp, Artificial
  CRISPR gRNA sequence
tgaggttttttttttctgct

SEQ ID NO: 599450 - DNA, 20 bp, Artificial
  CRISPR gRNA sequence
tttttttctgctgagaaaaa

SEQ ID NO: 599451 - DNA, 20 bp, Artificial
  CRISPR gRNA sequence
gctgagaaaaaaagatatat

SEQ ID NO: 599452 - DNA, 20 bp, Artificial
  CRISPR gRNA sequence
aaaaagatatattggaaatt

SEQ ID NO: 599453 - DNA, 20 bp, Artificial
  CRISPR gRNA sequence
attggaaattaagtcatcaa

SEQ ID NO: 599454 - DNA, 20 bp, Artificial
  CRISPR gRNA sequence
taagtcatcaacagtacctt

SEQ ID NO: 599455 - DNA, 20 bp, Artificial
  CRISPR gRNA sequence
gtaccttaagcaccactctg

SEQ ID NO: 599456 - DNA, 20 bp, Artificial
  CRISPR gRNA sequence
taccttaagcaccactctgt

SEQ ID NO: 599457 - DNA, 20 bp, Artificial
  CRISPR gRNA sequence
caccactctgtaggtaattt

SEQ ID NO: 599458 - DNA, 20 bp, Artificial
  CRISPR gRNA sequence
actctgtaggtaattttgga

SEQ ID NO: 599459 - DNA, 20 bp, Artificial
  CRISPR gRNA sequence
cttttctttacattttgata

SEQ ID NO: 599460 - DNA, 20 bp, Artificial
  CRISPR gRNA sequence
ttttctttacattttgatat

SEQ ID NO: 599461 - DNA, 20 bp, Artificial
  CRISPR gRNA sequence
tttctttacattttgatata

SEQ ID NO: 599462 - DNA, 20 bp, Artificial
  CRISPR gRNA sequence
ctttacattttgatataggg

SEQ ID NO: 599463 - DNA, 20 bp, Artificial
  CRISPR gRNA sequence
tttacattttgatataggga

SEQ ID NO: 599464 - DNA, 20 bp, Artificial
  CRISPR gRNA sequence
aattcacatcgacacaaacg

SEQ ID NO: 599465 - DNA, 20 bp, Artificial
  CRISPR gRNA sequence
catcgacacaaacgaagtaa

SEQ ID NO: 599466 - DNA, 20 bp, Artificial
  CRISPR gRNA sequence
atataacttgtgtgatactg

SEQ ID NO: 599467 - DNA, 20 bp, Artificial
  CRISPR gRNA sequence
tataatgaattacttcttga

SEQ ID NO: 599468 - DNA, 20 bp, Artificial
  CRISPR gRNA sequence
ttattaaacaattgtaacga

SEQ ID NO: 599469 - DNA, 20 bp, Artificial
  CRISPR gRNA sequence
agtctctttttgtttaacta

SEQ ID NO: 599470 - DNA, 20 bp, Artificial
  CRISPR gRNA sequence
ttttgtttaactatagaaaa

SEQ ID NO: 599471 - DNA, 20 bp, Artificial
  CRISPR gRNA sequence
tgtttaactatagaaaatgg

SEQ ID NO: 599472 - DNA, 20 bp, Artificial
  CRISPR gRNA sequence
taactatagaaaatggtaga

SEQ ID NO: 599473 - DNA, 20 bp, Artificial
  CRISPR gRNA sequence
atagaaaatggtagatagtg

SEQ ID NO: 599474 - DNA, 20 bp, Artificial
  CRISPR gRNA sequence
aaatggtagatagtgtggta

SEQ ID NO: 599475 - DNA, 20 bp, Artificial
  CRISPR gRNA sequence
gatagtgtggtacagcaaac

SEQ ID NO: 599476 - DNA, 20 bp, Artificial
  CRISPR gRNA sequence
caagattaacaaattttcgt

SEQ ID NO: 599477 - DNA, 20 bp, Artificial
  CRISPR gRNA sequence
agattaacaaattttcgttg

SEQ ID NO: 599478 - DNA, 20 bp, Artificial
  CRISPR gRNA sequence
attaacaaattttcgttgga

SEQ ID NO: 599479 - DNA, 20 bp, Artificial
  CRISPR gRNA sequence
ttcgttggagagaaattatt

SEQ ID NO: 599480 - DNA, 20 bp, Artificial
  CRISPR gRNA sequence
tcgttggagagaaattattt

SEQ ID NO: 599481 - DNA, 20 bp, Artificial
  CRISPR gRNA sequence
ggagagaaattatttgggct

SEQ ID NO: 599482 - DNA, 20 bp, Artificial
  CRISPR gRNA sequence
gagagaaattatttgggctc

SEQ ID NO: 599483 - DNA, 20 bp, Artificial
  CRISPR gRNA sequence
aataacattatgatgatttt

SEQ ID NO: 599484 - DNA, 20 bp, Artificial
  CRISPR gRNA sequence
gatgattttaagaaaaattg

SEQ ID NO: 599485 - DNA, 20 bp, Artificial
  CRISPR gRNA sequence
agaaaaattgcagttcctgt

SEQ ID NO: 599486 - DNA, 20 bp, Artificial
  CRISPR gRNA sequence
cctgtgagttatatattgat

SEQ ID NO: 599487 - DNA, 20 bp, Artificial
  CRISPR gRNA sequence
ctgtgagttatatattgata

SEQ ID NO: 599488 - DNA, 20 bp, Artificial
  CRISPR gRNA sequence
tgagttatatattgataagg

SEQ ID NO: 599489 - DNA, 20 bp, Artificial
  CRISPR gRNA sequence
aaggcagatttttaaacact

SEQ ID NO: 599490 - DNA, 20 bp, Artificial
  CRISPR gRNA sequence
aaacacttagttgctaaaat

SEQ ID NO: 599491 - DNA, 20 bp, Artificial
  CRISPR gRNA sequence
tgctaaaattagttttccta

SEQ ID NO: 599492 - DNA, 20 bp, Artificial
  CRISPR gRNA sequence
agttttcctaaagtcgtatt

SEQ ID NO: 599493 - DNA, 20 bp, Artificial
  CRISPR gRNA sequence
gttttcctaaagtcgtattt

SEQ ID NO: 599494 - DNA, 20 bp, Artificial
  CRISPR gRNA sequence
tcctaaagtcgtatttggga

SEQ ID NO: 599495 - DNA, 20 bp, Artificial
  CRISPR gRNA sequence
agtcgtatttgggaaagtct

SEQ ID NO: 599496 - DNA, 20 bp, Artificial
  CRISPR gRNA sequence
cgtatttgggaaagtctgag

SEQ ID NO: 599497 - DNA, 20 bp, Artificial
  CRISPR gRNA sequence
tatttgggaaagtctgagta

SEQ ID NO: 599498 - DNA, 20 bp, Artificial
  CRISPR gRNA sequence
ggaaagtctgagtagagaac

SEQ ID NO: 599499 - DNA, 20 bp, Artificial
  CRISPR gRNA sequence
agtctgagtagagaaccagt

SEQ ID NO: 599500 - DNA, 20 bp, Artificial
  CRISPR gRNA sequence
agtcactctaatcatcccaa

SEQ ID NO: 599501 - DNA, 20 bp, Artificial
  CRISPR gRNA sequence
tcactctaatcatcccaaca

SEQ ID NO: 599502 - DNA, 20 bp, Artificial
  CRISPR gRNA sequence
actctaatcatcccaacaga

SEQ ID NO: 599503 - DNA, 20 bp, Artificial
  CRISPR gRNA sequence
ccaacagagagcaaatattt

SEQ ID NO: 599504 - DNA, 20 bp, Artificial
  CRISPR gRNA sequence
atgtaaatgcacaatatgta

SEQ ID NO: 599505 - DNA, 20 bp, Artificial
  CRISPR gRNA sequence
tgtaaatgcacaatatgtaa

SEQ ID NO: 599506 - DNA, 20 bp, Artificial
  CRISPR gRNA sequence
caatatgtaaaggataacat

SEQ ID NO: 599507 - DNA, 20 bp, Artificial
  CRISPR gRNA sequence
taagttctcgaaattgtcat

SEQ ID NO: 599508 - DNA, 20 bp, Artificial
  CRISPR gRNA sequence
ccttcctaaaaactgaacct

SEQ ID NO: 599509 - DNA, 20 bp, Artificial
  CRISPR gRNA sequence
aaaaactgaacctaagtgtt

SEQ ID NO: 599510 - DNA, 20 bp, Artificial
  CRISPR gRNA sequence
aaaactgaacctaagtgttt

SEQ ID NO: 599511 - DNA, 20 bp, Artificial
  CRISPR gRNA sequence
tttaggtatctgtactgtta

SEQ ID NO: 599512 - DNA, 20 bp, Artificial
  CRISPR gRNA sequence
taggtatctgtactgttaca

SEQ ID NO: 599513 - DNA, 20 bp, Artificial
  CRISPR gRNA sequence
atccttgaaaatatgaaata

SEQ ID NO: 599514 - DNA, 20 bp, Artificial
  CRISPR gRNA sequence
aaataaagataatcgaaatt

SEQ ID NO: 599515 - DNA, 20 bp, Artificial
  CRISPR gRNA sequence
aattaagatgaaatgtctga

SEQ ID NO: 599516 - DNA, 20 bp, Artificial
  CRISPR gRNA sequence
gtttacacaatgtaattatt

SEQ ID NO: 599517 - DNA, 20 bp, Artificial
  CRISPR gRNA sequence
tacacaatgtaattatttgg

SEQ ID NO: 599518 - DNA, 20 bp, Artificial
  CRISPR gRNA sequence
acaatgtaattatttggtag

SEQ ID NO: 599519 - DNA, 20 bp, Artificial
  CRISPR gRNA sequence
aatgtaattatttggtagaa

SEQ ID NO: 599520 - DNA, 20 bp, Artificial
  CRISPR gRNA sequence
atgtaattatttggtagaag

SEQ ID NO: 599521 - DNA, 20 bp, Artificial
  CRISPR gRNA sequence
ggatccattgtgaaatctta

SEQ ID NO: 599522 - DNA, 20 bp, Artificial
  CRISPR gRNA sequence
atcttaaagatacatcctca

SEQ ID NO: 599523 - DNA, 20 bp, Artificial
  CRISPR gRNA sequence
gatacatcctcacagttacc

SEQ ID NO: 599524 - DNA, 20 bp, Artificial
  CRISPR gRNA sequence
tcacagttaccaagttgatg

SEQ ID NO: 599525 - DNA, 20 bp, Artificial
  CRISPR gRNA sequence
gttgatgtagtccttgcccc

SEQ ID NO: 599526 - DNA, 20 bp, Artificial
  CRISPR gRNA sequence
tccttgcccctggtttattg

SEQ ID NO: 599527 - DNA, 20 bp, Artificial
  CRISPR gRNA sequence
tggtttattgaagcttaatt

SEQ ID NO: 599528 - DNA, 20 bp, Artificial
  CRISPR gRNA sequence
agcttaatttagcttccttg

SEQ ID NO: 599529 - DNA, 20 bp, Artificial
  CRISPR gRNA sequence
taatttagcttccttgaagc

SEQ ID NO: 599530 - DNA, 20 bp, Artificial
  CRISPR gRNA sequence
ccttgaagctggtccttttc

SEQ ID NO: 599531 - DNA, 20 bp, Artificial
  CRISPR gRNA sequence
ttgaagctggtccttttcaa

SEQ ID NO: 599532 - DNA, 20 bp, Artificial
  CRISPR gRNA sequence
tttcaagagttaactttcac

SEQ ID NO: 599533 - DNA, 20 bp, Artificial
  CRISPR gRNA sequence
gttaactttcactggctgcc

SEQ ID NO: 599534 - DNA, 20 bp, Artificial
  CRISPR gRNA sequence
ttcactggctgcctagtcac

SEQ ID NO: 599535 - DNA, 20 bp, Artificial
  CRISPR gRNA sequence
cactggctgcctagtcacca

SEQ ID NO: 599536 - DNA, 20 bp, Artificial
  CRISPR gRNA sequence
actggctgcctagtcaccag

SEQ ID NO: 599537 - DNA, 20 bp, Artificial
  CRISPR gRNA sequence
agaggcacactttctccctc

SEQ ID NO: 599538 - DNA, 20 bp, Artificial
  CRISPR gRNA sequence
ggcacactttctccctctag

SEQ ID NO: 599539 - DNA, 20 bp, Artificial
  CRISPR gRNA sequence
actttctccctctagtggct

SEQ ID NO: 599540 - DNA, 20 bp, Artificial
  CRISPR gRNA sequence
ctttctccctctagtggcta

SEQ ID NO: 599541 - DNA, 20 bp, Artificial
  CRISPR gRNA sequence
ccctctagtggctaaggctt

SEQ ID NO: 599542 - DNA, 20 bp, Artificial
  CRISPR gRNA sequence
tcaccctgcctccccctgaa

SEQ ID NO: 599543 - DNA, 20 bp, Artificial
  CRISPR gRNA sequence
gcctccccctgaatggatcc

SEQ ID NO: 599544 - DNA, 20 bp, Artificial
  CRISPR gRNA sequence
cctgaatggatcccagattt

SEQ ID NO: 599545 - DNA, 20 bp, Artificial
  CRISPR gRNA sequence
tcccagattttagaataaca

SEQ ID NO: 599546 - DNA, 20 bp, Artificial
  CRISPR gRNA sequence
acaaagatctcatgaccacc

SEQ ID NO: 599547 - DNA, 20 bp, Artificial
  CRISPR gRNA sequence
caaagatctcatgaccacct

SEQ ID NO: 599548 - DNA, 20 bp, Artificial
  CRISPR gRNA sequence
aagatctcatgaccacctgg

SEQ ID NO: 599549 - DNA, 20 bp, Artificial
  CRISPR gRNA sequence
tcatgaccacctgggagaat

SEQ ID NO: 599550 - DNA, 20 bp, Artificial
  CRISPR gRNA sequence
ctgggagaattggaccatct

SEQ ID NO: 599551 - DNA, 20 bp, Artificial
  CRISPR gRNA sequence
ctacattcctttcttatttg

SEQ ID NO: 599552 - DNA, 20 bp, Artificial
  CRISPR gRNA sequence
tacattcctttcttatttgc

SEQ ID NO: 599553 - DNA, 20 bp, Artificial
  CRISPR gRNA sequence
cctttcttatttgcaggtta

SEQ ID NO: 599554 - DNA, 20 bp, Artificial
  CRISPR gRNA sequence
tatggtgtatctaactcatc

SEQ ID NO: 599555 - DNA, 20 bp, Artificial
  CRISPR gRNA sequence
tggtgtatctaactcatcca

SEQ ID NO: 599556 - DNA, 20 bp, Artificial
  CRISPR gRNA sequence
ctaactcatccagagaaatc

SEQ ID NO: 599557 - DNA, 20 bp, Artificial
  CRISPR gRNA sequence
caagattatgttttcatacc

SEQ ID NO: 599558 - DNA, 20 bp, Artificial
  CRISPR gRNA sequence
ttatgttttcataccaagat

SEQ ID NO: 599559 - DNA, 20 bp, Artificial
  CRISPR gRNA sequence
tatgttttcataccaagatt

SEQ ID NO: 599560 - DNA, 20 bp, Artificial
  CRISPR gRNA sequence
atgttttcataccaagattg

SEQ ID NO: 599561 - DNA, 20 bp, Artificial
  CRISPR gRNA sequence
tgttttcataccaagattgg

SEQ ID NO: 599562 - DNA, 20 bp, Artificial
  CRISPR gRNA sequence
ggggttttatttcatgcctg

SEQ ID NO: 599563 - DNA, 20 bp, Artificial
  CRISPR gRNA sequence
ggttttatttcatgcctgtg

SEQ ID NO: 599564 - DNA, 20 bp, Artificial
  CRISPR gRNA sequence
tttcatgcctgtggagtcta

SEQ ID NO: 599565 - DNA, 20 bp, Artificial
  CRISPR gRNA sequence
cctgtggagtctatagtcct

SEQ ID NO: 599566 - DNA, 20 bp, Artificial
  CRISPR gRNA sequence
ttcacaatgcaatccactca

SEQ ID NO: 599567 - DNA, 20 bp, Artificial
  CRISPR gRNA sequence
tcacaatgcaatccactcat

SEQ ID NO: 599568 - DNA, 20 bp, Artificial
  CRISPR gRNA sequence
aatgcaatccactcatggga

SEQ ID NO: 599569 - DNA, 20 bp, Artificial
  CRISPR gRNA sequence
aaactgtaattcactttgtt

SEQ ID NO: 599570 - DNA, 20 bp, Artificial
  CRISPR gRNA sequence
cactttgttcagaatttctc

SEQ ID NO: 599571 - DNA, 20 bp, Artificial
  CRISPR gRNA sequence
actttgttcagaatttctct

SEQ ID NO: 599572 - DNA, 20 bp, Artificial
  CRISPR gRNA sequence
ttgttcagaatttctctggg

SEQ ID NO: 599573 - DNA, 20 bp, Artificial
  CRISPR gRNA sequence
ttttgtttgtttgttcgttt

SEQ ID NO: 599574 - DNA, 20 bp, Artificial
  CRISPR gRNA sequence
gttttggttttgtttttgtt

SEQ ID NO: 599575 - DNA, 20 bp, Artificial
  CRISPR gRNA sequence
tggttttgtttttgttgaga

SEQ ID NO: 599576 - DNA, 20 bp, Artificial
  CRISPR gRNA sequence
gttttgtttttgttgagaca

SEQ ID NO: 599577 - DNA, 20 bp, Artificial
  CRISPR gRNA sequence
cagagtctcactctgtcacc

SEQ ID NO: 599578 - DNA, 20 bp, Artificial
  CRISPR gRNA sequence
agagtctcactctgtcaccc

SEQ ID NO: 599579 - DNA, 20 bp, Artificial
  CRISPR gRNA sequence
tctcactctgtcacccaggc

SEQ ID NO: 599580 - DNA, 20 bp, Artificial
  CRISPR gRNA sequence
tcactctgtcacccaggctg

SEQ ID NO: 599581 - DNA, 20 bp, Artificial
  CRISPR gRNA sequence
ctgtcacccaggctggagtg

SEQ ID NO: 599582 - DNA, 20 bp, Artificial
  CRISPR gRNA sequence
tcacccaggctggagtgcag

SEQ ID NO: 599583 - DNA, 20 bp, Artificial
  CRISPR gRNA sequence
ggagtgcagtggcgccgtct

SEQ ID NO: 599584 - DNA, 20 bp, Artificial
  CRISPR gRNA sequence
tcactacaatctctgcttcc

SEQ ID NO: 599585 - DNA, 20 bp, Artificial
  CRISPR gRNA sequence
cactacaatctctgcttcct

SEQ ID NO: 599586 - DNA, 20 bp, Artificial
  CRISPR gRNA sequence
ttcatgcgattctcctgcct

SEQ ID NO: 599587 - DNA, 20 bp, Artificial
  CRISPR gRNA sequence
ttctcctgcctcagccttct

SEQ ID NO: 599588 - DNA, 20 bp, Artificial
  CRISPR gRNA sequence
tcctgcctcagccttctgag

SEQ ID NO: 599589 - DNA, 20 bp, Artificial
  CRISPR gRNA sequence
gcctcagccttctgagtagc

SEQ ID NO: 599590 - DNA, 20 bp, Artificial
  CRISPR gRNA sequence
cctcagccttctgagtagct

SEQ ID NO: 599591 - DNA, 20 bp, Artificial
  CRISPR gRNA sequence
cttctgagtagctgggatca

SEQ ID NO: 599592 - DNA, 20 bp, Artificial
  CRISPR gRNA sequence
ttctgagtagctgggatcac

SEQ ID NO: 599593 - DNA, 20 bp, Artificial
  CRISPR gRNA sequence
cgcctgtgatcccagctact

SEQ ID NO: 599594 - DNA, 20 bp, Artificial
  CRISPR gRNA sequence
ctgtgatcccagctactcag

SEQ ID NO: 599595 - DNA, 20 bp, Artificial
  CRISPR gRNA sequence
tgtgatcccagctactcaga

SEQ ID NO: 599596 - DNA, 20 bp, Artificial
  CRISPR gRNA sequence
tcccagctactcagaaggct

SEQ ID NO: 599597 - DNA, 20 bp, Artificial
  CRISPR gRNA sequence
cccagctactcagaaggctg

SEQ ID NO: 599598 - DNA, 20 bp, Artificial
  CRISPR gRNA sequence
agctactcagaaggctgagg

SEQ ID NO: 599599 - DNA, 20 bp, Artificial
  CRISPR gRNA sequence
gctactcagaaggctgaggc

SEQ ID NO: 599600 - DNA, 20 bp, Artificial
  CRISPR gRNA sequence
tactcagaaggctgaggcag

SEQ ID NO: 599601 - DNA, 20 bp, Artificial
  CRISPR gRNA sequence
gcaggagaatcgcatgaacc

SEQ ID NO: 599602 - DNA, 20 bp, Artificial
  CRISPR gRNA sequence
caggagaatcgcatgaaccc

SEQ ID NO: 599603 - DNA, 20 bp, Artificial
  CRISPR gRNA sequence
gagaatcgcatgaacccagg

SEQ ID NO: 599604 - DNA, 20 bp, Artificial
  CRISPR gRNA sequence
aatcgcatgaacccaggaag

SEQ ID NO: 599605 - DNA, 20 bp, Artificial
  CRISPR gRNA sequence
tcgcatgaacccaggaagca

SEQ ID NO: 599606 - DNA, 20 bp, Artificial
  CRISPR gRNA sequence
aacccaggaagcagagattg

SEQ ID NO: 599607 - DNA, 20 bp, Artificial
  CRISPR gRNA sequence
caggaagcagagattgtagt

SEQ ID NO: 599608 - DNA, 20 bp, Artificial
  CRISPR gRNA sequence
agcagagattgtagtgagcc

SEQ ID NO: 599609 - DNA, 20 bp, Artificial
  CRISPR gRNA sequence
gagattgtagtgagccgaga

SEQ ID NO: 599610 - DNA, 20 bp, Artificial
  CRISPR gRNA sequence
gagacggcgccactgcactc

SEQ ID NO: 599611 - DNA, 20 bp, Artificial
  CRISPR gRNA sequence
ggcgccactgcactccagcc

SEQ ID NO: 599612 - DNA, 20 bp, Artificial
  CRISPR gRNA sequence
gcgccactgcactccagcct

SEQ ID NO: 599613 - DNA, 20 bp, Artificial
  CRISPR gRNA sequence
ctgcactccagcctgggtga

SEQ ID NO: 599614 - DNA, 20 bp, Artificial
  CRISPR gRNA sequence
gcactccagcctgggtgaca

SEQ ID NO: 599615 - DNA, 20 bp, Artificial
  CRISPR gRNA sequence
tccagcctgggtgacagagt

SEQ ID NO: 599616 - DNA, 20 bp, Artificial
  CRISPR gRNA sequence
aacaaacaaacaaaactacc

SEQ ID NO: 599617 - DNA, 20 bp, Artificial
  CRISPR gRNA sequence
caaacaaacaaaactaccca

SEQ ID NO: 599618 - DNA, 20 bp, Artificial
  CRISPR gRNA sequence
acccagagaaattctgaaca

SEQ ID NO: 599619 - DNA, 20 bp, Artificial
  CRISPR gRNA sequence
attctgaacaaagtgaatta

SEQ ID NO: 599620 - DNA, 20 bp, Artificial
  CRISPR gRNA sequence
aagtgaattacagtttatgc

SEQ ID NO: 599621 - DNA, 20 bp, Artificial
  CRISPR gRNA sequence
agtgaattacagtttatgca

SEQ ID NO: 599622 - DNA, 20 bp, Artificial
  CRISPR gRNA sequence
gtgaattacagtttatgcaa

SEQ ID NO: 599623 - DNA, 20 bp, Artificial
  CRISPR gRNA sequence
atgcaagggttctttcccat

SEQ ID NO: 599624 - DNA, 20 bp, Artificial
  CRISPR gRNA sequence
caagggttctttcccatgag

SEQ ID NO: 599625 - DNA, 20 bp, Artificial
  CRISPR gRNA sequence
gtggattgcattgtgaatct

SEQ ID NO: 599626 - DNA, 20 bp, Artificial
  CRISPR gRNA sequence
tggattgcattgtgaatctt

SEQ ID NO: 599627 - DNA, 20 bp, Artificial
  CRISPR gRNA sequence
cattgtgaatcttaggacta

SEQ ID NO: 599628 - DNA, 20 bp, Artificial
  CRISPR gRNA sequence
tcttaggactatagactcca

SEQ ID NO: 599629 - DNA, 20 bp, Artificial
  CRISPR gRNA sequence
cttaggactatagactccac

SEQ ID NO: 599630 - DNA, 20 bp, Artificial
  CRISPR gRNA sequence
tgaaataaaacccccaatct

SEQ ID NO: 599631 - DNA, 20 bp, Artificial
  CRISPR gRNA sequence
aaacataatcttgatttctc

SEQ ID NO: 599632 - DNA, 20 bp, Artificial
  CRISPR gRNA sequence
taatcttgatttctctggat

SEQ ID NO: 599633 - DNA, 20 bp, Artificial
  CRISPR gRNA sequence
cttgatttctctggatgagt

SEQ ID NO: 599634 - DNA, 20 bp, Artificial
  CRISPR gRNA sequence
atacaccataacctgcaaat

SEQ ID NO: 599635 - DNA, 20 bp, Artificial
  CRISPR gRNA sequence
accataacctgcaaataaga

SEQ ID NO: 599636 - DNA, 20 bp, Artificial
  CRISPR gRNA sequence
ccataacctgcaaataagaa

SEQ ID NO: 599637 - DNA, 20 bp, Artificial
  CRISPR gRNA sequence
ctgcaaataagaaaggaatg

SEQ ID NO: 599638 - DNA, 20 bp, Artificial
  CRISPR gRNA sequence
tgcaaataagaaaggaatgt

SEQ ID NO: 599639 - DNA, 20 bp, Artificial
  CRISPR gRNA sequence
aaggaatgtaggatgttaaa

SEQ ID NO: 599640 - DNA, 20 bp, Artificial
  CRISPR gRNA sequence
ggaatgtaggatgttaaaaa

SEQ ID NO: 599641 - DNA, 20 bp, Artificial
  CRISPR gRNA sequence
gaatgtaggatgttaaaaag

SEQ ID NO: 599642 - DNA, 20 bp, Artificial
  CRISPR gRNA sequence
aatgtaggatgttaaaaaga

SEQ ID NO: 599643 - DNA, 20 bp, Artificial
  CRISPR gRNA sequence
aaaagagggaaacatttgcc

SEQ ID NO: 599644 - DNA, 20 bp, Artificial
  CRISPR gRNA sequence
gagggaaacatttgccaaga

SEQ ID NO: 599645 - DNA, 20 bp, Artificial
  CRISPR gRNA sequence
ccaagatggtccaattctcc

SEQ ID NO: 599646 - DNA, 20 bp, Artificial
  CRISPR gRNA sequence
caagatggtccaattctccc

SEQ ID NO: 599647 - DNA, 20 bp, Artificial
  CRISPR gRNA sequence
gatggtccaattctcccagg

SEQ ID NO: 599648 - DNA, 20 bp, Artificial
  CRISPR gRNA sequence
caattctcccaggtggtcat

SEQ ID NO: 599649 - DNA, 20 bp, Artificial
  CRISPR gRNA sequence
atctttgttattctaaaatc

SEQ ID NO: 599650 - DNA, 20 bp, Artificial
  CRISPR gRNA sequence
tctttgttattctaaaatct

SEQ ID NO: 599651 - DNA, 20 bp, Artificial
  CRISPR gRNA sequence
tctaaaatctgggatccatt

SEQ ID NO: 599652 - DNA, 20 bp, Artificial
  CRISPR gRNA sequence
ctaaaatctgggatccattc

SEQ ID NO: 599653 - DNA, 20 bp, Artificial
  CRISPR gRNA sequence
taaaatctgggatccattca

SEQ ID NO: 599654 - DNA, 20 bp, Artificial
  CRISPR gRNA sequence
aaaatctgggatccattcag

SEQ ID NO: 599655 - DNA, 20 bp, Artificial
  CRISPR gRNA sequence
aaatctgggatccattcagg

SEQ ID NO: 599656 - DNA, 20 bp, Artificial
  CRISPR gRNA sequence
atctgggatccattcagggg

SEQ ID NO: 599657 - DNA, 20 bp, Artificial
  CRISPR gRNA sequence
tctgggatccattcaggggg

SEQ ID NO: 599658 - DNA, 20 bp, Artificial
  CRISPR gRNA sequence
gggatccattcagggggagg

SEQ ID NO: 599659 - DNA, 20 bp, Artificial
  CRISPR gRNA sequence
ggatccattcagggggaggc

SEQ ID NO: 599660 - DNA, 20 bp, Artificial
  CRISPR gRNA sequence
gatccattcagggggaggca

SEQ ID NO: 599661 - DNA, 20 bp, Artificial
  CRISPR gRNA sequence
ttcagggggaggcagggtga

SEQ ID NO: 599662 - DNA, 20 bp, Artificial
  CRISPR gRNA sequence
ggaggcagggtgacagaatg

SEQ ID NO: 599663 - DNA, 20 bp, Artificial
  CRISPR gRNA sequence
gtgacagaatgtagtgtctg

SEQ ID NO: 599664 - DNA, 20 bp, Artificial
  CRISPR gRNA sequence
gaatgtagtgtctgaagcct

SEQ ID NO: 599665 - DNA, 20 bp, Artificial
  CRISPR gRNA sequence
gtgtctgaagccttagccac

SEQ ID NO: 599666 - DNA, 20 bp, Artificial
  CRISPR gRNA sequence
gtctgaagccttagccacta

SEQ ID NO: 599667 - DNA, 20 bp, Artificial
  CRISPR gRNA sequence
tctgaagccttagccactag

SEQ ID NO: 599668 - DNA, 20 bp, Artificial
  CRISPR gRNA sequence
ctgaagccttagccactaga

SEQ ID NO: 599669 - DNA, 20 bp, Artificial
  CRISPR gRNA sequence
gaagccttagccactagagg

SEQ ID NO: 599670 - DNA, 20 bp, Artificial
  CRISPR gRNA sequence
ccttagccactagagggaga

SEQ ID NO: 599671 - DNA, 20 bp, Artificial
  CRISPR gRNA sequence
agagggagaaagtgtgcctc

SEQ ID NO: 599672 - DNA, 20 bp, Artificial
  CRISPR gRNA sequence
gaaagtgtgcctctggtgac

SEQ ID NO: 599673 - DNA, 20 bp, Artificial
  CRISPR gRNA sequence
aaagtgtgcctctggtgact

SEQ ID NO: 599674 - DNA, 20 bp, Artificial
  CRISPR gRNA sequence
gtgtgcctctggtgactagg

SEQ ID NO: 599675 - DNA, 20 bp, Artificial
  CRISPR gRNA sequence
gcctctggtgactaggcagc

SEQ ID NO: 599676 - DNA, 20 bp, Artificial
  CRISPR gRNA sequence
ggtgactaggcagccagtga

SEQ ID NO: 599677 - DNA, 20 bp, Artificial
  CRISPR gRNA sequence
agtgaaagttaactcttgaa

SEQ ID NO: 599678 - DNA, 20 bp, Artificial
  CRISPR gRNA sequence
gtgaaagttaactcttgaaa

SEQ ID NO: 599679 - DNA, 20 bp, Artificial
  CRISPR gRNA sequence
agttaactcttgaaaaggac

SEQ ID NO: 599680 - DNA, 20 bp, Artificial
  CRISPR gRNA sequence
tcttgaaaaggaccagcttc

SEQ ID NO: 599681 - DNA, 20 bp, Artificial
  CRISPR gRNA sequence
cttgaaaaggaccagcttca

SEQ ID NO: 599682 - DNA, 20 bp, Artificial
  CRISPR gRNA sequence
gaaaaggaccagcttcaagg

SEQ ID NO: 599683 - DNA, 20 bp, Artificial
  CRISPR gRNA sequence
agcttcaaggaagctaaatt

SEQ ID NO: 599684 - DNA, 20 bp, Artificial
  CRISPR gRNA sequence
taaattaagcttcaataaac

SEQ ID NO: 599685 - DNA, 20 bp, Artificial
  CRISPR gRNA sequence
aaattaagcttcaataaacc

SEQ ID NO: 599686 - DNA, 20 bp, Artificial
  CRISPR gRNA sequence
aattaagcttcaataaacca

SEQ ID NO: 599687 - DNA, 20 bp, Artificial
  CRISPR gRNA sequence
attaagcttcaataaaccag

SEQ ID NO: 599688 - DNA, 20 bp, Artificial
  CRISPR gRNA sequence
agcttcaataaaccaggggc

SEQ ID NO: 599689 - DNA, 20 bp, Artificial
  CRISPR gRNA sequence
gcttcaataaaccaggggca

SEQ ID NO: 599690 - DNA, 20 bp, Artificial
  CRISPR gRNA sequence
gggcaaggactacatcaact

SEQ ID NO: 599691 - DNA, 20 bp, Artificial
  CRISPR gRNA sequence
tacatcaacttggtaactgt

SEQ ID NO: 599692 - DNA, 20 bp, Artificial
  CRISPR gRNA sequence
acatcaacttggtaactgtg

SEQ ID NO: 599693 - DNA, 20 bp, Artificial
  CRISPR gRNA sequence
aactgtgaggatgtatcttt

SEQ ID NO: 599694 - DNA, 20 bp, Artificial
  CRISPR gRNA sequence
gtatctttaagatttcacaa

SEQ ID NO: 599695 - DNA, 20 bp, Artificial
  CRISPR gRNA sequence
aattacattgtgtaaactat

SEQ ID NO: 599696 - DNA, 20 bp, Artificial
  CRISPR gRNA sequence
tatctttatttcatattttc

SEQ ID NO: 599697 - DNA, 20 bp, Artificial
  CRISPR gRNA sequence
atctttatttcatattttca

SEQ ID NO: 599698 - DNA, 20 bp, Artificial
  CRISPR gRNA sequence
attttcaaggatctctgtaa

SEQ ID NO: 599699 - DNA, 20 bp, Artificial
  CRISPR gRNA sequence
caaggatctctgtaacagta

SEQ ID NO: 599700 - DNA, 20 bp, Artificial
  CRISPR gRNA sequence
agtacagatacctaaacact

SEQ ID NO: 599701 - DNA, 20 bp, Artificial
  CRISPR gRNA sequence
gtacagatacctaaacactt

SEQ ID NO: 599702 - DNA, 20 bp, Artificial
  CRISPR gRNA sequence
gatacctaaacacttaggtt

SEQ ID NO: 599703 - DNA, 20 bp, Artificial
  CRISPR gRNA sequence
aaacacttaggttcagtttt

SEQ ID NO: 599704 - DNA, 20 bp, Artificial
  CRISPR gRNA sequence
aacacttaggttcagttttt

SEQ ID NO: 599705 - DNA, 20 bp, Artificial
  CRISPR gRNA sequence
acttaggttcagtttttagg

SEQ ID NO: 599706 - DNA, 20 bp, Artificial
  CRISPR gRNA sequence
cttaggttcagtttttagga

SEQ ID NO: 599707 - DNA, 20 bp, Artificial
  CRISPR gRNA sequence
gaaggacttatgacaatttc

SEQ ID NO: 599708 - DNA, 20 bp, Artificial
  CRISPR gRNA sequence
tacatattataaacgacata

SEQ ID NO: 599709 - DNA, 20 bp, Artificial
  CRISPR gRNA sequence
aaacgacatacagatttttt

SEQ ID NO: 599710 - DNA, 20 bp, Artificial
  CRISPR gRNA sequence
aacgacatacagattttttg

SEQ ID NO: 599711 - DNA, 20 bp, Artificial
  CRISPR gRNA sequence
cagattttttgaggtaattt

SEQ ID NO: 599712 - DNA, 20 bp, Artificial
  CRISPR gRNA sequence
ctaaaatatttgctctctgt

SEQ ID NO: 599713 - DNA, 20 bp, Artificial
  CRISPR gRNA sequence
taaaatatttgctctctgtt

SEQ ID NO: 599714 - DNA, 20 bp, Artificial
  CRISPR gRNA sequence
ttgctctctgttgggatgat

SEQ ID NO: 599715 - DNA, 20 bp, Artificial
  CRISPR gRNA sequence
gctctctgttgggatgatta

SEQ ID NO: 599716 - DNA, 20 bp, Artificial
  CRISPR gRNA sequence
ggatgattagagtgacttac

SEQ ID NO: 599717 - DNA, 20 bp, Artificial
  CRISPR gRNA sequence
tgacttactggttctctact

SEQ ID NO: 599718 - DNA, 20 bp, Artificial
  CRISPR gRNA sequence
gactttcccaaatacgactt

SEQ ID NO: 599719 - DNA, 20 bp, Artificial
  CRISPR gRNA sequence
actttcccaaatacgacttt

SEQ ID NO: 599720 - DNA, 20 bp, Artificial
  CRISPR gRNA sequence
gactttaggaaaactaattt

SEQ ID NO: 599721 - DNA, 20 bp, Artificial
  CRISPR gRNA sequence
gaaaactaattttagcaact

SEQ ID NO: 599722 - DNA, 20 bp, Artificial
  CRISPR gRNA sequence
ccttatcaatatataactca

SEQ ID NO: 599723 - DNA, 20 bp, Artificial
  CRISPR gRNA sequence
cttatcaatatataactcac

SEQ ID NO: 599724 - DNA, 20 bp, Artificial
  CRISPR gRNA sequence
aatcatcataatgttattgc

SEQ ID NO: 599725 - DNA, 20 bp, Artificial
  CRISPR gRNA sequence
cataatgttattgcaagcct

SEQ ID NO: 599726 - DNA, 20 bp, Artificial
  CRISPR gRNA sequence
acactatctaccattttcta

SEQ ID NO: 599727 - DNA, 20 bp, Artificial
  CRISPR gRNA sequence
attttctatagttaaacaaa

SEQ ID NO: 599728 - DNA, 20 bp, Artificial
  CRISPR gRNA sequence
tttctatagttaaacaaaaa

SEQ ID NO: 599729 - DNA, 20 bp, Artificial
  CRISPR gRNA sequence
ttgtttaataatacattgta

SEQ ID NO: 599730 - DNA, 20 bp, Artificial
  CRISPR gRNA sequence
tgtttaataatacattgtat

SEQ ID NO: 599731 - DNA, 20 bp, Artificial
  CRISPR gRNA sequence
gtataggaaaaaaaactttc

SEQ ID NO: 599732 - DNA, 20 bp, Artificial
  CRISPR gRNA sequence
taggaaaaaaaactttcaag

SEQ ID NO: 599733 - DNA, 20 bp, Artificial
  CRISPR gRNA sequence
caagaagtaattcattataa

SEQ ID NO: 599734 - DNA, 20 bp, Artificial
  CRISPR gRNA sequence
gtaattcattataaaagcta

SEQ ID NO: 599735 - DNA, 20 bp, Artificial
  CRISPR gRNA sequence
taaaagctacagtatcacac

SEQ ID NO: 599736 - DNA, 20 bp, Artificial
  CRISPR gRNA sequence
acagtatcacacaagttata

SEQ ID NO: 599737 - DNA, 20 bp, Artificial
  CRISPR gRNA sequence
cttccctatatcaaaatgta

SEQ ID NO: 599738 - DNA, 20 bp, Artificial
  CRISPR gRNA sequence
ctatatcaaaatgtaaagaa

SEQ ID NO: 599739 - DNA, 20 bp, Artificial
  CRISPR gRNA sequence
acactatccaaaattaccta

SEQ ID NO: 599740 - DNA, 20 bp, Artificial
  CRISPR gRNA sequence
actatccaaaattacctaca

SEQ ID NO: 599741 - DNA, 20 bp, Artificial
  CRISPR gRNA sequence
atccaaaattacctacagag

SEQ ID NO: 599742 - DNA, 20 bp, Artificial
  CRISPR gRNA sequence
ttacctacagagtggtgctt

SEQ ID NO: 599743 - DNA, 20 bp, Artificial
  CRISPR gRNA sequence
tacctacagagtggtgctta

SEQ ID NO: 599744 - DNA, 20 bp, Artificial
  CRISPR gRNA sequence
tccaatatatctttttttct

SEQ ID NO: 599745 - DNA, 20 bp, Artificial
  CRISPR gRNA sequence
aatatatctttttttctcag

SEQ ID NO: 599746 - DNA, 20 bp, Artificial
  CRISPR gRNA sequence
aaaacctcaacaactatttc

SEQ ID NO: 599747 - DNA, 20 bp, Artificial
  CRISPR gRNA sequence
aaacctcaacaactatttct

SEQ ID NO: 599748 - DNA, 20 bp, Artificial
  CRISPR gRNA sequence
actatttctgggattcttca

SEQ ID NO: 599749 - DNA, 20 bp, Artificial
  CRISPR gRNA sequence
ctatttctgggattcttcaa

SEQ ID NO: 599750 - DNA, 20 bp, Artificial
  CRISPR gRNA sequence
atttctgggattcttcaaag

SEQ ID NO: 599751 - DNA, 20 bp, Artificial
  CRISPR gRNA sequence
ctgggattcttcaaaggagt

SEQ ID NO: 599752 - DNA, 20 bp, Artificial
  CRISPR gRNA sequence
gggattcttcaaaggagtaa

SEQ ID NO: 599753 - DNA, 20 bp, Artificial
  CRISPR gRNA sequence
tcttcaaaggagtaagagta

SEQ ID NO: 599754 - DNA, 20 bp, Artificial
  CRISPR gRNA sequence
ggtgcctgttccgactcttc

SEQ ID NO: 599755 - DNA, 20 bp, Artificial
  CRISPR gRNA sequence
tttcttcacaatctgtgata

SEQ ID NO: 599756 - DNA, 20 bp, Artificial
  CRISPR gRNA sequence
caatctgtgatatggtttct

SEQ ID NO: 599757 - DNA, 20 bp, Artificial
  CRISPR gRNA sequence
aatctgtgatatggtttctc

SEQ ID NO: 599758 - DNA, 20 bp, Artificial
  CRISPR gRNA sequence
ggtttctcaggaacaccgtt

SEQ ID NO: 599759 - DNA, 20 bp, Artificial
  CRISPR gRNA sequence
ttctcaggaacaccgtttgg

SEQ ID NO: 599760 - DNA, 20 bp, Artificial
  CRISPR gRNA sequence
tttcatgtgttttcaaattt

SEQ ID NO: 599761 - DNA, 20 bp, Artificial
  CRISPR gRNA sequence
gttttcaaatttcagccatc

SEQ ID NO: 599762 - DNA, 20 bp, Artificial
  CRISPR gRNA sequence
tttcagccatccagactaca

SEQ ID NO: 599763 - DNA, 20 bp, Artificial
  CRISPR gRNA sequence
actacacagttcactatttt

SEQ ID NO: 599764 - DNA, 20 bp, Artificial
  CRISPR gRNA sequence
tttccttttccctttaatta

SEQ ID NO: 599765 - DNA, 20 bp, Artificial
  CRISPR gRNA sequence
ccttttccctttaattatag

SEQ ID NO: 599766 - DNA, 20 bp, Artificial
  CRISPR gRNA sequence
attccctcttttcgcaaatg

SEQ ID NO: 599767 - DNA, 20 bp, Artificial
  CRISPR gRNA sequence
cctcttttcgcaaatgtggt

SEQ ID NO: 599768 - DNA, 20 bp, Artificial
  CRISPR gRNA sequence
ctcttttcgcaaatgtggtc

SEQ ID NO: 599769 - DNA, 20 bp, Artificial
  CRISPR gRNA sequence
tttcgcaaatgtggtcagga

SEQ ID NO: 599770 - DNA, 20 bp, Artificial
  CRISPR gRNA sequence
atactaaatgctactatttg

SEQ ID NO: 599771 - DNA, 20 bp, Artificial
  CRISPR gRNA sequence
taaatgctactatttgtaga

SEQ ID NO: 599772 - DNA, 20 bp, Artificial
  CRISPR gRNA sequence
tgcatttgtttttctcttga

SEQ ID NO: 599773 - DNA, 20 bp, Artificial
  CRISPR gRNA sequence
tttctcttgacggttcactt

SEQ ID NO: 599774 - DNA, 20 bp, Artificial
  CRISPR gRNA sequence
taagttctttccaaataaac

SEQ ID NO: 599775 - DNA, 20 bp, Artificial
  CRISPR gRNA sequence
ctttccaaataaacaagctg

SEQ ID NO: 599776 - DNA, 20 bp, Artificial
  CRISPR gRNA sequence
aataaacaagctgtggttga

SEQ ID NO: 599777 - DNA, 20 bp, Artificial
  CRISPR gRNA sequence
caagctgtggttgatagtga

SEQ ID NO: 599778 - DNA, 20 bp, Artificial
  CRISPR gRNA sequence
aagctgtggttgatagtgat

SEQ ID NO: 599779 - DNA, 20 bp, Artificial
  CRISPR gRNA sequence
atagtgataggtaacacttc

SEQ ID NO: 599780 - DNA, 20 bp, Artificial
  CRISPR gRNA sequence
tagtgataggtaacacttca

SEQ ID NO: 599781 - DNA, 20 bp, Artificial
  CRISPR gRNA sequence
agtgataggtaacacttcaa

SEQ ID NO: 599782 - DNA, 20 bp, Artificial
  CRISPR gRNA sequence
gataggtaacacttcaaggg

SEQ ID NO: 599783 - DNA, 20 bp, Artificial
  CRISPR gRNA sequence
ctcatccgttcctttgactt

SEQ ID NO: 599784 - DNA, 20 bp, Artificial
  CRISPR gRNA sequence
atccgttcctttgactttgg

SEQ ID NO: 599785 - DNA, 20 bp, Artificial
  CRISPR gRNA sequence
tcctttgactttggaagacg

SEQ ID NO: 599786 - DNA, 20 bp, Artificial
  CRISPR gRNA sequence
ggaagacgtggcacatgccc

SEQ ID NO: 599787 - DNA, 20 bp, Artificial
  CRISPR gRNA sequence
gaagacgtggcacatgcccc

SEQ ID NO: 599788 - DNA, 20 bp, Artificial
  CRISPR gRNA sequence
aagacgtggcacatgccccg

SEQ ID NO: 599789 - DNA, 20 bp, Artificial
  CRISPR gRNA sequence
agacgtggcacatgccccgg

SEQ ID NO: 599790 - DNA, 20 bp, Artificial
  CRISPR gRNA sequence
acgtggcacatgccccgggg

SEQ ID NO: 599791 - DNA, 20 bp, Artificial
  CRISPR gRNA sequence
cacatgccccgggggagaaa

SEQ ID NO: 599792 - DNA, 20 bp, Artificial
  CRISPR gRNA sequence
tgccccgggggagaaaaagc

SEQ ID NO: 599793 - DNA, 20 bp, Artificial
  CRISPR gRNA sequence
gaaaaagcaagtcaacactt

SEQ ID NO: 599794 - DNA, 20 bp, Artificial
  CRISPR gRNA sequence
tttttaaacttgcactgtta

SEQ ID NO: 599795 - DNA, 20 bp, Artificial
  CRISPR gRNA sequence
ctgttaaagcactttcaaaa

SEQ ID NO: 599796 - DNA, 20 bp, Artificial
  CRISPR gRNA sequence
aagcactttcaaaatagtaa

SEQ ID NO: 599797 - DNA, 20 bp, Artificial
  CRISPR gRNA sequence
ctttcaaaatagtaatagtt

SEQ ID NO: 599798 - DNA, 20 bp, Artificial
  CRISPR gRNA sequence
gtaatagttgagcttcatct

SEQ ID NO: 599799 - DNA, 20 bp, Artificial
  CRISPR gRNA sequence
tcagacatgaatgtctttct

SEQ ID NO: 599800 - DNA, 20 bp, Artificial
  CRISPR gRNA sequence
gtctttctcagtctattccc

SEQ ID NO: 599801 - DNA, 20 bp, Artificial
  CRISPR gRNA sequence
tctttctcagtctattcccc

SEQ ID NO: 599802 - DNA, 20 bp, Artificial
  CRISPR gRNA sequence
ggacccctcttatcccgctt

SEQ ID NO: 599803 - DNA, 20 bp, Artificial
  CRISPR gRNA sequence
gacccctcttatcccgcttc

SEQ ID NO: 599804 - DNA, 20 bp, Artificial
  CRISPR gRNA sequence
tcttatcccgcttcaggtcc

SEQ ID NO: 599805 - DNA, 20 bp, Artificial
  CRISPR gRNA sequence
gcttcaggtcccggtcaatg

SEQ ID NO: 599806 - DNA, 20 bp, Artificial
  CRISPR gRNA sequence
atgcggtgcgctttccgaaa

SEQ ID NO: 599807 - DNA, 20 bp, Artificial
  CRISPR gRNA sequence
tgcggtgcgctttccgaaat

SEQ ID NO: 599808 - DNA, 20 bp, Artificial
  CRISPR gRNA sequence
gcggtgcgctttccgaaatg

SEQ ID NO: 599809 - DNA, 20 bp, Artificial
  CRISPR gRNA sequence
cgctttccgaaatggggccg

SEQ ID NO: 599810 - DNA, 20 bp, Artificial
  CRISPR gRNA sequence
ctttccgaaatggggccgca

SEQ ID NO: 599811 - DNA, 20 bp, Artificial
  CRISPR gRNA sequence
aaatggggccgcagagttgc

SEQ ID NO: 599812 - DNA, 20 bp, Artificial
  CRISPR gRNA sequence
tggggccgcagagttgccgg

SEQ ID NO: 599813 - DNA, 20 bp, Artificial
  CRISPR gRNA sequence
gggccgcagagttgccggcg

SEQ ID NO: 599814 - DNA, 20 bp, Artificial
  CRISPR gRNA sequence
gcagagttgccggcggagac

SEQ ID NO: 599815 - DNA, 20 bp, Artificial
  CRISPR gRNA sequence
gagttgccggcggagaccag

SEQ ID NO: 599816 - DNA, 20 bp, Artificial
  CRISPR gRNA sequence
agttgccggcggagaccagt

SEQ ID NO: 599817 - DNA, 20 bp, Artificial
  CRISPR gRNA sequence
tgccggcggagaccagtagg

SEQ ID NO: 599818 - DNA, 20 bp, Artificial
  CRISPR gRNA sequence
gccggcggagaccagtaggt

SEQ ID NO: 599819 - DNA, 20 bp, Artificial
  CRISPR gRNA sequence
cggcggagaccagtaggtgg

SEQ ID NO: 599820 - DNA, 20 bp, Artificial
  CRISPR gRNA sequence
ggcggagaccagtaggtggg

SEQ ID NO: 599821 - DNA, 20 bp, Artificial
  CRISPR gRNA sequence
tccacgcacactccccgact

SEQ ID NO: 599822 - DNA, 20 bp, Artificial
  CRISPR gRNA sequence
cgcacactccccgactcggc

SEQ ID NO: 599823 - DNA, 20 bp, Artificial
  CRISPR gRNA sequence
gcacactccccgactcggcc

SEQ ID NO: 599824 - DNA, 20 bp, Artificial
  CRISPR gRNA sequence
tccccgactcggccgggacg

SEQ ID NO: 599825 - DNA, 20 bp, Artificial
  CRISPR gRNA sequence
ctcggccgggacgcggctcc

SEQ ID NO: 599826 - DNA, 20 bp, Artificial
  CRISPR gRNA sequence
cgcggctcccggactccgcg

SEQ ID NO: 599827 - DNA, 20 bp, Artificial
  CRISPR gRNA sequence
gcggctcccggactccgcgc

SEQ ID NO: 599828 - DNA, 20 bp, Artificial
  CRISPR gRNA sequence
cggctcccggactccgcgca

SEQ ID NO: 599829 - DNA, 20 bp, Artificial
  CRISPR gRNA sequence
cggactccgcgcagggcgcc

SEQ ID NO: 599830 - DNA, 20 bp, Artificial
  CRISPR gRNA sequence
gccgccccgctcccttcccc

SEQ ID NO: 599831 - DNA, 20 bp, Artificial
  CRISPR gRNA sequence
cccggcctccccaccaatcc

SEQ ID NO: 599832 - DNA, 20 bp, Artificial
  CRISPR gRNA sequence
ccccaccaatcccagtttga

SEQ ID NO: 599833 - DNA, 20 bp, Artificial
  CRISPR gRNA sequence
gtttgaaagaaaacttcacg

SEQ ID NO: 599834 - DNA, 20 bp, Artificial
  CRISPR gRNA sequence
gaacgtcacctcaccgctcc

SEQ ID NO: 599835 - DNA, 20 bp, Artificial
  CRISPR gRNA sequence
acctcaccgctccaagcctc

SEQ ID NO: 599836 - DNA, 20 bp, Artificial
  CRISPR gRNA sequence
caccgctccaagcctccagc

SEQ ID NO: 599837 - DNA, 20 bp, Artificial
  CRISPR gRNA sequence
cgctccaagcctccagccgg

SEQ ID NO: 599838 - DNA, 20 bp, Artificial
  CRISPR gRNA sequence
ctccagccggcagaaaacgt

SEQ ID NO: 599839 - DNA, 20 bp, Artificial
  CRISPR gRNA sequence
acgtgagatttattatgaca

SEQ ID NO: 599840 - DNA, 20 bp, Artificial
  CRISPR gRNA sequence
cgtgagatttattatgacac

SEQ ID NO: 599841 - DNA, 20 bp, Artificial
  CRISPR gRNA sequence
gtgagatttattatgacacg

SEQ ID NO: 599842 - DNA, 20 bp, Artificial
  CRISPR gRNA sequence
gagatttattatgacacggg

SEQ ID NO: 599843 - DNA, 20 bp, Artificial
  CRISPR gRNA sequence
agatttattatgacacgggg

SEQ ID NO: 599844 - DNA, 20 bp, Artificial
  CRISPR gRNA sequence
gatttattatgacacgggga

SEQ ID NO: 599845 - DNA, 20 bp, Artificial
  CRISPR gRNA sequence
atttattatgacacggggag

SEQ ID NO: 599846 - DNA, 20 bp, Artificial
  CRISPR gRNA sequence
ttattatgacacggggaggg

SEQ ID NO: 599847 - DNA, 20 bp, Artificial
  CRISPR gRNA sequence
tatgacacggggaggggaga

SEQ ID NO: 599848 - DNA, 20 bp, Artificial
  CRISPR gRNA sequence
atgacacggggaggggagat

SEQ ID NO: 599849 - DNA, 20 bp, Artificial
  CRISPR gRNA sequence
tgacacggggaggggagatg

SEQ ID NO: 599850 - DNA, 20 bp, Artificial
  CRISPR gRNA sequence
gacacggggaggggagatgg

SEQ ID NO: 599851 - DNA, 20 bp, Artificial
  CRISPR gRNA sequence
aggggagatgggggtcgccg

SEQ ID NO: 599852 - DNA, 20 bp, Artificial
  CRISPR gRNA sequence
gggggtcgccgtggcacact

SEQ ID NO: 599853 - DNA, 20 bp, Artificial
  CRISPR gRNA sequence
ggtcgccgtggcacactcgg

SEQ ID NO: 599854 - DNA, 20 bp, Artificial
  CRISPR gRNA sequence
cgccgtggcacactcggaag

SEQ ID NO: 599855 - DNA, 20 bp, Artificial
  CRISPR gRNA sequence
gccgtggcacactcggaagc

SEQ ID NO: 599856 - DNA, 20 bp, Artificial
  CRISPR gRNA sequence
acactcggaagcgggttacc

SEQ ID NO: 599857 - DNA, 20 bp, Artificial
  CRISPR gRNA sequence
gcgggttacctggcccccgt

SEQ ID NO: 599858 - DNA, 20 bp, Artificial
  CRISPR gRNA sequence
cgggttacctggcccccgtc

SEQ ID NO: 599859 - DNA, 20 bp, Artificial
  CRISPR gRNA sequence
gggttacctggcccccgtcg

SEQ ID NO: 599860 - DNA, 20 bp, Artificial
  CRISPR gRNA sequence
ggttacctggcccccgtcgg

SEQ ID NO: 599861 - DNA, 20 bp, Artificial
  CRISPR gRNA sequence
tacctggcccccgtcggggg

SEQ ID NO: 599862 - DNA, 20 bp, Artificial
  CRISPR gRNA sequence
acctggcccccgtcgggggc

SEQ ID NO: 599863 - DNA, 20 bp, Artificial
  CRISPR gRNA sequence
cctggcccccgtcgggggcg

SEQ ID NO: 599864 - DNA, 20 bp, Artificial
  CRISPR gRNA sequence
cccgtcgggggcggggtccg

SEQ ID NO: 599865 - DNA, 20 bp, Artificial
  CRISPR gRNA sequence
cgggggcggggtccgcagtc

SEQ ID NO: 599866 - DNA, 20 bp, Artificial
  CRISPR gRNA sequence
gggggcggggtccgcagtcc

SEQ ID NO: 599867 - DNA, 20 bp, Artificial
  CRISPR gRNA sequence
ggggcggggtccgcagtccg

SEQ ID NO: 599868 - DNA, 20 bp, Artificial
  CRISPR gRNA sequence
gtccgcagtccggggaccaa

SEQ ID NO: 599869 - DNA, 20 bp, Artificial
  CRISPR gRNA sequence
tccgcagtccggggaccaac

SEQ ID NO: 599870 - DNA, 20 bp, Artificial
  CRISPR gRNA sequence
cagtccggggaccaacgggc

SEQ ID NO: 599871 - DNA, 20 bp, Artificial
  CRISPR gRNA sequence
agtccggggaccaacgggct

SEQ ID NO: 599872 - DNA, 20 bp, Artificial
  CRISPR gRNA sequence
gtccggggaccaacgggctg

SEQ ID NO: 599873 - DNA, 20 bp, Artificial
  CRISPR gRNA sequence
tccggggaccaacgggctgg

SEQ ID NO: 599874 - DNA, 20 bp, Artificial
  CRISPR gRNA sequence
ccaacgggctgggggcgacg

SEQ ID NO: 599875 - DNA, 20 bp, Artificial
  CRISPR gRNA sequence
cgggctgggggcgacgcggc

SEQ ID NO: 599876 - DNA, 20 bp, Artificial
  CRISPR gRNA sequence
gggctgggggcgacgcggcc

SEQ ID NO: 599877 - DNA, 20 bp, Artificial
  CRISPR gRNA sequence
gggcgacgcggccgggcgcg

SEQ ID NO: 599878 - DNA, 20 bp, Artificial
  CRISPR gRNA sequence
ggcgacgcggccgggcgcgc

SEQ ID NO: 599879 - DNA, 20 bp, Artificial
  CRISPR gRNA sequence
gacgcggccgggcgcgcggg

SEQ ID NO: 599880 - DNA, 20 bp, Artificial
  CRISPR gRNA sequence
acgcggccgggcgcgcgggt

SEQ ID NO: 599881 - DNA, 20 bp, Artificial
  CRISPR gRNA sequence
ccgggcgcgcgggtgggcgc

SEQ ID NO: 599882 - DNA, 20 bp, Artificial
  CRISPR gRNA sequence
cgggcgcgcgggtgggcgcg

SEQ ID NO: 599883 - DNA, 20 bp, Artificial
  CRISPR gRNA sequence
gggcgcgcgggtgggcgcga

SEQ ID NO: 599884 - DNA, 20 bp, Artificial
  CRISPR gRNA sequence
gcgcgcgggtgggcgcgagg

SEQ ID NO: 599885 - DNA, 20 bp, Artificial
  CRISPR gRNA sequence
gcgagggagtgcgcgcgtcg

SEQ ID NO: 599886 - DNA, 20 bp, Artificial
  CRISPR gRNA sequence
gagggagtgcgcgcgtcgcg

SEQ ID NO: 599887 - DNA, 20 bp, Artificial
  CRISPR gRNA sequence
tgcgcgcgtcgcggagcctc

SEQ ID NO: 599888 - DNA, 20 bp, Artificial
  CRISPR gRNA sequence
gcgcgcgtcgcggagcctcc

SEQ ID NO: 599889 - DNA, 20 bp, Artificial
  CRISPR gRNA sequence
cgcgcgtcgcggagcctccg

SEQ ID NO: 599890 - DNA, 20 bp, Artificial
  CRISPR gRNA sequence
gcgtcgcggagcctccgggg

SEQ ID NO: 599891 - DNA, 20 bp, Artificial
  CRISPR gRNA sequence
ttgtcctgtaatcgattgcc

SEQ ID NO: 599892 - DNA, 20 bp, Artificial
  CRISPR gRNA sequence
aatcgattgccgagcgcgcc

SEQ ID NO: 599893 - DNA, 20 bp, Artificial
  CRISPR gRNA sequence
cgattgccgagcgcgccgag

SEQ ID NO: 599894 - DNA, 20 bp, Artificial
  CRISPR gRNA sequence
gccgagcgcgccgagcggct

SEQ ID NO: 599895 - DNA, 20 bp, Artificial
  CRISPR gRNA sequence
gcgccgagcggcttagcgcg

SEQ ID NO: 599896 - DNA, 20 bp, Artificial
  CRISPR gRNA sequence
acacgcgcacacgcgcccgc

SEQ ID NO: 599897 - DNA, 20 bp, Artificial
  CRISPR gRNA sequence
cgctctcatacacacacgca

SEQ ID NO: 599898 - DNA, 20 bp, Artificial
  CRISPR gRNA sequence
gctctcatacacacacgcac

SEQ ID NO: 599899 - DNA, 20 bp, Artificial
  CRISPR gRNA sequence
tacacacacgcacaggcgct

SEQ ID NO: 599900 - DNA, 20 bp, Artificial
  CRISPR gRNA sequence
acacacacgcacaggcgctc

SEQ ID NO: 599901 - DNA, 20 bp, Artificial
  CRISPR gRNA sequence
cacgtccgctcgcccgcgcc

SEQ ID NO: 599902 - DNA, 20 bp, Artificial
  CRISPR gRNA sequence
acgtccgctcgcccgcgccc

SEQ ID NO: 599903 - DNA, 20 bp, Artificial
  CRISPR gRNA sequence
cgtccgctcgcccgcgcccg

SEQ ID NO: 599904 - DNA, 20 bp, Artificial
  CRISPR gRNA sequence
ggggctccgctgcccgccgc

SEQ ID NO: 599905 - DNA, 20 bp, Artificial
  CRISPR gRNA sequence
gcccgccgccgccgccgccg

SEQ ID NO: 599906 - DNA, 20 bp, Artificial
  CRISPR gRNA sequence
gccgccgccgcagccgccgc

SEQ ID NO: 599907 - DNA, 20 bp, Artificial
  CRISPR gRNA sequence
gccagcccgccctccgcccg

SEQ ID NO: 599908 - DNA, 20 bp, Artificial
  CRISPR gRNA sequence
ccagcccgccctccgcccgc

SEQ ID NO: 599909 - DNA, 20 bp, Artificial
  CRISPR gRNA sequence
ccgcccgcgggcgtctgcgc

SEQ ID NO: 599910 - DNA, 20 bp, Artificial
  CRISPR gRNA sequence
cgcgggcgtctgcgcgagcc

SEQ ID NO: 599911 - DNA, 20 bp, Artificial
  CRISPR gRNA sequence
ggcgtctgcgcgagcccggc

SEQ ID NO: 599912 - DNA, 20 bp, Artificial
  CRISPR gRNA sequence
gtctgcgcgagcccggccgg

SEQ ID NO: 599913 - DNA, 20 bp, Artificial
  CRISPR gRNA sequence
tctgcgcgagcccggccggc

SEQ ID NO: 599914 - DNA, 20 bp, Artificial
  CRISPR gRNA sequence
ctgcgcgagcccggccggcg

SEQ ID NO: 599915 - DNA, 20 bp, Artificial
  CRISPR gRNA sequence
tgcgcgagcccggccggcgg

SEQ ID NO: 599916 - DNA, 20 bp, Artificial
  CRISPR gRNA sequence
cgcgagcccggccggcgggg

SEQ ID NO: 599917 - DNA, 20 bp, Artificial
  CRISPR gRNA sequence
gccggcgggggagatgtgct

SEQ ID NO: 599918 - DNA, 20 bp, Artificial
  CRISPR gRNA sequence
ccggcgggggagatgtgctc

SEQ ID NO: 599919 - DNA, 20 bp, Artificial
  CRISPR gRNA sequence
gagatgtgctcgggctccac

SEQ ID NO: 599920 - DNA, 20 bp, Artificial
  CRISPR gRNA sequence
gtgctcgggctccaccggat

SEQ ID NO: 599921 - DNA, 20 bp, Artificial
  CRISPR gRNA sequence
gctccaccggatcggtttct

SEQ ID NO: 599922 - DNA, 20 bp, Artificial
  CRISPR gRNA sequence
ctccaccggatcggtttctc

SEQ ID NO: 599923 - DNA, 20 bp, Artificial
  CRISPR gRNA sequence
tccaccggatcggtttctcg

SEQ ID NO: 599924 - DNA, 20 bp, Artificial
  CRISPR gRNA sequence
tcggtttctcggggtttgac

SEQ ID NO: 599925 - DNA, 20 bp, Artificial
  CRISPR gRNA sequence
cggggtttgaccagctgtcc

SEQ ID NO: 599926 - DNA, 20 bp, Artificial
  CRISPR gRNA sequence
ggggtttgaccagctgtccc

SEQ ID NO: 599927 - DNA, 20 bp, Artificial
  CRISPR gRNA sequence
gctaaccctgctcctcgctg

SEQ ID NO: 599928 - DNA, 20 bp, Artificial
  CRISPR gRNA sequence
accctgctcctcgctgaaga

SEQ ID NO: 599929 - DNA, 20 bp, Artificial
  CRISPR gRNA sequence
cctgctcctcgctgaagatg

SEQ ID NO: 599930 - DNA, 20 bp, Artificial
  CRISPR gRNA sequence
ctgctcctcgctgaagatgg

SEQ ID NO: 599931 - DNA, 20 bp, Artificial
  CRISPR gRNA sequence
ctcctcgctgaagatggagg

SEQ ID NO: 599932 - DNA, 20 bp, Artificial
  CRISPR gRNA sequence
gaagatggaggaagtaaaaa

SEQ ID NO: 599933 - DNA, 20 bp, Artificial
  CRISPR gRNA sequence
aagatggaggaagtaaaaac

SEQ ID NO: 599934 - DNA, 20 bp, Artificial
  CRISPR gRNA sequence
agtaaaaacaggattaccct

SEQ ID NO: 599935 - DNA, 20 bp, Artificial
  CRISPR gRNA sequence
aacaggattacccttagcta

SEQ ID NO: 599936 - DNA, 20 bp, Artificial
  CRISPR gRNA sequence
tagctacagatccactgcct

SEQ ID NO: 599937 - DNA, 20 bp, Artificial
  CRISPR gRNA sequence
ttagtttccaccaccaactg

SEQ ID NO: 599938 - DNA, 20 bp, Artificial
  CRISPR gRNA sequence
tgcagtgcacaaacacacgt

SEQ ID NO: 599939 - DNA, 20 bp, Artificial
  CRISPR gRNA sequence
gcagtgcacaaacacacgtt

SEQ ID NO: 599940 - DNA, 20 bp, Artificial
  CRISPR gRNA sequence
gcacaaacacacgttaggca

SEQ ID NO: 599941 - DNA, 20 bp, Artificial
  CRISPR gRNA sequence
cacaaacacacgttaggcac

SEQ ID NO: 599942 - DNA, 20 bp, Artificial
  CRISPR gRNA sequence
aacacacgttaggcacagga

SEQ ID NO: 599943 - DNA, 20 bp, Artificial
  CRISPR gRNA sequence
cacgttaggcacaggaaaga

SEQ ID NO: 599944 - DNA, 20 bp, Artificial
  CRISPR gRNA sequence
ttaggcacaggaaagaaaga

SEQ ID NO: 599945 - DNA, 20 bp, Artificial
  CRISPR gRNA sequence
gcacaggaaagaaagaaaga

SEQ ID NO: 599946 - DNA, 20 bp, Artificial
  CRISPR gRNA sequence
acaggaaagaaagaaagaca

SEQ ID NO: 599947 - DNA, 20 bp, Artificial
  CRISPR gRNA sequence
caggaaagaaagaaagacag

SEQ ID NO: 599948 - DNA, 20 bp, Artificial
  CRISPR gRNA sequence
aaagacagaggacacattaa

SEQ ID NO: 599949 - DNA, 20 bp, Artificial
  CRISPR gRNA sequence
ttaacagtaaacacaaacaa

SEQ ID NO: 599950 - DNA, 20 bp, Artificial
  CRISPR gRNA sequence
taacagtaaacacaaacaaa

SEQ ID NO: 599951 - DNA, 20 bp, Artificial
  CRISPR gRNA sequence
aacagtaaacacaaacaaaa

SEQ ID NO: 599952 - DNA, 20 bp, Artificial
  CRISPR gRNA sequence
aaacacaaacaaaagggtga

SEQ ID NO: 599953 - DNA, 20 bp, Artificial
  CRISPR gRNA sequence
aacacaaacaaaagggtgat

SEQ ID NO: 599954 - DNA, 20 bp, Artificial
  CRISPR gRNA sequence
attttactgcatgcactgct

SEQ ID NO: 599955 - DNA, 20 bp, Artificial
  CRISPR gRNA sequence
ttttactgcatgcactgctg

SEQ ID NO: 599956 - DNA, 20 bp, Artificial
  CRISPR gRNA sequence
tgctgaggtaaatctccgct

SEQ ID NO: 599957 - DNA, 20 bp, Artificial
  CRISPR gRNA sequence
atctccgcttggcttttgcg

SEQ ID NO: 599958 - DNA, 20 bp, Artificial
  CRISPR gRNA sequence
cgcttggcttttgcgtggtg

SEQ ID NO: 599959 - DNA, 20 bp, Artificial
  CRISPR gRNA sequence
ggcttttgcgtggtgaagaa

SEQ ID NO: 599960 - DNA, 20 bp, Artificial
  CRISPR gRNA sequence
ttgttttgtcttctgattca

SEQ ID NO: 599961 - DNA, 20 bp, Artificial
  CRISPR gRNA sequence
aaatatgtgtatgatttgca

SEQ ID NO: 599962 - DNA, 20 bp, Artificial
  CRISPR gRNA sequence
aatatgtgtatgatttgcaa

SEQ ID NO: 599963 - DNA, 20 bp, Artificial
  CRISPR gRNA sequence
atatgtgtatgatttgcaaa

SEQ ID NO: 599964 - DNA, 20 bp, Artificial
  CRISPR gRNA sequence
tatgtgtatgatttgcaaag

SEQ ID NO: 599965 - DNA, 20 bp, Artificial
  CRISPR gRNA sequence
atgtgtatgatttgcaaagg

SEQ ID NO: 599966 - DNA, 20 bp, Artificial
  CRISPR gRNA sequence
tgtgtatgatttgcaaaggg

SEQ ID NO: 599967 - DNA, 20 bp, Artificial
  CRISPR gRNA sequence
tgtatgatttgcaaaggggg

SEQ ID NO: 599968 - DNA, 20 bp, Artificial
  CRISPR gRNA sequence
caaaggggggagtgttttca

SEQ ID NO: 599969 - DNA, 20 bp, Artificial
  CRISPR gRNA sequence
gggggagtgttttcaaagtt

SEQ ID NO: 599970 - DNA, 20 bp, Artificial
  CRISPR gRNA sequence
caaagttaagtgtaattata

SEQ ID NO: 599971 - DNA, 20 bp, Artificial
  CRISPR gRNA sequence
aatgacttgttgctgttaac

SEQ ID NO: 599972 - DNA, 20 bp, Artificial
  CRISPR gRNA sequence
cagtaataataataataata

SEQ ID NO: 599973 - DNA, 20 bp, Artificial
  CRISPR gRNA sequence
agtaataataataataatat

SEQ ID NO: 599974 - DNA, 20 bp, Artificial
  CRISPR gRNA sequence
ataatataggtatttttctc

SEQ ID NO: 599975 - DNA, 20 bp, Artificial
  CRISPR gRNA sequence
taatataggtatttttctct

SEQ ID NO: 599976 - DNA, 20 bp, Artificial
  CRISPR gRNA sequence
atataggtatttttctctgg

SEQ ID NO: 599977 - DNA, 20 bp, Artificial
  CRISPR gRNA sequence
tataggtatttttctctggg

SEQ ID NO: 599978 - DNA, 20 bp, Artificial
  CRISPR gRNA sequence
ataggtatttttctctggga

SEQ ID NO: 599979 - DNA, 20 bp, Artificial
  CRISPR gRNA sequence
gtatttttctctgggaggga

SEQ ID NO: 599980 - DNA, 20 bp, Artificial
  CRISPR gRNA sequence
tctctgggagggatggattg

SEQ ID NO: 599981 - DNA, 20 bp, Artificial
  CRISPR gRNA sequence
ggatggattgtggttctgat

SEQ ID NO: 599982 - DNA, 20 bp, Artificial
  CRISPR gRNA sequence
gatggattgtggttctgatt

SEQ ID NO: 599983 - DNA, 20 bp, Artificial
  CRISPR gRNA sequence
atggattgtggttctgatta

SEQ ID NO: 599984 - DNA, 20 bp, Artificial
  CRISPR gRNA sequence
ttagggtaatgatttttgta

SEQ ID NO: 599985 - DNA, 20 bp, Artificial
  CRISPR gRNA sequence
tagggtaatgatttttgtaa

SEQ ID NO: 599986 - DNA, 20 bp, Artificial
  CRISPR gRNA sequence
tgatttttgtaaaggacgct

SEQ ID NO: 599987 - DNA, 20 bp, Artificial
  CRISPR gRNA sequence
gatttttgtaaaggacgctc

SEQ ID NO: 599988 - DNA, 20 bp, Artificial
  CRISPR gRNA sequence
atttttgtaaaggacgctca

SEQ ID NO: 599989 - DNA, 20 bp, Artificial
  CRISPR gRNA sequence
gtaaaggacgctcagggaat

SEQ ID NO: 599990 - DNA, 20 bp, Artificial
  CRISPR gRNA sequence
taaaggacgctcagggaatc

SEQ ID NO: 599991 - DNA, 20 bp, Artificial
  CRISPR gRNA sequence
acgctcagggaatcgggttg

SEQ ID NO: 599992 - DNA, 20 bp, Artificial
  CRISPR gRNA sequence
ccctccttgtaatctgtttc

SEQ ID NO: 599993 - DNA, 20 bp, Artificial
  CRISPR gRNA sequence
cctccttgtaatctgtttct

SEQ ID NO: 599994 - DNA, 20 bp, Artificial
  CRISPR gRNA sequence
tgggatgttaatcgattaat

SEQ ID NO: 599995 - DNA, 20 bp, Artificial
  CRISPR gRNA sequence
ttaatcagttctcatctcta

SEQ ID NO: 599996 - DNA, 20 bp, Artificial
  CRISPR gRNA sequence
ctctatagctgtcatgaatt

SEQ ID NO: 599997 - DNA, 20 bp, Artificial
  CRISPR gRNA sequence
tttgttttaacttgaattcc

SEQ ID NO: 599998 - DNA, 20 bp, Artificial
  CRISPR gRNA sequence
gttttaacttgaattccaag

SEQ ID NO: 599999 - DNA, 20 bp, Artificial
  CRISPR gRNA sequence
taacttgaattccaagaaga

SEQ ID NO: 600000 - DNA, 20 bp, Artificial
  CRISPR gRNA sequence
tgaattccaagaagaaagat

SEQ ID NO: 600001 - DNA, 20 bp, Artificial
  CRISPR gRNA sequence
gaattccaagaagaaagatt

SEQ ID NO: 600002 - DNA, 20 bp, Artificial
  CRISPR gRNA sequence
ttccaagaagaaagattggg

SEQ ID NO: 600003 - DNA, 20 bp, Artificial
  CRISPR gRNA sequence
tccaagaagaaagattgggt

SEQ ID NO: 600004 - DNA, 20 bp, Artificial
  CRISPR gRNA sequence
agaagaaagattgggtaggc

SEQ ID NO: 600005 - DNA, 20 bp, Artificial
  CRISPR gRNA sequence
gggtaggctggaataaattg

SEQ ID NO: 600006 - DNA, 20 bp, Artificial
  CRISPR gRNA sequence
tggaataaattgaagctgtc

SEQ ID NO: 600007 - DNA, 20 bp, Artificial
  CRISPR gRNA sequence
ataaattgaagctgtccaga

SEQ ID NO: 600008 - DNA, 20 bp, Artificial
  CRISPR gRNA sequence
aattgaagctgtccagatag

SEQ ID NO: 600009 - DNA, 20 bp, Artificial
  CRISPR gRNA sequence
attgaagctgtccagataga

SEQ ID NO: 600010 - DNA, 20 bp, Artificial
  CRISPR gRNA sequence
tccagatagaaggtaatatc

SEQ ID NO: 600011 - DNA, 20 bp, Artificial
  CRISPR gRNA sequence
aggtaatatccagatcctgt

SEQ ID NO: 600012 - DNA, 20 bp, Artificial
  CRISPR gRNA sequence
aaaaaaaaaaccaaaaaccc

SEQ ID NO: 600013 - DNA, 20 bp, Artificial
  CRISPR gRNA sequence
cctggtatgacacatgtaaa

SEQ ID NO: 600014 - DNA, 20 bp, Artificial
  CRISPR gRNA sequence
ctggtatgacacatgtaaac

SEQ ID NO: 600015 - DNA, 20 bp, Artificial
  CRISPR gRNA sequence
gtatgacacatgtaaacagg

SEQ ID NO: 600016 - DNA, 20 bp, Artificial
  CRISPR gRNA sequence
tgacacatgtaaacaggcag

SEQ ID NO: 600017 - DNA, 20 bp, Artificial
  CRISPR gRNA sequence
cagcagttaaatcactttga

SEQ ID NO: 600018 - DNA, 20 bp, Artificial
  CRISPR gRNA sequence
agcagttaaatcactttgac

SEQ ID NO: 600019 - DNA, 20 bp, Artificial
  CRISPR gRNA sequence
taaatcactttgacaggttc

SEQ ID NO: 600020 - DNA, 20 bp, Artificial
  CRISPR gRNA sequence
cactttgacaggttctagta

SEQ ID NO: 600021 - DNA, 20 bp, Artificial
  CRISPR gRNA sequence
actttgacaggttctagtat

SEQ ID NO: 600022 - DNA, 20 bp, Artificial
  CRISPR gRNA sequence
acaggttctagtatgggcga

SEQ ID NO: 600023 - DNA, 20 bp, Artificial
  CRISPR gRNA sequence
aggttctagtatgggcgaaa

SEQ ID NO: 600024 - DNA, 20 bp, Artificial
  CRISPR gRNA sequence
tctagtatgggcgaaagaga

SEQ ID NO: 600025 - DNA, 20 bp, Artificial
  CRISPR gRNA sequence
tgggcgaaagagatggaatt

SEQ ID NO: 600026 - DNA, 20 bp, Artificial
  CRISPR gRNA sequence
tattttttttcttttttgcc

SEQ ID NO: 600027 - DNA, 20 bp, Artificial
  CRISPR gRNA sequence
attttttttcttttttgcca

SEQ ID NO: 600028 - DNA, 20 bp, Artificial
  CRISPR gRNA sequence
ttttttttcttttttgccaa

SEQ ID NO: 600029 - DNA, 20 bp, Artificial
  CRISPR gRNA sequence
tttttgccaagggccaaaaa

SEQ ID NO: 600030 - DNA, 20 bp, Artificial
  CRISPR gRNA sequence
gggccaaaaacagtcctgtg

SEQ ID NO: 600031 - DNA, 20 bp, Artificial
  CRISPR gRNA sequence
caaaaacagtcctgtgaagt

SEQ ID NO: 600032 - DNA, 20 bp, Artificial
  CRISPR gRNA sequence
acagtcctgtgaagttggcc

SEQ ID NO: 600033 - DNA, 20 bp, Artificial
  CRISPR gRNA sequence
cagtcctgtgaagttggcct

SEQ ID NO: 600034 - DNA, 20 bp, Artificial
  CRISPR gRNA sequence
gtgaagttggcctgggttcc

SEQ ID NO: 600035 - DNA, 20 bp, Artificial
  CRISPR gRNA sequence
agttggcctgggttcctagc

SEQ ID NO: 600036 - DNA, 20 bp, Artificial
  CRISPR gRNA sequence
gttggcctgggttcctagct

SEQ ID NO: 600037 - DNA, 20 bp, Artificial
  CRISPR gRNA sequence
gcccccccccccttttcttt

SEQ ID NO: 600038 - DNA, 20 bp, Artificial
  CRISPR gRNA sequence
ttctttcagttttcttgtct

SEQ ID NO: 600039 - DNA, 20 bp, Artificial
  CRISPR gRNA sequence
agttttcttgtcttagcttt

SEQ ID NO: 600040 - DNA, 20 bp, Artificial
  CRISPR gRNA sequence
ttagcttttggtcgattctt

SEQ ID NO: 600041 - DNA, 20 bp, Artificial
  CRISPR gRNA sequence
tagcttttggtcgattctta

SEQ ID NO: 600042 - DNA, 20 bp, Artificial
  CRISPR gRNA sequence
ttggtcgattcttaaggaac

SEQ ID NO: 600043 - DNA, 20 bp, Artificial
  CRISPR gRNA sequence
gtcgattcttaaggaaccgg

SEQ ID NO: 600044 - DNA, 20 bp, Artificial
  CRISPR gRNA sequence
tcttaaggaaccggtggatc

SEQ ID NO: 600045 - DNA, 20 bp, Artificial
  CRISPR gRNA sequence
tcttgttaatcgcattgcta

SEQ ID NO: 600046 - DNA, 20 bp, Artificial
  CRISPR gRNA sequence
ttttttttcctctttcctga

SEQ ID NO: 600047 - DNA, 20 bp, Artificial
  CRISPR gRNA sequence
tcctctttcctgaaagtacg

SEQ ID NO: 600048 - DNA, 20 bp, Artificial
  CRISPR gRNA sequence
aagtacgtggtgccattcct

SEQ ID NO: 600049 - DNA, 20 bp, Artificial
  CRISPR gRNA sequence
tcctgagtgacttttcctac

SEQ ID NO: 600050 - DNA, 20 bp, Artificial
  CRISPR gRNA sequence
tttcctactagaccatccct

SEQ ID NO: 600051 - DNA, 20 bp, Artificial
  CRISPR gRNA sequence
ttcctactagaccatcccta

SEQ ID NO: 600052 - DNA, 20 bp, Artificial
  CRISPR gRNA sequence
tcctactagaccatccctaa

SEQ ID NO: 600053 - DNA, 20 bp, Artificial
  CRISPR gRNA sequence
ctagaccatccctaagggac

SEQ ID NO: 600054 - DNA, 20 bp, Artificial
  CRISPR gRNA sequence
tagaccatccctaagggacg

SEQ ID NO: 600055 - DNA, 20 bp, Artificial
  CRISPR gRNA sequence
agaccatccctaagggacga

SEQ ID NO: 600056 - DNA, 20 bp, Artificial
  CRISPR gRNA sequence
gaccatccctaagggacgag

SEQ ID NO: 600057 - DNA, 20 bp, Artificial
  CRISPR gRNA sequence
accatccctaagggacgagg

SEQ ID NO: 600058 - DNA, 20 bp, Artificial
  CRISPR gRNA sequence
catccctaagggacgagggg

SEQ ID NO: 600059 - DNA, 20 bp, Artificial
  CRISPR gRNA sequence
atccctaagggacgaggggg

SEQ ID NO: 600060 - DNA, 20 bp, Artificial
  CRISPR gRNA sequence
tccctaagggacgaggggga

SEQ ID NO: 600061 - DNA, 20 bp, Artificial
  CRISPR gRNA sequence
ccctaagggacgagggggag

SEQ ID NO: 600062 - DNA, 20 bp, Artificial
  CRISPR gRNA sequence
taagggacgagggggagggg

SEQ ID NO: 600063 - DNA, 20 bp, Artificial
  CRISPR gRNA sequence
gggacgagggggaggggtgg

SEQ ID NO: 600064 - DNA, 20 bp, Artificial
  CRISPR gRNA sequence
ggacgagggggaggggtgga

SEQ ID NO: 600065 - DNA, 20 bp, Artificial
  CRISPR gRNA sequence
acgagggggaggggtggaag

SEQ ID NO: 600066 - DNA, 20 bp, Artificial
  CRISPR gRNA sequence
cgagggggaggggtggaagg

SEQ ID NO: 600067 - DNA, 20 bp, Artificial
  CRISPR gRNA sequence
agggggaggggtggaaggag

SEQ ID NO: 600068 - DNA, 20 bp, Artificial
  CRISPR gRNA sequence
gggggaggggtggaaggagg

SEQ ID NO: 600069 - DNA, 20 bp, Artificial
  CRISPR gRNA sequence
gggaggggtggaaggaggag

SEQ ID NO: 600070 - DNA, 20 bp, Artificial
  CRISPR gRNA sequence
ggaggggtggaaggaggagg

SEQ ID NO: 600071 - DNA, 20 bp, Artificial
  CRISPR gRNA sequence
aggggtggaaggaggaggag

SEQ ID NO: 600072 - DNA, 20 bp, Artificial
  CRISPR gRNA sequence
ggggtggaaggaggaggagg

SEQ ID NO: 600073 - DNA, 20 bp, Artificial
  CRISPR gRNA sequence
ggtggaaggaggaggaggag

SEQ ID NO: 600074 - DNA, 20 bp, Artificial
  CRISPR gRNA sequence
gtggaaggaggaggaggagg

SEQ ID NO: 600075 - DNA, 20 bp, Artificial
  CRISPR gRNA sequence
aggaggaggaggaggaggac

SEQ ID NO: 600076 - DNA, 20 bp, Artificial
  CRISPR gRNA sequence
ggaggaggaggaggaggacg

SEQ ID NO: 600077 - DNA, 20 bp, Artificial
  CRISPR gRNA sequence
aggaggaggaggaggacgag

SEQ ID NO: 600078 - DNA, 20 bp, Artificial
  CRISPR gRNA sequence
ggaggaggaggaggacgagg

SEQ ID NO: 600079 - DNA, 20 bp, Artificial
  CRISPR gRNA sequence
aggaggaggaggacgaggag

SEQ ID NO: 600080 - DNA, 20 bp, Artificial
  CRISPR gRNA sequence
ggaggaggaggacgaggagg

SEQ ID NO: 600081 - DNA, 20 bp, Artificial
  CRISPR gRNA sequence
aggaggaggacgaggaggag

SEQ ID NO: 600082 - DNA, 20 bp, Artificial
  CRISPR gRNA sequence
ggaggaggacgaggaggagg

SEQ ID NO: 600083 - DNA, 20 bp, Artificial
  CRISPR gRNA sequence
aggaggacgaggaggaggag

SEQ ID NO: 600084 - DNA, 20 bp, Artificial
  CRISPR gRNA sequence
ggaggacgaggaggaggagg

SEQ ID NO: 600085 - DNA, 20 bp, Artificial
  CRISPR gRNA sequence
aggacgaggaggaggaggag

SEQ ID NO: 600086 - DNA, 20 bp, Artificial
  CRISPR gRNA sequence
ggacgaggaggaggaggagg

SEQ ID NO: 600087 - DNA, 20 bp, Artificial
  CRISPR gRNA sequence
acgaggaggaggaggaggag

SEQ ID NO: 600088 - DNA, 20 bp, Artificial
  CRISPR gRNA sequence
cgaggaggaggaggaggagg

SEQ ID NO: 600089 - DNA, 20 bp, Artificial
  CRISPR gRNA sequence
gaggaggaggaggaggagga

SEQ ID NO: 600090 - DNA, 20 bp, Artificial
  CRISPR gRNA sequence
aggaggaggaggaggaggag

SEQ ID NO: 600091 - DNA, 20 bp, Artificial
  CRISPR gRNA sequence
ggaggaggaggaggaggagg

SEQ ID NO: 600092 - DNA, 20 bp, Artificial
  CRISPR gRNA sequence
gaggaggaggaggaggaggg

SEQ ID NO: 600093 - DNA, 20 bp, Artificial
  CRISPR gRNA sequence
tgttcttctctctcatttct

SEQ ID NO: 600094 - DNA, 20 bp, Artificial
  CRISPR gRNA sequence
catttcttggttttgtttat

SEQ ID NO: 600095 - DNA, 20 bp, Artificial
  CRISPR gRNA sequence
ttatcagccgatctgtttgc

SEQ ID NO: 600096 - DNA, 20 bp, Artificial
  CRISPR gRNA sequence
gccgatctgtttgctggatt

SEQ ID NO: 600097 - DNA, 20 bp, Artificial
  CRISPR gRNA sequence
ccgatctgtttgctggattt

SEQ ID NO: 600098 - DNA, 20 bp, Artificial
  CRISPR gRNA sequence
ctgtttgctggatttgggct

SEQ ID NO: 600099 - DNA, 20 bp, Artificial
  CRISPR gRNA sequence
cttggaatgacccacctgta

SEQ ID NO: 600100 - DNA, 20 bp, Artificial
  CRISPR gRNA sequence
cctcctccccttgaactctg

SEQ ID NO: 600101 - DNA, 20 bp, Artificial
  CRISPR gRNA sequence
ctcctccccttgaactctgc

SEQ ID NO: 600102 - DNA, 20 bp, Artificial
  CRISPR gRNA sequence
tcctccccttgaactctgca

SEQ ID NO: 600103 - DNA, 20 bp, Artificial
  CRISPR gRNA sequence
cctccccttgaactctgcag

SEQ ID NO: 600104 - DNA, 20 bp, Artificial
  CRISPR gRNA sequence
ctccccttgaactctgcagg

SEQ ID NO: 600105 - DNA, 20 bp, Artificial
  CRISPR gRNA sequence
cttgaactctgcagggggct

SEQ ID NO: 600106 - DNA, 20 bp, Artificial
  CRISPR gRNA sequence
actctgcagggggcttggct

SEQ ID NO: 600107 - DNA, 20 bp, Artificial
  CRISPR gRNA sequence
tctgcagggggcttggcttg

SEQ ID NO: 600108 - DNA, 20 bp, Artificial
  CRISPR gRNA sequence
ctgcagggggcttggcttgg

SEQ ID NO: 600109 - DNA, 20 bp, Artificial
  CRISPR gRNA sequence
tgcagggggcttggcttgga

SEQ ID NO: 600110 - DNA, 20 bp, Artificial
  CRISPR gRNA sequence
gcagggggcttggcttggag

SEQ ID NO: 600111 - DNA, 20 bp, Artificial
  CRISPR gRNA sequence
cagggggcttggcttggagg

SEQ ID NO: 600112 - DNA, 20 bp, Artificial
  CRISPR gRNA sequence
gggcttggcttggagggggc

SEQ ID NO: 600113 - DNA, 20 bp, Artificial
  CRISPR gRNA sequence
ggcttggcttggagggggca

SEQ ID NO: 600114 - DNA, 20 bp, Artificial
  CRISPR gRNA sequence
gcttggcttggagggggcaa

SEQ ID NO: 600115 - DNA, 20 bp, Artificial
  CRISPR gRNA sequence
ttggcttggagggggcaagg

SEQ ID NO: 600116 - DNA, 20 bp, Artificial
  CRISPR gRNA sequence
tggcttggagggggcaaggg

SEQ ID NO: 600117 - DNA, 20 bp, Artificial
  CRISPR gRNA sequence
ggcttggagggggcaaggga

SEQ ID NO: 600118 - DNA, 20 bp, Artificial
  CRISPR gRNA sequence
tggagggggcaagggaggga

SEQ ID NO: 600119 - DNA, 20 bp, Artificial
  CRISPR gRNA sequence
gagggggcaagggagggaaa

SEQ ID NO: 600120 - DNA, 20 bp, Artificial
  CRISPR gRNA sequence
gggggcaagggagggaaaga

SEQ ID NO: 600121 - DNA, 20 bp, Artificial
  CRISPR gRNA sequence
ggcaagggagggaaagagag

SEQ ID NO: 600122 - DNA, 20 bp, Artificial
  CRISPR gRNA sequence
gcaagggagggaaagagaga

SEQ ID NO: 600123 - DNA, 20 bp, Artificial
  CRISPR gRNA sequence
caagggagggaaagagagaa

SEQ ID NO: 600124 - DNA, 20 bp, Artificial
  CRISPR gRNA sequence
aagggagggaaagagagaag

SEQ ID NO: 600125 - DNA, 20 bp, Artificial
  CRISPR gRNA sequence
agggagggaaagagagaagg

SEQ ID NO: 600126 - DNA, 20 bp, Artificial
  CRISPR gRNA sequence
tttctccctccgtttatctt

SEQ ID NO: 600127 - DNA, 20 bp, Artificial
  CRISPR gRNA sequence
gacattgtcacctcctcttt

SEQ ID NO: 600128 - DNA, 20 bp, Artificial
  CRISPR gRNA sequence
acattgtcacctcctctttg

SEQ ID NO: 600129 - DNA, 20 bp, Artificial
  CRISPR gRNA sequence
cattgtcacctcctctttga

SEQ ID NO: 600130 - DNA, 20 bp, Artificial
  CRISPR gRNA sequence
attgtcacctcctctttgag

SEQ ID NO: 600131 - DNA, 20 bp, Artificial
  CRISPR gRNA sequence
tcacctcctctttgaggggt

SEQ ID NO: 600132 - DNA, 20 bp, Artificial
  CRISPR gRNA sequence
cctcctctttgaggggttag

SEQ ID NO: 600133 - DNA, 20 bp, Artificial
  CRISPR gRNA sequence
cctctttgaggggttagaag

SEQ ID NO: 600134 - DNA, 20 bp, Artificial
  CRISPR gRNA sequence
ttgaggggttagaagaagct

SEQ ID NO: 600135 - DNA, 20 bp, Artificial
  CRISPR gRNA sequence
aagaagctgagatctcccga

SEQ ID NO: 600136 - DNA, 20 bp, Artificial
  CRISPR gRNA sequence
gaagctgagatctcccgaca

SEQ ID NO: 600137 - DNA, 20 bp, Artificial
  CRISPR gRNA sequence
ctgagatctcccgacagagc

SEQ ID NO: 600138 - DNA, 20 bp, Artificial
  CRISPR gRNA sequence
tctcccgacagagctggaaa

SEQ ID NO: 600139 - DNA, 20 bp, Artificial
  CRISPR gRNA sequence
tgatgaatcttttttaatca

SEQ ID NO: 600140 - DNA, 20 bp, Artificial
  CRISPR gRNA sequence
gatgaatcttttttaatcaa

SEQ ID NO: 600141 - DNA, 20 bp, Artificial
  CRISPR gRNA sequence
ttttccttctttccttctct

SEQ ID NO: 600142 - DNA, 20 bp, Artificial
  CRISPR gRNA sequence
tttccttctttccttctctg

SEQ ID NO: 600143 - DNA, 20 bp, Artificial
  CRISPR gRNA sequence
ttccttctttccttctctga

SEQ ID NO: 600144 - DNA, 20 bp, Artificial
  CRISPR gRNA sequence
gttaataaccatttcattga

SEQ ID NO: 600145 - DNA, 20 bp, Artificial
  CRISPR gRNA sequence
ttaataaccatttcattgat

SEQ ID NO: 600146 - DNA, 20 bp, Artificial
  CRISPR gRNA sequence
taataaccatttcattgatg

SEQ ID NO: 600147 - DNA, 20 bp, Artificial
  CRISPR gRNA sequence
taaccatttcattgatgggg

SEQ ID NO: 600148 - DNA, 20 bp, Artificial
  CRISPR gRNA sequence
gttaaatgtgtacattttta

SEQ ID NO: 600149 - DNA, 20 bp, Artificial
  CRISPR gRNA sequence
taaatgtgtacatttttaaa

SEQ ID NO: 600150 - DNA, 20 bp, Artificial
  CRISPR gRNA sequence
gtgtacatttttaaagagat

SEQ ID NO: 600151 - DNA, 20 bp, Artificial
  CRISPR gRNA sequence
gctcatttgtaaaatatccg

SEQ ID NO: 600152 - DNA, 20 bp, Artificial
  CRISPR gRNA sequence
tgctcctcttttaaacttta

SEQ ID NO: 600153 - DNA, 20 bp, Artificial
  CRISPR gRNA sequence
tttacggatctctttcttta

SEQ ID NO: 600154 - DNA, 20 bp, Artificial
  CRISPR gRNA sequence
cttatgtaatcataatttaa

SEQ ID NO: 600155 - DNA, 20 bp, Artificial
  CRISPR gRNA sequence
aatttaaaagaatgtgataa

SEQ ID NO: 600156 - DNA, 20 bp, Artificial
  CRISPR gRNA sequence
aaaagaatgtgataacagta

SEQ ID NO: 600157 - DNA, 20 bp, Artificial
  CRISPR gRNA sequence
agaatgtgataacagtacag

SEQ ID NO: 600158 - DNA, 20 bp, Artificial
  CRISPR gRNA sequence
gaatgtgataacagtacagc

SEQ ID NO: 600159 - DNA, 20 bp, Artificial
  CRISPR gRNA sequence
agtacagcaggttgaaattt

SEQ ID NO: 600160 - DNA, 20 bp, Artificial
  CRISPR gRNA sequence
gttgaaatttaagtgctatg

SEQ ID NO: 600161 - DNA, 20 bp, Artificial
  CRISPR gRNA sequence
ttaagtgctatgtagtgact

SEQ ID NO: 600162 - DNA, 20 bp, Artificial
  CRISPR gRNA sequence
gtgctatgtagtgactgagt

SEQ ID NO: 600163 - DNA, 20 bp, Artificial
  CRISPR gRNA sequence
tgctatgtagtgactgagtt

SEQ ID NO: 600164 - DNA, 20 bp, Artificial
  CRISPR gRNA sequence
tttgatctgattattccata

SEQ ID NO: 600165 - DNA, 20 bp, Artificial
  CRISPR gRNA sequence
atctgattattccataaaga

SEQ ID NO: 600166 - DNA, 20 bp, Artificial
  CRISPR gRNA sequence
ttccataaagaaagaaataa

SEQ ID NO: 600167 - DNA, 20 bp, Artificial
  CRISPR gRNA sequence
aagaaataaaagtttttttt

SEQ ID NO: 600168 - DNA, 20 bp, Artificial
  CRISPR gRNA sequence
agaaataaaagttttttttt

SEQ ID NO: 600169 - DNA, 20 bp, Artificial
  CRISPR gRNA sequence
gaaataaaagtttttttttg

SEQ ID NO: 600170 - DNA, 20 bp, Artificial
  CRISPR gRNA sequence
aaataaaagtttttttttgg

SEQ ID NO: 600171 - DNA, 20 bp, Artificial
  CRISPR gRNA sequence
aataaaagtttttttttggg

SEQ ID NO: 600172 - DNA, 20 bp, Artificial
  CRISPR gRNA sequence
ataaaagtttttttttgggg

SEQ ID NO: 600173 - DNA, 20 bp, Artificial
  CRISPR gRNA sequence
taaaagtttttttttggggg

SEQ ID NO: 600174 - DNA, 20 bp, Artificial
  CRISPR gRNA sequence
aaaagtttttttttgggggg

SEQ ID NO: 600175 - DNA, 20 bp, Artificial
  CRISPR gRNA sequence
aaagtttttttttggggggg

SEQ ID NO: 600176 - DNA, 20 bp, Artificial
  CRISPR gRNA sequence
tttttttttggggggggggt

SEQ ID NO: 600177 - DNA, 20 bp, Artificial
  CRISPR gRNA sequence
ttttttttggggggggggta

SEQ ID NO: 600178 - DNA, 20 bp, Artificial
  CRISPR gRNA sequence
tttttttggggggggggtaa

SEQ ID NO: 600179 - DNA, 20 bp, Artificial
  CRISPR gRNA sequence
tttttggggggggggtaagg

SEQ ID NO: 600180 - DNA, 20 bp, Artificial
  CRISPR gRNA sequence
ggggggggggtaagggagtg

SEQ ID NO: 600181 - DNA, 20 bp, Artificial
  CRISPR gRNA sequence
gggggggtaagggagtgtgg

SEQ ID NO: 600182 - DNA, 20 bp, Artificial
  CRISPR gRNA sequence
ggtaagggagtgtggtggtg

SEQ ID NO: 600183 - DNA, 20 bp, Artificial
  CRISPR gRNA sequence
aagggagtgtggtggtgaag

SEQ ID NO: 600184 - DNA, 20 bp, Artificial
  CRISPR gRNA sequence
agggagtgtggtggtgaaga

SEQ ID NO: 600185 - DNA, 20 bp, Artificial
  CRISPR gRNA sequence
gggagtgtggtggtgaagaa

SEQ ID NO: 600186 - DNA, 20 bp, Artificial
  CRISPR gRNA sequence
ggagtgtggtggtgaagaag

SEQ ID NO: 600187 - DNA, 20 bp, Artificial
  CRISPR gRNA sequence
agtgtggtggtgaagaaggg

SEQ ID NO: 600188 - DNA, 20 bp, Artificial
  CRISPR gRNA sequence
gtgtggtggtgaagaagggg

SEQ ID NO: 600189 - DNA, 20 bp, Artificial
  CRISPR gRNA sequence
tgtggtggtgaagaagggga

SEQ ID NO: 600190 - DNA, 20 bp, Artificial
  CRISPR gRNA sequence
gtggtggtgaagaaggggag

SEQ ID NO: 600191 - DNA, 20 bp, Artificial
  CRISPR gRNA sequence
ggtggtgaagaaggggaggg

SEQ ID NO: 600192 - DNA, 20 bp, Artificial
  CRISPR gRNA sequence
gtggtgaagaaggggagggg

SEQ ID NO: 600193 - DNA, 20 bp, Artificial
  CRISPR gRNA sequence
tggtgaagaaggggagggga

SEQ ID NO: 600194 - DNA, 20 bp, Artificial
  CRISPR gRNA sequence
gtgaagaaggggaggggagg

SEQ ID NO: 600195 - DNA, 20 bp, Artificial
  CRISPR gRNA sequence
aagaaggggaggggagggag

SEQ ID NO: 600196 - DNA, 20 bp, Artificial
  CRISPR gRNA sequence
agaaggggaggggagggaga

SEQ ID NO: 600197 - DNA, 20 bp, Artificial
  CRISPR gRNA sequence
gaaggggaggggagggagaa

SEQ ID NO: 600198 - DNA, 20 bp, Artificial
  CRISPR gRNA sequence
ggggaggggagggagaaggg

SEQ ID NO: 600199 - DNA, 20 bp, Artificial
  CRISPR gRNA sequence
gaggggagggagaagggaag

SEQ ID NO: 600200 - DNA, 20 bp, Artificial
  CRISPR gRNA sequence
agggagaagggaagtggttt

SEQ ID NO: 600201 - DNA, 20 bp, Artificial
  CRISPR gRNA sequence
ggagaagggaagtggttttg

SEQ ID NO: 600202 - DNA, 20 bp, Artificial
  CRISPR gRNA sequence
agggaagtggttttggagac

SEQ ID NO: 600203 - DNA, 20 bp, Artificial
  CRISPR gRNA sequence
gaagtggttttggagacaag

SEQ ID NO: 600204 - DNA, 20 bp, Artificial
  CRISPR gRNA sequence
ggttttggagacaagaagtg

SEQ ID NO: 600205 - DNA, 20 bp, Artificial
  CRISPR gRNA sequence
aagtgaagctgcctgttttc

SEQ ID NO: 600206 - DNA, 20 bp, Artificial
  CRISPR gRNA sequence
gaagctgcctgttttccagt

SEQ ID NO: 600207 - DNA, 20 bp, Artificial
  CRISPR gRNA sequence
gcctgttttccagtaagtaa

SEQ ID NO: 600208 - DNA, 20 bp, Artificial
  CRISPR gRNA sequence
ctgttttccagtaagtaatg

SEQ ID NO: 600209 - DNA, 20 bp, Artificial
  CRISPR gRNA sequence
agtaagtaatggagaaattc

SEQ ID NO: 600210 - DNA, 20 bp, Artificial
  CRISPR gRNA sequence
gtaagtaatggagaaattcc

SEQ ID NO: 600211 - DNA, 20 bp, Artificial
  CRISPR gRNA sequence
aagtaatggagaaattccag

SEQ ID NO: 600212 - DNA, 20 bp, Artificial
  CRISPR gRNA sequence
aatggagaaattccaggagc

SEQ ID NO: 600213 - DNA, 20 bp, Artificial
  CRISPR gRNA sequence
atggagaaattccaggagcc

SEQ ID NO: 600214 - DNA, 20 bp, Artificial
  CRISPR gRNA sequence
tggagaaattccaggagcca

SEQ ID NO: 600215 - DNA, 20 bp, Artificial
  CRISPR gRNA sequence
gagccagggctaaatatact

SEQ ID NO: 600216 - DNA, 20 bp, Artificial
  CRISPR gRNA sequence
aatatacttggcgatcaata

SEQ ID NO: 600217 - DNA, 20 bp, Artificial
  CRISPR gRNA sequence
cttggcgatcaatacagaaa

SEQ ID NO: 600218 - DNA, 20 bp, Artificial
  CRISPR gRNA sequence
atggctcattgtgaataatt

SEQ ID NO: 600219 - DNA, 20 bp, Artificial
  CRISPR gRNA sequence
attgtgaataatttagctgc

SEQ ID NO: 600220 - DNA, 20 bp, Artificial
  CRISPR gRNA sequence
gaataatttagctgctggtg

SEQ ID NO: 600221 - DNA, 20 bp, Artificial
  CRISPR gRNA sequence
aatttagctgctggtgcagt

SEQ ID NO: 600222 - DNA, 20 bp, Artificial
  CRISPR gRNA sequence
tttagctgctggtgcagtga

SEQ ID NO: 600223 - DNA, 20 bp, Artificial
  CRISPR gRNA sequence
cagtgagagttttgaaacta

SEQ ID NO: 600224 - DNA, 20 bp, Artificial
  CRISPR gRNA sequence
agtgagagttttgaaactaa

SEQ ID NO: 600225 - DNA, 20 bp, Artificial
  CRISPR gRNA sequence
gttttgaaactaaaggcaaa

SEQ ID NO: 600226 - DNA, 20 bp, Artificial
  CRISPR gRNA sequence
ttttgaaactaaaggcaaaa

SEQ ID NO: 600227 - DNA, 20 bp, Artificial
  CRISPR gRNA sequence
aactaaaggcaaaaaggacc

SEQ ID NO: 600228 - DNA, 20 bp, Artificial
  CRISPR gRNA sequence
actaaaggcaaaaaggacca

SEQ ID NO: 600229 - DNA, 20 bp, Artificial
  CRISPR gRNA sequence
ggcaaaaaggaccaaggcca

SEQ ID NO: 600230 - DNA, 20 bp, Artificial
  CRISPR gRNA sequence
gcaaaaaggaccaaggccaa

SEQ ID NO: 600231 - DNA, 20 bp, Artificial
  CRISPR gRNA sequence
caaaaaggaccaaggccaaa

SEQ ID NO: 600232 - DNA, 20 bp, Artificial
  CRISPR gRNA sequence
aaaaaggaccaaggccaaag

SEQ ID NO: 600233 - DNA, 20 bp, Artificial
  CRISPR gRNA sequence
aaaaggaccaaggccaaagg

SEQ ID NO: 600234 - DNA, 20 bp, Artificial
  CRISPR gRNA sequence
aaggccaaagggggaaaaaa

SEQ ID NO: 600235 - DNA, 20 bp, Artificial
  CRISPR gRNA sequence
aaaaaaagtaaaaatcttct

SEQ ID NO: 600236 - DNA, 20 bp, Artificial
  CRISPR gRNA sequence
aaaaaagtaaaaatcttctc

SEQ ID NO: 600237 - DNA, 20 bp, Artificial
  CRISPR gRNA sequence
ttcttaaacttttttcccca

SEQ ID NO: 600238 - DNA, 20 bp, Artificial
  CRISPR gRNA sequence
acttttttccccacagaata

SEQ ID NO: 600239 - DNA, 20 bp, Artificial
  CRISPR gRNA sequence
ttttccccacagaatacagt

SEQ ID NO: 600240 - DNA, 20 bp, Artificial
  CRISPR gRNA sequence
tcttttcattatgtgaatca

SEQ ID NO: 600241 - DNA, 20 bp, Artificial
  CRISPR gRNA sequence
ttcattatgtgaatcaaagc

SEQ ID NO: 600242 - DNA, 20 bp, Artificial
  CRISPR gRNA sequence
tcattatgtgaatcaaagct

SEQ ID NO: 600243 - DNA, 20 bp, Artificial
  CRISPR gRNA sequence
cattatgtgaatcaaagcta

SEQ ID NO: 600244 - DNA, 20 bp, Artificial
  CRISPR gRNA sequence
attatgtgaatcaaagctag

SEQ ID NO: 600245 - DNA, 20 bp, Artificial
  CRISPR gRNA sequence
ttatgtgaatcaaagctagg

SEQ ID NO: 600246 - DNA, 20 bp, Artificial
  CRISPR gRNA sequence
ctagggggtgtcatctcata

SEQ ID NO: 600247 - DNA, 20 bp, Artificial
  CRISPR gRNA sequence
tacagtttacttttgtttct

SEQ ID NO: 600248 - DNA, 20 bp, Artificial
  CRISPR gRNA sequence
gagaattatgttctgttgtg

SEQ ID NO: 600249 - DNA, 20 bp, Artificial
  CRISPR gRNA sequence
gttgtgtggcgtttgtgcat

SEQ ID NO: 600250 - DNA, 20 bp, Artificial
  CRISPR gRNA sequence
tgcatgagaataattgccca

SEQ ID NO: 600251 - DNA, 20 bp, Artificial
  CRISPR gRNA sequence
tttttttaaatgattctctc

SEQ ID NO: 600252 - DNA, 20 bp, Artificial
  CRISPR gRNA sequence
gattctctctagcacaacca

SEQ ID NO: 600253 - DNA, 20 bp, Artificial
  CRISPR gRNA sequence
gtttatgaaattttcaaaat

SEQ ID NO: 600254 - DNA, 20 bp, Artificial
  CRISPR gRNA sequence
tttcaaaatcagactgtatt

SEQ ID NO: 600255 - DNA, 20 bp, Artificial
  CRISPR gRNA sequence
caaaatcagactgtattaag

SEQ ID NO: 600256 - DNA, 20 bp, Artificial
  CRISPR gRNA sequence
aaaatcagactgtattaagt

SEQ ID NO: 600257 - DNA, 20 bp, Artificial
  CRISPR gRNA sequence
cagactgtattaagtaggct

SEQ ID NO: 600258 - DNA, 20 bp, Artificial
  CRISPR gRNA sequence
taggcttggcatttgtgtcc

SEQ ID NO: 600259 - DNA, 20 bp, Artificial
  CRISPR gRNA sequence
ttggcatttgtgtccaagca

SEQ ID NO: 600260 - DNA, 20 bp, Artificial
  CRISPR gRNA sequence
atttgtgtccaagcatggtc

SEQ ID NO: 600261 - DNA, 20 bp, Artificial
  CRISPR gRNA sequence
tgtgtccaagcatggtctgg

SEQ ID NO: 600262 - DNA, 20 bp, Artificial
  CRISPR gRNA sequence
gtgtccaagcatggtctggc

SEQ ID NO: 600263 - DNA, 20 bp, Artificial
  CRISPR gRNA sequence
gcatggtctggcaggaaatt

SEQ ID NO: 600264 - DNA, 20 bp, Artificial
  CRISPR gRNA sequence
catggtctggcaggaaatta

SEQ ID NO: 600265 - DNA, 20 bp, Artificial
  CRISPR gRNA sequence
gaaattaaggttacattgaa

SEQ ID NO: 600266 - DNA, 20 bp, Artificial
  CRISPR gRNA sequence
aaattaaggttacattgaac

SEQ ID NO: 600267 - DNA, 20 bp, Artificial
  CRISPR gRNA sequence
acattgaacaggtgcttaca

SEQ ID NO: 600268 - DNA, 20 bp, Artificial
  CRISPR gRNA sequence
acaggtgcttacacagaact

SEQ ID NO: 600269 - DNA, 20 bp, Artificial
  CRISPR gRNA sequence
caggtgcttacacagaactt

SEQ ID NO: 600270 - DNA, 20 bp, Artificial
  CRISPR gRNA sequence
aggtgcttacacagaacttg

SEQ ID NO: 600271 - DNA, 20 bp, Artificial
  CRISPR gRNA sequence
tgcttacacagaacttgggg

SEQ ID NO: 600272 - DNA, 20 bp, Artificial
  CRISPR gRNA sequence
gcttacacagaacttggggt

SEQ ID NO: 600273 - DNA, 20 bp, Artificial
  CRISPR gRNA sequence
gtaggttaaaatgtcaatac

SEQ ID NO: 600274 - DNA, 20 bp, Artificial
  CRISPR gRNA sequence
gttaaaatgtcaatacaagt

SEQ ID NO: 600275 - DNA, 20 bp, Artificial
  CRISPR gRNA sequence
ttaaaatgtcaatacaagtc

SEQ ID NO: 600276 - DNA, 20 bp, Artificial
  CRISPR gRNA sequence
taaaatgtcaatacaagtca

SEQ ID NO: 600277 - DNA, 20 bp, Artificial
  CRISPR gRNA sequence
aaatgtcaatacaagtcagg

SEQ ID NO: 600278 - DNA, 20 bp, Artificial
  CRISPR gRNA sequence
gtcaatacaagtcagggagt

SEQ ID NO: 600279 - DNA, 20 bp, Artificial
  CRISPR gRNA sequence
agggagttggccaactgctg

SEQ ID NO: 600280 - DNA, 20 bp, Artificial
  CRISPR gRNA sequence
caactgctgtagaaatcttc

SEQ ID NO: 600281 - DNA, 20 bp, Artificial
  CRISPR gRNA sequence
agaaatcttcaagacaccgt

SEQ ID NO: 600282 - DNA, 20 bp, Artificial
  CRISPR gRNA sequence
gaaatcttcaagacaccgtt

SEQ ID NO: 600283 - DNA, 20 bp, Artificial
  CRISPR gRNA sequence
tcaagacaccgttgggcact

SEQ ID NO: 600284 - DNA, 20 bp, Artificial
  CRISPR gRNA sequence
tttgtcctccccctccctat

SEQ ID NO: 600285 - DNA, 20 bp, Artificial
  CRISPR gRNA sequence
caacttgcaacaattgtgaa

SEQ ID NO: 600286 - DNA, 20 bp, Artificial
  CRISPR gRNA sequence
acttgcaacaattgtgaata

SEQ ID NO: 600287 - DNA, 20 bp, Artificial
  CRISPR gRNA sequence
gaatagagctatctgtatac

SEQ ID NO: 600288 - DNA, 20 bp, Artificial
  CRISPR gRNA sequence
aatagagctatctgtatact

SEQ ID NO: 600289 - DNA, 20 bp, Artificial
  CRISPR gRNA sequence
atagagctatctgtatactg

SEQ ID NO: 600290 - DNA, 20 bp, Artificial
  CRISPR gRNA sequence
gagctatctgtatactgggg

SEQ ID NO: 600291 - DNA, 20 bp, Artificial
  CRISPR gRNA sequence
ctggggaagtcctcaaactg

SEQ ID NO: 600292 - DNA, 20 bp, Artificial
  CRISPR gRNA sequence
ctcaaactgcagtgtgattg

SEQ ID NO: 600293 - DNA, 20 bp, Artificial
  CRISPR gRNA sequence
tcaaactgcagtgtgattgt

SEQ ID NO: 600294 - DNA, 20 bp, Artificial
  CRISPR gRNA sequence
aactgcagtgtgattgtggg

SEQ ID NO: 600295 - DNA, 20 bp, Artificial
  CRISPR gRNA sequence
tgcagtgtgattgtgggaag

SEQ ID NO: 600296 - DNA, 20 bp, Artificial
  CRISPR gRNA sequence
tgattgtgggaagtagtgaa

SEQ ID NO: 600297 - DNA, 20 bp, Artificial
  CRISPR gRNA sequence
atggtaaaacacttaaatcc

SEQ ID NO: 600298 - DNA, 20 bp, Artificial
  CRISPR gRNA sequence
aaacacttaaatcccagtta

SEQ ID NO: 600299 - DNA, 20 bp, Artificial
  CRISPR gRNA sequence
cagttaaagctgacacattt

SEQ ID NO: 600300 - DNA, 20 bp, Artificial
  CRISPR gRNA sequence
aaacccaataaattttgatt

SEQ ID NO: 600301 - DNA, 20 bp, Artificial
  CRISPR gRNA sequence
acccaataaattttgattaa

SEQ ID NO: 600302 - DNA, 20 bp, Artificial
  CRISPR gRNA sequence
ccaataaattttgattaaga

SEQ ID NO: 600303 - DNA, 20 bp, Artificial
  CRISPR gRNA sequence
gagtcattccctttttgctc

SEQ ID NO: 600304 - DNA, 20 bp, Artificial
  CRISPR gRNA sequence
ttttgctctagcccatctca

SEQ ID NO: 600305 - DNA, 20 bp, Artificial
  CRISPR gRNA sequence
tatctttcctatcctatctc

SEQ ID NO: 600306 - DNA, 20 bp, Artificial
  CRISPR gRNA sequence
ctttcctatcctatctccag

SEQ ID NO: 600307 - DNA, 20 bp, Artificial
  CRISPR gRNA sequence
tttcctatcctatctccagc

SEQ ID NO: 600308 - DNA, 20 bp, Artificial
  CRISPR gRNA sequence
atcctatctccagcaggaat

SEQ ID NO: 600309 - DNA, 20 bp, Artificial
  CRISPR gRNA sequence
agcaggaatcagatcatttg

SEQ ID NO: 600310 - DNA, 20 bp, Artificial
  CRISPR gRNA sequence
ggaatcagatcatttgcaga

SEQ ID NO: 600311 - DNA, 20 bp, Artificial
  CRISPR gRNA sequence
aatcagatcatttgcagaaa

SEQ ID NO: 600312 - DNA, 20 bp, Artificial
  CRISPR gRNA sequence
gatcatttgcagaaagagtt

SEQ ID NO: 600313 - DNA, 20 bp, Artificial
  CRISPR gRNA sequence
gagttcagtgacttgcaaat

SEQ ID NO: 600314 - DNA, 20 bp, Artificial
  CRISPR gRNA sequence
gacttgcaaatgagcacata

SEQ ID NO: 600315 - DNA, 20 bp, Artificial
  CRISPR gRNA sequence
cagtacactgtgtatgtttc

SEQ ID NO: 600316 - DNA, 20 bp, Artificial
  CRISPR gRNA sequence
agtacactgtgtatgtttct

SEQ ID NO: 600317 - DNA, 20 bp, Artificial
  CRISPR gRNA sequence
actgtgtatgtttctgggca

SEQ ID NO: 600318 - DNA, 20 bp, Artificial
  CRISPR gRNA sequence
ctgtgtatgtttctgggcac

SEQ ID NO: 600319 - DNA, 20 bp, Artificial
  CRISPR gRNA sequence
tgtatgtttctgggcacagg

SEQ ID NO: 600320 - DNA, 20 bp, Artificial
  CRISPR gRNA sequence
atgtttctgggcacaggtgg

SEQ ID NO: 600321 - DNA, 20 bp, Artificial
  CRISPR gRNA sequence
tttctgggcacaggtggcag

SEQ ID NO: 600322 - DNA, 20 bp, Artificial
  CRISPR gRNA sequence
cacaggtggcagcagcaaca

SEQ ID NO: 600323 - DNA, 20 bp, Artificial
  CRISPR gRNA sequence
agcaacatggactaactgct

SEQ ID NO: 600324 - DNA, 20 bp, Artificial
  CRISPR gRNA sequence
caacatggactaactgcttg

SEQ ID NO: 600325 - DNA, 20 bp, Artificial
  CRISPR gRNA sequence
aactgcttggagcttcaaat

SEQ ID NO: 600326 - DNA, 20 bp, Artificial
  CRISPR gRNA sequence
cttggagcttcaaataagtt

SEQ ID NO: 600327 - DNA, 20 bp, Artificial
  CRISPR gRNA sequence
caaataagttaagaatttaa

SEQ ID NO: 600328 - DNA, 20 bp, Artificial
  CRISPR gRNA sequence
ataagttaagaatttaatgg

SEQ ID NO: 600329 - DNA, 20 bp, Artificial
  CRISPR gRNA sequence
aatttaatggcagatactga

SEQ ID NO: 600330 - DNA, 20 bp, Artificial
  CRISPR gRNA sequence
atttaatggcagatactgaa

SEQ ID NO: 600331 - DNA, 20 bp, Artificial
  CRISPR gRNA sequence
ctgaaaggaatcattgtatt

SEQ ID NO: 600332 - DNA, 20 bp, Artificial
  CRISPR gRNA sequence
tgaaaggaatcattgtatta

SEQ ID NO: 600333 - DNA, 20 bp, Artificial
  CRISPR gRNA sequence
gaaaggaatcattgtattaa

SEQ ID NO: 600334 - DNA, 20 bp, Artificial
  CRISPR gRNA sequence
gggtataatcttttgttttg

SEQ ID NO: 600335 - DNA, 20 bp, Artificial
  CRISPR gRNA sequence
gcagcattgcactttgacta

SEQ ID NO: 600336 - DNA, 20 bp, Artificial
  CRISPR gRNA sequence
ttgcactttgactatggaaa

SEQ ID NO: 600337 - DNA, 20 bp, Artificial
  CRISPR gRNA sequence
gcactttgactatggaaaca

SEQ ID NO: 600338 - DNA, 20 bp, Artificial
  CRISPR gRNA sequence
cactttgactatggaaacag

SEQ ID NO: 600339 - DNA, 20 bp, Artificial
  CRISPR gRNA sequence
atggaaacagaggctattga

SEQ ID NO: 600340 - DNA, 20 bp, Artificial
  CRISPR gRNA sequence
ttgatggctatataacgtgt

SEQ ID NO: 600341 - DNA, 20 bp, Artificial
  CRISPR gRNA sequence
gctatataacgtgtaagtat

SEQ ID NO: 600342 - DNA, 20 bp, Artificial
  CRISPR gRNA sequence
agttttcattgatttgttat

SEQ ID NO: 600343 - DNA, 20 bp, Artificial
  CRISPR gRNA sequence
ttgatttgttattggtaata

SEQ ID NO: 600344 - DNA, 20 bp, Artificial
  CRISPR gRNA sequence
attacctgtgttttaattcc

SEQ ID NO: 600345 - DNA, 20 bp, Artificial
  CRISPR gRNA sequence
ctggattatgaaactttatt

SEQ ID NO: 600346 - DNA, 20 bp, Artificial
  CRISPR gRNA sequence
tcacaatttcacctttgaat

SEQ ID NO: 600347 - DNA, 20 bp, Artificial
  CRISPR gRNA sequence
tttcacctttgaatgagttt

SEQ ID NO: 600348 - DNA, 20 bp, Artificial
  CRISPR gRNA sequence
gaatgagtttgagaaaatga

SEQ ID NO: 600349 - DNA, 20 bp, Artificial
  CRISPR gRNA sequence
ttgagaaaatgacagcactg

SEQ ID NO: 600350 - DNA, 20 bp, Artificial
  CRISPR gRNA sequence
tgacagcactgaagtgaaat

SEQ ID NO: 600351 - DNA, 20 bp, Artificial
  CRISPR gRNA sequence
cagcactgaagtgaaataag

SEQ ID NO: 600352 - DNA, 20 bp, Artificial
  CRISPR gRNA sequence
agcactgaagtgaaataaga

SEQ ID NO: 600353 - DNA, 20 bp, Artificial
  CRISPR gRNA sequence
agtgaaataagaaggaaata

SEQ ID NO: 600354 - DNA, 20 bp, Artificial
  CRISPR gRNA sequence
aggaaatatagaaacatact

SEQ ID NO: 600355 - DNA, 20 bp, Artificial
  CRISPR gRNA sequence
atatagaaacatactaagtt

SEQ ID NO: 600356 - DNA, 20 bp, Artificial
  CRISPR gRNA sequence
tagaaacatactaagttaag

SEQ ID NO: 600357 - DNA, 20 bp, Artificial
  CRISPR gRNA sequence
aagtagtgtacttaaatcaa

SEQ ID NO: 600358 - DNA, 20 bp, Artificial
  CRISPR gRNA sequence
tagtgtacttaaatcaatag

SEQ ID NO: 600359 - DNA, 20 bp, Artificial
  CRISPR gRNA sequence
gtacttaaatcaatagtagc

SEQ ID NO: 600360 - DNA, 20 bp, Artificial
  CRISPR gRNA sequence
cttaaatcaatagtagctag

SEQ ID NO: 600361 - DNA, 20 bp, Artificial
  CRISPR gRNA sequence
tttataatttactttgttgt

SEQ ID NO: 600362 - DNA, 20 bp, Artificial
  CRISPR gRNA sequence
aatttactttgttgtaagtt

SEQ ID NO: 600363 - DNA, 20 bp, Artificial
  CRISPR gRNA sequence
actttgttgtaagttgagaa

SEQ ID NO: 600364 - DNA, 20 bp, Artificial
  CRISPR gRNA sequence
ctttgttgtaagttgagaat

SEQ ID NO: 600365 - DNA, 20 bp, Artificial
  CRISPR gRNA sequence
gttgtaagttgagaataggc

SEQ ID NO: 600366 - DNA, 20 bp, Artificial
  CRISPR gRNA sequence
ttgtaagttgagaataggcc

SEQ ID NO: 600367 - DNA, 20 bp, Artificial
  CRISPR gRNA sequence
ttcatatatgtctattaata

SEQ ID NO: 600368 - DNA, 20 bp, Artificial
  CRISPR gRNA sequence
ttctctgtaacctaattttt

SEQ ID NO: 600369 - DNA, 20 bp, Artificial
  CRISPR gRNA sequence
ttttcagacatattatgtga

SEQ ID NO: 600370 - DNA, 20 bp, Artificial
  CRISPR gRNA sequence
ttcagacatattatgtgaaa

SEQ ID NO: 600371 - DNA, 20 bp, Artificial
  CRISPR gRNA sequence
catattatgtgaaagagaat

SEQ ID NO: 600372 - DNA, 20 bp, Artificial
  CRISPR gRNA sequence
ttcctaacttgacatttctt

SEQ ID NO: 600373 - DNA, 20 bp, Artificial
  CRISPR gRNA sequence
cttttccatcctctctctga

SEQ ID NO: 600374 - DNA, 20 bp, Artificial
  CRISPR gRNA sequence
tccatcctctctctgatagc

SEQ ID NO: 600375 - DNA, 20 bp, Artificial
  CRISPR gRNA sequence
ctctctgatagccagcattt

SEQ ID NO: 600376 - DNA, 20 bp, Artificial
  CRISPR gRNA sequence
tgtgtgcttaacaattaaat

SEQ ID NO: 600377 - DNA, 20 bp, Artificial
  CRISPR gRNA sequence
acaattaaattagatgttaa

SEQ ID NO: 600378 - DNA, 20 bp, Artificial
  CRISPR gRNA sequence
taaattagatgttaaaagaa

SEQ ID NO: 600379 - DNA, 20 bp, Artificial
  CRISPR gRNA sequence
aagttatttctttcaactga

SEQ ID NO: 600380 - DNA, 20 bp, Artificial
  CRISPR gRNA sequence
ctttcaactgaaagatactt

SEQ ID NO: 600381 - DNA, 20 bp, Artificial
  CRISPR gRNA sequence
aaatcaacaacttatgtatt

SEQ ID NO: 600382 - DNA, 20 bp, Artificial
  CRISPR gRNA sequence
acttatgtattgagataata

SEQ ID NO: 600383 - DNA, 20 bp, Artificial
  CRISPR gRNA sequence
tttgttaattttttttattg

SEQ ID NO: 600384 - DNA, 20 bp, Artificial
  CRISPR gRNA sequence
ttgttaattttttttattgt

SEQ ID NO: 600385 - DNA, 20 bp, Artificial
  CRISPR gRNA sequence
tttttattgtgggttgatta

SEQ ID NO: 600386 - DNA, 20 bp, Artificial
  CRISPR gRNA sequence
ttctaaatgatatttcctta

SEQ ID NO: 600387 - DNA, 20 bp, Artificial
  CRISPR gRNA sequence
gatatttccttatagtttct

SEQ ID NO: 600388 - DNA, 20 bp, Artificial
  CRISPR gRNA sequence
atatttccttatagtttcta

SEQ ID NO: 600389 - DNA, 20 bp, Artificial
  CRISPR gRNA sequence
tatttccttatagtttctaa

SEQ ID NO: 600390 - DNA, 20 bp, Artificial
  CRISPR gRNA sequence
gggaaaaatgtattacctta

SEQ ID NO: 600391 - DNA, 20 bp, Artificial
  CRISPR gRNA sequence
atgtattaccttacagtttg

SEQ ID NO: 600392 - DNA, 20 bp, Artificial
  CRISPR gRNA sequence
tgtattaccttacagtttga

SEQ ID NO: 600393 - DNA, 20 bp, Artificial
  CRISPR gRNA sequence
tgcatgccattgcgtgtata

SEQ ID NO: 600394 - DNA, 20 bp, Artificial
  CRISPR gRNA sequence
gccattgcgtgtataaagca

SEQ ID NO: 600395 - DNA, 20 bp, Artificial
  CRISPR gRNA sequence
ttgcgtgtataaagcaaagt

SEQ ID NO: 600396 - DNA, 20 bp, Artificial
  CRISPR gRNA sequence
acatcttatgtgacaatgaa

SEQ ID NO: 600397 - DNA, 20 bp, Artificial
  CRISPR gRNA sequence
tgacaatgaatagaaaccaa

SEQ ID NO: 600398 - DNA, 20 bp, Artificial
  CRISPR gRNA sequence
caaaagattatattttgtga

SEQ ID NO: 600399 - DNA, 20 bp, Artificial
  CRISPR gRNA sequence
aagattatattttgtgaaag

SEQ ID NO: 600400 - DNA, 20 bp, Artificial
  CRISPR gRNA sequence
agattatattttgtgaaagc

SEQ ID NO: 600401 - DNA, 20 bp, Artificial
  CRISPR gRNA sequence
ttgtgaaagcaggtgacaat

SEQ ID NO: 600402 - DNA, 20 bp, Artificial
  CRISPR gRNA sequence
gacaatgagctttcacccga

SEQ ID NO: 600403 - DNA, 20 bp, Artificial
  CRISPR gRNA sequence
acaatgagctttcacccgaa

SEQ ID NO: 600404 - DNA, 20 bp, Artificial
  CRISPR gRNA sequence
caatgagctttcacccgaaa

SEQ ID NO: 600405 - DNA, 20 bp, Artificial
  CRISPR gRNA sequence
atgagctttcacccgaaagg

SEQ ID NO: 600406 - DNA, 20 bp, Artificial
  CRISPR gRNA sequence
cgaaagggagcactccaata

SEQ ID NO: 600407 - DNA, 20 bp, Artificial
  CRISPR gRNA sequence
atggcaattgacctcacctc

SEQ ID NO: 600408 - DNA, 20 bp, Artificial
  CRISPR gRNA sequence
ctcacctcaagcacacccaa

SEQ ID NO: 600409 - DNA, 20 bp, Artificial
  CRISPR gRNA sequence
cctcaagcacacccaatgga

SEQ ID NO: 600410 - DNA, 20 bp, Artificial
  CRISPR gRNA sequence
aatggacagcatgcctcacc

SEQ ID NO: 600411 - DNA, 20 bp, Artificial
  CRISPR gRNA sequence
gcctcaccaagtcacatgac

SEQ ID NO: 600412 - DNA, 20 bp, Artificial
  CRISPR gRNA sequence
tcaccaagtcacatgacaag

SEQ ID NO: 600413 - DNA, 20 bp, Artificial
  CRISPR gRNA sequence
caagtcacatgacaagcagt

SEQ ID NO: 600414 - DNA, 20 bp, Artificial
  CRISPR gRNA sequence
tttgtgtgtgtgtgtctctc

SEQ ID NO: 600415 - DNA, 20 bp, Artificial
  CRISPR gRNA sequence
tgtgtgtgtctctccagcaa

SEQ ID NO: 600416 - DNA, 20 bp, Artificial
  CRISPR gRNA sequence
agcaacagactttaatttgt

SEQ ID NO: 600417 - DNA, 20 bp, Artificial
  CRISPR gRNA sequence
gcaacagactttaatttgtt

SEQ ID NO: 600418 - DNA, 20 bp, Artificial
  CRISPR gRNA sequence
actttaatttgttaggtctg

SEQ ID NO: 600419 - DNA, 20 bp, Artificial
  CRISPR gRNA sequence
ctttaatttgttaggtctgt

SEQ ID NO: 600420 - DNA, 20 bp, Artificial
  CRISPR gRNA sequence
tttaatttgttaggtctgtg

SEQ ID NO: 600421 - DNA, 20 bp, Artificial
  CRISPR gRNA sequence
tgtggggtcctctcacattg

SEQ ID NO: 600422 - DNA, 20 bp, Artificial
  CRISPR gRNA sequence
ggtcctctcacattgtggta

SEQ ID NO: 600423 - DNA, 20 bp, Artificial
  CRISPR gRNA sequence
ttgtggtatagctactgtta

SEQ ID NO: 600424 - DNA, 20 bp, Artificial
  CRISPR gRNA sequence
tactgttatagattttgcta

SEQ ID NO: 600425 - DNA, 20 bp, Artificial
  CRISPR gRNA sequence
gttatagattttgctaaaga

SEQ ID NO: 600426 - DNA, 20 bp, Artificial
  CRISPR gRNA sequence
ttgctaaagaaagaacaaca

SEQ ID NO: 600427 - DNA, 20 bp, Artificial
  CRISPR gRNA sequence
agatttattcctgttcattc

SEQ ID NO: 600428 - DNA, 20 bp, Artificial
  CRISPR gRNA sequence
attctagtattataaaacat

SEQ ID NO: 600429 - DNA, 20 bp, Artificial
  CRISPR gRNA sequence
taaaacatgagcctgcttac

SEQ ID NO: 600430 - DNA, 20 bp, Artificial
  CRISPR gRNA sequence
ttactagtctgaactatccc

SEQ ID NO: 600431 - DNA, 20 bp, Artificial
  CRISPR gRNA sequence
tactagtctgaactatccca

SEQ ID NO: 600432 - DNA, 20 bp, Artificial
  CRISPR gRNA sequence
tagtctgaactatcccaagg

SEQ ID NO: 600433 - DNA, 20 bp, Artificial
  CRISPR gRNA sequence
aactatcccaaggtggcatt

SEQ ID NO: 600434 - DNA, 20 bp, Artificial
  CRISPR gRNA sequence
actatcccaaggtggcattt

SEQ ID NO: 600435 - DNA, 20 bp, Artificial
  CRISPR gRNA sequence
tatcccaaggtggcatttgg

SEQ ID NO: 600436 - DNA, 20 bp, Artificial
  CRISPR gRNA sequence
ccaaggtggcatttgggagc

SEQ ID NO: 600437 - DNA, 20 bp, Artificial
  CRISPR gRNA sequence
gagctggtgcttacctgtat

SEQ ID NO: 600438 - DNA, 20 bp, Artificial
  CRISPR gRNA sequence
agctggtgcttacctgtatc

SEQ ID NO: 600439 - DNA, 20 bp, Artificial
  CRISPR gRNA sequence
ggtgcttacctgtatcaggt

SEQ ID NO: 600440 - DNA, 20 bp, Artificial
  CRISPR gRNA sequence
cttacctgtatcaggtaaga

SEQ ID NO: 600441 - DNA, 20 bp, Artificial
  CRISPR gRNA sequence
ttacctgtatcaggtaagaa

SEQ ID NO: 600442 - DNA, 20 bp, Artificial
  CRISPR gRNA sequence
ctgtatcaggtaagaaaggt

SEQ ID NO: 600443 - DNA, 20 bp, Artificial
  CRISPR gRNA sequence
taagaaaggttagaatttgc

SEQ ID NO: 600444 - DNA, 20 bp, Artificial
  CRISPR gRNA sequence
tggttgttgttttgacttgc

SEQ ID NO: 600445 - DNA, 20 bp, Artificial
  CRISPR gRNA sequence
ggttgttgttttgacttgcc

SEQ ID NO: 600446 - DNA, 20 bp, Artificial
  CRISPR gRNA sequence
tgacttgccaggtttatgac

SEQ ID NO: 600447 - DNA, 20 bp, Artificial
  CRISPR gRNA sequence
actggattttttgttgttgt

SEQ ID NO: 600448 - DNA, 20 bp, Artificial
  CRISPR gRNA sequence
ctggattttttgttgttgtt

SEQ ID NO: 600449 - DNA, 20 bp, Artificial
  CRISPR gRNA sequence
ttgttgttgggtaaaaaatg

SEQ ID NO: 600450 - DNA, 20 bp, Artificial
  CRISPR gRNA sequence
atgtggaaacgtcacttcca

SEQ ID NO: 600451 - DNA, 20 bp, Artificial
  CRISPR gRNA sequence
tgtggaaacgtcacttccaa

SEQ ID NO: 600452 - DNA, 20 bp, Artificial
  CRISPR gRNA sequence
cacttccaaaggactcttca

SEQ ID NO: 600453 - DNA, 20 bp, Artificial
  CRISPR gRNA sequence
gaaataattttatgttgcct

SEQ ID NO: 600454 - DNA, 20 bp, Artificial
  CRISPR gRNA sequence
ataattttatgttgccttgg

SEQ ID NO: 600455 - DNA, 20 bp, Artificial
  CRISPR gRNA sequence
ttttatgttgccttggtaga

SEQ ID NO: 600456 - DNA, 20 bp, Artificial
  CRISPR gRNA sequence
ttggtagaaagctaaaccgt

SEQ ID NO: 600457 - DNA, 20 bp, Artificial
  CRISPR gRNA sequence
aaccgtcagtgataaaatta

SEQ ID NO: 600458 - DNA, 20 bp, Artificial
  CRISPR gRNA sequence
cttgcttttaaaaaatgtga

SEQ ID NO: 600459 - DNA, 20 bp, Artificial
  CRISPR gRNA sequence
atgtgaaagtttcttctcca

SEQ ID NO: 600460 - DNA, 20 bp, Artificial
  CRISPR gRNA sequence
aagtttcttctccaaagcat

SEQ ID NO: 600461 - DNA, 20 bp, Artificial
  CRISPR gRNA sequence
tttcttctccaaagcattgg

SEQ ID NO: 600462 - DNA, 20 bp, Artificial
  CRISPR gRNA sequence
tctccaaagcattggaagtg

SEQ ID NO: 600463 - DNA, 20 bp, Artificial
  CRISPR gRNA sequence
gaagtgtaattgaaaattta

SEQ ID NO: 600464 - DNA, 20 bp, Artificial
  CRISPR gRNA sequence
ctcatttatatccatttctg

SEQ ID NO: 600465 - DNA, 20 bp, Artificial
  CRISPR gRNA sequence
ttatatccatttctgtagca

SEQ ID NO: 600466 - DNA, 20 bp, Artificial
  CRISPR gRNA sequence
catttctgtagcaaagttga

SEQ ID NO: 600467 - DNA, 20 bp, Artificial
  CRISPR gRNA sequence
atttctgtagcaaagttgaa

SEQ ID NO: 600468 - DNA, 20 bp, Artificial
  CRISPR gRNA sequence
aaagttgaaaggcttttgtc

SEQ ID NO: 600469 - DNA, 20 bp, Artificial
  CRISPR gRNA sequence
agttgaaaggcttttgtcca

SEQ ID NO: 600470 - DNA, 20 bp, Artificial
  CRISPR gRNA sequence
tgaaaggcttttgtccagag

SEQ ID NO: 600471 - DNA, 20 bp, Artificial
  CRISPR gRNA sequence
agagaagaactgataaaatt

SEQ ID NO: 600472 - DNA, 20 bp, Artificial
  CRISPR gRNA sequence
aagaactgataaaatttgga

SEQ ID NO: 600473 - DNA, 20 bp, Artificial
  CRISPR gRNA sequence
ggaaagatgttttgaatttg

SEQ ID NO: 600474 - DNA, 20 bp, Artificial
  CRISPR gRNA sequence
gaaagatgttttgaatttgt

SEQ ID NO: 600475 - DNA, 20 bp, Artificial
  CRISPR gRNA sequence
atgttttgaatttgtaggaa

SEQ ID NO: 600476 - DNA, 20 bp, Artificial
  CRISPR gRNA sequence
tttgaatttgtaggaaaaga

SEQ ID NO: 600477 - DNA, 20 bp, Artificial
  CRISPR gRNA sequence
tttgtaggaaaagacagttt

SEQ ID NO: 600478 - DNA, 20 bp, Artificial
  CRISPR gRNA sequence
tttggctactgtttttgata

SEQ ID NO: 600479 - DNA, 20 bp, Artificial
  CRISPR gRNA sequence
ttggctactgtttttgataa

SEQ ID NO: 600480 - DNA, 20 bp, Artificial
  CRISPR gRNA sequence
tggctactgtttttgataaa

SEQ ID NO: 600481 - DNA, 20 bp, Artificial
  CRISPR gRNA sequence
atacattgtttttatgtaat

SEQ ID NO: 600482 - DNA, 20 bp, Artificial
  CRISPR gRNA sequence
agatgcaacttacatgctgt

SEQ ID NO: 600483 - DNA, 20 bp, Artificial
  CRISPR gRNA sequence
aacttacatgctgtcagtga

SEQ ID NO: 600484 - DNA, 20 bp, Artificial
  CRISPR gRNA sequence
ttacatgctgtcagtgacag

SEQ ID NO: 600485 - DNA, 20 bp, Artificial
  CRISPR gRNA sequence
agaagacaaaatactttatt

SEQ ID NO: 600486 - DNA, 20 bp, Artificial
  CRISPR gRNA sequence
aaaatactttattaagaata

SEQ ID NO: 600487 - DNA, 20 bp, Artificial
  CRISPR gRNA sequence
tcttaattataatattttat

SEQ ID NO: 600488 - DNA, 20 bp, Artificial
  CRISPR gRNA sequence
attataatattttatcagtt

SEQ ID NO: 600489 - DNA, 20 bp, Artificial
  CRISPR gRNA sequence
attttatcagtttagttatc

SEQ ID NO: 600490 - DNA, 20 bp, Artificial
  CRISPR gRNA sequence
tcagtttagttatcaagtgc

SEQ ID NO: 600491 - DNA, 20 bp, Artificial
  CRISPR gRNA sequence
gctttattactcttactcaa

SEQ ID NO: 600492 - DNA, 20 bp, Artificial
  CRISPR gRNA sequence
atcttgttttctttatactt

SEQ ID NO: 600493 - DNA, 20 bp, Artificial
  CRISPR gRNA sequence
tattttattcttacatgtta

SEQ ID NO: 600494 - DNA, 20 bp, Artificial
  CRISPR gRNA sequence
ttattcttacatgttataga

SEQ ID NO: 600495 - DNA, 20 bp, Artificial
  CRISPR gRNA sequence
tattcttacatgttatagaa

SEQ ID NO: 600496 - DNA, 20 bp, Artificial
  CRISPR gRNA sequence
acatgttatagaaaggacat

SEQ ID NO: 600497 - DNA, 20 bp, Artificial
  CRISPR gRNA sequence
gtaaatataattaaatttac

SEQ ID NO: 600498 - DNA, 20 bp, Artificial
  CRISPR gRNA sequence
aatttacaagttttctgttt

SEQ ID NO: 600499 - DNA, 20 bp, Artificial
  CRISPR gRNA sequence
ttctgttttggcaatatgtg

SEQ ID NO: 600500 - DNA, 20 bp, Artificial
  CRISPR gRNA sequence
tctgttttggcaatatgtga

SEQ ID NO: 600501 - DNA, 20 bp, Artificial
  CRISPR gRNA sequence
ttttggcaatatgtgaagga

SEQ ID NO: 600502 - DNA, 20 bp, Artificial
  CRISPR gRNA sequence
tttggcaatatgtgaaggaa

SEQ ID NO: 600503 - DNA, 20 bp, Artificial
  CRISPR gRNA sequence
tctttccttccccccccccg

SEQ ID NO: 600504 - DNA, 20 bp, Artificial
  CRISPR gRNA sequence
cccccgaagatttaataact

SEQ ID NO: 600505 - DNA, 20 bp, Artificial
  CRISPR gRNA sequence
gaagatttaataactaagaa

SEQ ID NO: 600506 - DNA, 20 bp, Artificial
  CRISPR gRNA sequence
tgaatcatgtacttaattat

SEQ ID NO: 600507 - DNA, 20 bp, Artificial
  CRISPR gRNA sequence
gtaaatgtattctgactatc

SEQ ID NO: 600508 - DNA, 20 bp, Artificial
  CRISPR gRNA sequence
aaatgtattctgactatcca

SEQ ID NO: 600509 - DNA, 20 bp, Artificial
  CRISPR gRNA sequence
atgtattctgactatccaga

SEQ ID NO: 600510 - DNA, 20 bp, Artificial
  CRISPR gRNA sequence
gtattctgactatccagaga

SEQ ID NO: 600511 - DNA, 20 bp, Artificial
  CRISPR gRNA sequence
ctttttctttttacttctaa

SEQ ID NO: 600512 - DNA, 20 bp, Artificial
  CRISPR gRNA sequence
ctaacagctctcgaaactgt

SEQ ID NO: 600513 - DNA, 20 bp, Artificial
  CRISPR gRNA sequence
gtaagttattataaaactgc

SEQ ID NO: 600514 - DNA, 20 bp, Artificial
  CRISPR gRNA sequence
ttattataaaactgcaagct

SEQ ID NO: 600515 - DNA, 20 bp, Artificial
  CRISPR gRNA sequence
aaaactgcaagcttagtaat

SEQ ID NO: 600516 - DNA, 20 bp, Artificial
  CRISPR gRNA sequence
agtaaatactactgaaattt

SEQ ID NO: 600517 - DNA, 20 bp, Artificial
  CRISPR gRNA sequence
tgaaatttaagcaatttata

SEQ ID NO: 600518 - DNA, 20 bp, Artificial
  CRISPR gRNA sequence
ttttgcaatttattaacttt

SEQ ID NO: 600519 - DNA, 20 bp, Artificial
  CRISPR gRNA sequence
ttattaactttaagtaattt

SEQ ID NO: 600520 - DNA, 20 bp, Artificial
  CRISPR gRNA sequence
attgacttgaaattatgatt

SEQ ID NO: 600521 - DNA, 20 bp, Artificial
  CRISPR gRNA sequence
aatttgctttatttatttaa

SEQ ID NO: 600522 - DNA, 20 bp, Artificial
  CRISPR gRNA sequence
ttaaaagttgtaattctttt

SEQ ID NO: 600523 - DNA, 20 bp, Artificial
  CRISPR gRNA sequence
ttgtaattcttttaagtaat

SEQ ID NO: 600524 - DNA, 20 bp, Artificial
  CRISPR gRNA sequence
ttaagtaatgagcacttcct

SEQ ID NO: 600525 - DNA, 20 bp, Artificial
  CRISPR gRNA sequence
ttcctaagaaaatttaatta

SEQ ID NO: 600526 - DNA, 20 bp, Artificial
  CRISPR gRNA sequence
ctaagaaaatttaattatag

SEQ ID NO: 600527 - DNA, 20 bp, Artificial
  CRISPR gRNA sequence
agaaaatttaattatagaag

SEQ ID NO: 600528 - DNA, 20 bp, Artificial
  CRISPR gRNA sequence
cttacaattcccgtatcatt

SEQ ID NO: 600529 - DNA, 20 bp, Artificial
  CRISPR gRNA sequence
caattcccgtatcatttaga

SEQ ID NO: 600530 - DNA, 20 bp, Artificial
  CRISPR gRNA sequence
atcatttagaaagaaaaaac

SEQ ID NO: 600531 - DNA, 20 bp, Artificial
  CRISPR gRNA sequence
ttagaaagaaaaaactagta

SEQ ID NO: 600532 - DNA, 20 bp, Artificial
  CRISPR gRNA sequence
aaagaaaaaactagtaaagt

SEQ ID NO: 600533 - DNA, 20 bp, Artificial
  CRISPR gRNA sequence
gaaaaaactagtaaagttag

SEQ ID NO: 600534 - DNA, 20 bp, Artificial
  CRISPR gRNA sequence
aaaaaactagtaaagttagc

SEQ ID NO: 600535 - DNA, 20 bp, Artificial
  CRISPR gRNA sequence
tttgcattcatgttttttgc

SEQ ID NO: 600536 - DNA, 20 bp, Artificial
  CRISPR gRNA sequence
aatatactatgactacaatt

SEQ ID NO: 600537 - DNA, 20 bp, Artificial
  CRISPR gRNA sequence
atatactatgactacaattt

SEQ ID NO: 600538 - DNA, 20 bp, Artificial
  CRISPR gRNA sequence
tatgactacaatttaggcaa

SEQ ID NO: 600539 - DNA, 20 bp, Artificial
  CRISPR gRNA sequence
atttttacatttcaatatac

SEQ ID NO: 600540 - DNA, 20 bp, Artificial
  CRISPR gRNA sequence
atttcaatatactagttatt

SEQ ID NO: 600541 - DNA, 20 bp, Artificial
  CRISPR gRNA sequence
ggtgtaatgtttttatttct

SEQ ID NO: 600542 - DNA, 20 bp, Artificial
  CRISPR gRNA sequence
ataactcacacaatttccta

SEQ ID NO: 600543 - DNA, 20 bp, Artificial
  CRISPR gRNA sequence
aactcacacaatttcctaaa

SEQ ID NO: 600544 - DNA, 20 bp, Artificial
  CRISPR gRNA sequence
acaatttcctaaagagtaaa

SEQ ID NO: 600545 - DNA, 20 bp, Artificial
  CRISPR gRNA sequence
aatttcctaaagagtaaaaa

SEQ ID NO: 600546 - DNA, 20 bp, Artificial
  CRISPR gRNA sequence
gagtaaaaagagataatatg

SEQ ID NO: 600547 - DNA, 20 bp, Artificial
  CRISPR gRNA sequence
agataatatgtagtttctat

SEQ ID NO: 600548 - DNA, 20 bp, Artificial
  CRISPR gRNA sequence
aatatgtagtttctattagt

SEQ ID NO: 600549 - DNA, 20 bp, Artificial
  CRISPR gRNA sequence
agtttctattagttagctat

SEQ ID NO: 600550 - DNA, 20 bp, Artificial
  CRISPR gRNA sequence
tattagttagctattggctt

SEQ ID NO: 600551 - DNA, 20 bp, Artificial
  CRISPR gRNA sequence
ctttagaaacattgcatgta

SEQ ID NO: 600552 - DNA, 20 bp, Artificial
  CRISPR gRNA sequence
tttagaaacattgcatgtat

SEQ ID NO: 600553 - DNA, 20 bp, Artificial
  CRISPR gRNA sequence
ttagaaacattgcatgtata

SEQ ID NO: 600554 - DNA, 20 bp, Artificial
  CRISPR gRNA sequence
gaaacattgcatgtataggg

SEQ ID NO: 600555 - DNA, 20 bp, Artificial
  CRISPR gRNA sequence
aaacattgcatgtatagggt

SEQ ID NO: 600556 - DNA, 20 bp, Artificial
  CRISPR gRNA sequence
aacattgcatgtatagggta

SEQ ID NO: 600557 - DNA, 20 bp, Artificial
  CRISPR gRNA sequence
cattgcatgtatagggtagg

SEQ ID NO: 600558 - DNA, 20 bp, Artificial
  CRISPR gRNA sequence
ggtagggagtaactgttaat

SEQ ID NO: 600559 - DNA, 20 bp, Artificial
  CRISPR gRNA sequence
tagggagtaactgttaatca

SEQ ID NO: 600560 - DNA, 20 bp, Artificial
  CRISPR gRNA sequence
gagacttgactgtcatcccc

SEQ ID NO: 600561 - DNA, 20 bp, Artificial
  CRISPR gRNA sequence
tcatcccctagacacaacca

SEQ ID NO: 600562 - DNA, 20 bp, Artificial
  CRISPR gRNA sequence
catcccctagacacaaccac

SEQ ID NO: 600563 - DNA, 20 bp, Artificial
  CRISPR gRNA sequence
accacaggaaaatgcttgtc

SEQ ID NO: 600564 - DNA, 20 bp, Artificial
  CRISPR gRNA sequence
acaggaaaatgcttgtcaag

SEQ ID NO: 600565 - DNA, 20 bp, Artificial
  CRISPR gRNA sequence
atgcttgtcaagtggttaat

SEQ ID NO: 600566 - DNA, 20 bp, Artificial
  CRISPR gRNA sequence
tttatttctgaatttgattc

SEQ ID NO: 600567 - DNA, 20 bp, Artificial
  CRISPR gRNA sequence
gaatttgattctggttttgc

SEQ ID NO: 600568 - DNA, 20 bp, Artificial
  CRISPR gRNA sequence
ggttttgcaagtacttgctt

SEQ ID NO: 600569 - DNA, 20 bp, Artificial
  CRISPR gRNA sequence
ttgcaagtacttgcttcaga

SEQ ID NO: 600570 - DNA, 20 bp, Artificial
  CRISPR gRNA sequence
tgcaagtacttgcttcagaa

SEQ ID NO: 600571 - DNA, 20 bp, Artificial
  CRISPR gRNA sequence
aagtacttgcttcagaaagg

SEQ ID NO: 600572 - DNA, 20 bp, Artificial
  CRISPR gRNA sequence
cactcatctttttaaataaa

SEQ ID NO: 600573 - DNA, 20 bp, Artificial
  CRISPR gRNA sequence
atctttttaaataaacagtg

SEQ ID NO: 600574 - DNA, 20 bp, Artificial
  CRISPR gRNA sequence
ctttttaaataaacagtgca

SEQ ID NO: 600575 - DNA, 20 bp, Artificial
  CRISPR gRNA sequence
taaataaacagtgcagagtg

SEQ ID NO: 600576 - DNA, 20 bp, Artificial
  CRISPR gRNA sequence
aaataaacagtgcagagtgt

SEQ ID NO: 600577 - DNA, 20 bp, Artificial
  CRISPR gRNA sequence
catgatcaatttgaacaaat

SEQ ID NO: 600578 - DNA, 20 bp, Artificial
  CRISPR gRNA sequence
gaactgtgcttttgacattt

SEQ ID NO: 600579 - DNA, 20 bp, Artificial
  CRISPR gRNA sequence
gagcttttctcacccaacaa

SEQ ID NO: 600580 - DNA, 20 bp, Artificial
  CRISPR gRNA sequence
aacaacagtaaacttatgtt

SEQ ID NO: 600581 - DNA, 20 bp, Artificial
  CRISPR gRNA sequence
aacagtaaacttatgtttgg

SEQ ID NO: 600582 - DNA, 20 bp, Artificial
  CRISPR gRNA sequence
cagtaaacttatgtttggta

SEQ ID NO: 600583 - DNA, 20 bp, Artificial
  CRISPR gRNA sequence
gtaaacttatgtttggtaga

SEQ ID NO: 600584 - DNA, 20 bp, Artificial
  CRISPR gRNA sequence
tagagagttttttaacttac

SEQ ID NO: 600585 - DNA, 20 bp, Artificial
  CRISPR gRNA sequence
ttttttaacttactagcctg

SEQ ID NO: 600586 - DNA, 20 bp, Artificial
  CRISPR gRNA sequence
agcctgtggcaattccatgt

SEQ ID NO: 600587 - DNA, 20 bp, Artificial
  CRISPR gRNA sequence
gtggcaattccatgttagta

SEQ ID NO: 600588 - DNA, 20 bp, Artificial
  CRISPR gRNA sequence
tggcaattccatgttagtac

SEQ ID NO: 600589 - DNA, 20 bp, Artificial
  CRISPR gRNA sequence
ttccatgttagtacaggttt

SEQ ID NO: 600590 - DNA, 20 bp, Artificial
  CRISPR gRNA sequence
tgttagtacaggttttggct

SEQ ID NO: 600591 - DNA, 20 bp, Artificial
  CRISPR gRNA sequence
ggctaagatgcacgtgtttt

SEQ ID NO: 600592 - DNA, 20 bp, Artificial
  CRISPR gRNA sequence
gctaagatgcacgtgttttc

SEQ ID NO: 600593 - DNA, 20 bp, Artificial
  CRISPR gRNA sequence
tgttttcaggttcttttcca

SEQ ID NO: 600594 - DNA, 20 bp, Artificial
  CRISPR gRNA sequence
ttttcaggttcttttccaaa

SEQ ID NO: 600595 - DNA, 20 bp, Artificial
  CRISPR gRNA sequence
ggttcttttccaaagagttg

SEQ ID NO: 600596 - DNA, 20 bp, Artificial
  CRISPR gRNA sequence
gttcttttccaaagagttgc

SEQ ID NO: 600597 - DNA, 20 bp, Artificial
  CRISPR gRNA sequence
gagttgcaggttaaatattt

SEQ ID NO: 600598 - DNA, 20 bp, Artificial
  CRISPR gRNA sequence
aaatattttggctctcactt

SEQ ID NO: 600599 - DNA, 20 bp, Artificial
  CRISPR gRNA sequence
atattttggctctcacttca

SEQ ID NO: 600600 - DNA, 20 bp, Artificial
  CRISPR gRNA sequence
tgtctcttgcatcctttatg

SEQ ID NO: 600601 - DNA, 20 bp, Artificial
  CRISPR gRNA sequence
ctttatgtagcctctattta

SEQ ID NO: 600602 - DNA, 20 bp, Artificial
  CRISPR gRNA sequence
tagcctctatttacagtatc

SEQ ID NO: 600603 - DNA, 20 bp, Artificial
  CRISPR gRNA sequence
agcctctatttacagtatct

SEQ ID NO: 600604 - DNA, 20 bp, Artificial
  CRISPR gRNA sequence
cagtatctaggttacccact

SEQ ID NO: 600605 - DNA, 20 bp, Artificial
  CRISPR gRNA sequence
agtatctaggttacccactt

SEQ ID NO: 600606 - DNA, 20 bp, Artificial
  CRISPR gRNA sequence
taggttacccacttaggtgt

SEQ ID NO: 600607 - DNA, 20 bp, Artificial
  CRISPR gRNA sequence
ttacccacttaggtgttaga

SEQ ID NO: 600608 - DNA, 20 bp, Artificial
  CRISPR gRNA sequence
acccacttaggtgttagatg

SEQ ID NO: 600609 - DNA, 20 bp, Artificial
  CRISPR gRNA sequence
cacttaggtgttagatggag

SEQ ID NO: 600610 - DNA, 20 bp, Artificial
  CRISPR gRNA sequence
tacccatttttcctctctgt

SEQ ID NO: 600611 - DNA, 20 bp, Artificial
  CRISPR gRNA sequence
tttttcctctctgttagatc

SEQ ID NO: 600612 - DNA, 20 bp, Artificial
  CRISPR gRNA sequence
ttttcctctctgttagatct

SEQ ID NO: 600613 - DNA, 20 bp, Artificial
  CRISPR gRNA sequence
ttcctctctgttagatctag

SEQ ID NO: 600614 - DNA, 20 bp, Artificial
  CRISPR gRNA sequence
tgttagatctaggagaatat

SEQ ID NO: 600615 - DNA, 20 bp, Artificial
  CRISPR gRNA sequence
ctaggagaatatcagcattt

SEQ ID NO: 600616 - DNA, 20 bp, Artificial
  CRISPR gRNA sequence
atcagcattttagattgcca

SEQ ID NO: 600617 - DNA, 20 bp, Artificial
  CRISPR gRNA sequence
ttttagattgccaaagcaaa

SEQ ID NO: 600618 - DNA, 20 bp, Artificial
  CRISPR gRNA sequence
attgccaaagcaaatagtga

SEQ ID NO: 600619 - DNA, 20 bp, Artificial
  CRISPR gRNA sequence
tgccaaagcaaatagtgata

SEQ ID NO: 600620 - DNA, 20 bp, Artificial
  CRISPR gRNA sequence
ccaaagcaaatagtgataga

SEQ ID NO: 600621 - DNA, 20 bp, Artificial
  CRISPR gRNA sequence
caaagcaaatagtgatagag

SEQ ID NO: 600622 - DNA, 20 bp, Artificial
  CRISPR gRNA sequence
aggaactctcgtctattaat

SEQ ID NO: 600623 - DNA, 20 bp, Artificial
  CRISPR gRNA sequence
tctcgtctattaattagaac

SEQ ID NO: 600624 - DNA, 20 bp, Artificial
  CRISPR gRNA sequence
tcgtctattaattagaacaa

SEQ ID NO: 600625 - DNA, 20 bp, Artificial
  CRISPR gRNA sequence
attaattagaacaagagacc

SEQ ID NO: 600626 - DNA, 20 bp, Artificial
  CRISPR gRNA sequence
tagaacaagagacctagaat

SEQ ID NO: 600627 - DNA, 20 bp, Artificial
  CRISPR gRNA sequence
tctgatgtttttctgtgact

SEQ ID NO: 600628 - DNA, 20 bp, Artificial
  CRISPR gRNA sequence
aataattttttgtgtgcatc

SEQ ID NO: 600629 - DNA, 20 bp, Artificial
  CRISPR gRNA sequence
ctgtcaaatcacttgtgtct

SEQ ID NO: 600630 - DNA, 20 bp, Artificial
  CRISPR gRNA sequence
tcacttgtgtctgagatcac

SEQ ID NO: 600631 - DNA, 20 bp, Artificial
  CRISPR gRNA sequence
tgttgactttgtttaatgaa

SEQ ID NO: 600632 - DNA, 20 bp, Artificial
  CRISPR gRNA sequence
atatcttcaaatatacttcc

SEQ ID NO: 600633 - DNA, 20 bp, Artificial
  CRISPR gRNA sequence
atcttcaaatatacttcctg

SEQ ID NO: 600634 - DNA, 20 bp, Artificial
  CRISPR gRNA sequence
tcttcaaatatacttcctgg

SEQ ID NO: 600635 - DNA, 20 bp, Artificial
  CRISPR gRNA sequence
cttcaaatatacttcctgga

SEQ ID NO: 600636 - DNA, 20 bp, Artificial
  CRISPR gRNA sequence
agggtgcctgcttccaaaaa

SEQ ID NO: 600637 - DNA, 20 bp, Artificial
  CRISPR gRNA sequence
agaattgcaattttgattga

SEQ ID NO: 600638 - DNA, 20 bp, Artificial
  CRISPR gRNA sequence
aattttgattgaaagtgtta

SEQ ID NO: 600639 - DNA, 20 bp, Artificial
  CRISPR gRNA sequence
attgaaagtgttaaagctaa

SEQ ID NO: 600640 - DNA, 20 bp, Artificial
  CRISPR gRNA sequence
aagtaaatgtgaaaaccttt

SEQ ID NO: 600641 - DNA, 20 bp, Artificial
  CRISPR gRNA sequence
aaatgtgaaaacctttaaga

SEQ ID NO: 600642 - DNA, 20 bp, Artificial
  CRISPR gRNA sequence
aaaacctttaagacagtttc

SEQ ID NO: 600643 - DNA, 20 bp, Artificial
  CRISPR gRNA sequence
acctttaagacagtttctag

SEQ ID NO: 600644 - DNA, 20 bp, Artificial
  CRISPR gRNA sequence
tttaagacagtttctagtag

SEQ ID NO: 600645 - DNA, 20 bp, Artificial
  CRISPR gRNA sequence
ttaagacagtttctagtagc

SEQ ID NO: 600646 - DNA, 20 bp, Artificial
  CRISPR gRNA sequence
agacagtttctagtagcagg

SEQ ID NO: 600647 - DNA, 20 bp, Artificial
  CRISPR gRNA sequence
gacagtttctagtagcagga

SEQ ID NO: 600648 - DNA, 20 bp, Artificial
  CRISPR gRNA sequence
cagtttctagtagcaggaag

SEQ ID NO: 600649 - DNA, 20 bp, Artificial
  CRISPR gRNA sequence
gtttctagtagcaggaagga

SEQ ID NO: 600650 - DNA, 20 bp, Artificial
  CRISPR gRNA sequence
tttctagtagcaggaaggag

SEQ ID NO: 600651 - DNA, 20 bp, Artificial
  CRISPR gRNA sequence
tagtagcaggaaggagagga

SEQ ID NO: 600652 - DNA, 20 bp, Artificial
  CRISPR gRNA sequence
agtagcaggaaggagaggat

SEQ ID NO: 600653 - DNA, 20 bp, Artificial
  CRISPR gRNA sequence
gaggatgggaatatatgtgt

SEQ ID NO: 600654 - DNA, 20 bp, Artificial
  CRISPR gRNA sequence
aggatgggaatatatgtgta

SEQ ID NO: 600655 - DNA, 20 bp, Artificial
  CRISPR gRNA sequence
gatgggaatatatgtgtaag

SEQ ID NO: 600656 - DNA, 20 bp, Artificial
  CRISPR gRNA sequence
atgggaatatatgtgtaagg

SEQ ID NO: 600657 - DNA, 20 bp, Artificial
  CRISPR gRNA sequence
tatatgtgtaaggaggaaaa

SEQ ID NO: 600658 - DNA, 20 bp, Artificial
  CRISPR gRNA sequence
ggaaaaaagttatttttaaa

SEQ ID NO: 600659 - DNA, 20 bp, Artificial
  CRISPR gRNA sequence
aacagttaaaaaaataaaat

SEQ ID NO: 600660 - DNA, 20 bp, Artificial
  CRISPR gRNA sequence
gtaaattttttttttttttt

SEQ ID NO: 600661 - DNA, 20 bp, Artificial
  CRISPR gRNA sequence
tttttttttttttagtaaaa

SEQ ID NO: 600662 - DNA, 20 bp, Artificial
  CRISPR gRNA sequence
tagtaaaacagctaacattc

SEQ ID NO: 600663 - DNA, 20 bp, Artificial
  CRISPR gRNA sequence
aaaacagctaacattctggc

SEQ ID NO: 600664 - DNA, 20 bp, Artificial
  CRISPR gRNA sequence
agctaacattctggccagaa

SEQ ID NO: 600665 - DNA, 20 bp, Artificial
  CRISPR gRNA sequence
ctggccagaaaagtatcaat

SEQ ID NO: 600666 - DNA, 20 bp, Artificial
  CRISPR gRNA sequence
tggccagaaaagtatcaata

SEQ ID NO: 600667 - DNA, 20 bp, Artificial
  CRISPR gRNA sequence
gaaaagtatcaataaggcat

SEQ ID NO: 600668 - DNA, 20 bp, Artificial
  CRISPR gRNA sequence
aaagtatcaataaggcatga

SEQ ID NO: 600669 - DNA, 20 bp, Artificial
  CRISPR gRNA sequence
gcatgagagctcacttattt

SEQ ID NO: 600670 - DNA, 20 bp, Artificial
  CRISPR gRNA sequence
gagctcacttattttggctt

SEQ ID NO: 600671 - DNA, 20 bp, Artificial
  CRISPR gRNA sequence
agctcacttattttggcttt

SEQ ID NO: 600672 - DNA, 20 bp, Artificial
  CRISPR gRNA sequence
tcacttattttggctttagg

SEQ ID NO: 600673 - DNA, 20 bp, Artificial
  CRISPR gRNA sequence
cacttattttggctttagga

SEQ ID NO: 600674 - DNA, 20 bp, Artificial
  CRISPR gRNA sequence
ttattttggctttaggaagg

SEQ ID NO: 600675 - DNA, 20 bp, Artificial
  CRISPR gRNA sequence
tttggctttaggaaggtggt

SEQ ID NO: 600676 - DNA, 20 bp, Artificial
  CRISPR gRNA sequence
aaggtggtcagtactactgt

SEQ ID NO: 600677 - DNA, 20 bp, Artificial
  CRISPR gRNA sequence
aggtggtcagtactactgta

SEQ ID NO: 600678 - DNA, 20 bp, Artificial
  CRISPR gRNA sequence
tcagtactactgtaaggtcc

SEQ ID NO: 600679 - DNA, 20 bp, Artificial
  CRISPR gRNA sequence
taaggtcccagcatttgttt

SEQ ID NO: 600680 - DNA, 20 bp, Artificial
  CRISPR gRNA sequence
cagcatttgtttaagctatt

SEQ ID NO: 600681 - DNA, 20 bp, Artificial
  CRISPR gRNA sequence
agctatttggtaactcttct

SEQ ID NO: 600682 - DNA, 20 bp, Artificial
  CRISPR gRNA sequence
ttggtaactcttctaagatg

SEQ ID NO: 600683 - DNA, 20 bp, Artificial
  CRISPR gRNA sequence
tggtaactcttctaagatga

SEQ ID NO: 600684 - DNA, 20 bp, Artificial
  CRISPR gRNA sequence
ggtaactcttctaagatgaa

SEQ ID NO: 600685 - DNA, 20 bp, Artificial
  CRISPR gRNA sequence
gtttctgtgcaacttgctgc

SEQ ID NO: 600686 - DNA, 20 bp, Artificial
  CRISPR gRNA sequence
ctattgtataaaaataatga

SEQ ID NO: 600687 - DNA, 20 bp, Artificial
  CRISPR gRNA sequence
ttgtataaaaataatgacgg

SEQ ID NO: 600688 - DNA, 20 bp, Artificial
  CRISPR gRNA sequence
cggcagctatcattatttga

SEQ ID NO: 600689 - DNA, 20 bp, Artificial
  CRISPR gRNA sequence
ctatcattatttgacagtgc

SEQ ID NO: 600690 - DNA, 20 bp, Artificial
  CRISPR gRNA sequence
attatttgacagtgctagaa

SEQ ID NO: 600691 - DNA, 20 bp, Artificial
  CRISPR gRNA sequence
tatttgacagtgctagaata

SEQ ID NO: 600692 - DNA, 20 bp, Artificial
  CRISPR gRNA sequence
acagtgctagaatagagcac

SEQ ID NO: 600693 - DNA, 20 bp, Artificial
  CRISPR gRNA sequence
agaatagagcactggtgact

SEQ ID NO: 600694 - DNA, 20 bp, Artificial
  CRISPR gRNA sequence
gaatagagcactggtgactt

SEQ ID NO: 600695 - DNA, 20 bp, Artificial
  CRISPR gRNA sequence
atagagcactggtgacttgg

SEQ ID NO: 600696 - DNA, 20 bp, Artificial
  CRISPR gRNA sequence
tagagcactggtgacttggg

SEQ ID NO: 600697 - DNA, 20 bp, Artificial
  CRISPR gRNA sequence
agagcactggtgacttggga

SEQ ID NO: 600698 - DNA, 20 bp, Artificial
  CRISPR gRNA sequence
agcactggtgacttgggagg

SEQ ID NO: 600699 - DNA, 20 bp, Artificial
  CRISPR gRNA sequence
cactggtgacttgggaggga

SEQ ID NO: 600700 - DNA, 20 bp, Artificial
  CRISPR gRNA sequence
aaaaatgttataatgcctga

SEQ ID NO: 600701 - DNA, 20 bp, Artificial
  CRISPR gRNA sequence
ttataatgcctgacagtttt

SEQ ID NO: 600702 - DNA, 20 bp, Artificial
  CRISPR gRNA sequence
cagtttttggttttaaaatt

SEQ ID NO: 600703 - DNA, 20 bp, Artificial
  CRISPR gRNA sequence
ggttttaaaatttagcatct

SEQ ID NO: 600704 - DNA, 20 bp, Artificial
  CRISPR gRNA sequence
ttagcatctaagataaactt

SEQ ID NO: 600705 - DNA, 20 bp, Artificial
  CRISPR gRNA sequence
gcatctaagataaacttaag

SEQ ID NO: 600706 - DNA, 20 bp, Artificial
  CRISPR gRNA sequence
tctaagataaacttaagaag

SEQ ID NO: 600707 - DNA, 20 bp, Artificial
  CRISPR gRNA sequence
agataaacttaagaagaagt

SEQ ID NO: 600708 - DNA, 20 bp, Artificial
  CRISPR gRNA sequence
ataaacttaagaagaagtaa

SEQ ID NO: 600709 - DNA, 20 bp, Artificial
  CRISPR gRNA sequence
taaacttaagaagaagtaag

SEQ ID NO: 600710 - DNA, 20 bp, Artificial
  CRISPR gRNA sequence
taagaagaagtaagaggtat

SEQ ID NO: 600711 - DNA, 20 bp, Artificial
  CRISPR gRNA sequence
tttataatgactacttccta

SEQ ID NO: 600712 - DNA, 20 bp, Artificial
  CRISPR gRNA sequence
tggttttgaatgaattttct

SEQ ID NO: 600713 - DNA, 20 bp, Artificial
  CRISPR gRNA sequence
gttttgaatgaattttctta

SEQ ID NO: 600714 - DNA, 20 bp, Artificial
  CRISPR gRNA sequence
gaactttaaactttttcttc

SEQ ID NO: 600715 - DNA, 20 bp, Artificial
  CRISPR gRNA sequence
taaactttttcttctggaat

SEQ ID NO: 600716 - DNA, 20 bp, Artificial
  CRISPR gRNA sequence
aaactttttcttctggaatg

SEQ ID NO: 600717 - DNA, 20 bp, Artificial
  CRISPR gRNA sequence
ggaatgaggatgtctttgtt

SEQ ID NO: 600718 - DNA, 20 bp, Artificial
  CRISPR gRNA sequence
atgaggatgtctttgttaag

SEQ ID NO: 600719 - DNA, 20 bp, Artificial
  CRISPR gRNA sequence
ggatgtctttgttaagaaga

SEQ ID NO: 600720 - DNA, 20 bp, Artificial
  CRISPR gRNA sequence
gaagatggacattgttgcct

SEQ ID NO: 600721 - DNA, 20 bp, Artificial
  CRISPR gRNA sequence
acattgttgcctgagatcat

SEQ ID NO: 600722 - DNA, 20 bp, Artificial
  CRISPR gRNA sequence
agatcattagtgtacatatt

SEQ ID NO: 600723 - DNA, 20 bp, Artificial
  CRISPR gRNA sequence
ttgagtctgctgacaatctt

SEQ ID NO: 600724 - DNA, 20 bp, Artificial
  CRISPR gRNA sequence
ctgctgacaatcttcggtgt

SEQ ID NO: 600725 - DNA, 20 bp, Artificial
  CRISPR gRNA sequence
tgctgacaatcttcggtgtc

SEQ ID NO: 600726 - DNA, 20 bp, Artificial
  CRISPR gRNA sequence
gctgacaatcttcggtgtca

SEQ ID NO: 600727 - DNA, 20 bp, Artificial
  CRISPR gRNA sequence
atcttcggtgtcagggatga

SEQ ID NO: 600728 - DNA, 20 bp, Artificial
  CRISPR gRNA sequence
gatgacagtatatgccttga

SEQ ID NO: 600729 - DNA, 20 bp, Artificial
  CRISPR gRNA sequence
gtatatgccttgatggctat

SEQ ID NO: 600730 - DNA, 20 bp, Artificial
  CRISPR gRNA sequence
tgatggctattggaaataca

SEQ ID NO: 600731 - DNA, 20 bp, Artificial
  CRISPR gRNA sequence
tattggaaatacacagtgtt

SEQ ID NO: 600732 - DNA, 20 bp, Artificial
  CRISPR gRNA sequence
tgttaagtgatttttaaaaa

SEQ ID NO: 600733 - DNA, 20 bp, Artificial
  CRISPR gRNA sequence
tgatttttaaaaatagaatc

SEQ ID NO: 600734 - DNA, 20 bp, Artificial
  CRISPR gRNA sequence
gatttttaaaaatagaatct

SEQ ID NO: 600735 - DNA, 20 bp, Artificial
  CRISPR gRNA sequence
aaaaatagaatctgggactt

SEQ ID NO: 600736 - DNA, 20 bp, Artificial
  CRISPR gRNA sequence
aatctgggacttaagaatct

SEQ ID NO: 600737 - DNA, 20 bp, Artificial
  CRISPR gRNA sequence
tgggacttaagaatctgaga

SEQ ID NO: 600738 - DNA, 20 bp, Artificial
  CRISPR gRNA sequence
agaatctgagacagacatct

SEQ ID NO: 600739 - DNA, 20 bp, Artificial
  CRISPR gRNA sequence
tctgagacagacatctcaga

SEQ ID NO: 600740 - DNA, 20 bp, Artificial
  CRISPR gRNA sequence
aaataatccatattgtattt

SEQ ID NO: 600741 - DNA, 20 bp, Artificial
  CRISPR gRNA sequence
catattgtatttcggcccat

SEQ ID NO: 600742 - DNA, 20 bp, Artificial
  CRISPR gRNA sequence
ttgtgattccttctgtttct

SEQ ID NO: 600743 - DNA, 20 bp, Artificial
  CRISPR gRNA sequence
gattccttctgtttcttggt

SEQ ID NO: 600744 - DNA, 20 bp, Artificial
  CRISPR gRNA sequence
gctcatttccaattcttgca

SEQ ID NO: 600745 - DNA, 20 bp, Artificial
  CRISPR gRNA sequence
ccaattcttgcatagttgtt

SEQ ID NO: 600746 - DNA, 20 bp, Artificial
  CRISPR gRNA sequence
cttgcatagttgttcagtat

SEQ ID NO: 600747 - DNA, 20 bp, Artificial
  CRISPR gRNA sequence
tagttgttcagtattggttt

SEQ ID NO: 600748 - DNA, 20 bp, Artificial
  CRISPR gRNA sequence
ggtttcagactgttctatac

SEQ ID NO: 600749 - DNA, 20 bp, Artificial
  CRISPR gRNA sequence
ttcagactgttctatactgg

SEQ ID NO: 600750 - DNA, 20 bp, Artificial
  CRISPR gRNA sequence
tcagactgttctatactggc

SEQ ID NO: 600751 - DNA, 20 bp, Artificial
  CRISPR gRNA sequence
actattttgaaaattgttta

SEQ ID NO: 600752 - DNA, 20 bp, Artificial
  CRISPR gRNA sequence
ttatgtataaatttactttg

SEQ ID NO: 600753 - DNA, 20 bp, Artificial
  CRISPR gRNA sequence
tatgtataaatttactttgc

SEQ ID NO: 600754 - DNA, 20 bp, Artificial
  CRISPR gRNA sequence
gtataaatttactttgcagg

SEQ ID NO: 600755 - DNA, 20 bp, Artificial
  CRISPR gRNA sequence
tttgcaggtagttacttaaa

SEQ ID NO: 600756 - DNA, 20 bp, Artificial
  CRISPR gRNA sequence
ttgcaggtagttacttaaat

SEQ ID NO: 600757 - DNA, 20 bp, Artificial
  CRISPR gRNA sequence
aatttgtttctattacttta

SEQ ID NO: 600758 - DNA, 20 bp, Artificial
  CRISPR gRNA sequence
tctattactttaaagctgtt

SEQ ID NO: 600759 - DNA, 20 bp, Artificial
  CRISPR gRNA sequence
attactttaaagctgttaag

SEQ ID NO: 600760 - DNA, 20 bp, Artificial
  CRISPR gRNA sequence
tgttaagtggatcaactgta

SEQ ID NO: 600761 - DNA, 20 bp, Artificial
  CRISPR gRNA sequence
gtacagtcaatgctatttat

SEQ ID NO: 600762 - DNA, 20 bp, Artificial
  CRISPR gRNA sequence
aatgctatttatcagtctga

SEQ ID NO: 600763 - DNA, 20 bp, Artificial
  CRISPR gRNA sequence
ctatttatcagtctgatggc

SEQ ID NO: 600764 - DNA, 20 bp, Artificial
  CRISPR gRNA sequence
tatttatcagtctgatggcc

SEQ ID NO: 600765 - DNA, 20 bp, Artificial
  CRISPR gRNA sequence
ttatcagtctgatggccagg

SEQ ID NO: 600766 - DNA, 20 bp, Artificial
  CRISPR gRNA sequence
tgatggccaggtggcatgta

SEQ ID NO: 600767 - DNA, 20 bp, Artificial
  CRISPR gRNA sequence
ccaggtggcatgtatggaat

SEQ ID NO: 600768 - DNA, 20 bp, Artificial
  CRISPR gRNA sequence
ggtggcatgtatggaatcgg

SEQ ID NO: 600769 - DNA, 20 bp, Artificial
  CRISPR gRNA sequence
ggcatgtatggaatcggaag

SEQ ID NO: 600770 - DNA, 20 bp, Artificial
  CRISPR gRNA sequence
atgtatggaatcggaagaag

SEQ ID NO: 600771 - DNA, 20 bp, Artificial
  CRISPR gRNA sequence
atggaatcggaagaagtagt

SEQ ID NO: 600772 - DNA, 20 bp, Artificial
  CRISPR gRNA sequence
atcggaagaagtagtaagtc

SEQ ID NO: 600773 - DNA, 20 bp, Artificial
  CRISPR gRNA sequence
agtagtaagtctagttttac

SEQ ID NO: 600774 - DNA, 20 bp, Artificial
  CRISPR gRNA sequence
gtagtaagtctagttttaca

SEQ ID NO: 600775 - DNA, 20 bp, Artificial
  CRISPR gRNA sequence
acaaggctctgaccaataat

SEQ ID NO: 600776 - DNA, 20 bp, Artificial
  CRISPR gRNA sequence
caaggctctgaccaataatc

SEQ ID NO: 600777 - DNA, 20 bp, Artificial
  CRISPR gRNA sequence
gctctgaccaataatcaggt

SEQ ID NO: 600778 - DNA, 20 bp, Artificial
  CRISPR gRNA sequence
ctctgaccaataatcaggtc

SEQ ID NO: 600779 - DNA, 20 bp, Artificial
  CRISPR gRNA sequence
tctgaccaataatcaggtca

SEQ ID NO: 600780 - DNA, 20 bp, Artificial
  CRISPR gRNA sequence
aataatcaggtcagggaatc

SEQ ID NO: 600781 - DNA, 20 bp, Artificial
  CRISPR gRNA sequence
ggaatctagtttattctttt

SEQ ID NO: 600782 - DNA, 20 bp, Artificial
  CRISPR gRNA sequence
aatctagtttattcttttca

SEQ ID NO: 600783 - DNA, 20 bp, Artificial
  CRISPR gRNA sequence
cttcacattaatttttttct

SEQ ID NO: 600784 - DNA, 20 bp, Artificial
  CRISPR gRNA sequence
acattaatttttttcttagc

SEQ ID NO: 600785 - DNA, 20 bp, Artificial
  CRISPR gRNA sequence
tcttagctagtttccatttt

SEQ ID NO: 600786 - DNA, 20 bp, Artificial
  CRISPR gRNA sequence
tagtttccatttttagaacc

SEQ ID NO: 600787 - DNA, 20 bp, Artificial
  CRISPR gRNA sequence
tccatttttagaacctagcg

SEQ ID NO: 600788 - DNA, 20 bp, Artificial
  CRISPR gRNA sequence
atttttagaacctagcgaag

SEQ ID NO: 600789 - DNA, 20 bp, Artificial
  CRISPR gRNA sequence
tttagaacctagcgaagcag

SEQ ID NO: 600790 - DNA, 20 bp, Artificial
  CRISPR gRNA sequence
tgatttctatttttcatatg

SEQ ID NO: 600791 - DNA, 20 bp, Artificial
  CRISPR gRNA sequence
atttttcatatgtggaaatt

SEQ ID NO: 600792 - DNA, 20 bp, Artificial
  CRISPR gRNA sequence
tttttcatatgtggaaattg

SEQ ID NO: 600793 - DNA, 20 bp, Artificial
  CRISPR gRNA sequence
tatgtggaaattgaggcttg

SEQ ID NO: 600794 - DNA, 20 bp, Artificial
  CRISPR gRNA sequence
gaagaaatcaatttacctct

SEQ ID NO: 600795 - DNA, 20 bp, Artificial
  CRISPR gRNA sequence
agaaatcaatttacctctta

SEQ ID NO: 600796 - DNA, 20 bp, Artificial
  CRISPR gRNA sequence
aatttacctcttagagaact

SEQ ID NO: 600797 - DNA, 20 bp, Artificial
  CRISPR gRNA sequence
ttacctcttagagaacttag

SEQ ID NO: 600798 - DNA, 20 bp, Artificial
  CRISPR gRNA sequence
ctcttagagaacttagcaga

SEQ ID NO: 600799 - DNA, 20 bp, Artificial
  CRISPR gRNA sequence
gagaacttagcagaaagatg

SEQ ID NO: 600800 - DNA, 20 bp, Artificial
  CRISPR gRNA sequence
tagcagaaagatgaagttat

SEQ ID NO: 600801 - DNA, 20 bp, Artificial
  CRISPR gRNA sequence
agcagaaagatgaagttatc

SEQ ID NO: 600802 - DNA, 20 bp, Artificial
  CRISPR gRNA sequence
aaagatgaagttatcaggat

SEQ ID NO: 600803 - DNA, 20 bp, Artificial
  CRISPR gRNA sequence
aagatgaagttatcaggatt

SEQ ID NO: 600804 - DNA, 20 bp, Artificial
  CRISPR gRNA sequence
aaaattgtgatattaccttg

SEQ ID NO: 600805 - DNA, 20 bp, Artificial
  CRISPR gRNA sequence
aaattgtgatattaccttgt

SEQ ID NO: 600806 - DNA, 20 bp, Artificial
  CRISPR gRNA sequence
tgtgatattaccttgtgggt

SEQ ID NO: 600807 - DNA, 20 bp, Artificial
  CRISPR gRNA sequence
atattaccttgtgggttagt

SEQ ID NO: 600808 - DNA, 20 bp, Artificial
  CRISPR gRNA sequence
tctctacaatgtcaccttct

SEQ ID NO: 600809 - DNA, 20 bp, Artificial
  CRISPR gRNA sequence
ctctacaatgtcaccttctc

SEQ ID NO: 600810 - DNA, 20 bp, Artificial
  CRISPR gRNA sequence
tctacaatgtcaccttctca

SEQ ID NO: 600811 - DNA, 20 bp, Artificial
  CRISPR gRNA sequence
gtgtctgccgtgtccaatac

SEQ ID NO: 600812 - DNA, 20 bp, Artificial
  CRISPR gRNA sequence
tatttttgtgacaaatatct

SEQ ID NO: 600813 - DNA, 20 bp, Artificial
  CRISPR gRNA sequence
tgtgacaaatatctcagaaa

SEQ ID NO: 600814 - DNA, 20 bp, Artificial
  CRISPR gRNA sequence
gacaaatatctcagaaatag

SEQ ID NO: 600815 - DNA, 20 bp, Artificial
  CRISPR gRNA sequence
caaatatctcagaaatagaa

SEQ ID NO: 600816 - DNA, 20 bp, Artificial
  CRISPR gRNA sequence
agaaatagaagagttattat

SEQ ID NO: 600817 - DNA, 20 bp, Artificial
  CRISPR gRNA sequence
gaaatagaagagttattatg

SEQ ID NO: 600818 - DNA, 20 bp, Artificial
  CRISPR gRNA sequence
aaatagaagagttattatga

SEQ ID NO: 600819 - DNA, 20 bp, Artificial
  CRISPR gRNA sequence
tagaagagttattatgaggg

SEQ ID NO: 600820 - DNA, 20 bp, Artificial
  CRISPR gRNA sequence
gaagagttattatgagggtg

SEQ ID NO: 600821 - DNA, 20 bp, Artificial
  CRISPR gRNA sequence
ttatgagggtggagtgatat

SEQ ID NO: 600822 - DNA, 20 bp, Artificial
  CRISPR gRNA sequence
gtgatatcagattatctttt

SEQ ID NO: 600823 - DNA, 20 bp, Artificial
  CRISPR gRNA sequence
tgatatcagattatcttttc

SEQ ID NO: 600824 - DNA, 20 bp, Artificial
  CRISPR gRNA sequence
tatcagattatcttttcagg

SEQ ID NO: 600825 - DNA, 20 bp, Artificial
  CRISPR gRNA sequence
atcagattatcttttcaggc

SEQ ID NO: 600826 - DNA, 20 bp, Artificial
  CRISPR gRNA sequence
ttctaatgcactttttgaaa

SEQ ID NO: 600827 - DNA, 20 bp, Artificial
  CRISPR gRNA sequence
ctaatgcactttttgaaata

SEQ ID NO: 600828 - DNA, 20 bp, Artificial
  CRISPR gRNA sequence
ttgaaatagagcctatatta

SEQ ID NO: 600829 - DNA, 20 bp, Artificial
  CRISPR gRNA sequence
tgaaatagagcctatattat

SEQ ID NO: 600830 - DNA, 20 bp, Artificial
  CRISPR gRNA sequence
gcctatattatgggacttac

SEQ ID NO: 600831 - DNA, 20 bp, Artificial
  CRISPR gRNA sequence
atgggacttaccagctttct

SEQ ID NO: 600832 - DNA, 20 bp, Artificial
  CRISPR gRNA sequence
gctttctgagttttcttctg

SEQ ID NO: 600833 - DNA, 20 bp, Artificial
  CRISPR gRNA sequence
ctgagttttcttctgtagct

SEQ ID NO: 600834 - DNA, 20 bp, Artificial
  CRISPR gRNA sequence
ttttcttctgtagcttagtt

SEQ ID NO: 600835 - DNA, 20 bp, Artificial
  CRISPR gRNA sequence
tcttctgtagcttagtttgg

SEQ ID NO: 600836 - DNA, 20 bp, Artificial
  CRISPR gRNA sequence
gtttggcagtcacccttgct

SEQ ID NO: 600837 - DNA, 20 bp, Artificial
  CRISPR gRNA sequence
cacccttgcttggatttctg

SEQ ID NO: 600838 - DNA, 20 bp, Artificial
  CRISPR gRNA sequence
acccttgcttggatttctgt

SEQ ID NO: 600839 - DNA, 20 bp, Artificial
  CRISPR gRNA sequence
gacacaccctaatataacac

SEQ ID NO: 600840 - DNA, 20 bp, Artificial
  CRISPR gRNA sequence
caccctaatataacaccaga

SEQ ID NO: 600841 - DNA, 20 bp, Artificial
  CRISPR gRNA sequence
accctaatataacaccagat

SEQ ID NO: 600842 - DNA, 20 bp, Artificial
  CRISPR gRNA sequence
ataacaccagatgggcttga

SEQ ID NO: 600843 - DNA, 20 bp, Artificial
  CRISPR gRNA sequence
gatagaaaatcttctgtttt

SEQ ID NO: 600844 - DNA, 20 bp, Artificial
  CRISPR gRNA sequence
ctgttttaagtcgccatact

SEQ ID NO: 600845 - DNA, 20 bp, Artificial
  CRISPR gRNA sequence
tgttttaagtcgccatactt

SEQ ID NO: 600846 - DNA, 20 bp, Artificial
  CRISPR gRNA sequence
tacccaatgtactttacatt

SEQ ID NO: 600847 - DNA, 20 bp, Artificial
  CRISPR gRNA sequence
tacatttagttcttgtttat

SEQ ID NO: 600848 - DNA, 20 bp, Artificial
  CRISPR gRNA sequence
acatttagttcttgtttatt

SEQ ID NO: 600849 - DNA, 20 bp, Artificial
  CRISPR gRNA sequence
catttagttcttgtttatta

SEQ ID NO: 600850 - DNA, 20 bp, Artificial
  CRISPR gRNA sequence
attagggaattaaataaaaa

SEQ ID NO: 600851 - DNA, 20 bp, Artificial
  CRISPR gRNA sequence
gttctgatttaatttcttta

SEQ ID NO: 600852 - DNA, 20 bp, Artificial
  CRISPR gRNA sequence
ttctgatttaatttctttac

SEQ ID NO: 600853 - DNA, 20 bp, Artificial
  CRISPR gRNA sequence
tttaatttctttacaggtat

SEQ ID NO: 600854 - DNA, 20 bp, Artificial
  CRISPR gRNA sequence
taatttctttacaggtatca

SEQ ID NO: 600855 - DNA, 20 bp, Artificial
  CRISPR gRNA sequence
atgtcataactatgtaccaa

SEQ ID NO: 600856 - DNA, 20 bp, Artificial
  CRISPR gRNA sequence
gtcataactatgtaccaaaa

SEQ ID NO: 600857 - DNA, 20 bp, Artificial
  CRISPR gRNA sequence
tatgtaccaaaagagaaaaa

SEQ ID NO: 600858 - DNA, 20 bp, Artificial
  CRISPR gRNA sequence
atgtaccaaaagagaaaaaa

SEQ ID NO: 600859 - DNA, 20 bp, Artificial
  CRISPR gRNA sequence
tgtaccaaaagagaaaaaaa

SEQ ID NO: 600860 - DNA, 20 bp, Artificial
  CRISPR gRNA sequence
agagaaaaaaagggaaaaaa

SEQ ID NO: 600861 - DNA, 20 bp, Artificial
  CRISPR gRNA sequence
gagaaaaaaagggaaaaaaa

SEQ ID NO: 600862 - DNA, 20 bp, Artificial
  CRISPR gRNA sequence
aaaaaagggaaaaaaaagga

SEQ ID NO: 600863 - DNA, 20 bp, Artificial
  CRISPR gRNA sequence
gggaaaaaaaaggaaagtaa

SEQ ID NO: 600864 - DNA, 20 bp, Artificial
  CRISPR gRNA sequence
gaaaaaaaaggaaagtaaaa

SEQ ID NO: 600865 - DNA, 20 bp, Artificial
  CRISPR gRNA sequence
aaaaaaaaggaaagtaaaag

SEQ ID NO: 600866 - DNA, 20 bp, Artificial
  CRISPR gRNA sequence
aaaggaaagtaaaagaggta

SEQ ID NO: 600867 - DNA, 20 bp, Artificial
  CRISPR gRNA sequence
taaaagaggtatagatttgt

SEQ ID NO: 600868 - DNA, 20 bp, Artificial
  CRISPR gRNA sequence
atagatttgttggtaatcaa

SEQ ID NO: 600869 - DNA, 20 bp, Artificial
  CRISPR gRNA sequence
ttgttggtaatcaacagcaa

SEQ ID NO: 600870 - DNA, 20 bp, Artificial
  CRISPR gRNA sequence
ctcccaactccctatctttt

SEQ ID NO: 600871 - DNA, 20 bp, Artificial
  CRISPR gRNA sequence
ccctatctttttagtctgct

SEQ ID NO: 600872 - DNA, 20 bp, Artificial
  CRISPR gRNA sequence
tttttagtctgcttagtact

SEQ ID NO: 600873 - DNA, 20 bp, Artificial
  CRISPR gRNA sequence
ctgcttagtactgagaatta

SEQ ID NO: 600874 - DNA, 20 bp, Artificial
  CRISPR gRNA sequence
tcaaaaaacaaaacaacgta

SEQ ID NO: 600875 - DNA, 20 bp, Artificial
  CRISPR gRNA sequence
aaaaacaaaacaacgtatgg

SEQ ID NO: 600876 - DNA, 20 bp, Artificial
  CRISPR gRNA sequence
acaaaacaacgtatggcaga

SEQ ID NO: 600877 - DNA, 20 bp, Artificial
  CRISPR gRNA sequence
tcaaaatctgtctttcccac

SEQ ID NO: 600878 - DNA, 20 bp, Artificial
  CRISPR gRNA sequence
aaatctgtctttcccactag

SEQ ID NO: 600879 - DNA, 20 bp, Artificial
  CRISPR gRNA sequence
tagaagtacttttttaaaaa

SEQ ID NO: 600880 - DNA, 20 bp, Artificial
  CRISPR gRNA sequence
agaagtacttttttaaaaaa

SEQ ID NO: 600881 - DNA, 20 bp, Artificial
  CRISPR gRNA sequence
accattgattgtgttctatt

SEQ ID NO: 600882 - DNA, 20 bp, Artificial
  CRISPR gRNA sequence
cattgattgtgttctattga

SEQ ID NO: 600883 - DNA, 20 bp, Artificial
  CRISPR gRNA sequence
tctattgagagtcttcctgt

SEQ ID NO: 600884 - DNA, 20 bp, Artificial
  CRISPR gRNA sequence
ccataatgaattttcatctc

SEQ ID NO: 600885 - DNA, 20 bp, Artificial
  CRISPR gRNA sequence
cataatgaattttcatctct

SEQ ID NO: 600886 - DNA, 20 bp, Artificial
  CRISPR gRNA sequence
ttacatatttttatcatatt

SEQ ID NO: 600887 - DNA, 20 bp, Artificial
  CRISPR gRNA sequence
atcatatttggaaatatcaa

SEQ ID NO: 600888 - DNA, 20 bp, Artificial
  CRISPR gRNA sequence
atatttggaaatatcaatag

SEQ ID NO: 600889 - DNA, 20 bp, Artificial
  CRISPR gRNA sequence
atttggaaatatcaatagca

SEQ ID NO: 600890 - DNA, 20 bp, Artificial
  CRISPR gRNA sequence
aaatatcaatagcagagttc

SEQ ID NO: 600891 - DNA, 20 bp, Artificial
  CRISPR gRNA sequence
cagagttccagtcctaaaat

SEQ ID NO: 600892 - DNA, 20 bp, Artificial
  CRISPR gRNA sequence
agagttccagtcctaaaatg

SEQ ID NO: 600893 - DNA, 20 bp, Artificial
  CRISPR gRNA sequence
gttccagtcctaaaatgagg

SEQ ID NO: 600894 - DNA, 20 bp, Artificial
  CRISPR gRNA sequence
tttatgttaaatgtatttgt

SEQ ID NO: 600895 - DNA, 20 bp, Artificial
  CRISPR gRNA sequence
aaatgtatttgttggcctgt

SEQ ID NO: 600896 - DNA, 20 bp, Artificial
  CRISPR gRNA sequence
tttccttttgcgaattaatt

SEQ ID NO: 600897 - DNA, 20 bp, Artificial
  CRISPR gRNA sequence
aatatacctctgttttgata

SEQ ID NO: 600898 - DNA, 20 bp, Artificial
  CRISPR gRNA sequence
atatacctctgttttgatat

SEQ ID NO: 600899 - DNA, 20 bp, Artificial
  CRISPR gRNA sequence
acctctgttttgatataggt

SEQ ID NO: 600900 - DNA, 20 bp, Artificial
  CRISPR gRNA sequence
cctctgttttgatataggta

SEQ ID NO: 600901 - DNA, 20 bp, Artificial
  CRISPR gRNA sequence
tgatataggtaaggaatatt

SEQ ID NO: 600902 - DNA, 20 bp, Artificial
  CRISPR gRNA sequence
gatataggtaaggaatattt

SEQ ID NO: 600903 - DNA, 20 bp, Artificial
  CRISPR gRNA sequence
atataggtaaggaatattta

SEQ ID NO: 600904 - DNA, 20 bp, Artificial
  CRISPR gRNA sequence
aggtaaggaatatttaggga

SEQ ID NO: 600905 - DNA, 20 bp, Artificial
  CRISPR gRNA sequence
ataaatgttataatcaccac

SEQ ID NO: 600906 - DNA, 20 bp, Artificial
  CRISPR gRNA sequence
aaatgttataatcaccacta

SEQ ID NO: 600907 - DNA, 20 bp, Artificial
  CRISPR gRNA sequence
gttataatcaccactagagc

SEQ ID NO: 600908 - DNA, 20 bp, Artificial
  CRISPR gRNA sequence
tataatcaccactagagcga

SEQ ID NO: 600909 - DNA, 20 bp, Artificial
  CRISPR gRNA sequence
aatcaccactagagcgagag

SEQ ID NO: 600910 - DNA, 20 bp, Artificial
  CRISPR gRNA sequence
atcaccactagagcgagaga

SEQ ID NO: 600911 - DNA, 20 bp, Artificial
  CRISPR gRNA sequence
accactagagcgagagaagg

SEQ ID NO: 600912 - DNA, 20 bp, Artificial
  CRISPR gRNA sequence
cactagagcgagagaaggta

SEQ ID NO: 600913 - DNA, 20 bp, Artificial
  CRISPR gRNA sequence
actagagcgagagaaggtag

SEQ ID NO: 600914 - DNA, 20 bp, Artificial
  CRISPR gRNA sequence
ctagagcgagagaaggtaga

SEQ ID NO: 600915 - DNA, 20 bp, Artificial
  CRISPR gRNA sequence
tagagcgagagaaggtagag

SEQ ID NO: 600916 - DNA, 20 bp, Artificial
  CRISPR gRNA sequence
gtagaggggcatcctttatt

SEQ ID NO: 600917 - DNA, 20 bp, Artificial
  CRISPR gRNA sequence
catcctttattgagtgcact

SEQ ID NO: 600918 - DNA, 20 bp, Artificial
  CRISPR gRNA sequence
attgagtgcacttagtatgc

SEQ ID NO: 600919 - DNA, 20 bp, Artificial
  CRISPR gRNA sequence
tgtctccacatcaattctgt

SEQ ID NO: 600920 - DNA, 20 bp, Artificial
  CRISPR gRNA sequence
gtctccacatcaattctgtg

SEQ ID NO: 600921 - DNA, 20 bp, Artificial
  CRISPR gRNA sequence
tccacatcaattctgtgagg

SEQ ID NO: 600922 - DNA, 20 bp, Artificial
  CRISPR gRNA sequence
ccacatcaattctgtgaggt

SEQ ID NO: 600923 - DNA, 20 bp, Artificial
  CRISPR gRNA sequence
attttataacacttaaaact

SEQ ID NO: 600924 - DNA, 20 bp, Artificial
  CRISPR gRNA sequence
ttttataacacttaaaactg

SEQ ID NO: 600925 - DNA, 20 bp, Artificial
  CRISPR gRNA sequence
taacacttaaaactgaggct

SEQ ID NO: 600926 - DNA, 20 bp, Artificial
  CRISPR gRNA sequence
cacttaaaactgaggctcag

SEQ ID NO: 600927 - DNA, 20 bp, Artificial
  CRISPR gRNA sequence
ttaaaactgaggctcagaag

SEQ ID NO: 600928 - DNA, 20 bp, Artificial
  CRISPR gRNA sequence
aaactgaggctcagaagcag

SEQ ID NO: 600929 - DNA, 20 bp, Artificial
  CRISPR gRNA sequence
gctcagaagcagtagactgt

SEQ ID NO: 600930 - DNA, 20 bp, Artificial
  CRISPR gRNA sequence
cagaagcagtagactgtgag

SEQ ID NO: 600931 - DNA, 20 bp, Artificial
  CRISPR gRNA sequence
actgtgagtggttaaaaata

SEQ ID NO: 600932 - DNA, 20 bp, Artificial
  CRISPR gRNA sequence
ctgtgagtggttaaaaatat

SEQ ID NO: 600933 - DNA, 20 bp, Artificial
  CRISPR gRNA sequence
tatgggctttgcaattatgc

SEQ ID NO: 600934 - DNA, 20 bp, Artificial
  CRISPR gRNA sequence
gctttgcaattatgctggcc

SEQ ID NO: 600935 - DNA, 20 bp, Artificial
  CRISPR gRNA sequence
ctttgcaattatgctggcct

SEQ ID NO: 600936 - DNA, 20 bp, Artificial
  CRISPR gRNA sequence
gcaattatgctggcctgggt

SEQ ID NO: 600937 - DNA, 20 bp, Artificial
  CRISPR gRNA sequence
cctgctttgctgtgtgacct

SEQ ID NO: 600938 - DNA, 20 bp, Artificial
  CRISPR gRNA sequence
ccatgtcacttcacatctct

SEQ ID NO: 600939 - DNA, 20 bp, Artificial
  CRISPR gRNA sequence
cacttcacatctctgagctc

SEQ ID NO: 600940 - DNA, 20 bp, Artificial
  CRISPR gRNA sequence
agctccagtttccttatccg

SEQ ID NO: 600941 - DNA, 20 bp, Artificial
  CRISPR gRNA sequence
cagtttccttatccgtagaa

SEQ ID NO: 600942 - DNA, 20 bp, Artificial
  CRISPR gRNA sequence
agtttccttatccgtagaat

SEQ ID NO: 600943 - DNA, 20 bp, Artificial
  CRISPR gRNA sequence
gtttccttatccgtagaata

SEQ ID NO: 600944 - DNA, 20 bp, Artificial
  CRISPR gRNA sequence
cttatccgtagaatagggat

SEQ ID NO: 600945 - DNA, 20 bp, Artificial
  CRISPR gRNA sequence
ataagcaatacctacctcaa

SEQ ID NO: 600946 - DNA, 20 bp, Artificial
  CRISPR gRNA sequence
taagcaatacctacctcaat

SEQ ID NO: 600947 - DNA, 20 bp, Artificial
  CRISPR gRNA sequence
ctacctcaatgggctgttgt

SEQ ID NO: 600948 - DNA, 20 bp, Artificial
  CRISPR gRNA sequence
ggctgttgtgagatttcaat

SEQ ID NO: 600949 - DNA, 20 bp, Artificial
  CRISPR gRNA sequence
gctgttgtgagatttcaata

SEQ ID NO: 600950 - DNA, 20 bp, Artificial
  CRISPR gRNA sequence
ggcaatacatgcaaaatgct

SEQ ID NO: 600951 - DNA, 20 bp, Artificial
  CRISPR gRNA sequence
aaaatgctcagcacaacttc

SEQ ID NO: 600952 - DNA, 20 bp, Artificial
  CRISPR gRNA sequence
cacaacttctggcacatgct

SEQ ID NO: 600953 - DNA, 20 bp, Artificial
  CRISPR gRNA sequence
taatcactgctgctattact

SEQ ID NO: 600954 - DNA, 20 bp, Artificial
  CRISPR gRNA sequence
atcactgctgctattactca

SEQ ID NO: 600955 - DNA, 20 bp, Artificial
  CRISPR gRNA sequence
actgctgctattactcagag

SEQ ID NO: 600956 - DNA, 20 bp, Artificial
  CRISPR gRNA sequence
tgctattactcagagcagtc

SEQ ID NO: 600957 - DNA, 20 bp, Artificial
  CRISPR gRNA sequence
gcagtcaagttactttttta

SEQ ID NO: 600958 - DNA, 20 bp, Artificial
  CRISPR gRNA sequence
tttatggacctatgacttgt

SEQ ID NO: 600959 - DNA, 20 bp, Artificial
  CRISPR gRNA sequence
gacctatgacttgtaagaaa

SEQ ID NO: 600960 - DNA, 20 bp, Artificial
  CRISPR gRNA sequence
acctatgacttgtaagaaaa

SEQ ID NO: 600961 - DNA, 20 bp, Artificial
  CRISPR gRNA sequence
cctatgacttgtaagaaaaa

SEQ ID NO: 600962 - DNA, 20 bp, Artificial
  CRISPR gRNA sequence
aagggtttgttttcaaatcc

SEQ ID NO: 600963 - DNA, 20 bp, Artificial
  CRISPR gRNA sequence
atccaagtctatttgaaatc

SEQ ID NO: 600964 - DNA, 20 bp, Artificial
  CRISPR gRNA sequence
tccaagtctatttgaaatct

SEQ ID NO: 600965 - DNA, 20 bp, Artificial
  CRISPR gRNA sequence
gctcttttctgtatattgca

SEQ ID NO: 600966 - DNA, 20 bp, Artificial
  CRISPR gRNA sequence
ctcttttctgtatattgcac

SEQ ID NO: 600967 - DNA, 20 bp, Artificial
  CRISPR gRNA sequence
ttctgtatattgcacaggtc

SEQ ID NO: 600968 - DNA, 20 bp, Artificial
  CRISPR gRNA sequence
tctgtatattgcacaggtcc

SEQ ID NO: 600969 - DNA, 20 bp, Artificial
  CRISPR gRNA sequence
ctgtatattgcacaggtcca

SEQ ID NO: 600970 - DNA, 20 bp, Artificial
  CRISPR gRNA sequence
tatattgcacaggtccaggg

SEQ ID NO: 600971 - DNA, 20 bp, Artificial
  CRISPR gRNA sequence
ttgcacaggtccagggaaga

SEQ ID NO: 600972 - DNA, 20 bp, Artificial
  CRISPR gRNA sequence
acaggtccagggaagaaaga

SEQ ID NO: 600973 - DNA, 20 bp, Artificial
  CRISPR gRNA sequence
caggtccagggaagaaagat

SEQ ID NO: 600974 - DNA, 20 bp, Artificial
  CRISPR gRNA sequence
aggtccagggaagaaagata

SEQ ID NO: 600975 - DNA, 20 bp, Artificial
  CRISPR gRNA sequence
gatagggatttctgataatt

SEQ ID NO: 600976 - DNA, 20 bp, Artificial
  CRISPR gRNA sequence
atagggatttctgataattt

SEQ ID NO: 600977 - DNA, 20 bp, Artificial
  CRISPR gRNA sequence
tagggatttctgataattta

SEQ ID NO: 600978 - DNA, 20 bp, Artificial
  CRISPR gRNA sequence
ataatttagggtaaaaattg

SEQ ID NO: 600979 - DNA, 20 bp, Artificial
  CRISPR gRNA sequence
atttagggtaaaaattgaag

SEQ ID NO: 600980 - DNA, 20 bp, Artificial
  CRISPR gRNA sequence
tttagggtaaaaattgaagc

SEQ ID NO: 600981 - DNA, 20 bp, Artificial
  CRISPR gRNA sequence
caggaaccctccgttattta

SEQ ID NO: 600982 - DNA, 20 bp, Artificial
  CRISPR gRNA sequence
cgttatttaaagcatctatg

SEQ ID NO: 600983 - DNA, 20 bp, Artificial
  CRISPR gRNA sequence
taaagcatctatgaagattt

SEQ ID NO: 600984 - DNA, 20 bp, Artificial
  CRISPR gRNA sequence
catctatgaagattttggtt

SEQ ID NO: 600985 - DNA, 20 bp, Artificial
  CRISPR gRNA sequence
tatgaagattttggttaaga

SEQ ID NO: 600986 - DNA, 20 bp, Artificial
  CRISPR gRNA sequence
gattttggttaagaaagaaa

SEQ ID NO: 600987 - DNA, 20 bp, Artificial
  CRISPR gRNA sequence
ttttggttaagaaagaaata

SEQ ID NO: 600988 - DNA, 20 bp, Artificial
  CRISPR gRNA sequence
aatagagtttgtctatatgt

SEQ ID NO: 600989 - DNA, 20 bp, Artificial
  CRISPR gRNA sequence
gtttgtctatatgtcagaat

SEQ ID NO: 600990 - DNA, 20 bp, Artificial
  CRISPR gRNA sequence
tttgtctatatgtcagaatt

SEQ ID NO: 600991 - DNA, 20 bp, Artificial
  CRISPR gRNA sequence
ttgtctatatgtcagaattg

SEQ ID NO: 600992 - DNA, 20 bp, Artificial
  CRISPR gRNA sequence
gtctatatgtcagaattggg

SEQ ID NO: 600993 - DNA, 20 bp, Artificial
  CRISPR gRNA sequence
tctatatgtcagaattgggg

SEQ ID NO: 600994 - DNA, 20 bp, Artificial
  CRISPR gRNA sequence
ctatatgtcagaattgggga

SEQ ID NO: 600995 - DNA, 20 bp, Artificial
  CRISPR gRNA sequence
tatatgtcagaattggggag

SEQ ID NO: 600996 - DNA, 20 bp, Artificial
  CRISPR gRNA sequence
atatgtcagaattggggagg

SEQ ID NO: 600997 - DNA, 20 bp, Artificial
  CRISPR gRNA sequence
tatgtcagaattggggaggg

SEQ ID NO: 600998 - DNA, 20 bp, Artificial
  CRISPR gRNA sequence
gtcagaattggggagggggg

SEQ ID NO: 600999 - DNA, 20 bp, Artificial
  CRISPR gRNA sequence
gggtggcgctcaacattcct

SEQ ID NO: 601000 - DNA, 20 bp, Artificial
  CRISPR gRNA sequence
gcgctcaacattcctgagta

SEQ ID NO: 601001 - DNA, 20 bp, Artificial
  CRISPR gRNA sequence
cattcctgagtatagttttg

SEQ ID NO: 601002 - DNA, 20 bp, Artificial
  CRISPR gRNA sequence
tgtggttttgatgatatgta

SEQ ID NO: 601003 - DNA, 20 bp, Artificial
  CRISPR gRNA sequence
agcaaatcactgcatattat

SEQ ID NO: 601004 - DNA, 20 bp, Artificial
  CRISPR gRNA sequence
actgcatattattggtgttc

SEQ ID NO: 601005 - DNA, 20 bp, Artificial
  CRISPR gRNA sequence
tattggtgttccagatatac

SEQ ID NO: 601006 - DNA, 20 bp, Artificial
  CRISPR gRNA sequence
ccagtcattacaaataacaa

SEQ ID NO: 601007 - DNA, 20 bp, Artificial
  CRISPR gRNA sequence
aaagaaaaaaattcccttaa

SEQ ID NO: 601008 - DNA, 20 bp, Artificial
  CRISPR gRNA sequence
agaaaaaaattcccttaata

SEQ ID NO: 601009 - DNA, 20 bp, Artificial
  CRISPR gRNA sequence
aatagagtaacctattccta

SEQ ID NO: 601010 - DNA, 20 bp, Artificial
  CRISPR gRNA sequence
tagagtaacctattcctaca

SEQ ID NO: 601011 - DNA, 20 bp, Artificial
  CRISPR gRNA sequence
tcctacagagaatcaattct

SEQ ID NO: 601012 - DNA, 20 bp, Artificial
  CRISPR gRNA sequence
ctacagagaatcaattctta

SEQ ID NO: 601013 - DNA, 20 bp, Artificial
  CRISPR gRNA sequence
acagagaatcaattcttaga

SEQ ID NO: 601014 - DNA, 20 bp, Artificial
  CRISPR gRNA sequence
ctaacctcatttgatgcttc

SEQ ID NO: 601015 - DNA, 20 bp, Artificial
  CRISPR gRNA sequence
acctcatttgatgcttctgg

SEQ ID NO: 601016 - DNA, 20 bp, Artificial
  CRISPR gRNA sequence
atgatacctaataaaattgt

SEQ ID NO: 601017 - DNA, 20 bp, Artificial
  CRISPR gRNA sequence
taattgttgattgtgcactt

SEQ ID NO: 601018 - DNA, 20 bp, Artificial
  CRISPR gRNA sequence
aattgttgattgtgcacttc

SEQ ID NO: 601019 - DNA, 20 bp, Artificial
  CRISPR gRNA sequence
attgttgattgtgcacttcg

SEQ ID NO: 601020 - DNA, 20 bp, Artificial
  CRISPR gRNA sequence
ttgttgattgtgcacttcgg

SEQ ID NO: 601021 - DNA, 20 bp, Artificial
  CRISPR gRNA sequence
ttgattgtgcacttcggggg

SEQ ID NO: 601022 - DNA, 20 bp, Artificial
  CRISPR gRNA sequence
attgtgcacttcgggggtag

SEQ ID NO: 601023 - DNA, 20 bp, Artificial
  CRISPR gRNA sequence
gcacttcgggggtagtagtt

SEQ ID NO: 601024 - DNA, 20 bp, Artificial
  CRISPR gRNA sequence
gtttagatgttctaaatttg

SEQ ID NO: 601025 - DNA, 20 bp, Artificial
  CRISPR gRNA sequence
tagatgttctaaatttgaag

SEQ ID NO: 601026 - DNA, 20 bp, Artificial
  CRISPR gRNA sequence
agatgttctaaatttgaagt

SEQ ID NO: 601027 - DNA, 20 bp, Artificial
  CRISPR gRNA sequence
taaatgcaattattaattat

SEQ ID NO: 601028 - DNA, 20 bp, Artificial
  CRISPR gRNA sequence
gacattttgctgttcaattc

SEQ ID NO: 601029 - DNA, 20 bp, Artificial
  CRISPR gRNA sequence
atcaattcaataaatatttg

SEQ ID NO: 601030 - DNA, 20 bp, Artificial
  CRISPR gRNA sequence
tcaattcaataaatatttgt

SEQ ID NO: 601031 - DNA, 20 bp, Artificial
  CRISPR gRNA sequence
gtgggatacctcatatgtgc

SEQ ID NO: 601032 - DNA, 20 bp, Artificial
  CRISPR gRNA sequence
tgggatacctcatatgtgcc

SEQ ID NO: 601033 - DNA, 20 bp, Artificial
  CRISPR gRNA sequence
tcatatgtgccaggtattgt

SEQ ID NO: 601034 - DNA, 20 bp, Artificial
  CRISPR gRNA sequence
catatgtgccaggtattgta

SEQ ID NO: 601035 - DNA, 20 bp, Artificial
  CRISPR gRNA sequence
ggtattgtaaggtgaatcca

SEQ ID NO: 601036 - DNA, 20 bp, Artificial
  CRISPR gRNA sequence
gtattgtaaggtgaatccaa

SEQ ID NO: 601037 - DNA, 20 bp, Artificial
  CRISPR gRNA sequence
ggtgaatccaaaggtgaata

SEQ ID NO: 601038 - DNA, 20 bp, Artificial
  CRISPR gRNA sequence
tgaatccaaaggtgaataaa

SEQ ID NO: 601039 - DNA, 20 bp, Artificial
  CRISPR gRNA sequence
ccaaaggtgaataaagagta

SEQ ID NO: 601040 - DNA, 20 bp, Artificial
  CRISPR gRNA sequence
aaaggtgaataaagagtata

SEQ ID NO: 601041 - DNA, 20 bp, Artificial
  CRISPR gRNA sequence
agtatagagtccttttcctc

SEQ ID NO: 601042 - DNA, 20 bp, Artificial
  CRISPR gRNA sequence
gtatagagtccttttcctcc

SEQ ID NO: 601043 - DNA, 20 bp, Artificial
  CRISPR gRNA sequence
tcctccaggaactcatactc

SEQ ID NO: 601044 - DNA, 20 bp, Artificial
  CRISPR gRNA sequence
tccaggaactcatactctag

SEQ ID NO: 601045 - DNA, 20 bp, Artificial
  CRISPR gRNA sequence
ccaggaactcatactctagt

SEQ ID NO: 601046 - DNA, 20 bp, Artificial
  CRISPR gRNA sequence
gaactcatactctagtggga

SEQ ID NO: 601047 - DNA, 20 bp, Artificial
  CRISPR gRNA sequence
tcatactctagtgggacaga

SEQ ID NO: 601048 - DNA, 20 bp, Artificial
  CRISPR gRNA sequence
tgggacagacagacattaaa

SEQ ID NO: 601049 - DNA, 20 bp, Artificial
  CRISPR gRNA sequence
gggacagacagacattaaat

SEQ ID NO: 601050 - DNA, 20 bp, Artificial
  CRISPR gRNA sequence
ggacagacagacattaaata

SEQ ID NO: 601051 - DNA, 20 bp, Artificial
  CRISPR gRNA sequence
ttaaatagggcattttactg

SEQ ID NO: 601052 - DNA, 20 bp, Artificial
  CRISPR gRNA sequence
atagggcattttactgtagt

SEQ ID NO: 601053 - DNA, 20 bp, Artificial
  CRISPR gRNA sequence
gcattttactgtagtaagct

SEQ ID NO: 601054 - DNA, 20 bp, Artificial
  CRISPR gRNA sequence
gcttagtgtcttgattatta

SEQ ID NO: 601055 - DNA, 20 bp, Artificial
  CRISPR gRNA sequence
cttagtgtcttgattattac

SEQ ID NO: 601056 - DNA, 20 bp, Artificial
  CRISPR gRNA sequence
ttagtgtcttgattattacg

SEQ ID NO: 601057 - DNA, 20 bp, Artificial
  CRISPR gRNA sequence
tagtgtcttgattattacgg

SEQ ID NO: 601058 - DNA, 20 bp, Artificial
  CRISPR gRNA sequence
tcttgattattacgggggat

SEQ ID NO: 601059 - DNA, 20 bp, Artificial
  CRISPR gRNA sequence
ttgattattacgggggatga

SEQ ID NO: 601060 - DNA, 20 bp, Artificial
  CRISPR gRNA sequence
tgattattacgggggatgag

SEQ ID NO: 601061 - DNA, 20 bp, Artificial
  CRISPR gRNA sequence
ttattacgggggatgagagg

SEQ ID NO: 601062 - DNA, 20 bp, Artificial
  CRISPR gRNA sequence
gatgagaggtggtgctcatt

SEQ ID NO: 601063 - DNA, 20 bp, Artificial
  CRISPR gRNA sequence
gctcatttggaaatattttt

SEQ ID NO: 601064 - DNA, 20 bp, Artificial
  CRISPR gRNA sequence
tcatttggaaatatttttta

SEQ ID NO: 601065 - DNA, 20 bp, Artificial
  CRISPR gRNA sequence
catttggaaatattttttag

SEQ ID NO: 601066 - DNA, 20 bp, Artificial
  CRISPR gRNA sequence
atttggaaatattttttaga

SEQ ID NO: 601067 - DNA, 20 bp, Artificial
  CRISPR gRNA sequence
tttggaaatattttttagag

SEQ ID NO: 601068 - DNA, 20 bp, Artificial
  CRISPR gRNA sequence
ttggaaatattttttagagg

SEQ ID NO: 601069 - DNA, 20 bp, Artificial
  CRISPR gRNA sequence
ggaaatattttttagagggg

SEQ ID NO: 601070 - DNA, 20 bp, Artificial
  CRISPR gRNA sequence
tttagagggggagactgctt

SEQ ID NO: 601071 - DNA, 20 bp, Artificial
  CRISPR gRNA sequence
agggggagactgcttgagcc

SEQ ID NO: 601072 - DNA, 20 bp, Artificial
  CRISPR gRNA sequence
gccgagacttattaaatgaa

SEQ ID NO: 601073 - DNA, 20 bp, Artificial
  CRISPR gRNA sequence
ccgagacttattaaatgaat

SEQ ID NO: 601074 - DNA, 20 bp, Artificial
  CRISPR gRNA sequence
cttattaaatgaataggatt

SEQ ID NO: 601075 - DNA, 20 bp, Artificial
  CRISPR gRNA sequence
ttattaaatgaataggattt

SEQ ID NO: 601076 - DNA, 20 bp, Artificial
  CRISPR gRNA sequence
attaaatgaataggatttag

SEQ ID NO: 601077 - DNA, 20 bp, Artificial
  CRISPR gRNA sequence
gaataggatttaggagtaac

SEQ ID NO: 601078 - DNA, 20 bp, Artificial
  CRISPR gRNA sequence
taggatttaggagtaactgg

SEQ ID NO: 601079 - DNA, 20 bp, Artificial
  CRISPR gRNA sequence
aggatttaggagtaactgga

SEQ ID NO: 601080 - DNA, 20 bp, Artificial
  CRISPR gRNA sequence
ataaataatatatccacaat

SEQ ID NO: 601081 - DNA, 20 bp, Artificial
  CRISPR gRNA sequence
aaataatatatccacaataa

SEQ ID NO: 601082 - DNA, 20 bp, Artificial
  CRISPR gRNA sequence
aataatatatccacaataag

SEQ ID NO: 601083 - DNA, 20 bp, Artificial
  CRISPR gRNA sequence
atatatccacaataagaggt

SEQ ID NO: 601084 - DNA, 20 bp, Artificial
  CRISPR gRNA sequence
ccacaataagaggtgagaaa

SEQ ID NO: 601085 - DNA, 20 bp, Artificial
  CRISPR gRNA sequence
agaaatagcatgcaatattc

SEQ ID NO: 601086 - DNA, 20 bp, Artificial
  CRISPR gRNA sequence
gaaatagcatgcaatattct

SEQ ID NO: 601087 - DNA, 20 bp, Artificial
  CRISPR gRNA sequence
tgcaatattctgggaaatac

SEQ ID NO: 601088 - DNA, 20 bp, Artificial
  CRISPR gRNA sequence
aatattctgggaaatacaag

SEQ ID NO: 601089 - DNA, 20 bp, Artificial
  CRISPR gRNA sequence
tctgggaaatacaagcagat

SEQ ID NO: 601090 - DNA, 20 bp, Artificial
  CRISPR gRNA sequence
tacaagcagattggtatttc

SEQ ID NO: 601091 - DNA, 20 bp, Artificial
  CRISPR gRNA sequence
attggtatttctagactata

SEQ ID NO: 601092 - DNA, 20 bp, Artificial
  CRISPR gRNA sequence
gtatttctagactataaagt

SEQ ID NO: 601093 - DNA, 20 bp, Artificial
  CRISPR gRNA sequence
atttctagactataaagttg

SEQ ID NO: 601094 - DNA, 20 bp, Artificial
  CRISPR gRNA sequence
tagactataaagttggagtc

SEQ ID NO: 601095 - DNA, 20 bp, Artificial
  CRISPR gRNA sequence
agactataaagttggagtct

SEQ ID NO: 601096 - DNA, 20 bp, Artificial
  CRISPR gRNA sequence
aagttggagtctaggaattc

SEQ ID NO: 601097 - DNA, 20 bp, Artificial
  CRISPR gRNA sequence
agttggagtctaggaattcg

SEQ ID NO: 601098 - DNA, 20 bp, Artificial
  CRISPR gRNA sequence
ggagtctaggaattcgaggc

SEQ ID NO: 601099 - DNA, 20 bp, Artificial
  CRISPR gRNA sequence
gagtctaggaattcgaggcc

SEQ ID NO: 601100 - DNA, 20 bp, Artificial
  CRISPR gRNA sequence
ttcgaggccaggaatgactt

SEQ ID NO: 601101 - DNA, 20 bp, Artificial
  CRISPR gRNA sequence
cgaggccaggaatgactttg

SEQ ID NO: 601102 - DNA, 20 bp, Artificial
  CRISPR gRNA sequence
aggccaggaatgactttgga

SEQ ID NO: 601103 - DNA, 20 bp, Artificial
  CRISPR gRNA sequence
atgactttggagagttaatc

SEQ ID NO: 601104 - DNA, 20 bp, Artificial
  CRISPR gRNA sequence
tgactttggagagttaatca

SEQ ID NO: 601105 - DNA, 20 bp, Artificial
  CRISPR gRNA sequence
ctttggagagttaatcaagg

SEQ ID NO: 601106 - DNA, 20 bp, Artificial
  CRISPR gRNA sequence
tttggagagttaatcaaggc

SEQ ID NO: 601107 - DNA, 20 bp, Artificial
  CRISPR gRNA sequence
agttaatcaaggcaggataa

SEQ ID NO: 601108 - DNA, 20 bp, Artificial
  CRISPR gRNA sequence
gataatggaacatcttgtat

SEQ ID NO: 601109 - DNA, 20 bp, Artificial
  CRISPR gRNA sequence
taatggaacatcttgtatga

SEQ ID NO: 601110 - DNA, 20 bp, Artificial
  CRISPR gRNA sequence
aatggaacatcttgtatgag

SEQ ID NO: 601111 - DNA, 20 bp, Artificial
  CRISPR gRNA sequence
atcttgtatgagaggaaact

SEQ ID NO: 601112 - DNA, 20 bp, Artificial
  CRISPR gRNA sequence
aaacttggcttttattttca

SEQ ID NO: 601113 - DNA, 20 bp, Artificial
  CRISPR gRNA sequence
cttggcttttattttcatgg

SEQ ID NO: 601114 - DNA, 20 bp, Artificial
  CRISPR gRNA sequence
tttattttcatggaagtcaa

SEQ ID NO: 601115 - DNA, 20 bp, Artificial
  CRISPR gRNA sequence
ggaagtcaatggttttaacg

SEQ ID NO: 601116 - DNA, 20 bp, Artificial
  CRISPR gRNA sequence
agtcaatggttttaacgaag

SEQ ID NO: 601117 - DNA, 20 bp, Artificial
  CRISPR gRNA sequence
gtcaatggttttaacgaagt

SEQ ID NO: 601118 - DNA, 20 bp, Artificial
  CRISPR gRNA sequence
tttaacgaagtaggtgactt

SEQ ID NO: 601119 - DNA, 20 bp, Artificial
  CRISPR gRNA sequence
cttcagtcttttgactgaca

SEQ ID NO: 601120 - DNA, 20 bp, Artificial
  CRISPR gRNA sequence
ggatcgatttgattacaatg

SEQ ID NO: 601121 - DNA, 20 bp, Artificial
  CRISPR gRNA sequence
gatcgatttgattacaatgt

SEQ ID NO: 601122 - DNA, 20 bp, Artificial
  CRISPR gRNA sequence
atcgatttgattacaatgtg

SEQ ID NO: 601123 - DNA, 20 bp, Artificial
  CRISPR gRNA sequence
ttgattacaatgtggggaaa

SEQ ID NO: 601124 - DNA, 20 bp, Artificial
  CRISPR gRNA sequence
caatgtggggaaaaagattg

SEQ ID NO: 601125 - DNA, 20 bp, Artificial
  CRISPR gRNA sequence
gtggggaaaaagattgtgga

SEQ ID NO: 601126 - DNA, 20 bp, Artificial
  CRISPR gRNA sequence
tggggaaaaagattgtggat

SEQ ID NO: 601127 - DNA, 20 bp, Artificial
  CRISPR gRNA sequence
ggggaaaaagattgtggatg

SEQ ID NO: 601128 - DNA, 20 bp, Artificial
  CRISPR gRNA sequence
aaaagattgtggatggggac

SEQ ID NO: 601129 - DNA, 20 bp, Artificial
  CRISPR gRNA sequence
tgtggatggggaccagtctc

SEQ ID NO: 601130 - DNA, 20 bp, Artificial
  CRISPR gRNA sequence
gtggatggggaccagtctct

SEQ ID NO: 601131 - DNA, 20 bp, Artificial
  CRISPR gRNA sequence
gatggggaccagtctctagg

SEQ ID NO: 601132 - DNA, 20 bp, Artificial
  CRISPR gRNA sequence
atggggaccagtctctaggc

SEQ ID NO: 601133 - DNA, 20 bp, Artificial
  CRISPR gRNA sequence
ctaggcaggtgcatatttaa

SEQ ID NO: 601134 - DNA, 20 bp, Artificial
  CRISPR gRNA sequence
taggcaggtgcatatttaac

SEQ ID NO: 601135 - DNA, 20 bp, Artificial
  CRISPR gRNA sequence
aacaggctgtttcaatgatt

SEQ ID NO: 601136 - DNA, 20 bp, Artificial
  CRISPR gRNA sequence
ggctgtttcaatgattgagt

SEQ ID NO: 601137 - DNA, 20 bp, Artificial
  CRISPR gRNA sequence
tgtttcaatgattgagtgag

SEQ ID NO: 601138 - DNA, 20 bp, Artificial
  CRISPR gRNA sequence
gattgagtgagaagtcatgc

SEQ ID NO: 601139 - DNA, 20 bp, Artificial
  CRISPR gRNA sequence
gagtgagaagtcatgcaagc

SEQ ID NO: 601140 - DNA, 20 bp, Artificial
  CRISPR gRNA sequence
tgagaagtcatgcaagctag

SEQ ID NO: 601141 - DNA, 20 bp, Artificial
  CRISPR gRNA sequence
gaagtcatgcaagctagcag

SEQ ID NO: 601142 - DNA, 20 bp, Artificial
  CRISPR gRNA sequence
gtcatgcaagctagcagtag

SEQ ID NO: 601143 - DNA, 20 bp, Artificial
  CRISPR gRNA sequence
tcatgcaagctagcagtagt

SEQ ID NO: 601144 - DNA, 20 bp, Artificial
  CRISPR gRNA sequence
gctagcagtagtgggataaa

SEQ ID NO: 601145 - DNA, 20 bp, Artificial
  CRISPR gRNA sequence
ctagcagtagtgggataaaa

SEQ ID NO: 601146 - DNA, 20 bp, Artificial
  CRISPR gRNA sequence
gcagtagtgggataaaaagg

SEQ ID NO: 601147 - DNA, 20 bp, Artificial
  CRISPR gRNA sequence
cagtagtgggataaaaagga

SEQ ID NO: 601148 - DNA, 20 bp, Artificial
  CRISPR gRNA sequence
gtagtgggataaaaaggaag

SEQ ID NO: 601149 - DNA, 20 bp, Artificial
  CRISPR gRNA sequence
gtgggataaaaaggaaggag

SEQ ID NO: 601150 - DNA, 20 bp, Artificial
  CRISPR gRNA sequence
tgggataaaaaggaaggaga

SEQ ID NO: 601151 - DNA, 20 bp, Artificial
  CRISPR gRNA sequence
aaaaaggaaggagaaggatc

SEQ ID NO: 601152 - DNA, 20 bp, Artificial
  CRISPR gRNA sequence
aaaaggaaggagaaggatct

SEQ ID NO: 601153 - DNA, 20 bp, Artificial
  CRISPR gRNA sequence
agaaggatctaggtaatatt

SEQ ID NO: 601154 - DNA, 20 bp, Artificial
  CRISPR gRNA sequence
aggtaatatttagcatctta

SEQ ID NO: 601155 - DNA, 20 bp, Artificial
  CRISPR gRNA sequence
taatatttagcatcttaaag

SEQ ID NO: 601156 - DNA, 20 bp, Artificial
  CRISPR gRNA sequence
atttagcatcttaaagtaga

SEQ ID NO: 601157 - DNA, 20 bp, Artificial
  CRISPR gRNA sequence
atcttaaagtagacagtact

SEQ ID NO: 601158 - DNA, 20 bp, Artificial
  CRISPR gRNA sequence
tcttaaagtagacagtactt

SEQ ID NO: 601159 - DNA, 20 bp, Artificial
  CRISPR gRNA sequence
taaagtagacagtacttggg

SEQ ID NO: 601160 - DNA, 20 bp, Artificial
  CRISPR gRNA sequence
agtagacagtacttgggtag

SEQ ID NO: 601161 - DNA, 20 bp, Artificial
  CRISPR gRNA sequence
agtacttgggtagtagaatt

SEQ ID NO: 601162 - DNA, 20 bp, Artificial
  CRISPR gRNA sequence
gtacttgggtagtagaatta

SEQ ID NO: 601163 - DNA, 20 bp, Artificial
  CRISPR gRNA sequence
acttgggtagtagaattaag

SEQ ID NO: 601164 - DNA, 20 bp, Artificial
  CRISPR gRNA sequence
tagtagaattaaggagacaa

SEQ ID NO: 601165 - DNA, 20 bp, Artificial
  CRISPR gRNA sequence
gtagaattaaggagacaata

SEQ ID NO: 601166 - DNA, 20 bp, Artificial
  CRISPR gRNA sequence
attaaggagacaatagagtc

SEQ ID NO: 601167 - DNA, 20 bp, Artificial
  CRISPR gRNA sequence
ttaaggagacaatagagtca

SEQ ID NO: 601168 - DNA, 20 bp, Artificial
  CRISPR gRNA sequence
ggagacaatagagtcaagga

SEQ ID NO: 601169 - DNA, 20 bp, Artificial
  CRISPR gRNA sequence
ggatggcaacctttaaatta

SEQ ID NO: 601170 - DNA, 20 bp, Artificial
  CRISPR gRNA sequence
gatggcaacctttaaattac

SEQ ID NO: 601171 - DNA, 20 bp, Artificial
  CRISPR gRNA sequence
gcaacctttaaattacggga

SEQ ID NO: 601172 - DNA, 20 bp, Artificial
  CRISPR gRNA sequence
cctttaaattacgggataga

SEQ ID NO: 601173 - DNA, 20 bp, Artificial
  CRISPR gRNA sequence
ttaaattacgggatagatgg

SEQ ID NO: 601174 - DNA, 20 bp, Artificial
  CRISPR gRNA sequence
aattacgggatagatggtgg

SEQ ID NO: 601175 - DNA, 20 bp, Artificial
  CRISPR gRNA sequence
tacgggatagatggtggtgg

SEQ ID NO: 601176 - DNA, 20 bp, Artificial
  CRISPR gRNA sequence
acgggatagatggtggtggt

SEQ ID NO: 601177 - DNA, 20 bp, Artificial
  CRISPR gRNA sequence
atggtggtggtaggttctgt

SEQ ID NO: 601178 - DNA, 20 bp, Artificial
  CRISPR gRNA sequence
ggtggtaggttctgtcagtg

SEQ ID NO: 601179 - DNA, 20 bp, Artificial
  CRISPR gRNA sequence
gtaggttctgtcagtgaaga

SEQ ID NO: 601180 - DNA, 20 bp, Artificial
  CRISPR gRNA sequence
tcagtgaagatagcaaatac

SEQ ID NO: 601181 - DNA, 20 bp, Artificial
  CRISPR gRNA sequence
agtgaagatagcaaatactg

SEQ ID NO: 601182 - DNA, 20 bp, Artificial
  CRISPR gRNA sequence
gaagatagcaaatactggag

SEQ ID NO: 601183 - DNA, 20 bp, Artificial
  CRISPR gRNA sequence
aagatagcaaatactggagc

SEQ ID NO: 601184 - DNA, 20 bp, Artificial
  CRISPR gRNA sequence
caaatactggagcaggtttc

SEQ ID NO: 601185 - DNA, 20 bp, Artificial
  CRISPR gRNA sequence
aaatactggagcaggtttcc

SEQ ID NO: 601186 - DNA, 20 bp, Artificial
  CRISPR gRNA sequence
ctggagcaggtttccgggaa

SEQ ID NO: 601187 - DNA, 20 bp, Artificial
  CRISPR gRNA sequence
caggtttccgggaaaagatt

SEQ ID NO: 601188 - DNA, 20 bp, Artificial
  CRISPR gRNA sequence
ttccgggaaaagatttagct

SEQ ID NO: 601189 - DNA, 20 bp, Artificial
  CRISPR gRNA sequence
gatttagcttagttcaattc

SEQ ID NO: 601190 - DNA, 20 bp, Artificial
  CRISPR gRNA sequence
cttagttcaattctggtttg

SEQ ID NO: 601191 - DNA, 20 bp, Artificial
  CRISPR gRNA sequence
attctggtttgaagcaccca

SEQ ID NO: 601192 - DNA, 20 bp, Artificial
  CRISPR gRNA sequence
ttctggtttgaagcacccac

SEQ ID NO: 601193 - DNA, 20 bp, Artificial
  CRISPR gRNA sequence
tctggtttgaagcacccaca

SEQ ID NO: 601194 - DNA, 20 bp, Artificial
  CRISPR gRNA sequence
agcacccacagggtacaatt

SEQ ID NO: 601195 - DNA, 20 bp, Artificial
  CRISPR gRNA sequence
gcacccacagggtacaattt

SEQ ID NO: 601196 - DNA, 20 bp, Artificial
  CRISPR gRNA sequence
acccacagggtacaatttgg

SEQ ID NO: 601197 - DNA, 20 bp, Artificial
  CRISPR gRNA sequence
ccacagggtacaatttggga

SEQ ID NO: 601198 - DNA, 20 bp, Artificial
  CRISPR gRNA sequence
cacagggtacaatttgggag

SEQ ID NO: 601199 - DNA, 20 bp, Artificial
  CRISPR gRNA sequence
acagggtacaatttgggaga

SEQ ID NO: 601200 - DNA, 20 bp, Artificial
  CRISPR gRNA sequence
ggtacaatttgggagaggga

SEQ ID NO: 601201 - DNA, 20 bp, Artificial
  CRISPR gRNA sequence
tttgggagagggatagcaat

SEQ ID NO: 601202 - DNA, 20 bp, Artificial
  CRISPR gRNA sequence
ttgggagagggatagcaatt

SEQ ID NO: 601203 - DNA, 20 bp, Artificial
  CRISPR gRNA sequence
agggatagcaattaggcaca

SEQ ID NO: 601204 - DNA, 20 bp, Artificial
  CRISPR gRNA sequence
agcaattaggcacatggata

SEQ ID NO: 601205 - DNA, 20 bp, Artificial
  CRISPR gRNA sequence
aggcacatggatatagactg

SEQ ID NO: 601206 - DNA, 20 bp, Artificial
  CRISPR gRNA sequence
gaagtatgaattttcctaat

SEQ ID NO: 601207 - DNA, 20 bp, Artificial
  CRISPR gRNA sequence
taattagtgaaaactaatat

SEQ ID NO: 601208 - DNA, 20 bp, Artificial
  CRISPR gRNA sequence
tgaaaactaatattagccca

SEQ ID NO: 601209 - DNA, 20 bp, Artificial
  CRISPR gRNA sequence
actaatattagcccatggtt

SEQ ID NO: 601210 - DNA, 20 bp, Artificial
  CRISPR gRNA sequence
ttctgcccatattactttaa

SEQ ID NO: 601211 - DNA, 20 bp, Artificial
  CRISPR gRNA sequence
tgcccatattactttaacag

SEQ ID NO: 601212 - DNA, 20 bp, Artificial
  CRISPR gRNA sequence
ttttgaaaacattcatgtct

SEQ ID NO: 601213 - DNA, 20 bp, Artificial
  CRISPR gRNA sequence
attcatgtctaagtaattct

SEQ ID NO: 601214 - DNA, 20 bp, Artificial
  CRISPR gRNA sequence
agtaattctcagtatttgat

SEQ ID NO: 601215 - DNA, 20 bp, Artificial
  CRISPR gRNA sequence
aattctcagtatttgatcag

SEQ ID NO: 601216 - DNA, 20 bp, Artificial
  CRISPR gRNA sequence
ttaaatcaaaattctatatt

SEQ ID NO: 601217 - DNA, 20 bp, Artificial
  CRISPR gRNA sequence
tatattgagttttatgtgca

SEQ ID NO: 601218 - DNA, 20 bp, Artificial
  CRISPR gRNA sequence
atattgagttttatgtgcac

SEQ ID NO: 601219 - DNA, 20 bp, Artificial
  CRISPR gRNA sequence
ttaataaactctttgcttaa

SEQ ID NO: 601220 - DNA, 20 bp, Artificial
  CRISPR gRNA sequence
cttaatggaatcctttatac

SEQ ID NO: 601221 - DNA, 20 bp, Artificial
  CRISPR gRNA sequence
ggaatcctttatactggtct

SEQ ID NO: 601222 - DNA, 20 bp, Artificial
  CRISPR gRNA sequence
atcctttatactggtctcag

SEQ ID NO: 601223 - DNA, 20 bp, Artificial
  CRISPR gRNA sequence
cccactgatttttaaacaaa

SEQ ID NO: 601224 - DNA, 20 bp, Artificial
  CRISPR gRNA sequence
aaaagctcttcaacattttg

SEQ ID NO: 601225 - DNA, 20 bp, Artificial
  CRISPR gRNA sequence
tgttttttaaaaaaaatcat

SEQ ID NO: 601226 - DNA, 20 bp, Artificial
  CRISPR gRNA sequence
ttaatgtatgccatatactc

SEQ ID NO: 601227 - DNA, 20 bp, Artificial
  CRISPR gRNA sequence
aaaatattacatacttatta

SEQ ID NO: 601228 - DNA, 20 bp, Artificial
  CRISPR gRNA sequence
aaatattacatacttattac

SEQ ID NO: 601229 - DNA, 20 bp, Artificial
  CRISPR gRNA sequence
acatacttattacaggttgt

SEQ ID NO: 601230 - DNA, 20 bp, Artificial
  CRISPR gRNA sequence
acaggttgttagctaaacat

SEQ ID NO: 601231 - DNA, 20 bp, Artificial
  CRISPR gRNA sequence
gttgttagctaaacattggc

SEQ ID NO: 601232 - DNA, 20 bp, Artificial
  CRISPR gRNA sequence
ggccagttctgccacattaa

SEQ ID NO: 601233 - DNA, 20 bp, Artificial
  CRISPR gRNA sequence
gttctgccacattaatagct

SEQ ID NO: 601234 - DNA, 20 bp, Artificial
  CRISPR gRNA sequence
ttctgccacattaatagcta

SEQ ID NO: 601235 - DNA, 20 bp, Artificial
  CRISPR gRNA sequence
aggaatttaatactcctcac

SEQ ID NO: 601236 - DNA, 20 bp, Artificial
  CRISPR gRNA sequence
gaatttaatactcctcacca

SEQ ID NO: 601237 - DNA, 20 bp, Artificial
  CRISPR gRNA sequence
tcctcaccagagcctttttg

SEQ ID NO: 601238 - DNA, 20 bp, Artificial
  CRISPR gRNA sequence
agagcctttttgaagacttt

SEQ ID NO: 601239 - DNA, 20 bp, Artificial
  CRISPR gRNA sequence
aagactttgagataaatatg

SEQ ID NO: 601240 - DNA, 20 bp, Artificial
  CRISPR gRNA sequence
tattttaaaatgattttgta

SEQ ID NO: 601241 - DNA, 20 bp, Artificial
  CRISPR gRNA sequence
aaatataatatcatacccct

SEQ ID NO: 601242 - DNA, 20 bp, Artificial
  CRISPR gRNA sequence
aatataatatcatacccctt

SEQ ID NO: 601243 - DNA, 20 bp, Artificial
  CRISPR gRNA sequence
aatatcataccccttgggat

SEQ ID NO: 601244 - DNA, 20 bp, Artificial
  CRISPR gRNA sequence
atatcataccccttgggatg

SEQ ID NO: 601245 - DNA, 20 bp, Artificial
  CRISPR gRNA sequence
ccccttgggatgaggttacc

SEQ ID NO: 601246 - DNA, 20 bp, Artificial
  CRISPR gRNA sequence
ttgggatgaggttacctaga

SEQ ID NO: 601247 - DNA, 20 bp, Artificial
  CRISPR gRNA sequence
tgggatgaggttacctagat

SEQ ID NO: 601248 - DNA, 20 bp, Artificial
  CRISPR gRNA sequence
atgaggttacctagatggga

SEQ ID NO: 601249 - DNA, 20 bp, Artificial
  CRISPR gRNA sequence
gttacctagatgggacagta

SEQ ID NO: 601250 - DNA, 20 bp, Artificial
  CRISPR gRNA sequence
ctagatgggacagtatagca

SEQ ID NO: 601251 - DNA, 20 bp, Artificial
  CRISPR gRNA sequence
agcatagataacatcttaat

SEQ ID NO: 601252 - DNA, 20 bp, Artificial
  CRISPR gRNA sequence
ttattctgaaatatttatta

SEQ ID NO: 601253 - DNA, 20 bp, Artificial
  CRISPR gRNA sequence
gaattccatcttaaaaatgt

SEQ ID NO: 601254 - DNA, 20 bp, Artificial
  CRISPR gRNA sequence
aatgtaagcgctgactaccc

SEQ ID NO: 601255 - DNA, 20 bp, Artificial
  CRISPR gRNA sequence
gctgactacccaagacacca

SEQ ID NO: 601256 - DNA, 20 bp, Artificial
  CRISPR gRNA sequence
ttccaaatgaatgttaatgc

SEQ ID NO: 601257 - DNA, 20 bp, Artificial
  CRISPR gRNA sequence
atgctagaaacacttcttct

SEQ ID NO: 601258 - DNA, 20 bp, Artificial
  CRISPR gRNA sequence
cttctgagatttcctgtatg

SEQ ID NO: 601259 - DNA, 20 bp, Artificial
  CRISPR gRNA sequence
tctgagatttcctgtatgtg

SEQ ID NO: 601260 - DNA, 20 bp, Artificial
  CRISPR gRNA sequence
atttcctgtatgtggagatt

SEQ ID NO: 601261 - DNA, 20 bp, Artificial
  CRISPR gRNA sequence
tgtggagattcagaactcct

SEQ ID NO: 601262 - DNA, 20 bp, Artificial
  CRISPR gRNA sequence
tggagattcagaactcctta

SEQ ID NO: 601263 - DNA, 20 bp, Artificial
  CRISPR gRNA sequence
gagattcagaactccttaga

SEQ ID NO: 601264 - DNA, 20 bp, Artificial
  CRISPR gRNA sequence
tcatctttcgatcattgatc

SEQ ID NO: 601265 - DNA, 20 bp, Artificial
  CRISPR gRNA sequence
tgatccagcaaacatttatt

SEQ ID NO: 601266 - DNA, 20 bp, Artificial
  CRISPR gRNA sequence
tactgtgtatgatgcattgc

SEQ ID NO: 601267 - DNA, 20 bp, Artificial
  CRISPR gRNA sequence
gtatgatgcattgctggtgc

SEQ ID NO: 601268 - DNA, 20 bp, Artificial
  CRISPR gRNA sequence
tatgatgcattgctggtgct

SEQ ID NO: 601269 - DNA, 20 bp, Artificial
  CRISPR gRNA sequence
atgatgcattgctggtgctg

SEQ ID NO: 601270 - DNA, 20 bp, Artificial
  CRISPR gRNA sequence
tggtgctggggctcaaaaaa

SEQ ID NO: 601271 - DNA, 20 bp, Artificial
  CRISPR gRNA sequence
ggtgctggggctcaaaaaat

SEQ ID NO: 601272 - DNA, 20 bp, Artificial
  CRISPR gRNA sequence
tggggctcaaaaaataggtt

SEQ ID NO: 601273 - DNA, 20 bp, Artificial
  CRISPR gRNA sequence
ggggctcaaaaaataggttt

SEQ ID NO: 601274 - DNA, 20 bp, Artificial
  CRISPR gRNA sequence
gggctcaaaaaataggtttg

SEQ ID NO: 601275 - DNA, 20 bp, Artificial
  CRISPR gRNA sequence
aataggtttggggtgttttc

SEQ ID NO: 601276 - DNA, 20 bp, Artificial
  CRISPR gRNA sequence
taggtttggggtgttttcta

SEQ ID NO: 601277 - DNA, 20 bp, Artificial
  CRISPR gRNA sequence
gtttggggtgttttctagag

SEQ ID NO: 601278 - DNA, 20 bp, Artificial
  CRISPR gRNA sequence
tttggggtgttttctagaga

SEQ ID NO: 601279 - DNA, 20 bp, Artificial
  CRISPR gRNA sequence
gggtgttttctagagaagga

SEQ ID NO: 601280 - DNA, 20 bp, Artificial
  CRISPR gRNA sequence
tagagaaggatggtatcttc

SEQ ID NO: 601281 - DNA, 20 bp, Artificial
  CRISPR gRNA sequence
agagaaggatggtatcttca

SEQ ID NO: 601282 - DNA, 20 bp, Artificial
  CRISPR gRNA sequence
gagaaggatggtatcttcaa

SEQ ID NO: 601283 - DNA, 20 bp, Artificial
  CRISPR gRNA sequence
aatgaattgatattttgtgt

SEQ ID NO: 601284 - DNA, 20 bp, Artificial
  CRISPR gRNA sequence
gtaatactgcttattgcatt

SEQ ID NO: 601285 - DNA, 20 bp, Artificial
  CRISPR gRNA sequence
atactgcttattgcatttag

SEQ ID NO: 601286 - DNA, 20 bp, Artificial
  CRISPR gRNA sequence
tattgcatttagaagtaaat

SEQ ID NO: 601287 - DNA, 20 bp, Artificial
  CRISPR gRNA sequence
actgtgacttacatccatta

SEQ ID NO: 601288 - DNA, 20 bp, Artificial
  CRISPR gRNA sequence
tacatccattatagattaat

SEQ ID NO: 601289 - DNA, 20 bp, Artificial
  CRISPR gRNA sequence
gcttctcaccttttacctcc

SEQ ID NO: 601290 - DNA, 20 bp, Artificial
  CRISPR gRNA sequence
ttctcaccttttacctccaa

SEQ ID NO: 601291 - DNA, 20 bp, Artificial
  CRISPR gRNA sequence
tttcaaatgtgtgtaaattt

SEQ ID NO: 601292 - DNA, 20 bp, Artificial
  CRISPR gRNA sequence
ttcaaatgtgtgtaaatttg

SEQ ID NO: 601293 - DNA, 20 bp, Artificial
  CRISPR gRNA sequence
tgtgtaaatttgaggatgta

SEQ ID NO: 601294 - DNA, 20 bp, Artificial
  CRISPR gRNA sequence
tttgaggatgtacagtgaaa

SEQ ID NO: 601295 - DNA, 20 bp, Artificial
  CRISPR gRNA sequence
atgtacagtgaaacagacaa

SEQ ID NO: 601296 - DNA, 20 bp, Artificial
  CRISPR gRNA sequence
tgtacagtgaaacagacaaa

SEQ ID NO: 601297 - DNA, 20 bp, Artificial
  CRISPR gRNA sequence
gtacagtgaaacagacaaaa

SEQ ID NO: 601298 - DNA, 20 bp, Artificial
  CRISPR gRNA sequence
gaaacagacaaaagggcaac

SEQ ID NO: 601299 - DNA, 20 bp, Artificial
  CRISPR gRNA sequence
caaaagggcaacaagccact

SEQ ID NO: 601300 - DNA, 20 bp, Artificial
  CRISPR gRNA sequence
agggcaacaagccacttaga

SEQ ID NO: 601301 - DNA, 20 bp, Artificial
  CRISPR gRNA sequence
gggcaacaagccacttagat

SEQ ID NO: 601302 - DNA, 20 bp, Artificial
  CRISPR gRNA sequence
aagccacttagataggttct

SEQ ID NO: 601303 - DNA, 20 bp, Artificial
  CRISPR gRNA sequence
gccacttagataggttctca

SEQ ID NO: 601304 - DNA, 20 bp, Artificial
  CRISPR gRNA sequence
ccacttagataggttctcag

SEQ ID NO: 601305 - DNA, 20 bp, Artificial
  CRISPR gRNA sequence
ccacaaaattatttataatg

SEQ ID NO: 601306 - DNA, 20 bp, Artificial
  CRISPR gRNA sequence
cacaaaattatttataatgc

SEQ ID NO: 601307 - DNA, 20 bp, Artificial
  CRISPR gRNA sequence
attatttataatgcaggatt

SEQ ID NO: 601308 - DNA, 20 bp, Artificial
  CRISPR gRNA sequence
gatttggcactcatccttgc

SEQ ID NO: 601309 - DNA, 20 bp, Artificial
  CRISPR gRNA sequence
atccttgcaagttctgaaac

SEQ ID NO: 601310 - DNA, 20 bp, Artificial
  CRISPR gRNA sequence
aagttctgaaactagatttg

SEQ ID NO: 601311 - DNA, 20 bp, Artificial
  CRISPR gRNA sequence
aactagatttgtggcacact

SEQ ID NO: 601312 - DNA, 20 bp, Artificial
  CRISPR gRNA sequence
ctagatttgtggcacactta

SEQ ID NO: 601313 - DNA, 20 bp, Artificial
  CRISPR gRNA sequence
gatttgtggcacacttagag

SEQ ID NO: 601314 - DNA, 20 bp, Artificial
  CRISPR gRNA sequence
ttagagtggatctgtatctc

SEQ ID NO: 601315 - DNA, 20 bp, Artificial
  CRISPR gRNA sequence
tagagtggatctgtatctca

SEQ ID NO: 601316 - DNA, 20 bp, Artificial
  CRISPR gRNA sequence
caaggttgactgacattaaa

SEQ ID NO: 601317 - DNA, 20 bp, Artificial
  CRISPR gRNA sequence
aaggttgactgacattaaac

SEQ ID NO: 601318 - DNA, 20 bp, Artificial
  CRISPR gRNA sequence
acaaaactgatatttaaaat

SEQ ID NO: 601319 - DNA, 20 bp, Artificial
  CRISPR gRNA sequence
tcagaatgccaatttatgtt

SEQ ID NO: 601320 - DNA, 20 bp, Artificial
  CRISPR gRNA sequence
ttagatattgattaaaaata

SEQ ID NO: 601321 - DNA, 20 bp, Artificial
  CRISPR gRNA sequence
acacatgcaaccaacaaaca

SEQ ID NO: 601322 - DNA, 20 bp, Artificial
  CRISPR gRNA sequence
cacatgcaaccaacaaacat

SEQ ID NO: 601323 - DNA, 20 bp, Artificial
  CRISPR gRNA sequence
catgcaaccaacaaacatag

SEQ ID NO: 601324 - DNA, 20 bp, Artificial
  CRISPR gRNA sequence
caaccaacaaacataggagc

SEQ ID NO: 601325 - DNA, 20 bp, Artificial
  CRISPR gRNA sequence
acataggagctggatcactc

SEQ ID NO: 601326 - DNA, 20 bp, Artificial
  CRISPR gRNA sequence
aggagctggatcactccagt

SEQ ID NO: 601327 - DNA, 20 bp, Artificial
  CRISPR gRNA sequence
atcactccagttggcttgac

SEQ ID NO: 601328 - DNA, 20 bp, Artificial
  CRISPR gRNA sequence
ttcttgtgaactgacctata

SEQ ID NO: 601329 - DNA, 20 bp, Artificial
  CRISPR gRNA sequence
tcttgtgaactgacctatat

SEQ ID NO: 601330 - DNA, 20 bp, Artificial
  CRISPR gRNA sequence
aactgacctatatgggtaat

SEQ ID NO: 601331 - DNA, 20 bp, Artificial
  CRISPR gRNA sequence
acctatatgggtaatcagta

SEQ ID NO: 601332 - DNA, 20 bp, Artificial
  CRISPR gRNA sequence
cctatatgggtaatcagtaa

SEQ ID NO: 601333 - DNA, 20 bp, Artificial
  CRISPR gRNA sequence
atcagtaaaggtcatttact

SEQ ID NO: 601334 - DNA, 20 bp, Artificial
  CRISPR gRNA sequence
gtaaaggtcatttactgagc

SEQ ID NO: 601335 - DNA, 20 bp, Artificial
  CRISPR gRNA sequence
taaaggtcatttactgagca

SEQ ID NO: 601336 - DNA, 20 bp, Artificial
  CRISPR gRNA sequence
ctgagcaaggaatctgaata

SEQ ID NO: 601337 - DNA, 20 bp, Artificial
  CRISPR gRNA sequence
tgagcaaggaatctgaataa

SEQ ID NO: 601338 - DNA, 20 bp, Artificial
  CRISPR gRNA sequence
gagcaaggaatctgaataaa

SEQ ID NO: 601339 - DNA, 20 bp, Artificial
  CRISPR gRNA sequence
gcaaggaatctgaataaagg

SEQ ID NO: 601340 - DNA, 20 bp, Artificial
  CRISPR gRNA sequence
ggaatctgaataaagggagt

SEQ ID NO: 601341 - DNA, 20 bp, Artificial
  CRISPR gRNA sequence
tatataattcaaatgtttaa

SEQ ID NO: 601342 - DNA, 20 bp, Artificial
  CRISPR gRNA sequence
attcaaatgtttaatggcat

SEQ ID NO: 601343 - DNA, 20 bp, Artificial
  CRISPR gRNA sequence
atgtttaatggcattagact

SEQ ID NO: 601344 - DNA, 20 bp, Artificial
  CRISPR gRNA sequence
gtttaatggcattagactaa

SEQ ID NO: 601345 - DNA, 20 bp, Artificial
  CRISPR gRNA sequence
ctaagagaacctaatatatt

SEQ ID NO: 601346 - DNA, 20 bp, Artificial
  CRISPR gRNA sequence
taatatattcagcatcacaa

SEQ ID NO: 601347 - DNA, 20 bp, Artificial
  CRISPR gRNA sequence
atatattcagcatcacaata

SEQ ID NO: 601348 - DNA, 20 bp, Artificial
  CRISPR gRNA sequence
attcagcatcacaatagaga

SEQ ID NO: 601349 - DNA, 20 bp, Artificial
  CRISPR gRNA sequence
atagagatagcattgctatt

SEQ ID NO: 601350 - DNA, 20 bp, Artificial
  CRISPR gRNA sequence
cattgctatttggataatta

SEQ ID NO: 601351 - DNA, 20 bp, Artificial
  CRISPR gRNA sequence
tatttggataattatggttg

SEQ ID NO: 601352 - DNA, 20 bp, Artificial
  CRISPR gRNA sequence
tatggttgaagtcctttgtc

SEQ ID NO: 601353 - DNA, 20 bp, Artificial
  CRISPR gRNA sequence
ccagttccctctccttttaa

SEQ ID NO: 601354 - DNA, 20 bp, Artificial
  CRISPR gRNA sequence
ccctctccttttaatggaca

SEQ ID NO: 601355 - DNA, 20 bp, Artificial
  CRISPR gRNA sequence
ccttttaatggacatggatt

SEQ ID NO: 601356 - DNA, 20 bp, Artificial
  CRISPR gRNA sequence
ggacatggatttagattccc

SEQ ID NO: 601357 - DNA, 20 bp, Artificial
  CRISPR gRNA sequence
agttcaaccaaaatacttct

SEQ ID NO: 601358 - DNA, 20 bp, Artificial
  CRISPR gRNA sequence
gattcatttttttttcccct

SEQ ID NO: 601359 - DNA, 20 bp, Artificial
  CRISPR gRNA sequence
tttttttccccttggcttcc

SEQ ID NO: 601360 - DNA, 20 bp, Artificial
  CRISPR gRNA sequence
ttttttccccttggcttcct

SEQ ID NO: 601361 - DNA, 20 bp, Artificial
  CRISPR gRNA sequence
gcttcctaggctaaatcccc

SEQ ID NO: 601362 - DNA, 20 bp, Artificial
  CRISPR gRNA sequence
taggctaaatcccccagatt

SEQ ID NO: 601363 - DNA, 20 bp, Artificial
  CRISPR gRNA sequence
cctatattaatacatacaat

SEQ ID NO: 601364 - DNA, 20 bp, Artificial
  CRISPR gRNA sequence
ctatattaatacatacaatc

SEQ ID NO: 601365 - DNA, 20 bp, Artificial
  CRISPR gRNA sequence
acatacaatcaggttacgac

SEQ ID NO: 601366 - DNA, 20 bp, Artificial
  CRISPR gRNA sequence
aggttacgacgagttctttc

SEQ ID NO: 601367 - DNA, 20 bp, Artificial
  CRISPR gRNA sequence
cgacgagttctttctggcct

SEQ ID NO: 601368 - DNA, 20 bp, Artificial
  CRISPR gRNA sequence
tgagatccattcattttctt

SEQ ID NO: 601369 - DNA, 20 bp, Artificial
  CRISPR gRNA sequence
tttgtaaaatgttgatttta

SEQ ID NO: 601370 - DNA, 20 bp, Artificial
  CRISPR gRNA sequence
ttttatagcctaactttatg

SEQ ID NO: 601371 - DNA, 20 bp, Artificial
  CRISPR gRNA sequence
actttatgaagacaatctta

SEQ ID NO: 601372 - DNA, 20 bp, Artificial
  CRISPR gRNA sequence
acaatcttatagtgcccata

SEQ ID NO: 601373 - DNA, 20 bp, Artificial
  CRISPR gRNA sequence
caatcttatagtgcccataa

SEQ ID NO: 601374 - DNA, 20 bp, Artificial
  CRISPR gRNA sequence
taaattcgaacttccattca

SEQ ID NO: 601375 - DNA, 20 bp, Artificial
  CRISPR gRNA sequence
tccattcacagaaatctcga

SEQ ID NO: 601376 - DNA, 20 bp, Artificial
  CRISPR gRNA sequence
agaaatctcgacagctgatg

SEQ ID NO: 601377 - DNA, 20 bp, Artificial
  CRISPR gRNA sequence
atctcgacagctgatgtggt

SEQ ID NO: 601378 - DNA, 20 bp, Artificial
  CRISPR gRNA sequence
tcgacagctgatgtggtcag

SEQ ID NO: 601379 - DNA, 20 bp, Artificial
  CRISPR gRNA sequence
gctgatgtggtcagcagttt

SEQ ID NO: 601380 - DNA, 20 bp, Artificial
  CRISPR gRNA sequence
tgatgtggtcagcagtttaa

SEQ ID NO: 601381 - DNA, 20 bp, Artificial
  CRISPR gRNA sequence
agagttcttaatatctattt

SEQ ID NO: 601382 - DNA, 20 bp, Artificial
  CRISPR gRNA sequence
cttaatatctattttagatg

SEQ ID NO: 601383 - DNA, 20 bp, Artificial
  CRISPR gRNA sequence
atatctattttagatgaaga

SEQ ID NO: 601384 - DNA, 20 bp, Artificial
  CRISPR gRNA sequence
ttttagatgaagatggaaaa

SEQ ID NO: 601385 - DNA, 20 bp, Artificial
  CRISPR gRNA sequence
tggaaaatagcactaccacc

SEQ ID NO: 601386 - DNA, 20 bp, Artificial
  CRISPR gRNA sequence
ggaaaatagcactaccacct

SEQ ID NO: 601387 - DNA, 20 bp, Artificial
  CRISPR gRNA sequence
aatagcactaccacctagga

SEQ ID NO: 601388 - DNA, 20 bp, Artificial
  CRISPR gRNA sequence
accacctaggaaagatcctt

SEQ ID NO: 601389 - DNA, 20 bp, Artificial
  CRISPR gRNA sequence
cctaggaaagatccttaagt

SEQ ID NO: 601390 - DNA, 20 bp, Artificial
  CRISPR gRNA sequence
ggaaagatccttaagttagc

SEQ ID NO: 601391 - DNA, 20 bp, Artificial
  CRISPR gRNA sequence
ccttaagttagctggtgata

SEQ ID NO: 601392 - DNA, 20 bp, Artificial
  CRISPR gRNA sequence
ttaagttagctggtgatata

SEQ ID NO: 601393 - DNA, 20 bp, Artificial
  CRISPR gRNA sequence
taagttagctggtgatatag

SEQ ID NO: 601394 - DNA, 20 bp, Artificial
  CRISPR gRNA sequence
tggtgatatagaggcacttc

SEQ ID NO: 601395 - DNA, 20 bp, Artificial
  CRISPR gRNA sequence
atagaggcacttccagttta

SEQ ID NO: 601396 - DNA, 20 bp, Artificial
  CRISPR gRNA sequence
tagaggcacttccagtttat

SEQ ID NO: 601397 - DNA, 20 bp, Artificial
  CRISPR gRNA sequence
ggcacttccagtttataggt

SEQ ID NO: 601398 - DNA, 20 bp, Artificial
  CRISPR gRNA sequence
acttccagtttataggtcag

SEQ ID NO: 601399 - DNA, 20 bp, Artificial
  CRISPR gRNA sequence
cttccagtttataggtcaga

SEQ ID NO: 601400 - DNA, 20 bp, Artificial
  CRISPR gRNA sequence
aaggaaaaaaaacaccaaac

SEQ ID NO: 601401 - DNA, 20 bp, Artificial
  CRISPR gRNA sequence
ccagtctcatgaaattattg

SEQ ID NO: 601402 - DNA, 20 bp, Artificial
  CRISPR gRNA sequence
gtgatctgaccgcatcaaat

SEQ ID NO: 601403 - DNA, 20 bp, Artificial
  CRISPR gRNA sequence
ccgcatcaaatgagatttta

SEQ ID NO: 601404 - DNA, 20 bp, Artificial
  CRISPR gRNA sequence
caaactgttgtatttcatgt

SEQ ID NO: 601405 - DNA, 20 bp, Artificial
  CRISPR gRNA sequence
ctgttgtatttcatgttagt

SEQ ID NO: 601406 - DNA, 20 bp, Artificial
  CRISPR gRNA sequence
ttgtatttcatgttagttag

SEQ ID NO: 601407 - DNA, 20 bp, Artificial
  CRISPR gRNA sequence
tgtatttcatgttagttagt

SEQ ID NO: 601408 - DNA, 20 bp, Artificial
  CRISPR gRNA sequence
tttcatgttagttagtagga

SEQ ID NO: 601409 - DNA, 20 bp, Artificial
  CRISPR gRNA sequence
ggaaagctgtcttaattact

SEQ ID NO: 601410 - DNA, 20 bp, Artificial
  CRISPR gRNA sequence
ttaattactgagtgtgaatt

SEQ ID NO: 601411 - DNA, 20 bp, Artificial
  CRISPR gRNA sequence
gtgaattaagtaacttttca

SEQ ID NO: 601412 - DNA, 20 bp, Artificial
  CRISPR gRNA sequence
aagtaacttttcaaagcata

SEQ ID NO: 601413 - DNA, 20 bp, Artificial
  CRISPR gRNA sequence
aaagcatatagatttatttg

SEQ ID NO: 601414 - DNA, 20 bp, Artificial
  CRISPR gRNA sequence
aagcatatagatttatttgt

SEQ ID NO: 601415 - DNA, 20 bp, Artificial
  CRISPR gRNA sequence
tgggccacaccttgattata

SEQ ID NO: 601416 - DNA, 20 bp, Artificial
  CRISPR gRNA sequence
ttgattataaagaaattaat

SEQ ID NO: 601417 - DNA, 20 bp, Artificial
  CRISPR gRNA sequence
tgattataaagaaattaatc

SEQ ID NO: 601418 - DNA, 20 bp, Artificial
  CRISPR gRNA sequence
aagaaattaatcaggttttc

SEQ ID NO: 601419 - DNA, 20 bp, Artificial
  CRISPR gRNA sequence
gttttccagatgtgaatctt

SEQ ID NO: 601420 - DNA, 20 bp, Artificial
  CRISPR gRNA sequence
ttttccagatgtgaatcttt

SEQ ID NO: 601421 - DNA, 20 bp, Artificial
  CRISPR gRNA sequence
tttccagatgtgaatctttg

SEQ ID NO: 601422 - DNA, 20 bp, Artificial
  CRISPR gRNA sequence
atgtgaatctttggggaaaa

SEQ ID NO: 601423 - DNA, 20 bp, Artificial
  CRISPR gRNA sequence
tggtcatatctcttcatccc

SEQ ID NO: 601424 - DNA, 20 bp, Artificial
  CRISPR gRNA sequence
catatgcattgtatgcattg

SEQ ID NO: 601425 - DNA, 20 bp, Artificial
  CRISPR gRNA sequence
atatgcattgtatgcattgt

SEQ ID NO: 601426 - DNA, 20 bp, Artificial
  CRISPR gRNA sequence
atgcattgtatgcattgtag

SEQ ID NO: 601427 - DNA, 20 bp, Artificial
  CRISPR gRNA sequence
ctgtaaatatttgttgaatg

SEQ ID NO: 601428 - DNA, 20 bp, Artificial
  CRISPR gRNA sequence
gttgaatgaagaaaatactt

SEQ ID NO: 601429 - DNA, 20 bp, Artificial
  CRISPR gRNA sequence
atgaagaaaatacttaagat

SEQ ID NO: 601430 - DNA, 20 bp, Artificial
  CRISPR gRNA sequence
attacatatgtctgtttaaa

SEQ ID NO: 601431 - DNA, 20 bp, Artificial
  CRISPR gRNA sequence
ctgatctacttgaaaaaatt

SEQ ID NO: 601432 - DNA, 20 bp, Artificial
  CRISPR gRNA sequence
aatttggaaacttgatttct

SEQ ID NO: 601433 - DNA, 20 bp, Artificial
  CRISPR gRNA sequence
tacttgtgattttctctgtt

SEQ ID NO: 601434 - DNA, 20 bp, Artificial
  CRISPR gRNA sequence
acttgtgattttctctgttt

SEQ ID NO: 601435 - DNA, 20 bp, Artificial
  CRISPR gRNA sequence
cttgtgattttctctgtttg

SEQ ID NO: 601436 - DNA, 20 bp, Artificial
  CRISPR gRNA sequence
tataatgtctcactctgaaa

SEQ ID NO: 601437 - DNA, 20 bp, Artificial
  CRISPR gRNA sequence
agattttgtaatcttcaaat

SEQ ID NO: 601438 - DNA, 20 bp, Artificial
  CRISPR gRNA sequence
aatcttcaaattggtcccaa

SEQ ID NO: 601439 - DNA, 20 bp, Artificial
  CRISPR gRNA sequence
ggtcccaaaagctgatctct

SEQ ID NO: 601440 - DNA, 20 bp, Artificial
  CRISPR gRNA sequence
ctgatctctaagtttctaaa

SEQ ID NO: 601441 - DNA, 20 bp, Artificial
  CRISPR gRNA sequence
tgattctatacaaccatgtt

SEQ ID NO: 601442 - DNA, 20 bp, Artificial
  CRISPR gRNA sequence
ttctatacaaccatgttcag

SEQ ID NO: 601443 - DNA, 20 bp, Artificial
  CRISPR gRNA sequence
aatccacatgaatgttaatg

SEQ ID NO: 601444 - DNA, 20 bp, Artificial
  CRISPR gRNA sequence
ctactattaatatcttgata

SEQ ID NO: 601445 - DNA, 20 bp, Artificial
  CRISPR gRNA sequence
tatcttgatatagcacattt

SEQ ID NO: 601446 - DNA, 20 bp, Artificial
  CRISPR gRNA sequence
atcttgatatagcacattta

SEQ ID NO: 601447 - DNA, 20 bp, Artificial
  CRISPR gRNA sequence
atatagcacatttaaggtta

SEQ ID NO: 601448 - DNA, 20 bp, Artificial
  CRISPR gRNA sequence
tccatatacttgtaatttta

SEQ ID NO: 601449 - DNA, 20 bp, Artificial
  CRISPR gRNA sequence
tatacttgtaattttaaagc

SEQ ID NO: 601450 - DNA, 20 bp, Artificial
  CRISPR gRNA sequence
tccatcacttaaactgtttt

SEQ ID NO: 601451 - DNA, 20 bp, Artificial
  CRISPR gRNA sequence
atcacttaaactgtttttag

SEQ ID NO: 601452 - DNA, 20 bp, Artificial
  CRISPR gRNA sequence
ctgtttttagtagcatgtac

SEQ ID NO: 601453 - DNA, 20 bp, Artificial
  CRISPR gRNA sequence
ttttagtagcatgtacaaga

SEQ ID NO: 601454 - DNA, 20 bp, Artificial
  CRISPR gRNA sequence
acaagatggaatgcttcaat

SEQ ID NO: 601455 - DNA, 20 bp, Artificial
  CRISPR gRNA sequence
ttagcttttcttatgcactc

SEQ ID NO: 601456 - DNA, 20 bp, Artificial
  CRISPR gRNA sequence
tgcactccagatattttgat

SEQ ID NO: 601457 - DNA, 20 bp, Artificial
  CRISPR gRNA sequence
ttgatgagtgtataattaat

SEQ ID NO: 601458 - DNA, 20 bp, Artificial
  CRISPR gRNA sequence
gtgtataattaatcagtgtg

SEQ ID NO: 601459 - DNA, 20 bp, Artificial
  CRISPR gRNA sequence
gttctaataaattaacattc

SEQ ID NO: 601460 - DNA, 20 bp, Artificial
  CRISPR gRNA sequence
ttctaataaattaacattct

SEQ ID NO: 601461 - DNA, 20 bp, Artificial
  CRISPR gRNA sequence
cattgctctcattatcattg

SEQ ID NO: 601462 - DNA, 20 bp, Artificial
  CRISPR gRNA sequence
tctcattatcattgaagctg

SEQ ID NO: 601463 - DNA, 20 bp, Artificial
  CRISPR gRNA sequence
ctccttacccttgtctatgt

SEQ ID NO: 601464 - DNA, 20 bp, Artificial
  CRISPR gRNA sequence
agctctacctacttcttact

SEQ ID NO: 601465 - DNA, 20 bp, Artificial
  CRISPR gRNA sequence
ttactaagacattcaacatg

SEQ ID NO: 601466 - DNA, 20 bp, Artificial
  CRISPR gRNA sequence
tactaagacattcaacatgc

SEQ ID NO: 601467 - DNA, 20 bp, Artificial
  CRISPR gRNA sequence
caggacttgatcttattttg

SEQ ID NO: 601468 - DNA, 20 bp, Artificial
  CRISPR gRNA sequence
ttgatcttattttgaagtgc

SEQ ID NO: 601469 - DNA, 20 bp, Artificial
  CRISPR gRNA sequence
tgatcttattttgaagtgct

SEQ ID NO: 601470 - DNA, 20 bp, Artificial
  CRISPR gRNA sequence
gatcttattttgaagtgcta

SEQ ID NO: 601471 - DNA, 20 bp, Artificial
  CRISPR gRNA sequence
gtactacgttgctgtgtttt

SEQ ID NO: 601472 - DNA, 20 bp, Artificial
  CRISPR gRNA sequence
tgtgttttcagttgaattaa

SEQ ID NO: 601473 - DNA, 20 bp, Artificial
  CRISPR gRNA sequence
ttttcagttgaattaacagt

SEQ ID NO: 601474 - DNA, 20 bp, Artificial
  CRISPR gRNA sequence
gaattaacagtgagaatttc

SEQ ID NO: 601475 - DNA, 20 bp, Artificial
  CRISPR gRNA sequence
aacagtgagaatttctggtt

SEQ ID NO: 601476 - DNA, 20 bp, Artificial
  CRISPR gRNA sequence
atttctggttgagttctaaa

SEQ ID NO: 601477 - DNA, 20 bp, Artificial
  CRISPR gRNA sequence
tttctggttgagttctaaat

SEQ ID NO: 601478 - DNA, 20 bp, Artificial
  CRISPR gRNA sequence
ataggcataatttcttctac

SEQ ID NO: 601479 - DNA, 20 bp, Artificial
  CRISPR gRNA sequence
atataaaacattttctttca

SEQ ID NO: 601480 - DNA, 20 bp, Artificial
  CRISPR gRNA sequence
ttaaaaatacacattttaac

SEQ ID NO: 601481 - DNA, 20 bp, Artificial
  CRISPR gRNA sequence
taacaagtaatatttacata

SEQ ID NO: 601482 - DNA, 20 bp, Artificial
  CRISPR gRNA sequence
ttacatatggaaatatctta

SEQ ID NO: 601483 - DNA, 20 bp, Artificial
  CRISPR gRNA sequence
tacatatggaaatatcttat

SEQ ID NO: 601484 - DNA, 20 bp, Artificial
  CRISPR gRNA sequence
tatcttataggtcttctaat

SEQ ID NO: 601485 - DNA, 20 bp, Artificial
  CRISPR gRNA sequence
atgccaatatgcttattatt

SEQ ID NO: 601486 - DNA, 20 bp, Artificial
  CRISPR gRNA sequence
caatatgcttattattcaga

SEQ ID NO: 601487 - DNA, 20 bp, Artificial
  CRISPR gRNA sequence
cttattattcagatggtctg

SEQ ID NO: 601488 - DNA, 20 bp, Artificial
  CRISPR gRNA sequence
attattcagatggtctgaag

SEQ ID NO: 601489 - DNA, 20 bp, Artificial
  CRISPR gRNA sequence
tcaatacatctgttactttt

SEQ ID NO: 601490 - DNA, 20 bp, Artificial
  CRISPR gRNA sequence
ctgttactttttagactgaa

SEQ ID NO: 601491 - DNA, 20 bp, Artificial
  CRISPR gRNA sequence
ttactttttagactgaaaag

SEQ ID NO: 601492 - DNA, 20 bp, Artificial
  CRISPR gRNA sequence
actgaaaagtggcatttcta

SEQ ID NO: 601493 - DNA, 20 bp, Artificial
  CRISPR gRNA sequence
agtggcatttctatagtttt

SEQ ID NO: 601494 - DNA, 20 bp, Artificial
  CRISPR gRNA sequence
gtggcatttctatagttttt

SEQ ID NO: 601495 - DNA, 20 bp, Artificial
  CRISPR gRNA sequence
tggcatttctatagttttta

SEQ ID NO: 601496 - DNA, 20 bp, Artificial
  CRISPR gRNA sequence
tttctatagtttttagggct

SEQ ID NO: 601497 - DNA, 20 bp, Artificial
  CRISPR gRNA sequence
ttctatagtttttagggctg

SEQ ID NO: 601498 - DNA, 20 bp, Artificial
  CRISPR gRNA sequence
tatttaattcgtgattgtaa

SEQ ID NO: 601499 - DNA, 20 bp, Artificial
  CRISPR gRNA sequence
atttaattcgtgattgtaaa

SEQ ID NO: 601500 - DNA, 20 bp, Artificial
  CRISPR gRNA sequence
tgtaaaaggtctatttctat

SEQ ID NO: 601501 - DNA, 20 bp, Artificial
  CRISPR gRNA sequence
ttctattagaaatgcttgct

SEQ ID NO: 601502 - DNA, 20 bp, Artificial
  CRISPR gRNA sequence
gatcacccaaatatcatcta

SEQ ID NO: 601503 - DNA, 20 bp, Artificial
  CRISPR gRNA sequence
tcatctaaagcttgaaaatt

SEQ ID NO: 601504 - DNA, 20 bp, Artificial
  CRISPR gRNA sequence
ttgagctattcaataatttt

SEQ ID NO: 601505 - DNA, 20 bp, Artificial
  CRISPR gRNA sequence
tgagctattcaataattttt

SEQ ID NO: 601506 - DNA, 20 bp, Artificial
  CRISPR gRNA sequence
taatttttaggtactaaaaa

SEQ ID NO: 601507 - DNA, 20 bp, Artificial
  CRISPR gRNA sequence
aatttttaggtactaaaaat

SEQ ID NO: 601508 - DNA, 20 bp, Artificial
  CRISPR gRNA sequence
ttttaggtactaaaaatagg

SEQ ID NO: 601509 - DNA, 20 bp, Artificial
  CRISPR gRNA sequence
taaaaacactgactcgaatg

SEQ ID NO: 601510 - DNA, 20 bp, Artificial
  CRISPR gRNA sequence
actgactcgaatgtagtatt

SEQ ID NO: 601511 - DNA, 20 bp, Artificial
  CRISPR gRNA sequence
catttttgaaaactacttga

SEQ ID NO: 601512 - DNA, 20 bp, Artificial
  CRISPR gRNA sequence
ttttgaaaactacttgaaag

SEQ ID NO: 601513 - DNA, 20 bp, Artificial
  CRISPR gRNA sequence
aaactacttgaaagcagcaa

SEQ ID NO: 601514 - DNA, 20 bp, Artificial
  CRISPR gRNA sequence
aagcagcaatagattgtgtc

SEQ ID NO: 601515 - DNA, 20 bp, Artificial
  CRISPR gRNA sequence
gattgtgtctggacataact

SEQ ID NO: 601516 - DNA, 20 bp, Artificial
  CRISPR gRNA sequence
acataactgagaattataaa

SEQ ID NO: 601517 - DNA, 20 bp, Artificial
  CRISPR gRNA sequence
agaattataaaaagaaatat

SEQ ID NO: 601518 - DNA, 20 bp, Artificial
  CRISPR gRNA sequence
gaaatatgagatttttctgt

SEQ ID NO: 601519 - DNA, 20 bp, Artificial
  CRISPR gRNA sequence
tctgtgagtctgctgttttt

SEQ ID NO: 601520 - DNA, 20 bp, Artificial
  CRISPR gRNA sequence
ctgctgtttttaagttctcg

SEQ ID NO: 601521 - DNA, 20 bp, Artificial
  CRISPR gRNA sequence
acacattaatgacctaatga

SEQ ID NO: 601522 - DNA, 20 bp, Artificial
  CRISPR gRNA sequence
taatgacctaatgatagttt

SEQ ID NO: 601523 - DNA, 20 bp, Artificial
  CRISPR gRNA sequence
ttttagatttaatttttttt

SEQ ID NO: 601524 - DNA, 20 bp, Artificial
  CRISPR gRNA sequence
tttttggaaataaaaacaaa

SEQ ID NO: 601525 - DNA, 20 bp, Artificial
  CRISPR gRNA sequence
ttttttacataaataaatca

SEQ ID NO: 601526 - DNA, 20 bp, Artificial
  CRISPR gRNA sequence
atagtaatgctgtttgcata

SEQ ID NO: 601527 - DNA, 20 bp, Artificial
  CRISPR gRNA sequence
atgctgtttgcataaagttt

SEQ ID NO: 601528 - DNA, 20 bp, Artificial
  CRISPR gRNA sequence
tgctgtttgcataaagtttt

SEQ ID NO: 601529 - DNA, 20 bp, Artificial
  CRISPR gRNA sequence
gctgtttgcataaagttttg

SEQ ID NO: 601530 - DNA, 20 bp, Artificial
  CRISPR gRNA sequence
gttttggggatgcatttgaa

SEQ ID NO: 601531 - DNA, 20 bp, Artificial
  CRISPR gRNA sequence
gggatgcatttgaatagttt

SEQ ID NO: 601532 - DNA, 20 bp, Artificial
  CRISPR gRNA sequence
tgcatttgaatagttttagt

SEQ ID NO: 601533 - DNA, 20 bp, Artificial
  CRISPR gRNA sequence
tttagttggtgttacatttt

SEQ ID NO: 601534 - DNA, 20 bp, Artificial
  CRISPR gRNA sequence
caatacctgtaacaaatttg

SEQ ID NO: 601535 - DNA, 20 bp, Artificial
  CRISPR gRNA sequence
atacctgtaacaaatttgaa

SEQ ID NO: 601536 - DNA, 20 bp, Artificial
  CRISPR gRNA sequence
aatttgaagagatatttttt

SEQ ID NO: 601537 - DNA, 20 bp, Artificial
  CRISPR gRNA sequence
tgaagagatattttttcagc

SEQ ID NO: 601538 - DNA, 20 bp, Artificial
  CRISPR gRNA sequence
aagagatattttttcagcca

SEQ ID NO: 601539 - DNA, 20 bp, Artificial
  CRISPR gRNA sequence
agatattttttcagccagag

SEQ ID NO: 601540 - DNA, 20 bp, Artificial
  CRISPR gRNA sequence
tttttcagccagagaagcta

SEQ ID NO: 601541 - DNA, 20 bp, Artificial
  CRISPR gRNA sequence
ccagagaagctatagttaac

SEQ ID NO: 601542 - DNA, 20 bp, Artificial
  CRISPR gRNA sequence
aataccatttatgtttttaa

SEQ ID NO: 601543 - DNA, 20 bp, Artificial
  CRISPR gRNA sequence
aatgtgtgaaaacaaataat

SEQ ID NO: 601544 - DNA, 20 bp, Artificial
  CRISPR gRNA sequence
tgaaaacaaataataagaac

SEQ ID NO: 601545 - DNA, 20 bp, Artificial
  CRISPR gRNA sequence
aaacaaataataagaacaag

SEQ ID NO: 601546 - DNA, 20 bp, Artificial
  CRISPR gRNA sequence
aacaaataataagaacaaga

SEQ ID NO: 601547 - DNA, 20 bp, Artificial
  CRISPR gRNA sequence
ggaaacgtcaaaacttgata

SEQ ID NO: 601548 - DNA, 20 bp, Artificial
  CRISPR gRNA sequence
aaacttgatatagttgactt

SEQ ID NO: 601549 - DNA, 20 bp, Artificial
  CRISPR gRNA sequence
aacttgatatagttgacttt

SEQ ID NO: 601550 - DNA, 20 bp, Artificial
  CRISPR gRNA sequence
tatagttgactttgggatat

SEQ ID NO: 601551 - DNA, 20 bp, Artificial
  CRISPR gRNA sequence
tagttgactttgggatatcg

SEQ ID NO: 601552 - DNA, 20 bp, Artificial
  CRISPR gRNA sequence
agttgactttgggatatcgg

SEQ ID NO: 601553 - DNA, 20 bp, Artificial
  CRISPR gRNA sequence
gttgactttgggatatcgga

SEQ ID NO: 601554 - DNA, 20 bp, Artificial
  CRISPR gRNA sequence
ttgggatatcggagggtaaa

SEQ ID NO: 601555 - DNA, 20 bp, Artificial
  CRISPR gRNA sequence
tgggatatcggagggtaaac

SEQ ID NO: 601556 - DNA, 20 bp, Artificial
  CRISPR gRNA sequence
gggatatcggagggtaaaca

SEQ ID NO: 601557 - DNA, 20 bp, Artificial
  CRISPR gRNA sequence
gttttatattttattctaaa

SEQ ID NO: 601558 - DNA, 20 bp, Artificial
  CRISPR gRNA sequence
taaatagttctacattcttt

SEQ ID NO: 601559 - DNA, 20 bp, Artificial
  CRISPR gRNA sequence
tatattatttgtgtaattta

SEQ ID NO: 601560 - DNA, 20 bp, Artificial
  CRISPR gRNA sequence
tatttgtgtaatttaaagaa

SEQ ID NO: 601561 - DNA, 20 bp, Artificial
  CRISPR gRNA sequence
aaagaaaagaccaatgaatt

SEQ ID NO: 601562 - DNA, 20 bp, Artificial
  CRISPR gRNA sequence
ttcagtcaaccatcctctaa

SEQ ID NO: 601563 - DNA, 20 bp, Artificial
  CRISPR gRNA sequence
gtcaaccatcctctaaaaga

SEQ ID NO: 601564 - DNA, 20 bp, Artificial
  CRISPR gRNA sequence
ccatcctctaaaagaaagta

SEQ ID NO: 601565 - DNA, 20 bp, Artificial
  CRISPR gRNA sequence
atcctctaaaagaaagtatg

SEQ ID NO: 601566 - DNA, 20 bp, Artificial
  CRISPR gRNA sequence
tctaaaagaaagtatggagc

SEQ ID NO: 601567 - DNA, 20 bp, Artificial
  CRISPR gRNA sequence
gtatggagccagaaaactga

SEQ ID NO: 601568 - DNA, 20 bp, Artificial
  CRISPR gRNA sequence
tggagccagaaaactgatag

SEQ ID NO: 601569 - DNA, 20 bp, Artificial
  CRISPR gRNA sequence
ttgaaatttcaataaaatta

SEQ ID NO: 601570 - DNA, 20 bp, Artificial
  CRISPR gRNA sequence
tatagactcataaaaatgat

SEQ ID NO: 601571 - DNA, 20 bp, Artificial
  CRISPR gRNA sequence
tcaatgataaatactgaaat

SEQ ID NO: 601572 - DNA, 20 bp, Artificial
  CRISPR gRNA sequence
caatgataaatactgaaatc

SEQ ID NO: 601573 - DNA, 20 bp, Artificial
  CRISPR gRNA sequence
tcatgtacaaatgatatctt

SEQ ID NO: 601574 - DNA, 20 bp, Artificial
  CRISPR gRNA sequence
tattgaatactattttacta

SEQ ID NO: 601575 - DNA, 20 bp, Artificial
  CRISPR gRNA sequence
atactattttactatagatt

SEQ ID NO: 601576 - DNA, 20 bp, Artificial
  CRISPR gRNA sequence
tatagatttagtcaaaatat

SEQ ID NO: 601577 - DNA, 20 bp, Artificial
  CRISPR gRNA sequence
atagatttagtcaaaatata

SEQ ID NO: 601578 - DNA, 20 bp, Artificial
  CRISPR gRNA sequence
tttttttttttttttttttt

SEQ ID NO: 601579 - DNA, 20 bp, Artificial
  CRISPR gRNA sequence
ttttttttttttttttgaga

SEQ ID NO: 601580 - DNA, 20 bp, Artificial
  CRISPR gRNA sequence
cagtgtcccgctctgtcacc

SEQ ID NO: 601581 - DNA, 20 bp, Artificial
  CRISPR gRNA sequence
agtgtcccgctctgtcaccc

SEQ ID NO: 601582 - DNA, 20 bp, Artificial
  CRISPR gRNA sequence
tcccgctctgtcacccaggc

SEQ ID NO: 601583 - DNA, 20 bp, Artificial
  CRISPR gRNA sequence
ccgctctgtcacccaggctg

SEQ ID NO: 601584 - DNA, 20 bp, Artificial
  CRISPR gRNA sequence
ctgtcacccaggctggagtg

SEQ ID NO: 601585 - DNA, 20 bp, Artificial
  CRISPR gRNA sequence
tcacccaggctggagtgcag

SEQ ID NO: 601586 - DNA, 20 bp, Artificial
  CRISPR gRNA sequence
ggagtgcagtggcgcgatct

SEQ ID NO: 601587 - DNA, 20 bp, Artificial
  CRISPR gRNA sequence
tcactgcaacccttcactcc

SEQ ID NO: 601588 - DNA, 20 bp, Artificial
  CRISPR gRNA sequence
cactgcaacccttcactccc

SEQ ID NO: 601589 - DNA, 20 bp, Artificial
  CRISPR gRNA sequence
aacccttcactcccaggttc

SEQ ID NO: 601590 - DNA, 20 bp, Artificial
  CRISPR gRNA sequence
ttcaagcaattctcctgcct

SEQ ID NO: 601591 - DNA, 20 bp, Artificial
  CRISPR gRNA sequence
ttctcctgcctcagtctccc

SEQ ID NO: 601592 - DNA, 20 bp, Artificial
  CRISPR gRNA sequence
tcctgcctcagtctcccgag

SEQ ID NO: 601593 - DNA, 20 bp, Artificial
  CRISPR gRNA sequence
gcctcagtctcccgagtagc

SEQ ID NO: 601594 - DNA, 20 bp, Artificial
  CRISPR gRNA sequence
cctcagtctcccgagtagct

SEQ ID NO: 601595 - DNA, 20 bp, Artificial
  CRISPR gRNA sequence
ctcccgagtagctgggatta

SEQ ID NO: 601596 - DNA, 20 bp, Artificial
  CRISPR gRNA sequence
tcccgagtagctgggattac

SEQ ID NO: 601597 - DNA, 20 bp, Artificial
  CRISPR gRNA sequence
caggcgcccatcaccacgtc

SEQ ID NO: 601598 - DNA, 20 bp, Artificial
  CRISPR gRNA sequence
cagctaatttttttattttt

SEQ ID NO: 601599 - DNA, 20 bp, Artificial
  CRISPR gRNA sequence
aatttttttattttttagtg

SEQ ID NO: 601600 - DNA, 20 bp, Artificial
  CRISPR gRNA sequence
tttttattttttagtgtaga

SEQ ID NO: 601601 - DNA, 20 bp, Artificial
  CRISPR gRNA sequence
ttttattttttagtgtagac

SEQ ID NO: 601602 - DNA, 20 bp, Artificial
  CRISPR gRNA sequence
tttattttttagtgtagaca

SEQ ID NO: 601603 - DNA, 20 bp, Artificial
  CRISPR gRNA sequence
agtgtagacagggtttcact

SEQ ID NO: 601604 - DNA, 20 bp, Artificial
  CRISPR gRNA sequence
tagacagggtttcactaagt

SEQ ID NO: 601605 - DNA, 20 bp, Artificial
  CRISPR gRNA sequence
cagggtttcactaagttggt

SEQ ID NO: 601606 - DNA, 20 bp, Artificial
  CRISPR gRNA sequence
agggtttcactaagttggtc

SEQ ID NO: 601607 - DNA, 20 bp, Artificial
  CRISPR gRNA sequence
tttcactaagttggtcaggc

SEQ ID NO: 601608 - DNA, 20 bp, Artificial
  CRISPR gRNA sequence
tggtctcaaactcttgacct

SEQ ID NO: 601609 - DNA, 20 bp, Artificial
  CRISPR gRNA sequence
ggtctcaaactcttgacctc

SEQ ID NO: 601610 - DNA, 20 bp, Artificial
  CRISPR gRNA sequence
ctcgggctatccacctgcct

SEQ ID NO: 601611 - DNA, 20 bp, Artificial
  CRISPR gRNA sequence
ccacctgcctcagcctccca

SEQ ID NO: 601612 - DNA, 20 bp, Artificial
  CRISPR gRNA sequence
gcctcagcctcccaaagtgc

SEQ ID NO: 601613 - DNA, 20 bp, Artificial
  CRISPR gRNA sequence
cctcccaaagtgctggatta

SEQ ID NO: 601614 - DNA, 20 bp, Artificial
  CRISPR gRNA sequence
ctcccaaagtgctggattac

SEQ ID NO: 601615 - DNA, 20 bp, Artificial
  CRISPR gRNA sequence
agtgctggattacaggcata

SEQ ID NO: 601616 - DNA, 20 bp, Artificial
  CRISPR gRNA sequence
aggcataaagccactgcccc

SEQ ID NO: 601617 - DNA, 20 bp, Artificial
  CRISPR gRNA sequence
tcttttttttttttttgaaa

SEQ ID NO: 601618 - DNA, 20 bp, Artificial
  CRISPR gRNA sequence
ttttttttttttttgaaacg

SEQ ID NO: 601619 - DNA, 20 bp, Artificial
  CRISPR gRNA sequence
tgaaacggagtctcgctctg

SEQ ID NO: 601620 - DNA, 20 bp, Artificial
  CRISPR gRNA sequence
cggagtctcgctctgtagcc

SEQ ID NO: 601621 - DNA, 20 bp, Artificial
  CRISPR gRNA sequence
ggagtctcgctctgtagccc

SEQ ID NO: 601622 - DNA, 20 bp, Artificial
  CRISPR gRNA sequence
tctcgctctgtagcccaggc

SEQ ID NO: 601623 - DNA, 20 bp, Artificial
  CRISPR gRNA sequence
tcgctctgtagcccaggctg

SEQ ID NO: 601624 - DNA, 20 bp, Artificial
  CRISPR gRNA sequence
tagcccaggctggagtgccg

SEQ ID NO: 601625 - DNA, 20 bp, Artificial
  CRISPR gRNA sequence
tggagtgccgtggcgcgatc

SEQ ID NO: 601626 - DNA, 20 bp, Artificial
  CRISPR gRNA sequence
tcactgcaacctccgcctcc

SEQ ID NO: 601627 - DNA, 20 bp, Artificial
  CRISPR gRNA sequence
cactgcaacctccgcctcct

SEQ ID NO: 601628 - DNA, 20 bp, Artificial
  CRISPR gRNA sequence
aacctccgcctcctgggttc

SEQ ID NO: 601629 - DNA, 20 bp, Artificial
  CRISPR gRNA sequence
ttcaagcaattctcctgcct

SEQ ID NO: 601630 - DNA, 20 bp, Artificial
  CRISPR gRNA sequence
ttctcctgcctcagcctcct

SEQ ID NO: 601631 - DNA, 20 bp, Artificial
  CRISPR gRNA sequence
tcctgcctcagcctcctgag

SEQ ID NO: 601632 - DNA, 20 bp, Artificial
  CRISPR gRNA sequence
gcctcagcctcctgagtagc

SEQ ID NO: 601633 - DNA, 20 bp, Artificial
  CRISPR gRNA sequence
cctcagcctcctgagtagct

SEQ ID NO: 601634 - DNA, 20 bp, Artificial
  CRISPR gRNA sequence
ctcctgagtagctgggatta

SEQ ID NO: 601635 - DNA, 20 bp, Artificial
  CRISPR gRNA sequence
tcctgagtagctgggattac

SEQ ID NO: 601636 - DNA, 20 bp, Artificial
  CRISPR gRNA sequence
tacaggcatgccaccatgcc

SEQ ID NO: 601637 - DNA, 20 bp, Artificial
  CRISPR gRNA sequence
ctaatttttttttgcatttt

SEQ ID NO: 601638 - DNA, 20 bp, Artificial
  CRISPR gRNA sequence
atttttttttgcatttttag

SEQ ID NO: 601639 - DNA, 20 bp, Artificial
  CRISPR gRNA sequence
ttttttttgcatttttagtg

SEQ ID NO: 601640 - DNA, 20 bp, Artificial
  CRISPR gRNA sequence
ttttgcatttttagtggaga

SEQ ID NO: 601641 - DNA, 20 bp, Artificial
  CRISPR gRNA sequence
tttgcatttttagtggagac

SEQ ID NO: 601642 - DNA, 20 bp, Artificial
  CRISPR gRNA sequence
ttgcatttttagtggagacg

SEQ ID NO: 601643 - DNA, 20 bp, Artificial
  CRISPR gRNA sequence
gagacggggtttcaccatgt

SEQ ID NO: 601644 - DNA, 20 bp, Artificial
  CRISPR gRNA sequence
cggggtttcaccatgttggt

SEQ ID NO: 601645 - DNA, 20 bp, Artificial
  CRISPR gRNA sequence
ggggtttcaccatgttggtc

SEQ ID NO: 601646 - DNA, 20 bp, Artificial
  CRISPR gRNA sequence
tcaggcgctctcgtactcct

SEQ ID NO: 601647 - DNA, 20 bp, Artificial
  CRISPR gRNA sequence
tctcgtactcctgagcttgt

SEQ ID NO: 601648 - DNA, 20 bp, Artificial
  CRISPR gRNA sequence
agcttgtgagccaccgtgcc

SEQ ID NO: 601649 - DNA, 20 bp, Artificial
  CRISPR gRNA sequence
ttctttccttttcctttcct

SEQ ID NO: 601650 - DNA, 20 bp, Artificial
  CRISPR gRNA sequence
ttccttttcctttcctgaga

SEQ ID NO: 601651 - DNA, 20 bp, Artificial
  CRISPR gRNA sequence
tccttttcctttcctgagat

SEQ ID NO: 601652 - DNA, 20 bp, Artificial
  CRISPR gRNA sequence
ccttttcctttcctgagatg

SEQ ID NO: 601653 - DNA, 20 bp, Artificial
  CRISPR gRNA sequence
tggggtcttgttctgttgtt

SEQ ID NO: 601654 - DNA, 20 bp, Artificial
  CRISPR gRNA sequence
ggggtcttgttctgttgttc

SEQ ID NO: 601655 - DNA, 20 bp, Artificial
  CRISPR gRNA sequence
tcttgttctgttgttcaggc

SEQ ID NO: 601656 - DNA, 20 bp, Artificial
  CRISPR gRNA sequence
ttgttctgttgttcaggctg

SEQ ID NO: 601657 - DNA, 20 bp, Artificial
  CRISPR gRNA sequence
ctgttgttcaggctggagta

SEQ ID NO: 601658 - DNA, 20 bp, Artificial
  CRISPR gRNA sequence
ggagtacggtgtcacgatta

SEQ ID NO: 601659 - DNA, 20 bp, Artificial
  CRISPR gRNA sequence
acggtgtcacgattatagct

SEQ ID NO: 601660 - DNA, 20 bp, Artificial
  CRISPR gRNA sequence
gtcacgattatagctcagtg

SEQ ID NO: 601661 - DNA, 20 bp, Artificial
  CRISPR gRNA sequence
gattatagctcagtgcagcc

SEQ ID NO: 601662 - DNA, 20 bp, Artificial
  CRISPR gRNA sequence
tcagtgcagcctggaactcc

SEQ ID NO: 601663 - DNA, 20 bp, Artificial
  CRISPR gRNA sequence
cagtgcagcctggaactcct

SEQ ID NO: 601664 - DNA, 20 bp, Artificial
  CRISPR gRNA sequence
agcctggaactcctgggctc

SEQ ID NO: 601665 - DNA, 20 bp, Artificial
  CRISPR gRNA sequence
tgggctcaagcaatcttctc

SEQ ID NO: 601666 - DNA, 20 bp, Artificial
  CRISPR gRNA sequence
aagcaatcttctcaagtatc

SEQ ID NO: 601667 - DNA, 20 bp, Artificial
  CRISPR gRNA sequence
agcaatcttctcaagtatct

SEQ ID NO: 601668 - DNA, 20 bp, Artificial
  CRISPR gRNA sequence
gcaatcttctcaagtatctg

SEQ ID NO: 601669 - DNA, 20 bp, Artificial
  CRISPR gRNA sequence
ttctcaagtatctggggcta

SEQ ID NO: 601670 - DNA, 20 bp, Artificial
  CRISPR gRNA sequence
tctcaagtatctggggctac

SEQ ID NO: 601671 - DNA, 20 bp, Artificial
  CRISPR gRNA sequence
caggtgcatgccaccatgcc

SEQ ID NO: 601672 - DNA, 20 bp, Artificial
  CRISPR gRNA sequence
aatttttaacaatttttttt

SEQ ID NO: 601673 - DNA, 20 bp, Artificial
  CRISPR gRNA sequence
tttttaacaattttttttta

SEQ ID NO: 601674 - DNA, 20 bp, Artificial
  CRISPR gRNA sequence
taacaatttttttttagagt

SEQ ID NO: 601675 - DNA, 20 bp, Artificial
  CRISPR gRNA sequence
aacaatttttttttagagtc

SEQ ID NO: 601676 - DNA, 20 bp, Artificial
  CRISPR gRNA sequence
acaatttttttttagagtca

SEQ ID NO: 601677 - DNA, 20 bp, Artificial
  CRISPR gRNA sequence
cactatcttactgtgttgtc

SEQ ID NO: 601678 - DNA, 20 bp, Artificial
  CRISPR gRNA sequence
actatcttactgtgttgtcc

SEQ ID NO: 601679 - DNA, 20 bp, Artificial
  CRISPR gRNA sequence
tcttactgtgttgtccaggc

SEQ ID NO: 601680 - DNA, 20 bp, Artificial
  CRISPR gRNA sequence
ccaggctggtcttgaactcc

SEQ ID NO: 601681 - DNA, 20 bp, Artificial
  CRISPR gRNA sequence
ggtcttgaactcctggcctc

SEQ ID NO: 601682 - DNA, 20 bp, Artificial
  CRISPR gRNA sequence
ctcaagtgattctcccgcct

SEQ ID NO: 601683 - DNA, 20 bp, Artificial
  CRISPR gRNA sequence
ttctcccgcctcagcctcct

SEQ ID NO: 601684 - DNA, 20 bp, Artificial
  CRISPR gRNA sequence
tcccgcctcagcctcctgag

SEQ ID NO: 601685 - DNA, 20 bp, Artificial
  CRISPR gRNA sequence
cctcagcctcctgagtagct

SEQ ID NO: 601686 - DNA, 20 bp, Artificial
  CRISPR gRNA sequence
ctcctgagtagctgagttta

SEQ ID NO: 601687 - DNA, 20 bp, Artificial
  CRISPR gRNA sequence
tcctgagtagctgagtttac

SEQ ID NO: 601688 - DNA, 20 bp, Artificial
  CRISPR gRNA sequence
gtagctgagtttacaggtgt

SEQ ID NO: 601689 - DNA, 20 bp, Artificial
  CRISPR gRNA sequence
caggtgtgagccaccacact

SEQ ID NO: 601690 - DNA, 20 bp, Artificial
  CRISPR gRNA sequence
tgtgagccaccacacttggc

SEQ ID NO: 601691 - DNA, 20 bp, Artificial
  CRISPR gRNA sequence
gtgagccaccacacttggct

SEQ ID NO: 601692 - DNA, 20 bp, Artificial
  CRISPR gRNA sequence
acacttggctaggttgttta

SEQ ID NO: 601693 - DNA, 20 bp, Artificial
  CRISPR gRNA sequence
cttggctaggttgtttacag

SEQ ID NO: 601694 - DNA, 20 bp, Artificial
  CRISPR gRNA sequence
tatactctgaattgttttat

SEQ ID NO: 601695 - DNA, 20 bp, Artificial
  CRISPR gRNA sequence
ttatgagtaatattcattca

SEQ ID NO: 601696 - DNA, 20 bp, Artificial
  CRISPR gRNA sequence
taatattcattcatagcatg

SEQ ID NO: 601697 - DNA, 20 bp, Artificial
  CRISPR gRNA sequence
taaaatgacatatcaatatt

SEQ ID NO: 601698 - DNA, 20 bp, Artificial
  CRISPR gRNA sequence
aaaatgacatatcaatatta

SEQ ID NO: 601699 - DNA, 20 bp, Artificial
  CRISPR gRNA sequence
aatgacatatcaatattaag

SEQ ID NO: 601700 - DNA, 20 bp, Artificial
  CRISPR gRNA sequence
tcaatattaaggagacattg

SEQ ID NO: 601701 - DNA, 20 bp, Artificial
  CRISPR gRNA sequence
ggagacattgtggcatctga

SEQ ID NO: 601702 - DNA, 20 bp, Artificial
  CRISPR gRNA sequence
attgtggcatctgatggcaa

SEQ ID NO: 601703 - DNA, 20 bp, Artificial
  CRISPR gRNA sequence
tctgatggcaaaagaaatct

SEQ ID NO: 601704 - DNA, 20 bp, Artificial
  CRISPR gRNA sequence
gatggcaaaagaaatctgag

SEQ ID NO: 601705 - DNA, 20 bp, Artificial
  CRISPR gRNA sequence
aaaagaaatctgagtagaat

SEQ ID NO: 601706 - DNA, 20 bp, Artificial
  CRISPR gRNA sequence
gagtagaatgagttaaaaca

SEQ ID NO: 601707 - DNA, 20 bp, Artificial
  CRISPR gRNA sequence
ctatcttgcatgtaacaaac

SEQ ID NO: 601708 - DNA, 20 bp, Artificial
  CRISPR gRNA sequence
aaacaagtttacttttaaaa

SEQ ID NO: 601709 - DNA, 20 bp, Artificial
  CRISPR gRNA sequence
acaagtttacttttaaaaaa

SEQ ID NO: 601710 - DNA, 20 bp, Artificial
  CRISPR gRNA sequence
ttacttttaaaaaagagcct

SEQ ID NO: 601711 - DNA, 20 bp, Artificial
  CRISPR gRNA sequence
tttttacattaaaactatta

SEQ ID NO: 601712 - DNA, 20 bp, Artificial
  CRISPR gRNA sequence
tttacattaaaactattaaa

SEQ ID NO: 601713 - DNA, 20 bp, Artificial
  CRISPR gRNA sequence
tattaaagagaaactatttt

SEQ ID NO: 601714 - DNA, 20 bp, Artificial
  CRISPR gRNA sequence
aaagagaaactatttttagc

SEQ ID NO: 601715 - DNA, 20 bp, Artificial
  CRISPR gRNA sequence
tatttttagcaagacaattc

SEQ ID NO: 601716 - DNA, 20 bp, Artificial
  CRISPR gRNA sequence
caattctggtatgttgctaa

SEQ ID NO: 601717 - DNA, 20 bp, Artificial
  CRISPR gRNA sequence
attctggtatgttgctaatg

SEQ ID NO: 601718 - DNA, 20 bp, Artificial
  CRISPR gRNA sequence
ttctggtatgttgctaatgg

SEQ ID NO: 601719 - DNA, 20 bp, Artificial
  CRISPR gRNA sequence
tggtatgttgctaatggagg

SEQ ID NO: 601720 - DNA, 20 bp, Artificial
  CRISPR gRNA sequence
ggtatgttgctaatggaggt

SEQ ID NO: 601721 - DNA, 20 bp, Artificial
  CRISPR gRNA sequence
aggacctgcgaaaataactt

SEQ ID NO: 601722 - DNA, 20 bp, Artificial
  CRISPR gRNA sequence
ggacctgcgaaaataactta

SEQ ID NO: 601723 - DNA, 20 bp, Artificial
  CRISPR gRNA sequence
aaataacttaaggcctataa

SEQ ID NO: 601724 - DNA, 20 bp, Artificial
  CRISPR gRNA sequence
aacttaaggcctataaaaga

SEQ ID NO: 601725 - DNA, 20 bp, Artificial
  CRISPR gRNA sequence
cttaaggcctataaaagaaa

SEQ ID NO: 601726 - DNA, 20 bp, Artificial
  CRISPR gRNA sequence
aaggcctataaaagaaagag

SEQ ID NO: 601727 - DNA, 20 bp, Artificial
  CRISPR gRNA sequence
ggcctataaaagaaagagca

SEQ ID NO: 601728 - DNA, 20 bp, Artificial
  CRISPR gRNA sequence
aaagaaagagcagagctgtg

SEQ ID NO: 601729 - DNA, 20 bp, Artificial
  CRISPR gRNA sequence
aagagcagagctgtgaagta

SEQ ID NO: 601730 - DNA, 20 bp, Artificial
  CRISPR gRNA sequence
gagcagagctgtgaagtata

SEQ ID NO: 601731 - DNA, 20 bp, Artificial
  CRISPR gRNA sequence
gcagagctgtgaagtataga

SEQ ID NO: 601732 - DNA, 20 bp, Artificial
  CRISPR gRNA sequence
gctgtgaagtatagagagca

SEQ ID NO: 601733 - DNA, 20 bp, Artificial
  CRISPR gRNA sequence
gtgaagtatagagagcatag

SEQ ID NO: 601734 - DNA, 20 bp, Artificial
  CRISPR gRNA sequence
agtatagagagcatagaaga

SEQ ID NO: 601735 - DNA, 20 bp, Artificial
  CRISPR gRNA sequence
tagagagcatagaagaaagc

SEQ ID NO: 601736 - DNA, 20 bp, Artificial
  CRISPR gRNA sequence
gagcatagaagaaagctggc

SEQ ID NO: 601737 - DNA, 20 bp, Artificial
  CRISPR gRNA sequence
catagaagaaagctggcaag

SEQ ID NO: 601738 - DNA, 20 bp, Artificial
  CRISPR gRNA sequence
gaagaaagctggcaagaaga

SEQ ID NO: 601739 - DNA, 20 bp, Artificial
  CRISPR gRNA sequence
aaagctggcaagaagaaaga

SEQ ID NO: 601740 - DNA, 20 bp, Artificial
  CRISPR gRNA sequence
gaaagaaagaataaaaataa

SEQ ID NO: 601741 - DNA, 20 bp, Artificial
  CRISPR gRNA sequence
aagaataaaaataacagatt

SEQ ID NO: 601742 - DNA, 20 bp, Artificial
  CRISPR gRNA sequence
aataaaaataacagattcag

SEQ ID NO: 601743 - DNA, 20 bp, Artificial
  CRISPR gRNA sequence
aaaaataacagattcagaag

SEQ ID NO: 601744 - DNA, 20 bp, Artificial
  CRISPR gRNA sequence
aaataacagattcagaagtg

SEQ ID NO: 601745 - DNA, 20 bp, Artificial
  CRISPR gRNA sequence
aataacagattcagaagtgg

SEQ ID NO: 601746 - DNA, 20 bp, Artificial
  CRISPR gRNA sequence
cagattcagaagtggaggac

SEQ ID NO: 601747 - DNA, 20 bp, Artificial
  CRISPR gRNA sequence
cagaagtggaggacaagcca

SEQ ID NO: 601748 - DNA, 20 bp, Artificial
  CRISPR gRNA sequence
acaagccacagactccactt

SEQ ID NO: 601749 - DNA, 20 bp, Artificial
  CRISPR gRNA sequence
gccacagactccacttgagt

SEQ ID NO: 601750 - DNA, 20 bp, Artificial
  CRISPR gRNA sequence
acagactccacttgagttag

SEQ ID NO: 601751 - DNA, 20 bp, Artificial
  CRISPR gRNA sequence
acttgagttagtagatccac

SEQ ID NO: 601752 - DNA, 20 bp, Artificial
  CRISPR gRNA sequence
ttgagttagtagatccactg

SEQ ID NO: 601753 - DNA, 20 bp, Artificial
  CRISPR gRNA sequence
gagttagtagatccactgga

SEQ ID NO: 601754 - DNA, 20 bp, Artificial
  CRISPR gRNA sequence
gttagtagatccactggaga

SEQ ID NO: 601755 - DNA, 20 bp, Artificial
  CRISPR gRNA sequence
agatccactggagagagcaa

SEQ ID NO: 601756 - DNA, 20 bp, Artificial
  CRISPR gRNA sequence
atccactggagagagcaata

SEQ ID NO: 601757 - DNA, 20 bp, Artificial
  CRISPR gRNA sequence
gcaatagagcaaatgaaaaa

SEQ ID NO: 601758 - DNA, 20 bp, Artificial
  CRISPR gRNA sequence
tcttcacaaaaaaataaata

SEQ ID NO: 601759 - DNA, 20 bp, Artificial
  CRISPR gRNA sequence
ttcacaaaaaaataaataaa

SEQ ID NO: 601760 - DNA, 20 bp, Artificial
  CRISPR gRNA sequence
aaaaataaataaagagaaat

SEQ ID NO: 601761 - DNA, 20 bp, Artificial
  CRISPR gRNA sequence
aaagagaaatcagaatttat

SEQ ID NO: 601762 - DNA, 20 bp, Artificial
  CRISPR gRNA sequence
tcagaatttataagtgaatc

SEQ ID NO: 601763 - DNA, 20 bp, Artificial
  CRISPR gRNA sequence
cagaatttataagtgaatca

SEQ ID NO: 601764 - DNA, 20 bp, Artificial
  CRISPR gRNA sequence
aatttataagtgaatcaagg

SEQ ID NO: 601765 - DNA, 20 bp, Artificial
  CRISPR gRNA sequence
atcaaggaagctgcctgctt

SEQ ID NO: 601766 - DNA, 20 bp, Artificial
  CRISPR gRNA sequence
aagctgcctgcttaagtgat

SEQ ID NO: 601767 - DNA, 20 bp, Artificial
  CRISPR gRNA sequence
agctgcctgcttaagtgatg

SEQ ID NO: 601768 - DNA, 20 bp, Artificial
  CRISPR gRNA sequence
tgcttaagtgatgaggaatg

SEQ ID NO: 601769 - DNA, 20 bp, Artificial
  CRISPR gRNA sequence
gtgatgaggaatgtggcaat

SEQ ID NO: 601770 - DNA, 20 bp, Artificial
  CRISPR gRNA sequence
gaggaatgtggcaataagat

SEQ ID NO: 601771 - DNA, 20 bp, Artificial
  CRISPR gRNA sequence
atgtggcaataagattagaa

SEQ ID NO: 601772 - DNA, 20 bp, Artificial
  CRISPR gRNA sequence
aataagattagaatggtttc

SEQ ID NO: 601773 - DNA, 20 bp, Artificial
  CRISPR gRNA sequence
aagattagaatggtttctgg

SEQ ID NO: 601774 - DNA, 20 bp, Artificial
  CRISPR gRNA sequence
attagaatggtttctggtag

SEQ ID NO: 601775 - DNA, 20 bp, Artificial
  CRISPR gRNA sequence
ctggtagaagctaaatgaat

SEQ ID NO: 601776 - DNA, 20 bp, Artificial
  CRISPR gRNA sequence
aagctaaatgaataagcatt

SEQ ID NO: 601777 - DNA, 20 bp, Artificial
  CRISPR gRNA sequence
aatgaataagcatttagatt

SEQ ID NO: 601778 - DNA, 20 bp, Artificial
  CRISPR gRNA sequence
atgaataagcatttagattc

SEQ ID NO: 601779 - DNA, 20 bp, Artificial
  CRISPR gRNA sequence
gaataagcatttagattcgg

SEQ ID NO: 601780 - DNA, 20 bp, Artificial
  CRISPR gRNA sequence
aagcatttagattcgggaga

SEQ ID NO: 601781 - DNA, 20 bp, Artificial
  CRISPR gRNA sequence
catttagattcgggagaaag

SEQ ID NO: 601782 - DNA, 20 bp, Artificial
  CRISPR gRNA sequence
gagaaagaagcatacttctt

SEQ ID NO: 601783 - DNA, 20 bp, Artificial
  CRISPR gRNA sequence
atacttcttcagatatttga

SEQ ID NO: 601784 - DNA, 20 bp, Artificial
  CRISPR gRNA sequence
ttcttcagatatttgaaagc

SEQ ID NO: 601785 - DNA, 20 bp, Artificial
  CRISPR gRNA sequence
tcttcagatatttgaaagcc

SEQ ID NO: 601786 - DNA, 20 bp, Artificial
  CRISPR gRNA sequence
cttcagatatttgaaagcca

SEQ ID NO: 601787 - DNA, 20 bp, Artificial
  CRISPR gRNA sequence
tcagatatttgaaagccagg

SEQ ID NO: 601788 - DNA, 20 bp, Artificial
  CRISPR gRNA sequence
gatatttgaaagccagggag

SEQ ID NO: 601789 - DNA, 20 bp, Artificial
  CRISPR gRNA sequence
atatttgaaagccagggagt

SEQ ID NO: 601790 - DNA, 20 bp, Artificial
  CRISPR gRNA sequence
atttgaaagccagggagtag

SEQ ID NO: 601791 - DNA, 20 bp, Artificial
  CRISPR gRNA sequence
gaaagccagggagtaggaga

SEQ ID NO: 601792 - DNA, 20 bp, Artificial
  CRISPR gRNA sequence
aaagccagggagtaggagat

SEQ ID NO: 601793 - DNA, 20 bp, Artificial
  CRISPR gRNA sequence
aagccagggagtaggagatg

SEQ ID NO: 601794 - DNA, 20 bp, Artificial
  CRISPR gRNA sequence
agccagggagtaggagatgg

SEQ ID NO: 601795 - DNA, 20 bp, Artificial
  CRISPR gRNA sequence
cagggagtaggagatggggg

SEQ ID NO: 601796 - DNA, 20 bp, Artificial
  CRISPR gRNA sequence
agtaggagatgggggtagat

SEQ ID NO: 601797 - DNA, 20 bp, Artificial
  CRISPR gRNA sequence
gatgggggtagattggttaa

SEQ ID NO: 601798 - DNA, 20 bp, Artificial
  CRISPR gRNA sequence
ggtagattggttaaaagaac

SEQ ID NO: 601799 - DNA, 20 bp, Artificial
  CRISPR gRNA sequence
gtagattggttaaaagaact

SEQ ID NO: 601800 - DNA, 20 bp, Artificial
  CRISPR gRNA sequence
ggttaaaagaactgggtcct

SEQ ID NO: 601801 - DNA, 20 bp, Artificial
  CRISPR gRNA sequence
gttaaaagaactgggtccta

SEQ ID NO: 601802 - DNA, 20 bp, Artificial
  CRISPR gRNA sequence
ttaaaagaactgggtcctaa

SEQ ID NO: 601803 - DNA, 20 bp, Artificial
  CRISPR gRNA sequence
gggtcctaagggattgattc

SEQ ID NO: 601804 - DNA, 20 bp, Artificial
  CRISPR gRNA sequence
gggattgattctagaacaat

SEQ ID NO: 601805 - DNA, 20 bp, Artificial
  CRISPR gRNA sequence
ctagaacaattagccaatta

SEQ ID NO: 601806 - DNA, 20 bp, Artificial
  CRISPR gRNA sequence
gaacaattagccaattaaag

SEQ ID NO: 601807 - DNA, 20 bp, Artificial
  CRISPR gRNA sequence
aacaattagccaattaaagc

SEQ ID NO: 601808 - DNA, 20 bp, Artificial
  CRISPR gRNA sequence
agccaattaaagcaggataa

SEQ ID NO: 601809 - DNA, 20 bp, Artificial
  CRISPR gRNA sequence
aattaaagcaggataaaagt

SEQ ID NO: 601810 - DNA, 20 bp, Artificial
  CRISPR gRNA sequence
taaagcaggataaaagttag

SEQ ID NO: 601811 - DNA, 20 bp, Artificial
  CRISPR gRNA sequence
ggataaaagttagtggtgcc

SEQ ID NO: 601812 - DNA, 20 bp, Artificial
  CRISPR gRNA sequence
gttagtggtgcctagttatt

SEQ ID NO: 601813 - DNA, 20 bp, Artificial
  CRISPR gRNA sequence
gcctagttattaagttatat

SEQ ID NO: 601814 - DNA, 20 bp, Artificial
  CRISPR gRNA sequence
aagttatattagttataaac

SEQ ID NO: 601815 - DNA, 20 bp, Artificial
  CRISPR gRNA sequence
ttataaaccagtgctattat

SEQ ID NO: 601816 - DNA, 20 bp, Artificial
  CRISPR gRNA sequence
taaaccagtgctattatcag

SEQ ID NO: 601817 - DNA, 20 bp, Artificial
  CRISPR gRNA sequence
gctattatcagtggccatct

SEQ ID NO: 601818 - DNA, 20 bp, Artificial
  CRISPR gRNA sequence
gtgtactatactgtgtgtgt

SEQ ID NO: 601819 - DNA, 20 bp, Artificial
  CRISPR gRNA sequence
gtactatactgtgtgtgtaa

SEQ ID NO: 601820 - DNA, 20 bp, Artificial
  CRISPR gRNA sequence
tgtgtaagagatatcctaac

SEQ ID NO: 601821 - DNA, 20 bp, Artificial
  CRISPR gRNA sequence
gtcgtattcctaaattatcg

SEQ ID NO: 601822 - DNA, 20 bp, Artificial
  CRISPR gRNA sequence
ttcctaaattatcgtggatg

SEQ ID NO: 601823 - DNA, 20 bp, Artificial
  CRISPR gRNA sequence
taaactttgatcttgcccct

SEQ ID NO: 601824 - DNA, 20 bp, Artificial
  CRISPR gRNA sequence
cctcagttgtctttttactt

SEQ ID NO: 601825 - DNA, 20 bp, Artificial
  CRISPR gRNA sequence
gttgtctttttactttagtt

SEQ ID NO: 601826 - DNA, 20 bp, Artificial
  CRISPR gRNA sequence
gtctttttactttagtttag

SEQ ID NO: 601827 - DNA, 20 bp, Artificial
  CRISPR gRNA sequence
tctttttactttagtttagt

SEQ ID NO: 601828 - DNA, 20 bp, Artificial
  CRISPR gRNA sequence
tttactttagtttagtggga

SEQ ID NO: 601829 - DNA, 20 bp, Artificial
  CRISPR gRNA sequence
ttactttagtttagtgggaa

SEQ ID NO: 601830 - DNA, 20 bp, Artificial
  CRISPR gRNA sequence
actttagtttagtgggaaag

SEQ ID NO: 601831 - DNA, 20 bp, Artificial
  CRISPR gRNA sequence
agtttagtgggaaaggagat

SEQ ID NO: 601832 - DNA, 20 bp, Artificial
  CRISPR gRNA sequence
ttagtgggaaaggagattgg

SEQ ID NO: 601833 - DNA, 20 bp, Artificial
  CRISPR gRNA sequence
tagtgggaaaggagattgga

SEQ ID NO: 601834 - DNA, 20 bp, Artificial
  CRISPR gRNA sequence
agtgggaaaggagattggaa

SEQ ID NO: 601835 - DNA, 20 bp, Artificial
  CRISPR gRNA sequence
gtgggaaaggagattggaag

SEQ ID NO: 601836 - DNA, 20 bp, Artificial
  CRISPR gRNA sequence
tgggaaaggagattggaagg

SEQ ID NO: 601837 - DNA, 20 bp, Artificial
  CRISPR gRNA sequence
aaaggagattggaagggggt

SEQ ID NO: 601838 - DNA, 20 bp, Artificial
  CRISPR gRNA sequence
aaggagattggaagggggtt

SEQ ID NO: 601839 - DNA, 20 bp, Artificial
  CRISPR gRNA sequence
aggagattggaagggggtta

SEQ ID NO: 601840 - DNA, 20 bp, Artificial
  CRISPR gRNA sequence
gagattggaagggggttagg

SEQ ID NO: 601841 - DNA, 20 bp, Artificial
  CRISPR gRNA sequence
aagggggttagggagactgt

SEQ ID NO: 601842 - DNA, 20 bp, Artificial
  CRISPR gRNA sequence
agggggttagggagactgta

SEQ ID NO: 601843 - DNA, 20 bp, Artificial
  CRISPR gRNA sequence
tagggagactgtaaggctgc

SEQ ID NO: 601844 - DNA, 20 bp, Artificial
  CRISPR gRNA sequence
gagactgtaaggctgccaga

SEQ ID NO: 601845 - DNA, 20 bp, Artificial
  CRISPR gRNA sequence
tctgctttttttccccctct

SEQ ID NO: 601846 - DNA, 20 bp, Artificial
  CRISPR gRNA sequence
ctgctttttttccccctctt

SEQ ID NO: 601847 - DNA, 20 bp, Artificial
  CRISPR gRNA sequence
gctttttttccccctcttgg

SEQ ID NO: 601848 - DNA, 20 bp, Artificial
  CRISPR gRNA sequence
tttttccccctcttgggaga

SEQ ID NO: 601849 - DNA, 20 bp, Artificial
  CRISPR gRNA sequence
cctcttgggagatggcaatg

SEQ ID NO: 601850 - DNA, 20 bp, Artificial
  CRISPR gRNA sequence
cttgggagatggcaatgaag

SEQ ID NO: 601851 - DNA, 20 bp, Artificial
  CRISPR gRNA sequence
ttgggagatggcaatgaaga

SEQ ID NO: 601852 - DNA, 20 bp, Artificial
  CRISPR gRNA sequence
tgaagaaggaacttgatatt

SEQ ID NO: 601853 - DNA, 20 bp, Artificial
  CRISPR gRNA sequence
agaaggaacttgatattgag

SEQ ID NO: 601854 - DNA, 20 bp, Artificial
  CRISPR gRNA sequence
gaacttgatattgagcagat

SEQ ID NO: 601855 - DNA, 20 bp, Artificial
  CRISPR gRNA sequence
tgatattgagcagatgagat

SEQ ID NO: 601856 - DNA, 20 bp, Artificial
  CRISPR gRNA sequence
gatattgagcagatgagatg

SEQ ID NO: 601857 - DNA, 20 bp, Artificial
  CRISPR gRNA sequence
atgagatgaggttttgcatc

SEQ ID NO: 601858 - DNA, 20 bp, Artificial
  CRISPR gRNA sequence
agtttttgtcctctgatcgc

SEQ ID NO: 601859 - DNA, 20 bp, Artificial
  CRISPR gRNA sequence
gtttttccattttcctctcg

SEQ ID NO: 601860 - DNA, 20 bp, Artificial
  CRISPR gRNA sequence
attttcctctcgaagtgtct

SEQ ID NO: 601861 - DNA, 20 bp, Artificial
  CRISPR gRNA sequence
ctctcgaagtgtctaagaca

SEQ ID NO: 601862 - DNA, 20 bp, Artificial
  CRISPR gRNA sequence
tctcgaagtgtctaagacac

SEQ ID NO: 601863 - DNA, 20 bp, Artificial
  CRISPR gRNA sequence
gtgtctaagacacaggcact

SEQ ID NO: 601864 - DNA, 20 bp, Artificial
  CRISPR gRNA sequence
tgtctaagacacaggcactg

SEQ ID NO: 601865 - DNA, 20 bp, Artificial
  CRISPR gRNA sequence
gtctaagacacaggcactga

SEQ ID NO: 601866 - DNA, 20 bp, Artificial
  CRISPR gRNA sequence
gacacaggcactgagggttc

SEQ ID NO: 601867 - DNA, 20 bp, Artificial
  CRISPR gRNA sequence
acaggcactgagggttccag

SEQ ID NO: 601868 - DNA, 20 bp, Artificial
  CRISPR gRNA sequence
gggttccagaagactttctt

SEQ ID NO: 601869 - DNA, 20 bp, Artificial
  CRISPR gRNA sequence
tgagatcatactctgttatt

SEQ ID NO: 601870 - DNA, 20 bp, Artificial
  CRISPR gRNA sequence
gatcatactctgttatttag

SEQ ID NO: 601871 - DNA, 20 bp, Artificial
  CRISPR gRNA sequence
atcatactctgttatttaga

SEQ ID NO: 601872 - DNA, 20 bp, Artificial
  CRISPR gRNA sequence
actctgttatttagaaggct

SEQ ID NO: 601873 - DNA, 20 bp, Artificial
  CRISPR gRNA sequence
ctctgttatttagaaggctc

SEQ ID NO: 601874 - DNA, 20 bp, Artificial
  CRISPR gRNA sequence
gttatttagaaggctcaggt

SEQ ID NO: 601875 - DNA, 20 bp, Artificial
  CRISPR gRNA sequence
caggttggcttttacccatt

SEQ ID NO: 601876 - DNA, 20 bp, Artificial
  CRISPR gRNA sequence
attaatctgctttaatactg

SEQ ID NO: 601877 - DNA, 20 bp, Artificial
  CRISPR gRNA sequence
atactgtagtaaaaatttat

SEQ ID NO: 601878 - DNA, 20 bp, Artificial
  CRISPR gRNA sequence
agtaaaaatttatcagttgt

SEQ ID NO: 601879 - DNA, 20 bp, Artificial
  CRISPR gRNA sequence
ttacatgtgtatcattgttg

SEQ ID NO: 601880 - DNA, 20 bp, Artificial
  CRISPR gRNA sequence
tgtgtatcattgttgaagaa

SEQ ID NO: 601881 - DNA, 20 bp, Artificial
  CRISPR gRNA sequence
gtgtatcattgttgaagaaa

SEQ ID NO: 601882 - DNA, 20 bp, Artificial
  CRISPR gRNA sequence
tgttgaagaaaaggtttact

SEQ ID NO: 601883 - DNA, 20 bp, Artificial
  CRISPR gRNA sequence
ccataaataacaataataaa

SEQ ID NO: 601884 - DNA, 20 bp, Artificial
  CRISPR gRNA sequence
aataacaataataaaaagat

SEQ ID NO: 601885 - DNA, 20 bp, Artificial
  CRISPR gRNA sequence
ataacaataataaaaagatc

SEQ ID NO: 601886 - DNA, 20 bp, Artificial
  CRISPR gRNA sequence
taacaataataaaaagatca

SEQ ID NO: 601887 - DNA, 20 bp, Artificial
  CRISPR gRNA sequence
tgcttaaaaaaacaaatttt

SEQ ID NO: 601888 - DNA, 20 bp, Artificial
  CRISPR gRNA sequence
aaacaaattttaagtctact

SEQ ID NO: 601889 - DNA, 20 bp, Artificial
  CRISPR gRNA sequence
aagaataccattttatttgt

SEQ ID NO: 601890 - DNA, 20 bp, Artificial
  CRISPR gRNA sequence
agaataccattttatttgta

SEQ ID NO: 601891 - DNA, 20 bp, Artificial
  CRISPR gRNA sequence
tttcaaaatgcttttacatc

SEQ ID NO: 601892 - DNA, 20 bp, Artificial
  CRISPR gRNA sequence
aaatgcttttacatctagca

SEQ ID NO: 601893 - DNA, 20 bp, Artificial
  CRISPR gRNA sequence
gaatgtgctgatcaaaactt

SEQ ID NO: 601894 - DNA, 20 bp, Artificial
  CRISPR gRNA sequence
gagcttaatatttatgcaac

SEQ ID NO: 601895 - DNA, 20 bp, Artificial
  CRISPR gRNA sequence
aatatttatgcaaccagtgt

SEQ ID NO: 601896 - DNA, 20 bp, Artificial
  CRISPR gRNA sequence
tatttatgcaaccagtgtca

SEQ ID NO: 601897 - DNA, 20 bp, Artificial
  CRISPR gRNA sequence
gagtaatctactctttttga

SEQ ID NO: 601898 - DNA, 20 bp, Artificial
  CRISPR gRNA sequence
ctactctttttgatagtact

SEQ ID NO: 601899 - DNA, 20 bp, Artificial
  CRISPR gRNA sequence
ttgatagtacttagcattac

SEQ ID NO: 601900 - DNA, 20 bp, Artificial
  CRISPR gRNA sequence
tacttagcattactggaaaa

SEQ ID NO: 601901 - DNA, 20 bp, Artificial
  CRISPR gRNA sequence
atttatttatttattttttc

SEQ ID NO: 601902 - DNA, 20 bp, Artificial
  CRISPR gRNA sequence
atttatttattttttcgaga

SEQ ID NO: 601903 - DNA, 20 bp, Artificial
  CRISPR gRNA sequence
ttatttattttttcgagacg

SEQ ID NO: 601904 - DNA, 20 bp, Artificial
  CRISPR gRNA sequence
cggagtctatctttgtcgcc

SEQ ID NO: 601905 - DNA, 20 bp, Artificial
  CRISPR gRNA sequence
ggagtctatctttgtcgccc

SEQ ID NO: 601906 - DNA, 20 bp, Artificial
  CRISPR gRNA sequence
tctatctttgtcgcccaggc

SEQ ID NO: 601907 - DNA, 20 bp, Artificial
  CRISPR gRNA sequence
tatctttgtcgcccaggcta

SEQ ID NO: 601908 - DNA, 20 bp, Artificial
  CRISPR gRNA sequence
ttgtcgcccaggctagagtg

SEQ ID NO: 601909 - DNA, 20 bp, Artificial
  CRISPR gRNA sequence
tcgcccaggctagagtgcgg

SEQ ID NO: 601910 - DNA, 20 bp, Artificial
  CRISPR gRNA sequence
agagtgcggtggtgcgatct

SEQ ID NO: 601911 - DNA, 20 bp, Artificial
  CRISPR gRNA sequence
cactgcaaccttcgcctccc

SEQ ID NO: 601912 - DNA, 20 bp, Artificial
  CRISPR gRNA sequence
tgcaaccttcgcctcccgag

SEQ ID NO: 601913 - DNA, 20 bp, Artificial
  CRISPR gRNA sequence
ccttcgcctcccgagaagct

SEQ ID NO: 601914 - DNA, 20 bp, Artificial
  CRISPR gRNA sequence
ctcccgagaagctgagatta

SEQ ID NO: 601915 - DNA, 20 bp, Artificial
  CRISPR gRNA sequence
tcccgagaagctgagattac

SEQ ID NO: 601916 - DNA, 20 bp, Artificial
  CRISPR gRNA sequence
caggtacctgccaccatgcc

SEQ ID NO: 601917 - DNA, 20 bp, Artificial
  CRISPR gRNA sequence
ctagcaaatttttgtatttt

SEQ ID NO: 601918 - DNA, 20 bp, Artificial
  CRISPR gRNA sequence
gcaaatttttgtatttttag

SEQ ID NO: 601919 - DNA, 20 bp, Artificial
  CRISPR gRNA sequence
aaatttttgtatttttagta

SEQ ID NO: 601920 - DNA, 20 bp, Artificial
  CRISPR gRNA sequence
tttgtatttttagtagagac

SEQ ID NO: 601921 - DNA, 20 bp, Artificial
  CRISPR gRNA sequence
ttgtatttttagtagagact

SEQ ID NO: 601922 - DNA, 20 bp, Artificial
  CRISPR gRNA sequence
gagactgggttttaccatgt

SEQ ID NO: 601923 - DNA, 20 bp, Artificial
  CRISPR gRNA sequence
ctgggttttaccatgttggt

SEQ ID NO: 601924 - DNA, 20 bp, Artificial
  CRISPR gRNA sequence
tgggttttaccatgttggtc

SEQ ID NO: 601925 - DNA, 20 bp, Artificial
  CRISPR gRNA sequence
ttttaccatgttggtcaggc

SEQ ID NO: 601926 - DNA, 20 bp, Artificial
  CRISPR gRNA sequence
agtcttgaacttctgacctc

SEQ ID NO: 601927 - DNA, 20 bp, Artificial
  CRISPR gRNA sequence
ctcaagtaatctgcctacct

SEQ ID NO: 601928 - DNA, 20 bp, Artificial
  CRISPR gRNA sequence
ctgcctacctcagcctccca

SEQ ID NO: 601929 - DNA, 20 bp, Artificial
  CRISPR gRNA sequence
acctcagcctcccaaagtgc

SEQ ID NO: 601930 - DNA, 20 bp, Artificial
  CRISPR gRNA sequence
cctcagcctcccaaagtgct

SEQ ID NO: 601931 - DNA, 20 bp, Artificial
  CRISPR gRNA sequence
ctcccaaagtgctgggatca

SEQ ID NO: 601932 - DNA, 20 bp, Artificial
  CRISPR gRNA sequence
tcccaaagtgctgggatcac

SEQ ID NO: 601933 - DNA, 20 bp, Artificial
  CRISPR gRNA sequence
agtgctgggatcacaggcgt

SEQ ID NO: 601934 - DNA, 20 bp, Artificial
  CRISPR gRNA sequence
caggcgtgagccaccgtgcc

SEQ ID NO: 601935 - DNA, 20 bp, Artificial
  CRISPR gRNA sequence
cgtgagccaccgtgcctggc

SEQ ID NO: 601936 - DNA, 20 bp, Artificial
  CRISPR gRNA sequence
aaacatgtttttaaaaatta

SEQ ID NO: 601937 - DNA, 20 bp, Artificial
  CRISPR gRNA sequence
tttttaaaaattacagaatt

SEQ ID NO: 601938 - DNA, 20 bp, Artificial
  CRISPR gRNA sequence
taaaaattacagaattgagc

SEQ ID NO: 601939 - DNA, 20 bp, Artificial
  CRISPR gRNA sequence
ttcctgtttctctccctctg

SEQ ID NO: 601940 - DNA, 20 bp, Artificial
  CRISPR gRNA sequence
ctctccctctgtggtatata

SEQ ID NO: 601941 - DNA, 20 bp, Artificial
  CRISPR gRNA sequence
tccctctgtggtatataaag

SEQ ID NO: 601942 - DNA, 20 bp, Artificial
  CRISPR gRNA sequence
ctctgtggtatataaagaag

SEQ ID NO: 601943 - DNA, 20 bp, Artificial
  CRISPR gRNA sequence
tctgtggtatataaagaagt

SEQ ID NO: 601944 - DNA, 20 bp, Artificial
  CRISPR gRNA sequence
acctaatatatgtcaaatgt

SEQ ID NO: 601945 - DNA, 20 bp, Artificial
  CRISPR gRNA sequence
cctaatatatgtcaaatgtg

SEQ ID NO: 601946 - DNA, 20 bp, Artificial
  CRISPR gRNA sequence
tatgtcaaatgtgaggcccc

SEQ ID NO: 601947 - DNA, 20 bp, Artificial
  CRISPR gRNA sequence
tcaaatgtgaggcccctaga

SEQ ID NO: 601948 - DNA, 20 bp, Artificial
  CRISPR gRNA sequence
tagacagatattttatctct

SEQ ID NO: 601949 - DNA, 20 bp, Artificial
  CRISPR gRNA sequence
acagatattttatctcttgg

SEQ ID NO: 601950 - DNA, 20 bp, Artificial
  CRISPR gRNA sequence
tattttatctcttggaagct

SEQ ID NO: 601951 - DNA, 20 bp, Artificial
  CRISPR gRNA sequence
agctcagctttatttgtaaa

SEQ ID NO: 601952 - DNA, 20 bp, Artificial
  CRISPR gRNA sequence
gctcagctttatttgtaaaa

SEQ ID NO: 601953 - DNA, 20 bp, Artificial
  CRISPR gRNA sequence
ctcagctttatttgtaaaaa

SEQ ID NO: 601954 - DNA, 20 bp, Artificial
  CRISPR gRNA sequence
tcagctttatttgtaaaaag

SEQ ID NO: 601955 - DNA, 20 bp, Artificial
  CRISPR gRNA sequence
aaggggatattgctctctgt

SEQ ID NO: 601956 - DNA, 20 bp, Artificial
  CRISPR gRNA sequence
ggggatattgctctctgtca

SEQ ID NO: 601957 - DNA, 20 bp, Artificial
  CRISPR gRNA sequence
gggatattgctctctgtcag

SEQ ID NO: 601958 - DNA, 20 bp, Artificial
  CRISPR gRNA sequence
gatattgctctctgtcagag

SEQ ID NO: 601959 - DNA, 20 bp, Artificial
  CRISPR gRNA sequence
attgctctctgtcagaggag

SEQ ID NO: 601960 - DNA, 20 bp, Artificial
  CRISPR gRNA sequence
ctctctgtcagaggagtggt

SEQ ID NO: 601961 - DNA, 20 bp, Artificial
  CRISPR gRNA sequence
gtcagaggagtggtaagcat

SEQ ID NO: 601962 - DNA, 20 bp, Artificial
  CRISPR gRNA sequence
cattagacacaatatatgta

SEQ ID NO: 601963 - DNA, 20 bp, Artificial
  CRISPR gRNA sequence
cacaatatatgtaaagcttc

SEQ ID NO: 601964 - DNA, 20 bp, Artificial
  CRISPR gRNA sequence
tatatgtaaagcttccagaa

SEQ ID NO: 601965 - DNA, 20 bp, Artificial
  CRISPR gRNA sequence
aaagcttccagaacagtgac

SEQ ID NO: 601966 - DNA, 20 bp, Artificial
  CRISPR gRNA sequence
ccagaacagtgactggctca

SEQ ID NO: 601967 - DNA, 20 bp, Artificial
  CRISPR gRNA sequence
aacagtgactggctcatggt

SEQ ID NO: 601968 - DNA, 20 bp, Artificial
  CRISPR gRNA sequence
gtgactggctcatggtaagt

SEQ ID NO: 601969 - DNA, 20 bp, Artificial
  CRISPR gRNA sequence
ctggctcatggtaagttagc

SEQ ID NO: 601970 - DNA, 20 bp, Artificial
  CRISPR gRNA sequence
tggtaagttagccagaatga

SEQ ID NO: 601971 - DNA, 20 bp, Artificial
  CRISPR gRNA sequence
gatagctcctattttattgt

SEQ ID NO: 601972 - DNA, 20 bp, Artificial
  CRISPR gRNA sequence
ctattttattgttagataaa

SEQ ID NO: 601973 - DNA, 20 bp, Artificial
  CRISPR gRNA sequence
ttgttagataaaaagaatat

SEQ ID NO: 601974 - DNA, 20 bp, Artificial
  CRISPR gRNA sequence
ataaaaagaatatgagaaaa

SEQ ID NO: 601975 - DNA, 20 bp, Artificial
  CRISPR gRNA sequence
agttgaattacataataact

SEQ ID NO: 601976 - DNA, 20 bp, Artificial
  CRISPR gRNA sequence
attacataataactaagaaa

SEQ ID NO: 601977 - DNA, 20 bp, Artificial
  CRISPR gRNA sequence
ttacataataactaagaaac

SEQ ID NO: 601978 - DNA, 20 bp, Artificial
  CRISPR gRNA sequence
tcccacaaacatatatcaaa

SEQ ID NO: 601979 - DNA, 20 bp, Artificial
  CRISPR gRNA sequence
acatatatcaaatagtcttc

SEQ ID NO: 601980 - DNA, 20 bp, Artificial
  CRISPR gRNA sequence
catatatcaaatagtcttct

SEQ ID NO: 601981 - DNA, 20 bp, Artificial
  CRISPR gRNA sequence
atatcaaatagtcttctagg

SEQ ID NO: 601982 - DNA, 20 bp, Artificial
  CRISPR gRNA sequence
tatcaaatagtcttctagga

SEQ ID NO: 601983 - DNA, 20 bp, Artificial
  CRISPR gRNA sequence
ttctaggaaggacatgcttt

SEQ ID NO: 601984 - DNA, 20 bp, Artificial
  CRISPR gRNA sequence
tcaacaataattttaaaaat

SEQ ID NO: 601985 - DNA, 20 bp, Artificial
  CRISPR gRNA sequence
taattttaaaaattagtcca

SEQ ID NO: 601986 - DNA, 20 bp, Artificial
  CRISPR gRNA sequence
aattagtccaaagcattgca

SEQ ID NO: 601987 - DNA, 20 bp, Artificial
  CRISPR gRNA sequence
tgcatggaacataacatatc

SEQ ID NO: 601988 - DNA, 20 bp, Artificial
  CRISPR gRNA sequence
tttctgcttttcatctgttt

SEQ ID NO: 601989 - DNA, 20 bp, Artificial
  CRISPR gRNA sequence
ttcatctgtttgagtgctgt

SEQ ID NO: 601990 - DNA, 20 bp, Artificial
  CRISPR gRNA sequence
tcatctgtttgagtgctgtc

SEQ ID NO: 601991 - DNA, 20 bp, Artificial
  CRISPR gRNA sequence
tctgtttgagtgctgtcagg

SEQ ID NO: 601992 - DNA, 20 bp, Artificial
  CRISPR gRNA sequence
tttgagtgctgtcaggtaga

SEQ ID NO: 601993 - DNA, 20 bp, Artificial
  CRISPR gRNA sequence
tgctgtcaggtagacagact

SEQ ID NO: 601994 - DNA, 20 bp, Artificial
  CRISPR gRNA sequence
actcagaatttttgtttgaa

SEQ ID NO: 601995 - DNA, 20 bp, Artificial
  CRISPR gRNA sequence
tttgaaaagaaatgtgtatg

SEQ ID NO: 601996 - DNA, 20 bp, Artificial
  CRISPR gRNA sequence
agaaatgtgtatgcagatat

SEQ ID NO: 601997 - DNA, 20 bp, Artificial
  CRISPR gRNA sequence
tgtattcaaatcaattactg

SEQ ID NO: 601998 - DNA, 20 bp, Artificial
  CRISPR gRNA sequence
atcaattactgaagaaatga

SEQ ID NO: 601999 - DNA, 20 bp, Artificial
  CRISPR gRNA sequence
taaacctactctgtttgtga

SEQ ID NO: 602000 - DNA, 20 bp, Artificial
  CRISPR gRNA sequence
aaacctactctgtttgtgac

SEQ ID NO: 602001 - DNA, 20 bp, Artificial
  CRISPR gRNA sequence
tgtgacgggtataattgaaa

SEQ ID NO: 602002 - DNA, 20 bp, Artificial
  CRISPR gRNA sequence
gtataattgaaatggtaatt

SEQ ID NO: 602003 - DNA, 20 bp, Artificial
  CRISPR gRNA sequence
taattgaaatggtaattaag

SEQ ID NO: 602004 - DNA, 20 bp, Artificial
  CRISPR gRNA sequence
ttgaaatggtaattaagtgg

SEQ ID NO: 602005 - DNA, 20 bp, Artificial
  CRISPR gRNA sequence
ggtagtaatgcatttcattt

SEQ ID NO: 602006 - DNA, 20 bp, Artificial
  CRISPR gRNA sequence
gtagtaatgcatttcatttg

SEQ ID NO: 602007 - DNA, 20 bp, Artificial
  CRISPR gRNA sequence
taatgcatttcatttgagga

SEQ ID NO: 602008 - DNA, 20 bp, Artificial
  CRISPR gRNA sequence
ttcatttgaggatggcaatt

SEQ ID NO: 602009 - DNA, 20 bp, Artificial
  CRISPR gRNA sequence
atttgaggatggcaattcag

SEQ ID NO: 602010 - DNA, 20 bp, Artificial
  CRISPR gRNA sequence
aattcagaagatgtgtttgc

SEQ ID NO: 602011 - DNA, 20 bp, Artificial
  CRISPR gRNA sequence
tcagaagatgtgtttgctgg

SEQ ID NO: 602012 - DNA, 20 bp, Artificial
  CRISPR gRNA sequence
cagaagatgtgtttgctggc

SEQ ID NO: 602013 - DNA, 20 bp, Artificial
  CRISPR gRNA sequence
atgtgtttgctggcaggtct

SEQ ID NO: 602014 - DNA, 20 bp, Artificial
  CRISPR gRNA sequence
gctggcaggtcttggctgct

SEQ ID NO: 602015 - DNA, 20 bp, Artificial
  CRISPR gRNA sequence
ggctgcttggtgtacctccc

SEQ ID NO: 602016 - DNA, 20 bp, Artificial
  CRISPR gRNA sequence
gctgcttggtgtacctccct

SEQ ID NO: 602017 - DNA, 20 bp, Artificial
  CRISPR gRNA sequence
cctccctaggtgaccttgtc

SEQ ID NO: 602018 - DNA, 20 bp, Artificial
  CRISPR gRNA sequence
tccctaggtgaccttgtcca

SEQ ID NO: 602019 - DNA, 20 bp, Artificial
  CRISPR gRNA sequence
taggtgaccttgtccagagt

SEQ ID NO: 602020 - DNA, 20 bp, Artificial
  CRISPR gRNA sequence
ccttgtccagagtgagtttt

SEQ ID NO: 602021 - DNA, 20 bp, Artificial
  CRISPR gRNA sequence
cttgtccagagtgagttttt

SEQ ID NO: 602022 - DNA, 20 bp, Artificial
  CRISPR gRNA sequence
tccagagtgagtttttagga

SEQ ID NO: 602023 - DNA, 20 bp, Artificial
  CRISPR gRNA sequence
gacttatttacttgtataac

SEQ ID NO: 602024 - DNA, 20 bp, Artificial
  CRISPR gRNA sequence
acttgtataactagatgtgt

SEQ ID NO: 602025 - DNA, 20 bp, Artificial
  CRISPR gRNA sequence
tgtgttggtgaatgaattcc

SEQ ID NO: 602026 - DNA, 20 bp, Artificial
  CRISPR gRNA sequence
tggtgaatgaattcctagta

SEQ ID NO: 602027 - DNA, 20 bp, Artificial
  CRISPR gRNA sequence
tttattaatttccatactta

SEQ ID NO: 602028 - DNA, 20 bp, Artificial
  CRISPR gRNA sequence
tcatgtctctgttgcatatc

SEQ ID NO: 602029 - DNA, 20 bp, Artificial
  CRISPR gRNA sequence
tgttgcatatctggaattct

SEQ ID NO: 602030 - DNA, 20 bp, Artificial
  CRISPR gRNA sequence
agaaccacatatacataccc

SEQ ID NO: 602031 - DNA, 20 bp, Artificial
  CRISPR gRNA sequence
accacatatacataccccag

SEQ ID NO: 602032 - DNA, 20 bp, Artificial
  CRISPR gRNA sequence
ttctttttttctctcttgtg

SEQ ID NO: 602033 - DNA, 20 bp, Artificial
  CRISPR gRNA sequence
tttctctcttgtgtagaatc

SEQ ID NO: 602034 - DNA, 20 bp, Artificial
  CRISPR gRNA sequence
ttctctcttgtgtagaatca

SEQ ID NO: 602035 - DNA, 20 bp, Artificial
  CRISPR gRNA sequence
ctctcttgtgtagaatcaag

SEQ ID NO: 602036 - DNA, 20 bp, Artificial
  CRISPR gRNA sequence
gtgtagaatcaaggagaaaa

SEQ ID NO: 602037 - DNA, 20 bp, Artificial
  CRISPR gRNA sequence
caaggagaaaacagaatatt

SEQ ID NO: 602038 - DNA, 20 bp, Artificial
  CRISPR gRNA sequence
aaacagaatattcagtttaa

SEQ ID NO: 602039 - DNA, 20 bp, Artificial
  CRISPR gRNA sequence
aacagaatattcagtttaaa

SEQ ID NO: 602040 - DNA, 20 bp, Artificial
  CRISPR gRNA sequence
agtttaaaaggatttcacat

SEQ ID NO: 602041 - DNA, 20 bp, Artificial
  CRISPR gRNA sequence
tttaaaaggatttcacatta

SEQ ID NO: 602042 - DNA, 20 bp, Artificial
  CRISPR gRNA sequence
cacattagagtacacataaa

SEQ ID NO: 602043 - DNA, 20 bp, Artificial
  CRISPR gRNA sequence
acataaacagacattttcct

SEQ ID NO: 602044 - DNA, 20 bp, Artificial
  CRISPR gRNA sequence
aacagacattttcctgagtg

SEQ ID NO: 602045 - DNA, 20 bp, Artificial
  CRISPR gRNA sequence
gagtgaagtttcaccttttt

SEQ ID NO: 602046 - DNA, 20 bp, Artificial
  CRISPR gRNA sequence
agtgaagtttcacctttttt

SEQ ID NO: 602047 - DNA, 20 bp, Artificial
  CRISPR gRNA sequence
aagtttcaccttttttgggt

SEQ ID NO: 602048 - DNA, 20 bp, Artificial
  CRISPR gRNA sequence
gtttcaccttttttgggtca

SEQ ID NO: 602049 - DNA, 20 bp, Artificial
  CRISPR gRNA sequence
ggtcagagttactattgtca

SEQ ID NO: 602050 - DNA, 20 bp, Artificial
  CRISPR gRNA sequence
gtcagagttactattgtcat

SEQ ID NO: 602051 - DNA, 20 bp, Artificial
  CRISPR gRNA sequence
agttactattgtcataggca

SEQ ID NO: 602052 - DNA, 20 bp, Artificial
  CRISPR gRNA sequence
gttactattgtcataggcac

SEQ ID NO: 602053 - DNA, 20 bp, Artificial
  CRISPR gRNA sequence
ctattgtcataggcacagga

SEQ ID NO: 602054 - DNA, 20 bp, Artificial
  CRISPR gRNA sequence
aatgatcttttttttttttt

SEQ ID NO: 602055 - DNA, 20 bp, Artificial
  CRISPR gRNA sequence
ttatcattgcttaatttctt

SEQ ID NO: 602056 - DNA, 20 bp, Artificial
  CRISPR gRNA sequence
tcttatctcctttgtgtgac

SEQ ID NO: 602057 - DNA, 20 bp, Artificial
  CRISPR gRNA sequence
tgtgtgactggaaactcctt

SEQ ID NO: 602058 - DNA, 20 bp, Artificial
  CRISPR gRNA sequence
gtgtgactggaaactccttg

SEQ ID NO: 602059 - DNA, 20 bp, Artificial
  CRISPR gRNA sequence
tgtgactggaaactccttga

SEQ ID NO: 602060 - DNA, 20 bp, Artificial
  CRISPR gRNA sequence
gactggaaactccttgaggg

SEQ ID NO: 602061 - DNA, 20 bp, Artificial
  CRISPR gRNA sequence
actggaaactccttgagggc

SEQ ID NO: 602062 - DNA, 20 bp, Artificial
  CRISPR gRNA sequence
ctggaaactccttgagggca

SEQ ID NO: 602063 - DNA, 20 bp, Artificial
  CRISPR gRNA sequence
aaatgactttgtaatctctg

SEQ ID NO: 602064 - DNA, 20 bp, Artificial
  CRISPR gRNA sequence
ctttgtaatctctgcagcct

SEQ ID NO: 602065 - DNA, 20 bp, Artificial
  CRISPR gRNA sequence
tttgtaatctctgcagcctg

SEQ ID NO: 602066 - DNA, 20 bp, Artificial
  CRISPR gRNA sequence
ttgtaatctctgcagcctga

SEQ ID NO: 602067 - DNA, 20 bp, Artificial
  CRISPR gRNA sequence
taatctctgcagcctgaggg

SEQ ID NO: 602068 - DNA, 20 bp, Artificial
  CRISPR gRNA sequence
tctctgcagcctgagggtag

SEQ ID NO: 602069 - DNA, 20 bp, Artificial
  CRISPR gRNA sequence
tgcagcctgagggtagcaga

SEQ ID NO: 602070 - DNA, 20 bp, Artificial
  CRISPR gRNA sequence
agcagacagaatatgacttt

SEQ ID NO: 602071 - DNA, 20 bp, Artificial
  CRISPR gRNA sequence
acttttagcacctaaccgac

SEQ ID NO: 602072 - DNA, 20 bp, Artificial
  CRISPR gRNA sequence
cttttagcacctaaccgact

SEQ ID NO: 602073 - DNA, 20 bp, Artificial
  CRISPR gRNA sequence
tagcacctaaccgactggga

SEQ ID NO: 602074 - DNA, 20 bp, Artificial
  CRISPR gRNA sequence
atctttcctatgctgtgttt

SEQ ID NO: 602075 - DNA, 20 bp, Artificial
  CRISPR gRNA sequence
tagttacctcatttgtaaaa

SEQ ID NO: 602076 - DNA, 20 bp, Artificial
  CRISPR gRNA sequence
agttacctcatttgtaaaat

SEQ ID NO: 602077 - DNA, 20 bp, Artificial
  CRISPR gRNA sequence
gttacctcatttgtaaaata

SEQ ID NO: 602078 - DNA, 20 bp, Artificial
  CRISPR gRNA sequence
cctcatttgtaaaataggga

SEQ ID NO: 602079 - DNA, 20 bp, Artificial
  CRISPR gRNA sequence
atttgtaaaatagggaaagt

SEQ ID NO: 602080 - DNA, 20 bp, Artificial
  CRISPR gRNA sequence
gaaagttagtgcttgtctct

SEQ ID NO: 602081 - DNA, 20 bp, Artificial
  CRISPR gRNA sequence
aagttagtgcttgtctcttg

SEQ ID NO: 602082 - DNA, 20 bp, Artificial
  CRISPR gRNA sequence
ttgtctcttggagttgttgt

SEQ ID NO: 602083 - DNA, 20 bp, Artificial
  CRISPR gRNA sequence
tgtctcttggagttgttgtg

SEQ ID NO: 602084 - DNA, 20 bp, Artificial
  CRISPR gRNA sequence
gtctcttggagttgttgtga

SEQ ID NO: 602085 - DNA, 20 bp, Artificial
  CRISPR gRNA sequence
gttgtgagggttaataaact

SEQ ID NO: 602086 - DNA, 20 bp, Artificial
  CRISPR gRNA sequence
gagggttaataaacttagta

SEQ ID NO: 602087 - DNA, 20 bp, Artificial
  CRISPR gRNA sequence
acttagtaaagcttttatca

SEQ ID NO: 602088 - DNA, 20 bp, Artificial
  CRISPR gRNA sequence
cttagtaaagcttttatcac

SEQ ID NO: 602089 - DNA, 20 bp, Artificial
  CRISPR gRNA sequence
ttagtaaagcttttatcaca

SEQ ID NO: 602090 - DNA, 20 bp, Artificial
  CRISPR gRNA sequence
cacagggcctaatacatttt

SEQ ID NO: 602091 - DNA, 20 bp, Artificial
  CRISPR gRNA sequence
tacattttaagaaataattt

SEQ ID NO: 602092 - DNA, 20 bp, Artificial
  CRISPR gRNA sequence
atattcatttatcttttcca

SEQ ID NO: 602093 - DNA, 20 bp, Artificial
  CRISPR gRNA sequence
ttcatttatcttttccacag

SEQ ID NO: 602094 - DNA, 20 bp, Artificial
  CRISPR gRNA sequence
cttttccacagaagctaaca

SEQ ID NO: 602095 - DNA, 20 bp, Artificial
  CRISPR gRNA sequence
ctaacacagtgccttataca

SEQ ID NO: 602096 - DNA, 20 bp, Artificial
  CRISPR gRNA sequence
acacagtgccttatacatag

SEQ ID NO: 602097 - DNA, 20 bp, Artificial
  CRISPR gRNA sequence
tacatagtagtctctcaatt

SEQ ID NO: 602098 - DNA, 20 bp, Artificial
  CRISPR gRNA sequence
atagtagtctctcaattaag

SEQ ID NO: 602099 - DNA, 20 bp, Artificial
  CRISPR gRNA sequence
tttattttaaaatatattgt

SEQ ID NO: 602100 - DNA, 20 bp, Artificial
  CRISPR gRNA sequence
gagttaatatccctatgtgt

SEQ ID NO: 602101 - DNA, 20 bp, Artificial
  CRISPR gRNA sequence
atctgattgactgaatgcat

SEQ ID NO: 602102 - DNA, 20 bp, Artificial
  CRISPR gRNA sequence
ctgattgactgaatgcatta

SEQ ID NO: 602103 - DNA, 20 bp, Artificial
  CRISPR gRNA sequence
aatgcattagagacgtctct

SEQ ID NO: 602104 - DNA, 20 bp, Artificial
  CRISPR gRNA sequence
gagacgtctctcagttattc

SEQ ID NO: 602105 - DNA, 20 bp, Artificial
  CRISPR gRNA sequence
ttattccagacattattatt

SEQ ID NO: 602106 - DNA, 20 bp, Artificial
  CRISPR gRNA sequence
tattattcagattaacccca

SEQ ID NO: 602107 - DNA, 20 bp, Artificial
  CRISPR gRNA sequence
attattcagattaaccccac

SEQ ID NO: 602108 - DNA, 20 bp, Artificial
  CRISPR gRNA sequence
attaaccccacaggttactt

SEQ ID NO: 602109 - DNA, 20 bp, Artificial
  CRISPR gRNA sequence
tcagttatgctatctgtgtt

SEQ ID NO: 602110 - DNA, 20 bp, Artificial
  CRISPR gRNA sequence
cagttatgctatctgtgttg

SEQ ID NO: 602111 - DNA, 20 bp, Artificial
  CRISPR gRNA sequence
gctatctgtgttgaggatac

SEQ ID NO: 602112 - DNA, 20 bp, Artificial
  CRISPR gRNA sequence
tatctgtgttgaggatacca

SEQ ID NO: 602113 - DNA, 20 bp, Artificial
  CRISPR gRNA sequence
ataccagagaccaaatcacc

SEQ ID NO: 602114 - DNA, 20 bp, Artificial
  CRISPR gRNA sequence
cagagaccaaatcacccagc

SEQ ID NO: 602115 - DNA, 20 bp, Artificial
  CRISPR gRNA sequence
atcacccagctagtcttacc

SEQ ID NO: 602116 - DNA, 20 bp, Artificial
  CRISPR gRNA sequence
acccagctagtcttacccag

SEQ ID NO: 602117 - DNA, 20 bp, Artificial
  CRISPR gRNA sequence
cccagctagtcttacccaga

SEQ ID NO: 602118 - DNA, 20 bp, Artificial
  CRISPR gRNA sequence
agctagtcttacccagaagg

SEQ ID NO: 602119 - DNA, 20 bp, Artificial
  CRISPR gRNA sequence
taaaataaatgctctaacga

SEQ ID NO: 602120 - DNA, 20 bp, Artificial
  CRISPR gRNA sequence
aaatgctctaacgatggctc

SEQ ID NO: 602121 - DNA, 20 bp, Artificial
  CRISPR gRNA sequence
ctctaacgatggctctagct

SEQ ID NO: 602122 - DNA, 20 bp, Artificial
  CRISPR gRNA sequence
tcattcaaacaatactacat

SEQ ID NO: 602123 - DNA, 20 bp, Artificial
  CRISPR gRNA sequence
acaatactacattggactaa

SEQ ID NO: 602124 - DNA, 20 bp, Artificial
  CRISPR gRNA sequence
cattggactaaaagcttctc

SEQ ID NO: 602125 - DNA, 20 bp, Artificial
  CRISPR gRNA sequence
tctcaagtacatgacttcaa

SEQ ID NO: 602126 - DNA, 20 bp, Artificial
  CRISPR gRNA sequence
atgacttcaaaagcttcaca

SEQ ID NO: 602127 - DNA, 20 bp, Artificial
  CRISPR gRNA sequence
cttcaaaatatacatctttt

SEQ ID NO: 602128 - DNA, 20 bp, Artificial
  CRISPR gRNA sequence
aaaatatacatcttttcagc

SEQ ID NO: 602129 - DNA, 20 bp, Artificial
  CRISPR gRNA sequence
cttttcagccagtgtcactc

SEQ ID NO: 602130 - DNA, 20 bp, Artificial
  CRISPR gRNA sequence
gccagtgtcactctagaatt

SEQ ID NO: 602131 - DNA, 20 bp, Artificial
  CRISPR gRNA sequence
cagtgtcactctagaattta

SEQ ID NO: 602132 - DNA, 20 bp, Artificial
  CRISPR gRNA sequence
gtcactctagaatttagaga

SEQ ID NO: 602133 - DNA, 20 bp, Artificial
  CRISPR gRNA sequence
tggattttataaaacacttt

SEQ ID NO: 602134 - DNA, 20 bp, Artificial
  CRISPR gRNA sequence
ggattttataaaacacttta

SEQ ID NO: 602135 - DNA, 20 bp, Artificial
  CRISPR gRNA sequence
gattttataaaacactttaa

SEQ ID NO: 602136 - DNA, 20 bp, Artificial
  CRISPR gRNA sequence
aaaacactttaagggatacc

SEQ ID NO: 602137 - DNA, 20 bp, Artificial
  CRISPR gRNA sequence
aacactttaagggataccta

SEQ ID NO: 602138 - DNA, 20 bp, Artificial
  CRISPR gRNA sequence
tcttgaaatgtatatacaaa

SEQ ID NO: 602139 - DNA, 20 bp, Artificial
  CRISPR gRNA sequence
cttgaaatgtatatacaaac

SEQ ID NO: 602140 - DNA, 20 bp, Artificial
  CRISPR gRNA sequence
aaatgtatatacaaacaggt

SEQ ID NO: 602141 - DNA, 20 bp, Artificial
  CRISPR gRNA sequence
atgtatatacaaacaggtca

SEQ ID NO: 602142 - DNA, 20 bp, Artificial
  CRISPR gRNA sequence
tgtatatacaaacaggtcag

SEQ ID NO: 602143 - DNA, 20 bp, Artificial
  CRISPR gRNA sequence
aaacaggtcagaggtattat

SEQ ID NO: 602144 - DNA, 20 bp, Artificial
  CRISPR gRNA sequence
ggtattattggaaaatctta

SEQ ID NO: 602145 - DNA, 20 bp, Artificial
  CRISPR gRNA sequence
atcttaaagatacaatttaa

SEQ ID NO: 602146 - DNA, 20 bp, Artificial
  CRISPR gRNA sequence
taaagatacaatttaaaagt

SEQ ID NO: 602147 - DNA, 20 bp, Artificial
  CRISPR gRNA sequence
agtgttactattattatttt

SEQ ID NO: 602148 - DNA, 20 bp, Artificial
  CRISPR gRNA sequence
ctttatgatccaaatctttc

SEQ ID NO: 602149 - DNA, 20 bp, Artificial
  CRISPR gRNA sequence
aaatctttcaagtcataaat

SEQ ID NO: 602150 - DNA, 20 bp, Artificial
  CRISPR gRNA sequence
caagtcataaatcagtcatt

SEQ ID NO: 602151 - DNA, 20 bp, Artificial
  CRISPR gRNA sequence
gtcataaatcagtcatttag

SEQ ID NO: 602152 - DNA, 20 bp, Artificial
  CRISPR gRNA sequence
gtttttaataaactttaatc

SEQ ID NO: 602153 - DNA, 20 bp, Artificial
  CRISPR gRNA sequence
tttaataaactttaatccag

SEQ ID NO: 602154 - DNA, 20 bp, Artificial
  CRISPR gRNA sequence
aatccagtagctaaatctca

SEQ ID NO: 602155 - DNA, 20 bp, Artificial
  CRISPR gRNA sequence
gctaaatctcaaagatcatt

SEQ ID NO: 602156 - DNA, 20 bp, Artificial
  CRISPR gRNA sequence
ttagaatcctatgaatcaaa

SEQ ID NO: 602157 - DNA, 20 bp, Artificial
  CRISPR gRNA sequence
ggctctcccttaaaactgtt

SEQ ID NO: 602158 - DNA, 20 bp, Artificial
  CRISPR gRNA sequence
ctcccttaaaactgttaaga

SEQ ID NO: 602159 - DNA, 20 bp, Artificial
  CRISPR gRNA sequence
taagacagttctgttgattc

SEQ ID NO: 602160 - DNA, 20 bp, Artificial
  CRISPR gRNA sequence
ttctgttgattccagattgt

SEQ ID NO: 602161 - DNA, 20 bp, Artificial
  CRISPR gRNA sequence
gttgattccagattgtgagc

SEQ ID NO: 602162 - DNA, 20 bp, Artificial
  CRISPR gRNA sequence
gagccagacctccattttct

SEQ ID NO: 602163 - DNA, 20 bp, Artificial
  CRISPR gRNA sequence
gccagacctccattttctta

SEQ ID NO: 602164 - DNA, 20 bp, Artificial
  CRISPR gRNA sequence
ccagacctccattttcttag

SEQ ID NO: 602165 - DNA, 20 bp, Artificial
  CRISPR gRNA sequence
agacctccattttcttagag

SEQ ID NO: 602166 - DNA, 20 bp, Artificial
  CRISPR gRNA sequence
tttgtctacaattattgtaa

SEQ ID NO: 602167 - DNA, 20 bp, Artificial
  CRISPR gRNA sequence
acaattattgtaacagtact

SEQ ID NO: 602168 - DNA, 20 bp, Artificial
  CRISPR gRNA sequence
caattattgtaacagtactt

SEQ ID NO: 602169 - DNA, 20 bp, Artificial
  CRISPR gRNA sequence
catatacacaatctttacaa

SEQ ID NO: 602170 - DNA, 20 bp, Artificial
  CRISPR gRNA sequence
tttacaaaagatatttcccc

SEQ ID NO: 602171 - DNA, 20 bp, Artificial
  CRISPR gRNA sequence
ccaacatttacattccccct

SEQ ID NO: 602172 - DNA, 20 bp, Artificial
  CRISPR gRNA sequence
cccctcagttgaattcttac

SEQ ID NO: 602173 - DNA, 20 bp, Artificial
  CRISPR gRNA sequence
atatttgcttaaatatgtcc

SEQ ID NO: 602174 - DNA, 20 bp, Artificial
  CRISPR gRNA sequence
gtccaagcaatttgttacat

SEQ ID NO: 602175 - DNA, 20 bp, Artificial
  CRISPR gRNA sequence
ttacatgagcaatcattatc

SEQ ID NO: 602176 - DNA, 20 bp, Artificial
  CRISPR gRNA sequence
caatcattatctagttttac

SEQ ID NO: 602177 - DNA, 20 bp, Artificial
  CRISPR gRNA sequence
tttgtttgtaatcattccta

SEQ ID NO: 602178 - DNA, 20 bp, Artificial
  CRISPR gRNA sequence
gtaatcattcctatagctgc

SEQ ID NO: 602179 - DNA, 20 bp, Artificial
  CRISPR gRNA sequence
ttcctatagctgcaagaaat

SEQ ID NO: 602180 - DNA, 20 bp, Artificial
  CRISPR gRNA sequence
tcctatagctgcaagaaata

SEQ ID NO: 602181 - DNA, 20 bp, Artificial
  CRISPR gRNA sequence
tatagctgcaagaaataagg

SEQ ID NO: 602182 - DNA, 20 bp, Artificial
  CRISPR gRNA sequence
aaataaggcagtatatttaa

SEQ ID NO: 602183 - DNA, 20 bp, Artificial
  CRISPR gRNA sequence
gcagtatatttaatagcttg

SEQ ID NO: 602184 - DNA, 20 bp, Artificial
  CRISPR gRNA sequence
tctctttgtttacattgtaa

SEQ ID NO: 602185 - DNA, 20 bp, Artificial
  CRISPR gRNA sequence
ttgtaacagatcatcttctt

SEQ ID NO: 602186 - DNA, 20 bp, Artificial
  CRISPR gRNA sequence
taacagatcatcttcttaag

SEQ ID NO: 602187 - DNA, 20 bp, Artificial
  CRISPR gRNA sequence
caaaaaaattttgtgttatt

SEQ ID NO: 602188 - DNA, 20 bp, Artificial
  CRISPR gRNA sequence
aaaaattttgtgttatttgg

SEQ ID NO: 602189 - DNA, 20 bp, Artificial
  CRISPR gRNA sequence
ctcatgaaatataatttgct

SEQ ID NO: 602190 - DNA, 20 bp, Artificial
  CRISPR gRNA sequence
aatataatttgcttggcgta

SEQ ID NO: 602191 - DNA, 20 bp, Artificial
  CRISPR gRNA sequence
ggcgtatggttctgtgaatt

SEQ ID NO: 602192 - DNA, 20 bp, Artificial
  CRISPR gRNA sequence
ttaagcccataatatctaac

SEQ ID NO: 602193 - DNA, 20 bp, Artificial
  CRISPR gRNA sequence
taatatctaactggcatata

SEQ ID NO: 602194 - DNA, 20 bp, Artificial
  CRISPR gRNA sequence
aatatctaactggcatatat

SEQ ID NO: 602195 - DNA, 20 bp, Artificial
  CRISPR gRNA sequence
tctaactggcatatatagga

SEQ ID NO: 602196 - DNA, 20 bp, Artificial
  CRISPR gRNA sequence
cctaactgaactgaaaattc

SEQ ID NO: 602197 - DNA, 20 bp, Artificial
  CRISPR gRNA sequence
agcttgtatccatatatttt

SEQ ID NO: 602198 - DNA, 20 bp, Artificial
  CRISPR gRNA sequence
ttgtatccatatatttttag

SEQ ID NO: 602199 - DNA, 20 bp, Artificial
  CRISPR gRNA sequence
gtagcaatttaatgataatc

SEQ ID NO: 602200 - DNA, 20 bp, Artificial
  CRISPR gRNA sequence
atatgcatttatgtgccaaa

SEQ ID NO: 602201 - DNA, 20 bp, Artificial
  CRISPR gRNA sequence
gtgccaaaaagaactgtttg

SEQ ID NO: 602202 - DNA, 20 bp, Artificial
  CRISPR gRNA sequence
gaattactgtaaaatacttt

SEQ ID NO: 602203 - DNA, 20 bp, Artificial
  CRISPR gRNA sequence
tgtaaaatactttcagctac

SEQ ID NO: 602204 - DNA, 20 bp, Artificial
  CRISPR gRNA sequence
aaatactttcagctactagt

SEQ ID NO: 602205 - DNA, 20 bp, Artificial
  CRISPR gRNA sequence
aaaattgatttttccctgct

SEQ ID NO: 602206 - DNA, 20 bp, Artificial
  CRISPR gRNA sequence
aaattgatttttccctgctt

SEQ ID NO: 602207 - DNA, 20 bp, Artificial
  CRISPR gRNA sequence
ttgatttttccctgcttggg

SEQ ID NO: 602208 - DNA, 20 bp, Artificial
  CRISPR gRNA sequence
tgatttttccctgcttgggt

SEQ ID NO: 602209 - DNA, 20 bp, Artificial
  CRISPR gRNA sequence
tccctgcttgggtgggtctt

SEQ ID NO: 602210 - DNA, 20 bp, Artificial
  CRISPR gRNA sequence
ccctgcttgggtgggtctta

SEQ ID NO: 602211 - DNA, 20 bp, Artificial
  CRISPR gRNA sequence
gcttgggtgggtcttaaggt

SEQ ID NO: 602212 - DNA, 20 bp, Artificial
  CRISPR gRNA sequence
tgggtgggtcttaaggttgg

SEQ ID NO: 602213 - DNA, 20 bp, Artificial
  CRISPR gRNA sequence
gggtgggtcttaaggttggt

SEQ ID NO: 602214 - DNA, 20 bp, Artificial
  CRISPR gRNA sequence
ggtgggtcttaaggttggtg

SEQ ID NO: 602215 - DNA, 20 bp, Artificial
  CRISPR gRNA sequence
ttaaggttggtggggaactt

SEQ ID NO: 602216 - DNA, 20 bp, Artificial
  CRISPR gRNA sequence
cccccaaatgcttccttttc

SEQ ID NO: 602217 - DNA, 20 bp, Artificial
  CRISPR gRNA sequence
atgcttccttttcaagtgtg

SEQ ID NO: 602218 - DNA, 20 bp, Artificial
  CRISPR gRNA sequence
cttttcaagtgtgaagttta

SEQ ID NO: 602219 - DNA, 20 bp, Artificial
  CRISPR gRNA sequence
tgtgaagtttacggatattt

SEQ ID NO: 602220 - DNA, 20 bp, Artificial
  CRISPR gRNA sequence
tttggatcttactgtgttct

SEQ ID NO: 602221 - DNA, 20 bp, Artificial
  CRISPR gRNA sequence
ttggatcttactgtgttctc

SEQ ID NO: 602222 - DNA, 20 bp, Artificial
  CRISPR gRNA sequence
tgttctcaggatcatgtctc

SEQ ID NO: 602223 - DNA, 20 bp, Artificial
  CRISPR gRNA sequence
gttctcaggatcatgtctct

SEQ ID NO: 602224 - DNA, 20 bp, Artificial
  CRISPR gRNA sequence
ctcaggatcatgtctctagg

SEQ ID NO: 602225 - DNA, 20 bp, Artificial
  CRISPR gRNA sequence
tcaggatcatgtctctaggt

SEQ ID NO: 602226 - DNA, 20 bp, Artificial
  CRISPR gRNA sequence
atcatgtctctaggtaggca

SEQ ID NO: 602227 - DNA, 20 bp, Artificial
  CRISPR gRNA sequence
tgtctattaattgtgtttgt

SEQ ID NO: 602228 - DNA, 20 bp, Artificial
  CRISPR gRNA sequence
gtgtttgtcagtttataaca

SEQ ID NO: 602229 - DNA, 20 bp, Artificial
  CRISPR gRNA sequence
tctaaaatgctctcatgctt

SEQ ID NO: 602230 - DNA, 20 bp, Artificial
  CRISPR gRNA sequence
ttgacttctttcctgcctgt

SEQ ID NO: 602231 - DNA, 20 bp, Artificial
  CRISPR gRNA sequence
gacttctttcctgcctgtga

SEQ ID NO: 602232 - DNA, 20 bp, Artificial
  CRISPR gRNA sequence
ttcctgcctgtgagagaccc

SEQ ID NO: 602233 - DNA, 20 bp, Artificial
  CRISPR gRNA sequence
gcctgtgagagaccctagct

SEQ ID NO: 602234 - DNA, 20 bp, Artificial
  CRISPR gRNA sequence
agagaccctagcttagtgat

SEQ ID NO: 602235 - DNA, 20 bp, Artificial
  CRISPR gRNA sequence
agtgattagtttttgtttct

SEQ ID NO: 602236 - DNA, 20 bp, Artificial
  CRISPR gRNA sequence
tctgagtttctgtttttacc

SEQ ID NO: 602237 - DNA, 20 bp, Artificial
  CRISPR gRNA sequence
taccaagtgtttttattttc

SEQ ID NO: 602238 - DNA, 20 bp, Artificial
  CRISPR gRNA sequence
gtttttattttctagattac

SEQ ID NO: 602239 - DNA, 20 bp, Artificial
  CRISPR gRNA sequence
ttttctagattactggctat

SEQ ID NO: 602240 - DNA, 20 bp, Artificial
  CRISPR gRNA sequence
tttctagattactggctatt

SEQ ID NO: 602241 - DNA, 20 bp, Artificial
  CRISPR gRNA sequence
gattactggctattgggata

SEQ ID NO: 602242 - DNA, 20 bp, Artificial
  CRISPR gRNA sequence
attactggctattgggataa

SEQ ID NO: 602243 - DNA, 20 bp, Artificial
  CRISPR gRNA sequence
ttgggataaaggaaatgatc

SEQ ID NO: 602244 - DNA, 20 bp, Artificial
  CRISPR gRNA sequence
gataaaggaaatgatccagt

SEQ ID NO: 602245 - DNA, 20 bp, Artificial
  CRISPR gRNA sequence
taaaggaaatgatccagtta

SEQ ID NO: 602246 - DNA, 20 bp, Artificial
  CRISPR gRNA sequence
aaaggaaatgatccagttag

SEQ ID NO: 602247 - DNA, 20 bp, Artificial
  CRISPR gRNA sequence
atgatccagttagaggacat

SEQ ID NO: 602248 - DNA, 20 bp, Artificial
  CRISPR gRNA sequence
gttagaggacatcagaaaac

SEQ ID NO: 602249 - DNA, 20 bp, Artificial
  CRISPR gRNA sequence
agaggacatcagaaaactag

SEQ ID NO: 602250 - DNA, 20 bp, Artificial
  CRISPR gRNA sequence
agaaaactagaagcttttga

SEQ ID NO: 602251 - DNA, 20 bp, Artificial
  CRISPR gRNA sequence
gaagcttttgatagaacaac

SEQ ID NO: 602252 - DNA, 20 bp, Artificial
  CRISPR gRNA sequence
tttgatagaacaacaagatc

SEQ ID NO: 602253 - DNA, 20 bp, Artificial
  CRISPR gRNA sequence
agatctagtgtccctatcta

SEQ ID NO: 602254 - DNA, 20 bp, Artificial
  CRISPR gRNA sequence
atctagtgtccctatctaaa

SEQ ID NO: 602255 - DNA, 20 bp, Artificial
  CRISPR gRNA sequence
tagtgtccctatctaaagag

SEQ ID NO: 602256 - DNA, 20 bp, Artificial
  CRISPR gRNA sequence
ccctatctaaagagaagaaa

SEQ ID NO: 602257 - DNA, 20 bp, Artificial
  CRISPR gRNA sequence
ctatctaaagagaagaaata

SEQ ID NO: 602258 - DNA, 20 bp, Artificial
  CRISPR gRNA sequence
tctaaagagaagaaatagag

SEQ ID NO: 602259 - DNA, 20 bp, Artificial
  CRISPR gRNA sequence
ctaaagagaagaaatagaga

SEQ ID NO: 602260 - DNA, 20 bp, Artificial
  CRISPR gRNA sequence
tagagaaggtgtgccttcat

SEQ ID NO: 602261 - DNA, 20 bp, Artificial
  CRISPR gRNA sequence
agaaggtgtgccttcattag

SEQ ID NO: 602262 - DNA, 20 bp, Artificial
  CRISPR gRNA sequence
attagaagtgttacaatcaa

SEQ ID NO: 602263 - DNA, 20 bp, Artificial
  CRISPR gRNA sequence
atcaatagctgccaattact

SEQ ID NO: 602264 - DNA, 20 bp, Artificial
  CRISPR gRNA sequence
atagctgccaattacttagt

SEQ ID NO: 602265 - DNA, 20 bp, Artificial
  CRISPR gRNA sequence
gctgccaattacttagtgag

SEQ ID NO: 602266 - DNA, 20 bp, Artificial
  CRISPR gRNA sequence
cttagtgagcagaaaacatc

SEQ ID NO: 602267 - DNA, 20 bp, Artificial
  CRISPR gRNA sequence
tactcaccttcatctatttg

SEQ ID NO: 602268 - DNA, 20 bp, Artificial
  CRISPR gRNA sequence
agcctgtatatctttatgta

SEQ ID NO: 602269 - DNA, 20 bp, Artificial
  CRISPR gRNA sequence
gcctgtatatctttatgtac

SEQ ID NO: 602270 - DNA, 20 bp, Artificial
  CRISPR gRNA sequence
aggtcctcttctctctttct

SEQ ID NO: 602271 - DNA, 20 bp, Artificial
  CRISPR gRNA sequence
tctttctcagtttatttctt

SEQ ID NO: 602272 - DNA, 20 bp, Artificial
  CRISPR gRNA sequence
gtttatttctttagatactg

SEQ ID NO: 602273 - DNA, 20 bp, Artificial
  CRISPR gRNA sequence
atgactttcaactctgcatc

SEQ ID NO: 602274 - DNA, 20 bp, Artificial
  CRISPR gRNA sequence
tagcactgtttctttcctca

SEQ ID NO: 602275 - DNA, 20 bp, Artificial
  CRISPR gRNA sequence
agcactgtttctttcctcaa

SEQ ID NO: 602276 - DNA, 20 bp, Artificial
  CRISPR gRNA sequence
ctcaaaggaaatcccacatc

SEQ ID NO: 602277 - DNA, 20 bp, Artificial
  CRISPR gRNA sequence
aaatcccacatccagtctat

SEQ ID NO: 602278 - DNA, 20 bp, Artificial
  CRISPR gRNA sequence
tccagtctatcagaaatcct

SEQ ID NO: 602279 - DNA, 20 bp, Artificial
  CRISPR gRNA sequence
tgaatttaaacaattctcac

SEQ ID NO: 602280 - DNA, 20 bp, Artificial
  CRISPR gRNA sequence
gaatttaaacaattctcacc

SEQ ID NO: 602281 - DNA, 20 bp, Artificial
  CRISPR gRNA sequence
caggcccgctactgtaactt

SEQ ID NO: 602282 - DNA, 20 bp, Artificial
  CRISPR gRNA sequence
tttagtctatcatcatttcc

SEQ ID NO: 602283 - DNA, 20 bp, Artificial
  CRISPR gRNA sequence
tcatcatttcctagtacctt

SEQ ID NO: 602284 - DNA, 20 bp, Artificial
  CRISPR gRNA sequence
ttaagcctaaaatattgcaa

SEQ ID NO: 602285 - DNA, 20 bp, Artificial
  CRISPR gRNA sequence
aaatattgcaacagtttaac

SEQ ID NO: 602286 - DNA, 20 bp, Artificial
  CRISPR gRNA sequence
cttccattcttgcttctctg

SEQ ID NO: 602287 - DNA, 20 bp, Artificial
  CRISPR gRNA sequence
gtagtttgttttccacacaa

SEQ ID NO: 602288 - DNA, 20 bp, Artificial
  CRISPR gRNA sequence
tttgttttccacacaataga

SEQ ID NO: 602289 - DNA, 20 bp, Artificial
  CRISPR gRNA sequence
tgttttccacacaatagaca

SEQ ID NO: 602290 - DNA, 20 bp, Artificial
  CRISPR gRNA sequence
tgactttctaaaacccaaat

SEQ ID NO: 602291 - DNA, 20 bp, Artificial
  CRISPR gRNA sequence
attcattgctttaaacacaa

SEQ ID NO: 602292 - DNA, 20 bp, Artificial
  CRISPR gRNA sequence
caaaagctttccactgaaac

SEQ ID NO: 602293 - DNA, 20 bp, Artificial
  CRISPR gRNA sequence
acaactaaaattcctttcca

SEQ ID NO: 602294 - DNA, 20 bp, Artificial
  CRISPR gRNA sequence
aattcctttccaaagtctgt

SEQ ID NO: 602295 - DNA, 20 bp, Artificial
  CRISPR gRNA sequence
attcctttccaaagtctgta

SEQ ID NO: 602296 - DNA, 20 bp, Artificial
  CRISPR gRNA sequence
ccaaagtctgtaaggtccta

SEQ ID NO: 602297 - DNA, 20 bp, Artificial
  CRISPR gRNA sequence
caaagtctgtaaggtcctaa

SEQ ID NO: 602298 - DNA, 20 bp, Artificial
  CRISPR gRNA sequence
ctgtaaggtcctaaaggctg

SEQ ID NO: 602299 - DNA, 20 bp, Artificial
  CRISPR gRNA sequence
cctcttccctttttcttttc

SEQ ID NO: 602300 - DNA, 20 bp, Artificial
  CRISPR gRNA sequence
ctcttccctttttcttttcc

SEQ ID NO: 602301 - DNA, 20 bp, Artificial
  CRISPR gRNA sequence
cctttttcttttccgggaca

SEQ ID NO: 602302 - DNA, 20 bp, Artificial
  CRISPR gRNA sequence
tttcttttccgggacatggc

SEQ ID NO: 602303 - DNA, 20 bp, Artificial
  CRISPR gRNA sequence
tggcaagttcgttcctgtct

SEQ ID NO: 602304 - DNA, 20 bp, Artificial
  CRISPR gRNA sequence
ggcaagttcgttcctgtcta

SEQ ID NO: 602305 - DNA, 20 bp, Artificial
  CRISPR gRNA sequence
ctctgtacttgctgtttctt

SEQ ID NO: 602306 - DNA, 20 bp, Artificial
  CRISPR gRNA sequence
tacttgctgtttctttggtt

SEQ ID NO: 602307 - DNA, 20 bp, Artificial
  CRISPR gRNA sequence
acttgctgtttctttggttt

SEQ ID NO: 602308 - DNA, 20 bp, Artificial
  CRISPR gRNA sequence
ttcttccttgttttgcatga

SEQ ID NO: 602309 - DNA, 20 bp, Artificial
  CRISPR gRNA sequence
ccatttaactgtcgcctcct

SEQ ID NO: 602310 - DNA, 20 bp, Artificial
  CRISPR gRNA sequence
ttaactgtcgcctccttggc

SEQ ID NO: 602311 - DNA, 20 bp, Artificial
  CRISPR gRNA sequence
taactgtcgcctccttggcg

SEQ ID NO: 602312 - DNA, 20 bp, Artificial
  CRISPR gRNA sequence
tccttggcgaggctttgcct

SEQ ID NO: 602313 - DNA, 20 bp, Artificial
  CRISPR gRNA sequence
gaggctttgcctgagcatcc

SEQ ID NO: 602314 - DNA, 20 bp, Artificial
  CRISPR gRNA sequence
cctgagcatcctagataaat

SEQ ID NO: 602315 - DNA, 20 bp, Artificial
  CRISPR gRNA sequence
tagataaataagcccctctc

SEQ ID NO: 602316 - DNA, 20 bp, Artificial
  CRISPR gRNA sequence
agataaataagcccctctcc

SEQ ID NO: 602317 - DNA, 20 bp, Artificial
  CRISPR gRNA sequence
attttctttattatacttaa

SEQ ID NO: 602318 - DNA, 20 bp, Artificial
  CRISPR gRNA sequence
ttatctcttctcccaacaca

SEQ ID NO: 602319 - DNA, 20 bp, Artificial
  CRISPR gRNA sequence
tcttctcccaacacacagtt

SEQ ID NO: 602320 - DNA, 20 bp, Artificial
  CRISPR gRNA sequence
cttctcccaacacacagttg

SEQ ID NO: 602321 - DNA, 20 bp, Artificial
  CRISPR gRNA sequence
acacacagttgaggaacatt

SEQ ID NO: 602322 - DNA, 20 bp, Artificial
  CRISPR gRNA sequence
atttggcttgttcattcatg

SEQ ID NO: 602323 - DNA, 20 bp, Artificial
  CRISPR gRNA sequence
tggcttgttcattcatgtag

SEQ ID NO: 602324 - DNA, 20 bp, Artificial
  CRISPR gRNA sequence
ggcttgttcattcatgtagt

SEQ ID NO: 602325 - DNA, 20 bp, Artificial
  CRISPR gRNA sequence
gcttgttcattcatgtagta

SEQ ID NO: 602326 - DNA, 20 bp, Artificial
  CRISPR gRNA sequence
gttcattcatgtagtagggc

SEQ ID NO: 602327 - DNA, 20 bp, Artificial
  CRISPR gRNA sequence
ttcattcatgtagtagggcc

SEQ ID NO: 602328 - DNA, 20 bp, Artificial
  CRISPR gRNA sequence
tagtagggccaggaatgtaa

SEQ ID NO: 602329 - DNA, 20 bp, Artificial
  CRISPR gRNA sequence
agacaataaatgtgaactca

SEQ ID NO: 602330 - DNA, 20 bp, Artificial
  CRISPR gRNA sequence
tgttctttcccttccataaa

SEQ ID NO: 602331 - DNA, 20 bp, Artificial
  CRISPR gRNA sequence
attctctgtgtgtgtctata

SEQ ID NO: 602332 - DNA, 20 bp, Artificial
  CRISPR gRNA sequence
gtgtgtctataaagcaaaca

SEQ ID NO: 602333 - DNA, 20 bp, Artificial
  CRISPR gRNA sequence
aaacaaagtgttttacactg

SEQ ID NO: 602334 - DNA, 20 bp, Artificial
  CRISPR gRNA sequence
tcattctaaaccctctattt

SEQ ID NO: 602335 - DNA, 20 bp, Artificial
  CRISPR gRNA sequence
attttagaaacctgtacatt

SEQ ID NO: 602336 - DNA, 20 bp, Artificial
  CRISPR gRNA sequence
ttttagaaacctgtacattg

SEQ ID NO: 602337 - DNA, 20 bp, Artificial
  CRISPR gRNA sequence
aaacctgtacattgaggcga

SEQ ID NO: 602338 - DNA, 20 bp, Artificial
  CRISPR gRNA sequence
acattgaggcgaaagtcaca

SEQ ID NO: 602339 - DNA, 20 bp, Artificial
  CRISPR gRNA sequence
cattgaggcgaaagtcacat

SEQ ID NO: 602340 - DNA, 20 bp, Artificial
  CRISPR gRNA sequence
attgaggcgaaagtcacatg

SEQ ID NO: 602341 - DNA, 20 bp, Artificial
  CRISPR gRNA sequence
tgaggcgaaagtcacatggg

SEQ ID NO: 602342 - DNA, 20 bp, Artificial
  CRISPR gRNA sequence
aggcgaaagtcacatgggga

SEQ ID NO: 602343 - DNA, 20 bp, Artificial
  CRISPR gRNA sequence
gcgaaagtcacatggggaga

SEQ ID NO: 602344 - DNA, 20 bp, Artificial
  CRISPR gRNA sequence
aaagtcacatggggagagag

SEQ ID NO: 602345 - DNA, 20 bp, Artificial
  CRISPR gRNA sequence
acgattaaaaaaccttatct

SEQ ID NO: 602346 - DNA, 20 bp, Artificial
  CRISPR gRNA sequence
ttaaaaaaccttatcttggc

SEQ ID NO: 602347 - DNA, 20 bp, Artificial
  CRISPR gRNA sequence
aaccttatcttggccagatg

SEQ ID NO: 602348 - DNA, 20 bp, Artificial
  CRISPR gRNA sequence
cttatcttggccagatgtgg

SEQ ID NO: 602349 - DNA, 20 bp, Artificial
  CRISPR gRNA sequence
gtggctcacgcctgtaatcc

SEQ ID NO: 602350 - DNA, 20 bp, Artificial
  CRISPR gRNA sequence
cgcctgtaatcccagcactt

SEQ ID NO: 602351 - DNA, 20 bp, Artificial
  CRISPR gRNA sequence
gcctgtaatcccagcacttt

SEQ ID NO: 602352 - DNA, 20 bp, Artificial
  CRISPR gRNA sequence
ctgtaatcccagcactttgg

SEQ ID NO: 602353 - DNA, 20 bp, Artificial
  CRISPR gRNA sequence
tgtaatcccagcactttggg

SEQ ID NO: 602354 - DNA, 20 bp, Artificial
  CRISPR gRNA sequence
tcccagcactttgggaggcc

SEQ ID NO: 602355 - DNA, 20 bp, Artificial
  CRISPR gRNA sequence
agcactttgggaggccgaga

SEQ ID NO: 602356 - DNA, 20 bp, Artificial
  CRISPR gRNA sequence
gcactttgggaggccgagac

SEQ ID NO: 602357 - DNA, 20 bp, Artificial
  CRISPR gRNA sequence
ctttgggaggccgagacggg

SEQ ID NO: 602358 - DNA, 20 bp, Artificial
  CRISPR gRNA sequence
ccgagacgggtggatcacct

SEQ ID NO: 602359 - DNA, 20 bp, Artificial
  CRISPR gRNA sequence
cgagacgggtggatcacctg

SEQ ID NO: 602360 - DNA, 20 bp, Artificial
  CRISPR gRNA sequence
acgggtggatcacctgaggt

SEQ ID NO: 602361 - DNA, 20 bp, Artificial
  CRISPR gRNA sequence
ggtggatcacctgaggtcag

SEQ ID NO: 602362 - DNA, 20 bp, Artificial
  CRISPR gRNA sequence
tcacctgaggtcagaagttc

SEQ ID NO: 602363 - DNA, 20 bp, Artificial
  CRISPR gRNA sequence
tgaggtcagaagttcgagac

SEQ ID NO: 602364 - DNA, 20 bp, Artificial
  CRISPR gRNA sequence
tcagaagttcgagaccagcc

SEQ ID NO: 602365 - DNA, 20 bp, Artificial
  CRISPR gRNA sequence
cgagaccagcctggccaaaa

SEQ ID NO: 602366 - DNA, 20 bp, Artificial
  CRISPR gRNA sequence
tacaaaaaaaaaaaaaaaaa

SEQ ID NO: 602367 - DNA, 20 bp, Artificial
  CRISPR gRNA sequence
aaaaaaaaagaaaaaaaaat

SEQ ID NO: 602368 - DNA, 20 bp, Artificial
  CRISPR gRNA sequence
aaaagaaaaaaaaattagtg

SEQ ID NO: 602369 - DNA, 20 bp, Artificial
  CRISPR gRNA sequence
aaaaaaaaattagtgtggtg

SEQ ID NO: 602370 - DNA, 20 bp, Artificial
  CRISPR gRNA sequence
aaaaaattagtgtggtgtgg

SEQ ID NO: 602371 - DNA, 20 bp, Artificial
  CRISPR gRNA sequence
gtggcctgcacctgtaatcc

SEQ ID NO: 602372 - DNA, 20 bp, Artificial
  CRISPR gRNA sequence
acctgtaatcccagctactc

SEQ ID NO: 602373 - DNA, 20 bp, Artificial
  CRISPR gRNA sequence
ctgtaatcccagctactctg

SEQ ID NO: 602374 - DNA, 20 bp, Artificial
  CRISPR gRNA sequence
tgtaatcccagctactctgg

SEQ ID NO: 602375 - DNA, 20 bp, Artificial
  CRISPR gRNA sequence
tcccagctactctggaggct

SEQ ID NO: 602376 - DNA, 20 bp, Artificial
  CRISPR gRNA sequence
cccagctactctggaggctg

SEQ ID NO: 602377 - DNA, 20 bp, Artificial
  CRISPR gRNA sequence
agctactctggaggctgagg

SEQ ID NO: 602378 - DNA, 20 bp, Artificial
  CRISPR gRNA sequence
gctactctggaggctgaggc

SEQ ID NO: 602379 - DNA, 20 bp, Artificial
  CRISPR gRNA sequence
tactctggaggctgaggcag

SEQ ID NO: 602380 - DNA, 20 bp, Artificial
  CRISPR gRNA sequence
tggaggctgaggcaggagaa

SEQ ID NO: 602381 - DNA, 20 bp, Artificial
  CRISPR gRNA sequence
gcaggagaatagtttgaact

SEQ ID NO: 602382 - DNA, 20 bp, Artificial
  CRISPR gRNA sequence
ggagaatagtttgaacttgg

SEQ ID NO: 602383 - DNA, 20 bp, Artificial
  CRISPR gRNA sequence
gagaatagtttgaacttggc

SEQ ID NO: 602384 - DNA, 20 bp, Artificial
  CRISPR gRNA sequence
aatagtttgaacttggcggg

SEQ ID NO: 602385 - DNA, 20 bp, Artificial
  CRISPR gRNA sequence
tagtttgaacttggcgggtg

SEQ ID NO: 602386 - DNA, 20 bp, Artificial
  CRISPR gRNA sequence
agtttgaacttggcgggtgg

SEQ ID NO: 602387 - DNA, 20 bp, Artificial
  CRISPR gRNA sequence
aacttggcgggtggaggttg

SEQ ID NO: 602388 - DNA, 20 bp, Artificial
  CRISPR gRNA sequence
tggcgggtggaggttgcagt

SEQ ID NO: 602389 - DNA, 20 bp, Artificial
  CRISPR gRNA sequence
ggtggaggttgcagtgagct

SEQ ID NO: 602390 - DNA, 20 bp, Artificial
  CRISPR gRNA sequence
catgccactgtactccatcc

SEQ ID NO: 602391 - DNA, 20 bp, Artificial
  CRISPR gRNA sequence
atgccactgtactccatcct

SEQ ID NO: 602392 - DNA, 20 bp, Artificial
  CRISPR gRNA sequence
ctgtactccatcctgggcga

SEQ ID NO: 602393 - DNA, 20 bp, Artificial
  CRISPR gRNA sequence
actccatcctgggcgacaga

SEQ ID NO: 602394 - DNA, 20 bp, Artificial
  CRISPR gRNA sequence
catcctgggcgacagaaagt

SEQ ID NO: 602395 - DNA, 20 bp, Artificial
  CRISPR gRNA sequence
aaaccttatcttctgactct

SEQ ID NO: 602396 - DNA, 20 bp, Artificial
  CRISPR gRNA sequence
ttatcttctgactcttggct

SEQ ID NO: 602397 - DNA, 20 bp, Artificial
  CRISPR gRNA sequence
catgatacactcttatgttt

SEQ ID NO: 602398 - DNA, 20 bp, Artificial
  CRISPR gRNA sequence
atgatacactcttatgtttt

SEQ ID NO: 602399 - DNA, 20 bp, Artificial
  CRISPR gRNA sequence
tgatacactcttatgttttg

SEQ ID NO: 602400 - DNA, 20 bp, Artificial
  CRISPR gRNA sequence
acactcttatgttttggggt

SEQ ID NO: 602401 - DNA, 20 bp, Artificial
  CRISPR gRNA sequence
cactcttatgttttggggtg

SEQ ID NO: 602402 - DNA, 20 bp, Artificial
  CRISPR gRNA sequence
tgttttggggtgaggccctg

SEQ ID NO: 602403 - DNA, 20 bp, Artificial
  CRISPR gRNA sequence
tttggggtgaggccctgtag

SEQ ID NO: 602404 - DNA, 20 bp, Artificial
  CRISPR gRNA sequence
ggggtgaggccctgtagaag

SEQ ID NO: 602405 - DNA, 20 bp, Artificial
  CRISPR gRNA sequence
gaggccctgtagaagtagtt

SEQ ID NO: 602406 - DNA, 20 bp, Artificial
  CRISPR gRNA sequence
ggccctgtagaagtagttaa

SEQ ID NO: 602407 - DNA, 20 bp, Artificial
  CRISPR gRNA sequence
gtactgattttcatattaca

SEQ ID NO: 602408 - DNA, 20 bp, Artificial
  CRISPR gRNA sequence
attttcatattacatagacc

SEQ ID NO: 602409 - DNA, 20 bp, Artificial
  CRISPR gRNA sequence
catattacatagacctggtt

SEQ ID NO: 602410 - DNA, 20 bp, Artificial
  CRISPR gRNA sequence
tattacatagacctggtttg

SEQ ID NO: 602411 - DNA, 20 bp, Artificial
  CRISPR gRNA sequence
atagacctggtttggagtcc

SEQ ID NO: 602412 - DNA, 20 bp, Artificial
  CRISPR gRNA sequence
ctggctgtgcaccctacttt

SEQ ID NO: 602413 - DNA, 20 bp, Artificial
  CRISPR gRNA sequence
tggctgtgcaccctactttt

SEQ ID NO: 602414 - DNA, 20 bp, Artificial
  CRISPR gRNA sequence
gtgcaccctacttttgggtt

SEQ ID NO: 602415 - DNA, 20 bp, Artificial
  CRISPR gRNA sequence
ctacttttgggttaagccgt

SEQ ID NO: 602416 - DNA, 20 bp, Artificial
  CRISPR gRNA sequence
tacttttgggttaagccgta

SEQ ID NO: 602417 - DNA, 20 bp, Artificial
  CRISPR gRNA sequence
acttttgggttaagccgtaa

SEQ ID NO: 602418 - DNA, 20 bp, Artificial
  CRISPR gRNA sequence
tccattgtttttcaacctaa

SEQ ID NO: 602419 - DNA, 20 bp, Artificial
  CRISPR gRNA sequence
acctaatagctgtgtgacct

SEQ ID NO: 602420 - DNA, 20 bp, Artificial
  CRISPR gRNA sequence
cctaatagctgtgtgacctt

SEQ ID NO: 602421 - DNA, 20 bp, Artificial
  CRISPR gRNA sequence
gtgaccttaggaatgttcct

SEQ ID NO: 602422 - DNA, 20 bp, Artificial
  CRISPR gRNA sequence
ttccttagatttcctaaatt

SEQ ID NO: 602423 - DNA, 20 bp, Artificial
  CRISPR gRNA sequence
tttcctaaatttagttcctt

SEQ ID NO: 602424 - DNA, 20 bp, Artificial
  CRISPR gRNA sequence
tagttccttcagctgtaaaa

SEQ ID NO: 602425 - DNA, 20 bp, Artificial
  CRISPR gRNA sequence
ataataataatacttgcctt

SEQ ID NO: 602426 - DNA, 20 bp, Artificial
  CRISPR gRNA sequence
aatacttgccttaagttttg

SEQ ID NO: 602427 - DNA, 20 bp, Artificial
  CRISPR gRNA sequence
aaataaatgtaacaattgca

SEQ ID NO: 602428 - DNA, 20 bp, Artificial
  CRISPR gRNA sequence
ataaatgtaacaattgcata

SEQ ID NO: 602429 - DNA, 20 bp, Artificial
  CRISPR gRNA sequence
taacaattgcatagagcact

SEQ ID NO: 602430 - DNA, 20 bp, Artificial
  CRISPR gRNA sequence
agagcacttagctcattttt

SEQ ID NO: 602431 - DNA, 20 bp, Artificial
  CRISPR gRNA sequence
acgtttgctgttgtgattta

SEQ ID NO: 602432 - DNA, 20 bp, Artificial
  CRISPR gRNA sequence
agactgcaaatatttgcata

SEQ ID NO: 602433 - DNA, 20 bp, Artificial
  CRISPR gRNA sequence
tatagctttttaatatttat

SEQ ID NO: 602434 - DNA, 20 bp, Artificial
  CRISPR gRNA sequence
ctttttaatatttattagat

SEQ ID NO: 602435 - DNA, 20 bp, Artificial
  CRISPR gRNA sequence
tttttaatatttattagata

SEQ ID NO: 602436 - DNA, 20 bp, Artificial
  CRISPR gRNA sequence
tatttattagataaggcttc

SEQ ID NO: 602437 - DNA, 20 bp, Artificial
  CRISPR gRNA sequence
atttattagataaggcttct

SEQ ID NO: 602438 - DNA, 20 bp, Artificial
  CRISPR gRNA sequence
tttattagataaggcttcta

SEQ ID NO: 602439 - DNA, 20 bp, Artificial
  CRISPR gRNA sequence
tgaataccaaccccattcta

SEQ ID NO: 602440 - DNA, 20 bp, Artificial
  CRISPR gRNA sequence
taaagttaccacttgcattc

SEQ ID NO: 602441 - DNA, 20 bp, Artificial
  CRISPR gRNA sequence
aaagttaccacttgcattct

SEQ ID NO: 602442 - DNA, 20 bp, Artificial
  CRISPR gRNA sequence
catttgttttgccttgtttt

SEQ ID NO: 602443 - DNA, 20 bp, Artificial
  CRISPR gRNA sequence
ttttgccttgttttaagatt

SEQ ID NO: 602444 - DNA, 20 bp, Artificial
  CRISPR gRNA sequence
agaataccttttttattaaa

SEQ ID NO: 602445 - DNA, 20 bp, Artificial
  CRISPR gRNA sequence
attaaacagacaaacaaaac

SEQ ID NO: 602446 - DNA, 20 bp, Artificial
  CRISPR gRNA sequence
accatttcacaaatctattg

SEQ ID NO: 602447 - DNA, 20 bp, Artificial
  CRISPR gRNA sequence
aaatctattttattttataa

SEQ ID NO: 602448 - DNA, 20 bp, Artificial
  CRISPR gRNA sequence
tttataatggtaactttatt

SEQ ID NO: 602449 - DNA, 20 bp, Artificial
  CRISPR gRNA sequence
tgcttttatattatacttaa

SEQ ID NO: 602450 - DNA, 20 bp, Artificial
  CRISPR gRNA sequence
taatagtattttaattatta

SEQ ID NO: 602451 - DNA, 20 bp, Artificial
  CRISPR gRNA sequence
attattatggttgatcatca

SEQ ID NO: 602452 - DNA, 20 bp, Artificial
  CRISPR gRNA sequence
tgatcatcatggtaatttaa

SEQ ID NO: 602453 - DNA, 20 bp, Artificial
  CRISPR gRNA sequence
atggtaatttaatagcctct

SEQ ID NO: 602454 - DNA, 20 bp, Artificial
  CRISPR gRNA sequence
tggtaatttaatagcctctt

SEQ ID NO: 602455 - DNA, 20 bp, Artificial
  CRISPR gRNA sequence
taatttaatagcctcttagg

SEQ ID NO: 602456 - DNA, 20 bp, Artificial
  CRISPR gRNA sequence
aatttaatagcctcttagga

SEQ ID NO: 602457 - DNA, 20 bp, Artificial
  CRISPR gRNA sequence
atttaatagcctcttaggaa

SEQ ID NO: 602458 - DNA, 20 bp, Artificial
  CRISPR gRNA sequence
acaatcaaatctaatttctt

SEQ ID NO: 602459 - DNA, 20 bp, Artificial
  CRISPR gRNA sequence
aatctaatttctttagttcc

SEQ ID NO: 602460 - DNA, 20 bp, Artificial
  CRISPR gRNA sequence
atctaatttctttagttcct

SEQ ID NO: 602461 - DNA, 20 bp, Artificial
  CRISPR gRNA sequence
ctttagttcctaggatattt

SEQ ID NO: 602462 - DNA, 20 bp, Artificial
  CRISPR gRNA sequence
ttggaaatacatgtattctt

SEQ ID NO: 602463 - DNA, 20 bp, Artificial
  CRISPR gRNA sequence
aaatacatgtattcttaagt

SEQ ID NO: 602464 - DNA, 20 bp, Artificial
  CRISPR gRNA sequence
gtattcttaagttagttaat

SEQ ID NO: 602465 - DNA, 20 bp, Artificial
  CRISPR gRNA sequence
tattcttaagttagttaatt

SEQ ID NO: 602466 - DNA, 20 bp, Artificial
  CRISPR gRNA sequence
tcttaagttagttaattggg

SEQ ID NO: 602467 - DNA, 20 bp, Artificial
  CRISPR gRNA sequence
ttaattgggtggaaaaattg

SEQ ID NO: 602468 - DNA, 20 bp, Artificial
  CRISPR gRNA sequence
aaattgcagttataattctt

SEQ ID NO: 602469 - DNA, 20 bp, Artificial
  CRISPR gRNA sequence
gcagttataattctttagaa

SEQ ID NO: 602470 - DNA, 20 bp, Artificial
  CRISPR gRNA sequence
ctaaccaaaaattctgatga

SEQ ID NO: 602471 - DNA, 20 bp, Artificial
  CRISPR gRNA sequence
ccaaaaattctgatgataga

SEQ ID NO: 602472 - DNA, 20 bp, Artificial
  CRISPR gRNA sequence
caaaaattctgatgatagat

SEQ ID NO: 602473 - DNA, 20 bp, Artificial
  CRISPR gRNA sequence
ctgatgatagataggactta

SEQ ID NO: 602474 - DNA, 20 bp, Artificial
  CRISPR gRNA sequence
gatgatagataggacttaaa

SEQ ID NO: 602475 - DNA, 20 bp, Artificial
  CRISPR gRNA sequence
cttaaagagaaaatgtaaac

SEQ ID NO: 602476 - DNA, 20 bp, Artificial
  CRISPR gRNA sequence
gatttcaaattacttttatt

SEQ ID NO: 602477 - DNA, 20 bp, Artificial
  CRISPR gRNA sequence
atttcaaattacttttattt

SEQ ID NO: 602478 - DNA, 20 bp, Artificial
  CRISPR gRNA sequence
caaattacttttatttgggt

SEQ ID NO: 602479 - DNA, 20 bp, Artificial
  CRISPR gRNA sequence
tacttttatttgggttggat

SEQ ID NO: 602480 - DNA, 20 bp, Artificial
  CRISPR gRNA sequence
tggattagctgtctttatgc

SEQ ID NO: 602481 - DNA, 20 bp, Artificial
  CRISPR gRNA sequence
ggattagctgtctttatgct

SEQ ID NO: 602482 - DNA, 20 bp, Artificial
  CRISPR gRNA sequence
aggactatttgtgtgtaata

SEQ ID NO: 602483 - DNA, 20 bp, Artificial
  CRISPR gRNA sequence
gtgtgtaatatagatcaaat

SEQ ID NO: 602484 - DNA, 20 bp, Artificial
  CRISPR gRNA sequence
tgtgtaatatagatcaaata

SEQ ID NO: 602485 - DNA, 20 bp, Artificial
  CRISPR gRNA sequence
tatagatcaaataaggtgtt

SEQ ID NO: 602486 - DNA, 20 bp, Artificial
  CRISPR gRNA sequence
atcaaataaggtgttcagaa

SEQ ID NO: 602487 - DNA, 20 bp, Artificial
  CRISPR gRNA sequence
tcaaataaggtgttcagaat

SEQ ID NO: 602488 - DNA, 20 bp, Artificial
  CRISPR gRNA sequence
tcagaatgggatgaactatc

SEQ ID NO: 602489 - DNA, 20 bp, Artificial
  CRISPR gRNA sequence
gaatgggatgaactatctgg

SEQ ID NO: 602490 - DNA, 20 bp, Artificial
  CRISPR gRNA sequence
aatgggatgaactatctgga

SEQ ID NO: 602491 - DNA, 20 bp, Artificial
  CRISPR gRNA sequence
gggatgaactatctggaagg

SEQ ID NO: 602492 - DNA, 20 bp, Artificial
  CRISPR gRNA sequence
atgaactatctggaaggaag

SEQ ID NO: 602493 - DNA, 20 bp, Artificial
  CRISPR gRNA sequence
tggtgttatctatactacta

SEQ ID NO: 602494 - DNA, 20 bp, Artificial
  CRISPR gRNA sequence
gttatctatactactacagc

SEQ ID NO: 602495 - DNA, 20 bp, Artificial
  CRISPR gRNA sequence
cacatcattattcaatgatt

SEQ ID NO: 602496 - DNA, 20 bp, Artificial
  CRISPR gRNA sequence
acatcattattcaatgatta

SEQ ID NO: 602497 - DNA, 20 bp, Artificial
  CRISPR gRNA sequence
attcaatgattaaggactgc

SEQ ID NO: 602498 - DNA, 20 bp, Artificial
  CRISPR gRNA sequence
ttcaatgattaaggactgct

SEQ ID NO: 602499 - DNA, 20 bp, Artificial
  CRISPR gRNA sequence
gctaggtgaaactgacataa

SEQ ID NO: 602500 - DNA, 20 bp, Artificial
  CRISPR gRNA sequence
ctaggtgaaactgacataat

SEQ ID NO: 602501 - DNA, 20 bp, Artificial
  CRISPR gRNA sequence
taggtgaaactgacataatg

SEQ ID NO: 602502 - DNA, 20 bp, Artificial
  CRISPR gRNA sequence
acataatggggttttctttt

SEQ ID NO: 602503 - DNA, 20 bp, Artificial
  CRISPR gRNA sequence
ggggttttctttttggaaaa

SEQ ID NO: 602504 - DNA, 20 bp, Artificial
  CRISPR gRNA sequence
ctttttggaaaatagtatct

SEQ ID NO: 602505 - DNA, 20 bp, Artificial
  CRISPR gRNA sequence
aaatagtatcttagttgtat

SEQ ID NO: 602506 - DNA, 20 bp, Artificial
  CRISPR gRNA sequence
tagttgtattggtattccac

SEQ ID NO: 602507 - DNA, 20 bp, Artificial
  CRISPR gRNA sequence
ttggtattccactggatatt

SEQ ID NO: 602508 - DNA, 20 bp, Artificial
  CRISPR gRNA sequence
ttccactggatatttagtaa

SEQ ID NO: 602509 - DNA, 20 bp, Artificial
  CRISPR gRNA sequence
tagtaaaagtgctatttact

SEQ ID NO: 602510 - DNA, 20 bp, Artificial
  CRISPR gRNA sequence
ctatttactgagaacatcct

SEQ ID NO: 602511 - DNA, 20 bp, Artificial
  CRISPR gRNA sequence
tatttactgagaacatcctt

SEQ ID NO: 602512 - DNA, 20 bp, Artificial
  CRISPR gRNA sequence
ctgagaacatccttaggatt

SEQ ID NO: 602513 - DNA, 20 bp, Artificial
  CRISPR gRNA sequence
gaacatccttaggatttaga

SEQ ID NO: 602514 - DNA, 20 bp, Artificial
  CRISPR gRNA sequence
acatccttaggatttagaaa

SEQ ID NO: 602515 - DNA, 20 bp, Artificial
  CRISPR gRNA sequence
gatttagaaagagaactatg

SEQ ID NO: 602516 - DNA, 20 bp, Artificial
  CRISPR gRNA sequence
aagagaactatgtagtttta

SEQ ID NO: 602517 - DNA, 20 bp, Artificial
  CRISPR gRNA sequence
actatgtagttttatagtta

SEQ ID NO: 602518 - DNA, 20 bp, Artificial
  CRISPR gRNA sequence
tatgtagttttatagttaca

SEQ ID NO: 602519 - DNA, 20 bp, Artificial
  CRISPR gRNA sequence
ttttatagttacagagattc

SEQ ID NO: 602520 - DNA, 20 bp, Artificial
  CRISPR gRNA sequence
tagttacagagattctggtg

SEQ ID NO: 602521 - DNA, 20 bp, Artificial
  CRISPR gRNA sequence
cagagattctggtgcagatt

SEQ ID NO: 602522 - DNA, 20 bp, Artificial
  CRISPR gRNA sequence
agagattctggtgcagattt

SEQ ID NO: 602523 - DNA, 20 bp, Artificial
  CRISPR gRNA sequence
gattctggtgcagatttggg

SEQ ID NO: 602524 - DNA, 20 bp, Artificial
  CRISPR gRNA sequence
ttctggtgcagatttgggaa

SEQ ID NO: 602525 - DNA, 20 bp, Artificial
  CRISPR gRNA sequence
tctggtgcagatttgggaag

SEQ ID NO: 602526 - DNA, 20 bp, Artificial
  CRISPR gRNA sequence
tttgggaagaggtttgaaat

SEQ ID NO: 602527 - DNA, 20 bp, Artificial
  CRISPR gRNA sequence
aggtttgaaattagtatgta

SEQ ID NO: 602528 - DNA, 20 bp, Artificial
  CRISPR gRNA sequence
ttgaaattagtatgtaaagt

SEQ ID NO: 602529 - DNA, 20 bp, Artificial
  CRISPR gRNA sequence
attagtatgtaaagtcagaa

SEQ ID NO: 602530 - DNA, 20 bp, Artificial
  CRISPR gRNA sequence
ccacaacctgccactaatga

SEQ ID NO: 602531 - DNA, 20 bp, Artificial
  CRISPR gRNA sequence
cacaacctgccactaatgaa

SEQ ID NO: 602532 - DNA, 20 bp, Artificial
  CRISPR gRNA sequence
actaatgaaaggtctttgat

SEQ ID NO: 602533 - DNA, 20 bp, Artificial
  CRISPR gRNA sequence
ccttatacccattttattta

SEQ ID NO: 602534 - DNA, 20 bp, Artificial
  CRISPR gRNA sequence
cattttatttacagttttca

SEQ ID NO: 602535 - DNA, 20 bp, Artificial
  CRISPR gRNA sequence
tttcatagctaatgaataat

SEQ ID NO: 602536 - DNA, 20 bp, Artificial
  CRISPR gRNA sequence
gaataataagaaaattccac

SEQ ID NO: 602537 - DNA, 20 bp, Artificial
  CRISPR gRNA sequence
aataataagaaaattccacc

SEQ ID NO: 602538 - DNA, 20 bp, Artificial
  CRISPR gRNA sequence
ctgattgtttacctctctaa

SEQ ID NO: 602539 - DNA, 20 bp, Artificial
  CRISPR gRNA sequence
ctctaatagcaatttacaaa

SEQ ID NO: 602540 - DNA, 20 bp, Artificial
  CRISPR gRNA sequence
tttacaaatggtgtatgctg

SEQ ID NO: 602541 - DNA, 20 bp, Artificial
  CRISPR gRNA sequence
ttacaaaccgtgtcctgtaa

SEQ ID NO: 602542 - DNA, 20 bp, Artificial
  CRISPR gRNA sequence
cctgtaatagcatttgatgt

SEQ ID NO: 602543 - DNA, 20 bp, Artificial
  CRISPR gRNA sequence
gtaatagcatttgatgtaag

SEQ ID NO: 602544 - DNA, 20 bp, Artificial
  CRISPR gRNA sequence
ctgctcaccattccatattg

SEQ ID NO: 602545 - DNA, 20 bp, Artificial
  CRISPR gRNA sequence
tcaccattccatattgtggt

SEQ ID NO: 602546 - DNA, 20 bp, Artificial
  CRISPR gRNA sequence
accattccatattgtggttg

SEQ ID NO: 602547 - DNA, 20 bp, Artificial
  CRISPR gRNA sequence
ttccatattgtggttggagc

SEQ ID NO: 602548 - DNA, 20 bp, Artificial
  CRISPR gRNA sequence
ccatattgtggttggagctg

SEQ ID NO: 602549 - DNA, 20 bp, Artificial
  CRISPR gRNA sequence
tgtggttggagctggagaaa

SEQ ID NO: 602550 - DNA, 20 bp, Artificial
  CRISPR gRNA sequence
gagctggagaaatagaaaat

SEQ ID NO: 602551 - DNA, 20 bp, Artificial
  CRISPR gRNA sequence
atagaaaattggtcatttcc

SEQ ID NO: 602552 - DNA, 20 bp, Artificial
  CRISPR gRNA sequence
gaaaattggtcatttcccgg

SEQ ID NO: 602553 - DNA, 20 bp, Artificial
  CRISPR gRNA sequence
attggtcatttcccggcaga

SEQ ID NO: 602554 - DNA, 20 bp, Artificial
  CRISPR gRNA sequence
ggtcatttcccggcagatag

SEQ ID NO: 602555 - DNA, 20 bp, Artificial
  CRISPR gRNA sequence
gatagcagtaactttcaatt

SEQ ID NO: 602556 - DNA, 20 bp, Artificial
  CRISPR gRNA sequence
gcagtaactttcaattcagt

SEQ ID NO: 602557 - DNA, 20 bp, Artificial
  CRISPR gRNA sequence
aattcagtcagaatgctgta

SEQ ID NO: 602558 - DNA, 20 bp, Artificial
  CRISPR gRNA sequence
attcagtcagaatgctgtat

SEQ ID NO: 602559 - DNA, 20 bp, Artificial
  CRISPR gRNA sequence
gaatgctgtatgggctgtga

SEQ ID NO: 602560 - DNA, 20 bp, Artificial
  CRISPR gRNA sequence
aatgctgtatgggctgtgat

SEQ ID NO: 602561 - DNA, 20 bp, Artificial
  CRISPR gRNA sequence
aggtttataattattaccca

SEQ ID NO: 602562 - DNA, 20 bp, Artificial
  CRISPR gRNA sequence
aattattacccaaagattga

SEQ ID NO: 602563 - DNA, 20 bp, Artificial
  CRISPR gRNA sequence
cccaaagattgatggttttt

SEQ ID NO: 602564 - DNA, 20 bp, Artificial
  CRISPR gRNA sequence
ttggtgtgtgtaaatttgtg

SEQ ID NO: 602565 - DNA, 20 bp, Artificial
  CRISPR gRNA sequence
gtgtgtgtaaatttgtgcag

SEQ ID NO: 602566 - DNA, 20 bp, Artificial
  CRISPR gRNA sequence
ttgtgcagcagtaatccatt

SEQ ID NO: 602567 - DNA, 20 bp, Artificial
  CRISPR gRNA sequence
aatcattccattctgatgtg

SEQ ID NO: 602568 - DNA, 20 bp, Artificial
  CRISPR gRNA sequence
ctgttataaatgtgtaccgt

SEQ ID NO: 602569 - DNA, 20 bp, Artificial
  CRISPR gRNA sequence
ttttttgaaattgtatttga

SEQ ID NO: 602570 - DNA, 20 bp, Artificial
  CRISPR gRNA sequence
gaaattgtatttgacagtat

SEQ ID NO: 602571 - DNA, 20 bp, Artificial
  CRISPR gRNA sequence
tatttgacagtattggaaat

SEQ ID NO: 602572 - DNA, 20 bp, Artificial
  CRISPR gRNA sequence
atttgacagtattggaaatg

SEQ ID NO: 602573 - DNA, 20 bp, Artificial
  CRISPR gRNA sequence
ccatatgacgtacctattgc

SEQ ID NO: 602574 - DNA, 20 bp, Artificial
  CRISPR gRNA sequence
aataattacaaattatttat

SEQ ID NO: 602575 - DNA, 20 bp, Artificial
  CRISPR gRNA sequence
acaaattatttataagctta

SEQ ID NO: 602576 - DNA, 20 bp, Artificial
  CRISPR gRNA sequence
tttataagcttaaagcatct

SEQ ID NO: 602577 - DNA, 20 bp, Artificial
  CRISPR gRNA sequence
cagtgtttctttctgtaatc

SEQ ID NO: 602578 - DNA, 20 bp, Artificial
  CRISPR gRNA sequence
gtgtttctttctgtaatctg

SEQ ID NO: 602579 - DNA, 20 bp, Artificial
  CRISPR gRNA sequence
tgtttctttctgtaatctgg

SEQ ID NO: 602580 - DNA, 20 bp, Artificial
  CRISPR gRNA sequence
gatttattaccaactctata

SEQ ID NO: 602581 - DNA, 20 bp, Artificial
  CRISPR gRNA sequence
tattaccaactctatatggt

SEQ ID NO: 602582 - DNA, 20 bp, Artificial
  CRISPR gRNA sequence
attaccaactctatatggtc

SEQ ID NO: 602583 - DNA, 20 bp, Artificial
  CRISPR gRNA sequence
ccaactctatatggtcagga

SEQ ID NO: 602584 - DNA, 20 bp, Artificial
  CRISPR gRNA sequence
actctatatggtcaggaaag

SEQ ID NO: 602585 - DNA, 20 bp, Artificial
  CRISPR gRNA sequence
ctctatatggtcaggaaagt

SEQ ID NO: 602586 - DNA, 20 bp, Artificial
  CRISPR gRNA sequence
ctctaatgtttatttattac

SEQ ID NO: 602587 - DNA, 20 bp, Artificial
  CRISPR gRNA sequence
tatttattaccggtacctcc

SEQ ID NO: 602588 - DNA, 20 bp, Artificial
  CRISPR gRNA sequence
atttattaccggtacctcct

SEQ ID NO: 602589 - DNA, 20 bp, Artificial
  CRISPR gRNA sequence
tacctcctaggatgccattg

SEQ ID NO: 602590 - DNA, 20 bp, Artificial
  CRISPR gRNA sequence
acctcctaggatgccattgt

SEQ ID NO: 602591 - DNA, 20 bp, Artificial
  CRISPR gRNA sequence
tcctaggatgccattgtggg

SEQ ID NO: 602592 - DNA, 20 bp, Artificial
  CRISPR gRNA sequence
aggatgccattgtgggaagc

SEQ ID NO: 602593 - DNA, 20 bp, Artificial
  CRISPR gRNA sequence
ggatgccattgtgggaagct

SEQ ID NO: 602594 - DNA, 20 bp, Artificial
  CRISPR gRNA sequence
cattgtgggaagctaggatt

SEQ ID NO: 602595 - DNA, 20 bp, Artificial
  CRISPR gRNA sequence
attgtgggaagctaggatta

SEQ ID NO: 602596 - DNA, 20 bp, Artificial
  CRISPR gRNA sequence
gtgggaagctaggattaagg

SEQ ID NO: 602597 - DNA, 20 bp, Artificial
  CRISPR gRNA sequence
cagcattgaccctactctca

SEQ ID NO: 602598 - DNA, 20 bp, Artificial
  CRISPR gRNA sequence
agcattgaccctactctcaa

SEQ ID NO: 602599 - DNA, 20 bp, Artificial
  CRISPR gRNA sequence
cattgaccctactctcaaag

SEQ ID NO: 602600 - DNA, 20 bp, Artificial
  CRISPR gRNA sequence
accctactctcaaaggagct

SEQ ID NO: 602601 - DNA, 20 bp, Artificial
  CRISPR gRNA sequence
tctcaaaggagcttagattt

SEQ ID NO: 602602 - DNA, 20 bp, Artificial
  CRISPR gRNA sequence
tcaaaggagcttagatttta

SEQ ID NO: 602603 - DNA, 20 bp, Artificial
  CRISPR gRNA sequence
aggagcttagattttagaga

SEQ ID NO: 602604 - DNA, 20 bp, Artificial
  CRISPR gRNA sequence
gcttagattttagagaaaga

SEQ ID NO: 602605 - DNA, 20 bp, Artificial
  CRISPR gRNA sequence
cttagattttagagaaagaa

SEQ ID NO: 602606 - DNA, 20 bp, Artificial
  CRISPR gRNA sequence
agattttagagaaagaaagg

SEQ ID NO: 602607 - DNA, 20 bp, Artificial
  CRISPR gRNA sequence
gaaatcaacacacataacat

SEQ ID NO: 602608 - DNA, 20 bp, Artificial
  CRISPR gRNA sequence
aaatcaacacacataacata

SEQ ID NO: 602609 - DNA, 20 bp, Artificial
  CRISPR gRNA sequence
aatcaacacacataacataa

SEQ ID NO: 602610 - DNA, 20 bp, Artificial
  CRISPR gRNA sequence
acacataacataagggtgtg

SEQ ID NO: 602611 - DNA, 20 bp, Artificial
  CRISPR gRNA sequence
aacataagggtgtgaagaaa

SEQ ID NO: 602612 - DNA, 20 bp, Artificial
  CRISPR gRNA sequence
acataagggtgtgaagaaat

SEQ ID NO: 602613 - DNA, 20 bp, Artificial
  CRISPR gRNA sequence
agggtgtgaagaaatgggaa

SEQ ID NO: 602614 - DNA, 20 bp, Artificial
  CRISPR gRNA sequence
gtgtgaagaaatgggaaaag

SEQ ID NO: 602615 - DNA, 20 bp, Artificial
  CRISPR gRNA sequence
tgaagaaatgggaaaagtgg

SEQ ID NO: 602616 - DNA, 20 bp, Artificial
  CRISPR gRNA sequence
gaagaaatgggaaaagtggt

SEQ ID NO: 602617 - DNA, 20 bp, Artificial
  CRISPR gRNA sequence
aagaaatgggaaaagtggta

SEQ ID NO: 602618 - DNA, 20 bp, Artificial
  CRISPR gRNA sequence
agaaatgggaaaagtggtag

SEQ ID NO: 602619 - DNA, 20 bp, Artificial
  CRISPR gRNA sequence
cctgaaaccatccattacgt

SEQ ID NO: 602620 - DNA, 20 bp, Artificial
  CRISPR gRNA sequence
ccattacgtaagttctgaac

SEQ ID NO: 602621 - DNA, 20 bp, Artificial
  CRISPR gRNA sequence
taagttctgaactggaactt

SEQ ID NO: 602622 - DNA, 20 bp, Artificial
  CRISPR gRNA sequence
gaactggaactttggtgtta

SEQ ID NO: 602623 - DNA, 20 bp, Artificial
  CRISPR gRNA sequence
actttggtgttatggcatga

SEQ ID NO: 602624 - DNA, 20 bp, Artificial
  CRISPR gRNA sequence
gtgttatggcatgatagtgc

SEQ ID NO: 602625 - DNA, 20 bp, Artificial
  CRISPR gRNA sequence
tgttatggcatgatagtgct

SEQ ID NO: 602626 - DNA, 20 bp, Artificial
  CRISPR gRNA sequence
gttatggcatgatagtgcta

SEQ ID NO: 602627 - DNA, 20 bp, Artificial
  CRISPR gRNA sequence
catgatagtgctagggatga

SEQ ID NO: 602628 - DNA, 20 bp, Artificial
  CRISPR gRNA sequence
atgatagtgctagggatgat

SEQ ID NO: 602629 - DNA, 20 bp, Artificial
  CRISPR gRNA sequence
tgatagtgctagggatgatg

SEQ ID NO: 602630 - DNA, 20 bp, Artificial
  CRISPR gRNA sequence
gtgctagggatgatggggtg

SEQ ID NO: 602631 - DNA, 20 bp, Artificial
  CRISPR gRNA sequence
tgctagggatgatggggtgt

SEQ ID NO: 602632 - DNA, 20 bp, Artificial
  CRISPR gRNA sequence
gggtgataaacttcatccca

SEQ ID NO: 602633 - DNA, 20 bp, Artificial
  CRISPR gRNA sequence
ggtgataaacttcatcccac

SEQ ID NO: 602634 - DNA, 20 bp, Artificial
  CRISPR gRNA sequence
gtgataaacttcatcccaca

SEQ ID NO: 602635 - DNA, 20 bp, Artificial
  CRISPR gRNA sequence
tgataaacttcatcccacag

SEQ ID NO: 602636 - DNA, 20 bp, Artificial
  CRISPR gRNA sequence
acttcatcccacaggggatg

SEQ ID NO: 602637 - DNA, 20 bp, Artificial
  CRISPR gRNA sequence
catcccacaggggatgtggc

SEQ ID NO: 602638 - DNA, 20 bp, Artificial
  CRISPR gRNA sequence
agcattacaaaattctgaca

SEQ ID NO: 602639 - DNA, 20 bp, Artificial
  CRISPR gRNA sequence
tacaaaattctgacatagtg

SEQ ID NO: 602640 - DNA, 20 bp, Artificial
  CRISPR gRNA sequence
acaaaattctgacatagtgt

SEQ ID NO: 602641 - DNA, 20 bp, Artificial
  CRISPR gRNA sequence
caaaattctgacatagtgtg

SEQ ID NO: 602642 - DNA, 20 bp, Artificial
  CRISPR gRNA sequence
tctgacatagtgtggggcta

SEQ ID NO: 602643 - DNA, 20 bp, Artificial
  CRISPR gRNA sequence
tgacatagtgtggggctaaa

SEQ ID NO: 602644 - DNA, 20 bp, Artificial
  CRISPR gRNA sequence
catagtgtggggctaaagag

SEQ ID NO: 602645 - DNA, 20 bp, Artificial
  CRISPR gRNA sequence
gggctaaagagcagtctaaa

SEQ ID NO: 602646 - DNA, 20 bp, Artificial
  CRISPR gRNA sequence
gctaaagagcagtctaaata

SEQ ID NO: 602647 - DNA, 20 bp, Artificial
  CRISPR gRNA sequence
agcagtctaaatagagattc

SEQ ID NO: 602648 - DNA, 20 bp, Artificial
  CRISPR gRNA sequence
gcagtctaaatagagattct

SEQ ID NO: 602649 - DNA, 20 bp, Artificial
  CRISPR gRNA sequence
gattctaggtaaaaatgata

SEQ ID NO: 602650 - DNA, 20 bp, Artificial
  CRISPR gRNA sequence
attctaggtaaaaatgatat

SEQ ID NO: 602651 - DNA, 20 bp, Artificial
  CRISPR gRNA sequence
gtaaaaatgatataggaaca

SEQ ID NO: 602652 - DNA, 20 bp, Artificial
  CRISPR gRNA sequence
tgatataggaacatagtata

SEQ ID NO: 602653 - DNA, 20 bp, Artificial
  CRISPR gRNA sequence
aacatagtataaagttaaaa

SEQ ID NO: 602654 - DNA, 20 bp, Artificial
  CRISPR gRNA sequence
atagtataaagttaaaacgg

SEQ ID NO: 602655 - DNA, 20 bp, Artificial
  CRISPR gRNA sequence
agtataaagttaaaacggta

SEQ ID NO: 602656 - DNA, 20 bp, Artificial
  CRISPR gRNA sequence
taaagttaaaacggtagaga

SEQ ID NO: 602657 - DNA, 20 bp, Artificial
  CRISPR gRNA sequence
agagaaagatataacatgaa

SEQ ID NO: 602658 - DNA, 20 bp, Artificial
  CRISPR gRNA sequence
agatataacatgaaaagtaa

SEQ ID NO: 602659 - DNA, 20 bp, Artificial
  CRISPR gRNA sequence
aagtaaaagctccaccactc

SEQ ID NO: 602660 - DNA, 20 bp, Artificial
  CRISPR gRNA sequence
gctccaccactcaagtaccc

SEQ ID NO: 602661 - DNA, 20 bp, Artificial
  CRISPR gRNA sequence
cactcaagtaccctagtcct

SEQ ID NO: 602662 - DNA, 20 bp, Artificial
  CRISPR gRNA sequence
attatctttccataattttt

SEQ ID NO: 602663 - DNA, 20 bp, Artificial
  CRISPR gRNA sequence
cataattttttggtatatac

SEQ ID NO: 602664 - DNA, 20 bp, Artificial
  CRISPR gRNA sequence
tttgtttcctttcctattaa

SEQ ID NO: 602665 - DNA, 20 bp, Artificial
  CRISPR gRNA sequence
tttcctattaatagtacaaa

SEQ ID NO: 602666 - DNA, 20 bp, Artificial
  CRISPR gRNA sequence
ttcctattaatagtacaaat

SEQ ID NO: 602667 - DNA, 20 bp, Artificial
  CRISPR gRNA sequence
tcctattaatagtacaaata

SEQ ID NO: 602668 - DNA, 20 bp, Artificial
  CRISPR gRNA sequence
atagtacaaatagggttgca

SEQ ID NO: 602669 - DNA, 20 bp, Artificial
  CRISPR gRNA sequence
ctatgactcaatttttcatt

SEQ ID NO: 602670 - DNA, 20 bp, Artificial
  CRISPR gRNA sequence
tatgactcaatttttcattt

SEQ ID NO: 602671 - DNA, 20 bp, Artificial
  CRISPR gRNA sequence
tttaataccaacgttgttct

SEQ ID NO: 602672 - DNA, 20 bp, Artificial
  CRISPR gRNA sequence
ttaataccaacgttgttctt

SEQ ID NO: 602673 - DNA, 20 bp, Artificial
  CRISPR gRNA sequence
ctttatacactgatgataca

SEQ ID NO: 602674 - DNA, 20 bp, Artificial
  CRISPR gRNA sequence
atttgctcctcattcactgt

SEQ ID NO: 602675 - DNA, 20 bp, Artificial
  CRISPR gRNA sequence
ctcattcactgttggacatt

SEQ ID NO: 602676 - DNA, 20 bp, Artificial
  CRISPR gRNA sequence
tcattcactgttggacattt

SEQ ID NO: 602677 - DNA, 20 bp, Artificial
  CRISPR gRNA sequence
tctatgtttttgttattatg

SEQ ID NO: 602678 - DNA, 20 bp, Artificial
  CRISPR gRNA sequence
ttattatgtagacattgttt

SEQ ID NO: 602679 - DNA, 20 bp, Artificial
  CRISPR gRNA sequence
atttaccttctttacatcct

SEQ ID NO: 602680 - DNA, 20 bp, Artificial
  CRISPR gRNA sequence
tttaccttctttacatcctt

SEQ ID NO: 602681 - DNA, 20 bp, Artificial
  CRISPR gRNA sequence
tttacatccttaggataact

SEQ ID NO: 602682 - DNA, 20 bp, Artificial
  CRISPR gRNA sequence
agctgtgtatttgctatgtc

SEQ ID NO: 602683 - DNA, 20 bp, Artificial
  CRISPR gRNA sequence
tgtgtatttgctatgtcaag

SEQ ID NO: 602684 - DNA, 20 bp, Artificial
  CRISPR gRNA sequence
agtctgtgcaatgaatattt

SEQ ID NO: 602685 - DNA, 20 bp, Artificial
  CRISPR gRNA sequence
ctgtgcaatgaatattttag

SEQ ID NO: 602686 - DNA, 20 bp, Artificial
  CRISPR gRNA sequence
aatgaatattttagtagata

SEQ ID NO: 602687 - DNA, 20 bp, Artificial
  CRISPR gRNA sequence
atattttagtagataaagtg

SEQ ID NO: 602688 - DNA, 20 bp, Artificial
  CRISPR gRNA sequence
agtgtggccaaattgctctt

SEQ ID NO: 602689 - DNA, 20 bp, Artificial
  CRISPR gRNA sequence
tggccaaattgctctttgga

SEQ ID NO: 602690 - DNA, 20 bp, Artificial
  CRISPR gRNA sequence
ataacaatttacactacaac

SEQ ID NO: 602691 - DNA, 20 bp, Artificial
  CRISPR gRNA sequence
cactacaactagtaatatgt

SEQ ID NO: 602692 - DNA, 20 bp, Artificial
  CRISPR gRNA sequence
aaaatgcattttatccattt

SEQ ID NO: 602693 - DNA, 20 bp, Artificial
  CRISPR gRNA sequence
tccattttggttcatctgaa

SEQ ID NO: 602694 - DNA, 20 bp, Artificial
  CRISPR gRNA sequence
ccattttggttcatctgaat

SEQ ID NO: 602695 - DNA, 20 bp, Artificial
  CRISPR gRNA sequence
cattttggttcatctgaatg

SEQ ID NO: 602696 - DNA, 20 bp, Artificial
  CRISPR gRNA sequence
attttggttcatctgaatgg

SEQ ID NO: 602697 - DNA, 20 bp, Artificial
  CRISPR gRNA sequence
ttggttcatctgaatggggg

SEQ ID NO: 602698 - DNA, 20 bp, Artificial
  CRISPR gRNA sequence
ttcatctgaatgggggaaga

SEQ ID NO: 602699 - DNA, 20 bp, Artificial
  CRISPR gRNA sequence
tgtttgacatttcttaatta

SEQ ID NO: 602700 - DNA, 20 bp, Artificial
  CRISPR gRNA sequence
acataatttcaaatgtttgt

SEQ ID NO: 602701 - DNA, 20 bp, Artificial
  CRISPR gRNA sequence
aatttcaaatgtttgttggt

SEQ ID NO: 602702 - DNA, 20 bp, Artificial
  CRISPR gRNA sequence
gtatttaatttttgttcctg

SEQ ID NO: 602703 - DNA, 20 bp, Artificial
  CRISPR gRNA sequence
cctgaagaatatttctgctt

SEQ ID NO: 602704 - DNA, 20 bp, Artificial
  CRISPR gRNA sequence
aatatttctgcttcagtgtc

SEQ ID NO: 602705 - DNA, 20 bp, Artificial
  CRISPR gRNA sequence
atatttctgcttcagtgtct

SEQ ID NO: 602706 - DNA, 20 bp, Artificial
  CRISPR gRNA sequence
atttctgcttcagtgtctgg

SEQ ID NO: 602707 - DNA, 20 bp, Artificial
  CRISPR gRNA sequence
attataattaaaaactctat

SEQ ID NO: 602708 - DNA, 20 bp, Artificial
  CRISPR gRNA sequence
ttataattaaaaactctatt

SEQ ID NO: 602709 - DNA, 20 bp, Artificial
  CRISPR gRNA sequence
ttaaaaactctattaggaac

SEQ ID NO: 602710 - DNA, 20 bp, Artificial
  CRISPR gRNA sequence
taaaaactctattaggaact

SEQ ID NO: 602711 - DNA, 20 bp, Artificial
  CRISPR gRNA sequence
aaaactctattaggaactag

SEQ ID NO: 602712 - DNA, 20 bp, Artificial
  CRISPR gRNA sequence
ctctattaggaactaggaga

SEQ ID NO: 602713 - DNA, 20 bp, Artificial
  CRISPR gRNA sequence
ctattaggaactaggagaaa

SEQ ID NO: 602714 - DNA, 20 bp, Artificial
  CRISPR gRNA sequence
attaggaactaggagaaaga

SEQ ID NO: 602715 - DNA, 20 bp, Artificial
  CRISPR gRNA sequence
actaggagaaagagagaaaa

SEQ ID NO: 602716 - DNA, 20 bp, Artificial
  CRISPR gRNA sequence
ttattcgtgattcatgattt

SEQ ID NO: 602717 - DNA, 20 bp, Artificial
  CRISPR gRNA sequence
tattcgtgattcatgatttg

SEQ ID NO: 602718 - DNA, 20 bp, Artificial
  CRISPR gRNA sequence
gatttgaggcatatttatta

SEQ ID NO: 602719 - DNA, 20 bp, Artificial
  CRISPR gRNA sequence
atttgaggcatatttattaa

SEQ ID NO: 602720 - DNA, 20 bp, Artificial
  CRISPR gRNA sequence
gcatatttattaaaggataa

SEQ ID NO: 602721 - DNA, 20 bp, Artificial
  CRISPR gRNA sequence
tatttattaaaggataatgg

SEQ ID NO: 602722 - DNA, 20 bp, Artificial
  CRISPR gRNA sequence
atttattaaaggataatggc

SEQ ID NO: 602723 - DNA, 20 bp, Artificial
  CRISPR gRNA sequence
tttattaaaggataatggca

SEQ ID NO: 602724 - DNA, 20 bp, Artificial
  CRISPR gRNA sequence
taaaggataatggcagggaa

SEQ ID NO: 602725 - DNA, 20 bp, Artificial
  CRISPR gRNA sequence
ggaatggatgatttgatgtt

SEQ ID NO: 602726 - DNA, 20 bp, Artificial
  CRISPR gRNA sequence
atggatgatttgatgttaag

SEQ ID NO: 602727 - DNA, 20 bp, Artificial
  CRISPR gRNA sequence
ttttcaaatgttatacactc

SEQ ID NO: 602728 - DNA, 20 bp, Artificial
  CRISPR gRNA sequence
aaatgttatacactctagaa

SEQ ID NO: 602729 - DNA, 20 bp, Artificial
  CRISPR gRNA sequence
tgttatacactctagaacag

SEQ ID NO: 602730 - DNA, 20 bp, Artificial
  CRISPR gRNA sequence
tgtatctgctctaatttcac

SEQ ID NO: 602731 - DNA, 20 bp, Artificial
  CRISPR gRNA sequence
tctaatttcactagttatct

SEQ ID NO: 602732 - DNA, 20 bp, Artificial
  CRISPR gRNA sequence
gttatcttggtaaatcacat

SEQ ID NO: 602733 - DNA, 20 bp, Artificial
  CRISPR gRNA sequence
tcacataagaaacccttcca

SEQ ID NO: 602734 - DNA, 20 bp, Artificial
  CRISPR gRNA sequence
agaaacccttccaaagtatt

SEQ ID NO: 602735 - DNA, 20 bp, Artificial
  CRISPR gRNA sequence
cccttccaaagtatttagca

SEQ ID NO: 602736 - DNA, 20 bp, Artificial
  CRISPR gRNA sequence
ttccaaagtatttagcatag

SEQ ID NO: 602737 - DNA, 20 bp, Artificial
  CRISPR gRNA sequence
tttagcatagcagttcaatg

SEQ ID NO: 602738 - DNA, 20 bp, Artificial
  CRISPR gRNA sequence
catagcagttcaatgaagtt

SEQ ID NO: 602739 - DNA, 20 bp, Artificial
  CRISPR gRNA sequence
atagcagttcaatgaagttc

SEQ ID NO: 602740 - DNA, 20 bp, Artificial
  CRISPR gRNA sequence
tagcagttcaatgaagttca

SEQ ID NO: 602741 - DNA, 20 bp, Artificial
  CRISPR gRNA sequence
agcagttcaatgaagttcag

SEQ ID NO: 602742 - DNA, 20 bp, Artificial
  CRISPR gRNA sequence
gaaatctgaattcttatatc

SEQ ID NO: 602743 - DNA, 20 bp, Artificial
  CRISPR gRNA sequence
aagaaaccttgtcatccata

SEQ ID NO: 602744 - DNA, 20 bp, Artificial
  CRISPR gRNA sequence
catccatatagccattctat

SEQ ID NO: 602745 - DNA, 20 bp, Artificial
  CRISPR gRNA sequence
atccatatagccattctatt

SEQ ID NO: 602746 - DNA, 20 bp, Artificial
  CRISPR gRNA sequence
tccatatagccattctatta

SEQ ID NO: 602747 - DNA, 20 bp, Artificial
  CRISPR gRNA sequence
ccatatagccattctattag

SEQ ID NO: 602748 - DNA, 20 bp, Artificial
  CRISPR gRNA sequence
tagccattctattaggggaa

SEQ ID NO: 602749 - DNA, 20 bp, Artificial
  CRISPR gRNA sequence
gaaaagattgtgtatctaat

SEQ ID NO: 602750 - DNA, 20 bp, Artificial
  CRISPR gRNA sequence
aagattgtgtatctaataag

SEQ ID NO: 602751 - DNA, 20 bp, Artificial
  CRISPR gRNA sequence
attgtgtatctaataagaag

SEQ ID NO: 602752 - DNA, 20 bp, Artificial
  CRISPR gRNA sequence
ctaataagaagtagcaaaca

SEQ ID NO: 602753 - DNA, 20 bp, Artificial
  CRISPR gRNA sequence
gaagtagcaaacaaagaata

SEQ ID NO: 602754 - DNA, 20 bp, Artificial
  CRISPR gRNA sequence
tagcaaacaaagaatacaga

SEQ ID NO: 602755 - DNA, 20 bp, Artificial
  CRISPR gRNA sequence
ttatacaattaattacattt

SEQ ID NO: 602756 - DNA, 20 bp, Artificial
  CRISPR gRNA sequence
attaattacatttaagttgc

SEQ ID NO: 602757 - DNA, 20 bp, Artificial
  CRISPR gRNA sequence
ttaattacatttaagttgct

SEQ ID NO: 602758 - DNA, 20 bp, Artificial
  CRISPR gRNA sequence
ttacatttaagttgctaggt

SEQ ID NO: 602759 - DNA, 20 bp, Artificial
  CRISPR gRNA sequence
tacatttaagttgctaggtg

SEQ ID NO: 602760 - DNA, 20 bp, Artificial
  CRISPR gRNA sequence
taagttgctaggtgaggtat

SEQ ID NO: 602761 - DNA, 20 bp, Artificial
  CRISPR gRNA sequence
aagttgctaggtgaggtata

SEQ ID NO: 602762 - DNA, 20 bp, Artificial
  CRISPR gRNA sequence
agttgctaggtgaggtataa

SEQ ID NO: 602763 - DNA, 20 bp, Artificial
  CRISPR gRNA sequence
ctaggtgaggtataagggaa

SEQ ID NO: 602764 - DNA, 20 bp, Artificial
  CRISPR gRNA sequence
aagggaatagataccttgtg

SEQ ID NO: 602765 - DNA, 20 bp, Artificial
  CRISPR gRNA sequence
agggaatagataccttgtgc

SEQ ID NO: 602766 - DNA, 20 bp, Artificial
  CRISPR gRNA sequence
agataccttgtgcaggatgt

SEQ ID NO: 602767 - DNA, 20 bp, Artificial
  CRISPR gRNA sequence
gataccttgtgcaggatgta

SEQ ID NO: 602768 - DNA, 20 bp, Artificial
  CRISPR gRNA sequence
ttgtgcaggatgtaaggaat

SEQ ID NO: 602769 - DNA, 20 bp, Artificial
  CRISPR gRNA sequence
tgtgcaggatgtaaggaata

SEQ ID NO: 602770 - DNA, 20 bp, Artificial
  CRISPR gRNA sequence
ttctttttctttcctatttc

SEQ ID NO: 602771 - DNA, 20 bp, Artificial
  CRISPR gRNA sequence
tttctttcctatttcaagac

SEQ ID NO: 602772 - DNA, 20 bp, Artificial
  CRISPR gRNA sequence
ctttcctatttcaagactgg

SEQ ID NO: 602773 - DNA, 20 bp, Artificial
  CRISPR gRNA sequence
ttcctatttcaagactggta

SEQ ID NO: 602774 - DNA, 20 bp, Artificial
  CRISPR gRNA sequence
caagactggtagagaactct

SEQ ID NO: 602775 - DNA, 20 bp, Artificial
  CRISPR gRNA sequence
ctctgagtttgtcaattgat

SEQ ID NO: 602776 - DNA, 20 bp, Artificial
  CRISPR gRNA sequence
gagtttgtcaattgattagc

SEQ ID NO: 602777 - DNA, 20 bp, Artificial
  CRISPR gRNA sequence
gattagcaagttgaattcct

SEQ ID NO: 602778 - DNA, 20 bp, Artificial
  CRISPR gRNA sequence
ttgaattccttggaaacaca

SEQ ID NO: 602779 - DNA, 20 bp, Artificial
  CRISPR gRNA sequence
tgaattccttggaaacacat

SEQ ID NO: 602780 - DNA, 20 bp, Artificial
  CRISPR gRNA sequence
tccttggaaacacataggca

SEQ ID NO: 602781 - DNA, 20 bp, Artificial
  CRISPR gRNA sequence
cataggcaaagcctaccctt

SEQ ID NO: 602782 - DNA, 20 bp, Artificial
  CRISPR gRNA sequence
gcaaagcctacccttgagaa

SEQ ID NO: 602783 - DNA, 20 bp, Artificial
  CRISPR gRNA sequence
ccttgagaaaagatgaaacc

SEQ ID NO: 602784 - DNA, 20 bp, Artificial
  CRISPR gRNA sequence
gttgttgttgtatacttatt

SEQ ID NO: 602785 - DNA, 20 bp, Artificial
  CRISPR gRNA sequence
ttgttgttgtatacttattc

SEQ ID NO: 602786 - DNA, 20 bp, Artificial
  CRISPR gRNA sequence
tgtatacttattcaggaaat

SEQ ID NO: 602787 - DNA, 20 bp, Artificial
  CRISPR gRNA sequence
aaataagttgtatacttatt

SEQ ID NO: 602788 - DNA, 20 bp, Artificial
  CRISPR gRNA sequence
aataagttgtatacttattc

SEQ ID NO: 602789 - DNA, 20 bp, Artificial
  CRISPR gRNA sequence
gttgtatacttattcaggtt

SEQ ID NO: 602790 - DNA, 20 bp, Artificial
  CRISPR gRNA sequence
caccctgtactttctacaca

SEQ ID NO: 602791 - DNA, 20 bp, Artificial
  CRISPR gRNA sequence
accctgtactttctacacat

SEQ ID NO: 602792 - DNA, 20 bp, Artificial
  CRISPR gRNA sequence
tgggaaactgaaatactctt

SEQ ID NO: 602793 - DNA, 20 bp, Artificial
  CRISPR gRNA sequence
ggaaactgaaatactcttga

SEQ ID NO: 602794 - DNA, 20 bp, Artificial
  CRISPR gRNA sequence
aactgaaatactcttgagag

SEQ ID NO: 602795 - DNA, 20 bp, Artificial
  CRISPR gRNA sequence
ctgaaatactcttgagagca

SEQ ID NO: 602796 - DNA, 20 bp, Artificial
  CRISPR gRNA sequence
aatactcttgagagcagaga

SEQ ID NO: 602797 - DNA, 20 bp, Artificial
  CRISPR gRNA sequence
acgtgaaaaattatgcatcc

SEQ ID NO: 602798 - DNA, 20 bp, Artificial
  CRISPR gRNA sequence
atgcatccaagtgtgtcgtg

SEQ ID NO: 602799 - DNA, 20 bp, Artificial
  CRISPR gRNA sequence
aagtgtgtcgtgtagttttg

SEQ ID NO: 602800 - DNA, 20 bp, Artificial
  CRISPR gRNA sequence
tcgtgtagttttgtagctcc

SEQ ID NO: 602801 - DNA, 20 bp, Artificial
  CRISPR gRNA sequence
ttgtagctcctggtctgtcc

SEQ ID NO: 602802 - DNA, 20 bp, Artificial
  CRISPR gRNA sequence
tgtagctcctggtctgtccc

SEQ ID NO: 602803 - DNA, 20 bp, Artificial
  CRISPR gRNA sequence
ctcctggtctgtcccgggaa

SEQ ID NO: 602804 - DNA, 20 bp, Artificial
  CRISPR gRNA sequence
tcctggtctgtcccgggaac

SEQ ID NO: 602805 - DNA, 20 bp, Artificial
  CRISPR gRNA sequence
ggtctgtcccgggaacggga

SEQ ID NO: 602806 - DNA, 20 bp, Artificial
  CRISPR gRNA sequence
cccgggaacgggatggtttg

SEQ ID NO: 602807 - DNA, 20 bp, Artificial
  CRISPR gRNA sequence
cgggatggtttgcagactgt

SEQ ID NO: 602808 - DNA, 20 bp, Artificial
  CRISPR gRNA sequence
ggatggtttgcagactgtta

SEQ ID NO: 602809 - DNA, 20 bp, Artificial
  CRISPR gRNA sequence
atggtttgcagactgttaga

SEQ ID NO: 602810 - DNA, 20 bp, Artificial
  CRISPR gRNA sequence
gactgttagagagtatgctg

SEQ ID NO: 602811 - DNA, 20 bp, Artificial
  CRISPR gRNA sequence
actgttagagagtatgctga

SEQ ID NO: 602812 - DNA, 20 bp, Artificial
  CRISPR gRNA sequence
agagtatgctgaaggttacc

SEQ ID NO: 602813 - DNA, 20 bp, Artificial
  CRISPR gRNA sequence
gagtatgctgaaggttacct

SEQ ID NO: 602814 - DNA, 20 bp, Artificial
  CRISPR gRNA sequence
gctgaaggttacctaggacc

SEQ ID NO: 602815 - DNA, 20 bp, Artificial
  CRISPR gRNA sequence
ctgaaggttacctaggacct

SEQ ID NO: 602816 - DNA, 20 bp, Artificial
  CRISPR gRNA sequence
tgggtttgttctttgaccta

SEQ ID NO: 602817 - DNA, 20 bp, Artificial
  CRISPR gRNA sequence
tttgacctaaagataatccc

SEQ ID NO: 602818 - DNA, 20 bp, Artificial
  CRISPR gRNA sequence
ttgacctaaagataatccct

SEQ ID NO: 602819 - DNA, 20 bp, Artificial
  CRISPR gRNA sequence
acctaaagataatccctagg

SEQ ID NO: 602820 - DNA, 20 bp, Artificial
  CRISPR gRNA sequence
taaagataatccctaggcag

SEQ ID NO: 602821 - DNA, 20 bp, Artificial
  CRISPR gRNA sequence
aaagataatccctaggcaga

SEQ ID NO: 602822 - DNA, 20 bp, Artificial
  CRISPR gRNA sequence
cctttcccccttctgcacaa

SEQ ID NO: 602823 - DNA, 20 bp, Artificial
  CRISPR gRNA sequence
ttcccccttctgcacaatgg

SEQ ID NO: 602824 - DNA, 20 bp, Artificial
  CRISPR gRNA sequence
gcacaatggcagtttcatga

SEQ ID NO: 602825 - DNA, 20 bp, Artificial
  CRISPR gRNA sequence
acaatggcagtttcatgaca

SEQ ID NO: 602826 - DNA, 20 bp, Artificial
  CRISPR gRNA sequence
aaaatcacatttaaaaatat

SEQ ID NO: 602827 - DNA, 20 bp, Artificial
  CRISPR gRNA sequence
aaatcacatttaaaaatatc

SEQ ID NO: 602828 - DNA, 20 bp, Artificial
  CRISPR gRNA sequence
tttaaaaatatcaggcttcc

SEQ ID NO: 602829 - DNA, 20 bp, Artificial
  CRISPR gRNA sequence
ggcttccaagttcttttgtg

SEQ ID NO: 602830 - DNA, 20 bp, Artificial
  CRISPR gRNA sequence
gtgtgtgtgcgcgcgcgcgc

SEQ ID NO: 602831 - DNA, 20 bp, Artificial
  CRISPR gRNA sequence
gcgcatgtgtgcgtgcacac

SEQ ID NO: 602832 - DNA, 20 bp, Artificial
  CRISPR gRNA sequence
cgcatgtgtgcgtgcacaca

SEQ ID NO: 602833 - DNA, 20 bp, Artificial
  CRISPR gRNA sequence
actgaaaataatccttgaat

SEQ ID NO: 602834 - DNA, 20 bp, Artificial
  CRISPR gRNA sequence
tccttgaatcagttacttaa

SEQ ID NO: 602835 - DNA, 20 bp, Artificial
  CRISPR gRNA sequence
gttacttaaaagtgacccca

SEQ ID NO: 602836 - DNA, 20 bp, Artificial
  CRISPR gRNA sequence
ttacttaaaagtgaccccaa

SEQ ID NO: 602837 - DNA, 20 bp, Artificial
  CRISPR gRNA sequence
aagtgaccccaaaggtcatt

SEQ ID NO: 602838 - DNA, 20 bp, Artificial
  CRISPR gRNA sequence
ttagaacaacttccttaaca

SEQ ID NO: 602839 - DNA, 20 bp, Artificial
  CRISPR gRNA sequence
aacaacttccttaacaaagc

SEQ ID NO: 602840 - DNA, 20 bp, Artificial
  CRISPR gRNA sequence
caaagcaagaatatccttga

SEQ ID NO: 602841 - DNA, 20 bp, Artificial
  CRISPR gRNA sequence
atccttgacagcatgcatga

SEQ ID NO: 602842 - DNA, 20 bp, Artificial
  CRISPR gRNA sequence
tccttgacagcatgcatgac

SEQ ID NO: 602843 - DNA, 20 bp, Artificial
  CRISPR gRNA sequence
ttgacagcatgcatgacagg

SEQ ID NO: 602844 - DNA, 20 bp, Artificial
  CRISPR gRNA sequence
catgcatgacaggtggtctc

SEQ ID NO: 602845 - DNA, 20 bp, Artificial
  CRISPR gRNA sequence
atgcatgacaggtggtctct

SEQ ID NO: 602846 - DNA, 20 bp, Artificial
  CRISPR gRNA sequence
ggattttgcttgactgcttc

SEQ ID NO: 602847 - DNA, 20 bp, Artificial
  CRISPR gRNA sequence
tgcttgactgcttcaagtgc

SEQ ID NO: 602848 - DNA, 20 bp, Artificial
  CRISPR gRNA sequence
cttgactgcttcaagtgcta

SEQ ID NO: 602849 - DNA, 20 bp, Artificial
  CRISPR gRNA sequence
ttgactgcttcaagtgctag

SEQ ID NO: 602850 - DNA, 20 bp, Artificial
  CRISPR gRNA sequence
ctgcttcaagtgctagagga

SEQ ID NO: 602851 - DNA, 20 bp, Artificial
  CRISPR gRNA sequence
tgcttcaagtgctagaggaa

SEQ ID NO: 602852 - DNA, 20 bp, Artificial
  CRISPR gRNA sequence
ttcaagtgctagaggaaagg

SEQ ID NO: 602853 - DNA, 20 bp, Artificial
  CRISPR gRNA sequence
tttactgttccattgctgat

SEQ ID NO: 602854 - DNA, 20 bp, Artificial
  CRISPR gRNA sequence
tgctgatcagctctaattct

SEQ ID NO: 602855 - DNA, 20 bp, Artificial
  CRISPR gRNA sequence
gatcagctctaattcttaga

SEQ ID NO: 602856 - DNA, 20 bp, Artificial
  CRISPR gRNA sequence
agaaagttcttccttatatt

SEQ ID NO: 602857 - DNA, 20 bp, Artificial
  CRISPR gRNA sequence
cactgcttttttttttcact

SEQ ID NO: 602858 - DNA, 20 bp, Artificial
  CRISPR gRNA sequence
tttttttttcactaagactc

SEQ ID NO: 602859 - DNA, 20 bp, Artificial
  CRISPR gRNA sequence
actcaagctaaatatctcac

SEQ ID NO: 602860 - DNA, 20 bp, Artificial
  CRISPR gRNA sequence
gctaaatatctcacaagttt

SEQ ID NO: 602861 - DNA, 20 bp, Artificial
  CRISPR gRNA sequence
ttagatgctttgttatgtat

SEQ ID NO: 602862 - DNA, 20 bp, Artificial
  CRISPR gRNA sequence
ttgttatgtattagtgcttg

SEQ ID NO: 602863 - DNA, 20 bp, Artificial
  CRISPR gRNA sequence
gttatgtattagtgcttgta

SEQ ID NO: 602864 - DNA, 20 bp, Artificial
  CRISPR gRNA sequence
atgtattagtgcttgtagag

SEQ ID NO: 602865 - DNA, 20 bp, Artificial
  CRISPR gRNA sequence
tgtattagtgcttgtagagc

SEQ ID NO: 602866 - DNA, 20 bp, Artificial
  CRISPR gRNA sequence
ttgtagagcaggctttcatg

SEQ ID NO: 602867 - DNA, 20 bp, Artificial
  CRISPR gRNA sequence
tgtagagcaggctttcatgt

SEQ ID NO: 602868 - DNA, 20 bp, Artificial
  CRISPR gRNA sequence
caggctttcatgtaggtttt

SEQ ID NO: 602869 - DNA, 20 bp, Artificial
  CRISPR gRNA sequence
ggctttcatgtaggttttta

SEQ ID NO: 602870 - DNA, 20 bp, Artificial
  CRISPR gRNA sequence
gtttttagagtgttttgcat

SEQ ID NO: 602871 - DNA, 20 bp, Artificial
  CRISPR gRNA sequence
tttgcattggcccttgtatt

SEQ ID NO: 602872 - DNA, 20 bp, Artificial
  CRISPR gRNA sequence
atactatcatcatttcttct

SEQ ID NO: 602873 - DNA, 20 bp, Artificial
  CRISPR gRNA sequence
tactatcatcatttcttctg

SEQ ID NO: 602874 - DNA, 20 bp, Artificial
  CRISPR gRNA sequence
tcttctgaggaatgatgctc

SEQ ID NO: 602875 - DNA, 20 bp, Artificial
  CRISPR gRNA sequence
cttctgaggaatgatgctct

SEQ ID NO: 602876 - DNA, 20 bp, Artificial
  CRISPR gRNA sequence
gaggaatgatgctctaggtg

SEQ ID NO: 602877 - DNA, 20 bp, Artificial
  CRISPR gRNA sequence
tttttccacctttgtaccaa

SEQ ID NO: 602878 - DNA, 20 bp, Artificial
  CRISPR gRNA sequence
acctttgtaccaacagctgc

SEQ ID NO: 602879 - DNA, 20 bp, Artificial
  CRISPR gRNA sequence
tgtaccaacagctgcaagta

SEQ ID NO: 602880 - DNA, 20 bp, Artificial
  CRISPR gRNA sequence
agctgcaagtaaagcatgtt

SEQ ID NO: 602881 - DNA, 20 bp, Artificial
  CRISPR gRNA sequence
caagtaaagcatgttaagta

SEQ ID NO: 602882 - DNA, 20 bp, Artificial
  CRISPR gRNA sequence
tgtatcttattgttactttt

SEQ ID NO: 602883 - DNA, 20 bp, Artificial
  CRISPR gRNA sequence
ttattttattattatacttt

SEQ ID NO: 602884 - DNA, 20 bp, Artificial
  CRISPR gRNA sequence
tattattatactttaagttc

SEQ ID NO: 602885 - DNA, 20 bp, Artificial
  CRISPR gRNA sequence
attattatactttaagttct

SEQ ID NO: 602886 - DNA, 20 bp, Artificial
  CRISPR gRNA sequence
ttattatactttaagttcta

SEQ ID NO: 602887 - DNA, 20 bp, Artificial
  CRISPR gRNA sequence
ctagggtacatgtgcacaac

SEQ ID NO: 602888 - DNA, 20 bp, Artificial
  CRISPR gRNA sequence
gggtacatgtgcacaacaag

SEQ ID NO: 602889 - DNA, 20 bp, Artificial
  CRISPR gRNA sequence
ggtacatgtgcacaacaagc

SEQ ID NO: 602890 - DNA, 20 bp, Artificial
  CRISPR gRNA sequence
tatgtttacatgtgccatgt

SEQ ID NO: 602891 - DNA, 20 bp, Artificial
  CRISPR gRNA sequence
tattaacttgtcatttacat

SEQ ID NO: 602892 - DNA, 20 bp, Artificial
  CRISPR gRNA sequence
attaacttgtcatttacatt

SEQ ID NO: 602893 - DNA, 20 bp, Artificial
  CRISPR gRNA sequence
tacattaggtatatcctttt

SEQ ID NO: 602894 - DNA, 20 bp, Artificial
  CRISPR gRNA sequence
tcgacaattcaaataactta

SEQ ID NO: 602895 - DNA, 20 bp, Artificial
  CRISPR gRNA sequence
tacaaaaactatgcctattt

SEQ ID NO: 602896 - DNA, 20 bp, Artificial
  CRISPR gRNA sequence
aactatgcctattttggaaa

SEQ ID NO: 602897 - DNA, 20 bp, Artificial
  CRISPR gRNA sequence
tacaattttgactttgtgca

SEQ ID NO: 602898 - DNA, 20 bp, Artificial
  CRISPR gRNA sequence
gactttgtgcatagaatttt

SEQ ID NO: 602899 - DNA, 20 bp, Artificial
  CRISPR gRNA sequence
tttgtgcatagaattttgag

SEQ ID NO: 602900 - DNA, 20 bp, Artificial
  CRISPR gRNA sequence
actataaaacctgatgcttt

SEQ ID NO: 602901 - DNA, 20 bp, Artificial
  CRISPR gRNA sequence
ctataaaacctgatgctttg

SEQ ID NO: 602902 - DNA, 20 bp, Artificial
  CRISPR gRNA sequence
cctgatgctttgaggcttaa

SEQ ID NO: 602903 - DNA, 20 bp, Artificial
  CRISPR gRNA sequence
gatgctttgaggcttaaaag

SEQ ID NO: 602904 - DNA, 20 bp, Artificial
  CRISPR gRNA sequence
atgctttgaggcttaaaagt

SEQ ID NO: 602905 - DNA, 20 bp, Artificial
  CRISPR gRNA sequence
aggcttaaaagtaggacata

SEQ ID NO: 602906 - DNA, 20 bp, Artificial
  CRISPR gRNA sequence
taaaagtaggacataaagtg

SEQ ID NO: 602907 - DNA, 20 bp, Artificial
  CRISPR gRNA sequence
aagtaggacataaagtgaag

SEQ ID NO: 602908 - DNA, 20 bp, Artificial
  CRISPR gRNA sequence
agtaggacataaagtgaaga

SEQ ID NO: 602909 - DNA, 20 bp, Artificial
  CRISPR gRNA sequence
acataaagtgaagaaggcta

SEQ ID NO: 602910 - DNA, 20 bp, Artificial
  CRISPR gRNA sequence
cataaagtgaagaaggctat

SEQ ID NO: 602911 - DNA, 20 bp, Artificial
  CRISPR gRNA sequence
ataaagtgaagaaggctata

SEQ ID NO: 602912 - DNA, 20 bp, Artificial
  CRISPR gRNA sequence
aaagtgaagaaggctatagg

SEQ ID NO: 602913 - DNA, 20 bp, Artificial
  CRISPR gRNA sequence
gatgttacaaaactcacatg

SEQ ID NO: 602914 - DNA, 20 bp, Artificial
  CRISPR gRNA sequence
atgttacaaaactcacatga

SEQ ID NO: 602915 - DNA, 20 bp, Artificial
  CRISPR gRNA sequence
ttacaaaactcacatgaagg

SEQ ID NO: 602916 - DNA, 20 bp, Artificial
  CRISPR gRNA sequence
aaggaagtatgatcatcttt

SEQ ID NO: 602917 - DNA, 20 bp, Artificial
  CRISPR gRNA sequence
aggaagtatgatcatctttc

SEQ ID NO: 602918 - DNA, 20 bp, Artificial
  CRISPR gRNA sequence
tttcaggattttactttgct

SEQ ID NO: 602919 - DNA, 20 bp, Artificial
  CRISPR gRNA sequence
ttcaggattttactttgctt

SEQ ID NO: 602920 - DNA, 20 bp, Artificial
  CRISPR gRNA sequence
attttactttgcttaggttg

SEQ ID NO: 602921 - DNA, 20 bp, Artificial
  CRISPR gRNA sequence
taggttgtggaaattcatca

SEQ ID NO: 602922 - DNA, 20 bp, Artificial
  CRISPR gRNA sequence
ggaaattcatcacggttttc

SEQ ID NO: 602923 - DNA, 20 bp, Artificial
  CRISPR gRNA sequence
ttttccagctgacatttctt

SEQ ID NO: 602924 - DNA, 20 bp, Artificial
  CRISPR gRNA sequence
ccagctgacatttcttaaga

SEQ ID NO: 602925 - DNA, 20 bp, Artificial
  CRISPR gRNA sequence
catttcttaagaaagattcc

SEQ ID NO: 602926 - DNA, 20 bp, Artificial
  CRISPR gRNA sequence
atttcttaagaaagattcct

SEQ ID NO: 602927 - DNA, 20 bp, Artificial
  CRISPR gRNA sequence
agaaagattcctaggtgaaa

SEQ ID NO: 602928 - DNA, 20 bp, Artificial
  CRISPR gRNA sequence
cctaggtgaaaaagataata

SEQ ID NO: 602929 - DNA, 20 bp, Artificial
  CRISPR gRNA sequence
taggtgaaaaagataatatg

SEQ ID NO: 602930 - DNA, 20 bp, Artificial
  CRISPR gRNA sequence
gataatatggagtctactga

SEQ ID NO: 602931 - DNA, 20 bp, Artificial
  CRISPR gRNA sequence
aatatggagtctactgaaag

SEQ ID NO: 602932 - DNA, 20 bp, Artificial
  CRISPR gRNA sequence
gagtctactgaaagtggttg

SEQ ID NO: 602933 - DNA, 20 bp, Artificial
  CRISPR gRNA sequence
agtctactgaaagtggttgt

SEQ ID NO: 602934 - DNA, 20 bp, Artificial
  CRISPR gRNA sequence
gcatccacatttcttcctct

SEQ ID NO: 602935 - DNA, 20 bp, Artificial
  CRISPR gRNA sequence
catccacatttcttcctctg

SEQ ID NO: 602936 - DNA, 20 bp, Artificial
  CRISPR gRNA sequence
atttcttcctctgaggatat

SEQ ID NO: 602937 - DNA, 20 bp, Artificial
  CRISPR gRNA sequence
gatattagcaacacttgaat

SEQ ID NO: 602938 - DNA, 20 bp, Artificial
  CRISPR gRNA sequence
ttcttatttctcccttgcct

SEQ ID NO: 602939 - DNA, 20 bp, Artificial
  CRISPR gRNA sequence
ttatttctcccttgcctgag

SEQ ID NO: 602940 - DNA, 20 bp, Artificial
  CRISPR gRNA sequence
tttctcccttgcctgagtgg

SEQ ID NO: 602941 - DNA, 20 bp, Artificial
  CRISPR gRNA sequence
cagttttactgtgcctttat

SEQ ID NO: 602942 - DNA, 20 bp, Artificial
  CRISPR gRNA sequence
attggatttactgttgtaat

SEQ ID NO: 602943 - DNA, 20 bp, Artificial
  CRISPR gRNA sequence
tttactgttgtaattggata

SEQ ID NO: 602944 - DNA, 20 bp, Artificial
  CRISPR gRNA sequence
aattggatatggaattgtgc

SEQ ID NO: 602945 - DNA, 20 bp, Artificial
  CRISPR gRNA sequence
attggatatggaattgtgcc

SEQ ID NO: 602946 - DNA, 20 bp, Artificial
  CRISPR gRNA sequence
ggatatggaattgtgccggg

SEQ ID NO: 602947 - DNA, 20 bp, Artificial
  CRISPR gRNA sequence
atatttcaatatgtgcacct

SEQ ID NO: 602948 - DNA, 20 bp, Artificial
  CRISPR gRNA sequence
accttagcaatctaaatcgt

SEQ ID NO: 602949 - DNA, 20 bp, Artificial
  CRISPR gRNA sequence
ccttagcaatctaaatcgtt

SEQ ID NO: 602950 - DNA, 20 bp, Artificial
  CRISPR gRNA sequence
agcaatctaaatcgttagga

SEQ ID NO: 602951 - DNA, 20 bp, Artificial
  CRISPR gRNA sequence
ggtgactcactcacatttaa

SEQ ID NO: 602952 - DNA, 20 bp, Artificial
  CRISPR gRNA sequence
gtgactcactcacatttaac

SEQ ID NO: 602953 - DNA, 20 bp, Artificial
  CRISPR gRNA sequence
tgactcactcacatttaaca

SEQ ID NO: 602954 - DNA, 20 bp, Artificial
  CRISPR gRNA sequence
ctcacatttaacagggaaat

SEQ ID NO: 602955 - DNA, 20 bp, Artificial
  CRISPR gRNA sequence
catttaacagggaaattagc

SEQ ID NO: 602956 - DNA, 20 bp, Artificial
  CRISPR gRNA sequence
tcgtctttgtgtgaacattt

SEQ ID NO: 602957 - DNA, 20 bp, Artificial
  CRISPR gRNA sequence
cgtctttgtgtgaacatttg

SEQ ID NO: 602958 - DNA, 20 bp, Artificial
  CRISPR gRNA sequence
tctttgtgtgaacatttgag

SEQ ID NO: 602959 - DNA, 20 bp, Artificial
  CRISPR gRNA sequence
ctttgtgtgaacatttgagg

SEQ ID NO: 602960 - DNA, 20 bp, Artificial
  CRISPR gRNA sequence
ttgtgtgaacatttgaggag

SEQ ID NO: 602961 - DNA, 20 bp, Artificial
  CRISPR gRNA sequence
atttgaggaggagctgaccc

SEQ ID NO: 602962 - DNA, 20 bp, Artificial
  CRISPR gRNA sequence
ggaggagctgaccctagctg

SEQ ID NO: 602963 - DNA, 20 bp, Artificial
  CRISPR gRNA sequence
tgcagaaatatcacgtgttc

SEQ ID NO: 602964 - DNA, 20 bp, Artificial
  CRISPR gRNA sequence
gcagaaatatcacgtgttcc

SEQ ID NO: 602965 - DNA, 20 bp, Artificial
  CRISPR gRNA sequence
cacgtgttccaggtcacctg

SEQ ID NO: 602966 - DNA, 20 bp, Artificial
  CRISPR gRNA sequence
aggtcacctgtggcaaaatc

SEQ ID NO: 602967 - DNA, 20 bp, Artificial
  CRISPR gRNA sequence
tggcaaaatctagccatgtg

SEQ ID NO: 602968 - DNA, 20 bp, Artificial
  CRISPR gRNA sequence
ggcaaaatctagccatgtga

SEQ ID NO: 602969 - DNA, 20 bp, Artificial
  CRISPR gRNA sequence
aatctagccatgtgaaggat

SEQ ID NO: 602970 - DNA, 20 bp, Artificial
  CRISPR gRNA sequence
tctagccatgtgaaggattg

SEQ ID NO: 602971 - DNA, 20 bp, Artificial
  CRISPR gRNA sequence
tggagtttcttttgattatc

SEQ ID NO: 602972 - DNA, 20 bp, Artificial
  CRISPR gRNA sequence
ggagtttcttttgattatct

SEQ ID NO: 602973 - DNA, 20 bp, Artificial
  CRISPR gRNA sequence
tttcttttgattatctaggc

SEQ ID NO: 602974 - DNA, 20 bp, Artificial
  CRISPR gRNA sequence
tgtcatccacctctttactt

SEQ ID NO: 602975 - DNA, 20 bp, Artificial
  CRISPR gRNA sequence
tccacctctttactttagtt

SEQ ID NO: 602976 - DNA, 20 bp, Artificial
  CRISPR gRNA sequence
cacctctttactttagtttg

SEQ ID NO: 602977 - DNA, 20 bp, Artificial
  CRISPR gRNA sequence
tttagtttggagaattattt

SEQ ID NO: 602978 - DNA, 20 bp, Artificial
  CRISPR gRNA sequence
agtttggagaattatttaag

SEQ ID NO: 602979 - DNA, 20 bp, Artificial
  CRISPR gRNA sequence
gtttggagaattatttaagt

SEQ ID NO: 602980 - DNA, 20 bp, Artificial
  CRISPR gRNA sequence
ttggagaattatttaagtag

SEQ ID NO: 602981 - DNA, 20 bp, Artificial
  CRISPR gRNA sequence
tatttaagtaggagaatcac

SEQ ID NO: 602982 - DNA, 20 bp, Artificial
  CRISPR gRNA sequence
aagtaggagaatcactggct

SEQ ID NO: 602983 - DNA, 20 bp, Artificial
  CRISPR gRNA sequence
atcactggctgagaaatgat

SEQ ID NO: 602984 - DNA, 20 bp, Artificial
  CRISPR gRNA sequence
aaatgattggatataaattt

SEQ ID NO: 602985 - DNA, 20 bp, Artificial
  CRISPR gRNA sequence
atgattggatataaatttaa

SEQ ID NO: 602986 - DNA, 20 bp, Artificial
  CRISPR gRNA sequence
tataaatttaagagctatgt

SEQ ID NO: 602987 - DNA, 20 bp, Artificial
  CRISPR gRNA sequence
cccatttaattatgtcactg

SEQ ID NO: 602988 - DNA, 20 bp, Artificial
  CRISPR gRNA sequence
taattatgtcactgcagatt

SEQ ID NO: 602989 - DNA, 20 bp, Artificial
  CRISPR gRNA sequence
tatgtcactgcagatttggt

SEQ ID NO: 602990 - DNA, 20 bp, Artificial
  CRISPR gRNA sequence
tgtcactgcagatttggtaa

SEQ ID NO: 602991 - DNA, 20 bp, Artificial
  CRISPR gRNA sequence
cagatttggtaagagtgttt

SEQ ID NO: 602992 - DNA, 20 bp, Artificial
  CRISPR gRNA sequence
tttggtaagagtgtttcagc

SEQ ID NO: 602993 - DNA, 20 bp, Artificial
  CRISPR gRNA sequence
ttggtaagagtgtttcagca

SEQ ID NO: 602994 - DNA, 20 bp, Artificial
  CRISPR gRNA sequence
agtgtttcagcaaggtcacg

SEQ ID NO: 602995 - DNA, 20 bp, Artificial
  CRISPR gRNA sequence
aaggtcacgtagtacttttc

SEQ ID NO: 602996 - DNA, 20 bp, Artificial
  CRISPR gRNA sequence
acttttctggtctgccatca

SEQ ID NO: 602997 - DNA, 20 bp, Artificial
  CRISPR gRNA sequence
ttctggtctgccatcatggc

SEQ ID NO: 602998 - DNA, 20 bp, Artificial
  CRISPR gRNA sequence
ctggtctgccatcatggcaa

SEQ ID NO: 602999 - DNA, 20 bp, Artificial
  CRISPR gRNA sequence
aagagacattatgaaattct

SEQ ID NO: 603000 - DNA, 20 bp, Artificial
  CRISPR gRNA sequence
agagacattatgaaattctt

SEQ ID NO: 603001 - DNA, 20 bp, Artificial
  CRISPR gRNA sequence
acattatgaaattcttagga

SEQ ID NO: 603002 - DNA, 20 bp, Artificial
  CRISPR gRNA sequence
aaaccaatttatttttaaaa

SEQ ID NO: 603003 - DNA, 20 bp, Artificial
  CRISPR gRNA sequence
tttttaaaatagttatgtca

SEQ ID NO: 603004 - DNA, 20 bp, Artificial
  CRISPR gRNA sequence
ttttaaaatagttatgtcat

SEQ ID NO: 603005 - DNA, 20 bp, Artificial
  CRISPR gRNA sequence
tttaaaatagttatgtcata

SEQ ID NO: 603006 - DNA, 20 bp, Artificial
  CRISPR gRNA sequence
tctcaaacttgcttgatcgt

SEQ ID NO: 603007 - DNA, 20 bp, Artificial
  CRISPR gRNA sequence
cttgatcgtaagaatcatct

SEQ ID NO: 603008 - DNA, 20 bp, Artificial
  CRISPR gRNA sequence
agatacttgaaaaaaataaa

SEQ ID NO: 603009 - DNA, 20 bp, Artificial
  CRISPR gRNA sequence
ttgaaaaaaataaacagtcc

SEQ ID NO: 603010 - DNA, 20 bp, Artificial
  CRISPR gRNA sequence
acagtcccagacctcaactc

SEQ ID NO: 603011 - DNA, 20 bp, Artificial
  CRISPR gRNA sequence
caagtatactgaatcaaaca

SEQ ID NO: 603012 - DNA, 20 bp, Artificial
  CRISPR gRNA sequence
ctgaatcaaacaaagtgttc

SEQ ID NO: 603013 - DNA, 20 bp, Artificial
  CRISPR gRNA sequence
tgaatcaaacaaagtgttca

SEQ ID NO: 603014 - DNA, 20 bp, Artificial
  CRISPR gRNA sequence
gaatcaaacaaagtgttcaa

SEQ ID NO: 603015 - DNA, 20 bp, Artificial
  CRISPR gRNA sequence
atcaaacaaagtgttcaagg

SEQ ID NO: 603016 - DNA, 20 bp, Artificial
  CRISPR gRNA sequence
tcaaacaaagtgttcaaggg

SEQ ID NO: 603017 - DNA, 20 bp, Artificial
  CRISPR gRNA sequence
aaacaaagtgttcaagggag

SEQ ID NO: 603018 - DNA, 20 bp, Artificial
  CRISPR gRNA sequence
aacaaagtgttcaagggagg

SEQ ID NO: 603019 - DNA, 20 bp, Artificial
  CRISPR gRNA sequence
caaagtgttcaagggaggag

SEQ ID NO: 603020 - DNA, 20 bp, Artificial
  CRISPR gRNA sequence
gcgactctaattctgataat

SEQ ID NO: 603021 - DNA, 20 bp, Artificial
  CRISPR gRNA sequence
cgactctaattctgataatc

SEQ ID NO: 603022 - DNA, 20 bp, Artificial
  CRISPR gRNA sequence
tctaattctgataatcaggc

SEQ ID NO: 603023 - DNA, 20 bp, Artificial
  CRISPR gRNA sequence
ttctgataatcaggcaagtt

SEQ ID NO: 603024 - DNA, 20 bp, Artificial
  CRISPR gRNA sequence
tctgataatcaggcaagttt

SEQ ID NO: 603025 - DNA, 20 bp, Artificial
  CRISPR gRNA sequence
gcaagtttaggaaatactgt

SEQ ID NO: 603026 - DNA, 20 bp, Artificial
  CRISPR gRNA sequence
gtttaggaaatactgtcaga

SEQ ID NO: 603027 - DNA, 20 bp, Artificial
  CRISPR gRNA sequence
actgtcagatagtatatgtg

SEQ ID NO: 603028 - DNA, 20 bp, Artificial
  CRISPR gRNA sequence
ctgtcagatagtatatgtgc

SEQ ID NO: 603029 - DNA, 20 bp, Artificial
  CRISPR gRNA sequence
tgtcagatagtatatgtgca

SEQ ID NO: 603030 - DNA, 20 bp, Artificial
  CRISPR gRNA sequence
atagtatatgtgcagggact

SEQ ID NO: 603031 - DNA, 20 bp, Artificial
  CRISPR gRNA sequence
tagtatatgtgcagggactt

SEQ ID NO: 603032 - DNA, 20 bp, Artificial
  CRISPR gRNA sequence
atatgtgcagggacttggga

SEQ ID NO: 603033 - DNA, 20 bp, Artificial
  CRISPR gRNA sequence
cagggacttgggaaagaaaa

SEQ ID NO: 603034 - DNA, 20 bp, Artificial
  CRISPR gRNA sequence
ggacttgggaaagaaaatag

SEQ ID NO: 603035 - DNA, 20 bp, Artificial
  CRISPR gRNA sequence
aagaaaatagtggttgctcc

SEQ ID NO: 603036 - DNA, 20 bp, Artificial
  CRISPR gRNA sequence
agaaaatagtggttgctcca

SEQ ID NO: 603037 - DNA, 20 bp, Artificial
  CRISPR gRNA sequence
aaaatagtggttgctccaag

SEQ ID NO: 603038 - DNA, 20 bp, Artificial
  CRISPR gRNA sequence
agtggttgctccaaggagct

SEQ ID NO: 603039 - DNA, 20 bp, Artificial
  CRISPR gRNA sequence
tccaaggagctaagatatta

SEQ ID NO: 603040 - DNA, 20 bp, Artificial
  CRISPR gRNA sequence
tttaccatcaatcactaaaa

SEQ ID NO: 603041 - DNA, 20 bp, Artificial
  CRISPR gRNA sequence
ctaaaatagtctctgctttt

SEQ ID NO: 603042 - DNA, 20 bp, Artificial
  CRISPR gRNA sequence
aaatagtctctgcttttcag

SEQ ID NO: 603043 - DNA, 20 bp, Artificial
  CRISPR gRNA sequence
agtctctgcttttcagaaga

SEQ ID NO: 603044 - DNA, 20 bp, Artificial
  CRISPR gRNA sequence
ctctgcttttcagaagatgg

SEQ ID NO: 603045 - DNA, 20 bp, Artificial
  CRISPR gRNA sequence
tgcttttcagaagatggtag

SEQ ID NO: 603046 - DNA, 20 bp, Artificial
  CRISPR gRNA sequence
acgtgactgaactgcatctt

SEQ ID NO: 603047 - DNA, 20 bp, Artificial
  CRISPR gRNA sequence
cgtgactgaactgcatcttt

SEQ ID NO: 603048 - DNA, 20 bp, Artificial
  CRISPR gRNA sequence
gtgactgaactgcatcttta

SEQ ID NO: 603049 - DNA, 20 bp, Artificial
  CRISPR gRNA sequence
ctgaactgcatctttagggt

SEQ ID NO: 603050 - DNA, 20 bp, Artificial
  CRISPR gRNA sequence
tgaactgcatctttagggtt

SEQ ID NO: 603051 - DNA, 20 bp, Artificial
  CRISPR gRNA sequence
actgcatctttagggttggg

SEQ ID NO: 603052 - DNA, 20 bp, Artificial
  CRISPR gRNA sequence
gcatctttagggttgggtgg

SEQ ID NO: 603053 - DNA, 20 bp, Artificial
  CRISPR gRNA sequence
catctttagggttgggtggt

SEQ ID NO: 603054 - DNA, 20 bp, Artificial
  CRISPR gRNA sequence
ctttagggttgggtggtagg

SEQ ID NO: 603055 - DNA, 20 bp, Artificial
  CRISPR gRNA sequence
tttagggttgggtggtaggc

SEQ ID NO: 603056 - DNA, 20 bp, Artificial
  CRISPR gRNA sequence
ttagggttgggtggtaggca

SEQ ID NO: 603057 - DNA, 20 bp, Artificial
  CRISPR gRNA sequence
agggttgggtggtaggcagg

SEQ ID NO: 603058 - DNA, 20 bp, Artificial
  CRISPR gRNA sequence
ggttgggtggtaggcaggga

SEQ ID NO: 603059 - DNA, 20 bp, Artificial
  CRISPR gRNA sequence
gtggtaggcagggagagttg

SEQ ID NO: 603060 - DNA, 20 bp, Artificial
  CRISPR gRNA sequence
ggagagttgtagctcttctc

SEQ ID NO: 603061 - DNA, 20 bp, Artificial
  CRISPR gRNA sequence
caagaaaaaactaaaaatgt

SEQ ID NO: 603062 - DNA, 20 bp, Artificial
  CRISPR gRNA sequence
tatgcataattttattattg

SEQ ID NO: 603063 - DNA, 20 bp, Artificial
  CRISPR gRNA sequence
ttgataatttttcctttgct

SEQ ID NO: 603064 - DNA, 20 bp, Artificial
  CRISPR gRNA sequence
ttttcctttgcttggctttc

SEQ ID NO: 603065 - DNA, 20 bp, Artificial
  CRISPR gRNA sequence
tttcctttgcttggctttct

SEQ ID NO: 603066 - DNA, 20 bp, Artificial
  CRISPR gRNA sequence
ctttctaggtctttttgatt

SEQ ID NO: 603067 - DNA, 20 bp, Artificial
  CRISPR gRNA sequence
ttatttctgcacttctctct

SEQ ID NO: 603068 - DNA, 20 bp, Artificial
  CRISPR gRNA sequence
ctctctcagttgtattcctt

SEQ ID NO: 603069 - DNA, 20 bp, Artificial
  CRISPR gRNA sequence
ttcagcctgttgacacaaaa

SEQ ID NO: 603070 - DNA, 20 bp, Artificial
  CRISPR gRNA sequence
atagacacatgttcctgttt

SEQ ID NO: 603071 - DNA, 20 bp, Artificial
  CRISPR gRNA sequence
acacatgttcctgtttcagc

SEQ ID NO: 603072 - DNA, 20 bp, Artificial
  CRISPR gRNA sequence
cacatgttcctgtttcagcc

SEQ ID NO: 603073 - DNA, 20 bp, Artificial
  CRISPR gRNA sequence
acatgttcctgtttcagcca

SEQ ID NO: 603074 - DNA, 20 bp, Artificial
  CRISPR gRNA sequence
atgttcctgtttcagccagg

SEQ ID NO: 603075 - DNA, 20 bp, Artificial
  CRISPR gRNA sequence
ttgtgcatctgttgacactt

SEQ ID NO: 603076 - DNA, 20 bp, Artificial
  CRISPR gRNA sequence
gttgacacttcagaaataat

SEQ ID NO: 603077 - DNA, 20 bp, Artificial
  CRISPR gRNA sequence
cacttcagaaataatcagtt

SEQ ID NO: 603078 - DNA, 20 bp, Artificial
  CRISPR gRNA sequence
ataatcagtttagatttcaa

SEQ ID NO: 603079 - DNA, 20 bp, Artificial
  CRISPR gRNA sequence
tttagatttcaacagctgat

SEQ ID NO: 603080 - DNA, 20 bp, Artificial
  CRISPR gRNA sequence
tgtgctgttctaaccaaact

SEQ ID NO: 603081 - DNA, 20 bp, Artificial
  CRISPR gRNA sequence
gctgttctaaccaaactgag

SEQ ID NO: 603082 - DNA, 20 bp, Artificial
  CRISPR gRNA sequence
ctgttctaaccaaactgaga

SEQ ID NO: 603083 - DNA, 20 bp, Artificial
  CRISPR gRNA sequence
caaactgagaaggaactctt

SEQ ID NO: 603084 - DNA, 20 bp, Artificial
  CRISPR gRNA sequence
tgagaaggaactcttcagaa

SEQ ID NO: 603085 - DNA, 20 bp, Artificial
  CRISPR gRNA sequence
ggaactcttcagaatggaaa

SEQ ID NO: 603086 - DNA, 20 bp, Artificial
  CRISPR gRNA sequence
gaaacagatattattctatt

SEQ ID NO: 603087 - DNA, 20 bp, Artificial
  CRISPR gRNA sequence
tttgtacaaatatgtaataa

SEQ ID NO: 603088 - DNA, 20 bp, Artificial
  CRISPR gRNA sequence
gccattttaaaccaatgctg

SEQ ID NO: 603089 - DNA, 20 bp, Artificial
  CRISPR gRNA sequence
aaccaatgctgtggttataa

SEQ ID NO: 603090 - DNA, 20 bp, Artificial
  CRISPR gRNA sequence
accaatgctgtggttataaa

SEQ ID NO: 603091 - DNA, 20 bp, Artificial
  CRISPR gRNA sequence
gttataaaaggcctttgctg

SEQ ID NO: 603092 - DNA, 20 bp, Artificial
  CRISPR gRNA sequence
tttttctttattgtacctca

SEQ ID NO: 603093 - DNA, 20 bp, Artificial
  CRISPR gRNA sequence
tttctttattgtacctcaaa

SEQ ID NO: 603094 - DNA, 20 bp, Artificial
  CRISPR gRNA sequence
ttctttattgtacctcaaag

SEQ ID NO: 603095 - DNA, 20 bp, Artificial
  CRISPR gRNA sequence
aaagaggctatcaaaatgtt

SEQ ID NO: 603096 - DNA, 20 bp, Artificial
  CRISPR gRNA sequence
ctatcaaaatgtttagtgac

SEQ ID NO: 603097 - DNA, 20 bp, Artificial
  CRISPR gRNA sequence
tttagtgaccagtattccac

SEQ ID NO: 603098 - DNA, 20 bp, Artificial
  CRISPR gRNA sequence
ttccacaagttgtaatatgc

SEQ ID NO: 603099 - DNA, 20 bp, Artificial
  CRISPR gRNA sequence
tccacaagttgtaatatgcc

SEQ ID NO: 603100 - DNA, 20 bp, Artificial
  CRISPR gRNA sequence
ccacaagttgtaatatgcca

SEQ ID NO: 603101 - DNA, 20 bp, Artificial
  CRISPR gRNA sequence
cacaagttgtaatatgccag

SEQ ID NO: 603102 - DNA, 20 bp, Artificial
  CRISPR gRNA sequence
taatcacaaacatttcataa

SEQ ID NO: 603103 - DNA, 20 bp, Artificial
  CRISPR gRNA sequence
cataatggtccttgtattta

SEQ ID NO: 603104 - DNA, 20 bp, Artificial
  CRISPR gRNA sequence
tatagcaactcaatgaatgt

SEQ ID NO: 603105 - DNA, 20 bp, Artificial
  CRISPR gRNA sequence
gcaactcaatgaatgttaga

SEQ ID NO: 603106 - DNA, 20 bp, Artificial
  CRISPR gRNA sequence
atgaatgttagaaagaatat

SEQ ID NO: 603107 - DNA, 20 bp, Artificial
  CRISPR gRNA sequence
aatgttagaaagaatattgg

SEQ ID NO: 603108 - DNA, 20 bp, Artificial
  CRISPR gRNA sequence
aaagaatattggtagaattc

SEQ ID NO: 603109 - DNA, 20 bp, Artificial
  CRISPR gRNA sequence
aagaatattggtagaattcc

SEQ ID NO: 603110 - DNA, 20 bp, Artificial
  CRISPR gRNA sequence
tatcatacatgatctgctaa

SEQ ID NO: 603111 - DNA, 20 bp, Artificial
  CRISPR gRNA sequence
acatgatctgctaacagttt

SEQ ID NO: 603112 - DNA, 20 bp, Artificial
  CRISPR gRNA sequence
tgctaacagtttcagaactc

SEQ ID NO: 603113 - DNA, 20 bp, Artificial
  CRISPR gRNA sequence
attgaattactactgaatgt

SEQ ID NO: 603114 - DNA, 20 bp, Artificial
  CRISPR gRNA sequence
actactgaatgtaagaaata

SEQ ID NO: 603115 - DNA, 20 bp, Artificial
  CRISPR gRNA sequence
aatgtaagaaatatagctaa

SEQ ID NO: 603116 - DNA, 20 bp, Artificial
  CRISPR gRNA sequence
agaaatatagctaatggtat

SEQ ID NO: 603117 - DNA, 20 bp, Artificial
  CRISPR gRNA sequence
tatagctaatggtatcagtg

SEQ ID NO: 603118 - DNA, 20 bp, Artificial
  CRISPR gRNA sequence
atggtatcagtgtagcaccc

SEQ ID NO: 603119 - DNA, 20 bp, Artificial
  CRISPR gRNA sequence
acccaagtactgatttgcct

SEQ ID NO: 603120 - DNA, 20 bp, Artificial
  CRISPR gRNA sequence
aagtactgatttgcctaaga

SEQ ID NO: 603121 - DNA, 20 bp, Artificial
  CRISPR gRNA sequence
agtactgatttgcctaagat

SEQ ID NO: 603122 - DNA, 20 bp, Artificial
  CRISPR gRNA sequence
actgatttgcctaagatagg

SEQ ID NO: 603123 - DNA, 20 bp, Artificial
  CRISPR gRNA sequence
ataggaagccatatctccat

SEQ ID NO: 603124 - DNA, 20 bp, Artificial
  CRISPR gRNA sequence
gaagccatatctccatgagc

SEQ ID NO: 603125 - DNA, 20 bp, Artificial
  CRISPR gRNA sequence
agccatatctccatgagctg

SEQ ID NO: 603126 - DNA, 20 bp, Artificial
  CRISPR gRNA sequence
tctccatgagctggagccaa

SEQ ID NO: 603127 - DNA, 20 bp, Artificial
  CRISPR gRNA sequence
ctccatgagctggagccaaa

SEQ ID NO: 603128 - DNA, 20 bp, Artificial
  CRISPR gRNA sequence
atgagctggagccaaaagga

SEQ ID NO: 603129 - DNA, 20 bp, Artificial
  CRISPR gRNA sequence
agctggagccaaaaggaaag

SEQ ID NO: 603130 - DNA, 20 bp, Artificial
  CRISPR gRNA sequence
ctggagccaaaaggaaagaa

SEQ ID NO: 603131 - DNA, 20 bp, Artificial
  CRISPR gRNA sequence
cgcttgtacaaatacttacc

SEQ ID NO: 603132 - DNA, 20 bp, Artificial
  CRISPR gRNA sequence
ttgaccttatatttctccaa

SEQ ID NO: 603133 - DNA, 20 bp, Artificial
  CRISPR gRNA sequence
tatatttctccaacagtctg

SEQ ID NO: 603134 - DNA, 20 bp, Artificial
  CRISPR gRNA sequence
tctccaacagtctgaagaaa

SEQ ID NO: 603135 - DNA, 20 bp, Artificial
  CRISPR gRNA sequence
aacagtctgaagaaatagat

SEQ ID NO: 603136 - DNA, 20 bp, Artificial
  CRISPR gRNA sequence
ctgaagaaatagatcagaaa

SEQ ID NO: 603137 - DNA, 20 bp, Artificial
  CRISPR gRNA sequence
tgaagaaatagatcagaaat

SEQ ID NO: 603138 - DNA, 20 bp, Artificial
  CRISPR gRNA sequence
aaatagatcagaaataggat

SEQ ID NO: 603139 - DNA, 20 bp, Artificial
  CRISPR gRNA sequence
aatagatcagaaataggatc

SEQ ID NO: 603140 - DNA, 20 bp, Artificial
  CRISPR gRNA sequence
atagatcagaaataggatca

SEQ ID NO: 603141 - DNA, 20 bp, Artificial
  CRISPR gRNA sequence
agatcagaaataggatcagg

SEQ ID NO: 603142 - DNA, 20 bp, Artificial
  CRISPR gRNA sequence
aataggatcagggagcataa

SEQ ID NO: 603143 - DNA, 20 bp, Artificial
  CRISPR gRNA sequence
atcagggagcataatagaat

SEQ ID NO: 603144 - DNA, 20 bp, Artificial
  CRISPR gRNA sequence
agggagcataatagaatcag

SEQ ID NO: 603145 - DNA, 20 bp, Artificial
  CRISPR gRNA sequence
tcagtagaaatattatataa

SEQ ID NO: 603146 - DNA, 20 bp, Artificial
  CRISPR gRNA sequence
gaaatattatataatagaaa

SEQ ID NO: 603147 - DNA, 20 bp, Artificial
  CRISPR gRNA sequence
ttatataatagaaacggaat

SEQ ID NO: 603148 - DNA, 20 bp, Artificial
  CRISPR gRNA sequence
ataatagaaacggaatcaga

SEQ ID NO: 603149 - DNA, 20 bp, Artificial
  CRISPR gRNA sequence
ggaatcagaaagcataaaac

SEQ ID NO: 603150 - DNA, 20 bp, Artificial
  CRISPR gRNA sequence
gaaagcataaaactagtttc

SEQ ID NO: 603151 - DNA, 20 bp, Artificial
  CRISPR gRNA sequence
cataaaactagtttctagaa

SEQ ID NO: 603152 - DNA, 20 bp, Artificial
  CRISPR gRNA sequence
agtttctagaaaagatccta

SEQ ID NO: 603153 - DNA, 20 bp, Artificial
  CRISPR gRNA sequence
gtttctagaaaagatcctat

SEQ ID NO: 603154 - DNA, 20 bp, Artificial
  CRISPR gRNA sequence
taactattatgcatcttgat

SEQ ID NO: 603155 - DNA, 20 bp, Artificial
  CRISPR gRNA sequence
tattatgcatcttgatcagt

SEQ ID NO: 603156 - DNA, 20 bp, Artificial
  CRISPR gRNA sequence
atgcatcttgatcagtcagc

SEQ ID NO: 603157 - DNA, 20 bp, Artificial
  CRISPR gRNA sequence
tcagtcagcaagtatctatt

SEQ ID NO: 603158 - DNA, 20 bp, Artificial
  CRISPR gRNA sequence
tttatgaaaaatattgtgta

SEQ ID NO: 603159 - DNA, 20 bp, Artificial
  CRISPR gRNA sequence
ttatgaaaaatattgtgtat

SEQ ID NO: 603160 - DNA, 20 bp, Artificial
  CRISPR gRNA sequence
gaaaaatattgtgtatagga

SEQ ID NO: 603161 - DNA, 20 bp, Artificial
  CRISPR gRNA sequence
aaaatattgtgtataggaca

SEQ ID NO: 603162 - DNA, 20 bp, Artificial
  CRISPR gRNA sequence
atattgtgtataggacagag

SEQ ID NO: 603163 - DNA, 20 bp, Artificial
  CRISPR gRNA sequence
ttgtgtataggacagagaag

SEQ ID NO: 603164 - DNA, 20 bp, Artificial
  CRISPR gRNA sequence
agaatgcattttttccttta

SEQ ID NO: 603165 - DNA, 20 bp, Artificial
  CRISPR gRNA sequence
aatgcattttttcctttaaa

SEQ ID NO: 603166 - DNA, 20 bp, Artificial
  CRISPR gRNA sequence
ttttttcctttaaagagaat

SEQ ID NO: 603167 - DNA, 20 bp, Artificial
  CRISPR gRNA sequence
ttaaagagaatcagatttca

SEQ ID NO: 603168 - DNA, 20 bp, Artificial
  CRISPR gRNA sequence
acataaataaaaaaattaaa

SEQ ID NO: 603169 - DNA, 20 bp, Artificial
  CRISPR gRNA sequence
taaataaaaaaattaaatag

SEQ ID NO: 603170 - DNA, 20 bp, Artificial
  CRISPR gRNA sequence
taaatagcagtttaatattt

SEQ ID NO: 603171 - DNA, 20 bp, Artificial
  CRISPR gRNA sequence
tagcagtttaatattttaga

SEQ ID NO: 603172 - DNA, 20 bp, Artificial
  CRISPR gRNA sequence
agcagtttaatattttagat

SEQ ID NO: 603173 - DNA, 20 bp, Artificial
  CRISPR gRNA sequence
cagtttaatattttagatgg

SEQ ID NO: 603174 - DNA, 20 bp, Artificial
  CRISPR gRNA sequence
aatattttagatgggagttt

SEQ ID NO: 603175 - DNA, 20 bp, Artificial
  CRISPR gRNA sequence
tagatgggagtttgagacat

SEQ ID NO: 603176 - DNA, 20 bp, Artificial
  CRISPR gRNA sequence
agatgggagtttgagacatt

SEQ ID NO: 603177 - DNA, 20 bp, Artificial
  CRISPR gRNA sequence
tttgagacattaggcaaaca

SEQ ID NO: 603178 - DNA, 20 bp, Artificial
  CRISPR gRNA sequence
aaattattttcatataatta

SEQ ID NO: 603179 - DNA, 20 bp, Artificial
  CRISPR gRNA sequence
attttcatataattaaagta

SEQ ID NO: 603180 - DNA, 20 bp, Artificial
  CRISPR gRNA sequence
ttcatataattaaagtacag

SEQ ID NO: 603181 - DNA, 20 bp, Artificial
  CRISPR gRNA sequence
ataattaaagtacagcagct

SEQ ID NO: 603182 - DNA, 20 bp, Artificial
  CRISPR gRNA sequence
taattaaagtacagcagctt

SEQ ID NO: 603183 - DNA, 20 bp, Artificial
  CRISPR gRNA sequence
gtacagcagcttgggcaaca

SEQ ID NO: 603184 - DNA, 20 bp, Artificial
  CRISPR gRNA sequence
ctacaaaaaatacaaaaaat

SEQ ID NO: 603185 - DNA, 20 bp, Artificial
  CRISPR gRNA sequence
aaaaaatacaaaaaattagc

SEQ ID NO: 603186 - DNA, 20 bp, Artificial
  CRISPR gRNA sequence
aaaaatacaaaaaattagct

SEQ ID NO: 603187 - DNA, 20 bp, Artificial
  CRISPR gRNA sequence
aaaaaattagctgggcgttg

SEQ ID NO: 603188 - DNA, 20 bp, Artificial
  CRISPR gRNA sequence
ggcgttgtggcacgtacccg

SEQ ID NO: 603189 - DNA, 20 bp, Artificial
  CRISPR gRNA sequence
gtggcacgtacccgtagtcc

SEQ ID NO: 603190 - DNA, 20 bp, Artificial
  CRISPR gRNA sequence
acccgtagtcccagctactt

SEQ ID NO: 603191 - DNA, 20 bp, Artificial
  CRISPR gRNA sequence
cccgtagtcccagctacttg

SEQ ID NO: 603192 - DNA, 20 bp, Artificial
  CRISPR gRNA sequence
ccgtagtcccagctacttga

SEQ ID NO: 603193 - DNA, 20 bp, Artificial
  CRISPR gRNA sequence
cgtagtcccagctacttgag

SEQ ID NO: 603194 - DNA, 20 bp, Artificial
  CRISPR gRNA sequence
tcccagctacttgaggggct

SEQ ID NO: 603195 - DNA, 20 bp, Artificial
  CRISPR gRNA sequence
cccagctacttgaggggctg

SEQ ID NO: 603196 - DNA, 20 bp, Artificial
  CRISPR gRNA sequence
gctacttgaggggctgaggt

SEQ ID NO: 603197 - DNA, 20 bp, Artificial
  CRISPR gRNA sequence
tacttgaggggctgaggtga

SEQ ID NO: 603198 - DNA, 20 bp, Artificial
  CRISPR gRNA sequence
acttgaggggctgaggtgag

SEQ ID NO: 603199 - DNA, 20 bp, Artificial
  CRISPR gRNA sequence
gtgagaggatcccttgaacc

SEQ ID NO: 603200 - DNA, 20 bp, Artificial
  CRISPR gRNA sequence
tgagaggatcccttgaaccc

SEQ ID NO: 603201 - DNA, 20 bp, Artificial
  CRISPR gRNA sequence
agaggatcccttgaacccag

SEQ ID NO: 603202 - DNA, 20 bp, Artificial
  CRISPR gRNA sequence
gaggatcccttgaacccagg

SEQ ID NO: 603203 - DNA, 20 bp, Artificial
  CRISPR gRNA sequence
tcccttgaacccaggaggtt

SEQ ID NO: 603204 - DNA, 20 bp, Artificial
  CRISPR gRNA sequence
cccttgaacccaggaggttg

SEQ ID NO: 603205 - DNA, 20 bp, Artificial
  CRISPR gRNA sequence
aacccaggaggttgaggctg

SEQ ID NO: 603206 - DNA, 20 bp, Artificial
  CRISPR gRNA sequence
caggaggttgaggctgcagt

SEQ ID NO: 603207 - DNA, 20 bp, Artificial
  CRISPR gRNA sequence
ggttgaggctgcagtgagcc

SEQ ID NO: 603208 - DNA, 20 bp, Artificial
  CRISPR gRNA sequence
aagatcttgcaactgcactc

SEQ ID NO: 603209 - DNA, 20 bp, Artificial
  CRISPR gRNA sequence
cttgcaactgcactccagcc

SEQ ID NO: 603210 - DNA, 20 bp, Artificial
  CRISPR gRNA sequence
ttgcaactgcactccagcct

SEQ ID NO: 603211 - DNA, 20 bp, Artificial
  CRISPR gRNA sequence
actccagcctgggttactac

SEQ ID NO: 603212 - DNA, 20 bp, Artificial
  CRISPR gRNA sequence
caaaaataaataaatatata

SEQ ID NO: 603213 - DNA, 20 bp, Artificial
  CRISPR gRNA sequence
ataaataaatatataaagtg

SEQ ID NO: 603214 - DNA, 20 bp, Artificial
  CRISPR gRNA sequence
taaataaatatataaagtgc

SEQ ID NO: 603215 - DNA, 20 bp, Artificial
  CRISPR gRNA sequence
aatatataaagtgcaggata

SEQ ID NO: 603216 - DNA, 20 bp, Artificial
  CRISPR gRNA sequence
tgcaggataaagtgatttct

SEQ ID NO: 603217 - DNA, 20 bp, Artificial
  CRISPR gRNA sequence
gcaggataaagtgatttctt

SEQ ID NO: 603218 - DNA, 20 bp, Artificial
  CRISPR gRNA sequence
tgatttcttaggactaattg

SEQ ID NO: 603219 - DNA, 20 bp, Artificial
  CRISPR gRNA sequence
gatttcttaggactaattgt

SEQ ID NO: 603220 - DNA, 20 bp, Artificial
  CRISPR gRNA sequence
attgtaggtcatctgccttc

SEQ ID NO: 603221 - DNA, 20 bp, Artificial
  CRISPR gRNA sequence
taggtcatctgccttccagt

SEQ ID NO: 603222 - DNA, 20 bp, Artificial
  CRISPR gRNA sequence
ggtcatctgccttccagtta

SEQ ID NO: 603223 - DNA, 20 bp, Artificial
  CRISPR gRNA sequence
ctgccttccagttagagtta

SEQ ID NO: 603224 - DNA, 20 bp, Artificial
  CRISPR gRNA sequence
aattaatcattgcctttctg

SEQ ID NO: 603225 - DNA, 20 bp, Artificial
  CRISPR gRNA sequence
ctgaatgactccccttacct

SEQ ID NO: 603226 - DNA, 20 bp, Artificial
  CRISPR gRNA sequence
tgaatgactccccttacctg

SEQ ID NO: 603227 - DNA, 20 bp, Artificial
  CRISPR gRNA sequence
ctccccttacctgaggaatg

SEQ ID NO: 603228 - DNA, 20 bp, Artificial
  CRISPR gRNA sequence
cctgaggaatgcagtctaat

SEQ ID NO: 603229 - DNA, 20 bp, Artificial
  CRISPR gRNA sequence
atgcagtctaataagctctt

SEQ ID NO: 603230 - DNA, 20 bp, Artificial
  CRISPR gRNA sequence
ctctttagcattttatacta

SEQ ID NO: 603231 - DNA, 20 bp, Artificial
  CRISPR gRNA sequence
atactacagcctttactaaa

SEQ ID NO: 603232 - DNA, 20 bp, Artificial
  CRISPR gRNA sequence
ttttcacatatactgtgctt

SEQ ID NO: 603233 - DNA, 20 bp, Artificial
  CRISPR gRNA sequence
catatactgtgcttcagcca

SEQ ID NO: 603234 - DNA, 20 bp, Artificial
  CRISPR gRNA sequence
atgaatccttctcctttcct

SEQ ID NO: 603235 - DNA, 20 bp, Artificial
  CRISPR gRNA sequence
tttctgtactttttctcaac

SEQ ID NO: 603236 - DNA, 20 bp, Artificial
  CRISPR gRNA sequence
ttctgtactttttctcaacc

SEQ ID NO: 603237 - DNA, 20 bp, Artificial
  CRISPR gRNA sequence
aaaactctcaatccttttca

SEQ ID NO: 603238 - DNA, 20 bp, Artificial
  CRISPR gRNA sequence
aaactctcaatccttttcaa

SEQ ID NO: 603239 - DNA, 20 bp, Artificial
  CRISPR gRNA sequence
ctcaatccttttcaaaggtc

SEQ ID NO: 603240 - DNA, 20 bp, Artificial
  CRISPR gRNA sequence
taactgcttatttgaatttt

SEQ ID NO: 603241 - DNA, 20 bp, Artificial
  CRISPR gRNA sequence
agttattccccatatttcta

SEQ ID NO: 603242 - DNA, 20 bp, Artificial
  CRISPR gRNA sequence
ccccatatttctatagcact

SEQ ID NO: 603243 - DNA, 20 bp, Artificial
  CRISPR gRNA sequence
gtatgtacatgtatctatta

SEQ ID NO: 603244 - DNA, 20 bp, Artificial
  CRISPR gRNA sequence
tatgtctttgtctcccatat

SEQ ID NO: 603245 - DNA, 20 bp, Artificial
  CRISPR gRNA sequence
tgtctcccatattagatttt

SEQ ID NO: 603246 - DNA, 20 bp, Artificial
  CRISPR gRNA sequence
tattagattttgagctcctc

SEQ ID NO: 603247 - DNA, 20 bp, Artificial
  CRISPR gRNA sequence
attagattttgagctcctct

SEQ ID NO: 603248 - DNA, 20 bp, Artificial
  CRISPR gRNA sequence
ttagattttgagctcctctg

SEQ ID NO: 603249 - DNA, 20 bp, Artificial
  CRISPR gRNA sequence
gattttgagctcctctgggg

SEQ ID NO: 603250 - DNA, 20 bp, Artificial
  CRISPR gRNA sequence
tataattttgccactgtacc

SEQ ID NO: 603251 - DNA, 20 bp, Artificial
  CRISPR gRNA sequence
aattttgccactgtacctgg

SEQ ID NO: 603252 - DNA, 20 bp, Artificial
  CRISPR gRNA sequence
ttttgccactgtacctggca

SEQ ID NO: 603253 - DNA, 20 bp, Artificial
  CRISPR gRNA sequence
ccactgtacctggcagagaa

SEQ ID NO: 603254 - DNA, 20 bp, Artificial
  CRISPR gRNA sequence
cactgtacctggcagagaat

SEQ ID NO: 603255 - DNA, 20 bp, Artificial
  CRISPR gRNA sequence
ttttatgaacaaatgactaa

SEQ ID NO: 603256 - DNA, 20 bp, Artificial
  CRISPR gRNA sequence
tttatgaacaaatgactaaa

SEQ ID NO: 603257 - DNA, 20 bp, Artificial
  CRISPR gRNA sequence
tatgaacaaatgactaaaag

SEQ ID NO: 603258 - DNA, 20 bp, Artificial
  CRISPR gRNA sequence
tgaacaaatgactaaaagga

SEQ ID NO: 603259 - DNA, 20 bp, Artificial
  CRISPR gRNA sequence
agagtgaatgaactttcatg

SEQ ID NO: 603260 - DNA, 20 bp, Artificial
  CRISPR gRNA sequence
gtgaatgaactttcatgaag

SEQ ID NO: 603261 - DNA, 20 bp, Artificial
  CRISPR gRNA sequence
atgaactttcatgaagtgga

SEQ ID NO: 603262 - DNA, 20 bp, Artificial
  CRISPR gRNA sequence
tgaactttcatgaagtggat

SEQ ID NO: 603263 - DNA, 20 bp, Artificial
  CRISPR gRNA sequence
aactttcatgaagtggatgg

SEQ ID NO: 603264 - DNA, 20 bp, Artificial
  CRISPR gRNA sequence
tttcatgaagtggatgggag

SEQ ID NO: 603265 - DNA, 20 bp, Artificial
  CRISPR gRNA sequence
ttcatgaagtggatgggagt

SEQ ID NO: 603266 - DNA, 20 bp, Artificial
  CRISPR gRNA sequence
aagtggatgggagtaggaac

SEQ ID NO: 603267 - DNA, 20 bp, Artificial
  CRISPR gRNA sequence
gggagtaggaactggccttg

SEQ ID NO: 603268 - DNA, 20 bp, Artificial
  CRISPR gRNA sequence
gtaggaactggccttgaaga

SEQ ID NO: 603269 - DNA, 20 bp, Artificial
  CRISPR gRNA sequence
aggaactggccttgaagaaa

SEQ ID NO: 603270 - DNA, 20 bp, Artificial
  CRISPR gRNA sequence
gaactggccttgaagaaaga

SEQ ID NO: 603271 - DNA, 20 bp, Artificial
  CRISPR gRNA sequence
tggccttgaagaaagagaga

SEQ ID NO: 603272 - DNA, 20 bp, Artificial
  CRISPR gRNA sequence
gccttgaagaaagagagatg

SEQ ID NO: 603273 - DNA, 20 bp, Artificial
  CRISPR gRNA sequence
tgaagaaagagagatggagt

SEQ ID NO: 603274 - DNA, 20 bp, Artificial
  CRISPR gRNA sequence
atggagttggctgctttacc

SEQ ID NO: 603275 - DNA, 20 bp, Artificial
  CRISPR gRNA sequence
tggagttggctgctttacct

SEQ ID NO: 603276 - DNA, 20 bp, Artificial
  CRISPR gRNA sequence
ggagttggctgctttacctg

SEQ ID NO: 603277 - DNA, 20 bp, Artificial
  CRISPR gRNA sequence
tgctttacctggggaatgaa

SEQ ID NO: 603278 - DNA, 20 bp, Artificial
  CRISPR gRNA sequence
ctttacctggggaatgaaaa

SEQ ID NO: 603279 - DNA, 20 bp, Artificial
  CRISPR gRNA sequence
tttacctggggaatgaaaag

SEQ ID NO: 603280 - DNA, 20 bp, Artificial
  CRISPR gRNA sequence
ttacctggggaatgaaaaga

SEQ ID NO: 603281 - DNA, 20 bp, Artificial
  CRISPR gRNA sequence
acctggggaatgaaaagagg

SEQ ID NO: 603282 - DNA, 20 bp, Artificial
  CRISPR gRNA sequence
ctggggaatgaaaagaggga

SEQ ID NO: 603283 - DNA, 20 bp, Artificial
  CRISPR gRNA sequence
aatgaaaagagggagagacc

SEQ ID NO: 603284 - DNA, 20 bp, Artificial
  CRISPR gRNA sequence
atgaaaagagggagagacct

SEQ ID NO: 603285 - DNA, 20 bp, Artificial
  CRISPR gRNA sequence
acctgggctcacataacatg

SEQ ID NO: 603286 - DNA, 20 bp, Artificial
  CRISPR gRNA sequence
aacatgtagtctgccttcaa

SEQ ID NO: 603287 - DNA, 20 bp, Artificial
  CRISPR gRNA sequence
aattcttttctccaaacaaa

SEQ ID NO: 603288 - DNA, 20 bp, Artificial
  CRISPR gRNA sequence
aaacagatactatctcacta

SEQ ID NO: 603289 - DNA, 20 bp, Artificial
  CRISPR gRNA sequence
ctatctcactaaagtcgaat

SEQ ID NO: 603290 - DNA, 20 bp, Artificial
  CRISPR gRNA sequence
ctcactaaagtcgaataagt

SEQ ID NO: 603291 - DNA, 20 bp, Artificial
  CRISPR gRNA sequence
gagactgcttctttctttgc

SEQ ID NO: 603292 - DNA, 20 bp, Artificial
  CRISPR gRNA sequence
agactgcttctttctttgcc

SEQ ID NO: 603293 - DNA, 20 bp, Artificial
  CRISPR gRNA sequence
aattatttttcttctccttc

SEQ ID NO: 603294 - DNA, 20 bp, Artificial
  CRISPR gRNA sequence
ttcttctccttcaagattgc

SEQ ID NO: 603295 - DNA, 20 bp, Artificial
  CRISPR gRNA sequence
ctccttcaagattgctagta

SEQ ID NO: 603296 - DNA, 20 bp, Artificial
  CRISPR gRNA sequence
tccttcaagattgctagtaa

SEQ ID NO: 603297 - DNA, 20 bp, Artificial
  CRISPR gRNA sequence
atcacatgcccttatgcaca

SEQ ID NO: 603298 - DNA, 20 bp, Artificial
  CRISPR gRNA sequence
tcacatgcccttatgcacac

SEQ ID NO: 603299 - DNA, 20 bp, Artificial
  CRISPR gRNA sequence
gcccttatgcacacaggatg

SEQ ID NO: 603300 - DNA, 20 bp, Artificial
  CRISPR gRNA sequence
cttatgcacacaggatgtgg

SEQ ID NO: 603301 - DNA, 20 bp, Artificial
  CRISPR gRNA sequence
ttatgcacacaggatgtggt

SEQ ID NO: 603302 - DNA, 20 bp, Artificial
  CRISPR gRNA sequence
tatgcacacaggatgtggta

SEQ ID NO: 603303 - DNA, 20 bp, Artificial
  CRISPR gRNA sequence
tggtagggatccatatatga

SEQ ID NO: 603304 - DNA, 20 bp, Artificial
  CRISPR gRNA sequence
tgatggtgacctctgaaccc

SEQ ID NO: 603305 - DNA, 20 bp, Artificial
  CRISPR gRNA sequence
gacctctgaacccgagtctg

SEQ ID NO: 603306 - DNA, 20 bp, Artificial
  CRISPR gRNA sequence
cctctgaacccgagtctgta

SEQ ID NO: 603307 - DNA, 20 bp, Artificial
  CRISPR gRNA sequence
tgaacccgagtctgtagaga

SEQ ID NO: 603308 - DNA, 20 bp, Artificial
  CRISPR gRNA sequence
tgtagagaaagccttgcatt

SEQ ID NO: 603309 - DNA, 20 bp, Artificial
  CRISPR gRNA sequence
aagccttgcattcagtaccc

SEQ ID NO: 603310 - DNA, 20 bp, Artificial
  CRISPR gRNA sequence
gtacccaagtccattcatct

SEQ ID NO: 603311 - DNA, 20 bp, Artificial
  CRISPR gRNA sequence
aagtccattcatcttggctt

SEQ ID NO: 603312 - DNA, 20 bp, Artificial
  CRISPR gRNA sequence
agtccattcatcttggcttc

SEQ ID NO: 603313 - DNA, 20 bp, Artificial
  CRISPR gRNA sequence
tcaggcatattcttataact

SEQ ID NO: 603314 - DNA, 20 bp, Artificial
  CRISPR gRNA sequence
aggcatattcttataactca

SEQ ID NO: 603315 - DNA, 20 bp, Artificial
  CRISPR gRNA sequence
cttataactcagagctgact

SEQ ID NO: 603316 - DNA, 20 bp, Artificial
  CRISPR gRNA sequence
taactcagagctgactaaga

SEQ ID NO: 603317 - DNA, 20 bp, Artificial
  CRISPR gRNA sequence
gactaagatggatatgtctg

SEQ ID NO: 603318 - DNA, 20 bp, Artificial
  CRISPR gRNA sequence
tctgtagctgtgcctcatca

SEQ ID NO: 603319 - DNA, 20 bp, Artificial
  CRISPR gRNA sequence
ctgtagctgtgcctcatcat

SEQ ID NO: 603320 - DNA, 20 bp, Artificial
  CRISPR gRNA sequence
tgtagctgtgcctcatcata

SEQ ID NO: 603321 - DNA, 20 bp, Artificial
  CRISPR gRNA sequence
agctgtgcctcatcataggg

SEQ ID NO: 603322 - DNA, 20 bp, Artificial
  CRISPR gRNA sequence
ctgtgcctcatcatagggta

SEQ ID NO: 603323 - DNA, 20 bp, Artificial
  CRISPR gRNA sequence
gtattaatacacaaaattac

SEQ ID NO: 603324 - DNA, 20 bp, Artificial
  CRISPR gRNA sequence
tattaatacacaaaattact

SEQ ID NO: 603325 - DNA, 20 bp, Artificial
  CRISPR gRNA sequence
attaatacacaaaattacta

SEQ ID NO: 603326 - DNA, 20 bp, Artificial
  CRISPR gRNA sequence
cttatgtgtgtcatctgtaa

SEQ ID NO: 603327 - DNA, 20 bp, Artificial
  CRISPR gRNA sequence
catctgtaacagaataacaa

SEQ ID NO: 603328 - DNA, 20 bp, Artificial
  CRISPR gRNA sequence
gtaacagaataacaacagaa

SEQ ID NO: 603329 - DNA, 20 bp, Artificial
  CRISPR gRNA sequence
acagaataacaacagaacag

SEQ ID NO: 603330 - DNA, 20 bp, Artificial
  CRISPR gRNA sequence
ctttcatctcttgtttatgc

SEQ ID NO: 603331 - DNA, 20 bp, Artificial
  CRISPR gRNA sequence
ctcttgtttatgctggctcg

SEQ ID NO: 603332 - DNA, 20 bp, Artificial
  CRISPR gRNA sequence
tttatgctggctcgcagcat

SEQ ID NO: 603333 - DNA, 20 bp, Artificial
  CRISPR gRNA sequence
tatgaaacttcctctgacta

SEQ ID NO: 603334 - DNA, 20 bp, Artificial
  CRISPR gRNA sequence
aaacttcctctgactaaagt

SEQ ID NO: 603335 - DNA, 20 bp, Artificial
  CRISPR gRNA sequence
aacttcctctgactaaagtt

SEQ ID NO: 603336 - DNA, 20 bp, Artificial
  CRISPR gRNA sequence
acttcctctgactaaagtta

SEQ ID NO: 603337 - DNA, 20 bp, Artificial
  CRISPR gRNA sequence
tagggaaatttgtttcatct

SEQ ID NO: 603338 - DNA, 20 bp, Artificial
  CRISPR gRNA sequence
tcagtcatttgctctttgtc

SEQ ID NO: 603339 - DNA, 20 bp, Artificial
  CRISPR gRNA sequence
cctatttcattaaaaaaaat

SEQ ID NO: 603340 - DNA, 20 bp, Artificial
  CRISPR gRNA sequence
ctatttcattaaaaaaaatg

SEQ ID NO: 603341 - DNA, 20 bp, Artificial
  CRISPR gRNA sequence
cattaaaaaaaatgaggttg

SEQ ID NO: 603342 - DNA, 20 bp, Artificial
  CRISPR gRNA sequence
taaaaaaaatgaggttgtgg

SEQ ID NO: 603343 - DNA, 20 bp, Artificial
  CRISPR gRNA sequence
aaaaaaaatgaggttgtggt

SEQ ID NO: 603344 - DNA, 20 bp, Artificial
  CRISPR gRNA sequence
aaatgaggttgtggtaggat

SEQ ID NO: 603345 - DNA, 20 bp, Artificial
  CRISPR gRNA sequence
gttgtggtaggatgagtact

SEQ ID NO: 603346 - DNA, 20 bp, Artificial
  CRISPR gRNA sequence
taggatgagtacttagaatg

SEQ ID NO: 603347 - DNA, 20 bp, Artificial
  CRISPR gRNA sequence
aggatgagtacttagaatgc

SEQ ID NO: 603348 - DNA, 20 bp, Artificial
  CRISPR gRNA sequence
atgagtacttagaatgcagg

SEQ ID NO: 603349 - DNA, 20 bp, Artificial
  CRISPR gRNA sequence
tgagtacttagaatgcagga

SEQ ID NO: 603350 - DNA, 20 bp, Artificial
  CRISPR gRNA sequence
gagtacttagaatgcaggaa

SEQ ID NO: 603351 - DNA, 20 bp, Artificial
  CRISPR gRNA sequence
agtacttagaatgcaggaag

SEQ ID NO: 603352 - DNA, 20 bp, Artificial
  CRISPR gRNA sequence
gtacttagaatgcaggaagg

SEQ ID NO: 603353 - DNA, 20 bp, Artificial
  CRISPR gRNA sequence
gcaggaagggggcatgccac

SEQ ID NO: 603354 - DNA, 20 bp, Artificial
  CRISPR gRNA sequence
ggggcatgccaccagtgccc

SEQ ID NO: 603355 - DNA, 20 bp, Artificial
  CRISPR gRNA sequence
atgccaccagtgccctagca

SEQ ID NO: 603356 - DNA, 20 bp, Artificial
  CRISPR gRNA sequence
tgccaccagtgccctagcaa

SEQ ID NO: 603357 - DNA, 20 bp, Artificial
  CRISPR gRNA sequence
gtgccctagcaaaggttata

SEQ ID NO: 603358 - DNA, 20 bp, Artificial
  CRISPR gRNA sequence
cctagcaaaggttatacaga

SEQ ID NO: 603359 - DNA, 20 bp, Artificial
  CRISPR gRNA sequence
ctagcaaaggttatacagat

SEQ ID NO: 603360 - DNA, 20 bp, Artificial
  CRISPR gRNA sequence
tagcaaaggttatacagata

SEQ ID NO: 603361 - DNA, 20 bp, Artificial
  CRISPR gRNA sequence
aaaggttatacagatagggc

SEQ ID NO: 603362 - DNA, 20 bp, Artificial
  CRISPR gRNA sequence
tatacagatagggctggctt

SEQ ID NO: 603363 - DNA, 20 bp, Artificial
  CRISPR gRNA sequence
tacagatagggctggcttta

SEQ ID NO: 603364 - DNA, 20 bp, Artificial
  CRISPR gRNA sequence
gaattacctatgaattgttt

SEQ ID NO: 603365 - DNA, 20 bp, Artificial
  CRISPR gRNA sequence
aattacctatgaattgtttt

SEQ ID NO: 603366 - DNA, 20 bp, Artificial
  CRISPR gRNA sequence
attacctatgaattgttttg

SEQ ID NO: 603367 - DNA, 20 bp, Artificial
  CRISPR gRNA sequence
actattctttttttctttct

SEQ ID NO: 603368 - DNA, 20 bp, Artificial
  CRISPR gRNA sequence
ttgcaaacccacttcccttg

SEQ ID NO: 603369 - DNA, 20 bp, Artificial
  CRISPR gRNA sequence
tgttgcttcactgtcctgct

SEQ ID NO: 603370 - DNA, 20 bp, Artificial
  CRISPR gRNA sequence
gctcagtcctgcctgccttt

SEQ ID NO: 603371 - DNA, 20 bp, Artificial
  CRISPR gRNA sequence
ctcagtcctgcctgcctttc

SEQ ID NO: 603372 - DNA, 20 bp, Artificial
  CRISPR gRNA sequence
tcagtcctgcctgcctttca

SEQ ID NO: 603373 - DNA, 20 bp, Artificial
  CRISPR gRNA sequence
ttcaaaccaaaacctgtctg

SEQ ID NO: 603374 - DNA, 20 bp, Artificial
  CRISPR gRNA sequence
caaaacctgtctgtggacac

SEQ ID NO: 603375 - DNA, 20 bp, Artificial
  CRISPR gRNA sequence
aaaacctgtctgtggacact

SEQ ID NO: 603376 - DNA, 20 bp, Artificial
  CRISPR gRNA sequence
gacactaggaaccctttccc

SEQ ID NO: 603377 - DNA, 20 bp, Artificial
  CRISPR gRNA sequence
cccagctttccatcctgtca

SEQ ID NO: 603378 - DNA, 20 bp, Artificial
  CRISPR gRNA sequence
atcctgtcatagaacaattc

SEQ ID NO: 603379 - DNA, 20 bp, Artificial
  CRISPR gRNA sequence
caattcaagtaaatgaattc

SEQ ID NO: 603380 - DNA, 20 bp, Artificial
  CRISPR gRNA sequence
caagtaaatgaattcaagct

SEQ ID NO: 603381 - DNA, 20 bp, Artificial
  CRISPR gRNA sequence
aagtaaatgaattcaagcta

SEQ ID NO: 603382 - DNA, 20 bp, Artificial
  CRISPR gRNA sequence
gaattcaagctaaggttttt

SEQ ID NO: 603383 - DNA, 20 bp, Artificial
  CRISPR gRNA sequence
taaggtttttgagactgaca

SEQ ID NO: 603384 - DNA, 20 bp, Artificial
  CRISPR gRNA sequence
ttgagactgacatagtttaa

SEQ ID NO: 603385 - DNA, 20 bp, Artificial
  CRISPR gRNA sequence
aatagattactgttgtttta

SEQ ID NO: 603386 - DNA, 20 bp, Artificial
  CRISPR gRNA sequence
agattactgttgttttatag

SEQ ID NO: 603387 - DNA, 20 bp, Artificial
  CRISPR gRNA sequence
tagtggcataaatgctttaa

SEQ ID NO: 603388 - DNA, 20 bp, Artificial
  CRISPR gRNA sequence
gtggcataaatgctttaata

SEQ ID NO: 603389 - DNA, 20 bp, Artificial
  CRISPR gRNA sequence
tgctttaatagagatgtctc

SEQ ID NO: 603390 - DNA, 20 bp, Artificial
  CRISPR gRNA sequence
atagagatgtctctagaaat

SEQ ID NO: 603391 - DNA, 20 bp, Artificial
  CRISPR gRNA sequence
gtctctagaaattggttccc

SEQ ID NO: 603392 - DNA, 20 bp, Artificial
  CRISPR gRNA sequence
agaaattggttcccaagcca

SEQ ID NO: 603393 - DNA, 20 bp, Artificial
  CRISPR gRNA sequence
aattggttcccaagccatag

SEQ ID NO: 603394 - DNA, 20 bp, Artificial
  CRISPR gRNA sequence
tagtagtaaatttctgataa

SEQ ID NO: 603395 - DNA, 20 bp, Artificial
  CRISPR gRNA sequence
gtagtaaatttctgataatg

SEQ ID NO: 603396 - DNA, 20 bp, Artificial
  CRISPR gRNA sequence
atttctgataatggagattt

SEQ ID NO: 603397 - DNA, 20 bp, Artificial
  CRISPR gRNA sequence
tttctgataatggagatttc

SEQ ID NO: 603398 - DNA, 20 bp, Artificial
  CRISPR gRNA sequence
ataatggagatttcaggtac

SEQ ID NO: 603399 - DNA, 20 bp, Artificial
  CRISPR gRNA sequence
tttcaggtaccagattatgc

SEQ ID NO: 603400 - DNA, 20 bp, Artificial
  CRISPR gRNA sequence
tcaggtaccagattatgctg

SEQ ID NO: 603401 - DNA, 20 bp, Artificial
  CRISPR gRNA sequence
caggtaccagattatgctgg

SEQ ID NO: 603402 - DNA, 20 bp, Artificial
  CRISPR gRNA sequence
aggtaccagattatgctgga

SEQ ID NO: 603403 - DNA, 20 bp, Artificial
  CRISPR gRNA sequence
ccagattatgctggagggta

SEQ ID NO: 603404 - DNA, 20 bp, Artificial
  CRISPR gRNA sequence
agattatgctggagggtatg

SEQ ID NO: 603405 - DNA, 20 bp, Artificial
  CRISPR gRNA sequence
ttatgctggagggtatggag

SEQ ID NO: 603406 - DNA, 20 bp, Artificial
  CRISPR gRNA sequence
tgctggagggtatggagaag

SEQ ID NO: 603407 - DNA, 20 bp, Artificial
  CRISPR gRNA sequence
gagggtatggagaagaagtt

SEQ ID NO: 603408 - DNA, 20 bp, Artificial
  CRISPR gRNA sequence
agggtatggagaagaagttt

SEQ ID NO: 603409 - DNA, 20 bp, Artificial
  CRISPR gRNA sequence
ggtatggagaagaagtttgg

SEQ ID NO: 603410 - DNA, 20 bp, Artificial
  CRISPR gRNA sequence
tatggagaagaagtttggga

SEQ ID NO: 603411 - DNA, 20 bp, Artificial
  CRISPR gRNA sequence
ctgtcaaattaataccatta

SEQ ID NO: 603412 - DNA, 20 bp, Artificial
  CRISPR gRNA sequence
cattaaagtaactgtctttg

SEQ ID NO: 603413 - DNA, 20 bp, Artificial
  CRISPR gRNA sequence
gtaactgtctttgcagccca

SEQ ID NO: 603414 - DNA, 20 bp, Artificial
  CRISPR gRNA sequence
taactgtctttgcagcccaa

SEQ ID NO: 603415 - DNA, 20 bp, Artificial
  CRISPR gRNA sequence
ctgtctttgcagcccaaagg

SEQ ID NO: 603416 - DNA, 20 bp, Artificial
  CRISPR gRNA sequence
ttgcagcccaaaggtagtac

SEQ ID NO: 603417 - DNA, 20 bp, Artificial
  CRISPR gRNA sequence
ccaaaggtagtaccagacct

SEQ ID NO: 603418 - DNA, 20 bp, Artificial
  CRISPR gRNA sequence
aaggtagtaccagacctgag

SEQ ID NO: 603419 - DNA, 20 bp, Artificial
  CRISPR gRNA sequence
ggtagtaccagacctgagta

SEQ ID NO: 603420 - DNA, 20 bp, Artificial
  CRISPR gRNA sequence
agtagagactcttttttcac

SEQ ID NO: 603421 - DNA, 20 bp, Artificial
  CRISPR gRNA sequence
ttttcacaagcacaaaatat

SEQ ID NO: 603422 - DNA, 20 bp, Artificial
  CRISPR gRNA sequence
agcactgatgactgactttg

SEQ ID NO: 603423 - DNA, 20 bp, Artificial
  CRISPR gRNA sequence
gactgactttgtagttacaa

SEQ ID NO: 603424 - DNA, 20 bp, Artificial
  CRISPR gRNA sequence
ctttgtagttacaaaagtgt

SEQ ID NO: 603425 - DNA, 20 bp, Artificial
  CRISPR gRNA sequence
ttgtagttacaaaagtgtta

SEQ ID NO: 603426 - DNA, 20 bp, Artificial
  CRISPR gRNA sequence
acaaaagtgttagagaatat

SEQ ID NO: 603427 - DNA, 20 bp, Artificial
  CRISPR gRNA sequence
tagagaatattagaatctga

SEQ ID NO: 603428 - DNA, 20 bp, Artificial
  CRISPR gRNA sequence
agaatctgaaagtgactctt

SEQ ID NO: 603429 - DNA, 20 bp, Artificial
  CRISPR gRNA sequence
ccctgttccaaaaatttttc

SEQ ID NO: 603430 - DNA, 20 bp, Artificial
  CRISPR gRNA sequence
cctgttccaaaaatttttct

SEQ ID NO: 603431 - DNA, 20 bp, Artificial
  CRISPR gRNA sequence
aaaaatttttctgggaaaaa

SEQ ID NO: 603432 - DNA, 20 bp, Artificial
  CRISPR gRNA sequence
ttttctgggaaaaaaagttt

SEQ ID NO: 603433 - DNA, 20 bp, Artificial
  CRISPR gRNA sequence
tttctgggaaaaaaagtttt

SEQ ID NO: 603434 - DNA, 20 bp, Artificial
  CRISPR gRNA sequence
ctgggaaaaaaagttttagg

SEQ ID NO: 603435 - DNA, 20 bp, Artificial
  CRISPR gRNA sequence
agttttaggtggcatctgta

SEQ ID NO: 603436 - DNA, 20 bp, Artificial
  CRISPR gRNA sequence
tggcatctgtaaagctaaac

SEQ ID NO: 603437 - DNA, 20 bp, Artificial
  CRISPR gRNA sequence
tattctttcaactgcctttt

SEQ ID NO: 603438 - DNA, 20 bp, Artificial
  CRISPR gRNA sequence
caactgccttttcagtttgt

SEQ ID NO: 603439 - DNA, 20 bp, Artificial
  CRISPR gRNA sequence
actgccttttcagtttgtta

SEQ ID NO: 603440 - DNA, 20 bp, Artificial
  CRISPR gRNA sequence
ccttttcagtttgttagagt

SEQ ID NO: 603441 - DNA, 20 bp, Artificial
  CRISPR gRNA sequence
cttttgttttgttttaatat

SEQ ID NO: 603442 - DNA, 20 bp, Artificial
  CRISPR gRNA sequence
ttttgttttgttttaatata

SEQ ID NO: 603443 - DNA, 20 bp, Artificial
  CRISPR gRNA sequence
gttttaatataaggaacttc

SEQ ID NO: 603444 - DNA, 20 bp, Artificial
  CRISPR gRNA sequence
atataaggaacttctagtta

SEQ ID NO: 603445 - DNA, 20 bp, Artificial
  CRISPR gRNA sequence
tagttatagttttacaaata

SEQ ID NO: 603446 - DNA, 20 bp, Artificial
  CRISPR gRNA sequence
accacataacatatactcga

SEQ ID NO: 603447 - DNA, 20 bp, Artificial
  CRISPR gRNA sequence
taacatatactcgatagtct

SEQ ID NO: 603448 - DNA, 20 bp, Artificial
  CRISPR gRNA sequence
tatactcgatagtcttagaa

SEQ ID NO: 603449 - DNA, 20 bp, Artificial
  CRISPR gRNA sequence
tactcgatagtcttagaaca

SEQ ID NO: 603450 - DNA, 20 bp, Artificial
  CRISPR gRNA sequence
ttagaacagagccctccacc

SEQ ID NO: 603451 - DNA, 20 bp, Artificial
  CRISPR gRNA sequence
aacagagccctccacctagc

SEQ ID NO: 603452 - DNA, 20 bp, Artificial
  CRISPR gRNA sequence
tccacctagctagtctcttc

SEQ ID NO: 603453 - DNA, 20 bp, Artificial
  CRISPR gRNA sequence
ctagctagtctcttctggat

SEQ ID NO: 603454 - DNA, 20 bp, Artificial
  CRISPR gRNA sequence
gctagtctcttctggataag

SEQ ID NO: 603455 - DNA, 20 bp, Artificial
  CRISPR gRNA sequence
tcttctggataagcagttct

SEQ ID NO: 603456 - DNA, 20 bp, Artificial
  CRISPR gRNA sequence
aagcagttctcagtcatgtg

SEQ ID NO: 603457 - DNA, 20 bp, Artificial
  CRISPR gRNA sequence
cagtcatgtgtagtgttgaa

SEQ ID NO: 603458 - DNA, 20 bp, Artificial
  CRISPR gRNA sequence
agtcatgtgtagtgttgaaa

SEQ ID NO: 603459 - DNA, 20 bp, Artificial
  CRISPR gRNA sequence
tgctcatttaattatttcca

SEQ ID NO: 603460 - DNA, 20 bp, Artificial
  CRISPR gRNA sequence
cagttgtcaaacctctgcca

SEQ ID NO: 603461 - DNA, 20 bp, Artificial
  CRISPR gRNA sequence
gtcaaacctctgccatggaa

SEQ ID NO: 603462 - DNA, 20 bp, Artificial
  CRISPR gRNA sequence
gaatttcaaccattttgata

SEQ ID NO: 603463 - DNA, 20 bp, Artificial
  CRISPR gRNA sequence
ataaagcccctataaaacca

SEQ ID NO: 603464 - DNA, 20 bp, Artificial
  CRISPR gRNA sequence
cttctaaatatccttaaaaa

SEQ ID NO: 603465 - DNA, 20 bp, Artificial
  CRISPR gRNA sequence
taaatatccttaaaaatgga

SEQ ID NO: 603466 - DNA, 20 bp, Artificial
  CRISPR gRNA sequence
tccttaaaaatggaaagcca

SEQ ID NO: 603467 - DNA, 20 bp, Artificial
  CRISPR gRNA sequence
ccttaaaaatggaaagccac

SEQ ID NO: 603468 - DNA, 20 bp, Artificial
  CRISPR gRNA sequence
atattttgcaaaaatatacc

SEQ ID NO: 603469 - DNA, 20 bp, Artificial
  CRISPR gRNA sequence
tataccaagtgtttctattg

SEQ ID NO: 603470 - DNA, 20 bp, Artificial
  CRISPR gRNA sequence
ggtgtccaattcacttattc

SEQ ID NO: 603471 - DNA, 20 bp, Artificial
  CRISPR gRNA sequence
ccaattcacttattctagaa

SEQ ID NO: 603472 - DNA, 20 bp, Artificial
  CRISPR gRNA sequence
attcacttattctagaatag

SEQ ID NO: 603473 - DNA, 20 bp, Artificial
  CRISPR gRNA sequence
ttcacttattctagaataga

SEQ ID NO: 603474 - DNA, 20 bp, Artificial
  CRISPR gRNA sequence
cttattctagaatagaagga

SEQ ID NO: 603475 - DNA, 20 bp, Artificial
  CRISPR gRNA sequence
tctagaatagaaggaaagcc

SEQ ID NO: 603476 - DNA, 20 bp, Artificial
  CRISPR gRNA sequence
agaaggaaagcctggtgtgt

SEQ ID NO: 603477 - DNA, 20 bp, Artificial
  CRISPR gRNA sequence
aggaaagcctggtgtgttgg

SEQ ID NO: 603478 - DNA, 20 bp, Artificial
  CRISPR gRNA sequence
aagcctggtgtgttggaaga

SEQ ID NO: 603479 - DNA, 20 bp, Artificial
  CRISPR gRNA sequence
gcctggtgtgttggaagaca

SEQ ID NO: 603480 - DNA, 20 bp, Artificial
  CRISPR gRNA sequence
gtgttggaagacagagtaaa

SEQ ID NO: 603481 - DNA, 20 bp, Artificial
  CRISPR gRNA sequence
gtaaaaagtcattaatgtaa

SEQ ID NO: 603482 - DNA, 20 bp, Artificial
  CRISPR gRNA sequence
aaaaagtcattaatgtaaca

SEQ ID NO: 603483 - DNA, 20 bp, Artificial
  CRISPR gRNA sequence
tgtaacagagattgtctttt

SEQ ID NO: 603484 - DNA, 20 bp, Artificial
  CRISPR gRNA sequence
tgtcttttaagtccatttat

SEQ ID NO: 603485 - DNA, 20 bp, Artificial
  CRISPR gRNA sequence
gccgtctctctttttttaat

SEQ ID NO: 603486 - DNA, 20 bp, Artificial
  CRISPR gRNA sequence
tttgttctgtatcctgatta

SEQ ID NO: 603487 - DNA, 20 bp, Artificial
  CRISPR gRNA sequence
gttctgtatcctgattatgg

SEQ ID NO: 603488 - DNA, 20 bp, Artificial
  CRISPR gRNA sequence
ctgtatcctgattatggtag

SEQ ID NO: 603489 - DNA, 20 bp, Artificial
  CRISPR gRNA sequence
ctgattatggtagtggttat

SEQ ID NO: 603490 - DNA, 20 bp, Artificial
  CRISPR gRNA sequence
ataagaatctatgcatgttg

SEQ ID NO: 603491 - DNA, 20 bp, Artificial
  CRISPR gRNA sequence
gttgtagaactgaatgctaa

SEQ ID NO: 603492 - DNA, 20 bp, Artificial
  CRISPR gRNA sequence
ttgtagaactgaatgctaaa

SEQ ID NO: 603493 - DNA, 20 bp, Artificial
  CRISPR gRNA sequence
acaactttaaaaataaaatg

SEQ ID NO: 603494 - DNA, 20 bp, Artificial
  CRISPR gRNA sequence
caactttaaaaataaaatga

SEQ ID NO: 603495 - DNA, 20 bp, Artificial
  CRISPR gRNA sequence
aactttaaaaataaaatgaa

SEQ ID NO: 603496 - DNA, 20 bp, Artificial
  CRISPR gRNA sequence
actttaaaaataaaatgaag

SEQ ID NO: 603497 - DNA, 20 bp, Artificial
  CRISPR gRNA sequence
aaaataaaatgaaggggtta

SEQ ID NO: 603498 - DNA, 20 bp, Artificial
  CRISPR gRNA sequence
acttgaaacactgctaaaaa

SEQ ID NO: 603499 - DNA, 20 bp, Artificial
  CRISPR gRNA sequence
tgaaacactgctaaaaatgg

SEQ ID NO: 603500 - DNA, 20 bp, Artificial
  CRISPR gRNA sequence
tggtggttaaattccattga

SEQ ID NO: 603501 - DNA, 20 bp, Artificial
  CRISPR gRNA sequence
ttgaaagaaacaacaataaa

SEQ ID NO: 603502 - DNA, 20 bp, Artificial
  CRISPR gRNA sequence
tgaaagaaacaacaataaaa

SEQ ID NO: 603503 - DNA, 20 bp, Artificial
  CRISPR gRNA sequence
gaaacaacaataaaaaggct

SEQ ID NO: 603504 - DNA, 20 bp, Artificial
  CRISPR gRNA sequence
ataaaaaggcttagttaatg

SEQ ID NO: 603505 - DNA, 20 bp, Artificial
  CRISPR gRNA sequence
cttagttaatgtggcaattg

SEQ ID NO: 603506 - DNA, 20 bp, Artificial
  CRISPR gRNA sequence
agttaatgtggcaattgtag

SEQ ID NO: 603507 - DNA, 20 bp, Artificial
  CRISPR gRNA sequence
gttaatgtggcaattgtagt

SEQ ID NO: 603508 - DNA, 20 bp, Artificial
  CRISPR gRNA sequence
ttaatgtggcaattgtagta

SEQ ID NO: 603509 - DNA, 20 bp, Artificial
  CRISPR gRNA sequence
ggcaattgtagtagggttaa

SEQ ID NO: 603510 - DNA, 20 bp, Artificial
  CRISPR gRNA sequence
attatacaaactaacactat

SEQ ID NO: 603511 - DNA, 20 bp, Artificial
  CRISPR gRNA sequence
ttatacaaactaacactatg

SEQ ID NO: 603512 - DNA, 20 bp, Artificial
  CRISPR gRNA sequence
atacattttaaatcacaaat

SEQ ID NO: 603513 - DNA, 20 bp, Artificial
  CRISPR gRNA sequence
ttaaatcacaaatcagaact

SEQ ID NO: 603514 - DNA, 20 bp, Artificial
  CRISPR gRNA sequence
taaatcacaaatcagaactt

SEQ ID NO: 603515 - DNA, 20 bp, Artificial
  CRISPR gRNA sequence
actttcccctgttcattgtc

SEQ ID NO: 603516 - DNA, 20 bp, Artificial
  CRISPR gRNA sequence
tttcccctgttcattgtcaa

SEQ ID NO: 603517 - DNA, 20 bp, Artificial
  CRISPR gRNA sequence
cccctgttcattgtcaagag

SEQ ID NO: 603518 - DNA, 20 bp, Artificial
  CRISPR gRNA sequence
ccctgttcattgtcaagagt

SEQ ID NO: 603519 - DNA, 20 bp, Artificial
  CRISPR gRNA sequence
tcattgtcaagagtgggaaa

SEQ ID NO: 603520 - DNA, 20 bp, Artificial
  CRISPR gRNA sequence
ttgtcaagagtgggaaacgg

SEQ ID NO: 603521 - DNA, 20 bp, Artificial
  CRISPR gRNA sequence
ggaaacggaagtattgtaat

SEQ ID NO: 603522 - DNA, 20 bp, Artificial
  CRISPR gRNA sequence
aagtattgtaattagccttc

SEQ ID NO: 603523 - DNA, 20 bp, Artificial
  CRISPR gRNA sequence
tgtaattagccttctggtgc

SEQ ID NO: 603524 - DNA, 20 bp, Artificial
  CRISPR gRNA sequence
aattagccttctggtgcaag

SEQ ID NO: 603525 - DNA, 20 bp, Artificial
  CRISPR gRNA sequence
ggtgcaagtggcaataaatg

SEQ ID NO: 603526 - DNA, 20 bp, Artificial
  CRISPR gRNA sequence
agtggcaataaatgcagttg

SEQ ID NO: 603527 - DNA, 20 bp, Artificial
  CRISPR gRNA sequence
aaatgcagttgcagtgactg

SEQ ID NO: 603528 - DNA, 20 bp, Artificial
  CRISPR gRNA sequence
agttgcagtgactgcagtga

SEQ ID NO: 603529 - DNA, 20 bp, Artificial
  CRISPR gRNA sequence
agtgactgcagtgatggatg

SEQ ID NO: 603530 - DNA, 20 bp, Artificial
  CRISPR gRNA sequence
gtgactgcagtgatggatgt

SEQ ID NO: 603531 - DNA, 20 bp, Artificial
  CRISPR gRNA sequence
tgactgcagtgatggatgta

SEQ ID NO: 603532 - DNA, 20 bp, Artificial
  CRISPR gRNA sequence
cagtgatggatgtagggact

SEQ ID NO: 603533 - DNA, 20 bp, Artificial
  CRISPR gRNA sequence
agtgatggatgtagggactc

SEQ ID NO: 603534 - DNA, 20 bp, Artificial
  CRISPR gRNA sequence
tggatgtagggactcaggat

SEQ ID NO: 603535 - DNA, 20 bp, Artificial
  CRISPR gRNA sequence
ggactcaggatcagaatttg

SEQ ID NO: 603536 - DNA, 20 bp, Artificial
  CRISPR gRNA sequence
actcaggatcagaatttgaa

SEQ ID NO: 603537 - DNA, 20 bp, Artificial
  CRISPR gRNA sequence
ctcaggatcagaatttgaag

SEQ ID NO: 603538 - DNA, 20 bp, Artificial
  CRISPR gRNA sequence
tcaggatcagaatttgaaga

SEQ ID NO: 603539 - DNA, 20 bp, Artificial
  CRISPR gRNA sequence
ggatcagaatttgaagaggg

SEQ ID NO: 603540 - DNA, 20 bp, Artificial
  CRISPR gRNA sequence
gaatttgaagagggtagacc

SEQ ID NO: 603541 - DNA, 20 bp, Artificial
  CRISPR gRNA sequence
atttgaagagggtagaccta

SEQ ID NO: 603542 - DNA, 20 bp, Artificial
  CRISPR gRNA sequence
ggtagacctagagtaattgt

SEQ ID NO: 603543 - DNA, 20 bp, Artificial
  CRISPR gRNA sequence
tagacctagagtaattgtta

SEQ ID NO: 603544 - DNA, 20 bp, Artificial
  CRISPR gRNA sequence
attgttagagcccctgccct

SEQ ID NO: 603545 - DNA, 20 bp, Artificial
  CRISPR gRNA sequence
gttagagcccctgcccttag

SEQ ID NO: 603546 - DNA, 20 bp, Artificial
  CRISPR gRNA sequence
tagagcccctgcccttagca

SEQ ID NO: 603547 - DNA, 20 bp, Artificial
  CRISPR gRNA sequence
agcatgtcttgactgttgtg

SEQ ID NO: 603548 - DNA, 20 bp, Artificial
  CRISPR gRNA sequence
tgtcttgactgttgtgcagt

SEQ ID NO: 603549 - DNA, 20 bp, Artificial
  CRISPR gRNA sequence
cttgactgttgtgcagttag

SEQ ID NO: 603550 - DNA, 20 bp, Artificial
  CRISPR gRNA sequence
agttagcagctccttgtgcc

SEQ ID NO: 603551 - DNA, 20 bp, Artificial
  CRISPR gRNA sequence
cttgtgcctagcattttttc

SEQ ID NO: 603552 - DNA, 20 bp, Artificial
  CRISPR gRNA sequence
tgtgcctagcattttttctg

SEQ ID NO: 603553 - DNA, 20 bp, Artificial
  CRISPR gRNA sequence
gcctagcattttttctggag

SEQ ID NO: 603554 - DNA, 20 bp, Artificial
  CRISPR gRNA sequence
cctagcattttttctggagt

SEQ ID NO: 603555 - DNA, 20 bp, Artificial
  CRISPR gRNA sequence
aataactactgattaaattc

SEQ ID NO: 603556 - DNA, 20 bp, Artificial
  CRISPR gRNA sequence
ataactactgattaaattct

SEQ ID NO: 603557 - DNA, 20 bp, Artificial
  CRISPR gRNA sequence
taactactgattaaattctg

SEQ ID NO: 603558 - DNA, 20 bp, Artificial
  CRISPR gRNA sequence
actgattaaattctggggcc

SEQ ID NO: 603559 - DNA, 20 bp, Artificial
  CRISPR gRNA sequence
ctgattaaattctggggcct

SEQ ID NO: 603560 - DNA, 20 bp, Artificial
  CRISPR gRNA sequence
tggggcctaggttcaaatct

SEQ ID NO: 603561 - DNA, 20 bp, Artificial
  CRISPR gRNA sequence
caaatcttggctctacttac

SEQ ID NO: 603562 - DNA, 20 bp, Artificial
  CRISPR gRNA sequence
acttaccagctatgtgatct

SEQ ID NO: 603563 - DNA, 20 bp, Artificial
  CRISPR gRNA sequence
tctccatgcctcattcctct

SEQ ID NO: 603564 - DNA, 20 bp, Artificial
  CRISPR gRNA sequence
cctcattcctctcagcccta

SEQ ID NO: 603565 - DNA, 20 bp, Artificial
  CRISPR gRNA sequence
ctcattcctctcagccctaa

SEQ ID NO: 603566 - DNA, 20 bp, Artificial
  CRISPR gRNA sequence
tcattcctctcagccctaaa

SEQ ID NO: 603567 - DNA, 20 bp, Artificial
  CRISPR gRNA sequence
ctctcagccctaaagggttg

SEQ ID NO: 603568 - DNA, 20 bp, Artificial
  CRISPR gRNA sequence
ttgaagaacatctctctcat

SEQ ID NO: 603569 - DNA, 20 bp, Artificial
  CRISPR gRNA sequence
tgaagaacatctctctcata

SEQ ID NO: 603570 - DNA, 20 bp, Artificial
  CRISPR gRNA sequence
catctctctcataaggctgt

SEQ ID NO: 603571 - DNA, 20 bp, Artificial
  CRISPR gRNA sequence
atctctctcataaggctgtt

SEQ ID NO: 603572 - DNA, 20 bp, Artificial
  CRISPR gRNA sequence
ctctctcataaggctgttgg

SEQ ID NO: 603573 - DNA, 20 bp, Artificial
  CRISPR gRNA sequence
tgggagaattaaatgatatt

SEQ ID NO: 603574 - DNA, 20 bp, Artificial
  CRISPR gRNA sequence
tattaagcttttaaatctct

SEQ ID NO: 603575 - DNA, 20 bp, Artificial
  CRISPR gRNA sequence
agcttttaaatctcttagca

SEQ ID NO: 603576 - DNA, 20 bp, Artificial
  CRISPR gRNA sequence
ttaaatctcttagcaaagta

SEQ ID NO: 603577 - DNA, 20 bp, Artificial
  CRISPR gRNA sequence
aaatctcttagcaaagtatg

SEQ ID NO: 603578 - DNA, 20 bp, Artificial
  CRISPR gRNA sequence
caaagtatggagcatataat

SEQ ID NO: 603579 - DNA, 20 bp, Artificial
  CRISPR gRNA sequence
ataagtgttccaataaatgt

SEQ ID NO: 603580 - DNA, 20 bp, Artificial
  CRISPR gRNA sequence
aaatgtgagatatgattatt

SEQ ID NO: 603581 - DNA, 20 bp, Artificial
  CRISPR gRNA sequence
atatgattattcagtaactg

SEQ ID NO: 603582 - DNA, 20 bp, Artificial
  CRISPR gRNA sequence
tatgattattcagtaactgt

SEQ ID NO: 603583 - DNA, 20 bp, Artificial
  CRISPR gRNA sequence
ttcagtaactgtgggttgaa

SEQ ID NO: 603584 - DNA, 20 bp, Artificial
  CRISPR gRNA sequence
agtaactgtgggttgaatgg

SEQ ID NO: 603585 - DNA, 20 bp, Artificial
  CRISPR gRNA sequence
gttgaatggcagtatctcgt

SEQ ID NO: 603586 - DNA, 20 bp, Artificial
  CRISPR gRNA sequence
ttgaatggcagtatctcgta

SEQ ID NO: 603587 - DNA, 20 bp, Artificial
  CRISPR gRNA sequence
gtatctcgtaaggcttgtgt

SEQ ID NO: 603588 - DNA, 20 bp, Artificial
  CRISPR gRNA sequence
atctcgtaaggcttgtgttg

SEQ ID NO: 603589 - DNA, 20 bp, Artificial
  CRISPR gRNA sequence
ctcgtaaggcttgtgttgga

SEQ ID NO: 603590 - DNA, 20 bp, Artificial
  CRISPR gRNA sequence
tcgtaaggcttgtgttggag

SEQ ID NO: 603591 - DNA, 20 bp, Artificial
  CRISPR gRNA sequence
taaggcttgtgttggagagg

SEQ ID NO: 603592 - DNA, 20 bp, Artificial
  CRISPR gRNA sequence
ggagaggcagtgttgaatga

SEQ ID NO: 603593 - DNA, 20 bp, Artificial
  CRISPR gRNA sequence
tgaatgacagttgctccttt

SEQ ID NO: 603594 - DNA, 20 bp, Artificial
  CRISPR gRNA sequence
acagttgctcctttcagtgc

SEQ ID NO: 603595 - DNA, 20 bp, Artificial
  CRISPR gRNA sequence
ttcagtgctggtctgtttat

SEQ ID NO: 603596 - DNA, 20 bp, Artificial
  CRISPR gRNA sequence
tcagtgctggtctgtttatt

SEQ ID NO: 603597 - DNA, 20 bp, Artificial
  CRISPR gRNA sequence
cagtgctggtctgtttattg

SEQ ID NO: 603598 - DNA, 20 bp, Artificial
  CRISPR gRNA sequence
gctggtctgtttattggggt

SEQ ID NO: 603599 - DNA, 20 bp, Artificial
  CRISPR gRNA sequence
ctggtctgtttattggggtc

SEQ ID NO: 603600 - DNA, 20 bp, Artificial
  CRISPR gRNA sequence
ggtctgtttattggggtcag

SEQ ID NO: 603601 - DNA, 20 bp, Artificial
  CRISPR gRNA sequence
aattaatttctttcgctgtt

SEQ ID NO: 603602 - DNA, 20 bp, Artificial
  CRISPR gRNA sequence
atttctttcgctgttcagca

SEQ ID NO: 603603 - DNA, 20 bp, Artificial
  CRISPR gRNA sequence
gctgttcagcacagaatact

SEQ ID NO: 603604 - DNA, 20 bp, Artificial
  CRISPR gRNA sequence
tccttatgtacctcaaattc

SEQ ID NO: 603605 - DNA, 20 bp, Artificial
  CRISPR gRNA sequence
ccttatgtacctcaaattct

SEQ ID NO: 603606 - DNA, 20 bp, Artificial
  CRISPR gRNA sequence
aattctgggctttttaccta

SEQ ID NO: 603607 - DNA, 20 bp, Artificial
  CRISPR gRNA sequence
tacctacggaattttaccct

SEQ ID NO: 603608 - DNA, 20 bp, Artificial
  CRISPR gRNA sequence
attttaccctaagtgctgtt

SEQ ID NO: 603609 - DNA, 20 bp, Artificial
  CRISPR gRNA sequence
tgctgttgagtacaaattac

SEQ ID NO: 603610 - DNA, 20 bp, Artificial
  CRISPR gRNA sequence
gctgttgagtacaaattacg

SEQ ID NO: 603611 - DNA, 20 bp, Artificial
  CRISPR gRNA sequence
gtacaaattacgaggtacaa

SEQ ID NO: 603612 - DNA, 20 bp, Artificial
  CRISPR gRNA sequence
aaattacgaggtacaacagt

SEQ ID NO: 603613 - DNA, 20 bp, Artificial
  CRISPR gRNA sequence
tagatgaattttttataata

SEQ ID NO: 603614 - DNA, 20 bp, Artificial
  CRISPR gRNA sequence
agatgaattttttataatat

SEQ ID NO: 603615 - DNA, 20 bp, Artificial
  CRISPR gRNA sequence
tttttccaaattgtgattat

SEQ ID NO: 603616 - DNA, 20 bp, Artificial
  CRISPR gRNA sequence
tttttaataaacatttttga

SEQ ID NO: 603617 - DNA, 20 bp, Artificial
  CRISPR gRNA sequence
catttttgatagaatgaatg

SEQ ID NO: 603618 - DNA, 20 bp, Artificial
  CRISPR gRNA sequence
atttttgatagaatgaatgc

SEQ ID NO: 603619 - DNA, 20 bp, Artificial
  CRISPR gRNA sequence
agaatgaatgcaggttaatt

SEQ ID NO: 603620 - DNA, 20 bp, Artificial
  CRISPR gRNA sequence
gaatgaatgcaggttaatta

SEQ ID NO: 603621 - DNA, 20 bp, Artificial
  CRISPR gRNA sequence
atgaatgcaggttaattaag

SEQ ID NO: 603622 - DNA, 20 bp, Artificial
  CRISPR gRNA sequence
aatgcaggttaattaaggag

SEQ ID NO: 603623 - DNA, 20 bp, Artificial
  CRISPR gRNA sequence
atgcaggttaattaaggaga

SEQ ID NO: 603624 - DNA, 20 bp, Artificial
  CRISPR gRNA sequence
tgcaggttaattaaggagaa

SEQ ID NO: 603625 - DNA, 20 bp, Artificial
  CRISPR gRNA sequence
gcaggttaattaaggagaag

SEQ ID NO: 603626 - DNA, 20 bp, Artificial
  CRISPR gRNA sequence
aggagaaggggaacatgcac

SEQ ID NO: 603627 - DNA, 20 bp, Artificial
  CRISPR gRNA sequence
aggggaacatgcacaagtaa

SEQ ID NO: 603628 - DNA, 20 bp, Artificial
  CRISPR gRNA sequence
ggggaacatgcacaagtaaa

SEQ ID NO: 603629 - DNA, 20 bp, Artificial
  CRISPR gRNA sequence
gaacatgcacaagtaaaagg

SEQ ID NO: 603630 - DNA, 20 bp, Artificial
  CRISPR gRNA sequence
atgcacaagtaaaaggaagt

SEQ ID NO: 603631 - DNA, 20 bp, Artificial
  CRISPR gRNA sequence
tgcacaagtaaaaggaagtc

SEQ ID NO: 603632 - DNA, 20 bp, Artificial
  CRISPR gRNA sequence
gcacaagtaaaaggaagtca

SEQ ID NO: 603633 - DNA, 20 bp, Artificial
  CRISPR gRNA sequence
gtaaaaggaagtcagggcta

SEQ ID NO: 603634 - DNA, 20 bp, Artificial
  CRISPR gRNA sequence
aaaggaagtcagggctaaag

SEQ ID NO: 603635 - DNA, 20 bp, Artificial
  CRISPR gRNA sequence
agcagtcataattgtacatt

SEQ ID NO: 603636 - DNA, 20 bp, Artificial
  CRISPR gRNA sequence
cagtcataattgtacattca

SEQ ID NO: 603637 - DNA, 20 bp, Artificial
  CRISPR gRNA sequence
attaccatacaaaatgataa

SEQ ID NO: 603638 - DNA, 20 bp, Artificial
  CRISPR gRNA sequence
accatacaaaatgataatag

SEQ ID NO: 603639 - DNA, 20 bp, Artificial
  CRISPR gRNA sequence
aatagcagatttttgtgtgt

SEQ ID NO: 603640 - DNA, 20 bp, Artificial
  CRISPR gRNA sequence
gcagatttttgtgtgtgaga

SEQ ID NO: 603641 - DNA, 20 bp, Artificial
  CRISPR gRNA sequence
cagatttttgtgtgtgagac

SEQ ID NO: 603642 - DNA, 20 bp, Artificial
  CRISPR gRNA sequence
agatttttgtgtgtgagaca

SEQ ID NO: 603643 - DNA, 20 bp, Artificial
  CRISPR gRNA sequence
cagggtctcactctgtcacc

SEQ ID NO: 603644 - DNA, 20 bp, Artificial
  CRISPR gRNA sequence
agggtctcactctgtcaccc

SEQ ID NO: 603645 - DNA, 20 bp, Artificial
  CRISPR gRNA sequence
tcactctgtcacccaggctt

SEQ ID NO: 603646 - DNA, 20 bp, Artificial
  CRISPR gRNA sequence
ctgtcacccaggcttgagtg

SEQ ID NO: 603647 - DNA, 20 bp, Artificial
  CRISPR gRNA sequence
tgagtgcagtgatgcgatca

SEQ ID NO: 603648 - DNA, 20 bp, Artificial
  CRISPR gRNA sequence
gcagtgatgcgatcatggct

SEQ ID NO: 603649 - DNA, 20 bp, Artificial
  CRISPR gRNA sequence
cagtgtcaacttcgacctca

SEQ ID NO: 603650 - DNA, 20 bp, Artificial
  CRISPR gRNA sequence
caacttcgacctcacagcct

SEQ ID NO: 603651 - DNA, 20 bp, Artificial
  CRISPR gRNA sequence
aacttcgacctcacagcctc

SEQ ID NO: 603652 - DNA, 20 bp, Artificial
  CRISPR gRNA sequence
ctcaggtgatcatcccacct

SEQ ID NO: 603653 - DNA, 20 bp, Artificial
  CRISPR gRNA sequence
tcatcccacctcagccttcc

SEQ ID NO: 603654 - DNA, 20 bp, Artificial
  CRISPR gRNA sequence
tcccacctcagccttccaag

SEQ ID NO: 603655 - DNA, 20 bp, Artificial
  CRISPR gRNA sequence
acctcagccttccaagtagc

SEQ ID NO: 603656 - DNA, 20 bp, Artificial
  CRISPR gRNA sequence
cctcagccttccaagtagct

SEQ ID NO: 603657 - DNA, 20 bp, Artificial
  CRISPR gRNA sequence
cttccaagtagctgggacta

SEQ ID NO: 603658 - DNA, 20 bp, Artificial
  CRISPR gRNA sequence
ttccaagtagctgggactac

SEQ ID NO: 603659 - DNA, 20 bp, Artificial
  CRISPR gRNA sequence
agtagctgggactacaggca

SEQ ID NO: 603660 - DNA, 20 bp, Artificial
  CRISPR gRNA sequence
gtagctgggactacaggcac

SEQ ID NO: 603661 - DNA, 20 bp, Artificial
  CRISPR gRNA sequence
ttttttaaatgttttttgta

SEQ ID NO: 603662 - DNA, 20 bp, Artificial
  CRISPR gRNA sequence
taaatgttttttgtacagac

SEQ ID NO: 603663 - DNA, 20 bp, Artificial
  CRISPR gRNA sequence
caagatcccactgtgtttcc

SEQ ID NO: 603664 - DNA, 20 bp, Artificial
  CRISPR gRNA sequence
aagatcccactgtgtttccc

SEQ ID NO: 603665 - DNA, 20 bp, Artificial
  CRISPR gRNA sequence
tcccactgtgtttcccaggc

SEQ ID NO: 603666 - DNA, 20 bp, Artificial
  CRISPR gRNA sequence
ccaggctggtcttgaactcc

SEQ ID NO: 603667 - DNA, 20 bp, Artificial
  CRISPR gRNA sequence
ggtcttgaactcctggactc

SEQ ID NO: 603668 - DNA, 20 bp, Artificial
  CRISPR gRNA sequence
ctcaagcaatccacccgcct

SEQ ID NO: 603669 - DNA, 20 bp, Artificial
  CRISPR gRNA sequence
gccttggcctcccaaaatgc

SEQ ID NO: 603670 - DNA, 20 bp, Artificial
  CRISPR gRNA sequence
ccttggcctcccaaaatgct

SEQ ID NO: 603671 - DNA, 20 bp, Artificial
  CRISPR gRNA sequence
ctcccaaaatgctgggatta

SEQ ID NO: 603672 - DNA, 20 bp, Artificial
  CRISPR gRNA sequence
aatgctgggattacagatgt

SEQ ID NO: 603673 - DNA, 20 bp, Artificial
  CRISPR gRNA sequence
gatgtgagccactgtgcccc

SEQ ID NO: 603674 - DNA, 20 bp, Artificial
  CRISPR gRNA sequence
gccactgtgcccccagcctg

SEQ ID NO: 603675 - DNA, 20 bp, Artificial
  CRISPR gRNA sequence
ccagcctgcagaaattctta

SEQ ID NO: 603676 - DNA, 20 bp, Artificial
  CRISPR gRNA sequence
agcctgcagaaattcttaaa

SEQ ID NO: 603677 - DNA, 20 bp, Artificial
  CRISPR gRNA sequence
aaagagcatttactgtgtat

SEQ ID NO: 603678 - DNA, 20 bp, Artificial
  CRISPR gRNA sequence
aagagcatttactgtgtatt

SEQ ID NO: 603679 - DNA, 20 bp, Artificial
  CRISPR gRNA sequence
tgtgtattaggcattgttct

SEQ ID NO: 603680 - DNA, 20 bp, Artificial
  CRISPR gRNA sequence
tgctttgcatataattcact

SEQ ID NO: 603681 - DNA, 20 bp, Artificial
  CRISPR gRNA sequence
ataattcacttagcaactca

SEQ ID NO: 603682 - DNA, 20 bp, Artificial
  CRISPR gRNA sequence
caactcaaagtatatctgtt

SEQ ID NO: 603683 - DNA, 20 bp, Artificial
  CRISPR gRNA sequence
tttctatgaccatgtaaaca

SEQ ID NO: 603684 - DNA, 20 bp, Artificial
  CRISPR gRNA sequence
tgaccatgtaaacatggaaa

SEQ ID NO: 603685 - DNA, 20 bp, Artificial
  CRISPR gRNA sequence
catgtaaacatggaaatgga

SEQ ID NO: 603686 - DNA, 20 bp, Artificial
  CRISPR gRNA sequence
atgtaaacatggaaatggat

SEQ ID NO: 603687 - DNA, 20 bp, Artificial
  CRISPR gRNA sequence
aaatggatgggattgtataa

SEQ ID NO: 603688 - DNA, 20 bp, Artificial
  CRISPR gRNA sequence
caacactgtttcatgtttct

SEQ ID NO: 603689 - DNA, 20 bp, Artificial
  CRISPR gRNA sequence
acatacattataattattaa

SEQ ID NO: 603690 - DNA, 20 bp, Artificial
  CRISPR gRNA sequence
attataattattaacagcta

SEQ ID NO: 603691 - DNA, 20 bp, Artificial
  CRISPR gRNA sequence
tataattattaacagctaca

SEQ ID NO: 603692 - DNA, 20 bp, Artificial
  CRISPR gRNA sequence
ctacagagtaattctttctg

SEQ ID NO: 603693 - DNA, 20 bp, Artificial
  CRISPR gRNA sequence
agtaattctttctgtggtaa

SEQ ID NO: 603694 - DNA, 20 bp, Artificial
  CRISPR gRNA sequence
ttctgtggtaatggactaac

SEQ ID NO: 603695 - DNA, 20 bp, Artificial
  CRISPR gRNA sequence
ttttttgtgttcctgtaacg

SEQ ID NO: 603696 - DNA, 20 bp, Artificial
  CRISPR gRNA sequence
ttgtgttcctgtaacgaaga

SEQ ID NO: 603697 - DNA, 20 bp, Artificial
  CRISPR gRNA sequence
gtgttcctgtaacgaagaaa

SEQ ID NO: 603698 - DNA, 20 bp, Artificial
  CRISPR gRNA sequence
gaagaaagagtttaacattt

SEQ ID NO: 603699 - DNA, 20 bp, Artificial
  CRISPR gRNA sequence
aaagagtttaacatttaaga

SEQ ID NO: 603700 - DNA, 20 bp, Artificial
  CRISPR gRNA sequence
gatttttgtttttctaaaaa

SEQ ID NO: 603701 - DNA, 20 bp, Artificial
  CRISPR gRNA sequence
ctaaaaatagtgttattaac

SEQ ID NO: 603702 - DNA, 20 bp, Artificial
  CRISPR gRNA sequence
aaaatagtgttattaactag

SEQ ID NO: 603703 - DNA, 20 bp, Artificial
  CRISPR gRNA sequence
aaatagtgttattaactaga

SEQ ID NO: 603704 - DNA, 20 bp, Artificial
  CRISPR gRNA sequence
tattaactagaaggtcaata

SEQ ID NO: 603705 - DNA, 20 bp, Artificial
  CRISPR gRNA sequence
ctgttatccctttacattaa

SEQ ID NO: 603706 - DNA, 20 bp, Artificial
  CRISPR gRNA sequence
gttatccctttacattaaaa

SEQ ID NO: 603707 - DNA, 20 bp, Artificial
  CRISPR gRNA sequence
ttatccctttacattaaaag

SEQ ID NO: 603708 - DNA, 20 bp, Artificial
  CRISPR gRNA sequence
tacattaaaagaggttcaaa

SEQ ID NO: 603709 - DNA, 20 bp, Artificial
  CRISPR gRNA sequence
aacagtgctttgctatattt

SEQ ID NO: 603710 - DNA, 20 bp, Artificial
  CRISPR gRNA sequence
cagtgctttgctatatttaa

SEQ ID NO: 603711 - DNA, 20 bp, Artificial
  CRISPR gRNA sequence
gttttacccatacacaaaat

SEQ ID NO: 603712 - DNA, 20 bp, Artificial
  CRISPR gRNA sequence
tacccatacacaaaataaga

SEQ ID NO: 603713 - DNA, 20 bp, Artificial
  CRISPR gRNA sequence
aagaaagctctgatgttaca

SEQ ID NO: 603714 - DNA, 20 bp, Artificial
  CRISPR gRNA sequence
acacccatacattgtaataa

SEQ ID NO: 603715 - DNA, 20 bp, Artificial
  CRISPR gRNA sequence
cacccatacattgtaataat

SEQ ID NO: 603716 - DNA, 20 bp, Artificial
  CRISPR gRNA sequence
acccatacattgtaataatg

SEQ ID NO: 603717 - DNA, 20 bp, Artificial
  CRISPR gRNA sequence
catacattgtaataatgggg

SEQ ID NO: 603718 - DNA, 20 bp, Artificial
  CRISPR gRNA sequence
attatttgctaaatgcttta

SEQ ID NO: 603719 - DNA, 20 bp, Artificial
  CRISPR gRNA sequence
tttaaagtaaaataaaatcc

SEQ ID NO: 603720 - DNA, 20 bp, Artificial
  CRISPR gRNA sequence
tgtgaatattttgacttttt

SEQ ID NO: 603721 - DNA, 20 bp, Artificial
  CRISPR gRNA sequence
ttttttggtttactgacatt

SEQ ID NO: 603722 - DNA, 20 bp, Artificial
  CRISPR gRNA sequence
gtttactgacatttggtgtt

SEQ ID NO: 603723 - DNA, 20 bp, Artificial
  CRISPR gRNA sequence
ttagcatttccattgtcttt

SEQ ID NO: 603724 - DNA, 20 bp, Artificial
  CRISPR gRNA sequence
ccattgtcttttggttttga

SEQ ID NO: 603725 - DNA, 20 bp, Artificial
  CRISPR gRNA sequence
cattgtcttttggttttgac

SEQ ID NO: 603726 - DNA, 20 bp, Artificial
  CRISPR gRNA sequence
tggttttgacgggaaaaact

SEQ ID NO: 603727 - DNA, 20 bp, Artificial
  CRISPR gRNA sequence
ataccaattatgactgttcc

SEQ ID NO: 603728 - DNA, 20 bp, Artificial
  CRISPR gRNA sequence
caattatgactgttccaaga

SEQ ID NO: 603729 - DNA, 20 bp, Artificial
  CRISPR gRNA sequence
gactgttccaagatagtaaa

SEQ ID NO: 603730 - DNA, 20 bp, Artificial
  CRISPR gRNA sequence
gtaaatggaacatacttgtt

SEQ ID NO: 603731 - DNA, 20 bp, Artificial
  CRISPR gRNA sequence
catacttgttgagattcaca

SEQ ID NO: 603732 - DNA, 20 bp, Artificial
  CRISPR gRNA sequence
tgttgagattcacatggttt

SEQ ID NO: 603733 - DNA, 20 bp, Artificial
  CRISPR gRNA sequence
tatccttttaatttattgtt

SEQ ID NO: 603734 - DNA, 20 bp, Artificial
  CRISPR gRNA sequence
atccttttaatttattgtta

SEQ ID NO: 603735 - DNA, 20 bp, Artificial
  CRISPR gRNA sequence
cttttaatttattgttaagg

SEQ ID NO: 603736 - DNA, 20 bp, Artificial
  CRISPR gRNA sequence
ttttaatttattgttaaggc

SEQ ID NO: 603737 - DNA, 20 bp, Artificial
  CRISPR gRNA sequence
ttaatttattgttaaggcag

SEQ ID NO: 603738 - DNA, 20 bp, Artificial
  CRISPR gRNA sequence
taaggcaggagttcaaatta

SEQ ID NO: 603739 - DNA, 20 bp, Artificial
  CRISPR gRNA sequence
caggagttcaaattatggac

SEQ ID NO: 603740 - DNA, 20 bp, Artificial
  CRISPR gRNA sequence
ttcaaattatggactggttt

SEQ ID NO: 603741 - DNA, 20 bp, Artificial
  CRISPR gRNA sequence
tcaaattatggactggtttc

SEQ ID NO: 603742 - DNA, 20 bp, Artificial
  CRISPR gRNA sequence
caaattatggactggtttca

SEQ ID NO: 603743 - DNA, 20 bp, Artificial
  CRISPR gRNA sequence
tggtttcagggtgtgaacat

SEQ ID NO: 603744 - DNA, 20 bp, Artificial
  CRISPR gRNA sequence
atcagtctctgattataatt

SEQ ID NO: 603745 - DNA, 20 bp, Artificial
  CRISPR gRNA sequence
tcagtctctgattataattc

SEQ ID NO: 603746 - DNA, 20 bp, Artificial
  CRISPR gRNA sequence
agtctctgattataattcag

SEQ ID NO: 603747 - DNA, 20 bp, Artificial
  CRISPR gRNA sequence
attataattcaggagatatg

SEQ ID NO: 603748 - DNA, 20 bp, Artificial
  CRISPR gRNA sequence
tcaggagatatgtggatctg

SEQ ID NO: 603749 - DNA, 20 bp, Artificial
  CRISPR gRNA sequence
atatgtggatctgaagttga

SEQ ID NO: 603750 - DNA, 20 bp, Artificial
  CRISPR gRNA sequence
gtggatctgaagttgatgga

SEQ ID NO: 603751 - DNA, 20 bp, Artificial
  CRISPR gRNA sequence
tggatctgaagttgatggac

SEQ ID NO: 603752 - DNA, 20 bp, Artificial
  CRISPR gRNA sequence
aagttgatggacaggctgcc

SEQ ID NO: 603753 - DNA, 20 bp, Artificial
  CRISPR gRNA sequence
tgatggacaggctgcctggt

SEQ ID NO: 603754 - DNA, 20 bp, Artificial
  CRISPR gRNA sequence
ggacaggctgcctggttagc

SEQ ID NO: 603755 - DNA, 20 bp, Artificial
  CRISPR gRNA sequence
gacaggctgcctggttagcc

SEQ ID NO: 603756 - DNA, 20 bp, Artificial
  CRISPR gRNA sequence
ggctgcctggttagccaggc

SEQ ID NO: 603757 - DNA, 20 bp, Artificial
  CRISPR gRNA sequence
aggcaagctcccattatctc

SEQ ID NO: 603758 - DNA, 20 bp, Artificial
  CRISPR gRNA sequence
tctcaagaacctctgctgat

SEQ ID NO: 603759 - DNA, 20 bp, Artificial
  CRISPR gRNA sequence
gattagtttgctatcatttt

SEQ ID NO: 603760 - DNA, 20 bp, Artificial
  CRISPR gRNA sequence
ttagtttgctatcattttga

SEQ ID NO: 603761 - DNA, 20 bp, Artificial
  CRISPR gRNA sequence
gagagacctcactatgaaaa

SEQ ID NO: 603762 - DNA, 20 bp, Artificial
  CRISPR gRNA sequence
tatgaaaacagacattttcc

SEQ ID NO: 603763 - DNA, 20 bp, Artificial
  CRISPR gRNA sequence
atgaaaacagacattttccc

SEQ ID NO: 603764 - DNA, 20 bp, Artificial
  CRISPR gRNA sequence
tgaaaacagacattttccca

SEQ ID NO: 603765 - DNA, 20 bp, Artificial
  CRISPR gRNA sequence
aaacagacattttcccaggg

SEQ ID NO: 603766 - DNA, 20 bp, Artificial
  CRISPR gRNA sequence
cagacattttcccagggtgg

SEQ ID NO: 603767 - DNA, 20 bp, Artificial
  CRISPR gRNA sequence
gacattttcccagggtggca

SEQ ID NO: 603768 - DNA, 20 bp, Artificial
  CRISPR gRNA sequence
cattttcccagggtggcaga

SEQ ID NO: 603769 - DNA, 20 bp, Artificial
  CRISPR gRNA sequence
cccagggtggcagagagata

SEQ ID NO: 603770 - DNA, 20 bp, Artificial
  CRISPR gRNA sequence
ccagggtggcagagagataa

SEQ ID NO: 603771 - DNA, 20 bp, Artificial
  CRISPR gRNA sequence
taaaggaaatattcgctatg

SEQ ID NO: 603772 - DNA, 20 bp, Artificial
  CRISPR gRNA sequence
cttccattgttttatgccta

SEQ ID NO: 603773 - DNA, 20 bp, Artificial
  CRISPR gRNA sequence
gcctatggaattttatttaa

SEQ ID NO: 603774 - DNA, 20 bp, Artificial
  CRISPR gRNA sequence
tggaattttatttaatagta

SEQ ID NO: 603775 - DNA, 20 bp, Artificial
  CRISPR gRNA sequence
aatagtatagcatatttatt

SEQ ID NO: 603776 - DNA, 20 bp, Artificial
  CRISPR gRNA sequence
atagtatagcatatttattc

SEQ ID NO: 603777 - DNA, 20 bp, Artificial
  CRISPR gRNA sequence
agtatagcatatttattcag

SEQ ID NO: 603778 - DNA, 20 bp, Artificial
  CRISPR gRNA sequence
gtatagcatatttattcagg

SEQ ID NO: 603779 - DNA, 20 bp, Artificial
  CRISPR gRNA sequence
atagcatatttattcaggag

SEQ ID NO: 603780 - DNA, 20 bp, Artificial
  CRISPR gRNA sequence
atatttattcaggaggagac

SEQ ID NO: 603781 - DNA, 20 bp, Artificial
  CRISPR gRNA sequence
gactagtgttgtttactctc

SEQ ID NO: 603782 - DNA, 20 bp, Artificial
  CRISPR gRNA sequence
tccttcctcatacctcaaat

SEQ ID NO: 603783 - DNA, 20 bp, Artificial
  CRISPR gRNA sequence
ccttcctcatacctcaaatt

SEQ ID NO: 603784 - DNA, 20 bp, Artificial
  CRISPR gRNA sequence
attaggatcgtttcatattt

SEQ ID NO: 603785 - DNA, 20 bp, Artificial
  CRISPR gRNA sequence
tttcatatttaagacattgt

SEQ ID NO: 603786 - DNA, 20 bp, Artificial
  CRISPR gRNA sequence
aagacatgatactattttct

SEQ ID NO: 603787 - DNA, 20 bp, Artificial
  CRISPR gRNA sequence
atgatactattttcttagac

SEQ ID NO: 603788 - DNA, 20 bp, Artificial
  CRISPR gRNA sequence
cctgacattgattaaaactt

SEQ ID NO: 603789 - DNA, 20 bp, Artificial
  CRISPR gRNA sequence
cgtatcgaatactgaatgaa

SEQ ID NO: 603790 - DNA, 20 bp, Artificial
  CRISPR gRNA sequence
gaatactgaatgaatggaat

SEQ ID NO: 603791 - DNA, 20 bp, Artificial
  CRISPR gRNA sequence
aatactgaatgaatggaatt

SEQ ID NO: 603792 - DNA, 20 bp, Artificial
  CRISPR gRNA sequence
tgaatgaatggaattaggtt

SEQ ID NO: 603793 - DNA, 20 bp, Artificial
  CRISPR gRNA sequence
gaattaggtttagacctgtg

SEQ ID NO: 603794 - DNA, 20 bp, Artificial
  CRISPR gRNA sequence
aattaggtttagacctgtgt

SEQ ID NO: 603795 - DNA, 20 bp, Artificial
  CRISPR gRNA sequence
tagacctgtgtaggaacatg

SEQ ID NO: 603796 - DNA, 20 bp, Artificial
  CRISPR gRNA sequence
gattgtatatatttattatc

SEQ ID NO: 603797 - DNA, 20 bp, Artificial
  CRISPR gRNA sequence
tttattatccagctttttca

SEQ ID NO: 603798 - DNA, 20 bp, Artificial
  CRISPR gRNA sequence
ttttcacagctgccatcatc

SEQ ID NO: 603799 - DNA, 20 bp, Artificial
  CRISPR gRNA sequence
actgtgattccgccttcttt

SEQ ID NO: 603800 - DNA, 20 bp, Artificial
  CRISPR gRNA sequence
tgattccgccttctttgagc

SEQ ID NO: 603801 - DNA, 20 bp, Artificial
  CRISPR gRNA sequence
actacactgttgtaactttt

SEQ ID NO: 603802 - DNA, 20 bp, Artificial
  CRISPR gRNA sequence
ctacactgttgtaactttta

SEQ ID NO: 603803 - DNA, 20 bp, Artificial
  CRISPR gRNA sequence
tacactgttgtaacttttaa

SEQ ID NO: 603804 - DNA, 20 bp, Artificial
  CRISPR gRNA sequence
acgtgcatttgccttcattc

SEQ ID NO: 603805 - DNA, 20 bp, Artificial
  CRISPR gRNA sequence
atttgccttcattctagaaa

SEQ ID NO: 603806 - DNA, 20 bp, Artificial
  CRISPR gRNA sequence
tttgccttcattctagaaat

SEQ ID NO: 603807 - DNA, 20 bp, Artificial
  CRISPR gRNA sequence
ctttgatttttttttttttt

SEQ ID NO: 603808 - DNA, 20 bp, Artificial
  CRISPR gRNA sequence
gattttttttttttttgaga

SEQ ID NO: 603809 - DNA, 20 bp, Artificial
  CRISPR gRNA sequence
ttttttttttttttgagatg

SEQ ID NO: 603810 - DNA, 20 bp, Artificial
  CRISPR gRNA sequence
atggagtctcactctgtcac

SEQ ID NO: 603811 - DNA, 20 bp, Artificial
  CRISPR gRNA sequence
tggagtctcactctgtcacc

SEQ ID NO: 603812 - DNA, 20 bp, Artificial
  CRISPR gRNA sequence
gtctcactctgtcaccaggc

SEQ ID NO: 603813 - DNA, 20 bp, Artificial
  CRISPR gRNA sequence
ctcactctgtcaccaggctg

SEQ ID NO: 603814 - DNA, 20 bp, Artificial
  CRISPR gRNA sequence
tctgtcaccaggctggagtg

SEQ ID NO: 603815 - DNA, 20 bp, Artificial
  CRISPR gRNA sequence
gtcaccaggctggagtgcag

SEQ ID NO: 603816 - DNA, 20 bp, Artificial
  CRISPR gRNA sequence
tggagtgcagtggcaccatc

SEQ ID NO: 603817 - DNA, 20 bp, Artificial
  CRISPR gRNA sequence
ggagtgcagtggcaccatct

SEQ ID NO: 603818 - DNA, 20 bp, Artificial
  CRISPR gRNA sequence
ggcaccatctgggctcacta

SEQ ID NO: 603819 - DNA, 20 bp, Artificial
  CRISPR gRNA sequence
ggctcactacagttgcctcc

SEQ ID NO: 603820 - DNA, 20 bp, Artificial
  CRISPR gRNA sequence
gctcactacagttgcctccc

SEQ ID NO: 603821 - DNA, 20 bp, Artificial
  CRISPR gRNA sequence
tacagttgcctcccgggttc

SEQ ID NO: 603822 - DNA, 20 bp, Artificial
  CRISPR gRNA sequence
ttcaagtgattttcctgcct

SEQ ID NO: 603823 - DNA, 20 bp, Artificial
  CRISPR gRNA sequence
ttttcctgcctcagcctcct

SEQ ID NO: 603824 - DNA, 20 bp, Artificial
  CRISPR gRNA sequence
tcctgcctcagcctcctgag

SEQ ID NO: 603825 - DNA, 20 bp, Artificial
  CRISPR gRNA sequence
gcctcagcctcctgagtagc

SEQ ID NO: 603826 - DNA, 20 bp, Artificial
  CRISPR gRNA sequence
cctcagcctcctgagtagct

SEQ ID NO: 603827 - DNA, 20 bp, Artificial
  CRISPR gRNA sequence
ctcctgagtagctgggacta

SEQ ID NO: 603828 - DNA, 20 bp, Artificial
  CRISPR gRNA sequence
tcctgagtagctgggactac

SEQ ID NO: 603829 - DNA, 20 bp, Artificial
  CRISPR gRNA sequence
caggcgcgcgctaccatgcc

SEQ ID NO: 603830 - DNA, 20 bp, Artificial
  CRISPR gRNA sequence
ccagctaatttttgtatttt

SEQ ID NO: 603831 - DNA, 20 bp, Artificial
  CRISPR gRNA sequence
gctaatttttgtatttttag

SEQ ID NO: 603832 - DNA, 20 bp, Artificial
  CRISPR gRNA sequence
taatttttgtatttttagta

SEQ ID NO: 603833 - DNA, 20 bp, Artificial
  CRISPR gRNA sequence
tttgtatttttagtagagat

SEQ ID NO: 603834 - DNA, 20 bp, Artificial
  CRISPR gRNA sequence
ttgtatttttagtagagatg

SEQ ID NO: 603835 - DNA, 20 bp, Artificial
  CRISPR gRNA sequence
gagatgaggtttcaccatgt

SEQ ID NO: 603836 - DNA, 20 bp, Artificial
  CRISPR gRNA sequence
tgaggtttcaccatgttggc

SEQ ID NO: 603837 - DNA, 20 bp, Artificial
  CRISPR gRNA sequence
gaggtttcaccatgttggcc

SEQ ID NO: 603838 - DNA, 20 bp, Artificial
  CRISPR gRNA sequence
tttcaccatgttggccagga

SEQ ID NO: 603839 - DNA, 20 bp, Artificial
  CRISPR gRNA sequence
tcttgacctcgtgatccgcc

SEQ ID NO: 603840 - DNA, 20 bp, Artificial
  CRISPR gRNA sequence
cttgacctcgtgatccgccc

SEQ ID NO: 603841 - DNA, 20 bp, Artificial
  CRISPR gRNA sequence
ccgcccaggttgccctccca

SEQ ID NO: 603842 - DNA, 20 bp, Artificial
  CRISPR gRNA sequence
aggttgccctcccaaagtgc

SEQ ID NO: 603843 - DNA, 20 bp, Artificial
  CRISPR gRNA sequence
ggttgccctcccaaagtgct

SEQ ID NO: 603844 - DNA, 20 bp, Artificial
  CRISPR gRNA sequence
ctcccaaagtgctgggatta

SEQ ID NO: 603845 - DNA, 20 bp, Artificial
  CRISPR gRNA sequence
tcccaaagtgctgggattat

SEQ ID NO: 603846 - DNA, 20 bp, Artificial
  CRISPR gRNA sequence
ccaaagtgctgggattatag

SEQ ID NO: 603847 - DNA, 20 bp, Artificial
  CRISPR gRNA sequence
agtgctgggattataggagt

SEQ ID NO: 603848 - DNA, 20 bp, Artificial
  CRISPR gRNA sequence
taggagtgagccaccgcacc

SEQ ID NO: 603849 - DNA, 20 bp, Artificial
  CRISPR gRNA sequence
agcctgtgcttttgtttctt

SEQ ID NO: 603850 - DNA, 20 bp, Artificial
  CRISPR gRNA sequence
cctgtgcttttgtttcttaa

SEQ ID NO: 603851 - DNA, 20 bp, Artificial
  CRISPR gRNA sequence
ctgtgcttttgtttcttaag

SEQ ID NO: 603852 - DNA, 20 bp, Artificial
  CRISPR gRNA sequence
tgatcaaaatcatattaaat

SEQ ID NO: 603853 - DNA, 20 bp, Artificial
  CRISPR gRNA sequence
atattaaatcagttactgtt

SEQ ID NO: 603854 - DNA, 20 bp, Artificial
  CRISPR gRNA sequence
tattaaatcagttactgttc

SEQ ID NO: 603855 - DNA, 20 bp, Artificial
  CRISPR gRNA sequence
gttcacattttcacactttt

SEQ ID NO: 603856 - DNA, 20 bp, Artificial
  CRISPR gRNA sequence
cacattttcacactttttgg

SEQ ID NO: 603857 - DNA, 20 bp, Artificial
  CRISPR gRNA sequence
cacactttttggaagacttt

SEQ ID NO: 603858 - DNA, 20 bp, Artificial
  CRISPR gRNA sequence
ttggaaaaatctcttaccct

SEQ ID NO: 603859 - DNA, 20 bp, Artificial
  CRISPR gRNA sequence
cattttcatacactttattt

SEQ ID NO: 603860 - DNA, 20 bp, Artificial
  CRISPR gRNA sequence
attttcatacactttatttt

SEQ ID NO: 603861 - DNA, 20 bp, Artificial
  CRISPR gRNA sequence
ttcatacactttattttggg

SEQ ID NO: 603862 - DNA, 20 bp, Artificial
  CRISPR gRNA sequence
tcatacactttattttggga

SEQ ID NO: 603863 - DNA, 20 bp, Artificial
  CRISPR gRNA sequence
ctttattttgggaaggcatt

SEQ ID NO: 603864 - DNA, 20 bp, Artificial
  CRISPR gRNA sequence
gggaaggcatttggttcatt

SEQ ID NO: 603865 - DNA, 20 bp, Artificial
  CRISPR gRNA sequence
attcagtgtcatacatcaca

SEQ ID NO: 603866 - DNA, 20 bp, Artificial
  CRISPR gRNA sequence
cactattaattccatttctc

SEQ ID NO: 603867 - DNA, 20 bp, Artificial
  CRISPR gRNA sequence
catttctcaagtccatccaa

SEQ ID NO: 603868 - DNA, 20 bp, Artificial
  CRISPR gRNA sequence
tccatccaacagtaaataaa

SEQ ID NO: 603869 - DNA, 20 bp, Artificial
  CRISPR gRNA sequence
atccaacagtaaataaatgg

SEQ ID NO: 603870 - DNA, 20 bp, Artificial
  CRISPR gRNA sequence
cagtaaataaatggaagaaa

SEQ ID NO: 603871 - DNA, 20 bp, Artificial
  CRISPR gRNA sequence
agtaaataaatggaagaaat

SEQ ID NO: 603872 - DNA, 20 bp, Artificial
  CRISPR gRNA sequence
aataaatggaagaaatagga

SEQ ID NO: 603873 - DNA, 20 bp, Artificial
  CRISPR gRNA sequence
ataaatggaagaaataggaa

SEQ ID NO: 603874 - DNA, 20 bp, Artificial
  CRISPR gRNA sequence
aatggaagaaataggaaagg

SEQ ID NO: 603875 - DNA, 20 bp, Artificial
  CRISPR gRNA sequence
taggaaaggaagaaaaaact

SEQ ID NO: 603876 - DNA, 20 bp, Artificial
  CRISPR gRNA sequence
tttaattcaaaataacgttt

SEQ ID NO: 603877 - DNA, 20 bp, Artificial
  CRISPR gRNA sequence
tttctgtaacaatttacatt

SEQ ID NO: 603878 - DNA, 20 bp, Artificial
  CRISPR gRNA sequence
ttctgtaacaatttacattt

SEQ ID NO: 603879 - DNA, 20 bp, Artificial
  CRISPR gRNA sequence
tttacatttaggatctctca

SEQ ID NO: 603880 - DNA, 20 bp, Artificial
  CRISPR gRNA sequence
atctctcaaagtcaaactat

SEQ ID NO: 603881 - DNA, 20 bp, Artificial
  CRISPR gRNA sequence
caaactatcagaatacttgt

SEQ ID NO: 603882 - DNA, 20 bp, Artificial
  CRISPR gRNA sequence
aactatcagaatacttgtca

SEQ ID NO: 603883 - DNA, 20 bp, Artificial
  CRISPR gRNA sequence
acatccacacctttttatta

SEQ ID NO: 603884 - DNA, 20 bp, Artificial
  CRISPR gRNA sequence
atccacacctttttattata

SEQ ID NO: 603885 - DNA, 20 bp, Artificial
  CRISPR gRNA sequence
tccacacctttttattatag

SEQ ID NO: 603886 - DNA, 20 bp, Artificial
  CRISPR gRNA sequence
acacctttttattatagagg

SEQ ID NO: 603887 - DNA, 20 bp, Artificial
  CRISPR gRNA sequence
tatagaggaagatttgattt

SEQ ID NO: 603888 - DNA, 20 bp, Artificial
  CRISPR gRNA sequence
atttgattttagattactct

SEQ ID NO: 603889 - DNA, 20 bp, Artificial
  CRISPR gRNA sequence
tttgattttagattactctg

SEQ ID NO: 603890 - DNA, 20 bp, Artificial
  CRISPR gRNA sequence
gattttagattactctgagg

SEQ ID NO: 603891 - DNA, 20 bp, Artificial
  CRISPR gRNA sequence
tgaggaagaaaatttttttt

SEQ ID NO: 603892 - DNA, 20 bp, Artificial
  CRISPR gRNA sequence
gaggaagaaaattttttttc

SEQ ID NO: 603893 - DNA, 20 bp, Artificial
  CRISPR gRNA sequence
tcaggaaaacctattatcct

SEQ ID NO: 603894 - DNA, 20 bp, Artificial
  CRISPR gRNA sequence
gaaaatatattgaaaacttt

SEQ ID NO: 603895 - DNA, 20 bp, Artificial
  CRISPR gRNA sequence
atatattgaaaactttcagt

SEQ ID NO: 603896 - DNA, 20 bp, Artificial
  CRISPR gRNA sequence
tattatttgaactcaaaatt

SEQ ID NO: 603897 - DNA, 20 bp, Artificial
  CRISPR gRNA sequence
ttatttgaactcaaaatttg

SEQ ID NO: 603898 - DNA, 20 bp, Artificial
  CRISPR gRNA sequence
ttgaactcaaaatttggagt

SEQ ID NO: 603899 - DNA, 20 bp, Artificial
  CRISPR gRNA sequence
tgaactcaaaatttggagtt

SEQ ID NO: 603900 - DNA, 20 bp, Artificial
  CRISPR gRNA sequence
ttggagttgggtgtcaatgt

SEQ ID NO: 603901 - DNA, 20 bp, Artificial
  CRISPR gRNA sequence
ggagttgggtgtcaatgtta

SEQ ID NO: 603902 - DNA, 20 bp, Artificial
  CRISPR gRNA sequence
ggtgtcaatgttagagattt

SEQ ID NO: 603903 - DNA, 20 bp, Artificial
  CRISPR gRNA sequence
gtgtcaatgttagagatttt

SEQ ID NO: 603904 - DNA, 20 bp, Artificial
  CRISPR gRNA sequence
tcaatgttagagattttagg

SEQ ID NO: 603905 - DNA, 20 bp, Artificial
  CRISPR gRNA sequence
gagattttaggaagacattt

SEQ ID NO: 603906 - DNA, 20 bp, Artificial
  CRISPR gRNA sequence
agattttaggaagacattta

SEQ ID NO: 603907 - DNA, 20 bp, Artificial
  CRISPR gRNA sequence
ttttaggaagacatttaagg

SEQ ID NO: 603908 - DNA, 20 bp, Artificial
  CRISPR gRNA sequence
ttaggaagacatttaaggca

SEQ ID NO: 603909 - DNA, 20 bp, Artificial
  CRISPR gRNA sequence
agacatttaaggcagagaac

SEQ ID NO: 603910 - DNA, 20 bp, Artificial
  CRISPR gRNA sequence
gacatttaaggcagagaacc

SEQ ID NO: 603911 - DNA, 20 bp, Artificial
  CRISPR gRNA sequence
taaggcagagaaccaggctc

SEQ ID NO: 603912 - DNA, 20 bp, Artificial
  CRISPR gRNA sequence
aggcagagaaccaggctcaa

SEQ ID NO: 603913 - DNA, 20 bp, Artificial
  CRISPR gRNA sequence
accaggctcaagagatgtat

SEQ ID NO: 603914 - DNA, 20 bp, Artificial
  CRISPR gRNA sequence
ttagacgtaactgattatta

SEQ ID NO: 603915 - DNA, 20 bp, Artificial
  CRISPR gRNA sequence
tagacgtaactgattattac

SEQ ID NO: 603916 - DNA, 20 bp, Artificial
  CRISPR gRNA sequence
actgattattacaggtatat

SEQ ID NO: 603917 - DNA, 20 bp, Artificial
  CRISPR gRNA sequence
ctgattattacaggtatatt

SEQ ID NO: 603918 - DNA, 20 bp, Artificial
  CRISPR gRNA sequence
gattattacaggtatattag

SEQ ID NO: 603919 - DNA, 20 bp, Artificial
  CRISPR gRNA sequence
attattacaggtatattagg

SEQ ID NO: 603920 - DNA, 20 bp, Artificial
  CRISPR gRNA sequence
tattacaggtatattaggag

SEQ ID NO: 603921 - DNA, 20 bp, Artificial
  CRISPR gRNA sequence
caggtatattaggaggagtt

SEQ ID NO: 603922 - DNA, 20 bp, Artificial
  CRISPR gRNA sequence
aggtatattaggaggagttt

SEQ ID NO: 603923 - DNA, 20 bp, Artificial
  CRISPR gRNA sequence
ttaggaggagtttgggattg

SEQ ID NO: 603924 - DNA, 20 bp, Artificial
  CRISPR gRNA sequence
ggagtttgggattgcagttg

SEQ ID NO: 603925 - DNA, 20 bp, Artificial
  CRISPR gRNA sequence
gtttgggattgcagttgcag

SEQ ID NO: 603926 - DNA, 20 bp, Artificial
  CRISPR gRNA sequence
tttgggattgcagttgcagt

SEQ ID NO: 603927 - DNA, 20 bp, Artificial
  CRISPR gRNA sequence
tgggattgcagttgcagtgg

SEQ ID NO: 603928 - DNA, 20 bp, Artificial
  CRISPR gRNA sequence
attgcagttgcagtgggaga

SEQ ID NO: 603929 - DNA, 20 bp, Artificial
  CRISPR gRNA sequence
ttgcagttgcagtgggagat

SEQ ID NO: 603930 - DNA, 20 bp, Artificial
  CRISPR gRNA sequence
gcagtgggagataggcattc

SEQ ID NO: 603931 - DNA, 20 bp, Artificial
  CRISPR gRNA sequence
ataggcattctggccattgc

SEQ ID NO: 603932 - DNA, 20 bp, Artificial
  CRISPR gRNA sequence
gcacttgtcatccttgtgat

SEQ ID NO: 603933 - DNA, 20 bp, Artificial
  CRISPR gRNA sequence
ccttgtgatgagtataaaaa

SEQ ID NO: 603934 - DNA, 20 bp, Artificial
  CRISPR gRNA sequence
ccttgcccctccttgctcaa

SEQ ID NO: 603935 - DNA, 20 bp, Artificial
  CRISPR gRNA sequence
gctcaatagatgccaacttt

SEQ ID NO: 603936 - DNA, 20 bp, Artificial
  CRISPR gRNA sequence
caactttaagaatataatcc

SEQ ID NO: 603937 - DNA, 20 bp, Artificial
  CRISPR gRNA sequence
aactttaagaatataatccc

SEQ ID NO: 603938 - DNA, 20 bp, Artificial
  CRISPR gRNA sequence
aatataatcccaggcacatt

SEQ ID NO: 603939 - DNA, 20 bp, Artificial
  CRISPR gRNA sequence
cactccttccctaaaacaat

SEQ ID NO: 603940 - DNA, 20 bp, Artificial
  CRISPR gRNA sequence
ttagaaaaaacgtatgtgcc

SEQ ID NO: 603941 - DNA, 20 bp, Artificial
  CRISPR gRNA sequence
acgtatgtgccaagtatcaa

SEQ ID NO: 603942 - DNA, 20 bp, Artificial
  CRISPR gRNA sequence
cgtatgtgccaagtatcaat

SEQ ID NO: 603943 - DNA, 20 bp, Artificial
  CRISPR gRNA sequence
gtgccaagtatcaataggta

SEQ ID NO: 603944 - DNA, 20 bp, Artificial
  CRISPR gRNA sequence
agtatcaataggtacagctg

SEQ ID NO: 603945 - DNA, 20 bp, Artificial
  CRISPR gRNA sequence
tcaataggtacagctgaaga

SEQ ID NO: 603946 - DNA, 20 bp, Artificial
  CRISPR gRNA sequence
aataggtacagctgaagaaa

SEQ ID NO: 603947 - DNA, 20 bp, Artificial
  CRISPR gRNA sequence
taggtacagctgaagaaaga

SEQ ID NO: 603948 - DNA, 20 bp, Artificial
  CRISPR gRNA sequence
acagctgaagaaagagagat

SEQ ID NO: 603949 - DNA, 20 bp, Artificial
  CRISPR gRNA sequence
cagctgaagaaagagagata

SEQ ID NO: 603950 - DNA, 20 bp, Artificial
  CRISPR gRNA sequence
agctgaagaaagagagataa

SEQ ID NO: 603951 - DNA, 20 bp, Artificial
  CRISPR gRNA sequence
gctgaagaaagagagataag

SEQ ID NO: 603952 - DNA, 20 bp, Artificial
  CRISPR gRNA sequence
gagataaggggaaaaaaacc

SEQ ID NO: 603953 - DNA, 20 bp, Artificial
  CRISPR gRNA sequence
aaccaaacttcttacctcca

SEQ ID NO: 603954 - DNA, 20 bp, Artificial
  CRISPR gRNA sequence
agtaaattaactttgaaaca

SEQ ID NO: 603955 - DNA, 20 bp, Artificial
  CRISPR gRNA sequence
aaacatggttctttgttttt

SEQ ID NO: 603956 - DNA, 20 bp, Artificial
  CRISPR gRNA sequence
acatggttctttgtttttta

SEQ ID NO: 603957 - DNA, 20 bp, Artificial
  CRISPR gRNA sequence
ttctttgttttttagagaaa

SEQ ID NO: 603958 - DNA, 20 bp, Artificial
  CRISPR gRNA sequence
tttagagaaacagacatttg

SEQ ID NO: 603959 - DNA, 20 bp, Artificial
  CRISPR gRNA sequence
tagagaaacagacatttgca

SEQ ID NO: 603960 - DNA, 20 bp, Artificial
  CRISPR gRNA sequence
gaaacagacatttgcagagt

SEQ ID NO: 603961 - DNA, 20 bp, Artificial
  CRISPR gRNA sequence
aaacagacatttgcagagtt

SEQ ID NO: 603962 - DNA, 20 bp, Artificial
  CRISPR gRNA sequence
aacagacatttgcagagtta

SEQ ID NO: 603963 - DNA, 20 bp, Artificial
  CRISPR gRNA sequence
acagacatttgcagagttag

SEQ ID NO: 603964 - DNA, 20 bp, Artificial
  CRISPR gRNA sequence
gcagagttaggggatttctt

SEQ ID NO: 603965 - DNA, 20 bp, Artificial
  CRISPR gRNA sequence
tttcttgagattgtacctga

SEQ ID NO: 603966 - DNA, 20 bp, Artificial
  CRISPR gRNA sequence
cttgagattgtacctgaaag

SEQ ID NO: 603967 - DNA, 20 bp, Artificial
  CRISPR gRNA sequence
ttgagattgtacctgaaagt

SEQ ID NO: 603968 - DNA, 20 bp, Artificial
  CRISPR gRNA sequence
agattgtacctgaaagtagg

SEQ ID NO: 603969 - DNA, 20 bp, Artificial
  CRISPR gRNA sequence
aaagtaggtagtatatttac

SEQ ID NO: 603970 - DNA, 20 bp, Artificial
  CRISPR gRNA sequence
agtaggtagtatatttacta

SEQ ID NO: 603971 - DNA, 20 bp, Artificial
  CRISPR gRNA sequence
gtaggtagtatatttactag

SEQ ID NO: 603972 - DNA, 20 bp, Artificial
  CRISPR gRNA sequence
ataccatttgttttgtacaa

SEQ ID NO: 603973 - DNA, 20 bp, Artificial
  CRISPR gRNA sequence
tttgtacaatggataaatcc

SEQ ID NO: 603974 - DNA, 20 bp, Artificial
  CRISPR gRNA sequence
tacaatggataaatcccagc

SEQ ID NO: 603975 - DNA, 20 bp, Artificial
  CRISPR gRNA sequence
atcccagcaagcttatgtaa

SEQ ID NO: 603976 - DNA, 20 bp, Artificial
  CRISPR gRNA sequence
gtaatagtaaaattatgtgt

SEQ ID NO: 603977 - DNA, 20 bp, Artificial
  CRISPR gRNA sequence
gtaaaattatgtgtaagaaa

SEQ ID NO: 603978 - DNA, 20 bp, Artificial
  CRISPR gRNA sequence
taagaaaaagctattctcca

SEQ ID NO: 603979 - DNA, 20 bp, Artificial
  CRISPR gRNA sequence
aagaaaaagctattctccat

SEQ ID NO: 603980 - DNA, 20 bp, Artificial
  CRISPR gRNA sequence
gctattctccatgggctcta

SEQ ID NO: 603981 - DNA, 20 bp, Artificial
  CRISPR gRNA sequence
gggctctaaagttaactttg

SEQ ID NO: 603982 - DNA, 20 bp, Artificial
  CRISPR gRNA sequence
gctctaaagttaactttgaa

SEQ ID NO: 603983 - DNA, 20 bp, Artificial
  CRISPR gRNA sequence
ctctaaagttaactttgaag

SEQ ID NO: 603984 - DNA, 20 bp, Artificial
  CRISPR gRNA sequence
gaagaggccccaaaaaaact

SEQ ID NO: 603985 - DNA, 20 bp, Artificial
  CRISPR gRNA sequence
ggccccaaaaaaactgagtt

SEQ ID NO: 603986 - DNA, 20 bp, Artificial
  CRISPR gRNA sequence
gccccaaaaaaactgagtta

SEQ ID NO: 603987 - DNA, 20 bp, Artificial
  CRISPR gRNA sequence
ccaaaaaaactgagttaagg

SEQ ID NO: 603988 - DNA, 20 bp, Artificial
  CRISPR gRNA sequence
aaaaaaactgagttaaggaa

SEQ ID NO: 603989 - DNA, 20 bp, Artificial
  CRISPR gRNA sequence
aactgagttaaggaagagat

SEQ ID NO: 603990 - DNA, 20 bp, Artificial
  CRISPR gRNA sequence
gataagatcattctttcctc

SEQ ID NO: 603991 - DNA, 20 bp, Artificial
  CRISPR gRNA sequence
ataagatcattctttcctcc

SEQ ID NO: 603992 - DNA, 20 bp, Artificial
  CRISPR gRNA sequence
ctttcctccaggctgatttt

SEQ ID NO: 603993 - DNA, 20 bp, Artificial
  CRISPR gRNA sequence
ttaaactcctaaatactgta

SEQ ID NO: 603994 - DNA, 20 bp, Artificial
  CRISPR gRNA sequence
ctcctaaatactgtaaagat

SEQ ID NO: 603995 - DNA, 20 bp, Artificial
  CRISPR gRNA sequence
tcctaaatactgtaaagatt

SEQ ID NO: 603996 - DNA, 20 bp, Artificial
  CRISPR gRNA sequence
ctactctctgcataccattt

SEQ ID NO: 603997 - DNA, 20 bp, Artificial
  CRISPR gRNA sequence
tctgcataccatttcagaat

SEQ ID NO: 603998 - DNA, 20 bp, Artificial
  CRISPR gRNA sequence
cataccatttcagaatgagt

SEQ ID NO: 603999 - DNA, 20 bp, Artificial
  CRISPR gRNA sequence
taccatttcagaatgagttg

SEQ ID NO: 604000 - DNA, 20 bp, Artificial
  CRISPR gRNA sequence
gagttggagttgtaccatta

SEQ ID NO: 604001 - DNA, 20 bp, Artificial
  CRISPR gRNA sequence
taccattatagatctccact

SEQ ID NO: 604002 - DNA, 20 bp, Artificial
  CRISPR gRNA sequence
tagatctccactaagtctct

SEQ ID NO: 604003 - DNA, 20 bp, Artificial
  CRISPR gRNA sequence
agtgttatcaacttctttga

SEQ ID NO: 604004 - DNA, 20 bp, Artificial
  CRISPR gRNA sequence
tcaacttctttgatagtcat

SEQ ID NO: 604005 - DNA, 20 bp, Artificial
  CRISPR gRNA sequence
aacttctttgatagtcattg

SEQ ID NO: 604006 - DNA, 20 bp, Artificial
  CRISPR gRNA sequence
tctttgatagtcattggagc

SEQ ID NO: 604007 - DNA, 20 bp, Artificial
  CRISPR gRNA sequence
ctttgatagtcattggagca

SEQ ID NO: 604008 - DNA, 20 bp, Artificial
  CRISPR gRNA sequence
tttgatagtcattggagcaa

SEQ ID NO: 604009 - DNA, 20 bp, Artificial
  CRISPR gRNA sequence
gagcaagggacatccatata

SEQ ID NO: 604010 - DNA, 20 bp, Artificial
  CRISPR gRNA sequence
caagggacatccatataaag

SEQ ID NO: 604011 - DNA, 20 bp, Artificial
  CRISPR gRNA sequence
aagggacatccatataaagt

SEQ ID NO: 604012 - DNA, 20 bp, Artificial
  CRISPR gRNA sequence
tccatataaagtaggaataa

SEQ ID NO: 604013 - DNA, 20 bp, Artificial
  CRISPR gRNA sequence
catataaagtaggaataaaa

SEQ ID NO: 604014 - DNA, 20 bp, Artificial
  CRISPR gRNA sequence
aacttaatgattatttaact

SEQ ID NO: 604015 - DNA, 20 bp, Artificial
  CRISPR gRNA sequence
ttaacttagctaatatttac

SEQ ID NO: 604016 - DNA, 20 bp, Artificial
  CRISPR gRNA sequence
taatatttactggttatctc

SEQ ID NO: 604017 - DNA, 20 bp, Artificial
  CRISPR gRNA sequence
aatatttactggttatctca

SEQ ID NO: 604018 - DNA, 20 bp, Artificial
  CRISPR gRNA sequence
tggttatctcaaggccttga

SEQ ID NO: 604019 - DNA, 20 bp, Artificial
  CRISPR gRNA sequence
gttatctcaaggccttgaaa

SEQ ID NO: 604020 - DNA, 20 bp, Artificial
  CRISPR gRNA sequence
atctcaaggccttgaaagag

SEQ ID NO: 604021 - DNA, 20 bp, Artificial
  CRISPR gRNA sequence
aggccttgaaagagaagatc

SEQ ID NO: 604022 - DNA, 20 bp, Artificial
  CRISPR gRNA sequence
ttgaaagagaagatccagtt

SEQ ID NO: 604023 - DNA, 20 bp, Artificial
  CRISPR gRNA sequence
gattcactttaaaaaacaat

SEQ ID NO: 604024 - DNA, 20 bp, Artificial
  CRISPR gRNA sequence
ttaaaaaacaatcagatatt

SEQ ID NO: 604025 - DNA, 20 bp, Artificial
  CRISPR gRNA sequence
atcagatatttagattatat

SEQ ID NO: 604026 - DNA, 20 bp, Artificial
  CRISPR gRNA sequence
atgctcataattattttttt

SEQ ID NO: 604027 - DNA, 20 bp, Artificial
  CRISPR gRNA sequence
taattattttttttagatga

SEQ ID NO: 604028 - DNA, 20 bp, Artificial
  CRISPR gRNA sequence
aattattttttttagatgat

SEQ ID NO: 604029 - DNA, 20 bp, Artificial
  CRISPR gRNA sequence
tattttttttagatgatagg

SEQ ID NO: 604030 - DNA, 20 bp, Artificial
  CRISPR gRNA sequence
tatatctaatgatttctcca

SEQ ID NO: 604031 - DNA, 20 bp, Artificial
  CRISPR gRNA sequence
tctccacagtttttgtattt

SEQ ID NO: 604032 - DNA, 20 bp, Artificial
  CRISPR gRNA sequence
ctccacagtttttgtatttt

SEQ ID NO: 604033 - DNA, 20 bp, Artificial
  CRISPR gRNA sequence
tccacagtttttgtattttg

SEQ ID NO: 604034 - DNA, 20 bp, Artificial
  CRISPR gRNA sequence
tttttgtattttggggatgc

SEQ ID NO: 604035 - DNA, 20 bp, Artificial
  CRISPR gRNA sequence
atgcaagtttttgctttttt

SEQ ID NO: 604036 - DNA, 20 bp, Artificial
  CRISPR gRNA sequence
tttgctttttttagcaactg

SEQ ID NO: 604037 - DNA, 20 bp, Artificial
  CRISPR gRNA sequence
ttgctttttttagcaactgt

SEQ ID NO: 604038 - DNA, 20 bp, Artificial
  CRISPR gRNA sequence
tttttagcaactgtaggatc

SEQ ID NO: 604039 - DNA, 20 bp, Artificial
  CRISPR gRNA sequence
ttttagcaactgtaggatca

SEQ ID NO: 604040 - DNA, 20 bp, Artificial
  CRISPR gRNA sequence
tttagcaactgtaggatcaa

SEQ ID NO: 604041 - DNA, 20 bp, Artificial
  CRISPR gRNA sequence
taatctcaataaaaccctat

SEQ ID NO: 604042 - DNA, 20 bp, Artificial
  CRISPR gRNA sequence
aatctcaataaaaccctatg

SEQ ID NO: 604043 - DNA, 20 bp, Artificial
  CRISPR gRNA sequence
ctcaataaaaccctatgagg

SEQ ID NO: 604044 - DNA, 20 bp, Artificial
  CRISPR gRNA sequence
aaaccctatgaggtagatgc

SEQ ID NO: 604045 - DNA, 20 bp, Artificial
  CRISPR gRNA sequence
ctagtattgccccgctgtta

SEQ ID NO: 604046 - DNA, 20 bp, Artificial
  CRISPR gRNA sequence
gctgttatagatgaaaaact

SEQ ID NO: 604047 - DNA, 20 bp, Artificial
  CRISPR gRNA sequence
ctgttatagatgaaaaactg

SEQ ID NO: 604048 - DNA, 20 bp, Artificial
  CRISPR gRNA sequence
aaaaactgaggtgcaattaa

SEQ ID NO: 604049 - DNA, 20 bp, Artificial
  CRISPR gRNA sequence
aggtgcaattaaaagccatt

SEQ ID NO: 604050 - DNA, 20 bp, Artificial
  CRISPR gRNA sequence
gtgcaattaaaagccattaa

SEQ ID NO: 604051 - DNA, 20 bp, Artificial
  CRISPR gRNA sequence
tgcaattaaaagccattaag

SEQ ID NO: 604052 - DNA, 20 bp, Artificial
  CRISPR gRNA sequence
ttaaaagccattaagaggta

SEQ ID NO: 604053 - DNA, 20 bp, Artificial
  CRISPR gRNA sequence
taaagctgtgattcaaacct

SEQ ID NO: 604054 - DNA, 20 bp, Artificial
  CRISPR gRNA sequence
tgattcaaaccttggttgcc

SEQ ID NO: 604055 - DNA, 20 bp, Artificial
  CRISPR gRNA sequence
aaaccttggttgcctagttc

SEQ ID NO: 604056 - DNA, 20 bp, Artificial
  CRISPR gRNA sequence
agttccagaatccttcgtct

SEQ ID NO: 604057 - DNA, 20 bp, Artificial
  CRISPR gRNA sequence
ctgtaaattttaatttatta

SEQ ID NO: 604058 - DNA, 20 bp, Artificial
  CRISPR gRNA sequence
tgtaaattttaatttattat

SEQ ID NO: 604059 - DNA, 20 bp, Artificial
  CRISPR gRNA sequence
aattttaatttattatgggt

SEQ ID NO: 604060 - DNA, 20 bp, Artificial
  CRISPR gRNA sequence
attttaatttattatgggtt

SEQ ID NO: 604061 - DNA, 20 bp, Artificial
  CRISPR gRNA sequence
ttttaatttattatgggttg

SEQ ID NO: 604062 - DNA, 20 bp, Artificial
  CRISPR gRNA sequence
tttattatgggttggggaat

SEQ ID NO: 604063 - DNA, 20 bp, Artificial
  CRISPR gRNA sequence
tggggaatcggtgtaatgta

SEQ ID NO: 604064 - DNA, 20 bp, Artificial
  CRISPR gRNA sequence
atgtatagaaaccaacactt

SEQ ID NO: 604065 - DNA, 20 bp, Artificial
  CRISPR gRNA sequence
acactttagtaaaaatgata

SEQ ID NO: 604066 - DNA, 20 bp, Artificial
  CRISPR gRNA sequence
ttagtaaaaatgatatggaa

SEQ ID NO: 604067 - DNA, 20 bp, Artificial
  CRISPR gRNA sequence
tgatatggaatagaaaacgt

SEQ ID NO: 604068 - DNA, 20 bp, Artificial
  CRISPR gRNA sequence
gaatagaaaacgttagaata

SEQ ID NO: 604069 - DNA, 20 bp, Artificial
  CRISPR gRNA sequence
acgttagaatatggaatatt

SEQ ID NO: 604070 - DNA, 20 bp, Artificial
  CRISPR gRNA sequence
tagaatatggaatattgagc

SEQ ID NO: 604071 - DNA, 20 bp, Artificial
  CRISPR gRNA sequence
agaatatggaatattgagct

SEQ ID NO: 604072 - DNA, 20 bp, Artificial
  CRISPR gRNA sequence
atggaatattgagctgggcc

SEQ ID NO: 604073 - DNA, 20 bp, Artificial
  CRISPR gRNA sequence
gaatattgagctgggcccag

SEQ ID NO: 604074 - DNA, 20 bp, Artificial
  CRISPR gRNA sequence
gtggcttgcacctgtaattt

SEQ ID NO: 604075 - DNA, 20 bp, Artificial
  CRISPR gRNA sequence
cacctgtaattttagctatg

SEQ ID NO: 604076 - DNA, 20 bp, Artificial
  CRISPR gRNA sequence
ctgtaattttagctatgcag

SEQ ID NO: 604077 - DNA, 20 bp, Artificial
  CRISPR gRNA sequence
tgtaattttagctatgcaga

SEQ ID NO: 604078 - DNA, 20 bp, Artificial
  CRISPR gRNA sequence
ttttagctatgcagaaggct

SEQ ID NO: 604079 - DNA, 20 bp, Artificial
  CRISPR gRNA sequence
tttagctatgcagaaggctg

SEQ ID NO: 604080 - DNA, 20 bp, Artificial
  CRISPR gRNA sequence
gctatgcagaaggctgaggc

SEQ ID NO: 604081 - DNA, 20 bp, Artificial
  CRISPR gRNA sequence
tatgcagaaggctgaggcaa

SEQ ID NO: 604082 - DNA, 20 bp, Artificial
  CRISPR gRNA sequence
atgcagaaggctgaggcaag

SEQ ID NO: 604083 - DNA, 20 bp, Artificial
  CRISPR gRNA sequence
ctgaggcaagaggatcactt

SEQ ID NO: 604084 - DNA, 20 bp, Artificial
  CRISPR gRNA sequence
caagaggatcacttgagccc

SEQ ID NO: 604085 - DNA, 20 bp, Artificial
  CRISPR gRNA sequence
agaggatcacttgagccctg

SEQ ID NO: 604086 - DNA, 20 bp, Artificial
  CRISPR gRNA sequence
cacttgagccctggagttca

SEQ ID NO: 604087 - DNA, 20 bp, Artificial
  CRISPR gRNA sequence
tgagccctggagttcatggc

SEQ ID NO: 604088 - DNA, 20 bp, Artificial
  CRISPR gRNA sequence
ccctggagttcatggctagt

SEQ ID NO: 604089 - DNA, 20 bp, Artificial
  CRISPR gRNA sequence
gccactgcacaatctgtcac

SEQ ID NO: 604090 - DNA, 20 bp, Artificial
  CRISPR gRNA sequence
ccactgcacaatctgtcact

SEQ ID NO: 604091 - DNA, 20 bp, Artificial
  CRISPR gRNA sequence
actgcacaatctgtcactgg

SEQ ID NO: 604092 - DNA, 20 bp, Artificial
  CRISPR gRNA sequence
cacaatctgtcactgggaga

SEQ ID NO: 604093 - DNA, 20 bp, Artificial
  CRISPR gRNA sequence
acaatctgtcactgggagac

SEQ ID NO: 604094 - DNA, 20 bp, Artificial
  CRISPR gRNA sequence
caatctgtcactgggagaca

SEQ ID NO: 604095 - DNA, 20 bp, Artificial
  CRISPR gRNA sequence
ctgtcactgggagacagggt

SEQ ID NO: 604096 - DNA, 20 bp, Artificial
  CRISPR gRNA sequence
agaccctgtcttaaaaaaaa

SEQ ID NO: 604097 - DNA, 20 bp, Artificial
  CRISPR gRNA sequence
cctgtcttaaaaaaaaaaga

SEQ ID NO: 604098 - DNA, 20 bp, Artificial
  CRISPR gRNA sequence
gtcttaaaaaaaaaagaaag

SEQ ID NO: 604099 - DNA, 20 bp, Artificial
  CRISPR gRNA sequence
tcttaaaaaaaaaagaaaga

SEQ ID NO: 604100 - DNA, 20 bp, Artificial
  CRISPR gRNA sequence
aaaaaaaaaagaaagaagga

SEQ ID NO: 604101 - DNA, 20 bp, Artificial
  CRISPR gRNA sequence
gaaagaactatgattatgtg

SEQ ID NO: 604102 - DNA, 20 bp, Artificial
  CRISPR gRNA sequence
atgtgtagtattgtttcatt

SEQ ID NO: 604103 - DNA, 20 bp, Artificial
  CRISPR gRNA sequence
cataaacattaatatgtatt

SEQ ID NO: 604104 - DNA, 20 bp, Artificial
  CRISPR gRNA sequence
aatatgtatttagacataca

SEQ ID NO: 604105 - DNA, 20 bp, Artificial
  CRISPR gRNA sequence
catacatagacatatgtata

SEQ ID NO: 604106 - DNA, 20 bp, Artificial
  CRISPR gRNA sequence
catagacatatgtatatagt

SEQ ID NO: 604107 - DNA, 20 bp, Artificial
  CRISPR gRNA sequence
tatattttttattgtctgtc

SEQ ID NO: 604108 - DNA, 20 bp, Artificial
  CRISPR gRNA sequence
atattttttattgtctgtct

SEQ ID NO: 604109 - DNA, 20 bp, Artificial
  CRISPR gRNA sequence
tgtctgtctgggtcaaaaaa

SEQ ID NO: 604110 - DNA, 20 bp, Artificial
  CRISPR gRNA sequence
tgggtcaaaaaaaagtttgc

SEQ ID NO: 604111 - DNA, 20 bp, Artificial
  CRISPR gRNA sequence
caatctcaataccttgaaaa

SEQ ID NO: 604112 - DNA, 20 bp, Artificial
  CRISPR gRNA sequence
ccttgaaaatagttgatgtt

SEQ ID NO: 604113 - DNA, 20 bp, Artificial
  CRISPR gRNA sequence
atgttcagtaaatctgtact

SEQ ID NO: 604114 - DNA, 20 bp, Artificial
  CRISPR gRNA sequence
aataaaaaataacccataaa

SEQ ID NO: 604115 - DNA, 20 bp, Artificial
  CRISPR gRNA sequence
aaataacccataaacagtgt

SEQ ID NO: 604116 - DNA, 20 bp, Artificial
  CRISPR gRNA sequence
aataacccataaacagtgtt

SEQ ID NO: 604117 - DNA, 20 bp, Artificial
  CRISPR gRNA sequence
taggataaaatacttctgct

SEQ ID NO: 604118 - DNA, 20 bp, Artificial
  CRISPR gRNA sequence
ctgagcatataatttcccta

SEQ ID NO: 604119 - DNA, 20 bp, Artificial
  CRISPR gRNA sequence
gagcatataatttccctatg

SEQ ID NO: 604120 - DNA, 20 bp, Artificial
  CRISPR gRNA sequence
catataatttccctatggag

SEQ ID NO: 604121 - DNA, 20 bp, Artificial
  CRISPR gRNA sequence
atataatttccctatggagt

SEQ ID NO: 604122 - DNA, 20 bp, Artificial
  CRISPR gRNA sequence
tggagtaggactgaaaatgt

SEQ ID NO: 604123 - DNA, 20 bp, Artificial
  CRISPR gRNA sequence
gactgaaaatgttagtctca

SEQ ID NO: 604124 - DNA, 20 bp, Artificial
  CRISPR gRNA sequence
aattatcaaacataatctat

SEQ ID NO: 604125 - DNA, 20 bp, Artificial
  CRISPR gRNA sequence
tatacctgctcctcaaccta

SEQ ID NO: 604126 - DNA, 20 bp, Artificial
  CRISPR gRNA sequence
ttctcctctgcaaatctttc

SEQ ID NO: 604127 - DNA, 20 bp, Artificial
  CRISPR gRNA sequence
cctctgcaaatctttctggt

SEQ ID NO: 604128 - DNA, 20 bp, Artificial
  CRISPR gRNA sequence
tggtaattttttattgcttt

SEQ ID NO: 604129 - DNA, 20 bp, Artificial
  CRISPR gRNA sequence
ggtaattttttattgcttta

SEQ ID NO: 604130 - DNA, 20 bp, Artificial
  CRISPR gRNA sequence
ttttttattgctttaaggct

SEQ ID NO: 604131 - DNA, 20 bp, Artificial
  CRISPR gRNA sequence
tcttgtcctttaacaatatc

SEQ ID NO: 604132 - DNA, 20 bp, Artificial
  CRISPR gRNA sequence
ttaacaatatcaagtaataa

SEQ ID NO: 604133 - DNA, 20 bp, Artificial
  CRISPR gRNA sequence
tcaagtaataatagtccaaa

SEQ ID NO: 604134 - DNA, 20 bp, Artificial
  CRISPR gRNA sequence
agtaataatagtccaaaaag

SEQ ID NO: 604135 - DNA, 20 bp, Artificial
  CRISPR gRNA sequence
taataatagtccaaaaagaa

SEQ ID NO: 604136 - DNA, 20 bp, Artificial
  CRISPR gRNA sequence
aataatagtccaaaaagaag

SEQ ID NO: 604137 - DNA, 20 bp, Artificial
  CRISPR gRNA sequence
aatagtccaaaaagaagagg

SEQ ID NO: 604138 - DNA, 20 bp, Artificial
  CRISPR gRNA sequence
ttacaatttgaattccctga

SEQ ID NO: 604139 - DNA, 20 bp, Artificial
  CRISPR gRNA sequence
taataatttgttattaacaa

SEQ ID NO: 604140 - DNA, 20 bp, Artificial
  CRISPR gRNA sequence
ttaacaaaagaaatttattt

SEQ ID NO: 604141 - DNA, 20 bp, Artificial
  CRISPR gRNA sequence
acaaaagaaatttatttcag

SEQ ID NO: 604142 - DNA, 20 bp, Artificial
  CRISPR gRNA sequence
gaaatttatttcagcagtgc

SEQ ID NO: 604143 - DNA, 20 bp, Artificial
  CRISPR gRNA sequence
aaatttatttcagcagtgca

SEQ ID NO: 604144 - DNA, 20 bp, Artificial
  CRISPR gRNA sequence
ttatttcagcagtgcaagga

SEQ ID NO: 604145 - DNA, 20 bp, Artificial
  CRISPR gRNA sequence
gtgcaaggatggatcaataa

SEQ ID NO: 604146 - DNA, 20 bp, Artificial
  CRISPR gRNA sequence
tgcaaggatggatcaataat

SEQ ID NO: 604147 - DNA, 20 bp, Artificial
  CRISPR gRNA sequence
atatttatcatattaaacta

SEQ ID NO: 604148 - DNA, 20 bp, Artificial
  CRISPR gRNA sequence
atttatcatattaaactaaa

SEQ ID NO: 604149 - DNA, 20 bp, Artificial
  CRISPR gRNA sequence
caatcatatgattttctcta

SEQ ID NO: 604150 - DNA, 20 bp, Artificial
  CRISPR gRNA sequence
catatgattttctctataga

SEQ ID NO: 604151 - DNA, 20 bp, Artificial
  CRISPR gRNA sequence
ctatagacagtgaaaaaaca

SEQ ID NO: 604152 - DNA, 20 bp, Artificial
  CRISPR gRNA sequence
tatagacagtgaaaaaacat

SEQ ID NO: 604153 - DNA, 20 bp, Artificial
  CRISPR gRNA sequence
taacaaccattctctacacc

SEQ ID NO: 604154 - DNA, 20 bp, Artificial
  CRISPR gRNA sequence
cattctctacacccagtaaa

SEQ ID NO: 604155 - DNA, 20 bp, Artificial
  CRISPR gRNA sequence
acacccagtaaacagaaata

SEQ ID NO: 604156 - DNA, 20 bp, Artificial
  CRISPR gRNA sequence
cacccagtaaacagaaataa

SEQ ID NO: 604157 - DNA, 20 bp, Artificial
  CRISPR gRNA sequence
acccagtaaacagaaataaa

SEQ ID NO: 604158 - DNA, 20 bp, Artificial
  CRISPR gRNA sequence
aataaagggaaacttcttca

SEQ ID NO: 604159 - DNA, 20 bp, Artificial
  CRISPR gRNA sequence
gtgatcaaatgtatgtatgt

SEQ ID NO: 604160 - DNA, 20 bp, Artificial
  CRISPR gRNA sequence
atgtatgtatgtgagtccaa

SEQ ID NO: 604161 - DNA, 20 bp, Artificial
  CRISPR gRNA sequence
ccaaaagccattatgattca

SEQ ID NO: 604162 - DNA, 20 bp, Artificial
  CRISPR gRNA sequence
caaaagccattatgattcat

SEQ ID NO: 604163 - DNA, 20 bp, Artificial
  CRISPR gRNA sequence
ggaaaacacatacgcatgct

SEQ ID NO: 604164 - DNA, 20 bp, Artificial
  CRISPR gRNA sequence
atacgcatgctcagtaattt

SEQ ID NO: 604165 - DNA, 20 bp, Artificial
  CRISPR gRNA sequence
tgctcagtaatttcagaaac

SEQ ID NO: 604166 - DNA, 20 bp, Artificial
  CRISPR gRNA sequence
gctcagtaatttcagaaact

SEQ ID NO: 604167 - DNA, 20 bp, Artificial
  CRISPR gRNA sequence
cagtaatttcagaaactagg

SEQ ID NO: 604168 - DNA, 20 bp, Artificial
  CRISPR gRNA sequence
actcttttttaatattgtgc

SEQ ID NO: 604169 - DNA, 20 bp, Artificial
  CRISPR gRNA sequence
gtgctggacgaaactgccaa

SEQ ID NO: 604170 - DNA, 20 bp, Artificial
  CRISPR gRNA sequence
gacgaaactgccaatggatt

SEQ ID NO: 604171 - DNA, 20 bp, Artificial
  CRISPR gRNA sequence
ggatttagataataaaaaat

SEQ ID NO: 604172 - DNA, 20 bp, Artificial
  CRISPR gRNA sequence
ataagattataaaaatttga

SEQ ID NO: 604173 - DNA, 20 bp, Artificial
  CRISPR gRNA sequence
taagattataaaaatttgat

SEQ ID NO: 604174 - DNA, 20 bp, Artificial
  CRISPR gRNA sequence
gattataaaaatttgatagg

SEQ ID NO: 604175 - DNA, 20 bp, Artificial
  CRISPR gRNA sequence
ttataaaaatttgataggta

SEQ ID NO: 604176 - DNA, 20 bp, Artificial
  CRISPR gRNA sequence
gataaaataatcactttttg

SEQ ID NO: 604177 - DNA, 20 bp, Artificial
  CRISPR gRNA sequence
aaataatcactttttgcaga

SEQ ID NO: 604178 - DNA, 20 bp, Artificial
  CRISPR gRNA sequence
tgttttgtatccataaactg

SEQ ID NO: 604179 - DNA, 20 bp, Artificial
  CRISPR gRNA sequence
ttttgtatccataaactgca

SEQ ID NO: 604180 - DNA, 20 bp, Artificial
  CRISPR gRNA sequence
atccataaactgcagagaat

SEQ ID NO: 604181 - DNA, 20 bp, Artificial
  CRISPR gRNA sequence
aactgcagagaatcagctga

SEQ ID NO: 604182 - DNA, 20 bp, Artificial
  CRISPR gRNA sequence
tcataaacaataaaataatt

SEQ ID NO: 604183 - DNA, 20 bp, Artificial
  CRISPR gRNA sequence
acaataaaataatttagtaa

SEQ ID NO: 604184 - DNA, 20 bp, Artificial
  CRISPR gRNA sequence
caataaaataatttagtaat

SEQ ID NO: 604185 - DNA, 20 bp, Artificial
  CRISPR gRNA sequence
aataaaataatttagtaata

SEQ ID NO: 604186 - DNA, 20 bp, Artificial
  CRISPR gRNA sequence
aaaataatttagtaataggg

SEQ ID NO: 604187 - DNA, 20 bp, Artificial
  CRISPR gRNA sequence
aatgtgtaatatttgtatta

SEQ ID NO: 604188 - DNA, 20 bp, Artificial
  CRISPR gRNA sequence
tatttgtattaaagaacatg

SEQ ID NO: 604189 - DNA, 20 bp, Artificial
  CRISPR gRNA sequence
ttgtattaaagaacatgcag

SEQ ID NO: 604190 - DNA, 20 bp, Artificial
  CRISPR gRNA sequence
atgcagaagcgtacttaaaa

SEQ ID NO: 604191 - DNA, 20 bp, Artificial
  CRISPR gRNA sequence
tgcagaagcgtacttaaaat

SEQ ID NO: 604192 - DNA, 20 bp, Artificial
  CRISPR gRNA sequence
gcagaagcgtacttaaaatg

SEQ ID NO: 604193 - DNA, 20 bp, Artificial
  CRISPR gRNA sequence
gaagcgtacttaaaatgggg

SEQ ID NO: 604194 - DNA, 20 bp, Artificial
  CRISPR gRNA sequence
aatggggaagatatactgtg

SEQ ID NO: 604195 - DNA, 20 bp, Artificial
  CRISPR gRNA sequence
tactgtgaagtattctttca

SEQ ID NO: 604196 - DNA, 20 bp, Artificial
  CRISPR gRNA sequence
actgtgaagtattctttcac

SEQ ID NO: 604197 - DNA, 20 bp, Artificial
  CRISPR gRNA sequence
gtgaagtattctttcacagg

SEQ ID NO: 604198 - DNA, 20 bp, Artificial
  CRISPR gRNA sequence
ttatatcttatactgaactt

SEQ ID NO: 604199 - DNA, 20 bp, Artificial
  CRISPR gRNA sequence
tatatcttatactgaacttc

SEQ ID NO: 604200 - DNA, 20 bp, Artificial
  CRISPR gRNA sequence
cttcaggataaactctgaat

SEQ ID NO: 604201 - DNA, 20 bp, Artificial
  CRISPR gRNA sequence
ataaactctgaattggaaca

SEQ ID NO: 604202 - DNA, 20 bp, Artificial
  CRISPR gRNA sequence
gaacaaagatatatacatga

SEQ ID NO: 604203 - DNA, 20 bp, Artificial
  CRISPR gRNA sequence
tacatgaaagttaaccatat

SEQ ID NO: 604204 - DNA, 20 bp, Artificial
  CRISPR gRNA sequence
aaagttaaccatataagtaa

SEQ ID NO: 604205 - DNA, 20 bp, Artificial
  CRISPR gRNA sequence
gttaaccatataagtaatag

SEQ ID NO: 604206 - DNA, 20 bp, Artificial
  CRISPR gRNA sequence
agtaatagaagaaaatgtga

SEQ ID NO: 604207 - DNA, 20 bp, Artificial
  CRISPR gRNA sequence
aaaatgtgaaagtcttatta

SEQ ID NO: 604208 - DNA, 20 bp, Artificial
  CRISPR gRNA sequence
gtcttattatggtcttacta

SEQ ID NO: 604209 - DNA, 20 bp, Artificial
  CRISPR gRNA sequence
tcttattatggtcttactat

SEQ ID NO: 604210 - DNA, 20 bp, Artificial
  CRISPR gRNA sequence
tattatggtcttactatggg

SEQ ID NO: 604211 - DNA, 20 bp, Artificial
  CRISPR gRNA sequence
taataaaattcaatatctaa

SEQ ID NO: 604212 - DNA, 20 bp, Artificial
  CRISPR gRNA sequence
atatctaaaagtcaatttca

SEQ ID NO: 604213 - DNA, 20 bp, Artificial
  CRISPR gRNA sequence
tatctaaaagtcaatttcaa

SEQ ID NO: 604214 - DNA, 20 bp, Artificial
  CRISPR gRNA sequence
aaataataaaaatttctaca

SEQ ID NO: 604215 - DNA, 20 bp, Artificial
  CRISPR gRNA sequence
aatttctacatggcaaaaaa

SEQ ID NO: 604216 - DNA, 20 bp, Artificial
  CRISPR gRNA sequence
aatagcataaataaaaccaa

SEQ ID NO: 604217 - DNA, 20 bp, Artificial
  CRISPR gRNA sequence
atagcataaataaaaccaaa

SEQ ID NO: 604218 - DNA, 20 bp, Artificial
  CRISPR gRNA sequence
aaaaccaaaaggtaaacaac

SEQ ID NO: 604219 - DNA, 20 bp, Artificial
  CRISPR gRNA sequence
ccaaaaggtaaacaacaagc

SEQ ID NO: 604220 - DNA, 20 bp, Artificial
  CRISPR gRNA sequence
aaaaggtaaacaacaagctg

SEQ ID NO: 604221 - DNA, 20 bp, Artificial
  CRISPR gRNA sequence
aaaggtaaacaacaagctgg

SEQ ID NO: 604222 - DNA, 20 bp, Artificial
  CRISPR gRNA sequence
aactcatatgatgacttaaa

SEQ ID NO: 604223 - DNA, 20 bp, Artificial
  CRISPR gRNA sequence
ggttaatctctaatacataa

SEQ ID NO: 604224 - DNA, 20 bp, Artificial
  CRISPR gRNA sequence
ctctaatacataacagctcc

SEQ ID NO: 604225 - DNA, 20 bp, Artificial
  CRISPR gRNA sequence
acagctcctagtaattcctg

SEQ ID NO: 604226 - DNA, 20 bp, Artificial
  CRISPR gRNA sequence
tcctagtaattcctgaagta

SEQ ID NO: 604227 - DNA, 20 bp, Artificial
  CRISPR gRNA sequence
agtaattcctgaagtacagt

SEQ ID NO: 604228 - DNA, 20 bp, Artificial
  CRISPR gRNA sequence
gaagtacagtaagtatctaa

SEQ ID NO: 604229 - DNA, 20 bp, Artificial
  CRISPR gRNA sequence
gtaagtatctaatagaaatt

SEQ ID NO: 604230 - DNA, 20 bp, Artificial
  CRISPR gRNA sequence
ggttaaattattctaacaca

SEQ ID NO: 604231 - DNA, 20 bp, Artificial
  CRISPR gRNA sequence
ttattctaacacacagttca

SEQ ID NO: 604232 - DNA, 20 bp, Artificial
  CRISPR gRNA sequence
agttcacagaaaaataccat

SEQ ID NO: 604233 - DNA, 20 bp, Artificial
  CRISPR gRNA sequence
cattggctcctacacatata

SEQ ID NO: 604234 - DNA, 20 bp, Artificial
  CRISPR gRNA sequence
tttcttaacttcacccaaaa

SEQ ID NO: 604235 - DNA, 20 bp, Artificial
  CRISPR gRNA sequence
ttcttaacttcacccaaaat

SEQ ID NO: 604236 - DNA, 20 bp, Artificial
  CRISPR gRNA sequence
cttaacttcacccaaaatag

SEQ ID NO: 604237 - DNA, 20 bp, Artificial
  CRISPR gRNA sequence
ttaacttcacccaaaatagg

SEQ ID NO: 604238 - DNA, 20 bp, Artificial
  CRISPR gRNA sequence
tatataaaactatactgaca

SEQ ID NO: 604239 - DNA, 20 bp, Artificial
  CRISPR gRNA sequence
gcatgtctaattcattatat

SEQ ID NO: 604240 - DNA, 20 bp, Artificial
  CRISPR gRNA sequence
aattttgtgtcatgctgtgt

SEQ ID NO: 604241 - DNA, 20 bp, Artificial
  CRISPR gRNA sequence
ttgtgtcatgctgtgttggc

SEQ ID NO: 604242 - DNA, 20 bp, Artificial
  CRISPR gRNA sequence
tgtgtcatgctgtgttggca

SEQ ID NO: 604243 - DNA, 20 bp, Artificial
  CRISPR gRNA sequence
tgctgtgttggcaaggctgc

SEQ ID NO: 604244 - DNA, 20 bp, Artificial
  CRISPR gRNA sequence
gctgtgttggcaaggctgca

SEQ ID NO: 604245 - DNA, 20 bp, Artificial
  CRISPR gRNA sequence
ttggcaaggctgcaaggaaa

SEQ ID NO: 604246 - DNA, 20 bp, Artificial
  CRISPR gRNA sequence
tggcaaggctgcaaggaaac

SEQ ID NO: 604247 - DNA, 20 bp, Artificial
  CRISPR gRNA sequence
ggcaaggctgcaaggaaaca

SEQ ID NO: 604248 - DNA, 20 bp, Artificial
  CRISPR gRNA sequence
ggccttttatgtattgttga

SEQ ID NO: 604249 - DNA, 20 bp, Artificial
  CRISPR gRNA sequence
gccttttatgtattgttgat

SEQ ID NO: 604250 - DNA, 20 bp, Artificial
  CRISPR gRNA sequence
cttttatgtattgttgatgg

SEQ ID NO: 604251 - DNA, 20 bp, Artificial
  CRISPR gRNA sequence
aaatttatataaatgtgaat

SEQ ID NO: 604252 - DNA, 20 bp, Artificial
  CRISPR gRNA sequence
aatgcttataaactttgact

SEQ ID NO: 604253 - DNA, 20 bp, Artificial
  CRISPR gRNA sequence
ataataatttgtcaaatgtt

SEQ ID NO: 604254 - DNA, 20 bp, Artificial
  CRISPR gRNA sequence
tttgtcaaatgttgagtgca

SEQ ID NO: 604255 - DNA, 20 bp, Artificial
  CRISPR gRNA sequence
gtgcacagatttattcattg

SEQ ID NO: 604256 - DNA, 20 bp, Artificial
  CRISPR gRNA sequence
agcattgtttttcatatcaa

SEQ ID NO: 604257 - DNA, 20 bp, Artificial
  CRISPR gRNA sequence
ttgtttttcatatcaaaaga

SEQ ID NO: 604258 - DNA, 20 bp, Artificial
  CRISPR gRNA sequence
tgtttttcatatcaaaagat

SEQ ID NO: 604259 - DNA, 20 bp, Artificial
  CRISPR gRNA sequence
attgtgcaaacaatgcccat

SEQ ID NO: 604260 - DNA, 20 bp, Artificial
  CRISPR gRNA sequence
gtgcaaacaatgcccatcag

SEQ ID NO: 604261 - DNA, 20 bp, Artificial
  CRISPR gRNA sequence
caaacaatgcccatcagtag

SEQ ID NO: 604262 - DNA, 20 bp, Artificial
  CRISPR gRNA sequence
agtggattgattaaataaat

SEQ ID NO: 604263 - DNA, 20 bp, Artificial
  CRISPR gRNA sequence
gtggattgattaaataaatt

SEQ ID NO: 604264 - DNA, 20 bp, Artificial
  CRISPR gRNA sequence
ccaataattgaatattatgc

SEQ ID NO: 604265 - DNA, 20 bp, Artificial
  CRISPR gRNA sequence
tatgcaagtatataaaaaat

SEQ ID NO: 604266 - DNA, 20 bp, Artificial
  CRISPR gRNA sequence
aaaaataagaatcatgaata

SEQ ID NO: 604267 - DNA, 20 bp, Artificial
  CRISPR gRNA sequence
ataagaatcatgaatatgga

SEQ ID NO: 604268 - DNA, 20 bp, Artificial
  CRISPR gRNA sequence
gatttcgaaaatatattgct

SEQ ID NO: 604269 - DNA, 20 bp, Artificial
  CRISPR gRNA sequence
atattgctaagattaaaaaa

SEQ ID NO: 604270 - DNA, 20 bp, Artificial
  CRISPR gRNA sequence
tattgctaagattaaaaaaa

SEQ ID NO: 604271 - DNA, 20 bp, Artificial
  CRISPR gRNA sequence
tgctaagattaaaaaaaagg

SEQ ID NO: 604272 - DNA, 20 bp, Artificial
  CRISPR gRNA sequence
gctaagattaaaaaaaagga

SEQ ID NO: 604273 - DNA, 20 bp, Artificial
  CRISPR gRNA sequence
ctaagattaaaaaaaaggaa

SEQ ID NO: 604274 - DNA, 20 bp, Artificial
  CRISPR gRNA sequence
taagattaaaaaaaaggaag

SEQ ID NO: 604275 - DNA, 20 bp, Artificial
  CRISPR gRNA sequence
gattaaaaaaaaggaagggg

SEQ ID NO: 604276 - DNA, 20 bp, Artificial
  CRISPR gRNA sequence
taaaaaaaaggaaggggcag

SEQ ID NO: 604277 - DNA, 20 bp, Artificial
  CRISPR gRNA sequence
aggaaggggcagaagaaaat

SEQ ID NO: 604278 - DNA, 20 bp, Artificial
  CRISPR gRNA sequence
aggggcagaagaaaataagt

SEQ ID NO: 604279 - DNA, 20 bp, Artificial
  CRISPR gRNA sequence
ggggcagaagaaaataagtt

SEQ ID NO: 604280 - DNA, 20 bp, Artificial
  CRISPR gRNA sequence
aagttgggtaaaaaaaaccc

SEQ ID NO: 604281 - DNA, 20 bp, Artificial
  CRISPR gRNA sequence
taattatatttaaaaactca

SEQ ID NO: 604282 - DNA, 20 bp, Artificial
  CRISPR gRNA sequence
aattatatttaaaaactcat

SEQ ID NO: 604283 - DNA, 20 bp, Artificial
  CRISPR gRNA sequence
taaaaactcataggataaac

SEQ ID NO: 604284 - DNA, 20 bp, Artificial
  CRISPR gRNA sequence
aaactcataggataaacaag

SEQ ID NO: 604285 - DNA, 20 bp, Artificial
  CRISPR gRNA sequence
aactcataggataaacaaga

SEQ ID NO: 604286 - DNA, 20 bp, Artificial
  CRISPR gRNA sequence
taatgaaataattaattgtt

SEQ ID NO: 604287 - DNA, 20 bp, Artificial
  CRISPR gRNA sequence
aatgaaataattaattgttt

SEQ ID NO: 604288 - DNA, 20 bp, Artificial
  CRISPR gRNA sequence
tgaaataattaattgtttgg

SEQ ID NO: 604289 - DNA, 20 bp, Artificial
  CRISPR gRNA sequence
attaattgtttgggagtgta

SEQ ID NO: 604290 - DNA, 20 bp, Artificial
  CRISPR gRNA sequence
attgtttgggagtgtataga

SEQ ID NO: 604291 - DNA, 20 bp, Artificial
  CRISPR gRNA sequence
tgtttgggagtgtatagata

SEQ ID NO: 604292 - DNA, 20 bp, Artificial
  CRISPR gRNA sequence
gtttgggagtgtatagatag

SEQ ID NO: 604293 - DNA, 20 bp, Artificial
  CRISPR gRNA sequence
tttgggagtgtatagataga

SEQ ID NO: 604294 - DNA, 20 bp, Artificial
  CRISPR gRNA sequence
gtgtatagatagagggatga

SEQ ID NO: 604295 - DNA, 20 bp, Artificial
  CRISPR gRNA sequence
tagatagagggatgacagct

SEQ ID NO: 604296 - DNA, 20 bp, Artificial
  CRISPR gRNA sequence
atagagggatgacagctgag

SEQ ID NO: 604297 - DNA, 20 bp, Artificial
  CRISPR gRNA sequence
gggatgacagctgagcagat

SEQ ID NO: 604298 - DNA, 20 bp, Artificial
  CRISPR gRNA sequence
ggatgacagctgagcagatg

SEQ ID NO: 604299 - DNA, 20 bp, Artificial
  CRISPR gRNA sequence
gatgacagctgagcagatga

SEQ ID NO: 604300 - DNA, 20 bp, Artificial
  CRISPR gRNA sequence
atgacagctgagcagatgag

SEQ ID NO: 604301 - DNA, 20 bp, Artificial
  CRISPR gRNA sequence
cagctgagcagatgaggggc

SEQ ID NO: 604302 - DNA, 20 bp, Artificial
  CRISPR gRNA sequence
agctgagcagatgaggggct

SEQ ID NO: 604303 - DNA, 20 bp, Artificial
  CRISPR gRNA sequence
gagcagatgaggggctggga

SEQ ID NO: 604304 - DNA, 20 bp, Artificial
  CRISPR gRNA sequence
atgaggggctgggatggaac

SEQ ID NO: 604305 - DNA, 20 bp, Artificial
  CRISPR gRNA sequence
gatggaacaagactcttcac

SEQ ID NO: 604306 - DNA, 20 bp, Artificial
  CRISPR gRNA sequence
atttgacaacatcaaaacaa

SEQ ID NO: 604307 - DNA, 20 bp, Artificial
  CRISPR gRNA sequence
tttgacaacatcaaaacaaa

SEQ ID NO: 604308 - DNA, 20 bp, Artificial
  CRISPR gRNA sequence
taataataacaactaaacca

SEQ ID NO: 604309 - DNA, 20 bp, Artificial
  CRISPR gRNA sequence
aactaaaccacagtaaatat

SEQ ID NO: 604310 - DNA, 20 bp, Artificial
  CRISPR gRNA sequence
cagtaaatattagttttttt

SEQ ID NO: 604311 - DNA, 20 bp, Artificial
  CRISPR gRNA sequence
tttttgagaaaatatttcta

SEQ ID NO: 604312 - DNA, 20 bp, Artificial
  CRISPR gRNA sequence
ttttgagaaaatatttctat

SEQ ID NO: 604313 - DNA, 20 bp, Artificial
  CRISPR gRNA sequence
tttgagaaaatatttctata

SEQ ID NO: 604314 - DNA, 20 bp, Artificial
  CRISPR gRNA sequence
agaaaatatttctatagggt

SEQ ID NO: 604315 - DNA, 20 bp, Artificial
  CRISPR gRNA sequence
tttctatagggtgagactga

SEQ ID NO: 604316 - DNA, 20 bp, Artificial
  CRISPR gRNA sequence
tagggtgagactgaaagtgt

SEQ ID NO: 604317 - DNA, 20 bp, Artificial
  CRISPR gRNA sequence
tcagcccttcaactgtttgc

SEQ ID NO: 604318 - DNA, 20 bp, Artificial
  CRISPR gRNA sequence
gcccttcaactgtttgccag

SEQ ID NO: 604319 - DNA, 20 bp, Artificial
  CRISPR gRNA sequence
ctgtttgccagtggaactgt

SEQ ID NO: 604320 - DNA, 20 bp, Artificial
  CRISPR gRNA sequence
ccagtggaactgtaagaaac

SEQ ID NO: 604321 - DNA, 20 bp, Artificial
  CRISPR gRNA sequence
tgcttccccaacacccaatt

SEQ ID NO: 604322 - DNA, 20 bp, Artificial
  CRISPR gRNA sequence
cccaacacccaatttagatg

SEQ ID NO: 604323 - DNA, 20 bp, Artificial
  CRISPR gRNA sequence
agatgtagattccttacact

SEQ ID NO: 604324 - DNA, 20 bp, Artificial
  CRISPR gRNA sequence
acactcagatcatttgttga

SEQ ID NO: 604325 - DNA, 20 bp, Artificial
  CRISPR gRNA sequence
tcctacacattaactccatc

SEQ ID NO: 604326 - DNA, 20 bp, Artificial
  CRISPR gRNA sequence
atcaagcaattaatattgaa

SEQ ID NO: 604327 - DNA, 20 bp, Artificial
  CRISPR gRNA sequence
taatattgaacagtgtaatt

SEQ ID NO: 604328 - DNA, 20 bp, Artificial
  CRISPR gRNA sequence
tattgaacagtgtaattaag

SEQ ID NO: 604329 - DNA, 20 bp, Artificial
  CRISPR gRNA sequence
tgaacagtgtaattaagtgg

SEQ ID NO: 604330 - DNA, 20 bp, Artificial
  CRISPR gRNA sequence
aagtggtagttttaaaacac

SEQ ID NO: 604331 - DNA, 20 bp, Artificial
  CRISPR gRNA sequence
acaccagttgtacaaaaatc

SEQ ID NO: 604332 - DNA, 20 bp, Artificial
  CRISPR gRNA sequence
agttgtacaaaaatcaagac

SEQ ID NO: 604333 - DNA, 20 bp, Artificial
  CRISPR gRNA sequence
atcaagaccagtgttcattt

SEQ ID NO: 604334 - DNA, 20 bp, Artificial
  CRISPR gRNA sequence
ttttatacaatatgcaactt

SEQ ID NO: 604335 - DNA, 20 bp, Artificial
  CRISPR gRNA sequence
aatattatttaaaatttcta

SEQ ID NO: 604336 - DNA, 20 bp, Artificial
  CRISPR gRNA sequence
atgtttttcttcttgaaata

SEQ ID NO: 604337 - DNA, 20 bp, Artificial
  CRISPR gRNA sequence
ctgtaacatcatgataataa

SEQ ID NO: 604338 - DNA, 20 bp, Artificial
  CRISPR gRNA sequence
taacatcatgataataatgg

SEQ ID NO: 604339 - DNA, 20 bp, Artificial
  CRISPR gRNA sequence
catgataataatggtagtgt

SEQ ID NO: 604340 - DNA, 20 bp, Artificial
  CRISPR gRNA sequence
atgataataatggtagtgtt

SEQ ID NO: 604341 - DNA, 20 bp, Artificial
  CRISPR gRNA sequence
tgttaggaatttattttcat

SEQ ID NO: 604342 - DNA, 20 bp, Artificial
  CRISPR gRNA sequence
taggaatttattttcattag

SEQ ID NO: 604343 - DNA, 20 bp, Artificial
  CRISPR gRNA sequence
tttattttcattagtggtca

SEQ ID NO: 604344 - DNA, 20 bp, Artificial
  CRISPR gRNA sequence
tttcattagtggtcatagta

SEQ ID NO: 604345 - DNA, 20 bp, Artificial
  CRISPR gRNA sequence
gtacagttaatataaatata

SEQ ID NO: 604346 - DNA, 20 bp, Artificial
  CRISPR gRNA sequence
tatagcacataaatataaat

SEQ ID NO: 604347 - DNA, 20 bp, Artificial
  CRISPR gRNA sequence
gagaacactaaatatctgtt

SEQ ID NO: 604348 - DNA, 20 bp, Artificial
  CRISPR gRNA sequence
actaaatatctgtttggaaa

SEQ ID NO: 604349 - DNA, 20 bp, Artificial
  CRISPR gRNA sequence
ctaaatatctgtttggaaat

SEQ ID NO: 604350 - DNA, 20 bp, Artificial
  CRISPR gRNA sequence
tctgtttggaaatgggattc

SEQ ID NO: 604351 - DNA, 20 bp, Artificial
  CRISPR gRNA sequence
tgtttggaaatgggattcaa

SEQ ID NO: 604352 - DNA, 20 bp, Artificial
  CRISPR gRNA sequence
ggattcaagagctgtgtctt

SEQ ID NO: 604353 - DNA, 20 bp, Artificial
  CRISPR gRNA sequence
aagagctgtgtcttaagttt

SEQ ID NO: 604354 - DNA, 20 bp, Artificial
  CRISPR gRNA sequence
agctgtgtcttaagttttgg

SEQ ID NO: 604355 - DNA, 20 bp, Artificial
  CRISPR gRNA sequence
gctgtgtcttaagttttggt

SEQ ID NO: 604356 - DNA, 20 bp, Artificial
  CRISPR gRNA sequence
ttttggtaggattcatttaa

SEQ ID NO: 604357 - DNA, 20 bp, Artificial
  CRISPR gRNA sequence
gtgtgaattacttaaccttt

SEQ ID NO: 604358 - DNA, 20 bp, Artificial
  CRISPR gRNA sequence
gaattacttaacctttcaga

SEQ ID NO: 604359 - DNA, 20 bp, Artificial
  CRISPR gRNA sequence
tttcttaatctgttaaaaaa

SEQ ID NO: 604360 - DNA, 20 bp, Artificial
  CRISPR gRNA sequence
tgatactaatacatgcctta

SEQ ID NO: 604361 - DNA, 20 bp, Artificial
  CRISPR gRNA sequence
gatactaatacatgccttac

SEQ ID NO: 604362 - DNA, 20 bp, Artificial
  CRISPR gRNA sequence
atactaatacatgccttaca

SEQ ID NO: 604363 - DNA, 20 bp, Artificial
  CRISPR gRNA sequence
atacatgccttacagggttg

SEQ ID NO: 604364 - DNA, 20 bp, Artificial
  CRISPR gRNA sequence
tgccttacagggttgtggtc

SEQ ID NO: 604365 - DNA, 20 bp, Artificial
  CRISPR gRNA sequence
gccttacagggttgtggtca

SEQ ID NO: 604366 - DNA, 20 bp, Artificial
  CRISPR gRNA sequence
tacagggttgtggtcaaggt

SEQ ID NO: 604367 - DNA, 20 bp, Artificial
  CRISPR gRNA sequence
cagggttgtggtcaaggttg

SEQ ID NO: 604368 - DNA, 20 bp, Artificial
  CRISPR gRNA sequence
gtgaatgtctttataatacc

SEQ ID NO: 604369 - DNA, 20 bp, Artificial
  CRISPR gRNA sequence
tgtctttataatacctagta

SEQ ID NO: 604370 - DNA, 20 bp, Artificial
  CRISPR gRNA sequence
tagtatagtatcttcaatgc

SEQ ID NO: 604371 - DNA, 20 bp, Artificial
  CRISPR gRNA sequence
gcaagcatctattattcctg

SEQ ID NO: 604372 - DNA, 20 bp, Artificial
  CRISPR gRNA sequence
gttgtgttacttatgatatg

SEQ ID NO: 604373 - DNA, 20 bp, Artificial
  CRISPR gRNA sequence
atatgtagccctaaaattgc

SEQ ID NO: 604374 - DNA, 20 bp, Artificial
  CRISPR gRNA sequence
attgcaagatgaatattaac

SEQ ID NO: 604375 - DNA, 20 bp, Artificial
  CRISPR gRNA sequence
tattaacaagacaatatgca

SEQ ID NO: 604376 - DNA, 20 bp, Artificial
  CRISPR gRNA sequence
cacagtttgccactacctgt

SEQ ID NO: 604377 - DNA, 20 bp, Artificial
  CRISPR gRNA sequence
ctgtaagatttgatttattt

SEQ ID NO: 604378 - DNA, 20 bp, Artificial
  CRISPR gRNA sequence
tgatttatttgagtaaaata

SEQ ID NO: 604379 - DNA, 20 bp, Artificial
  CRISPR gRNA sequence
gatttatttgagtaaaataa

SEQ ID NO: 604380 - DNA, 20 bp, Artificial
  CRISPR gRNA sequence
atttatttgagtaaaataaa

SEQ ID NO: 604381 - DNA, 20 bp, Artificial
  CRISPR gRNA sequence
tttatttgagtaaaataaag

SEQ ID NO: 604382 - DNA, 20 bp, Artificial
  CRISPR gRNA sequence
tatttgagtaaaataaaggg

SEQ ID NO: 604383 - DNA, 20 bp, Artificial
  CRISPR gRNA sequence
atttgagtaaaataaagggg

SEQ ID NO: 604384 - DNA, 20 bp, Artificial
  CRISPR gRNA sequence
tgagtaaaataaaggggagg

SEQ ID NO: 604385 - DNA, 20 bp, Artificial
  CRISPR gRNA sequence
gcttgcatgttttacttgct

SEQ ID NO: 604386 - DNA, 20 bp, Artificial
  CRISPR gRNA sequence
tgttttacttgctgagaatt

SEQ ID NO: 604387 - DNA, 20 bp, Artificial
  CRISPR gRNA sequence
tttacttgctgagaatttgg

SEQ ID NO: 604388 - DNA, 20 bp, Artificial
  CRISPR gRNA sequence
ttacttgctgagaatttggt

SEQ ID NO: 604389 - DNA, 20 bp, Artificial
  CRISPR gRNA sequence
tacttgctgagaatttggta

SEQ ID NO: 604390 - DNA, 20 bp, Artificial
  CRISPR gRNA sequence
gctgagaatttggtagggtc

SEQ ID NO: 604391 - DNA, 20 bp, Artificial
  CRISPR gRNA sequence
gttaaaatcacttctaaaat

SEQ ID NO: 604392 - DNA, 20 bp, Artificial
  CRISPR gRNA sequence
ttctaaaataagtctcctca

SEQ ID NO: 604393 - DNA, 20 bp, Artificial
  CRISPR gRNA sequence
ctcaaagtgattatttaata

SEQ ID NO: 604394 - DNA, 20 bp, Artificial
  CRISPR gRNA sequence
caaagtgattatttaatacg

SEQ ID NO: 604395 - DNA, 20 bp, Artificial
  CRISPR gRNA sequence
ctaatttgaaatattttaaa

SEQ ID NO: 604396 - DNA, 20 bp, Artificial
  CRISPR gRNA sequence
atttgaaatattttaaatag

SEQ ID NO: 604397 - DNA, 20 bp, Artificial
  CRISPR gRNA sequence
gaaatattttaaatagtggt

SEQ ID NO: 604398 - DNA, 20 bp, Artificial
  CRISPR gRNA sequence
ttaaaaaataatatattaat

SEQ ID NO: 604399 - DNA, 20 bp, Artificial
  CRISPR gRNA sequence
aaaataatatattaattgga

SEQ ID NO: 604400 - DNA, 20 bp, Artificial
  CRISPR gRNA sequence
attaattggatagaataaaa

SEQ ID NO: 604401 - DNA, 20 bp, Artificial
  CRISPR gRNA sequence
taattggatagaataaaatg

SEQ ID NO: 604402 - DNA, 20 bp, Artificial
  CRISPR gRNA sequence
tgttaaaaaccatgtgcttt

SEQ ID NO: 604403 - DNA, 20 bp, Artificial
  CRISPR gRNA sequence
atgtgctttaagaatgatta

SEQ ID NO: 604404 - DNA, 20 bp, Artificial
  CRISPR gRNA sequence
ctttaagaatgattatggca

SEQ ID NO: 604405 - DNA, 20 bp, Artificial
  CRISPR gRNA sequence
tttgaaatacatacattaaa

SEQ ID NO: 604406 - DNA, 20 bp, Artificial
  CRISPR gRNA sequence
atacattaaaaagattatac

SEQ ID NO: 604407 - DNA, 20 bp, Artificial
  CRISPR gRNA sequence
aaagattatacaagtttata

SEQ ID NO: 604408 - DNA, 20 bp, Artificial
  CRISPR gRNA sequence
gattatacaagtttatatag

SEQ ID NO: 604409 - DNA, 20 bp, Artificial
  CRISPR gRNA sequence
attatacaagtttatatagt

SEQ ID NO: 604410 - DNA, 20 bp, Artificial
  CRISPR gRNA sequence
agtaggatctcaaatatgta

SEQ ID NO: 604411 - DNA, 20 bp, Artificial
  CRISPR gRNA sequence
gatctcaaatatgtaaagaa

SEQ ID NO: 604412 - DNA, 20 bp, Artificial
  CRISPR gRNA sequence
aaaagcgtgccatatataaa

SEQ ID NO: 604413 - DNA, 20 bp, Artificial
  CRISPR gRNA sequence
ataaatagatgtatatttca

SEQ ID NO: 604414 - DNA, 20 bp, Artificial
  CRISPR gRNA sequence
aaatagatgtatatttcata

SEQ ID NO: 604415 - DNA, 20 bp, Artificial
  CRISPR gRNA sequence
aatagatgtatatttcatag

SEQ ID NO: 604416 - DNA, 20 bp, Artificial
  CRISPR gRNA sequence
gatgtatatttcatagagga

SEQ ID NO: 604417 - DNA, 20 bp, Artificial
  CRISPR gRNA sequence
atatttcatagaggaaagat

SEQ ID NO: 604418 - DNA, 20 bp, Artificial
  CRISPR gRNA sequence
gaatatacaccaaatgtgaa

SEQ ID NO: 604419 - DNA, 20 bp, Artificial
  CRISPR gRNA sequence
tatacaccaaatgtgaatag

SEQ ID NO: 604420 - DNA, 20 bp, Artificial
  CRISPR gRNA sequence
tgtgaatagtggtcattttt

SEQ ID NO: 604421 - DNA, 20 bp, Artificial
  CRISPR gRNA sequence
tagtggtcatttttgagtgt

SEQ ID NO: 604422 - DNA, 20 bp, Artificial
  CRISPR gRNA sequence
agtggtcatttttgagtgtt

SEQ ID NO: 604423 - DNA, 20 bp, Artificial
  CRISPR gRNA sequence
ttgtttgatttatactttta

SEQ ID NO: 604424 - DNA, 20 bp, Artificial
  CRISPR gRNA sequence
tttacatttttttttacaat

SEQ ID NO: 604425 - DNA, 20 bp, Artificial
  CRISPR gRNA sequence
agcatatattacttttatat

SEQ ID NO: 604426 - DNA, 20 bp, Artificial
  CRISPR gRNA sequence
tacttttatattagcaaaaa

SEQ ID NO: 604427 - DNA, 20 bp, Artificial
  CRISPR gRNA sequence
tttatgtttatgtattcttc

SEQ ID NO: 604428 - DNA, 20 bp, Artificial
  CRISPR gRNA sequence
tattcttcgagattgaattg

SEQ ID NO: 604429 - DNA, 20 bp, Artificial
  CRISPR gRNA sequence
attcttcgagattgaattgt

SEQ ID NO: 604430 - DNA, 20 bp, Artificial
  CRISPR gRNA sequence
tcgagattgaattgtaggat

SEQ ID NO: 604431 - DNA, 20 bp, Artificial
  CRISPR gRNA sequence
agattgaattgtaggatgag

SEQ ID NO: 604432 - DNA, 20 bp, Artificial
  CRISPR gRNA sequence
aatatatgtaccttctttta

SEQ ID NO: 604433 - DNA, 20 bp, Artificial
  CRISPR gRNA sequence
atgtaccttcttttaaagaa

SEQ ID NO: 604434 - DNA, 20 bp, Artificial
  CRISPR gRNA sequence
ttttaaagaaaagcacttta

SEQ ID NO: 604435 - DNA, 20 bp, Artificial
  CRISPR gRNA sequence
taaagctatatcaactttgt

SEQ ID NO: 604436 - DNA, 20 bp, Artificial
  CRISPR gRNA sequence
agctatatcaactttgttag

SEQ ID NO: 604437 - DNA, 20 bp, Artificial
  CRISPR gRNA sequence
ttgttagtggaattttattc

SEQ ID NO: 604438 - DNA, 20 bp, Artificial
  CRISPR gRNA sequence
ttagtggaattttattccag

SEQ ID NO: 604439 - DNA, 20 bp, Artificial
  CRISPR gRNA sequence
agtggaattttattccagaa

SEQ ID NO: 604440 - DNA, 20 bp, Artificial
  CRISPR gRNA sequence
ggaattttattccagaagag

SEQ ID NO: 604441 - DNA, 20 bp, Artificial
  CRISPR gRNA sequence
attttattccagaagagtag

SEQ ID NO: 604442 - DNA, 20 bp, Artificial
  CRISPR gRNA sequence
tattccagaagagtagaagt

SEQ ID NO: 604443 - DNA, 20 bp, Artificial
  CRISPR gRNA sequence
gaagagtagaagttggcacc

SEQ ID NO: 604444 - DNA, 20 bp, Artificial
  CRISPR gRNA sequence
gagtagaagttggcacctgg

SEQ ID NO: 604445 - DNA, 20 bp, Artificial
  CRISPR gRNA sequence
ttggcacctggaagcactct

SEQ ID NO: 604446 - DNA, 20 bp, Artificial
  CRISPR gRNA sequence
tcttggaccgttttcctatt

SEQ ID NO: 604447 - DNA, 20 bp, Artificial
  CRISPR gRNA sequence
cttggaccgttttcctattg

SEQ ID NO: 604448 - DNA, 20 bp, Artificial
  CRISPR gRNA sequence
tggaccgttttcctattgag

SEQ ID NO: 604449 - DNA, 20 bp, Artificial
  CRISPR gRNA sequence
ggaccgttttcctattgagg

SEQ ID NO: 604450 - DNA, 20 bp, Artificial
  CRISPR gRNA sequence
gaccgttttcctattgagga

SEQ ID NO: 604451 - DNA, 20 bp, Artificial
  CRISPR gRNA sequence
accgttttcctattgaggag

SEQ ID NO: 604452 - DNA, 20 bp, Artificial
  CRISPR gRNA sequence
tattgaggaggggtttattt

SEQ ID NO: 604453 - DNA, 20 bp, Artificial
  CRISPR gRNA sequence
aggaggggtttattttggta

SEQ ID NO: 604454 - DNA, 20 bp, Artificial
  CRISPR gRNA sequence
gtaaagtaacactaccactg

SEQ ID NO: 604455 - DNA, 20 bp, Artificial
  CRISPR gRNA sequence
acactaccactgtagcccga

SEQ ID NO: 604456 - DNA, 20 bp, Artificial
  CRISPR gRNA sequence
ctgtagcccgatggctactg

SEQ ID NO: 604457 - DNA, 20 bp, Artificial
  CRISPR gRNA sequence
tagcccgatggctactgcag

SEQ ID NO: 604458 - DNA, 20 bp, Artificial
  CRISPR gRNA sequence
agcccgatggctactgcagt

SEQ ID NO: 604459 - DNA, 20 bp, Artificial
  CRISPR gRNA sequence
gatggctactgcagtgggat

SEQ ID NO: 604460 - DNA, 20 bp, Artificial
  CRISPR gRNA sequence
actgcagtgggatcagatct

SEQ ID NO: 604461 - DNA, 20 bp, Artificial
  CRISPR gRNA sequence
ctgcagtgggatcagatctc

SEQ ID NO: 604462 - DNA, 20 bp, Artificial
  CRISPR gRNA sequence
gatcagatctcaggtcatat

SEQ ID NO: 604463 - DNA, 20 bp, Artificial
  CRISPR gRNA sequence
gatctcaggtcatatcagtt

SEQ ID NO: 604464 - DNA, 20 bp, Artificial
  CRISPR gRNA sequence
ctcaggtcatatcagttcag

SEQ ID NO: 604465 - DNA, 20 bp, Artificial
  CRISPR gRNA sequence
gtcatatcagttcagtagct

SEQ ID NO: 604466 - DNA, 20 bp, Artificial
  CRISPR gRNA sequence
cagttcagtagctcagcttg

SEQ ID NO: 604467 - DNA, 20 bp, Artificial
  CRISPR gRNA sequence
agctctgatctctcaaactg

SEQ ID NO: 604468 - DNA, 20 bp, Artificial
  CRISPR gRNA sequence
gctctgatctctcaaactgt

SEQ ID NO: 604469 - DNA, 20 bp, Artificial
  CRISPR gRNA sequence
ctctgatctctcaaactgtg

SEQ ID NO: 604470 - DNA, 20 bp, Artificial
  CRISPR gRNA sequence
atctctcaaactgtggggca

SEQ ID NO: 604471 - DNA, 20 bp, Artificial
  CRISPR gRNA sequence
ctcaaactgtggggcacagt

SEQ ID NO: 604472 - DNA, 20 bp, Artificial
  CRISPR gRNA sequence
aaactgtggggcacagtgag

SEQ ID NO: 604473 - DNA, 20 bp, Artificial
  CRISPR gRNA sequence
aactgtggggcacagtgaga

SEQ ID NO: 604474 - DNA, 20 bp, Artificial
  CRISPR gRNA sequence
actgtggggcacagtgagaa

SEQ ID NO: 604475 - DNA, 20 bp, Artificial
  CRISPR gRNA sequence
gcacagtgagaagggttttt

SEQ ID NO: 604476 - DNA, 20 bp, Artificial
  CRISPR gRNA sequence
cagtgagaagggttttttag

SEQ ID NO: 604477 - DNA, 20 bp, Artificial
  CRISPR gRNA sequence
gagaagggttttttagaagc

SEQ ID NO: 604478 - DNA, 20 bp, Artificial
  CRISPR gRNA sequence
aaatctgcttattatgacca

SEQ ID NO: 604479 - DNA, 20 bp, Artificial
  CRISPR gRNA sequence
ttattatgaccacagttcat

SEQ ID NO: 604480 - DNA, 20 bp, Artificial
  CRISPR gRNA sequence
tattatgaccacagttcatt

SEQ ID NO: 604481 - DNA, 20 bp, Artificial
  CRISPR gRNA sequence
attatgaccacagttcattg

SEQ ID NO: 604482 - DNA, 20 bp, Artificial
  CRISPR gRNA sequence
tgaccacagttcattgggga

SEQ ID NO: 604483 - DNA, 20 bp, Artificial
  CRISPR gRNA sequence
ccacagttcattggggatgg

SEQ ID NO: 604484 - DNA, 20 bp, Artificial
  CRISPR gRNA sequence
cagttcattggggatggcag

SEQ ID NO: 604485 - DNA, 20 bp, Artificial
  CRISPR gRNA sequence
ttcattggggatggcagaag

SEQ ID NO: 604486 - DNA, 20 bp, Artificial
  CRISPR gRNA sequence
gatggcagaagtagtacata

SEQ ID NO: 604487 - DNA, 20 bp, Artificial
  CRISPR gRNA sequence
gtagtacataaagctaatgt

SEQ ID NO: 604488 - DNA, 20 bp, Artificial
  CRISPR gRNA sequence
tgtaaaatatttacgtcatg

SEQ ID NO: 604489 - DNA, 20 bp, Artificial
  CRISPR gRNA sequence
aaaatatttacgtcatgtag

SEQ ID NO: 604490 - DNA, 20 bp, Artificial
  CRISPR gRNA sequence
taaaatttgtaaaattttgt

SEQ ID NO: 604491 - DNA, 20 bp, Artificial
  CRISPR gRNA sequence
aaaaatcacctactttccaa

SEQ ID NO: 604492 - DNA, 20 bp, Artificial
  CRISPR gRNA sequence
ggataattctacatcttata

SEQ ID NO: 604493 - DNA, 20 bp, Artificial
  CRISPR gRNA sequence
gtccttatttcattttttca

SEQ ID NO: 604494 - DNA, 20 bp, Artificial
  CRISPR gRNA sequence
tccttatttcattttttcac

SEQ ID NO: 604495 - DNA, 20 bp, Artificial
  CRISPR gRNA sequence
cattttttcacaggttatcc

SEQ ID NO: 604496 - DNA, 20 bp, Artificial
  CRISPR gRNA sequence
ggttatcctagttgacatca

SEQ ID NO: 604497 - DNA, 20 bp, Artificial
  CRISPR gRNA sequence
tgcacccattttgaatattt

SEQ ID NO: 604498 - DNA, 20 bp, Artificial
  CRISPR gRNA sequence
gcacccattttgaatatttc

SEQ ID NO: 604499 - DNA, 20 bp, Artificial
  CRISPR gRNA sequence
aaatctcattaaacactgaa

SEQ ID NO: 604500 - DNA, 20 bp, Artificial
  CRISPR gRNA sequence
aatctcattaaacactgaaa

SEQ ID NO: 604501 - DNA, 20 bp, Artificial
  CRISPR gRNA sequence
ctgaaaaggataatgccttg

SEQ ID NO: 604502 - DNA, 20 bp, Artificial
  CRISPR gRNA sequence
tgaaaaggataatgccttgt

SEQ ID NO: 604503 - DNA, 20 bp, Artificial
  CRISPR gRNA sequence
atgccttgtgggttgctcca

SEQ ID NO: 604504 - DNA, 20 bp, Artificial
  CRISPR gRNA sequence
atttcaatcgtttttttccc

SEQ ID NO: 604505 - DNA, 20 bp, Artificial
  CRISPR gRNA sequence
accccattctcctatcaact

SEQ ID NO: 604506 - DNA, 20 bp, Artificial
  CRISPR gRNA sequence
ccattctcctatcaactcag

SEQ ID NO: 604507 - DNA, 20 bp, Artificial
  CRISPR gRNA sequence
cattctcctatcaactcagt

SEQ ID NO: 604508 - DNA, 20 bp, Artificial
  CRISPR gRNA sequence
attctcctatcaactcagta

SEQ ID NO: 604509 - DNA, 20 bp, Artificial
  CRISPR gRNA sequence
atcaactcagtagggtttca

SEQ ID NO: 604510 - DNA, 20 bp, Artificial
  CRISPR gRNA sequence
ttgcttccttttgcctaatt

SEQ ID NO: 604511 - DNA, 20 bp, Artificial
  CRISPR gRNA sequence
taatttagcatcatgcctga

SEQ ID NO: 604512 - DNA, 20 bp, Artificial
  CRISPR gRNA sequence
gtttacatttcacttaatca

SEQ ID NO: 604513 - DNA, 20 bp, Artificial
  CRISPR gRNA sequence
ttcacttaatcatagctttc

SEQ ID NO: 604514 - DNA, 20 bp, Artificial
  CRISPR gRNA sequence
taatcatagctttcgagatg

SEQ ID NO: 604515 - DNA, 20 bp, Artificial
  CRISPR gRNA sequence
tagcatacctctctttgttc

SEQ ID NO: 604516 - DNA, 20 bp, Artificial
  CRISPR gRNA sequence
gcatacctctctttgttcta

SEQ ID NO: 604517 - DNA, 20 bp, Artificial
  CRISPR gRNA sequence
gatatgaaaactaacctaca

SEQ ID NO: 604518 - DNA, 20 bp, Artificial
  CRISPR gRNA sequence
tgaaaactaacctacacagt

SEQ ID NO: 604519 - DNA, 20 bp, Artificial
  CRISPR gRNA sequence
taacctacacagttagaaca

SEQ ID NO: 604520 - DNA, 20 bp, Artificial
  CRISPR gRNA sequence
aacctacacagttagaacac

SEQ ID NO: 604521 - DNA, 20 bp, Artificial
  CRISPR gRNA sequence
gttagaacacaggtaaactt

SEQ ID NO: 604522 - DNA, 20 bp, Artificial
  CRISPR gRNA sequence
ttagaacacaggtaaacttc

SEQ ID NO: 604523 - DNA, 20 bp, Artificial
  CRISPR gRNA sequence
aggtcttttgatttcgaatt

SEQ ID NO: 604524 - DNA, 20 bp, Artificial
  CRISPR gRNA sequence
cattgtgttctgtcgtgttc

SEQ ID NO: 604525 - DNA, 20 bp, Artificial
  CRISPR gRNA sequence
tcgtgttccagtattcttga

SEQ ID NO: 604526 - DNA, 20 bp, Artificial
  CRISPR gRNA sequence
tagttctctaaaatgttgtc

SEQ ID NO: 604527 - DNA, 20 bp, Artificial
  CRISPR gRNA sequence
ttctctaaaatgttgtcaag

SEQ ID NO: 604528 - DNA, 20 bp, Artificial
  CRISPR gRNA sequence
tctctaaaatgttgtcaaga

SEQ ID NO: 604529 - DNA, 20 bp, Artificial
  CRISPR gRNA sequence
ctctaaaatgttgtcaagaa

SEQ ID NO: 604530 - DNA, 20 bp, Artificial
  CRISPR gRNA sequence
aatgttgtcaagaagggcct

SEQ ID NO: 604531 - DNA, 20 bp, Artificial
  CRISPR gRNA sequence
agatctttgtgatctcgcca

SEQ ID NO: 604532 - DNA, 20 bp, Artificial
  CRISPR gRNA sequence
atctttgtgatctcgccaaa

SEQ ID NO: 604533 - DNA, 20 bp, Artificial
  CRISPR gRNA sequence
tgtgatctcgccaaagagtt

SEQ ID NO: 604534 - DNA, 20 bp, Artificial
  CRISPR gRNA sequence
gatctcgccaaagagtttag

SEQ ID NO: 604535 - DNA, 20 bp, Artificial
  CRISPR gRNA sequence
ttgtttgtttttcctcctgc

SEQ ID NO: 604536 - DNA, 20 bp, Artificial
  CRISPR gRNA sequence
ttcctcctgcaagaattcct

SEQ ID NO: 604537 - DNA, 20 bp, Artificial
  CRISPR gRNA sequence
tctaaattttcactgaaaac

SEQ ID NO: 604538 - DNA, 20 bp, Artificial
  CRISPR gRNA sequence
cactgaaaacaagaattcct

SEQ ID NO: 604539 - DNA, 20 bp, Artificial
  CRISPR gRNA sequence
actgaaaactctaatacatg

SEQ ID NO: 604540 - DNA, 20 bp, Artificial
  CRISPR gRNA sequence
ctgaaaactctaatacatga

SEQ ID NO: 604541 - DNA, 20 bp, Artificial
  CRISPR gRNA sequence
aaaactctaatacatgaagg

SEQ ID NO: 604542 - DNA, 20 bp, Artificial
  CRISPR gRNA sequence
aatacatgaaggtagttaca

SEQ ID NO: 604543 - DNA, 20 bp, Artificial
  CRISPR gRNA sequence
tgaaggtagttacacagttc

SEQ ID NO: 604544 - DNA, 20 bp, Artificial
  CRISPR gRNA sequence
atttacataccttccctatt

SEQ ID NO: 604545 - DNA, 20 bp, Artificial
  CRISPR gRNA sequence
ataccttccctattaagtgc

SEQ ID NO: 604546 - DNA, 20 bp, Artificial
  CRISPR gRNA sequence
cttccctattaagtgccagt

SEQ ID NO: 604547 - DNA, 20 bp, Artificial
  CRISPR gRNA sequence
ttccctattaagtgccagtc

SEQ ID NO: 604548 - DNA, 20 bp, Artificial
  CRISPR gRNA sequence
tgccagtcaggttctcgcta

SEQ ID NO: 604549 - DNA, 20 bp, Artificial
  CRISPR gRNA sequence
gtcaggttctcgctacagat

SEQ ID NO: 604550 - DNA, 20 bp, Artificial
  CRISPR gRNA sequence
gagcaaatctgctttttcca

SEQ ID NO: 604551 - DNA, 20 bp, Artificial
  CRISPR gRNA sequence
aaatctgctttttccacagt

SEQ ID NO: 604552 - DNA, 20 bp, Artificial
  CRISPR gRNA sequence
tccacagtgagaaaaacatt

SEQ ID NO: 604553 - DNA, 20 bp, Artificial
  CRISPR gRNA sequence
cacagtgagaaaaacattta

SEQ ID NO: 604554 - DNA, 20 bp, Artificial
  CRISPR gRNA sequence
tttagagacaattctacaat

SEQ ID NO: 604555 - DNA, 20 bp, Artificial
  CRISPR gRNA sequence
ttagaattttgtgatactaa

SEQ ID NO: 604556 - DNA, 20 bp, Artificial
  CRISPR gRNA sequence
aattttgtgatactaatgga

SEQ ID NO: 604557 - DNA, 20 bp, Artificial
  CRISPR gRNA sequence
tatgtacacgtacttaaaat

SEQ ID NO: 604558 - DNA, 20 bp, Artificial
  CRISPR gRNA sequence
aaatgagctatacaatttgt

SEQ ID NO: 604559 - DNA, 20 bp, Artificial
  CRISPR gRNA sequence
aatgagctatacaatttgtt

SEQ ID NO: 604560 - DNA, 20 bp, Artificial
  CRISPR gRNA sequence
tgagctatacaatttgttgg

SEQ ID NO: 604561 - DNA, 20 bp, Artificial
  CRISPR gRNA sequence
tatacaatttgttgggagtt

SEQ ID NO: 604562 - DNA, 20 bp, Artificial
  CRISPR gRNA sequence
ctttaaaaactacaactgtg

SEQ ID NO: 604563 - DNA, 20 bp, Artificial
  CRISPR gRNA sequence
aactacaactgtgaagctat

SEQ ID NO: 604564 - DNA, 20 bp, Artificial
  CRISPR gRNA sequence
tgtgaagctataagacctca

SEQ ID NO: 604565 - DNA, 20 bp, Artificial
  CRISPR gRNA sequence
aaatgtgataaaccttgccc

SEQ ID NO: 604566 - DNA, 20 bp, Artificial
  CRISPR gRNA sequence
aattctttgtttgtcttgct

SEQ ID NO: 604567 - DNA, 20 bp, Artificial
  CRISPR gRNA sequence
gtttgtcttgctaagcctta

SEQ ID NO: 604568 - DNA, 20 bp, Artificial
  CRISPR gRNA sequence
gctaagccttaaagttctca

SEQ ID NO: 604569 - DNA, 20 bp, Artificial
  CRISPR gRNA sequence
ctaagccttaaagttctcat

SEQ ID NO: 604570 - DNA, 20 bp, Artificial
  CRISPR gRNA sequence
gccttaaagttctcatgggc

SEQ ID NO: 604571 - DNA, 20 bp, Artificial
  CRISPR gRNA sequence
ccttaaagttctcatgggca

SEQ ID NO: 604572 - DNA, 20 bp, Artificial
  CRISPR gRNA sequence
cttaaagttctcatgggcaa

SEQ ID NO: 604573 - DNA, 20 bp, Artificial
  CRISPR gRNA sequence
agttctcatgggcaagggat

SEQ ID NO: 604574 - DNA, 20 bp, Artificial
  CRISPR gRNA sequence
ctcatgggcaagggatgaga

SEQ ID NO: 604575 - DNA, 20 bp, Artificial
  CRISPR gRNA sequence
tcatgggcaagggatgagaa

SEQ ID NO: 604576 - DNA, 20 bp, Artificial
  CRISPR gRNA sequence
catgggcaagggatgagaaa

SEQ ID NO: 604577 - DNA, 20 bp, Artificial
  CRISPR gRNA sequence
gggatgagaaagggtcttct

SEQ ID NO: 604578 - DNA, 20 bp, Artificial
  CRISPR gRNA sequence
ggatgagaaagggtcttctg

SEQ ID NO: 604579 - DNA, 20 bp, Artificial
  CRISPR gRNA sequence
ttttttttgtcttgtgttaa

SEQ ID NO: 604580 - DNA, 20 bp, Artificial
  CRISPR gRNA sequence
ttgtcttgtgttaacagcct

SEQ ID NO: 604581 - DNA, 20 bp, Artificial
  CRISPR gRNA sequence
acagcctgagtgctttgtga

SEQ ID NO: 604582 - DNA, 20 bp, Artificial
  CRISPR gRNA sequence
tggtctttcactgtgtgtct

SEQ ID NO: 604583 - DNA, 20 bp, Artificial
  CRISPR gRNA sequence
ggtctttcactgtgtgtctg

SEQ ID NO: 604584 - DNA, 20 bp, Artificial
  CRISPR gRNA sequence
gtctttcactgtgtgtctga

SEQ ID NO: 604585 - DNA, 20 bp, Artificial
  CRISPR gRNA sequence
tgtgtgtctgagggaaccct

SEQ ID NO: 604586 - DNA, 20 bp, Artificial
  CRISPR gRNA sequence
taagtgttgtttctgactct

SEQ ID NO: 604587 - DNA, 20 bp, Artificial
  CRISPR gRNA sequence
gtgttgtttctgactctgag

SEQ ID NO: 604588 - DNA, 20 bp, Artificial
  CRISPR gRNA sequence
tgttgtttctgactctgagc

SEQ ID NO: 604589 - DNA, 20 bp, Artificial
  CRISPR gRNA sequence
gcaggctaatttgctcatca

SEQ ID NO: 604590 - DNA, 20 bp, Artificial
  CRISPR gRNA sequence
aatttgctcatcatagacaa

SEQ ID NO: 604591 - DNA, 20 bp, Artificial
  CRISPR gRNA sequence
acaatggacctgttgacaaa

SEQ ID NO: 604592 - DNA, 20 bp, Artificial
  CRISPR gRNA sequence
caatggacctgttgacaaac

SEQ ID NO: 604593 - DNA, 20 bp, Artificial
  CRISPR gRNA sequence
gtgtccttctatatgtgata

SEQ ID NO: 604594 - DNA, 20 bp, Artificial
  CRISPR gRNA sequence
tatgtgatatagttgatttc

SEQ ID NO: 604595 - DNA, 20 bp, Artificial
  CRISPR gRNA sequence
atgtgatatagttgatttct

SEQ ID NO: 604596 - DNA, 20 bp, Artificial
  CRISPR gRNA sequence
ttttccccattataattaat

SEQ ID NO: 604597 - DNA, 20 bp, Artificial
  CRISPR gRNA sequence
tccccattataattaatcag

SEQ ID NO: 604598 - DNA, 20 bp, Artificial
  CRISPR gRNA sequence
atctgctgtttatcatataa

SEQ ID NO: 604599 - DNA, 20 bp, Artificial
  CRISPR gRNA sequence
tcatataatggctttcttga

SEQ ID NO: 604600 - DNA, 20 bp, Artificial
  CRISPR gRNA sequence
catataatggctttcttgat

SEQ ID NO: 604601 - DNA, 20 bp, Artificial
  CRISPR gRNA sequence
ataatggctttcttgatggg

SEQ ID NO: 604602 - DNA, 20 bp, Artificial
  CRISPR gRNA sequence
gctttcttgatgggtggcat

SEQ ID NO: 604603 - DNA, 20 bp, Artificial
  CRISPR gRNA sequence
ctttcttgatgggtggcata

SEQ ID NO: 604604 - DNA, 20 bp, Artificial
  CRISPR gRNA sequence
ttttgacttttgctctgaat

SEQ ID NO: 604605 - DNA, 20 bp, Artificial
  CRISPR gRNA sequence
ttgacttttgctctgaattg

SEQ ID NO: 604606 - DNA, 20 bp, Artificial
  CRISPR gRNA sequence
gacttttgctctgaattgga

SEQ ID NO: 604607 - DNA, 20 bp, Artificial
  CRISPR gRNA sequence
tgaattggagagatactttt

SEQ ID NO: 604608 - DNA, 20 bp, Artificial
  CRISPR gRNA sequence
actttttggtacctttgctc

SEQ ID NO: 604609 - DNA, 20 bp, Artificial
  CRISPR gRNA sequence
attacttaatgtgttcatca

SEQ ID NO: 604610 - DNA, 20 bp, Artificial
  CRISPR gRNA sequence
tcatcatagtacaaaatatg

SEQ ID NO: 604611 - DNA, 20 bp, Artificial
  CRISPR gRNA sequence
atagtacaaaatatgaagaa

SEQ ID NO: 604612 - DNA, 20 bp, Artificial
  CRISPR gRNA sequence
agtacaaaatatgaagaata

SEQ ID NO: 604613 - DNA, 20 bp, Artificial
  CRISPR gRNA sequence
aatatgaagaatagagttat

SEQ ID NO: 604614 - DNA, 20 bp, Artificial
  CRISPR gRNA sequence
tgaagaatagagttatgagt

SEQ ID NO: 604615 - DNA, 20 bp, Artificial
  CRISPR gRNA sequence
tagagttatgagtgagactt

SEQ ID NO: 604616 - DNA, 20 bp, Artificial
  CRISPR gRNA sequence
gacttgagatgtttcacttt

SEQ ID NO: 604617 - DNA, 20 bp, Artificial
  CRISPR gRNA sequence
gtttcacttttagatttttc

SEQ ID NO: 604618 - DNA, 20 bp, Artificial
  CRISPR gRNA sequence
tcacttttagatttttcaag

SEQ ID NO: 604619 - DNA, 20 bp, Artificial
  CRISPR gRNA sequence
ttttagatttttcaagtggc

SEQ ID NO: 604620 - DNA, 20 bp, Artificial
  CRISPR gRNA sequence
ttcaagtggcaagaaacttt

SEQ ID NO: 604621 - DNA, 20 bp, Artificial
  CRISPR gRNA sequence
gcaagaaacttttagatatt

SEQ ID NO: 604622 - DNA, 20 bp, Artificial
  CRISPR gRNA sequence
aacttttagatatttagtct

SEQ ID NO: 604623 - DNA, 20 bp, Artificial
  CRISPR gRNA sequence
tagatatttagtctcagaaa

SEQ ID NO: 604624 - DNA, 20 bp, Artificial
  CRISPR gRNA sequence
ttttttcttttttttttttt

SEQ ID NO: 604625 - DNA, 20 bp, Artificial
  CRISPR gRNA sequence
ttcttttttttttttttaga

SEQ ID NO: 604626 - DNA, 20 bp, Artificial
  CRISPR gRNA sequence
tcttttttttttttttagac

SEQ ID NO: 604627 - DNA, 20 bp, Artificial
  CRISPR gRNA sequence
cttttttttttttttagaca

SEQ ID NO: 604628 - DNA, 20 bp, Artificial
  CRISPR gRNA sequence
gtttccctcactctgtcgcc

SEQ ID NO: 604629 - DNA, 20 bp, Artificial
  CRISPR gRNA sequence
tttccctcactctgtcgccc

SEQ ID NO: 604630 - DNA, 20 bp, Artificial
  CRISPR gRNA sequence
cctcactctgtcgcccaggt

SEQ ID NO: 604631 - DNA, 20 bp, Artificial
  CRISPR gRNA sequence
tcactctgtcgcccaggttg

SEQ ID NO: 604632 - DNA, 20 bp, Artificial
  CRISPR gRNA sequence
ctgtcgcccaggttggagtg

SEQ ID NO: 604633 - DNA, 20 bp, Artificial
  CRISPR gRNA sequence
tcgcccaggttggagtgcag

SEQ ID NO: 604634 - DNA, 20 bp, Artificial
  CRISPR gRNA sequence
gtgcagtggcaccatgatca

SEQ ID NO: 604635 - DNA, 20 bp, Artificial
  CRISPR gRNA sequence
caccatgatcatggcttatg

SEQ ID NO: 604636 - DNA, 20 bp, Artificial
  CRISPR gRNA sequence
catgatcatggcttatgtgg

SEQ ID NO: 604637 - DNA, 20 bp, Artificial
  CRISPR gRNA sequence
atgtggcagcctcgaactcc

SEQ ID NO: 604638 - DNA, 20 bp, Artificial
  CRISPR gRNA sequence
tgtggcagcctcgaactcct

SEQ ID NO: 604639 - DNA, 20 bp, Artificial
  CRISPR gRNA sequence
agcctcgaactcctgggctc

SEQ ID NO: 604640 - DNA, 20 bp, Artificial
  CRISPR gRNA sequence
cctcgaactcctgggctcaa

SEQ ID NO: 604641 - DNA, 20 bp, Artificial
  CRISPR gRNA sequence
ctcaagagatcctctcacct

SEQ ID NO: 604642 - DNA, 20 bp, Artificial
  CRISPR gRNA sequence
gatcctctcacctcagcctc

SEQ ID NO: 604643 - DNA, 20 bp, Artificial
  CRISPR gRNA sequence
tctcacctcagcctctggac

SEQ ID NO: 604644 - DNA, 20 bp, Artificial
  CRISPR gRNA sequence
acctcagcctctggactagc

SEQ ID NO: 604645 - DNA, 20 bp, Artificial
  CRISPR gRNA sequence
cctcagcctctggactagct

SEQ ID NO: 604646 - DNA, 20 bp, Artificial
  CRISPR gRNA sequence
ctcagcctctggactagctg

SEQ ID NO: 604647 - DNA, 20 bp, Artificial
  CRISPR gRNA sequence
gcctctggactagctggggc

SEQ ID NO: 604648 - DNA, 20 bp, Artificial
  CRISPR gRNA sequence
cctctggactagctggggct

SEQ ID NO: 604649 - DNA, 20 bp, Artificial
  CRISPR gRNA sequence
ctctggactagctggggcta

SEQ ID NO: 604650 - DNA, 20 bp, Artificial
  CRISPR gRNA sequence
acatgcgccaccaccatgcc

SEQ ID NO: 604651 - DNA, 20 bp, Artificial
  CRISPR gRNA sequence
atgcctggctaatatctctc

SEQ ID NO: 604652 - DNA, 20 bp, Artificial
  CRISPR gRNA sequence
gctaatatctctctagatcc

SEQ ID NO: 604653 - DNA, 20 bp, Artificial
  CRISPR gRNA sequence
ctaatatctctctagatccg

SEQ ID NO: 604654 - DNA, 20 bp, Artificial
  CRISPR gRNA sequence
cgaggtctcactatgtctca

SEQ ID NO: 604655 - DNA, 20 bp, Artificial
  CRISPR gRNA sequence
gaggtctcactatgtctcac

SEQ ID NO: 604656 - DNA, 20 bp, Artificial
  CRISPR gRNA sequence
tctcactatgtctcacaggc

SEQ ID NO: 604657 - DNA, 20 bp, Artificial
  CRISPR gRNA sequence
acaggctggtctcaaacact

SEQ ID NO: 604658 - DNA, 20 bp, Artificial
  CRISPR gRNA sequence
caggctggtctcaaacactt

SEQ ID NO: 604659 - DNA, 20 bp, Artificial
  CRISPR gRNA sequence
ggtctcaaacacttgggctc

SEQ ID NO: 604660 - DNA, 20 bp, Artificial
  CRISPR gRNA sequence
cttgggctcaagcgattctc

SEQ ID NO: 604661 - DNA, 20 bp, Artificial
  CRISPR gRNA sequence
ctcaagcgattctccagccg

SEQ ID NO: 604662 - DNA, 20 bp, Artificial
  CRISPR gRNA sequence
tctccagccgcggcctccca

SEQ ID NO: 604663 - DNA, 20 bp, Artificial
  CRISPR gRNA sequence
gccgcggcctcccaaagtgt

SEQ ID NO: 604664 - DNA, 20 bp, Artificial
  CRISPR gRNA sequence
ccgcggcctcccaaagtgtt

SEQ ID NO: 604665 - DNA, 20 bp, Artificial
  CRISPR gRNA sequence
ctcccaaagtgttgggatta

SEQ ID NO: 604666 - DNA, 20 bp, Artificial
  CRISPR gRNA sequence
tagacgtgaaccattgtgcc

SEQ ID NO: 604667 - DNA, 20 bp, Artificial
  CRISPR gRNA sequence
tagccatttttttttttcgt

SEQ ID NO: 604668 - DNA, 20 bp, Artificial
  CRISPR gRNA sequence
gccatttttttttttcgtaa

SEQ ID NO: 604669 - DNA, 20 bp, Artificial
  CRISPR gRNA sequence
atttttttttttcgtaagag

SEQ ID NO: 604670 - DNA, 20 bp, Artificial
  CRISPR gRNA sequence
ttttttttcgtaagagtagt

SEQ ID NO: 604671 - DNA, 20 bp, Artificial
  CRISPR gRNA sequence
ccaactcttcctttaaaaaa

SEQ ID NO: 604672 - DNA, 20 bp, Artificial
  CRISPR gRNA sequence
caactcttcctttaaaaaac

SEQ ID NO: 604673 - DNA, 20 bp, Artificial
  CRISPR gRNA sequence
ttcctttaaaaaacaggcgc

SEQ ID NO: 604674 - DNA, 20 bp, Artificial
  CRISPR gRNA sequence
tcctttaaaaaacaggcgca

SEQ ID NO: 604675 - DNA, 20 bp, Artificial
  CRISPR gRNA sequence
aggcgcaaggatctcttaaa

SEQ ID NO: 604676 - DNA, 20 bp, Artificial
  CRISPR gRNA sequence
ggatctcttaaacagaaaaa

SEQ ID NO: 604677 - DNA, 20 bp, Artificial
  CRISPR gRNA sequence
tcttaaacagaaaaatagat

SEQ ID NO: 604678 - DNA, 20 bp, Artificial
  CRISPR gRNA sequence
aattttcttttcaaccacaa

SEQ ID NO: 604679 - DNA, 20 bp, Artificial
  CRISPR gRNA sequence
ttttcttttcaaccacaaaa

SEQ ID NO: 604680 - DNA, 20 bp, Artificial
  CRISPR gRNA sequence
aaaagagatttttttaaaaa

SEQ ID NO: 604681 - DNA, 20 bp, Artificial
  CRISPR gRNA sequence
ttaaaaaaagattgatttta

SEQ ID NO: 604682 - DNA, 20 bp, Artificial
  CRISPR gRNA sequence
atatgtaaatactaattatt

SEQ ID NO: 604683 - DNA, 20 bp, Artificial
  CRISPR gRNA sequence
attatttggattataattat

SEQ ID NO: 604684 - DNA, 20 bp, Artificial
  CRISPR gRNA sequence
attataattattggtcatta

SEQ ID NO: 604685 - DNA, 20 bp, Artificial
  CRISPR gRNA sequence
atggtaatgccttttttaaa

SEQ ID NO: 604686 - DNA, 20 bp, Artificial
  CRISPR gRNA sequence
ggtaatgccttttttaaaaa

SEQ ID NO: 604687 - DNA, 20 bp, Artificial
  CRISPR gRNA sequence
gccttttttaaaaagagaaa

SEQ ID NO: 604688 - DNA, 20 bp, Artificial
  CRISPR gRNA sequence
aagagaaatagctaatcatg

SEQ ID NO: 604689 - DNA, 20 bp, Artificial
  CRISPR gRNA sequence
gaagtctgacaatttaaata

SEQ ID NO: 604690 - DNA, 20 bp, Artificial
  CRISPR gRNA sequence
tctgacaatttaaataaaga

SEQ ID NO: 604691 - DNA, 20 bp, Artificial
  CRISPR gRNA sequence
caatttaaataaagacagtt

SEQ ID NO: 604692 - DNA, 20 bp, Artificial
  CRISPR gRNA sequence
aatttaaataaagacagttt

SEQ ID NO: 604693 - DNA, 20 bp, Artificial
  CRISPR gRNA sequence
ttaggtaaatttatatctta

SEQ ID NO: 604694 - DNA, 20 bp, Artificial
  CRISPR gRNA sequence
ttatatcttaaagtgaaaaa

SEQ ID NO: 604695 - DNA, 20 bp, Artificial
  CRISPR gRNA sequence
ttaattttgttactatattt

SEQ ID NO: 604696 - DNA, 20 bp, Artificial
  CRISPR gRNA sequence
taattttgttactatatttt

SEQ ID NO: 604697 - DNA, 20 bp, Artificial
  CRISPR gRNA sequence
tcataaaaatatactgattg

SEQ ID NO: 604698 - DNA, 20 bp, Artificial
  CRISPR gRNA sequence
tgtacatttatcttttgccc

SEQ ID NO: 604699 - DNA, 20 bp, Artificial
  CRISPR gRNA sequence
caagaaatctatttttatct

SEQ ID NO: 604700 - DNA, 20 bp, Artificial
  CRISPR gRNA sequence
aaatctatttttatctgagc

SEQ ID NO: 604701 - DNA, 20 bp, Artificial
  CRISPR gRNA sequence
aatctatttttatctgagct

SEQ ID NO: 604702 - DNA, 20 bp, Artificial
  CRISPR gRNA sequence
atctgagctaggtaaaactt

SEQ ID NO: 604703 - DNA, 20 bp, Artificial
  CRISPR gRNA sequence
gagctaggtaaaacttaagt

SEQ ID NO: 604704 - DNA, 20 bp, Artificial
  CRISPR gRNA sequence
aacttaagtcagtgtaaaac

SEQ ID NO: 604705 - DNA, 20 bp, Artificial
  CRISPR gRNA sequence
tcagtgtaaaacaagttgtt

SEQ ID NO: 604706 - DNA, 20 bp, Artificial
  CRISPR gRNA sequence
aaatctttttgaaaacatta

SEQ ID NO: 604707 - DNA, 20 bp, Artificial
  CRISPR gRNA sequence
acattacagcgaaataacaa

SEQ ID NO: 604708 - DNA, 20 bp, Artificial
  CRISPR gRNA sequence
gcgaaataacaaaagttttc

SEQ ID NO: 604709 - DNA, 20 bp, Artificial
  CRISPR gRNA sequence
aaataacaaaagttttccag

SEQ ID NO: 604710 - DNA, 20 bp, Artificial
  CRISPR gRNA sequence
ataacaaaagttttccagaa

SEQ ID NO: 604711 - DNA, 20 bp, Artificial
  CRISPR gRNA sequence
aaaagttttccagaagagtc

SEQ ID NO: 604712 - DNA, 20 bp, Artificial
  CRISPR gRNA sequence
ttttccagaagagtctggtt

SEQ ID NO: 604713 - DNA, 20 bp, Artificial
  CRISPR gRNA sequence
gaagagtctggttaagcatt

SEQ ID NO: 604714 - DNA, 20 bp, Artificial
  CRISPR gRNA sequence
agtctggttaagcattgagc

SEQ ID NO: 604715 - DNA, 20 bp, Artificial
  CRISPR gRNA sequence
tctggttaagcattgagcta

SEQ ID NO: 604716 - DNA, 20 bp, Artificial
  CRISPR gRNA sequence
ttaagcattgagctagagca

SEQ ID NO: 604717 - DNA, 20 bp, Artificial
  CRISPR gRNA sequence
ctagagcacagcattttcac

SEQ ID NO: 604718 - DNA, 20 bp, Artificial
  CRISPR gRNA sequence
agagcacagcattttcacaa

SEQ ID NO: 604719 - DNA, 20 bp, Artificial
  CRISPR gRNA sequence
gcacagcattttcacaagag

SEQ ID NO: 604720 - DNA, 20 bp, Artificial
  CRISPR gRNA sequence
attttcacaagagaagtttt

SEQ ID NO: 604721 - DNA, 20 bp, Artificial
  CRISPR gRNA sequence
gcatgatgttaccctatcaa

SEQ ID NO: 604722 - DNA, 20 bp, Artificial
  CRISPR gRNA sequence
tgttaccctatcaatagtcg

SEQ ID NO: 604723 - DNA, 20 bp, Artificial
  CRISPR gRNA sequence
cctatcaatagtcgtggctg

SEQ ID NO: 604724 - DNA, 20 bp, Artificial
  CRISPR gRNA sequence
atcaatagtcgtggctgaag

SEQ ID NO: 604725 - DNA, 20 bp, Artificial
  CRISPR gRNA sequence
ctttgatttttgtttgtttg

SEQ ID NO: 604726 - DNA, 20 bp, Artificial
  CRISPR gRNA sequence
gtttgcagaattctgatttg

SEQ ID NO: 604727 - DNA, 20 bp, Artificial
  CRISPR gRNA sequence
ttgataatcacaaatttaaa

SEQ ID NO: 604728 - DNA, 20 bp, Artificial
  CRISPR gRNA sequence
tgataatcacaaatttaaaa

SEQ ID NO: 604729 - DNA, 20 bp, Artificial
  CRISPR gRNA sequence
ttgcacttgtgttttgattt

SEQ ID NO: 604730 - DNA, 20 bp, Artificial
  CRISPR gRNA sequence
ttggtcacaattttataaat

SEQ ID NO: 604731 - DNA, 20 bp, Artificial
  CRISPR gRNA sequence
gtatgtttcgatgtttttgt

SEQ ID NO: 604732 - DNA, 20 bp, Artificial
  CRISPR gRNA sequence
tatgtttcgatgtttttgtt

SEQ ID NO: 604733 - DNA, 20 bp, Artificial
  CRISPR gRNA sequence
ctacacttctttaaatacgc

SEQ ID NO: 604734 - DNA, 20 bp, Artificial
  CRISPR gRNA sequence
ccagataaaatcatttaatc

SEQ ID NO: 604735 - DNA, 20 bp, Artificial
  CRISPR gRNA sequence
aatcatttaatcaagctttt

SEQ ID NO: 604736 - DNA, 20 bp, Artificial
  CRISPR gRNA sequence
atcatttaatcaagcttttt

SEQ ID NO: 604737 - DNA, 20 bp, Artificial
  CRISPR gRNA sequence
caagctttttgggaatgttt

SEQ ID NO: 604738 - DNA, 20 bp, Artificial
  CRISPR gRNA sequence
ttgggaatgtttgagtgtgt

SEQ ID NO: 604739 - DNA, 20 bp, Artificial
  CRISPR gRNA sequence
gggaatgtttgagtgtgtca

SEQ ID NO: 604740 - DNA, 20 bp, Artificial
  CRISPR gRNA sequence
ggaatgtttgagtgtgtcag

SEQ ID NO: 604741 - DNA, 20 bp, Artificial
  CRISPR gRNA sequence
cagaggtgacgtattgtgta

SEQ ID NO: 604742 - DNA, 20 bp, Artificial
  CRISPR gRNA sequence
tgacgtattgtgtatagaca

SEQ ID NO: 604743 - DNA, 20 bp, Artificial
  CRISPR gRNA sequence
gacgtattgtgtatagacaa

SEQ ID NO: 604744 - DNA, 20 bp, Artificial
  CRISPR gRNA sequence
tattgtgtatagacaaaggt

SEQ ID NO: 604745 - DNA, 20 bp, Artificial
  CRISPR gRNA sequence
ttgtgtatagacaaaggtaa

SEQ ID NO: 604746 - DNA, 20 bp, Artificial
  CRISPR gRNA sequence
agacaaaggtaagagaaaac

SEQ ID NO: 604747 - DNA, 20 bp, Artificial
  CRISPR gRNA sequence
aaggtaagagaaaaccagtc

SEQ ID NO: 604748 - DNA, 20 bp, Artificial
  CRISPR gRNA sequence
aggtaagagaaaaccagtcc

SEQ ID NO: 604749 - DNA, 20 bp, Artificial
  CRISPR gRNA sequence
gagaaaaccagtccaggaat

SEQ ID NO: 604750 - DNA, 20 bp, Artificial
  CRISPR gRNA sequence
gtgtttttcctttgctctaa

SEQ ID NO: 604751 - DNA, 20 bp, Artificial
  CRISPR gRNA sequence
ctcccttcccccaaaacctc

SEQ ID NO: 604752 - DNA, 20 bp, Artificial
  CRISPR gRNA sequence
attttcactaataatgatgt

SEQ ID NO: 604753 - DNA, 20 bp, Artificial
  CRISPR gRNA sequence
ttttcactaataatgatgtc

SEQ ID NO: 604754 - DNA, 20 bp, Artificial
  CRISPR gRNA sequence
cactaataatgatgtcaggt

SEQ ID NO: 604755 - DNA, 20 bp, Artificial
  CRISPR gRNA sequence
actaataatgatgtcaggtt

SEQ ID NO: 604756 - DNA, 20 bp, Artificial
  CRISPR gRNA sequence
gatgtcaggttaggtacttt

SEQ ID NO: 604757 - DNA, 20 bp, Artificial
  CRISPR gRNA sequence
atgtcaggttaggtactttt

SEQ ID NO: 604758 - DNA, 20 bp, Artificial
  CRISPR gRNA sequence
aggttaggtacttttgggaa

SEQ ID NO: 604759 - DNA, 20 bp, Artificial
  CRISPR gRNA sequence
taggtacttttgggaacagt

SEQ ID NO: 604760 - DNA, 20 bp, Artificial
  CRISPR gRNA sequence
tacttttgggaacagttgga

SEQ ID NO: 604761 - DNA, 20 bp, Artificial
  CRISPR gRNA sequence
acttttgggaacagttggaa

SEQ ID NO: 604762 - DNA, 20 bp, Artificial
  CRISPR gRNA sequence
ggaacagttggaaaggaaaa

SEQ ID NO: 604763 - DNA, 20 bp, Artificial
  CRISPR gRNA sequence
cagttggaaaggaaaacagc

SEQ ID NO: 604764 - DNA, 20 bp, Artificial
  CRISPR gRNA sequence
agttggaaaggaaaacagca

SEQ ID NO: 604765 - DNA, 20 bp, Artificial
  CRISPR gRNA sequence
gttggaaaggaaaacagcaa

SEQ ID NO: 604766 - DNA, 20 bp, Artificial
  CRISPR gRNA sequence
tggaaaggaaaacagcaagg

SEQ ID NO: 604767 - DNA, 20 bp, Artificial
  CRISPR gRNA sequence
aaaggaaaacagcaagggag

SEQ ID NO: 604768 - DNA, 20 bp, Artificial
  CRISPR gRNA sequence
aggaaaacagcaagggagaa

SEQ ID NO: 604769 - DNA, 20 bp, Artificial
  CRISPR gRNA sequence
ggaaaacagcaagggagaag

SEQ ID NO: 604770 - DNA, 20 bp, Artificial
  CRISPR gRNA sequence
acagcaagggagaagaggat

SEQ ID NO: 604771 - DNA, 20 bp, Artificial
  CRISPR gRNA sequence
ggagaagaggattggatctt

SEQ ID NO: 604772 - DNA, 20 bp, Artificial
  CRISPR gRNA sequence
gagaagaggattggatcttc

SEQ ID NO: 604773 - DNA, 20 bp, Artificial
  CRISPR gRNA sequence
ttggatcttcgggctatgat

SEQ ID NO: 604774 - DNA, 20 bp, Artificial
  CRISPR gRNA sequence
tggatcttcgggctatgatt

SEQ ID NO: 604775 - DNA, 20 bp, Artificial
  CRISPR gRNA sequence
gatcttcgggctatgattgg

SEQ ID NO: 604776 - DNA, 20 bp, Artificial
  CRISPR gRNA sequence
atcttcgggctatgattggg

SEQ ID NO: 604777 - DNA, 20 bp, Artificial
  CRISPR gRNA sequence
tcttcgggctatgattggga

SEQ ID NO: 604778 - DNA, 20 bp, Artificial
  CRISPR gRNA sequence
tcgggctatgattgggaggg

SEQ ID NO: 604779 - DNA, 20 bp, Artificial
  CRISPR gRNA sequence
cgggctatgattgggaggga

SEQ ID NO: 604780 - DNA, 20 bp, Artificial
  CRISPR gRNA sequence
gctatgattgggagggaagg

SEQ ID NO: 604781 - DNA, 20 bp, Artificial
  CRISPR gRNA sequence
gattgggagggaaggcagtc

SEQ ID NO: 604782 - DNA, 20 bp, Artificial
  CRISPR gRNA sequence
attgggagggaaggcagtct

SEQ ID NO: 604783 - DNA, 20 bp, Artificial
  CRISPR gRNA sequence
ttgggagggaaggcagtcta

SEQ ID NO: 604784 - DNA, 20 bp, Artificial
  CRISPR gRNA sequence
gggaaggcagtctagggaac

SEQ ID NO: 604785 - DNA, 20 bp, Artificial
  CRISPR gRNA sequence
gtctagggaactggtttctg

SEQ ID NO: 604786 - DNA, 20 bp, Artificial
  CRISPR gRNA sequence
tctagggaactggtttctgt

SEQ ID NO: 604787 - DNA, 20 bp, Artificial
  CRISPR gRNA sequence
agggaactggtttctgtggg

SEQ ID NO: 604788 - DNA, 20 bp, Artificial
  CRISPR gRNA sequence
ggtttctgtgggtagctcat

SEQ ID NO: 604789 - DNA, 20 bp, Artificial
  CRISPR gRNA sequence
gtttctgtgggtagctcatg

SEQ ID NO: 604790 - DNA, 20 bp, Artificial
  CRISPR gRNA sequence
tttctgtgggtagctcatga

SEQ ID NO: 604791 - DNA, 20 bp, Artificial
  CRISPR gRNA sequence
tctgtgggtagctcatgagg

SEQ ID NO: 604792 - DNA, 20 bp, Artificial
  CRISPR gRNA sequence
tgtgggtagctcatgaggga

SEQ ID NO: 604793 - DNA, 20 bp, Artificial
  CRISPR gRNA sequence
gctcatgagggagagctttg

SEQ ID NO: 604794 - DNA, 20 bp, Artificial
  CRISPR gRNA sequence
catgagggagagctttgcag

SEQ ID NO: 604795 - DNA, 20 bp, Artificial
  CRISPR gRNA sequence
gagggagagctttgcagtag

SEQ ID NO: 604796 - DNA, 20 bp, Artificial
  CRISPR gRNA sequence
gggagagctttgcagtagaa

SEQ ID NO: 604797 - DNA, 20 bp, Artificial
  CRISPR gRNA sequence
ggagagctttgcagtagaag

SEQ ID NO: 604798 - DNA, 20 bp, Artificial
  CRISPR gRNA sequence
agagctttgcagtagaagag

SEQ ID NO: 604799 - DNA, 20 bp, Artificial
  CRISPR gRNA sequence
agaagaggagtcaaaccttt

SEQ ID NO: 604800 - DNA, 20 bp, Artificial
  CRISPR gRNA sequence
gaagaggagtcaaacctttt

SEQ ID NO: 604801 - DNA, 20 bp, Artificial
  CRISPR gRNA sequence
agaggagtcaaaccttttgg

SEQ ID NO: 604802 - DNA, 20 bp, Artificial
  CRISPR gRNA sequence
gaggagtcaaaccttttggg

SEQ ID NO: 604803 - DNA, 20 bp, Artificial
  CRISPR gRNA sequence
aggagtcaaaccttttggga

SEQ ID NO: 604804 - DNA, 20 bp, Artificial
  CRISPR gRNA sequence
gtcaaaccttttgggagggt

SEQ ID NO: 604805 - DNA, 20 bp, Artificial
  CRISPR gRNA sequence
tcaaaccttttgggagggtc

SEQ ID NO: 604806 - DNA, 20 bp, Artificial
  CRISPR gRNA sequence
caaaccttttgggagggtca

SEQ ID NO: 604807 - DNA, 20 bp, Artificial
  CRISPR gRNA sequence
aaaccttttgggagggtcag

SEQ ID NO: 604808 - DNA, 20 bp, Artificial
  CRISPR gRNA sequence
ggagggtcaggggaataaat

SEQ ID NO: 604809 - DNA, 20 bp, Artificial
  CRISPR gRNA sequence
ggggaataaattggacattt

SEQ ID NO: 604810 - DNA, 20 bp, Artificial
  CRISPR gRNA sequence
gggaataaattggacatttc

SEQ ID NO: 604811 - DNA, 20 bp, Artificial
  CRISPR gRNA sequence
ggaataaattggacatttca

SEQ ID NO: 604812 - DNA, 20 bp, Artificial
  CRISPR gRNA sequence
aataaattggacatttcagg

SEQ ID NO: 604813 - DNA, 20 bp, Artificial
  CRISPR gRNA sequence
tggacatttcagggagtccc

SEQ ID NO: 604814 - DNA, 20 bp, Artificial
  CRISPR gRNA sequence
cagggagtccctggaattga

SEQ ID NO: 604815 - DNA, 20 bp, Artificial
  CRISPR gRNA sequence
ggagtccctggaattgaaag

SEQ ID NO: 604816 - DNA, 20 bp, Artificial
  CRISPR gRNA sequence
gtccctggaattgaaagaag

SEQ ID NO: 604817 - DNA, 20 bp, Artificial
  CRISPR gRNA sequence
ggaattgaaagaagcagtca

SEQ ID NO: 604818 - DNA, 20 bp, Artificial
  CRISPR gRNA sequence
aaagaagcagtcaaagcatt

SEQ ID NO: 604819 - DNA, 20 bp, Artificial
  CRISPR gRNA sequence
aagaagcagtcaaagcatta

SEQ ID NO: 604820 - DNA, 20 bp, Artificial
  CRISPR gRNA sequence
agaagcagtcaaagcattaa

SEQ ID NO: 604821 - DNA, 20 bp, Artificial
  CRISPR gRNA sequence
agcagtcaaagcattaaggg

SEQ ID NO: 604822 - DNA, 20 bp, Artificial
  CRISPR gRNA sequence
agtctttttgacactactca

SEQ ID NO: 604823 - DNA, 20 bp, Artificial
  CRISPR gRNA sequence
gtctttttgacactactcaa

SEQ ID NO: 604824 - DNA, 20 bp, Artificial
  CRISPR gRNA sequence
tttttgacactactcaaagg

SEQ ID NO: 604825 - DNA, 20 bp, Artificial
  CRISPR gRNA sequence
tgacactactcaaaggaagc

SEQ ID NO: 604826 - DNA, 20 bp, Artificial
  CRISPR gRNA sequence
actactcaaaggaagccagt

SEQ ID NO: 604827 - DNA, 20 bp, Artificial
  CRISPR gRNA sequence
ctactcaaaggaagccagtg

SEQ ID NO: 604828 - DNA, 20 bp, Artificial
  CRISPR gRNA sequence
tactcaaaggaagccagtga

SEQ ID NO: 604829 - DNA, 20 bp, Artificial
  CRISPR gRNA sequence
caaaggaagccagtgaggga

SEQ ID NO: 604830 - DNA, 20 bp, Artificial
  CRISPR gRNA sequence
agccagtgagggaaagcaat

SEQ ID NO: 604831 - DNA, 20 bp, Artificial
  CRISPR gRNA sequence
ggaaagcaatgagctccttt

SEQ ID NO: 604832 - DNA, 20 bp, Artificial
  CRISPR gRNA sequence
gagctcctttgagaaaattc

SEQ ID NO: 604833 - DNA, 20 bp, Artificial
  CRISPR gRNA sequence
agctcctttgagaaaattct

SEQ ID NO: 604834 - DNA, 20 bp, Artificial
  CRISPR gRNA sequence
cctttgagaaaattctggga

SEQ ID NO: 604835 - DNA, 20 bp, Artificial
  CRISPR gRNA sequence
ctttgagaaaattctgggat

SEQ ID NO: 604836 - DNA, 20 bp, Artificial
  CRISPR gRNA sequence
ttgagaaaattctgggatag

SEQ ID NO: 604837 - DNA, 20 bp, Artificial
  CRISPR gRNA sequence
aaaattctgggataggagca

SEQ ID NO: 604838 - DNA, 20 bp, Artificial
  CRISPR gRNA sequence
aaattctgggataggagcat

SEQ ID NO: 604839 - DNA, 20 bp, Artificial
  CRISPR gRNA sequence
aattctgggataggagcatg

SEQ ID NO: 604840 - DNA, 20 bp, Artificial
  CRISPR gRNA sequence
attctgggataggagcatgg

SEQ ID NO: 604841 - DNA, 20 bp, Artificial
  CRISPR gRNA sequence
gggataggagcatgggggcc

SEQ ID NO: 604842 - DNA, 20 bp, Artificial
  CRISPR gRNA sequence
ggataggagcatgggggcct

SEQ ID NO: 604843 - DNA, 20 bp, Artificial
  CRISPR gRNA sequence
ataggagcatgggggcctgg

SEQ ID NO: 604844 - DNA, 20 bp, Artificial
  CRISPR gRNA sequence
taggagcatgggggcctggg

SEQ ID NO: 604845 - DNA, 20 bp, Artificial
  CRISPR gRNA sequence
aggagcatgggggcctggga

SEQ ID NO: 604846 - DNA, 20 bp, Artificial
  CRISPR gRNA sequence
ggagcatgggggcctgggag

SEQ ID NO: 604847 - DNA, 20 bp, Artificial
  CRISPR gRNA sequence
agcatgggggcctgggaggg

SEQ ID NO: 604848 - DNA, 20 bp, Artificial
  CRISPR gRNA sequence
gcatgggggcctgggagggg

SEQ ID NO: 604849 - DNA, 20 bp, Artificial
  CRISPR gRNA sequence
catgggggcctgggagggga

SEQ ID NO: 604850 - DNA, 20 bp, Artificial
  CRISPR gRNA sequence
ctgggaggggagggaatctc

SEQ ID NO: 604851 - DNA, 20 bp, Artificial
  CRISPR gRNA sequence
gggaggggagggaatctctg

SEQ ID NO: 604852 - DNA, 20 bp, Artificial
  CRISPR gRNA sequence
ctctggagtacctttgttgt

SEQ ID NO: 604853 - DNA, 20 bp, Artificial
  CRISPR gRNA sequence
cctttgttgttggctccaca

SEQ ID NO: 604854 - DNA, 20 bp, Artificial
  CRISPR gRNA sequence
ctttgttgttggctccacat

SEQ ID NO: 604855 - DNA, 20 bp, Artificial
  CRISPR gRNA sequence
gttggctccacataggtccc

SEQ ID NO: 604856 - DNA, 20 bp, Artificial
  CRISPR gRNA sequence
cataggtccctggtgtgtga

SEQ ID NO: 604857 - DNA, 20 bp, Artificial
  CRISPR gRNA sequence
ataggtccctggtgtgtgaa

SEQ ID NO: 604858 - DNA, 20 bp, Artificial
  CRISPR gRNA sequence
ccctggtgtgtgaaaggatc

SEQ ID NO: 604859 - DNA, 20 bp, Artificial
  CRISPR gRNA sequence
ggtgtgtgaaaggatctaga

SEQ ID NO: 604860 - DNA, 20 bp, Artificial
  CRISPR gRNA sequence
gtgtgtgaaaggatctagat

SEQ ID NO: 604861 - DNA, 20 bp, Artificial
  CRISPR gRNA sequence
tgaaaggatctagataggtg

SEQ ID NO: 604862 - DNA, 20 bp, Artificial
  CRISPR gRNA sequence
tagataggtgtagttataaa

SEQ ID NO: 604863 - DNA, 20 bp, Artificial
  CRISPR gRNA sequence
agataggtgtagttataaat

SEQ ID NO: 604864 - DNA, 20 bp, Artificial
  CRISPR gRNA sequence
aggtgtagttataaatgggt

SEQ ID NO: 604865 - DNA, 20 bp, Artificial
  CRISPR gRNA sequence
ttctttttacattcttatct

SEQ ID NO: 604866 - DNA, 20 bp, Artificial
  CRISPR gRNA sequence
tttacattcttatctgagta

SEQ ID NO: 604867 - DNA, 20 bp, Artificial
  CRISPR gRNA sequence
ttacattcttatctgagtat

SEQ ID NO: 604868 - DNA, 20 bp, Artificial
  CRISPR gRNA sequence
ttcttatctgagtatgggaa

SEQ ID NO: 604869 - DNA, 20 bp, Artificial
  CRISPR gRNA sequence
tctgagtatgggaatggctg

SEQ ID NO: 604870 - DNA, 20 bp, Artificial
  CRISPR gRNA sequence
ctgagtatgggaatggctga

SEQ ID NO: 604871 - DNA, 20 bp, Artificial
  CRISPR gRNA sequence
tctgtgtgttgcatgctatg

SEQ ID NO: 604872 - DNA, 20 bp, Artificial
  CRISPR gRNA sequence
gcatgctatgtggatctttt

SEQ ID NO: 604873 - DNA, 20 bp, Artificial
  CRISPR gRNA sequence
catgctatgtggatctttta

SEQ ID NO: 604874 - DNA, 20 bp, Artificial
  CRISPR gRNA sequence
tttaaggcgtgaccttatca

SEQ ID NO: 604875 - DNA, 20 bp, Artificial
  CRISPR gRNA sequence
aggcgtgaccttatcaaagt

SEQ ID NO: 604876 - DNA, 20 bp, Artificial
  CRISPR gRNA sequence
aagttggcatctaaatgcaa

SEQ ID NO: 604877 - DNA, 20 bp, Artificial
  CRISPR gRNA sequence
tctaaatgcaaaagaaaatg

SEQ ID NO: 604878 - DNA, 20 bp, Artificial
  CRISPR gRNA sequence
ctaaatgcaaaagaaaatgc

SEQ ID NO: 604879 - DNA, 20 bp, Artificial
  CRISPR gRNA sequence
taaatgcaaaagaaaatgca

SEQ ID NO: 604880 - DNA, 20 bp, Artificial
  CRISPR gRNA sequence
tgcaaaagaaaatgcagggc

SEQ ID NO: 604881 - DNA, 20 bp, Artificial
  CRISPR gRNA sequence
aatgcagggcaagcttgttc

SEQ ID NO: 604882 - DNA, 20 bp, Artificial
  CRISPR gRNA sequence
cagggcaagcttgttctagt

SEQ ID NO: 604883 - DNA, 20 bp, Artificial
  CRISPR gRNA sequence
agggcaagcttgttctagtt

SEQ ID NO: 604884 - DNA, 20 bp, Artificial
  CRISPR gRNA sequence
gggcaagcttgttctagttg

SEQ ID NO: 604885 - DNA, 20 bp, Artificial
  CRISPR gRNA sequence
ctagttggggttcctgtcac

SEQ ID NO: 604886 - DNA, 20 bp, Artificial
  CRISPR gRNA sequence
gggttcctgtcaccagacca

SEQ ID NO: 604887 - DNA, 20 bp, Artificial
  CRISPR gRNA sequence
gtcaccagaccatagcaatt

SEQ ID NO: 604888 - DNA, 20 bp, Artificial
  CRISPR gRNA sequence
accatagcaatttggaacaa

SEQ ID NO: 604889 - DNA, 20 bp, Artificial
  CRISPR gRNA sequence
gatacattacctgaattcac

SEQ ID NO: 604890 - DNA, 20 bp, Artificial
  CRISPR gRNA sequence
acattacctgaattcactgg

SEQ ID NO: 604891 - DNA, 20 bp, Artificial
  CRISPR gRNA sequence
tacctgaattcactggcagc

SEQ ID NO: 604892 - DNA, 20 bp, Artificial
  CRISPR gRNA sequence
ctgaattcactggcagcaag

SEQ ID NO: 604893 - DNA, 20 bp, Artificial
  CRISPR gRNA sequence
gaattcactggcagcaagca

SEQ ID NO: 604894 - DNA, 20 bp, Artificial
  CRISPR gRNA sequence
gcttctatgcgtgcccttat

SEQ ID NO: 604895 - DNA, 20 bp, Artificial
  CRISPR gRNA sequence
gcccttatcagtgtttaaaa

SEQ ID NO: 604896 - DNA, 20 bp, Artificial
  CRISPR gRNA sequence
ctcgtactctgcgtactatc

SEQ ID NO: 604897 - DNA, 20 bp, Artificial
  CRISPR gRNA sequence
gtactctgcgtactatctag

SEQ ID NO: 604898 - DNA, 20 bp, Artificial
  CRISPR gRNA sequence
actctgcgtactatctagaa

SEQ ID NO: 604899 - DNA, 20 bp, Artificial
  CRISPR gRNA sequence
cctattctttattaatattt

SEQ ID NO: 604900 - DNA, 20 bp, Artificial
  CRISPR gRNA sequence
ctattctttattaatatttt

SEQ ID NO: 604901 - DNA, 20 bp, Artificial
  CRISPR gRNA sequence
tattctttattaatattttg

SEQ ID NO: 604902 - DNA, 20 bp, Artificial
  CRISPR gRNA sequence
attctttattaatattttgg

SEQ ID NO: 604903 - DNA, 20 bp, Artificial
  CRISPR gRNA sequence
ttctttattaatattttggg

SEQ ID NO: 604904 - DNA, 20 bp, Artificial
  CRISPR gRNA sequence
ggggaatgctttcatttcaa

SEQ ID NO: 604905 - DNA, 20 bp, Artificial
  CRISPR gRNA sequence
aatgctttcatttcaatagt

SEQ ID NO: 604906 - DNA, 20 bp, Artificial
  CRISPR gRNA sequence
atttcaatagttagaaaatg

SEQ ID NO: 604907 - DNA, 20 bp, Artificial
  CRISPR gRNA sequence
gttagaaaatgtggaaaaac

SEQ ID NO: 604908 - DNA, 20 bp, Artificial
  CRISPR gRNA sequence
atgtggaaaaacaagattgc

SEQ ID NO: 604909 - DNA, 20 bp, Artificial
  CRISPR gRNA sequence
tgtggaaaaacaagattgca

SEQ ID NO: 604910 - DNA, 20 bp, Artificial
  CRISPR gRNA sequence
aaaaacaagattgcaaggtt

SEQ ID NO: 604911 - DNA, 20 bp, Artificial
  CRISPR gRNA sequence
aaaacaagattgcaaggttg

SEQ ID NO: 604912 - DNA, 20 bp, Artificial
  CRISPR gRNA sequence
agattgcaaggttgaggtga

SEQ ID NO: 604913 - DNA, 20 bp, Artificial
  CRISPR gRNA sequence
ttgcaaggttgaggtgaaag

SEQ ID NO: 604914 - DNA, 20 bp, Artificial
  CRISPR gRNA sequence
ggttgaggtgaaagtagtac

SEQ ID NO: 604915 - DNA, 20 bp, Artificial
  CRISPR gRNA sequence
aggtgaaagtagtacaagat

SEQ ID NO: 604916 - DNA, 20 bp, Artificial
  CRISPR gRNA sequence
tgaaagtagtacaagattgg

SEQ ID NO: 604917 - DNA, 20 bp, Artificial
  CRISPR gRNA sequence
gaaactcttttttcttcact

SEQ ID NO: 604918 - DNA, 20 bp, Artificial
  CRISPR gRNA sequence
actcagtaaaatgatacttt

SEQ ID NO: 604919 - DNA, 20 bp, Artificial
  CRISPR gRNA sequence
gtaaaatgatacttttggct

SEQ ID NO: 604920 - DNA, 20 bp, Artificial
  CRISPR gRNA sequence
gatacttttggctcagtgcc

SEQ ID NO: 604921 - DNA, 20 bp, Artificial
  CRISPR gRNA sequence
atacttttggctcagtgcct

SEQ ID NO: 604922 - DNA, 20 bp, Artificial
  CRISPR gRNA sequence
tacttttggctcagtgcctg

SEQ ID NO: 604923 - DNA, 20 bp, Artificial
  CRISPR gRNA sequence
ggctcagtgcctggggaaca

SEQ ID NO: 604924 - DNA, 20 bp, Artificial
  CRISPR gRNA sequence
gctcagtgcctggggaacat

SEQ ID NO: 604925 - DNA, 20 bp, Artificial
  CRISPR gRNA sequence
agtgcctggggaacataggc

SEQ ID NO: 604926 - DNA, 20 bp, Artificial
  CRISPR gRNA sequence
cctggggaacataggcgagt

SEQ ID NO: 604927 - DNA, 20 bp, Artificial
  CRISPR gRNA sequence
ctggggaacataggcgagtt

SEQ ID NO: 604928 - DNA, 20 bp, Artificial
  CRISPR gRNA sequence
ggaacataggcgagttagga

SEQ ID NO: 604929 - DNA, 20 bp, Artificial
  CRISPR gRNA sequence
ataggcgagttaggatggtg

SEQ ID NO: 604930 - DNA, 20 bp, Artificial
  CRISPR gRNA sequence
gcgagttaggatggtgcaga

SEQ ID NO: 604931 - DNA, 20 bp, Artificial
  CRISPR gRNA sequence
cgagttaggatggtgcagac

SEQ ID NO: 604932 - DNA, 20 bp, Artificial
  CRISPR gRNA sequence
taggatggtgcagacaggac

SEQ ID NO: 604933 - DNA, 20 bp, Artificial
  CRISPR gRNA sequence
gtgcagacaggactagcaac

SEQ ID NO: 604934 - DNA, 20 bp, Artificial
  CRISPR gRNA sequence
ggactagcaacaagtttgtt

SEQ ID NO: 604935 - DNA, 20 bp, Artificial
  CRISPR gRNA sequence
gactagcaacaagtttgtta

SEQ ID NO: 604936 - DNA, 20 bp, Artificial
  CRISPR gRNA sequence
gcaacaagtttgttaaggaa

SEQ ID NO: 604937 - DNA, 20 bp, Artificial
  CRISPR gRNA sequence
caacaagtttgttaaggaat

SEQ ID NO: 604938 - DNA, 20 bp, Artificial
  CRISPR gRNA sequence
agtttgttaaggaatgggct

SEQ ID NO: 604939 - DNA, 20 bp, Artificial
  CRISPR gRNA sequence
aaccccttgcctctgccctg

SEQ ID NO: 604940 - DNA, 20 bp, Artificial
  CRISPR gRNA sequence
ctctgccctgtggtttacta

SEQ ID NO: 604941 - DNA, 20 bp, Artificial
  CRISPR gRNA sequence
tgtggtttactacagaattt

SEQ ID NO: 604942 - DNA, 20 bp, Artificial
  CRISPR gRNA sequence
ttttttttttttttgtccgt

SEQ ID NO: 604943 - DNA, 20 bp, Artificial
  CRISPR gRNA sequence
tttttttttttgtccgttag

SEQ ID NO: 604944 - DNA, 20 bp, Artificial
  CRISPR gRNA sequence
ttttttttgtccgttagaag

SEQ ID NO: 604945 - DNA, 20 bp, Artificial
  CRISPR gRNA sequence
tttttgtccgttagaagcag

SEQ ID NO: 604946 - DNA, 20 bp, Artificial
  CRISPR gRNA sequence
ttgtccgttagaagcagtgg

SEQ ID NO: 604947 - DNA, 20 bp, Artificial
  CRISPR gRNA sequence
gtccgttagaagcagtggta

SEQ ID NO: 604948 - DNA, 20 bp, Artificial
  CRISPR gRNA sequence
ccgttagaagcagtggtaga

SEQ ID NO: 604949 - DNA, 20 bp, Artificial
  CRISPR gRNA sequence
tggtagagagattacacact

SEQ ID NO: 604950 - DNA, 20 bp, Artificial
  CRISPR gRNA sequence
cacactaagctttaaaacca

SEQ ID NO: 604951 - DNA, 20 bp, Artificial
  CRISPR gRNA sequence
aaacttttaaaacacttgtg

SEQ ID NO: 604952 - DNA, 20 bp, Artificial
  CRISPR gRNA sequence
aaacacttgtgcggtaacct

SEQ ID NO: 604953 - DNA, 20 bp, Artificial
  CRISPR gRNA sequence
cacttgtgcggtaacctcag

SEQ ID NO: 604954 - DNA, 20 bp, Artificial
  CRISPR gRNA sequence
tgtgcggtaacctcagaaga

SEQ ID NO: 604955 - DNA, 20 bp, Artificial
  CRISPR gRNA sequence
gtgcggtaacctcagaagac

SEQ ID NO: 604956 - DNA, 20 bp, Artificial
  CRISPR gRNA sequence
gtactattaatgtgttttgc

SEQ ID NO: 604957 - DNA, 20 bp, Artificial
  CRISPR gRNA sequence
ttgcaagtttgcaatacctc

SEQ ID NO: 604958 - DNA, 20 bp, Artificial
  CRISPR gRNA sequence
gtttgcaatacctctagaca

SEQ ID NO: 604959 - DNA, 20 bp, Artificial
  CRISPR gRNA sequence
ttgcaatacctctagacatg

SEQ ID NO: 604960 - DNA, 20 bp, Artificial
  CRISPR gRNA sequence
tgcaatacctctagacatgg

SEQ ID NO: 604961 - DNA, 20 bp, Artificial
  CRISPR gRNA sequence
gtatactgcaaatcgaatcc

SEQ ID NO: 604962 - DNA, 20 bp, Artificial
  CRISPR gRNA sequence
tatactgcaaatcgaatccg

SEQ ID NO: 604963 - DNA, 20 bp, Artificial
  CRISPR gRNA sequence
gaatccgaggtgtgtcttgt

SEQ ID NO: 604964 - DNA, 20 bp, Artificial
  CRISPR gRNA sequence
aaaataatgaaaacaaaaca

SEQ ID NO: 604965 - DNA, 20 bp, Artificial
  CRISPR gRNA sequence
aaacaaaacacagttttatc

SEQ ID NO: 604966 - DNA, 20 bp, Artificial
  CRISPR gRNA sequence
aacaaaacacagttttatcc

SEQ ID NO: 604967 - DNA, 20 bp, Artificial
  CRISPR gRNA sequence
tcaaaatatactactctttt

SEQ ID NO: 604968 - DNA, 20 bp, Artificial
  CRISPR gRNA sequence
tactctttttagcaaattca

SEQ ID NO: 604969 - DNA, 20 bp, Artificial
  CRISPR gRNA sequence
atatcactatatttgtaact

SEQ ID NO: 604970 - DNA, 20 bp, Artificial
  CRISPR gRNA sequence
tatcactatatttgtaacta

SEQ ID NO: 604971 - DNA, 20 bp, Artificial
  CRISPR gRNA sequence
tttgtaactaaggaatttta

SEQ ID NO: 604972 - DNA, 20 bp, Artificial
  CRISPR gRNA sequence
taactaaggaattttatggt

SEQ ID NO: 604973 - DNA, 20 bp, Artificial
  CRISPR gRNA sequence
attttatggtgagattattt

SEQ ID NO: 604974 - DNA, 20 bp, Artificial
  CRISPR gRNA sequence
tttgagctttatttctgtaa

SEQ ID NO: 604975 - DNA, 20 bp, Artificial
  CRISPR gRNA sequence
atttctgtaacagttgttct

SEQ ID NO: 604976 - DNA, 20 bp, Artificial
  CRISPR gRNA sequence
acatctttaacacatctata

SEQ ID NO: 604977 - DNA, 20 bp, Artificial
  CRISPR gRNA sequence
catctatatagactttaaaa

SEQ ID NO: 604978 - DNA, 20 bp, Artificial
  CRISPR gRNA sequence
ctgtttcccctaattattca

SEQ ID NO: 604979 - DNA, 20 bp, Artificial
  CRISPR gRNA sequence
aacaaacatttattgacgat

SEQ ID NO: 604980 - DNA, 20 bp, Artificial
  CRISPR gRNA sequence
attgacgatcagtgatgtca

SEQ ID NO: 604981 - DNA, 20 bp, Artificial
  CRISPR gRNA sequence
tgatgtcacagttttattgt

SEQ ID NO: 604982 - DNA, 20 bp, Artificial
  CRISPR gRNA sequence
tgtcacagttttattgtaag

SEQ ID NO: 604983 - DNA, 20 bp, Artificial
  CRISPR gRNA sequence
tgtaagaagacatttccttt

SEQ ID NO: 604984 - DNA, 20 bp, Artificial
  CRISPR gRNA sequence
taagaagacatttcctttca

SEQ ID NO: 604985 - DNA, 20 bp, Artificial
  CRISPR gRNA sequence
ttcctttcagagaattaacg

SEQ ID NO: 604986 - DNA, 20 bp, Artificial
  CRISPR gRNA sequence
cagagaattaacgtagaaat

SEQ ID NO: 604987 - DNA, 20 bp, Artificial
  CRISPR gRNA sequence
agagaattaacgtagaaata

SEQ ID NO: 604988 - DNA, 20 bp, Artificial
  CRISPR gRNA sequence
gaattaacgtagaaataagg

SEQ ID NO: 604989 - DNA, 20 bp, Artificial
  CRISPR gRNA sequence
aattaacgtagaaataagga
